United States Patent 7,888,497 (BIOINFORMATICALLY DETECTABLE GROUP OF NOVEL REGULATORY OLIGONUCLEOTIDES AND USES THEREOF) - sequence listing, part 13

SEQ ID NO: 506911 - DNA, 14 bp, Homo sapiens
cgctttcctgagcc

SEQ ID NO: 506912 - DNA, 13 bp, Homo sapiens
cgtcttcctcctc

SEQ ID NO: 506913 - DNA, 20 bp, Homo sapiens
cgttaacacatggcttccta

SEQ ID NO: 506914 - DNA, 17 bp, Homo sapiens
ctaatgtaacttcctct

SEQ ID NO: 506915 - DNA, 13 bp, Homo sapiens
ctcagcatcctcc

SEQ ID NO: 506916 - DNA, 16 bp, Homo sapiens
ctccacgggctgcgcc

SEQ ID NO: 506917 - DNA, 15 bp, Homo sapiens
ctcccgtcttcctcc

SEQ ID NO: 506918 - DNA, 15 bp, Homo sapiens
ctcctcccctggcaa

SEQ ID NO: 506919 - DNA, 17 bp, Homo sapiens
ctccttcgctttcctga

SEQ ID NO: 506920 - DNA, 17 bp, Homo sapiens
ctctgtcacgttctgga

SEQ ID NO: 506921 - DNA, 21 bp, Homo sapiens
ctctgtcacgttctggaacat

SEQ ID NO: 506922 - DNA, 22 bp, Homo sapiens
ctgttgtctaaaataggttttc

SEQ ID NO: 506923 - DNA, 12 bp, Homo sapiens
cttcctcctccc

SEQ ID NO: 506924 - DNA, 16 bp, Homo sapiens
cttgcccacttctcct

SEQ ID NO: 506925 - DNA, 18 bp, Homo sapiens
gaacattctgtcatcacc

SEQ ID NO: 506926 - DNA, 14 bp, Homo sapiens
gagaagagtccagg

SEQ ID NO: 506927 - DNA, 17 bp, Homo sapiens
gagaagtcggccaggta

SEQ ID NO: 506928 - DNA, 14 bp, Homo sapiens
gagtccaggaaggg

SEQ ID NO: 506929 - DNA, 14 bp, Homo sapiens
gcaatcatttcccc

SEQ ID NO: 506930 - DNA, 22 bp, Homo sapiens
gcacagagcatccgtctcccct

SEQ ID NO: 506931 - DNA, 17 bp, Homo sapiens
gcatccgtctcccctcg

SEQ ID NO: 506932 - DNA, 23 bp, Homo sapiens
gcccacttctccttcgctttcct

SEQ ID NO: 506933 - DNA, 16 bp, Homo sapiens
gcctggcctggcaccg

SEQ ID NO: 506934 - DNA, 14 bp, Homo sapiens
gcctgggtggctca

SEQ ID NO: 506935 - DNA, 15 bp, Homo sapiens
gcctgggtggctcag

SEQ ID NO: 506936 - DNA, 15 bp, Homo sapiens
gctcagcatcctcca

SEQ ID NO: 506937 - DNA, 13 bp, Homo sapiens
gctttcctgagcc

SEQ ID NO: 506938 - DNA, 19 bp, Homo sapiens
ggacatttcatataaatgg

SEQ ID NO: 506939 - DNA, 18 bp, Homo sapiens
ggagcgggcccgccaccc

SEQ ID NO: 506940 - DNA, 19 bp, Homo sapiens
ggcaatgactgcgcagagt

SEQ ID NO: 506941 - DNA, 18 bp, Homo sapiens
ggcaccgttatccctgca

SEQ ID NO: 506942 - DNA, 14 bp, Homo sapiens
ggctcagcatcctc

SEQ ID NO: 506943 - DNA, 17 bp, Homo sapiens
ggctcagcatcctccac

SEQ ID NO: 506944 - DNA, 20 bp, Homo sapiens
ggtaactgcctggcctggca

SEQ ID NO: 506945 - DNA, 12 bp, Homo sapiens
gtaacttcctct

SEQ ID NO: 506946 - DNA, 11 bp, Homo sapiens
gtctcccctcg

SEQ ID NO: 506947 - DNA, 10 bp, Homo sapiens
gtcttcctcc

SEQ ID NO: 506948 - DNA, 15 bp, Homo sapiens
gtcttcctcctcccc

SEQ ID NO: 506949 - DNA, 16 bp, Homo sapiens
gtcttcctcctcccct

SEQ ID NO: 506950 - DNA, 20 bp, Homo sapiens
gtcttcctcctcccctggca

SEQ ID NO: 506951 - DNA, 13 bp, Homo sapiens
taacttcctctta

SEQ ID NO: 506952 - DNA, 13 bp, Homo sapiens
taggcaccacctc

SEQ ID NO: 506953 - DNA, 13 bp, Homo sapiens
taggttttccctg

SEQ ID NO: 506954 - DNA, 14 bp, Homo sapiens
tcccgtcttcctcc

SEQ ID NO: 506955 - DNA, 18 bp, Homo sapiens
tcccgtcttcctcctccc

SEQ ID NO: 506956 - DNA, 15 bp, Homo sapiens
tccctgttctggaca

SEQ ID NO: 506957 - DNA, 17 bp, Homo sapiens
tcgactttgtgtctctg

SEQ ID NO: 506958 - DNA, 19 bp, Homo sapiens
tctaaaataggttttccct

SEQ ID NO: 506959 - DNA, 22 bp, Homo sapiens
tctaaaataggttttccctgtt

SEQ ID NO: 506960 - DNA, 14 bp, Homo sapiens
taaatggaatcaca

SEQ ID NO: 506961 - DNA, 20 bp, Homo sapiens
taacctaaaaatcaatcact

SEQ ID NO: 506962 - DNA, 12 bp, Homo sapiens
taacttcctctt

SEQ ID NO: 506963 - DNA, 18 bp, Homo sapiens
tcagcatcctccacgggc

SEQ ID NO: 506964 - DNA, 20 bp, Homo sapiens
tcccctcccgtcttcctcct

SEQ ID NO: 506965 - DNA, 21 bp, Homo sapiens
tcccctcccgtcttcctcctc

SEQ ID NO: 506966 - DNA, 13 bp, Homo sapiens
tccgtctcccctc

SEQ ID NO: 506967 - DNA, 18 bp, Homo sapiens
tcctaaatggccctgttt

SEQ ID NO: 506968 - DNA, 14 bp, Homo sapiens
tcctcctcccctgg

SEQ ID NO: 506969 - DNA, 23 bp, Homo sapiens
tctaaaataggttttccctgttc

SEQ ID NO: 506970 - DNA, 22 bp, Homo sapiens
tctcccctcgttaacacatggc

SEQ ID NO: 506971 - DNA, 15 bp, Homo sapiens
tctgtcatcaccccg

SEQ ID NO: 506972 - DNA, 17 bp, Homo sapiens
tgcacacggcacagagc

SEQ ID NO: 506973 - DNA, 14 bp, Homo sapiens
tgcccacttctcct

SEQ ID NO: 506974 - DNA, 22 bp, Homo sapiens
tggacatttcatataaatggaa

SEQ ID NO: 506975 - DNA, 15 bp, Homo sapiens
tggcttcctaaatgg

SEQ ID NO: 506976 - DNA, 17 bp, Homo sapiens
tgggttttttaattgag

SEQ ID NO: 506977 - DNA, 13 bp, Homo sapiens
tgtaggcaccacc

SEQ ID NO: 506978 - DNA, 14 bp, Homo sapiens
tgtaggcaccacct

SEQ ID NO: 506979 - DNA, 23 bp, Homo sapiens
tgtctaaaataggttttccctgt

SEQ ID NO: 506980 - DNA, 22 bp, Homo sapiens
tgtgtaggcaccacctctgtca

SEQ ID NO: 506981 - DNA, 13 bp, Homo sapiens
ttcatataaatgg

SEQ ID NO: 506982 - DNA, 22 bp, Homo sapiens
ttcccctcccgtcttcctcctc

SEQ ID NO: 506983 - DNA, 20 bp, Homo sapiens
ttctctaatgtaacttcctc

SEQ ID NO: 506984 - DNA, 14 bp, Homo sapiens
tttcatataaatgg

SEQ ID NO: 506985 - DNA, 19 bp, Homo sapiens
ctgtcacgttctggaacat

SEQ ID NO: 506986 - DNA, 15 bp, Homo sapiens
cttcctcctcccctg

SEQ ID NO: 506987 - DNA, 22 bp, Homo sapiens
gaaggggcggggagaagcctgg

SEQ ID NO: 506988 - DNA, 18 bp, Homo sapiens
gaagtcggccaggtagga

SEQ ID NO: 506989 - DNA, 15 bp, Homo sapiens
gagaagtcggccagg

SEQ ID NO: 506990 - DNA, 16 bp, Homo sapiens
gagagaagtcggccag

SEQ ID NO: 506991 - DNA, 18 bp, Homo sapiens
gagcatccgtctcccctc

SEQ ID NO: 506992 - DNA, 13 bp, Homo sapiens
gatgaacacaggc

SEQ ID NO: 506993 - DNA, 17 bp, Homo sapiens
gatgtttcaccaaggaa

SEQ ID NO: 506994 - DNA, 17 bp, Homo sapiens
gcaatcatttcccctcc

SEQ ID NO: 506995 - DNA, 16 bp, Homo sapiens
gcacacggcacagagc

SEQ ID NO: 506996 - DNA, 23 bp, Homo sapiens
gcacagagcatccgtctcccctc

SEQ ID NO: 506997 - DNA, 21 bp, Homo sapiens
gccacccttgcccacttctcc

SEQ ID NO: 506998 - DNA, 22 bp, Homo sapiens
gccaggtaggatgaacacaggc

SEQ ID NO: 506999 - DNA, 18 bp, Homo sapiens
gcccacttctccttcgct

SEQ ID NO: 507000 - DNA, 16 bp, Homo sapiens
gcctgggtggctcagc

SEQ ID NO: 507001 - DNA, 18 bp, Homo sapiens
gcggggagaagcctgggt

SEQ ID NO: 507002 - DNA, 14 bp, Homo sapiens
gctcagcatcctcc

SEQ ID NO: 507003 - DNA, 14 bp, Homo sapiens
gcttcctaaatggc

SEQ ID NO: 507004 - DNA, 13 bp, Homo sapiens
ggcaccacctctg

SEQ ID NO: 507005 - DNA, 20 bp, Homo sapiens
ggcaccgttatccctgcaca

SEQ ID NO: 507006 - DNA, 16 bp, Homo sapiens
gtcacgttctggaaca

SEQ ID NO: 507007 - DNA, 23 bp, Homo sapiens
gtctaaaataggttttccctgtt

SEQ ID NO: 507008 - DNA, 18 bp, Homo sapiens
gttatccctgcacacggc

SEQ ID NO: 507009 - DNA, 19 bp, Homo sapiens
gttgtgtaggcaccacctc

SEQ ID NO: 507010 - DNA, 18 bp, Homo sapiens
gttttccctgttctggac

SEQ ID NO: 507011 - DNA, 23 bp, Homo sapiens
tctcccctcgttaacacatggct

SEQ ID NO: 507012 - DNA, 20 bp, Homo sapiens
tctgtcacgttctggaacat

SEQ ID NO: 507013 - DNA, 20 bp, Homo sapiens
tcttaggatgtttcaccaag

SEQ ID NO: 507014 - DNA, 13 bp, Homo sapiens
tgactgcgcagag

SEQ ID NO: 507015 - DNA, 16 bp, Homo sapiens
tgcacacggcacagag

SEQ ID NO: 507016 - DNA, 18 bp, Homo sapiens
tgcacacggcacagagca

SEQ ID NO: 507017 - DNA, 14 bp, Homo sapiens
tgcctggcctggca

SEQ ID NO: 507018 - DNA, 23 bp, Homo sapiens
tggacatttcatataaatggaat

SEQ ID NO: 507019 - DNA, 16 bp, Homo sapiens
tggcttcctaaatggc

SEQ ID NO: 507020 - DNA, 13 bp, Homo sapiens
tgtaacttcctct

SEQ ID NO: 507021 - DNA, 14 bp, Homo sapiens
ttcatataaatgga

SEQ ID NO: 507022 - DNA, 15 bp, Homo sapiens
ttcatataaatggaa

SEQ ID NO: 507023 - DNA, 18 bp, Homo sapiens
ttctccttcgctttcctg

SEQ ID NO: 507024 - DNA, 19 bp, Homo sapiens
tttgggttttttaattgag

SEQ ID NO: 507025 - DNA, 22 bp, Homo sapiens
taacacatggcttcctaaatgg

SEQ ID NO: 507026 - DNA, 15 bp, Homo sapiens
taggttttccctgtt

SEQ ID NO: 507027 - DNA, 14 bp, Homo sapiens
tcaccaaggaaata

SEQ ID NO: 507028 - DNA, 19 bp, Homo sapiens
tcatttcccctcccgtctt

SEQ ID NO: 507029 - DNA, 16 bp, Homo sapiens
tcccgtcttcctcctc

SEQ ID NO: 507030 - DNA, 14 bp, Homo sapiens
tccgtctcccctcg

SEQ ID NO: 507031 - DNA, 17 bp, Homo sapiens
tcctaaatggccctgtt

SEQ ID NO: 507032 - DNA, 15 bp, Homo sapiens
tcgctttcctgagcc

SEQ ID NO: 507033 - DNA, 18 bp, Homo sapiens
tctaatgtaacttcctct

SEQ ID NO: 507034 - DNA, 20 bp, Homo sapiens
tctaatgtaacttcctctta

SEQ ID NO: 507035 - DNA, 18 bp, Homo sapiens
tctccttcgctttcctga

SEQ ID NO: 507036 - DNA, 21 bp, Homo sapiens
tctccttcgctttcctgagcc

SEQ ID NO: 507037 - DNA, 23 bp, Homo sapiens
tgaacacaggcaatgactgcgca

SEQ ID NO: 507038 - DNA, 23 bp, Homo sapiens
tgagagagaagtcggccaggtag

SEQ ID NO: 507039 - DNA, 15 bp, Homo sapiens
tgcgcagagtggatt

SEQ ID NO: 507040 - DNA, 15 bp, Homo sapiens
tgtcacgttctggaa

SEQ ID NO: 507041 - DNA, 18 bp, Homo sapiens
ttaacacatggcttccta

SEQ ID NO: 507042 - DNA, 23 bp, Homo sapiens
ttcctcctcccctggcaactgct

SEQ ID NO: 507043 - DNA, 22 bp, Homo sapiens
ttgtctaaaataggttttccct

SEQ ID NO: 507044 - DNA, 21 bp, Homo sapiens
tttcccctcccgtcttcctcc

SEQ ID NO: 507045 - DNA, 19 bp, Homo sapiens
aaaataggttttccctgtt

SEQ ID NO: 507046 - DNA, 20 bp, Homo sapiens
aagagagaagagtccaggaa

SEQ ID NO: 507047 - DNA, 20 bp, Homo sapiens
aagtgaacaatcagcggcat

SEQ ID NO: 507048 - DNA, 23 bp, Homo sapiens
acacggcacagagcatccgtctc

SEQ ID NO: 507049 - DNA, 12 bp, Homo sapiens
acattctgtcat

SEQ ID NO: 507050 - DNA, 17 bp, Homo sapiens
acattctgtcatcaccc

SEQ ID NO: 507051 - DNA, 18 bp, Homo sapiens
acatttcatataaatgga

SEQ ID NO: 507052 - DNA, 21 bp, Homo sapiens
acgttctggaacattctgtca

SEQ ID NO: 507053 - DNA, 15 bp, Homo sapiens
agaagagtccaggaa

SEQ ID NO: 507054 - DNA, 15 bp, Homo sapiens
agaagtcggccaggt

SEQ ID NO: 507055 - DNA, 17 bp, Homo sapiens
agagaagagtccaggaa

SEQ ID NO: 507056 - DNA, 19 bp, Homo sapiens
agagaagagtccaggaagg

SEQ ID NO: 507057 - DNA, 20 bp, Homo sapiens
agagaagtcggccaggtagg

SEQ ID NO: 507058 - DNA, 15 bp, Homo sapiens
agagcatccgtctcc

SEQ ID NO: 507059 - DNA, 13 bp, Homo sapiens
agagtccaggaag

SEQ ID NO: 507060 - DNA, 18 bp, Homo sapiens
agcaatcatttcccctcc

SEQ ID NO: 507061 - DNA, 19 bp, Homo sapiens
agcaatcatttcccctccc

SEQ ID NO: 507062 - DNA, 17 bp, Homo sapiens
agcatccgtctcccctc

SEQ ID NO: 507063 - DNA, 19 bp, Homo sapiens
agcatccgtctcccctcgt

SEQ ID NO: 507064 - DNA, 21 bp, Homo sapiens
agcggcatttagtacatccag

SEQ ID NO: 507065 - DNA, 20 bp, Homo sapiens
aggatgtttcaccaaggaaa

SEQ ID NO: 507066 - DNA, 22 bp, Homo sapiens
aggcaccacctctgtcacgttc

SEQ ID NO: 507067 - DNA, 17 bp, Homo sapiens
atataaatggaatcaca

SEQ ID NO: 507068 - DNA, 16 bp, Homo sapiens
atgtttcaccaaggaa

SEQ ID NO: 507069 - DNA, 17 bp, Homo sapiens
atttcatataaatggaa

SEQ ID NO: 507070 - DNA, 21 bp, Homo sapiens
cacagagcatccgtctcccct

SEQ ID NO: 507071 - DNA, 22 bp, Homo sapiens
cacagagcatccgtctcccctc

SEQ ID NO: 507072 - DNA, 22 bp, Homo sapiens
cacaggcaatgactgcgcagag

SEQ ID NO: 507073 - DNA, 21 bp, Homo sapiens
cagaaagttgtgtaggcacca

SEQ ID NO: 507074 - DNA, 20 bp, Homo sapiens
caggcaatgactgcgcagag

SEQ ID NO: 507075 - DNA, 14 bp, Homo sapiens
cattctgtcatcac

SEQ ID NO: 507076 - DNA, 12 bp, Homo sapiens
catttcccctcc

SEQ ID NO: 507077 - DNA, 22 bp, Homo sapiens
ccagaaagttgtgtaggcacca

SEQ ID NO: 507078 - DNA, 23 bp, Homo sapiens
ccagaaagttgtgtaggcaccac

SEQ ID NO: 507079 - DNA, 21 bp, Homo sapiens
ccaggtaggatgaacacaggc

SEQ ID NO: 507080 - DNA, 19 bp, Homo sapiens
cccctcccgtcttcctcct

SEQ ID NO: 507081 - DNA, 19 bp, Homo sapiens
ccctgcacacggcacagag

SEQ ID NO: 507082 - DNA, 12 bp, Homo sapiens
ccctgttctgga

SEQ ID NO: 507083 - DNA, 14 bp, Homo sapiens
ccgtcttcctcctc

SEQ ID NO: 507084 - DNA, 22 bp, Homo sapiens
ccgtcttcctcctcccctggca

SEQ ID NO: 507085 - DNA, 12 bp, Homo sapiens
cctcctcccctg

SEQ ID NO: 507086 - DNA, 21 bp, Homo sapiens
cctcctcccctggcaactgct

SEQ ID NO: 507087 - DNA, 16 bp, Homo sapiens
cctgcacacggcacag

SEQ ID NO: 507088 - DNA, 15 bp, Homo sapiens
cctggcaactgctga

SEQ ID NO: 507089 - DNA, 11 bp, Homo sapiens
cggcacagagc

SEQ ID NO: 507090 - DNA, 15 bp, Homo sapiens
ctaaaaatcaatcac

SEQ ID NO: 507091 - DNA, 14 bp, Homo sapiens
ctcagcatcctcca

SEQ ID NO: 507092 - DNA, 20 bp, Homo sapiens
ctcagcatcctccacgggct

SEQ ID NO: 507093 - DNA, 13 bp, Homo sapiens
ctcccgtcttcct

SEQ ID NO: 507094 - DNA, 14 bp, Homo sapiens
ctcccgtcttcctc

SEQ ID NO: 507095 - DNA, 21 bp, Homo sapiens
ctctaatgtaacttcctctta

SEQ ID NO: 507096 - DNA, 16 bp, Homo sapiens
ctgcacacggcacaga

SEQ ID NO: 507097 - DNA, 15 bp, Homo sapiens
ctgcctggcctggca

SEQ ID NO: 507098 - DNA, 21 bp, Homo sapiens
ctggcaccgttatccctgcac

SEQ ID NO: 507099 - DNA, 22 bp, Homo sapiens
aaaagagagaagagtccaggaa

SEQ ID NO: 507100 - DNA, 18 bp, Homo sapiens
aaataggttttccctgtt

SEQ ID NO: 507101 - DNA, 13 bp, Homo sapiens
aaatggccctgtt

SEQ ID NO: 507102 - DNA, 11 bp, Homo sapiens
aacttcctctt

SEQ ID NO: 507103 - DNA, 17 bp, Homo sapiens
aataggttttccctgtt

SEQ ID NO: 507104 - DNA, 12 bp, Homo sapiens
acagagcatccg

SEQ ID NO: 507105 - DNA, 19 bp, Homo sapiens
acatggcttcctaaatggc

SEQ ID NO: 507106 - DNA, 14 bp, Homo sapiens
accacctctgtcac

SEQ ID NO: 507107 - DNA, 18 bp, Homo sapiens
acctaaaaatcaatcact

SEQ ID NO: 507108 - DNA, 20 bp, Homo sapiens
acctctgtcacgttctggaa

SEQ ID NO: 507109 - DNA, 16 bp, Homo sapiens
actgcctggcctggca

SEQ ID NO: 507110 - DNA, 15 bp, Homo sapiens
agagaagagtccagg

SEQ ID NO: 507111 - DNA, 18 bp, Homo sapiens
agagagaagagtccagga

SEQ ID NO: 507112 - DNA, 18 bp, Homo sapiens
agagagaagtcggccagg

SEQ ID NO: 507113 - DNA, 14 bp, Homo sapiens
agcatccgtctccc

SEQ ID NO: 507114 - DNA, 15 bp, Homo sapiens
aggatgaacacaggc

SEQ ID NO: 507115 - DNA, 19 bp, Homo sapiens
aggcaatgactgcgcagag

SEQ ID NO: 507116 - DNA, 13 bp, Homo sapiens
agtcggccaggta

SEQ ID NO: 507117 - DNA, 16 bp, Homo sapiens
ataggttttccctgtt

SEQ ID NO: 507118 - DNA, 13 bp, Homo sapiens
atatgtgattttc

SEQ ID NO: 507119 - DNA, 14 bp, Homo sapiens
atcatttcccctcc

SEQ ID NO: 507120 - DNA, 22 bp, Homo sapiens
atccctgcacacggcacagagc

SEQ ID NO: 507121 - DNA, 23 bp, Homo sapiens
attgagagagaagtcggccaggt

SEQ ID NO: 507122 - DNA, 22 bp, Homo sapiens
attggtaactgcctggcctggc

SEQ ID NO: 507123 - DNA, 20 bp, Homo sapiens
atttcccctcccgtcttcct

SEQ ID NO: 507124 - DNA, 22 bp, Homo sapiens
caatgactgcgcagagtggatt

SEQ ID NO: 507125 - DNA, 18 bp, Homo sapiens
cacatggcttcctaaatg

SEQ ID NO: 507126 - DNA, 21 bp, Homo sapiens
cacccttgcccacttctcctt

SEQ ID NO: 507127 - DNA, 13 bp, Homo sapiens
cacggcacagagc

SEQ ID NO: 507128 - DNA, 16 bp, Homo sapiens
catggcttcctaaatg

SEQ ID NO: 507129 - DNA, 15 bp, Homo sapiens
catttcatataaatg

SEQ ID NO: 507130 - DNA, 22 bp, Homo sapiens
ccacgggctgcgccgtctgctc

SEQ ID NO: 507131 - DNA, 21 bp, Homo sapiens
ccaggaaggggcggggagaag

SEQ ID NO: 507132 - DNA, 20 bp, Homo sapiens
cccgtcttcctcctcccctg

SEQ ID NO: 507133 - DNA, 20 bp, Homo sapiens
cctggcaccgttatccctgc

SEQ ID NO: 507134 - DNA, 13 bp, Homo sapiens
cctgggtggctca

SEQ ID NO: 507135 - DNA, 17 bp, Homo sapiens
cgccacccttgcccact

SEQ ID NO: 507136 - DNA, 12 bp, Homo sapiens
cgtcttcctcct

SEQ ID NO: 507137 - DNA, 16 bp, Homo sapiens
ctcccgtcttcctcct

SEQ ID NO: 507138 - DNA, 22 bp, Homo sapiens
ctcgttaacacatggcttccta

SEQ ID NO: 507139 - DNA, 18 bp, Homo sapiens
ctgctcggggctgagctg

SEQ ID NO: 507140 - DNA, 14 bp, Homo sapiens
ctgggtggctcagc

SEQ ID NO: 507141 - DNA, 13 bp, Homo sapiens
ctgttctggacat

SEQ ID NO: 507142 - DNA, 18 bp, Homo sapiens
cttcctcctcccctggca

SEQ ID NO: 507143 - DNA, 13 bp, Homo sapiens
aagagtccaggaa

SEQ ID NO: 507144 - DNA, 23 bp, Homo sapiens
aataggttttccctgttctggac

SEQ ID NO: 507145 - DNA, 20 bp, Homo sapiens
aatgactgcgcagagtggat

SEQ ID NO: 507146 - DNA, 16 bp, Homo sapiens
acctaaaaatcaatca

SEQ ID NO: 507147 - DNA, 17 bp, Homo sapiens
acctaaaaatcaatcac

SEQ ID NO: 507148 - DNA, 18 bp, Homo sapiens
acggcctatgagatgaaa

SEQ ID NO: 507149 - DNA, 17 bp, Homo sapiens
actgcctggcctggcac

SEQ ID NO: 507150 - DNA, 22 bp, Homo sapiens
acttcctcttaggatgtttcac

SEQ ID NO: 507151 - DNA, 22 bp, Homo sapiens
agaaagttgtgtaggcaccacc

SEQ ID NO: 507152 - DNA, 14 bp, Homo sapiens
agaagagtccagga

SEQ ID NO: 507153 - DNA, 14 bp, Homo sapiens
agaagcctgggtgg

SEQ ID NO: 507154 - DNA, 16 bp, Homo sapiens
agaagtcggccaggta

SEQ ID NO: 507155 - DNA, 17 bp, Homo sapiens
agagagaagagtccagg

SEQ ID NO: 507156 - DNA, 19 bp, Homo sapiens
agagcatccgtctcccctc

SEQ ID NO: 507157 - DNA, 12 bp, Homo sapiens
agagtccaggaa

SEQ ID NO: 507158 - DNA, 18 bp, Homo sapiens
agatgaaattcaaataac

SEQ ID NO: 507159 - DNA, 17 bp, Homo sapiens
agcaatcatttcccctc

SEQ ID NO: 507160 - DNA, 22 bp, Homo sapiens
aggaaatattgagagagaagtc

SEQ ID NO: 507161 - DNA, 20 bp, Homo sapiens
aggcaaaagagagaagagtc

SEQ ID NO: 507162 - DNA, 15 bp, Homo sapiens
ataggttttccctgt

SEQ ID NO: 507163 - DNA, 16 bp, Homo sapiens
atataaatggaatcac

SEQ ID NO: 507164 - DNA, 12 bp, Homo sapiens
atccgtctcccc

SEQ ID NO: 507165 - DNA, 13 bp, Homo sapiens
atcctccacgggc

SEQ ID NO: 507166 - DNA, 14 bp, Homo sapiens
atgtaacttcctct

SEQ ID NO: 507167 - DNA, 15 bp, Homo sapiens
atgtaacttcctctt

SEQ ID NO: 507168 - DNA, 16 bp, Homo sapiens
attggtaactgcctgg

SEQ ID NO: 507169 - DNA, 18 bp, Homo sapiens
atttagtacatccagaaa

SEQ ID NO: 507170 - DNA, 22 bp, Homo sapiens
atttcccctcccgtcttcctcc

SEQ ID NO: 507171 - DNA, 18 bp, Homo sapiens
caatcacttgaaagtgaa

SEQ ID NO: 507172 - DNA, 15 bp, Homo sapiens
cacacggcacagagc

SEQ ID NO: 507173 - DNA, 11 bp, Homo sapiens
cacggcacaga

SEQ ID NO: 507174 - DNA, 23 bp, Homo sapiens
caggcaatgactgcgcagagtgg

SEQ ID NO: 507175 - DNA, 21 bp, Homo sapiens
caggtaggatgaacacaggca

SEQ ID NO: 507176 - DNA, 21 bp, Homo sapiens
catttcccctcccgtcttcct

SEQ ID NO: 507177 - DNA, 23 bp, Homo sapiens
ccaaggaaatattgagagagaag

SEQ ID NO: 507178 - DNA, 15 bp, Homo sapiens
ccctgttctggacat

SEQ ID NO: 507179 - DNA, 12 bp, Homo sapiens
cctcccctggca

SEQ ID NO: 507180 - DNA, 13 bp, Homo sapiens
cctcctcccctgg

SEQ ID NO: 507181 - DNA, 21 bp, Homo sapiens
cctcgttaacacatggcttcc

SEQ ID NO: 507182 - DNA, 10 bp, Homo sapiens
cctgagccct

SEQ ID NO: 507183 - DNA, 19 bp, Homo sapiens
cctgcacacggcacagagc

SEQ ID NO: 507184 - DNA, 23 bp, Homo sapiens
cctgcacacggcacagagcatcc

SEQ ID NO: 507185 - DNA, 18 bp, Homo sapiens
cctgggtggctcagcatc

SEQ ID NO: 507186 - DNA, 18 bp, Homo sapiens
cgctgggcggtgcggagc

SEQ ID NO: 507187 - DNA, 20 bp, Homo sapiens
cgtgattggtaactgcctgg

SEQ ID NO: 507188 - DNA, 15 bp, Homo sapiens
ctcagcatcctccac

SEQ ID NO: 507189 - DNA, 17 bp, Homo sapiens
ctcccgtcttcctcctc

SEQ ID NO: 507190 - DNA, 14 bp, Homo sapiens
ctcctcccctggca

SEQ ID NO: 507191 - DNA, 21 bp, Homo sapiens
ctcctcccctggcaactgctg

SEQ ID NO: 507192 - DNA, 20 bp, Homo sapiens
ctccttcgctttcctgagcc

SEQ ID NO: 507193 - DNA, 20 bp, Homo sapiens
ctcgttaacacatggcttcc

SEQ ID NO: 507194 - DNA, 17 bp, Homo sapiens
ctctaatgtaacttcct

SEQ ID NO: 507195 - DNA, 17 bp, Homo sapiens
ctgcacacggcacagag

SEQ ID NO: 507196 - DNA, 20 bp, Homo sapiens
ctggacatttcatataaatg

SEQ ID NO: 507197 - DNA, 21 bp, Homo sapiens
ctggacatttcatataaatgg

SEQ ID NO: 507198 - DNA, 22 bp, Homo sapiens
ctggacatttcatataaatgga

SEQ ID NO: 507199 - DNA, 17 bp, Homo sapiens
ctggcaccgttatccct

SEQ ID NO: 507200 - DNA, 17 bp, Homo sapiens
cttcgctttcctgagcc

SEQ ID NO: 507201 - DNA, 21 bp, Homo sapiens
gaaagttgtgtaggcaccacc

SEQ ID NO: 507202 - DNA, 14 bp, Homo sapiens
gaagagtccaggaa

SEQ ID NO: 507203 - DNA, 22 bp, Homo sapiens
gagaagcctgggtggctcagca

SEQ ID NO: 507204 - DNA, 18 bp, Homo sapiens
gagagaagtcggccaggt

SEQ ID NO: 507205 - DNA, 23 bp, Homo sapiens
gatgaaatatgtgattttctcta

SEQ ID NO: 507206 - DNA, 17 bp, Homo sapiens
gattggtaactgcctgg

SEQ ID NO: 507207 - DNA, 20 bp, Homo sapiens
gcaatcatttcccctcccgt

SEQ ID NO: 507208 - DNA, 19 bp, Homo sapiens
gcacagagcatccgtctcc

SEQ ID NO: 507209 - DNA, 21 bp, Homo sapiens
gcacagagcatccgtctcccc

SEQ ID NO: 507210 - DNA, 22 bp, Homo sapiens
ggagaagcctgggtggctcagc

SEQ ID NO: 507211 - DNA, 15 bp, Homo sapiens
ggcaccgttatccct

SEQ ID NO: 507212 - DNA, 16 bp, Homo sapiens
ggcaccgttatccctg

SEQ ID NO: 507213 - DNA, 22 bp, Homo sapiens
gggtggctcagcatcctccacg

SEQ ID NO: 507214 - DNA, 12 bp, Homo sapiens
ggttttccctgt

SEQ ID NO: 507215 - DNA, 20 bp, Homo sapiens
gtgaagcaatcatttcccct

SEQ ID NO: 507216 - DNA, 16 bp, Homo sapiens
accaccacacccggct

SEQ ID NO: 507217 - DNA, 14 bp, Homo sapiens
accaccccatctgc

SEQ ID NO: 507218 - DNA, 18 bp, Homo sapiens
accaccccatctgcattc

SEQ ID NO: 507219 - DNA, 19 bp, Homo sapiens
accagcgcttgaagcctga

SEQ ID NO: 507220 - DNA, 15 bp, Homo sapiens
acccaggcacctgca

SEQ ID NO: 507221 - DNA, 20 bp, Homo sapiens
acccagggtggagtgcagtg

SEQ ID NO: 507222 - DNA, 15 bp, Homo sapiens
accgaggagggagag

SEQ ID NO: 507223 - DNA, 17 bp, Homo sapiens
accgaggagggagagtc

SEQ ID NO: 507224 - DNA, 14 bp, Homo sapiens
acctctgcttccca

SEQ ID NO: 507225 - DNA, 19 bp, Homo sapiens
acctctgcttcccaggttc

SEQ ID NO: 507226 - DNA, 11 bp, Homo sapiens
acctctgtgcc

SEQ ID NO: 507227 - DNA, 16 bp, Homo sapiens
acctgatacggctccc

SEQ ID NO: 507228 - DNA, 19 bp, Homo sapiens
acctgtatatttcttttaa

SEQ ID NO: 507229 - DNA, 22 bp, Homo sapiens
accttaggcccggagctgcccc

SEQ ID NO: 507230 - DNA, 19 bp, Homo sapiens
acgtctggcctacagaatg

SEQ ID NO: 507231 - DNA, 20 bp, Homo sapiens
acgttctgttaatttagtaa

SEQ ID NO: 507232 - DNA, 20 bp, Homo sapiens
actaaaaatttacaagagaa

SEQ ID NO: 507233 - DNA, 12 bp, Homo sapiens
actaaaattatg

SEQ ID NO: 507234 - DNA, 18 bp, Homo sapiens
actaaaattatgttactg

SEQ ID NO: 507235 - DNA, 13 bp, Homo sapiens
actataaatatac

SEQ ID NO: 507236 - DNA, 15 bp, Homo sapiens
actataaatatacat

SEQ ID NO: 507237 - DNA, 19 bp, Homo sapiens
actataaatatacatataa

SEQ ID NO: 507238 - DNA, 14 bp, Homo sapiens
actatatatttctt

SEQ ID NO: 507239 - DNA, 21 bp, Homo sapiens
actcaataaacagtcactgga

SEQ ID NO: 507240 - DNA, 23 bp, Homo sapiens
actctaactgtgacaaagaagac

SEQ ID NO: 507241 - DNA, 15 bp, Homo sapiens
actgagaaagaggca

SEQ ID NO: 507242 - DNA, 16 bp, Homo sapiens
actggctgtgtgacct

SEQ ID NO: 507243 - DNA, 15 bp, Homo sapiens
acttaaaaaactgca

SEQ ID NO: 507244 - DNA, 20 bp, Homo sapiens
acttccagtgcaacactgaa

SEQ ID NO: 507245 - DNA, 22 bp, Homo sapiens
acttctacctacatatttgtat

SEQ ID NO: 507246 - DNA, 16 bp, Homo sapiens
actttaatttattttg

SEQ ID NO: 507247 - DNA, 13 bp, Homo sapiens
agaaattttagta

SEQ ID NO: 507248 - DNA, 16 bp, Homo sapiens
agaagagtttcttaac

SEQ ID NO: 507249 - DNA, 19 bp, Homo sapiens
agaagagtttcttaactta

SEQ ID NO: 507250 - DNA, 15 bp, Homo sapiens
agaagtaatcagtat

SEQ ID NO: 507251 - DNA, 23 bp, Homo sapiens
agaagtacctttgttacagctac

SEQ ID NO: 507252 - DNA, 19 bp, Homo sapiens
agaagttgaatgggcacag

SEQ ID NO: 507253 - DNA, 12 bp, Homo sapiens
agaatctacttt

SEQ ID NO: 507254 - DNA, 16 bp, Homo sapiens
agacagagcctcgctc

SEQ ID NO: 507255 - DNA, 17 bp, Homo sapiens
agacattccttctacat

SEQ ID NO: 507256 - DNA, 23 bp, Homo sapiens
agacattccttctacatgtaatg

SEQ ID NO: 507257 - DNA, 13 bp, Homo sapiens
agagaccgaggag

SEQ ID NO: 507258 - DNA, 16 bp, Homo sapiens
agaggcagggacctaa

SEQ ID NO: 507259 - DNA, 15 bp, Homo sapiens
agatagttactatat

SEQ ID NO: 507260 - DNA, 14 bp, Homo sapiens
agatgaaacattaa

SEQ ID NO: 507261 - DNA, 12 bp, Homo sapiens
ttgttcttcaga

SEQ ID NO: 507262 - DNA, 15 bp, Homo sapiens
tttaaaagttattaa

SEQ ID NO: 507263 - DNA, 14 bp, Homo sapiens
tttaattacagaag

SEQ ID NO: 507264 - DNA, 18 bp, Homo sapiens
tttaattgttaagatatg

SEQ ID NO: 507265 - DNA, 19 bp, Homo sapiens
tttaatttattttgtgaac

SEQ ID NO: 507266 - DNA, 20 bp, Homo sapiens
tttcacaaatagttgtaaat

SEQ ID NO: 507267 - DNA, 13 bp, Homo sapiens
tttgtccacttca

SEQ ID NO: 507268 - DNA, 13 bp, Homo sapiens
tttgttcttcaga

SEQ ID NO: 507269 - DNA, 13 bp, Homo sapiens
tttgtttcacttt

SEQ ID NO: 507270 - DNA, 16 bp, Homo sapiens
ttttaaaagttattaa

SEQ ID NO: 507271 - DNA, 15 bp, Homo sapiens
ttttaattacagaag

SEQ ID NO: 507272 - DNA, 23 bp, Homo sapiens
ttttcacacaatacaataagtta

SEQ ID NO: 507273 - DNA, 17 bp, Homo sapiens
ttttccccctatcagtt

SEQ ID NO: 507274 - DNA, 22 bp, Homo sapiens
ttttgtgaacacttttgaaaat

SEQ ID NO: 507275 - DNA, 22 bp, Homo sapiens
tttttcacttctacctacatat

SEQ ID NO: 507276 - DNA, 18 bp, Homo sapiens
tttttccccctatcagtt

SEQ ID NO: 507277 - DNA, 21 bp, Homo sapiens
tctaaccttcacgattaactg

SEQ ID NO: 507278 - DNA, 17 bp, Homo sapiens
tctacctacatatttgt

SEQ ID NO: 507279 - DNA, 23 bp, Homo sapiens
tctagaggagggggcaggctgag

SEQ ID NO: 507280 - DNA, 16 bp, Homo sapiens
tctcgcatcttcccaa

SEQ ID NO: 507281 - DNA, 14 bp, Homo sapiens
tctcggctcagtgc

SEQ ID NO: 507282 - DNA, 16 bp, Homo sapiens
tctcggctcagtgcaa

SEQ ID NO: 507283 - DNA, 17 bp, Homo sapiens
tctctgggcctcagagg

SEQ ID NO: 507284 - DNA, 17 bp, Homo sapiens
tctctggtgagcgagga

SEQ ID NO: 507285 - DNA, 12 bp, Homo sapiens
tctgcttcccag

SEQ ID NO: 507286 - DNA, 22 bp, Homo sapiens
tctgcttcccaggttcaagcga

SEQ ID NO: 507287 - DNA, 21 bp, Homo sapiens
tctgggcactggtaatcccaa

SEQ ID NO: 507288 - DNA, 14 bp, Homo sapiens
tcttagtagatttt

SEQ ID NO: 507289 - DNA, 18 bp, Homo sapiens
tcttcagtttttcacttc

SEQ ID NO: 507290 - DNA, 23 bp, Homo sapiens
tctttaggggaagtaaaacagtc

SEQ ID NO: 507291 - DNA, 19 bp, Homo sapiens
tctttattaagtagatgaa

SEQ ID NO: 507292 - DNA, 12 bp, Homo sapiens
tctttgctgtta

SEQ ID NO: 507293 - DNA, 18 bp, Homo sapiens
tgaaaaaggaaaaatatt

SEQ ID NO: 507294 - DNA, 22 bp, Homo sapiens
tgaaagctcctcgagggcaggg

SEQ ID NO: 507295 - DNA, 14 bp, Homo sapiens
tgaactcaatgata

SEQ ID NO: 507296 - DNA, 14 bp, Homo sapiens
tgaagcaaacacat

SEQ ID NO: 507297 - DNA, 19 bp, Homo sapiens
tgaagcaatttgaaataat

SEQ ID NO: 507298 - DNA, 22 bp, Homo sapiens
tgacagatcttttttttttccc

SEQ ID NO: 507299 - DNA, 17 bp, Homo sapiens
tgacctactcgagggac

SEQ ID NO: 507300 - DNA, 15 bp, Homo sapiens
tgagacagacattca

SEQ ID NO: 507301 - DNA, 18 bp, Homo sapiens
tgagacatgaagacacca

SEQ ID NO: 507302 - DNA, 20 bp, Homo sapiens
tgagaggaggcagcaggact

SEQ ID NO: 507303 - DNA, 18 bp, Homo sapiens
tgagcagcctggagccct

SEQ ID NO: 507304 - DNA, 17 bp, Homo sapiens
tgagcgaggacattctc

SEQ ID NO: 507305 - DNA, 21 bp, Homo sapiens
tgagctctgcagcccagggac

SEQ ID NO: 507306 - DNA, 22 bp, Homo sapiens
tgagctttatgtaataatgtga

SEQ ID NO: 507307 - DNA, 22 bp, Homo sapiens
tgaggtgcccagctagctgcag

SEQ ID NO: 507308 - DNA, 20 bp, Homo sapiens
tgagtcaatagcttgtcttc

SEQ ID NO: 507309 - DNA, 18 bp, Homo sapiens
tgagttttgtttcacttt

SEQ ID NO: 507310 - DNA, 16 bp, Homo sapiens
tgataacatggaaatg

SEQ ID NO: 507311 - DNA, 12 bp, Homo sapiens
tgatcctcccac

SEQ ID NO: 507312 - DNA, 21 bp, Homo sapiens
tgcaaagcaatcttttataca

SEQ ID NO: 507313 - DNA, 20 bp, Homo sapiens
tgcaacctctgcttcccagg

SEQ ID NO: 507314 - DNA, 21 bp, Homo sapiens
tgcaagaccgtttgtccactt

SEQ ID NO: 507315 - DNA, 18 bp, Homo sapiens
tgcatcccacgttctgtt

SEQ ID NO: 507316 - DNA, 19 bp, Homo sapiens
tgcatcccacgttctgtta

SEQ ID NO: 507317 - DNA, 17 bp, Homo sapiens
tgcccagtttcagggct

SEQ ID NO: 507318 - DNA, 12 bp, Homo sapiens
tgcccctctctg

SEQ ID NO: 507319 - DNA, 13 bp, Homo sapiens
tgcccctctctgg

SEQ ID NO: 507320 - DNA, 16 bp, Homo sapiens
tgcctcagcctcccga

SEQ ID NO: 507321 - DNA, 19 bp, Homo sapiens
tgcgatctcggctcagtgc

SEQ ID NO: 507322 - DNA, 14 bp, Homo sapiens
tgctcaggggccct

SEQ ID NO: 507323 - DNA, 17 bp, Homo sapiens
tgctcaggggccctgga

SEQ ID NO: 507324 - DNA, 18 bp, Homo sapiens
tgctcaggggccctggag

SEQ ID NO: 507325 - DNA, 17 bp, Homo sapiens
tgctgtaaaaactgtgg

SEQ ID NO: 507326 - DNA, 23 bp, Homo sapiens
tgctgttaaaattaatatatcat

SEQ ID NO: 507327 - DNA, 14 bp, Homo sapiens
tgcttcccaggttc

SEQ ID NO: 507328 - DNA, 19 bp, Homo sapiens
tggaaagacagcttctcat

SEQ ID NO: 507329 - DNA, 23 bp, Homo sapiens
tggaaagacagcttctcatcctg

SEQ ID NO: 507330 - DNA, 23 bp, Homo sapiens
tggaaagagtgccagtcagcagt

SEQ ID NO: 507331 - DNA, 13 bp, Homo sapiens
tggagccctggag

SEQ ID NO: 507332 - DNA, 14 bp, Homo sapiens
tggagccctggaga

SEQ ID NO: 507333 - DNA, 15 bp, Homo sapiens
tggattaggtctctg

SEQ ID NO: 507334 - DNA, 17 bp, Homo sapiens
tggcaagggttcacctg

SEQ ID NO: 507335 - DNA, 19 bp, Homo sapiens
tggcccacagcaggtgctg

SEQ ID NO: 507336 - DNA, 13 bp, Homo sapiens
tgggaaaggggag

SEQ ID NO: 507337 - DNA, 24 bp, Homo sapiens
tgggacctccaccgttggtgttca

SEQ ID NO: 507338 - DNA, 22 bp, Homo sapiens
tgggcagctaccatttcccttt

SEQ ID NO: 507339 - DNA, 16 bp, Homo sapiens
tggggctgggcagcta

SEQ ID NO: 507340 - DNA, 22 bp, Homo sapiens
tgggggaacactgagaaagagg

SEQ ID NO: 507341 - DNA, 15 bp, Homo sapiens
tggtctattgtctgt

SEQ ID NO: 507342 - DNA, 17 bp, Homo sapiens
tggttctaactgctgtt

SEQ ID NO: 507343 - DNA, 13 bp, Homo sapiens
tgtaataatgtga

SEQ ID NO: 507344 - DNA, 19 bp, Homo sapiens
tgtataacagccttttcct

SEQ ID NO: 507345 - DNA, 14 bp, Homo sapiens
tgtataatcacagt

SEQ ID NO: 507346 - DNA, 19 bp, Homo sapiens
tgtcggcctggtgttctgt

SEQ ID NO: 507347 - DNA, 20 bp, Homo sapiens
tgtctgaccttccaaagact

SEQ ID NO: 507348 - DNA, 16 bp, Homo sapiens
tgtgacaaagaagacc

SEQ ID NO: 507349 - DNA, 22 bp, Homo sapiens
tgtgacccagcactgcccaaag

SEQ ID NO: 507350 - DNA, 16 bp, Homo sapiens
tgttaaaattaatata

SEQ ID NO: 507351 - DNA, 12 bp, Homo sapiens
tgttattatata

SEQ ID NO: 507352 - DNA, 19 bp, Homo sapiens
tgttcctttgtaattgaca

SEQ ID NO: 507353 - DNA, 20 bp, Homo sapiens
tgttgacaaatgacagatct

SEQ ID NO: 507354 - DNA, 22 bp, Homo sapiens
tgttgacaaatgacagatcttt

SEQ ID NO: 507355 - DNA, 18 bp, Homo sapiens
tgtttgagctctgcagcc

SEQ ID NO: 507356 - DNA, 14 bp, Homo sapiens
ttaagatatgatgt

SEQ ID NO: 507357 - DNA, 19 bp, Homo sapiens
ttacaagagaagaaagtga

SEQ ID NO: 507358 - DNA, 21 bp, Homo sapiens
ttacagaagagtttcttaact

SEQ ID NO: 507359 - DNA, 22 bp, Homo sapiens
ttactgtatttttcagaaatca

SEQ ID NO: 507360 - DNA, 20 bp, Homo sapiens
cttgcccagtttcagggcta

SEQ ID NO: 507361 - DNA, 12 bp, Homo sapiens
cttgcctgcagg

SEQ ID NO: 507362 - DNA, 14 bp, Homo sapiens
ctttattaagtaga

SEQ ID NO: 507363 - DNA, 19 bp, Homo sapiens
ctttccctgcttaatgaaa

SEQ ID NO: 507364 - DNA, 15 bp, Homo sapiens
cttttgaaaatgtac

SEQ ID NO: 507365 - DNA, 13 bp, Homo sapiens
gaaaatgtacatg

SEQ ID NO: 507366 - DNA, 14 bp, Homo sapiens
gaaagaggcaggga

SEQ ID NO: 507367 - DNA, 20 bp, Homo sapiens
gaaaggggagtaggtggggg

SEQ ID NO: 507368 - DNA, 17 bp, Homo sapiens
gaaatatacacacagca

SEQ ID NO: 507369 - DNA, 19 bp, Homo sapiens
gaacccatattttaaattc

SEQ ID NO: 507370 - DNA, 21 bp, Homo sapiens
gaacttgttaacctttctaac

SEQ ID NO: 507371 - DNA, 21 bp, Homo sapiens
gaagacactgaaatatacaca

SEQ ID NO: 507372 - DNA, 12 bp, Homo sapiens
gaagagccacag

SEQ ID NO: 507373 - DNA, 16 bp, Homo sapiens
gaagagtttcttaact

SEQ ID NO: 507374 - DNA, 13 bp, Homo sapiens
gaagcaatttgaa

SEQ ID NO: 507375 - DNA, 16 bp, Homo sapiens
gaagtaaaacagtcat

SEQ ID NO: 507376 - DNA, 15 bp, Homo sapiens
gaagtacctttgtta

SEQ ID NO: 507377 - DNA, 15 bp, Homo sapiens
gaagttgaatgggca

SEQ ID NO: 507378 - DNA, 17 bp, Homo sapiens
gaatcatcaggaccctg

SEQ ID NO: 507379 - DNA, 16 bp, Homo sapiens
gaatctagaggagggg

SEQ ID NO: 507380 - DNA, 23 bp, Homo sapiens
gaatctttttcagaaacagtgag

SEQ ID NO: 507381 - DNA, 19 bp, Homo sapiens
gaattcactgagttttgtt

SEQ ID NO: 507382 - DNA, 18 bp, Homo sapiens
gacactcaataaacagtc

SEQ ID NO: 507383 - DNA, 21 bp, Homo sapiens
gacagacattccttctacatg

SEQ ID NO: 507384 - DNA, 22 bp, Homo sapiens
gacagcttctcatcctgcaggc

SEQ ID NO: 507385 - DNA, 18 bp, Homo sapiens
gaccgaggagggagagtc

SEQ ID NO: 507386 - DNA, 14 bp, Homo sapiens
gactacctctgtgc

SEQ ID NO: 507387 - DNA, 17 bp, Homo sapiens
gagaaactcttgagatc

SEQ ID NO: 507388 - DNA, 12 bp, Homo sapiens
gagaagcactgt

SEQ ID NO: 507389 - DNA, 20 bp, Homo sapiens
gagaagccagtgcggcaggt

SEQ ID NO: 507390 - DNA, 17 bp, Homo sapiens
gagcatgagaggaggca

SEQ ID NO: 507391 - DNA, 17 bp, Homo sapiens
gagctgcccacagcagg

SEQ ID NO: 507392 - DNA, 15 bp, Homo sapiens
gagctgcccctctct

SEQ ID NO: 507393 - DNA, 19 bp, Homo sapiens
gagctgcccctctctgggc

SEQ ID NO: 507394 - DNA, 19 bp, Homo sapiens
gaggaaaggtttgagaagc

SEQ ID NO: 507395 - DNA, 14 bp, Homo sapiens
gaggaggcagcagg

SEQ ID NO: 507396 - DNA, 15 bp, Homo sapiens
gaggaggcagcagga

SEQ ID NO: 507397 - DNA, 15 bp, Homo sapiens
gaggcagcaggactg

SEQ ID NO: 507398 - DNA, 16 bp, Homo sapiens
gaggccggggccgggt

SEQ ID NO: 507399 - DNA, 18 bp, Homo sapiens
gaggcctggagtaacaca

SEQ ID NO: 507400 - DNA, 21 bp, Homo sapiens
gaggccttatgagggtcctct

SEQ ID NO: 507401 - DNA, 11 bp, Homo sapiens
gaggccttcca

SEQ ID NO: 507402 - DNA, 11 bp, Homo sapiens
gagggcaggga

SEQ ID NO: 507403 - DNA, 18 bp, Homo sapiens
gagggtcgtgggaaaggg

SEQ ID NO: 507404 - DNA, 19 bp, Homo sapiens
gagggtcgtgggaaagggg

SEQ ID NO: 507405 - DNA, 15 bp, Homo sapiens
gagtctcccagggag

SEQ ID NO: 507406 - DNA, 15 bp, Homo sapiens
gatcctgagaagtac

SEQ ID NO: 507407 - DNA, 19 bp, Homo sapiens
gatgaagcaaacacattaa

SEQ ID NO: 507408 - DNA, 13 bp, Homo sapiens
gatggccaggctg

SEQ ID NO: 507409 - DNA, 20 bp, Homo sapiens
gatgggcatatgtgtcagtg

SEQ ID NO: 507410 - DNA, 16 bp, Homo sapiens
gcaaagtattgtgaaa

SEQ ID NO: 507411 - DNA, 16 bp, Homo sapiens
gcactgttccagcctg

SEQ ID NO: 507412 - DNA, 15 bp, Homo sapiens
gcagcctggagccct

SEQ ID NO: 507413 - DNA, 15 bp, Homo sapiens
gcaggactgtcccct

SEQ ID NO: 507414 - DNA, 23 bp, Homo sapiens
gcaggctgagggtcgtgggaaag

SEQ ID NO: 507415 - DNA, 24 bp, Homo sapiens
gcaggggatggcgtggtcaagcac

SEQ ID NO: 507416 - DNA, 18 bp, Homo sapiens
gcatcccacgttctgtta

SEQ ID NO: 507417 - DNA, 23 bp, Homo sapiens
gcatcccacgttctgttaattta

SEQ ID NO: 507418 - DNA, 15 bp, Homo sapiens
gcatgagaggaggca

SEQ ID NO: 507419 - DNA, 16 bp, Homo sapiens
gccaccaaaggccagg

SEQ ID NO: 507420 - DNA, 12 bp, Homo sapiens
gcccctctctgg

SEQ ID NO: 507421 - DNA, 15 bp, Homo sapiens
gcccctctctgggcc

SEQ ID NO: 507422 - DNA, 22 bp, Homo sapiens
gccctggagaccccaccagcct

SEQ ID NO: 507423 - DNA, 15 bp, Homo sapiens
gccctggagcagcca

SEQ ID NO: 507424 - DNA, 19 bp, Homo sapiens
gcctcgctctgttacccag

SEQ ID NO: 507425 - DNA, 20 bp, Homo sapiens
gcctcgctctgttacccagg

SEQ ID NO: 507426 - DNA, 12 bp, Homo sapiens
gcctggagccct

SEQ ID NO: 507427 - DNA, 15 bp, Homo sapiens
gcctggagccctgga

SEQ ID NO: 507428 - DNA, 22 bp, Homo sapiens
gcctggcccacagcaggtgctg

SEQ ID NO: 507429 - DNA, 20 bp, Homo sapiens
gctaccttgtgacccagcac

SEQ ID NO: 507430 - DNA, 21 bp, Homo sapiens
gctaccttgtgacccagcact

SEQ ID NO: 507431 - DNA, 16 bp, Homo sapiens
gctagctgcagagcca

SEQ ID NO: 507432 - DNA, 18 bp, Homo sapiens
gctcaggggccctggagc

SEQ ID NO: 507433 - DNA, 19 bp, Homo sapiens
gctcaggggccctggagca

SEQ ID NO: 507434 - DNA, 11 bp, Homo sapiens
gctcccaggcc

SEQ ID NO: 507435 - DNA, 17 bp, Homo sapiens
gctcctcgagggcaggg

SEQ ID NO: 507436 - DNA, 20 bp, Homo sapiens
gctcctcgagggcagggact

SEQ ID NO: 507437 - DNA, 21 bp, Homo sapiens
gctctctgagtcctggcccaa

SEQ ID NO: 507438 - DNA, 15 bp, Homo sapiens
gctctgcagcccagg

SEQ ID NO: 507439 - DNA, 16 bp, Homo sapiens
catgagaggaggcagc

SEQ ID NO: 507440 - DNA, 16 bp, Homo sapiens
catggctgagctgccc

SEQ ID NO: 507441 - DNA, 14 bp, Homo sapiens
ccaaggagatgaag

SEQ ID NO: 507442 - DNA, 20 bp, Homo sapiens
ccacaatcttaaggggcagc

SEQ ID NO: 507443 - DNA, 18 bp, Homo sapiens
ccacactctttctcctgc

SEQ ID NO: 507444 - DNA, 20 bp, Homo sapiens
ccacatggggctgggcagct

SEQ ID NO: 507445 - DNA, 21 bp, Homo sapiens
ccacatggggctgggcagcta

SEQ ID NO: 507446 - DNA, 22 bp, Homo sapiens
ccacattcttcagtttttcact

SEQ ID NO: 507447 - DNA, 18 bp, Homo sapiens
ccactgcaccccgtctca

SEQ ID NO: 507448 - DNA, 22 bp, Homo sapiens
ccagctattgatataaataaaa

SEQ ID NO: 507449 - DNA, 18 bp, Homo sapiens
ccaggccgagaagccagt

SEQ ID NO: 507450 - DNA, 18 bp, Homo sapiens
ccaggcttgcctgcaggc

SEQ ID NO: 507451 - DNA, 19 bp, Homo sapiens
ccagggacgaagaagagcc

SEQ ID NO: 507452 - DNA, 21 bp, Homo sapiens
ccagggacgaagaagagccac

SEQ ID NO: 507453 - DNA, 23 bp, Homo sapiens
ccagggacgaagaagagccacag

SEQ ID NO: 507454 - DNA, 19 bp, Homo sapiens
ccagggagcatgagaggag

SEQ ID NO: 507455 - DNA, 15 bp, Homo sapiens
ccagtcagcagtcat

SEQ ID NO: 507456 - DNA, 15 bp, Homo sapiens
ccagtgcggcaggtt

SEQ ID NO: 507457 - DNA, 15 bp, Homo sapiens
ccatattttaaattc

SEQ ID NO: 507458 - DNA, 13 bp, Homo sapiens
ccatgatggccag

SEQ ID NO: 507459 - DNA, 17 bp, Homo sapiens
ccatgctggccttgcca

SEQ ID NO: 507460 - DNA, 21 bp, Homo sapiens
ccatgggcacaaagggcccag

SEQ ID NO: 507461 - DNA, 19 bp, Homo sapiens
cccagggtggagtgcagtg

SEQ ID NO: 507462 - DNA, 20 bp, Homo sapiens
cccagggtggagtgcagtgg

SEQ ID NO: 507463 - DNA, 11 bp, Homo sapiens
cccctctctgg

SEQ ID NO: 507464 - DNA, 12 bp, Homo sapiens
cccctctctggg

SEQ ID NO: 507465 - DNA, 13 bp, Homo sapiens
cccctctctgggc

SEQ ID NO: 507466 - DNA, 22 bp, Homo sapiens
cccggagctgcccctctctggg

SEQ ID NO: 507467 - DNA, 21 bp, Homo sapiens
ccctaaggtcattaccacagg

SEQ ID NO: 507468 - DNA, 18 bp, Homo sapiens
ccctatcagttgattttt

SEQ ID NO: 507469 - DNA, 16 bp, Homo sapiens
ccctgcatggctgagc

SEQ ID NO: 507470 - DNA, 22 bp, Homo sapiens
ccctggagaccccaccagcctc

SEQ ID NO: 507471 - DNA, 14 bp, Homo sapiens
ccctggagcagcca

SEQ ID NO: 507472 - DNA, 17 bp, Homo sapiens
cccttaagccctggccc

SEQ ID NO: 507473 - DNA, 21 bp, Homo sapiens
cccttttgcggatgggagggg

SEQ ID NO: 507474 - DNA, 14 bp, Homo sapiens
ccgagaagccagtg

SEQ ID NO: 507475 - DNA, 17 bp, Homo sapiens
ccgaggagggagagtct

SEQ ID NO: 507476 - DNA, 13 bp, Homo sapiens
ccgaggggcggga

SEQ ID NO: 507477 - DNA, 20 bp, Homo sapiens
ccggagctgcccctctctgg

SEQ ID NO: 507478 - DNA, 21 bp, Homo sapiens
ccggagctgcccctctctggg

SEQ ID NO: 507479 - DNA, 15 bp, Homo sapiens
cctacatatttgtat

SEQ ID NO: 507480 - DNA, 17 bp, Homo sapiens
cctcaagtgatcctccc

SEQ ID NO: 507481 - DNA, 15 bp, Homo sapiens
cctccacctgccgtg

SEQ ID NO: 507482 - DNA, 15 bp, Homo sapiens
cctcgctctgttacc

SEQ ID NO: 507483 - DNA, 12 bp, Homo sapiens
cctctgacctat

SEQ ID NO: 507484 - DNA, 13 bp, Homo sapiens
cctctgcttccca

SEQ ID NO: 507485 - DNA, 14 bp, Homo sapiens
cctctgcttcccag

SEQ ID NO: 507486 - DNA, 13 bp, Homo sapiens
cctgaaaaaggaa

SEQ ID NO: 507487 - DNA, 21 bp, Homo sapiens
cctgcatggctgagctgccca

SEQ ID NO: 507488 - DNA, 19 bp, Homo sapiens
cctgcccgcagacctctgg

SEQ ID NO: 507489 - DNA, 17 bp, Homo sapiens
cctggagcagccacccc

SEQ ID NO: 507490 - DNA, 20 bp, Homo sapiens
cctgtagaatagcctgtggc

SEQ ID NO: 507491 - DNA, 21 bp, Homo sapiens
cctgtagaatagcctgtggcc

SEQ ID NO: 507492 - DNA, 13 bp, Homo sapiens
cctgtcggcctgg

SEQ ID NO: 507493 - DNA, 19 bp, Homo sapiens
ccttttgcggatgggaggg

SEQ ID NO: 507494 - DNA, 19 bp, Homo sapiens
cgaactcctaacctcaagt

SEQ ID NO: 507495 - DNA, 18 bp, Homo sapiens
cgaagaagagccacagtg

SEQ ID NO: 507496 - DNA, 14 bp, Homo sapiens
cgaccacagggtct

SEQ ID NO: 507497 - DNA, 15 bp, Homo sapiens
cgatctcggctcagt

SEQ ID NO: 507498 - DNA, 18 bp, Homo sapiens
cgattctcctgcctcagc

SEQ ID NO: 507499 - DNA, 15 bp, Homo sapiens
cggcaggttctcttt

SEQ ID NO: 507500 - DNA, 19 bp, Homo sapiens
cggctcagtgcaacctctg

SEQ ID NO: 507501 - DNA, 20 bp, Homo sapiens
cggctcagtgcaacctctgc

SEQ ID NO: 507502 - DNA, 16 bp, Homo sapiens
cgtgggaaaggggagt

SEQ ID NO: 507503 - DNA, 20 bp, Homo sapiens
cgtgggaaaggggagtaggt

SEQ ID NO: 507504 - DNA, 16 bp, Homo sapiens
ctaaaattatgttact

SEQ ID NO: 507505 - DNA, 19 bp, Homo sapiens
ctaaagggactacctctgt

SEQ ID NO: 507506 - DNA, 21 bp, Homo sapiens
ctaaagggactacctctgtgc

SEQ ID NO: 507507 - DNA, 23 bp, Homo sapiens
ctaaagggactacctctgtgcct

SEQ ID NO: 507508 - DNA, 18 bp, Homo sapiens
ctaacttaaaaaactgca

SEQ ID NO: 507509 - DNA, 19 bp, Homo sapiens
ctaatgtgcctagttcttt

SEQ ID NO: 507510 - DNA, 20 bp, Homo sapiens
ctacatatttgtatgttttt

SEQ ID NO: 507511 - DNA, 23 bp, Homo sapiens
ctacatatttgtatgtttttctg

SEQ ID NO: 507512 - DNA, 14 bp, Homo sapiens
ctaccttgtgaccc

SEQ ID NO: 507513 - DNA, 16 bp, Homo sapiens
ctagaattcactgagt

SEQ ID NO: 507514 - DNA, 15 bp, Homo sapiens
ctagaggagggggca

SEQ ID NO: 507515 - DNA, 23 bp, Homo sapiens
ctaggggtcttgttaagtgcagt

SEQ ID NO: 507516 - DNA, 17 bp, Homo sapiens
ctatcagttgatttttc

SEQ ID NO: 507517 - DNA, 18 bp, Homo sapiens
ctatcagttgatttttct

SEQ ID NO: 507518 - DNA, 13 bp, Homo sapiens
ctcaataaacagt

SEQ ID NO: 507519 - DNA, 20 bp, Homo sapiens
ctcaataaacagtcactgga

SEQ ID NO: 507520 - DNA, 16 bp, Homo sapiens
ctcaatgatagcacct

SEQ ID NO: 507521 - DNA, 18 bp, Homo sapiens
ctcaggggccctggagca

SEQ ID NO: 507522 - DNA, 19 bp, Homo sapiens
ctcaggggccctggagcag

SEQ ID NO: 507523 - DNA, 15 bp, Homo sapiens
ctcagtgcaacctct

SEQ ID NO: 507524 - DNA, 16 bp, Homo sapiens
ctcagtgcaacctctg

SEQ ID NO: 507525 - DNA, 22 bp, Homo sapiens
ctcagtgcaacctctgcttccc

SEQ ID NO: 507526 - DNA, 18 bp, Homo sapiens
ctcataatagacttccca

SEQ ID NO: 507527 - DNA, 22 bp, Homo sapiens
ctccacattcttcagtttttca

SEQ ID NO: 507528 - DNA, 21 bp, Homo sapiens
ctcccaggccgagaagccagt

SEQ ID NO: 507529 - DNA, 17 bp, Homo sapiens
ctccctgtcggcctggt

SEQ ID NO: 507530 - DNA, 19 bp, Homo sapiens
ctcctaacctcaagtgatc

SEQ ID NO: 507531 - DNA, 20 bp, Homo sapiens
ctcctgcccgcagacctctg

SEQ ID NO: 507532 - DNA, 15 bp, Homo sapiens
ctcgcatcttcccaa

SEQ ID NO: 507533 - DNA, 18 bp, Homo sapiens
ctcggctcagtgcaacct

SEQ ID NO: 507534 - DNA, 13 bp, Homo sapiens
ctctacttcagga

SEQ ID NO: 507535 - DNA, 16 bp, Homo sapiens
ctctcgcatcttccca

SEQ ID NO: 507536 - DNA, 18 bp, Homo sapiens
ctctctgagtcctggccc

SEQ ID NO: 507537 - DNA, 16 bp, Homo sapiens
ctctctgggcctcaga

SEQ ID NO: 507538 - DNA, 20 bp, Homo sapiens
ctctctgggcctcagaggcc

SEQ ID NO: 507539 - DNA, 17 bp, Homo sapiens
ctctgagtcctggccca

SEQ ID NO: 507540 - DNA, 18 bp, Homo sapiens
ctctgagtcctggcccaa

SEQ ID NO: 507541 - DNA, 15 bp, Homo sapiens
ctctgatcaagtatt

SEQ ID NO: 507542 - DNA, 14 bp, Homo sapiens
ctctgcagcccagg

SEQ ID NO: 507543 - DNA, 13 bp, Homo sapiens
ctctgcttcccag

SEQ ID NO: 507544 - DNA, 17 bp, Homo sapiens
ctctggattaggtctct

SEQ ID NO: 507545 - DNA, 22 bp, Homo sapiens
ctctgttacccagggtggagtg

SEQ ID NO: 507546 - DNA, 13 bp, Homo sapiens
ctctgttgactgg

SEQ ID NO: 507547 - DNA, 17 bp, Homo sapiens
ctctgttgactggctgt

SEQ ID NO: 507548 - DNA, 21 bp, Homo sapiens
ctcttgaagacactgaaatat

SEQ ID NO: 507549 - DNA, 20 bp, Homo sapiens
ctcttgagatcttggtcctg

SEQ ID NO: 507550 - DNA, 22 bp, Homo sapiens
ctgaaaaaggaaaaatattgaa

SEQ ID NO: 507551 - DNA, 20 bp, Homo sapiens
ctgacactcaataaacagtc

SEQ ID NO: 507552 - DNA, 23 bp, Homo sapiens
ctgacactcaataaacagtcact

SEQ ID NO: 507553 - DNA, 15 bp, Homo sapiens
ctgagaaagaggcag

SEQ ID NO: 507554 - DNA, 17 bp, Homo sapiens
ctgagaaagaggcaggg

SEQ ID NO: 507555 - DNA, 21 bp, Homo sapiens
ataagtccttgcaagaatcag

SEQ ID NO: 507556 - DNA, 22 bp, Homo sapiens
ataagttaactattttattttc

SEQ ID NO: 507557 - DNA, 19 bp, Homo sapiens
ataatcacagttgtgttcc

SEQ ID NO: 507558 - DNA, 23 bp, Homo sapiens
ataattgaagtgttccctttttc

SEQ ID NO: 507559 - DNA, 22 bp, Homo sapiens
atagcttgtcttcgtccatctg

SEQ ID NO: 507560 - DNA, 19 bp, Homo sapiens
atagtgaagcaatttgaaa

SEQ ID NO: 507561 - DNA, 20 bp, Homo sapiens
atagtgaagcaatttgaaat

SEQ ID NO: 507562 - DNA, 15 bp, Homo sapiens
atatacaagtagatc

SEQ ID NO: 507563 - DNA, 22 bp, Homo sapiens
atatagtgaagcaatttgaaat

SEQ ID NO: 507564 - DNA, 19 bp, Homo sapiens
atatcattatctttgctgt

SEQ ID NO: 507565 - DNA, 20 bp, Homo sapiens
atatgagctttatgtaataa

SEQ ID NO: 507566 - DNA, 12 bp, Homo sapiens
atatttcttaat

SEQ ID NO: 507567 - DNA, 18 bp, Homo sapiens
atatttgtatgtttttct

SEQ ID NO: 507568 - DNA, 20 bp, Homo sapiens
atatttgtatgtttttctgt

SEQ ID NO: 507569 - DNA, 18 bp, Homo sapiens
atattttaaattctcata

SEQ ID NO: 507570 - DNA, 14 bp, Homo sapiens
atcatcaggaccct

SEQ ID NO: 507571 - DNA, 17 bp, Homo sapiens
atcattatctttgctgt

SEQ ID NO: 507572 - DNA, 15 bp, Homo sapiens
atccctctgggcact

SEQ ID NO: 507573 - DNA, 23 bp, Homo sapiens
atctagaattcactgagttttgt

SEQ ID NO: 507574 - DNA, 14 bp, Homo sapiens
atctgttgacaaat

SEQ ID NO: 507575 - DNA, 15 bp, Homo sapiens
atcttttaattacag

SEQ ID NO: 507576 - DNA, 22 bp, Homo sapiens
atgaaagctcctcgagggcagg

SEQ ID NO: 507577 - DNA, 15 bp, Homo sapiens
atgaagttgtaggta

SEQ ID NO: 507578 - DNA, 14 bp, Homo sapiens
atgagaactctgag

SEQ ID NO: 507579 - DNA, 19 bp, Homo sapiens
atgagacagacattcacct

SEQ ID NO: 507580 - DNA, 13 bp, Homo sapiens
atgagaggaggca

SEQ ID NO: 507581 - DNA, 20 bp, Homo sapiens
atgagctttatgtaataatg

SEQ ID NO: 507582 - DNA, 16 bp, Homo sapiens
atgcaacaggcactca

SEQ ID NO: 507583 - DNA, 20 bp, Homo sapiens
atgctggccttgccacactc

SEQ ID NO: 507584 - DNA, 16 bp, Homo sapiens
atgtaataatgtgaat

SEQ ID NO: 507585 - DNA, 19 bp, Homo sapiens
atgtacatgttcctttgta

SEQ ID NO: 507586 - DNA, 23 bp, Homo sapiens
atgtacatgttcctttgtaattg

SEQ ID NO: 507587 - DNA, 22 bp, Homo sapiens
atgtgtcagtggggctctctga

SEQ ID NO: 507588 - DNA, 19 bp, Homo sapiens
atgttcctttgtaattgac

SEQ ID NO: 507589 - DNA, 20 bp, Homo sapiens
attacagaagagtttcttaa

SEQ ID NO: 507590 - DNA, 19 bp, Homo sapiens
attatggtcatatttcaca

SEQ ID NO: 507591 - DNA, 17 bp, Homo sapiens
attcatgtaataaacag

SEQ ID NO: 507592 - DNA, 17 bp, Homo sapiens
attcttcagtttttcac

SEQ ID NO: 507593 - DNA, 22 bp, Homo sapiens
attgtgtaagtttataatgcag

SEQ ID NO: 507594 - DNA, 12 bp, Homo sapiens
atttagtaaata

SEQ ID NO: 507595 - DNA, 17 bp, Homo sapiens
atttatacctaactgaa

SEQ ID NO: 507596 - DNA, 20 bp, Homo sapiens
atttcttaataaaataattc

SEQ ID NO: 507597 - DNA, 18 bp, Homo sapiens
atttgaaataattttcaa

SEQ ID NO: 507598 - DNA, 13 bp, Homo sapiens
attttaatctaat

SEQ ID NO: 507599 - DNA, 15 bp, Homo sapiens
attttcacataaaat

SEQ ID NO: 507600 - DNA, 15 bp, Homo sapiens
atttttcagaaatca

SEQ ID NO: 507601 - DNA, 23 bp, Homo sapiens
caaaagtgcagcaggagaactct

SEQ ID NO: 507602 - DNA, 23 bp, Homo sapiens
caaacacattaagccttccacac

SEQ ID NO: 507603 - DNA, 23 bp, Homo sapiens
caaacttccagtgcaacactgaa

SEQ ID NO: 507604 - DNA, 16 bp, Homo sapiens
caaagcaatcttttat

SEQ ID NO: 507605 - DNA, 22 bp, Homo sapiens
caaatggggtttcacaaatagt

SEQ ID NO: 507606 - DNA, 19 bp, Homo sapiens
caagaatcagtgcaaagat

SEQ ID NO: 507607 - DNA, 22 bp, Homo sapiens
caagcaaagtattgtgaaagta

SEQ ID NO: 507608 - DNA, 18 bp, Homo sapiens
caagcgattctcctgcct

SEQ ID NO: 507609 - DNA, 20 bp, Homo sapiens
caagcgattctcctgcctca

SEQ ID NO: 507610 - DNA, 23 bp, Homo sapiens
caaggagatgaagcaaacacatt

SEQ ID NO: 507611 - DNA, 18 bp, Homo sapiens
caataaacagtcactgga

SEQ ID NO: 507612 - DNA, 15 bp, Homo sapiens
caataattgaagtgt

SEQ ID NO: 507613 - DNA, 19 bp, Homo sapiens
caatcttaaggggcagctt

SEQ ID NO: 507614 - DNA, 13 bp, Homo sapiens
cacaaagggccca

SEQ ID NO: 507615 - DNA, 16 bp, Homo sapiens
cacaaagggcccagat

SEQ ID NO: 507616 - DNA, 20 bp, Homo sapiens
cacaaatagttatcttttaa

SEQ ID NO: 507617 - DNA, 18 bp, Homo sapiens
cacaatcttaaggggcag

SEQ ID NO: 507618 - DNA, 20 bp, Homo sapiens
cacaatcttaaggggcagct

SEQ ID NO: 507619 - DNA, 20 bp, Homo sapiens
cacatggggctgggcagcta

SEQ ID NO: 507620 - DNA, 16 bp, Homo sapiens
cacattctggctcagg

SEQ ID NO: 507621 - DNA, 21 bp, Homo sapiens
cacattctggctcagggaggt

SEQ ID NO: 507622 - DNA, 15 bp, Homo sapiens
caccatgatggccag

SEQ ID NO: 507623 - DNA, 18 bp, Homo sapiens
cactccacattcttcagt

SEQ ID NO: 507624 - DNA, 15 bp, Homo sapiens
cactctagggcagtg

SEQ ID NO: 507625 - DNA, 16 bp, Homo sapiens
cactctttctcctgct

SEQ ID NO: 507626 - DNA, 20 bp, Homo sapiens
cactgaaatatacacacagc

SEQ ID NO: 507627 - DNA, 12 bp, Homo sapiens
cactgagaaaga

SEQ ID NO: 507628 - DNA, 13 bp, Homo sapiens
cactgagaaagag

SEQ ID NO: 507629 - DNA, 17 bp, Homo sapiens
cactgagaaagaggcag

SEQ ID NO: 507630 - DNA, 19 bp, Homo sapiens
cagaagagtttcttaactt

SEQ ID NO: 507631 - DNA, 19 bp, Homo sapiens
cagaatgcggcctctgaga

SEQ ID NO: 507632 - DNA, 22 bp, Homo sapiens
cagacattcacctgtatatttc

SEQ ID NO: 507633 - DNA, 23 bp, Homo sapiens
cagactcctgactgtctcccggg

SEQ ID NO: 507634 - DNA, 19 bp, Homo sapiens
cagatcttttttttttccc

SEQ ID NO: 507635 - DNA, 19 bp, Homo sapiens
cagatgagaaactcttgag

SEQ ID NO: 507636 - DNA, 23 bp, Homo sapiens
cagatgggcatatgtgtcagtgg

SEQ ID NO: 507637 - DNA, 18 bp, Homo sapiens
cagccccgcctccaggcc

SEQ ID NO: 507638 - DNA, 18 bp, Homo sapiens
cagcctcccgagtagctg

SEQ ID NO: 507639 - DNA, 21 bp, Homo sapiens
cagcctccctgtcggcctggt

SEQ ID NO: 507640 - DNA, 17 bp, Homo sapiens
cagcctgccctcttcat

SEQ ID NO: 507641 - DNA, 16 bp, Homo sapiens
cagctactataaatat

SEQ ID NO: 507642 - DNA, 19 bp, Homo sapiens
cagctctaccctgcatggc

SEQ ID NO: 507643 - DNA, 19 bp, Homo sapiens
cagcttctattagccagtc

SEQ ID NO: 507644 - DNA, 22 bp, Homo sapiens
caggcagctttttctctcccac

SEQ ID NO: 507645 - DNA, 18 bp, Homo sapiens
caggccgagaagccagtg

SEQ ID NO: 507646 - DNA, 15 bp, Homo sapiens
caggcgaggcctgga

SEQ ID NO: 507647 - DNA, 21 bp, Homo sapiens
caggctgagggtcgtgggaaa

SEQ ID NO: 507648 - DNA, 17 bp, Homo sapiens
caggcttgcctgcaggc

SEQ ID NO: 507649 - DNA, 21 bp, Homo sapiens
cagggacctaaagggactacc

SEQ ID NO: 507650 - DNA, 19 bp, Homo sapiens
cagggacgaagaagagcca

SEQ ID NO: 507651 - DNA, 22 bp, Homo sapiens
cagggagcatgagaggaggcag

SEQ ID NO: 507652 - DNA, 23 bp, Homo sapiens
cagggaggttaagtgacttgccc

SEQ ID NO: 507653 - DNA, 21 bp, Homo sapiens
cagggtcactgaaggcctggc

SEQ ID NO: 507654 - DNA, 22 bp, Homo sapiens
caggttcaagcgattctcctgc

SEQ ID NO: 507655 - DNA, 18 bp, Homo sapiens
cagtagcagtagatgcat

SEQ ID NO: 507656 - DNA, 22 bp, Homo sapiens
cagtctgatgagaactctgagc

SEQ ID NO: 507657 - DNA, 15 bp, Homo sapiens
cagtgcaacactgaa

SEQ ID NO: 507658 - DNA, 16 bp, Homo sapiens
cagtgcaacctctgct

SEQ ID NO: 507659 - DNA, 19 bp, Homo sapiens
cagtgcaacctctgcttcc

SEQ ID NO: 507660 - DNA, 12 bp, Homo sapiens
cagtgcttctca

SEQ ID NO: 507661 - DNA, 18 bp, Homo sapiens
cagtggggctctctgagt

SEQ ID NO: 507662 - DNA, 15 bp, Homo sapiens
cagtttttcacttct

SEQ ID NO: 507663 - DNA, 21 bp, Homo sapiens
cataaagccttggatgtatat

SEQ ID NO: 507664 - DNA, 17 bp, Homo sapiens
catatttgtatgttttt

SEQ ID NO: 507665 - DNA, 22 bp, Homo sapiens
catatttgtatgtttttctgta

SEQ ID NO: 507666 - DNA, 16 bp, Homo sapiens
catattttaaattctc

SEQ ID NO: 507667 - DNA, 15 bp, Homo sapiens
catctagaattcact

SEQ ID NO: 507668 - DNA, 22 bp, Homo sapiens
catgacttgagaaacaaataat

SEQ ID NO: 507669 - DNA, 14 bp, Homo sapiens
catgagaggaggca

SEQ ID NO: 507670 - DNA, 17 bp, Homo sapiens
aaaactttttatatttt

SEQ ID NO: 507671 - DNA, 23 bp, Homo sapiens
aaaaggtaaaactttttatattt

SEQ ID NO: 507672 - DNA, 20 bp, Homo sapiens
aaaagtactaatagaacttg

SEQ ID NO: 507673 - DNA, 12 bp, Homo sapiens
aaagaggcaggg

SEQ ID NO: 507674 - DNA, 17 bp, Homo sapiens
aaagctgttctgtcttc

SEQ ID NO: 507675 - DNA, 14 bp, Homo sapiens
aaagtgaaagcaaa

SEQ ID NO: 507676 - DNA, 22 bp, Homo sapiens
aaataaaacattttcacacaat

SEQ ID NO: 507677 - DNA, 23 bp, Homo sapiens
aaatatagtgaagcaatttgaaa

SEQ ID NO: 507678 - DNA, 13 bp, Homo sapiens
aaatcaaactgct

SEQ ID NO: 507679 - DNA, 13 bp, Homo sapiens
aaatgtacatgtt

SEQ ID NO: 507680 - DNA, 22 bp, Homo sapiens
aaatgtcagtggaagaagcaga

SEQ ID NO: 507681 - DNA, 23 bp, Homo sapiens
aaattatgttactgtatttttca

SEQ ID NO: 507682 - DNA, 11 bp, Homo sapiens
aacacttttga

SEQ ID NO: 507683 - DNA, 17 bp, Homo sapiens
aacagtcactggaaaga

SEQ ID NO: 507684 - DNA, 16 bp, Homo sapiens
aaccaccccatctgca

SEQ ID NO: 507685 - DNA, 21 bp, Homo sapiens
aacccaagatgcaagaaggag

SEQ ID NO: 507686 - DNA, 19 bp, Homo sapiens
aacccatattttaaattct

SEQ ID NO: 507687 - DNA, 21 bp, Homo sapiens
aaccctaaaaagcagagcttt

SEQ ID NO: 507688 - DNA, 24 bp, Homo sapiens
aaccttcacgattaactgtgaaat

SEQ ID NO: 507689 - DNA, 13 bp, Homo sapiens
aactctaactgtg

SEQ ID NO: 507690 - DNA, 16 bp, Homo sapiens
aactctaactgtgaca

SEQ ID NO: 507691 - DNA, 19 bp, Homo sapiens
aactgctgttaaaattaat

SEQ ID NO: 507692 - DNA, 13 bp, Homo sapiens
aactgtgaaatgt

SEQ ID NO: 507693 - DNA, 16 bp, Homo sapiens
aacttaaaaaactgca

SEQ ID NO: 507694 - DNA, 11 bp, Homo sapiens
aagaaatttta

SEQ ID NO: 507695 - DNA, 20 bp, Homo sapiens
aagactcgcggcaggttctc

SEQ ID NO: 507696 - DNA, 19 bp, Homo sapiens
aagaggcagggacctaaag

SEQ ID NO: 507697 - DNA, 17 bp, Homo sapiens
aagatctgtgcagcccc

SEQ ID NO: 507698 - DNA, 16 bp, Homo sapiens
aagatttgctttaatt

SEQ ID NO: 507699 - DNA, 12 bp, Homo sapiens
aagcaaacacat

SEQ ID NO: 507700 - DNA, 13 bp, Homo sapiens
aagcaatttgaaa

SEQ ID NO: 507701 - DNA, 23 bp, Homo sapiens
aagcatattgttattatataatt

SEQ ID NO: 507702 - DNA, 17 bp, Homo sapiens
aagccagtgcggcaggt

SEQ ID NO: 507703 - DNA, 20 bp, Homo sapiens
aagctcttgaagacactgaa

SEQ ID NO: 507704 - DNA, 23 bp, Homo sapiens
aaggagaatcatcaggaccctgg

SEQ ID NO: 507705 - DNA, 18 bp, Homo sapiens
aaggaggctatgctcagg

SEQ ID NO: 507706 - DNA, 20 bp, Homo sapiens
aagggactacctctgtgcct

SEQ ID NO: 507707 - DNA, 17 bp, Homo sapiens
aagtaaaacagtcatct

SEQ ID NO: 507708 - DNA, 21 bp, Homo sapiens
aagtattctaagccaagtttt

SEQ ID NO: 507709 - DNA, 17 bp, Homo sapiens
aagtgcttccaaggcag

SEQ ID NO: 507710 - DNA, 19 bp, Homo sapiens
aataaaacattttcacaca

SEQ ID NO: 507711 - DNA, 15 bp, Homo sapiens
aataatgtgaatcat

SEQ ID NO: 507712 - DNA, 22 bp, Homo sapiens
aatattgaactcaatgatagca

SEQ ID NO: 507713 - DNA, 21 bp, Homo sapiens
aatcatctttattaagtagat

SEQ ID NO: 507714 - DNA, 23 bp, Homo sapiens
aattacagaagagtttcttaact

SEQ ID NO: 507715 - DNA, 14 bp, Homo sapiens
aattatgttactgt

SEQ ID NO: 507716 - DNA, 16 bp, Homo sapiens
aattatgttactgtat

SEQ ID NO: 507717 - DNA, 22 bp, Homo sapiens
aattatgttactgtatttttca

SEQ ID NO: 507718 - DNA, 23 bp, Homo sapiens
aattgacactatatatttcttaa

SEQ ID NO: 507719 - DNA, 15 bp, Homo sapiens
aattgttaagatatg

SEQ ID NO: 507720 - DNA, 21 bp, Homo sapiens
acaaaatgggcccttgcctct

SEQ ID NO: 507721 - DNA, 21 bp, Homo sapiens
acaaagaagaccacaaatagt

SEQ ID NO: 507722 - DNA, 20 bp, Homo sapiens
acaaatagttatcttttaat

SEQ ID NO: 507723 - DNA, 19 bp, Homo sapiens
acaagagtggtatatacaa

SEQ ID NO: 507724 - DNA, 15 bp, Homo sapiens
acaagctcccaggcc

SEQ ID NO: 507725 - DNA, 18 bp, Homo sapiens
acaatcttaaggggcagc

SEQ ID NO: 507726 - DNA, 19 bp, Homo sapiens
acaatcttaaggggcagct

SEQ ID NO: 507727 - DNA, 21 bp, Homo sapiens
acaccaggcttgcctgcaggc

SEQ ID NO: 507728 - DNA, 18 bp, Homo sapiens
acactcacctctaaaaca

SEQ ID NO: 507729 - DNA, 17 bp, Homo sapiens
acactctttctcctgct

SEQ ID NO: 507730 - DNA, 19 bp, Homo sapiens
acactgagaaagaggcagg

SEQ ID NO: 507731 - DNA, 19 bp, Homo sapiens
acagatcttttttttttcc

SEQ ID NO: 507732 - DNA, 23 bp, Homo sapiens
acagctgagcacattctggctca

SEQ ID NO: 507733 - DNA, 21 bp, Homo sapiens
acagcttctcatcctgcaggc

SEQ ID NO: 507734 - DNA, 18 bp, Homo sapiens
acagtgagggagatccca

SEQ ID NO: 507735 - DNA, 18 bp, Homo sapiens
acatgtaatgacacttct

SEQ ID NO: 507736 - DNA, 17 bp, Homo sapiens
acattaagccttccaca

SEQ ID NO: 507737 - DNA, 19 bp, Homo sapiens
acattccttctacatgtaa

SEQ ID NO: 507738 - DNA, 17 bp, Homo sapiens
accagatgatgggggag

SEQ ID NO: 507739 - DNA, 18 bp, Homo sapiens
accaggcttgcctgcagg

SEQ ID NO: 507740 - DNA, 19 bp, Homo sapiens
accaggcttgcctgcaggc

SEQ ID NO: 507741 - DNA, 20 bp, Homo sapiens
gcagggacctaaagggacta

SEQ ID NO: 507742 - DNA, 13 bp, Homo sapiens
gcaggttctcttt

SEQ ID NO: 507743 - DNA, 15 bp, Homo sapiens
gcagtgcttctcaaa

SEQ ID NO: 507744 - DNA, 15 bp, Homo sapiens
gcatatgtatgactc

SEQ ID NO: 507745 - DNA, 15 bp, Homo sapiens
gcatattgttattat

SEQ ID NO: 507746 - DNA, 22 bp, Homo sapiens
gcatgtaccctaaggtcattac

SEQ ID NO: 507747 - DNA, 21 bp, Homo sapiens
gcattcatgtaataaacaggt

SEQ ID NO: 507748 - DNA, 20 bp, Homo sapiens
gccacactctttctcctgct

SEQ ID NO: 507749 - DNA, 21 bp, Homo sapiens
catgagaggaggcagcaggac

SEQ ID NO: 507750 - DNA, 21 bp, Homo sapiens
catgatggccaggctgatctc

SEQ ID NO: 507751 - DNA, 17 bp, Homo sapiens
catggctgagctgccca

SEQ ID NO: 507752 - DNA, 20 bp, Homo sapiens
catggctgagctgcccacag

SEQ ID NO: 507753 - DNA, 15 bp, Homo sapiens
catgtaataaacagg

SEQ ID NO: 507754 - DNA, 19 bp, Homo sapiens
catgtaccctaaggtcatt

SEQ ID NO: 507755 - DNA, 19 bp, Homo sapiens
cattcacctgtatatttct

SEQ ID NO: 507756 - DNA, 17 bp, Homo sapiens
cattcccagctctaccc

SEQ ID NO: 507757 - DNA, 18 bp, Homo sapiens
cattcccagctctaccct

SEQ ID NO: 507758 - DNA, 21 bp, Homo sapiens
cattccttctacatgtaatga

SEQ ID NO: 507759 - DNA, 22 bp, Homo sapiens
catttaaaagacagacattcct

SEQ ID NO: 507760 - DNA, 23 bp, Homo sapiens
ccacattcttcagtttttcactt

SEQ ID NO: 507761 - DNA, 20 bp, Homo sapiens
ccaccaaaggccagggtcac

SEQ ID NO: 507762 - DNA, 13 bp, Homo sapiens
ccacgttctgtta

SEQ ID NO: 507763 - DNA, 19 bp, Homo sapiens
ccactctagggcagtggag

SEQ ID NO: 507764 - DNA, 12 bp, Homo sapiens
ccacttcatttt

SEQ ID NO: 507765 - DNA, 21 bp, Homo sapiens
ccagactcctgactgtctccc

SEQ ID NO: 507766 - DNA, 14 bp, Homo sapiens
ccagcactgcccaa

SEQ ID NO: 507767 - DNA, 20 bp, Homo sapiens
ccagctctaccctgcatggc

SEQ ID NO: 507768 - DNA, 17 bp, Homo sapiens
ccaggcttgcctgcagg

SEQ ID NO: 507769 - DNA, 18 bp, Homo sapiens
ccagggacgaagaagagc

SEQ ID NO: 507770 - DNA, 20 bp, Homo sapiens
ccagggacgaagaagagcca

SEQ ID NO: 507771 - DNA, 22 bp, Homo sapiens
ccagggagcatgagaggaggca

SEQ ID NO: 507772 - DNA, 23 bp, Homo sapiens
ccagggagcatgagaggaggcag

SEQ ID NO: 507773 - DNA, 21 bp, Homo sapiens
ccagggtcactgaaggcctgg

SEQ ID NO: 507774 - DNA, 23 bp, Homo sapiens
ccaggttcaagcgattctcctgc

SEQ ID NO: 507775 - DNA, 14 bp, Homo sapiens
ccagtgcggcaggt

SEQ ID NO: 507776 - DNA, 23 bp, Homo sapiens
cccacaatcttaaggggcagctt

SEQ ID NO: 507777 - DNA, 18 bp, Homo sapiens
cccatctgcattcccagc

SEQ ID NO: 507778 - DNA, 23 bp, Homo sapiens
cccatgctggccttgccacactc

SEQ ID NO: 507779 - DNA, 14 bp, Homo sapiens
ccccggagttcagt

SEQ ID NO: 507780 - DNA, 21 bp, Homo sapiens
cccgcagacctctggattagg

SEQ ID NO: 507781 - DNA, 13 bp, Homo sapiens
ccctctctgggcc

SEQ ID NO: 507782 - DNA, 14 bp, Homo sapiens
ccctctctgggcct

SEQ ID NO: 507783 - DNA, 13 bp, Homo sapiens
ccctctgggcact

SEQ ID NO: 507784 - DNA, 11 bp, Homo sapiens
ccctttttcat

SEQ ID NO: 507785 - DNA, 19 bp, Homo sapiens
ccgagtagctgggattaca

SEQ ID NO: 507786 - DNA, 14 bp, Homo sapiens
ccgcagacctctgg

SEQ ID NO: 507787 - DNA, 19 bp, Homo sapiens
ccggagctgcccctctctg

SEQ ID NO: 507788 - DNA, 23 bp, Homo sapiens
cctaaagggactacctctgtgcc

SEQ ID NO: 507789 - DNA, 19 bp, Homo sapiens
cctcaagtgatcctcccac

SEQ ID NO: 507790 - DNA, 17 bp, Homo sapiens
cctcgagggcagggact

SEQ ID NO: 507791 - DNA, 21 bp, Homo sapiens
cctctggattaggtctctgtt

SEQ ID NO: 507792 - DNA, 19 bp, Homo sapiens
cctgaaaaaggaaaaatat

SEQ ID NO: 507793 - DNA, 17 bp, Homo sapiens
cctgagcgcctgggtcc

SEQ ID NO: 507794 - DNA, 23 bp, Homo sapiens
cctgagtttccttttctgtctct

SEQ ID NO: 507795 - DNA, 20 bp, Homo sapiens
cctgcccgcagacctctgga

SEQ ID NO: 507796 - DNA, 23 bp, Homo sapiens
cctgccgtggacttggggtcaga

SEQ ID NO: 507797 - DNA, 16 bp, Homo sapiens
cctgcctcagcctccc

SEQ ID NO: 507798 - DNA, 19 bp, Homo sapiens
cctgcctcagcctcccgag

SEQ ID NO: 507799 - DNA, 21 bp, Homo sapiens
cctggagccctggagacccca

SEQ ID NO: 507800 - DNA, 21 bp, Homo sapiens
cctggcccacagcaggtgctg

SEQ ID NO: 507801 - DNA, 23 bp, Homo sapiens
cctgggtccaggggaggccttcc

SEQ ID NO: 507802 - DNA, 18 bp, Homo sapiens
ccttaagccctggccccc

SEQ ID NO: 507803 - DNA, 19 bp, Homo sapiens
ccttcacgattaactgtga

SEQ ID NO: 507804 - DNA, 14 bp, Homo sapiens
ccttgatgtgcctg

SEQ ID NO: 507805 - DNA, 13 bp, Homo sapiens
ccttgccacactc

SEQ ID NO: 507806 - DNA, 18 bp, Homo sapiens
ccttttctgtctctctct

SEQ ID NO: 507807 - DNA, 17 bp, Homo sapiens
cgaatctagaggagggg

SEQ ID NO: 507808 - DNA, 18 bp, Homo sapiens
cgaggagggagagtctcc

SEQ ID NO: 507809 - DNA, 12 bp, Homo sapiens
cgagggcaggga

SEQ ID NO: 507810 - DNA, 21 bp, Homo sapiens
cgaggggcgggacccaggcac

SEQ ID NO: 507811 - DNA, 12 bp, Homo sapiens
cgattctcctgc

SEQ ID NO: 507812 - DNA, 13 bp, Homo sapiens
cgcagacctctgg

SEQ ID NO: 507813 - DNA, 15 bp, Homo sapiens
cgcagacctctggat

SEQ ID NO: 507814 - DNA, 16 bp, Homo sapiens
cgcttgaagcctgaac

SEQ ID NO: 507815 - DNA, 17 bp, Homo sapiens
cggagctgcccctctct

SEQ ID NO: 507816 - DNA, 23 bp, Homo sapiens
cggagctgcccctctctgggcct

SEQ ID NO: 507817 - DNA, 17 bp, Homo sapiens
cggcaggttcacaggcg

SEQ ID NO: 507818 - DNA, 13 bp, Homo sapiens
cgtcatttgtgca

SEQ ID NO: 507819 - DNA, 15 bp, Homo sapiens
cgtgggaaaggggag

SEQ ID NO: 507820 - DNA, 15 bp, Homo sapiens
cgtggtcaagcactc

SEQ ID NO: 507821 - DNA, 14 bp, Homo sapiens
ctaaaaatttacaa

SEQ ID NO: 507822 - DNA, 19 bp, Homo sapiens
ctaaaaatttacaagagaa

SEQ ID NO: 507823 - DNA, 22 bp, Homo sapiens
ctaacctcaagtgatcctccca

SEQ ID NO: 507824 - DNA, 13 bp, Homo sapiens
ctaactgctgtta

SEQ ID NO: 507825 - DNA, 14 bp, Homo sapiens
ctaagactacagca

SEQ ID NO: 507826 - DNA, 19 bp, Homo sapiens
ctaaggtcattaccacagg

SEQ ID NO: 507827 - DNA, 19 bp, Homo sapiens
ctacatatttgtatgtttt

SEQ ID NO: 507828 - DNA, 15 bp, Homo sapiens
ctacatgtaatgaca

SEQ ID NO: 507829 - DNA, 14 bp, Homo sapiens
ctaccctgcatggc

SEQ ID NO: 507830 - DNA, 20 bp, Homo sapiens
ctaccctgcatggctgagct

SEQ ID NO: 507831 - DNA, 15 bp, Homo sapiens
ctacctacatatttg

SEQ ID NO: 507832 - DNA, 12 bp, Homo sapiens
ctacctctgtgc

SEQ ID NO: 507833 - DNA, 14 bp, Homo sapiens
ctacctctgtgcct

SEQ ID NO: 507834 - DNA, 17 bp, Homo sapiens
ctacctctgtgccttgc

SEQ ID NO: 507835 - DNA, 15 bp, Homo sapiens
ctactataaatatac

SEQ ID NO: 507836 - DNA, 19 bp, Homo sapiens
ctacttcaggaacaccccc

SEQ ID NO: 507837 - DNA, 16 bp, Homo sapiens
ctagaggagggggcag

SEQ ID NO: 507838 - DNA, 13 bp, Homo sapiens
ctattagccagtc

SEQ ID NO: 507839 - DNA, 17 bp, Homo sapiens
ctcaagtgatcctccca

SEQ ID NO: 507840 - DNA, 23 bp, Homo sapiens
ctcacaccaggcttgcctgcagg

SEQ ID NO: 507841 - DNA, 21 bp, Homo sapiens
ctcaggggccctggagcagcc

SEQ ID NO: 507842 - DNA, 17 bp, Homo sapiens
ctcagtgcaacctctgc

SEQ ID NO: 507843 - DNA, 15 bp, Homo sapiens
ctcatagcacttccc

SEQ ID NO: 507844 - DNA, 14 bp, Homo sapiens
ctcatcctgcaggc

SEQ ID NO: 507845 - DNA, 18 bp, Homo sapiens
ctccacattcttcagttt

SEQ ID NO: 507846 - DNA, 20 bp, Homo sapiens
ctccaggccacatggggctg

SEQ ID NO: 507847 - DNA, 15 bp, Homo sapiens
ctcctcgagggcagg

SEQ ID NO: 507848 - DNA, 21 bp, Homo sapiens
ctcctgcccgcagacctctgg

SEQ ID NO: 507849 - DNA, 14 bp, Homo sapiens
ctcgcatcttccca

SEQ ID NO: 507850 - DNA, 16 bp, Homo sapiens
ctcggctcagtgcaac

SEQ ID NO: 507851 - DNA, 23 bp, Homo sapiens
ctcggctcagtgcaacctctgct

SEQ ID NO: 507852 - DNA, 18 bp, Homo sapiens
ctctaaatagcacttttt

SEQ ID NO: 507853 - DNA, 22 bp, Homo sapiens
ctctaccctgcatggctgagct

SEQ ID NO: 507854 - DNA, 15 bp, Homo sapiens
ctctgagtcctggcc

SEQ ID NO: 507855 - DNA, 16 bp, Homo sapiens
ctctgagtcctggccc

SEQ ID NO: 507856 - DNA, 23 bp, Homo sapiens
ctctgtgccttgccacattaaat

SEQ ID NO: 507857 - DNA, 20 bp, Homo sapiens
acccaagatgcaagaaggag

SEQ ID NO: 507858 - DNA, 21 bp, Homo sapiens
acccagggtggagtgcagtgg

SEQ ID NO: 507859 - DNA, 19 bp, Homo sapiens
accccatgctggccttgcc

SEQ ID NO: 507860 - DNA, 19 bp, Homo sapiens
accccttaagccctggccc

SEQ ID NO: 507861 - DNA, 22 bp, Homo sapiens
accctgcatggctgagctgccc

SEQ ID NO: 507862 - DNA, 21 bp, Homo sapiens
accgaggagggagagtctccc

SEQ ID NO: 507863 - DNA, 23 bp, Homo sapiens
accgaggagggagagtctcccag

SEQ ID NO: 507864 - DNA, 12 bp, Homo sapiens
acctaaacttac

SEQ ID NO: 507865 - DNA, 16 bp, Homo sapiens
acctaaacttacattt

SEQ ID NO: 507866 - DNA, 18 bp, Homo sapiens
acctctaaaacagtcctt

SEQ ID NO: 507867 - DNA, 21 bp, Homo sapiens
acctctggattaggtctctgt

SEQ ID NO: 507868 - DNA, 15 bp, Homo sapiens
acctctgtgccttgc

SEQ ID NO: 507869 - DNA, 23 bp, Homo sapiens
accttcacgattaactgtgaaat

SEQ ID NO: 507870 - DNA, 15 bp, Homo sapiens
acgaagaagagccac

SEQ ID NO: 507871 - DNA, 15 bp, Homo sapiens
actacctctgtgcct

SEQ ID NO: 507872 - DNA, 17 bp, Homo sapiens
actatatatttcttaat

SEQ ID NO: 507873 - DNA, 14 bp, Homo sapiens
actcaataaacagt

SEQ ID NO: 507874 - DNA, 19 bp, Homo sapiens
actcaataaacagtcactg

SEQ ID NO: 507875 - DNA, 20 bp, Homo sapiens
actccacattcttcagtttt

SEQ ID NO: 507876 - DNA, 16 bp, Homo sapiens
actctaactgtgacaa

SEQ ID NO: 507877 - DNA, 13 bp, Homo sapiens
actctagggcagt

SEQ ID NO: 507878 - DNA, 17 bp, Homo sapiens
actgaaggcctggccca

SEQ ID NO: 507879 - DNA, 19 bp, Homo sapiens
actgagaaagaggcaggga

SEQ ID NO: 507880 - DNA, 20 bp, Homo sapiens
actgcatcccacgttctgtt

SEQ ID NO: 507881 - DNA, 14 bp, Homo sapiens
actgcccaaagtgc

SEQ ID NO: 507882 - DNA, 17 bp, Homo sapiens
actgcttatgaaaagta

SEQ ID NO: 507883 - DNA, 21 bp, Homo sapiens
actggctgtgtgaccttaggc

SEQ ID NO: 507884 - DNA, 18 bp, Homo sapiens
actgtatttttcagaaat

SEQ ID NO: 507885 - DNA, 16 bp, Homo sapiens
actgtgacaaagaaga

SEQ ID NO: 507886 - DNA, 15 bp, Homo sapiens
acttaacaagctccc

SEQ ID NO: 507887 - DNA, 20 bp, Homo sapiens
acttaacaagctcccaggcc

SEQ ID NO: 507888 - DNA, 14 bp, Homo sapiens
acttcattttgtat

SEQ ID NO: 507889 - DNA, 20 bp, Homo sapiens
acttttgaaaatgtacatgt

SEQ ID NO: 507890 - DNA, 21 bp, Homo sapiens
actttttatattttatacatt

SEQ ID NO: 507891 - DNA, 13 bp, Homo sapiens
agaaacagtgagt

SEQ ID NO: 507892 - DNA, 21 bp, Homo sapiens
agaacttgttaacctttctaa

SEQ ID NO: 507893 - DNA, 11 bp, Homo sapiens
agaagagccac

SEQ ID NO: 507894 - DNA, 13 bp, Homo sapiens
agaagagccacag

SEQ ID NO: 507895 - DNA, 14 bp, Homo sapiens
agaagtacctttgt

SEQ ID NO: 507896 - DNA, 14 bp, Homo sapiens
agaatctactttaa

SEQ ID NO: 507897 - DNA, 23 bp, Homo sapiens
agaattcactgagttttgtttca

SEQ ID NO: 507898 - DNA, 13 bp, Homo sapiens
agacactgaaata

SEQ ID NO: 507899 - DNA, 21 bp, Homo sapiens
agacactgaaatatacacaca

SEQ ID NO: 507900 - DNA, 22 bp, Homo sapiens
agacactgaaatatacacacag

SEQ ID NO: 507901 - DNA, 23 bp, Homo sapiens
agacagcttctcatcctgcaggc

SEQ ID NO: 507902 - DNA, 21 bp, Homo sapiens
agacattccttctacatgtaa

SEQ ID NO: 507903 - DNA, 12 bp, Homo sapiens
agacctctggat

SEQ ID NO: 507904 - DNA, 23 bp, Homo sapiens
agactctcgcatcttcccaaccc

SEQ ID NO: 507905 - DNA, 14 bp, Homo sapiens
agagaagaaagtga

SEQ ID NO: 507906 - DNA, 15 bp, Homo sapiens
agagaagaaagtgaa

SEQ ID NO: 507907 - DNA, 23 bp, Homo sapiens
agagaggaaaggtttgagaagca

SEQ ID NO: 507908 - DNA, 16 bp, Homo sapiens
agagccaccctgtgtt

SEQ ID NO: 507909 - DNA, 12 bp, Homo sapiens
agaggaggcagc

SEQ ID NO: 507910 - DNA, 15 bp, Homo sapiens
agagtctcccaggga

SEQ ID NO: 507911 - DNA, 17 bp, Homo sapiens
agagtctcccagggagc

SEQ ID NO: 507912 - DNA, 17 bp, Homo sapiens
agagtgccagtcagcag

SEQ ID NO: 507913 - DNA, 23 bp, Homo sapiens
agagtttcttaacttacttttgt

SEQ ID NO: 507914 - DNA, 18 bp, Homo sapiens
agatgaaacattaactct

SEQ ID NO: 507915 - DNA, 19 bp, Homo sapiens
agatgaagcaaacacatta

SEQ ID NO: 507916 - DNA, 13 bp, Homo sapiens
agcaaacacatta

SEQ ID NO: 507917 - DNA, 23 bp, Homo sapiens
agcaactctaagactacagcaca

SEQ ID NO: 507918 - DNA, 13 bp, Homo sapiens
agcaatttgaaat

SEQ ID NO: 507919 - DNA, 16 bp, Homo sapiens
agcaatttgaaataat

SEQ ID NO: 507920 - DNA, 18 bp, Homo sapiens
agcacctaaacttacatt

SEQ ID NO: 507921 - DNA, 12 bp, Homo sapiens
agcactgcccaa

SEQ ID NO: 507922 - DNA, 22 bp, Homo sapiens
agcagccaccccatgctggcct

SEQ ID NO: 507923 - DNA, 20 bp, Homo sapiens
agcagcctggagccctggag

SEQ ID NO: 507924 - DNA, 18 bp, Homo sapiens
agcaggccaggtccagag

SEQ ID NO: 507925 - DNA, 19 bp, Homo sapiens
agcaggccaggtccagaga

SEQ ID NO: 507926 - DNA, 23 bp, Homo sapiens
agcaggccaggtccagagagacc

SEQ ID NO: 507927 - DNA, 13 bp, Homo sapiens
agccaatgcttac

SEQ ID NO: 507928 - DNA, 16 bp, Homo sapiens
agccaccccatgctgg

SEQ ID NO: 507929 - DNA, 13 bp, Homo sapiens
agccagtctttac

SEQ ID NO: 507930 - DNA, 22 bp, Homo sapiens
agccatgggcacaaagggccca

SEQ ID NO: 507931 - DNA, 23 bp, Homo sapiens
agcctcgctctgttacccagggt

SEQ ID NO: 507932 - DNA, 17 bp, Homo sapiens
agcctgtggcctttgca

SEQ ID NO: 507933 - DNA, 14 bp, Homo sapiens
agcgattctcctgc

SEQ ID NO: 507934 - DNA, 19 bp, Homo sapiens
agctactataaatatacat

SEQ ID NO: 507935 - DNA, 19 bp, Homo sapiens
agctcttgaagacactgaa

SEQ ID NO: 507936 - DNA, 16 bp, Homo sapiens
agctgcagagccaccc

SEQ ID NO: 507937 - DNA, 14 bp, Homo sapiens
agctgcccctctct

SEQ ID NO: 507938 - DNA, 18 bp, Homo sapiens
agctgttctgtcttccca

SEQ ID NO: 507939 - DNA, 17 bp, Homo sapiens
agcttctattagccagt

SEQ ID NO: 507940 - DNA, 22 bp, Homo sapiens
agctttatgtaataatgtgaat

SEQ ID NO: 507941 - DNA, 21 bp, Homo sapiens
aggactgtccccttgaaggag

SEQ ID NO: 507942 - DNA, 14 bp, Homo sapiens
aggaggcagcagga

SEQ ID NO: 507943 - DNA, 20 bp, Homo sapiens
aggaggctatgctcaggggc

SEQ ID NO: 507944 - DNA, 19 bp, Homo sapiens
aggagggggcaggctgagg

SEQ ID NO: 507945 - DNA, 18 bp, Homo sapiens
aggcagggacctaaaggg

SEQ ID NO: 507946 - DNA, 20 bp, Homo sapiens
aggcatccttcctcacacca

SEQ ID NO: 507947 - DNA, 23 bp, Homo sapiens
aggccacatggggctgggcagct

SEQ ID NO: 507948 - DNA, 12 bp, Homo sapiens
aggccagggtca

SEQ ID NO: 507949 - DNA, 20 bp, Homo sapiens
aggccagggtcactgaaggc

SEQ ID NO: 507950 - DNA, 16 bp, Homo sapiens
aggccgagaagccagt

SEQ ID NO: 507951 - DNA, 15 bp, Homo sapiens
aggccggggccgggt

SEQ ID NO: 507952 - DNA, 21 bp, Homo sapiens
aggctgagggtcgtgggaaag

SEQ ID NO: 507953 - DNA, 22 bp, Homo sapiens
agggacgaagaagagccacagt

SEQ ID NO: 507954 - DNA, 16 bp, Homo sapiens
agggactacctctgtg

SEQ ID NO: 507955 - DNA, 22 bp, Homo sapiens
agggagagtctcccagggagca

SEQ ID NO: 507956 - DNA, 17 bp, Homo sapiens
agggagcatgagaggag

SEQ ID NO: 507957 - DNA, 19 bp, Homo sapiens
agggagttttaaagaaatt

SEQ ID NO: 507958 - DNA, 15 bp, Homo sapiens
aggggcagcttctat

SEQ ID NO: 507959 - DNA, 20 bp, Homo sapiens
aggtccagagagaccgagga

SEQ ID NO: 507960 - DNA, 21 bp, Homo sapiens
aggtgctgagcaaagggaaca

SEQ ID NO: 507961 - DNA, 23 bp, Homo sapiens
aggtgggggaacactgagaaaga

SEQ ID NO: 507962 - DNA, 17 bp, Homo sapiens
aggtttgagaagcactg

SEQ ID NO: 507963 - DNA, 16 bp, Homo sapiens
agtaacgggacagtaa

SEQ ID NO: 507964 - DNA, 20 bp, Homo sapiens
agtactggctgatggagtaa

SEQ ID NO: 507965 - DNA, 13 bp, Homo sapiens
agtattgtgaaag

SEQ ID NO: 507966 - DNA, 17 bp, Homo sapiens
agtccgaggggcgggac

SEQ ID NO: 507967 - DNA, 14 bp, Homo sapiens
agtctcccagggag

SEQ ID NO: 507968 - DNA, 16 bp, Homo sapiens
agtgaacccatatttt

SEQ ID NO: 507969 - DNA, 19 bp, Homo sapiens
agtgagcagcctggagccc

SEQ ID NO: 507970 - DNA, 15 bp, Homo sapiens
agtgcaacctctgct

SEQ ID NO: 507971 - DNA, 15 bp, Homo sapiens
agtggggctctctga

SEQ ID NO: 507972 - DNA, 13 bp, Homo sapiens
agttaaagcagtg

SEQ ID NO: 507973 - DNA, 19 bp, Homo sapiens
tacatatttgcatatgtat

SEQ ID NO: 507974 - DNA, 15 bp, Homo sapiens
tacatgttcctttgt

SEQ ID NO: 507975 - DNA, 17 bp, Homo sapiens
tacatgttcctttgtaa

SEQ ID NO: 507976 - DNA, 18 bp, Homo sapiens
tacccagggtggagtgca

SEQ ID NO: 507977 - DNA, 13 bp, Homo sapiens
tacctacatattt

SEQ ID NO: 507978 - DNA, 20 bp, Homo sapiens
tacctacatatttgtatgtt

SEQ ID NO: 507979 - DNA, 20 bp, Homo sapiens
tactaaaattatgttactgt

SEQ ID NO: 507980 - DNA, 16 bp, Homo sapiens
tagatcctgagaagta

SEQ ID NO: 507981 - DNA, 13 bp, Homo sapiens
tagatgaaacatt

SEQ ID NO: 507982 - DNA, 20 bp, Homo sapiens
tagcattcatgtaataaaca

SEQ ID NO: 507983 - DNA, 13 bp, Homo sapiens
tagcctgtggcct

SEQ ID NO: 507984 - DNA, 19 bp, Homo sapiens
tagctaagcggaccagcct

SEQ ID NO: 507985 - DNA, 19 bp, Homo sapiens
taggggaagtaaaacagtc

SEQ ID NO: 507986 - DNA, 13 bp, Homo sapiens
tagtaaataaaca

SEQ ID NO: 507987 - DNA, 15 bp, Homo sapiens
tagttactatatgcc

SEQ ID NO: 507988 - DNA, 19 bp, Homo sapiens
tagttatcttttaattaca

SEQ ID NO: 507989 - DNA, 14 bp, Homo sapiens
tagtttgttcttca

SEQ ID NO: 507990 - DNA, 22 bp, Homo sapiens
tatataattacatatttgcata

SEQ ID NO: 507991 - DNA, 14 bp, Homo sapiens
tatatatttcttaa

SEQ ID NO: 507992 - DNA, 16 bp, Homo sapiens
tatgctcaggggccct

SEQ ID NO: 507993 - DNA, 20 bp, Homo sapiens
tatttgtatgtttttctgta

SEQ ID NO: 507994 - DNA, 14 bp, Homo sapiens
tattttaaattctc

SEQ ID NO: 507995 - DNA, 14 bp, Homo sapiens
tatttttcagaaat

SEQ ID NO: 507996 - DNA, 16 bp, Homo sapiens
tcaataaacagtcact

SEQ ID NO: 507997 - DNA, 21 bp, Homo sapiens
tcacaccaggcttgcctgcag

SEQ ID NO: 507998 - DNA, 22 bp, Homo sapiens
tcacaccaggcttgcctgcagg

SEQ ID NO: 507999 - DNA, 18 bp, Homo sapiens
tcacataaaatagatttt

SEQ ID NO: 508000 - DNA, 20 bp, Homo sapiens
tcacctctaaaacagtcctt

SEQ ID NO: 508001 - DNA, 21 bp, Homo sapiens
tcacgattaactgtgaaatgt

SEQ ID NO: 508002 - DNA, 22 bp, Homo sapiens
tcactgagttttgtttcacttt

SEQ ID NO: 508003 - DNA, 15 bp, Homo sapiens
tcactttgacatttg

SEQ ID NO: 508004 - DNA, 13 bp, Homo sapiens
tcagcagtcatgc

SEQ ID NO: 508005 - DNA, 16 bp, Homo sapiens
tcaggaggaaggctta

SEQ ID NO: 508006 - DNA, 16 bp, Homo sapiens
tcaggggccctggagc

SEQ ID NO: 508007 - DNA, 19 bp, Homo sapiens
tcagtggggctctctgagt

SEQ ID NO: 508008 - DNA, 17 bp, Homo sapiens
tcatcaaccctaaaaag

SEQ ID NO: 508009 - DNA, 12 bp, Homo sapiens
tcatcctgcagg

SEQ ID NO: 508010 - DNA, 13 bp, Homo sapiens
tcattaccacagg

SEQ ID NO: 508011 - DNA, 18 bp, Homo sapiens
tcattatctttgctgtta

SEQ ID NO: 508012 - DNA, 22 bp, Homo sapiens
tccacttcattttgtataatca

SEQ ID NO: 508013 - DNA, 21 bp, Homo sapiens
tccagggacgaagaagagcca

SEQ ID NO: 508014 - DNA, 18 bp, Homo sapiens
tccagtgcaacactgaag

SEQ ID NO: 508015 - DNA, 19 bp, Homo sapiens
tccatgtgaccgaacactg

SEQ ID NO: 508016 - DNA, 18 bp, Homo sapiens
tcccaagatctgtgcagc

SEQ ID NO: 508017 - DNA, 22 bp, Homo sapiens
tcccacgttctgttaatttagt

SEQ ID NO: 508018 - DNA, 21 bp, Homo sapiens
tcccagggagcatgagaggag

SEQ ID NO: 508019 - DNA, 21 bp, Homo sapiens
tcccgagtagctgggattaca

SEQ ID NO: 508020 - DNA, 16 bp, Homo sapiens
tccctttttcataatt

SEQ ID NO: 508021 - DNA, 15 bp, Homo sapiens
tccgaggggcgggac

SEQ ID NO: 508022 - DNA, 20 bp, Homo sapiens
tccgaggggcgggacccagg

SEQ ID NO: 508023 - DNA, 17 bp, Homo sapiens
tcctcgagggcagggac

SEQ ID NO: 508024 - DNA, 20 bp, Homo sapiens
tcctgcccgcagacctctgg

SEQ ID NO: 508025 - DNA, 21 bp, Homo sapiens
tcctgcccgcagacctctgga

SEQ ID NO: 508026 - DNA, 11 bp, Homo sapiens
tcctttgtaat

SEQ ID NO: 508027 - DNA, 15 bp, Homo sapiens
tcgagggcagggact

SEQ ID NO: 508028 - DNA, 13 bp, Homo sapiens
tcgtgggaaaggg

SEQ ID NO: 508029 - DNA, 15 bp, Homo sapiens
tcgtgggaaagggga

SEQ ID NO: 508030 - DNA, 13 bp, Homo sapiens
tctaaaatgagtt

SEQ ID NO: 508031 - DNA, 12 bp, Homo sapiens
tctaacagacaa

SEQ ID NO: 508032 - DNA, 20 bp, Homo sapiens
tctaattctaaggaatatga

SEQ ID NO: 508033 - DNA, 16 bp, Homo sapiens
tctacatgtaatgaca

SEQ ID NO: 508034 - DNA, 21 bp, Homo sapiens
tctaccctgcatggctgagct

SEQ ID NO: 508035 - DNA, 22 bp, Homo sapiens
tctagaggagggggcaggctga

SEQ ID NO: 508036 - DNA, 19 bp, Homo sapiens
tctcccactagacaagtcc

SEQ ID NO: 508037 - DNA, 15 bp, Homo sapiens
tctcctgcctcagcc

SEQ ID NO: 508038 - DNA, 15 bp, Homo sapiens
tttgaaaatgtacat

SEQ ID NO: 508039 - DNA, 15 bp, Homo sapiens
tttgcatatgtatga

SEQ ID NO: 508040 - DNA, 17 bp, Homo sapiens
tttgtatgtttttctgt

SEQ ID NO: 508041 - DNA, 19 bp, Homo sapiens
ttttaaagaaattttagta

SEQ ID NO: 508042 - DNA, 20 bp, Homo sapiens
agtggtatatacaagtagat

SEQ ID NO: 508043 - DNA, 21 bp, Homo sapiens
agtggtgcgatctcggctcag

SEQ ID NO: 508044 - DNA, 14 bp, Homo sapiens
agtgtcaggaggaa

SEQ ID NO: 508045 - DNA, 16 bp, Homo sapiens
agttactaaaattatg

SEQ ID NO: 508046 - DNA, 14 bp, Homo sapiens
agtttataatgcag

SEQ ID NO: 508047 - DNA, 14 bp, Homo sapiens
agtttcttaactta

SEQ ID NO: 508048 - DNA, 22 bp, Homo sapiens
agttttaaagaaattttagtag

SEQ ID NO: 508049 - DNA, 19 bp, Homo sapiens
ataaacaagtcaaagactt

SEQ ID NO: 508050 - DNA, 11 bp, Homo sapiens
ataaacagtca

SEQ ID NO: 508051 - DNA, 12 bp, Homo sapiens
ataaacagtcac

SEQ ID NO: 508052 - DNA, 16 bp, Homo sapiens
ataaacagtcactgga

SEQ ID NO: 508053 - DNA, 13 bp, Homo sapiens
ataaataaaacat

SEQ ID NO: 508054 - DNA, 17 bp, Homo sapiens
ataacagccttttcctt

SEQ ID NO: 508055 - DNA, 22 bp, Homo sapiens
ataatgcaggggaagtactact

SEQ ID NO: 508056 - DNA, 22 bp, Homo sapiens
atagaatctactttaatttatt

SEQ ID NO: 508057 - DNA, 16 bp, Homo sapiens
atatagtgaagcaatt

SEQ ID NO: 508058 - DNA, 20 bp, Homo sapiens
atatatcattatctttgctg

SEQ ID NO: 508059 - DNA, 13 bp, Homo sapiens
atatatttcttaa

SEQ ID NO: 508060 - DNA, 16 bp, Homo sapiens
atcagttgatttttct

SEQ ID NO: 508061 - DNA, 17 bp, Homo sapiens
atcccacgttctgttaa

SEQ ID NO: 508062 - DNA, 21 bp, Homo sapiens
atctactttaatttattttgt

SEQ ID NO: 508063 - DNA, 15 bp, Homo sapiens
atctagaattcactg

SEQ ID NO: 508064 - DNA, 20 bp, Homo sapiens
atctgttgacaaatgacaga

SEQ ID NO: 508065 - DNA, 18 bp, Homo sapiens
atctttattaagtagatg

SEQ ID NO: 508066 - DNA, 21 bp, Homo sapiens
atctttgctgttattgacagc

SEQ ID NO: 508067 - DNA, 19 bp, Homo sapiens
atcttttaattacagaaga

SEQ ID NO: 508068 - DNA, 17 bp, Homo sapiens
atgaaacattaactcta

SEQ ID NO: 508069 - DNA, 15 bp, Homo sapiens
atgaagcaaacacat

SEQ ID NO: 508070 - DNA, 18 bp, Homo sapiens
atgagctttatgtaataa

SEQ ID NO: 508071 - DNA, 14 bp, Homo sapiens
atgatttataccta

SEQ ID NO: 508072 - DNA, 14 bp, Homo sapiens
atgcaagaaggagg

SEQ ID NO: 508073 - DNA, 18 bp, Homo sapiens
atgggcacaaagggccca

SEQ ID NO: 508074 - DNA, 12 bp, Homo sapiens
atggtcatattt

SEQ ID NO: 508075 - DNA, 14 bp, Homo sapiens
atgtaataatgtga

SEQ ID NO: 508076 - DNA, 14 bp, Homo sapiens
atgtaatgacactt

SEQ ID NO: 508077 - DNA, 21 bp, Homo sapiens
atgttactgtatttttcagaa

SEQ ID NO: 508078 - DNA, 14 bp, Homo sapiens
atgtttttctgtat

SEQ ID NO: 508079 - DNA, 16 bp, Homo sapiens
attaactgtgaaatgt

SEQ ID NO: 508080 - DNA, 17 bp, Homo sapiens
attaactgtgaaatgta

SEQ ID NO: 508081 - DNA, 22 bp, Homo sapiens
attacagaagagtttcttaact

SEQ ID NO: 508082 - DNA, 15 bp, Homo sapiens
attatctttgctgtt

SEQ ID NO: 508083 - DNA, 14 bp, Homo sapiens
attcatgtaataaa

SEQ ID NO: 508084 - DNA, 15 bp, Homo sapiens
attcctccacctgcc

SEQ ID NO: 508085 - DNA, 19 bp, Homo sapiens
attcttcagtttttcactt

SEQ ID NO: 508086 - DNA, 22 bp, Homo sapiens
attgacactatatatttcttaa

SEQ ID NO: 508087 - DNA, 14 bp, Homo sapiens
atttaaaagacaga

SEQ ID NO: 508088 - DNA, 19 bp, Homo sapiens
atttacaagagaagaaagt

SEQ ID NO: 508089 - DNA, 17 bp, Homo sapiens
atttgcatatgtatgac

SEQ ID NO: 508090 - DNA, 18 bp, Homo sapiens
atttgtatgtttttctgt

SEQ ID NO: 508091 - DNA, 20 bp, Homo sapiens
atttgtatgtttttctgtat

SEQ ID NO: 508092 - DNA, 14 bp, Homo sapiens
attttaaattctca

SEQ ID NO: 508093 - DNA, 21 bp, Homo sapiens
attttaatgcacctgaatgtt

SEQ ID NO: 508094 - DNA, 15 bp, Homo sapiens
attttattacatatg

SEQ ID NO: 508095 - DNA, 20 bp, Homo sapiens
attttcacacaatacaataa

SEQ ID NO: 508096 - DNA, 13 bp, Homo sapiens
caaacacattaag

SEQ ID NO: 508097 - DNA, 15 bp, Homo sapiens
caaaggccagggtca

SEQ ID NO: 508098 - DNA, 16 bp, Homo sapiens
caaagtattgtgaaag

SEQ ID NO: 508099 - DNA, 22 bp, Homo sapiens
caaagtattgtgaaagtattct

SEQ ID NO: 508100 - DNA, 19 bp, Homo sapiens
caaatagttgtaaatatag

SEQ ID NO: 508101 - DNA, 16 bp, Homo sapiens
caaatgacagatcttt

SEQ ID NO: 508102 - DNA, 18 bp, Homo sapiens
caaatgacagatcttttt

SEQ ID NO: 508103 - DNA, 19 bp, Homo sapiens
caaccccttaagccctggc

SEQ ID NO: 508104 - DNA, 16 bp, Homo sapiens
caacctctgcttccca

SEQ ID NO: 508105 - DNA, 16 bp, Homo sapiens
caagaagtaatcagta

SEQ ID NO: 508106 - DNA, 12 bp, Homo sapiens
caagagaagaaa

SEQ ID NO: 508107 - DNA, 21 bp, Homo sapiens
caagagaagaaagtgaaagca

SEQ ID NO: 508108 - DNA, 16 bp, Homo sapiens
caagcgattctcctgc

SEQ ID NO: 508109 - DNA, 17 bp, Homo sapiens
caagcgattctcctgcc

SEQ ID NO: 508110 - DNA, 13 bp, Homo sapiens
caataaacagtca

SEQ ID NO: 508111 - DNA, 14 bp, Homo sapiens
caataaacagtcac

SEQ ID NO: 508112 - DNA, 13 bp, Homo sapiens
cacaatacaataa

SEQ ID NO: 508113 - DNA, 20 bp, Homo sapiens
cacacgtcatttcttagcta

SEQ ID NO: 508114 - DNA, 19 bp, Homo sapiens
cacagtgagggagatccca

SEQ ID NO: 508115 - DNA, 23 bp, Homo sapiens
cacattaagccttccacactcac

SEQ ID NO: 508116 - DNA, 16 bp, Homo sapiens
cacattcttcagtttt

SEQ ID NO: 508117 - DNA, 12 bp, Homo sapiens
caccccacctct

SEQ ID NO: 508118 - DNA, 22 bp, Homo sapiens
cacctgtatatttcttttaatg

SEQ ID NO: 508119 - DNA, 16 bp, Homo sapiens
cactcaataaacagtc

SEQ ID NO: 508120 - DNA, 19 bp, Homo sapiens
cactctagggcagtggagt

SEQ ID NO: 508121 - DNA, 19 bp, Homo sapiens
cactgagaaagaggcaggg

SEQ ID NO: 508122 - DNA, 20 bp, Homo sapiens
cactgagttttgtttcactt

SEQ ID NO: 508123 - DNA, 21 bp, Homo sapiens
cactgagttttgtttcacttt

SEQ ID NO: 508124 - DNA, 21 bp, Homo sapiens
cactgcccaaagtgcttccaa

SEQ ID NO: 508125 - DNA, 22 bp, Homo sapiens
cacttaacaagctcccaggccg

SEQ ID NO: 508126 - DNA, 15 bp, Homo sapiens
cagaaacagtgagtt

SEQ ID NO: 508127 - DNA, 16 bp, Homo sapiens
cagaagagtttcttaa

SEQ ID NO: 508128 - DNA, 12 bp, Homo sapiens
cagacctctgga

SEQ ID NO: 508129 - DNA, 13 bp, Homo sapiens
cagacctctggat

SEQ ID NO: 508130 - DNA, 12 bp, Homo sapiens
cagagagaccga

SEQ ID NO: 508131 - DNA, 14 bp, Homo sapiens
cagagagaccgagg

SEQ ID NO: 508132 - DNA, 14 bp, Homo sapiens
cagagcctcgctct

SEQ ID NO: 508133 - DNA, 16 bp, Homo sapiens
cagagcctcgctctgt

SEQ ID NO: 508134 - DNA, 23 bp, Homo sapiens
cagcaggccaggtccagagagac

SEQ ID NO: 508135 - DNA, 15 bp, Homo sapiens
cagcgtactcatcat

SEQ ID NO: 508136 - DNA, 20 bp, Homo sapiens
cagcttctcatcctgcaggc

SEQ ID NO: 508137 - DNA, 14 bp, Homo sapiens
caggaccctggacc

SEQ ID NO: 508138 - DNA, 15 bp, Homo sapiens
caggaccctggacct

SEQ ID NO: 508139 - DNA, 17 bp, Homo sapiens
caggaccctggacctga

SEQ ID NO: 508140 - DNA, 14 bp, Homo sapiens
caggactgtcccct

SEQ ID NO: 508141 - DNA, 23 bp, Homo sapiens
caggactgtccccttgaaggaga

SEQ ID NO: 508142 - DNA, 19 bp, Homo sapiens
caggcagctttttctctcc

SEQ ID NO: 508143 - DNA, 23 bp, Homo sapiens
caggccacatggggctgggcagc

SEQ ID NO: 508144 - DNA, 16 bp, Homo sapiens
caggccaggtccagag

SEQ ID NO: 508145 - DNA, 16 bp, Homo sapiens
caggcttgcctgcagg

SEQ ID NO: 508146 - DNA, 18 bp, Homo sapiens
cagggacctaaagggact

SEQ ID NO: 508147 - DNA, 22 bp, Homo sapiens
cagggacgaagaagagccacag

SEQ ID NO: 508148 - DNA, 18 bp, Homo sapiens
cagggagcatgagaggag

SEQ ID NO: 508149 - DNA, 20 bp, Homo sapiens
caggggccctggagcagcca

SEQ ID NO: 508150 - DNA, 13 bp, Homo sapiens
caggttctctttg

SEQ ID NO: 508151 - DNA, 15 bp, Homo sapiens
caggttctctttgag

SEQ ID NO: 508152 - DNA, 15 bp, Homo sapiens
cagtcagcagtcatg

SEQ ID NO: 508153 - DNA, 16 bp, Homo sapiens
cagtcatctagaattc

SEQ ID NO: 508154 - DNA, 19 bp, Homo sapiens
cagtgagcagcctggagcc

SEQ ID NO: 508155 - DNA, 16 bp, Homo sapiens
cagtgaggtgcccagc

SEQ ID NO: 508156 - DNA, 13 bp, Homo sapiens
cagtggaagaagc

SEQ ID NO: 508157 - DNA, 15 bp, Homo sapiens
gcctcagcctcccga

SEQ ID NO: 508158 - DNA, 21 bp, Homo sapiens
gcctggcccacagcaggtgct

SEQ ID NO: 508159 - DNA, 20 bp, Homo sapiens
gcctgtagaatagcctgtgg

SEQ ID NO: 508160 - DNA, 23 bp, Homo sapiens
gccttatgagggtcctctacttc

SEQ ID NO: 508161 - DNA, 16 bp, Homo sapiens
gcgaatctagaggagg

SEQ ID NO: 508162 - DNA, 16 bp, Homo sapiens
gcgatctcggctcagt

SEQ ID NO: 508163 - DNA, 13 bp, Homo sapiens
gcgattctcctgc

SEQ ID NO: 508164 - DNA, 22 bp, Homo sapiens
gctattgatataaataaaacat

SEQ ID NO: 508165 - DNA, 18 bp, Homo sapiens
gctcagtgcaacctctgc

SEQ ID NO: 508166 - DNA, 21 bp, Homo sapiens
gctcagtgcaacctctgcttc

SEQ ID NO: 508167 - DNA, 12 bp, Homo sapiens
gctcccaggccg

SEQ ID NO: 508168 - DNA, 22 bp, Homo sapiens
gctcccaggccgagaagccagt

SEQ ID NO: 508169 - DNA, 16 bp, Homo sapiens
gctccctcccatccct

SEQ ID NO: 508170 - DNA, 18 bp, Homo sapiens
gctcctcgagggcaggga

SEQ ID NO: 508171 - DNA, 19 bp, Homo sapiens
gctgcagagccaccctgtg

SEQ ID NO: 508172 - DNA, 17 bp, Homo sapiens
gctgcccctctctgggc

SEQ ID NO: 508173 - DNA, 12 bp, Homo sapiens
gctgggcagcta

SEQ ID NO: 508174 - DNA, 13 bp, Homo sapiens
gctgggcagctac

SEQ ID NO: 508175 - DNA, 21 bp, Homo sapiens
gcttccaaggcagaagcagca

SEQ ID NO: 508176 - DNA, 18 bp, Homo sapiens
gcttctcatcctgcaggc

SEQ ID NO: 508177 - DNA, 18 bp, Homo sapiens
ggaacactgagaaagagg

SEQ ID NO: 508178 - DNA, 20 bp, Homo sapiens
ggaagcatattgttattata

SEQ ID NO: 508179 - DNA, 17 bp, Homo sapiens
ggacagtaaacactcca

SEQ ID NO: 508180 - DNA, 19 bp, Homo sapiens
ggacgaagaagagccacag

SEQ ID NO: 508181 - DNA, 17 bp, Homo sapiens
ggagaatcatcaggacc

SEQ ID NO: 508182 - DNA, 19 bp, Homo sapiens
ggagatgaagcaaacacat

SEQ ID NO: 508183 - DNA, 22 bp, Homo sapiens
ggagctgcccctctctgggcct

SEQ ID NO: 508184 - DNA, 16 bp, Homo sapiens
ggaggcagcaggactg

SEQ ID NO: 508185 - DNA, 17 bp, Homo sapiens
ggaggccttccagggac

SEQ ID NO: 508186 - DNA, 14 bp, Homo sapiens
ggagtgcagtggtg

SEQ ID NO: 508187 - DNA, 14 bp, Homo sapiens
ggcagggacctaaa

SEQ ID NO: 508188 - DNA, 16 bp, Homo sapiens
ggcagggacctaaagg

SEQ ID NO: 508189 - DNA, 16 bp, Homo sapiens
ggccacatggggctgg

SEQ ID NO: 508190 - DNA, 17 bp, Homo sapiens
ggccacatggggctggg

SEQ ID NO: 508191 - DNA, 23 bp, Homo sapiens
ggcccacagcaggtgctgagcaa

SEQ ID NO: 508192 - DNA, 16 bp, Homo sapiens
ggccctggagcagcca

SEQ ID NO: 508193 - DNA, 13 bp, Homo sapiens
ggccggggccggg

SEQ ID NO: 508194 - DNA, 19 bp, Homo sapiens
ggcgggacccaggcacctg

SEQ ID NO: 508195 - DNA, 18 bp, Homo sapiens
ggctcagtgcaacctctg

SEQ ID NO: 508196 - DNA, 19 bp, Homo sapiens
ggctcagtgcaacctctgc

SEQ ID NO: 508197 - DNA, 20 bp, Homo sapiens
ggctctctgagtcctggccc

SEQ ID NO: 508198 - DNA, 20 bp, Homo sapiens
ggctgagctgcccacagcag

SEQ ID NO: 508199 - DNA, 17 bp, Homo sapiens
ggctgagggtcgtggga

SEQ ID NO: 508200 - DNA, 15 bp, Homo sapiens
ggctgatggagtaaa

SEQ ID NO: 508201 - DNA, 20 bp, Homo sapiens
ggctgcgaatctagaggagg

SEQ ID NO: 508202 - DNA, 13 bp, Homo sapiens
ggcttgcctgcag

SEQ ID NO: 508203 - DNA, 17 bp, Homo sapiens
gggaacactgagaaaga

SEQ ID NO: 508204 - DNA, 20 bp, Homo sapiens
gggacgaagaagagccacag

SEQ ID NO: 508205 - DNA, 18 bp, Homo sapiens
gggactacctctgtgcct

SEQ ID NO: 508206 - DNA, 15 bp, Homo sapiens
gggcacaaagggccc

SEQ ID NO: 508207 - DNA, 14 bp, Homo sapiens
gggctgggcagcta

SEQ ID NO: 508208 - DNA, 17 bp, Homo sapiens
ggggaacactgagaaag

SEQ ID NO: 508209 - DNA, 16 bp, Homo sapiens
ggggccctggagcagc

SEQ ID NO: 508210 - DNA, 19 bp, Homo sapiens
gggggctcccgtggcctgt

SEQ ID NO: 508211 - DNA, 20 bp, Homo sapiens
gggttcacctgggctgaggc

SEQ ID NO: 508212 - DNA, 16 bp, Homo sapiens
ggtaacttgcacctct

SEQ ID NO: 508213 - DNA, 20 bp, Homo sapiens
ggtcagagactgctgtgttt

SEQ ID NO: 508214 - DNA, 19 bp, Homo sapiens
ggtctattgtctgtatttg

SEQ ID NO: 508215 - DNA, 19 bp, Homo sapiens
ggtctctgttgactggctg

SEQ ID NO: 508216 - DNA, 12 bp, Homo sapiens
ggttctctttga

SEQ ID NO: 508217 - DNA, 17 bp, Homo sapiens
gtaataatgtgaatcat

SEQ ID NO: 508218 - DNA, 14 bp, Homo sapiens
gtaatgacacttct

SEQ ID NO: 508219 - DNA, 15 bp, Homo sapiens
gtacaccccacctct

SEQ ID NO: 508220 - DNA, 15 bp, Homo sapiens
gtatatttcttttaa

SEQ ID NO: 508221 - DNA, 21 bp, Homo sapiens
gtattctaagccaagttttaa

SEQ ID NO: 508222 - DNA, 21 bp, Homo sapiens
gtattttagtaagagattcct

SEQ ID NO: 508223 - DNA, 20 bp, Homo sapiens
gtctctgttgactggctgtg

SEQ ID NO: 508224 - DNA, 13 bp, Homo sapiens
gtcttcccaccca

SEQ ID NO: 508225 - DNA, 23 bp, Homo sapiens
gtgcccagctagctgcagagcca

SEQ ID NO: 508226 - DNA, 20 bp, Homo sapiens
gtgggggaacactgagaaag

SEQ ID NO: 508227 - DNA, 21 bp, Homo sapiens
gtgggggaacactgagaaaga

SEQ ID NO: 508228 - DNA, 13 bp, Homo sapiens
gtggtatatacaa

SEQ ID NO: 508229 - DNA, 17 bp, Homo sapiens
gtgttccctttttcata

SEQ ID NO: 508230 - DNA, 21 bp, Homo sapiens
gttaactattttattttctaa

SEQ ID NO: 508231 - DNA, 15 bp, Homo sapiens
gttaagatatgatgt

SEQ ID NO: 508232 - DNA, 20 bp, Homo sapiens
gttacccagggtggagtgca

SEQ ID NO: 508233 - DNA, 22 bp, Homo sapiens
gttatcttttaattacagaaga

SEQ ID NO: 508234 - DNA, 13 bp, Homo sapiens
gttgtaaatatag

SEQ ID NO: 508235 - DNA, 23 bp, Homo sapiens
gtttgagctctgcagcccaggga

SEQ ID NO: 508236 - DNA, 15 bp, Homo sapiens
gttttaaagaaattt

SEQ ID NO: 508237 - DNA, 22 bp, Homo sapiens
taaaaatttacaagagaagaaa

SEQ ID NO: 508238 - DNA, 23 bp, Homo sapiens
taaaactttttatattttataca

SEQ ID NO: 508239 - DNA, 15 bp, Homo sapiens
taaaataattctcaa

SEQ ID NO: 508240 - DNA, 15 bp, Homo sapiens
taaacttacatttaa

SEQ ID NO: 508241 - DNA, 21 bp, Homo sapiens
taaagggactacctctgtgcc

SEQ ID NO: 508242 - DNA, 18 bp, Homo sapiens
taacctttctaaccttca

SEQ ID NO: 508243 - DNA, 19 bp, Homo sapiens
taactattttattttctaa

SEQ ID NO: 508244 - DNA, 13 bp, Homo sapiens
taaggggcagctt

SEQ ID NO: 508245 - DNA, 17 bp, Homo sapiens
taagtagatgaaacatt

SEQ ID NO: 508246 - DNA, 16 bp, Homo sapiens
taagtagcattcatgt

SEQ ID NO: 508247 - DNA, 20 bp, Homo sapiens
taagtccttgcaagaatcag

SEQ ID NO: 508248 - DNA, 14 bp, Homo sapiens
taatgacacttctt

SEQ ID NO: 508249 - DNA, 17 bp, Homo sapiens
taattacatatttgcat

SEQ ID NO: 508250 - DNA, 12 bp, Homo sapiens
taattgacacta

SEQ ID NO: 508251 - DNA, 18 bp, Homo sapiens
taattgacactatatatt

SEQ ID NO: 508252 - DNA, 17 bp, Homo sapiens
taatttattttgtgaac

SEQ ID NO: 508253 - DNA, 19 bp, Homo sapiens
tacagctactataaatata

SEQ ID NO: 508254 - DNA, 12 bp, Homo sapiens
tacatataaatt

SEQ ID NO: 508255 - DNA, 21 bp, Homo sapiens
tacatatttgcatatgtatga

SEQ ID NO: 508256 - DNA, 16 bp, Homo sapiens
tacatatttgtatgtt

SEQ ID NO: 508257 - DNA, 20 bp, Homo sapiens
tacatttaaaagacagacat

SEQ ID NO: 508258 - DNA, 18 bp, Homo sapiens
taccagatgatgggggag

SEQ ID NO: 508259 - DNA, 20 bp, Homo sapiens
tacccagggtggagtgcagt

SEQ ID NO: 508260 - DNA, 21 bp, Homo sapiens
tacctacatatttgtatgttt

SEQ ID NO: 508261 - DNA, 22 bp, Homo sapiens
tacctacatatttgtatgtttt

SEQ ID NO: 508262 - DNA, 18 bp, Homo sapiens
tactgtatttttcagaaa

SEQ ID NO: 508263 - DNA, 16 bp, Homo sapiens
tagaggagggggcagg

SEQ ID NO: 508264 - DNA, 16 bp, Homo sapiens
tagatgaaacattaac

SEQ ID NO: 508265 - DNA, 14 bp, Homo sapiens
tagtaaataaacaa

SEQ ID NO: 508266 - DNA, 12 bp, Homo sapiens
tagtagatttta

SEQ ID NO: 508267 - DNA, 16 bp, Homo sapiens
tagttgcataagcatt

SEQ ID NO: 508268 - DNA, 17 bp, Homo sapiens
tataaattatagaatct

SEQ ID NO: 508269 - DNA, 14 bp, Homo sapiens
tatacaagtagatc

SEQ ID NO: 508270 - DNA, 16 bp, Homo sapiens
tatatatttcttaata

SEQ ID NO: 508271 - DNA, 20 bp, Homo sapiens
tatatcattatctttgctgt

SEQ ID NO: 508272 - DNA, 17 bp, Homo sapiens
tatcagttgatttttct

SEQ ID NO: 508273 - DNA, 16 bp, Homo sapiens
tatccggactcctgcc

SEQ ID NO: 508274 - DNA, 22 bp, Homo sapiens
tatcttttaattacagaagagt

SEQ ID NO: 508275 - DNA, 16 bp, Homo sapiens
tatgagctttatgtaa

SEQ ID NO: 508276 - DNA, 13 bp, Homo sapiens
tatgtttttctgt

SEQ ID NO: 508277 - DNA, 15 bp, Homo sapiens
tatttgcatatgtat

SEQ ID NO: 508278 - DNA, 18 bp, Homo sapiens
tatttgtatgtttttctg

SEQ ID NO: 508279 - DNA, 16 bp, Homo sapiens
tattttatacattaac

SEQ ID NO: 508280 - DNA, 18 bp, Homo sapiens
tcaaccctaaaaagcaga

SEQ ID NO: 508281 - DNA, 17 bp, Homo sapiens
tcaagaagtaatcagta

SEQ ID NO: 508282 - DNA, 17 bp, Homo sapiens
tcaagcgattctcctgc

SEQ ID NO: 508283 - DNA, 13 bp, Homo sapiens
tcaataaacagtc

SEQ ID NO: 508284 - DNA, 15 bp, Homo sapiens
tcaatagcttgtctt

SEQ ID NO: 508285 - DNA, 23 bp, Homo sapiens
tcacaccaggcttgcctgcaggc

SEQ ID NO: 508286 - DNA, 17 bp, Homo sapiens
tcacagcaccaaaataa

SEQ ID NO: 508287 - DNA, 20 bp, Homo sapiens
tcactgagttttgtttcact

SEQ ID NO: 508288 - DNA, 16 bp, Homo sapiens
tcagaaatcaaactgc

SEQ ID NO: 508289 - DNA, 15 bp, Homo sapiens
tcagagactgctgtg

SEQ ID NO: 508290 - DNA, 22 bp, Homo sapiens
tcagaggccttatgagggtcct

SEQ ID NO: 508291 - DNA, 20 bp, Homo sapiens
tcaggggccctggagcagcc

SEQ ID NO: 508292 - DNA, 21 bp, Homo sapiens
tcagtggaagaagcagatgag

SEQ ID NO: 508293 - DNA, 15 bp, Homo sapiens
tcagtttttcacttc

SEQ ID NO: 508294 - DNA, 21 bp, Homo sapiens
tcatctttattaagtagatga

SEQ ID NO: 508295 - DNA, 23 bp, Homo sapiens
tccaaggcagaagcagcagggga

SEQ ID NO: 508296 - DNA, 14 bp, Homo sapiens
tccagagagaccga

SEQ ID NO: 508297 - DNA, 21 bp, Homo sapiens
tcccaaccccttaagccctgg

SEQ ID NO: 508298 - DNA, 23 bp, Homo sapiens
tcccacaatcttaaggggcagct

SEQ ID NO: 508299 - DNA, 20 bp, Homo sapiens
tccccttgtctgaactggag

SEQ ID NO: 508300 - DNA, 15 bp, Homo sapiens
tcccgagtagctggg

SEQ ID NO: 508301 - DNA, 20 bp, Homo sapiens
tcctccacctgccgtggact

SEQ ID NO: 508302 - DNA, 16 bp, Homo sapiens
tccttcctcacaccag

SEQ ID NO: 508303 - DNA, 21 bp, Homo sapiens
tccttcctcacaccaggcttg

SEQ ID NO: 508304 - DNA, 17 bp, Homo sapiens
tctacatgtaatgacac

SEQ ID NO: 508305 - DNA, 18 bp, Homo sapiens
tctacatgtaatgacact

SEQ ID NO: 508306 - DNA, 23 bp, Homo sapiens
tctcaaaccttgatgtgcctgtg

SEQ ID NO: 508307 - DNA, 15 bp, Homo sapiens
tctcatcctgcaggc

SEQ ID NO: 508308 - DNA, 21 bp, Homo sapiens
tctctgacctactcgagggac

SEQ ID NO: 508309 - DNA, 18 bp, Homo sapiens
tctctgttgactggctgt

SEQ ID NO: 508310 - DNA, 16 bp, Homo sapiens
tctctttgagtcaata

SEQ ID NO: 508311 - DNA, 20 bp, Homo sapiens
tctgagattattttaatcta

SEQ ID NO: 508312 - DNA, 16 bp, Homo sapiens
tctgagtcctggccca

SEQ ID NO: 508313 - DNA, 13 bp, Homo sapiens
tctgcagcccagg

SEQ ID NO: 508314 - DNA, 17 bp, Homo sapiens
tctggattaggtctctg

SEQ ID NO: 508315 - DNA, 20 bp, Homo sapiens
tctggttctaactgctgtta

SEQ ID NO: 508316 - DNA, 16 bp, Homo sapiens
tcttaaggggcagctt

SEQ ID NO: 508317 - DNA, 23 bp, Homo sapiens
tcttatttacagataacttcttt

SEQ ID NO: 508318 - DNA, 15 bp, Homo sapiens
tcttcagtttttcac

SEQ ID NO: 508319 - DNA, 15 bp, Homo sapiens
tcttttaattacaga

SEQ ID NO: 508320 - DNA, 15 bp, Homo sapiens
tcttttttttttccc

SEQ ID NO: 508321 - DNA, 14 bp, Homo sapiens
tgaaaaaggaaaaa

SEQ ID NO: 508322 - DNA, 15 bp, Homo sapiens
tgaaatatacacaca

SEQ ID NO: 508323 - DNA, 22 bp, Homo sapiens
tgaaatgtacgtcatttgtgca

SEQ ID NO: 508324 - DNA, 16 bp, Homo sapiens
tgaagcaatttgaaat

SEQ ID NO: 508325 - DNA, 17 bp, Homo sapiens
tgaagcaatttgaaata

SEQ ID NO: 508326 - DNA, 20 bp, Homo sapiens
tgacaaagaagaccacaaat

SEQ ID NO: 508327 - DNA, 19 bp, Homo sapiens
tgacactcaataaacagtc

SEQ ID NO: 508328 - DNA, 20 bp, Homo sapiens
tgacccagcactgcccaaag

SEQ ID NO: 508329 - DNA, 16 bp, Homo sapiens
tgacctatcacttcca

SEQ ID NO: 508330 - DNA, 18 bp, Homo sapiens
tgagctctgcagcccagg

SEQ ID NO: 508331 - DNA, 14 bp, Homo sapiens
tgagggtcgtggga

SEQ ID NO: 508332 - DNA, 16 bp, Homo sapiens
tgagggtcgtgggaaa

SEQ ID NO: 508333 - DNA, 14 bp, Homo sapiens
tgagtcctggccca

SEQ ID NO: 508334 - DNA, 14 bp, Homo sapiens
tgataacatggaaa

SEQ ID NO: 508335 - DNA, 14 bp, Homo sapiens
tgatataaataaaa

SEQ ID NO: 508336 - DNA, 16 bp, Homo sapiens
tgatgtccctatggaa

SEQ ID NO: 508337 - DNA, 12 bp, Homo sapiens
tgcaaagatttg

SEQ ID NO: 508338 - DNA, 12 bp, Homo sapiens
tgcaacctctgc

SEQ ID NO: 508339 - DNA, 19 bp, Homo sapiens
tgcaacctctgcttcccag

SEQ ID NO: 508340 - DNA, 23 bp, Homo sapiens
tgcacttaacaagctcccaggcc

SEQ ID NO: 508341 - DNA, 21 bp, Homo sapiens
tgcagccccgcctccaggcca

SEQ ID NO: 508342 - DNA, 23 bp, Homo sapiens
tgcagccccgcctccaggccaca

SEQ ID NO: 508343 - DNA, 15 bp, Homo sapiens
tgcaggggaagtact

SEQ ID NO: 508344 - DNA, 12 bp, Homo sapiens
tgcatatgtatg

SEQ ID NO: 508345 - DNA, 15 bp, Homo sapiens
tgccacattaaattg

SEQ ID NO: 508346 - DNA, 21 bp, Homo sapiens
tgcccagctagctgcagagcc

SEQ ID NO: 508347 - DNA, 19 bp, Homo sapiens
tgcgaatctagaggagggg

SEQ ID NO: 508348 - DNA, 21 bp, Homo sapiens
tgctgtgtttgagctctgcag

SEQ ID NO: 508349 - DNA, 20 bp, Homo sapiens
tggagaccccaccagcctca

SEQ ID NO: 508350 - DNA, 16 bp, Homo sapiens
tggagcagccacccca

SEQ ID NO: 508351 - DNA, 14 bp, Homo sapiens
tggagtcggaaggg

SEQ ID NO: 508352 - DNA, 20 bp, Homo sapiens
tggccaggctgatctcgaac

SEQ ID NO: 508353 - DNA, 19 bp, Homo sapiens
tggcctgtagaatagcctg

SEQ ID NO: 508354 - DNA, 23 bp, Homo sapiens
tggcctgtagaatagcctgtggc

SEQ ID NO: 508355 - DNA, 22 bp, Homo sapiens
tggcttcatggcagtaattctc

SEQ ID NO: 508356 - DNA, 19 bp, Homo sapiens
tgggcacaaagggcccaga

SEQ ID NO: 508357 - DNA, 23 bp, Homo sapiens
tggggttcaagaagtaatcagta

SEQ ID NO: 508358 - DNA, 14 bp, Homo sapiens
tgtaaaaactgtgg

SEQ ID NO: 508359 - DNA, 17 bp, Homo sapiens
tgtaagtttataatgca

SEQ ID NO: 508360 - DNA, 22 bp, Homo sapiens
tgtaattgacactatatatttc

SEQ ID NO: 508361 - DNA, 18 bp, Homo sapiens
tgtagaatagcctgtggc

SEQ ID NO: 508362 - DNA, 22 bp, Homo sapiens
tgtataatcacagttgtgttcc

SEQ ID NO: 508363 - DNA, 17 bp, Homo sapiens
tgtatgcaacaggcact

SEQ ID NO: 508364 - DNA, 15 bp, Homo sapiens
tgtcagtggaagaag

SEQ ID NO: 508365 - DNA, 20 bp, Homo sapiens
tgtcagtggggctctctgag

SEQ ID NO: 508366 - DNA, 15 bp, Homo sapiens
tgtcatctcagtgct

SEQ ID NO: 508367 - DNA, 14 bp, Homo sapiens
tgtgacaaagaaga

SEQ ID NO: 508368 - DNA, 19 bp, Homo sapiens
tgtgcaccaccacacccgg

SEQ ID NO: 508369 - DNA, 21 bp, Homo sapiens
tgtgcaccaccacacccggct

SEQ ID NO: 508370 - DNA, 22 bp, Homo sapiens
tgtgcagccccgcctccaggcc

SEQ ID NO: 508371 - DNA, 23 bp, Homo sapiens
tgtgcagccccgcctccaggcca

SEQ ID NO: 508372 - DNA, 17 bp, Homo sapiens
tgttccctttttcataa

SEQ ID NO: 508373 - DNA, 19 bp, Homo sapiens
ttaacaagctcccaggccg

SEQ ID NO: 508374 - DNA, 12 bp, Homo sapiens
ttaactctaact

SEQ ID NO: 508375 - DNA, 16 bp, Homo sapiens
ttaataaaataattct

SEQ ID NO: 508376 - DNA, 21 bp, Homo sapiens
ttaatttattttgtgaacact

SEQ ID NO: 508377 - DNA, 22 bp, Homo sapiens
ttacatatttgcatatgtatga

SEQ ID NO: 508378 - DNA, 20 bp, Homo sapiens
ttacccagggtggagtgcag

SEQ ID NO: 508379 - DNA, 12 bp, Homo sapiens
ttactgtatttt

SEQ ID NO: 508380 - DNA, 21 bp, Homo sapiens
ttaggggaagtaaaacagtca

SEQ ID NO: 508381 - DNA, 22 bp, Homo sapiens
ttagtagttactaaaattatgt

SEQ ID NO: 508382 - DNA, 21 bp, Homo sapiens
ttatgaaaagtactaatagaa

SEQ ID NO: 508383 - DNA, 19 bp, Homo sapiens
ttatgagggtcctctactt

SEQ ID NO: 508384 - DNA, 21 bp, Homo sapiens
ttatgtaataatgtgaatcat

SEQ ID NO: 508385 - DNA, 20 bp, Homo sapiens
aaaactttttatattttata

SEQ ID NO: 508386 - DNA, 15 bp, Homo sapiens
aaaagacagacattc

SEQ ID NO: 508387 - DNA, 15 bp, Homo sapiens
aaaataattctcaaa

SEQ ID NO: 508388 - DNA, 19 bp, Homo sapiens
aaaattatgttactgtatt

SEQ ID NO: 508389 - DNA, 13 bp, Homo sapiens
aaacattttcaca

SEQ ID NO: 508390 - DNA, 16 bp, Homo sapiens
aaacattttcacacaa

SEQ ID NO: 508391 - DNA, 16 bp, Homo sapiens
aaactaaaaatttaca

SEQ ID NO: 508392 - DNA, 22 bp, Homo sapiens
aaactgcatcccacgttctgtt

SEQ ID NO: 508393 - DNA, 23 bp, Homo sapiens
aaactgcatcccacgttctgtta

SEQ ID NO: 508394 - DNA, 20 bp, Homo sapiens
aaagctcctcgagggcaggg

SEQ ID NO: 508395 - DNA, 21 bp, Homo sapiens
aaatgagttacctacatttta

SEQ ID NO: 508396 - DNA, 22 bp, Homo sapiens
aaatgtacatgttcctttgtaa

SEQ ID NO: 508397 - DNA, 22 bp, Homo sapiens
aaattatgttactgtatttttc

SEQ ID NO: 508398 - DNA, 18 bp, Homo sapiens
aaattttcacataaaata

SEQ ID NO: 508399 - DNA, 23 bp, Homo sapiens
aacaggtttttagtttgttcttc

SEQ ID NO: 508400 - DNA, 13 bp, Homo sapiens
aacattttcacac

SEQ ID NO: 508401 - DNA, 14 bp, Homo sapiens
aacccatattttaa

SEQ ID NO: 508402 - DNA, 20 bp, Homo sapiens
aaccccttaagccctggccc

SEQ ID NO: 508403 - DNA, 22 bp, Homo sapiens
aactgcatcccacgttctgtta

SEQ ID NO: 508404 - DNA, 13 bp, Homo sapiens
aacttacttttgt

SEQ ID NO: 508405 - DNA, 16 bp, Homo sapiens
aagaagcaaggaacca

SEQ ID NO: 508406 - DNA, 15 bp, Homo sapiens
aagagattcctgagc

SEQ ID NO: 508407 - DNA, 15 bp, Homo sapiens
aagaggcagggacct

SEQ ID NO: 508408 - DNA, 17 bp, Homo sapiens
aagagtggtatatacaa

SEQ ID NO: 508409 - DNA, 13 bp, Homo sapiens
aagcaaacacatt

SEQ ID NO: 508410 - DNA, 14 bp, Homo sapiens
aagcaatcttttat

SEQ ID NO: 508411 - DNA, 17 bp, Homo sapiens
aagcaatttgaaataat

SEQ ID NO: 508412 - DNA, 17 bp, Homo sapiens
aagcatattgttattat

SEQ ID NO: 508413 - DNA, 20 bp, Homo sapiens
aagcgattctcctgcctcag

SEQ ID NO: 508414 - DNA, 14 bp, Homo sapiens
aagctcccaggccg

SEQ ID NO: 508415 - DNA, 16 bp, Homo sapiens
aagcttccataacatt

SEQ ID NO: 508416 - DNA, 17 bp, Homo sapiens
aaggagaatcatcagga

SEQ ID NO: 508417 - DNA, 19 bp, Homo sapiens
aaggagaatcatcaggacc

SEQ ID NO: 508418 - DNA, 19 bp, Homo sapiens
aagggactacctctgtgcc

SEQ ID NO: 508419 - DNA, 15 bp, Homo sapiens
aagtaaaacagtcat

SEQ ID NO: 508420 - DNA, 16 bp, Homo sapiens
aagtacctttgttaca

SEQ ID NO: 508421 - DNA, 16 bp, Homo sapiens
aagtagatgaaacatt

SEQ ID NO: 508422 - DNA, 14 bp, Homo sapiens
aagtattgtgaaag

SEQ ID NO: 508423 - DNA, 18 bp, Homo sapiens
aagtattgtgaaagtatt

SEQ ID NO: 508424 - DNA, 13 bp, Homo sapiens
aataaacagtcac

SEQ ID NO: 508425 - DNA, 17 bp, Homo sapiens
aataattgaagtgttcc

SEQ ID NO: 508426 - DNA, 21 bp, Homo sapiens
aataattgaagtgttcccttt

SEQ ID NO: 508427 - DNA, 14 bp, Homo sapiens
aatagcactttttg

SEQ ID NO: 508428 - DNA, 14 bp, Homo sapiens
aatagcctgtggcc

SEQ ID NO: 508429 - DNA, 17 bp, Homo sapiens
aatctactttaatttat

SEQ ID NO: 508430 - DNA, 17 bp, Homo sapiens
aatgtgcctagttcttt

SEQ ID NO: 508431 - DNA, 16 bp, Homo sapiens
aattgtattttagtaa

SEQ ID NO: 508432 - DNA, 18 bp, Homo sapiens
aatttagtaaataaacaa

SEQ ID NO: 508433 - DNA, 15 bp, Homo sapiens
aatttattttgtgaa

SEQ ID NO: 508434 - DNA, 23 bp, Homo sapiens
aatttattttgtgaacacttttg

SEQ ID NO: 508435 - DNA, 18 bp, Homo sapiens
aattttagtagttactaa

SEQ ID NO: 508436 - DNA, 17 bp, Homo sapiens
acaaatagttatctttt

SEQ ID NO: 508437 - DNA, 12 bp, Homo sapiens
acacaatacaat

SEQ ID NO: 508438 - DNA, 14 bp, Homo sapiens
acacaatacaataa

SEQ ID NO: 508439 - DNA, 12 bp, Homo sapiens
acacctcgcccc

SEQ ID NO: 508440 - DNA, 18 bp, Homo sapiens
acactcaataaacagtca

SEQ ID NO: 508441 - DNA, 19 bp, Homo sapiens
acactcacctctaaaacag

SEQ ID NO: 508442 - DNA, 16 bp, Homo sapiens
acactccacattcttc

SEQ ID NO: 508443 - DNA, 17 bp, Homo sapiens
acactgaaatatacaca

SEQ ID NO: 508444 - DNA, 22 bp, Homo sapiens
acactgaaatatacacacagca

SEQ ID NO: 508445 - DNA, 15 bp, Homo sapiens
acacttttgaaaatg

SEQ ID NO: 508446 - DNA, 19 bp, Homo sapiens
acagaagagtttcttaact

SEQ ID NO: 508447 - DNA, 23 bp, Homo sapiens
acagacaagagtggtatatacaa

SEQ ID NO: 508448 - DNA, 17 bp, Homo sapiens
acagagcctcgctctgt

SEQ ID NO: 508449 - DNA, 22 bp, Homo sapiens
acagcaggccaggtccagagag

SEQ ID NO: 508450 - DNA, 18 bp, Homo sapiens
acagctgagcacattctg

SEQ ID NO: 508451 - DNA, 13 bp, Homo sapiens
acaggtgtgcacc

SEQ ID NO: 508452 - DNA, 19 bp, Homo sapiens
acatatttgtatgtttttc

SEQ ID NO: 508453 - DNA, 21 bp, Homo sapiens
acatatttgtatgtttttctg

SEQ ID NO: 508454 - DNA, 21 bp, Homo sapiens
acattaaattgataacatgga

SEQ ID NO: 508455 - DNA, 15 bp, Homo sapiens
acattaactctaact

SEQ ID NO: 508456 - DNA, 21 bp, Homo sapiens
acattcttcagtttttcactt

SEQ ID NO: 508457 - DNA, 23 bp, Homo sapiens
acatttaaaagacagacattcct

SEQ ID NO: 508458 - DNA, 13 bp, Homo sapiens
accaaaggccagg

SEQ ID NO: 508459 - DNA, 18 bp, Homo sapiens
accagatgatgggggagg

SEQ ID NO: 508460 - DNA, 19 bp, Homo sapiens
acccagggtggagtgcagt

SEQ ID NO: 508461 - DNA, 17 bp, Homo sapiens
accccatctgcattccc

SEQ ID NO: 508462 - DNA, 18 bp, Homo sapiens
accccttaagccctggcc

SEQ ID NO: 508463 - DNA, 20 bp, Homo sapiens
accccttaagccctggcccc

SEQ ID NO: 508464 - DNA, 22 bp, Homo sapiens
accctaaggtcattaccacagg

SEQ ID NO: 508465 - DNA, 20 bp, Homo sapiens
acttcccactctagggcagt

SEQ ID NO: 508466 - DNA, 18 bp, Homo sapiens
acttgttaacctttctaa

SEQ ID NO: 508467 - DNA, 20 bp, Homo sapiens
acttgttaacctttctaacc

SEQ ID NO: 508468 - DNA, 17 bp, Homo sapiens
actttaatttattttgt

SEQ ID NO: 508469 - DNA, 12 bp, Homo sapiens
agaaacagtgag

SEQ ID NO: 508470 - DNA, 14 bp, Homo sapiens
agaagaaagtgaaa

SEQ ID NO: 508471 - DNA, 13 bp, Homo sapiens
agaagcagatgag

SEQ ID NO: 508472 - DNA, 13 bp, Homo sapiens
agaatcatcagga

SEQ ID NO: 508473 - DNA, 20 bp, Homo sapiens
agacactgaaatatacacac

SEQ ID NO: 508474 - DNA, 15 bp, Homo sapiens
agacagacattcacc

SEQ ID NO: 508475 - DNA, 20 bp, Homo sapiens
agacattccttctacatgta

SEQ ID NO: 508476 - DNA, 11 bp, Homo sapiens
agacctctgga

SEQ ID NO: 508477 - DNA, 21 bp, Homo sapiens
agactcgcggcaggttctctt

SEQ ID NO: 508478 - DNA, 19 bp, Homo sapiens
agactctcgcatcttccca

SEQ ID NO: 508479 - DNA, 16 bp, Homo sapiens
agaggaggcagcagga

SEQ ID NO: 508480 - DNA, 16 bp, Homo sapiens
agaggagggggcaggc

SEQ ID NO: 508481 - DNA, 23 bp, Homo sapiens
agaggagggggcaggctgagggt

SEQ ID NO: 508482 - DNA, 19 bp, Homo sapiens
agagtttcttaacttactt

SEQ ID NO: 508483 - DNA, 16 bp, Homo sapiens
agcacctaaacttaca

SEQ ID NO: 508484 - DNA, 16 bp, Homo sapiens
agcactgttccagcct

SEQ ID NO: 508485 - DNA, 20 bp, Homo sapiens
agcactgttccagcctgccc

SEQ ID NO: 508486 - DNA, 20 bp, Homo sapiens
agcagccaccccatgctggc

SEQ ID NO: 508487 - DNA, 20 bp, Homo sapiens
agccaagttttaaatattat

SEQ ID NO: 508488 - DNA, 20 bp, Homo sapiens
agccacagtgagggagatcc

SEQ ID NO: 508489 - DNA, 22 bp, Homo sapiens
agccacagtgagggagatccca

SEQ ID NO: 508490 - DNA, 19 bp, Homo sapiens
agccaccccatgctggcct

SEQ ID NO: 508491 - DNA, 16 bp, Homo sapiens
agccccgcctccaggc

SEQ ID NO: 508492 - DNA, 15 bp, Homo sapiens
agccctggccccctg

SEQ ID NO: 508493 - DNA, 18 bp, Homo sapiens
agcctccctgtcggcctg

SEQ ID NO: 508494 - DNA, 16 bp, Homo sapiens
agccttccacactcac

SEQ ID NO: 508495 - DNA, 17 bp, Homo sapiens
agctactataaatatac

SEQ ID NO: 508496 - DNA, 17 bp, Homo sapiens
agctagctgcagagcca

SEQ ID NO: 508497 - DNA, 17 bp, Homo sapiens
agctattgatataaata

SEQ ID NO: 508498 - DNA, 23 bp, Homo sapiens
agctattgatataaataaaacat

SEQ ID NO: 508499 - DNA, 14 bp, Homo sapiens
agctctaccctgca

SEQ ID NO: 508500 - DNA, 16 bp, Homo sapiens
agctctgcagcccagg

SEQ ID NO: 508501 - DNA, 13 bp, Homo sapiens
agctgcagagcca

SEQ ID NO: 508502 - DNA, 17 bp, Homo sapiens
agctgcccacagcaggc

SEQ ID NO: 508503 - DNA, 15 bp, Homo sapiens
agctgcccctctctg

SEQ ID NO: 508504 - DNA, 14 bp, Homo sapiens
agctttatgtaata

SEQ ID NO: 508505 - DNA, 16 bp, Homo sapiens
agctttatgtaataat

SEQ ID NO: 508506 - DNA, 13 bp, Homo sapiens
aggaccctggacc

SEQ ID NO: 508507 - DNA, 15 bp, Homo sapiens
aggaggcagcaggac

SEQ ID NO: 508508 - DNA, 16 bp, Homo sapiens
aggaggccggggccgg

SEQ ID NO: 508509 - DNA, 23 bp, Homo sapiens
aggaggctatgctcaggggccct

SEQ ID NO: 508510 - DNA, 18 bp, Homo sapiens
aggagggggcaggctgag

SEQ ID NO: 508511 - DNA, 22 bp, Homo sapiens
aggccacatggggctgggcagc

SEQ ID NO: 508512 - DNA, 17 bp, Homo sapiens
aggccgagaagccagtg

SEQ ID NO: 508513 - DNA, 19 bp, Homo sapiens
aggccggggccgggtactg

SEQ ID NO: 508514 - DNA, 17 bp, Homo sapiens
aggcttgcctgcaggca

SEQ ID NO: 508515 - DNA, 14 bp, Homo sapiens
agggaacagtgagg

SEQ ID NO: 508516 - DNA, 19 bp, Homo sapiens
agggagagtctcccaggga

SEQ ID NO: 508517 - DNA, 13 bp, Homo sapiens
agggcggcactca

SEQ ID NO: 508518 - DNA, 17 bp, Homo sapiens
aggggccctggagcagc

SEQ ID NO: 508519 - DNA, 15 bp, Homo sapiens
agggggcaggctgag

SEQ ID NO: 508520 - DNA, 20 bp, Homo sapiens
agggtcgtgggaaaggggag

SEQ ID NO: 508521 - DNA, 21 bp, Homo sapiens
agggtcgtgggaaaggggagt

SEQ ID NO: 508522 - DNA, 16 bp, Homo sapiens
agtacaccccacctct

SEQ ID NO: 508523 - DNA, 16 bp, Homo sapiens
agtactaatagaactt

SEQ ID NO: 508524 - DNA, 20 bp, Homo sapiens
agtagcagtagatgcatgta

SEQ ID NO: 508525 - DNA, 14 bp, Homo sapiens
agtattgtgaaagt

SEQ ID NO: 508526 - DNA, 15 bp, Homo sapiens
agtattgtgaaagta

SEQ ID NO: 508527 - DNA, 13 bp, Homo sapiens
agtcctggcccaa

SEQ ID NO: 508528 - DNA, 15 bp, Homo sapiens
agtgacttgcccagt

SEQ ID NO: 508529 - DNA, 21 bp, Homo sapiens
agtgcaaagatttgctttaat

SEQ ID NO: 508530 - DNA, 17 bp, Homo sapiens
agtgcaacactgaagct

SEQ ID NO: 508531 - DNA, 14 bp, Homo sapiens
agtgcaacctctgc

SEQ ID NO: 508532 - DNA, 16 bp, Homo sapiens
agtgcaacctctgctt

SEQ ID NO: 508533 - DNA, 16 bp, Homo sapiens
agtgcttccaaggcag

SEQ ID NO: 508534 - DNA, 17 bp, Homo sapiens
agtggaagaagcagatg

SEQ ID NO: 508535 - DNA, 13 bp, Homo sapiens
agtggggctctct

SEQ ID NO: 508536 - DNA, 14 bp, Homo sapiens
agttatcttttaat

SEQ ID NO: 508537 - DNA, 19 bp, Homo sapiens
agttcagttttaccagatg

SEQ ID NO: 508538 - DNA, 23 bp, Homo sapiens
agtttccttttctgtctctctct

SEQ ID NO: 508539 - DNA, 16 bp, Homo sapiens
agttttaccagatgat

SEQ ID NO: 508540 - DNA, 14 bp, Homo sapiens
agtttttcacttct

SEQ ID NO: 508541 - DNA, 19 bp, Homo sapiens
ataagtagcattcatgtaa

SEQ ID NO: 508542 - DNA, 15 bp, Homo sapiens
atacggctccccagt

SEQ ID NO: 508543 - DNA, 17 bp, Homo sapiens
atagaatctactttaat

SEQ ID NO: 508544 - DNA, 15 bp, Homo sapiens
atagttgtaaatata

SEQ ID NO: 508545 - DNA, 18 bp, Homo sapiens
atataaataaaacatttt

SEQ ID NO: 508546 - DNA, 14 bp, Homo sapiens
atatacaagtagat

SEQ ID NO: 508547 - DNA, 14 bp, Homo sapiens
atatatttcttaat

SEQ ID NO: 508548 - DNA, 19 bp, Homo sapiens
atattgaactcaatgatag

SEQ ID NO: 508549 - DNA, 20 bp, Homo sapiens
atattgttattatataatta

SEQ ID NO: 508550 - DNA, 22 bp, Homo sapiens
atatttcacagcaccaaaataa

SEQ ID NO: 508551 - DNA, 22 bp, Homo sapiens
atatttgtatgtttttctgtat

SEQ ID NO: 508552 - DNA, 11 bp, Homo sapiens
atcaaactgct

SEQ ID NO: 508553 - DNA, 18 bp, Homo sapiens
atcacagttgtgttcctg

SEQ ID NO: 508554 - DNA, 14 bp, Homo sapiens
atcaggaccctgga

SEQ ID NO: 508555 - DNA, 19 bp, Homo sapiens
atcccaagatctgtgcagc

SEQ ID NO: 508556 - DNA, 21 bp, Homo sapiens
atcccaagatctgtgcagccc

SEQ ID NO: 508557 - DNA, 17 bp, Homo sapiens
atccttcctcacaccag

SEQ ID NO: 508558 - DNA, 14 bp, Homo sapiens
atctaacagacaag

SEQ ID NO: 508559 - DNA, 18 bp, Homo sapiens
atctagaattcactgagt

SEQ ID NO: 508560 - DNA, 20 bp, Homo sapiens
atctagaggagggggcaggc

SEQ ID NO: 508561 - DNA, 15 bp, Homo sapiens
atctcggctcagtgc

SEQ ID NO: 508562 - DNA, 14 bp, Homo sapiens
atctgcattcccag

SEQ ID NO: 508563 - DNA, 16 bp, Homo sapiens
atcttaaggggcagct

SEQ ID NO: 508564 - DNA, 16 bp, Homo sapiens
atcttttttttttccc

SEQ ID NO: 508565 - DNA, 22 bp, Homo sapiens
atgagctttatgtaataatgtg

SEQ ID NO: 508566 - DNA, 13 bp, Homo sapiens
atgcaagaaggag

SEQ ID NO: 508567 - DNA, 12 bp, Homo sapiens
atgctcaggggc

SEQ ID NO: 508568 - DNA, 20 bp, Homo sapiens
atgggcacaaagggcccaga

SEQ ID NO: 508569 - DNA, 14 bp, Homo sapiens
atgtaataaacagg

SEQ ID NO: 508570 - DNA, 13 bp, Homo sapiens
atgtaatgacact

SEQ ID NO: 508571 - DNA, 21 bp, Homo sapiens
atgtacatgttcctttgtaat

SEQ ID NO: 508572 - DNA, 18 bp, Homo sapiens
atgtttttctgtataaca

SEQ ID NO: 508573 - DNA, 21 bp, Homo sapiens
attacatatttgcatatgtat

SEQ ID NO: 508574 - DNA, 19 bp, Homo sapiens
attagagggatgagacaga

SEQ ID NO: 508575 - DNA, 14 bp, Homo sapiens
attatagaatctac

SEQ ID NO: 508576 - DNA, 18 bp, Homo sapiens
attatagaatctacttta

SEQ ID NO: 508577 - DNA, 14 bp, Homo sapiens
attatgttactgta

SEQ ID NO: 508578 - DNA, 15 bp, Homo sapiens
attccttctacatgt

SEQ ID NO: 508579 - DNA, 20 bp, Homo sapiens
attctcataagtagcattca

SEQ ID NO: 508580 - DNA, 17 bp, Homo sapiens
attgataacatggaaat

SEQ ID NO: 508581 - DNA, 22 bp, Homo sapiens
attgatagggagttttaaagaa

SEQ ID NO: 508582 - DNA, 19 bp, Homo sapiens
ccaaccccttaagccctgg

SEQ ID NO: 508583 - DNA, 21 bp, Homo sapiens
ccaaggcagaagcagcagggg

SEQ ID NO: 508584 - DNA, 16 bp, Homo sapiens
ccacactctttctcct

SEQ ID NO: 508585 - DNA, 14 bp, Homo sapiens
ccacattcttcagt

SEQ ID NO: 508586 - DNA, 16 bp, Homo sapiens
ccacattcttcagttt

SEQ ID NO: 508587 - DNA, 17 bp, Homo sapiens
ccacattcttcagtttt

SEQ ID NO: 508588 - DNA, 12 bp, Homo sapiens
ccaccccatgct

SEQ ID NO: 508589 - DNA, 12 bp, Homo sapiens
ccaccctgtgtt

SEQ ID NO: 508590 - DNA, 19 bp, Homo sapiens
ccagatgatgggggagggg

SEQ ID NO: 508591 - DNA, 13 bp, Homo sapiens
ccagcactgccca

SEQ ID NO: 508592 - DNA, 21 bp, Homo sapiens
ccagcgcttgaagcctgaacc

SEQ ID NO: 508593 - DNA, 17 bp, Homo sapiens
ccagggtcactgaaggc

SEQ ID NO: 508594 - DNA, 20 bp, Homo sapiens
ccaggttcaagcgattctcc

SEQ ID NO: 508595 - DNA, 22 bp, Homo sapiens
ccaggttcaagcgattctcctg

SEQ ID NO: 508596 - DNA, 18 bp, Homo sapiens
ccagtacaccccacctct

SEQ ID NO: 508597 - DNA, 19 bp, Homo sapiens
ccagtgagcagcctggagc

SEQ ID NO: 508598 - DNA, 17 bp, Homo sapiens
ccatctgcattcccagc

SEQ ID NO: 508599 - DNA, 18 bp, Homo sapiens
ccatgacttgagaaacaa

SEQ ID NO: 508600 - DNA, 22 bp, Homo sapiens
cccacaatcttaaggggcagct

SEQ ID NO: 508601 - DNA, 18 bp, Homo sapiens
cccacgttctgttaattt

SEQ ID NO: 508602 - DNA, 18 bp, Homo sapiens
cccaggccgagaagccag

SEQ ID NO: 508603 - DNA, 18 bp, Homo sapiens
cccagggtggagtgcagt

SEQ ID NO: 508604 - DNA, 18 bp, Homo sapiens
cccagtacaccccacctc

SEQ ID NO: 508605 - DNA, 21 bp, Homo sapiens
cccagtgagcagcctggagcc

SEQ ID NO: 508606 - DNA, 18 bp, Homo sapiens
ccccaccagcctcaccag

SEQ ID NO: 508607 - DNA, 14 bp, Homo sapiens
ccccatgctggcct

SEQ ID NO: 508608 - DNA, 18 bp, Homo sapiens
ccccatgctggccttgcc

SEQ ID NO: 508609 - DNA, 22 bp, Homo sapiens
ccccttgaaggagaatcatcag

SEQ ID NO: 508610 - DNA, 14 bp, Homo sapiens
cccgcagacctctg

SEQ ID NO: 508611 - DNA, 18 bp, Homo sapiens
ttaactgtgaaatgtacg

SEQ ID NO: 508612 - DNA, 13 bp, Homo sapiens
ttaagtagatgaa

SEQ ID NO: 508613 - DNA, 19 bp, Homo sapiens
ttaatttagtaaataaaca

SEQ ID NO: 508614 - DNA, 19 bp, Homo sapiens
ttacagaagagtttcttaa

SEQ ID NO: 508615 - DNA, 19 bp, Homo sapiens
ttacaggtgtgcaccacca

SEQ ID NO: 508616 - DNA, 16 bp, Homo sapiens
ttacatttaaaagaca

SEQ ID NO: 508617 - DNA, 18 bp, Homo sapiens
ttactcatagcacttccc

SEQ ID NO: 508618 - DNA, 20 bp, Homo sapiens
ttaggggaagtaaaacagtc

SEQ ID NO: 508619 - DNA, 14 bp, Homo sapiens
ttagtttgttcttc

SEQ ID NO: 508620 - DNA, 16 bp, Homo sapiens
ttatcttttaattaca

SEQ ID NO: 508621 - DNA, 14 bp, Homo sapiens
ttatgaaaagtact

SEQ ID NO: 508622 - DNA, 16 bp, Homo sapiens
ttatgtaataatgtga

SEQ ID NO: 508623 - DNA, 22 bp, Homo sapiens
ttcaagaagtaatcagtatgca

SEQ ID NO: 508624 - DNA, 10 bp, Homo sapiens
ttcacaggcg

SEQ ID NO: 508625 - DNA, 19 bp, Homo sapiens
ttcacaggcgaggcctgga

SEQ ID NO: 508626 - DNA, 19 bp, Homo sapiens
ttcacataaaatagatttt

SEQ ID NO: 508627 - DNA, 16 bp, Homo sapiens
ttcacctgtatatttc

SEQ ID NO: 508628 - DNA, 19 bp, Homo sapiens
ttcacctgtatatttcttt

SEQ ID NO: 508629 - DNA, 16 bp, Homo sapiens
ttcaggaacaccccca

SEQ ID NO: 508630 - DNA, 18 bp, Homo sapiens
ttcagtttttcacttcta

SEQ ID NO: 508631 - DNA, 14 bp, Homo sapiens
ttcattttgtataa

SEQ ID NO: 508632 - DNA, 21 bp, Homo sapiens
ttccagtgcaacactgaagct

SEQ ID NO: 508633 - DNA, 18 bp, Homo sapiens
ttcccactctagggcagt

SEQ ID NO: 508634 - DNA, 19 bp, Homo sapiens
ttcctttgtaattgacact

SEQ ID NO: 508635 - DNA, 18 bp, Homo sapiens
ttctaaggaatatgagct

SEQ ID NO: 508636 - DNA, 19 bp, Homo sapiens
ttctacatgtaatgacact

SEQ ID NO: 508637 - DNA, 16 bp, Homo sapiens
ttctacctacatattt

SEQ ID NO: 508638 - DNA, 22 bp, Homo sapiens
ttctacctacatatttgtatgt

SEQ ID NO: 508639 - DNA, 14 bp, Homo sapiens
ttctggttctaact

SEQ ID NO: 508640 - DNA, 21 bp, Homo sapiens
ttctggttctaactgctgtta

SEQ ID NO: 508641 - DNA, 17 bp, Homo sapiens
ttctgtaccaaagtgtt

SEQ ID NO: 508642 - DNA, 16 bp, Homo sapiens
ttgaaataattttcaa

SEQ ID NO: 508643 - DNA, 22 bp, Homo sapiens
ttgaagacactgaaatatacac

SEQ ID NO: 508644 - DNA, 20 bp, Homo sapiens
ttgagaaacaaataatttgt

SEQ ID NO: 508645 - DNA, 17 bp, Homo sapiens
ttgataacatggaaatg

SEQ ID NO: 508646 - DNA, 14 bp, Homo sapiens
ttgcaagaatcagt

SEQ ID NO: 508647 - DNA, 19 bp, Homo sapiens
ttgcataagcattgctcaa

SEQ ID NO: 508648 - DNA, 16 bp, Homo sapiens
ttgctttaattgttaa

SEQ ID NO: 508649 - DNA, 23 bp, Homo sapiens
tttaagactctcgcatcttccca

SEQ ID NO: 508650 - DNA, 12 bp, Homo sapiens
tttataatgcag

SEQ ID NO: 508651 - DNA, 21 bp, Homo sapiens
tttcaccatgatggccaggct

SEQ ID NO: 508652 - DNA, 14 bp, Homo sapiens
tttcactttgacat

SEQ ID NO: 508653 - DNA, 22 bp, Homo sapiens
tttccctgcttaatgaaaagct

SEQ ID NO: 508654 - DNA, 16 bp, Homo sapiens
tttgcttctctctcta

SEQ ID NO: 508655 - DNA, 13 bp, Homo sapiens
tttgtaattgaca

SEQ ID NO: 508656 - DNA, 14 bp, Homo sapiens
tttgttcttcagat

SEQ ID NO: 508657 - DNA, 12 bp, Homo sapiens
tttgtttcactt

SEQ ID NO: 508658 - DNA, 13 bp, Homo sapiens
ttttaattacaga

SEQ ID NO: 508659 - DNA, 14 bp, Homo sapiens
ttttagtttgttct

SEQ ID NO: 508660 - DNA, 14 bp, Homo sapiens
ttttcaagcaaagt

SEQ ID NO: 508661 - DNA, 16 bp, Homo sapiens
ttttggggttcaagaa

SEQ ID NO: 508662 - DNA, 15 bp, Homo sapiens
ttttgtataatcaca

SEQ ID NO: 508663 - DNA, 13 bp, Homo sapiens
tttttcacttcta

SEQ ID NO: 508664 - DNA, 17 bp, Homo sapiens
cccgcagacctctggat

SEQ ID NO: 508665 - DNA, 17 bp, Homo sapiens
cccggagctgcccctct

SEQ ID NO: 508666 - DNA, 17 bp, Homo sapiens
ccctatggaagcatatt

SEQ ID NO: 508667 - DNA, 16 bp, Homo sapiens
ccctggagcagccacc

SEQ ID NO: 508668 - DNA, 16 bp, Homo sapiens
ccctggccccctgagt

SEQ ID NO: 508669 - DNA, 23 bp, Homo sapiens
ccgaggggcgggacccaggcacc

SEQ ID NO: 508670 - DNA, 15 bp, Homo sapiens
ccgcagacctctgga

SEQ ID NO: 508671 - DNA, 23 bp, Homo sapiens
ccggagctgcccctctctgggcc

SEQ ID NO: 508672 - DNA, 13 bp, Homo sapiens
cctaaagggacta

SEQ ID NO: 508673 - DNA, 16 bp, Homo sapiens
cctaggattgtgcctg

SEQ ID NO: 508674 - DNA, 16 bp, Homo sapiens
cctcgagggcagggac

SEQ ID NO: 508675 - DNA, 12 bp, Homo sapiens
cctcgctctgtt

SEQ ID NO: 508676 - DNA, 13 bp, Homo sapiens
cctctctgggcct

SEQ ID NO: 508677 - DNA, 16 bp, Homo sapiens
cctctctgggcctcag

SEQ ID NO: 508678 - DNA, 14 bp, Homo sapiens
cctctgggcactgg

SEQ ID NO: 508679 - DNA, 16 bp, Homo sapiens
cctgcatggctgagct

SEQ ID NO: 508680 - DNA, 21 bp, Homo sapiens
cctgctttaaccaccccatct

SEQ ID NO: 508681 - DNA, 15 bp, Homo sapiens
cctggccccctgagt

SEQ ID NO: 508682 - DNA, 14 bp, Homo sapiens
ccttaagccctggc

SEQ ID NO: 508683 - DNA, 16 bp, Homo sapiens
ccttaagccctggccc

SEQ ID NO: 508684 - DNA, 16 bp, Homo sapiens
ccttgaaggagaatca

SEQ ID NO: 508685 - DNA, 15 bp, Homo sapiens
ccttgcaagaatcag

SEQ ID NO: 508686 - DNA, 17 bp, Homo sapiens
ccttgccacattaaatt

SEQ ID NO: 508687 - DNA, 17 bp, Homo sapiens
ccttgtctgaactggag

SEQ ID NO: 508688 - DNA, 15 bp, Homo sapiens
cgaagaagagccaca

SEQ ID NO: 508689 - DNA, 17 bp, Homo sapiens
cgaagaagagccacagt

SEQ ID NO: 508690 - DNA, 16 bp, Homo sapiens
cgaatctagaggaggg

SEQ ID NO: 508691 - DNA, 23 bp, Homo sapiens
cgaccacagggtctgcactctaa

SEQ ID NO: 508692 - DNA, 17 bp, Homo sapiens
cgaggggcgggacccag

SEQ ID NO: 508693 - DNA, 19 bp, Homo sapiens
cgcagacctctggattagg

SEQ ID NO: 508694 - DNA, 19 bp, Homo sapiens
cgcatcttcccaacccctt

SEQ ID NO: 508695 - DNA, 13 bp, Homo sapiens
cgcctccaggcca

SEQ ID NO: 508696 - DNA, 22 bp, Homo sapiens
cgcgaaagtatcaccagggtgc

SEQ ID NO: 508697 - DNA, 19 bp, Homo sapiens
cggagctgcccctctctgg

SEQ ID NO: 508698 - DNA, 20 bp, Homo sapiens
cggcaggttcacaggcgagg

SEQ ID NO: 508699 - DNA, 15 bp, Homo sapiens
cggcctggtgttctg

SEQ ID NO: 508700 - DNA, 21 bp, Homo sapiens
cggctcagtgcaacctctgct

SEQ ID NO: 508701 - DNA, 22 bp, Homo sapiens
cgtggacttggggtcagagact

SEQ ID NO: 508702 - DNA, 15 bp, Homo sapiens
ctaaaattatgttac

SEQ ID NO: 508703 - DNA, 19 bp, Homo sapiens
ctaaaattatgttactgta

SEQ ID NO: 508704 - DNA, 18 bp, Homo sapiens
ctaaacttacatttaaaa

SEQ ID NO: 508705 - DNA, 20 bp, Homo sapiens
ctaactgtgacaaagaagac

SEQ ID NO: 508706 - DNA, 19 bp, Homo sapiens
ctaagccaagttttaaata

SEQ ID NO: 508707 - DNA, 18 bp, Homo sapiens
ctacatgtaatgacactt

SEQ ID NO: 508708 - DNA, 13 bp, Homo sapiens
ctacctctgtgcc

SEQ ID NO: 508709 - DNA, 16 bp, Homo sapiens
ctactataaatataca

SEQ ID NO: 508710 - DNA, 13 bp, Homo sapiens
ctagaggaggggg

SEQ ID NO: 508711 - DNA, 18 bp, Homo sapiens
ctagaggagggggcaggc

SEQ ID NO: 508712 - DNA, 20 bp, Homo sapiens
ctagaggagggggcaggctg

SEQ ID NO: 508713 - DNA, 17 bp, Homo sapiens
ctatgctcaggggccct

SEQ ID NO: 508714 - DNA, 22 bp, Homo sapiens
ctatgctcaggggccctggagc

SEQ ID NO: 508715 - DNA, 21 bp, Homo sapiens
ctattgatataaataaaacat

SEQ ID NO: 508716 - DNA, 23 bp, Homo sapiens
ctcagtgcaacctctgcttccca

SEQ ID NO: 508717 - DNA, 18 bp, Homo sapiens
ctcattcctccacctgcc

SEQ ID NO: 508718 - DNA, 21 bp, Homo sapiens
ctcattcctccacctgccgtg

SEQ ID NO: 508719 - DNA, 15 bp, Homo sapiens
ctccacattcttcag

SEQ ID NO: 508720 - DNA, 22 bp, Homo sapiens
ctccatgtgaccgaacactgca

SEQ ID NO: 508721 - DNA, 22 bp, Homo sapiens
ctccccagtacaccccacctct

SEQ ID NO: 508722 - DNA, 23 bp, Homo sapiens
ctcctgcccgcagacctctggat

SEQ ID NO: 508723 - DNA, 23 bp, Homo sapiens
ctctgacctactcgagggactta

SEQ ID NO: 508724 - DNA, 14 bp, Homo sapiens
ctctgcttcccagg

SEQ ID NO: 508725 - DNA, 19 bp, Homo sapiens
ctctgttgactggctgtgt

SEQ ID NO: 508726 - DNA, 20 bp, Homo sapiens
ctcttgaagacactgaaata

SEQ ID NO: 508727 - DNA, 12 bp, Homo sapiens
ctgaaaaaggaa

SEQ ID NO: 508728 - DNA, 18 bp, Homo sapiens
ctgaaatatacacacagc

SEQ ID NO: 508729 - DNA, 21 bp, Homo sapiens
ctgaaggcctggcccacagca

SEQ ID NO: 508730 - DNA, 18 bp, Homo sapiens
ctgacactcaataaacag

SEQ ID NO: 508731 - DNA, 17 bp, Homo sapiens
ctgacctatcacttcca

SEQ ID NO: 508732 - DNA, 13 bp, Homo sapiens
ctgagagtctgca

SEQ ID NO: 508733 - DNA, 15 bp, Homo sapiens
ctgagcgcctgggtc

SEQ ID NO: 508734 - DNA, 17 bp, Homo sapiens
ctgagggtcgtgggaaa

SEQ ID NO: 508735 - DNA, 23 bp, Homo sapiens
ctgagggtcgtgggaaaggggag

SEQ ID NO: 508736 - DNA, 23 bp, Homo sapiens
ctgcactctaaccctaggcatca

SEQ ID NO: 508737 - DNA, 19 bp, Homo sapiens
ctgcatcccacgttctgtt

SEQ ID NO: 508738 - DNA, 18 bp, Homo sapiens
ctgccaccaaaggccagg

SEQ ID NO: 508739 - DNA, 15 bp, Homo sapiens
ctgcccacagcaggc

SEQ ID NO: 508740 - DNA, 14 bp, Homo sapiens
ctgcccctctctgg

SEQ ID NO: 508741 - DNA, 15 bp, Homo sapiens
ctgcccctctctggg

SEQ ID NO: 508742 - DNA, 18 bp, Homo sapiens
ctgcccgcagacctctgg

SEQ ID NO: 508743 - DNA, 18 bp, Homo sapiens
ctgcctcagcctcccgag

SEQ ID NO: 508744 - DNA, 21 bp, Homo sapiens
ctgcgaatctagaggaggggg

SEQ ID NO: 508745 - DNA, 15 bp, Homo sapiens
ctggagccatgggca

SEQ ID NO: 508746 - DNA, 15 bp, Homo sapiens
ctgtatatttctttt

SEQ ID NO: 508747 - DNA, 16 bp, Homo sapiens
ctgtatatttctttta

SEQ ID NO: 508748 - DNA, 15 bp, Homo sapiens
ctgtgacaaagaaga

SEQ ID NO: 508749 - DNA, 15 bp, Homo sapiens
tgatgtccctatgga

SEQ ID NO: 508750 - DNA, 15 bp, Homo sapiens
tgcaacaggcactca

SEQ ID NO: 508751 - DNA, 21 bp, Homo sapiens
tgcaacctctgcttcccaggt

SEQ ID NO: 508752 - DNA, 13 bp, Homo sapiens
tgcaaggcaaaga

SEQ ID NO: 508753 - DNA, 18 bp, Homo sapiens
tgcacttaacaagctccc

SEQ ID NO: 508754 - DNA, 20 bp, Homo sapiens
tgcagccccgcctccaggcc

SEQ ID NO: 508755 - DNA, 18 bp, Homo sapiens
tgcataagcattgctcaa

SEQ ID NO: 508756 - DNA, 22 bp, Homo sapiens
tgccacattaaattgataacat

SEQ ID NO: 508757 - DNA, 21 bp, Homo sapiens
tgcccaaagtgcttccaaggc

SEQ ID NO: 508758 - DNA, 16 bp, Homo sapiens
tgcccctctctgggcc

SEQ ID NO: 508759 - DNA, 21 bp, Homo sapiens
tgcccctctctgggcctcaga

SEQ ID NO: 508760 - DNA, 17 bp, Homo sapiens
tgcccgcagacctctgg

SEQ ID NO: 508761 - DNA, 18 bp, Homo sapiens
tgcccgcagacctctgga

SEQ ID NO: 508762 - DNA, 23 bp, Homo sapiens
tgcggcaggttcacaggcgaggc

SEQ ID NO: 508763 - DNA, 20 bp, Homo sapiens
tgctcaggggccctggagca

SEQ ID NO: 508764 - DNA, 12 bp, Homo sapiens
tgcttaatgaaa

SEQ ID NO: 508765 - DNA, 21 bp, Homo sapiens
tgctttaaccaccccatctgc

SEQ ID NO: 508766 - DNA, 19 bp, Homo sapiens
tggaagcatattgttatta

SEQ ID NO: 508767 - DNA, 21 bp, Homo sapiens
tggcctgtagaatagcctgtg

SEQ ID NO: 508768 - DNA, 20 bp, Homo sapiens
tgggatccctctgggcactg

SEQ ID NO: 508769 - DNA, 20 bp, Homo sapiens
tgggcacaaagggcccagat

SEQ ID NO: 508770 - DNA, 22 bp, Homo sapiens
tggggctctctgagtcctggcc

SEQ ID NO: 508771 - DNA, 17 bp, Homo sapiens
tggggtcagagactgct

SEQ ID NO: 508772 - DNA, 13 bp, Homo sapiens
tgtaataaacagg

SEQ ID NO: 508773 - DNA, 22 bp, Homo sapiens
tgtaataaacaggtttttagtt

SEQ ID NO: 508774 - DNA, 19 bp, Homo sapiens
tgtataagtccttgcaaga

SEQ ID NO: 508775 - DNA, 18 bp, Homo sapiens
tgtcagtggggctctctg

SEQ ID NO: 508776 - DNA, 14 bp, Homo sapiens
tgtctgaccttcca

SEQ ID NO: 508777 - DNA, 17 bp, Homo sapiens
tgtgaccttaggcccgg

SEQ ID NO: 508778 - DNA, 19 bp, Homo sapiens
tgtgtcagtggggctctct

SEQ ID NO: 508779 - DNA, 22 bp, Homo sapiens
tgtgtcagtggggctctctgag

SEQ ID NO: 508780 - DNA, 15 bp, Homo sapiens
tgttaacctttctaa

SEQ ID NO: 508781 - DNA, 17 bp, Homo sapiens
tgttaacctttctaacc

SEQ ID NO: 508782 - DNA, 15 bp, Homo sapiens
tgttaaggttcaaga

SEQ ID NO: 508783 - DNA, 22 bp, Homo sapiens
tgttcctgacactcaataaaca

SEQ ID NO: 508784 - DNA, 15 bp, Homo sapiens
tgttgacaaatgaca

SEQ ID NO: 508785 - DNA, 15 bp, Homo sapiens
tgttttttctgccac

SEQ ID NO: 508786 - DNA, 14 bp, Homo sapiens
ttaaagaaatttta

SEQ ID NO: 508787 - DNA, 18 bp, Homo sapiens
ttaaagcagtgcttctca

SEQ ID NO: 508788 - DNA, 19 bp, Homo sapiens
ttaactattttattttcta

SEQ ID NO: 508789 - DNA, 23 bp, Homo sapiens
gctctgttacccagggtggagtg

SEQ ID NO: 508790 - DNA, 11 bp, Homo sapiens
gctgagggtcg

SEQ ID NO: 508791 - DNA, 13 bp, Homo sapiens
gctgcagagccac

SEQ ID NO: 508792 - DNA, 14 bp, Homo sapiens
gctgcccctctctg

SEQ ID NO: 508793 - DNA, 16 bp, Homo sapiens
gctgcccctctctggg

SEQ ID NO: 508794 - DNA, 23 bp, Homo sapiens
gctgcccctctctgggcctcaga

SEQ ID NO: 508795 - DNA, 19 bp, Homo sapiens
gctgcgaatctagaggagg

SEQ ID NO: 508796 - DNA, 23 bp, Homo sapiens
gctgcgaatctagaggagggggc

SEQ ID NO: 508797 - DNA, 22 bp, Homo sapiens
gcttctcatcctgcaggcagct

SEQ ID NO: 508798 - DNA, 22 bp, Homo sapiens
gcttgtcttcgtccatctgttg

SEQ ID NO: 508799 - DNA, 22 bp, Homo sapiens
ggaaaataggaagtgaacccat

SEQ ID NO: 508800 - DNA, 15 bp, Homo sapiens
ggaacactgagaaag

SEQ ID NO: 508801 - DNA, 15 bp, Homo sapiens
ggaagtaaaacagtc

SEQ ID NO: 508802 - DNA, 21 bp, Homo sapiens
ggaagtgaacccatattttaa

SEQ ID NO: 508803 - DNA, 13 bp, Homo sapiens
ggaatatgagctt

SEQ ID NO: 508804 - DNA, 15 bp, Homo sapiens
ggagaatcatcagga

SEQ ID NO: 508805 - DNA, 22 bp, Homo sapiens
ggagaatcatcaggaccctgga

SEQ ID NO: 508806 - DNA, 14 bp, Homo sapiens
ggaggcagcaggac

SEQ ID NO: 508807 - DNA, 18 bp, Homo sapiens
ggagggggcaggctgagg

SEQ ID NO: 508808 - DNA, 23 bp, Homo sapiens
ggaggggtaacttgcacctctga

SEQ ID NO: 508809 - DNA, 18 bp, Homo sapiens
ggatgtatatgtcatctc

SEQ ID NO: 508810 - DNA, 20 bp, Homo sapiens
ggcagcttctattagccagt

SEQ ID NO: 508811 - DNA, 15 bp, Homo sapiens
ggcaggctgagggtc

SEQ ID NO: 508812 - DNA, 20 bp, Homo sapiens
ggcagggacctaaagggact

SEQ ID NO: 508813 - DNA, 21 bp, Homo sapiens
ggccctggagcagccacccca

SEQ ID NO: 508814 - DNA, 19 bp, Homo sapiens
ggcctggtgttctgtggga

SEQ ID NO: 508815 - DNA, 15 bp, Homo sapiens
ggctgagggtcgtgg

SEQ ID NO: 508816 - DNA, 21 bp, Homo sapiens
gggaacactgagaaagaggca

SEQ ID NO: 508817 - DNA, 17 bp, Homo sapiens
gggacgaagaagagcca

SEQ ID NO: 508818 - DNA, 19 bp, Homo sapiens
gggacgaagaagagccaca

SEQ ID NO: 508819 - DNA, 21 bp, Homo sapiens
gggagcatgagaggaggcagc

SEQ ID NO: 508820 - DNA, 16 bp, Homo sapiens
gggcacaaagggccca

SEQ ID NO: 508821 - DNA, 11 bp, Homo sapiens
gggccctggag

SEQ ID NO: 508822 - DNA, 15 bp, Homo sapiens
gggccctggagcagc

SEQ ID NO: 508823 - DNA, 18 bp, Homo sapiens
ggggaacactgagaaaga

SEQ ID NO: 508824 - DNA, 23 bp, Homo sapiens
ggggcagcttctattagccagtc

SEQ ID NO: 508825 - DNA, 19 bp, Homo sapiens
gggggaacactgagaaaga

SEQ ID NO: 508826 - DNA, 15 bp, Homo sapiens
ggtcgtgggaaaggg

SEQ ID NO: 508827 - DNA, 19 bp, Homo sapiens
ggtcgtgggaaaggggagt

SEQ ID NO: 508828 - DNA, 22 bp, Homo sapiens
ggtcgtgggaaaggggagtagg

SEQ ID NO: 508829 - DNA, 19 bp, Homo sapiens
ggtggagtgcagtggtgcg

SEQ ID NO: 508830 - DNA, 15 bp, Homo sapiens
gtactaatagaactt

SEQ ID NO: 508831 - DNA, 20 bp, Homo sapiens
gtactcatcatcaaccctaa

SEQ ID NO: 508832 - DNA, 19 bp, Homo sapiens
gtagaatagcctgtggcct

SEQ ID NO: 508833 - DNA, 17 bp, Homo sapiens
gtagatcctgagaagta

SEQ ID NO: 508834 - DNA, 21 bp, Homo sapiens
gtagattttaaaagttattaa

SEQ ID NO: 508835 - DNA, 21 bp, Homo sapiens
gtagcattcatgtaataaaca

SEQ ID NO: 508836 - DNA, 21 bp, Homo sapiens
gtagctgggattacaggtgtg

SEQ ID NO: 508837 - DNA, 14 bp, Homo sapiens
gtataatcacagtt

SEQ ID NO: 508838 - DNA, 13 bp, Homo sapiens
gtatatacaagta

SEQ ID NO: 508839 - DNA, 16 bp, Homo sapiens
gtcagagactgctgtg

SEQ ID NO: 508840 - DNA, 14 bp, Homo sapiens
gtccacttcatttt

SEQ ID NO: 508841 - DNA, 21 bp, Homo sapiens
gtcctgtgttttttctgccac

SEQ ID NO: 508842 - DNA, 15 bp, Homo sapiens
gtcgtgggaaagggg

SEQ ID NO: 508843 - DNA, 22 bp, Homo sapiens
gtgaacacttttgaaaatgtac

SEQ ID NO: 508844 - DNA, 21 bp, Homo sapiens
gtgagcagcctggagccctgg

SEQ ID NO: 508845 - DNA, 22 bp, Homo sapiens
gtgcagccccgcctccaggcca

SEQ ID NO: 508846 - DNA, 21 bp, Homo sapiens
gtgcctgtatgcaacaggcac

SEQ ID NO: 508847 - DNA, 18 bp, Homo sapiens
gtgtaagtttataatgca

SEQ ID NO: 508848 - DNA, 21 bp, Homo sapiens
gtgttaaactaaaaatttaca

SEQ ID NO: 508849 - DNA, 18 bp, Homo sapiens
gttactgtatttttcaga

SEQ ID NO: 508850 - DNA, 18 bp, Homo sapiens
gttcaagaagtaatcagt

SEQ ID NO: 508851 - DNA, 22 bp, Homo sapiens
gtttataatgcaggggaagtac

SEQ ID NO: 508852 - DNA, 23 bp, Homo sapiens
gtttccttttctgtctctctctt

SEQ ID NO: 508853 - DNA, 15 bp, Homo sapiens
gtttgagaagcactg

SEQ ID NO: 508854 - DNA, 14 bp, Homo sapiens
gtttgttcttcaga

SEQ ID NO: 508855 - DNA, 16 bp, Homo sapiens
gttttgtttcactttg

SEQ ID NO: 508856 - DNA, 14 bp, Homo sapiens
gtttttcacttcta

SEQ ID NO: 508857 - DNA, 12 bp, Homo sapiens
taaaacagtcat

SEQ ID NO: 508858 - DNA, 15 bp, Homo sapiens
taaaacattttcaca

SEQ ID NO: 508859 - DNA, 14 bp, Homo sapiens
taaacttacattta

SEQ ID NO: 508860 - DNA, 17 bp, Homo sapiens
taaagggactacctctg

SEQ ID NO: 508861 - DNA, 19 bp, Homo sapiens
taaagggactacctctgtg

SEQ ID NO: 508862 - DNA, 22 bp, Homo sapiens
taaataaaacattttcacacaa

SEQ ID NO: 508863 - DNA, 15 bp, Homo sapiens
taaatatacatataa

SEQ ID NO: 508864 - DNA, 21 bp, Homo sapiens
taaatcatctttattaagtag

SEQ ID NO: 508865 - DNA, 15 bp, Homo sapiens
taacaagctcccagg

SEQ ID NO: 508866 - DNA, 17 bp, Homo sapiens
taagatgctaccttgtg

SEQ ID NO: 508867 - DNA, 23 bp, Homo sapiens
taagatgctaccttgtgacccag

SEQ ID NO: 508868 - DNA, 18 bp, Homo sapiens
taaggtcattaccacagg

SEQ ID NO: 508869 - DNA, 14 bp, Homo sapiens
taatagaacttgtt

SEQ ID NO: 508870 - DNA, 17 bp, Homo sapiens
taatctaattctaagga

SEQ ID NO: 508871 - DNA, 21 bp, Homo sapiens
taattctaaggaatatgagct

SEQ ID NO: 508872 - DNA, 20 bp, Homo sapiens
taattgttaagatatgatgt

SEQ ID NO: 508873 - DNA, 16 bp, Homo sapiens
taatttattttgtgaa

SEQ ID NO: 508874 - DNA, 15 bp, Homo sapiens
taattttcaagcaaa

SEQ ID NO: 508875 - DNA, 16 bp, Homo sapiens
tacaagagaagaaagt

SEQ ID NO: 508876 - DNA, 19 bp, Homo sapiens
tacagctgagcacattctg

SEQ ID NO: 508877 - DNA, 18 bp, Homo sapiens
taccttgtgacccagcac

SEQ ID NO: 508878 - DNA, 16 bp, Homo sapiens
tactgtatttttcaga

SEQ ID NO: 508879 - DNA, 21 bp, Homo sapiens
tactgtatttttcagaaatca

SEQ ID NO: 508880 - DNA, 21 bp, Homo sapiens
tagaatagcctgtggcctttg

SEQ ID NO: 508881 - DNA, 22 bp, Homo sapiens
tagacaagtccagcctggcaag

SEQ ID NO: 508882 - DNA, 15 bp, Homo sapiens
tagagatgaggtttc

SEQ ID NO: 508883 - DNA, 12 bp, Homo sapiens
tagcctgtggcc

SEQ ID NO: 508884 - DNA, 21 bp, Homo sapiens
taggaagtgaacccatatttt

SEQ ID NO: 508885 - DNA, 19 bp, Homo sapiens
taggcccggagctgcccct

SEQ ID NO: 508886 - DNA, 17 bp, Homo sapiens
tagtgaagcaatttgaa

SEQ ID NO: 508887 - DNA, 12 bp, Homo sapiens
tagttgtaaata

SEQ ID NO: 508888 - DNA, 13 bp, Homo sapiens
tataaatatacat

SEQ ID NO: 508889 - DNA, 18 bp, Homo sapiens
tataattacatatttgca

SEQ ID NO: 508890 - DNA, 13 bp, Homo sapiens
tatacaagtagat

SEQ ID NO: 508891 - DNA, 12 bp, Homo sapiens
tatacacacagc

SEQ ID NO: 508892 - DNA, 12 bp, Homo sapiens
tatagtgaagca

SEQ ID NO: 508893 - DNA, 14 bp, Homo sapiens
tatatacaagtaga

SEQ ID NO: 508894 - DNA, 15 bp, Homo sapiens
tatatcattatcttt

SEQ ID NO: 508895 - DNA, 18 bp, Homo sapiens
tatcattatctttgctgt

SEQ ID NO: 508896 - DNA, 20 bp, Homo sapiens
tatcattatctttgctgtta

SEQ ID NO: 508897 - DNA, 20 bp, Homo sapiens
tatgaaaagtactaatagaa

SEQ ID NO: 508898 - DNA, 22 bp, Homo sapiens
tatgattagagggatgagacag

SEQ ID NO: 508899 - DNA, 16 bp, Homo sapiens
tatgtaataatgtgaa

SEQ ID NO: 508900 - DNA, 14 bp, Homo sapiens
tatgtttttctgta

SEQ ID NO: 508901 - DNA, 13 bp, Homo sapiens
tattaagtagatg

SEQ ID NO: 508902 - DNA, 15 bp, Homo sapiens
tattaatattttaat

SEQ ID NO: 508903 - DNA, 16 bp, Homo sapiens
tattagccagtcttta

SEQ ID NO: 508904 - DNA, 22 bp, Homo sapiens
tcaaacttccagtgcaacactg

SEQ ID NO: 508905 - DNA, 21 bp, Homo sapiens
ttagagggatgagacagacat

SEQ ID NO: 508906 - DNA, 22 bp, Homo sapiens
ttatttacagataacttcttta

SEQ ID NO: 508907 - DNA, 17 bp, Homo sapiens
ttcacctgtatatttct

SEQ ID NO: 508908 - DNA, 20 bp, Homo sapiens
ttcacctgtatatttctttt

SEQ ID NO: 508909 - DNA, 23 bp, Homo sapiens
ttcacgattaactgtgaaatgta

SEQ ID NO: 508910 - DNA, 12 bp, Homo sapiens
ttcagtttttca

SEQ ID NO: 508911 - DNA, 18 bp, Homo sapiens
ttccacactcacctctaa

SEQ ID NO: 508912 - DNA, 18 bp, Homo sapiens
ttcccagctctaccctgc

SEQ ID NO: 508913 - DNA, 17 bp, Homo sapiens
ttccctgcttaatgaaa

SEQ ID NO: 508914 - DNA, 16 bp, Homo sapiens
ttccctttttcataat

SEQ ID NO: 508915 - DNA, 23 bp, Homo sapiens
ttcctgacactcaataaacagtc

SEQ ID NO: 508916 - DNA, 18 bp, Homo sapiens
ttctacatgtaatgacac

SEQ ID NO: 508917 - DNA, 20 bp, Homo sapiens
ttctattagccagtctttac

SEQ ID NO: 508918 - DNA, 22 bp, Homo sapiens
ttctcataagtagcattcatgt

SEQ ID NO: 508919 - DNA, 15 bp, Homo sapiens
ttctcatcctgcagg

SEQ ID NO: 508920 - DNA, 17 bp, Homo sapiens
ttctggctcagggaggt

SEQ ID NO: 508921 - DNA, 15 bp, Homo sapiens
ttcttagtagatttt

SEQ ID NO: 508922 - DNA, 12 bp, Homo sapiens
ttcttcagattg

SEQ ID NO: 508923 - DNA, 13 bp, Homo sapiens
ttgaagacactga

SEQ ID NO: 508924 - DNA, 20 bp, Homo sapiens
ttgacaaatgacagatcttt

SEQ ID NO: 508925 - DNA, 22 bp, Homo sapiens
ttgacaaatgacagatcttttt

SEQ ID NO: 508926 - DNA, 19 bp, Homo sapiens
ttgagctctgcagcccagg

SEQ ID NO: 508927 - DNA, 18 bp, Homo sapiens
ttgatataaataaaacat

SEQ ID NO: 508928 - DNA, 14 bp, Homo sapiens
ttgatttttcttat

SEQ ID NO: 508929 - DNA, 12 bp, Homo sapiens
ttgcctgcaggc

SEQ ID NO: 508930 - DNA, 12 bp, Homo sapiens
ttgtaaatatag

SEQ ID NO: 508931 - DNA, 21 bp, Homo sapiens
ttgtaagtttttattgtgtaa

SEQ ID NO: 508932 - DNA, 18 bp, Homo sapiens
ttgtatgtttttctgtat

SEQ ID NO: 508933 - DNA, 14 bp, Homo sapiens
ttgtgaacactttt

SEQ ID NO: 508934 - DNA, 18 bp, Homo sapiens
ttgttaacctttctaacc

SEQ ID NO: 508935 - DNA, 19 bp, Homo sapiens
ctgagattattttaatcta

SEQ ID NO: 508936 - DNA, 22 bp, Homo sapiens
ctgagccagtgtcaggaggaag

SEQ ID NO: 508937 - DNA, 18 bp, Homo sapiens
ctgagctgcccacagcag

SEQ ID NO: 508938 - DNA, 21 bp, Homo sapiens
ctgagctgcccacagcaggcc

SEQ ID NO: 508939 - DNA, 21 bp, Homo sapiens
ctgagggtcgtgggaaagggg

SEQ ID NO: 508940 - DNA, 14 bp, Homo sapiens
ctgagtcctggccc

SEQ ID NO: 508941 - DNA, 15 bp, Homo sapiens
ctgagtcctggccca

SEQ ID NO: 508942 - DNA, 22 bp, Homo sapiens
ctgccaccaaaggccagggtca

SEQ ID NO: 508943 - DNA, 22 bp, Homo sapiens
ctgcccaaagtgcttccaaggc

SEQ ID NO: 508944 - DNA, 12 bp, Homo sapiens
ctgcccctctct

SEQ ID NO: 508945 - DNA, 13 bp, Homo sapiens
ctgcccctctctg

SEQ ID NO: 508946 - DNA, 17 bp, Homo sapiens
ctgcccctctctgggcc

SEQ ID NO: 508947 - DNA, 18 bp, Homo sapiens
ctgcccctctctgggcct

SEQ ID NO: 508948 - DNA, 17 bp, Homo sapiens
ctgcccgcagacctctg

SEQ ID NO: 508949 - DNA, 19 bp, Homo sapiens
ctgcccgcagacctctgga

SEQ ID NO: 508950 - DNA, 15 bp, Homo sapiens
ctgcctcagcctccc

SEQ ID NO: 508951 - DNA, 20 bp, Homo sapiens
ctgcgaatctagaggagggg

SEQ ID NO: 508952 - DNA, 14 bp, Homo sapiens
ctgcttaatgaaaa

SEQ ID NO: 508953 - DNA, 14 bp, Homo sapiens
ctgcttatgaaaag

SEQ ID NO: 508954 - DNA, 17 bp, Homo sapiens
ctgctttaaccacccca

SEQ ID NO: 508955 - DNA, 12 bp, Homo sapiens
ctggagcagcca

SEQ ID NO: 508956 - DNA, 14 bp, Homo sapiens
ctggagcagccacc

SEQ ID NO: 508957 - DNA, 11 bp, Homo sapiens
ctgggcagcta

SEQ ID NO: 508958 - DNA, 20 bp, Homo sapiens
ctgtagaatagcctgtggcc

SEQ ID NO: 508959 - DNA, 13 bp, Homo sapiens
ctgtatatttctt

SEQ ID NO: 508960 - DNA, 22 bp, Homo sapiens
ctgtatttgccggtgcctagga

SEQ ID NO: 508961 - DNA, 11 bp, Homo sapiens
ctgtctctctc

SEQ ID NO: 508962 - DNA, 23 bp, Homo sapiens
ctgtgccttgccacattaaattg

SEQ ID NO: 508963 - DNA, 23 bp, Homo sapiens
ctgttccagcctgccctcttcat

SEQ ID NO: 508964 - DNA, 22 bp, Homo sapiens
ctgttgactggctgtgtgacct

SEQ ID NO: 508965 - DNA, 14 bp, Homo sapiens
cttaaaaaactgca

SEQ ID NO: 508966 - DNA, 15 bp, Homo sapiens
cttaaggggcagctt

SEQ ID NO: 508967 - DNA, 20 bp, Homo sapiens
cttatgagggtcctctactt

SEQ ID NO: 508968 - DNA, 19 bp, Homo sapiens
cttcatggcagtaattctc

SEQ ID NO: 508969 - DNA, 22 bp, Homo sapiens
cttcccactctagggcagtgga

SEQ ID NO: 508970 - DNA, 15 bp, Homo sapiens
cttctcatcctgcag

SEQ ID NO: 508971 - DNA, 18 bp, Homo sapiens
cttctctctctaaaatga

SEQ ID NO: 508972 - DNA, 22 bp, Homo sapiens
cttgcaagaatcagtgcaaaga

SEQ ID NO: 508973 - DNA, 22 bp, Homo sapiens
tcaaccctaaaaagcagagctt

SEQ ID NO: 508974 - DNA, 23 bp, Homo sapiens
tcaaccctaaaaagcagagcttt

SEQ ID NO: 508975 - DNA, 20 bp, Homo sapiens
tcaagaagtaatcagtatgc

SEQ ID NO: 508976 - DNA, 17 bp, Homo sapiens
tcaagtgatcctcccac

SEQ ID NO: 508977 - DNA, 14 bp, Homo sapiens
tcaataaacagtca

SEQ ID NO: 508978 - DNA, 20 bp, Homo sapiens
tcaatgatagcacctaaact

SEQ ID NO: 508979 - DNA, 19 bp, Homo sapiens
tcacacaatacaataagtt

SEQ ID NO: 508980 - DNA, 20 bp, Homo sapiens
tcacaggcgaggcctggagt

SEQ ID NO: 508981 - DNA, 16 bp, Homo sapiens
tcacctgtatatttct

SEQ ID NO: 508982 - DNA, 18 bp, Homo sapiens
tcagtggggctctctgag

SEQ ID NO: 508983 - DNA, 13 bp, Homo sapiens
tcagtttttcact

SEQ ID NO: 508984 - DNA, 19 bp, Homo sapiens
tcatcaggaccctggacct

SEQ ID NO: 508985 - DNA, 13 bp, Homo sapiens
tcatcctgcaggc

SEQ ID NO: 508986 - DNA, 18 bp, Homo sapiens
tcatctagaattcactga

SEQ ID NO: 508987 - DNA, 23 bp, Homo sapiens
tccacactcacctctaaaacagt

SEQ ID NO: 508988 - DNA, 15 bp, Homo sapiens
tccacttcattttgt

SEQ ID NO: 508989 - DNA, 14 bp, Homo sapiens
tccatggattttgg

SEQ ID NO: 508990 - DNA, 15 bp, Homo sapiens
tcccacgttctgtta

SEQ ID NO: 508991 - DNA, 17 bp, Homo sapiens
tcccactctagggcagt

SEQ ID NO: 508992 - DNA, 17 bp, Homo sapiens
tcccagctctaccctgc

SEQ ID NO: 508993 - DNA, 19 bp, Homo sapiens
tcccagctctaccctgcat

SEQ ID NO: 508994 - DNA, 15 bp, Homo sapiens
tccccggagttcagt

SEQ ID NO: 508995 - DNA, 12 bp, Homo sapiens
tccctttttcat

SEQ ID NO: 508996 - DNA, 23 bp, Homo sapiens
tccgaggggcgggacccaggcac

SEQ ID NO: 508997 - DNA, 21 bp, Homo sapiens
tcctgacactcaataaacagt

SEQ ID NO: 508998 - DNA, 23 bp, Homo sapiens
tcctgagccagtgtcaggaggaa

SEQ ID NO: 508999 - DNA, 13 bp, Homo sapiens
tcctgcctcagcc

SEQ ID NO: 509000 - DNA, 21 bp, Homo sapiens
tcctgcctcagcctcccgagt

SEQ ID NO: 509001 - DNA, 14 bp, Homo sapiens
tccttctacatgta

SEQ ID NO: 509002 - DNA, 13 bp, Homo sapiens
tccttctggttct

SEQ ID NO: 509003 - DNA, 14 bp, Homo sapiens
tcgcatcttcccaa

SEQ ID NO: 509004 - DNA, 19 bp, Homo sapiens
tcgtgggaaaggggagtag

SEQ ID NO: 509005 - DNA, 23 bp, Homo sapiens
tctaaccctaggcatcacatgct

SEQ ID NO: 509006 - DNA, 19 bp, Homo sapiens
agttatcttttaattacag

SEQ ID NO: 509007 - DNA, 13 bp, Homo sapiens
agttgatttttct

SEQ ID NO: 509008 - DNA, 14 bp, Homo sapiens
agttgcataagcat

SEQ ID NO: 509009 - DNA, 14 bp, Homo sapiens
agttgtaaatatag

SEQ ID NO: 509010 - DNA, 16 bp, Homo sapiens
agttttaaagaaattt

SEQ ID NO: 509011 - DNA, 21 bp, Homo sapiens
agttttgtttcactttgacat

SEQ ID NO: 509012 - DNA, 19 bp, Homo sapiens
ataacagccttttccttct

SEQ ID NO: 509013 - DNA, 20 bp, Homo sapiens
ataagcattgctcaagagga

SEQ ID NO: 509014 - DNA, 17 bp, Homo sapiens
ataagtagcattcatgt

SEQ ID NO: 509015 - DNA, 15 bp, Homo sapiens
ataattttattacat

SEQ ID NO: 509016 - DNA, 21 bp, Homo sapiens
atacaagtagatcctgagaag

SEQ ID NO: 509017 - DNA, 16 bp, Homo sapiens
atacaataattgaagt

SEQ ID NO: 509018 - DNA, 14 bp, Homo sapiens
atacctaactgaat

SEQ ID NO: 509019 - DNA, 18 bp, Homo sapiens
atagcacctaaacttaca

SEQ ID NO: 509020 - DNA, 21 bp, Homo sapiens
atagcacctaaacttacattt

SEQ ID NO: 509021 - DNA, 15 bp, Homo sapiens
atataaataaaacat

SEQ ID NO: 509022 - DNA, 13 bp, Homo sapiens
atatacacacagc

SEQ ID NO: 509023 - DNA, 15 bp, Homo sapiens
atattttaaattctc

SEQ ID NO: 509024 - DNA, 22 bp, Homo sapiens
atcaaactgcttatgaaaagta

SEQ ID NO: 509025 - DNA, 15 bp, Homo sapiens
atcagttgatttttc

SEQ ID NO: 509026 - DNA, 16 bp, Homo sapiens
atcccacgttctgtta

SEQ ID NO: 509027 - DNA, 20 bp, Homo sapiens
atcctgagaagtacctttgt

SEQ ID NO: 509028 - DNA, 22 bp, Homo sapiens
atcctgagaagtacctttgtta

SEQ ID NO: 509029 - DNA, 17 bp, Homo sapiens
atctaacagacaagagt

SEQ ID NO: 509030 - DNA, 14 bp, Homo sapiens
atctagaattcact

SEQ ID NO: 509031 - DNA, 17 bp, Homo sapiens
atctcagtgctgtaaaa

SEQ ID NO: 509032 - DNA, 12 bp, Homo sapiens
atctttgctgtt

SEQ ID NO: 509033 - DNA, 13 bp, Homo sapiens
atcttttatacaa

SEQ ID NO: 509034 - DNA, 14 bp, Homo sapiens
atgaagcaaacaca

SEQ ID NO: 509035 - DNA, 23 bp, Homo sapiens
atgatagcacctaaacttacatt

SEQ ID NO: 509036 - DNA, 24 bp, Homo sapiens
atgcacctgaatgttagatagtta

SEQ ID NO: 509037 - DNA, 23 bp, Homo sapiens
atgctaccttgtgacccagcact

SEQ ID NO: 509038 - DNA, 21 bp, Homo sapiens
atgctcaggggccctggagca

SEQ ID NO: 509039 - DNA, 22 bp, Homo sapiens
atgctcaggggccctggagcag

SEQ ID NO: 509040 - DNA, 18 bp, Homo sapiens
atggcgtggtcaagcact

SEQ ID NO: 509041 - DNA, 19 bp, Homo sapiens
atgggggaggggggaagga

SEQ ID NO: 509042 - DNA, 18 bp, Homo sapiens
atgtacatgttcctttgt

SEQ ID NO: 509043 - DNA, 21 bp, Homo sapiens
atgtgtcagtggggctctctg

SEQ ID NO: 509044 - DNA, 15 bp, Homo sapiens
atgttcctttgtaat

SEQ ID NO: 509045 - DNA, 18 bp, Homo sapiens
atgttcctttgtaattga

SEQ ID NO: 509046 - DNA, 13 bp, Homo sapiens
attaactctaact

SEQ ID NO: 509047 - DNA, 16 bp, Homo sapiens
attaactctaactgtg

SEQ ID NO: 509048 - DNA, 19 bp, Homo sapiens
attaactgtgaaatgtacg

SEQ ID NO: 509049 - DNA, 15 bp, Homo sapiens
attaagccttccaca

SEQ ID NO: 509050 - DNA, 15 bp, Homo sapiens
attaagtagatgaaa

SEQ ID NO: 509051 - DNA, 14 bp, Homo sapiens
attaatattttaat

SEQ ID NO: 509052 - DNA, 21 bp, Homo sapiens
attacagaagagtttcttaac

SEQ ID NO: 509053 - DNA, 20 bp, Homo sapiens
attatagaatctactttaat

SEQ ID NO: 509054 - DNA, 12 bp, Homo sapiens
attcccagctct

SEQ ID NO: 509055 - DNA, 21 bp, Homo sapiens
attctcataagtagcattcat

SEQ ID NO: 509056 - DNA, 17 bp, Homo sapiens
attgacactatatattt

SEQ ID NO: 509057 - DNA, 18 bp, Homo sapiens
attgatataaataaaaca

SEQ ID NO: 509058 - DNA, 19 bp, Homo sapiens
attgatataaataaaacat

SEQ ID NO: 509059 - DNA, 13 bp, Homo sapiens
atttacaagagaa

SEQ ID NO: 509060 - DNA, 17 bp, Homo sapiens
atttagtaaataaacaa

SEQ ID NO: 509061 - DNA, 18 bp, Homo sapiens
atttattttgtgaacact

SEQ ID NO: 509062 - DNA, 15 bp, Homo sapiens
atttgcatatgtatg

SEQ ID NO: 509063 - DNA, 13 bp, Homo sapiens
attttaaattctc

SEQ ID NO: 509064 - DNA, 20 bp, Homo sapiens
attttgtataatcacagttg

SEQ ID NO: 509065 - DNA, 13 bp, Homo sapiens
atttttcagaaat

SEQ ID NO: 509066 - DNA, 16 bp, Homo sapiens
caaaccttgatgtgcc

SEQ ID NO: 509067 - DNA, 19 bp, Homo sapiens
caaactgcttatgaaaagt

SEQ ID NO: 509068 - DNA, 13 bp, Homo sapiens
caaaggccagggt

SEQ ID NO: 509069 - DNA, 17 bp, Homo sapiens
caaagtattgtgaaagt

SEQ ID NO: 509070 - DNA, 17 bp, Homo sapiens
caagagaagaaagtgaa

SEQ ID NO: 509071 - DNA, 20 bp, Homo sapiens
caagatctgtgcagccccgc

SEQ ID NO: 509072 - DNA, 14 bp, Homo sapiens
caagctcccaggcc

SEQ ID NO: 509073 - DNA, 20 bp, Homo sapiens
caagtagatcctgagaagta

SEQ ID NO: 509074 - DNA, 22 bp, Homo sapiens
caagttttaaatattatctaac

SEQ ID NO: 509075 - DNA, 12 bp, Homo sapiens
caataaacagtc

SEQ ID NO: 509076 - DNA, 15 bp, Homo sapiens
cacaaagggcccaga

SEQ ID NO: 509077 - DNA, 21 bp, Homo sapiens
cacaaatagttatcttttaat

SEQ ID NO: 509078 - DNA, 19 bp, Homo sapiens
cacaatcttaaggggcagc

SEQ ID NO: 509079 - DNA, 21 bp, Homo sapiens
cacaccaggcttgcctgcagg

SEQ ID NO: 509080 - DNA, 14 bp, Homo sapiens
cacagggtctgcac

SEQ ID NO: 509081 - DNA, 22 bp, Homo sapiens
cacagtggaaagacagcttctc

SEQ ID NO: 509082 - DNA, 22 bp, Homo sapiens
cacatgctcaatgactctctgg

SEQ ID NO: 509083 - DNA, 19 bp, Homo sapiens
cacatggggctgggcagct

SEQ ID NO: 509084 - DNA, 13 bp, Homo sapiens
caccaaaggccag

SEQ ID NO: 509085 - DNA, 16 bp, Homo sapiens
caccccacctcttcct

SEQ ID NO: 509086 - DNA, 14 bp, Homo sapiens
caccccatgctggc

SEQ ID NO: 509087 - DNA, 15 bp, Homo sapiens
caccccatgctggcc

SEQ ID NO: 509088 - DNA, 17 bp, Homo sapiens
cactcaataaacagtca

SEQ ID NO: 509089 - DNA, 16 bp, Homo sapiens
cacttcattttgtata

SEQ ID NO: 509090 - DNA, 16 bp, Homo sapiens
cagaaatcaaactgct

SEQ ID NO: 509091 - DNA, 18 bp, Homo sapiens
cagaagagtttcttaact

SEQ ID NO: 509092 - DNA, 20 bp, Homo sapiens
cagaagagtttcttaactta

SEQ ID NO: 509093 - DNA, 14 bp, Homo sapiens
cagagactgctgtg

SEQ ID NO: 509094 - DNA, 15 bp, Homo sapiens
cagataacttcttta

SEQ ID NO: 509095 - DNA, 17 bp, Homo sapiens
cagatgagaaactcttg

SEQ ID NO: 509096 - DNA, 21 bp, Homo sapiens
cagcaggccaggtccagagag

SEQ ID NO: 509097 - DNA, 15 bp, Homo sapiens
cagccaccccatgct

SEQ ID NO: 509098 - DNA, 20 bp, Homo sapiens
cagccaccccatgctggcct

SEQ ID NO: 509099 - DNA, 12 bp, Homo sapiens
cagcccagggac

SEQ ID NO: 509100 - DNA, 19 bp, Homo sapiens
cagcctggagccctggaga

SEQ ID NO: 509101 - DNA, 16 bp, Homo sapiens
cagcgcttgaagcctg

SEQ ID NO: 509102 - DNA, 19 bp, Homo sapiens
cagcttctcatcctgcagg

SEQ ID NO: 509103 - DNA, 22 bp, Homo sapiens
caggactgtccccttgaaggag

SEQ ID NO: 509104 - DNA, 19 bp, Homo sapiens
caggaggccggggccgggt

SEQ ID NO: 509105 - DNA, 18 bp, Homo sapiens
caggcttgcctgcaggca

SEQ ID NO: 509106 - DNA, 20 bp, Homo sapiens
cagggacctaaagggactac

SEQ ID NO: 509107 - DNA, 21 bp, Homo sapiens
cagggagcatgagaggaggca

SEQ ID NO: 509108 - DNA, 23 bp, Homo sapiens
cagggagcatgagaggaggcagc

SEQ ID NO: 509109 - DNA, 16 bp, Homo sapiens
caggggatggcgtggt

SEQ ID NO: 509110 - DNA, 22 bp, Homo sapiens
caggggatggcgtggtcaagca

SEQ ID NO: 509111 - DNA, 17 bp, Homo sapiens
caggggccctggagcag

SEQ ID NO: 509112 - DNA, 20 bp, Homo sapiens
cagggtcactgaaggcctgg

SEQ ID NO: 509113 - DNA, 18 bp, Homo sapiens
cagggtggagtgcagtgg

SEQ ID NO: 509114 - DNA, 20 bp, Homo sapiens
caggttcacaggcgaggcct

SEQ ID NO: 509115 - DNA, 22 bp, Homo sapiens
cagtatgcaaagcaatctttta

SEQ ID NO: 509116 - DNA, 15 bp, Homo sapiens
cagtgaggtgcccag

SEQ ID NO: 509117 - DNA, 17 bp, Homo sapiens
cagtgatcaaagtccga

SEQ ID NO: 509118 - DNA, 14 bp, Homo sapiens
cagtgcaacctctg

SEQ ID NO: 509119 - DNA, 21 bp, Homo sapiens
cagtgcaacctctgcttccca

SEQ ID NO: 509120 - DNA, 20 bp, Homo sapiens
cagtggggctctctgagtcc

SEQ ID NO: 509121 - DNA, 19 bp, Homo sapiens
cagttgatttttcttattt

SEQ ID NO: 509122 - DNA, 14 bp, Homo sapiens
cagtttttcacttc

SEQ ID NO: 509123 - DNA, 16 bp, Homo sapiens
cataacattgatgact

SEQ ID NO: 509124 - DNA, 21 bp, Homo sapiens
cataagcattgctcaagagga

SEQ ID NO: 509125 - DNA, 23 bp, Homo sapiens
cataatagacttcccactctagg

SEQ ID NO: 509126 - DNA, 14 bp, Homo sapiens
catattgttattat

SEQ ID NO: 509127 - DNA, 23 bp, Homo sapiens
catatttgtatgtttttctgtat

SEQ ID NO: 509128 - DNA, 15 bp, Homo sapiens
catattttaaattct

SEQ ID NO: 509129 - DNA, 12 bp, Homo sapiens
catcctgcaggc

SEQ ID NO: 509130 - DNA, 21 bp, Homo sapiens
gccatgggcacaaagggccca

SEQ ID NO: 509131 - DNA, 16 bp, Homo sapiens
gcccacagcaggtgct

SEQ ID NO: 509132 - DNA, 15 bp, Homo sapiens
gcccacgtagggcgg

SEQ ID NO: 509133 - DNA, 16 bp, Homo sapiens
gcccacgtagggcggc

SEQ ID NO: 509134 - DNA, 16 bp, Homo sapiens
gcccagtttcagggct

SEQ ID NO: 509135 - DNA, 17 bp, Homo sapiens
gcccagtttcagggcta

SEQ ID NO: 509136 - DNA, 18 bp, Homo sapiens
gcccgcagacctctggat

SEQ ID NO: 509137 - DNA, 21 bp, Homo sapiens
gcctccaggccacatggggct

SEQ ID NO: 509138 - DNA, 22 bp, Homo sapiens
gcctccaggccacatggggctg

SEQ ID NO: 509139 - DNA, 16 bp, Homo sapiens
gcctgggtccagggga

SEQ ID NO: 509140 - DNA, 19 bp, Homo sapiens
gcctgtagaatagcctgtg

SEQ ID NO: 509141 - DNA, 22 bp, Homo sapiens
gcctgtagaatagcctgtggcc

SEQ ID NO: 509142 - DNA, 22 bp, Homo sapiens
gccttttccttctggttctaac

SEQ ID NO: 509143 - DNA, 21 bp, Homo sapiens
gcgaatctagaggagggggca

SEQ ID NO: 509144 - DNA, 14 bp, Homo sapiens
gcgggacccaggca

SEQ ID NO: 509145 - DNA, 17 bp, Homo sapiens
gctactataaatataca

SEQ ID NO: 509146 - DNA, 20 bp, Homo sapiens
gctatgctcaggggccctgg

SEQ ID NO: 509147 - DNA, 17 bp, Homo sapiens
gctcagtgcaacctctg

SEQ ID NO: 509148 - DNA, 19 bp, Homo sapiens
gctcagtgcaacctctgct

SEQ ID NO: 509149 - DNA, 14 bp, Homo sapiens
gctcccgtggcctg

SEQ ID NO: 509150 - DNA, 18 bp, Homo sapiens
gctctctgagtcctggcc

SEQ ID NO: 509151 - DNA, 18 bp, Homo sapiens
gctctgcagcccagggac

SEQ ID NO: 509152 - DNA, 19 bp, Homo sapiens
gctctgcagcccagggacc

SEQ ID NO: 509153 - DNA, 16 bp, Homo sapiens
gctgagggtcgtggga

SEQ ID NO: 509154 - DNA, 17 bp, Homo sapiens
gctgcccacagcaggcc

SEQ ID NO: 509155 - DNA, 12 bp, Homo sapiens
gctgcccctctc

SEQ ID NO: 509156 - DNA, 19 bp, Homo sapiens
gctgcccctctctgggcct

SEQ ID NO: 509157 - DNA, 21 bp, Homo sapiens
gctgcgaatctagaggagggg

SEQ ID NO: 509158 - DNA, 13 bp, Homo sapiens
gctgtgtgacctt

SEQ ID NO: 509159 - DNA, 17 bp, Homo sapiens
gctgtgtttgagctctg

SEQ ID NO: 509160 - DNA, 16 bp, Homo sapiens
gcttctattagccagt

SEQ ID NO: 509161 - DNA, 13 bp, Homo sapiens
gcttgcctgcagg

SEQ ID NO: 509162 - DNA, 22 bp, Homo sapiens
gcttggtggatgaaatgtcagt

SEQ ID NO: 509163 - DNA, 11 bp, Homo sapiens
ggaaaggggag

SEQ ID NO: 509164 - DNA, 17 bp, Homo sapiens
ggaccaaggagatgaag

SEQ ID NO: 509165 - DNA, 20 bp, Homo sapiens
ggacgaagaagagccacagt

SEQ ID NO: 509166 - DNA, 17 bp, Homo sapiens
ggagccctggagacccc

SEQ ID NO: 509167 - DNA, 15 bp, Homo sapiens
ggagctgcccctctc

SEQ ID NO: 509168 - DNA, 22 bp, Homo sapiens
ggaggctatgctcaggggccct

SEQ ID NO: 509169 - DNA, 22 bp, Homo sapiens
ggagggagagtctcccagggag

SEQ ID NO: 509170 - DNA, 18 bp, Homo sapiens
ggatccctctgggcactg

SEQ ID NO: 509171 - DNA, 12 bp, Homo sapiens
ggcaggctgagg

SEQ ID NO: 509172 - DNA, 18 bp, Homo sapiens
ggcagggacctaaaggga

SEQ ID NO: 509173 - DNA, 20 bp, Homo sapiens
ggcagtggagtcggaagggc

SEQ ID NO: 509174 - DNA, 20 bp, Homo sapiens
ggcatccttcctcacaccag

SEQ ID NO: 509175 - DNA, 19 bp, Homo sapiens
ggccacatggggctgggca

SEQ ID NO: 509176 - DNA, 22 bp, Homo sapiens
ggcccacgtagggcggcactca

SEQ ID NO: 509177 - DNA, 23 bp, Homo sapiens
ggcctggcccacagcaggtgctg

SEQ ID NO: 509178 - DNA, 16 bp, Homo sapiens
ggcgggacccaggcac

SEQ ID NO: 509179 - DNA, 22 bp, Homo sapiens
ggctcagggaggttaagtgact

SEQ ID NO: 509180 - DNA, 21 bp, Homo sapiens
ggctcagtgcaacctctgctt

SEQ ID NO: 509181 - DNA, 16 bp, Homo sapiens
ggctccccagtacacc

SEQ ID NO: 509182 - DNA, 16 bp, Homo sapiens
ggctcccgtggcctgt

SEQ ID NO: 509183 - DNA, 14 bp, Homo sapiens
ggcttgcctgcagg

SEQ ID NO: 509184 - DNA, 15 bp, Homo sapiens
gggaacactgagaaa

SEQ ID NO: 509185 - DNA, 18 bp, Homo sapiens
gggacccaggcacctgca

SEQ ID NO: 509186 - DNA, 21 bp, Homo sapiens
gggacgaagaagagccacagt

SEQ ID NO: 509187 - DNA, 17 bp, Homo sapiens
gggcacaaagggcccag

SEQ ID NO: 509188 - DNA, 12 bp, Homo sapiens
gggcaggctgag

SEQ ID NO: 509189 - DNA, 21 bp, Homo sapiens
gggcaggctgagggtcgtggg

SEQ ID NO: 509190 - DNA, 18 bp, Homo sapiens
ggggccctggagcagcca

SEQ ID NO: 509191 - DNA, 22 bp, Homo sapiens
gggggaacactgagaaagaggc

SEQ ID NO: 509192 - DNA, 13 bp, Homo sapiens
gggtcgtgggaaa

SEQ ID NO: 509193 - DNA, 19 bp, Homo sapiens
gggtcgtgggaaaggggag

SEQ ID NO: 509194 - DNA, 20 bp, Homo sapiens
gggtcgtgggaaaggggagt

SEQ ID NO: 509195 - DNA, 15 bp, Homo sapiens
ggtctattgtctgta

SEQ ID NO: 509196 - DNA, 17 bp, Homo sapiens
ggtctattgtctgtatt

SEQ ID NO: 509197 - DNA, 21 bp, Homo sapiens
ggtgcctaggattgtgcctgt

SEQ ID NO: 509198 - DNA, 20 bp, Homo sapiens
tctcgaactcctaacctcaa

SEQ ID NO: 509199 - DNA, 12 bp, Homo sapiens
tctctgacctac

SEQ ID NO: 509200 - DNA, 15 bp, Homo sapiens
tctctgggcctcaga

SEQ ID NO: 509201 - DNA, 15 bp, Homo sapiens
tctgaactggagcca

SEQ ID NO: 509202 - DNA, 21 bp, Homo sapiens
tctgcactctaaccctaggca

SEQ ID NO: 509203 - DNA, 15 bp, Homo sapiens
tctgcagcccaggga

SEQ ID NO: 509204 - DNA, 19 bp, Homo sapiens
tctgccaccaaaggccagg

SEQ ID NO: 509205 - DNA, 13 bp, Homo sapiens
tctgcttcccagg

SEQ ID NO: 509206 - DNA, 14 bp, Homo sapiens
tctgcttcccaggt

SEQ ID NO: 509207 - DNA, 22 bp, Homo sapiens
tctggtgagcgaggacattctc

SEQ ID NO: 509208 - DNA, 15 bp, Homo sapiens
tctgttaatttagta

SEQ ID NO: 509209 - DNA, 16 bp, Homo sapiens
tcttgttaagtgcagt

SEQ ID NO: 509210 - DNA, 22 bp, Homo sapiens
tctttaggggaagtaaaacagt

SEQ ID NO: 509211 - DNA, 22 bp, Homo sapiens
tctttgagtcaatagcttgtct

SEQ ID NO: 509212 - DNA, 13 bp, Homo sapiens
tgaaaatgtacat

SEQ ID NO: 509213 - DNA, 15 bp, Homo sapiens
tgaaataattttcaa

SEQ ID NO: 509214 - DNA, 16 bp, Homo sapiens
tgaaatatacacacag

SEQ ID NO: 509215 - DNA, 19 bp, Homo sapiens
tgaaatgcagagtcaatga

SEQ ID NO: 509216 - DNA, 20 bp, Homo sapiens
tgaacacttttgaaaatgta

SEQ ID NO: 509217 - DNA, 13 bp, Homo sapiens
tgaagcaaacaca

SEQ ID NO: 509218 - DNA, 15 bp, Homo sapiens
tgaagcaaacacatt

SEQ ID NO: 509219 - DNA, 18 bp, Homo sapiens
tgaagcctgaacccaaga

SEQ ID NO: 509220 - DNA, 21 bp, Homo sapiens
tgaagtgttccctttttcata

SEQ ID NO: 509221 - DNA, 16 bp, Homo sapiens
tgaatcacctaggggt

SEQ ID NO: 509222 - DNA, 19 bp, Homo sapiens
tgaatcatggtttttctta

SEQ ID NO: 509223 - DNA, 14 bp, Homo sapiens
tgacaaagaagacc

SEQ ID NO: 509224 - DNA, 23 bp, Homo sapiens
tgacactcaataaacagtcactg

SEQ ID NO: 509225 - DNA, 17 bp, Homo sapiens
tgaccttccaaagacta

SEQ ID NO: 509226 - DNA, 14 bp, Homo sapiens
tgagacagagcctc

SEQ ID NO: 509227 - DNA, 14 bp, Homo sapiens
tgagggagatccca

SEQ ID NO: 509228 - DNA, 15 bp, Homo sapiens
tgagtcctggcccaa

SEQ ID NO: 509229 - DNA, 17 bp, Homo sapiens
tgagttttgtttcactt

SEQ ID NO: 509230 - DNA, 22 bp, Homo sapiens
tgatagggagttttaaagaaat

SEQ ID NO: 509231 - DNA, 20 bp, Homo sapiens
tgatcaaagtccgaggggcg

SEQ ID NO: 509232 - DNA, 18 bp, Homo sapiens
tgcaacctctgcttccca

SEQ ID NO: 509233 - DNA, 22 bp, Homo sapiens
tgcactctaaccctaggcatca

SEQ ID NO: 509234 - DNA, 23 bp, Homo sapiens
tgcagtggtgcgatctcggctca

SEQ ID NO: 509235 - DNA, 15 bp, Homo sapiens
tgcatatgtatgact

SEQ ID NO: 509236 - DNA, 14 bp, Homo sapiens
tgcattcccagctc

SEQ ID NO: 509237 - DNA, 18 bp, Homo sapiens
tgccaccaaaggccaggg

SEQ ID NO: 509238 - DNA, 14 bp, Homo sapiens
tgcccagctagctg

SEQ ID NO: 509239 - DNA, 20 bp, Homo sapiens
tgcccagctagctgcagagc

SEQ ID NO: 509240 - DNA, 14 bp, Homo sapiens
tgcccctctctggg

SEQ ID NO: 509241 - DNA, 12 bp, Homo sapiens
tgccctcttcat

SEQ ID NO: 509242 - DNA, 18 bp, Homo sapiens
tgcctaggattgtgcctg

SEQ ID NO: 509243 - DNA, 17 bp, Homo sapiens
tgcctcagcctcccgag

SEQ ID NO: 509244 - DNA, 18 bp, Homo sapiens
tgctcaatgactctctgg

SEQ ID NO: 509245 - DNA, 14 bp, Homo sapiens
tgcttaatgaaaag

SEQ ID NO: 509246 - DNA, 19 bp, Homo sapiens
tgctttaattgttaagata

SEQ ID NO: 509247 - DNA, 20 bp, Homo sapiens
tggagaagagagaggaaagg

SEQ ID NO: 509248 - DNA, 13 bp, Homo sapiens
tggagcagccacc

SEQ ID NO: 509249 - DNA, 16 bp, Homo sapiens
tggagccctggagacc

SEQ ID NO: 509250 - DNA, 13 bp, Homo sapiens
tggattaggtctc

SEQ ID NO: 509251 - DNA, 20 bp, Homo sapiens
tgggaaaggggagtaggtgg

SEQ ID NO: 509252 - DNA, 18 bp, Homo sapiens
tgggggaacactgagaaa

SEQ ID NO: 509253 - DNA, 19 bp, Homo sapiens
tgggggaacactgagaaag

SEQ ID NO: 509254 - DNA, 21 bp, Homo sapiens
tgggggaacactgagaaagag

SEQ ID NO: 509255 - DNA, 23 bp, Homo sapiens
tgggggggctcccgtggcctgta

SEQ ID NO: 509256 - DNA, 11 bp, Homo sapiens
tggttctaact

SEQ ID NO: 509257 - DNA, 13 bp, Homo sapiens
tgtaattgacact

SEQ ID NO: 509258 - DNA, 16 bp, Homo sapiens
tgtataagtccttgca

SEQ ID NO: 509259 - DNA, 15 bp, Homo sapiens
tgtatgtttttctgt

SEQ ID NO: 509260 - DNA, 16 bp, Homo sapiens
tgtatgtttttctgta

SEQ ID NO: 509261 - DNA, 13 bp, Homo sapiens
tgtatttttcaga

SEQ ID NO: 509262 - DNA, 19 bp, Homo sapiens
tgtcagtggggctctctga

SEQ ID NO: 509263 - DNA, 17 bp, Homo sapiens
tgtgacccagcactgcc

SEQ ID NO: 509264 - DNA, 20 bp, Homo sapiens
tgtgacccagcactgcccaa

SEQ ID NO: 509265 - DNA, 21 bp, Homo sapiens
tgtgtcagtggggctctctga

SEQ ID NO: 509266 - DNA, 20 bp, Homo sapiens
tgttactgtatttttcagaa

SEQ ID NO: 509267 - DNA, 17 bp, Homo sapiens
tgttccagcctgccctc

SEQ ID NO: 509268 - DNA, 13 bp, Homo sapiens
ttaacttactttt

SEQ ID NO: 509269 - DNA, 18 bp, Homo sapiens
ttaataaaataattctca

SEQ ID NO: 509270 - DNA, 18 bp, Homo sapiens
ttaatatatcattatctt

SEQ ID NO: 509271 - DNA, 16 bp, Homo sapiens
ttaatgggcacaaaat

SEQ ID NO: 509272 - DNA, 12 bp, Homo sapiens
ttaattacagaa

SEQ ID NO: 509273 - DNA, 13 bp, Homo sapiens
ttaatttagtaaa

SEQ ID NO: 509274 - DNA, 22 bp, Homo sapiens
ttacagaagagtttcttaactt

SEQ ID NO: 509275 - DNA, 17 bp, Homo sapiens
ttacatttaaaagacag

SEQ ID NO: 509276 - DNA, 18 bp, Homo sapiens
ttactgtatttttcagaa

SEQ ID NO: 509277 - DNA, 20 bp, Homo sapiens
ttactgtatttttcagaaat

SEQ ID NO: 509278 - DNA, 24 bp, Homo sapiens
ttaggggaagtaaaacagtcatct

SEQ ID NO: 509279 - DNA, 16 bp, Homo sapiens
ttaggtctctgttgac

SEQ ID NO: 509280 - DNA, 15 bp, Homo sapiens
ttatgaaaagtacta

SEQ ID NO: 509281 - DNA, 17 bp, Homo sapiens
ttatgtaataatgtgaa

SEQ ID NO: 509282 - DNA, 20 bp, Homo sapiens
ttatgttactgtatttttca

SEQ ID NO: 509283 - DNA, 21 bp, Homo sapiens
ttattatggtcatatttcaca

SEQ ID NO: 509284 - DNA, 20 bp, Homo sapiens
ttcacaaatagttgtaaata

SEQ ID NO: 509285 - DNA, 22 bp, Homo sapiens
ttcactgagttttgtttcactt

SEQ ID NO: 509286 - DNA, 13 bp, Homo sapiens
ttcagtttttcac

SEQ ID NO: 509287 - DNA, 15 bp, Homo sapiens
ttcagtttttcactt

SEQ ID NO: 509288 - DNA, 16 bp, Homo sapiens
ttcagtttttcacttc

SEQ ID NO: 509289 - DNA, 18 bp, Homo sapiens
ttcatgtaataaacaggt

SEQ ID NO: 509290 - DNA, 15 bp, Homo sapiens
ttccagtgcaacact

SEQ ID NO: 509291 - DNA, 19 bp, Homo sapiens
ttccagtgcaacactgaag

SEQ ID NO: 509292 - DNA, 21 bp, Homo sapiens
ttcccaaccccttaagccctg

SEQ ID NO: 509293 - DNA, 21 bp, Homo sapiens
ttcctcacaccaggcttgcct

SEQ ID NO: 509294 - DNA, 18 bp, Homo sapiens
ttccttctggttctaact

SEQ ID NO: 509295 - DNA, 15 bp, Homo sapiens
ttcctttgtaattga

SEQ ID NO: 509296 - DNA, 23 bp, Homo sapiens
ttctaaccttcacgattaactgt

SEQ ID NO: 509297 - DNA, 14 bp, Homo sapiens
ttctaaggaatatg

SEQ ID NO: 509298 - DNA, 24 bp, Homo sapiens
ttctcataagtagcattcatgtaa

SEQ ID NO: 509299 - DNA, 15 bp, Homo sapiens
ttctgtctctctctt

SEQ ID NO: 509300 - DNA, 21 bp, Homo sapiens
ttctttccctgcttaatgaaa

SEQ ID NO: 509301 - DNA, 18 bp, Homo sapiens
ttgctttaattgttaaga

SEQ ID NO: 509302 - DNA, 20 bp, Homo sapiens
ttgtccacttcattttgtat

SEQ ID NO: 509303 - DNA, 17 bp, Homo sapiens
ttgttaagatatgatgt

SEQ ID NO: 509304 - DNA, 18 bp, Homo sapiens
tttacaagagaagaaagt

SEQ ID NO: 509305 - DNA, 18 bp, Homo sapiens
tttagtttgttcttcaga

SEQ ID NO: 509306 - DNA, 12 bp, Homo sapiens
tttcagaaatca

SEQ ID NO: 509307 - DNA, 22 bp, Homo sapiens
tttcagggctaacgaccacagg

SEQ ID NO: 509308 - DNA, 19 bp, Homo sapiens
tttccttctggttctaact

SEQ ID NO: 509309 - DNA, 22 bp, Homo sapiens
tttctaaccttcacgattaact

SEQ ID NO: 509310 - DNA, 20 bp, Homo sapiens
acctcaagtgatcctcccac

SEQ ID NO: 509311 - DNA, 15 bp, Homo sapiens
acctctgcttcccag

SEQ ID NO: 509312 - DNA, 19 bp, Homo sapiens
acctgatacggctccccag

SEQ ID NO: 509313 - DNA, 17 bp, Homo sapiens
acctgtatatttctttt

SEQ ID NO: 509314 - DNA, 17 bp, Homo sapiens
acgaagaagagccacag

SEQ ID NO: 509315 - DNA, 17 bp, Homo sapiens
acgaccacagggtctgc

SEQ ID NO: 509316 - DNA, 23 bp, Homo sapiens
acgcgaaagtatcaccagggtgc

SEQ ID NO: 509317 - DNA, 14 bp, Homo sapiens
actaaaattatgtt

SEQ ID NO: 509318 - DNA, 19 bp, Homo sapiens
actaaaattatgttactgt

SEQ ID NO: 509319 - DNA, 14 bp, Homo sapiens
actaatagaacttg

SEQ ID NO: 509320 - DNA, 15 bp, Homo sapiens
actaatagaacttgt

SEQ ID NO: 509321 - DNA, 17 bp, Homo sapiens
actataaatatacatat

SEQ ID NO: 509322 - DNA, 11 bp, Homo sapiens
actattttatt

SEQ ID NO: 509323 - DNA, 17 bp, Homo sapiens
actattttattttctaa

SEQ ID NO: 509324 - DNA, 16 bp, Homo sapiens
actcacctctaaaaca

SEQ ID NO: 509325 - DNA, 21 bp, Homo sapiens
actctaactgtgacaaagaag

SEQ ID NO: 509326 - DNA, 18 bp, Homo sapiens
actctcgcatcttcccaa

SEQ ID NO: 509327 - DNA, 15 bp, Homo sapiens
actgaaatatacaca

SEQ ID NO: 509328 - DNA, 16 bp, Homo sapiens
actgaaatatacacac

SEQ ID NO: 509329 - DNA, 17 bp, Homo sapiens
actgaaatatacacaca

SEQ ID NO: 509330 - DNA, 12 bp, Homo sapiens
actgagaaagag

SEQ ID NO: 509331 - DNA, 15 bp, Homo sapiens
actggagccatgggc

SEQ ID NO: 509332 - DNA, 18 bp, Homo sapiens
actgtccccttgaaggag

SEQ ID NO: 509333 - DNA, 17 bp, Homo sapiens
gggagcatgagaggagg

SEQ ID NO: 509334 - DNA, 13 bp, Homo sapiens
gggccctggagca

SEQ ID NO: 509335 - DNA, 21 bp, Homo sapiens
gggccctggagcagccacccc

SEQ ID NO: 509336 - DNA, 17 bp, Homo sapiens
gggcgggacccaggcac

SEQ ID NO: 509337 - DNA, 14 bp, Homo sapiens
ggggcaggctgagg

SEQ ID NO: 509338 - DNA, 12 bp, Homo sapiens
ggtcatatttca

SEQ ID NO: 509339 - DNA, 16 bp, Homo sapiens
ggtcgtgggaaagggg

SEQ ID NO: 509340 - DNA, 22 bp, Homo sapiens
ggttcacaggcgaggcctggag

SEQ ID NO: 509341 - DNA, 14 bp, Homo sapiens
gtaaaacagtcatc

SEQ ID NO: 509342 - DNA, 20 bp, Homo sapiens
gtaaacactccacattcttc

SEQ ID NO: 509343 - DNA, 14 bp, Homo sapiens
gtacaccccacctc

SEQ ID NO: 509344 - DNA, 17 bp, Homo sapiens
gtacaccccacctcttc

SEQ ID NO: 509345 - DNA, 15 bp, Homo sapiens
gtagcagtagatgca

SEQ ID NO: 509346 - DNA, 22 bp, Homo sapiens
gtataacagccttttccttctg

SEQ ID NO: 509347 - DNA, 23 bp, Homo sapiens
gtataagtccttgcaagaatcag

SEQ ID NO: 509348 - DNA, 16 bp, Homo sapiens
gtatgtttttctgtat

SEQ ID NO: 509349 - DNA, 11 bp, Homo sapiens
gtcaagcactc

SEQ ID NO: 509350 - DNA, 15 bp, Homo sapiens
gtcactgaaggcctg

SEQ ID NO: 509351 - DNA, 21 bp, Homo sapiens
gtcactgaaggcctggcccac

SEQ ID NO: 509352 - DNA, 18 bp, Homo sapiens
gtcagtggggctctctga

SEQ ID NO: 509353 - DNA, 18 bp, Homo sapiens
gtccaggggaggccttcc

SEQ ID NO: 509354 - DNA, 22 bp, Homo sapiens
gtctgcactctaaccctaggca

SEQ ID NO: 509355 - DNA, 20 bp, Homo sapiens
gtcttgttaagtgcagtctg

SEQ ID NO: 509356 - DNA, 16 bp, Homo sapiens
gtgaagcaatttgaaa

SEQ ID NO: 509357 - DNA, 17 bp, Homo sapiens
gtgagcagcctggagcc

SEQ ID NO: 509358 - DNA, 14 bp, Homo sapiens
gtgaggtgcccagc

SEQ ID NO: 509359 - DNA, 13 bp, Homo sapiens
gtgcaacctctgc

SEQ ID NO: 509360 - DNA, 17 bp, Homo sapiens
gtgcaacctctgcttcc

SEQ ID NO: 509361 - DNA, 18 bp, Homo sapiens
gtgcaccaccacacccgg

SEQ ID NO: 509362 - DNA, 18 bp, Homo sapiens
gtgcgatctcggctcagt

SEQ ID NO: 509363 - DNA, 19 bp, Homo sapiens
gtggagtgcagtggtgcga

SEQ ID NO: 509364 - DNA, 15 bp, Homo sapiens
gttactgtatttttc

SEQ ID NO: 509365 - DNA, 17 bp, Homo sapiens
gttactgtatttttcag

SEQ ID NO: 509366 - DNA, 20 bp, Homo sapiens
gttcaagcgattctcctgcc

SEQ ID NO: 509367 - DNA, 13 bp, Homo sapiens
gttccagcctgcc

SEQ ID NO: 509368 - DNA, 22 bp, Homo sapiens
gttctgagattattttaatcta

SEQ ID NO: 509369 - DNA, 19 bp, Homo sapiens
gttgaatccagcacgtctg

SEQ ID NO: 509370 - DNA, 22 bp, Homo sapiens
gtttcaccatgatggccaggct

SEQ ID NO: 509371 - DNA, 19 bp, Homo sapiens
gttttaaagaaattttagt

SEQ ID NO: 509372 - DNA, 13 bp, Homo sapiens
taaaacagtcatc

SEQ ID NO: 509373 - DNA, 22 bp, Homo sapiens
taaaacagtcatctagaattca

SEQ ID NO: 509374 - DNA, 17 bp, Homo sapiens
taaaacattttcacaca

SEQ ID NO: 509375 - DNA, 13 bp, Homo sapiens
taaaactttttat

SEQ ID NO: 509376 - DNA, 17 bp, Homo sapiens
taaaagttattaatatt

SEQ ID NO: 509377 - DNA, 19 bp, Homo sapiens
taaaattatgttactgtat

SEQ ID NO: 509378 - DNA, 16 bp, Homo sapiens
taaactaaaaatttac

SEQ ID NO: 509379 - DNA, 20 bp, Homo sapiens
taaagggactacctctgtgc

SEQ ID NO: 509380 - DNA, 22 bp, Homo sapiens
taaagggactacctctgtgcct

SEQ ID NO: 509381 - DNA, 21 bp, Homo sapiens
taaataaaacattttcacaca

SEQ ID NO: 509382 - DNA, 16 bp, Homo sapiens
taaatagcactttttg

SEQ ID NO: 509383 - DNA, 17 bp, Homo sapiens
taacaagctcccaggcc

SEQ ID NO: 509384 - DNA, 15 bp, Homo sapiens
taacagccttttcct

SEQ ID NO: 509385 - DNA, 11 bp, Homo sapiens
taaccacccca

SEQ ID NO: 509386 - DNA, 19 bp, Homo sapiens
taacctcaagtgatcctcc

SEQ ID NO: 509387 - DNA, 22 bp, Homo sapiens
taacctcaagtgatcctcccac

SEQ ID NO: 509388 - DNA, 19 bp, Homo sapiens
taacctttctaaccttcac

SEQ ID NO: 509389 - DNA, 21 bp, Homo sapiens
taacgggacagtaaacactcc

SEQ ID NO: 509390 - DNA, 18 bp, Homo sapiens
taactgtgacaaagaaga

SEQ ID NO: 509391 - DNA, 22 bp, Homo sapiens
taacttaaaaaactgcatccca

SEQ ID NO: 509392 - DNA, 15 bp, Homo sapiens
taacttgcacctctg

SEQ ID NO: 509393 - DNA, 23 bp, Homo sapiens
taagactcgcggcaggttctctt

SEQ ID NO: 509394 - DNA, 17 bp, Homo sapiens
taagcattgctcaagag

SEQ ID NO: 509395 - DNA, 13 bp, Homo sapiens
taagccctggccc

SEQ ID NO: 509396 - DNA, 19 bp, Homo sapiens
taagtagatgaaacattaa

SEQ ID NO: 509397 - DNA, 13 bp, Homo sapiens
taagtagcattca

SEQ ID NO: 509398 - DNA, 13 bp, Homo sapiens
taataatgtgaat

SEQ ID NO: 509399 - DNA, 12 bp, Homo sapiens
taatagaacttg

SEQ ID NO: 509400 - DNA, 15 bp, Homo sapiens
taatagaacttgtta

SEQ ID NO: 509401 - DNA, 18 bp, Homo sapiens
taatatatcattatcttt

SEQ ID NO: 509402 - DNA, 15 bp, Homo sapiens
taattacagaagagt

SEQ ID NO: 509403 - DNA, 24 bp, Homo sapiens
taatttagtaaataaacaagtcaa

SEQ ID NO: 509404 - DNA, 12 bp, Homo sapiens
tacaagtagatc

SEQ ID NO: 509405 - DNA, 21 bp, Homo sapiens
tacagaatgcggcctctgaga

SEQ ID NO: 509406 - DNA, 16 bp, Homo sapiens
tacagataacttcttt

SEQ ID NO: 509407 - DNA, 13 bp, Homo sapiens
tacatatttgtat

SEQ ID NO: 509408 - DNA, 14 bp, Homo sapiens
tacatgtaatgaca

SEQ ID NO: 509409 - DNA, 14 bp, Homo sapiens
tacctacatatttg

SEQ ID NO: 509410 - DNA, 12 bp, Homo sapiens
tacctctgtgcc

SEQ ID NO: 509411 - DNA, 13 bp, Homo sapiens
tacctctgtgcct

SEQ ID NO: 509412 - DNA, 18 bp, Homo sapiens
tactaaaattatgttact

SEQ ID NO: 509413 - DNA, 15 bp, Homo sapiens
tactgtatttttcag

SEQ ID NO: 509414 - DNA, 15 bp, Homo sapiens
tagaattcactgagt

SEQ ID NO: 509415 - DNA, 19 bp, Homo sapiens
tagatgaaacattaactct

SEQ ID NO: 509416 - DNA, 17 bp, Homo sapiens
tagttactaaaattatg

SEQ ID NO: 509417 - DNA, 18 bp, Homo sapiens
tagtttgttcttcagatt

SEQ ID NO: 509418 - DNA, 16 bp, Homo sapiens
tatacctaactgaata

SEQ ID NO: 509419 - DNA, 21 bp, Homo sapiens
tatattttatacattaacttc

SEQ ID NO: 509420 - DNA, 14 bp, Homo sapiens
tatctttgctgtta

SEQ ID NO: 509421 - DNA, 14 bp, Homo sapiens
tatcttttaattac

SEQ ID NO: 509422 - DNA, 16 bp, Homo sapiens
tatcttttaattacag

SEQ ID NO: 509423 - DNA, 16 bp, Homo sapiens
tatgactcccaaattt

SEQ ID NO: 509424 - DNA, 22 bp, Homo sapiens
tatggaagcatattgttattat

SEQ ID NO: 509425 - DNA, 18 bp, Homo sapiens
tatggtcatatttcacag

SEQ ID NO: 509426 - DNA, 15 bp, Homo sapiens
tatgtaataatgtga

SEQ ID NO: 509427 - DNA, 21 bp, Homo sapiens
tatgttactgtatttttcaga

SEQ ID NO: 509428 - DNA, 23 bp, Homo sapiens
tatgtttttctgtataacagcct

SEQ ID NO: 509429 - DNA, 18 bp, Homo sapiens
tattaagtagatgaaaca

SEQ ID NO: 509430 - DNA, 12 bp, Homo sapiens
tattatctaaca

SEQ ID NO: 509431 - DNA, 20 bp, Homo sapiens
tcaagcaaagtattgtgaaa

SEQ ID NO: 509432 - DNA, 23 bp, Homo sapiens
tcaagcaaagtattgtgaaagta

SEQ ID NO: 509433 - DNA, 16 bp, Homo sapiens
tcaagcgattctcctg

SEQ ID NO: 509434 - DNA, 15 bp, Homo sapiens
tcaataaacagtcac

SEQ ID NO: 509435 - DNA, 19 bp, Homo sapiens
tcacaaatagttgtaaata

SEQ ID NO: 509436 - DNA, 18 bp, Homo sapiens
tcacaggcgaggcctgga

SEQ ID NO: 509437 - DNA, 21 bp, Homo sapiens
tcaccatgatggccaggctga

SEQ ID NO: 509438 - DNA, 20 bp, Homo sapiens
tcacctgtatatttctttta

SEQ ID NO: 509439 - DNA, 16 bp, Homo sapiens
tcactgaaggcctggc

SEQ ID NO: 509440 - DNA, 21 bp, Homo sapiens
tcactgagttttgtttcactt

SEQ ID NO: 509441 - DNA, 21 bp, Homo sapiens
tcacttctacctacatatttg

SEQ ID NO: 509442 - DNA, 20 bp, Homo sapiens
tcagcctcccgagtagctgg

SEQ ID NO: 509443 - DNA, 23 bp, Homo sapiens
tcaggaggaaggcttacacccac

SEQ ID NO: 509444 - DNA, 18 bp, Homo sapiens
tcaggggccctggagcag

SEQ ID NO: 509445 - DNA, 14 bp, Homo sapiens
tcagtgcaaagatt

SEQ ID NO: 509446 - DNA, 17 bp, Homo sapiens
tcagtgcaacctctgct

SEQ ID NO: 509447 - DNA, 16 bp, Homo sapiens
tcagtggaagaagcag

SEQ ID NO: 509448 - DNA, 16 bp, Homo sapiens
tcagtggggctctctg

SEQ ID NO: 509449 - DNA, 17 bp, Homo sapiens
tcagtggggctctctga

SEQ ID NO: 509450 - DNA, 20 bp, Homo sapiens
tcagttgatttttcttattt

SEQ ID NO: 509451 - DNA, 16 bp, Homo sapiens
tcagtttttcacttct

SEQ ID NO: 509452 - DNA, 14 bp, Homo sapiens
tcatagcacttccc

SEQ ID NO: 509453 - DNA, 18 bp, Homo sapiens
tcatatttcacagcacca

SEQ ID NO: 509454 - DNA, 22 bp, Homo sapiens
tcatatttcacagcaccaaaat

SEQ ID NO: 509455 - DNA, 19 bp, Homo sapiens
tcatctttattaagtagat

SEQ ID NO: 509456 - DNA, 17 bp, Homo sapiens
tcatgtaataaacaggt

SEQ ID NO: 509457 - DNA, 15 bp, Homo sapiens
tcattatctttgctg

SEQ ID NO: 509458 - DNA, 16 bp, Homo sapiens
tccaaggcagaagcag

SEQ ID NO: 509459 - DNA, 15 bp, Homo sapiens
tccacattcttcagt

SEQ ID NO: 509460 - DNA, 16 bp, Homo sapiens
tccacttcattttgta

SEQ ID NO: 509461 - DNA, 17 bp, Homo sapiens
tccacttcattttgtat

SEQ ID NO: 509462 - DNA, 15 bp, Homo sapiens
tccatcagaatgaaa

SEQ ID NO: 509463 - DNA, 22 bp, Homo sapiens
tcccaaccccttaagccctggc

SEQ ID NO: 509464 - DNA, 22 bp, Homo sapiens
tcccacaatcttaaggggcagc

SEQ ID NO: 509465 - DNA, 22 bp, Homo sapiens
tcccactctagggcagtggagt

SEQ ID NO: 509466 - DNA, 22 bp, Homo sapiens
tcccagggagcatgagaggagg

SEQ ID NO: 509467 - DNA, 16 bp, Homo sapiens
tccctgtcggcctggt

SEQ ID NO: 509468 - DNA, 23 bp, Homo sapiens
tcccttttgcggatgggaggggt

SEQ ID NO: 509469 - DNA, 19 bp, Homo sapiens
tcctgacactcaataaaca

SEQ ID NO: 509470 - DNA, 22 bp, Homo sapiens
tcctgacactcaataaacagtc

SEQ ID NO: 509471 - DNA, 23 bp, Homo sapiens
tcctgactgtctcccgggactac

SEQ ID NO: 509472 - DNA, 18 bp, Homo sapiens
tcctgcctcagcctcccg

SEQ ID NO: 509473 - DNA, 20 bp, Homo sapiens
tcctgtgttttttctgccac

SEQ ID NO: 509474 - DNA, 19 bp, Homo sapiens
tcgcggcaggttctctttg

SEQ ID NO: 509475 - DNA, 19 bp, Homo sapiens
tcgctctgttacccagggt

SEQ ID NO: 509476 - DNA, 22 bp, Homo sapiens
tctaaccttcacgattaactgt

SEQ ID NO: 509477 - DNA, 16 bp, Homo sapiens
tctacctacatatttg

SEQ ID NO: 509478 - DNA, 15 bp, Homo sapiens
tctagaattcactga

SEQ ID NO: 509479 - DNA, 13 bp, Homo sapiens
tctagaggagggg

SEQ ID NO: 509480 - DNA, 21 bp, Homo sapiens
tctcataagtagcattcatgt

SEQ ID NO: 509481 - DNA, 13 bp, Homo sapiens
tctcatcctgcag

SEQ ID NO: 509482 - DNA, 14 bp, Homo sapiens
tctcctgcctcagc

SEQ ID NO: 509483 - DNA, 18 bp, Homo sapiens
tctcctgcctcagcctcc

SEQ ID NO: 509484 - DNA, 23 bp, Homo sapiens
tctcggctcagtgcaacctctgc

SEQ ID NO: 509485 - DNA, 14 bp, Homo sapiens
tctgaactggagcc

SEQ ID NO: 509486 - DNA, 20 bp, Homo sapiens
tctgaactggagccatgggc

SEQ ID NO: 509487 - DNA, 16 bp, Homo sapiens
tctgccaccaaaggcc

SEQ ID NO: 509488 - DNA, 17 bp, Homo sapiens
tctgtataacagccttt

SEQ ID NO: 509489 - DNA, 12 bp, Homo sapiens
tctgtctctctc

SEQ ID NO: 509490 - DNA, 13 bp, Homo sapiens
tctgttacccagg

SEQ ID NO: 509491 - DNA, 20 bp, Homo sapiens
tctttccctgcttaatgaaa

SEQ ID NO: 509492 - DNA, 16 bp, Homo sapiens
tcttttaattacagaa

SEQ ID NO: 509493 - DNA, 22 bp, Homo sapiens
tgaaaagtactaatagaacttg

SEQ ID NO: 509494 - DNA, 17 bp, Homo sapiens
tgaaaatgtacatgttc

SEQ ID NO: 509495 - DNA, 15 bp, Homo sapiens
tgaaacattaactct

SEQ ID NO: 509496 - DNA, 19 bp, Homo sapiens
tgaaacattaactctaact

SEQ ID NO: 509497 - DNA, 17 bp, Homo sapiens
tgaaatatacacacagc

SEQ ID NO: 509498 - DNA, 16 bp, Homo sapiens
tgaaatgtacgtcatt

SEQ ID NO: 509499 - DNA, 14 bp, Homo sapiens
tgaacccatatttt

SEQ ID NO: 509500 - DNA, 22 bp, Homo sapiens
tgaacccatattttaaattctc

SEQ ID NO: 509501 - DNA, 17 bp, Homo sapiens
tgaactcaatgatagca

SEQ ID NO: 509502 - DNA, 18 bp, Homo sapiens
tgaaggcctggcccacag

SEQ ID NO: 509503 - DNA, 19 bp, Homo sapiens
tgaagtgttccctttttca

SEQ ID NO: 509504 - DNA, 22 bp, Homo sapiens
tgaagtgttccctttttcataa

SEQ ID NO: 509505 - DNA, 15 bp, Homo sapiens
tgaatcacctagggg

SEQ ID NO: 509506 - DNA, 20 bp, Homo sapiens
tgacactatatatttcttaa

SEQ ID NO: 509507 - DNA, 18 bp, Homo sapiens
tgacactcaataaacagt

SEQ ID NO: 509508 - DNA, 18 bp, Homo sapiens
tgacctactcgagggact

SEQ ID NO: 509509 - DNA, 13 bp, Homo sapiens
tgacttgcccagt

SEQ ID NO: 509510 - DNA, 17 bp, Homo sapiens
tgagaaagaggcaggga

SEQ ID NO: 509511 - DNA, 11 bp, Homo sapiens
tgagaagtacc

SEQ ID NO: 509512 - DNA, 16 bp, Homo sapiens
tgagaggaggcagcag

SEQ ID NO: 509513 - DNA, 20 bp, Homo sapiens
tgagagtctgcacttaacaa

SEQ ID NO: 509514 - DNA, 15 bp, Homo sapiens
tgagattattttaat

SEQ ID NO: 509515 - DNA, 20 bp, Homo sapiens
tgagcaaagggaacagtgag

SEQ ID NO: 509516 - DNA, 13 bp, Homo sapiens
tgagcacattctg

SEQ ID NO: 509517 - DNA, 16 bp, Homo sapiens
tgagcagcctggagcc

SEQ ID NO: 509518 - DNA, 21 bp, Homo sapiens
tgagcagcctggagccctgga

SEQ ID NO: 509519 - DNA, 17 bp, Homo sapiens
tgagctgcccacagcag

SEQ ID NO: 509520 - DNA, 12 bp, Homo sapiens
tgagggaagctt

SEQ ID NO: 509521 - DNA, 22 bp, Homo sapiens
tgagggtcgtgggaaaggggag

SEQ ID NO: 509522 - DNA, 21 bp, Homo sapiens
tgaggtgcccagctagctgca

SEQ ID NO: 509523 - DNA, 13 bp, Homo sapiens
tgagtcctggccc

SEQ ID NO: 509524 - DNA, 18 bp, Homo sapiens
tgatctcgaactcctaac

SEQ ID NO: 509525 - DNA, 15 bp, Homo sapiens
tgatgggggaggggg

SEQ ID NO: 509526 - DNA, 19 bp, Homo sapiens
atttacagataacttcttt

SEQ ID NO: 509527 - DNA, 17 bp, Homo sapiens
atttagccaatgcttac

SEQ ID NO: 509528 - DNA, 14 bp, Homo sapiens
atttattttgtgaa

SEQ ID NO: 509529 - DNA, 15 bp, Homo sapiens
atttattttgtgaac

SEQ ID NO: 509530 - DNA, 23 bp, Homo sapiens
atttattttgtgaacacttttga

SEQ ID NO: 509531 - DNA, 14 bp, Homo sapiens
atttgaaataattt

SEQ ID NO: 509532 - DNA, 19 bp, Homo sapiens
atttgtatgtttttctgta

SEQ ID NO: 509533 - DNA, 19 bp, Homo sapiens
attttaaattctcataagt

SEQ ID NO: 509534 - DNA, 15 bp, Homo sapiens
attttatacattaac

SEQ ID NO: 509535 - DNA, 17 bp, Homo sapiens
attttcaagcaaagtat

SEQ ID NO: 509536 - DNA, 14 bp, Homo sapiens
attttgtataatca

SEQ ID NO: 509537 - DNA, 12 bp, Homo sapiens
caaagggcccag

SEQ ID NO: 509538 - DNA, 14 bp, Homo sapiens
caaagggcccagat

SEQ ID NO: 509539 - DNA, 20 bp, Homo sapiens
caaccccttaagccctggcc

SEQ ID NO: 509540 - DNA, 21 bp, Homo sapiens
caaccccttaagccctggccc

SEQ ID NO: 509541 - DNA, 17 bp, Homo sapiens
caacctctgcttcccag

SEQ ID NO: 509542 - DNA, 20 bp, Homo sapiens
caacctctgcttcccaggtt

SEQ ID NO: 509543 - DNA, 18 bp, Homo sapiens
caagaatcagtgcaaaga

SEQ ID NO: 509544 - DNA, 15 bp, Homo sapiens
caagatctgtgcagc

SEQ ID NO: 509545 - DNA, 13 bp, Homo sapiens
caaggagatgaag

SEQ ID NO: 509546 - DNA, 19 bp, Homo sapiens
caagtagatcctgagaagt

SEQ ID NO: 509547 - DNA, 15 bp, Homo sapiens
caataaacagtcact

SEQ ID NO: 509548 - DNA, 14 bp, Homo sapiens
caatgactctctgg

SEQ ID NO: 509549 - DNA, 16 bp, Homo sapiens
caattcgatatccgga

SEQ ID NO: 509550 - DNA, 22 bp, Homo sapiens
cacaccaggcttgcctgcaggc

SEQ ID NO: 509551 - DNA, 23 bp, Homo sapiens
cacagttgtgttcctgacactca

SEQ ID NO: 509552 - DNA, 13 bp, Homo sapiens
cacattaaattga

SEQ ID NO: 509553 - DNA, 20 bp, Homo sapiens
cacattctggctcagggagg

SEQ ID NO: 509554 - DNA, 14 bp, Homo sapiens
cacattcttcagtt

SEQ ID NO: 509555 - DNA, 13 bp, Homo sapiens
caccaccacaccc

SEQ ID NO: 509556 - DNA, 20 bp, Homo sapiens
caccaggcttgcctgcaggc

SEQ ID NO: 509557 - DNA, 21 bp, Homo sapiens
cacctaaacttacatttaaaa

SEQ ID NO: 509558 - DNA, 24 bp, Homo sapiens
cacctgccgtggacttggggtcag

SEQ ID NO: 509559 - DNA, 19 bp, Homo sapiens
cacctgtatatttctttta

SEQ ID NO: 509560 - DNA, 16 bp, Homo sapiens
cactgaaatatacaca

SEQ ID NO: 509561 - DNA, 18 bp, Homo sapiens
cactgaaggcctggccca

SEQ ID NO: 509562 - DNA, 17 bp, Homo sapiens
cactgcaccccgtctca

SEQ ID NO: 509563 - DNA, 20 bp, Homo sapiens
cactgcccaaagtgcttcca

SEQ ID NO: 509564 - DNA, 20 bp, Homo sapiens
cactgttccagcctgccctc

SEQ ID NO: 509565 - DNA, 12 bp, Homo sapiens
cacttttgaaaa

SEQ ID NO: 509566 - DNA, 19 bp, Homo sapiens
cagacattcacctgtatat

SEQ ID NO: 509567 - DNA, 16 bp, Homo sapiens
cagataacttctttag

SEQ ID NO: 509568 - DNA, 22 bp, Homo sapiens
cagattgatagggagttttaaa

SEQ ID NO: 509569 - DNA, 13 bp, Homo sapiens
cagcactgcccaa

SEQ ID NO: 509570 - DNA, 14 bp, Homo sapiens
cagcaggactgtcc

SEQ ID NO: 509571 - DNA, 18 bp, Homo sapiens
cagccaccccatgctggc

SEQ ID NO: 509572 - DNA, 19 bp, Homo sapiens
cagccaccccatgctggcc

SEQ ID NO: 509573 - DNA, 14 bp, Homo sapiens
cagcctggagccct

SEQ ID NO: 509574 - DNA, 13 bp, Homo sapiens
cagccttttcctt

SEQ ID NO: 509575 - DNA, 18 bp, Homo sapiens
cagcgatataattttatt

SEQ ID NO: 509576 - DNA, 18 bp, Homo sapiens
cagctattgatataaata

SEQ ID NO: 509577 - DNA, 15 bp, Homo sapiens
cagctctaccctgca

SEQ ID NO: 509578 - DNA, 22 bp, Homo sapiens
cagctgagcacattctggctca

SEQ ID NO: 509579 - DNA, 18 bp, Homo sapiens
cagcttctcatcctgcag

SEQ ID NO: 509580 - DNA, 21 bp, Homo sapiens
cagcttctcatcctgcaggca

SEQ ID NO: 509581 - DNA, 12 bp, Homo sapiens
caggccaggtcc

SEQ ID NO: 509582 - DNA, 22 bp, Homo sapiens
caggctgagggtcgtgggaaag

SEQ ID NO: 509583 - DNA, 15 bp, Homo sapiens
caggcttgcctgcag

SEQ ID NO: 509584 - DNA, 15 bp, Homo sapiens
cagggacctaaaggg

SEQ ID NO: 509585 - DNA, 23 bp, Homo sapiens
cagggacgaagaagagccacagt

SEQ ID NO: 509586 - DNA, 15 bp, Homo sapiens
caggggccctggagc

SEQ ID NO: 509587 - DNA, 18 bp, Homo sapiens
caggggccctggagcagc

SEQ ID NO: 509588 - DNA, 20 bp, Homo sapiens
cagggtggagtgcagtggtg

SEQ ID NO: 509589 - DNA, 16 bp, Homo sapiens
caggtccagagagacc

SEQ ID NO: 509590 - DNA, 22 bp, Homo sapiens
caggttcacaggcgaggcctgg

SEQ ID NO: 509591 - DNA, 12 bp, Homo sapiens
cagtcagcagtc

SEQ ID NO: 509592 - DNA, 15 bp, Homo sapiens
cagtgcaacctctgc

SEQ ID NO: 509593 - DNA, 19 bp, Homo sapiens
cagtggggctctctgagtc

SEQ ID NO: 509594 - DNA, 13 bp, Homo sapiens
cagttgatttttc

SEQ ID NO: 509595 - DNA, 17 bp, Homo sapiens
catatttgcatatgtat

SEQ ID NO: 509596 - DNA, 19 bp, Homo sapiens
catatttgcatatgtatga

SEQ ID NO: 509597 - DNA, 16 bp, Homo sapiens
catatttgtatgtttt

SEQ ID NO: 509598 - DNA, 15 bp, Homo sapiens
catcaggaccctgga

SEQ ID NO: 509599 - DNA, 18 bp, Homo sapiens
catcaggaccctggacct

SEQ ID NO: 509600 - DNA, 17 bp, Homo sapiens
catcccacgttctgtta

SEQ ID NO: 509601 - DNA, 18 bp, Homo sapiens
catccttcctcacaccag

SEQ ID NO: 509602 - DNA, 15 bp, Homo sapiens
catgagaggaggcag

SEQ ID NO: 509603 - DNA, 13 bp, Homo sapiens
catgatggccagg

SEQ ID NO: 509604 - DNA, 13 bp, Homo sapiens
catggctgagctg

SEQ ID NO: 509605 - DNA, 21 bp, Homo sapiens
catgggcacaaagggcccaga

SEQ ID NO: 509606 - DNA, 17 bp, Homo sapiens
catggggctgggcagct

SEQ ID NO: 509607 - DNA, 13 bp, Homo sapiens
catgtaatgacac

SEQ ID NO: 509608 - DNA, 19 bp, Homo sapiens
catgttcctttgtaattga

SEQ ID NO: 509609 - DNA, 17 bp, Homo sapiens
cattaactctaactgtg

SEQ ID NO: 509610 - DNA, 17 bp, Homo sapiens
cattatctttgctgtta

SEQ ID NO: 509611 - DNA, 17 bp, Homo sapiens
cattcttcagtttttca

SEQ ID NO: 509612 - DNA, 20 bp, Homo sapiens
cattcttcagtttttcactt

SEQ ID NO: 509613 - DNA, 21 bp, Homo sapiens
cattcttcagtttttcacttc

SEQ ID NO: 509614 - DNA, 16 bp, Homo sapiens
ctgtgacaaagaagac

SEQ ID NO: 509615 - DNA, 15 bp, Homo sapiens
ctgttgactggctgt

SEQ ID NO: 509616 - DNA, 19 bp, Homo sapiens
cttaacttacttttgtaag

SEQ ID NO: 509617 - DNA, 13 bp, Homo sapiens
cttaagccctggc

SEQ ID NO: 509618 - DNA, 16 bp, Homo sapiens
cttaagccctggcccc

SEQ ID NO: 509619 - DNA, 18 bp, Homo sapiens
cttacatttaaaagacag

SEQ ID NO: 509620 - DNA, 19 bp, Homo sapiens
cttatgaaaagtactaata

SEQ ID NO: 509621 - DNA, 23 bp, Homo sapiens
cttcaggaacacccccatgacat

SEQ ID NO: 509622 - DNA, 17 bp, Homo sapiens
cttccaaagactaagac

SEQ ID NO: 509623 - DNA, 13 bp, Homo sapiens
cttccataacatt

SEQ ID NO: 509624 - DNA, 23 bp, Homo sapiens
cttctacatgtaatgacacttct

SEQ ID NO: 509625 - DNA, 18 bp, Homo sapiens
cttctattagccagtctt

SEQ ID NO: 509626 - DNA, 16 bp, Homo sapiens
cttctcaaaccttgat

SEQ ID NO: 509627 - DNA, 16 bp, Homo sapiens
cttctcatcctgcagg

SEQ ID NO: 509628 - DNA, 17 bp, Homo sapiens
cttctcatcctgcaggc

SEQ ID NO: 509629 - DNA, 12 bp, Homo sapiens
cttgatgtgcct

SEQ ID NO: 509630 - DNA, 14 bp, Homo sapiens
cttgcaagaatcag

SEQ ID NO: 509631 - DNA, 18 bp, Homo sapiens
cttgcaagaatcagtgca

SEQ ID NO: 509632 - DNA, 16 bp, Homo sapiens
cttgcacctctgacct

SEQ ID NO: 509633 - DNA, 14 bp, Homo sapiens
cttgcccagtttca

SEQ ID NO: 509634 - DNA, 21 bp, Homo sapiens
cttgcctctaaatagcacttt

SEQ ID NO: 509635 - DNA, 15 bp, Homo sapiens
cttggatgtatatgt

SEQ ID NO: 509636 - DNA, 22 bp, Homo sapiens
ctttaggggaagtaaaacagtc

SEQ ID NO: 509637 - DNA, 16 bp, Homo sapiens
ctttatgtaataatgt

SEQ ID NO: 509638 - DNA, 17 bp, Homo sapiens
ctttattaagtagatga

SEQ ID NO: 509639 - DNA, 22 bp, Homo sapiens
ctttattaagtagatgaaacat

SEQ ID NO: 509640 - DNA, 19 bp, Homo sapiens
ctttgctgttattgacagc

SEQ ID NO: 509641 - DNA, 17 bp, Homo sapiens
cttttaattacagaaga

SEQ ID NO: 509642 - DNA, 18 bp, Homo sapiens
cttttctgtctctctctt

SEQ ID NO: 509643 - DNA, 12 bp, Homo sapiens
ctttttcataat

SEQ ID NO: 509644 - DNA, 23 bp, Homo sapiens
gaaactcataatagacttcccac

SEQ ID NO: 509645 - DNA, 16 bp, Homo sapiens
gaaagacagcttctca

SEQ ID NO: 509646 - DNA, 15 bp, Homo sapiens
gaaaggggagtaggt

SEQ ID NO: 509647 - DNA, 19 bp, Homo sapiens
gaaaggggagtaggtgggg

SEQ ID NO: 509648 - DNA, 13 bp, Homo sapiens
gaaataattttca

SEQ ID NO: 509649 - DNA, 15 bp, Homo sapiens
gaaatatacacacag

SEQ ID NO: 509650 - DNA, 14 bp, Homo sapiens
gaacactgagaaag

SEQ ID NO: 509651 - DNA, 15 bp, Homo sapiens
gaacactgagaaaga

SEQ ID NO: 509652 - DNA, 22 bp, Homo sapiens
gaacacttttgaaaatgtacat

SEQ ID NO: 509653 - DNA, 18 bp, Homo sapiens
gaacagtgaggtgcccag

SEQ ID NO: 509654 - DNA, 14 bp, Homo sapiens
gaagaagagccaca

SEQ ID NO: 509655 - DNA, 13 bp, Homo sapiens
gaagagccacagt

SEQ ID NO: 509656 - DNA, 15 bp, Homo sapiens
gaagcaaacacatta

SEQ ID NO: 509657 - DNA, 18 bp, Homo sapiens
gaagctcttgaagacact

SEQ ID NO: 509658 - DNA, 18 bp, Homo sapiens
gaaggagaatcatcagga

SEQ ID NO: 509659 - DNA, 13 bp, Homo sapiens
gaaggagttttat

SEQ ID NO: 509660 - DNA, 19 bp, Homo sapiens
gaagtgaacccatatttta

SEQ ID NO: 509661 - DNA, 15 bp, Homo sapiens
gaatagcctgtggcc

SEQ ID NO: 509662 - DNA, 19 bp, Homo sapiens
gaatatgagctttatgtaa

SEQ ID NO: 509663 - DNA, 15 bp, Homo sapiens
gaatcagtgcaaaga

SEQ ID NO: 509664 - DNA, 13 bp, Homo sapiens
gaatctactttaa

SEQ ID NO: 509665 - DNA, 14 bp, Homo sapiens
gaattgcagagtac

SEQ ID NO: 509666 - DNA, 17 bp, Homo sapiens
gacactcaataaacagt

SEQ ID NO: 509667 - DNA, 23 bp, Homo sapiens
gacactgaaatatacacacagca

SEQ ID NO: 509668 - DNA, 18 bp, Homo sapiens
gacagcgatataatttta

SEQ ID NO: 509669 - DNA, 16 bp, Homo sapiens
gaccaaggagatgaag

SEQ ID NO: 509670 - DNA, 14 bp, Homo sapiens
gaccagcctccctg

SEQ ID NO: 509671 - DNA, 22 bp, Homo sapiens
gaccagcctccctgtcggcctg

SEQ ID NO: 509672 - DNA, 11 bp, Homo sapiens
gacccaggcac

SEQ ID NO: 509673 - DNA, 15 bp, Homo sapiens
gaccccaccagcctc

SEQ ID NO: 509674 - DNA, 16 bp, Homo sapiens
gacgaagaagagccac

SEQ ID NO: 509675 - DNA, 16 bp, Homo sapiens
gactacctctgtgcct

SEQ ID NO: 509676 - DNA, 19 bp, Homo sapiens
gactacctctgtgccttgc

SEQ ID NO: 509677 - DNA, 22 bp, Homo sapiens
gactacctctgtgccttgccac

SEQ ID NO: 509678 - DNA, 16 bp, Homo sapiens
gagaagaaagtgaaag

SEQ ID NO: 509679 - DNA, 20 bp, Homo sapiens
gagacagagcctcgctctgt

SEQ ID NO: 509680 - DNA, 15 bp, Homo sapiens
gagatgaagcaaaca

SEQ ID NO: 509681 - DNA, 14 bp, Homo sapiens
gagcctcgctctgt

SEQ ID NO: 509682 - DNA, 15 bp, Homo sapiens
gagctctgcagccca

SEQ ID NO: 509683 - DNA, 18 bp, Homo sapiens
gagctgcccacagcaggc

SEQ ID NO: 509684 - DNA, 18 bp, Homo sapiens
gagctgcccctctctggg

SEQ ID NO: 509685 - DNA, 12 bp, Homo sapiens
gaggaggcagca

SEQ ID NO: 509686 - DNA, 13 bp, Homo sapiens
gaggaggcagcag

SEQ ID NO: 509687 - DNA, 16 bp, Homo sapiens
gaggaggcagcaggac

SEQ ID NO: 509688 - DNA, 17 bp, Homo sapiens
gaggcagcaggactgtc

SEQ ID NO: 509689 - DNA, 12 bp, Homo sapiens
gaggcagggacc

SEQ ID NO: 509690 - DNA, 20 bp, Homo sapiens
gaggctatgctcaggggccc

SEQ ID NO: 509691 - DNA, 16 bp, Homo sapiens
gagggtcgtgggaaag

SEQ ID NO: 509692 - DNA, 17 bp, Homo sapiens
gagggtcgtgggaaagg

SEQ ID NO: 509693 - DNA, 22 bp, Homo sapiens
gagggtcgtgggaaaggggagt

SEQ ID NO: 509694 - DNA, 13 bp, Homo sapiens
gagtctcccaggg

SEQ ID NO: 509695 - DNA, 14 bp, Homo sapiens
gagttcagttttac

SEQ ID NO: 509696 - DNA, 23 bp, Homo sapiens
gatagcacctaaacttacattta

SEQ ID NO: 509697 - DNA, 21 bp, Homo sapiens
gatgagacagacattcacctg

SEQ ID NO: 509698 - DNA, 22 bp, Homo sapiens
gcaaagactattcccttctaac

SEQ ID NO: 509699 - DNA, 13 bp, Homo sapiens
gcagcctggagcc

SEQ ID NO: 509700 - DNA, 19 bp, Homo sapiens
gcaggccaggtccagagag

SEQ ID NO: 509701 - DNA, 16 bp, Homo sapiens
gcagtggtgcgatctc

SEQ ID NO: 509702 - DNA, 17 bp, Homo sapiens
gcatcccacgttctgtt

SEQ ID NO: 509703 - DNA, 17 bp, Homo sapiens
gcatgagaggaggcagc

SEQ ID NO: 509704 - DNA, 17 bp, Homo sapiens
gccacatggggctgggc

SEQ ID NO: 509705 - DNA, 17 bp, Homo sapiens
gccaccaaaggccaggg

SEQ ID NO: 509706 - DNA, 15 bp, Homo sapiens
gccaggctgatctcg

SEQ ID NO: 509707 - DNA, 14 bp, Homo sapiens
gcccacagcaggcc

SEQ ID NO: 509708 - DNA, 14 bp, Homo sapiens
gcccctctctgggc

SEQ ID NO: 509709 - DNA, 17 bp, Homo sapiens
gcccgcagacctctgga

SEQ ID NO: 509710 - DNA, 22 bp, Homo sapiens
gccgggtactgagagtctgcac

SEQ ID NO: 509711 - DNA, 16 bp, Homo sapiens
gcctcagcctcccgag

SEQ ID NO: 509712 - DNA, 12 bp, Homo sapiens
gcctccaggcca

SEQ ID NO: 509713 - DNA, 23 bp, Homo sapiens
gcctcgctctgttacccagggtg

SEQ ID NO: 509714 - DNA, 14 bp, Homo sapiens
gcctgaacccaaga

SEQ ID NO: 509715 - DNA, 16 bp, Homo sapiens
gcctggagccctggag

SEQ ID NO: 509716 - DNA, 17 bp, Homo sapiens
gcctggagccctggaga

SEQ ID NO: 509717 - DNA, 16 bp, Homo sapiens
gcctgtggcctttgca

SEQ ID NO: 509718 - DNA, 17 bp, Homo sapiens
gcgaatctagaggaggg

SEQ ID NO: 509719 - DNA, 21 bp, Homo sapiens
gctactataaatatacatata

SEQ ID NO: 509720 - DNA, 16 bp, Homo sapiens
gctatgctcaggggcc

SEQ ID NO: 509721 - DNA, 16 bp, Homo sapiens
gctcaggggccctgga

SEQ ID NO: 509722 - DNA, 17 bp, Homo sapiens
gctcaggggccctggag

SEQ ID NO: 509723 - DNA, 20 bp, Homo sapiens
gctcagtgcaacctctgctt

SEQ ID NO: 509724 - DNA, 23 bp, Homo sapiens
gctcccaggccgagaagccagtg

SEQ ID NO: 509725 - DNA, 15 bp, Homo sapiens
gctcccgtggcctgt

SEQ ID NO: 509726 - DNA, 15 bp, Homo sapiens
gctcctcgagggcag

SEQ ID NO: 509727 - DNA, 13 bp, Homo sapiens
gctctgcagccca

SEQ ID NO: 509728 - DNA, 17 bp, Homo sapiens
gctctgttacccagggt

SEQ ID NO: 509729 - DNA, 22 bp, Homo sapiens
gctgagctgcccacagcaggcc

SEQ ID NO: 509730 - DNA, 14 bp, Homo sapiens
gctgagggtcgtgg

SEQ ID NO: 509731 - DNA, 19 bp, Homo sapiens
gctgagggtcgtgggaaag

SEQ ID NO: 509732 - DNA, 22 bp, Homo sapiens
gctgagggtcgtgggaaagggg

SEQ ID NO: 509733 - DNA, 15 bp, Homo sapiens
gctgcccctctctgg

SEQ ID NO: 509734 - DNA, 12 bp, Homo sapiens
gcttaatgaaaa

SEQ ID NO: 509735 - DNA, 16 bp, Homo sapiens
gcttctcatcctgcag

SEQ ID NO: 509736 - DNA, 17 bp, Homo sapiens
gcttctcatcctgcagg

SEQ ID NO: 509737 - DNA, 14 bp, Homo sapiens
gcttgcctgcaggc

SEQ ID NO: 509738 - DNA, 15 bp, Homo sapiens
gctttatgtaataat

SEQ ID NO: 509739 - DNA, 17 bp, Homo sapiens
ggagaccccaccagcct

SEQ ID NO: 509740 - DNA, 17 bp, Homo sapiens
ggagagtctcccaggga

SEQ ID NO: 509741 - DNA, 18 bp, Homo sapiens
ggagcatgagaggaggca

SEQ ID NO: 509742 - DNA, 21 bp, Homo sapiens
ggaggaaggcttacacccaca

SEQ ID NO: 509743 - DNA, 13 bp, Homo sapiens
ggaggcagcagga

SEQ ID NO: 509744 - DNA, 15 bp, Homo sapiens
ggagggggcaggctg

SEQ ID NO: 509745 - DNA, 21 bp, Homo sapiens
ggatgctcctcccttctctac

SEQ ID NO: 509746 - DNA, 17 bp, Homo sapiens
ggcacaaagggcccaga

SEQ ID NO: 509747 - DNA, 20 bp, Homo sapiens
ggcacagcaactctaagact

SEQ ID NO: 509748 - DNA, 21 bp, Homo sapiens
ggcagcgtactcatcatcaac

SEQ ID NO: 509749 - DNA, 21 bp, Homo sapiens
ggcatcacatgctcaatgact

SEQ ID NO: 509750 - DNA, 23 bp, Homo sapiens
ggccagggtcactgaaggcctgg

SEQ ID NO: 509751 - DNA, 19 bp, Homo sapiens
ggcccacagcaggtgctga

SEQ ID NO: 509752 - DNA, 23 bp, Homo sapiens
ggcccggagctgcccctctctgg

SEQ ID NO: 509753 - DNA, 17 bp, Homo sapiens
ggcgtggtcaagcactc

SEQ ID NO: 509754 - DNA, 12 bp, Homo sapiens
ggctctctgagt

SEQ ID NO: 509755 - DNA, 14 bp, Homo sapiens
ggctgagctgccca

SEQ ID NO: 509756 - DNA, 18 bp, Homo sapiens
ggctgagggtcgtgggaa

SEQ ID NO: 509757 - DNA, 21 bp, Homo sapiens
ggctgagggtcgtgggaaagg

SEQ ID NO: 509758 - DNA, 12 bp, Homo sapiens
ggctgggcagct

SEQ ID NO: 509759 - DNA, 13 bp, Homo sapiens
ggctgggcagcta

SEQ ID NO: 509760 - DNA, 13 bp, Homo sapiens
ggcttacacccac

SEQ ID NO: 509761 - DNA, 15 bp, Homo sapiens
ggcttgcctgcaggc

SEQ ID NO: 509762 - DNA, 16 bp, Homo sapiens
gggaacactgagaaag

SEQ ID NO: 509763 - DNA, 17 bp, Homo sapiens
aaaaatttacaagagaa

SEQ ID NO: 509764 - DNA, 20 bp, Homo sapiens
aaaacagtccttcaaacttc

SEQ ID NO: 509765 - DNA, 19 bp, Homo sapiens
aaaacattttcacacaata

SEQ ID NO: 509766 - DNA, 15 bp, Homo sapiens
aaaaggaaaaatatt

SEQ ID NO: 509767 - DNA, 14 bp, Homo sapiens
aaaaggtaaaactt

SEQ ID NO: 509768 - DNA, 12 bp, Homo sapiens
aaaagttattaa

SEQ ID NO: 509769 - DNA, 17 bp, Homo sapiens
aaaagttattaatattt

SEQ ID NO: 509770 - DNA, 18 bp, Homo sapiens
aaacactccacattcttc

SEQ ID NO: 509771 - DNA, 19 bp, Homo sapiens
aaacttccagtgcaacact

SEQ ID NO: 509772 - DNA, 23 bp, Homo sapiens
aaacttccagtgcaacactgaag

SEQ ID NO: 509773 - DNA, 16 bp, Homo sapiens
aaagacagacattcct

SEQ ID NO: 509774 - DNA, 15 bp, Homo sapiens
aaaggaaaaatattg

SEQ ID NO: 509775 - DNA, 18 bp, Homo sapiens
aaagtattgtgaaagtat

SEQ ID NO: 509776 - DNA, 21 bp, Homo sapiens
aaagttattaatattttaatt

SEQ ID NO: 509777 - DNA, 18 bp, Homo sapiens
aaataaaacattttcaca

SEQ ID NO: 509778 - DNA, 13 bp, Homo sapiens
aaatagttgtaaa

SEQ ID NO: 509779 - DNA, 15 bp, Homo sapiens
aaatatacacacagc

SEQ ID NO: 509780 - DNA, 18 bp, Homo sapiens
aaattaatatatcattat

SEQ ID NO: 509781 - DNA, 19 bp, Homo sapiens
aaattgataacatggaaat

SEQ ID NO: 509782 - DNA, 21 bp, Homo sapiens
aacacattaagccttccacac

SEQ ID NO: 509783 - DNA, 14 bp, Homo sapiens
aacactgagaaaga

SEQ ID NO: 509784 - DNA, 15 bp, Homo sapiens
aacactgagaaagag

SEQ ID NO: 509785 - DNA, 20 bp, Homo sapiens
aacacttttgaaaatgtaca

SEQ ID NO: 509786 - DNA, 19 bp, Homo sapiens
aacagtcatctagaattca

SEQ ID NO: 509787 - DNA, 16 bp, Homo sapiens
aacattaactctaact

SEQ ID NO: 509788 - DNA, 17 bp, Homo sapiens
aacattaactctaactg

SEQ ID NO: 509789 - DNA, 16 bp, Homo sapiens
aacctctgcttcccag

SEQ ID NO: 509790 - DNA, 18 bp, Homo sapiens
aacctctgcttcccaggt

SEQ ID NO: 509791 - DNA, 20 bp, Homo sapiens
aactaaaaatttacaagaga

SEQ ID NO: 509792 - DNA, 13 bp, Homo sapiens
aactcaatgatag

SEQ ID NO: 509793 - DNA, 19 bp, Homo sapiens
aactgaaaacaagccatga

SEQ ID NO: 509794 - DNA, 14 bp, Homo sapiens
aagaagagccacag

SEQ ID NO: 509795 - DNA, 15 bp, Homo sapiens
aagaagagccacagt

SEQ ID NO: 509796 - DNA, 21 bp, Homo sapiens
aagacactgaaatatacacac

SEQ ID NO: 509797 - DNA, 22 bp, Homo sapiens
aagacactgaaatatacacaca

SEQ ID NO: 509798 - DNA, 22 bp, Homo sapiens
aagacagcttctcatcctgcag

SEQ ID NO: 509799 - DNA, 14 bp, Homo sapiens
aagcaaacacatta

SEQ ID NO: 509800 - DNA, 18 bp, Homo sapiens
aagcaaagtattgtgaaa

SEQ ID NO: 509801 - DNA, 20 bp, Homo sapiens
aagcaaagtattgtgaaagt

SEQ ID NO: 509802 - DNA, 15 bp, Homo sapiens
aagcagtgcttctca

SEQ ID NO: 509803 - DNA, 12 bp, Homo sapiens
aagccctggccc

SEQ ID NO: 509804 - DNA, 16 bp, Homo sapiens
aagccttccacactca

SEQ ID NO: 509805 - DNA, 15 bp, Homo sapiens
aagcgattctcctgc

SEQ ID NO: 509806 - DNA, 19 bp, Homo sapiens
aagctcttgaagacactga

SEQ ID NO: 509807 - DNA, 16 bp, Homo sapiens
aaggagaatcatcagg

SEQ ID NO: 509808 - DNA, 17 bp, Homo sapiens
aaggcctggcccacagc

SEQ ID NO: 509809 - DNA, 18 bp, Homo sapiens
aagggactacctctgtgc

SEQ ID NO: 509810 - DNA, 22 bp, Homo sapiens
aaggggagtaggtgggggaaca

SEQ ID NO: 509811 - DNA, 14 bp, Homo sapiens
aagtaaaacagtca

SEQ ID NO: 509812 - DNA, 17 bp, Homo sapiens
aagtagcattcatgtaa

SEQ ID NO: 509813 - DNA, 13 bp, Homo sapiens
aagtgaaagcaaa

SEQ ID NO: 509814 - DNA, 20 bp, Homo sapiens
aagtgaacccatattttaaa

SEQ ID NO: 509815 - DNA, 18 bp, Homo sapiens
aagtgttccctttttcat

SEQ ID NO: 509816 - DNA, 14 bp, Homo sapiens
aagttattaatatt

SEQ ID NO: 509817 - DNA, 11 bp, Homo sapiens
aataaacagtc

SEQ ID NO: 509818 - DNA, 12 bp, Homo sapiens
aataaacagtca

SEQ ID NO: 509819 - DNA, 14 bp, Homo sapiens
aatacaataagtta

SEQ ID NO: 509820 - DNA, 13 bp, Homo sapiens
aatagaacttgtt

SEQ ID NO: 509821 - DNA, 13 bp, Homo sapiens
aatagcacttttt

SEQ ID NO: 509822 - DNA, 20 bp, Homo sapiens
aatattgaactcaatgatag

SEQ ID NO: 509823 - DNA, 13 bp, Homo sapiens
aatcaaactgctt

SEQ ID NO: 509824 - DNA, 15 bp, Homo sapiens
aatctagaggagggg

SEQ ID NO: 509825 - DNA, 17 bp, Homo sapiens
aatgaagttgtaggtaa

SEQ ID NO: 509826 - DNA, 11 bp, Homo sapiens
aatgacacttc

SEQ ID NO: 509827 - DNA, 13 bp, Homo sapiens
aatgtacgtcatt

SEQ ID NO: 509828 - DNA, 18 bp, Homo sapiens
aattatgttactgtattt

SEQ ID NO: 509829 - DNA, 23 bp, Homo sapiens
aattatgttactgtatttttcag

SEQ ID NO: 509830 - DNA, 19 bp, Homo sapiens
aattttcaagcaaagtatt

SEQ ID NO: 509831 - DNA, 14 bp, Homo sapiens
acaaagggcccaga

SEQ ID NO: 509832 - DNA, 14 bp, Homo sapiens
acaaatagttgtaa

SEQ ID NO: 509833 - DNA, 21 bp, Homo sapiens
acaataagttaactattttat

SEQ ID NO: 509834 - DNA, 17 bp, Homo sapiens
acactcaataaacagtc

SEQ ID NO: 509835 - DNA, 21 bp, Homo sapiens
acagctactataaatatacat

SEQ ID NO: 509836 - DNA, 20 bp, Homo sapiens
acagcttctcatcctgcagg

SEQ ID NO: 509837 - DNA, 12 bp, Homo sapiens
acagtcactgga

SEQ ID NO: 509838 - DNA, 21 bp, Homo sapiens
acagtcatctagaattcactg

SEQ ID NO: 509839 - DNA, 17 bp, Homo sapiens
acagtgaggtgcccagc

SEQ ID NO: 509840 - DNA, 17 bp, Homo sapiens
acatataaattatagaa

SEQ ID NO: 509841 - DNA, 20 bp, Homo sapiens
acatatttgtatgtttttct

SEQ ID NO: 509842 - DNA, 18 bp, Homo sapiens
acatgaagacaccatctc

SEQ ID NO: 509843 - DNA, 18 bp, Homo sapiens
acatggggctgggcagct

SEQ ID NO: 509844 - DNA, 14 bp, Homo sapiens
acatgtaatgacac

SEQ ID NO: 509845 - DNA, 21 bp, Homo sapiens
acattcacctgtatatttctt

SEQ ID NO: 509846 - DNA, 22 bp, Homo sapiens
acattcacctgtatatttcttt

SEQ ID NO: 509847 - DNA, 17 bp, Homo sapiens
acattccttctacatgt

SEQ ID NO: 509848 - DNA, 18 bp, Homo sapiens
acattccttctacatgta

SEQ ID NO: 509849 - DNA, 15 bp, Homo sapiens
acatttaaaagacag

SEQ ID NO: 509850 - DNA, 15 bp, Homo sapiens
acattttaatgcacc

SEQ ID NO: 509851 - DNA, 19 bp, Homo sapiens
acattttaatgcacctgaa

SEQ ID NO: 509852 - DNA, 22 bp, Homo sapiens
accaaaataaatcatctttatt

SEQ ID NO: 509853 - DNA, 17 bp, Homo sapiens
accaaggagatgaagca

SEQ ID NO: 509854 - DNA, 16 bp, Homo sapiens
cagtggggctctctga

SEQ ID NO: 509855 - DNA, 21 bp, Homo sapiens
cagtggggctctctgagtcct

SEQ ID NO: 509856 - DNA, 19 bp, Homo sapiens
cagtggtgcgatctcggct

SEQ ID NO: 509857 - DNA, 13 bp, Homo sapiens
cagtttttcactt

SEQ ID NO: 509858 - DNA, 22 bp, Homo sapiens
cataagcattgctcaagaggaa

SEQ ID NO: 509859 - DNA, 22 bp, Homo sapiens
cataatagacttcccactctag

SEQ ID NO: 509860 - DNA, 14 bp, Homo sapiens
catagcacttcccc

SEQ ID NO: 509861 - DNA, 15 bp, Homo sapiens
catatttgcatatgt

SEQ ID NO: 509862 - DNA, 19 bp, Homo sapiens
catatttgtatgtttttct

SEQ ID NO: 509863 - DNA, 14 bp, Homo sapiens
catcaggaccctgg

SEQ ID NO: 509864 - DNA, 18 bp, Homo sapiens
catctcagtgctgtaaaa

SEQ ID NO: 509865 - DNA, 14 bp, Homo sapiens
catcttcccaaccc

SEQ ID NO: 509866 - DNA, 20 bp, Homo sapiens
catgagaggaggcagcagga

SEQ ID NO: 509867 - DNA, 19 bp, Homo sapiens
catgggcacaaagggccca

SEQ ID NO: 509868 - DNA, 19 bp, Homo sapiens
catgtgaccgaacactgca

SEQ ID NO: 509869 - DNA, 13 bp, Homo sapiens
cattaaattgata

SEQ ID NO: 509870 - DNA, 16 bp, Homo sapiens
cattaagccttccaca

SEQ ID NO: 509871 - DNA, 16 bp, Homo sapiens
cattatctttgctgtt

SEQ ID NO: 509872 - DNA, 17 bp, Homo sapiens
cattgctcaagaggaaa

SEQ ID NO: 509873 - DNA, 14 bp, Homo sapiens
catttaaaagacag

SEQ ID NO: 509874 - DNA, 20 bp, Homo sapiens
cattttgtataatcacagtt

SEQ ID NO: 509875 - DNA, 18 bp, Homo sapiens
ccaaatttaagactctcg

SEQ ID NO: 509876 - DNA, 23 bp, Homo sapiens
ccaaggagatgaagcaaacacat

SEQ ID NO: 509877 - DNA, 19 bp, Homo sapiens
ccacactctttctcctgct

SEQ ID NO: 509878 - DNA, 12 bp, Homo sapiens
ccacagcaggcc

SEQ ID NO: 509879 - DNA, 11 bp, Homo sapiens
ccacagggtct

SEQ ID NO: 509880 - DNA, 19 bp, Homo sapiens
ccacatggggctgggcagc

SEQ ID NO: 509881 - DNA, 20 bp, Homo sapiens
ccagactcctgactgtctcc

SEQ ID NO: 509882 - DNA, 19 bp, Homo sapiens
ccaggccacatggggctgg

SEQ ID NO: 509883 - DNA, 16 bp, Homo sapiens
ccagtcagcagtcatg

SEQ ID NO: 509884 - DNA, 14 bp, Homo sapiens
ccagtgcaacactg

SEQ ID NO: 509885 - DNA, 11 bp, Homo sapiens
ccataacattg

SEQ ID NO: 509886 - DNA, 11 bp, Homo sapiens
ccatattttaa

SEQ ID NO: 509887 - DNA, 15 bp, Homo sapiens
ccatctgcattccca

SEQ ID NO: 509888 - DNA, 18 bp, Homo sapiens
ccatgatggccaggctga

SEQ ID NO: 509889 - DNA, 21 bp, Homo sapiens
cccaaagtgcttccaaggcag

SEQ ID NO: 509890 - DNA, 23 bp, Homo sapiens
cccaaccccttaagccctggccc

SEQ ID NO: 509891 - DNA, 12 bp, Homo sapiens
cccacagcaggc

SEQ ID NO: 509892 - DNA, 17 bp, Homo sapiens
cccagggaccgaaaagt

SEQ ID NO: 509893 - DNA, 19 bp, Homo sapiens
cccagtacaccccacctct

SEQ ID NO: 509894 - DNA, 16 bp, Homo sapiens
ccccatctgcattccc

SEQ ID NO: 509895 - DNA, 13 bp, Homo sapiens
ccccatgctggcc

SEQ ID NO: 509896 - DNA, 18 bp, Homo sapiens
cccctatcagttgatttt

SEQ ID NO: 509897 - DNA, 16 bp, Homo sapiens
ccccttaagccctggc

SEQ ID NO: 509898 - DNA, 15 bp, Homo sapiens
cccgcagacctctgg

SEQ ID NO: 509899 - DNA, 13 bp, Homo sapiens
ccctatcagttga

SEQ ID NO: 509900 - DNA, 19 bp, Homo sapiens
ccctctctgggcctcagag

SEQ ID NO: 509901 - DNA, 21 bp, Homo sapiens
ccctgcatggctgagctgccc

SEQ ID NO: 509902 - DNA, 17 bp, Homo sapiens
ccctgctccctcccatc

SEQ ID NO: 509903 - DNA, 20 bp, Homo sapiens
ccctggagcagccaccccat

SEQ ID NO: 509904 - DNA, 12 bp, Homo sapiens
ccctggccccct

SEQ ID NO: 509905 - DNA, 15 bp, Homo sapiens
cccttaagccctggc

SEQ ID NO: 509906 - DNA, 20 bp, Homo sapiens
ccgagtagctgggattacag

SEQ ID NO: 509907 - DNA, 18 bp, Homo sapiens
ccggagctgcccctctct

SEQ ID NO: 509908 - DNA, 22 bp, Homo sapiens
ccggagctgcccctctctgggc

SEQ ID NO: 509909 - DNA, 22 bp, Homo sapiens
cctaaacttacatttaaaagac

SEQ ID NO: 509910 - DNA, 23 bp, Homo sapiens
cctacatatttgtatgtttttct

SEQ ID NO: 509911 - DNA, 18 bp, Homo sapiens
cctcaagtgatcctccca

SEQ ID NO: 509912 - DNA, 14 bp, Homo sapiens
cctcgagggcaggg

SEQ ID NO: 509913 - DNA, 19 bp, Homo sapiens
cctcgctctgttacccagg

SEQ ID NO: 509914 - DNA, 21 bp, Homo sapiens
cctcgctctgttacccagggt

SEQ ID NO: 509915 - DNA, 15 bp, Homo sapiens
cctctgcttcccagg

SEQ ID NO: 509916 - DNA, 13 bp, Homo sapiens
cctgactgtctcc

SEQ ID NO: 509917 - DNA, 18 bp, Homo sapiens
cctgcccgcagacctctg

SEQ ID NO: 509918 - DNA, 15 bp, Homo sapiens
cctgctccctcccat

SEQ ID NO: 509919 - DNA, 17 bp, Homo sapiens
cctgctttaaccacccc

SEQ ID NO: 509920 - DNA, 19 bp, Homo sapiens
cctgctttaaccaccccat

SEQ ID NO: 509921 - DNA, 15 bp, Homo sapiens
cctggagaccccacc

SEQ ID NO: 509922 - DNA, 19 bp, Homo sapiens
cctgtatgcaacaggcact

SEQ ID NO: 509923 - DNA, 17 bp, Homo sapiens
cctgtcggcctggtgtt

SEQ ID NO: 509924 - DNA, 18 bp, Homo sapiens
ccttgccacattaaattg

SEQ ID NO: 509925 - DNA, 18 bp, Homo sapiens
cctttactcatagcactt

SEQ ID NO: 509926 - DNA, 22 bp, Homo sapiens
cgaaaagttggtgtcaatgaat

SEQ ID NO: 509927 - DNA, 16 bp, Homo sapiens
cgaagaagagccacag

SEQ ID NO: 509928 - DNA, 23 bp, Homo sapiens
cgaggagggagagtctcccaggg

SEQ ID NO: 509929 - DNA, 19 bp, Homo sapiens
cgcccccaccctgagcgcc

SEQ ID NO: 509930 - DNA, 17 bp, Homo sapiens
cgcctgggtccagggga

SEQ ID NO: 509931 - DNA, 12 bp, Homo sapiens
cggaagggcaca

SEQ ID NO: 509932 - DNA, 20 bp, Homo sapiens
cggagctgcccctctctggg

SEQ ID NO: 509933 - DNA, 22 bp, Homo sapiens
cggagctgcccctctctgggcc

SEQ ID NO: 509934 - DNA, 13 bp, Homo sapiens
cgtgggaaagggg

SEQ ID NO: 509935 - DNA, 13 bp, Homo sapiens
ctaaaagtcttcg

SEQ ID NO: 509936 - DNA, 18 bp, Homo sapiens
ctaaaattatgttactgt

SEQ ID NO: 509937 - DNA, 22 bp, Homo sapiens
ctaaagggactacctctgtgcc

SEQ ID NO: 509938 - DNA, 17 bp, Homo sapiens
ctaactgtgacaaagaa

SEQ ID NO: 509939 - DNA, 22 bp, Homo sapiens
ctaagcggaccagcctccctgt

SEQ ID NO: 509940 - DNA, 13 bp, Homo sapiens
ctaatagaacttg

SEQ ID NO: 509941 - DNA, 22 bp, Homo sapiens
ctacatatttgtatgtttttct

SEQ ID NO: 509942 - DNA, 16 bp, Homo sapiens
ctacatgtaatgacac

SEQ ID NO: 509943 - DNA, 19 bp, Homo sapiens
ctaccttgtgacccagcac

SEQ ID NO: 509944 - DNA, 19 bp, Homo sapiens
ctagacgcttcatcccaca

SEQ ID NO: 509945 - DNA, 22 bp, Homo sapiens
ctagaggagggggcaggctgag

SEQ ID NO: 509946 - DNA, 20 bp, Homo sapiens
ctatcagttgatttttctta

SEQ ID NO: 509947 - DNA, 21 bp, Homo sapiens
ctatcagttgatttttcttat

SEQ ID NO: 509948 - DNA, 17 bp, Homo sapiens
ctatggaagcatattgt

SEQ ID NO: 509949 - DNA, 18 bp, Homo sapiens
ctcaagtgatcctcccac

SEQ ID NO: 509950 - DNA, 14 bp, Homo sapiens
ctcaataaacagtc

SEQ ID NO: 509951 - DNA, 23 bp, Homo sapiens
ctcaccccagactcctgactgtc

SEQ ID NO: 509952 - DNA, 16 bp, Homo sapiens
ctcacctctaaaacag

SEQ ID NO: 509953 - DNA, 12 bp, Homo sapiens
ctcagcctcccg

SEQ ID NO: 509954 - DNA, 13 bp, Homo sapiens
ctcatcctgcagg

SEQ ID NO: 509955 - DNA, 22 bp, Homo sapiens
ctcccagggagcatgagaggag

SEQ ID NO: 509956 - DNA, 22 bp, Homo sapiens
ctcccgagtagctgggattaca

SEQ ID NO: 509957 - DNA, 17 bp, Homo sapiens
ctcctcgagggcaggga

SEQ ID NO: 509958 - DNA, 21 bp, Homo sapiens
ctcctcgagggcagggacttt

SEQ ID NO: 509959 - DNA, 22 bp, Homo sapiens
ctcctgcccgcagacctctgga

SEQ ID NO: 509960 - DNA, 15 bp, Homo sapiens
ctcctgcctcagcct

SEQ ID NO: 509961 - DNA, 13 bp, Homo sapiens
ctcgagggcaggg

SEQ ID NO: 509962 - DNA, 16 bp, Homo sapiens
ctcgctctgttaccca

SEQ ID NO: 509963 - DNA, 22 bp, Homo sapiens
ctcggctcagtgcaacctctgc

SEQ ID NO: 509964 - DNA, 15 bp, Homo sapiens
ctctaaccctaggca

SEQ ID NO: 509965 - DNA, 14 bp, Homo sapiens
ctctagggcagtgg

SEQ ID NO: 509966 - DNA, 15 bp, Homo sapiens
ctctcgcatcttccc

SEQ ID NO: 509967 - DNA, 17 bp, Homo sapiens
ctctcgcatcttcccaa

SEQ ID NO: 509968 - DNA, 19 bp, Homo sapiens
ctctctgagtcctggccca

SEQ ID NO: 509969 - DNA, 21 bp, Homo sapiens
aaaatgagttacctacatttt

SEQ ID NO: 509970 - DNA, 22 bp, Homo sapiens
aaaattatgttactgtattttt

SEQ ID NO: 509971 - DNA, 14 bp, Homo sapiens
aaacattttcacac

SEQ ID NO: 509972 - DNA, 22 bp, Homo sapiens
aaacattttcacacaatacaat

SEQ ID NO: 509973 - DNA, 21 bp, Homo sapiens
aaacttccagtgcaacactga

SEQ ID NO: 509974 - DNA, 22 bp, Homo sapiens
aaacttccagtgcaacactgaa

SEQ ID NO: 509975 - DNA, 14 bp, Homo sapiens
aaagcaatctttta

SEQ ID NO: 509976 - DNA, 10 bp, Homo sapiens
aaaggggagt

SEQ ID NO: 509977 - DNA, 19 bp, Homo sapiens
aaagtactaatagaacttg

SEQ ID NO: 509978 - DNA, 13 bp, Homo sapiens
aaagtattgtgaa

SEQ ID NO: 509979 - DNA, 12 bp, Homo sapiens
aaataaaacatt

SEQ ID NO: 509980 - DNA, 15 bp, Homo sapiens
aaataaatcatcttt

SEQ ID NO: 509981 - DNA, 12 bp, Homo sapiens
aaataattttca

SEQ ID NO: 509982 - DNA, 20 bp, Homo sapiens
aaatagttgtaaatatagtg

SEQ ID NO: 509983 - DNA, 17 bp, Homo sapiens
aaatatagtgaagcaat

SEQ ID NO: 509984 - DNA, 17 bp, Homo sapiens
aaatgacagatcttttt

SEQ ID NO: 509985 - DNA, 20 bp, Homo sapiens
aaatgtacgtcatttgtgca

SEQ ID NO: 509986 - DNA, 19 bp, Homo sapiens
aacactgagaaagaggcag

SEQ ID NO: 509987 - DNA, 21 bp, Homo sapiens
aacacttttgaaaatgtacat

SEQ ID NO: 509988 - DNA, 13 bp, Homo sapiens
aacccatatttta

SEQ ID NO: 509989 - DNA, 21 bp, Homo sapiens
aaccctaaggaagttgctaac

SEQ ID NO: 509990 - DNA, 20 bp, Homo sapiens
aacctctgcttcccaggttc

SEQ ID NO: 509991 - DNA, 12 bp, Homo sapiens
aactctaactgt

SEQ ID NO: 509992 - DNA, 21 bp, Homo sapiens
aactgcatcccacgttctgtt

SEQ ID NO: 509993 - DNA, 14 bp, Homo sapiens
aagaaattttagta

SEQ ID NO: 509994 - DNA, 14 bp, Homo sapiens
aagacactgaaata

SEQ ID NO: 509995 - DNA, 11 bp, Homo sapiens
aagagccacag

SEQ ID NO: 509996 - DNA, 19 bp, Homo sapiens
aagagtttcttaacttact

SEQ ID NO: 509997 - DNA, 19 bp, Homo sapiens
aagatctgtgcagccccgc

SEQ ID NO: 509998 - DNA, 17 bp, Homo sapiens
aagcaaagtattgtgaa

SEQ ID NO: 509999 - DNA, 14 bp, Homo sapiens
aagcgattctcctg

SEQ ID NO: 510000 - DNA, 17 bp, Homo sapiens
aagctcttgaagacact

SEQ ID NO: 510001 - DNA, 21 bp, Homo sapiens
aagctcttgaagacactgaaa

SEQ ID NO: 510002 - DNA, 18 bp, Homo sapiens
aaggagaatcatcaggac

SEQ ID NO: 510003 - DNA, 15 bp, Homo sapiens
aaggagatgaagcaa

SEQ ID NO: 510004 - DNA, 14 bp, Homo sapiens
aaggcagaagcagc

SEQ ID NO: 510005 - DNA, 23 bp, Homo sapiens
aagggaacagtgaggtgcccagc

SEQ ID NO: 510006 - DNA, 15 bp, Homo sapiens
aagggactacctctg

SEQ ID NO: 510007 - DNA, 16 bp, Homo sapiens
aaggggagtaggtggg

SEQ ID NO: 510008 - DNA, 13 bp, Homo sapiens
aagtaaaacagtc

SEQ ID NO: 510009 - DNA, 14 bp, Homo sapiens
aagtagcattcatg

SEQ ID NO: 510010 - DNA, 17 bp, Homo sapiens
aagtgaacccatatttt

SEQ ID NO: 510011 - DNA, 19 bp, Homo sapiens
aagttattaatattttaat

SEQ ID NO: 510012 - DNA, 17 bp, Homo sapiens
aataaaacattttcaca

SEQ ID NO: 510013 - DNA, 18 bp, Homo sapiens
aataaacagtcactggaa

SEQ ID NO: 510014 - DNA, 22 bp, Homo sapiens
aataagttaactattttatttt

SEQ ID NO: 510015 - DNA, 21 bp, Homo sapiens
aataattttcaagcaaagtat

SEQ ID NO: 510016 - DNA, 21 bp, Homo sapiens
aatagttatcttttaattaca

SEQ ID NO: 510017 - DNA, 13 bp, Homo sapiens
aatatacacacag

SEQ ID NO: 510018 - DNA, 16 bp, Homo sapiens
aatatagtgaagcaat

SEQ ID NO: 510019 - DNA, 17 bp, Homo sapiens
aatcacagttgtgttcc

SEQ ID NO: 510020 - DNA, 15 bp, Homo sapiens
aatcatggtttttct

SEQ ID NO: 510021 - DNA, 20 bp, Homo sapiens
aatcccaagatctgtgcagc

SEQ ID NO: 510022 - DNA, 19 bp, Homo sapiens
aatgagttacctacatttt

SEQ ID NO: 510023 - DNA, 12 bp, Homo sapiens
aatgggcacagc

SEQ ID NO: 510024 - DNA, 22 bp, Homo sapiens
aatgtacatgttcctttgtaat

SEQ ID NO: 510025 - DNA, 15 bp, Homo sapiens
aatgttagatagtta

SEQ ID NO: 510026 - DNA, 20 bp, Homo sapiens
aattgacactatatatttct

SEQ ID NO: 510027 - DNA, 14 bp, Homo sapiens
aatttattttgtga

SEQ ID NO: 510028 - DNA, 22 bp, Homo sapiens
acaaaaaggtaaaactttttat

SEQ ID NO: 510029 - DNA, 17 bp, Homo sapiens
acaaatgacagatcttt

SEQ ID NO: 510030 - DNA, 20 bp, Homo sapiens
acaatcttaaggggcagctt

SEQ ID NO: 510031 - DNA, 15 bp, Homo sapiens
acactcaataaacag

SEQ ID NO: 510032 - DNA, 20 bp, Homo sapiens
acactcaataaacagtcact

SEQ ID NO: 510033 - DNA, 18 bp, Homo sapiens
acactgaaatatacacac

SEQ ID NO: 510034 - DNA, 20 bp, Homo sapiens
acactgaaatatacacacag

SEQ ID NO: 510035 - DNA, 21 bp, Homo sapiens
acactgaaatatacacacagc

SEQ ID NO: 510036 - DNA, 21 bp, Homo sapiens
acactgaagctcttgaagaca

SEQ ID NO: 510037 - DNA, 12 bp, Homo sapiens
acactgagaaag

SEQ ID NO: 510038 - DNA, 22 bp, Homo sapiens
acacttttgaaaatgtacatgt

SEQ ID NO: 510039 - DNA, 16 bp, Homo sapiens
acagataacttcttta

SEQ ID NO: 510040 - DNA, 19 bp, Homo sapiens
acagctactataaatatac

SEQ ID NO: 510041 - DNA, 14 bp, Homo sapiens
acaggcgaggcctg

SEQ ID NO: 510042 - DNA, 21 bp, Homo sapiens
acaggtttttagtttgttctt

SEQ ID NO: 510043 - DNA, 23 bp, Homo sapiens
acagtaaacactccacattcttc

SEQ ID NO: 510044 - DNA, 17 bp, Homo sapiens
acatatttgtatgtttt

SEQ ID NO: 510045 - DNA, 23 bp, Homo sapiens
acatatttgtatgtttttctgta

SEQ ID NO: 510046 - DNA, 13 bp, Homo sapiens
acattaaattgat

SEQ ID NO: 510047 - DNA, 20 bp, Homo sapiens
acattctggctcagggaggt

SEQ ID NO: 510048 - DNA, 20 bp, Homo sapiens
acattcttcagtttttcact

SEQ ID NO: 510049 - DNA, 13 bp, Homo sapiens
acattttcacaca

SEQ ID NO: 510050 - DNA, 15 bp, Homo sapiens
acattttcacacaat

SEQ ID NO: 510051 - DNA, 20 bp, Homo sapiens
acattttcacacaatacaat

SEQ ID NO: 510052 - DNA, 22 bp, Homo sapiens
agatgaaacattaactctaact

SEQ ID NO: 510053 - DNA, 18 bp, Homo sapiens
agatgaagcaaacacatt

SEQ ID NO: 510054 - DNA, 16 bp, Homo sapiens
agatgcaagaaggagg

SEQ ID NO: 510055 - DNA, 22 bp, Homo sapiens
agatgggcatatgtgtcagtgg

SEQ ID NO: 510056 - DNA, 19 bp, Homo sapiens
agattgatagggagtttta

SEQ ID NO: 510057 - DNA, 20 bp, Homo sapiens
agcaaagtattgtgaaagta

SEQ ID NO: 510058 - DNA, 22 bp, Homo sapiens
agcaaagtattgtgaaagtatt

SEQ ID NO: 510059 - DNA, 14 bp, Homo sapiens
agcaatttgaaata

SEQ ID NO: 510060 - DNA, 21 bp, Homo sapiens
agcaatttgaaataattttca

SEQ ID NO: 510061 - DNA, 17 bp, Homo sapiens
agcactgttccagcctg

SEQ ID NO: 510062 - DNA, 15 bp, Homo sapiens
agcagcctggagccc

SEQ ID NO: 510063 - DNA, 19 bp, Homo sapiens
agcagcctggagccctgga

SEQ ID NO: 510064 - DNA, 14 bp, Homo sapiens
agcagtgcttctca

SEQ ID NO: 510065 - DNA, 22 bp, Homo sapiens
agcattgctcaagaggaaaatc

SEQ ID NO: 510066 - DNA, 16 bp, Homo sapiens
agccaagttttaaata

SEQ ID NO: 510067 - DNA, 23 bp, Homo sapiens
agccatgggcacaaagggcccag

SEQ ID NO: 510068 - DNA, 12 bp, Homo sapiens
agccctggcccc

SEQ ID NO: 510069 - DNA, 16 bp, Homo sapiens
agccctggccccctga

SEQ ID NO: 510070 - DNA, 18 bp, Homo sapiens
agcctggagccctggaga

SEQ ID NO: 510071 - DNA, 16 bp, Homo sapiens
agccttggatgtatat

SEQ ID NO: 510072 - DNA, 21 bp, Homo sapiens
agctcccaggccgagaagcca

SEQ ID NO: 510073 - DNA, 20 bp, Homo sapiens
agctcctcgagggcagggac

SEQ ID NO: 510074 - DNA, 19 bp, Homo sapiens
agcttctcatcctgcaggc

SEQ ID NO: 510075 - DNA, 14 bp, Homo sapiens
aggaagtgaaccca

SEQ ID NO: 510076 - DNA, 14 bp, Homo sapiens
aggactgtcccctt

SEQ ID NO: 510077 - DNA, 18 bp, Homo sapiens
aggagaatcatcaggacc

SEQ ID NO: 510078 - DNA, 17 bp, Homo sapiens
aggaggcagcaggactg

SEQ ID NO: 510079 - DNA, 21 bp, Homo sapiens
aggaggctatgctcaggggcc

SEQ ID NO: 510080 - DNA, 20 bp, Homo sapiens
aggagggagagtctcccagg

SEQ ID NO: 510081 - DNA, 20 bp, Homo sapiens
aggcagctttttctctccca

SEQ ID NO: 510082 - DNA, 22 bp, Homo sapiens
aggcagggacctaaagggacta

SEQ ID NO: 510083 - DNA, 16 bp, Homo sapiens
aggccaggtccagaga

SEQ ID NO: 510084 - DNA, 18 bp, Homo sapiens
aggccttatgagggtcct

SEQ ID NO: 510085 - DNA, 21 bp, Homo sapiens
agggacgaagaagagccacag

SEQ ID NO: 510086 - DNA, 20 bp, Homo sapiens
agggagagtctcccagggag

SEQ ID NO: 510087 - DNA, 20 bp, Homo sapiens
agggagttttaaagaaattt

SEQ ID NO: 510088 - DNA, 19 bp, Homo sapiens
aggggaagtaaaacagtca

SEQ ID NO: 510089 - DNA, 15 bp, Homo sapiens
aggggccctggagca

SEQ ID NO: 510090 - DNA, 15 bp, Homo sapiens
agggtcgtgggaaag

SEQ ID NO: 510091 - DNA, 22 bp, Homo sapiens
agggtcgtgggaaaggggagta

SEQ ID NO: 510092 - DNA, 19 bp, Homo sapiens
aggtccagagagaccgagg

SEQ ID NO: 510093 - DNA, 21 bp, Homo sapiens
aggtctctgttgactggctgt

SEQ ID NO: 510094 - DNA, 21 bp, Homo sapiens
aggtgggggaacactgagaaa

SEQ ID NO: 510095 - DNA, 12 bp, Homo sapiens
agtaaaacagtc

SEQ ID NO: 510096 - DNA, 14 bp, Homo sapiens
agtaaaacagtcat

SEQ ID NO: 510097 - DNA, 15 bp, Homo sapiens
agtaaataaacaagt

SEQ ID NO: 510098 - DNA, 20 bp, Homo sapiens
agtaggtgggggaacactga

SEQ ID NO: 510099 - DNA, 19 bp, Homo sapiens
agtagttactaaaattatg

SEQ ID NO: 510100 - DNA, 22 bp, Homo sapiens
agtatgcaaagcaatcttttat

SEQ ID NO: 510101 - DNA, 13 bp, Homo sapiens
agtcactggaaag

SEQ ID NO: 510102 - DNA, 16 bp, Homo sapiens
agtcagcagtcatgca

SEQ ID NO: 510103 - DNA, 22 bp, Homo sapiens
agtcgaaccatggtgaactcca

SEQ ID NO: 510104 - DNA, 13 bp, Homo sapiens
agtctcccaggga

SEQ ID NO: 510105 - DNA, 15 bp, Homo sapiens
agtctgatccaggag

SEQ ID NO: 510106 - DNA, 22 bp, Homo sapiens
agtctgatccaggaggccgggg

SEQ ID NO: 510107 - DNA, 20 bp, Homo sapiens
agtctttacagctgagcaca

SEQ ID NO: 510108 - DNA, 14 bp, Homo sapiens
agtgacttgcccag

SEQ ID NO: 510109 - DNA, 13 bp, Homo sapiens
agtgcaacctctg

SEQ ID NO: 510110 - DNA, 16 bp, Homo sapiens
agtgccagtcagcagt

SEQ ID NO: 510111 - DNA, 12 bp, Homo sapiens
agtgctgtaaaa

SEQ ID NO: 510112 - DNA, 19 bp, Homo sapiens
agtggtatatacaagtaga

SEQ ID NO: 510113 - DNA, 16 bp, Homo sapiens
agttaactattttatt

SEQ ID NO: 510114 - DNA, 23 bp, Homo sapiens
agttgctaacttaaaaaactgca

SEQ ID NO: 510115 - DNA, 19 bp, Homo sapiens
agtttccttttctgtctct

SEQ ID NO: 510116 - DNA, 17 bp, Homo sapiens
agtttgttcttcagatt

SEQ ID NO: 510117 - DNA, 14 bp, Homo sapiens
agttttaaatatta

SEQ ID NO: 510118 - DNA, 16 bp, Homo sapiens
agttttgtttcacttt

SEQ ID NO: 510119 - DNA, 18 bp, Homo sapiens
ataaaacattttcacaca

SEQ ID NO: 510120 - DNA, 20 bp, Homo sapiens
ataaaacattttcacacaat

SEQ ID NO: 510121 - DNA, 20 bp, Homo sapiens
ataaagccttggatgtatat

SEQ ID NO: 510122 - DNA, 14 bp, Homo sapiens
ataagcattgctca

SEQ ID NO: 510123 - DNA, 13 bp, Homo sapiens
ggtgttgaatcca

SEQ ID NO: 510124 - DNA, 12 bp, Homo sapiens
gtaataaacagg

SEQ ID NO: 510125 - DNA, 16 bp, Homo sapiens
gtaataatgtgaatca

SEQ ID NO: 510126 - DNA, 19 bp, Homo sapiens
gtactggctgatggagtaa

SEQ ID NO: 510127 - DNA, 23 bp, Homo sapiens
gtagttgcataagcattgctcaa

SEQ ID NO: 510128 - DNA, 18 bp, Homo sapiens
gtccagagagaccgagga

SEQ ID NO: 510129 - DNA, 20 bp, Homo sapiens
gtccagagagaccgaggagg

SEQ ID NO: 510130 - DNA, 18 bp, Homo sapiens
gtcgtgggaaaggggagt

SEQ ID NO: 510131 - DNA, 14 bp, Homo sapiens
gtgaacacttttga

SEQ ID NO: 510132 - DNA, 21 bp, Homo sapiens
gtgcaacctctgcttcccagg

SEQ ID NO: 510133 - DNA, 21 bp, Homo sapiens
gtgcctaggattgtgcctgta

SEQ ID NO: 510134 - DNA, 19 bp, Homo sapiens
gtgcctgtatgcaacaggc

SEQ ID NO: 510135 - DNA, 20 bp, Homo sapiens
gtgccttgccacattaaatt

SEQ ID NO: 510136 - DNA, 16 bp, Homo sapiens
gtgcttccaaggcaga

SEQ ID NO: 510137 - DNA, 14 bp, Homo sapiens
gtggagtgcagtgg

SEQ ID NO: 510138 - DNA, 17 bp, Homo sapiens
gtggagtgcagtggtgc

SEQ ID NO: 510139 - DNA, 22 bp, Homo sapiens
gtggcctgtagaatagcctgtg

SEQ ID NO: 510140 - DNA, 16 bp, Homo sapiens
gtgggaaaggggagta

SEQ ID NO: 510141 - DNA, 20 bp, Homo sapiens
gtgtcagtggggctctctga

SEQ ID NO: 510142 - DNA, 21 bp, Homo sapiens
gttaaaccatccatgtatttt

SEQ ID NO: 510143 - DNA, 17 bp, Homo sapiens
gttaaggttcaagacag

SEQ ID NO: 510144 - DNA, 13 bp, Homo sapiens
gttactatatgcc

SEQ ID NO: 510145 - DNA, 18 bp, Homo sapiens
gttatcttttaattacag

SEQ ID NO: 510146 - DNA, 14 bp, Homo sapiens
gttccctttttcat

SEQ ID NO: 510147 - DNA, 20 bp, Homo sapiens
gttgacacctcgcccctgct

SEQ ID NO: 510148 - DNA, 13 bp, Homo sapiens
gtttataatgcag

SEQ ID NO: 510149 - DNA, 13 bp, Homo sapiens
gtttcttaactta

SEQ ID NO: 510150 - DNA, 13 bp, Homo sapiens
gttttgtttcact

SEQ ID NO: 510151 - DNA, 14 bp, Homo sapiens
gttttgtttcactt

SEQ ID NO: 510152 - DNA, 18 bp, Homo sapiens
taaaacattttcacacaa

SEQ ID NO: 510153 - DNA, 18 bp, Homo sapiens
taaactaaaaatttacaa

SEQ ID NO: 510154 - DNA, 22 bp, Homo sapiens
taaactaaaaatttacaagaga

SEQ ID NO: 510155 - DNA, 18 bp, Homo sapiens
taaagggactacctctgt

SEQ ID NO: 510156 - DNA, 23 bp, Homo sapiens
taaatatagtgaagcaatttgaa

SEQ ID NO: 510157 - DNA, 22 bp, Homo sapiens
taaatcatctttattaagtaga

SEQ ID NO: 510158 - DNA, 21 bp, Homo sapiens
taaattgataacatggaaatg

SEQ ID NO: 510159 - DNA, 17 bp, Homo sapiens
taacagccttttccttc

SEQ ID NO: 510160 - DNA, 16 bp, Homo sapiens
taaccaccccatctgc

SEQ ID NO: 510161 - DNA, 17 bp, Homo sapiens
taacgaccacagggtct

SEQ ID NO: 510162 - DNA, 17 bp, Homo sapiens
taactgtgaaatgtacg

SEQ ID NO: 510163 - DNA, 21 bp, Homo sapiens
taagccaagttttaaatatta

SEQ ID NO: 510164 - DNA, 15 bp, Homo sapiens
taagccctggccccc

SEQ ID NO: 510165 - DNA, 16 bp, Homo sapiens
taataaaataattctc

SEQ ID NO: 510166 - DNA, 17 bp, Homo sapiens
taatgtgcctagttctt

SEQ ID NO: 510167 - DNA, 13 bp, Homo sapiens
taattctaaggaa

SEQ ID NO: 510168 - DNA, 19 bp, Homo sapiens
tacaagagaagaaagtgaa

SEQ ID NO: 510169 - DNA, 20 bp, Homo sapiens
tacagaagagtttcttaact

SEQ ID NO: 510170 - DNA, 15 bp, Homo sapiens
tacagataacttctt

SEQ ID NO: 510171 - DNA, 19 bp, Homo sapiens
ctgaaatatacacacagca

SEQ ID NO: 510172 - DNA, 19 bp, Homo sapiens
ctgaactgatgggtttctc

SEQ ID NO: 510173 - DNA, 13 bp, Homo sapiens
ctgaaggcctggc

SEQ ID NO: 510174 - DNA, 19 bp, Homo sapiens
ctgacactcaataaacagt

SEQ ID NO: 510175 - DNA, 20 bp, Homo sapiens
ctgactgtctcccgggacta

SEQ ID NO: 510176 - DNA, 19 bp, Homo sapiens
ctgagcacattctggctca

SEQ ID NO: 510177 - DNA, 22 bp, Homo sapiens
ctgagcgcctgggtccagggga

SEQ ID NO: 510178 - DNA, 16 bp, Homo sapiens
ctgagggtcgtgggaa

SEQ ID NO: 510179 - DNA, 22 bp, Homo sapiens
ctgagggtcgtgggaaagggga

SEQ ID NO: 510180 - DNA, 13 bp, Homo sapiens
ctgagtcctggcc

SEQ ID NO: 510181 - DNA, 12 bp, Homo sapiens
ctgcagcccagg

SEQ ID NO: 510182 - DNA, 16 bp, Homo sapiens
ctgcccctctctgggc

SEQ ID NO: 510183 - DNA, 22 bp, Homo sapiens
ctgcccctctctgggcctcaga

SEQ ID NO: 510184 - DNA, 20 bp, Homo sapiens
ctgcccgcagacctctggat

SEQ ID NO: 510185 - DNA, 18 bp, Homo sapiens
ctgcgaatctagaggagg

SEQ ID NO: 510186 - DNA, 12 bp, Homo sapiens
ctgcttcccagg

SEQ ID NO: 510187 - DNA, 13 bp, Homo sapiens
ctgcttcccaggt

SEQ ID NO: 510188 - DNA, 23 bp, Homo sapiens
ctgcttcccaggttcaagcgatt

SEQ ID NO: 510189 - DNA, 20 bp, Homo sapiens
ctggagaccccaccagcctc

SEQ ID NO: 510190 - DNA, 21 bp, Homo sapiens
ctggagaccccaccagcctca

SEQ ID NO: 510191 - DNA, 17 bp, Homo sapiens
ctggagcagccacccca

SEQ ID NO: 510192 - DNA, 15 bp, Homo sapiens
ctggagccctggaga

SEQ ID NO: 510193 - DNA, 18 bp, Homo sapiens
ctggccttgccacactct

SEQ ID NO: 510194 - DNA, 19 bp, Homo sapiens
ctgggattacaggtgtgca

SEQ ID NO: 510195 - DNA, 20 bp, Homo sapiens
ctgggcagctaccatttccc

SEQ ID NO: 510196 - DNA, 15 bp, Homo sapiens
ctgtaaaaactgtgg

SEQ ID NO: 510197 - DNA, 19 bp, Homo sapiens
ctgtagaatagcctgtggc

SEQ ID NO: 510198 - DNA, 17 bp, Homo sapiens
ctgtagttgcataagca

SEQ ID NO: 510199 - DNA, 14 bp, Homo sapiens
ctgtatatttcttt

SEQ ID NO: 510200 - DNA, 13 bp, Homo sapiens
ctgtatttttcag

SEQ ID NO: 510201 - DNA, 11 bp, Homo sapiens
ctgtcttccca

SEQ ID NO: 510202 - DNA, 14 bp, Homo sapiens
ctgtgcagccccgc

SEQ ID NO: 510203 - DNA, 20 bp, Homo sapiens
ctgtgtttgagctctgcagc

SEQ ID NO: 510204 - DNA, 22 bp, Homo sapiens
ctgtgtttgagctctgcagccc

SEQ ID NO: 510205 - DNA, 14 bp, Homo sapiens
ctgttccagcctgc

SEQ ID NO: 510206 - DNA, 17 bp, Homo sapiens
ctgttccagcctgccct

SEQ ID NO: 510207 - DNA, 14 bp, Homo sapiens
cttaagccctggcc

SEQ ID NO: 510208 - DNA, 12 bp, Homo sapiens
cttaaggggcag

SEQ ID NO: 510209 - DNA, 20 bp, Homo sapiens
cttatgaaaagtactaatag

SEQ ID NO: 510210 - DNA, 13 bp, Homo sapiens
cttcattttgtat

SEQ ID NO: 510211 - DNA, 17 bp, Homo sapiens
cttcattttgtataatc

SEQ ID NO: 510212 - DNA, 19 bp, Homo sapiens
cttccagggacgaagaaga

SEQ ID NO: 510213 - DNA, 22 bp, Homo sapiens
cttccagggacgaagaagagcc

SEQ ID NO: 510214 - DNA, 13 bp, Homo sapiens
cttgccacactct

SEQ ID NO: 510215 - DNA, 19 bp, Homo sapiens
cttgccacattaaattgat

SEQ ID NO: 510216 - DNA, 13 bp, Homo sapiens
cttgcctgcaggc

SEQ ID NO: 510217 - DNA, 13 bp, Homo sapiens
cttgtgacccagc

SEQ ID NO: 510218 - DNA, 17 bp, Homo sapiens
cttgtgacccagcactg

SEQ ID NO: 510219 - DNA, 19 bp, Homo sapiens
ctttaggggaagtaaaaca

SEQ ID NO: 510220 - DNA, 23 bp, Homo sapiens
ctttaggggaagtaaaacagtca

SEQ ID NO: 510221 - DNA, 14 bp, Homo sapiens
ctttgtaattgaca

SEQ ID NO: 510222 - DNA, 21 bp, Homo sapiens
cttttatacaataattgaagt

SEQ ID NO: 510223 - DNA, 16 bp, Homo sapiens
cttttgaaaatgtaca

SEQ ID NO: 510224 - DNA, 16 bp, Homo sapiens
ctttttcataattact

SEQ ID NO: 510225 - DNA, 18 bp, Homo sapiens
gaaagagtgccagtcagc

SEQ ID NO: 510226 - DNA, 22 bp, Homo sapiens
gaaagctcctcgagggcaggga

SEQ ID NO: 510227 - DNA, 21 bp, Homo sapiens
gaaaggggagtaggtggggga

SEQ ID NO: 510228 - DNA, 20 bp, Homo sapiens
gaaaggtttgagaagcactg

SEQ ID NO: 510229 - DNA, 16 bp, Homo sapiens
gaaatgtacgtcattt

SEQ ID NO: 510230 - DNA, 17 bp, Homo sapiens
gaactggagccatgggc

SEQ ID NO: 510231 - DNA, 24 bp, Homo sapiens
gaactttccacattcagagcttac

SEQ ID NO: 510232 - DNA, 15 bp, Homo sapiens
gaagagtttcttaac

SEQ ID NO: 510233 - DNA, 17 bp, Homo sapiens
gaagcaaacacattaag

SEQ ID NO: 510234 - DNA, 19 bp, Homo sapiens
gaagcactgttccagcctg

SEQ ID NO: 510235 - DNA, 22 bp, Homo sapiens
gaaggagaatcatcaggaccct

SEQ ID NO: 510236 - DNA, 21 bp, Homo sapiens
gaaggaggctatgctcagggg

SEQ ID NO: 510237 - DNA, 14 bp, Homo sapiens
gaagtaaaacagtc

SEQ ID NO: 510238 - DNA, 13 bp, Homo sapiens
gaattcactgagt

SEQ ID NO: 510239 - DNA, 16 bp, Homo sapiens
gacactatatatttct

SEQ ID NO: 510240 - DNA, 20 bp, Homo sapiens
gacactatatatttcttaat

SEQ ID NO: 510241 - DNA, 21 bp, Homo sapiens
gacagcttctcatcctgcagg

SEQ ID NO: 510242 - DNA, 23 bp, Homo sapiens
gacagtaaacactccacattctt

SEQ ID NO: 510243 - DNA, 19 bp, Homo sapiens
gacattccttctacatgta

SEQ ID NO: 510244 - DNA, 22 bp, Homo sapiens
gacattccttctacatgtaatg

SEQ ID NO: 510245 - DNA, 13 bp, Homo sapiens
gacccagcactgc

SEQ ID NO: 510246 - DNA, 17 bp, Homo sapiens
gacccagcactgcccaa

SEQ ID NO: 510247 - DNA, 23 bp, Homo sapiens
gaccgtttgtccacttcattttg

SEQ ID NO: 510248 - DNA, 18 bp, Homo sapiens
gacctaaagggactacct

SEQ ID NO: 510249 - DNA, 18 bp, Homo sapiens
gacgaagaagagccacag

SEQ ID NO: 510250 - DNA, 20 bp, Homo sapiens
gactctgaatctttttcaga

SEQ ID NO: 510251 - DNA, 21 bp, Homo sapiens
gactctgaatctttttcagaa

SEQ ID NO: 510252 - DNA, 14 bp, Homo sapiens
gagaatcatcagga

SEQ ID NO: 510253 - DNA, 15 bp, Homo sapiens
gagacagacattcac

SEQ ID NO: 510254 - DNA, 18 bp, Homo sapiens
gagaccccaccagcctca

SEQ ID NO: 510255 - DNA, 19 bp, Homo sapiens
gagagaccgaggagggaga

SEQ ID NO: 510256 - DNA, 17 bp, Homo sapiens
gagaggaggcagcagga

SEQ ID NO: 510257 - DNA, 20 bp, Homo sapiens
gagatgaagcaaacacatta

SEQ ID NO: 510258 - DNA, 20 bp, Homo sapiens
gagcagccaccccatgctgg

SEQ ID NO: 510259 - DNA, 14 bp, Homo sapiens
gagcatgagaggag

SEQ ID NO: 510260 - DNA, 17 bp, Homo sapiens
gagccatgggcacaaag

SEQ ID NO: 510261 - DNA, 19 bp, Homo sapiens
gagctgcccacagcaggcc

SEQ ID NO: 510262 - DNA, 22 bp, Homo sapiens
gaggcagggacctaaagggact

SEQ ID NO: 510263 - DNA, 13 bp, Homo sapiens
gagtcggaagggc

SEQ ID NO: 510264 - DNA, 14 bp, Homo sapiens
gagtctcccaggga

SEQ ID NO: 510265 - DNA, 14 bp, Homo sapiens
gagtttccttttct

SEQ ID NO: 510266 - DNA, 15 bp, Homo sapiens
gataacttctttagg

SEQ ID NO: 510267 - DNA, 15 bp, Homo sapiens
gatataaataaaaca

SEQ ID NO: 510268 - DNA, 16 bp, Homo sapiens
gatctcggctcagtgc

SEQ ID NO: 510269 - DNA, 16 bp, Homo sapiens
gatgaagcaaacacat

SEQ ID NO: 510270 - DNA, 23 bp, Homo sapiens
gatgggcatatgtgtcagtgggg

SEQ ID NO: 510271 - DNA, 15 bp, Homo sapiens
gattctcctgcctca

SEQ ID NO: 510272 - DNA, 17 bp, Homo sapiens
gcaaagcaatcttttat

SEQ ID NO: 510273 - DNA, 19 bp, Homo sapiens
gcaaagtattgtgaaagta

SEQ ID NO: 510274 - DNA, 20 bp, Homo sapiens
gcaacctctgcttcccaggt

SEQ ID NO: 510275 - DNA, 14 bp, Homo sapiens
gcaagaaggaggct

SEQ ID NO: 510276 - DNA, 22 bp, Homo sapiens
gcacttaacaagctcccaggcc

SEQ ID NO: 510277 - DNA, 12 bp, Homo sapiens
gcagacctctgg

SEQ ID NO: 510278 - DNA, 12 bp, Homo sapiens
gcagcctggagc

SEQ ID NO: 510279 - DNA, 14 bp, Homo sapiens
accagcctcaccag

SEQ ID NO: 510280 - DNA, 18 bp, Homo sapiens
accatgatggccaggctg

SEQ ID NO: 510281 - DNA, 19 bp, Homo sapiens
accatgatggccaggctga

SEQ ID NO: 510282 - DNA, 15 bp, Homo sapiens
acccagggtggagtg

SEQ ID NO: 510283 - DNA, 14 bp, Homo sapiens
accccacctcttcc

SEQ ID NO: 510284 - DNA, 16 bp, Homo sapiens
accccatctgcattcc

SEQ ID NO: 510285 - DNA, 19 bp, Homo sapiens
accctaaaaagcagagctt

SEQ ID NO: 510286 - DNA, 18 bp, Homo sapiens
accgtttgtccacttcat

SEQ ID NO: 510287 - DNA, 21 bp, Homo sapiens
acctaaagggactacctctgt

SEQ ID NO: 510288 - DNA, 13 bp, Homo sapiens
acctacatatttg

SEQ ID NO: 510289 - DNA, 17 bp, Homo sapiens
acctctgcttcccaggt

SEQ ID NO: 510290 - DNA, 18 bp, Homo sapiens
acctgtatatttctttta

SEQ ID NO: 510291 - DNA, 20 bp, Homo sapiens
accttcacgattaactgtga

SEQ ID NO: 510292 - DNA, 17 bp, Homo sapiens
acctttctaaccttcac

SEQ ID NO: 510293 - DNA, 18 bp, Homo sapiens
acgaagaagagccacagt

SEQ ID NO: 510294 - DNA, 22 bp, Homo sapiens
acgcgaaagtatcaccagggtg

SEQ ID NO: 510295 - DNA, 14 bp, Homo sapiens
actacctctgtgcc

SEQ ID NO: 510296 - DNA, 15 bp, Homo sapiens
actatatatttctta

SEQ ID NO: 510297 - DNA, 15 bp, Homo sapiens
actcaataaacagtc

SEQ ID NO: 510298 - DNA, 18 bp, Homo sapiens
actcctaacctcaagtga

SEQ ID NO: 510299 - DNA, 17 bp, Homo sapiens
actctcgcatcttccca

SEQ ID NO: 510300 - DNA, 20 bp, Homo sapiens
actgaaggcctggcccacag

SEQ ID NO: 510301 - DNA, 20 bp, Homo sapiens
actgagttttgtttcacttt

SEQ ID NO: 510302 - DNA, 21 bp, Homo sapiens
actgagttttgtttcactttg

SEQ ID NO: 510303 - DNA, 19 bp, Homo sapiens
actgcccaaagtgcttcca

SEQ ID NO: 510304 - DNA, 15 bp, Homo sapiens
actgtccccttgaag

SEQ ID NO: 510305 - DNA, 14 bp, Homo sapiens
actgttccagcctg

SEQ ID NO: 510306 - DNA, 22 bp, Homo sapiens
acttcattttgtataatcacag

SEQ ID NO: 510307 - DNA, 19 bp, Homo sapiens
acttctacctacatatttg

SEQ ID NO: 510308 - DNA, 19 bp, Homo sapiens
acttcttgtgttaaactaa

SEQ ID NO: 510309 - DNA, 13 bp, Homo sapiens
acttgcacctctg

SEQ ID NO: 510310 - DNA, 17 bp, Homo sapiens
actttttatattttata

SEQ ID NO: 510311 - DNA, 14 bp, Homo sapiens
agaaagaggcaggg

SEQ ID NO: 510312 - DNA, 14 bp, Homo sapiens
agaaagtgaaagca

SEQ ID NO: 510313 - DNA, 14 bp, Homo sapiens
agaagagccacagt

SEQ ID NO: 510314 - DNA, 22 bp, Homo sapiens
agaagagccacagtgagggaga

SEQ ID NO: 510315 - DNA, 15 bp, Homo sapiens
agaagagtttcttaa

SEQ ID NO: 510316 - DNA, 21 bp, Homo sapiens
agaagagtttcttaacttact

SEQ ID NO: 510317 - DNA, 17 bp, Homo sapiens
agaagtacctttgttac

SEQ ID NO: 510318 - DNA, 16 bp, Homo sapiens
agaatcagtgcaaaga

SEQ ID NO: 510319 - DNA, 15 bp, Homo sapiens
agaatctactttaat

SEQ ID NO: 510320 - DNA, 15 bp, Homo sapiens
agaatgaaagctcct

SEQ ID NO: 510321 - DNA, 22 bp, Homo sapiens
agacagcttctcatcctgcagg

SEQ ID NO: 510322 - DNA, 23 bp, Homo sapiens
agacctctggattaggtctctgt

SEQ ID NO: 510323 - DNA, 23 bp, Homo sapiens
agactcctgactgtctcccggga

SEQ ID NO: 510324 - DNA, 20 bp, Homo sapiens
agactctcgcatcttcccaa

SEQ ID NO: 510325 - DNA, 20 bp, Homo sapiens
agactgctgtgtttgagctc

SEQ ID NO: 510326 - DNA, 19 bp, Homo sapiens
agaggagggggcaggctga

SEQ ID NO: 510327 - DNA, 20 bp, Homo sapiens
agaggagggggcaggctgag

SEQ ID NO: 510328 - DNA, 13 bp, Homo sapiens
agagtctcccagg

SEQ ID NO: 510329 - DNA, 13 bp, Homo sapiens
agataacttcttt

SEQ ID NO: 510330 - DNA, 17 bp, Homo sapiens
agatcttttttttttcc

SEQ ID NO: 510331 - DNA, 17 bp, Homo sapiens
agatgaagcaaacacat

SEQ ID NO: 510332 - DNA, 17 bp, Homo sapiens
agatgatgggggagggg

SEQ ID NO: 510333 - DNA, 18 bp, Homo sapiens
agcaaagtattgtgaaag

SEQ ID NO: 510334 - DNA, 14 bp, Homo sapiens
agcagcctggagcc

SEQ ID NO: 510335 - DNA, 16 bp, Homo sapiens
agcagcctggagccct

SEQ ID NO: 510336 - DNA, 17 bp, Homo sapiens
agcatgagaggaggcag

SEQ ID NO: 510337 - DNA, 20 bp, Homo sapiens
agccatgacttgagaaacaa

SEQ ID NO: 510338 - DNA, 13 bp, Homo sapiens
agcctcgctctgt

SEQ ID NO: 510339 - DNA, 17 bp, Homo sapiens
agcctggagccctggag

SEQ ID NO: 510340 - DNA, 13 bp, Homo sapiens
agcctgtggcctt

SEQ ID NO: 510341 - DNA, 18 bp, Homo sapiens
agcgtactcatcatcaac

SEQ ID NO: 510342 - DNA, 23 bp, Homo sapiens
agcgtgggtgttgaatccagcac

SEQ ID NO: 510343 - DNA, 14 bp, Homo sapiens
agctactataaata

SEQ ID NO: 510344 - DNA, 18 bp, Homo sapiens
agctactataaatataca

SEQ ID NO: 510345 - DNA, 13 bp, Homo sapiens
agctcccaggccg

SEQ ID NO: 510346 - DNA, 14 bp, Homo sapiens
agctcccaggccga

SEQ ID NO: 510347 - DNA, 17 bp, Homo sapiens
agctcctcgagggcagg

SEQ ID NO: 510348 - DNA, 14 bp, Homo sapiens
agctctgcagccca

SEQ ID NO: 510349 - DNA, 16 bp, Homo sapiens
agctgcccctctctgg

SEQ ID NO: 510350 - DNA, 18 bp, Homo sapiens
agctgcccctctctgggc

SEQ ID NO: 510351 - DNA, 15 bp, Homo sapiens
agcttccataacatt

SEQ ID NO: 510352 - DNA, 20 bp, Homo sapiens
agctttgcttctctctctaa

SEQ ID NO: 510353 - DNA, 14 bp, Homo sapiens
aggaccctggacct

SEQ ID NO: 510354 - DNA, 23 bp, Homo sapiens
aggactgtccccttgaaggagaa

SEQ ID NO: 510355 - DNA, 14 bp, Homo sapiens
aggcacctgcattt

SEQ ID NO: 510356 - DNA, 18 bp, Homo sapiens
aggcatccttcctcacac

SEQ ID NO: 510357 - DNA, 19 bp, Homo sapiens
aggccacatggggctgggc

SEQ ID NO: 510358 - DNA, 23 bp, Homo sapiens
aggccagggtcactgaaggcctg

SEQ ID NO: 510359 - DNA, 15 bp, Homo sapiens
aggccaggtccagag

SEQ ID NO: 510360 - DNA, 17 bp, Homo sapiens
aggccaggtccagagag

SEQ ID NO: 510361 - DNA, 16 bp, Homo sapiens
aggctgagggtcgtgg

SEQ ID NO: 510362 - DNA, 23 bp, Homo sapiens
aggctgagggtcgtgggaaaggg

SEQ ID NO: 510363 - DNA, 14 bp, Homo sapiens
aggcttacacccac

SEQ ID NO: 510364 - DNA, 15 bp, Homo sapiens
aggcttgcctgcagg

SEQ ID NO: 510365 - DNA, 16 bp, Homo sapiens
aggcttgcctgcaggc

SEQ ID NO: 510366 - DNA, 16 bp, Homo sapiens
agggaattgcagagta

SEQ ID NO: 510367 - DNA, 17 bp, Homo sapiens
agggacgaagaagagcc

SEQ ID NO: 510368 - DNA, 17 bp, Homo sapiens
agggactacctctgtgc

SEQ ID NO: 510369 - DNA, 18 bp, Homo sapiens
agggactacctctgtgcc

SEQ ID NO: 510370 - DNA, 20 bp, Homo sapiens
agggagcatgagaggaggca

SEQ ID NO: 510371 - DNA, 12 bp, Homo sapiens
agggcagggact

SEQ ID NO: 510372 - DNA, 18 bp, Homo sapiens
aggggaagtaaaacagtc

SEQ ID NO: 510373 - DNA, 15 bp, Homo sapiens
aggggaggccttcca

SEQ ID NO: 510374 - DNA, 21 bp, Homo sapiens
aggggagtaggtgggggaaca

SEQ ID NO: 510375 - DNA, 11 bp, Homo sapiens
aggggcagctt

SEQ ID NO: 510376 - DNA, 14 bp, Homo sapiens
aggggcagcttcta

SEQ ID NO: 510377 - DNA, 18 bp, Homo sapiens
aggggcgggacccaggca

SEQ ID NO: 510378 - DNA, 19 bp, Homo sapiens
aggggcgggacccaggcac

SEQ ID NO: 510379 - DNA, 18 bp, Homo sapiens
agggtcctctacttcagg

SEQ ID NO: 510380 - DNA, 17 bp, Homo sapiens
agggtcgtgggaaaggg

SEQ ID NO: 510381 - DNA, 21 bp, Homo sapiens
agtaacgggacagtaaacact

SEQ ID NO: 510382 - DNA, 17 bp, Homo sapiens
agtaggtgggggaacac

SEQ ID NO: 510383 - DNA, 17 bp, Homo sapiens
agtcaatagcttgtctt

SEQ ID NO: 510384 - DNA, 19 bp, Homo sapiens
agtcatctagaattcactg

SEQ ID NO: 510385 - DNA, 15 bp, Homo sapiens
agtccttgcaagaat

SEQ ID NO: 510386 - DNA, 18 bp, Homo sapiens
agtccttgcaagaatcag

SEQ ID NO: 510387 - DNA, 15 bp, Homo sapiens
agtctcccagggagc

SEQ ID NO: 510388 - DNA, 16 bp, Homo sapiens
agtgagggagatccca

SEQ ID NO: 510389 - DNA, 15 bp, Homo sapiens
agtgaggtgcccagc

SEQ ID NO: 510390 - DNA, 15 bp, Homo sapiens
agtgatcctcccacc

SEQ ID NO: 510391 - DNA, 17 bp, Homo sapiens
agtgcttccaaggcaga

SEQ ID NO: 510392 - DNA, 22 bp, Homo sapiens
agtggaaagacagcttctcatc

SEQ ID NO: 510393 - DNA, 20 bp, Homo sapiens
agtggggctctctgagtcct

SEQ ID NO: 510394 - DNA, 20 bp, Homo sapiens
ctctctgagtcctggcccaa

SEQ ID NO: 510395 - DNA, 16 bp, Homo sapiens
ctctgcagcccaggga

SEQ ID NO: 510396 - DNA, 11 bp, Homo sapiens
ctgagaaagag

SEQ ID NO: 510397 - DNA, 16 bp, Homo sapiens
ctgagccagtgtcagg

SEQ ID NO: 510398 - DNA, 22 bp, Homo sapiens
ctgagctgcccacagcaggcca

SEQ ID NO: 510399 - DNA, 15 bp, Homo sapiens
ctgagggtcgtggga

SEQ ID NO: 510400 - DNA, 18 bp, Homo sapiens
ctgagggtcgtgggaaag

SEQ ID NO: 510401 - DNA, 19 bp, Homo sapiens
ctgagggtcgtgggaaagg

SEQ ID NO: 510402 - DNA, 19 bp, Homo sapiens
ctgagttttgtttcacttt

SEQ ID NO: 510403 - DNA, 16 bp, Homo sapiens
ctgcagcccagggacc

SEQ ID NO: 510404 - DNA, 15 bp, Homo sapiens
ctgccaccaaaggcc

SEQ ID NO: 510405 - DNA, 23 bp, Homo sapiens
ctgcccctctctgggcctcagag

SEQ ID NO: 510406 - DNA, 19 bp, Homo sapiens
ctggagaccccaccagcct

SEQ ID NO: 510407 - DNA, 13 bp, Homo sapiens
ctggagcagccac

SEQ ID NO: 510408 - DNA, 21 bp, Homo sapiens
ctggagccatgggcacaaagg

SEQ ID NO: 510409 - DNA, 18 bp, Homo sapiens
ctggcccacagcaggtgc

SEQ ID NO: 510410 - DNA, 21 bp, Homo sapiens
ctgtagaatagcctgtggcct

SEQ ID NO: 510411 - DNA, 18 bp, Homo sapiens
ctgtgaatcacctagggg

SEQ ID NO: 510412 - DNA, 22 bp, Homo sapiens
ctgtgcagccccgcctccaggc

SEQ ID NO: 510413 - DNA, 22 bp, Homo sapiens
ctgtgggatccctctgggcact

SEQ ID NO: 510414 - DNA, 22 bp, Homo sapiens
ctgttacccagggtggagtgca

SEQ ID NO: 510415 - DNA, 14 bp, Homo sapiens
cttaaggggcagct

SEQ ID NO: 510416 - DNA, 18 bp, Homo sapiens
cttaaggggcagcttcta

SEQ ID NO: 510417 - DNA, 11 bp, Homo sapiens
cttacacccac

SEQ ID NO: 510418 - DNA, 20 bp, Homo sapiens
cttacacccacagtggaaag

SEQ ID NO: 510419 - DNA, 17 bp, Homo sapiens
cttacatttaaaagaca

SEQ ID NO: 510420 - DNA, 21 bp, Homo sapiens
cttaggcccggagctgcccct

SEQ ID NO: 510421 - DNA, 15 bp, Homo sapiens
cttatgaaaagtact

SEQ ID NO: 510422 - DNA, 19 bp, Homo sapiens
cttatttacagataacttc

SEQ ID NO: 510423 - DNA, 20 bp, Homo sapiens
cttatttacagataacttct

SEQ ID NO: 510424 - DNA, 16 bp, Homo sapiens
cttcagtttttcactt

SEQ ID NO: 510425 - DNA, 17 bp, Homo sapiens
cttcatcccacaatctt

SEQ ID NO: 510426 - DNA, 20 bp, Homo sapiens
cttccataacattgatgact

SEQ ID NO: 510427 - DNA, 18 bp, Homo sapiens
cttcccactctagggcag

SEQ ID NO: 510428 - DNA, 19 bp, Homo sapiens
cttcccactctagggcagt

SEQ ID NO: 510429 - DNA, 20 bp, Homo sapiens
cttcccactctagggcagtg

SEQ ID NO: 510430 - DNA, 18 bp, Homo sapiens
cttcccaggttcaagcga

SEQ ID NO: 510431 - DNA, 18 bp, Homo sapiens
cttctacatgtaatgaca

SEQ ID NO: 510432 - DNA, 17 bp, Homo sapiens
cttctacctacatattt

SEQ ID NO: 510433 - DNA, 13 bp, Homo sapiens
cttgaaggagaat

SEQ ID NO: 510434 - DNA, 23 bp, Homo sapiens
ctttaattgttaagatatgatgt

SEQ ID NO: 510435 - DNA, 12 bp, Homo sapiens
cttttaattaca

SEQ ID NO: 510436 - DNA, 13 bp, Homo sapiens
ctttttcataatt

SEQ ID NO: 510437 - DNA, 15 bp, Homo sapiens
gaaaatgtacatgtt

SEQ ID NO: 510438 - DNA, 17 bp, Homo sapiens
gaaagacagcttctcat

SEQ ID NO: 510439 - DNA, 22 bp, Homo sapiens
gaaagaggcagggacctaaagg

SEQ ID NO: 510440 - DNA, 22 bp, Homo sapiens
gaacactgagaaagaggcaggg

SEQ ID NO: 510441 - DNA, 18 bp, Homo sapiens
gaactggagccatgggca

SEQ ID NO: 510442 - DNA, 13 bp, Homo sapiens
gaagaaagtgaaa

SEQ ID NO: 510443 - DNA, 15 bp, Homo sapiens
gaagaagagccacag

SEQ ID NO: 510444 - DNA, 13 bp, Homo sapiens
gaagcaaacacat

SEQ ID NO: 510445 - DNA, 18 bp, Homo sapiens
gaagccagtgcggcaggt

SEQ ID NO: 510446 - DNA, 18 bp, Homo sapiens
gaagtgaacccatatttt

SEQ ID NO: 510447 - DNA, 14 bp, Homo sapiens
gaatctagaggagg

SEQ ID NO: 510448 - DNA, 14 bp, Homo sapiens
gaatgaaagctcct

SEQ ID NO: 510449 - DNA, 12 bp, Homo sapiens
gacattcacctg

SEQ ID NO: 510450 - DNA, 16 bp, Homo sapiens
gacccaggcacctgca

SEQ ID NO: 510451 - DNA, 21 bp, Homo sapiens
gaccgtttgtccacttcattt

SEQ ID NO: 510452 - DNA, 15 bp, Homo sapiens
gacctatcacttcca

SEQ ID NO: 510453 - DNA, 23 bp, Homo sapiens
gacctctggattaggtctctgtt

SEQ ID NO: 510454 - DNA, 19 bp, Homo sapiens
gacttcccactctagggca

SEQ ID NO: 510455 - DNA, 19 bp, Homo sapiens
gacttgagaaacaaataat

SEQ ID NO: 510456 - DNA, 23 bp, Homo sapiens
gacttgagaaacaaataatttgt

SEQ ID NO: 510457 - DNA, 17 bp, Homo sapiens
gagagaccgaggaggga

SEQ ID NO: 510458 - DNA, 15 bp, Homo sapiens
gagagtctcccaggg

SEQ ID NO: 510459 - DNA, 16 bp, Homo sapiens
gagagtctcccaggga

SEQ ID NO: 510460 - DNA, 19 bp, Homo sapiens
gagatcccatccccttgtc

SEQ ID NO: 510461 - DNA, 18 bp, Homo sapiens
gagatgaagcaaacacat

SEQ ID NO: 510462 - DNA, 15 bp, Homo sapiens
gagcagcctggagcc

SEQ ID NO: 510463 - DNA, 21 bp, Homo sapiens
gagcagcctggagccctggag

SEQ ID NO: 510464 - DNA, 22 bp, Homo sapiens
gagcagcctggagccctggaga

SEQ ID NO: 510465 - DNA, 23 bp, Homo sapiens
gagcatgagaggaggcagcagga

SEQ ID NO: 510466 - DNA, 18 bp, Homo sapiens
gagccatgggcacaaagg

SEQ ID NO: 510467 - DNA, 22 bp, Homo sapiens
gagctttatgtaataatgtgaa

SEQ ID NO: 510468 - DNA, 14 bp, Homo sapiens
gaggagggggcagg

SEQ ID NO: 510469 - DNA, 19 bp, Homo sapiens
gaggagggggcaggctgag

SEQ ID NO: 510470 - DNA, 16 bp, Homo sapiens
gaggcagggacctaaa

SEQ ID NO: 510471 - DNA, 18 bp, Homo sapiens
gaggcagggacctaaagg

SEQ ID NO: 510472 - DNA, 16 bp, Homo sapiens
gaggctatgctcaggg

SEQ ID NO: 510473 - DNA, 17 bp, Homo sapiens
gaggctatgctcagggg

SEQ ID NO: 510474 - DNA, 16 bp, Homo sapiens
gagggagagtctccca

SEQ ID NO: 510475 - DNA, 22 bp, Homo sapiens
gaggtttcaccatgatggccag

SEQ ID NO: 510476 - DNA, 18 bp, Homo sapiens
gagttttgtttcactttg

SEQ ID NO: 510477 - DNA, 16 bp, Homo sapiens
gatagggagttttaaa

SEQ ID NO: 510478 - DNA, 13 bp, Homo sapiens
gatataaataaaa

SEQ ID NO: 510479 - DNA, 15 bp, Homo sapiens
gatgaagcaaacaca

SEQ ID NO: 510480 - DNA, 15 bp, Homo sapiens
gattcctgagccagt

SEQ ID NO: 510481 - DNA, 14 bp, Homo sapiens
gatttttcttattt

SEQ ID NO: 510482 - DNA, 21 bp, Homo sapiens
gcaaagactattcccttctaa

SEQ ID NO: 510483 - DNA, 16 bp, Homo sapiens
gcacaaagggcccaga

SEQ ID NO: 510484 - DNA, 23 bp, Homo sapiens
gcacacggggtgcgtctccccgg

SEQ ID NO: 510485 - DNA, 19 bp, Homo sapiens
gcacctctgacctatcact

SEQ ID NO: 510486 - DNA, 21 bp, Homo sapiens
gcactcgggaaacctggggct

SEQ ID NO: 510487 - DNA, 21 bp, Homo sapiens
gcactgttccagcctgccctc

SEQ ID NO: 510488 - DNA, 16 bp, Homo sapiens
gcagaaaattgcctaa

SEQ ID NO: 510489 - DNA, 18 bp, Homo sapiens
gcagcaggactgtcccct

SEQ ID NO: 510490 - DNA, 19 bp, Homo sapiens
gcagcctggagccctggag

SEQ ID NO: 510491 - DNA, 18 bp, Homo sapiens
gcaggactgtccccttga

SEQ ID NO: 510492 - DNA, 22 bp, Homo sapiens
gcaggctgagggtcgtgggaaa

SEQ ID NO: 510493 - DNA, 14 bp, Homo sapiens
gcaggttctctttg

SEQ ID NO: 510494 - DNA, 17 bp, Homo sapiens
gcagtctgatccaggag

SEQ ID NO: 510495 - DNA, 14 bp, Homo sapiens
gcagtggtgcgatc

SEQ ID NO: 510496 - DNA, 19 bp, Homo sapiens
gcatattgttattatataa

SEQ ID NO: 510497 - DNA, 21 bp, Homo sapiens
gccacactctttctcctgctt

SEQ ID NO: 510498 - DNA, 20 bp, Homo sapiens
gccacatggggctgggcagc

SEQ ID NO: 510499 - DNA, 15 bp, Homo sapiens
gccaggtccagagag

SEQ ID NO: 510500 - DNA, 17 bp, Homo sapiens
gcccacgtagggcggca

SEQ ID NO: 510501 - DNA, 22 bp, Homo sapiens
gcccagattaaagtctttatcc

SEQ ID NO: 510502 - DNA, 15 bp, Homo sapiens
gcccagctagctgca

SEQ ID NO: 510503 - DNA, 15 bp, Homo sapiens
gcccgcagacctctg

SEQ ID NO: 510504 - DNA, 16 bp, Homo sapiens
gcccgcagacctctgg

SEQ ID NO: 510505 - DNA, 19 bp, Homo sapiens
gcccggagctgcccctctc

SEQ ID NO: 510506 - DNA, 23 bp, Homo sapiens
gcccggagctgcccctctctggg

SEQ ID NO: 510507 - DNA, 20 bp, Homo sapiens
gccgagaagccagtgcggca

SEQ ID NO: 510508 - DNA, 13 bp, Homo sapiens
ttattttgtgaac

SEQ ID NO: 510509 - DNA, 15 bp, Homo sapiens
ttcaagaagtaatca

SEQ ID NO: 510510 - DNA, 18 bp, Homo sapiens
ttcaagaagtaatcagta

SEQ ID NO: 510511 - DNA, 19 bp, Homo sapiens
ttcaagaagtaatcagtat

SEQ ID NO: 510512 - DNA, 21 bp, Homo sapiens
ttcaccatgatggccaggctg

SEQ ID NO: 510513 - DNA, 19 bp, Homo sapiens
ttcagttttaccagatgat

SEQ ID NO: 510514 - DNA, 17 bp, Homo sapiens
ttcatggcagtaattct

SEQ ID NO: 510515 - DNA, 14 bp, Homo sapiens
ttccatggattttg

SEQ ID NO: 510516 - DNA, 19 bp, Homo sapiens
ttcccagtaaccctaagga

SEQ ID NO: 510517 - DNA, 19 bp, Homo sapiens
ttccttctacatgtaatga

SEQ ID NO: 510518 - DNA, 17 bp, Homo sapiens
ttcctttgtaattgaca

SEQ ID NO: 510519 - DNA, 17 bp, Homo sapiens
ttctaaccttcacgatt

SEQ ID NO: 510520 - DNA, 17 bp, Homo sapiens
ttctacatgtaatgaca

SEQ ID NO: 510521 - DNA, 23 bp, Homo sapiens
ttgaaaatgtacatgttcctttg

SEQ ID NO: 510522 - DNA, 15 bp, Homo sapiens
ttgaagacactgaaa

SEQ ID NO: 510523 - DNA, 15 bp, Homo sapiens
ttgaagtgttccctt

SEQ ID NO: 510524 - DNA, 19 bp, Homo sapiens
ttgactggctgtgtgacct

SEQ ID NO: 510525 - DNA, 14 bp, Homo sapiens
ttgcatatgtatga

SEQ ID NO: 510526 - DNA, 14 bp, Homo sapiens
ttgccacattaaat

SEQ ID NO: 510527 - DNA, 18 bp, Homo sapiens
ttgccacattaaattgat

SEQ ID NO: 510528 - DNA, 21 bp, Homo sapiens
ttgggggggctcccgtggcct

SEQ ID NO: 510529 - DNA, 20 bp, Homo sapiens
ttgtatgtttttctgtataa

SEQ ID NO: 510530 - DNA, 16 bp, Homo sapiens
ttgttaacctttctaa

SEQ ID NO: 510531 - DNA, 17 bp, Homo sapiens
ttgttacagctactata

SEQ ID NO: 510532 - DNA, 14 bp, Homo sapiens
ttgttattatataa

SEQ ID NO: 510533 - DNA, 23 bp, Homo sapiens
ttgttattatataattacatatt

SEQ ID NO: 510534 - DNA, 19 bp, Homo sapiens
tttaaaagttattaatatt

SEQ ID NO: 510535 - DNA, 13 bp, Homo sapiens
tttaaagaaattt

SEQ ID NO: 510536 - DNA, 13 bp, Homo sapiens
tttattaagtaga

SEQ ID NO: 510537 - DNA, 16 bp, Homo sapiens
tttattaagtagatga

SEQ ID NO: 510538 - DNA, 16 bp, Homo sapiens
tttattacatatgatt

SEQ ID NO: 510539 - DNA, 22 bp, Homo sapiens
tttcacttctacctacatattt

SEQ ID NO: 510540 - DNA, 13 bp, Homo sapiens
tttccttctggtt

SEQ ID NO: 510541 - DNA, 14 bp, Homo sapiens
tttgaaaatgtaca

SEQ ID NO: 510542 - DNA, 20 bp, Homo sapiens
tttgagctctgcagcccagg

SEQ ID NO: 510543 - DNA, 15 bp, Homo sapiens
tttgttcttcagatt

SEQ ID NO: 510544 - DNA, 16 bp, Homo sapiens
ttttccttctggttct

SEQ ID NO: 510545 - DNA, 13 bp, Homo sapiens
cctcatgaatgta

SEQ ID NO: 510546 - DNA, 17 bp, Homo sapiens
cctcatgaatgtaaatt

SEQ ID NO: 510547 - DNA, 22 bp, Homo sapiens
cctcatgaatgtaaatttgtac

SEQ ID NO: 510548 - DNA, 14 bp, Homo sapiens
cctcatgcccaccc

SEQ ID NO: 510549 - DNA, 20 bp, Homo sapiens
cctcatgcccaccccctgcc

SEQ ID NO: 510550 - DNA, 21 bp, Homo sapiens
cctcatgcccaccccctgccc

SEQ ID NO: 510551 - DNA, 22 bp, Homo sapiens
cctcatgcccaccccctgccct

SEQ ID NO: 510552 - DNA, 17 bp, Homo sapiens
cctccatccatgtgttc

SEQ ID NO: 510553 - DNA, 19 bp, Homo sapiens
cctccatccatgtgttcca

SEQ ID NO: 510554 - DNA, 15 bp, Homo sapiens
cctccccatttccca

SEQ ID NO: 510555 - DNA, 21 bp, Homo sapiens
cctccccatttcccatctgca

SEQ ID NO: 510556 - DNA, 15 bp, Homo sapiens
cctcccttccttttc

SEQ ID NO: 510557 - DNA, 17 bp, Homo sapiens
cctcccttccttttccc

SEQ ID NO: 510558 - DNA, 19 bp, Homo sapiens
cctccgagagggagagaga

SEQ ID NO: 510559 - DNA, 19 bp, Homo sapiens
cctcctaaaaggcccagag

SEQ ID NO: 510560 - DNA, 21 bp, Homo sapiens
cctcctaaaaggcccagagag

SEQ ID NO: 510561 - DNA, 14 bp, Homo sapiens
cctcctcacctcat

SEQ ID NO: 510562 - DNA, 19 bp, Homo sapiens
cctcctcacctcatgccca

SEQ ID NO: 510563 - DNA, 20 bp, Homo sapiens
cctcctctggacggcaggct

SEQ ID NO: 510564 - DNA, 16 bp, Homo sapiens
cctcgcccagtcccag

SEQ ID NO: 510565 - DNA, 17 bp, Homo sapiens
cctcgcccagtcccagc

SEQ ID NO: 510566 - DNA, 19 bp, Homo sapiens
cctcgcccagtcccagcag

SEQ ID NO: 510567 - DNA, 16 bp, Homo sapiens
cctctcctttcactcc

SEQ ID NO: 510568 - DNA, 21 bp, Homo sapiens
cctctggacggcaggctcact

SEQ ID NO: 510569 - DNA, 14 bp, Homo sapiens
cctgaaaattccaa

SEQ ID NO: 510570 - DNA, 13 bp, Homo sapiens
cctgagcccactg

SEQ ID NO: 510571 - DNA, 18 bp, Homo sapiens
cctgagcccccagcttcc

SEQ ID NO: 510572 - DNA, 15 bp, Homo sapiens
cctgaggggagacag

SEQ ID NO: 510573 - DNA, 19 bp, Homo sapiens
cctgaggggagacagagca

SEQ ID NO: 510574 - DNA, 19 bp, Homo sapiens
cctgatgtttttctgtgtt

SEQ ID NO: 510575 - DNA, 21 bp, Homo sapiens
cctgcacttgggggctcagca

SEQ ID NO: 510576 - DNA, 22 bp, Homo sapiens
cctgcagttcccctggaagcag

SEQ ID NO: 510577 - DNA, 15 bp, Homo sapiens
cctgccaggcacagg

SEQ ID NO: 510578 - DNA, 16 bp, Homo sapiens
cctgccaggcacaggc

SEQ ID NO: 510579 - DNA, 22 bp, Homo sapiens
cctgccaggcacaggcagggca

SEQ ID NO: 510580 - DNA, 13 bp, Homo sapiens
cctgccaggcagg

SEQ ID NO: 510581 - DNA, 14 bp, Homo sapiens
cctgccaggcaggg

SEQ ID NO: 510582 - DNA, 14 bp, Homo sapiens
cctgcccccagccc

SEQ ID NO: 510583 - DNA, 20 bp, Homo sapiens
cctgccccgcccccagtccc

SEQ ID NO: 510584 - DNA, 17 bp, Homo sapiens
cctgcctctccgcccct

SEQ ID NO: 510585 - DNA, 18 bp, Homo sapiens
cctgcctctccgcccctg

SEQ ID NO: 510586 - DNA, 22 bp, Homo sapiens
cctgcctctccgcccctgagcc

SEQ ID NO: 510587 - DNA, 23 bp, Homo sapiens
cctgcctctccgcccctgagccc

SEQ ID NO: 510588 - DNA, 15 bp, Homo sapiens
cctgcgtcctcctca

SEQ ID NO: 510589 - DNA, 17 bp, Homo sapiens
cctgcgtcctcctcacc

SEQ ID NO: 510590 - DNA, 18 bp, Homo sapiens
cctgcgtcctcctcacct

SEQ ID NO: 510591 - DNA, 22 bp, Homo sapiens
cctgcttccaggaaactccaca

SEQ ID NO: 510592 - DNA, 13 bp, Homo sapiens
cctgcttggccca

SEQ ID NO: 510593 - DNA, 14 bp, Homo sapiens
cctgcttggcccag

SEQ ID NO: 510594 - DNA, 15 bp, Homo sapiens
cctgcttggcccagg

SEQ ID NO: 510595 - DNA, 17 bp, Homo sapiens
cctggaagcagtgccca

SEQ ID NO: 510596 - DNA, 18 bp, Homo sapiens
cctggaagcagtgcccag

SEQ ID NO: 510597 - DNA, 19 bp, Homo sapiens
cctggaagcagtgcccagg

SEQ ID NO: 510598 - DNA, 23 bp, Homo sapiens
cctggaagcagtgcccaggtggc

SEQ ID NO: 510599 - DNA, 17 bp, Homo sapiens
cctggaccccagcctca

SEQ ID NO: 510600 - DNA, 15 bp, Homo sapiens
cctggcccatgtatg

SEQ ID NO: 510601 - DNA, 21 bp, Homo sapiens
cctggcccccacatggtgatg

SEQ ID NO: 510602 - DNA, 22 bp, Homo sapiens
cctggccggtgtgggggccccg

SEQ ID NO: 510603 - DNA, 23 bp, Homo sapiens
cctggccggtgtgggggccccgt

SEQ ID NO: 510604 - DNA, 20 bp, Homo sapiens
cctggctccctcactctcag

SEQ ID NO: 510605 - DNA, 23 bp, Homo sapiens
cctggctgactgccttgctagaa

SEQ ID NO: 510606 - DNA, 24 bp, Homo sapiens
cctggctgaggttcctctgcctgc

SEQ ID NO: 510607 - DNA, 16 bp, Homo sapiens
cctggctgctgccccc

SEQ ID NO: 510608 - DNA, 20 bp, Homo sapiens
cctggctgctgcccccaccc

SEQ ID NO: 510609 - DNA, 21 bp, Homo sapiens
cctggctgctgcccccacccc

SEQ ID NO: 510610 - DNA, 19 bp, Homo sapiens
cctgggcctggctccctca

SEQ ID NO: 510611 - DNA, 21 bp, Homo sapiens
cctggggcatccatggggtct

SEQ ID NO: 510612 - DNA, 15 bp, Homo sapiens
cctgggtgggctctg

SEQ ID NO: 510613 - DNA, 17 bp, Homo sapiens
cctgggttagactgcca

SEQ ID NO: 510614 - DNA, 20 bp, Homo sapiens
cctgggttagactgccagct

SEQ ID NO: 510615 - DNA, 22 bp, Homo sapiens
cctgggttagactgccagctct

SEQ ID NO: 510616 - DNA, 17 bp, Homo sapiens
cctgtgacatggtgcct

SEQ ID NO: 510617 - DNA, 18 bp, Homo sapiens
cctgtgacatggtgcctg

SEQ ID NO: 510618 - DNA, 21 bp, Homo sapiens
cctgtgacatggtgcctgaga

SEQ ID NO: 510619 - DNA, 17 bp, Homo sapiens
cctgtgtctccaagcct

SEQ ID NO: 510620 - DNA, 12 bp, Homo sapiens
cctgtgtggaga

SEQ ID NO: 510621 - DNA, 15 bp, Homo sapiens
cctgtgtggagaggg

SEQ ID NO: 510622 - DNA, 16 bp, Homo sapiens
cctgtgtggagaggga

SEQ ID NO: 510623 - DNA, 21 bp, Homo sapiens
cctgtgtggagagggaatgtg

SEQ ID NO: 510624 - DNA, 23 bp, Homo sapiens
cctgtgtggagagggaatgtgaa

SEQ ID NO: 510625 - DNA, 16 bp, Homo sapiens
ccttaaaaccaaagag

SEQ ID NO: 510626 - DNA, 19 bp, Homo sapiens
ccttaatttttgaaaagct

SEQ ID NO: 510627 - DNA, 20 bp, Homo sapiens
ccttcaaaatatttgtcctt

SEQ ID NO: 510628 - DNA, 15 bp, Homo sapiens
ccttccctagcttta

SEQ ID NO: 510629 - DNA, 20 bp, Homo sapiens
ccttccttttccctgcttcc

SEQ ID NO: 510630 - DNA, 16 bp, Homo sapiens
ccttctcccctgcact

SEQ ID NO: 510631 - DNA, 22 bp, Homo sapiens
ccttctcccctgcactgtaaaa

SEQ ID NO: 510632 - DNA, 15 bp, Homo sapiens
ccttctctcctcccc

SEQ ID NO: 510633 - DNA, 20 bp, Homo sapiens
ccttctctcctccccaaatc

SEQ ID NO: 510634 - DNA, 13 bp, Homo sapiens
ccttgccagctgc

SEQ ID NO: 510635 - DNA, 14 bp, Homo sapiens
ccttgccagctgct

SEQ ID NO: 510636 - DNA, 22 bp, Homo sapiens
ccttgccagctgctgagccgca

SEQ ID NO: 510637 - DNA, 24 bp, Homo sapiens
ccttgccagctgctgagccgcaga

SEQ ID NO: 510638 - DNA, 23 bp, Homo sapiens
ccttgcctccccatttcccatct

SEQ ID NO: 510639 - DNA, 11 bp, Homo sapiens
ccttttaaaga

SEQ ID NO: 510640 - DNA, 13 bp, Homo sapiens
ccttttccctgct

SEQ ID NO: 510641 - DNA, 14 bp, Homo sapiens
ccttttccctgctt

SEQ ID NO: 510642 - DNA, 19 bp, Homo sapiens
ccttttccctgcttccagg

SEQ ID NO: 510643 - DNA, 10 bp, Homo sapiens
ccttttgcac

SEQ ID NO: 510644 - DNA, 17 bp, Homo sapiens
cgccagcctcctctgga

SEQ ID NO: 510645 - DNA, 23 bp, Homo sapiens
cgccagcctcctctggacggcag

SEQ ID NO: 510646 - DNA, 14 bp, Homo sapiens
cgcccctgagccca

SEQ ID NO: 510647 - DNA, 15 bp, Homo sapiens
cgcccctgagcccac

SEQ ID NO: 510648 - DNA, 15 bp, Homo sapiens
cgccctggcccccac

SEQ ID NO: 510649 - DNA, 17 bp, Homo sapiens
cgccggttcattttgca

SEQ ID NO: 510650 - DNA, 18 bp, Homo sapiens
cgcttgcttttctgtatt

SEQ ID NO: 510651 - DNA, 12 bp, Homo sapiens
cagtgtgatttt

SEQ ID NO: 510652 - DNA, 17 bp, Homo sapiens
cagttcccctggaagca

SEQ ID NO: 510653 - DNA, 20 bp, Homo sapiens
cagttgaagaaaaaatggca

SEQ ID NO: 510654 - DNA, 21 bp, Homo sapiens
cagttgaagaaaaaatggcaa

SEQ ID NO: 510655 - DNA, 21 bp, Homo sapiens
cataattcacacattaataaa

SEQ ID NO: 510656 - DNA, 23 bp, Homo sapiens
cataattcacacattaataaaca

SEQ ID NO: 510657 - DNA, 19 bp, Homo sapiens
cataattttttttttctca

SEQ ID NO: 510658 - DNA, 11 bp, Homo sapiens
catccatgggg

SEQ ID NO: 510659 - DNA, 20 bp, Homo sapiens
catccatggggtctctcaca

SEQ ID NO: 510660 - DNA, 22 bp, Homo sapiens
catccatggggtctctcacaga

SEQ ID NO: 510661 - DNA, 16 bp, Homo sapiens
catccatgtgttccaa

SEQ ID NO: 510662 - DNA, 16 bp, Homo sapiens
catctatctcaatcct

SEQ ID NO: 510663 - DNA, 19 bp, Homo sapiens
catctgcaccccttctctc

SEQ ID NO: 510664 - DNA, 20 bp, Homo sapiens
catctgccttaaaaccaaag

SEQ ID NO: 510665 - DNA, 21 bp, Homo sapiens
catgaacacaaatgtgtattt

SEQ ID NO: 510666 - DNA, 13 bp, Homo sapiens
catgcccaccccc

SEQ ID NO: 510667 - DNA, 15 bp, Homo sapiens
catgcccaccccctg

SEQ ID NO: 510668 - DNA, 17 bp, Homo sapiens
cggttcctacacaggac

SEQ ID NO: 510669 - DNA, 20 bp, Homo sapiens
cgtgatagttattattttcc

SEQ ID NO: 510670 - DNA, 12 bp, Homo sapiens
ctaaaaggccca

SEQ ID NO: 510671 - DNA, 14 bp, Homo sapiens
ctaaaaggcccaga

SEQ ID NO: 510672 - DNA, 18 bp, Homo sapiens
ctaaaataaataccaaag

SEQ ID NO: 510673 - DNA, 20 bp, Homo sapiens
ctaaagagcccttgcctccc

SEQ ID NO: 510674 - DNA, 21 bp, Homo sapiens
ctaaagagcccttgcctcccc

SEQ ID NO: 510675 - DNA, 20 bp, Homo sapiens
ctaaagtcttcctattgtac

SEQ ID NO: 510676 - DNA, 14 bp, Homo sapiens
ctaagcattttctc

SEQ ID NO: 510677 - DNA, 15 bp, Homo sapiens
ctaatttctcctccc

SEQ ID NO: 510678 - DNA, 16 bp, Homo sapiens
ctacaatgggaaaact

SEQ ID NO: 510679 - DNA, 22 bp, Homo sapiens
ctacacaggacaggggttcctt

SEQ ID NO: 510680 - DNA, 13 bp, Homo sapiens
ctacacctggctg

SEQ ID NO: 510681 - DNA, 15 bp, Homo sapiens
ctacacctggctgag

SEQ ID NO: 510682 - DNA, 11 bp, Homo sapiens
ctacagggccg

SEQ ID NO: 510683 - DNA, 16 bp, Homo sapiens
ctacagtggttttata

SEQ ID NO: 510684 - DNA, 16 bp, Homo sapiens
ctagaatcatgtattt

SEQ ID NO: 510685 - DNA, 18 bp, Homo sapiens
ctagctggagaggagccc

SEQ ID NO: 510686 - DNA, 13 bp, Homo sapiens
ctatacccagcag

SEQ ID NO: 510687 - DNA, 14 bp, Homo sapiens
ctatacccagcaga

SEQ ID NO: 510688 - DNA, 15 bp, Homo sapiens
ctatacccagcagag

SEQ ID NO: 510689 - DNA, 16 bp, Homo sapiens
ctatacccagcagagg

SEQ ID NO: 510690 - DNA, 19 bp, Homo sapiens
ctatacccagcagagggat

SEQ ID NO: 510691 - DNA, 18 bp, Homo sapiens
ctatccctctaagagtat

SEQ ID NO: 510692 - DNA, 15 bp, Homo sapiens
ctatctcaactctgt

SEQ ID NO: 510693 - DNA, 18 bp, Homo sapiens
ctatctcaatcctaattt

SEQ ID NO: 510694 - DNA, 16 bp, Homo sapiens
ctatgacaatttttgc

SEQ ID NO: 510695 - DNA, 22 bp, Homo sapiens
ctatggcactgttgtcatttcc

SEQ ID NO: 510696 - DNA, 14 bp, Homo sapiens
ctatgtttttaaag

SEQ ID NO: 510697 - DNA, 21 bp, Homo sapiens
ctattaagtcatcatctccaa

SEQ ID NO: 510698 - DNA, 18 bp, Homo sapiens
ctattatgatgttttgca

SEQ ID NO: 510699 - DNA, 14 bp, Homo sapiens
ctattcttgatgta

SEQ ID NO: 510700 - DNA, 16 bp, Homo sapiens
ctattcttgatgtaaa

SEQ ID NO: 510701 - DNA, 17 bp, Homo sapiens
ctattcttgatgtaaaa

SEQ ID NO: 510702 - DNA, 22 bp, Homo sapiens
ctattcttgatgtaaaatcttg

SEQ ID NO: 510703 - DNA, 15 bp, Homo sapiens
ctatttcccttttct

SEQ ID NO: 510704 - DNA, 22 bp, Homo sapiens
ctatttttaaaaagtaccacat

SEQ ID NO: 510705 - DNA, 15 bp, Homo sapiens
ctcaaatccaggacc

SEQ ID NO: 510706 - DNA, 16 bp, Homo sapiens
ctcaaatccaggaccc

SEQ ID NO: 510707 - DNA, 20 bp, Homo sapiens
ctcaaatccaggaccctgcc

SEQ ID NO: 510708 - DNA, 21 bp, Homo sapiens
ctcaacattggagacatcact

SEQ ID NO: 510709 - DNA, 19 bp, Homo sapiens
ctcaatcctaatttctcct

SEQ ID NO: 510710 - DNA, 22 bp, Homo sapiens
ctcaatcctaatttctcctccc

SEQ ID NO: 510711 - DNA, 22 bp, Homo sapiens
ctcacagacaggacccctgcag

SEQ ID NO: 510712 - DNA, 23 bp, Homo sapiens
ctcacagacaggacccctgcagt

SEQ ID NO: 510713 - DNA, 17 bp, Homo sapiens
ctcaccatttggatcct

SEQ ID NO: 510714 - DNA, 23 bp, Homo sapiens
ctcacctcatgcccaccccctgc

SEQ ID NO: 510715 - DNA, 11 bp, Homo sapiens
ctcactgccag

SEQ ID NO: 510716 - DNA, 14 bp, Homo sapiens
ctcactgccaggcc

SEQ ID NO: 510717 - DNA, 19 bp, Homo sapiens
ctcactgccaggccagcct

SEQ ID NO: 510718 - DNA, 22 bp, Homo sapiens
ctcactgccaggccagcctccg

SEQ ID NO: 510719 - DNA, 12 bp, Homo sapiens
ctcagcaagacc

SEQ ID NO: 510720 - DNA, 15 bp, Homo sapiens
ctcagcaaggccacc

SEQ ID NO: 510721 - DNA, 17 bp, Homo sapiens
ctcagcaaggccacctc

SEQ ID NO: 510722 - DNA, 20 bp, Homo sapiens
ctcaggaaatgctgacccat

SEQ ID NO: 510723 - DNA, 23 bp, Homo sapiens
ctcaggaaatgctgacccatggg

SEQ ID NO: 510724 - DNA, 12 bp, Homo sapiens
ctcagtatttta

SEQ ID NO: 510725 - DNA, 18 bp, Homo sapiens
ctcatctatctcaatcct

SEQ ID NO: 510726 - DNA, 12 bp, Homo sapiens
ctcatgaatgta

SEQ ID NO: 510727 - DNA, 14 bp, Homo sapiens
ctcatgaatgtaaa

SEQ ID NO: 510728 - DNA, 22 bp, Homo sapiens
ctcatgaatgtaaatttgtact

SEQ ID NO: 510729 - DNA, 20 bp, Homo sapiens
ctcatgatgcgcttcaaagt

SEQ ID NO: 510730 - DNA, 17 bp, Homo sapiens
ctcatgcccaccccctg

SEQ ID NO: 510731 - DNA, 22 bp, Homo sapiens
ctcatgcccaccccctgccctg

SEQ ID NO: 510732 - DNA, 17 bp, Homo sapiens
ctccacatctgccttaa

SEQ ID NO: 510733 - DNA, 16 bp, Homo sapiens
ctccatgatgttaatg

SEQ ID NO: 510734 - DNA, 18 bp, Homo sapiens
ctcccaggtaccagctgc

SEQ ID NO: 510735 - DNA, 22 bp, Homo sapiens
ctcccaggtaccagctgcgctt

SEQ ID NO: 510736 - DNA, 21 bp, Homo sapiens
ctccccaaatcaatacactag

SEQ ID NO: 510737 - DNA, 18 bp, Homo sapiens
ctccccatttcccatctg

SEQ ID NO: 510738 - DNA, 21 bp, Homo sapiens
ctccccatttcccatctgcac

SEQ ID NO: 510739 - DNA, 22 bp, Homo sapiens
ctccccatttcccatctgcacc

SEQ ID NO: 510740 - DNA, 13 bp, Homo sapiens
ctcccctgcactg

SEQ ID NO: 510741 - DNA, 15 bp, Homo sapiens
ctccccttgccagct

SEQ ID NO: 510742 - DNA, 15 bp, Homo sapiens
ctccctcactctcag

SEQ ID NO: 510743 - DNA, 14 bp, Homo sapiens
ctccgagagggaga

SEQ ID NO: 510744 - DNA, 16 bp, Homo sapiens
ctccgagagggagaga

SEQ ID NO: 510745 - DNA, 12 bp, Homo sapiens
ctccgccagcct

SEQ ID NO: 510746 - DNA, 20 bp, Homo sapiens
ctccgccagcctcctctgga

SEQ ID NO: 510747 - DNA, 14 bp, Homo sapiens
ctccgcccctgagc

SEQ ID NO: 510748 - DNA, 18 bp, Homo sapiens
ctccgcccctgagcccac

SEQ ID NO: 510749 - DNA, 16 bp, Homo sapiens
ctcctaaaaggcccag

SEQ ID NO: 510750 - DNA, 19 bp, Homo sapiens
ctcctaaaaggcccagaga

SEQ ID NO: 510751 - DNA, 12 bp, Homo sapiens
ctcctataccca

SEQ ID NO: 510752 - DNA, 13 bp, Homo sapiens
ctcctatacccag

SEQ ID NO: 510753 - DNA, 17 bp, Homo sapiens
ctcctatacccagcaga

SEQ ID NO: 510754 - DNA, 12 bp, Homo sapiens
ctcctcacctca

SEQ ID NO: 510755 - DNA, 20 bp, Homo sapiens
ctcctcacctcatgcccacc

SEQ ID NO: 510756 - DNA, 18 bp, Homo sapiens
ctcctccatccatgtgtt

SEQ ID NO: 510757 - DNA, 14 bp, Homo sapiens
ctcctccccaaatc

SEQ ID NO: 510758 - DNA, 14 bp, Homo sapiens
ctcctcccttcctt

SEQ ID NO: 510759 - DNA, 15 bp, Homo sapiens
ctcctcccttccttt

SEQ ID NO: 510760 - DNA, 22 bp, Homo sapiens
ctcctcccttccttttccctgc

SEQ ID NO: 510761 - DNA, 12 bp, Homo sapiens
ctcctgagcccc

SEQ ID NO: 510762 - DNA, 14 bp, Homo sapiens
ctcctgagccccca

SEQ ID NO: 510763 - DNA, 14 bp, Homo sapiens
ctcgcccagtccca

SEQ ID NO: 510764 - DNA, 14 bp, Homo sapiens
ctctaaatagccca

SEQ ID NO: 510765 - DNA, 13 bp, Homo sapiens
ctctaagagtata

SEQ ID NO: 510766 - DNA, 15 bp, Homo sapiens
ctctagaagccaagg

SEQ ID NO: 510767 - DNA, 18 bp, Homo sapiens
ctctcacagacaggaccc

SEQ ID NO: 510768 - DNA, 18 bp, Homo sapiens
ctctccgcccctgagccc

SEQ ID NO: 510769 - DNA, 18 bp, Homo sapiens
gctccctcactctcagga

SEQ ID NO: 510770 - DNA, 17 bp, Homo sapiens
gctctcaataaactttt

SEQ ID NO: 510771 - DNA, 21 bp, Homo sapiens
gctgacccatgggcaggagac

SEQ ID NO: 510772 - DNA, 16 bp, Homo sapiens
gctgactacagggccg

SEQ ID NO: 510773 - DNA, 17 bp, Homo sapiens
gctgactacagggccgc

SEQ ID NO: 510774 - DNA, 20 bp, Homo sapiens
gctgaggttcctctgcctgc

SEQ ID NO: 510775 - DNA, 22 bp, Homo sapiens
gctgaggttcctctgcctgccc

SEQ ID NO: 510776 - DNA, 23 bp, Homo sapiens
gctgaggttcctctgcctgcccc

SEQ ID NO: 510777 - DNA, 13 bp, Homo sapiens
gctgccttcccta

SEQ ID NO: 510778 - DNA, 15 bp, Homo sapiens
gctgcgcttgctttt

SEQ ID NO: 510779 - DNA, 16 bp, Homo sapiens
gctgcgcttgcttttc

SEQ ID NO: 510780 - DNA, 22 bp, Homo sapiens
gctgctattatgatgttttgca

SEQ ID NO: 510781 - DNA, 16 bp, Homo sapiens
gctggagaggagccct

SEQ ID NO: 510782 - DNA, 20 bp, Homo sapiens
gctggcacccaccgtggagg

SEQ ID NO: 510783 - DNA, 21 bp, Homo sapiens
gctggcacccaccgtggagga

SEQ ID NO: 510784 - DNA, 14 bp, Homo sapiens
gctgggctgggcac

SEQ ID NO: 510785 - DNA, 19 bp, Homo sapiens
gctgggggatgggcctgag

SEQ ID NO: 510786 - DNA, 17 bp, Homo sapiens
gcttacacttaaaagaa

SEQ ID NO: 510787 - DNA, 14 bp, Homo sapiens
gcttccagcaggag

SEQ ID NO: 510788 - DNA, 15 bp, Homo sapiens
gcttccagcaggagg

SEQ ID NO: 510789 - DNA, 20 bp, Homo sapiens
gcttccagcaggagggacag

SEQ ID NO: 510790 - DNA, 19 bp, Homo sapiens
gcttccaggaaactccaca

SEQ ID NO: 510791 - DNA, 20 bp, Homo sapiens
gcttcctctagaagccaagg

SEQ ID NO: 510792 - DNA, 23 bp, Homo sapiens
gcttcctgaggggagacagagca

SEQ ID NO: 510793 - DNA, 15 bp, Homo sapiens
gcttctccgccagcc

SEQ ID NO: 510794 - DNA, 16 bp, Homo sapiens
gcttctgcttttctgc

SEQ ID NO: 510795 - DNA, 18 bp, Homo sapiens
gcttgaagccaaagaaaa

SEQ ID NO: 510796 - DNA, 20 bp, Homo sapiens
gcttgaagccaaagaaaaat

SEQ ID NO: 510797 - DNA, 21 bp, Homo sapiens
gcttgagccgggcccctgggc

SEQ ID NO: 510798 - DNA, 12 bp, Homo sapiens
gcttgcttttct

SEQ ID NO: 510799 - DNA, 13 bp, Homo sapiens
gcttggcccaggg

SEQ ID NO: 510800 - DNA, 14 bp, Homo sapiens
gcttggcccagggg

SEQ ID NO: 510801 - DNA, 16 bp, Homo sapiens
gcttggcctgctgtga

SEQ ID NO: 510802 - DNA, 17 bp, Homo sapiens
gctttagaccctgggtg

SEQ ID NO: 510803 - DNA, 14 bp, Homo sapiens
gcttttctgccctg

SEQ ID NO: 510804 - DNA, 22 bp, Homo sapiens
gcttttctgccctggctgctgc

SEQ ID NO: 510805 - DNA, 18 bp, Homo sapiens
gcttttctgtattttatt

SEQ ID NO: 510806 - DNA, 19 bp, Homo sapiens
ggaaaaagtgggtttttta

SEQ ID NO: 510807 - DNA, 22 bp, Homo sapiens
ggaaaacttcactccaaagaga

SEQ ID NO: 510808 - DNA, 18 bp, Homo sapiens
ggaaactccacatctgcc

SEQ ID NO: 510809 - DNA, 20 bp, Homo sapiens
ggaaactccacatctgcctt

SEQ ID NO: 510810 - DNA, 18 bp, Homo sapiens
ggaaacttgcctttttta

SEQ ID NO: 510811 - DNA, 21 bp, Homo sapiens
ggaaaggggagagcctgctgg

SEQ ID NO: 510812 - DNA, 15 bp, Homo sapiens
ggaaataaaaggtta

SEQ ID NO: 510813 - DNA, 22 bp, Homo sapiens
ggaaatctttcaacttatttct

SEQ ID NO: 510814 - DNA, 19 bp, Homo sapiens
ggaacgcccacttccctgg

SEQ ID NO: 510815 - DNA, 13 bp, Homo sapiens
ggaagaagggaga

SEQ ID NO: 510816 - DNA, 18 bp, Homo sapiens
ggaagaagggagaagaaa

SEQ ID NO: 510817 - DNA, 15 bp, Homo sapiens
ggaagcagtgcccag

SEQ ID NO: 510818 - DNA, 18 bp, Homo sapiens
ggaaggacacattgtttt

SEQ ID NO: 510819 - DNA, 15 bp, Homo sapiens
ggaaggagaggaaac

SEQ ID NO: 510820 - DNA, 16 bp, Homo sapiens
ggaaggtgtttaaaga

SEQ ID NO: 510821 - DNA, 12 bp, Homo sapiens
ggaccagcccac

SEQ ID NO: 510822 - DNA, 13 bp, Homo sapiens
ggaccagcccacg

SEQ ID NO: 510823 - DNA, 16 bp, Homo sapiens
ggaccagcccacgctg

SEQ ID NO: 510824 - DNA, 16 bp, Homo sapiens
ggaccatgctgtctgg

SEQ ID NO: 510825 - DNA, 14 bp, Homo sapiens
gggcaggaccagcc

SEQ ID NO: 510826 - DNA, 15 bp, Homo sapiens
gggcaggaccagccc

SEQ ID NO: 510827 - DNA, 16 bp, Homo sapiens
gggcaggaccagccca

SEQ ID NO: 510828 - DNA, 23 bp, Homo sapiens
gggcccctgggcttggcctgctg

SEQ ID NO: 510829 - DNA, 15 bp, Homo sapiens
gggcctgggcctggc

SEQ ID NO: 510830 - DNA, 17 bp, Homo sapiens
gggctcagcaaggccac

SEQ ID NO: 510831 - DNA, 18 bp, Homo sapiens
gggctcccgcctccaacc

SEQ ID NO: 510832 - DNA, 16 bp, Homo sapiens
gggctctgtgcagtca

SEQ ID NO: 510833 - DNA, 20 bp, Homo sapiens
gggctgggcactgctctcac

SEQ ID NO: 510834 - DNA, 19 bp, Homo sapiens
gggcttcctctagaagcca

SEQ ID NO: 510835 - DNA, 18 bp, Homo sapiens
gggcttcctgaggggaga

SEQ ID NO: 510836 - DNA, 13 bp, Homo sapiens
gggcttggcctgc

SEQ ID NO: 510837 - DNA, 18 bp, Homo sapiens
gggcttttccttttgcac

SEQ ID NO: 510838 - DNA, 15 bp, Homo sapiens
ggggactgccacctc

SEQ ID NO: 510839 - DNA, 16 bp, Homo sapiens
ggggagagcctgctgg

SEQ ID NO: 510840 - DNA, 15 bp, Homo sapiens
ggggtctctcacaga

SEQ ID NO: 510841 - DNA, 17 bp, Homo sapiens
ggggtggaggcttcctg

SEQ ID NO: 510842 - DNA, 18 bp, Homo sapiens
ggggtgggggtggaggct

SEQ ID NO: 510843 - DNA, 12 bp, Homo sapiens
gggtcacaggaa

SEQ ID NO: 510844 - DNA, 18 bp, Homo sapiens
gggtctctcacagacagg

SEQ ID NO: 510845 - DNA, 24 bp, Homo sapiens
gggtctctcacagacaggacccct

SEQ ID NO: 510846 - DNA, 13 bp, Homo sapiens
gggttccttctgg

SEQ ID NO: 510847 - DNA, 22 bp, Homo sapiens
gggttttttagttgaatttttt

SEQ ID NO: 510848 - DNA, 20 bp, Homo sapiens
ggtaatgcacgacattgatt

SEQ ID NO: 510849 - DNA, 12 bp, Homo sapiens
ggtaccagctgc

SEQ ID NO: 510850 - DNA, 16 bp, Homo sapiens
ggtattggtgctttgt

SEQ ID NO: 510851 - DNA, 15 bp, Homo sapiens
ggtcactggaaaggg

SEQ ID NO: 510852 - DNA, 19 bp, Homo sapiens
ggtgagtttgagctgcctt

SEQ ID NO: 510853 - DNA, 22 bp, Homo sapiens
ggtgatgttgacatcactggca

SEQ ID NO: 510854 - DNA, 15 bp, Homo sapiens
ggtgctgggaggagg

SEQ ID NO: 510855 - DNA, 15 bp, Homo sapiens
ggtgctttgtgtcta

SEQ ID NO: 510856 - DNA, 16 bp, Homo sapiens
ggtggaattacttaaa

SEQ ID NO: 510857 - DNA, 13 bp, Homo sapiens
ggtgggctctgtg

SEQ ID NO: 510858 - DNA, 16 bp, Homo sapiens
ggtgggctctgtgcag

SEQ ID NO: 510859 - DNA, 20 bp, Homo sapiens
ggttatcctatttttaaaca

SEQ ID NO: 510860 - DNA, 15 bp, Homo sapiens
ggttcctacacagga

SEQ ID NO: 510861 - DNA, 21 bp, Homo sapiens
ggttgggacccagtggcaggg

SEQ ID NO: 510862 - DNA, 13 bp, Homo sapiens
gtaaaagcaaaag

SEQ ID NO: 510863 - DNA, 12 bp, Homo sapiens
gtaaaatcttgt

SEQ ID NO: 510864 - DNA, 18 bp, Homo sapiens
gtaaaatcttgtcatgtg

SEQ ID NO: 510865 - DNA, 23 bp, Homo sapiens
gtaaaatcttgtcatgtgtataa

SEQ ID NO: 510866 - DNA, 17 bp, Homo sapiens
gtaaacagaaattgcaa

SEQ ID NO: 510867 - DNA, 19 bp, Homo sapiens
gtaaactgatgtttgtgat

SEQ ID NO: 510868 - DNA, 18 bp, Homo sapiens
gtaacttttttattttaa

SEQ ID NO: 510869 - DNA, 12 bp, Homo sapiens
gtaatttctgag

SEQ ID NO: 510870 - DNA, 18 bp, Homo sapiens
gtactatttaactgacta

SEQ ID NO: 510871 - DNA, 20 bp, Homo sapiens
gtactcttatatttttctgg

SEQ ID NO: 510872 - DNA, 20 bp, Homo sapiens
gtagtgcttttaaaaatttt

SEQ ID NO: 510873 - DNA, 16 bp, Homo sapiens
gtataaaaataaaaaa

SEQ ID NO: 510874 - DNA, 20 bp, Homo sapiens
gtataggggaaaatattatt

SEQ ID NO: 510875 - DNA, 21 bp, Homo sapiens
gtatggggggggcaagaaaga

SEQ ID NO: 510876 - DNA, 17 bp, Homo sapiens
gtattatatctctgtat

SEQ ID NO: 510877 - DNA, 15 bp, Homo sapiens
gtatttgtagccagt

SEQ ID NO: 510878 - DNA, 16 bp, Homo sapiens
gtcaagagccaagaca

SEQ ID NO: 510879 - DNA, 22 bp, Homo sapiens
gtcaagagccaagacacaggta

SEQ ID NO: 510880 - DNA, 12 bp, Homo sapiens
gtcactggaaag

SEQ ID NO: 510881 - DNA, 20 bp, Homo sapiens
gtcactggaaaggggagagc

SEQ ID NO: 510882 - DNA, 23 bp, Homo sapiens
gtcactggaaaggggagagcctg

SEQ ID NO: 510883 - DNA, 23 bp, Homo sapiens
gtcactggaggttgaagccaagt

SEQ ID NO: 510884 - DNA, 17 bp, Homo sapiens
gtcacttcatattttat

SEQ ID NO: 510885 - DNA, 21 bp, Homo sapiens
gtcagaggcccaaaacagtta

SEQ ID NO: 510886 - DNA, 21 bp, Homo sapiens
gtcagtgttgaattttattga

SEQ ID NO: 510887 - DNA, 13 bp, Homo sapiens
gtcatgtgtataa

SEQ ID NO: 510888 - DNA, 21 bp, Homo sapiens
gtcatttccaaattcctagaa

SEQ ID NO: 510889 - DNA, 14 bp, Homo sapiens
gtcccagcagccag

SEQ ID NO: 510890 - DNA, 19 bp, Homo sapiens
taccttcaaaatatttgtc

SEQ ID NO: 510891 - DNA, 13 bp, Homo sapiens
tactatttaactg

SEQ ID NO: 510892 - DNA, 16 bp, Homo sapiens
tactatttaactgact

SEQ ID NO: 510893 - DNA, 14 bp, Homo sapiens
tactcaggataaca

SEQ ID NO: 510894 - DNA, 20 bp, Homo sapiens
tactcaggataacagagaat

SEQ ID NO: 510895 - DNA, 12 bp, Homo sapiens
tactgaaggaaa

SEQ ID NO: 510896 - DNA, 14 bp, Homo sapiens
tactgacttttctt

SEQ ID NO: 510897 - DNA, 21 bp, Homo sapiens
tacttatattagagtcagaga

SEQ ID NO: 510898 - DNA, 18 bp, Homo sapiens
tacttctgtgtgcaattg

SEQ ID NO: 510899 - DNA, 23 bp, Homo sapiens
tacttgaatcagacattttaagg

SEQ ID NO: 510900 - DNA, 14 bp, Homo sapiens
tactttgtttttat

SEQ ID NO: 510901 - DNA, 22 bp, Homo sapiens
tagaataagttatgggttttta

SEQ ID NO: 510902 - DNA, 16 bp, Homo sapiens
tagaccctgggtgggc

SEQ ID NO: 510903 - DNA, 12 bp, Homo sapiens
tagactgccagc

SEQ ID NO: 510904 - DNA, 22 bp, Homo sapiens
tagactgccagctcttcctagc

SEQ ID NO: 510905 - DNA, 14 bp, Homo sapiens
tagaggcttctccg

SEQ ID NO: 510906 - DNA, 19 bp, Homo sapiens
tagaggcttctccgccagc

SEQ ID NO: 510907 - DNA, 21 bp, Homo sapiens
tagaggcttctccgccagcct

SEQ ID NO: 510908 - DNA, 18 bp, Homo sapiens
tagatccaaatgtaaagg

SEQ ID NO: 510909 - DNA, 20 bp, Homo sapiens
tagcacaggctgagtgcagg

SEQ ID NO: 510910 - DNA, 17 bp, Homo sapiens
tagctggagaggagccc

SEQ ID NO: 510911 - DNA, 20 bp, Homo sapiens
tagtcagtgtagtgctttta

SEQ ID NO: 510912 - DNA, 12 bp, Homo sapiens
tagttgaatttt

SEQ ID NO: 510913 - DNA, 22 bp, Homo sapiens
tagttgaattttttttaacatt

SEQ ID NO: 510914 - DNA, 23 bp, Homo sapiens
tagttgaattttttttaacattc

SEQ ID NO: 510915 - DNA, 17 bp, Homo sapiens
tataattacaatgcaca

SEQ ID NO: 510916 - DNA, 18 bp, Homo sapiens
tataccgcagagtatttg

SEQ ID NO: 510917 - DNA, 21 bp, Homo sapiens
tatactctcaccatttggatc

SEQ ID NO: 510918 - DNA, 22 bp, Homo sapiens
tatatttttttcaactgccaat

SEQ ID NO: 510919 - DNA, 16 bp, Homo sapiens
tatcagatattttcat

SEQ ID NO: 510920 - DNA, 20 bp, Homo sapiens
tatctacattataccgcaga

SEQ ID NO: 510921 - DNA, 15 bp, Homo sapiens
tatctcaactctgtt

SEQ ID NO: 510922 - DNA, 16 bp, Homo sapiens
tatgacaatttttgct

SEQ ID NO: 510923 - DNA, 17 bp, Homo sapiens
tcctcatgaatgtaaat

SEQ ID NO: 510924 - DNA, 21 bp, Homo sapiens
tcctccatccatgtgttccaa

SEQ ID NO: 510925 - DNA, 16 bp, Homo sapiens
tcctccccaaatcaat

SEQ ID NO: 510926 - DNA, 21 bp, Homo sapiens
tcctccccaaatcaatacact

SEQ ID NO: 510927 - DNA, 17 bp, Homo sapiens
tcctcccttccttttcc

SEQ ID NO: 510928 - DNA, 18 bp, Homo sapiens
tcctcccttccttttccc

SEQ ID NO: 510929 - DNA, 16 bp, Homo sapiens
tcctcctcacctcatg

SEQ ID NO: 510930 - DNA, 17 bp, Homo sapiens
tcctctagaagccaagg

SEQ ID NO: 510931 - DNA, 22 bp, Homo sapiens
tcctctagaagccaagggaaag

SEQ ID NO: 510932 - DNA, 12 bp, Homo sapiens
tcctctgcctgc

SEQ ID NO: 510933 - DNA, 13 bp, Homo sapiens
tcctctgcctgcc

SEQ ID NO: 510934 - DNA, 22 bp, Homo sapiens
tcctctgcctgccccgccccca

SEQ ID NO: 510935 - DNA, 22 bp, Homo sapiens
tcctctggacggcaggctcact

SEQ ID NO: 510936 - DNA, 16 bp, Homo sapiens
tcctgagcccccagct

SEQ ID NO: 510937 - DNA, 18 bp, Homo sapiens
tcctgagcccccagcttc

SEQ ID NO: 510938 - DNA, 20 bp, Homo sapiens
tcctgatgtttttctgtgtt

SEQ ID NO: 510939 - DNA, 21 bp, Homo sapiens
tcctgcgtcctcctcacctca

SEQ ID NO: 510940 - DNA, 21 bp, Homo sapiens
tcctgtgtggagagggaatgt

SEQ ID NO: 510941 - DNA, 22 bp, Homo sapiens
tcctgtgtggagagggaatgtg

SEQ ID NO: 510942 - DNA, 15 bp, Homo sapiens
tccttttccctgctt

SEQ ID NO: 510943 - DNA, 12 bp, Homo sapiens
tccttttgtgta

SEQ ID NO: 510944 - DNA, 22 bp, Homo sapiens
tccttttgtgtaattttaaagt

SEQ ID NO: 510945 - DNA, 17 bp, Homo sapiens
tcgcccagtcccagcag

SEQ ID NO: 510946 - DNA, 23 bp, Homo sapiens
tcgcccagtcccagcagccagcc

SEQ ID NO: 510947 - DNA, 23 bp, Homo sapiens
tcggatttattcccttttaaaga

SEQ ID NO: 510948 - DNA, 12 bp, Homo sapiens
tctaagagaagt

SEQ ID NO: 510949 - DNA, 22 bp, Homo sapiens
tctacagtggttttatactgaa

SEQ ID NO: 510950 - DNA, 13 bp, Homo sapiens
tctagggcagagt

SEQ ID NO: 510951 - DNA, 13 bp, Homo sapiens
tctatcctttcct

SEQ ID NO: 510952 - DNA, 12 bp, Homo sapiens
tctatctcatct

SEQ ID NO: 510953 - DNA, 18 bp, Homo sapiens
tctcaactctgtttattt

SEQ ID NO: 510954 - DNA, 23 bp, Homo sapiens
tctcaatcctaatttctcctccc

SEQ ID NO: 510955 - DNA, 12 bp, Homo sapiens
tctcacagacag

SEQ ID NO: 510956 - DNA, 13 bp, Homo sapiens
tctcacagacagg

SEQ ID NO: 510957 - DNA, 21 bp, Homo sapiens
tctcacagacaggacccctgc

SEQ ID NO: 510958 - DNA, 15 bp, Homo sapiens
tctcaccatttggat

SEQ ID NO: 510959 - DNA, 16 bp, Homo sapiens
tctcaccatttggatc

SEQ ID NO: 510960 - DNA, 17 bp, Homo sapiens
tctcaccttggttcctg

SEQ ID NO: 510961 - DNA, 14 bp, Homo sapiens
tctcccctgcactg

SEQ ID NO: 510962 - DNA, 15 bp, Homo sapiens
tctcccctgcactgt

SEQ ID NO: 510963 - DNA, 16 bp, Homo sapiens
tctcccctgcactgta

SEQ ID NO: 510964 - DNA, 15 bp, Homo sapiens
tctccgcccctgagc

SEQ ID NO: 510965 - DNA, 19 bp, Homo sapiens
tctccgcccctgagcccac

SEQ ID NO: 510966 - DNA, 17 bp, Homo sapiens
tctcctatacccagcag

SEQ ID NO: 510967 - DNA, 20 bp, Homo sapiens
tctcctatacccagcagagg

SEQ ID NO: 510968 - DNA, 14 bp, Homo sapiens
tctcctcccttcct

SEQ ID NO: 510969 - DNA, 23 bp, Homo sapiens
tctcctcccttccttttccctgc

SEQ ID NO: 510970 - DNA, 12 bp, Homo sapiens
tctcctttcact

SEQ ID NO: 510971 - DNA, 17 bp, Homo sapiens
tctctcacagacaggac

SEQ ID NO: 510972 - DNA, 13 bp, Homo sapiens
tctctcctcccca

SEQ ID NO: 510973 - DNA, 12 bp, Homo sapiens
tctgaaaaagag

SEQ ID NO: 510974 - DNA, 22 bp, Homo sapiens
tctgaatgccgtgcctgcaaaa

SEQ ID NO: 510975 - DNA, 15 bp, Homo sapiens
tctgactttttctgt

SEQ ID NO: 510976 - DNA, 19 bp, Homo sapiens
tctgcaccccttctctcct

SEQ ID NO: 510977 - DNA, 22 bp, Homo sapiens
tctgcaccccttctctcctccc

SEQ ID NO: 510978 - DNA, 14 bp, Homo sapiens
tctgccctggctgc

SEQ ID NO: 510979 - DNA, 17 bp, Homo sapiens
tctgccttaaaaccaaa

SEQ ID NO: 510980 - DNA, 20 bp, Homo sapiens
tctgccttaaaaccaaagag

SEQ ID NO: 510981 - DNA, 17 bp, Homo sapiens
tctgcttttctgccctg

SEQ ID NO: 510982 - DNA, 18 bp, Homo sapiens
tctgcttttctgccctgg

SEQ ID NO: 510983 - DNA, 19 bp, Homo sapiens
tctggaatagttactttac

SEQ ID NO: 510984 - DNA, 15 bp, Homo sapiens
tctggacggcaggct

SEQ ID NO: 510985 - DNA, 22 bp, Homo sapiens
tctggacggcaggctcactgcc

SEQ ID NO: 510986 - DNA, 13 bp, Homo sapiens
tctggcacagcct

SEQ ID NO: 510987 - DNA, 20 bp, Homo sapiens
tctgggacctgccaggcagg

SEQ ID NO: 510988 - DNA, 22 bp, Homo sapiens
tctgggattactgacttttctt

SEQ ID NO: 510989 - DNA, 19 bp, Homo sapiens
tctggggttgattcccaga

SEQ ID NO: 510990 - DNA, 22 bp, Homo sapiens
tctgggttgttgtttttttctt

SEQ ID NO: 510991 - DNA, 15 bp, Homo sapiens
tctgtttcctgtgtc

SEQ ID NO: 510992 - DNA, 21 bp, Homo sapiens
tctgtttcctgtgtctccaag

SEQ ID NO: 510993 - DNA, 19 bp, Homo sapiens
tcttgatgtaaaatcttgt

SEQ ID NO: 510994 - DNA, 22 bp, Homo sapiens
tcttgatgtaaaatcttgtcat

SEQ ID NO: 510995 - DNA, 23 bp, Homo sapiens
tcttggtatgggctgttctgttt

SEQ ID NO: 510996 - DNA, 11 bp, Homo sapiens
tcttgtcatgt

SEQ ID NO: 510997 - DNA, 11 bp, Homo sapiens
tctttttaatt

SEQ ID NO: 510998 - DNA, 12 bp, Homo sapiens
tgaaaattccaa

SEQ ID NO: 510999 - DNA, 19 bp, Homo sapiens
tgaaagataaatgggttta

SEQ ID NO: 511000 - DNA, 12 bp, Homo sapiens
tgaaatcaagag

SEQ ID NO: 511001 - DNA, 18 bp, Homo sapiens
tgaaatgaaaatcaattt

SEQ ID NO: 511002 - DNA, 20 bp, Homo sapiens
tgaacacaaatgtgtatttt

SEQ ID NO: 511003 - DNA, 23 bp, Homo sapiens
tgaaccgccggttcattttgcac

SEQ ID NO: 511004 - DNA, 16 bp, Homo sapiens
tgaagaaaaaatggca

SEQ ID NO: 511005 - DNA, 12 bp, Homo sapiens
tgaagccaaaga

SEQ ID NO: 511006 - DNA, 14 bp, Homo sapiens
tgaagccaaagaaa

SEQ ID NO: 511007 - DNA, 21 bp, Homo sapiens
tgaaggaggccacctcctaaa

SEQ ID NO: 511008 - DNA, 19 bp, Homo sapiens
tgaatcagacattttaagg

SEQ ID NO: 511009 - DNA, 20 bp, Homo sapiens
tgaatgtaaatttgtactat

SEQ ID NO: 511010 - DNA, 16 bp, Homo sapiens
tgaattttattgaaag

SEQ ID NO: 511011 - DNA, 17 bp, Homo sapiens
tgaattttattgaaagc

SEQ ID NO: 511012 - DNA, 18 bp, Homo sapiens
tgaattttttttaacatt

SEQ ID NO: 511013 - DNA, 19 bp, Homo sapiens
tgaattttttttaacattc

SEQ ID NO: 511014 - DNA, 20 bp, Homo sapiens
tgaattttttttaacattcc

SEQ ID NO: 511015 - DNA, 21 bp, Homo sapiens
tgaattttttttaacattcct

SEQ ID NO: 511016 - DNA, 14 bp, Homo sapiens
tgacatcactggca

SEQ ID NO: 511017 - DNA, 16 bp, Homo sapiens
tgacatcactggcatg

SEQ ID NO: 511018 - DNA, 16 bp, Homo sapiens
tgacatggtgcctgag

SEQ ID NO: 511019 - DNA, 17 bp, Homo sapiens
tgacatggtgcctgaga

SEQ ID NO: 511020 - DNA, 17 bp, Homo sapiens
tgaccacaaaagaggct

SEQ ID NO: 511021 - DNA, 19 bp, Homo sapiens
tgacccatgggcaggagac

SEQ ID NO: 511022 - DNA, 18 bp, Homo sapiens
tgacggttcctacacagg

SEQ ID NO: 511023 - DNA, 20 bp, Homo sapiens
tgacggttcctacacaggac

SEQ ID NO: 511024 - DNA, 23 bp, Homo sapiens
tgacggttcctacacaggacagg

SEQ ID NO: 511025 - DNA, 21 bp, Homo sapiens
tgactattcttgatgtaaaat

SEQ ID NO: 511026 - DNA, 15 bp, Homo sapiens
tgagaaatttgaaag

SEQ ID NO: 511027 - DNA, 16 bp, Homo sapiens
tggccccacctggccc

SEQ ID NO: 511028 - DNA, 24 bp, Homo sapiens
tggccctctctgaaggaggccacc

SEQ ID NO: 511029 - DNA, 16 bp, Homo sapiens
tggctccctcactctc

SEQ ID NO: 511030 - DNA, 20 bp, Homo sapiens
tggctccctcactctcagga

SEQ ID NO: 511031 - DNA, 15 bp, Homo sapiens
tggctgactgccttg

SEQ ID NO: 511032 - DNA, 17 bp, Homo sapiens
tggctgaggttcctctg

SEQ ID NO: 511033 - DNA, 21 bp, Homo sapiens
tggctgaggttcctctgcctg

SEQ ID NO: 511034 - DNA, 22 bp, Homo sapiens
tggctgaggttcctctgcctgc

SEQ ID NO: 511035 - DNA, 20 bp, Homo sapiens
tggctgctgcccccaccccg

SEQ ID NO: 511036 - DNA, 11 bp, Homo sapiens
tgggaaaactt

SEQ ID NO: 511037 - DNA, 17 bp, Homo sapiens
tgggaatgaggtgggag

SEQ ID NO: 511038 - DNA, 18 bp, Homo sapiens
tgggacccagtggcaggg

SEQ ID NO: 511039 - DNA, 18 bp, Homo sapiens
tgggacctgccaggcagg

SEQ ID NO: 511040 - DNA, 23 bp, Homo sapiens
tgggacctgccaggcaggggtgg

SEQ ID NO: 511041 - DNA, 15 bp, Homo sapiens
gtccccacccctgcc

SEQ ID NO: 511042 - DNA, 16 bp, Homo sapiens
gtccccacccctgccc

SEQ ID NO: 511043 - DNA, 17 bp, Homo sapiens
gtccccacccctgcccc

SEQ ID NO: 511044 - DNA, 21 bp, Homo sapiens
gtcctcctcacctcatgccca

SEQ ID NO: 511045 - DNA, 14 bp, Homo sapiens
gtctagtcagtgta

SEQ ID NO: 511046 - DNA, 20 bp, Homo sapiens
gtctcaccatttccccaggg

SEQ ID NO: 511047 - DNA, 23 bp, Homo sapiens
gtctcaccatttccccagggcac

SEQ ID NO: 511048 - DNA, 16 bp, Homo sapiens
gtctggcacagcctgc

SEQ ID NO: 511049 - DNA, 17 bp, Homo sapiens
gtctggcacagcctgca

SEQ ID NO: 511050 - DNA, 13 bp, Homo sapiens
gtctgtaaagaaa

SEQ ID NO: 511051 - DNA, 14 bp, Homo sapiens
gtctgtaaagaaaa

SEQ ID NO: 511052 - DNA, 19 bp, Homo sapiens
gtcttattttattatttct

SEQ ID NO: 511053 - DNA, 23 bp, Homo sapiens
gtgacatggtgcctgagaggcag

SEQ ID NO: 511054 - DNA, 12 bp, Homo sapiens
gtgagctaagca

SEQ ID NO: 511055 - DNA, 18 bp, Homo sapiens
gtgagtttgagctgcctt

SEQ ID NO: 511056 - DNA, 22 bp, Homo sapiens
gtgcacaggtttgttttttcaa

SEQ ID NO: 511057 - DNA, 15 bp, Homo sapiens
gtgctgggaggaggg

SEQ ID NO: 511058 - DNA, 19 bp, Homo sapiens
gtgctgggaggagggagag

SEQ ID NO: 511059 - DNA, 19 bp, Homo sapiens
gtgctttgtgtctagggca

SEQ ID NO: 511060 - DNA, 19 bp, Homo sapiens
gtgcttttaaaaattttgt

SEQ ID NO: 511061 - DNA, 19 bp, Homo sapiens
gtgcttttatagaggctag

SEQ ID NO: 511062 - DNA, 12 bp, Homo sapiens
gtggaaaaggaa

SEQ ID NO: 511063 - DNA, 16 bp, Homo sapiens
gtggaagaagggagaa

SEQ ID NO: 511064 - DNA, 18 bp, Homo sapiens
gtggaagaagggagaaga

SEQ ID NO: 511065 - DNA, 20 bp, Homo sapiens
gtggaagaagggagaagaaa

SEQ ID NO: 511066 - DNA, 17 bp, Homo sapiens
gtggagaatcacaggct

SEQ ID NO: 511067 - DNA, 21 bp, Homo sapiens
gtggagaatcacaggctgggc

SEQ ID NO: 511068 - DNA, 14 bp, Homo sapiens
gtggagactgctcc

SEQ ID NO: 511069 - DNA, 13 bp, Homo sapiens
gtggaggcttcct

SEQ ID NO: 511070 - DNA, 11 bp, Homo sapiens
gtggccccacc

SEQ ID NO: 511071 - DNA, 21 bp, Homo sapiens
gtggctttttgtactgtagtt

SEQ ID NO: 511072 - DNA, 19 bp, Homo sapiens
gtgggggccccgtctcagg

SEQ ID NO: 511073 - DNA, 20 bp, Homo sapiens
gtgggggccccgtctcaggt

SEQ ID NO: 511074 - DNA, 20 bp, Homo sapiens
gtgggggtggaggcttcctg

SEQ ID NO: 511075 - DNA, 12 bp, Homo sapiens
gtgtataaaaat

SEQ ID NO: 511076 - DNA, 14 bp, Homo sapiens
gtgtataaaaataa

SEQ ID NO: 511077 - DNA, 21 bp, Homo sapiens
gtgtgggggccccgtctcagg

SEQ ID NO: 511078 - DNA, 23 bp, Homo sapiens
atattggaggaatacttctgata

SEQ ID NO: 511079 - DNA, 20 bp, Homo sapiens
atatttaaagccaaatgtaa

SEQ ID NO: 511080 - DNA, 22 bp, Homo sapiens
atatttaaagccaaatgtaaat

SEQ ID NO: 511081 - DNA, 16 bp, Homo sapiens
atatttgatctaagtt

SEQ ID NO: 511082 - DNA, 12 bp, Homo sapiens
atcaatacacta

SEQ ID NO: 511083 - DNA, 19 bp, Homo sapiens
atcaatacactagttgttt

SEQ ID NO: 511084 - DNA, 14 bp, Homo sapiens
atcacaggctgggc

SEQ ID NO: 511085 - DNA, 22 bp, Homo sapiens
atcagatattttcatatttaaa

SEQ ID NO: 511086 - DNA, 14 bp, Homo sapiens
atcatatcctcaga

SEQ ID NO: 511087 - DNA, 13 bp, Homo sapiens
atcatctccaaac

SEQ ID NO: 511088 - DNA, 12 bp, Homo sapiens
aggccacctcct

SEQ ID NO: 511089 - DNA, 23 bp, Homo sapiens
aggccacctcctaaaaggcccag

SEQ ID NO: 511090 - DNA, 21 bp, Homo sapiens
aggccacctcttcctggccgg

SEQ ID NO: 511091 - DNA, 23 bp, Homo sapiens
aggccacctcttcctggccggtg

SEQ ID NO: 511092 - DNA, 10 bp, Homo sapiens
aggccagcct

SEQ ID NO: 511093 - DNA, 11 bp, Homo sapiens
aggccagcctc

SEQ ID NO: 511094 - DNA, 13 bp, Homo sapiens
aggccagcctccg

SEQ ID NO: 511095 - DNA, 22 bp, Homo sapiens
aggcccagagagaagagcccca

SEQ ID NO: 511096 - DNA, 19 bp, Homo sapiens
aggccccaataccccatgg

SEQ ID NO: 511097 - DNA, 15 bp, Homo sapiens
aggctagcttctgct

SEQ ID NO: 511098 - DNA, 16 bp, Homo sapiens
aggctcactgccaggc

SEQ ID NO: 511099 - DNA, 17 bp, Homo sapiens
aggctcactgccaggcc

SEQ ID NO: 511100 - DNA, 17 bp, Homo sapiens
aggctgagtgcaggccc

SEQ ID NO: 511101 - DNA, 23 bp, Homo sapiens
aggctgagtgcaggcccaccctg

SEQ ID NO: 511102 - DNA, 10 bp, Homo sapiens
aggcttcctg

SEQ ID NO: 511103 - DNA, 20 bp, Homo sapiens
aggcttcctgcgtcctcctc

SEQ ID NO: 511104 - DNA, 16 bp, Homo sapiens
aggcttctccgccagc

SEQ ID NO: 511105 - DNA, 20 bp, Homo sapiens
aggcttctccgccagcctcc

SEQ ID NO: 511106 - DNA, 21 bp, Homo sapiens
aggcttctccgccagcctcct

SEQ ID NO: 511107 - DNA, 16 bp, Homo sapiens
agggacagtctcacca

SEQ ID NO: 511108 - DNA, 11 bp, Homo sapiens
agggagagaga

SEQ ID NO: 511109 - DNA, 23 bp, Homo sapiens
agggagagagagagagagaggac

SEQ ID NO: 511110 - DNA, 13 bp, Homo sapiens
agggagagggagg

SEQ ID NO: 511111 - DNA, 17 bp, Homo sapiens
agggcacagggcctggc

SEQ ID NO: 511112 - DNA, 18 bp, Homo sapiens
agggcaggaccagcccac

SEQ ID NO: 511113 - DNA, 19 bp, Homo sapiens
agggcaggaccagcccacg

SEQ ID NO: 511114 - DNA, 13 bp, Homo sapiens
agggcctggccca

SEQ ID NO: 511115 - DNA, 16 bp, Homo sapiens
agggcctggcccatgt

SEQ ID NO: 511116 - DNA, 13 bp, Homo sapiens
agggcctgggcct

SEQ ID NO: 511117 - DNA, 19 bp, Homo sapiens
agggcctgggcctggctcc

SEQ ID NO: 511118 - DNA, 20 bp, Homo sapiens
agggcctgggcctggctccc

SEQ ID NO: 511119 - DNA, 12 bp, Homo sapiens
agggcttcctct

SEQ ID NO: 511120 - DNA, 20 bp, Homo sapiens
agggcttcctctagaagcca

SEQ ID NO: 511121 - DNA, 21 bp, Homo sapiens
agggcttcctctagaagccaa

SEQ ID NO: 511122 - DNA, 15 bp, Homo sapiens
aggggagacagagca

SEQ ID NO: 511123 - DNA, 16 bp, Homo sapiens
agggggcttgaagcca

SEQ ID NO: 511124 - DNA, 15 bp, Homo sapiens
agggggtggaggggt

SEQ ID NO: 511125 - DNA, 18 bp, Homo sapiens
aggggtgtggcagtggtt

SEQ ID NO: 511126 - DNA, 19 bp, Homo sapiens
aggggttccttctgggcat

SEQ ID NO: 511127 - DNA, 20 bp, Homo sapiens
aggtcactggaaaggggaga

SEQ ID NO: 511128 - DNA, 19 bp, Homo sapiens
aggtgagtttgagctgcct

SEQ ID NO: 511129 - DNA, 21 bp, Homo sapiens
aggtgagtttgagctgccttc

SEQ ID NO: 511130 - DNA, 17 bp, Homo sapiens
aggtggaagaagggaga

SEQ ID NO: 511131 - DNA, 18 bp, Homo sapiens
aggtggaagaagggagaa

SEQ ID NO: 511132 - DNA, 17 bp, Homo sapiens
aggtggaattacttaaa

SEQ ID NO: 511133 - DNA, 16 bp, Homo sapiens
aggtgtggacaagcca

SEQ ID NO: 511134 - DNA, 16 bp, Homo sapiens
aggtgtttaaagagtt

SEQ ID NO: 511135 - DNA, 18 bp, Homo sapiens
aggttcctctgcctgccc

SEQ ID NO: 511136 - DNA, 13 bp, Homo sapiens
aggttgaagccaa

SEQ ID NO: 511137 - DNA, 18 bp, Homo sapiens
aggtttgttttttcaaga

SEQ ID NO: 511138 - DNA, 18 bp, Homo sapiens
agtaacagttgaagaaaa

SEQ ID NO: 511139 - DNA, 12 bp, Homo sapiens
agtaatttctga

SEQ ID NO: 511140 - DNA, 15 bp, Homo sapiens
agtaccacattccat

SEQ ID NO: 511141 - DNA, 15 bp, Homo sapiens
agtacctatatgcta

SEQ ID NO: 511142 - DNA, 18 bp, Homo sapiens
agtagaatctcttttctg

SEQ ID NO: 511143 - DNA, 22 bp, Homo sapiens
agtagcacaggctgagtgcagg

SEQ ID NO: 511144 - DNA, 22 bp, Homo sapiens
agtcactggaggttgaagccaa

SEQ ID NO: 511145 - DNA, 14 bp, Homo sapiens
agtcccagcagcca

SEQ ID NO: 511146 - DNA, 19 bp, Homo sapiens
agtcccagcagccagccaa

SEQ ID NO: 511147 - DNA, 13 bp, Homo sapiens
agtccccacccct

SEQ ID NO: 511148 - DNA, 15 bp, Homo sapiens
agtccccacccctgc

SEQ ID NO: 511149 - DNA, 16 bp, Homo sapiens
agtccccacccctgcc

SEQ ID NO: 511150 - DNA, 22 bp, Homo sapiens
agtctcaccatttccccagggc

SEQ ID NO: 511151 - DNA, 23 bp, Homo sapiens
agtctcaccatttccccagggca

SEQ ID NO: 511152 - DNA, 13 bp, Homo sapiens
agtgcaggcccac

SEQ ID NO: 511153 - DNA, 19 bp, Homo sapiens
agtgcaggcccaccctgct

SEQ ID NO: 511154 - DNA, 22 bp, Homo sapiens
agtgcctacaatgggaaaactt

SEQ ID NO: 511155 - DNA, 21 bp, Homo sapiens
agtgctgccacttaaaaagac

SEQ ID NO: 511156 - DNA, 12 bp, Homo sapiens
agtggcagggca

SEQ ID NO: 511157 - DNA, 22 bp, Homo sapiens
agtggcagggcacagggcctgg

SEQ ID NO: 511158 - DNA, 12 bp, Homo sapiens
agtggccccacc

SEQ ID NO: 511159 - DNA, 14 bp, Homo sapiens
agtggccccacctg

SEQ ID NO: 511160 - DNA, 18 bp, Homo sapiens
agtggctttttgtactgt

SEQ ID NO: 511161 - DNA, 23 bp, Homo sapiens
agtggctttttgtactgtagttc

SEQ ID NO: 511162 - DNA, 19 bp, Homo sapiens
agtggggggaacgcccact

SEQ ID NO: 511163 - DNA, 15 bp, Homo sapiens
agtgggttttttagt

SEQ ID NO: 511164 - DNA, 17 bp, Homo sapiens
agtgtagtgcttttaaa

SEQ ID NO: 511165 - DNA, 19 bp, Homo sapiens
agttattagcgttttaaca

SEQ ID NO: 511166 - DNA, 16 bp, Homo sapiens
agttattattttccca

SEQ ID NO: 511167 - DNA, 12 bp, Homo sapiens
agttctttttca

SEQ ID NO: 511168 - DNA, 19 bp, Homo sapiens
agttgaagaaaaaatggca

SEQ ID NO: 511169 - DNA, 22 bp, Homo sapiens
agttgaattttttttaacattc

SEQ ID NO: 511170 - DNA, 24 bp, Homo sapiens
agttgttaccccaagcgccctggc

SEQ ID NO: 511171 - DNA, 14 bp, Homo sapiens
agtttgagctgcct

SEQ ID NO: 511172 - DNA, 11 bp, Homo sapiens
ataaaaaagat

SEQ ID NO: 511173 - DNA, 14 bp, Homo sapiens
ataaaaataaaaaa

SEQ ID NO: 511174 - DNA, 16 bp, Homo sapiens
ataaaagcccaggagc

SEQ ID NO: 511175 - DNA, 14 bp, Homo sapiens
ataaataccaaaga

SEQ ID NO: 511176 - DNA, 15 bp, Homo sapiens
ataacaaaggcaaga

SEQ ID NO: 511177 - DNA, 12 bp, Homo sapiens
ataagacaagat

SEQ ID NO: 511178 - DNA, 13 bp, Homo sapiens
atactgaaggaaa

SEQ ID NO: 511179 - DNA, 22 bp, Homo sapiens
atactgaaggaaaaacacaagc

SEQ ID NO: 511180 - DNA, 15 bp, Homo sapiens
atacttctgataatt

SEQ ID NO: 511181 - DNA, 19 bp, Homo sapiens
atagaggctagcttctgct

SEQ ID NO: 511182 - DNA, 20 bp, Homo sapiens
atagaggctagcttctgctt

SEQ ID NO: 511183 - DNA, 23 bp, Homo sapiens
atagaggcttctccgccagcctc

SEQ ID NO: 511184 - DNA, 19 bp, Homo sapiens
atatctctgtatgccatta

SEQ ID NO: 511185 - DNA, 14 bp, Homo sapiens
atatgcagacatgt

SEQ ID NO: 511186 - DNA, 13 bp, Homo sapiens
cagcaaggccacc

SEQ ID NO: 511187 - DNA, 20 bp, Homo sapiens
cagcaaggccacctcttcct

SEQ ID NO: 511188 - DNA, 23 bp, Homo sapiens
cagcaaggccacctcttcctggc

SEQ ID NO: 511189 - DNA, 16 bp, Homo sapiens
cagcagccagccaaac

SEQ ID NO: 511190 - DNA, 11 bp, Homo sapiens
cagcaggaggg

SEQ ID NO: 511191 - DNA, 15 bp, Homo sapiens
cagcaggagggacag

SEQ ID NO: 511192 - DNA, 23 bp, Homo sapiens
cagcaggagggacagtctcacca

SEQ ID NO: 511193 - DNA, 16 bp, Homo sapiens
cagccaaacacacaga

SEQ ID NO: 511194 - DNA, 18 bp, Homo sapiens
cagcctcaaatccaggac

SEQ ID NO: 511195 - DNA, 21 bp, Homo sapiens
cagcctcaaatccaggaccct

SEQ ID NO: 511196 - DNA, 19 bp, Homo sapiens
cagcctccgagagggagag

SEQ ID NO: 511197 - DNA, 14 bp, Homo sapiens
cagcctcctctgga

SEQ ID NO: 511198 - DNA, 21 bp, Homo sapiens
cagcctcctctggacggcagg

SEQ ID NO: 511199 - DNA, 19 bp, Homo sapiens
cagctatttcccttttctg

SEQ ID NO: 511200 - DNA, 13 bp, Homo sapiens
cagctgctgagcc

SEQ ID NO: 511201 - DNA, 17 bp, Homo sapiens
cagctgctgagccgcag

SEQ ID NO: 511202 - DNA, 14 bp, Homo sapiens
cagcttgttctaga

SEQ ID NO: 511203 - DNA, 16 bp, Homo sapiens
caggaaatgctgaccc

SEQ ID NO: 511204 - DNA, 22 bp, Homo sapiens
caggaagtagcacaggctgagt

SEQ ID NO: 511205 - DNA, 17 bp, Homo sapiens
caggacaggggttcctt

SEQ ID NO: 511206 - DNA, 21 bp, Homo sapiens
caggacaggggttccttctgg

SEQ ID NO: 511207 - DNA, 17 bp, Homo sapiens
caggaccagcccacgct

SEQ ID NO: 511208 - DNA, 18 bp, Homo sapiens
caggaccctgccaggcac

SEQ ID NO: 511209 - DNA, 19 bp, Homo sapiens
caggaccctgccaggcaca

SEQ ID NO: 511210 - DNA, 12 bp, Homo sapiens
caggagcccatt

SEQ ID NO: 511211 - DNA, 19 bp, Homo sapiens
caggagggacagtctcacc

SEQ ID NO: 511212 - DNA, 17 bp, Homo sapiens
caggcacaggcagggca

SEQ ID NO: 511213 - DNA, 19 bp, Homo sapiens
caggcacaggcagggcagg

SEQ ID NO: 511214 - DNA, 17 bp, Homo sapiens
caggcagggcaggacca

SEQ ID NO: 511215 - DNA, 22 bp, Homo sapiens
caggcagggcaggaccagccca

SEQ ID NO: 511216 - DNA, 17 bp, Homo sapiens
caggcaggggtgggggt

SEQ ID NO: 511217 - DNA, 21 bp, Homo sapiens
caggcaggggtgggggtggag

SEQ ID NO: 511218 - DNA, 14 bp, Homo sapiens
caggcatagaggct

SEQ ID NO: 511219 - DNA, 17 bp, Homo sapiens
caggcatagaggcttct

SEQ ID NO: 511220 - DNA, 13 bp, Homo sapiens
caggccagcctcc

SEQ ID NO: 511221 - DNA, 16 bp, Homo sapiens
caggccagcctccgag

SEQ ID NO: 511222 - DNA, 21 bp, Homo sapiens
caggccagcctccgagaggga

SEQ ID NO: 511223 - DNA, 23 bp, Homo sapiens
caggccagcctccgagagggaga

SEQ ID NO: 511224 - DNA, 13 bp, Homo sapiens
caggcccaccctg

SEQ ID NO: 511225 - DNA, 23 bp, Homo sapiens
caggcccaccctgcttggcccag

SEQ ID NO: 511226 - DNA, 15 bp, Homo sapiens
caggctcactgccag

SEQ ID NO: 511227 - DNA, 23 bp, Homo sapiens
caggctcactgccaggccagcct

SEQ ID NO: 511228 - DNA, 16 bp, Homo sapiens
caggctgagtgcaggc

SEQ ID NO: 511229 - DNA, 20 bp, Homo sapiens
caggctgagtgcaggcccac

SEQ ID NO: 511230 - DNA, 16 bp, Homo sapiens
caggctgggctgggca

SEQ ID NO: 511231 - DNA, 19 bp, Homo sapiens
caggctgggctgggcactg

SEQ ID NO: 511232 - DNA, 14 bp, Homo sapiens
cagggcacagggcc

SEQ ID NO: 511233 - DNA, 15 bp, Homo sapiens
cagggcacagggcct

SEQ ID NO: 511234 - DNA, 20 bp, Homo sapiens
cagggcacagggcctggccc

SEQ ID NO: 511235 - DNA, 21 bp, Homo sapiens
cagggcacagggcctggccca

SEQ ID NO: 511236 - DNA, 12 bp, Homo sapiens
cagggcacgtgg

SEQ ID NO: 511237 - DNA, 16 bp, Homo sapiens
cagggcaggaccagcc

SEQ ID NO: 511238 - DNA, 17 bp, Homo sapiens
cagggcaggaccagccc

SEQ ID NO: 511239 - DNA, 22 bp, Homo sapiens
cagggcaggaccagcccacgct

SEQ ID NO: 511240 - DNA, 11 bp, Homo sapiens
cagggcctggc

SEQ ID NO: 511241 - DNA, 13 bp, Homo sapiens
cagggcctggccc

SEQ ID NO: 511242 - DNA, 16 bp, Homo sapiens
cagggcctggcccatg

SEQ ID NO: 511243 - DNA, 13 bp, Homo sapiens
cagggggcttcct

SEQ ID NO: 511244 - DNA, 13 bp, Homo sapiens
caggtaccagctg

SEQ ID NO: 511245 - DNA, 16 bp, Homo sapiens
caggtaccagctgcgc

SEQ ID NO: 511246 - DNA, 17 bp, Homo sapiens
caggtaccagctgcgct

SEQ ID NO: 511247 - DNA, 15 bp, Homo sapiens
cagtaatttctgaga

SEQ ID NO: 511248 - DNA, 12 bp, Homo sapiens
cagtcccagcag

SEQ ID NO: 511249 - DNA, 20 bp, Homo sapiens
cagtctcaccatttccccag

SEQ ID NO: 511250 - DNA, 21 bp, Homo sapiens
cagtctcctatacccagcaga

SEQ ID NO: 511251 - DNA, 15 bp, Homo sapiens
cagtgcagtaatttc

SEQ ID NO: 511252 - DNA, 14 bp, Homo sapiens
cagtgcccaggtgg

SEQ ID NO: 511253 - DNA, 17 bp, Homo sapiens
cagtgctgccacttaaa

SEQ ID NO: 511254 - DNA, 12 bp, Homo sapiens
cagtggcagggc

SEQ ID NO: 511255 - DNA, 17 bp, Homo sapiens
cagtggcagggcacagg

SEQ ID NO: 511256 - DNA, 20 bp, Homo sapiens
cagtggcagggcacagggcc

SEQ ID NO: 511257 - DNA, 15 bp, Homo sapiens
cagtggttttatact

SEQ ID NO: 511258 - DNA, 21 bp, Homo sapiens
cagttcccctggaagcagtgc

SEQ ID NO: 511259 - DNA, 14 bp, Homo sapiens
cagttgaagaaaaa

SEQ ID NO: 511260 - DNA, 16 bp, Homo sapiens
cataaactatattctg

SEQ ID NO: 511261 - DNA, 12 bp, Homo sapiens
catagaggcttc

SEQ ID NO: 511262 - DNA, 15 bp, Homo sapiens
catagaggcttctcc

SEQ ID NO: 511263 - DNA, 19 bp, Homo sapiens
catagaggcttctccgcca

SEQ ID NO: 511264 - DNA, 22 bp, Homo sapiens
catagaggcttctccgccagcc

SEQ ID NO: 511265 - DNA, 24 bp, Homo sapiens
catatctggaagggcactatattt

SEQ ID NO: 511266 - DNA, 14 bp, Homo sapiens
catatttaaagcca

SEQ ID NO: 511267 - DNA, 13 bp, Homo sapiens
catatttttgcac

SEQ ID NO: 511268 - DNA, 14 bp, Homo sapiens
catcactggcatgg

SEQ ID NO: 511269 - DNA, 21 bp, Homo sapiens
catccatggggtctctcacag

SEQ ID NO: 511270 - DNA, 14 bp, Homo sapiens
catccatgtgttcc

SEQ ID NO: 511271 - DNA, 20 bp, Homo sapiens
catctatctcatctatctca

SEQ ID NO: 511272 - DNA, 23 bp, Homo sapiens
catctgcaccccttctctcctcc

SEQ ID NO: 511273 - DNA, 23 bp, Homo sapiens
catgaacacaaatgtgtattttt

SEQ ID NO: 511274 - DNA, 16 bp, Homo sapiens
catgaatgtaaatttg

SEQ ID NO: 511275 - DNA, 17 bp, Homo sapiens
catgaatgtaaatttgt

SEQ ID NO: 511276 - DNA, 19 bp, Homo sapiens
catgaatgtaaatttgtac

SEQ ID NO: 511277 - DNA, 21 bp, Homo sapiens
catgacacccaagggtcgcct

SEQ ID NO: 511278 - DNA, 16 bp, Homo sapiens
catgatgcgcttcaaa

SEQ ID NO: 511279 - DNA, 16 bp, Homo sapiens
catgcccaccccctgc

SEQ ID NO: 511280 - DNA, 17 bp, Homo sapiens
catgcccaccccctgcc

SEQ ID NO: 511281 - DNA, 18 bp, Homo sapiens
catgcccaccccctgccc

SEQ ID NO: 511282 - DNA, 20 bp, Homo sapiens
catgcccaccccctgccctg

SEQ ID NO: 511283 - DNA, 17 bp, Homo sapiens
catgctgtctggcacag

SEQ ID NO: 511284 - DNA, 23 bp, Homo sapiens
catgctgtctggcacagcctgca

SEQ ID NO: 511285 - DNA, 20 bp, Homo sapiens
catggactgttcatttgaaa

SEQ ID NO: 511286 - DNA, 14 bp, Homo sapiens
catgggcaggagac

SEQ ID NO: 511287 - DNA, 15 bp, Homo sapiens
catggtgcctgagag

SEQ ID NO: 511288 - DNA, 21 bp, Homo sapiens
catggtgcctgagaggcaggc

SEQ ID NO: 511289 - DNA, 19 bp, Homo sapiens
catggtggttgggacccag

SEQ ID NO: 511290 - DNA, 19 bp, Homo sapiens
catgtaacttttttatttt

SEQ ID NO: 511291 - DNA, 14 bp, Homo sapiens
catgtatggccagg

SEQ ID NO: 511292 - DNA, 15 bp, Homo sapiens
catgtatggccagga

SEQ ID NO: 511293 - DNA, 14 bp, Homo sapiens
cattataccgcaga

SEQ ID NO: 511294 - DNA, 16 bp, Homo sapiens
cattataccgcagagt

SEQ ID NO: 511295 - DNA, 23 bp, Homo sapiens
cattataccgcagagtatttgaa

SEQ ID NO: 511296 - DNA, 21 bp, Homo sapiens
cattatgtaacactagccgaa

SEQ ID NO: 511297 - DNA, 19 bp, Homo sapiens
cattccaaaattcatttca

SEQ ID NO: 511298 - DNA, 17 bp, Homo sapiens
cattccatgacgcagga

SEQ ID NO: 511299 - DNA, 17 bp, Homo sapiens
cattcctcatgaatgta

SEQ ID NO: 511300 - DNA, 18 bp, Homo sapiens
cattcctcatgaatgtaa

SEQ ID NO: 511301 - DNA, 15 bp, Homo sapiens
catttactttggtca

SEQ ID NO: 511302 - DNA, 14 bp, Homo sapiens
catttcccatctgc

SEQ ID NO: 511303 - DNA, 15 bp, Homo sapiens
catttcccatctgca

SEQ ID NO: 511304 - DNA, 14 bp, Homo sapiens
catttccccagggc

SEQ ID NO: 511305 - DNA, 16 bp, Homo sapiens
catttccccagggcac

SEQ ID NO: 511306 - DNA, 17 bp, Homo sapiens
catttccccagggcacg

SEQ ID NO: 511307 - DNA, 21 bp, Homo sapiens
catttggatcctgtgtggaga

SEQ ID NO: 511308 - DNA, 20 bp, Homo sapiens
catttttctaataatcataa

SEQ ID NO: 511309 - DNA, 18 bp, Homo sapiens
ccaaagagtattcagtga

SEQ ID NO: 511310 - DNA, 18 bp, Homo sapiens
ccaagagtggccccacct

SEQ ID NO: 511311 - DNA, 20 bp, Homo sapiens
ccaagcctctgtcttttctg

SEQ ID NO: 511312 - DNA, 17 bp, Homo sapiens
ccaagcgccctggcccc

SEQ ID NO: 511313 - DNA, 17 bp, Homo sapiens
ccaataccccatggacc

SEQ ID NO: 511314 - DNA, 11 bp, Homo sapiens
ccacattccat

SEQ ID NO: 511315 - DNA, 13 bp, Homo sapiens
ccaccccctgccc

SEQ ID NO: 511316 - DNA, 18 bp, Homo sapiens
ccaccccctgccctgcac

SEQ ID NO: 511317 - DNA, 13 bp, Homo sapiens
ccaccgtggagga

SEQ ID NO: 511318 - DNA, 20 bp, Homo sapiens
ccacctccccttgccagctg

SEQ ID NO: 511319 - DNA, 21 bp, Homo sapiens
ccacctcctaaaaggcccaga

SEQ ID NO: 511320 - DNA, 12 bp, Homo sapiens
ccacctggccct

SEQ ID NO: 511321 - DNA, 13 bp, Homo sapiens
ccacgctgactac

SEQ ID NO: 511322 - DNA, 18 bp, Homo sapiens
ccactctcagaggcccca

SEQ ID NO: 511323 - DNA, 18 bp, Homo sapiens
ccagagagaagagcccca

SEQ ID NO: 511324 - DNA, 13 bp, Homo sapiens
ccagatcccaaga

SEQ ID NO: 511325 - DNA, 23 bp, Homo sapiens
ccagatgtgtgttgcttctctat

SEQ ID NO: 511326 - DNA, 14 bp, Homo sapiens
ccagcagccagcca

SEQ ID NO: 511327 - DNA, 15 bp, Homo sapiens
ccagcagccagccaa

SEQ ID NO: 511328 - DNA, 18 bp, Homo sapiens
ccagccaaacacacagaa

SEQ ID NO: 511329 - DNA, 17 bp, Homo sapiens
ccagcctcaaatccagg

SEQ ID NO: 511330 - DNA, 20 bp, Homo sapiens
ccagcctcaaatccaggacc

SEQ ID NO: 511331 - DNA, 23 bp, Homo sapiens
ccagcctcaaatccaggaccctg

SEQ ID NO: 511332 - DNA, 19 bp, Homo sapiens
ccagcctccgagagggaga

SEQ ID NO: 511333 - DNA, 14 bp, Homo sapiens
ccagcctcctctgg

SEQ ID NO: 511334 - DNA, 23 bp, Homo sapiens
ccagcctcctctggacggcaggc

SEQ ID NO: 511335 - DNA, 16 bp, Homo sapiens
ccagctcttcctagct

SEQ ID NO: 511336 - DNA, 20 bp, Homo sapiens
ccagctcttcctagctggag

SEQ ID NO: 511337 - DNA, 16 bp, Homo sapiens
ccagctgcgcttgctt

SEQ ID NO: 511338 - DNA, 20 bp, Homo sapiens
ccagctgcgcttgcttttct

SEQ ID NO: 511339 - DNA, 21 bp, Homo sapiens
ccagctgcgcttgcttttctg

SEQ ID NO: 511340 - DNA, 15 bp, Homo sapiens
ccagctgctgagccg

SEQ ID NO: 511341 - DNA, 19 bp, Homo sapiens
ccagctgctgagccgcaga

SEQ ID NO: 511342 - DNA, 17 bp, Homo sapiens
ccagcttccagcaggag

SEQ ID NO: 511343 - DNA, 19 bp, Homo sapiens
ccaggaaactccacatctg

SEQ ID NO: 511344 - DNA, 20 bp, Homo sapiens
ccaggaaactccacatctgc

SEQ ID NO: 511345 - DNA, 16 bp, Homo sapiens
ccaggaagtagcacag

SEQ ID NO: 511346 - DNA, 11 bp, Homo sapiens
ccaggagccca

SEQ ID NO: 511347 - DNA, 12 bp, Homo sapiens
ccaggagcccat

SEQ ID NO: 511348 - DNA, 13 bp, Homo sapiens
ccaggagcccatt

SEQ ID NO: 511349 - DNA, 13 bp, Homo sapiens
ccaggcacaggca

SEQ ID NO: 511350 - DNA, 17 bp, Homo sapiens
ccaggcacaggcagggc

SEQ ID NO: 511351 - DNA, 11 bp, Homo sapiens
ccaggccagcc

SEQ ID NO: 511352 - DNA, 12 bp, Homo sapiens
ccaggccagcct

SEQ ID NO: 511353 - DNA, 15 bp, Homo sapiens
ccaggccagcctccg

SEQ ID NO: 511354 - DNA, 19 bp, Homo sapiens
ccaggccagcctccgagag

SEQ ID NO: 511355 - DNA, 20 bp, Homo sapiens
ccaggccagcctccgagagg

SEQ ID NO: 511356 - DNA, 22 bp, Homo sapiens
ccagggggcttcctgaggggag

SEQ ID NO: 511357 - DNA, 23 bp, Homo sapiens
ccaggtaccagctgcgcttgctt

SEQ ID NO: 511358 - DNA, 15 bp, Homo sapiens
ccaggtggaattact

SEQ ID NO: 511359 - DNA, 18 bp, Homo sapiens
ccagtcccagcagccagc

SEQ ID NO: 511360 - DNA, 20 bp, Homo sapiens
ccagtcccagcagccagcca

SEQ ID NO: 511361 - DNA, 19 bp, Homo sapiens
ccagtccccacccctgccc

SEQ ID NO: 511362 - DNA, 18 bp, Homo sapiens
ccagtctcctatacccag

SEQ ID NO: 511363 - DNA, 14 bp, Homo sapiens
ccagtggcagggca

SEQ ID NO: 511364 - DNA, 19 bp, Homo sapiens
ccagtggcagggcacaggg

SEQ ID NO: 511365 - DNA, 20 bp, Homo sapiens
ccagtggcagggcacagggc

SEQ ID NO: 511366 - DNA, 21 bp, Homo sapiens
ccagtggcagggcacagggcc

SEQ ID NO: 511367 - DNA, 23 bp, Homo sapiens
ccagtggcagggcacagggcctg

SEQ ID NO: 511368 - DNA, 20 bp, Homo sapiens
ccatctgcaccccttctctc

SEQ ID NO: 511369 - DNA, 13 bp, Homo sapiens
ccatgacacccaa

SEQ ID NO: 511370 - DNA, 18 bp, Homo sapiens
ccatgctgtctggcacag

SEQ ID NO: 511371 - DNA, 23 bp, Homo sapiens
ccatgctgtctggcacagcctgc

SEQ ID NO: 511372 - DNA, 15 bp, Homo sapiens
ccatgtatggccagg

SEQ ID NO: 511373 - DNA, 21 bp, Homo sapiens
ccatgtatggccaggaagtag

SEQ ID NO: 511374 - DNA, 20 bp, Homo sapiens
ccatgtgttccaaatttgct

SEQ ID NO: 511375 - DNA, 14 bp, Homo sapiens
ccattctcccaggt

SEQ ID NO: 511376 - DNA, 23 bp, Homo sapiens
ccattctcccaggtaccagctgc

SEQ ID NO: 511377 - DNA, 19 bp, Homo sapiens
ccatttgctgtctttttgt

SEQ ID NO: 511378 - DNA, 22 bp, Homo sapiens
cccaaaacagttatacagatga

SEQ ID NO: 511379 - DNA, 14 bp, Homo sapiens
cccaaatcaataca

SEQ ID NO: 511380 - DNA, 16 bp, Homo sapiens
cccaaatcaatacact

SEQ ID NO: 511381 - DNA, 20 bp, Homo sapiens
cccaagcgccctggccccca

SEQ ID NO: 511382 - DNA, 14 bp, Homo sapiens
cccaccccctgccc

SEQ ID NO: 511383 - DNA, 16 bp, Homo sapiens
cccaccccctgccctg

SEQ ID NO: 511384 - DNA, 21 bp, Homo sapiens
cccaccccggggaccctgtga

SEQ ID NO: 511385 - DNA, 12 bp, Homo sapiens
cccacccctgcc

SEQ ID NO: 511386 - DNA, 21 bp, Homo sapiens
cccaccctgcttggcccaggg

SEQ ID NO: 511387 - DNA, 19 bp, Homo sapiens
cccaccgtggaggaggaag

SEQ ID NO: 511388 - DNA, 13 bp, Homo sapiens
cccacctggccct

SEQ ID NO: 511389 - DNA, 12 bp, Homo sapiens
cccactctcaga

SEQ ID NO: 511390 - DNA, 13 bp, Homo sapiens
cccactctcagag

SEQ ID NO: 511391 - DNA, 15 bp, Homo sapiens
cccactctcagaggc

SEQ ID NO: 511392 - DNA, 17 bp, Homo sapiens
cccactctcagaggccc

SEQ ID NO: 511393 - DNA, 14 bp, Homo sapiens
cccagatcccaaga

SEQ ID NO: 511394 - DNA, 12 bp, Homo sapiens
cccagcagccag

SEQ ID NO: 511395 - DNA, 15 bp, Homo sapiens
cccagccccggggtg

SEQ ID NO: 511396 - DNA, 21 bp, Homo sapiens
cccagcctcaaatccaggacc

SEQ ID NO: 511397 - DNA, 13 bp, Homo sapiens
cccaggagcccat

SEQ ID NO: 511398 - DNA, 16 bp, Homo sapiens
cccaggagcccatttg

SEQ ID NO: 511399 - DNA, 22 bp, Homo sapiens
cccaggagcccatttggagggc

SEQ ID NO: 511400 - DNA, 14 bp, Homo sapiens
cccagggcacgtgg

SEQ ID NO: 511401 - DNA, 15 bp, Homo sapiens
cccaggtaccagctg

SEQ ID NO: 511402 - DNA, 17 bp, Homo sapiens
cccaggtaccagctgcg

SEQ ID NO: 511403 - DNA, 19 bp, Homo sapiens
cccaggtaccagctgcgct

SEQ ID NO: 511404 - DNA, 17 bp, Homo sapiens
cccagtcccagcagcca

SEQ ID NO: 511405 - DNA, 15 bp, Homo sapiens
cccagtccccacccc

SEQ ID NO: 511406 - DNA, 21 bp, Homo sapiens
cccagtccccacccctgcccc

SEQ ID NO: 511407 - DNA, 16 bp, Homo sapiens
cccagtggcagggcac

SEQ ID NO: 511408 - DNA, 16 bp, Homo sapiens
cccatttcccatctgc

SEQ ID NO: 511409 - DNA, 14 bp, Homo sapiens
cccatttggagggc

SEQ ID NO: 511410 - DNA, 13 bp, Homo sapiens
ccccacccctgcc

SEQ ID NO: 511411 - DNA, 14 bp, Homo sapiens
ccccacccctgccc

SEQ ID NO: 511412 - DNA, 12 bp, Homo sapiens
ccccactctcag

SEQ ID NO: 511413 - DNA, 22 bp, Homo sapiens
ccccagcctcaaatccaggacc

SEQ ID NO: 511414 - DNA, 16 bp, Homo sapiens
ccccagcttccagcag

SEQ ID NO: 511415 - DNA, 21 bp, Homo sapiens
ccccagcttccagcaggaggg

SEQ ID NO: 511416 - DNA, 19 bp, Homo sapiens
ccccagtccccacccctgc

SEQ ID NO: 511417 - DNA, 20 bp, Homo sapiens
ccccatttcccatctgcacc

SEQ ID NO: 511418 - DNA, 14 bp, Homo sapiens
cccccagcttccag

SEQ ID NO: 511419 - DNA, 12 bp, Homo sapiens
ccccctgccctg

SEQ ID NO: 511420 - DNA, 15 bp, Homo sapiens
cccctgagcccactg

SEQ ID NO: 511421 - DNA, 16 bp, Homo sapiens
cccctgcactgtaaaa

SEQ ID NO: 511422 - DNA, 18 bp, Homo sapiens
cccctgcactgtaaaatg

SEQ ID NO: 511423 - DNA, 14 bp, Homo sapiens
cccctgccctgcac

SEQ ID NO: 511424 - DNA, 16 bp, Homo sapiens
cccctggaccccagcc

SEQ ID NO: 511425 - DNA, 19 bp, Homo sapiens
cccctggaccccagcctca

SEQ ID NO: 511426 - DNA, 18 bp, Homo sapiens
cccctgggcttggcctgc

SEQ ID NO: 511427 - DNA, 19 bp, Homo sapiens
cccctgggcttggcctgct

SEQ ID NO: 511428 - DNA, 21 bp, Homo sapiens
cccctgggcttggcctgctgt

SEQ ID NO: 511429 - DNA, 14 bp, Homo sapiens
ccccttctctcctc

SEQ ID NO: 511430 - DNA, 21 bp, Homo sapiens
ccccttgccagctgctgagcc

SEQ ID NO: 511431 - DNA, 14 bp, Homo sapiens
cccgcctccaaccc

SEQ ID NO: 511432 - DNA, 17 bp, Homo sapiens
cccggggaccctgtgac

SEQ ID NO: 511433 - DNA, 21 bp, Homo sapiens
cccggggaccctgtgacatgg

SEQ ID NO: 511434 - DNA, 18 bp, Homo sapiens
ccctagctttagaccctg

SEQ ID NO: 511435 - DNA, 21 bp, Homo sapiens
ccctagctttagaccctgggt

SEQ ID NO: 511436 - DNA, 15 bp, Homo sapiens
ccctcactctcagga

SEQ ID NO: 511437 - DNA, 16 bp, Homo sapiens
ccctcgcccagtccca

SEQ ID NO: 511438 - DNA, 17 bp, Homo sapiens
ccctctcctttcactcc

SEQ ID NO: 511439 - DNA, 23 bp, Homo sapiens
ccctctctgaaggaggccacctc

SEQ ID NO: 511440 - DNA, 17 bp, Homo sapiens
ccctgcactgtaaaatg

SEQ ID NO: 511441 - DNA, 17 bp, Homo sapiens
ccctgcagttcccctgg

SEQ ID NO: 511442 - DNA, 21 bp, Homo sapiens
ccctgcagttcccctggaagc

SEQ ID NO: 511443 - DNA, 13 bp, Homo sapiens
ccctgcctctccg

SEQ ID NO: 511444 - DNA, 22 bp, Homo sapiens
ccctgcctctccgcccctgagc

SEQ ID NO: 511445 - DNA, 14 bp, Homo sapiens
ccctgcttccagga

SEQ ID NO: 511446 - DNA, 15 bp, Homo sapiens
ccctgcttccaggaa

SEQ ID NO: 511447 - DNA, 16 bp, Homo sapiens
ccctgcttggcccagg

SEQ ID NO: 511448 - DNA, 15 bp, Homo sapiens
ccctggaagcagtgc

SEQ ID NO: 511449 - DNA, 12 bp, Homo sapiens
ccctggccccca

SEQ ID NO: 511450 - DNA, 15 bp, Homo sapiens
ccctggctgctgccc

SEQ ID NO: 511451 - DNA, 22 bp, Homo sapiens
ccctggctgctgcccccacccc

SEQ ID NO: 511452 - DNA, 19 bp, Homo sapiens
ccctgggcttggcctgctg

SEQ ID NO: 511453 - DNA, 17 bp, Homo sapiens
ccctgggtgggctctgt

SEQ ID NO: 511454 - DNA, 18 bp, Homo sapiens
ccctgggtgggctctgtg

SEQ ID NO: 511455 - DNA, 22 bp, Homo sapiens
ccctgggttagactgccagctc

SEQ ID NO: 511456 - DNA, 22 bp, Homo sapiens
ccctgtgacatggtgcctgaga

SEQ ID NO: 511457 - DNA, 14 bp, Homo sapiens
cccttctcccctgc

SEQ ID NO: 511458 - DNA, 18 bp, Homo sapiens
cccttctcccctgcactg

SEQ ID NO: 511459 - DNA, 21 bp, Homo sapiens
cccttgccagctgctgagccg

SEQ ID NO: 511460 - DNA, 23 bp, Homo sapiens
cccttgcctccccatttcccatc

SEQ ID NO: 511461 - DNA, 20 bp, Homo sapiens
ccctttggtttttttcttct

SEQ ID NO: 511462 - DNA, 21 bp, Homo sapiens
cccttttaaagaatttttgcc

SEQ ID NO: 511463 - DNA, 14 bp, Homo sapiens
ccgccagcctcctc

SEQ ID NO: 511464 - DNA, 23 bp, Homo sapiens
ccgccagcctcctctggacggca

SEQ ID NO: 511465 - DNA, 14 bp, Homo sapiens
ccgcccctgagccc

SEQ ID NO: 511466 - DNA, 16 bp, Homo sapiens
ccgcccctgagcccac

SEQ ID NO: 511467 - DNA, 17 bp, Homo sapiens
ccgcccctgagcccact

SEQ ID NO: 511468 - DNA, 20 bp, Homo sapiens
ccgccggcaataaaagccca

SEQ ID NO: 511469 - DNA, 21 bp, Homo sapiens
ccgccggcaataaaagcccag

SEQ ID NO: 511470 - DNA, 22 bp, Homo sapiens
ccgccggcaataaaagcccagg

SEQ ID NO: 511471 - DNA, 16 bp, Homo sapiens
ccgggcccctgggctt

SEQ ID NO: 511472 - DNA, 17 bp, Homo sapiens
ccggtgtgggggccccg

SEQ ID NO: 511473 - DNA, 16 bp, Homo sapiens
ccgtggaggaggaagg

SEQ ID NO: 511474 - DNA, 20 bp, Homo sapiens
ccgtggaggaggaaggcaag

SEQ ID NO: 511475 - DNA, 23 bp, Homo sapiens
ccgtggaggaggaaggcaagagg

SEQ ID NO: 511476 - DNA, 15 bp, Homo sapiens
cctaaaaggcccaga

SEQ ID NO: 511477 - DNA, 18 bp, Homo sapiens
cctaatccccttctcccc

SEQ ID NO: 511478 - DNA, 16 bp, Homo sapiens
cctaatttctcctccc

SEQ ID NO: 511479 - DNA, 16 bp, Homo sapiens
cctacaatgggaaaac

SEQ ID NO: 511480 - DNA, 11 bp, Homo sapiens
cctacacagga

SEQ ID NO: 511481 - DNA, 23 bp, Homo sapiens
cctagaaaagtttgttttacttt

SEQ ID NO: 511482 - DNA, 21 bp, Homo sapiens
cctagctggagaggagccctg

SEQ ID NO: 511483 - DNA, 22 bp, Homo sapiens
cctagctggagaggagccctgc

SEQ ID NO: 511484 - DNA, 17 bp, Homo sapiens
cctagctttagaccctg

SEQ ID NO: 511485 - DNA, 18 bp, Homo sapiens
cctattaagtcatcatct

SEQ ID NO: 511486 - DNA, 20 bp, Homo sapiens
cctatttgtgaattctggga

SEQ ID NO: 511487 - DNA, 16 bp, Homo sapiens
cctatttttaaaaagt

SEQ ID NO: 511488 - DNA, 24 bp, Homo sapiens
cctcaaatccaggaccctgccagg

SEQ ID NO: 511489 - DNA, 12 bp, Homo sapiens
cctcacctcatg

SEQ ID NO: 511490 - DNA, 15 bp, Homo sapiens
cctcacctcatgccc

SEQ ID NO: 511491 - DNA, 16 bp, Homo sapiens
cctcacctcatgccca

SEQ ID NO: 511492 - DNA, 22 bp, Homo sapiens
cctcacctcatgcccaccccct

SEQ ID NO: 511493 - DNA, 23 bp, Homo sapiens
cctcacctcatgcccaccccctg

SEQ ID NO: 511494 - DNA, 13 bp, Homo sapiens
cctcactctcagg

SEQ ID NO: 511495 - DNA, 16 bp, Homo sapiens
cctcatgaatgtaaat

SEQ ID NO: 511496 - DNA, 23 bp, Homo sapiens
cctcatgaatgtaaatttgtact

SEQ ID NO: 511497 - DNA, 13 bp, Homo sapiens
cctcatgcccacc

SEQ ID NO: 511498 - DNA, 15 bp, Homo sapiens
cctccatccatgtgt

SEQ ID NO: 511499 - DNA, 20 bp, Homo sapiens
cctccccatttcccatctgc

SEQ ID NO: 511500 - DNA, 22 bp, Homo sapiens
cctccccttgccagctgctgag

SEQ ID NO: 511501 - DNA, 21 bp, Homo sapiens
cctcccttccttttccctgct

SEQ ID NO: 511502 - DNA, 17 bp, Homo sapiens
cctcctaaaaggcccag

SEQ ID NO: 511503 - DNA, 18 bp, Homo sapiens
cctcctaaaaggcccaga

SEQ ID NO: 511504 - DNA, 15 bp, Homo sapiens
cctcctcacctcatg

SEQ ID NO: 511505 - DNA, 22 bp, Homo sapiens
cctcctcacctcatgcccaccc

SEQ ID NO: 511506 - DNA, 13 bp, Homo sapiens
cctcgcccagtcc

SEQ ID NO: 511507 - DNA, 15 bp, Homo sapiens
cctctagaagccaag

SEQ ID NO: 511508 - DNA, 16 bp, Homo sapiens
cctctagaagccaagg

SEQ ID NO: 511509 - DNA, 19 bp, Homo sapiens
cctctccgcccctgagccc

SEQ ID NO: 511510 - DNA, 13 bp, Homo sapiens
cctctgcctgccc

SEQ ID NO: 511511 - DNA, 23 bp, Homo sapiens
cctctgggttgttgtttttttct

SEQ ID NO: 511512 - DNA, 15 bp, Homo sapiens
cctgaaaattccaat

SEQ ID NO: 511513 - DNA, 12 bp, Homo sapiens
cctgagaggcag

SEQ ID NO: 511514 - DNA, 13 bp, Homo sapiens
cctgagaggcagg

SEQ ID NO: 511515 - DNA, 17 bp, Homo sapiens
cctgagaggcaggcata

SEQ ID NO: 511516 - DNA, 11 bp, Homo sapiens
cctgagcccac

SEQ ID NO: 511517 - DNA, 16 bp, Homo sapiens
cctgagcccactgtgc

SEQ ID NO: 511518 - DNA, 14 bp, Homo sapiens
cctgagcccccagc

SEQ ID NO: 511519 - DNA, 16 bp, Homo sapiens
cctgagtgagagggga

SEQ ID NO: 511520 - DNA, 18 bp, Homo sapiens
cctgagtgagaggggagg

SEQ ID NO: 511521 - DNA, 21 bp, Homo sapiens
cctgagtgagaggggaggcca

SEQ ID NO: 511522 - DNA, 22 bp, Homo sapiens
cctgagtgagaggggaggccaa

SEQ ID NO: 511523 - DNA, 18 bp, Homo sapiens
cctgcacttgggggctca

SEQ ID NO: 511524 - DNA, 22 bp, Homo sapiens
cctgcacttgggggctcagcaa

SEQ ID NO: 511525 - DNA, 22 bp, Homo sapiens
caaaaaaaaaaaaaagcatcta

SEQ ID NO: 511526 - DNA, 13 bp, Homo sapiens
caaaaatgactct

SEQ ID NO: 511527 - DNA, 16 bp, Homo sapiens
caaaaatgactctaaa

SEQ ID NO: 511528 - DNA, 15 bp, Homo sapiens
caaacacacagaagg

SEQ ID NO: 511529 - DNA, 13 bp, Homo sapiens
caaacgctaaaga

SEQ ID NO: 511530 - DNA, 14 bp, Homo sapiens
caaagaaagactgt

SEQ ID NO: 511531 - DNA, 14 bp, Homo sapiens
caaagagggcttcc

SEQ ID NO: 511532 - DNA, 15 bp, Homo sapiens
ctccgcccctgagcc

SEQ ID NO: 511533 - DNA, 16 bp, Homo sapiens
ctccgcccctgagccc

SEQ ID NO: 511534 - DNA, 20 bp, Homo sapiens
ctccgcccctgagcccactg

SEQ ID NO: 511535 - DNA, 16 bp, Homo sapiens
ctcctatacccagcag

SEQ ID NO: 511536 - DNA, 15 bp, Homo sapiens
ctcctcacctcatgc

SEQ ID NO: 511537 - DNA, 16 bp, Homo sapiens
ctcctcacctcatgcc

SEQ ID NO: 511538 - DNA, 19 bp, Homo sapiens
ctcctcacctcatgcccac

SEQ ID NO: 511539 - DNA, 17 bp, Homo sapiens
tgcctacaatgggaaaa

SEQ ID NO: 511540 - DNA, 21 bp, Homo sapiens
tgcctctccgcccctgagccc

SEQ ID NO: 511541 - DNA, 15 bp, Homo sapiens
tgcctgagaggcagg

SEQ ID NO: 511542 - DNA, 18 bp, Homo sapiens
tgcctgagaggcaggcat

SEQ ID NO: 511543 - DNA, 19 bp, Homo sapiens
tgcctgagaggcaggcata

SEQ ID NO: 511544 - DNA, 17 bp, Homo sapiens
tgcctgccccgccccca

SEQ ID NO: 511545 - DNA, 20 bp, Homo sapiens
tgcctggtaagtggcttttt

SEQ ID NO: 511546 - DNA, 18 bp, Homo sapiens
tgccttaaaaccaaagag

SEQ ID NO: 511547 - DNA, 20 bp, Homo sapiens
tgccttaaaaccaaagaggg

SEQ ID NO: 511548 - DNA, 22 bp, Homo sapiens
tgccttaaaaccaaagagggct

SEQ ID NO: 511549 - DNA, 14 bp, Homo sapiens
tgccttccctagct

SEQ ID NO: 511550 - DNA, 14 bp, Homo sapiens
tgcgcttgcttttc

SEQ ID NO: 511551 - DNA, 16 bp, Homo sapiens
tgcgtcctcctcacct

SEQ ID NO: 511552 - DNA, 14 bp, Homo sapiens
tgctcctgagcccc

SEQ ID NO: 511553 - DNA, 20 bp, Homo sapiens
tgctctcaccttggttcctg

SEQ ID NO: 511554 - DNA, 22 bp, Homo sapiens
tgctctcaccttggttcctggg

SEQ ID NO: 511555 - DNA, 20 bp, Homo sapiens
tgctgaatttattgcctgga

SEQ ID NO: 511556 - DNA, 16 bp, Homo sapiens
tgctgacccatgggca

SEQ ID NO: 511557 - DNA, 19 bp, Homo sapiens
tgctgccacttaaaaagac

SEQ ID NO: 511558 - DNA, 19 bp, Homo sapiens
tgctgtctggcacagcctg

SEQ ID NO: 511559 - DNA, 19 bp, Homo sapiens
tgcttccaggaaactccac

SEQ ID NO: 511560 - DNA, 22 bp, Homo sapiens
tgcttttaaaaattttgtcctt

SEQ ID NO: 511561 - DNA, 15 bp, Homo sapiens
tgcttttctgccctg

SEQ ID NO: 511562 - DNA, 15 bp, Homo sapiens
tggaaaggggagagc

SEQ ID NO: 511563 - DNA, 19 bp, Homo sapiens
tggaaaggggagagcctgc

SEQ ID NO: 511564 - DNA, 21 bp, Homo sapiens
tggaaaggggagagcctgctg

SEQ ID NO: 511565 - DNA, 23 bp, Homo sapiens
tggaaaggggagagcctgctggc

SEQ ID NO: 511566 - DNA, 19 bp, Homo sapiens
tggaagaagggagaagaaa

SEQ ID NO: 511567 - DNA, 16 bp, Homo sapiens
tggaagcagtgcccag

SEQ ID NO: 511568 - DNA, 18 bp, Homo sapiens
tggaagcagtgcccaggt

SEQ ID NO: 511569 - DNA, 15 bp, Homo sapiens
tggagaatcacaggc

SEQ ID NO: 511570 - DNA, 22 bp, Homo sapiens
tggagaatcacaggctgggctg

SEQ ID NO: 511571 - DNA, 22 bp, Homo sapiens
tggagactgctcctgagccccc

SEQ ID NO: 511572 - DNA, 16 bp, Homo sapiens
tggagagaaaatacaa

SEQ ID NO: 511573 - DNA, 22 bp, Homo sapiens
tggagcttacacttaaaagaaa

SEQ ID NO: 511574 - DNA, 14 bp, Homo sapiens
tggaggaggaaggc

SEQ ID NO: 511575 - DNA, 21 bp, Homo sapiens
tggaggaggaaggcaagaggg

SEQ ID NO: 511576 - DNA, 22 bp, Homo sapiens
tggaggcttcctgcgtcctcct

SEQ ID NO: 511577 - DNA, 18 bp, Homo sapiens
tggagggcctgggcctgg

SEQ ID NO: 511578 - DNA, 17 bp, Homo sapiens
tggagtctcaaaatcaa

SEQ ID NO: 511579 - DNA, 14 bp, Homo sapiens
tggatgtatttgta

SEQ ID NO: 511580 - DNA, 15 bp, Homo sapiens
tggatgtatttgtag

SEQ ID NO: 511581 - DNA, 13 bp, Homo sapiens
tggattgtacata

SEQ ID NO: 511582 - DNA, 17 bp, Homo sapiens
tggcaagagatcatatc

SEQ ID NO: 511583 - DNA, 22 bp, Homo sapiens
tggcacccaccgtggaggagga

SEQ ID NO: 511584 - DNA, 15 bp, Homo sapiens
tggcagggcacaggg

SEQ ID NO: 511585 - DNA, 18 bp, Homo sapiens
tggcagggcacagggcct

SEQ ID NO: 511586 - DNA, 19 bp, Homo sapiens
tggcagggcacagggcctg

SEQ ID NO: 511587 - DNA, 18 bp, Homo sapiens
tggcataacaaaggcaag

SEQ ID NO: 511588 - DNA, 21 bp, Homo sapiens
tggcatggtggttgggaccca

SEQ ID NO: 511589 - DNA, 18 bp, Homo sapiens
tggcccatgtatggccag

SEQ ID NO: 511590 - DNA, 19 bp, Homo sapiens
tggcctccacacttgctct

SEQ ID NO: 511591 - DNA, 12 bp, Homo sapiens
tggcctgctgtg

SEQ ID NO: 511592 - DNA, 18 bp, Homo sapiens
tggctccctcactctcag

SEQ ID NO: 511593 - DNA, 19 bp, Homo sapiens
tggctccctcactctcagg

SEQ ID NO: 511594 - DNA, 24 bp, Homo sapiens
tggctgaggttcctctgcctgccc

SEQ ID NO: 511595 - DNA, 12 bp, Homo sapiens
tggctgctgccc

SEQ ID NO: 511596 - DNA, 15 bp, Homo sapiens
tggctgctgccccca

SEQ ID NO: 511597 - DNA, 16 bp, Homo sapiens
tggcttgggaaactga

SEQ ID NO: 511598 - DNA, 13 bp, Homo sapiens
tggctttttgtac

SEQ ID NO: 511599 - DNA, 18 bp, Homo sapiens
tgggaaaaaaaaaagtgt

SEQ ID NO: 511600 - DNA, 15 bp, Homo sapiens
tgggaaaacttcact

SEQ ID NO: 511601 - DNA, 22 bp, Homo sapiens
tgggaaaacttcactccaaaga

SEQ ID NO: 511602 - DNA, 14 bp, Homo sapiens
tgggaatgaggtgg

SEQ ID NO: 511603 - DNA, 19 bp, Homo sapiens
tgggacccagtggcagggc

SEQ ID NO: 511604 - DNA, 17 bp, Homo sapiens
tgggacctgccaggcag

SEQ ID NO: 511605 - DNA, 20 bp, Homo sapiens
tgggacctgccaggcagggg

SEQ ID NO: 511606 - DNA, 15 bp, Homo sapiens
tgggaggagggagag

SEQ ID NO: 511607 - DNA, 23 bp, Homo sapiens
tgggagggggcttgaagccaaag

SEQ ID NO: 511608 - DNA, 13 bp, Homo sapiens
tgggaggtggaaa

SEQ ID NO: 511609 - DNA, 14 bp, Homo sapiens
tgagtgcaggccca

SEQ ID NO: 511610 - DNA, 16 bp, Homo sapiens
tgagtgcaggcccacc

SEQ ID NO: 511611 - DNA, 18 bp, Homo sapiens
tgagtgcaggcccaccct

SEQ ID NO: 511612 - DNA, 15 bp, Homo sapiens
tgagttgtaaagaaa

SEQ ID NO: 511613 - DNA, 16 bp, Homo sapiens
tgagtttgagctgcct

SEQ ID NO: 511614 - DNA, 17 bp, Homo sapiens
tgagtttgagctgcctt

SEQ ID NO: 511615 - DNA, 21 bp, Homo sapiens
tgatattggaggaatacttct

SEQ ID NO: 511616 - DNA, 16 bp, Homo sapiens
tgatgtaaaatcttgt

SEQ ID NO: 511617 - DNA, 20 bp, Homo sapiens
tgatgttgacatcactggca

SEQ ID NO: 511618 - DNA, 17 bp, Homo sapiens
tgattattgagaaagga

SEQ ID NO: 511619 - DNA, 15 bp, Homo sapiens
tgattttttttctct

SEQ ID NO: 511620 - DNA, 21 bp, Homo sapiens
tgcacaggtttgttttttcaa

SEQ ID NO: 511621 - DNA, 15 bp, Homo sapiens
tgcaccccttctctc

SEQ ID NO: 511622 - DNA, 12 bp, Homo sapiens
tgcactgtaaaa

SEQ ID NO: 511623 - DNA, 21 bp, Homo sapiens
tgcacttgggggctcagcaag

SEQ ID NO: 511624 - DNA, 22 bp, Homo sapiens
tgcacttgggggctcagcaagg

SEQ ID NO: 511625 - DNA, 20 bp, Homo sapiens
tgcagaagctatgtttttaa

SEQ ID NO: 511626 - DNA, 18 bp, Homo sapiens
tgcagtgtagttttcctt

SEQ ID NO: 511627 - DNA, 23 bp, Homo sapiens
tgcagttcccctggaagcagtgc

SEQ ID NO: 511628 - DNA, 20 bp, Homo sapiens
tgcattctttcttctcttta

SEQ ID NO: 511629 - DNA, 17 bp, Homo sapiens
tgccacctccccttgcc

SEQ ID NO: 511630 - DNA, 13 bp, Homo sapiens
tgccacttaaaaa

SEQ ID NO: 511631 - DNA, 14 bp, Homo sapiens
tgccacttaaaaag

SEQ ID NO: 511632 - DNA, 17 bp, Homo sapiens
tgccacttaaaaagact

SEQ ID NO: 511633 - DNA, 15 bp, Homo sapiens
tgccagctcttccta

SEQ ID NO: 511634 - DNA, 15 bp, Homo sapiens
tgccagctgctgagc

SEQ ID NO: 511635 - DNA, 16 bp, Homo sapiens
tgccagctgctgagcc

SEQ ID NO: 511636 - DNA, 17 bp, Homo sapiens
tgccagctgctgagccg

SEQ ID NO: 511637 - DNA, 20 bp, Homo sapiens
tgccagctgctgagccgcag

SEQ ID NO: 511638 - DNA, 19 bp, Homo sapiens
tgccaggcacaggcagggc

SEQ ID NO: 511639 - DNA, 16 bp, Homo sapiens
tgccaggcaggggtgg

SEQ ID NO: 511640 - DNA, 16 bp, Homo sapiens
tgccaggccagcctcc

SEQ ID NO: 511641 - DNA, 11 bp, Homo sapiens
tgcccaccccc

SEQ ID NO: 511642 - DNA, 13 bp, Homo sapiens
tgcccaccccctg

SEQ ID NO: 511643 - DNA, 14 bp, Homo sapiens
tgcccaccccctgc

SEQ ID NO: 511644 - DNA, 18 bp, Homo sapiens
tgcccaccccctgccctg

SEQ ID NO: 511645 - DNA, 19 bp, Homo sapiens
tgcccaggtggctgtggaa

SEQ ID NO: 511646 - DNA, 20 bp, Homo sapiens
tgcccccagccccggggtga

SEQ ID NO: 511647 - DNA, 23 bp, Homo sapiens
tgccccctaatccccttctcccc

SEQ ID NO: 511648 - DNA, 14 bp, Homo sapiens
tgccctggctgctg

SEQ ID NO: 511649 - DNA, 18 bp, Homo sapiens
tgccctggctgctgcccc

SEQ ID NO: 511650 - DNA, 14 bp, Homo sapiens
ttggcctgctgtga

SEQ ID NO: 511651 - DNA, 21 bp, Homo sapiens
ttgggaaggtgtttaaagagt

SEQ ID NO: 511652 - DNA, 13 bp, Homo sapiens
ttgggagagactt

SEQ ID NO: 511653 - DNA, 15 bp, Homo sapiens
ttgggtatttgattt

SEQ ID NO: 511654 - DNA, 13 bp, Homo sapiens
ttggttcctgggg

SEQ ID NO: 511655 - DNA, 18 bp, Homo sapiens
ttgtaaacagaaattgca

SEQ ID NO: 511656 - DNA, 13 bp, Homo sapiens
ttgtactatttaa

SEQ ID NO: 511657 - DNA, 22 bp, Homo sapiens
ttgtatctaaagtcttcctatt

SEQ ID NO: 511658 - DNA, 13 bp, Homo sapiens
ttgtatttgtgta

SEQ ID NO: 511659 - DNA, 21 bp, Homo sapiens
ttgtctttatttttatcccag

SEQ ID NO: 511660 - DNA, 15 bp, Homo sapiens
ttgtgtataggggaa

SEQ ID NO: 511661 - DNA, 15 bp, Homo sapiens
ttgtgtttttccaaa

SEQ ID NO: 511662 - DNA, 21 bp, Homo sapiens
ttgttctagaatcatgtattt

SEQ ID NO: 511663 - DNA, 13 bp, Homo sapiens
ttgttgcagtgta

SEQ ID NO: 511664 - DNA, 21 bp, Homo sapiens
ttgttttagatccaaatgtaa

SEQ ID NO: 511665 - DNA, 23 bp, Homo sapiens
ttgttttagatccaaatgtaaag

SEQ ID NO: 511666 - DNA, 23 bp, Homo sapiens
tttaaaaagtaccacattccatg

SEQ ID NO: 511667 - DNA, 16 bp, Homo sapiens
tttaaagcctgaaaat

SEQ ID NO: 511668 - DNA, 15 bp, Homo sapiens
tttaaagtgtacatt

SEQ ID NO: 511669 - DNA, 20 bp, Homo sapiens
tttaaagtgtacattttata

SEQ ID NO: 511670 - DNA, 15 bp, Homo sapiens
tttaaagttccctat

SEQ ID NO: 511671 - DNA, 23 bp, Homo sapiens
tttaagaggaagaagaagaaagg

SEQ ID NO: 511672 - DNA, 18 bp, Homo sapiens
tttaattgacatactcag

SEQ ID NO: 511673 - DNA, 23 bp, Homo sapiens
tttacatatgattgtatttgtgt

SEQ ID NO: 511674 - DNA, 22 bp, Homo sapiens
tttagacaagagatgggaatga

SEQ ID NO: 511675 - DNA, 17 bp, Homo sapiens
tttatcagatattttca

SEQ ID NO: 511676 - DNA, 15 bp, Homo sapiens
tttattgaaagctca

SEQ ID NO: 511677 - DNA, 18 bp, Homo sapiens
tttattttaagaggaaga

SEQ ID NO: 511678 - DNA, 16 bp, Homo sapiens
tttcaacttatttctg

SEQ ID NO: 511679 - DNA, 17 bp, Homo sapiens
tttcaacttatttctga

SEQ ID NO: 511680 - DNA, 19 bp, Homo sapiens
tttcaagatacatgttgta

SEQ ID NO: 511681 - DNA, 23 bp, Homo sapiens
tttcagcatggactgttcatttg

SEQ ID NO: 511682 - DNA, 17 bp, Homo sapiens
tttcagccttcagattt

SEQ ID NO: 511683 - DNA, 13 bp, Homo sapiens
tttcccatctgca

SEQ ID NO: 511684 - DNA, 14 bp, Homo sapiens
tttcctgtgtctcc

SEQ ID NO: 511685 - DNA, 16 bp, Homo sapiens
tttcctgtgtctccaa

SEQ ID NO: 511686 - DNA, 13 bp, Homo sapiens
tttccttttgcac

SEQ ID NO: 511687 - DNA, 15 bp, Homo sapiens
tttctcctcccttcc

SEQ ID NO: 511688 - DNA, 15 bp, Homo sapiens
tttctgccctggctg

SEQ ID NO: 511689 - DNA, 9 bp, Homo sapiens
tttcttttc

SEQ ID NO: 511690 - DNA, 14 bp, Homo sapiens
tttgaaatgaaaat

SEQ ID NO: 511691 - DNA, 12 bp, Homo sapiens
tttgagctgcct

SEQ ID NO: 511692 - DNA, 18 bp, Homo sapiens
tttgcaccttattcagaa

SEQ ID NO: 511693 - DNA, 22 bp, Homo sapiens
tttgccttggttcttcctagtg

SEQ ID NO: 511694 - DNA, 10 bp, Homo sapiens
tttggatgcc

SEQ ID NO: 511695 - DNA, 19 bp, Homo sapiens
tttggcaaacgctaaagag

SEQ ID NO: 511696 - DNA, 23 bp, Homo sapiens
tttgggaaggtgtttaaagagtt

SEQ ID NO: 511697 - DNA, 17 bp, Homo sapiens
tttgtaaactgatgttt

SEQ ID NO: 511698 - DNA, 21 bp, Homo sapiens
tttgtcaagagccaagacaca

SEQ ID NO: 511699 - DNA, 15 bp, Homo sapiens
tttgtgatggtctct

SEQ ID NO: 511700 - DNA, 22 bp, Homo sapiens
tttgtgtttttccaaaacttga

SEQ ID NO: 511701 - DNA, 22 bp, Homo sapiens
tttgttgcagtgtagttttcct

SEQ ID NO: 511702 - DNA, 14 bp, Homo sapiens
ttttaaacaaaatg

SEQ ID NO: 511703 - DNA, 14 bp, Homo sapiens
ttttaacattcctc

SEQ ID NO: 511704 - DNA, 15 bp, Homo sapiens
ttttaatttaaagtt

SEQ ID NO: 511705 - DNA, 15 bp, Homo sapiens
ttttaccttcaaaat

SEQ ID NO: 511706 - DNA, 12 bp, Homo sapiens
ttttactttgtt

SEQ ID NO: 511707 - DNA, 14 bp, Homo sapiens
ttttactttgtttt

SEQ ID NO: 511708 - DNA, 18 bp, Homo sapiens
ttttagatccaaatgtaa

SEQ ID NO: 511709 - DNA, 21 bp, Homo sapiens
ttttagatccaaatgtaaagg

SEQ ID NO: 511710 - DNA, 16 bp, Homo sapiens
ttttattgaaagctca

SEQ ID NO: 511711 - DNA, 19 bp, Homo sapiens
ttttcaagaaaattttgca

SEQ ID NO: 511712 - DNA, 23 bp, Homo sapiens
ttttcaagaaaattttgcagaag

SEQ ID NO: 511713 - DNA, 16 bp, Homo sapiens
ttttcccatttgctgt

SEQ ID NO: 511714 - DNA, 13 bp, Homo sapiens
ttttctacagtgg

SEQ ID NO: 511715 - DNA, 16 bp, Homo sapiens
ttttctcactgaagct

SEQ ID NO: 511716 - DNA, 23 bp, Homo sapiens
ttttctctctctctttgttacat

SEQ ID NO: 511717 - DNA, 13 bp, Homo sapiens
ttttctgccctgg

SEQ ID NO: 511718 - DNA, 12 bp, Homo sapiens
ttttctgtattt

SEQ ID NO: 511719 - DNA, 19 bp, Homo sapiens
ttttgcacattccaaaatt

SEQ ID NO: 511720 - DNA, 11 bp, Homo sapiens
ttttggatgcc

SEQ ID NO: 511721 - DNA, 16 bp, Homo sapiens
ttttgtcctttcatgt

SEQ ID NO: 511722 - DNA, 16 bp, Homo sapiens
tttttctaagagaagt

SEQ ID NO: 511723 - DNA, 11 bp, Homo sapiens
tttttctgtgc

SEQ ID NO: 511724 - DNA, 16 bp, Homo sapiens
tttttcttctgtattt

SEQ ID NO: 511725 - DNA, 20 bp, Homo sapiens
tttttgttgcagtgtagttt

SEQ ID NO: 511726 - DNA, 20 bp, Homo sapiens
ttttttctctctctctttgt

SEQ ID NO: 511727 - DNA, 13 bp, Homo sapiens
aggtgtttaaaga

SEQ ID NO: 511728 - DNA, 13 bp, Homo sapiens
aggttcctctgcc

SEQ ID NO: 511729 - DNA, 14 bp, Homo sapiens
aggttcctctgcct

SEQ ID NO: 511730 - DNA, 17 bp, Homo sapiens
aggttcctctgcctgcc

SEQ ID NO: 511731 - DNA, 19 bp, Homo sapiens
aggttcctctgcctgcccc

SEQ ID NO: 511732 - DNA, 17 bp, Homo sapiens
aggtttgttttttcaag

SEQ ID NO: 511733 - DNA, 20 bp, Homo sapiens
agtaaccaatttctttctaa

SEQ ID NO: 511734 - DNA, 23 bp, Homo sapiens
agtagggaatgggaggcttgctg

SEQ ID NO: 511735 - DNA, 16 bp, Homo sapiens
agtatgttcttgaaga

SEQ ID NO: 511736 - DNA, 17 bp, Homo sapiens
agtatgttcttgaagaa

SEQ ID NO: 511737 - DNA, 20 bp, Homo sapiens
agtattgatttaacttcatt

SEQ ID NO: 511738 - DNA, 13 bp, Homo sapiens
agtcacactgtaa

SEQ ID NO: 511739 - DNA, 14 bp, Homo sapiens
agtcagtgttgaat

SEQ ID NO: 511740 - DNA, 12 bp, Homo sapiens
agtcatcatctc

SEQ ID NO: 511741 - DNA, 17 bp, Homo sapiens
agtcatcatctccaaac

SEQ ID NO: 511742 - DNA, 16 bp, Homo sapiens
agtccattctcccagg

SEQ ID NO: 511743 - DNA, 17 bp, Homo sapiens
agtccattctcccaggt

SEQ ID NO: 511744 - DNA, 19 bp, Homo sapiens
agtccattctcccaggtac

SEQ ID NO: 511745 - DNA, 17 bp, Homo sapiens
agtcccagcagccagcc

SEQ ID NO: 511746 - DNA, 11 bp, Homo sapiens
agtccccaccc

SEQ ID NO: 511747 - DNA, 17 bp, Homo sapiens
agtccccacccctgccc

SEQ ID NO: 511748 - DNA, 15 bp, Homo sapiens
agtctagtcagtgta

SEQ ID NO: 511749 - DNA, 15 bp, Homo sapiens
agtctcaaaatcaac

SEQ ID NO: 511750 - DNA, 21 bp, Homo sapiens
agtctcaccatttccccaggg

SEQ ID NO: 511751 - DNA, 18 bp, Homo sapiens
agtctcctatacccagca

SEQ ID NO: 511752 - DNA, 21 bp, Homo sapiens
agtctcctatacccagcagag

SEQ ID NO: 511753 - DNA, 23 bp, Homo sapiens
agtgacggttcctacacaggaca

SEQ ID NO: 511754 - DNA, 12 bp, Homo sapiens
agtgcaggccca

SEQ ID NO: 511755 - DNA, 15 bp, Homo sapiens
agtgcaggcccaccc

SEQ ID NO: 511756 - DNA, 14 bp, Homo sapiens
agtgcagtaatttc

SEQ ID NO: 511757 - DNA, 17 bp, Homo sapiens
agtgcagtaatttctga

SEQ ID NO: 511758 - DNA, 18 bp, Homo sapiens
agtgcagtaatttctgag

SEQ ID NO: 511759 - DNA, 14 bp, Homo sapiens
agtgcctacaatgg

SEQ ID NO: 511760 - DNA, 19 bp, Homo sapiens
agtgcttttaaaaattttg

SEQ ID NO: 511761 - DNA, 20 bp, Homo sapiens
agtgcttttaaaaattttgt

SEQ ID NO: 511762 - DNA, 19 bp, Homo sapiens
agtggcaagtatttggcta

SEQ ID NO: 511763 - DNA, 16 bp, Homo sapiens
agtggcagggcacagg

SEQ ID NO: 511764 - DNA, 18 bp, Homo sapiens
agtggggggaacgcccac

SEQ ID NO: 511765 - DNA, 18 bp, Homo sapiens
agtggttttatactgaag

SEQ ID NO: 511766 - DNA, 20 bp, Homo sapiens
agtggttttatactgaagga

SEQ ID NO: 511767 - DNA, 21 bp, Homo sapiens
agtggttttatactgaaggaa

SEQ ID NO: 511768 - DNA, 23 bp, Homo sapiens
agtgtagttttccttttgtgtaa

SEQ ID NO: 511769 - DNA, 14 bp, Homo sapiens
agttattttctaca

SEQ ID NO: 511770 - DNA, 18 bp, Homo sapiens
agttcagatagagatatt

SEQ ID NO: 511771 - DNA, 22 bp, Homo sapiens
agttcccctggaagcagtgccc

SEQ ID NO: 511772 - DNA, 12 bp, Homo sapiens
agttgaattttt

SEQ ID NO: 511773 - DNA, 13 bp, Homo sapiens
agttgaatttttt

SEQ ID NO: 511774 - DNA, 21 bp, Homo sapiens
agttgaattttttttaacatt

SEQ ID NO: 511775 - DNA, 14 bp, Homo sapiens
agttgtaaagaaaa

SEQ ID NO: 511776 - DNA, 16 bp, Homo sapiens
agttgtcctgatgttt

SEQ ID NO: 511777 - DNA, 19 bp, Homo sapiens
ataaaaataaaaaagatcc

SEQ ID NO: 511778 - DNA, 15 bp, Homo sapiens
ataaagtttatcaga

SEQ ID NO: 511779 - DNA, 16 bp, Homo sapiens
ataaagtttatcagat

SEQ ID NO: 511780 - DNA, 13 bp, Homo sapiens
ataaataccaaag

SEQ ID NO: 511781 - DNA, 18 bp, Homo sapiens
ataatggaactctttttt

SEQ ID NO: 511782 - DNA, 16 bp, Homo sapiens
ataattcacacattaa

SEQ ID NO: 511783 - DNA, 14 bp, Homo sapiens
ataatttattgtct

SEQ ID NO: 511784 - DNA, 12 bp, Homo sapiens
atactgaaggaa

SEQ ID NO: 511785 - DNA, 14 bp, Homo sapiens
atactgaaggaaaa

SEQ ID NO: 511786 - DNA, 20 bp, Homo sapiens
atagaaagtataatttcagt

SEQ ID NO: 511787 - DNA, 21 bp, Homo sapiens
atagaggcttctccgccagcc

SEQ ID NO: 511788 - DNA, 22 bp, Homo sapiens
atagaggcttctccgccagcct

SEQ ID NO: 511789 - DNA, 23 bp, Homo sapiens
atagatgttgtagaataagttat

SEQ ID NO: 511790 - DNA, 17 bp, Homo sapiens
atagcccagatcccaag

SEQ ID NO: 511791 - DNA, 18 bp, Homo sapiens
atattaaaaaaagacata

SEQ ID NO: 511792 - DNA, 17 bp, Homo sapiens
atcaatacactagttgt

SEQ ID NO: 511793 - DNA, 15 bp, Homo sapiens
atcacaggctgggct

SEQ ID NO: 511794 - DNA, 23 bp, Homo sapiens
atcacaggctgggctgggcactg

SEQ ID NO: 511795 - DNA, 13 bp, Homo sapiens
atcagatattttc

SEQ ID NO: 511796 - DNA, 17 bp, Homo sapiens
atcagatattttcatat

SEQ ID NO: 511797 - DNA, 21 bp, Homo sapiens
atcagatattttcatatttaa

SEQ ID NO: 511798 - DNA, 15 bp, Homo sapiens
atcatgtattttgta

SEQ ID NO: 511799 - DNA, 18 bp, Homo sapiens
atcatgtattttgtaaac

SEQ ID NO: 511800 - DNA, 20 bp, Homo sapiens
atccagaatgcttctcttta

SEQ ID NO: 511801 - DNA, 11 bp, Homo sapiens
atccaggaccc

SEQ ID NO: 511802 - DNA, 15 bp, Homo sapiens
atccaggaccctgcc

SEQ ID NO: 511803 - DNA, 19 bp, Homo sapiens
atccaggaccctgccaggc

SEQ ID NO: 511804 - DNA, 20 bp, Homo sapiens
atccaggaccctgccaggca

SEQ ID NO: 511805 - DNA, 22 bp, Homo sapiens
atccaggaccctgccaggcaca

SEQ ID NO: 511806 - DNA, 18 bp, Homo sapiens
atccatggggtctctcac

SEQ ID NO: 511807 - DNA, 19 bp, Homo sapiens
atccatggggtctctcaca

SEQ ID NO: 511808 - DNA, 13 bp, Homo sapiens
atccatgtgttcc

SEQ ID NO: 511809 - DNA, 22 bp, Homo sapiens
atccccccattttctctattct

SEQ ID NO: 511810 - DNA, 13 bp, Homo sapiens
atccccttctccc

SEQ ID NO: 511811 - DNA, 16 bp, Homo sapiens
atcctaatttctcctc

SEQ ID NO: 511812 - DNA, 17 bp, Homo sapiens
atcctatttttaaacaa

SEQ ID NO: 511813 - DNA, 18 bp, Homo sapiens
atcctgtgtggagaggga

SEQ ID NO: 511814 - DNA, 22 bp, Homo sapiens
atcctgtgtggagagggaatgt

SEQ ID NO: 511815 - DNA, 23 bp, Homo sapiens
atcctgtgtggagagggaatgtg

SEQ ID NO: 511816 - DNA, 18 bp, Homo sapiens
atccttttctattaagat

SEQ ID NO: 511817 - DNA, 10 bp, Homo sapiens
atctgcaccc

SEQ ID NO: 511818 - DNA, 20 bp, Homo sapiens
atctgcaccccttctctcct

SEQ ID NO: 511819 - DNA, 22 bp, Homo sapiens
atctgcaccccttctctcctcc

SEQ ID NO: 511820 - DNA, 15 bp, Homo sapiens
atctggaagggcact

SEQ ID NO: 511821 - DNA, 15 bp, Homo sapiens
atcttggtatgggct

SEQ ID NO: 511822 - DNA, 21 bp, Homo sapiens
atcttggtatgggctgttctg

SEQ ID NO: 511823 - DNA, 12 bp, Homo sapiens
atctttaaatag

SEQ ID NO: 511824 - DNA, 20 bp, Homo sapiens
atgaaaatgtctcagtattt

SEQ ID NO: 511825 - DNA, 13 bp, Homo sapiens
atgaacacaaatg

SEQ ID NO: 511826 - DNA, 16 bp, Homo sapiens
atgaatgtaaatttgt

SEQ ID NO: 511827 - DNA, 19 bp, Homo sapiens
atgaatgtaaatttgtact

SEQ ID NO: 511828 - DNA, 15 bp, Homo sapiens
atgacaatttttgct

SEQ ID NO: 511829 - DNA, 20 bp, Homo sapiens
atgacggtactggtcaagat

SEQ ID NO: 511830 - DNA, 13 bp, Homo sapiens
atgagtttcacag

SEQ ID NO: 511831 - DNA, 18 bp, Homo sapiens
atgatgttaatgggttat

SEQ ID NO: 511832 - DNA, 16 bp, Homo sapiens
atgatgttttgcaaag

SEQ ID NO: 511833 - DNA, 14 bp, Homo sapiens
atgattgtatttgt

SEQ ID NO: 511834 - DNA, 15 bp, Homo sapiens
atgcccaccccctgc

SEQ ID NO: 511835 - DNA, 16 bp, Homo sapiens
atgcccaccccctgcc

SEQ ID NO: 511836 - DNA, 21 bp, Homo sapiens
atgcctggtaagtggcttttt

SEQ ID NO: 511837 - DNA, 13 bp, Homo sapiens
atgctgacccatg

SEQ ID NO: 511838 - DNA, 17 bp, Homo sapiens
atgctgtctggcacagc

SEQ ID NO: 511839 - DNA, 19 bp, Homo sapiens
atgctgtctggcacagcct

SEQ ID NO: 511840 - DNA, 12 bp, Homo sapiens
atggatgtattt

SEQ ID NO: 511841 - DNA, 17 bp, Homo sapiens
atggattgtacatattt

SEQ ID NO: 511842 - DNA, 18 bp, Homo sapiens
atggattgtacatatttt

SEQ ID NO: 511843 - DNA, 17 bp, Homo sapiens
atggcaagagatcatat

SEQ ID NO: 511844 - DNA, 12 bp, Homo sapiens
atgggaggcttg

SEQ ID NO: 511845 - DNA, 20 bp, Homo sapiens
atgggagggggcttgaagcc

SEQ ID NO: 511846 - DNA, 16 bp, Homo sapiens
atggggtctctcacag

SEQ ID NO: 511847 - DNA, 20 bp, Homo sapiens
atggggtctctcacagacag

SEQ ID NO: 511848 - DNA, 23 bp, Homo sapiens
atgggttatctcaaattttaagt

SEQ ID NO: 511849 - DNA, 19 bp, Homo sapiens
atggtgagcgctgtgagat

SEQ ID NO: 511850 - DNA, 13 bp, Homo sapiens
atggtgatgttga

SEQ ID NO: 511851 - DNA, 15 bp, Homo sapiens
atggtgcctgagagg

SEQ ID NO: 511852 - DNA, 18 bp, Homo sapiens
atggtgcctgagaggcag

SEQ ID NO: 511853 - DNA, 19 bp, Homo sapiens
atggtttcaaagaaagact

SEQ ID NO: 511854 - DNA, 15 bp, Homo sapiens
atgtaaaatcttgtc

SEQ ID NO: 511855 - DNA, 16 bp, Homo sapiens
atgtaaaatcttgtca

SEQ ID NO: 511856 - DNA, 20 bp, Homo sapiens
atgtaaaatcttgtcatgtg

SEQ ID NO: 511857 - DNA, 13 bp, Homo sapiens
atgtaaatttgta

SEQ ID NO: 511858 - DNA, 14 bp, Homo sapiens
atgtaaatttgtac

SEQ ID NO: 511859 - DNA, 15 bp, Homo sapiens
atgtaaatttgtact

SEQ ID NO: 511860 - DNA, 23 bp, Homo sapiens
atgtaacactagccgaatggtag

SEQ ID NO: 511861 - DNA, 21 bp, Homo sapiens
atgtaactcctccatccatgt

SEQ ID NO: 511862 - DNA, 16 bp, Homo sapiens
atgtatttgtagccag

SEQ ID NO: 511863 - DNA, 14 bp, Homo sapiens
atgtattttgtaaa

SEQ ID NO: 511864 - DNA, 14 bp, Homo sapiens
atgtcacttcatat

SEQ ID NO: 511865 - DNA, 16 bp, Homo sapiens
atgtcacttcatattt

SEQ ID NO: 511866 - DNA, 12 bp, Homo sapiens
atgtcttatttt

SEQ ID NO: 511867 - DNA, 20 bp, Homo sapiens
atgtcttattttattatttc

SEQ ID NO: 511868 - DNA, 20 bp, Homo sapiens
atgtgaaatttacatcattt

SEQ ID NO: 511869 - DNA, 23 bp, Homo sapiens
atgtgaaatttacatcatttctt

SEQ ID NO: 511870 - DNA, 18 bp, Homo sapiens
atgtgacccgatggcaca

SEQ ID NO: 511871 - DNA, 14 bp, Homo sapiens
atgtgggattatgg

SEQ ID NO: 511872 - DNA, 18 bp, Homo sapiens
atgtgggattatgggtca

SEQ ID NO: 511873 - DNA, 21 bp, Homo sapiens
atgtggtattggtgctttgtg

SEQ ID NO: 511874 - DNA, 13 bp, Homo sapiens
atgtgtataaaaa

SEQ ID NO: 511875 - DNA, 23 bp, Homo sapiens
atgtgtataaaaataaaaaagat

SEQ ID NO: 511876 - DNA, 18 bp, Homo sapiens
atgttcttctgttattta

SEQ ID NO: 511877 - DNA, 16 bp, Homo sapiens
atgtttttctgtgtta

SEQ ID NO: 511878 - DNA, 22 bp, Homo sapiens
attaaaaaacagcttgttctag

SEQ ID NO: 511879 - DNA, 15 bp, Homo sapiens
attaagtcatcatct

SEQ ID NO: 511880 - DNA, 20 bp, Homo sapiens
attactgacttttcttttta

SEQ ID NO: 511881 - DNA, 23 bp, Homo sapiens
attagagtcagagatcttggtat

SEQ ID NO: 511882 - DNA, 17 bp, Homo sapiens
attagcataaagcacta

SEQ ID NO: 511883 - DNA, 13 bp, Homo sapiens
attataaaatttt

SEQ ID NO: 511884 - DNA, 18 bp, Homo sapiens
attataccgcagagtatt

SEQ ID NO: 511885 - DNA, 21 bp, Homo sapiens
attataccgcagagtatttga

SEQ ID NO: 511886 - DNA, 15 bp, Homo sapiens
attatatctctgtat

SEQ ID NO: 511887 - DNA, 12 bp, Homo sapiens
attatttctaaa

SEQ ID NO: 511888 - DNA, 16 bp, Homo sapiens
attcacacattaataa

SEQ ID NO: 511889 - DNA, 18 bp, Homo sapiens
attcagtgatatgtaaat

SEQ ID NO: 511890 - DNA, 18 bp, Homo sapiens
attccactacacctggct

SEQ ID NO: 511891 - DNA, 19 bp, Homo sapiens
attccactacacctggctg

SEQ ID NO: 511892 - DNA, 22 bp, Homo sapiens
attccactacacctggctgagg

SEQ ID NO: 511893 - DNA, 16 bp, Homo sapiens
attcctcatgaatgta

SEQ ID NO: 511894 - DNA, 18 bp, Homo sapiens
attcctcatgaatgtaaa

SEQ ID NO: 511895 - DNA, 19 bp, Homo sapiens
attcctcatgaatgtaaat

SEQ ID NO: 511896 - DNA, 22 bp, Homo sapiens
attctgtgacatgctaattatt

SEQ ID NO: 511897 - DNA, 12 bp, Homo sapiens
attcttgatgta

SEQ ID NO: 511898 - DNA, 20 bp, Homo sapiens
attcttgatgtaaaatcttg

SEQ ID NO: 511899 - DNA, 13 bp, Homo sapiens
attcttgtaactt

SEQ ID NO: 511900 - DNA, 14 bp, Homo sapiens
attctttccatgac

SEQ ID NO: 511901 - DNA, 12 bp, Homo sapiens
attctttcctaa

SEQ ID NO: 511902 - DNA, 17 bp, Homo sapiens
attctttcttctcttta

SEQ ID NO: 511903 - DNA, 14 bp, Homo sapiens
attgagttgtaaag

SEQ ID NO: 511904 - DNA, 15 bp, Homo sapiens
attgagttgtaaaga

SEQ ID NO: 511905 - DNA, 22 bp, Homo sapiens
attgagttgtaaagaaaactta

SEQ ID NO: 511906 - DNA, 19 bp, Homo sapiens
attgattgctgcattttac

SEQ ID NO: 511907 - DNA, 18 bp, Homo sapiens
attgatttaacttcattt

SEQ ID NO: 511908 - DNA, 20 bp, Homo sapiens
attgatttaacttcattttt

SEQ ID NO: 511909 - DNA, 21 bp, Homo sapiens
attgatttaacttcatttttc

SEQ ID NO: 511910 - DNA, 17 bp, Homo sapiens
attggtgctttgtgtct

SEQ ID NO: 511911 - DNA, 19 bp, Homo sapiens
attgtaaacagaaattgca

SEQ ID NO: 511912 - DNA, 15 bp, Homo sapiens
attgttttccagaag

SEQ ID NO: 511913 - DNA, 20 bp, Homo sapiens
attgttttccagaagcctcc

SEQ ID NO: 511914 - DNA, 16 bp, Homo sapiens
atttaaagccaaatgt

SEQ ID NO: 511915 - DNA, 20 bp, Homo sapiens
atttaaagttccctatttgt

SEQ ID NO: 511916 - DNA, 13 bp, Homo sapiens
atttaactgacta

SEQ ID NO: 511917 - DNA, 16 bp, Homo sapiens
atttacatcatttctt

SEQ ID NO: 511918 - DNA, 14 bp, Homo sapiens
atttagacaagaga

SEQ ID NO: 511919 - DNA, 16 bp, Homo sapiens
atttagacaagagatg

SEQ ID NO: 511920 - DNA, 16 bp, Homo sapiens
atttattcccttttaa

SEQ ID NO: 511921 - DNA, 17 bp, Homo sapiens
atttattcccttttaaa

SEQ ID NO: 511922 - DNA, 14 bp, Homo sapiens
atttcccatctgca

SEQ ID NO: 511923 - DNA, 14 bp, Homo sapiens
atttctcctccctt

SEQ ID NO: 511924 - DNA, 16 bp, Homo sapiens
atttctgaaaaagaga

SEQ ID NO: 511925 - DNA, 12 bp, Homo sapiens
atttctttctaa

SEQ ID NO: 511926 - DNA, 18 bp, Homo sapiens
atttgatggcttgggaaa

SEQ ID NO: 511927 - DNA, 17 bp, Homo sapiens
atttggagggcctgggc

SEQ ID NO: 511928 - DNA, 15 bp, Homo sapiens
atttggatcctgtgt

SEQ ID NO: 511929 - DNA, 17 bp, Homo sapiens
atttgtactatttaact

SEQ ID NO: 511930 - DNA, 18 bp, Homo sapiens
atttgtactatttaactg

SEQ ID NO: 511931 - DNA, 22 bp, Homo sapiens
atttgtactatttaactgacta

SEQ ID NO: 511932 - DNA, 18 bp, Homo sapiens
attttaaagcctgaaaat

SEQ ID NO: 511933 - DNA, 23 bp, Homo sapiens
attttaaagcctgaaaattccaa

SEQ ID NO: 511934 - DNA, 17 bp, Homo sapiens
attttaaggatgtcact

SEQ ID NO: 511935 - DNA, 18 bp, Homo sapiens
attttaatgatattggag

SEQ ID NO: 511936 - DNA, 17 bp, Homo sapiens
attttcaatgaaacaaa

SEQ ID NO: 511937 - DNA, 19 bp, Homo sapiens
attttcatatttaaagcca

SEQ ID NO: 511938 - DNA, 20 bp, Homo sapiens
attttcatatttaaagccaa

SEQ ID NO: 511939 - DNA, 21 bp, Homo sapiens
attttcatatttaaagccaaa

SEQ ID NO: 511940 - DNA, 18 bp, Homo sapiens
atttttatatattatgtc

SEQ ID NO: 511941 - DNA, 16 bp, Homo sapiens
atttttatcccaggaa

SEQ ID NO: 511942 - DNA, 19 bp, Homo sapiens
atttttctgggcttttcct

SEQ ID NO: 511943 - DNA, 17 bp, Homo sapiens
atttttgcacagtggag

SEQ ID NO: 511944 - DNA, 14 bp, Homo sapiens
atttttgctgtttt

SEQ ID NO: 511945 - DNA, 17 bp, Homo sapiens
atttttgttgcagtgta

SEQ ID NO: 511946 - DNA, 13 bp, Homo sapiens
atttttttcccaa

SEQ ID NO: 511947 - DNA, 22 bp, Homo sapiens
atttttttcccaaggagtaacc

SEQ ID NO: 511948 - DNA, 18 bp, Homo sapiens
attttttttaacattcct

SEQ ID NO: 511949 - DNA, 14 bp, Homo sapiens
atttttttttctaa

SEQ ID NO: 511950 - DNA, 15 bp, Homo sapiens
atttttttttctaag

SEQ ID NO: 511951 - DNA, 14 bp, Homo sapiens
caaacaaaaatgac

SEQ ID NO: 511952 - DNA, 21 bp, Homo sapiens
caaacgctaaagagcccttgc

SEQ ID NO: 511953 - DNA, 13 bp, Homo sapiens
caaagagaaacct

SEQ ID NO: 511954 - DNA, 23 bp, Homo sapiens
caaagataatgcatatttttgca

SEQ ID NO: 511955 - DNA, 20 bp, Homo sapiens
caaagtgaactctattttga

SEQ ID NO: 511956 - DNA, 20 bp, Homo sapiens
caaagtggcaagtatttggc

SEQ ID NO: 511957 - DNA, 17 bp, Homo sapiens
caaatccaggaccctgc

SEQ ID NO: 511958 - DNA, 13 bp, Homo sapiens
caaatctgacttt

SEQ ID NO: 511959 - DNA, 18 bp, Homo sapiens
caaatctgactttttctg

SEQ ID NO: 511960 - DNA, 21 bp, Homo sapiens
caacccctcgcccagtcccag

SEQ ID NO: 511961 - DNA, 23 bp, Homo sapiens
caacccctcgcccagtcccagca

SEQ ID NO: 511962 - DNA, 22 bp, Homo sapiens
caacccctggaccccagcctca

SEQ ID NO: 511963 - DNA, 21 bp, Homo sapiens
caacttatttctgaaaaagag

SEQ ID NO: 511964 - DNA, 13 bp, Homo sapiens
caagaaaattttg

SEQ ID NO: 511965 - DNA, 16 bp, Homo sapiens
caagaaaattttgcag

SEQ ID NO: 511966 - DNA, 17 bp, Homo sapiens
caagactctgccttaat

SEQ ID NO: 511967 - DNA, 22 bp, Homo sapiens
caagactctgccttaatttttg

SEQ ID NO: 511968 - DNA, 17 bp, Homo sapiens
caagagattatgtaact

SEQ ID NO: 511969 - DNA, 18 bp, Homo sapiens
caagagcctgattttttg

SEQ ID NO: 511970 - DNA, 15 bp, Homo sapiens
caagagggggtggag

SEQ ID NO: 511971 - DNA, 18 bp, Homo sapiens
caagagtggccccacctg

SEQ ID NO: 511972 - DNA, 19 bp, Homo sapiens
caagatacatgttgtattt

SEQ ID NO: 511973 - DNA, 19 bp, Homo sapiens
caagatgggtcaagcaagc

SEQ ID NO: 511974 - DNA, 17 bp, Homo sapiens
caagcgccctggccccc

SEQ ID NO: 511975 - DNA, 23 bp, Homo sapiens
caagcgccctggcccccacatgg

SEQ ID NO: 511976 - DNA, 16 bp, Homo sapiens
caaggatgtttttaat

SEQ ID NO: 511977 - DNA, 12 bp, Homo sapiens
caaggccacctc

SEQ ID NO: 511978 - DNA, 13 bp, Homo sapiens
caaggccacctct

SEQ ID NO: 511979 - DNA, 14 bp, Homo sapiens
caaggccacctctt

SEQ ID NO: 511980 - DNA, 16 bp, Homo sapiens
caagggaaaggggtgc

SEQ ID NO: 511981 - DNA, 15 bp, Homo sapiens
caagtatttggctat

SEQ ID NO: 511982 - DNA, 18 bp, Homo sapiens
caagtggggtgctgggag

SEQ ID NO: 511983 - DNA, 18 bp, Homo sapiens
caataaaagcccaggagc

SEQ ID NO: 511984 - DNA, 18 bp, Homo sapiens
caataatttgtggtgatt

SEQ ID NO: 511985 - DNA, 20 bp, Homo sapiens
caataatttgtggtgatttg

SEQ ID NO: 511986 - DNA, 14 bp, Homo sapiens
caataccccatgga

SEQ ID NO: 511987 - DNA, 16 bp, Homo sapiens
caattcttgtaacttt

SEQ ID NO: 511988 - DNA, 17 bp, Homo sapiens
caattcttgtaactttc

SEQ ID NO: 511989 - DNA, 21 bp, Homo sapiens
caattgtaaacagaaattgca

SEQ ID NO: 511990 - DNA, 16 bp, Homo sapiens
cacaaatgtgtatttt

SEQ ID NO: 511991 - DNA, 18 bp, Homo sapiens
cacaaatgtgtatttttg

SEQ ID NO: 511992 - DNA, 22 bp, Homo sapiens
cacaagcaaaaaaaaaaaaaag

SEQ ID NO: 511993 - DNA, 16 bp, Homo sapiens
cacaatggtttcaaag

SEQ ID NO: 511994 - DNA, 21 bp, Homo sapiens
cacaatggtttcaaagaaaga

SEQ ID NO: 511995 - DNA, 22 bp, Homo sapiens
cacacagaaggggactgccacc

SEQ ID NO: 511996 - DNA, 15 bp, Homo sapiens
cacactgtaacctca

SEQ ID NO: 511997 - DNA, 23 bp, Homo sapiens
cacagaaggggactgccacctcc

SEQ ID NO: 511998 - DNA, 22 bp, Homo sapiens
cacagacaggacccctgcagtt

SEQ ID NO: 511999 - DNA, 13 bp, Homo sapiens
cacagcctgcact

SEQ ID NO: 512000 - DNA, 18 bp, Homo sapiens
cacaggacaggggttcct

SEQ ID NO: 512001 - DNA, 17 bp, Homo sapiens
cagcaaggccacctctt

SEQ ID NO: 512002 - DNA, 19 bp, Homo sapiens
cagcaaggccacctcttcc

SEQ ID NO: 512003 - DNA, 13 bp, Homo sapiens
cagcagagggata

SEQ ID NO: 512004 - DNA, 12 bp, Homo sapiens
cagcagccagcc

SEQ ID NO: 512005 - DNA, 13 bp, Homo sapiens
cagcagccagcca

SEQ ID NO: 512006 - DNA, 23 bp, Homo sapiens
cagcagccagccaaacacacaga

SEQ ID NO: 512007 - DNA, 15 bp, Homo sapiens
cagcccacgctgact

SEQ ID NO: 512008 - DNA, 20 bp, Homo sapiens
cagcctcaaatccaggaccc

SEQ ID NO: 512009 - DNA, 20 bp, Homo sapiens
cagcctccgagagggagaga

SEQ ID NO: 512010 - DNA, 13 bp, Homo sapiens
cagctcttcctag

SEQ ID NO: 512011 - DNA, 19 bp, Homo sapiens
cagctcttcctagctggag

SEQ ID NO: 512012 - DNA, 17 bp, Homo sapiens
cagctgcgcttgctttt

SEQ ID NO: 512013 - DNA, 14 bp, Homo sapiens
cagctgctgagccg

SEQ ID NO: 512014 - DNA, 15 bp, Homo sapiens
cagcttccagcagga

SEQ ID NO: 512015 - DNA, 16 bp, Homo sapiens
cagcttccagcaggag

SEQ ID NO: 512016 - DNA, 17 bp, Homo sapiens
cagcttccagcaggagg

SEQ ID NO: 512017 - DNA, 21 bp, Homo sapiens
cagcttgagccgggcccctgg

SEQ ID NO: 512018 - DNA, 15 bp, Homo sapiens
cagcttgttctagaa

SEQ ID NO: 512019 - DNA, 23 bp, Homo sapiens
caggaaactccacatctgcctta

SEQ ID NO: 512020 - DNA, 20 bp, Homo sapiens
caggaaatgctgacccatgg

SEQ ID NO: 512021 - DNA, 21 bp, Homo sapiens
caggaaatgctgacccatggg

SEQ ID NO: 512022 - DNA, 22 bp, Homo sapiens
caggaaatgctgacccatgggc

SEQ ID NO: 512023 - DNA, 18 bp, Homo sapiens
caggaagtagcacaggct

SEQ ID NO: 512024 - DNA, 16 bp, Homo sapiens
caggaccagcccacgc

SEQ ID NO: 512025 - DNA, 20 bp, Homo sapiens
caggacccctgcagttcccc

SEQ ID NO: 512026 - DNA, 14 bp, Homo sapiens
caggaccctgccag

SEQ ID NO: 512027 - DNA, 16 bp, Homo sapiens
caggaccctgccaggc

SEQ ID NO: 512028 - DNA, 20 bp, Homo sapiens
caggaccctgccaggcacag

SEQ ID NO: 512029 - DNA, 12 bp, Homo sapiens
caggagggacag

SEQ ID NO: 512030 - DNA, 16 bp, Homo sapiens
caggcacaggcagggc

SEQ ID NO: 512031 - DNA, 12 bp, Homo sapiens
caggcagggcag

SEQ ID NO: 512032 - DNA, 16 bp, Homo sapiens
caggcagggcaggacc

SEQ ID NO: 512033 - DNA, 23 bp, Homo sapiens
caggcaggggtgggggtggaggc

SEQ ID NO: 512034 - DNA, 21 bp, Homo sapiens
caggcatagaggcttctccgc

SEQ ID NO: 512035 - DNA, 23 bp, Homo sapiens
caggcatagaggcttctccgcca

SEQ ID NO: 512036 - DNA, 11 bp, Homo sapiens
caggccagcct

SEQ ID NO: 512037 - DNA, 15 bp, Homo sapiens
caggccagcctccga

SEQ ID NO: 512038 - DNA, 14 bp, Homo sapiens
caggcccaccctgc

SEQ ID NO: 512039 - DNA, 24 bp, Homo sapiens
caggcccaccctgcttggcccagg

SEQ ID NO: 512040 - DNA, 18 bp, Homo sapiens
caggctcactgccaggcc

SEQ ID NO: 512041 - DNA, 21 bp, Homo sapiens
caggctcactgccaggccagc

SEQ ID NO: 512042 - DNA, 14 bp, Homo sapiens
caggctgagtgcag

SEQ ID NO: 512043 - DNA, 18 bp, Homo sapiens
caggctgagtgcaggccc

SEQ ID NO: 512044 - DNA, 12 bp, Homo sapiens
caggctgggctg

SEQ ID NO: 512045 - DNA, 13 bp, Homo sapiens
caggctgggctgg

SEQ ID NO: 512046 - DNA, 17 bp, Homo sapiens
caggctgggctgggcac

SEQ ID NO: 512047 - DNA, 18 bp, Homo sapiens
ctgcctgccccgccccca

SEQ ID NO: 512048 - DNA, 19 bp, Homo sapiens
ctgccttaatttttgaaaa

SEQ ID NO: 512049 - DNA, 17 bp, Homo sapiens
ctgcgtcctcctcacct

SEQ ID NO: 512050 - DNA, 19 bp, Homo sapiens
ctgcgtcctcctcacctca

SEQ ID NO: 512051 - DNA, 15 bp, Homo sapiens
ctgctcctgagcccc

SEQ ID NO: 512052 - DNA, 20 bp, Homo sapiens
ctgctcctgagcccccagct

SEQ ID NO: 512053 - DNA, 22 bp, Homo sapiens
ctgctctcaccttggttcctgg

SEQ ID NO: 512054 - DNA, 13 bp, Homo sapiens
ctgctgagccgca

SEQ ID NO: 512055 - DNA, 14 bp, Homo sapiens
ctgctgagccgcag

SEQ ID NO: 512056 - DNA, 14 bp, Homo sapiens
ctgctgcccccacc

SEQ ID NO: 512057 - DNA, 15 bp, Homo sapiens
ctgctgcccccaccc

SEQ ID NO: 512058 - DNA, 21 bp, Homo sapiens
ctgctgcccccaccccgggga

SEQ ID NO: 512059 - DNA, 22 bp, Homo sapiens
ctgctgcccccaccccggggac

SEQ ID NO: 512060 - DNA, 16 bp, Homo sapiens
ctgctggcacccaccg

SEQ ID NO: 512061 - DNA, 17 bp, Homo sapiens
ctgctggcacccaccgt

SEQ ID NO: 512062 - DNA, 18 bp, Homo sapiens
ctgcttggcccagggggc

SEQ ID NO: 512063 - DNA, 16 bp, Homo sapiens
ctgcttttctgccctg

SEQ ID NO: 512064 - DNA, 21 bp, Homo sapiens
ctgcttttctgccctggctgc

SEQ ID NO: 512065 - DNA, 13 bp, Homo sapiens
ctggaaaggggag

SEQ ID NO: 512066 - DNA, 17 bp, Homo sapiens
ctggaaaggggagagcc

SEQ ID NO: 512067 - DNA, 22 bp, Homo sapiens
ctggaaaggggagagcctgctg

SEQ ID NO: 512068 - DNA, 15 bp, Homo sapiens
ctggaagcagtgccc

SEQ ID NO: 512069 - DNA, 16 bp, Homo sapiens
ctggaagcagtgccca

SEQ ID NO: 512070 - DNA, 16 bp, Homo sapiens
ctggaatagttacttt

SEQ ID NO: 512071 - DNA, 20 bp, Homo sapiens
ctggacggcaggctcactgc

SEQ ID NO: 512072 - DNA, 21 bp, Homo sapiens
ctggccctctctgaaggaggc

SEQ ID NO: 512073 - DNA, 23 bp, Homo sapiens
ctggccctctctgaaggaggcca

SEQ ID NO: 512074 - DNA, 20 bp, Homo sapiens
ctggccggtgtgggggcccc

SEQ ID NO: 512075 - DNA, 13 bp, Homo sapiens
ctggctccctcac

SEQ ID NO: 512076 - DNA, 18 bp, Homo sapiens
ctggctccctcactctca

SEQ ID NO: 512077 - DNA, 17 bp, Homo sapiens
ctggctgaggttcctct

SEQ ID NO: 512078 - DNA, 20 bp, Homo sapiens
ctggctgaggttcctctgcc

SEQ ID NO: 512079 - DNA, 21 bp, Homo sapiens
ctggctgaggttcctctgcct

SEQ ID NO: 512080 - DNA, 12 bp, Homo sapiens
ctggctgctgcc

SEQ ID NO: 512081 - DNA, 18 bp, Homo sapiens
ctgggacctgccaggcag

SEQ ID NO: 512082 - DNA, 20 bp, Homo sapiens
ctgggacctgccaggcaggg

SEQ ID NO: 512083 - DNA, 15 bp, Homo sapiens
ctgggaggagggaga

SEQ ID NO: 512084 - DNA, 17 bp, Homo sapiens
ctgggaggagggagagg

SEQ ID NO: 512085 - DNA, 19 bp, Homo sapiens
ctgggcactgctctcacct

SEQ ID NO: 512086 - DNA, 14 bp, Homo sapiens
ctgggcctggctcc

SEQ ID NO: 512087 - DNA, 22 bp, Homo sapiens
ctgggcctggctccctcactct

SEQ ID NO: 512088 - DNA, 23 bp, Homo sapiens
ctgggcctggctccctcactctc

SEQ ID NO: 512089 - DNA, 12 bp, Homo sapiens
ctgggctgggca

SEQ ID NO: 512090 - DNA, 15 bp, Homo sapiens
ctgggcttggcctgc

SEQ ID NO: 512091 - DNA, 18 bp, Homo sapiens
ctgggcttggcctgctgt

SEQ ID NO: 512092 - DNA, 20 bp, Homo sapiens
ctgggcttggcctgctgtga

SEQ ID NO: 512093 - DNA, 18 bp, Homo sapiens
ctgggggatgggcctgag

SEQ ID NO: 512094 - DNA, 23 bp, Homo sapiens
ctgggttagactgccagctcttc

SEQ ID NO: 512095 - DNA, 13 bp, Homo sapiens
ctggtaattttgg

SEQ ID NO: 512096 - DNA, 22 bp, Homo sapiens
ctgtattttatttagacaagag

SEQ ID NO: 512097 - DNA, 18 bp, Homo sapiens
ctgtatttttttttctaa

SEQ ID NO: 512098 - DNA, 22 bp, Homo sapiens
ctgtatttttttttctaagaga

SEQ ID NO: 512099 - DNA, 18 bp, Homo sapiens
ctgtgacatggtgcctga

SEQ ID NO: 512100 - DNA, 23 bp, Homo sapiens
ctgtgacatggtgcctgagaggc

SEQ ID NO: 512101 - DNA, 15 bp, Homo sapiens
ctgtgagatggatgt

SEQ ID NO: 512102 - DNA, 19 bp, Homo sapiens
ctgtgagatggatgtattt

SEQ ID NO: 512103 - DNA, 22 bp, Homo sapiens
ctgtgattccactacacctggc

SEQ ID NO: 512104 - DNA, 16 bp, Homo sapiens
ctgtgcagtcactgga

SEQ ID NO: 512105 - DNA, 18 bp, Homo sapiens
ctgtgcagtcactggagg

SEQ ID NO: 512106 - DNA, 17 bp, Homo sapiens
ctgtgcgccttaaacaa

SEQ ID NO: 512107 - DNA, 14 bp, Homo sapiens
ctgtggagactgct

SEQ ID NO: 512108 - DNA, 17 bp, Homo sapiens
ctgtggagactgctcct

SEQ ID NO: 512109 - DNA, 23 bp, Homo sapiens
ctgtggagactgctcctgagccc

SEQ ID NO: 512110 - DNA, 21 bp, Homo sapiens
ctgtgggttttaacattttta

SEQ ID NO: 512111 - DNA, 16 bp, Homo sapiens
ctgtgtggagagggaa

SEQ ID NO: 512112 - DNA, 20 bp, Homo sapiens
ctgttaatgcattctttctt

SEQ ID NO: 512113 - DNA, 15 bp, Homo sapiens
ctgttatttatttca

SEQ ID NO: 512114 - DNA, 17 bp, Homo sapiens
ctgttctgtttcctgtg

SEQ ID NO: 512115 - DNA, 21 bp, Homo sapiens
ctgttctgtttcctgtgtctc

SEQ ID NO: 512116 - DNA, 18 bp, Homo sapiens
ctgttgtcatttccaaat

SEQ ID NO: 512117 - DNA, 13 bp, Homo sapiens
cttaaaaccaaag

SEQ ID NO: 512118 - DNA, 16 bp, Homo sapiens
cttaaacaattcttgt

SEQ ID NO: 512119 - DNA, 21 bp, Homo sapiens
cttaaacaattcttgtaactt

SEQ ID NO: 512120 - DNA, 11 bp, Homo sapiens
cttaatggcac

SEQ ID NO: 512121 - DNA, 12 bp, Homo sapiens
cttacacttaaa

SEQ ID NO: 512122 - DNA, 20 bp, Homo sapiens
cttataaggttcgtattgct

SEQ ID NO: 512123 - DNA, 15 bp, Homo sapiens
cttatatttttctgg

SEQ ID NO: 512124 - DNA, 15 bp, Homo sapiens
cttatgaacagatat

SEQ ID NO: 512125 - DNA, 22 bp, Homo sapiens
cttatggtattatatctctgta

SEQ ID NO: 512126 - DNA, 18 bp, Homo sapiens
cttatttctgaaaaagag

SEQ ID NO: 512127 - DNA, 19 bp, Homo sapiens
cttcaaaatatttgtcctt

SEQ ID NO: 512128 - DNA, 20 bp, Homo sapiens
cttcaaagtggcaagtattt

SEQ ID NO: 512129 - DNA, 17 bp, Homo sapiens
cttccaggaaactccac

SEQ ID NO: 512130 - DNA, 19 bp, Homo sapiens
cttccaggaaactccacat

SEQ ID NO: 512131 - DNA, 21 bp, Homo sapiens
cttccctagctttagaccctg

SEQ ID NO: 512132 - DNA, 21 bp, Homo sapiens
cttcctattgtactgcacaaa

SEQ ID NO: 512133 - DNA, 18 bp, Homo sapiens
cttcctctagaagccaag

SEQ ID NO: 512134 - DNA, 22 bp, Homo sapiens
cttcctgaggggagacagagca

SEQ ID NO: 512135 - DNA, 23 bp, Homo sapiens
cttcctgaggggagacagagcaa

SEQ ID NO: 512136 - DNA, 16 bp, Homo sapiens
cttcctgcgtcctcct

SEQ ID NO: 512137 - DNA, 20 bp, Homo sapiens
cttcctgcgtcctcctcacc

SEQ ID NO: 512138 - DNA, 14 bp, Homo sapiens
cttccttttccctg

SEQ ID NO: 512139 - DNA, 15 bp, Homo sapiens
cttccttttccctgc

SEQ ID NO: 512140 - DNA, 19 bp, Homo sapiens
cttccttttccctgcttcc

SEQ ID NO: 512141 - DNA, 15 bp, Homo sapiens
cttcggatttattcc

SEQ ID NO: 512142 - DNA, 19 bp, Homo sapiens
ctcatgcccaccccctgcc

SEQ ID NO: 512143 - DNA, 21 bp, Homo sapiens
ctcatgcccaccccctgccct

SEQ ID NO: 512144 - DNA, 16 bp, Homo sapiens
ctccaaactaaaccct

SEQ ID NO: 512145 - DNA, 15 bp, Homo sapiens
ctccaacccctcgcc

SEQ ID NO: 512146 - DNA, 23 bp, Homo sapiens
ctccaacccctcgcccagtccca

SEQ ID NO: 512147 - DNA, 17 bp, Homo sapiens
ctccaagcctctgtctt

SEQ ID NO: 512148 - DNA, 13 bp, Homo sapiens
ctccacatctgcc

SEQ ID NO: 512149 - DNA, 16 bp, Homo sapiens
ctccacatctgcctta

SEQ ID NO: 512150 - DNA, 16 bp, Homo sapiens
ctcccaggtaccagct

SEQ ID NO: 512151 - DNA, 19 bp, Homo sapiens
ctcccaggtaccagctgcg

SEQ ID NO: 512152 - DNA, 21 bp, Homo sapiens
ctcccaggtaccagctgcgct

SEQ ID NO: 512153 - DNA, 24 bp, Homo sapiens
ctcccaggtaccagctgcgcttgc

SEQ ID NO: 512154 - DNA, 12 bp, Homo sapiens
ctcccctgcact

SEQ ID NO: 512155 - DNA, 15 bp, Homo sapiens
ctcccctgcactgta

SEQ ID NO: 512156 - DNA, 16 bp, Homo sapiens
ctcccctgcactgtaa

SEQ ID NO: 512157 - DNA, 18 bp, Homo sapiens
ctcccctgcactgtaaaa

SEQ ID NO: 512158 - DNA, 13 bp, Homo sapiens
ctccccttgccag

SEQ ID NO: 512159 - DNA, 17 bp, Homo sapiens
ctccccttgccagctgc

SEQ ID NO: 512160 - DNA, 16 bp, Homo sapiens
ctcccgcctccaaccc

SEQ ID NO: 512161 - DNA, 14 bp, Homo sapiens
ctccctcactctca

SEQ ID NO: 512162 - DNA, 17 bp, Homo sapiens
ctccctcactctcagga

SEQ ID NO: 512163 - DNA, 18 bp, Homo sapiens
ctccctcactctcaggaa

SEQ ID NO: 512164 - DNA, 23 bp, Homo sapiens
ctccctcgatccccccattttct

SEQ ID NO: 512165 - DNA, 20 bp, Homo sapiens
ctcccttccttttccctgct

SEQ ID NO: 512166 - DNA, 13 bp, Homo sapiens
ctccgccagcctc

SEQ ID NO: 512167 - DNA, 21 bp, Homo sapiens
ctccgccagcctcctctggac

SEQ ID NO: 512168 - DNA, 17 bp, Homo sapiens
ctccgcccctgagccca

SEQ ID NO: 512169 - DNA, 17 bp, Homo sapiens
ctcctaaaaggcccaga

SEQ ID NO: 512170 - DNA, 18 bp, Homo sapiens
ctcctaaaaggcccagag

SEQ ID NO: 512171 - DNA, 19 bp, Homo sapiens
ctcctatacccagcagagg

SEQ ID NO: 512172 - DNA, 14 bp, Homo sapiens
ctcctcacctcatg

SEQ ID NO: 512173 - DNA, 17 bp, Homo sapiens
ctcctcacctcatgccc

SEQ ID NO: 512174 - DNA, 19 bp, Homo sapiens
ctcctccatccatgtgttc

SEQ ID NO: 512175 - DNA, 17 bp, Homo sapiens
ctcctgagcccccagct

SEQ ID NO: 512176 - DNA, 19 bp, Homo sapiens
ctcctgagcccccagcttc

SEQ ID NO: 512177 - DNA, 21 bp, Homo sapiens
ctcctgagcccccagcttcca

SEQ ID NO: 512178 - DNA, 23 bp, Homo sapiens
ctcctgagcccccagcttccagc

SEQ ID NO: 512179 - DNA, 14 bp, Homo sapiens
ctctattctttcca

SEQ ID NO: 512180 - DNA, 15 bp, Homo sapiens
ctctattctttccat

SEQ ID NO: 512181 - DNA, 18 bp, Homo sapiens
ctctattctttccatgac

SEQ ID NO: 512182 - DNA, 19 bp, Homo sapiens
ctctattctttccatgaca

SEQ ID NO: 512183 - DNA, 14 bp, Homo sapiens
ctctcacagacagg

SEQ ID NO: 512184 - DNA, 18 bp, Homo sapiens
ctctcaccttggttcctg

SEQ ID NO: 512185 - DNA, 23 bp, Homo sapiens
ctctcaccttggttcctggggca

SEQ ID NO: 512186 - DNA, 20 bp, Homo sapiens
ctctcaggaaatgctgaccc

SEQ ID NO: 512187 - DNA, 11 bp, Homo sapiens
ctctcctcccc

SEQ ID NO: 512188 - DNA, 13 bp, Homo sapiens
ctctctctctttg

SEQ ID NO: 512189 - DNA, 12 bp, Homo sapiens
ctctctttgtta

SEQ ID NO: 512190 - DNA, 15 bp, Homo sapiens
ctctgaaggaggcca

SEQ ID NO: 512191 - DNA, 19 bp, Homo sapiens
ctctgaaggaggccacctc

SEQ ID NO: 512192 - DNA, 20 bp, Homo sapiens
ctctgaaggaggccacctcc

SEQ ID NO: 512193 - DNA, 11 bp, Homo sapiens
ctctgcctgcc

SEQ ID NO: 512194 - DNA, 12 bp, Homo sapiens
ctctgcctgccc

SEQ ID NO: 512195 - DNA, 15 bp, Homo sapiens
ctctgcctgccccgc

SEQ ID NO: 512196 - DNA, 20 bp, Homo sapiens
ctctgccttaatttttgaaa

SEQ ID NO: 512197 - DNA, 19 bp, Homo sapiens
ctctggaatagttacttta

SEQ ID NO: 512198 - DNA, 15 bp, Homo sapiens
ctctggacggcaggc

SEQ ID NO: 512199 - DNA, 22 bp, Homo sapiens
ctctgtatgccattaaaaaaca

SEQ ID NO: 512200 - DNA, 12 bp, Homo sapiens
ctgaaaaagaga

SEQ ID NO: 512201 - DNA, 17 bp, Homo sapiens
ctgaaaattccaatttg

SEQ ID NO: 512202 - DNA, 15 bp, Homo sapiens
ctgaacatggatatc

SEQ ID NO: 512203 - DNA, 11 bp, Homo sapiens
ctgaaggaaaa

SEQ ID NO: 512204 - DNA, 19 bp, Homo sapiens
ctgaaggaggccacctcct

SEQ ID NO: 512205 - DNA, 15 bp, Homo sapiens
ctgaatttattgcct

SEQ ID NO: 512206 - DNA, 14 bp, Homo sapiens
ctgactacagggcc

SEQ ID NO: 512207 - DNA, 18 bp, Homo sapiens
ctgactattcttgatgta

SEQ ID NO: 512208 - DNA, 21 bp, Homo sapiens
ctgactattcttgatgtaaaa

SEQ ID NO: 512209 - DNA, 17 bp, Homo sapiens
ctgacttttctttttaa

SEQ ID NO: 512210 - DNA, 14 bp, Homo sapiens
ctgactttttctgt

SEQ ID NO: 512211 - DNA, 20 bp, Homo sapiens
ctgactttttctgtgcgcct

SEQ ID NO: 512212 - DNA, 13 bp, Homo sapiens
ctgagaggcaggc

SEQ ID NO: 512213 - DNA, 11 bp, Homo sapiens
ctgagcccact

SEQ ID NO: 512214 - DNA, 18 bp, Homo sapiens
ctgagcccccagcttcca

SEQ ID NO: 512215 - DNA, 23 bp, Homo sapiens
ctgagcccccagcttccagcagg

SEQ ID NO: 512216 - DNA, 11 bp, Homo sapiens
ctgaggcaagc

SEQ ID NO: 512217 - DNA, 18 bp, Homo sapiens
ctgaggggagacagagca

SEQ ID NO: 512218 - DNA, 15 bp, Homo sapiens
ctgaggttcctctgc

SEQ ID NO: 512219 - DNA, 20 bp, Homo sapiens
ctgaggttcctctgcctgcc

SEQ ID NO: 512220 - DNA, 14 bp, Homo sapiens
ctgagtgcaggccc

SEQ ID NO: 512221 - DNA, 16 bp, Homo sapiens
ctgagtgcaggcccac

SEQ ID NO: 512222 - DNA, 21 bp, Homo sapiens
ctgagtgcaggcccaccctgc

SEQ ID NO: 512223 - DNA, 16 bp, Homo sapiens
ctgagttgttacccca

SEQ ID NO: 512224 - DNA, 17 bp, Homo sapiens
ctgagttgttaccccaa

SEQ ID NO: 512225 - DNA, 20 bp, Homo sapiens
ctgataatttattgtcttta

SEQ ID NO: 512226 - DNA, 12 bp, Homo sapiens
ctgcacgtcatg

SEQ ID NO: 512227 - DNA, 13 bp, Homo sapiens
ctgcactgtaaaa

SEQ ID NO: 512228 - DNA, 24 bp, Homo sapiens
ctgcacttgggggctcagcaaggc

SEQ ID NO: 512229 - DNA, 15 bp, Homo sapiens
ctgcagttcccctgg

SEQ ID NO: 512230 - DNA, 17 bp, Homo sapiens
ctgcagttcccctggaa

SEQ ID NO: 512231 - DNA, 14 bp, Homo sapiens
cccctcgcccagtc

SEQ ID NO: 512232 - DNA, 12 bp, Homo sapiens
cccctgagccca

SEQ ID NO: 512233 - DNA, 14 bp, Homo sapiens
cccctgcactgtaa

SEQ ID NO: 512234 - DNA, 17 bp, Homo sapiens
cccctgcactgtaaaat

SEQ ID NO: 512235 - DNA, 12 bp, Homo sapiens
cccctgccccca

SEQ ID NO: 512236 - DNA, 19 bp, Homo sapiens
cccctggaagcagtgccca

SEQ ID NO: 512237 - DNA, 23 bp, Homo sapiens
cccctggaagcagtgcccaggtg

SEQ ID NO: 512238 - DNA, 11 bp, Homo sapiens
cccctggaccc

SEQ ID NO: 512239 - DNA, 20 bp, Homo sapiens
cccctgggcttggcctgctg

SEQ ID NO: 512240 - DNA, 15 bp, Homo sapiens
cccggggaccctgtg

SEQ ID NO: 512241 - DNA, 14 bp, Homo sapiens
ccctcactctcagg

SEQ ID NO: 512242 - DNA, 13 bp, Homo sapiens
ccctcgcccagtc

SEQ ID NO: 512243 - DNA, 18 bp, Homo sapiens
ccctcgcccagtcccagc

SEQ ID NO: 512244 - DNA, 16 bp, Homo sapiens
ccctgagcccactgtg

SEQ ID NO: 512245 - DNA, 13 bp, Homo sapiens
ccctgcacgtcat

SEQ ID NO: 512246 - DNA, 14 bp, Homo sapiens
ccctgcacgtcatg

SEQ ID NO: 512247 - DNA, 20 bp, Homo sapiens
ccctgcactgtaaaatgtgg

SEQ ID NO: 512248 - DNA, 22 bp, Homo sapiens
ccctgcagttcccctggaagca

SEQ ID NO: 512249 - DNA, 23 bp, Homo sapiens
ccctgccaggcacaggcagggca

SEQ ID NO: 512250 - DNA, 13 bp, Homo sapiens
ccctgccctgcac

SEQ ID NO: 512251 - DNA, 14 bp, Homo sapiens
ccctgcctctccgc

SEQ ID NO: 512252 - DNA, 16 bp, Homo sapiens
ccctgcctctccgccc

SEQ ID NO: 512253 - DNA, 21 bp, Homo sapiens
ccctgcctctccgcccctgag

SEQ ID NO: 512254 - DNA, 14 bp, Homo sapiens
ccctgcttggccca

SEQ ID NO: 512255 - DNA, 16 bp, Homo sapiens
ccctggaagcagtgcc

SEQ ID NO: 512256 - DNA, 15 bp, Homo sapiens
ccctggaccccagcc

SEQ ID NO: 512257 - DNA, 16 bp, Homo sapiens
ccctggaccccagcct

SEQ ID NO: 512258 - DNA, 19 bp, Homo sapiens
ccctggaccccagcctcaa

SEQ ID NO: 512259 - DNA, 18 bp, Homo sapiens
ccctgggcttggcctgct

SEQ ID NO: 512260 - DNA, 18 bp, Homo sapiens
ccctgggttagactgcca

SEQ ID NO: 512261 - DNA, 20 bp, Homo sapiens
ccctgggttagactgccagc

SEQ ID NO: 512262 - DNA, 20 bp, Homo sapiens
ccctgtgacatggtgcctga

SEQ ID NO: 512263 - DNA, 24 bp, Homo sapiens
ccctgtgacatggtgcctgagagg

SEQ ID NO: 512264 - DNA, 18 bp, Homo sapiens
cccttccttttccctgct

SEQ ID NO: 512265 - DNA, 19 bp, Homo sapiens
cccttccttttccctgctt

SEQ ID NO: 512266 - DNA, 16 bp, Homo sapiens
cccttctcccctgcac

SEQ ID NO: 512267 - DNA, 20 bp, Homo sapiens
cccttgccagctgctgagcc

SEQ ID NO: 512268 - DNA, 12 bp, Homo sapiens
cccttgcctccc

SEQ ID NO: 512269 - DNA, 15 bp, Homo sapiens
cccttgcctccccat

SEQ ID NO: 512270 - DNA, 19 bp, Homo sapiens
cccttgcctccccatttcc

SEQ ID NO: 512271 - DNA, 20 bp, Homo sapiens
cccttgcctccccatttccc

SEQ ID NO: 512272 - DNA, 19 bp, Homo sapiens
cccttttaaagaatttttg

SEQ ID NO: 512273 - DNA, 11 bp, Homo sapiens
cccttttctgt

SEQ ID NO: 512274 - DNA, 21 bp, Homo sapiens
ccgacgtctatcctttcctgc

SEQ ID NO: 512275 - DNA, 13 bp, Homo sapiens
ccgagagggagag

SEQ ID NO: 512276 - DNA, 15 bp, Homo sapiens
ccgccagcctcctct

SEQ ID NO: 512277 - DNA, 13 bp, Homo sapiens
ccgcccccagtcc

SEQ ID NO: 512278 - DNA, 19 bp, Homo sapiens
ccgcccccagtccccaccc

SEQ ID NO: 512279 - DNA, 19 bp, Homo sapiens
ccggcaataaaagcccagg

SEQ ID NO: 512280 - DNA, 23 bp, Homo sapiens
ccggcaataaaagcccaggagcc

SEQ ID NO: 512281 - DNA, 23 bp, Homo sapiens
ccgggcccctgggcttggcctgc

SEQ ID NO: 512282 - DNA, 22 bp, Homo sapiens
ccgtggaggaggaaggcaagag

SEQ ID NO: 512283 - DNA, 14 bp, Homo sapiens
cctaaaaggcccag

SEQ ID NO: 512284 - DNA, 14 bp, Homo sapiens
cctaatttctcctc

SEQ ID NO: 512285 - DNA, 18 bp, Homo sapiens
cctaatttctcctccctt

SEQ ID NO: 512286 - DNA, 20 bp, Homo sapiens
cctaatttctcctcccttcc

SEQ ID NO: 512287 - DNA, 23 bp, Homo sapiens
cctaatttctcctcccttccttt

SEQ ID NO: 512288 - DNA, 15 bp, Homo sapiens
cctacacaggacagg

SEQ ID NO: 512289 - DNA, 20 bp, Homo sapiens
cctagaaaagtttgttttac

SEQ ID NO: 512290 - DNA, 16 bp, Homo sapiens
cctagctggagaggag

SEQ ID NO: 512291 - DNA, 20 bp, Homo sapiens
cctagctttagaccctgggt

SEQ ID NO: 512292 - DNA, 23 bp, Homo sapiens
cctagctttagaccctgggtggg

SEQ ID NO: 512293 - DNA, 14 bp, Homo sapiens
cctcaaatccagga

SEQ ID NO: 512294 - DNA, 17 bp, Homo sapiens
cctcaaatccaggaccc

SEQ ID NO: 512295 - DNA, 23 bp, Homo sapiens
cctcaaatccaggaccctgccag

SEQ ID NO: 512296 - DNA, 22 bp, Homo sapiens
cctcaacattggagacatcact

SEQ ID NO: 512297 - DNA, 14 bp, Homo sapiens
cctcacctcatgcc

SEQ ID NO: 512298 - DNA, 18 bp, Homo sapiens
cctcagaccaggtggaat

SEQ ID NO: 512299 - DNA, 21 bp, Homo sapiens
cctcagaccaggtggaattac

SEQ ID NO: 512300 - DNA, 19 bp, Homo sapiens
cctcatgaatgtaaatttg

SEQ ID NO: 512301 - DNA, 15 bp, Homo sapiens
cctcatgcccacccc

SEQ ID NO: 512302 - DNA, 23 bp, Homo sapiens
cctcatgcccaccccctgccctg

SEQ ID NO: 512303 - DNA, 20 bp, Homo sapiens
cctccaacccctcgcccagt

SEQ ID NO: 512304 - DNA, 14 bp, Homo sapiens
cctccccatttccc

SEQ ID NO: 512305 - DNA, 14 bp, Homo sapiens
cctccccttgccag

SEQ ID NO: 512306 - DNA, 13 bp, Homo sapiens
cctcccttccttt

SEQ ID NO: 512307 - DNA, 16 bp, Homo sapiens
cctcccttccttttcc

SEQ ID NO: 512308 - DNA, 16 bp, Homo sapiens
cctccgagagggagag

SEQ ID NO: 512309 - DNA, 16 bp, Homo sapiens
cctcctcacctcatgc

SEQ ID NO: 512310 - DNA, 12 bp, Homo sapiens
cctcgcccagtc

SEQ ID NO: 512311 - DNA, 15 bp, Homo sapiens
cctcgcccagtccca

SEQ ID NO: 512312 - DNA, 23 bp, Homo sapiens
cctcgcccagtcccagcagccag

SEQ ID NO: 512313 - DNA, 18 bp, Homo sapiens
cctctagaagccaaggga

SEQ ID NO: 512314 - DNA, 18 bp, Homo sapiens
cctctccgcccctgagcc

SEQ ID NO: 512315 - DNA, 20 bp, Homo sapiens
cctctccgcccctgagccca

SEQ ID NO: 512316 - DNA, 18 bp, Homo sapiens
cctctctgaaggaggcca

SEQ ID NO: 512317 - DNA, 11 bp, Homo sapiens
cctctgcctgc

SEQ ID NO: 512318 - DNA, 16 bp, Homo sapiens
cctctgcctgccccgc

SEQ ID NO: 512319 - DNA, 15 bp, Homo sapiens
cctctggacggcagg

SEQ ID NO: 512320 - DNA, 16 bp, Homo sapiens
cctctggacggcaggc

SEQ ID NO: 512321 - DNA, 23 bp, Homo sapiens
cctctggacggcaggctcactgc

SEQ ID NO: 512322 - DNA, 11 bp, Homo sapiens
cctctgggttg

SEQ ID NO: 512323 - DNA, 14 bp, Homo sapiens
cctgagaggcaggc

SEQ ID NO: 512324 - DNA, 15 bp, Homo sapiens
cctgagaggcaggca

SEQ ID NO: 512325 - DNA, 15 bp, Homo sapiens
cctgagcccactgtg

SEQ ID NO: 512326 - DNA, 13 bp, Homo sapiens
cctgagcccccag

SEQ ID NO: 512327 - DNA, 15 bp, Homo sapiens
cctgagcccccagct

SEQ ID NO: 512328 - DNA, 18 bp, Homo sapiens
cctgaggggagacagagc

SEQ ID NO: 512329 - DNA, 22 bp, Homo sapiens
cctgaggggagacagagcaacc

SEQ ID NO: 512330 - DNA, 18 bp, Homo sapiens
cctgattttttgaggcca

SEQ ID NO: 512331 - DNA, 19 bp, Homo sapiens
cctgcacgtcatgggaggg

SEQ ID NO: 512332 - DNA, 11 bp, Homo sapiens
cctgcactgta

SEQ ID NO: 512333 - DNA, 12 bp, Homo sapiens
cctgcactgtaa

SEQ ID NO: 512334 - DNA, 16 bp, Homo sapiens
cctgcacttgggggct

SEQ ID NO: 512335 - DNA, 20 bp, Homo sapiens
cctgcacttgggggctcagc

SEQ ID NO: 512336 - DNA, 18 bp, Homo sapiens
cctgccaggcacaggcag

SEQ ID NO: 512337 - DNA, 20 bp, Homo sapiens
cctgccaggcacaggcaggg

SEQ ID NO: 512338 - DNA, 15 bp, Homo sapiens
cctgcccccagcccc

SEQ ID NO: 512339 - DNA, 17 bp, Homo sapiens
cctgcccccagccccgg

SEQ ID NO: 512340 - DNA, 11 bp, Homo sapiens
cctgccctgca

SEQ ID NO: 512341 - DNA, 9 bp, Homo sapiens
cctgctggc

SEQ ID NO: 512342 - DNA, 15 bp, Homo sapiens
cctgctggcacccac

SEQ ID NO: 512343 - DNA, 23 bp, Homo sapiens
cctgctgtgattccactacacct

SEQ ID NO: 512344 - DNA, 15 bp, Homo sapiens
cctggaagcagtgcc

SEQ ID NO: 512345 - DNA, 20 bp, Homo sapiens
tgtctggcacagcctgcact

SEQ ID NO: 512346 - DNA, 13 bp, Homo sapiens
tgtcttctttgct

SEQ ID NO: 512347 - DNA, 20 bp, Homo sapiens
tgtctttttgtatctaaagt

SEQ ID NO: 512348 - DNA, 14 bp, Homo sapiens
tgtgaaatttacat

SEQ ID NO: 512349 - DNA, 22 bp, Homo sapiens
tgtgattccactacacctggct

SEQ ID NO: 512350 - DNA, 17 bp, Homo sapiens
tgtgcagtcactggagg

SEQ ID NO: 512351 - DNA, 15 bp, Homo sapiens
tgtggagactgctcc

SEQ ID NO: 512352 - DNA, 23 bp, Homo sapiens
tgtggagactgctcctgagcccc

SEQ ID NO: 512353 - DNA, 17 bp, Homo sapiens
tgtggagagggaatgtg

SEQ ID NO: 512354 - DNA, 19 bp, Homo sapiens
tgtggagagggaatgtgaa

SEQ ID NO: 512355 - DNA, 11 bp, Homo sapiens
tgtggcagtgg

SEQ ID NO: 512356 - DNA, 21 bp, Homo sapiens
tgtgggggccccgtctcaggt

SEQ ID NO: 512357 - DNA, 17 bp, Homo sapiens
tgtgtaattttaaagtc

SEQ ID NO: 512358 - DNA, 21 bp, Homo sapiens
tgtgtataaaaataaaaaaga

SEQ ID NO: 512359 - DNA, 21 bp, Homo sapiens
tgtgtatttttgttgcagtgt

SEQ ID NO: 512360 - DNA, 22 bp, Homo sapiens
tgtgtctccaagcctctgtctt

SEQ ID NO: 512361 - DNA, 21 bp, Homo sapiens
tgtgtggagagggaatgtgaa

SEQ ID NO: 512362 - DNA, 22 bp, Homo sapiens
tgtgtggagagggaatgtgaaa

SEQ ID NO: 512363 - DNA, 22 bp, Homo sapiens
tgtgttccaaatttgctttaca

SEQ ID NO: 512364 - DNA, 17 bp, Homo sapiens
tgttaatgcattctttc

SEQ ID NO: 512365 - DNA, 16 bp, Homo sapiens
tgttattttcaatgaa

SEQ ID NO: 512366 - DNA, 16 bp, Homo sapiens
tgttcatttgaaacct

SEQ ID NO: 512367 - DNA, 14 bp, Homo sapiens
tgttctagaatcat

SEQ ID NO: 512368 - DNA, 17 bp, Homo sapiens
tgttgtcatttccaaat

SEQ ID NO: 512369 - DNA, 12 bp, Homo sapiens
tgtttcctgtgt

SEQ ID NO: 512370 - DNA, 13 bp, Homo sapiens
tgttttgcaaagg

SEQ ID NO: 512371 - DNA, 19 bp, Homo sapiens
tgttttgtgtttttccaaa

SEQ ID NO: 512372 - DNA, 13 bp, Homo sapiens
tgtttttccaaaa

SEQ ID NO: 512373 - DNA, 18 bp, Homo sapiens
tgttttttcaagaaaatt

SEQ ID NO: 512374 - DNA, 22 bp, Homo sapiens
ttaaaaattttgtcctttcatg

SEQ ID NO: 512375 - DNA, 15 bp, Homo sapiens
ttaaaagaaaacaaa

SEQ ID NO: 512376 - DNA, 20 bp, Homo sapiens
ttaaacaattcttgtaactt

SEQ ID NO: 512377 - DNA, 15 bp, Homo sapiens
ttaaagccaaatgta

SEQ ID NO: 512378 - DNA, 20 bp, Homo sapiens
ttaaagcctgaaaattccaa

SEQ ID NO: 512379 - DNA, 22 bp, Homo sapiens
ttaaattttaaagcctgaaaat

SEQ ID NO: 512380 - DNA, 23 bp, Homo sapiens
ttaacttaatggcacaaagtctt

SEQ ID NO: 512381 - DNA, 16 bp, Homo sapiens
ttaagaggaagaagaa

SEQ ID NO: 512382 - DNA, 17 bp, Homo sapiens
ttaaggtgggaaaaaaa

SEQ ID NO: 512383 - DNA, 12 bp, Homo sapiens
ttaatttaaagt

SEQ ID NO: 512384 - DNA, 13 bp, Homo sapiens
ttactaaggaagg

SEQ ID NO: 512385 - DNA, 18 bp, Homo sapiens
ttactaaggaaggacaca

SEQ ID NO: 512386 - DNA, 20 bp, Homo sapiens
ttactttgtttttattctgt

SEQ ID NO: 512387 - DNA, 16 bp, Homo sapiens
ttagacaagagatggg

SEQ ID NO: 512388 - DNA, 21 bp, Homo sapiens
ttatagaggctagcttctgct

SEQ ID NO: 512389 - DNA, 15 bp, Homo sapiens
ttatgatgttttgca

SEQ ID NO: 512390 - DNA, 16 bp, Homo sapiens
ttatgatgttttgcaa

SEQ ID NO: 512391 - DNA, 21 bp, Homo sapiens
ttatgatgttttgcaaaggaa

SEQ ID NO: 512392 - DNA, 20 bp, Homo sapiens
ttgctagaaacataattttt

SEQ ID NO: 512393 - DNA, 16 bp, Homo sapiens
ttgctagaattgattt

SEQ ID NO: 512394 - DNA, 14 bp, Homo sapiens
ttggagggcctggg

SEQ ID NO: 512395 - DNA, 15 bp, Homo sapiens
ttggagggcctgggc

SEQ ID NO: 512396 - DNA, 18 bp, Homo sapiens
ttggatcctgtgtggaga

SEQ ID NO: 512397 - DNA, 19 bp, Homo sapiens
ttgggaaggtgtttaaaga

SEQ ID NO: 512398 - DNA, 20 bp, Homo sapiens
ttgggacccagtggcagggc

SEQ ID NO: 512399 - DNA, 22 bp, Homo sapiens
ttgggacccagtggcagggcac

SEQ ID NO: 512400 - DNA, 23 bp, Homo sapiens
ttgggagagacttgttttggatg

SEQ ID NO: 512401 - DNA, 15 bp, Homo sapiens
ttggggattgagttg

SEQ ID NO: 512402 - DNA, 13 bp, Homo sapiens
ttgggtatttgat

SEQ ID NO: 512403 - DNA, 12 bp, Homo sapiens
ttggtgctttgt

SEQ ID NO: 512404 - DNA, 14 bp, Homo sapiens
ttggtgctttgtgt

SEQ ID NO: 512405 - DNA, 16 bp, Homo sapiens
ttgtactatttaactg

SEQ ID NO: 512406 - DNA, 18 bp, Homo sapiens
ttgtgtctagggcagagt

SEQ ID NO: 512407 - DNA, 24 bp, Homo sapiens
ttgtgtctagggcagagtatgttc

SEQ ID NO: 512408 - DNA, 11 bp, Homo sapiens
ttgttctagaa

SEQ ID NO: 512409 - DNA, 16 bp, Homo sapiens
ttgttttagatccaaa

SEQ ID NO: 512410 - DNA, 14 bp, Homo sapiens
ttgttttggatgcc

SEQ ID NO: 512411 - DNA, 12 bp, Homo sapiens
ttgttttgtgtt

SEQ ID NO: 512412 - DNA, 22 bp, Homo sapiens
tttaaagcctgaaaattccaat

SEQ ID NO: 512413 - DNA, 13 bp, Homo sapiens
tttaacattcctc

SEQ ID NO: 512414 - DNA, 23 bp, Homo sapiens
tttaacattcctcatgaatgtaa

SEQ ID NO: 512415 - DNA, 23 bp, Homo sapiens
tttaactgactattcttgatgta

SEQ ID NO: 512416 - DNA, 15 bp, Homo sapiens
tttaacttaatggca

SEQ ID NO: 512417 - DNA, 17 bp, Homo sapiens
tttaattggagtctcaa

SEQ ID NO: 512418 - DNA, 12 bp, Homo sapiens
tttactttgttt

SEQ ID NO: 512419 - DNA, 23 bp, Homo sapiens
tttagttgaattttttttaacat

SEQ ID NO: 512420 - DNA, 16 bp, Homo sapiens
tttatactgaaggaaa

SEQ ID NO: 512421 - DNA, 14 bp, Homo sapiens
tttatcagatattt

SEQ ID NO: 512422 - DNA, 21 bp, Homo sapiens
tttatcagatattttcatatt

SEQ ID NO: 512423 - DNA, 15 bp, Homo sapiens
tttatcccaggaaat

SEQ ID NO: 512424 - DNA, 13 bp, Homo sapiens
tttcaaagaaaga

SEQ ID NO: 512425 - DNA, 20 bp, Homo sapiens
tttcagtgcagtaatttctg

SEQ ID NO: 512426 - DNA, 11 bp, Homo sapiens
tttcatgtaac

SEQ ID NO: 512427 - DNA, 19 bp, Homo sapiens
tttcatgtaacttttttat

SEQ ID NO: 512428 - DNA, 12 bp, Homo sapiens
tttcccatctgc

SEQ ID NO: 512429 - DNA, 13 bp, Homo sapiens
tttcctgtgtctc

SEQ ID NO: 512430 - DNA, 14 bp, Homo sapiens
tttccttttgcaca

SEQ ID NO: 512431 - DNA, 11 bp, Homo sapiens
tttctaagaga

SEQ ID NO: 512432 - DNA, 16 bp, Homo sapiens
tttctaagagaagtta

SEQ ID NO: 512433 - DNA, 19 bp, Homo sapiens
tttctacagtggttttata

SEQ ID NO: 512434 - DNA, 16 bp, Homo sapiens
tttctcctcccttcct

SEQ ID NO: 512435 - DNA, 12 bp, Homo sapiens
tttctgccctgg

SEQ ID NO: 512436 - DNA, 18 bp, Homo sapiens
tttcttcaaaaagcattt

SEQ ID NO: 512437 - DNA, 22 bp, Homo sapiens
tttgaaaagctgctaactacat

SEQ ID NO: 512438 - DNA, 16 bp, Homo sapiens
tttgaaacctttttct

SEQ ID NO: 512439 - DNA, 17 bp, Homo sapiens
tttgagctgccttccct

SEQ ID NO: 512440 - DNA, 16 bp, Homo sapiens
tttgattattgagaaa

SEQ ID NO: 512441 - DNA, 16 bp, Homo sapiens
tttgcacattccaaaa

SEQ ID NO: 512442 - DNA, 23 bp, Homo sapiens
tttgggagagacttgttttggat

SEQ ID NO: 512443 - DNA, 11 bp, Homo sapiens
tacttcctttc

SEQ ID NO: 512444 - DNA, 14 bp, Homo sapiens
tagaaaagtttgtt

SEQ ID NO: 512445 - DNA, 15 bp, Homo sapiens
tagaagccaagggaa

SEQ ID NO: 512446 - DNA, 17 bp, Homo sapiens
tagaatctcttttctgg

SEQ ID NO: 512447 - DNA, 12 bp, Homo sapiens
tagaccctgggt

SEQ ID NO: 512448 - DNA, 11 bp, Homo sapiens
tagactgccag

SEQ ID NO: 512449 - DNA, 14 bp, Homo sapiens
tagactgccagctc

SEQ ID NO: 512450 - DNA, 16 bp, Homo sapiens
tagactgccagctctt

SEQ ID NO: 512451 - DNA, 20 bp, Homo sapiens
tagaggcttctccgccagcc

SEQ ID NO: 512452 - DNA, 16 bp, Homo sapiens
tagaggtctgtaaaga

SEQ ID NO: 512453 - DNA, 18 bp, Homo sapiens
tagaggtctgtaaagaaa

SEQ ID NO: 512454 - DNA, 21 bp, Homo sapiens
tgaaggaaaaacacaagcaaa

SEQ ID NO: 512455 - DNA, 14 bp, Homo sapiens
tgaaggaggccacc

SEQ ID NO: 512456 - DNA, 16 bp, Homo sapiens
tgaaggaggccacctc

SEQ ID NO: 512457 - DNA, 20 bp, Homo sapiens
tgaaggaggccacctcctaa

SEQ ID NO: 512458 - DNA, 16 bp, Homo sapiens
tgaatcagacatttta

SEQ ID NO: 512459 - DNA, 16 bp, Homo sapiens
tgaatgtaaatttgta

SEQ ID NO: 512460 - DNA, 18 bp, Homo sapiens
tgaatgtaaatttgtact

SEQ ID NO: 512461 - DNA, 19 bp, Homo sapiens
tgaatgtaaatttgtacta

SEQ ID NO: 512462 - DNA, 21 bp, Homo sapiens
tgaatgtaaatttgtactatt

SEQ ID NO: 512463 - DNA, 22 bp, Homo sapiens
tgaatgtaaatttgtactattt

SEQ ID NO: 512464 - DNA, 18 bp, Homo sapiens
tgaattctgggattactg

SEQ ID NO: 512465 - DNA, 15 bp, Homo sapiens
tgacatggtgcctga

SEQ ID NO: 512466 - DNA, 18 bp, Homo sapiens
tgacatggtgcctgagag

SEQ ID NO: 512467 - DNA, 19 bp, Homo sapiens
tgactattcttgatgtaaa

SEQ ID NO: 512468 - DNA, 22 bp, Homo sapiens
tgactattcttgatgtaaaatc

SEQ ID NO: 512469 - DNA, 15 bp, Homo sapiens
tgactttttctgtgc

SEQ ID NO: 512470 - DNA, 16 bp, Homo sapiens
tgagaaatttgaaagg

SEQ ID NO: 512471 - DNA, 12 bp, Homo sapiens
tgagaggcaggc

SEQ ID NO: 512472 - DNA, 17 bp, Homo sapiens
tgagaggggaggccaag

SEQ ID NO: 512473 - DNA, 16 bp, Homo sapiens
tgagcccccagcttcc

SEQ ID NO: 512474 - DNA, 20 bp, Homo sapiens
tgagccgggcccctgggctt

SEQ ID NO: 512475 - DNA, 17 bp, Homo sapiens
tgagcgctgtgagatgg

SEQ ID NO: 512476 - DNA, 22 bp, Homo sapiens
tgagctaagcattttctcctgt

SEQ ID NO: 512477 - DNA, 12 bp, Homo sapiens
tgagctgccttc

SEQ ID NO: 512478 - DNA, 17 bp, Homo sapiens
tgagctgccttccctag

SEQ ID NO: 512479 - DNA, 15 bp, Homo sapiens
tgaggccagtaattc

SEQ ID NO: 512480 - DNA, 13 bp, Homo sapiens
tgaggtgggaggt

SEQ ID NO: 512481 - DNA, 14 bp, Homo sapiens
tgaggttcctctgc

SEQ ID NO: 512482 - DNA, 16 bp, Homo sapiens
tgaggttcctctgcct

SEQ ID NO: 512483 - DNA, 20 bp, Homo sapiens
tgagtccattctcccaggta

SEQ ID NO: 512484 - DNA, 15 bp, Homo sapiens
tgagtgcaggcccac

SEQ ID NO: 512485 - DNA, 20 bp, Homo sapiens
tgataatttattgtctttat

SEQ ID NO: 512486 - DNA, 18 bp, Homo sapiens
tgatgcgcttcaaagtgg

SEQ ID NO: 512487 - DNA, 15 bp, Homo sapiens
tgatgtaaaatcttg

SEQ ID NO: 512488 - DNA, 19 bp, Homo sapiens
tgattccactacacctggc

SEQ ID NO: 512489 - DNA, 21 bp, Homo sapiens
tgattccactacacctggctg

SEQ ID NO: 512490 - DNA, 23 bp, Homo sapiens
tgattccactacacctggctgag

SEQ ID NO: 512491 - DNA, 23 bp, Homo sapiens
tgatttatccagaatgcttctct

SEQ ID NO: 512492 - DNA, 19 bp, Homo sapiens
tgcaaaggaaaataatcaa

SEQ ID NO: 512493 - DNA, 22 bp, Homo sapiens
tgcacacttatttttttcccaa

SEQ ID NO: 512494 - DNA, 23 bp, Homo sapiens
tgcacaggtttgttttttcaaga

SEQ ID NO: 512495 - DNA, 14 bp, Homo sapiens
tgcacattccaaaa

SEQ ID NO: 512496 - DNA, 19 bp, Homo sapiens
tgcaccccttctctcctcc

SEQ ID NO: 512497 - DNA, 17 bp, Homo sapiens
tgcactgtaaaatgtgg

SEQ ID NO: 512498 - DNA, 19 bp, Homo sapiens
tgcacttgggggctcagca

SEQ ID NO: 512499 - DNA, 18 bp, Homo sapiens
tgcagaagctatgttttt

SEQ ID NO: 512500 - DNA, 15 bp, Homo sapiens
tgcaggcccaccctg

SEQ ID NO: 512501 - DNA, 17 bp, Homo sapiens
tgcaggcccaccctgct

SEQ ID NO: 512502 - DNA, 14 bp, Homo sapiens
tgcagtaatttctg

SEQ ID NO: 512503 - DNA, 20 bp, Homo sapiens
tgcagtaatttctgagagct

SEQ ID NO: 512504 - DNA, 15 bp, Homo sapiens
tgcatatttttgcac

SEQ ID NO: 512505 - DNA, 15 bp, Homo sapiens
tgcattttcttcact

SEQ ID NO: 512506 - DNA, 21 bp, Homo sapiens
tgccacctccccttgccagct

SEQ ID NO: 512507 - DNA, 22 bp, Homo sapiens
tgccacctccccttgccagctg

SEQ ID NO: 512508 - DNA, 19 bp, Homo sapiens
tgccagctgctgagccgca

SEQ ID NO: 512509 - DNA, 15 bp, Homo sapiens
tgccaggcacaggca

SEQ ID NO: 512510 - DNA, 18 bp, Homo sapiens
tgccaggcacaggcaggg

SEQ ID NO: 512511 - DNA, 21 bp, Homo sapiens
tgccaggcacaggcagggcag

SEQ ID NO: 512512 - DNA, 17 bp, Homo sapiens
tgccaggcaggggtggg

SEQ ID NO: 512513 - DNA, 18 bp, Homo sapiens
tgccaggcaggggtgggg

SEQ ID NO: 512514 - DNA, 14 bp, Homo sapiens
tgccaggccagcct

SEQ ID NO: 512515 - DNA, 17 bp, Homo sapiens
tgccaggccagcctccg

SEQ ID NO: 512516 - DNA, 18 bp, Homo sapiens
tgccattaaaaaacagct

SEQ ID NO: 512517 - DNA, 20 bp, Homo sapiens
tgcccaccccctgccctgca

SEQ ID NO: 512518 - DNA, 23 bp, Homo sapiens
tgcccccaccccggggaccctgt

SEQ ID NO: 512519 - DNA, 14 bp, Homo sapiens
tgcccccagccccg

SEQ ID NO: 512520 - DNA, 16 bp, Homo sapiens
tgcccccagccccggg

SEQ ID NO: 512521 - DNA, 21 bp, Homo sapiens
tgccccctaatccccttctcc

SEQ ID NO: 512522 - DNA, 16 bp, Homo sapiens
tgccctggctgctgcc

SEQ ID NO: 512523 - DNA, 20 bp, Homo sapiens
tgccctggctgctgccccca

SEQ ID NO: 512524 - DNA, 19 bp, Homo sapiens
tgcctacaatgggaaaact

SEQ ID NO: 512525 - DNA, 20 bp, Homo sapiens
tgcctccccatttcccatct

SEQ ID NO: 512526 - DNA, 12 bp, Homo sapiens
tgcctgccccgc

SEQ ID NO: 512527 - DNA, 16 bp, Homo sapiens
tgccttaaaaccaaag

SEQ ID NO: 512528 - DNA, 16 bp, Homo sapiens
tgccttaatttttgaa

SEQ ID NO: 512529 - DNA, 16 bp, Homo sapiens
tgccttccctagcttt

SEQ ID NO: 512530 - DNA, 17 bp, Homo sapiens
tgccttccctagcttta

SEQ ID NO: 512531 - DNA, 12 bp, Homo sapiens
tgcgcttcaaag

SEQ ID NO: 512532 - DNA, 13 bp, Homo sapiens
tgcgcttcaaagt

SEQ ID NO: 512533 - DNA, 19 bp, Homo sapiens
tgcgtcctcctcacctcat

SEQ ID NO: 512534 - DNA, 20 bp, Homo sapiens
tgctagaaacataatttttt

SEQ ID NO: 512535 - DNA, 18 bp, Homo sapiens
tgctagaattgatttttt

SEQ ID NO: 512536 - DNA, 18 bp, Homo sapiens
tgctatgttcttctgtta

SEQ ID NO: 512537 - DNA, 16 bp, Homo sapiens
tgctattatgatgttt

SEQ ID NO: 512538 - DNA, 12 bp, Homo sapiens
tgctcctgagcc

SEQ ID NO: 512539 - DNA, 13 bp, Homo sapiens
tgctcctgagccc

SEQ ID NO: 512540 - DNA, 16 bp, Homo sapiens
tgctcctgagccccca

SEQ ID NO: 512541 - DNA, 21 bp, Homo sapiens
tgctcctgagcccccagcttc

SEQ ID NO: 512542 - DNA, 23 bp, Homo sapiens
tgctcttctgatcagtctgtctg

SEQ ID NO: 512543 - DNA, 21 bp, Homo sapiens
tgctgacccatgggcaggaga

SEQ ID NO: 512544 - DNA, 23 bp, Homo sapiens
tgctgacccatgggcaggagact

SEQ ID NO: 512545 - DNA, 20 bp, Homo sapiens
tgctgcccccaccccgggga

SEQ ID NO: 512546 - DNA, 22 bp, Homo sapiens
tgctgcccccaccccggggacc

SEQ ID NO: 512547 - DNA, 17 bp, Homo sapiens
tgctgggaggagggaga

SEQ ID NO: 512548 - DNA, 18 bp, Homo sapiens
tgctgggaggagggagag

SEQ ID NO: 512549 - DNA, 20 bp, Homo sapiens
tgctgggaggagggagaggg

SEQ ID NO: 512550 - DNA, 15 bp, Homo sapiens
tgctgtctggcacag

SEQ ID NO: 512551 - DNA, 16 bp, Homo sapiens
tgcttccaggaaactc

SEQ ID NO: 512552 - DNA, 15 bp, Homo sapiens
tgcttggcccagggg

SEQ ID NO: 512553 - DNA, 19 bp, Homo sapiens
tgctttgtgtctagggcag

SEQ ID NO: 512554 - DNA, 20 bp, Homo sapiens
tggaaaaggaacccaatttt

SEQ ID NO: 512555 - DNA, 14 bp, Homo sapiens
tggaaaggggagag

SEQ ID NO: 512556 - DNA, 22 bp, Homo sapiens
tggaaaggggagagcctgctgg

SEQ ID NO: 512557 - DNA, 13 bp, Homo sapiens
tggaagaagggag

SEQ ID NO: 512558 - DNA, 21 bp, Homo sapiens
tggaagaagggagaagaaagg

SEQ ID NO: 512559 - DNA, 14 bp, Homo sapiens
tggaagcagtgccc

SEQ ID NO: 512560 - DNA, 15 bp, Homo sapiens
tggaatagttacttt

SEQ ID NO: 512561 - DNA, 14 bp, Homo sapiens
tggaattacttaaa

SEQ ID NO: 512562 - DNA, 14 bp, Homo sapiens
tggaccccagcctc

SEQ ID NO: 512563 - DNA, 13 bp, Homo sapiens
tggacggcaggct

SEQ ID NO: 512564 - DNA, 23 bp, Homo sapiens
tggacggcaggctcactgccagg

SEQ ID NO: 512565 - DNA, 22 bp, Homo sapiens
gcttcctctagaagccaaggga

SEQ ID NO: 512566 - DNA, 15 bp, Homo sapiens
gcttcctgaggggag

SEQ ID NO: 512567 - DNA, 20 bp, Homo sapiens
gcttcctgcgtcctcctcac

SEQ ID NO: 512568 - DNA, 17 bp, Homo sapiens
gcttctccgccagcctc

SEQ ID NO: 512569 - DNA, 19 bp, Homo sapiens
gcttctccgccagcctcct

SEQ ID NO: 512570 - DNA, 20 bp, Homo sapiens
gcttctccgccagcctcctc

SEQ ID NO: 512571 - DNA, 23 bp, Homo sapiens
gcttctccgccagcctcctctgg

SEQ ID NO: 512572 - DNA, 24 bp, Homo sapiens
gcttctccgccagcctcctctgga

SEQ ID NO: 512573 - DNA, 14 bp, Homo sapiens
gcttctgcttttct

SEQ ID NO: 512574 - DNA, 19 bp, Homo sapiens
gcttctgcttttctgccct

SEQ ID NO: 512575 - DNA, 20 bp, Homo sapiens
gcttctgcttttctgccctg

SEQ ID NO: 512576 - DNA, 21 bp, Homo sapiens
gcttctgcttttctgccctgg

SEQ ID NO: 512577 - DNA, 11 bp, Homo sapiens
gcttgaagcca

SEQ ID NO: 512578 - DNA, 13 bp, Homo sapiens
gcttggcctgctg

SEQ ID NO: 512579 - DNA, 15 bp, Homo sapiens
gcttggcctgctgtg

SEQ ID NO: 512580 - DNA, 19 bp, Homo sapiens
gctttaaatggcaattttt

SEQ ID NO: 512581 - DNA, 20 bp, Homo sapiens
gctttacatatgattgtatt

SEQ ID NO: 512582 - DNA, 14 bp, Homo sapiens
gctttagaccctgg

SEQ ID NO: 512583 - DNA, 15 bp, Homo sapiens
gcttttaaaaatttt

SEQ ID NO: 512584 - DNA, 22 bp, Homo sapiens
gcttttatagaggctagcttct

SEQ ID NO: 512585 - DNA, 16 bp, Homo sapiens
gcttttccttttgcac

SEQ ID NO: 512586 - DNA, 15 bp, Homo sapiens
gcttttctgccctgg

SEQ ID NO: 512587 - DNA, 19 bp, Homo sapiens
gcttttctgccctggctgc

SEQ ID NO: 512588 - DNA, 11 bp, Homo sapiens
ggaaaacttca

SEQ ID NO: 512589 - DNA, 19 bp, Homo sapiens
ggaaaacttcactccaaag

SEQ ID NO: 512590 - DNA, 14 bp, Homo sapiens
ggaaacttgccttt

SEQ ID NO: 512591 - DNA, 13 bp, Homo sapiens
ggaaaggggagag

SEQ ID NO: 512592 - DNA, 13 bp, Homo sapiens
ggaaatctttcaa

SEQ ID NO: 512593 - DNA, 15 bp, Homo sapiens
ggaaatctttcaact

SEQ ID NO: 512594 - DNA, 23 bp, Homo sapiens
ggaaatctttcaacttatttctg

SEQ ID NO: 512595 - DNA, 14 bp, Homo sapiens
ggaagaagggagaa

SEQ ID NO: 512596 - DNA, 15 bp, Homo sapiens
ggaagaagggagaag

SEQ ID NO: 512597 - DNA, 14 bp, Homo sapiens
ggaagcagtgccca

SEQ ID NO: 512598 - DNA, 18 bp, Homo sapiens
ggaagcagtgcccaggtg

SEQ ID NO: 512599 - DNA, 18 bp, Homo sapiens
ggaagggcactatatttt

SEQ ID NO: 512600 - DNA, 17 bp, Homo sapiens
ggaaggtgtttaaagag

SEQ ID NO: 512601 - DNA, 14 bp, Homo sapiens
ggaagtagcacagg

SEQ ID NO: 512602 - DNA, 18 bp, Homo sapiens
ggaagtagcacaggctga

SEQ ID NO: 512603 - DNA, 15 bp, Homo sapiens
ggaccagcccacgct

SEQ ID NO: 512604 - DNA, 22 bp, Homo sapiens
ggaccatgctgtctggcacagc

SEQ ID NO: 512605 - DNA, 23 bp, Homo sapiens
ggaccatgctgtctggcacagcc

SEQ ID NO: 512606 - DNA, 19 bp, Homo sapiens
ggacccagtggcagggcac

SEQ ID NO: 512607 - DNA, 21 bp, Homo sapiens
ggaccctgccaggcacaggca

SEQ ID NO: 512608 - DNA, 16 bp, Homo sapiens
ggaccctgtgacatgg

SEQ ID NO: 512609 - DNA, 16 bp, Homo sapiens
ggacctgccaggcagg

SEQ ID NO: 512610 - DNA, 17 bp, Homo sapiens
ggacctgccaggcaggg

SEQ ID NO: 512611 - DNA, 17 bp, Homo sapiens
ggactgaggcaagcaca

SEQ ID NO: 512612 - DNA, 13 bp, Homo sapiens
ggactgccacctc

SEQ ID NO: 512613 - DNA, 14 bp, Homo sapiens
ggactgccacctcc

SEQ ID NO: 512614 - DNA, 13 bp, Homo sapiens
ggagaatcacagg

SEQ ID NO: 512615 - DNA, 15 bp, Homo sapiens
ggagaatcacaggct

SEQ ID NO: 512616 - DNA, 22 bp, Homo sapiens
ggagaggaaacttgcctttttt

SEQ ID NO: 512617 - DNA, 15 bp, Homo sapiens
ggagaggagccctgc

SEQ ID NO: 512618 - DNA, 19 bp, Homo sapiens
ggagagggaatgtgaaatt

SEQ ID NO: 512619 - DNA, 13 bp, Homo sapiens
ggagagggaggtc

SEQ ID NO: 512620 - DNA, 17 bp, Homo sapiens
ggagagggaggtcactg

SEQ ID NO: 512621 - DNA, 18 bp, Homo sapiens
ggagcccatttggagggc

SEQ ID NO: 512622 - DNA, 21 bp, Homo sapiens
ggagcccatttggagggcctg

SEQ ID NO: 512623 - DNA, 19 bp, Homo sapiens
ggagccctgcctctccgcc

SEQ ID NO: 512624 - DNA, 16 bp, Homo sapiens
ggagctgtggaaatgg

SEQ ID NO: 512625 - DNA, 17 bp, Homo sapiens
ggagctgtggaaatggt

SEQ ID NO: 512626 - DNA, 14 bp, Homo sapiens
ggaggccacctcct

SEQ ID NO: 512627 - DNA, 16 bp, Homo sapiens
ggagggcctgggcctg

SEQ ID NO: 512628 - DNA, 23 bp, Homo sapiens
ggagggcctgggcctggctccct

SEQ ID NO: 512629 - DNA, 18 bp, Homo sapiens
ggagggggcttgaagcca

SEQ ID NO: 512630 - DNA, 21 bp, Homo sapiens
ggagggggcttgaagccaaag

SEQ ID NO: 512631 - DNA, 17 bp, Homo sapiens
ggaggtcactggaaagg

SEQ ID NO: 512632 - DNA, 16 bp, Homo sapiens
ggaggttgaagccaag

SEQ ID NO: 512633 - DNA, 22 bp, Homo sapiens
ggagtaaccaatttctttctaa

SEQ ID NO: 512634 - DNA, 15 bp, Homo sapiens
ggatttattcccttt

SEQ ID NO: 512635 - DNA, 16 bp, Homo sapiens
ggcaagagggggtgga

SEQ ID NO: 512636 - DNA, 16 bp, Homo sapiens
ggcaataaaagcccag

SEQ ID NO: 512637 - DNA, 17 bp, Homo sapiens
ggcaataaaagcccagg

SEQ ID NO: 512638 - DNA, 21 bp, Homo sapiens
ggcacaggcagggcaggacca

SEQ ID NO: 512639 - DNA, 14 bp, Homo sapiens
ggcacagggcctgg

SEQ ID NO: 512640 - DNA, 21 bp, Homo sapiens
ggcacccaccgtggaggagga

SEQ ID NO: 512641 - DNA, 22 bp, Homo sapiens
ggcactgttgtcatttccaaat

SEQ ID NO: 512642 - DNA, 13 bp, Homo sapiens
ggcaggaccagcc

SEQ ID NO: 512643 - DNA, 19 bp, Homo sapiens
ggcaggaccagcccacgct

SEQ ID NO: 512644 - DNA, 16 bp, Homo sapiens
ggcaggctcactgcca

SEQ ID NO: 512645 - DNA, 22 bp, Homo sapiens
ggcaggctcactgccaggccag

SEQ ID NO: 512646 - DNA, 16 bp, Homo sapiens
ggcagggcacagggcc

SEQ ID NO: 512647 - DNA, 14 bp, Homo sapiens
ggcattatgtaaca

SEQ ID NO: 512648 - DNA, 14 bp, Homo sapiens
ggccaagagtggcc

SEQ ID NO: 512649 - DNA, 17 bp, Homo sapiens
ggccaagagtggcccca

SEQ ID NO: 512650 - DNA, 22 bp, Homo sapiens
ggccacctcctaaaaggcccag

SEQ ID NO: 512651 - DNA, 15 bp, Homo sapiens
ggccacctcttcctg

SEQ ID NO: 512652 - DNA, 19 bp, Homo sapiens
ggccacctcttcctggccg

SEQ ID NO: 512653 - DNA, 12 bp, Homo sapiens
ggcccaccctgc

SEQ ID NO: 512654 - DNA, 18 bp, Homo sapiens
ggcccagagagaagagcc

SEQ ID NO: 512655 - DNA, 23 bp, Homo sapiens
ggcccagagagaagagccccact

SEQ ID NO: 512656 - DNA, 17 bp, Homo sapiens
ggcccatgtatggccag

SEQ ID NO: 512657 - DNA, 22 bp, Homo sapiens
ggccccacctggccctctctga

SEQ ID NO: 512658 - DNA, 15 bp, Homo sapiens
ggccccgtctcaggt

SEQ ID NO: 512659 - DNA, 20 bp, Homo sapiens
ggcccctgggcttggcctgc

SEQ ID NO: 512660 - DNA, 23 bp, Homo sapiens
ggcccctgggcttggcctgctgt

SEQ ID NO: 512661 - DNA, 20 bp, Homo sapiens
ggccctctctgaaggaggcc

SEQ ID NO: 512662 - DNA, 23 bp, Homo sapiens
ggccctctctgaaggaggccacc

SEQ ID NO: 512663 - DNA, 22 bp, Homo sapiens
ggccgccggcaataaaagccca

SEQ ID NO: 512664 - DNA, 12 bp, Homo sapiens
ggcctggcccat

SEQ ID NO: 512665 - DNA, 20 bp, Homo sapiens
ggctagcttctgcttttctg

SEQ ID NO: 512666 - DNA, 14 bp, Homo sapiens
ggctcactgccagg

SEQ ID NO: 512667 - DNA, 20 bp, Homo sapiens
ggctcactgccaggccagcc

SEQ ID NO: 512668 - DNA, 19 bp, Homo sapiens
ggctcagcaaggccacctc

SEQ ID NO: 512669 - DNA, 21 bp, Homo sapiens
ggctcagcaaggccacctctt

SEQ ID NO: 512670 - DNA, 20 bp, Homo sapiens
ggctcccgcctccaacccct

SEQ ID NO: 512671 - DNA, 18 bp, Homo sapiens
ggctccctcactctcagg

SEQ ID NO: 512672 - DNA, 16 bp, Homo sapiens
gtgaccacaaaagagg

SEQ ID NO: 512673 - DNA, 13 bp, Homo sapiens
gtgacggttccta

SEQ ID NO: 512674 - DNA, 24 bp, Homo sapiens
gtgagctaagcattttctcctgtg

SEQ ID NO: 512675 - DNA, 22 bp, Homo sapiens
gtgagttctttttcactctgtg

SEQ ID NO: 512676 - DNA, 14 bp, Homo sapiens
gtgatggtctctgg

SEQ ID NO: 512677 - DNA, 12 bp, Homo sapiens
gtgcaggcccac

SEQ ID NO: 512678 - DNA, 16 bp, Homo sapiens
gtgcctacaatgggaa

SEQ ID NO: 512679 - DNA, 14 bp, Homo sapiens
gtgcctgagaggca

SEQ ID NO: 512680 - DNA, 22 bp, Homo sapiens
gccaggaagtagcacaggctga

SEQ ID NO: 512681 - DNA, 14 bp, Homo sapiens
gccaggcacaggca

SEQ ID NO: 512682 - DNA, 15 bp, Homo sapiens
gccaggcacaggcag

SEQ ID NO: 512683 - DNA, 20 bp, Homo sapiens
gccaggcacaggcagggcag

SEQ ID NO: 512684 - DNA, 16 bp, Homo sapiens
gccaggcaggggtggg

SEQ ID NO: 512685 - DNA, 17 bp, Homo sapiens
gccaggcaggggtgggg

SEQ ID NO: 512686 - DNA, 12 bp, Homo sapiens
gccaggccagcc

SEQ ID NO: 512687 - DNA, 13 bp, Homo sapiens
gccaggccagcct

SEQ ID NO: 512688 - DNA, 19 bp, Homo sapiens
gccagtaattcgtttgcta

SEQ ID NO: 512689 - DNA, 21 bp, Homo sapiens
gccagtctcctatacccagca

SEQ ID NO: 512690 - DNA, 15 bp, Homo sapiens
gcccaccccctgccc

SEQ ID NO: 512691 - DNA, 16 bp, Homo sapiens
gcccaccccctgccct

SEQ ID NO: 512692 - DNA, 20 bp, Homo sapiens
gcccaccctgcttggcccag

SEQ ID NO: 512693 - DNA, 23 bp, Homo sapiens
gcccaccctgcttggcccagggg

SEQ ID NO: 512694 - DNA, 15 bp, Homo sapiens
gcccacttccctggg

SEQ ID NO: 512695 - DNA, 21 bp, Homo sapiens
gcccagagagaagagccccac

SEQ ID NO: 512696 - DNA, 22 bp, Homo sapiens
gcccagagagaagagccccact

SEQ ID NO: 512697 - DNA, 11 bp, Homo sapiens
gcccaggagcc

SEQ ID NO: 512698 - DNA, 15 bp, Homo sapiens
gcccaggagcccatt

SEQ ID NO: 512699 - DNA, 20 bp, Homo sapiens
gcccagggggcttcctgagg

SEQ ID NO: 512700 - DNA, 14 bp, Homo sapiens
gcccagtcccagca

SEQ ID NO: 512701 - DNA, 16 bp, Homo sapiens
gcccagtcccagcagc

SEQ ID NO: 512702 - DNA, 17 bp, Homo sapiens
gcccagtcccagcagcc

SEQ ID NO: 512703 - DNA, 19 bp, Homo sapiens
gcccagtcccagcagccag

SEQ ID NO: 512704 - DNA, 20 bp, Homo sapiens
gcccagtcccagcagccagc

SEQ ID NO: 512705 - DNA, 18 bp, Homo sapiens
gcccatgtatggccagga

SEQ ID NO: 512706 - DNA, 21 bp, Homo sapiens
gcccatgtatggccaggaagt

SEQ ID NO: 512707 - DNA, 15 bp, Homo sapiens
gccccacctggccct

SEQ ID NO: 512708 - DNA, 13 bp, Homo sapiens
gccccactctcag

SEQ ID NO: 512709 - DNA, 18 bp, Homo sapiens
gccccactctcagaggcc

SEQ ID NO: 512710 - DNA, 21 bp, Homo sapiens
gccccactctcagaggcccca

SEQ ID NO: 512711 - DNA, 22 bp, Homo sapiens
gccccactctcagaggccccaa

SEQ ID NO: 512712 - DNA, 21 bp, Homo sapiens
gcccccagccccggggtgagt

SEQ ID NO: 512713 - DNA, 12 bp, Homo sapiens
gcccccagcttc

SEQ ID NO: 512714 - DNA, 18 bp, Homo sapiens
gcccccagcttccagcag

SEQ ID NO: 512715 - DNA, 22 bp, Homo sapiens
gcccccagtccccacccctgcc

SEQ ID NO: 512716 - DNA, 21 bp, Homo sapiens
gccccgcccccagtccccacc

SEQ ID NO: 512717 - DNA, 19 bp, Homo sapiens
gccccggggtgagtccatt

SEQ ID NO: 512718 - DNA, 14 bp, Homo sapiens
gcccctgagcccac

SEQ ID NO: 512719 - DNA, 20 bp, Homo sapiens
gcccctgggcttggcctgct

SEQ ID NO: 512720 - DNA, 16 bp, Homo sapiens
gccctggcccccacat

SEQ ID NO: 512721 - DNA, 14 bp, Homo sapiens
gccctggctgctgc

SEQ ID NO: 512722 - DNA, 14 bp, Homo sapiens
gcccttgcctcccc

SEQ ID NO: 512723 - DNA, 16 bp, Homo sapiens
gcccttgcctccccat

SEQ ID NO: 512724 - DNA, 20 bp, Homo sapiens
gccggcaataaaagcccagg

SEQ ID NO: 512725 - DNA, 23 bp, Homo sapiens
gccggcaataaaagcccaggagc

SEQ ID NO: 512726 - DNA, 14 bp, Homo sapiens
gccgggcccctggg

SEQ ID NO: 512727 - DNA, 17 bp, Homo sapiens
gccggttcattttgcac

SEQ ID NO: 512728 - DNA, 14 bp, Homo sapiens
gcctcaaatccagg

SEQ ID NO: 512729 - DNA, 16 bp, Homo sapiens
gcctcaaatccaggac

SEQ ID NO: 512730 - DNA, 17 bp, Homo sapiens
gcctccaacccctcgcc

SEQ ID NO: 512731 - DNA, 20 bp, Homo sapiens
gcctccaacccctcgcccag

SEQ ID NO: 512732 - DNA, 18 bp, Homo sapiens
gcctccccatttcccatc

SEQ ID NO: 512733 - DNA, 21 bp, Homo sapiens
gcctccccatttcccatctgc

SEQ ID NO: 512734 - DNA, 16 bp, Homo sapiens
gcctccgagagggaga

SEQ ID NO: 512735 - DNA, 17 bp, Homo sapiens
gcctcctctggacggca

SEQ ID NO: 512736 - DNA, 20 bp, Homo sapiens
gcctcctctggacggcaggc

SEQ ID NO: 512737 - DNA, 21 bp, Homo sapiens
gcctctccgcccctgagccca

SEQ ID NO: 512738 - DNA, 22 bp, Homo sapiens
gcctctccgcccctgagcccac

SEQ ID NO: 512739 - DNA, 23 bp, Homo sapiens
gcctctccgcccctgagcccact

SEQ ID NO: 512740 - DNA, 14 bp, Homo sapiens
gcctgaaaattcca

SEQ ID NO: 512741 - DNA, 19 bp, Homo sapiens
gcctgagaggcaggcatag

SEQ ID NO: 512742 - DNA, 20 bp, Homo sapiens
gcctgagaggcaggcataga

SEQ ID NO: 512743 - DNA, 22 bp, Homo sapiens
gcctgagtgagaggggaggcca

SEQ ID NO: 512744 - DNA, 10 bp, Homo sapiens
gcctgctggc

SEQ ID NO: 512745 - DNA, 19 bp, Homo sapiens
gcctggctccctcactctc

SEQ ID NO: 512746 - DNA, 11 bp, Homo sapiens
gcctgggcctg

SEQ ID NO: 512747 - DNA, 13 bp, Homo sapiens
gcctgggcctggc

SEQ ID NO: 512748 - DNA, 16 bp, Homo sapiens
gcctgggcctggctcc

SEQ ID NO: 512749 - DNA, 17 bp, Homo sapiens
gcctgggcctggctccc

SEQ ID NO: 512750 - DNA, 17 bp, Homo sapiens
gccttaaacaattcttg

SEQ ID NO: 512751 - DNA, 18 bp, Homo sapiens
gccttaatttttgaaaag

SEQ ID NO: 512752 - DNA, 13 bp, Homo sapiens
gcgccctggcccc

SEQ ID NO: 512753 - DNA, 16 bp, Homo sapiens
gcgccctggcccccac

SEQ ID NO: 512754 - DNA, 20 bp, Homo sapiens
gcgtcctcctcacctcatgc

SEQ ID NO: 512755 - DNA, 22 bp, Homo sapiens
gctaaagagcccttgcctcccc

SEQ ID NO: 512756 - DNA, 18 bp, Homo sapiens
gctagcttctgcttttct

SEQ ID NO: 512757 - DNA, 13 bp, Homo sapiens
gctatgttcttct

SEQ ID NO: 512758 - DNA, 15 bp, Homo sapiens
gctattatgatgttt

SEQ ID NO: 512759 - DNA, 15 bp, Homo sapiens
gctcactgccaggcc

SEQ ID NO: 512760 - DNA, 19 bp, Homo sapiens
gctcactgccaggccagcc

SEQ ID NO: 512761 - DNA, 19 bp, Homo sapiens
gctcccgcctccaacccct

SEQ ID NO: 512762 - DNA, 17 bp, Homo sapiens
gctccctcactctcagg

SEQ ID NO: 512763 - DNA, 21 bp, Homo sapiens
gctctcaccttggttcctggg

SEQ ID NO: 512764 - DNA, 14 bp, Homo sapiens
gctctgtgcagtca

SEQ ID NO: 512765 - DNA, 21 bp, Homo sapiens
gctctgtgcagtcactggagg

SEQ ID NO: 512766 - DNA, 21 bp, Homo sapiens
gctcttaattaaaaattactg

SEQ ID NO: 512767 - DNA, 14 bp, Homo sapiens
gctgacccatgggc

SEQ ID NO: 512768 - DNA, 18 bp, Homo sapiens
gctgacccatgggcagga

SEQ ID NO: 512769 - DNA, 19 bp, Homo sapiens
gctgacccatgggcaggag

SEQ ID NO: 512770 - DNA, 17 bp, Homo sapiens
gctgaggttcctctgcc

SEQ ID NO: 512771 - DNA, 19 bp, Homo sapiens
gctgaggttcctctgcctg

SEQ ID NO: 512772 - DNA, 16 bp, Homo sapiens
gctgagtgcaggccca

SEQ ID NO: 512773 - DNA, 18 bp, Homo sapiens
gctgagtgcaggcccacc

SEQ ID NO: 512774 - DNA, 23 bp, Homo sapiens
gctgagtgcaggcccaccctgct

SEQ ID NO: 512775 - DNA, 20 bp, Homo sapiens
gctgcccccaccccggggac

SEQ ID NO: 512776 - DNA, 15 bp, Homo sapiens
gctgccttccctagc

SEQ ID NO: 512777 - DNA, 16 bp, Homo sapiens
gctgctgagccgcaga

SEQ ID NO: 512778 - DNA, 20 bp, Homo sapiens
gctgctgagccgcagagaag

SEQ ID NO: 512779 - DNA, 17 bp, Homo sapiens
gctgctgcccccacccc

SEQ ID NO: 512780 - DNA, 15 bp, Homo sapiens
gctggagaggagccc

SEQ ID NO: 512781 - DNA, 21 bp, Homo sapiens
gctggagaggagccctgcctc

SEQ ID NO: 512782 - DNA, 22 bp, Homo sapiens
gctggagaggagccctgcctct

SEQ ID NO: 512783 - DNA, 16 bp, Homo sapiens
gctggcacccaccgtg

SEQ ID NO: 512784 - DNA, 23 bp, Homo sapiens
gctggcacccaccgtggaggagg

SEQ ID NO: 512785 - DNA, 16 bp, Homo sapiens
gctgggaggagggaga

SEQ ID NO: 512786 - DNA, 17 bp, Homo sapiens
gctgggaggagggagag

SEQ ID NO: 512787 - DNA, 13 bp, Homo sapiens
gctgggctgggca

SEQ ID NO: 512788 - DNA, 18 bp, Homo sapiens
gctgggggatgggcctga

SEQ ID NO: 512789 - DNA, 19 bp, Homo sapiens
gctgtctggcacagcctgc

SEQ ID NO: 512790 - DNA, 14 bp, Homo sapiens
gctgtctttttgta

SEQ ID NO: 512791 - DNA, 14 bp, Homo sapiens
gctgtgagatggat

SEQ ID NO: 512792 - DNA, 17 bp, Homo sapiens
gcttcctctagaagcca

SEQ ID NO: 512793 - DNA, 18 bp, Homo sapiens
aactgaggtgttattttc

SEQ ID NO: 512794 - DNA, 18 bp, Homo sapiens
aacttatttctgaaaaag

SEQ ID NO: 512795 - DNA, 21 bp, Homo sapiens
aacttatttctgaaaaagaga

SEQ ID NO: 512796 - DNA, 12 bp, Homo sapiens
aacttcattttt

SEQ ID NO: 512797 - DNA, 15 bp, Homo sapiens
aagaaaaaatggcaa

SEQ ID NO: 512798 - DNA, 16 bp, Homo sapiens
aagaaaaaatggcaag

SEQ ID NO: 512799 - DNA, 18 bp, Homo sapiens
aagaaaaaatggcaagag

SEQ ID NO: 512800 - DNA, 18 bp, Homo sapiens
aagaaaacttacagaaga

SEQ ID NO: 512801 - DNA, 11 bp, Homo sapiens
aagaaagaggg

SEQ ID NO: 512802 - DNA, 21 bp, Homo sapiens
aagaaaggcaaatctgacttt

SEQ ID NO: 512803 - DNA, 12 bp, Homo sapiens
aagaatttttgc

SEQ ID NO: 512804 - DNA, 21 bp, Homo sapiens
aagaatttttgcccatatctg

SEQ ID NO: 512805 - DNA, 21 bp, Homo sapiens
aagactctgccttaatttttg

SEQ ID NO: 512806 - DNA, 21 bp, Homo sapiens
aagagaagttattttctacag

SEQ ID NO: 512807 - DNA, 16 bp, Homo sapiens
aagagattatgtaact

SEQ ID NO: 512808 - DNA, 13 bp, Homo sapiens
aagagcccttgcc

SEQ ID NO: 512809 - DNA, 16 bp, Homo sapiens
aagagcccttgcctcc

SEQ ID NO: 512810 - DNA, 20 bp, Homo sapiens
aagagcctgattttttgagg

SEQ ID NO: 512811 - DNA, 22 bp, Homo sapiens
aagagtggccccacctggccct

SEQ ID NO: 512812 - DNA, 18 bp, Homo sapiens
aagagttgtcctgatgtt

SEQ ID NO: 512813 - DNA, 22 bp, Homo sapiens
aagataatgcatatttttgcac

SEQ ID NO: 512814 - DNA, 21 bp, Homo sapiens
aagcacaatggtttcaaagaa

SEQ ID NO: 512815 - DNA, 19 bp, Homo sapiens
aagcagggaaacagggagg

SEQ ID NO: 512816 - DNA, 14 bp, Homo sapiens
aagcagtgcccagg

SEQ ID NO: 512817 - DNA, 21 bp, Homo sapiens
aagcattttaatgatattgga

SEQ ID NO: 512818 - DNA, 15 bp, Homo sapiens
aagcattttctcctg

SEQ ID NO: 512819 - DNA, 13 bp, Homo sapiens
aagccaagggaaa

SEQ ID NO: 512820 - DNA, 15 bp, Homo sapiens
aagcccaggagccca

SEQ ID NO: 512821 - DNA, 21 bp, Homo sapiens
aagcctctgtcttttctggga

SEQ ID NO: 512822 - DNA, 19 bp, Homo sapiens
aagctatgtttttaaagtg

SEQ ID NO: 512823 - DNA, 16 bp, Homo sapiens
aaggaacccaattttc

SEQ ID NO: 512824 - DNA, 23 bp, Homo sapiens
aaggagattcaggcagactggtg

SEQ ID NO: 512825 - DNA, 12 bp, Homo sapiens
aaggaggccacc

SEQ ID NO: 512826 - DNA, 15 bp, Homo sapiens
aaggaggccacctcc

SEQ ID NO: 512827 - DNA, 16 bp, Homo sapiens
aaggaggccacctcct

SEQ ID NO: 512828 - DNA, 13 bp, Homo sapiens
aaggatgttttta

SEQ ID NO: 512829 - DNA, 18 bp, Homo sapiens
aaggcaaatctgactttt

SEQ ID NO: 512830 - DNA, 14 bp, Homo sapiens
aaggccacctcttc

SEQ ID NO: 512831 - DNA, 20 bp, Homo sapiens
aaggccacctcttcctggcc

SEQ ID NO: 512832 - DNA, 17 bp, Homo sapiens
aagggactgaggcaagc

SEQ ID NO: 512833 - DNA, 12 bp, Homo sapiens
aaggggagagcc

SEQ ID NO: 512834 - DNA, 15 bp, Homo sapiens
aaggggagagcctgc

SEQ ID NO: 512835 - DNA, 18 bp, Homo sapiens
aaggggagagcctgctgg

SEQ ID NO: 512836 - DNA, 14 bp, Homo sapiens
aaggggtgctttta

SEQ ID NO: 512837 - DNA, 19 bp, Homo sapiens
aagtaacagttgaagaaaa

SEQ ID NO: 512838 - DNA, 19 bp, Homo sapiens
aagtagaatctcttttctg

SEQ ID NO: 512839 - DNA, 15 bp, Homo sapiens
aagtagcacaggctg

SEQ ID NO: 512840 - DNA, 15 bp, Homo sapiens
aagtataatttcagt

SEQ ID NO: 512841 - DNA, 15 bp, Homo sapiens
aagtcatcatctcca

SEQ ID NO: 512842 - DNA, 14 bp, Homo sapiens
aagtgacggttcct

SEQ ID NO: 512843 - DNA, 16 bp, Homo sapiens
aagtggcaagtatttg

SEQ ID NO: 512844 - DNA, 14 bp, Homo sapiens
aagttattttctac

SEQ ID NO: 512845 - DNA, 15 bp, Homo sapiens
aataaaaaagatccc

SEQ ID NO: 512846 - DNA, 15 bp, Homo sapiens
aataaaagcccagga

SEQ ID NO: 512847 - DNA, 19 bp, Homo sapiens
aataaaagcccaggagccc

SEQ ID NO: 512848 - DNA, 14 bp, Homo sapiens
aataaataccaaag

SEQ ID NO: 512849 - DNA, 18 bp, Homo sapiens
aataaccctttggttttt

SEQ ID NO: 512850 - DNA, 17 bp, Homo sapiens
aatacactagttgtttc

SEQ ID NO: 512851 - DNA, 21 bp, Homo sapiens
aataccgacgtctatcctttc

SEQ ID NO: 512852 - DNA, 23 bp, Homo sapiens
aatacttctgataatttattgtc

SEQ ID NO: 512853 - DNA, 13 bp, Homo sapiens
aatataaaatttc

SEQ ID NO: 512854 - DNA, 19 bp, Homo sapiens
aatcaatacactagttgtt

SEQ ID NO: 512855 - DNA, 14 bp, Homo sapiens
aatcacaagtaaag

SEQ ID NO: 512856 - DNA, 16 bp, Homo sapiens
aatcagacattttaag

SEQ ID NO: 512857 - DNA, 16 bp, Homo sapiens
aatcatgtattttgta

SEQ ID NO: 512858 - DNA, 21 bp, Homo sapiens
aatcctaatttctcctccctt

SEQ ID NO: 512859 - DNA, 19 bp, Homo sapiens
aatcctagccattgacaat

SEQ ID NO: 512860 - DNA, 14 bp, Homo sapiens
aatctcttttctgg

SEQ ID NO: 512861 - DNA, 15 bp, Homo sapiens
aatcttgtcatgtgt

SEQ ID NO: 512862 - DNA, 17 bp, Homo sapiens
aatcttgtcatgtgtat

SEQ ID NO: 512863 - DNA, 18 bp, Homo sapiens
aatctttcaacttatttc

SEQ ID NO: 512864 - DNA, 21 bp, Homo sapiens
aatgcattctttcttctcttt

SEQ ID NO: 512865 - DNA, 22 bp, Homo sapiens
aatgctgacccatgggcaggag

SEQ ID NO: 512866 - DNA, 13 bp, Homo sapiens
aatgggaaaactt

SEQ ID NO: 512867 - DNA, 22 bp, Homo sapiens
aatgggaaaacttcactccaaa

SEQ ID NO: 512868 - DNA, 21 bp, Homo sapiens
aatgggttatctcaaatttta

SEQ ID NO: 512869 - DNA, 22 bp, Homo sapiens
aatgtaaaggcaggtttgggaa

SEQ ID NO: 512870 - DNA, 12 bp, Homo sapiens
aatgtaaatttg

SEQ ID NO: 512871 - DNA, 16 bp, Homo sapiens
aatgtaaatttgtact

SEQ ID NO: 512872 - DNA, 21 bp, Homo sapiens
aatgtgagctaagcattttct

SEQ ID NO: 512873 - DNA, 21 bp, Homo sapiens
aattctgggattactgacttt

SEQ ID NO: 512874 - DNA, 17 bp, Homo sapiens
aattgattttttttctc

SEQ ID NO: 512875 - DNA, 20 bp, Homo sapiens
aattgattttttttctctct

SEQ ID NO: 512876 - DNA, 15 bp, Homo sapiens
aatttacaacttata

SEQ ID NO: 512877 - DNA, 14 bp, Homo sapiens
aatttataattaca

SEQ ID NO: 512878 - DNA, 14 bp, Homo sapiens
aatttattgtcttt

SEQ ID NO: 512879 - DNA, 20 bp, Homo sapiens
aatttctcctcccttccttt

SEQ ID NO: 512880 - DNA, 14 bp, Homo sapiens
aatttgtggtgatt

SEQ ID NO: 512881 - DNA, 14 bp, Homo sapiens
aattttgtcctttc

SEQ ID NO: 512882 - DNA, 13 bp, Homo sapiens
aatttttgaaaag

SEQ ID NO: 512883 - DNA, 16 bp, Homo sapiens
acaaaggcaagactct

SEQ ID NO: 512884 - DNA, 19 bp, Homo sapiens
acaaatgtgtatttttgtt

SEQ ID NO: 512885 - DNA, 16 bp, Homo sapiens
acaatttataattaca

SEQ ID NO: 512886 - DNA, 13 bp, Homo sapiens
acaatttttgctg

SEQ ID NO: 512887 - DNA, 23 bp, Homo sapiens
acacagaaggggactgccacctc

SEQ ID NO: 512888 - DNA, 13 bp, Homo sapiens
acacattaataaa

SEQ ID NO: 512889 - DNA, 14 bp, Homo sapiens
acacattgttttcc

SEQ ID NO: 512890 - DNA, 23 bp, Homo sapiens
acacctggctgaggttcctctgc

SEQ ID NO: 512891 - DNA, 13 bp, Homo sapiens
acagaaattgcaa

SEQ ID NO: 512892 - DNA, 14 bp, Homo sapiens
acagaaattgcaat

SEQ ID NO: 512893 - DNA, 22 bp, Homo sapiens
acagaaggggactgccacctcc

SEQ ID NO: 512894 - DNA, 13 bp, Homo sapiens
acagacaggaccc

SEQ ID NO: 512895 - DNA, 18 bp, Homo sapiens
acagacaggacccctgca

SEQ ID NO: 512896 - DNA, 20 bp, Homo sapiens
acagagcaacccctggaccc

SEQ ID NO: 512897 - DNA, 20 bp, Homo sapiens
acagctatttcccttttctg

SEQ ID NO: 512898 - DNA, 21 bp, Homo sapiens
acagcttgagccgggcccctg

SEQ ID NO: 512899 - DNA, 12 bp, Homo sapiens
acaggaaaaagt

SEQ ID NO: 512900 - DNA, 18 bp, Homo sapiens
acaggacaggggttcctt

SEQ ID NO: 512901 - DNA, 15 bp, Homo sapiens
acaggacccctgcag

SEQ ID NO: 512902 - DNA, 16 bp, Homo sapiens
acaggacccctgcagt

SEQ ID NO: 512903 - DNA, 20 bp, Homo sapiens
acaggacccctgcagttccc

SEQ ID NO: 512904 - DNA, 13 bp, Homo sapiens
acaggcagggcag

SEQ ID NO: 512905 - DNA, 18 bp, Homo sapiens
agaaacattctttcctaa

SEQ ID NO: 512906 - DNA, 19 bp, Homo sapiens
agaaacattctttcctaaa

SEQ ID NO: 512907 - DNA, 21 bp, Homo sapiens
agaaacctattaagtcatcat

SEQ ID NO: 512908 - DNA, 14 bp, Homo sapiens
agaagagccccact

SEQ ID NO: 512909 - DNA, 15 bp, Homo sapiens
agaagccaagggaaa

SEQ ID NO: 512910 - DNA, 16 bp, Homo sapiens
agaagccaagggaaag

SEQ ID NO: 512911 - DNA, 22 bp, Homo sapiens
agaagccaagggaaaggggtgc

SEQ ID NO: 512912 - DNA, 18 bp, Homo sapiens
agaagctatgtttttaaa

SEQ ID NO: 512913 - DNA, 23 bp, Homo sapiens
agaagttattttctacagtggtt

SEQ ID NO: 512914 - DNA, 15 bp, Homo sapiens
agaatcacaggctgg

SEQ ID NO: 512915 - DNA, 16 bp, Homo sapiens
agaatcatgtattttg

SEQ ID NO: 512916 - DNA, 20 bp, Homo sapiens
agaatcatgtattttgtaaa

SEQ ID NO: 512917 - DNA, 21 bp, Homo sapiens
agaattgattttttttctctc

SEQ ID NO: 512918 - DNA, 15 bp, Homo sapiens
agacaagagatggga

SEQ ID NO: 512919 - DNA, 12 bp, Homo sapiens
agacattttaag

SEQ ID NO: 512920 - DNA, 19 bp, Homo sapiens
agaccctgggtgggctctg

SEQ ID NO: 512921 - DNA, 19 bp, Homo sapiens
agactctgccttaattttt

SEQ ID NO: 512922 - DNA, 21 bp, Homo sapiens
agactctgccttaatttttga

SEQ ID NO: 512923 - DNA, 11 bp, Homo sapiens
agactgccagc

SEQ ID NO: 512924 - DNA, 20 bp, Homo sapiens
agactgctcctgagccccca

SEQ ID NO: 512925 - DNA, 23 bp, Homo sapiens
agagaaacctattaagtcatcat

SEQ ID NO: 512926 - DNA, 15 bp, Homo sapiens
agagaagagccccac

SEQ ID NO: 512927 - DNA, 18 bp, Homo sapiens
agagaagagccccactct

SEQ ID NO: 512928 - DNA, 21 bp, Homo sapiens
agagaagagccccactctcag

SEQ ID NO: 512929 - DNA, 18 bp, Homo sapiens
agagacaataactttgaa

SEQ ID NO: 512930 - DNA, 15 bp, Homo sapiens
agagagagagagaga

SEQ ID NO: 512931 - DNA, 15 bp, Homo sapiens
agagagagaggacag

SEQ ID NO: 512932 - DNA, 21 bp, Homo sapiens
agagcaacccctggaccccag

SEQ ID NO: 512933 - DNA, 22 bp, Homo sapiens
agagcaacccctggaccccagc

SEQ ID NO: 512934 - DNA, 23 bp, Homo sapiens
agagcaacccctggaccccagcc

SEQ ID NO: 512935 - DNA, 20 bp, Homo sapiens
agagccccactctcagaggc

SEQ ID NO: 512936 - DNA, 19 bp, Homo sapiens
agagcccttgcctccccat

SEQ ID NO: 512937 - DNA, 12 bp, Homo sapiens
agagcctgctgg

SEQ ID NO: 512938 - DNA, 15 bp, Homo sapiens
agaggagccctgcct

SEQ ID NO: 512939 - DNA, 21 bp, Homo sapiens
agaggccccaataccccatgg

SEQ ID NO: 512940 - DNA, 12 bp, Homo sapiens
agaggcttctcc

SEQ ID NO: 512941 - DNA, 16 bp, Homo sapiens
agaggcttctccgcca

SEQ ID NO: 512942 - DNA, 20 bp, Homo sapiens
agaggcttctccgccagcct

SEQ ID NO: 512943 - DNA, 23 bp, Homo sapiens
agaggcttctccgccagcctcct

SEQ ID NO: 512944 - DNA, 12 bp, Homo sapiens
agagggaatgtg

SEQ ID NO: 512945 - DNA, 15 bp, Homo sapiens
agagggaatgtgaaa

SEQ ID NO: 512946 - DNA, 20 bp, Homo sapiens
agagggaggtcactggaaag

SEQ ID NO: 512947 - DNA, 13 bp, Homo sapiens
agaggggaggcca

SEQ ID NO: 512948 - DNA, 15 bp, Homo sapiens
agagtatgttcttga

SEQ ID NO: 512949 - DNA, 15 bp, Homo sapiens
agagtggccccacct

SEQ ID NO: 512950 - DNA, 16 bp, Homo sapiens
agatattttcatattt

SEQ ID NO: 512951 - DNA, 17 bp, Homo sapiens
agatattttcatattta

SEQ ID NO: 512952 - DNA, 19 bp, Homo sapiens
agatattttcatatttaaa

SEQ ID NO: 512953 - DNA, 21 bp, Homo sapiens
agatattttcatatttaaagc

SEQ ID NO: 512954 - DNA, 15 bp, Homo sapiens
agatcatatcctcag

SEQ ID NO: 512955 - DNA, 10 bp, Homo sapiens
agatcccaaa

SEQ ID NO: 512956 - DNA, 11 bp, Homo sapiens
agatcccaaga

SEQ ID NO: 512957 - DNA, 19 bp, Homo sapiens
agcaacccctggaccccag

SEQ ID NO: 512958 - DNA, 24 bp, Homo sapiens
agcaacccctggaccccagcctca

SEQ ID NO: 512959 - DNA, 22 bp, Homo sapiens
agcacaatggtttcaaagaaag

SEQ ID NO: 512960 - DNA, 18 bp, Homo sapiens
agcacaggctgagtgcag

SEQ ID NO: 512961 - DNA, 20 bp, Homo sapiens
agcacaggctgagtgcaggc

SEQ ID NO: 512962 - DNA, 21 bp, Homo sapiens
agcagccagccaaacacacag

SEQ ID NO: 512963 - DNA, 12 bp, Homo sapiens
agcagtgcccag

SEQ ID NO: 512964 - DNA, 23 bp, Homo sapiens
agcagtgcccaggtggctgtgga

SEQ ID NO: 512965 - DNA, 15 bp, Homo sapiens
agcatctatctcatc

SEQ ID NO: 512966 - DNA, 17 bp, Homo sapiens
agcatggttttagcaaa

SEQ ID NO: 512967 - DNA, 17 bp, Homo sapiens
agcattttaatgatatt

SEQ ID NO: 512968 - DNA, 22 bp, Homo sapiens
agccaaacacacagaaggggac

SEQ ID NO: 512969 - DNA, 12 bp, Homo sapiens
agccaaagaaaa

SEQ ID NO: 512970 - DNA, 14 bp, Homo sapiens
agccaagggaaagg

SEQ ID NO: 512971 - DNA, 20 bp, Homo sapiens
agccaagggaaaggggtgct

SEQ ID NO: 512972 - DNA, 20 bp, Homo sapiens
agccagtctcctatacccag

SEQ ID NO: 512973 - DNA, 16 bp, Homo sapiens
agcccagatcccaaga

SEQ ID NO: 512974 - DNA, 12 bp, Homo sapiens
agcccaggagcc

SEQ ID NO: 512975 - DNA, 15 bp, Homo sapiens
agcccaggagcccat

SEQ ID NO: 512976 - DNA, 19 bp, Homo sapiens
agcccatttggagggcctg

SEQ ID NO: 512977 - DNA, 20 bp, Homo sapiens
agcccatttggagggcctgg

SEQ ID NO: 512978 - DNA, 19 bp, Homo sapiens
agccccactctcagaggcc

SEQ ID NO: 512979 - DNA, 21 bp, Homo sapiens
agccccactctcagaggcccc

SEQ ID NO: 512980 - DNA, 18 bp, Homo sapiens
agcctcaaatccaggacc

SEQ ID NO: 512981 - DNA, 19 bp, Homo sapiens
agcctcaaatccaggaccc

SEQ ID NO: 512982 - DNA, 20 bp, Homo sapiens
agcctcaaatccaggaccct

SEQ ID NO: 512983 - DNA, 22 bp, Homo sapiens
agcctcaaatccaggaccctgc

SEQ ID NO: 512984 - DNA, 19 bp, Homo sapiens
agcctcctctggacggcag

SEQ ID NO: 512985 - DNA, 14 bp, Homo sapiens
agcctctgggttgt

SEQ ID NO: 512986 - DNA, 14 bp, Homo sapiens
agcctctgtctttt

SEQ ID NO: 512987 - DNA, 17 bp, Homo sapiens
agcctgaaaattccaat

SEQ ID NO: 512988 - DNA, 17 bp, Homo sapiens
agcctgctggcacccac

SEQ ID NO: 512989 - DNA, 14 bp, Homo sapiens
agcgccctggcccc

SEQ ID NO: 512990 - DNA, 16 bp, Homo sapiens
agcgccctggccccca

SEQ ID NO: 512991 - DNA, 16 bp, Homo sapiens
agctaagcattttctc

SEQ ID NO: 512992 - DNA, 17 bp, Homo sapiens
agctaagcattttctcc

SEQ ID NO: 512993 - DNA, 18 bp, Homo sapiens
agctagtacctatatgct

SEQ ID NO: 512994 - DNA, 20 bp, Homo sapiens
agctatgtttttaaagtgta

SEQ ID NO: 512995 - DNA, 14 bp, Homo sapiens
agctatttcccttt

SEQ ID NO: 512996 - DNA, 13 bp, Homo sapiens
agctgctgagccg

SEQ ID NO: 512997 - DNA, 18 bp, Homo sapiens
agctggagaggagccctg

SEQ ID NO: 512998 - DNA, 23 bp, Homo sapiens
agctggagaggagccctgcctct

SEQ ID NO: 512999 - DNA, 18 bp, Homo sapiens
agctgtggaaatggtgag

SEQ ID NO: 513000 - DNA, 16 bp, Homo sapiens
agcttccagcaggagg

SEQ ID NO: 513001 - DNA, 19 bp, Homo sapiens
agcttccagcaggagggac

SEQ ID NO: 513002 - DNA, 23 bp, Homo sapiens
agcttctgcttttctgccctggc

SEQ ID NO: 513003 - DNA, 24 bp, Homo sapiens
agcttgagccgggcccctgggctt

SEQ ID NO: 513004 - DNA, 11 bp, Homo sapiens
agcttgtcctg

SEQ ID NO: 513005 - DNA, 14 bp, Homo sapiens
agcttgttctagaa

SEQ ID NO: 513006 - DNA, 13 bp, Homo sapiens
agctttagaccct

SEQ ID NO: 513007 - DNA, 17 bp, Homo sapiens
agctttagaccctgggt

SEQ ID NO: 513008 - DNA, 19 bp, Homo sapiens
agctttagaccctgggtgg

SEQ ID NO: 513009 - DNA, 20 bp, Homo sapiens
aggaaactccacatctgcct

SEQ ID NO: 513010 - DNA, 21 bp, Homo sapiens
aggaaactccacatctgcctt

SEQ ID NO: 513011 - DNA, 22 bp, Homo sapiens
aggaaactccacatctgcctta

SEQ ID NO: 513012 - DNA, 15 bp, Homo sapiens
aggacaggggttcct

SEQ ID NO: 513013 - DNA, 13 bp, Homo sapiens
aggaccagcccac

SEQ ID NO: 513014 - DNA, 14 bp, Homo sapiens
aggaccagcccacg

SEQ ID NO: 513015 - DNA, 16 bp, Homo sapiens
aggaccctgccaggca

SEQ ID NO: 513016 - DNA, 13 bp, Homo sapiens
atacatgttgtat

SEQ ID NO: 513017 - DNA, 20 bp, Homo sapiens
atacatgttgtatttatgga

SEQ ID NO: 513018 - DNA, 23 bp, Homo sapiens
atacatgttgtatttatggaaga

SEQ ID NO: 513019 - DNA, 16 bp, Homo sapiens
atacccagcagaggga

SEQ ID NO: 513020 - DNA, 18 bp, Homo sapiens
atacccagcagagggata

SEQ ID NO: 513021 - DNA, 23 bp, Homo sapiens
atacccagcagagggataaccca

SEQ ID NO: 513022 - DNA, 20 bp, Homo sapiens
atactgaaggaaaaacacaa

SEQ ID NO: 513023 - DNA, 12 bp, Homo sapiens
atagaggctagc

SEQ ID NO: 513024 - DNA, 18 bp, Homo sapiens
atagaggcttctccgcca

SEQ ID NO: 513025 - DNA, 17 bp, Homo sapiens
atagaggtctgtaaaga

SEQ ID NO: 513026 - DNA, 15 bp, Homo sapiens
atataaaatttctgg

SEQ ID NO: 513027 - DNA, 19 bp, Homo sapiens
atatatttttttcaactgc

SEQ ID NO: 513028 - DNA, 16 bp, Homo sapiens
atatttaaagccaaat

SEQ ID NO: 513029 - DNA, 19 bp, Homo sapiens
atatttcccttacaattaa

SEQ ID NO: 513030 - DNA, 13 bp, Homo sapiens
atatttgtcattt

SEQ ID NO: 513031 - DNA, 15 bp, Homo sapiens
atatttgtcattttc

SEQ ID NO: 513032 - DNA, 15 bp, Homo sapiens
atcaaaccaaagagt

SEQ ID NO: 513033 - DNA, 16 bp, Homo sapiens
atcaaaccaaagagta

SEQ ID NO: 513034 - DNA, 17 bp, Homo sapiens
atcaaaccaaagagtat

SEQ ID NO: 513035 - DNA, 22 bp, Homo sapiens
atcaaaccaaagagtattcagt

SEQ ID NO: 513036 - DNA, 20 bp, Homo sapiens
atcacaggctgggctgggca

SEQ ID NO: 513037 - DNA, 21 bp, Homo sapiens
atcacaggctgggctgggcac

SEQ ID NO: 513038 - DNA, 16 bp, Homo sapiens
atcactggcatggtgg

SEQ ID NO: 513039 - DNA, 17 bp, Homo sapiens
atcactggcatggtggt

SEQ ID NO: 513040 - DNA, 23 bp, Homo sapiens
atccaggaccctgccaggcacag

SEQ ID NO: 513041 - DNA, 14 bp, Homo sapiens
atccatgtgttcca

SEQ ID NO: 513042 - DNA, 10 bp, Homo sapiens
atcccaggaa

SEQ ID NO: 513043 - DNA, 22 bp, Homo sapiens
atccccttctcccctgcactgt

SEQ ID NO: 513044 - DNA, 15 bp, Homo sapiens
atcctaatttctcct

SEQ ID NO: 513045 - DNA, 19 bp, Homo sapiens
atcctaatttctcctccct

SEQ ID NO: 513046 - DNA, 23 bp, Homo sapiens
atcctaatttctcctcccttcct

SEQ ID NO: 513047 - DNA, 16 bp, Homo sapiens
atcctgtgtggagagg

SEQ ID NO: 513048 - DNA, 21 bp, Homo sapiens
atcctgtgtggagagggaatg

SEQ ID NO: 513049 - DNA, 20 bp, Homo sapiens
atctcaaattttaagttaaa

SEQ ID NO: 513050 - DNA, 13 bp, Homo sapiens
atctcaactctgt

SEQ ID NO: 513051 - DNA, 17 bp, Homo sapiens
atctccaaactaaaccc

SEQ ID NO: 513052 - DNA, 11 bp, Homo sapiens
atctgactttt

SEQ ID NO: 513053 - DNA, 23 bp, Homo sapiens
atctgcaccccttctctcctccc

SEQ ID NO: 513054 - DNA, 11 bp, Homo sapiens
atcttgtcatg

SEQ ID NO: 513055 - DNA, 12 bp, Homo sapiens
atcttgtcatgt

SEQ ID NO: 513056 - DNA, 14 bp, Homo sapiens
atcttgtcatgtgt

SEQ ID NO: 513057 - DNA, 21 bp, Homo sapiens
atctttcaacttatttctgaa

SEQ ID NO: 513058 - DNA, 12 bp, Homo sapiens
atgaatatctgg

SEQ ID NO: 513059 - DNA, 22 bp, Homo sapiens
atgagttctgtcccgtaaatca

SEQ ID NO: 513060 - DNA, 23 bp, Homo sapiens
atgagttctgtcccgtaaatcat

SEQ ID NO: 513061 - DNA, 15 bp, Homo sapiens
atgagtttcacagtg

SEQ ID NO: 513062 - DNA, 21 bp, Homo sapiens
atgatgttaatgggttatctc

SEQ ID NO: 513063 - DNA, 14 bp, Homo sapiens
atgatgttttgcaa

SEQ ID NO: 513064 - DNA, 20 bp, Homo sapiens
atgatgttttgcaaaggaaa

SEQ ID NO: 513065 - DNA, 19 bp, Homo sapiens
atgattagcataaagcact

SEQ ID NO: 513066 - DNA, 15 bp, Homo sapiens
atgcagcacttcaga

SEQ ID NO: 513067 - DNA, 16 bp, Homo sapiens
atgcatatttttgcac

SEQ ID NO: 513068 - DNA, 18 bp, Homo sapiens
atgcattctttcttctct

SEQ ID NO: 513069 - DNA, 14 bp, Homo sapiens
atgccattaaaaaa

SEQ ID NO: 513070 - DNA, 12 bp, Homo sapiens
atgcccaccccc

SEQ ID NO: 513071 - DNA, 19 bp, Homo sapiens
atgcccaccccctgccctg

SEQ ID NO: 513072 - DNA, 16 bp, Homo sapiens
atgctgtctggcacag

SEQ ID NO: 513073 - DNA, 23 bp, Homo sapiens
atggaccatgctgtctggcacag

SEQ ID NO: 513074 - DNA, 21 bp, Homo sapiens
atggccaggaagtagcacagg

SEQ ID NO: 513075 - DNA, 21 bp, Homo sapiens
atgggaaaacttcactccaaa

SEQ ID NO: 513076 - DNA, 12 bp, Homo sapiens
atgggcctgagt

SEQ ID NO: 513077 - DNA, 13 bp, Homo sapiens
atgggtcacagga

SEQ ID NO: 513078 - DNA, 21 bp, Homo sapiens
atggtctaaaacagctatttc

SEQ ID NO: 513079 - DNA, 23 bp, Homo sapiens
atggtgcctgagaggcaggcata

SEQ ID NO: 513080 - DNA, 14 bp, Homo sapiens
atgtaaaatcttgt

SEQ ID NO: 513081 - DNA, 19 bp, Homo sapiens
atgtaaattaaatgaagat

SEQ ID NO: 513082 - DNA, 16 bp, Homo sapiens
atgtatttatgtcttt

SEQ ID NO: 513083 - DNA, 14 bp, Homo sapiens
atgtcttattttat

SEQ ID NO: 513084 - DNA, 21 bp, Homo sapiens
atgtcttattttattatttct

SEQ ID NO: 513085 - DNA, 12 bp, Homo sapiens
atgtgttccaaa

SEQ ID NO: 513086 - DNA, 21 bp, Homo sapiens
atgtgttccaaatttgcttta

SEQ ID NO: 513087 - DNA, 13 bp, Homo sapiens
atgttcttgaaga

SEQ ID NO: 513088 - DNA, 18 bp, Homo sapiens
atgttcttgaagaaaggc

SEQ ID NO: 513089 - DNA, 14 bp, Homo sapiens
atgttttgcaaagg

SEQ ID NO: 513090 - DNA, 17 bp, Homo sapiens
atgtttttaaagtgtac

SEQ ID NO: 513091 - DNA, 16 bp, Homo sapiens
atgtttttaatggcat

SEQ ID NO: 513092 - DNA, 20 bp, Homo sapiens
attaagtcatcatctccaaa

SEQ ID NO: 513093 - DNA, 20 bp, Homo sapiens
attatgatgttttgcaaagg

SEQ ID NO: 513094 - DNA, 15 bp, Homo sapiens
attatgggtcacagg

SEQ ID NO: 513095 - DNA, 17 bp, Homo sapiens
attatgggtcacaggaa

SEQ ID NO: 513096 - DNA, 16 bp, Homo sapiens
attatgtcttatttta

SEQ ID NO: 513097 - DNA, 19 bp, Homo sapiens
attattttcccatttgctg

SEQ ID NO: 513098 - DNA, 20 bp, Homo sapiens
attattttcccatttgctgt

SEQ ID NO: 513099 - DNA, 17 bp, Homo sapiens
attcagtgatatgtaaa

SEQ ID NO: 513100 - DNA, 21 bp, Homo sapiens
attcagtgatatgtaaattaa

SEQ ID NO: 513101 - DNA, 17 bp, Homo sapiens
attccaaaattcatttc

SEQ ID NO: 513102 - DNA, 16 bp, Homo sapiens
attccactacacctgg

SEQ ID NO: 513103 - DNA, 23 bp, Homo sapiens
attcccttttaaagaatttttgc

SEQ ID NO: 513104 - DNA, 17 bp, Homo sapiens
attcctcatgaatgtaa

SEQ ID NO: 513105 - DNA, 22 bp, Homo sapiens
attcctcatgaatgtaaatttg

SEQ ID NO: 513106 - DNA, 16 bp, Homo sapiens
attcgtttgctagaat

SEQ ID NO: 513107 - DNA, 19 bp, Homo sapiens
attcgtttgctagaattga

SEQ ID NO: 513108 - DNA, 21 bp, Homo sapiens
attctcccaggtaccagctgc

SEQ ID NO: 513109 - DNA, 22 bp, Homo sapiens
attctcccaggtaccagctgcg

SEQ ID NO: 513110 - DNA, 17 bp, Homo sapiens
attcttgatgtaaaatc

SEQ ID NO: 513111 - DNA, 13 bp, Homo sapiens
attctttccatga

SEQ ID NO: 513112 - DNA, 20 bp, Homo sapiens
attgactgggtctccttaat

SEQ ID NO: 513113 - DNA, 16 bp, Homo sapiens
attgagaaaggagtag

SEQ ID NO: 513114 - DNA, 16 bp, Homo sapiens
attggtgctttgtgtc

SEQ ID NO: 513115 - DNA, 18 bp, Homo sapiens
attggtgctttgtgtcta

SEQ ID NO: 513116 - DNA, 20 bp, Homo sapiens
attgtaaacagaaattgcaa

SEQ ID NO: 513117 - DNA, 13 bp, Homo sapiens
attgtacatattt

SEQ ID NO: 513118 - DNA, 19 bp, Homo sapiens
attgtacatatttttatat

SEQ ID NO: 513119 - DNA, 14 bp, Homo sapiens
attgtatttgtgta

SEQ ID NO: 513120 - DNA, 12 bp, Homo sapiens
atttatggaaga

SEQ ID NO: 513121 - DNA, 19 bp, Homo sapiens
atttattcccttttaaaga

SEQ ID NO: 513122 - DNA, 14 bp, Homo sapiens
atttattgtcttta

SEQ ID NO: 513123 - DNA, 19 bp, Homo sapiens
atttatttcagcatggact

SEQ ID NO: 513124 - DNA, 17 bp, Homo sapiens
atttcagtgcagtaatt

SEQ ID NO: 513125 - DNA, 13 bp, Homo sapiens
atttcccatctgc

SEQ ID NO: 513126 - DNA, 15 bp, Homo sapiens
atttcccatctgcac

SEQ ID NO: 513127 - DNA, 13 bp, Homo sapiens
cagattccctgtt

SEQ ID NO: 513128 - DNA, 20 bp, Homo sapiens
cagcaaagtagaatctcttt

SEQ ID NO: 513129 - DNA, 21 bp, Homo sapiens
cagcaaggccacctcttcctg

SEQ ID NO: 513130 - DNA, 12 bp, Homo sapiens
cagcaggaggga

SEQ ID NO: 513131 - DNA, 19 bp, Homo sapiens
cagcaggagggacagtctc

SEQ ID NO: 513132 - DNA, 22 bp, Homo sapiens
cagcaggagggacagtctcacc

SEQ ID NO: 513133 - DNA, 23 bp, Homo sapiens
cagccaaacacacagaaggggac

SEQ ID NO: 513134 - DNA, 22 bp, Homo sapiens
cagcccacgctgactacagggc

SEQ ID NO: 513135 - DNA, 17 bp, Homo sapiens
cagcctcaaatccagga

SEQ ID NO: 513136 - DNA, 17 bp, Homo sapiens
cagcctcctctggacgg

SEQ ID NO: 513137 - DNA, 23 bp, Homo sapiens
cagcctcctctggacggcaggct

SEQ ID NO: 513138 - DNA, 20 bp, Homo sapiens
cagctcttcctagctggaga

SEQ ID NO: 513139 - DNA, 19 bp, Homo sapiens
cagctgctgagccgcagag

SEQ ID NO: 513140 - DNA, 11 bp, Homo sapiens
cagcttccagc

SEQ ID NO: 513141 - DNA, 12 bp, Homo sapiens
cagcttccagca

SEQ ID NO: 513142 - DNA, 13 bp, Homo sapiens
cagcttccagcag

SEQ ID NO: 513143 - DNA, 14 bp, Homo sapiens
cagcttgagccggg

SEQ ID NO: 513144 - DNA, 20 bp, Homo sapiens
cagcttttgccttggttctt

SEQ ID NO: 513145 - DNA, 21 bp, Homo sapiens
caggaaactccacatctgcct

SEQ ID NO: 513146 - DNA, 22 bp, Homo sapiens
caggaaactccacatctgcctt

SEQ ID NO: 513147 - DNA, 23 bp, Homo sapiens
caggaaatgctgacccatgggca

SEQ ID NO: 513148 - DNA, 16 bp, Homo sapiens
caggaagtagcacagg

SEQ ID NO: 513149 - DNA, 20 bp, Homo sapiens
caggaagtagcacaggctga

SEQ ID NO: 513150 - DNA, 15 bp, Homo sapiens
caggacaggggttcc

SEQ ID NO: 513151 - DNA, 16 bp, Homo sapiens
caggacaggggttcct

SEQ ID NO: 513152 - DNA, 13 bp, Homo sapiens
caggaccagccca

SEQ ID NO: 513153 - DNA, 12 bp, Homo sapiens
caggaccctgcc

SEQ ID NO: 513154 - DNA, 13 bp, Homo sapiens
caggaccctgcca

SEQ ID NO: 513155 - DNA, 15 bp, Homo sapiens
caggaccctgccagg

SEQ ID NO: 513156 - DNA, 16 bp, Homo sapiens
caggagggacagtctc

SEQ ID NO: 513157 - DNA, 12 bp, Homo sapiens
caggcacaggca

SEQ ID NO: 513158 - DNA, 14 bp, Homo sapiens
caggcacaggcagg

SEQ ID NO: 513159 - DNA, 15 bp, Homo sapiens
caggcacaggcaggg

SEQ ID NO: 513160 - DNA, 18 bp, Homo sapiens
caggcacaggcagggcag

SEQ ID NO: 513161 - DNA, 18 bp, Homo sapiens
caggcagggcaggaccag

SEQ ID NO: 513162 - DNA, 13 bp, Homo sapiens
caggcaggggtgg

SEQ ID NO: 513163 - DNA, 22 bp, Homo sapiens
caggcaggggtgggggtggagg

SEQ ID NO: 513164 - DNA, 22 bp, Homo sapiens
caggcagttttgaaatgaaaat

SEQ ID NO: 513165 - DNA, 15 bp, Homo sapiens
caggcccaccctgct

SEQ ID NO: 513166 - DNA, 16 bp, Homo sapiens
caggctcactgccagg

SEQ ID NO: 513167 - DNA, 20 bp, Homo sapiens
caggctcactgccaggccag

SEQ ID NO: 513168 - DNA, 22 bp, Homo sapiens
caggctcactgccaggccagcc

SEQ ID NO: 513169 - DNA, 17 bp, Homo sapiens
caggctgagtgcaggcc

SEQ ID NO: 513170 - DNA, 19 bp, Homo sapiens
caggctgagtgcaggccca

SEQ ID NO: 513171 - DNA, 22 bp, Homo sapiens
caggctgagtgcaggcccaccc

SEQ ID NO: 513172 - DNA, 23 bp, Homo sapiens
caggctgagtgcaggcccaccct

SEQ ID NO: 513173 - DNA, 21 bp, Homo sapiens
caggctgggctgggcactgct

SEQ ID NO: 513174 - DNA, 16 bp, Homo sapiens
cagggcacagggcctg

SEQ ID NO: 513175 - DNA, 13 bp, Homo sapiens
cagggcaggacca

SEQ ID NO: 513176 - DNA, 19 bp, Homo sapiens
cagggcaggaccagcccac

SEQ ID NO: 513177 - DNA, 12 bp, Homo sapiens
cagggggcttcc

SEQ ID NO: 513178 - DNA, 22 bp, Homo sapiens
cagggggcttcctgaggggaga

SEQ ID NO: 513179 - DNA, 12 bp, Homo sapiens
caggggtggggg

SEQ ID NO: 513180 - DNA, 20 bp, Homo sapiens
caggggtgggggtggaggct

SEQ ID NO: 513181 - DNA, 22 bp, Homo sapiens
caggggtgggggtggaggcttc

SEQ ID NO: 513182 - DNA, 19 bp, Homo sapiens
caggggttccttctgggca

SEQ ID NO: 513183 - DNA, 20 bp, Homo sapiens
caggggttccttctgggcat

SEQ ID NO: 513184 - DNA, 21 bp, Homo sapiens
caggggttccttctgggcatt

SEQ ID NO: 513185 - DNA, 14 bp, Homo sapiens
caggtaccagctgc

SEQ ID NO: 513186 - DNA, 15 bp, Homo sapiens
caggtaccagctgcg

SEQ ID NO: 513187 - DNA, 18 bp, Homo sapiens
cagtaattcgtttgctag

SEQ ID NO: 513188 - DNA, 14 bp, Homo sapiens
cagtaatttctgag

SEQ ID NO: 513189 - DNA, 14 bp, Homo sapiens
cagtcccagcagcc

SEQ ID NO: 513190 - DNA, 15 bp, Homo sapiens
cagtcccagcagcca

SEQ ID NO: 513191 - DNA, 12 bp, Homo sapiens
cagtccccaccc

SEQ ID NO: 513192 - DNA, 13 bp, Homo sapiens
cagtccccacccc

SEQ ID NO: 513193 - DNA, 15 bp, Homo sapiens
cagtccccacccctg

SEQ ID NO: 513194 - DNA, 19 bp, Homo sapiens
cagtccccacccctgcccc

SEQ ID NO: 513195 - DNA, 21 bp, Homo sapiens
cagtctcaccatttccccagg

SEQ ID NO: 513196 - DNA, 18 bp, Homo sapiens
cagtctcctatacccagc

SEQ ID NO: 513197 - DNA, 19 bp, Homo sapiens
cagtctcctatacccagca

SEQ ID NO: 513198 - DNA, 22 bp, Homo sapiens
cagtgcccaggtggctgtggaa

SEQ ID NO: 513199 - DNA, 13 bp, Homo sapiens
cagtggcagggca

SEQ ID NO: 513200 - DNA, 20 bp, Homo sapiens
cagtggttttatactgaagg

SEQ ID NO: 513201 - DNA, 18 bp, Homo sapiens
cagtgtagtgcttttaaa

SEQ ID NO: 513202 - DNA, 22 bp, Homo sapiens
cagttgaagaaaaaatggcaag

SEQ ID NO: 513203 - DNA, 20 bp, Homo sapiens
catagaggcttctccgccag

SEQ ID NO: 513204 - DNA, 21 bp, Homo sapiens
catagaggcttctccgccagc

SEQ ID NO: 513205 - DNA, 23 bp, Homo sapiens
catagaggcttctccgccagcct

SEQ ID NO: 513206 - DNA, 21 bp, Homo sapiens
catagattcctggttatccta

SEQ ID NO: 513207 - DNA, 15 bp, Homo sapiens
catatttaaagccaa

SEQ ID NO: 513208 - DNA, 21 bp, Homo sapiens
catatttcccttacaattaat

SEQ ID NO: 513209 - DNA, 14 bp, Homo sapiens
catcatctccaaac

SEQ ID NO: 513210 - DNA, 13 bp, Homo sapiens
catccatgtgttc

SEQ ID NO: 513211 - DNA, 15 bp, Homo sapiens
catctatctcaatcc

SEQ ID NO: 513212 - DNA, 17 bp, Homo sapiens
catctgcaccccttctc

SEQ ID NO: 513213 - DNA, 22 bp, Homo sapiens
catctgcaccccttctctcctc

SEQ ID NO: 513214 - DNA, 18 bp, Homo sapiens
catctgccttaaaaccaa

SEQ ID NO: 513215 - DNA, 13 bp, Homo sapiens
catgaatgtaaat

SEQ ID NO: 513216 - DNA, 14 bp, Homo sapiens
catgaatgtaaatt

SEQ ID NO: 513217 - DNA, 22 bp, Homo sapiens
catgaatgtaaatttgtactat

SEQ ID NO: 513218 - DNA, 14 bp, Homo sapiens
catgattagcataa

SEQ ID NO: 513219 - DNA, 19 bp, Homo sapiens
catgcccaccccctgccct

SEQ ID NO: 513220 - DNA, 21 bp, Homo sapiens
catgcccaccccctgccctgc

SEQ ID NO: 513221 - DNA, 22 bp, Homo sapiens
catgcccaccccctgccctgca

SEQ ID NO: 513222 - DNA, 23 bp, Homo sapiens
catgcccaccccctgccctgcac

SEQ ID NO: 513223 - DNA, 12 bp, Homo sapiens
catgctgtctgg

SEQ ID NO: 513224 - DNA, 19 bp, Homo sapiens
catgctgtctggcacagcc

SEQ ID NO: 513225 - DNA, 20 bp, Homo sapiens
catgctgtctggcacagcct

SEQ ID NO: 513226 - DNA, 21 bp, Homo sapiens
catgctgtctggcacagcctg

SEQ ID NO: 513227 - DNA, 13 bp, Homo sapiens
catggattgtaca

SEQ ID NO: 513228 - DNA, 16 bp, Homo sapiens
catggggtctctcaca

SEQ ID NO: 513229 - DNA, 19 bp, Homo sapiens
catggggtctctcacagac

SEQ ID NO: 513230 - DNA, 13 bp, Homo sapiens
catggtgcctgag

SEQ ID NO: 513231 - DNA, 19 bp, Homo sapiens
catggtgcctgagaggcag

SEQ ID NO: 513232 - DNA, 22 bp, Homo sapiens
catggtgcctgagaggcaggca

SEQ ID NO: 513233 - DNA, 17 bp, Homo sapiens
catgtaacttttttatt

SEQ ID NO: 513234 - DNA, 12 bp, Homo sapiens
catgtatggcca

SEQ ID NO: 513235 - DNA, 19 bp, Homo sapiens
catgtattttgtaaactga

SEQ ID NO: 513236 - DNA, 11 bp, Homo sapiens
catgtgttcca

SEQ ID NO: 513237 - DNA, 22 bp, Homo sapiens
catgtgttccaaatttgcttta

SEQ ID NO: 513238 - DNA, 12 bp, Homo sapiens
aaaaaatggcaa

SEQ ID NO: 513239 - DNA, 22 bp, Homo sapiens
aaaaagtgggttttttagttga

SEQ ID NO: 513240 - DNA, 23 bp, Homo sapiens
aaaaagtgggttttttagttgaa

SEQ ID NO: 513241 - DNA, 19 bp, Homo sapiens
aaaaatataaaatttctgg

SEQ ID NO: 513242 - DNA, 15 bp, Homo sapiens
aaaaatggcaagaga

SEQ ID NO: 513243 - DNA, 18 bp, Homo sapiens
aaaaatggcaagagatca

SEQ ID NO: 513244 - DNA, 18 bp, Homo sapiens
aaaacttcactccaaaga

SEQ ID NO: 513245 - DNA, 20 bp, Homo sapiens
aaaacttcactccaaagaga

SEQ ID NO: 513246 - DNA, 14 bp, Homo sapiens
aaaagcccaggagc

SEQ ID NO: 513247 - DNA, 18 bp, Homo sapiens
aaaaggaacccaattttc

SEQ ID NO: 513248 - DNA, 23 bp, Homo sapiens
aaaagtgggttttttagttgaat

SEQ ID NO: 513249 - DNA, 16 bp, Homo sapiens
aaaagtttgttttact

SEQ ID NO: 513250 - DNA, 17 bp, Homo sapiens
aaaatggcaagagatca

SEQ ID NO: 513251 - DNA, 19 bp, Homo sapiens
aaaattcaacccatttact

SEQ ID NO: 513252 - DNA, 13 bp, Homo sapiens
aaaattttgcaga

SEQ ID NO: 513253 - DNA, 14 bp, Homo sapiens
aaacagaaattgca

SEQ ID NO: 513254 - DNA, 23 bp, Homo sapiens
aaacagctatttcccttttctgt

SEQ ID NO: 513255 - DNA, 17 bp, Homo sapiens
aaacagttatacagatg

SEQ ID NO: 513256 - DNA, 17 bp, Homo sapiens
aaacattctttcctaaa

SEQ ID NO: 513257 - DNA, 20 bp, Homo sapiens
aaaccaaagagggcttcctc

SEQ ID NO: 513258 - DNA, 20 bp, Homo sapiens
aaaccaaagagtattcagtg

SEQ ID NO: 513259 - DNA, 21 bp, Homo sapiens
aaacctattaagtcatcatct

SEQ ID NO: 513260 - DNA, 15 bp, Homo sapiens
aaacctttttctagt

SEQ ID NO: 513261 - DNA, 19 bp, Homo sapiens
aaacttcactccaaagaga

SEQ ID NO: 513262 - DNA, 22 bp, Homo sapiens
aaacttgaacttgcaggcaagc

SEQ ID NO: 513263 - DNA, 12 bp, Homo sapiens
aaagaaagactg

SEQ ID NO: 513264 - DNA, 12 bp, Homo sapiens
aaagaatttttg

SEQ ID NO: 513265 - DNA, 13 bp, Homo sapiens
aaagaatttttgc

SEQ ID NO: 513266 - DNA, 15 bp, Homo sapiens
aaagagcccttgcct

SEQ ID NO: 513267 - DNA, 17 bp, Homo sapiens
aaagataatgcatattt

SEQ ID NO: 513268 - DNA, 20 bp, Homo sapiens
aaagataatgcatatttttg

SEQ ID NO: 513269 - DNA, 20 bp, Homo sapiens
aaagcagttgagattctcta

SEQ ID NO: 513270 - DNA, 14 bp, Homo sapiens
aaagcccaggagcc

SEQ ID NO: 513271 - DNA, 19 bp, Homo sapiens
aaaggcaaatctgactttt

SEQ ID NO: 513272 - DNA, 12 bp, Homo sapiens
aaaggcccagag

SEQ ID NO: 513273 - DNA, 18 bp, Homo sapiens
aaagtaccacattccatg

SEQ ID NO: 513274 - DNA, 22 bp, Homo sapiens
aaagtcagtgttgaattttatt

SEQ ID NO: 513275 - DNA, 16 bp, Homo sapiens
aaagtgaactctattt

SEQ ID NO: 513276 - DNA, 19 bp, Homo sapiens
aaagtgaactctattttga

SEQ ID NO: 513277 - DNA, 16 bp, Homo sapiens
aaagtttatcagatat

SEQ ID NO: 513278 - DNA, 20 bp, Homo sapiens
aaataattgccatagaaagt

SEQ ID NO: 513279 - DNA, 21 bp, Homo sapiens
aaatagcccagatcccaagag

SEQ ID NO: 513280 - DNA, 22 bp, Homo sapiens
aaatagcccagatcccaagaga

SEQ ID NO: 513281 - DNA, 17 bp, Homo sapiens
aaatataaaatttctgg

SEQ ID NO: 513282 - DNA, 17 bp, Homo sapiens
aaatcaatacactagtt

SEQ ID NO: 513283 - DNA, 22 bp, Homo sapiens
aaatcaatacactagttgtttc

SEQ ID NO: 513284 - DNA, 11 bp, Homo sapiens
aaatccaggac

SEQ ID NO: 513285 - DNA, 12 bp, Homo sapiens
aaatccaggacc

SEQ ID NO: 513286 - DNA, 19 bp, Homo sapiens
aaatccaggaccctgccag

SEQ ID NO: 513287 - DNA, 14 bp, Homo sapiens
aaatcttgtcatgt

SEQ ID NO: 513288 - DNA, 17 bp, Homo sapiens
aaatcttgtcatgtgta

SEQ ID NO: 513289 - DNA, 18 bp, Homo sapiens
aaatcttgtcatgtgtat

SEQ ID NO: 513290 - DNA, 19 bp, Homo sapiens
aaatcttgtcatgtgtata

SEQ ID NO: 513291 - DNA, 20 bp, Homo sapiens
aaatcttgtcatgtgtataa

SEQ ID NO: 513292 - DNA, 22 bp, Homo sapiens
aaatctttcaacttatttctga

SEQ ID NO: 513293 - DNA, 17 bp, Homo sapiens
aaatgaagatacagtgg

SEQ ID NO: 513294 - DNA, 19 bp, Homo sapiens
aaatgccaaagcagggaaa

SEQ ID NO: 513295 - DNA, 15 bp, Homo sapiens
aaatggcaatttttt

SEQ ID NO: 513296 - DNA, 18 bp, Homo sapiens
aaatgtagacaaagtgaa

SEQ ID NO: 513297 - DNA, 22 bp, Homo sapiens
aaatgtgtatttttgttgcagt

SEQ ID NO: 513298 - DNA, 13 bp, Homo sapiens
aaatttgtactat

SEQ ID NO: 513299 - DNA, 14 bp, Homo sapiens
aaattttaaagcct

SEQ ID NO: 513300 - DNA, 14 bp, Homo sapiens
aaattttgcagaag

SEQ ID NO: 513301 - DNA, 19 bp, Homo sapiens
aaattttgtcctttcatgt

SEQ ID NO: 513302 - DNA, 15 bp, Homo sapiens
aacaaagaaagagat

SEQ ID NO: 513303 - DNA, 16 bp, Homo sapiens
aacagttgaagaaaaa

SEQ ID NO: 513304 - DNA, 22 bp, Homo sapiens
aacagttgaagaaaaaatggca

SEQ ID NO: 513305 - DNA, 20 bp, Homo sapiens
aacataattttttttttctc

SEQ ID NO: 513306 - DNA, 12 bp, Homo sapiens
aaccaatttctt

SEQ ID NO: 513307 - DNA, 16 bp, Homo sapiens
aacccctcgcccagtc

SEQ ID NO: 513308 - DNA, 20 bp, Homo sapiens
aacccctggaccccagcctc

SEQ ID NO: 513309 - DNA, 22 bp, Homo sapiens
aacgctaaagagcccttgcctc

SEQ ID NO: 513310 - DNA, 17 bp, Homo sapiens
aactacatgaacacaaa

SEQ ID NO: 513311 - DNA, 22 bp, Homo sapiens
aactgactattcttgatgtaaa

SEQ ID NO: 513312 - DNA, 23 bp, Homo sapiens
aactgactattcttgatgtaaaa

SEQ ID NO: 513313 - DNA, 20 bp, Homo sapiens
ctgccaggcaggggtggggg

SEQ ID NO: 513314 - DNA, 23 bp, Homo sapiens
ctgccaggccagcctccgagagg

SEQ ID NO: 513315 - DNA, 16 bp, Homo sapiens
ctgccctggctgctgc

SEQ ID NO: 513316 - DNA, 17 bp, Homo sapiens
ctgccctggctgctgcc

SEQ ID NO: 513317 - DNA, 19 bp, Homo sapiens
ctgcctgccccgcccccag

SEQ ID NO: 513318 - DNA, 21 bp, Homo sapiens
ctgcctgccccgcccccagtc

SEQ ID NO: 513319 - DNA, 16 bp, Homo sapiens
ctgccttaaaaccaaa

SEQ ID NO: 513320 - DNA, 19 bp, Homo sapiens
ctgccttaaaaccaaagag

SEQ ID NO: 513321 - DNA, 11 bp, Homo sapiens
ctgccttccct

SEQ ID NO: 513322 - DNA, 12 bp, Homo sapiens
ctgccttcccta

SEQ ID NO: 513323 - DNA, 17 bp, Homo sapiens
ctgccttccctagcttt

SEQ ID NO: 513324 - DNA, 22 bp, Homo sapiens
ctgctaactacatgaacacaaa

SEQ ID NO: 513325 - DNA, 14 bp, Homo sapiens
ctgctcctgagccc

SEQ ID NO: 513326 - DNA, 16 bp, Homo sapiens
ctgctcctgagccccc

SEQ ID NO: 513327 - DNA, 17 bp, Homo sapiens
ctgctcctgagccccca

SEQ ID NO: 513328 - DNA, 18 bp, Homo sapiens
ctgctcctgagcccccag

SEQ ID NO: 513329 - DNA, 18 bp, Homo sapiens
ctgctgagccgcagagaa

SEQ ID NO: 513330 - DNA, 14 bp, Homo sapiens
ctgctggcacccac

SEQ ID NO: 513331 - DNA, 22 bp, Homo sapiens
ctgctgtgattccactacacct

SEQ ID NO: 513332 - DNA, 14 bp, Homo sapiens
ctgcttggcccagg

SEQ ID NO: 513333 - DNA, 14 bp, Homo sapiens
ctgcttttctgccc

SEQ ID NO: 513334 - DNA, 15 bp, Homo sapiens
ctgcttttctgccct

SEQ ID NO: 513335 - DNA, 19 bp, Homo sapiens
ctgcttttctgccctggct

SEQ ID NO: 513336 - DNA, 24 bp, Homo sapiens
ctgcttttctgccctggctgctgc

SEQ ID NO: 513337 - DNA, 15 bp, Homo sapiens
ctggaaaggggagag

SEQ ID NO: 513338 - DNA, 23 bp, Homo sapiens
ctggaaaggggagagcctgctgg

SEQ ID NO: 513339 - DNA, 14 bp, Homo sapiens
ctggaagcagtgcc

SEQ ID NO: 513340 - DNA, 18 bp, Homo sapiens
ctggaagcagtgcccagg

SEQ ID NO: 513341 - DNA, 12 bp, Homo sapiens
ctggaccccagc

SEQ ID NO: 513342 - DNA, 14 bp, Homo sapiens
ctggaccccagcct

SEQ ID NO: 513343 - DNA, 15 bp, Homo sapiens
ctggaccccagcctc

SEQ ID NO: 513344 - DNA, 16 bp, Homo sapiens
ctggaccccagcctca

SEQ ID NO: 513345 - DNA, 21 bp, Homo sapiens
ctggacggcaggctcactgcc

SEQ ID NO: 513346 - DNA, 18 bp, Homo sapiens
ctggagaggagccctgcc

SEQ ID NO: 513347 - DNA, 21 bp, Homo sapiens
ctggagaggagccctgcctct

SEQ ID NO: 513348 - DNA, 13 bp, Homo sapiens
ctggcacagcctg

SEQ ID NO: 513349 - DNA, 14 bp, Homo sapiens
ctggcacagcctgc

SEQ ID NO: 513350 - DNA, 21 bp, Homo sapiens
ctggcatggtggttgggaccc

SEQ ID NO: 513351 - DNA, 21 bp, Homo sapiens
ctggcccatgtatggccagga

SEQ ID NO: 513352 - DNA, 22 bp, Homo sapiens
ctggccctctctgaaggaggcc

SEQ ID NO: 513353 - DNA, 14 bp, Homo sapiens
ctggctccctcact

SEQ ID NO: 513354 - DNA, 20 bp, Homo sapiens
ctggctccctcactctcagg

SEQ ID NO: 513355 - DNA, 21 bp, Homo sapiens
ctggctccctcactctcagga

SEQ ID NO: 513356 - DNA, 19 bp, Homo sapiens
ctggctgaggttcctctgc

SEQ ID NO: 513357 - DNA, 19 bp, Homo sapiens
ctggctgctgcccccaccc

SEQ ID NO: 513358 - DNA, 21 bp, Homo sapiens
ctgggatgtggtattggtgct

SEQ ID NO: 513359 - DNA, 17 bp, Homo sapiens
ctgggcactgctctcac

SEQ ID NO: 513360 - DNA, 13 bp, Homo sapiens
ctgggctgggcac

SEQ ID NO: 513361 - DNA, 12 bp, Homo sapiens
ctgggcttttcc

SEQ ID NO: 513362 - DNA, 20 bp, Homo sapiens
ctgggcttttccttttgcac

SEQ ID NO: 513363 - DNA, 16 bp, Homo sapiens
ctgggggatgggcctg

SEQ ID NO: 513364 - DNA, 15 bp, Homo sapiens
ctgggtgggctctgt

SEQ ID NO: 513365 - DNA, 16 bp, Homo sapiens
ctgggttagactgcca

SEQ ID NO: 513366 - DNA, 19 bp, Homo sapiens
ctgggttagactgccagct

SEQ ID NO: 513367 - DNA, 21 bp, Homo sapiens
ctgtaaaatgtgggattatgg

SEQ ID NO: 513368 - DNA, 18 bp, Homo sapiens
ctgtctggcacagcctgc

SEQ ID NO: 513369 - DNA, 19 bp, Homo sapiens
ctgtcttttctgggatgtg

SEQ ID NO: 513370 - DNA, 17 bp, Homo sapiens
ctgtgacatggtgcctg

SEQ ID NO: 513371 - DNA, 19 bp, Homo sapiens
ctgtgacatggtgcctgag

SEQ ID NO: 513372 - DNA, 21 bp, Homo sapiens
ctgtgacatggtgcctgagag

SEQ ID NO: 513373 - DNA, 22 bp, Homo sapiens
ctgtgacatggtgcctgagagg

SEQ ID NO: 513374 - DNA, 24 bp, Homo sapiens
ctgtgacatggtgcctgagaggca

SEQ ID NO: 513375 - DNA, 18 bp, Homo sapiens
ctgtgagatggatgtatt

SEQ ID NO: 513376 - DNA, 21 bp, Homo sapiens
ctgtgagatggatgtatttgt

SEQ ID NO: 513377 - DNA, 14 bp, Homo sapiens
ctgtgcgtggggct

SEQ ID NO: 513378 - DNA, 21 bp, Homo sapiens
ctgtggagactgctcctgagc

SEQ ID NO: 513379 - DNA, 14 bp, Homo sapiens
ctgttggtcagagg

SEQ ID NO: 513380 - DNA, 15 bp, Homo sapiens
ctgtttatttgatga

SEQ ID NO: 513381 - DNA, 12 bp, Homo sapiens
ctgtttcctgtg

SEQ ID NO: 513382 - DNA, 16 bp, Homo sapiens
ctgtttcctgtgtctc

SEQ ID NO: 513383 - DNA, 18 bp, Homo sapiens
ctgtttcctgtgtctcca

SEQ ID NO: 513384 - DNA, 21 bp, Homo sapiens
cttaaaaccaaagagggcttc

SEQ ID NO: 513385 - DNA, 18 bp, Homo sapiens
cttacacttaaaagaaaa

SEQ ID NO: 513386 - DNA, 11 bp, Homo sapiens
cttattttatt

SEQ ID NO: 513387 - DNA, 17 bp, Homo sapiens
cttcaccttagggaaga

SEQ ID NO: 513388 - DNA, 17 bp, Homo sapiens
cttcactccaaagagaa

SEQ ID NO: 513389 - DNA, 11 bp, Homo sapiens
cttccagcagg

SEQ ID NO: 513390 - DNA, 21 bp, Homo sapiens
cttccaggaaactccacatct

SEQ ID NO: 513391 - DNA, 22 bp, Homo sapiens
cttccaggaaactccacatctg

SEQ ID NO: 513392 - DNA, 23 bp, Homo sapiens
cttccctagctttagaccctggg

SEQ ID NO: 513393 - DNA, 22 bp, Homo sapiens
cttccctgggttagactgccag

SEQ ID NO: 513394 - DNA, 23 bp, Homo sapiens
cttccctgggttagactgccagc

SEQ ID NO: 513395 - DNA, 20 bp, Homo sapiens
cttcctagctggagaggagc

SEQ ID NO: 513396 - DNA, 19 bp, Homo sapiens
cttcctctagaagccaagg

SEQ ID NO: 513397 - DNA, 13 bp, Homo sapiens
cttcctgagggga

SEQ ID NO: 513398 - DNA, 15 bp, Homo sapiens
cttcctgcgtcctcc

SEQ ID NO: 513399 - DNA, 16 bp, Homo sapiens
cttccttttccctgct

SEQ ID NO: 513400 - DNA, 13 bp, Homo sapiens
cttctcccctgca

SEQ ID NO: 513401 - DNA, 17 bp, Homo sapiens
cttctcccctgcactgt

SEQ ID NO: 513402 - DNA, 18 bp, Homo sapiens
cttctcccctgcactgta

SEQ ID NO: 513403 - DNA, 21 bp, Homo sapiens
cttctcccctgcactgtaaaa

SEQ ID NO: 513404 - DNA, 12 bp, Homo sapiens
cttctccgccag

SEQ ID NO: 513405 - DNA, 14 bp, Homo sapiens
cttctccgccagcc

SEQ ID NO: 513406 - DNA, 17 bp, Homo sapiens
cttctccgccagcctcc

SEQ ID NO: 513407 - DNA, 18 bp, Homo sapiens
cttctccgccagcctcct

SEQ ID NO: 513408 - DNA, 21 bp, Homo sapiens
cttctccgccagcctcctctg

SEQ ID NO: 513409 - DNA, 15 bp, Homo sapiens
cttctctcctcccca

SEQ ID NO: 513410 - DNA, 22 bp, Homo sapiens
cttctgataatttattgtcttt

SEQ ID NO: 513411 - DNA, 16 bp, Homo sapiens
cttctgcttttctgcc

SEQ ID NO: 513412 - DNA, 17 bp, Homo sapiens
cttctgcttttctgccc

SEQ ID NO: 513413 - DNA, 19 bp, Homo sapiens
cttctgcttttctgccctg

SEQ ID NO: 513414 - DNA, 17 bp, Homo sapiens
cttgaaatcaagagaca

SEQ ID NO: 513415 - DNA, 19 bp, Homo sapiens
cttgaacttgcaggcaagc

SEQ ID NO: 513416 - DNA, 12 bp, Homo sapiens
cttgaagccaaa

SEQ ID NO: 513417 - DNA, 14 bp, Homo sapiens
cttgaagccaaaga

SEQ ID NO: 513418 - DNA, 13 bp, Homo sapiens
cttgatgtaaaat

SEQ ID NO: 513419 - DNA, 13 bp, Homo sapiens
cttgcaggcaagc

SEQ ID NO: 513420 - DNA, 12 bp, Homo sapiens
cttgccagctgc

SEQ ID NO: 513421 - DNA, 12 bp, Homo sapiens
cttgcctcccca

SEQ ID NO: 513422 - DNA, 14 bp, Homo sapiens
cttgcctccccatt

SEQ ID NO: 513423 - DNA, 13 bp, Homo sapiens
cttgctagaaaca

SEQ ID NO: 513424 - DNA, 15 bp, Homo sapiens
cttggcccagggggc

SEQ ID NO: 513425 - DNA, 15 bp, Homo sapiens
gctgctgagccgcag

SEQ ID NO: 513426 - DNA, 17 bp, Homo sapiens
gctggagaggagccctg

SEQ ID NO: 513427 - DNA, 18 bp, Homo sapiens
gctggagaggagccctgc

SEQ ID NO: 513428 - DNA, 19 bp, Homo sapiens
gctgggcactgctctcacc

SEQ ID NO: 513429 - DNA, 20 bp, Homo sapiens
gcttacacttaaaagaaaac

SEQ ID NO: 513430 - DNA, 21 bp, Homo sapiens
gcttccaggaaactccacatc

SEQ ID NO: 513431 - DNA, 16 bp, Homo sapiens
gcttctccgccagcct

SEQ ID NO: 513432 - DNA, 15 bp, Homo sapiens
gcttctgcttttctg

SEQ ID NO: 513433 - DNA, 14 bp, Homo sapiens
gcttgaagccaaag

SEQ ID NO: 513434 - DNA, 16 bp, Homo sapiens
gcttgaagccaaagaa

SEQ ID NO: 513435 - DNA, 12 bp, Homo sapiens
gcttgagccggg

SEQ ID NO: 513436 - DNA, 18 bp, Homo sapiens
gcttgagccgggcccctg

SEQ ID NO: 513437 - DNA, 22 bp, Homo sapiens
gcttgagccgggcccctgggct

SEQ ID NO: 513438 - DNA, 14 bp, Homo sapiens
gcttggcctgctgt

SEQ ID NO: 513439 - DNA, 17 bp, Homo sapiens
gcttttaaaaattttgt

SEQ ID NO: 513440 - DNA, 16 bp, Homo sapiens
gcttttatagaggcta

SEQ ID NO: 513441 - DNA, 12 bp, Homo sapiens
gcttttcctttt

SEQ ID NO: 513442 - DNA, 16 bp, Homo sapiens
gcttttctgccctggc

SEQ ID NO: 513443 - DNA, 17 bp, Homo sapiens
gcttttctgccctggct

SEQ ID NO: 513444 - DNA, 18 bp, Homo sapiens
gcttttctgccctggctg

SEQ ID NO: 513445 - DNA, 12 bp, Homo sapiens
gctttttgtact

SEQ ID NO: 513446 - DNA, 19 bp, Homo sapiens
gctttttgtactgtagttc

SEQ ID NO: 513447 - DNA, 20 bp, Homo sapiens
gctttttgtactgtagttca

SEQ ID NO: 513448 - DNA, 23 bp, Homo sapiens
ggaaaacttcactccaaagagaa

SEQ ID NO: 513449 - DNA, 18 bp, Homo sapiens
ggaaaggggagagcctgc

SEQ ID NO: 513450 - DNA, 19 bp, Homo sapiens
ggaaaggggagagcctgct

SEQ ID NO: 513451 - DNA, 13 bp, Homo sapiens
ggaacgcccactt

SEQ ID NO: 513452 - DNA, 16 bp, Homo sapiens
ggaagaagggagaaga

SEQ ID NO: 513453 - DNA, 16 bp, Homo sapiens
ggaaggacacattgtt

SEQ ID NO: 513454 - DNA, 15 bp, Homo sapiens
ggaagtagcacaggc

SEQ ID NO: 513455 - DNA, 17 bp, Homo sapiens
ggaagtagcacaggctg

SEQ ID NO: 513456 - DNA, 15 bp, Homo sapiens
ggacaggggttcctt

SEQ ID NO: 513457 - DNA, 19 bp, Homo sapiens
ggaccatgctgtctggcac

SEQ ID NO: 513458 - DNA, 20 bp, Homo sapiens
ggaccatgctgtctggcaca

SEQ ID NO: 513459 - DNA, 14 bp, Homo sapiens
ggacccagtggcag

SEQ ID NO: 513460 - DNA, 14 bp, Homo sapiens
ggaccccagcctca

SEQ ID NO: 513461 - DNA, 15 bp, Homo sapiens
ggaccccagcctcaa

SEQ ID NO: 513462 - DNA, 17 bp, Homo sapiens
ggaccctgccaggcaca

SEQ ID NO: 513463 - DNA, 18 bp, Homo sapiens
ggaccctgccaggcacag

SEQ ID NO: 513464 - DNA, 22 bp, Homo sapiens
ggaccctgccaggcacaggcag

SEQ ID NO: 513465 - DNA, 17 bp, Homo sapiens
ggactgccacctcccct

SEQ ID NO: 513466 - DNA, 21 bp, Homo sapiens
ggactgccacctccccttgcc

SEQ ID NO: 513467 - DNA, 23 bp, Homo sapiens
ggactgccacctccccttgccag

SEQ ID NO: 513468 - DNA, 16 bp, Homo sapiens
ggagaatcacaggctg

SEQ ID NO: 513469 - DNA, 18 bp, Homo sapiens
ggagactgctcctgagcc

SEQ ID NO: 513470 - DNA, 23 bp, Homo sapiens
ggagcccatttggagggcctggg

SEQ ID NO: 513471 - DNA, 12 bp, Homo sapiens
ggagccctgcct

SEQ ID NO: 513472 - DNA, 13 bp, Homo sapiens
ggaggaaggcaag

SEQ ID NO: 513473 - DNA, 14 bp, Homo sapiens
ggaggaaggcaaga

SEQ ID NO: 513474 - DNA, 13 bp, Homo sapiens
ggaggaggaaggc

SEQ ID NO: 513475 - DNA, 12 bp, Homo sapiens
ggaggagggaga

SEQ ID NO: 513476 - DNA, 13 bp, Homo sapiens
ggaggagggagag

SEQ ID NO: 513477 - DNA, 18 bp, Homo sapiens
ggaggccacctcctaaaa

SEQ ID NO: 513478 - DNA, 17 bp, Homo sapiens
ggaggggtgtggcagtg

SEQ ID NO: 513479 - DNA, 20 bp, Homo sapiens
ggaggtggaagaagggagaa

SEQ ID NO: 513480 - DNA, 23 bp, Homo sapiens
ggatatctacattataccgcaga

SEQ ID NO: 513481 - DNA, 19 bp, Homo sapiens
ggattactgacttttcttt

SEQ ID NO: 513482 - DNA, 15 bp, Homo sapiens
ggcaaatctgacttt

SEQ ID NO: 513483 - DNA, 22 bp, Homo sapiens
ggcaagactctgccttaatttt

SEQ ID NO: 513484 - DNA, 14 bp, Homo sapiens
ggcacagcctgcac

SEQ ID NO: 513485 - DNA, 12 bp, Homo sapiens
ggcacaggcagg

SEQ ID NO: 513486 - DNA, 13 bp, Homo sapiens
ggcacaggcaggg

SEQ ID NO: 513487 - DNA, 16 bp, Homo sapiens
ggcacaggcagggcag

SEQ ID NO: 513488 - DNA, 12 bp, Homo sapiens
ggcacagggcct

SEQ ID NO: 513489 - DNA, 15 bp, Homo sapiens
ggcacagggcctggc

SEQ ID NO: 513490 - DNA, 14 bp, Homo sapiens
ggcactatattttt

SEQ ID NO: 513491 - DNA, 21 bp, Homo sapiens
ggcactgttgtcatttccaaa

SEQ ID NO: 513492 - DNA, 15 bp, Homo sapiens
ggcaggaccagccca

SEQ ID NO: 513493 - DNA, 16 bp, Homo sapiens
ggcaggaccagcccac

SEQ ID NO: 513494 - DNA, 17 bp, Homo sapiens
ggcaggaccagcccacg

SEQ ID NO: 513495 - DNA, 19 bp, Homo sapiens
ggcaggctcactgccaggc

SEQ ID NO: 513496 - DNA, 23 bp, Homo sapiens
ggcagggcacagggcctggccca

SEQ ID NO: 513497 - DNA, 18 bp, Homo sapiens
ggcataacaaaggcaaga

SEQ ID NO: 513498 - DNA, 22 bp, Homo sapiens
ggcatagaggcttctccgccag

SEQ ID NO: 513499 - DNA, 13 bp, Homo sapiens
ggcatccatgggg

SEQ ID NO: 513500 - DNA, 20 bp, Homo sapiens
ggcatcctggcattctcaaa

SEQ ID NO: 513501 - DNA, 19 bp, Homo sapiens
ggccaagagtggccccacc

SEQ ID NO: 513502 - DNA, 11 bp, Homo sapiens
ggccacctcct

SEQ ID NO: 513503 - DNA, 20 bp, Homo sapiens
ggccacctcttcctggccgg

SEQ ID NO: 513504 - DNA, 16 bp, Homo sapiens
ggccagcctccgagag

SEQ ID NO: 513505 - DNA, 23 bp, Homo sapiens
ggccaggaagtagcacaggctga

SEQ ID NO: 513506 - DNA, 21 bp, Homo sapiens
ggcccaccctgcttggcccag

SEQ ID NO: 513507 - DNA, 22 bp, Homo sapiens
ggcccaccctgcttggcccagg

SEQ ID NO: 513508 - DNA, 19 bp, Homo sapiens
ggcccagggggcttcctga

SEQ ID NO: 513509 - DNA, 13 bp, Homo sapiens
ggccccacctggc

SEQ ID NO: 513510 - DNA, 15 bp, Homo sapiens
ggccccacctggccc

SEQ ID NO: 513511 - DNA, 20 bp, Homo sapiens
ggcctgagtgagaggggagg

SEQ ID NO: 513512 - DNA, 22 bp, Homo sapiens
ggcctgagtgagaggggaggcc

SEQ ID NO: 513513 - DNA, 14 bp, Homo sapiens
ggcctggctccctc

SEQ ID NO: 513514 - DNA, 22 bp, Homo sapiens
ggctagcttctgcttttctgcc

SEQ ID NO: 513515 - DNA, 20 bp, Homo sapiens
ggctattaactgccaaaaca

SEQ ID NO: 513516 - DNA, 21 bp, Homo sapiens
ggctcactgccaggccagcct

SEQ ID NO: 513517 - DNA, 22 bp, Homo sapiens
ggctcactgccaggccagcctc

SEQ ID NO: 513518 - DNA, 14 bp, Homo sapiens
ggctcagcaaggcc

SEQ ID NO: 513519 - DNA, 17 bp, Homo sapiens
ggctcagcaaggccacc

SEQ ID NO: 513520 - DNA, 20 bp, Homo sapiens
ggctcagcaaggccacctct

SEQ ID NO: 513521 - DNA, 17 bp, Homo sapiens
ggctcccgcctccaacc

SEQ ID NO: 513522 - DNA, 20 bp, Homo sapiens
ggctgaggttcctctgcctg

SEQ ID NO: 513523 - DNA, 17 bp, Homo sapiens
ggctgagtgcaggccca

SEQ ID NO: 513524 - DNA, 11 bp, Homo sapiens
ggctgctgccc

SEQ ID NO: 513525 - DNA, 19 bp, Homo sapiens
ggctgggggatgggcctga

SEQ ID NO: 513526 - DNA, 20 bp, Homo sapiens
ggcttcctgaggggagacag

SEQ ID NO: 513527 - DNA, 16 bp, Homo sapiens
ggcttctccgccagcc

SEQ ID NO: 513528 - DNA, 13 bp, Homo sapiens
ggcttgaagccaa

SEQ ID NO: 513529 - DNA, 20 bp, Homo sapiens
ggcttgaagccaaagaaaaa

SEQ ID NO: 513530 - DNA, 14 bp, Homo sapiens
ggcttggcctgctg

SEQ ID NO: 513531 - DNA, 16 bp, Homo sapiens
ggcttttccttttgca

SEQ ID NO: 513532 - DNA, 20 bp, Homo sapiens
gggaacgcccacttccctgg

SEQ ID NO: 513533 - DNA, 15 bp, Homo sapiens
gggacagtctcacca

SEQ ID NO: 513534 - DNA, 14 bp, Homo sapiens
gggactgccacctc

SEQ ID NO: 513535 - DNA, 16 bp, Homo sapiens
gggactgccacctccc

SEQ ID NO: 513536 - DNA, 22 bp, Homo sapiens
gggagaagaaaggtgagtttga

SEQ ID NO: 513537 - DNA, 20 bp, Homo sapiens
tagggcggcaaatgccaaag

SEQ ID NO: 513538 - DNA, 19 bp, Homo sapiens
tagtgcttttaaaaatttt

SEQ ID NO: 513539 - DNA, 22 bp, Homo sapiens
tataaaaataaaaaagatccca

SEQ ID NO: 513540 - DNA, 14 bp, Homo sapiens
tataaaatttctgg

SEQ ID NO: 513541 - DNA, 21 bp, Homo sapiens
tataaagtttatcagatattt

SEQ ID NO: 513542 - DNA, 21 bp, Homo sapiens
tatagaggctagcttctgctt

SEQ ID NO: 513543 - DNA, 13 bp, Homo sapiens
tatatttttctgg

SEQ ID NO: 513544 - DNA, 17 bp, Homo sapiens
tatcagatattttcata

SEQ ID NO: 513545 - DNA, 20 bp, Homo sapiens
tatcagatattttcatattt

SEQ ID NO: 513546 - DNA, 16 bp, Homo sapiens
tatgatctatgctata

SEQ ID NO: 513547 - DNA, 20 bp, Homo sapiens
tatgattgtatttgtgtata

SEQ ID NO: 513548 - DNA, 22 bp, Homo sapiens
tatggccaggaagtagcacagg

SEQ ID NO: 513549 - DNA, 22 bp, Homo sapiens
tatgtcttattttattatttct

SEQ ID NO: 513550 - DNA, 15 bp, Homo sapiens
tattaactgccaaaa

SEQ ID NO: 513551 - DNA, 13 bp, Homo sapiens
tattatttctaaa

SEQ ID NO: 513552 - DNA, 16 bp, Homo sapiens
tattcccttttaaaga

SEQ ID NO: 513553 - DNA, 14 bp, Homo sapiens
tattgaaagctcat

SEQ ID NO: 513554 - DNA, 14 bp, Homo sapiens
tattggtgctttgt

SEQ ID NO: 513555 - DNA, 11 bp, Homo sapiens
tattgtcttta

SEQ ID NO: 513556 - DNA, 11 bp, Homo sapiens
tatttaactga

SEQ ID NO: 513557 - DNA, 15 bp, Homo sapiens
tatttagacaagaga

SEQ ID NO: 513558 - DNA, 16 bp, Homo sapiens
tatttcccttttctgt

SEQ ID NO: 513559 - DNA, 18 bp, Homo sapiens
tatttcccttttctgtgt

SEQ ID NO: 513560 - DNA, 18 bp, Homo sapiens
tatttctgaaaaagagaa

SEQ ID NO: 513561 - DNA, 21 bp, Homo sapiens
tattttcaatgaaacaaagaa

SEQ ID NO: 513562 - DNA, 23 bp, Homo sapiens
tattttcaatgaaacaaagaaag

SEQ ID NO: 513563 - DNA, 14 bp, Homo sapiens
tatttttgcacagt

SEQ ID NO: 513564 - DNA, 19 bp, Homo sapiens
tatttttttttctaagaga

SEQ ID NO: 513565 - DNA, 17 bp, Homo sapiens
tcaaaatatttgtcctt

SEQ ID NO: 513566 - DNA, 14 bp, Homo sapiens
tcaaaccaaagagt

SEQ ID NO: 513567 - DNA, 22 bp, Homo sapiens
tcaaaccaaagagtattcagtg

SEQ ID NO: 513568 - DNA, 18 bp, Homo sapiens
tcaaagtggcaagtattt

SEQ ID NO: 513569 - DNA, 19 bp, Homo sapiens
tcaaagtggcaagtatttg

SEQ ID NO: 513570 - DNA, 22 bp, Homo sapiens
tcaaagtggcaagtatttggct

SEQ ID NO: 513571 - DNA, 15 bp, Homo sapiens
tcaacttatttctga

SEQ ID NO: 513572 - DNA, 16 bp, Homo sapiens
tcaacttatttctgaa

SEQ ID NO: 513573 - DNA, 14 bp, Homo sapiens
tcaagatacatgtt

SEQ ID NO: 513574 - DNA, 17 bp, Homo sapiens
tcaagatacatgttgta

SEQ ID NO: 513575 - DNA, 23 bp, Homo sapiens
tcaataatttgtggtgatttgga

SEQ ID NO: 513576 - DNA, 14 bp, Homo sapiens
tcaatacactagtt

SEQ ID NO: 513577 - DNA, 21 bp, Homo sapiens
tcaatcctaatttctcctccc

SEQ ID NO: 513578 - DNA, 13 bp, Homo sapiens
tcaatgaaacaaa

SEQ ID NO: 513579 - DNA, 16 bp, Homo sapiens
tcacaagtaaaggaga

SEQ ID NO: 513580 - DNA, 22 bp, Homo sapiens
tcacaagtaacagttgaagaaa

SEQ ID NO: 513581 - DNA, 11 bp, Homo sapiens
tcacagacagg

SEQ ID NO: 513582 - DNA, 20 bp, Homo sapiens
tcacagacaggacccctgca

SEQ ID NO: 513583 - DNA, 21 bp, Homo sapiens
tcacagacaggacccctgcag

SEQ ID NO: 513584 - DNA, 19 bp, Homo sapiens
tcacaggctgggctgggca

SEQ ID NO: 513585 - DNA, 16 bp, Homo sapiens
tcacagtgtgattttg

SEQ ID NO: 513586 - DNA, 19 bp, Homo sapiens
tcaccatttccccagggca

SEQ ID NO: 513587 - DNA, 20 bp, Homo sapiens
tcaccatttccccagggcac

SEQ ID NO: 513588 - DNA, 16 bp, Homo sapiens
tcaccatttggatcct

SEQ ID NO: 513589 - DNA, 23 bp, Homo sapiens
tcacctcatgcccaccccctgcc

SEQ ID NO: 513590 - DNA, 22 bp, Homo sapiens
tcactatggcactgttgtcatt

SEQ ID NO: 513591 - DNA, 14 bp, Homo sapiens
tcactccaaagaga

SEQ ID NO: 513592 - DNA, 11 bp, Homo sapiens
tcactgccagg

SEQ ID NO: 513593 - DNA, 14 bp, Homo sapiens
tcactgccaggcca

SEQ ID NO: 513594 - DNA, 18 bp, Homo sapiens
tcactgccaggccagcct

SEQ ID NO: 513595 - DNA, 19 bp, Homo sapiens
tcactgccaggccagcctc

SEQ ID NO: 513596 - DNA, 23 bp, Homo sapiens
tcactgccaggccagcctccgag

SEQ ID NO: 513597 - DNA, 18 bp, Homo sapiens
tcagagatcttggtatgg

SEQ ID NO: 513598 - DNA, 22 bp, Homo sapiens
tcagaggccccaataccccatg

SEQ ID NO: 513599 - DNA, 22 bp, Homo sapiens
tcagcaaagtagaatctctttt

SEQ ID NO: 513600 - DNA, 14 bp, Homo sapiens
tcagcaaggccacc

SEQ ID NO: 513601 - DNA, 23 bp, Homo sapiens
tcagcatggactgttcatttgaa

SEQ ID NO: 513602 - DNA, 23 bp, Homo sapiens
tcatatcctcagaccaggtggaa

SEQ ID NO: 513603 - DNA, 12 bp, Homo sapiens
tcatgaatgtaa

SEQ ID NO: 513604 - DNA, 14 bp, Homo sapiens
tcatgaatgtaaat

SEQ ID NO: 513605 - DNA, 21 bp, Homo sapiens
tcatgaatgtaaatttgtact

SEQ ID NO: 513606 - DNA, 19 bp, Homo sapiens
tcatgatgcgcttcaaagt

SEQ ID NO: 513607 - DNA, 16 bp, Homo sapiens
tcatgcccaccccctg

SEQ ID NO: 513608 - DNA, 16 bp, Homo sapiens
tcatgtaactttttta

SEQ ID NO: 513609 - DNA, 13 bp, Homo sapiens
tcatgtgtagtgt

SEQ ID NO: 513610 - DNA, 15 bp, Homo sapiens
tcatgtgtataaaaa

SEQ ID NO: 513611 - DNA, 12 bp, Homo sapiens
tcatttccaaat

SEQ ID NO: 513612 - DNA, 20 bp, Homo sapiens
tcatttccaaattcctagaa

SEQ ID NO: 513613 - DNA, 22 bp, Homo sapiens
tcatttgaaacctttttctagt

SEQ ID NO: 513614 - DNA, 11 bp, Homo sapiens
tcattttgcac

SEQ ID NO: 513615 - DNA, 22 bp, Homo sapiens
tcattttgcaccttattcagaa

SEQ ID NO: 513616 - DNA, 21 bp, Homo sapiens
tccaaactaaaccctcacaag

SEQ ID NO: 513617 - DNA, 13 bp, Homo sapiens
tccaacccctcgc

SEQ ID NO: 513618 - DNA, 14 bp, Homo sapiens
tccaacccctcgcc

SEQ ID NO: 513619 - DNA, 16 bp, Homo sapiens
tccaagcctctgtctt

SEQ ID NO: 513620 - DNA, 17 bp, Homo sapiens
tccaagcctctgtcttt

SEQ ID NO: 513621 - DNA, 18 bp, Homo sapiens
tccacatctgccttaaaa

SEQ ID NO: 513622 - DNA, 17 bp, Homo sapiens
tccactacacctggctg

SEQ ID NO: 513623 - DNA, 22 bp, Homo sapiens
tccagcaggagggacagtctca

SEQ ID NO: 513624 - DNA, 21 bp, Homo sapiens
tccaggaaactccacatctgc

SEQ ID NO: 513625 - DNA, 17 bp, Homo sapiens
tccaggaccctgccagg

SEQ ID NO: 513626 - DNA, 18 bp, Homo sapiens
tccaggaccctgccaggc

SEQ ID NO: 513627 - DNA, 19 bp, Homo sapiens
tccaggaccctgccaggca

SEQ ID NO: 513628 - DNA, 15 bp, Homo sapiens
tccatgacgcaggag

SEQ ID NO: 513629 - DNA, 14 bp, Homo sapiens
tccatgtgttccaa

SEQ ID NO: 513630 - DNA, 13 bp, Homo sapiens
tcccagcagccag

SEQ ID NO: 513631 - DNA, 18 bp, Homo sapiens
tcccaggtaccagctgcg

SEQ ID NO: 513632 - DNA, 13 bp, Homo sapiens
tcccatctgcacc

SEQ ID NO: 513633 - DNA, 19 bp, Homo sapiens
tcccatctgcaccccttct

SEQ ID NO: 513634 - DNA, 20 bp, Homo sapiens
tcccatttgctgtctttttg

SEQ ID NO: 513635 - DNA, 18 bp, Homo sapiens
tccccaaatcaatacact

SEQ ID NO: 513636 - DNA, 23 bp, Homo sapiens
tccccaaatcaatacactagttg

SEQ ID NO: 513637 - DNA, 15 bp, Homo sapiens
tccccacccctgccc

SEQ ID NO: 513638 - DNA, 16 bp, Homo sapiens
tccccacccctgcccc

SEQ ID NO: 513639 - DNA, 18 bp, Homo sapiens
tccccacccctgccccca

SEQ ID NO: 513640 - DNA, 13 bp, Homo sapiens
tccccagggcacg

SEQ ID NO: 513641 - DNA, 18 bp, Homo sapiens
tccccatttcccatctgc

SEQ ID NO: 513642 - DNA, 20 bp, Homo sapiens
tccccatttcccatctgcac

SEQ ID NO: 513643 - DNA, 15 bp, Homo sapiens
tccccctaaacacac

SEQ ID NO: 513644 - DNA, 13 bp, Homo sapiens
tcccctgcactgt

SEQ ID NO: 513645 - DNA, 14 bp, Homo sapiens
tcccctgcactgta

SEQ ID NO: 513646 - DNA, 21 bp, Homo sapiens
tcccctggaagcagtgcccag

SEQ ID NO: 513647 - DNA, 22 bp, Homo sapiens
tcccctggaagcagtgcccagg

SEQ ID NO: 513648 - DNA, 17 bp, Homo sapiens
tgaattttttttaacat

SEQ ID NO: 513649 - DNA, 18 bp, Homo sapiens
tgacatcactggcatggt

SEQ ID NO: 513650 - DNA, 13 bp, Homo sapiens
tgaccacaaaaga

SEQ ID NO: 513651 - DNA, 16 bp, Homo sapiens
tgacccatgggcagga

SEQ ID NO: 513652 - DNA, 18 bp, Homo sapiens
tgacccatgggcaggaga

SEQ ID NO: 513653 - DNA, 12 bp, Homo sapiens
tgacggttccta

SEQ ID NO: 513654 - DNA, 20 bp, Homo sapiens
tgagaacttctcttcccata

SEQ ID NO: 513655 - DNA, 13 bp, Homo sapiens
tgagaggcaggca

SEQ ID NO: 513656 - DNA, 16 bp, Homo sapiens
tgagaggcaggcatag

SEQ ID NO: 513657 - DNA, 17 bp, Homo sapiens
tgagatggatgtatttg

SEQ ID NO: 513658 - DNA, 12 bp, Homo sapiens
tgagcccactgt

SEQ ID NO: 513659 - DNA, 15 bp, Homo sapiens
tgagcccccagcttc

SEQ ID NO: 513660 - DNA, 15 bp, Homo sapiens
tgagccgggcccctg

SEQ ID NO: 513661 - DNA, 17 bp, Homo sapiens
tgagctaagcattttct

SEQ ID NO: 513662 - DNA, 11 bp, Homo sapiens
tgagctgcctt

SEQ ID NO: 513663 - DNA, 19 bp, Homo sapiens
tgagctgccttccctagct

SEQ ID NO: 513664 - DNA, 15 bp, Homo sapiens
tgaggttcctctgcc

SEQ ID NO: 513665 - DNA, 17 bp, Homo sapiens
tgaggttcctctgcctg

SEQ ID NO: 513666 - DNA, 18 bp, Homo sapiens
tgaggttcctctgcctgc

SEQ ID NO: 513667 - DNA, 19 bp, Homo sapiens
tgaggttcctctgcctgcc

SEQ ID NO: 513668 - DNA, 20 bp, Homo sapiens
tgaggttcctctgcctgccc

SEQ ID NO: 513669 - DNA, 21 bp, Homo sapiens
tgagtggggggaacgcccact

SEQ ID NO: 513670 - DNA, 23 bp, Homo sapiens
tgagttctttttcactctgtgtc

SEQ ID NO: 513671 - DNA, 19 bp, Homo sapiens
tgagttgtaaagaaaactt

SEQ ID NO: 513672 - DNA, 22 bp, Homo sapiens
tgagttgttaccccaagcgccc

SEQ ID NO: 513673 - DNA, 18 bp, Homo sapiens
tgagtttgagctgccttc

SEQ ID NO: 513674 - DNA, 21 bp, Homo sapiens
tgagtttgagctgccttccct

SEQ ID NO: 513675 - DNA, 14 bp, Homo sapiens
tgataatttattgt

SEQ ID NO: 513676 - DNA, 16 bp, Homo sapiens
tgatattggaggaata

SEQ ID NO: 513677 - DNA, 19 bp, Homo sapiens
tgatgtaaaatcttgtcat

SEQ ID NO: 513678 - DNA, 21 bp, Homo sapiens
tgatgtaaaatcttgtcatgt

SEQ ID NO: 513679 - DNA, 23 bp, Homo sapiens
tgatgtaaaatcttgtcatgtgt

SEQ ID NO: 513680 - DNA, 19 bp, Homo sapiens
tgattgctgcattttacct

SEQ ID NO: 513681 - DNA, 13 bp, Homo sapiens
tgattgtatttgt

SEQ ID NO: 513682 - DNA, 18 bp, Homo sapiens
tgcaagcagattccctgt

SEQ ID NO: 513683 - DNA, 13 bp, Homo sapiens
tgcaagcttttcc

SEQ ID NO: 513684 - DNA, 23 bp, Homo sapiens
tgcaattgtaaacagaaattgca

SEQ ID NO: 513685 - DNA, 14 bp, Homo sapiens
tgcacaggtttgtt

SEQ ID NO: 513686 - DNA, 20 bp, Homo sapiens
tgcaccccttctctcctccc

SEQ ID NO: 513687 - DNA, 15 bp, Homo sapiens
tgcacgtcatgggag

SEQ ID NO: 513688 - DNA, 13 bp, Homo sapiens
tgcactgtaaaat

SEQ ID NO: 513689 - DNA, 23 bp, Homo sapiens
tgcagaagctatgtttttaaagt

SEQ ID NO: 513690 - DNA, 11 bp, Homo sapiens
tgcaggcaagc

SEQ ID NO: 513691 - DNA, 14 bp, Homo sapiens
tgcaggcccaccct

SEQ ID NO: 513692 - DNA, 15 bp, Homo sapiens
tgcagtaatttctga

SEQ ID NO: 513693 - DNA, 15 bp, Homo sapiens
tgcagtcactggagg

SEQ ID NO: 513694 - DNA, 17 bp, Homo sapiens
tgcagtcactggaggtt

SEQ ID NO: 513695 - DNA, 13 bp, Homo sapiens
tgcagtgtagttt

SEQ ID NO: 513696 - DNA, 13 bp, Homo sapiens
tgcattttcttca

SEQ ID NO: 513697 - DNA, 13 bp, Homo sapiens
tgccacctcccct

SEQ ID NO: 513698 - DNA, 18 bp, Homo sapiens
tgccagctcttcctagct

SEQ ID NO: 513699 - DNA, 22 bp, Homo sapiens
tgccagctcttcctagctggag

SEQ ID NO: 513700 - DNA, 14 bp, Homo sapiens
tgccaggcacaggc

SEQ ID NO: 513701 - DNA, 16 bp, Homo sapiens
tgccaggcacaggcag

SEQ ID NO: 513702 - DNA, 17 bp, Homo sapiens
tgccaggcacaggcagg

SEQ ID NO: 513703 - DNA, 22 bp, Homo sapiens
tgccaggcacaggcagggcagg

SEQ ID NO: 513704 - DNA, 15 bp, Homo sapiens
tgcccaccccctgcc

SEQ ID NO: 513705 - DNA, 16 bp, Homo sapiens
tgcccaccccctgccc

SEQ ID NO: 513706 - DNA, 19 bp, Homo sapiens
tgcccaccccctgccctgc

SEQ ID NO: 513707 - DNA, 17 bp, Homo sapiens
tgcccaggtggctgtgg

SEQ ID NO: 513708 - DNA, 22 bp, Homo sapiens
tgcccccaccccggggaccctg

SEQ ID NO: 513709 - DNA, 22 bp, Homo sapiens
tgccccgcccccagtccccacc

SEQ ID NO: 513710 - DNA, 11 bp, Homo sapiens
tgccctggctg

SEQ ID NO: 513711 - DNA, 15 bp, Homo sapiens
tgccctggctgctgc

SEQ ID NO: 513712 - DNA, 17 bp, Homo sapiens
tgccctggctgctgccc

SEQ ID NO: 513713 - DNA, 17 bp, Homo sapiens
tgcctccccatttccca

SEQ ID NO: 513714 - DNA, 15 bp, Homo sapiens
tgcctctccgcccct

SEQ ID NO: 513715 - DNA, 22 bp, Homo sapiens
tgcctctccgcccctgagccca

SEQ ID NO: 513716 - DNA, 14 bp, Homo sapiens
tgcctgagaggcag

SEQ ID NO: 513717 - DNA, 17 bp, Homo sapiens
tgcctgagaggcaggca

SEQ ID NO: 513718 - DNA, 15 bp, Homo sapiens
tgccttaatttttga

SEQ ID NO: 513719 - DNA, 18 bp, Homo sapiens
tgccttaatttttgaaaa

SEQ ID NO: 513720 - DNA, 13 bp, Homo sapiens
tgccttccctagc

SEQ ID NO: 513721 - DNA, 19 bp, Homo sapiens
tgccttggttcttcctagt

SEQ ID NO: 513722 - DNA, 14 bp, Homo sapiens
tgcgccttaaacaa

SEQ ID NO: 513723 - DNA, 14 bp, Homo sapiens
tgcgtcctcctcac

SEQ ID NO: 513724 - DNA, 15 bp, Homo sapiens
tgctattatgatgtt

SEQ ID NO: 513725 - DNA, 23 bp, Homo sapiens
tgctattatgatgttttgcaaag

SEQ ID NO: 513726 - DNA, 17 bp, Homo sapiens
tgctattttcttatcct

SEQ ID NO: 513727 - DNA, 15 bp, Homo sapiens
tgctcctgagccccc

SEQ ID NO: 513728 - DNA, 15 bp, Homo sapiens
tgctgacccatgggc

SEQ ID NO: 513729 - DNA, 18 bp, Homo sapiens
tgctgacccatgggcagg

SEQ ID NO: 513730 - DNA, 19 bp, Homo sapiens
tgctgacccatgggcagga

SEQ ID NO: 513731 - DNA, 21 bp, Homo sapiens
tgctgccacttaaaaagactt

SEQ ID NO: 513732 - DNA, 23 bp, Homo sapiens
tgctgccacttaaaaagacttga

SEQ ID NO: 513733 - DNA, 14 bp, Homo sapiens
tgctgcccccaccc

SEQ ID NO: 513734 - DNA, 12 bp, Homo sapiens
tgcttctcttta

SEQ ID NO: 513735 - DNA, 13 bp, Homo sapiens
tgcttggcccagg

SEQ ID NO: 513736 - DNA, 11 bp, Homo sapiens
tgctttgtgtc

SEQ ID NO: 513737 - DNA, 13 bp, Homo sapiens
tgctttgtgtcta

SEQ ID NO: 513738 - DNA, 16 bp, Homo sapiens
tgcttttctgccctgg

SEQ ID NO: 513739 - DNA, 17 bp, Homo sapiens
tggaaaggggagagcct

SEQ ID NO: 513740 - DNA, 15 bp, Homo sapiens
tggaagaagggagaa

SEQ ID NO: 513741 - DNA, 17 bp, Homo sapiens
tggaagaagggagaaga

SEQ ID NO: 513742 - DNA, 20 bp, Homo sapiens
tggaagcagtgcccaggtgg

SEQ ID NO: 513743 - DNA, 20 bp, Homo sapiens
tggaatagttactttacaac

SEQ ID NO: 513744 - DNA, 23 bp, Homo sapiens
tggaattacttaaattttaaagc

SEQ ID NO: 513745 - DNA, 22 bp, Homo sapiens
tggaccatgctgtctggcacag

SEQ ID NO: 513746 - DNA, 15 bp, Homo sapiens
tggacggcaggctca

SEQ ID NO: 513747 - DNA, 18 bp, Homo sapiens
tggacggcaggctcactg

SEQ ID NO: 513748 - DNA, 21 bp, Homo sapiens
tggacggcaggctcactgcca

SEQ ID NO: 513749 - DNA, 19 bp, Homo sapiens
tggactgttcatttgaaac

SEQ ID NO: 513750 - DNA, 17 bp, Homo sapiens
tggagaatcacaggctg

SEQ ID NO: 513751 - DNA, 18 bp, Homo sapiens
tggagaatcacaggctgg

SEQ ID NO: 513752 - DNA, 23 bp, Homo sapiens
tggagactgctcctgagccccca

SEQ ID NO: 513753 - DNA, 15 bp, Homo sapiens
tggagaggagccctg

SEQ ID NO: 513754 - DNA, 16 bp, Homo sapiens
tggagaggagccctgc

SEQ ID NO: 513755 - DNA, 17 bp, Homo sapiens
tggaggaggaaggcaag

SEQ ID NO: 513756 - DNA, 15 bp, Homo sapiens
tggaggcttcctgcg

SEQ ID NO: 513757 - DNA, 17 bp, Homo sapiens
tggaggcttcctgcgtc

SEQ ID NO: 513758 - DNA, 12 bp, Homo sapiens
tggagggcctgg

SEQ ID NO: 513759 - DNA, 22 bp, Homo sapiens
tggagggcctgggcctggctcc

SEQ ID NO: 513760 - DNA, 14 bp, Homo sapiens
tttctgggatgtgg

SEQ ID NO: 513761 - DNA, 23 bp, Homo sapiens
tttctgggcttttccttttgcac

SEQ ID NO: 513762 - DNA, 13 bp, Homo sapiens
tttctggtaattt

SEQ ID NO: 513763 - DNA, 23 bp, Homo sapiens
tttcttctgtatttttttttcta

SEQ ID NO: 513764 - DNA, 20 bp, Homo sapiens
tttctttgtattataaaatt

SEQ ID NO: 513765 - DNA, 15 bp, Homo sapiens
tttgcacattccaaa

SEQ ID NO: 513766 - DNA, 14 bp, Homo sapiens
tttgggagagactt

SEQ ID NO: 513767 - DNA, 21 bp, Homo sapiens
tttgtaaactgatgtttgtga

SEQ ID NO: 513768 - DNA, 14 bp, Homo sapiens
tttgtttttattct

SEQ ID NO: 513769 - DNA, 16 bp, Homo sapiens
ttttaaaaattttgtc

SEQ ID NO: 513770 - DNA, 14 bp, Homo sapiens
ttttaatttaaagt

SEQ ID NO: 513771 - DNA, 12 bp, Homo sapiens
ttttagttgaat

SEQ ID NO: 513772 - DNA, 18 bp, Homo sapiens
ttttataaagtttatcag

SEQ ID NO: 513773 - DNA, 14 bp, Homo sapiens
ttttattgaaagct

SEQ ID NO: 513774 - DNA, 18 bp, Homo sapiens
ttttcaatgaaacaaaga

SEQ ID NO: 513775 - DNA, 18 bp, Homo sapiens
ttttcatatttaaagcca

SEQ ID NO: 513776 - DNA, 13 bp, Homo sapiens
ttttccttttgtg

SEQ ID NO: 513777 - DNA, 18 bp, Homo sapiens
ttttctacagtggtttta

SEQ ID NO: 513778 - DNA, 15 bp, Homo sapiens
ttttctgccctggct

SEQ ID NO: 513779 - DNA, 13 bp, Homo sapiens
ttttctgggatgt

SEQ ID NO: 513780 - DNA, 17 bp, Homo sapiens
ttttctgggcttttcct

SEQ ID NO: 513781 - DNA, 21 bp, Homo sapiens
ttttctggtaattttgggttt

SEQ ID NO: 513782 - DNA, 19 bp, Homo sapiens
ttttggcaaacgctaaaga

SEQ ID NO: 513783 - DNA, 12 bp, Homo sapiens
ttttgtactgta

SEQ ID NO: 513784 - DNA, 16 bp, Homo sapiens
tttttaaagtgtacat

SEQ ID NO: 513785 - DNA, 12 bp, Homo sapiens
tttttagttgaa

SEQ ID NO: 513786 - DNA, 15 bp, Homo sapiens
tttttagttgaattt

SEQ ID NO: 513787 - DNA, 14 bp, Homo sapiens
tttttatgttttgt

SEQ ID NO: 513788 - DNA, 22 bp, Homo sapiens
tttttcaagaaaattttgcaga

SEQ ID NO: 513789 - DNA, 15 bp, Homo sapiens
tttttctaagagaag

SEQ ID NO: 513790 - DNA, 16 bp, Homo sapiens
tttttgttgcagtgta

SEQ ID NO: 513791 - DNA, 12 bp, Homo sapiens
ttttttctaaga

SEQ ID NO: 513792 - DNA, 15 bp, Homo sapiens
ttttttctaagagaa

SEQ ID NO: 513793 - DNA, 14 bp, Homo sapiens
tttttttctaagag

SEQ ID NO: 513794 - DNA, 22 bp, Homo sapiens
aagctcatgatgcgcttcaaag

SEQ ID NO: 513795 - DNA, 17 bp, Homo sapiens
aagcttgtcctgagaag

SEQ ID NO: 513796 - DNA, 14 bp, Homo sapiens
aagcttttcctaat

SEQ ID NO: 513797 - DNA, 20 bp, Homo sapiens
aaggaaaaacacaagcaaaa

SEQ ID NO: 513798 - DNA, 19 bp, Homo sapiens
aaggaggccacctcctaaa

SEQ ID NO: 513799 - DNA, 13 bp, Homo sapiens
aaggcaagagggg

SEQ ID NO: 513800 - DNA, 22 bp, Homo sapiens
aaggccacctcttcctggccgg

SEQ ID NO: 513801 - DNA, 21 bp, Homo sapiens
aaggcccagagagaagagccc

SEQ ID NO: 513802 - DNA, 16 bp, Homo sapiens
aagggcactatatttt

SEQ ID NO: 513803 - DNA, 17 bp, Homo sapiens
aaggggactgccacctc

SEQ ID NO: 513804 - DNA, 19 bp, Homo sapiens
aaggggagagcctgctggc

SEQ ID NO: 513805 - DNA, 22 bp, Homo sapiens
aaggtgagtttgagctgccttc

SEQ ID NO: 513806 - DNA, 16 bp, Homo sapiens
aaggtgtttaaagagt

SEQ ID NO: 513807 - DNA, 19 bp, Homo sapiens
aagtaccacattccatgac

SEQ ID NO: 513808 - DNA, 15 bp, Homo sapiens
aagtagaatctcttt

SEQ ID NO: 513809 - DNA, 23 bp, Homo sapiens
aagtagagtgagttctttttcac

SEQ ID NO: 513810 - DNA, 16 bp, Homo sapiens
aagtataatttcagtg

SEQ ID NO: 513811 - DNA, 14 bp, Homo sapiens
aagtcacactgtaa

SEQ ID NO: 513812 - DNA, 18 bp, Homo sapiens
aagtcagtgttgaatttt

SEQ ID NO: 513813 - DNA, 15 bp, Homo sapiens
aagtgacggttccta

SEQ ID NO: 513814 - DNA, 18 bp, Homo sapiens
aagtggggtgctgggagg

SEQ ID NO: 513815 - DNA, 17 bp, Homo sapiens
aagtgggttttttagtt

SEQ ID NO: 513816 - DNA, 13 bp, Homo sapiens
aagtggttgtttt

SEQ ID NO: 513817 - DNA, 23 bp, Homo sapiens
aagttaaactacctaaaataaat

SEQ ID NO: 513818 - DNA, 23 bp, Homo sapiens
aataaacttttaccacaaattga

SEQ ID NO: 513819 - DNA, 21 bp, Homo sapiens
aataaatgtcacttcatattt

SEQ ID NO: 513820 - DNA, 18 bp, Homo sapiens
aatagaggtctgtaaaga

SEQ ID NO: 513821 - DNA, 19 bp, Homo sapiens
aatagaggtctgtaaagaa

SEQ ID NO: 513822 - DNA, 20 bp, Homo sapiens
aatagcccagatcccaagag

SEQ ID NO: 513823 - DNA, 15 bp, Homo sapiens
aatataaaatttctg

SEQ ID NO: 513824 - DNA, 16 bp, Homo sapiens
aatattatttttatgc

SEQ ID NO: 513825 - DNA, 14 bp, Homo sapiens
aatcaaaccaaaga

SEQ ID NO: 513826 - DNA, 16 bp, Homo sapiens
aatcaaaccaaagagt

SEQ ID NO: 513827 - DNA, 20 bp, Homo sapiens
aatcataaactatattctgt

SEQ ID NO: 513828 - DNA, 13 bp, Homo sapiens
aatcatgtatttt

SEQ ID NO: 513829 - DNA, 16 bp, Homo sapiens
aatccccttctcccct

SEQ ID NO: 513830 - DNA, 20 bp, Homo sapiens
aatccccttctcccctgcac

SEQ ID NO: 513831 - DNA, 16 bp, Homo sapiens
aatcctaatttctcct

SEQ ID NO: 513832 - DNA, 19 bp, Homo sapiens
aatcctaatttctcctccc

SEQ ID NO: 513833 - DNA, 11 bp, Homo sapiens
aatctttcaac

SEQ ID NO: 513834 - DNA, 19 bp, Homo sapiens
aatctttcaacttatttct

SEQ ID NO: 513835 - DNA, 20 bp, Homo sapiens
aatctttcaacttatttctg

SEQ ID NO: 513836 - DNA, 13 bp, Homo sapiens
aatgaaacaaaga

SEQ ID NO: 513837 - DNA, 17 bp, Homo sapiens
aatgaaacaaagaaaga

SEQ ID NO: 513838 - DNA, 20 bp, Homo sapiens
aatgactctaaatagcccag

SEQ ID NO: 513839 - DNA, 23 bp, Homo sapiens
aatgaggtgggaggtggaagaag

SEQ ID NO: 513840 - DNA, 15 bp, Homo sapiens
aatgcatatttttgc

SEQ ID NO: 513841 - DNA, 15 bp, Homo sapiens
aatgctgacccatgg

SEQ ID NO: 513842 - DNA, 21 bp, Homo sapiens
aatgggggtgaccacaaaaga

SEQ ID NO: 513843 - DNA, 10 bp, Homo sapiens
ggctgctgcc

SEQ ID NO: 513844 - DNA, 18 bp, Homo sapiens
ggctgctgcccccacccc

SEQ ID NO: 513845 - DNA, 19 bp, Homo sapiens
ggctgggcactgctctcac

SEQ ID NO: 513846 - DNA, 15 bp, Homo sapiens
ggctgggctgggcac

SEQ ID NO: 513847 - DNA, 20 bp, Homo sapiens
ggcttcctgcgtcctcctca

SEQ ID NO: 513848 - DNA, 17 bp, Homo sapiens
ggcttctccgccagcct

SEQ ID NO: 513849 - DNA, 12 bp, Homo sapiens
ggcttttccttt

SEQ ID NO: 513850 - DNA, 20 bp, Homo sapiens
gggaaaacttcactccaaag

SEQ ID NO: 513851 - DNA, 22 bp, Homo sapiens
gggaaaacttcactccaaagag

SEQ ID NO: 513852 - DNA, 13 bp, Homo sapiens
gggaaaggggtgc

SEQ ID NO: 513853 - DNA, 11 bp, Homo sapiens
gggaatgtgaa

SEQ ID NO: 513854 - DNA, 20 bp, Homo sapiens
gggacccagtggcagggcac

SEQ ID NO: 513855 - DNA, 17 bp, Homo sapiens
gggacctgccaggcagg

SEQ ID NO: 513856 - DNA, 22 bp, Homo sapiens
gggagagagagagagagaggac

SEQ ID NO: 513857 - DNA, 23 bp, Homo sapiens
gggagagagagagagagaggaca

SEQ ID NO: 513858 - DNA, 13 bp, Homo sapiens
gggaggagggaga

SEQ ID NO: 513859 - DNA, 19 bp, Homo sapiens
gggaggccaagagtggccc

SEQ ID NO: 513860 - DNA, 20 bp, Homo sapiens
gggattatgggtcacaggaa

SEQ ID NO: 513861 - DNA, 20 bp, Homo sapiens
gggcacagggcctggcccat

SEQ ID NO: 513862 - DNA, 16 bp, Homo sapiens
gggcactgctctcacc

SEQ ID NO: 513863 - DNA, 13 bp, Homo sapiens
gggcaggaccagc

SEQ ID NO: 513864 - DNA, 17 bp, Homo sapiens
gggcaggaccagcccac

SEQ ID NO: 513865 - DNA, 14 bp, Homo sapiens
gggcccctgggctt

SEQ ID NO: 513866 - DNA, 20 bp, Homo sapiens
gggctcagcaaggccacctc

SEQ ID NO: 513867 - DNA, 13 bp, Homo sapiens
gggctcccgcctc

SEQ ID NO: 513868 - DNA, 22 bp, Homo sapiens
gggctgggcactgctctcacct

SEQ ID NO: 513869 - DNA, 19 bp, Homo sapiens
gggctgggggatgggcctg

SEQ ID NO: 513870 - DNA, 16 bp, Homo sapiens
gggctgttctgtttcc

SEQ ID NO: 513871 - DNA, 15 bp, Homo sapiens
gggcttgaagccaaa

SEQ ID NO: 513872 - DNA, 16 bp, Homo sapiens
gggcttggcctgctgt

SEQ ID NO: 513873 - DNA, 14 bp, Homo sapiens
ggggagagcctgct

SEQ ID NO: 513874 - DNA, 18 bp, Homo sapiens
ggggagagcctgctggca

SEQ ID NO: 513875 - DNA, 19 bp, Homo sapiens
ggggattgagttgtaaaga

SEQ ID NO: 513876 - DNA, 12 bp, Homo sapiens
ggggctcagcaa

SEQ ID NO: 513877 - DNA, 15 bp, Homo sapiens
ggggctcagcaaggc

SEQ ID NO: 513878 - DNA, 20 bp, Homo sapiens
ggggctcccgcctccaaccc

SEQ ID NO: 513879 - DNA, 20 bp, Homo sapiens
gggggaacgcccacttccct

SEQ ID NO: 513880 - DNA, 13 bp, Homo sapiens
gggggtggaggct

SEQ ID NO: 513881 - DNA, 20 bp, Homo sapiens
ggggtgcttttatagaggct

SEQ ID NO: 513882 - DNA, 20 bp, Homo sapiens
gggtcgcctatttttaaaaa

SEQ ID NO: 513883 - DNA, 22 bp, Homo sapiens
gggtctctcacagacaggaccc

SEQ ID NO: 513884 - DNA, 20 bp, Homo sapiens
gggtgcttttatagaggcta

SEQ ID NO: 513885 - DNA, 16 bp, Homo sapiens
gggtggaggcttcctg

SEQ ID NO: 513886 - DNA, 22 bp, Homo sapiens
ggtatggggggggcaagaaaga

SEQ ID NO: 513887 - DNA, 20 bp, Homo sapiens
ggtattggtgctttgtgtct

SEQ ID NO: 513888 - DNA, 21 bp, Homo sapiens
ggtattggtgctttgtgtcta

SEQ ID NO: 513889 - DNA, 18 bp, Homo sapiens
ggtcagaggcccaaaaca

SEQ ID NO: 513890 - DNA, 21 bp, Homo sapiens
ggtctgagttgttaccccaag

SEQ ID NO: 513891 - DNA, 20 bp, Homo sapiens
ggtctgtaaagaaaaataat

SEQ ID NO: 513892 - DNA, 20 bp, Homo sapiens
ggtgagtttgagctgccttc

SEQ ID NO: 513893 - DNA, 15 bp, Homo sapiens
ggtgcctgagaggca

SEQ ID NO: 513894 - DNA, 17 bp, Homo sapiens
ggtgcctgagaggcagg

SEQ ID NO: 513895 - DNA, 18 bp, Homo sapiens
ggtgcctgagaggcaggc

SEQ ID NO: 513896 - DNA, 20 bp, Homo sapiens
ggtgctgggaggagggagag

SEQ ID NO: 513897 - DNA, 21 bp, Homo sapiens
ggtgcttttatagaggctagc

SEQ ID NO: 513898 - DNA, 21 bp, Homo sapiens
ggtggaattacttaaatttta

SEQ ID NO: 513899 - DNA, 15 bp, Homo sapiens
ggtggaggcttcctg

SEQ ID NO: 513900 - DNA, 21 bp, Homo sapiens
ggtgttattttcaatgaaaca

SEQ ID NO: 513901 - DNA, 17 bp, Homo sapiens
ggttatcctatttttaa

SEQ ID NO: 513902 - DNA, 14 bp, Homo sapiens
ggttcctctgcctg

SEQ ID NO: 513903 - DNA, 17 bp, Homo sapiens
ggttcctctgcctgccc

SEQ ID NO: 513904 - DNA, 18 bp, Homo sapiens
ggttcctctgcctgcccc

SEQ ID NO: 513905 - DNA, 22 bp, Homo sapiens
ggttcctggggcatccatgggg

SEQ ID NO: 513906 - DNA, 19 bp, Homo sapiens
ggttgggacccagtggcag

SEQ ID NO: 513907 - DNA, 22 bp, Homo sapiens
ggttgggacccagtggcagggc

SEQ ID NO: 513908 - DNA, 14 bp, Homo sapiens
ggttgggtatttga

SEQ ID NO: 513909 - DNA, 16 bp, Homo sapiens
ggttttatactgaagg

SEQ ID NO: 513910 - DNA, 21 bp, Homo sapiens
ggttttggcaaacgctaaaga

SEQ ID NO: 513911 - DNA, 14 bp, Homo sapiens
ggttttttagttga

SEQ ID NO: 513912 - DNA, 19 bp, Homo sapiens
gtaaaactcactgaatcta

SEQ ID NO: 513913 - DNA, 15 bp, Homo sapiens
gtaaaatcttgtcat

SEQ ID NO: 513914 - DNA, 19 bp, Homo sapiens
gtaaaatcttgtcatgtgt

SEQ ID NO: 513915 - DNA, 20 bp, Homo sapiens
gtaaaatcttgtcatgtgta

SEQ ID NO: 513916 - DNA, 19 bp, Homo sapiens
gtaaccaatttctttctaa

SEQ ID NO: 513917 - DNA, 19 bp, Homo sapiens
gtaacttttttattttaag

SEQ ID NO: 513918 - DNA, 13 bp, Homo sapiens
gtaattttaaagt

SEQ ID NO: 513919 - DNA, 15 bp, Homo sapiens
gtacatatttttata

SEQ ID NO: 513920 - DNA, 15 bp, Homo sapiens
gtacattttataaag

SEQ ID NO: 513921 - DNA, 16 bp, Homo sapiens
gtaccagctgcgcttg

SEQ ID NO: 513922 - DNA, 17 bp, Homo sapiens
gtaccagctgcgcttgc

SEQ ID NO: 513923 - DNA, 19 bp, Homo sapiens
gtagaatctcttttctggt

SEQ ID NO: 513924 - DNA, 14 bp, Homo sapiens
gtatctaaagtctt

SEQ ID NO: 513925 - DNA, 17 bp, Homo sapiens
gtattggtgctttgtgt

SEQ ID NO: 513926 - DNA, 18 bp, Homo sapiens
gtatttttttttctaaga

SEQ ID NO: 513927 - DNA, 22 bp, Homo sapiens
gtatttttttttctaagagaag

SEQ ID NO: 513928 - DNA, 16 bp, Homo sapiens
gtcaatatttgatcta

SEQ ID NO: 513929 - DNA, 15 bp, Homo sapiens
gtcactggaaagggg

SEQ ID NO: 513930 - DNA, 20 bp, Homo sapiens
gtcactggaggttgaagcca

SEQ ID NO: 513931 - DNA, 16 bp, Homo sapiens
gtcatcatctccaaac

SEQ ID NO: 513932 - DNA, 12 bp, Homo sapiens
gtcatgtgtata

SEQ ID NO: 513933 - DNA, 13 bp, Homo sapiens
gtcattttctctt

SEQ ID NO: 513934 - DNA, 11 bp, Homo sapiens
gtcccagcagc

SEQ ID NO: 513935 - DNA, 16 bp, Homo sapiens
gtcccagcagccagcc

SEQ ID NO: 513936 - DNA, 13 bp, Homo sapiens
gtcctacagtgtc

SEQ ID NO: 513937 - DNA, 17 bp, Homo sapiens
gtcctcctcacctcatg

SEQ ID NO: 513938 - DNA, 15 bp, Homo sapiens
gtctagggcagagta

SEQ ID NO: 513939 - DNA, 21 bp, Homo sapiens
gtctcaccatttccccagggc

SEQ ID NO: 513940 - DNA, 19 bp, Homo sapiens
gtctcctatacccagcaga

SEQ ID NO: 513941 - DNA, 19 bp, Homo sapiens
gtctctcacagacaggacc

SEQ ID NO: 513942 - DNA, 16 bp, Homo sapiens
gtctctggttcttgaa

SEQ ID NO: 513943 - DNA, 19 bp, Homo sapiens
gtctgtaaagaaaaataat

SEQ ID NO: 513944 - DNA, 12 bp, Homo sapiens
gtcttattttat

SEQ ID NO: 513945 - DNA, 20 bp, Homo sapiens
gtctttatttttatcccagg

SEQ ID NO: 513946 - DNA, 14 bp, Homo sapiens
gtctttttgtatct

SEQ ID NO: 513947 - DNA, 16 bp, Homo sapiens
gtgacatggtgcctga

SEQ ID NO: 513948 - DNA, 17 bp, Homo sapiens
tagatccaaatgtaaag

SEQ ID NO: 513949 - DNA, 12 bp, Homo sapiens
tagcacaggctg

SEQ ID NO: 513950 - DNA, 12 bp, Homo sapiens
tagcatggtttt

SEQ ID NO: 513951 - DNA, 20 bp, Homo sapiens
tagccagtctcctataccca

SEQ ID NO: 513952 - DNA, 13 bp, Homo sapiens
tagcctctgggtt

SEQ ID NO: 513953 - DNA, 19 bp, Homo sapiens
tagctggagaggagccctg

SEQ ID NO: 513954 - DNA, 15 bp, Homo sapiens
tagcttctgcttttc

SEQ ID NO: 513955 - DNA, 16 bp, Homo sapiens
tagctttagaccctgg

SEQ ID NO: 513956 - DNA, 12 bp, Homo sapiens
taggaaggagag

SEQ ID NO: 513957 - DNA, 11 bp, Homo sapiens
tagggcagagt

SEQ ID NO: 513958 - DNA, 19 bp, Homo sapiens
tagggcagagtatgttctt

SEQ ID NO: 513959 - DNA, 15 bp, Homo sapiens
tagttttccttttgt

SEQ ID NO: 513960 - DNA, 19 bp, Homo sapiens
tataaaaataaaaaagatc

SEQ ID NO: 513961 - DNA, 13 bp, Homo sapiens
tataaaatttctg

SEQ ID NO: 513962 - DNA, 13 bp, Homo sapiens
tatacccagcaga

SEQ ID NO: 513963 - DNA, 17 bp, Homo sapiens
tataccgcagagtattt

SEQ ID NO: 513964 - DNA, 12 bp, Homo sapiens
tatactgaagga

SEQ ID NO: 513965 - DNA, 22 bp, Homo sapiens
tatactgaaggaaaaacacaag

SEQ ID NO: 513966 - DNA, 21 bp, Homo sapiens
tatctacattataccgcagag

SEQ ID NO: 513967 - DNA, 21 bp, Homo sapiens
tatgatgttttgcaaaggaaa

SEQ ID NO: 513968 - DNA, 16 bp, Homo sapiens
tatgattgtatttgtg

SEQ ID NO: 513969 - DNA, 23 bp, Homo sapiens
tatggccaggaagtagcacaggc

SEQ ID NO: 513970 - DNA, 20 bp, Homo sapiens
tatggggggggcaagaaaga

SEQ ID NO: 513971 - DNA, 11 bp, Homo sapiens
tatgggtcaca

SEQ ID NO: 513972 - DNA, 13 bp, Homo sapiens
tatgggtcacagg

SEQ ID NO: 513973 - DNA, 15 bp, Homo sapiens
tatgggtcacaggaa

SEQ ID NO: 513974 - DNA, 16 bp, Homo sapiens
tatgtaaattaaatga

SEQ ID NO: 513975 - DNA, 16 bp, Homo sapiens
tatgttcttctgttat

SEQ ID NO: 513976 - DNA, 21 bp, Homo sapiens
tatgtttttaaagtgtacatt

SEQ ID NO: 513977 - DNA, 19 bp, Homo sapiens
tattatgatgttttgcaaa

SEQ ID NO: 513978 - DNA, 15 bp, Homo sapiens
tattcccttttaaag

SEQ ID NO: 513979 - DNA, 16 bp, Homo sapiens
tattcttgatgtaaaa

SEQ ID NO: 513980 - DNA, 21 bp, Homo sapiens
tattgatttaacttcattttt

SEQ ID NO: 513981 - DNA, 21 bp, Homo sapiens
tatttaaagccaaatgtaaat

SEQ ID NO: 513982 - DNA, 19 bp, Homo sapiens
tatttagacaagagatggg

SEQ ID NO: 513983 - DNA, 13 bp, Homo sapiens
tatttatggaaga

SEQ ID NO: 513984 - DNA, 20 bp, Homo sapiens
tattttaagaggaagaagaa

SEQ ID NO: 513985 - DNA, 18 bp, Homo sapiens
tattttattatttctaaa

SEQ ID NO: 513986 - DNA, 17 bp, Homo sapiens
tattttatttagacaag

SEQ ID NO: 513987 - DNA, 14 bp, Homo sapiens
tattttctacagtg

SEQ ID NO: 513988 - DNA, 20 bp, Homo sapiens
tattttgtaaactgatgttt

SEQ ID NO: 513989 - DNA, 22 bp, Homo sapiens
tattttgtaaactgatgtttgt

SEQ ID NO: 513990 - DNA, 22 bp, Homo sapiens
tatttttaaaaagtaccacatt

SEQ ID NO: 513991 - DNA, 15 bp, Homo sapiens
tatttttaaacaaaa

SEQ ID NO: 513992 - DNA, 14 bp, Homo sapiens
tcaaaaagcatttt

SEQ ID NO: 513993 - DNA, 13 bp, Homo sapiens
tcaaaccaaagag

SEQ ID NO: 513994 - DNA, 15 bp, Homo sapiens
tcaaaccaaagagta

SEQ ID NO: 513995 - DNA, 22 bp, Homo sapiens
tcaaatccaggaccctgccagg

SEQ ID NO: 513996 - DNA, 13 bp, Homo sapiens
tcaaattttaagt

SEQ ID NO: 513997 - DNA, 13 bp, Homo sapiens
tcaacttatttct

SEQ ID NO: 513998 - DNA, 21 bp, Homo sapiens
tcaacttatttctgaaaaaga

SEQ ID NO: 513999 - DNA, 17 bp, Homo sapiens
tcaagaaaattttgcag

SEQ ID NO: 514000 - DNA, 14 bp, Homo sapiens
tcacagacaggacc

SEQ ID NO: 514001 - DNA, 16 bp, Homo sapiens
tcaccatttccccagg

SEQ ID NO: 514002 - DNA, 20 bp, Homo sapiens
tcaccatttggatcctgtgt

SEQ ID NO: 514003 - DNA, 13 bp, Homo sapiens
tcacctcatgccc

SEQ ID NO: 514004 - DNA, 15 bp, Homo sapiens
tcaccttggttcctg

SEQ ID NO: 514005 - DNA, 17 bp, Homo sapiens
tcaccttggttcctggg

SEQ ID NO: 514006 - DNA, 16 bp, Homo sapiens
tcactgccaggccagc

SEQ ID NO: 514007 - DNA, 15 bp, Homo sapiens
tcactggaaagggga

SEQ ID NO: 514008 - DNA, 17 bp, Homo sapiens
tcactggaaaggggaga

SEQ ID NO: 514009 - DNA, 18 bp, Homo sapiens
tcactggaaaggggagag

SEQ ID NO: 514010 - DNA, 13 bp, Homo sapiens
tcactggcatggt

SEQ ID NO: 514011 - DNA, 14 bp, Homo sapiens
tcagacattttaag

SEQ ID NO: 514012 - DNA, 15 bp, Homo sapiens
tcagaggcccaaaac

SEQ ID NO: 514013 - DNA, 13 bp, Homo sapiens
tcagatattttca

SEQ ID NO: 514014 - DNA, 22 bp, Homo sapiens
tcagatattttcatatttaaag

SEQ ID NO: 514015 - DNA, 12 bp, Homo sapiens
tcagcaaggcca

SEQ ID NO: 514016 - DNA, 23 bp, Homo sapiens
tcagcaaggccacctcttcctgg

SEQ ID NO: 514017 - DNA, 20 bp, Homo sapiens
tcagtctacccctctccttt

SEQ ID NO: 514018 - DNA, 13 bp, Homo sapiens
tcatatttaaagc

SEQ ID NO: 514019 - DNA, 17 bp, Homo sapiens
tcatatttaaagccaaa

SEQ ID NO: 514020 - DNA, 21 bp, Homo sapiens
tcatatttaaagccaaatgta

SEQ ID NO: 514021 - DNA, 15 bp, Homo sapiens
tcatcatctccaaac

SEQ ID NO: 514022 - DNA, 19 bp, Homo sapiens
tcatgaatgtaaatttgta

SEQ ID NO: 514023 - DNA, 20 bp, Homo sapiens
tcatgaatgtaaatttgtac

SEQ ID NO: 514024 - DNA, 18 bp, Homo sapiens
tcatgatgcgcttcaaag

SEQ ID NO: 514025 - DNA, 21 bp, Homo sapiens
tcatgcccaccccctgccctg

SEQ ID NO: 514026 - DNA, 21 bp, Homo sapiens
tcatgtaacttttttatttta

SEQ ID NO: 514027 - DNA, 12 bp, Homo sapiens
tcatgtattttg

SEQ ID NO: 514028 - DNA, 10 bp, Homo sapiens
tcatgtgtat

SEQ ID NO: 514029 - DNA, 22 bp, Homo sapiens
tcatttctttttgggagagact

SEQ ID NO: 514030 - DNA, 19 bp, Homo sapiens
tccaaattcctagaaaagt

SEQ ID NO: 514031 - DNA, 20 bp, Homo sapiens
tccaagcctctgtcttttct

SEQ ID NO: 514032 - DNA, 14 bp, Homo sapiens
tccacatctgcctt

SEQ ID NO: 514033 - DNA, 15 bp, Homo sapiens
tccacatctgcctta

SEQ ID NO: 514034 - DNA, 15 bp, Homo sapiens
tccactacacctggc

SEQ ID NO: 514035 - DNA, 18 bp, Homo sapiens
tccatccatgtgttccaa

SEQ ID NO: 514036 - DNA, 19 bp, Homo sapiens
tccatggggtctctcacag

SEQ ID NO: 514037 - DNA, 13 bp, Homo sapiens
tccatgtgttcca

SEQ ID NO: 514038 - DNA, 16 bp, Homo sapiens
tcccaagagattatgt

SEQ ID NO: 514039 - DNA, 15 bp, Homo sapiens
tcccagatgtgtgtt

SEQ ID NO: 514040 - DNA, 17 bp, Homo sapiens
tcccaggtaccagctgc

SEQ ID NO: 514041 - DNA, 14 bp, Homo sapiens
tccccacccctgcc

SEQ ID NO: 514042 - DNA, 20 bp, Homo sapiens
ttatggaagaaagagttgtc

SEQ ID NO: 514043 - DNA, 11 bp, Homo sapiens
ttatgggtcac

SEQ ID NO: 514044 - DNA, 20 bp, Homo sapiens
ttattattttcccatttgct

SEQ ID NO: 514045 - DNA, 18 bp, Homo sapiens
ttatttagacaagagatg

SEQ ID NO: 514046 - DNA, 23 bp, Homo sapiens
ttatttctaaataaaaaaattaa

SEQ ID NO: 514047 - DNA, 21 bp, Homo sapiens
ttatttttatcccaggaaata

SEQ ID NO: 514048 - DNA, 23 bp, Homo sapiens
ttcaacttatttctgaaaaagag

SEQ ID NO: 514049 - DNA, 21 bp, Homo sapiens
ttcaagatacatgttgtattt

SEQ ID NO: 514050 - DNA, 14 bp, Homo sapiens
ttcatatttaaagc

SEQ ID NO: 514051 - DNA, 22 bp, Homo sapiens
ttcatatttaaagccaaatgta

SEQ ID NO: 514052 - DNA, 15 bp, Homo sapiens
ttccactacacctgg

SEQ ID NO: 514053 - DNA, 17 bp, Homo sapiens
ttccactacacctggct

SEQ ID NO: 514054 - DNA, 19 bp, Homo sapiens
ttccactacacctggctga

SEQ ID NO: 514055 - DNA, 12 bp, Homo sapiens
ttccagcaggag

SEQ ID NO: 514056 - DNA, 22 bp, Homo sapiens
ttccaggaaactccacatctgc

SEQ ID NO: 514057 - DNA, 16 bp, Homo sapiens
ttccatgacgcaggag

SEQ ID NO: 514058 - DNA, 22 bp, Homo sapiens
ttcccataccacccaaaatcat

SEQ ID NO: 514059 - DNA, 14 bp, Homo sapiens
ttcccatctgcacc

SEQ ID NO: 514060 - DNA, 13 bp, Homo sapiens
ttccctgcttcca

SEQ ID NO: 514061 - DNA, 13 bp, Homo sapiens
ttccctgggttag

SEQ ID NO: 514062 - DNA, 12 bp, Homo sapiens
ttccgctctggg

SEQ ID NO: 514063 - DNA, 16 bp, Homo sapiens
ttcctcatgaatgtaa

SEQ ID NO: 514064 - DNA, 21 bp, Homo sapiens
ttcctcatgaatgtaaatttg

SEQ ID NO: 514065 - DNA, 15 bp, Homo sapiens
ttcctctagaagcca

SEQ ID NO: 514066 - DNA, 13 bp, Homo sapiens
ttcctctgcctgc

SEQ ID NO: 514067 - DNA, 16 bp, Homo sapiens
ttcctgcgtcctcctc

SEQ ID NO: 514068 - DNA, 14 bp, Homo sapiens
ttcctttcttacca

SEQ ID NO: 514069 - DNA, 17 bp, Homo sapiens
ttccttttccctgcttc

SEQ ID NO: 514070 - DNA, 12 bp, Homo sapiens
ttctaagagaag

SEQ ID NO: 514071 - DNA, 13 bp, Homo sapiens
ttctaagagaagt

SEQ ID NO: 514072 - DNA, 21 bp, Homo sapiens
ttctacagtggttttatactg

SEQ ID NO: 514073 - DNA, 17 bp, Homo sapiens
ttctcactgaagctcaa

SEQ ID NO: 514074 - DNA, 15 bp, Homo sapiens
ttctcccctgcactg

SEQ ID NO: 514075 - DNA, 16 bp, Homo sapiens
ttctcccctgcactgt

SEQ ID NO: 514076 - DNA, 18 bp, Homo sapiens
ttctcccctgcactgtaa

SEQ ID NO: 514077 - DNA, 15 bp, Homo sapiens
ttctccgccagcctc

SEQ ID NO: 514078 - DNA, 20 bp, Homo sapiens
ttctcctcccttccttttcc

SEQ ID NO: 514079 - DNA, 12 bp, Homo sapiens
ttctctcctccc

SEQ ID NO: 514080 - DNA, 14 bp, Homo sapiens
ttctgaaaaagaga

SEQ ID NO: 514081 - DNA, 17 bp, Homo sapiens
ttctgataatttattgt

SEQ ID NO: 514082 - DNA, 21 bp, Homo sapiens
ttctgataatttattgtcttt

SEQ ID NO: 514083 - DNA, 13 bp, Homo sapiens
ttctgcttttctg

SEQ ID NO: 514084 - DNA, 18 bp, Homo sapiens
ttctgcttttctgccctg

SEQ ID NO: 514085 - DNA, 22 bp, Homo sapiens
ttctgtcccgtaaatcatattt

SEQ ID NO: 514086 - DNA, 13 bp, Homo sapiens
ttctgtgttactt

SEQ ID NO: 514087 - DNA, 22 bp, Homo sapiens
ttcttgaacagccatatctgaa

SEQ ID NO: 514088 - DNA, 15 bp, Homo sapiens
ttcttgacagtgaga

SEQ ID NO: 514089 - DNA, 14 bp, Homo sapiens
ttcttgatgtaaaa

SEQ ID NO: 514090 - DNA, 19 bp, Homo sapiens
ttcttgatgtaaaatcttg

SEQ ID NO: 514091 - DNA, 20 bp, Homo sapiens
ttcttgtaactttcttcaaa

SEQ ID NO: 514092 - DNA, 17 bp, Homo sapiens
ttgaagaaaaaatggca

SEQ ID NO: 514093 - DNA, 11 bp, Homo sapiens
ttgaagccaaa

SEQ ID NO: 514094 - DNA, 23 bp, Homo sapiens
ttgacagtgagaggatattgagg

SEQ ID NO: 514095 - DNA, 11 bp, Homo sapiens
ttgagctgcct

SEQ ID NO: 514096 - DNA, 19 bp, Homo sapiens
ttgagctgccttccctagc

SEQ ID NO: 514097 - DNA, 18 bp, Homo sapiens
ttgatgtaaaatcttgtc

SEQ ID NO: 514098 - DNA, 12 bp, Homo sapiens
ttgcacagtgga

SEQ ID NO: 514099 - DNA, 23 bp, Homo sapiens
ttgcacattccaaaattcatttc

SEQ ID NO: 514100 - DNA, 16 bp, Homo sapiens
ttgcaccttattcaga

SEQ ID NO: 514101 - DNA, 17 bp, Homo sapiens
ttgccagctgctgagcc

SEQ ID NO: 514102 - DNA, 17 bp, Homo sapiens
ttgcctccccatttccc

SEQ ID NO: 514103 - DNA, 20 bp, Homo sapiens
ttgcctccccatttcccatc

SEQ ID NO: 514104 - DNA, 21 bp, Homo sapiens
ttgcctccccatttcccatct

SEQ ID NO: 514105 - DNA, 12 bp, Homo sapiens
aaacaaagaaag

SEQ ID NO: 514106 - DNA, 20 bp, Homo sapiens
aaacaattcttgtaactttc

SEQ ID NO: 514107 - DNA, 22 bp, Homo sapiens
aaacaattcttgtaactttctt

SEQ ID NO: 514108 - DNA, 23 bp, Homo sapiens
aaacaattcttgtaactttcttc

SEQ ID NO: 514109 - DNA, 15 bp, Homo sapiens
aaacagcttgttcta

SEQ ID NO: 514110 - DNA, 17 bp, Homo sapiens
aaaccaaagagggcttc

SEQ ID NO: 514111 - DNA, 21 bp, Homo sapiens
aaaccaaagagggcttcctct

SEQ ID NO: 514112 - DNA, 19 bp, Homo sapiens
aaaccactcagtaaaagca

SEQ ID NO: 514113 - DNA, 18 bp, Homo sapiens
aaaccatggattgtacat

SEQ ID NO: 514114 - DNA, 22 bp, Homo sapiens
aaacgctaaagagcccttgcct

SEQ ID NO: 514115 - DNA, 16 bp, Homo sapiens
aaactacctaaaataa

SEQ ID NO: 514116 - DNA, 13 bp, Homo sapiens
aaactatgacaat

SEQ ID NO: 514117 - DNA, 18 bp, Homo sapiens
aaactatgacaatttttg

SEQ ID NO: 514118 - DNA, 16 bp, Homo sapiens
aaactccacatctgcc

SEQ ID NO: 514119 - DNA, 20 bp, Homo sapiens
aaactgaggtgttattttca

SEQ ID NO: 514120 - DNA, 18 bp, Homo sapiens
aaacttgaacttgcaggc

SEQ ID NO: 514121 - DNA, 18 bp, Homo sapiens
aaagagcccttgcctccc

SEQ ID NO: 514122 - DNA, 21 bp, Homo sapiens
aaagagttgtcctgatgtttt

SEQ ID NO: 514123 - DNA, 12 bp, Homo sapiens
aaagcccaggag

SEQ ID NO: 514124 - DNA, 13 bp, Homo sapiens
aaagcccaggagc

SEQ ID NO: 514125 - DNA, 18 bp, Homo sapiens
aaagcctgaaaattccaa

SEQ ID NO: 514126 - DNA, 14 bp, Homo sapiens
aaagctgctaacta

SEQ ID NO: 514127 - DNA, 16 bp, Homo sapiens
aaaggcaaatctgact

SEQ ID NO: 514128 - DNA, 14 bp, Homo sapiens
aaaggggagagcct

SEQ ID NO: 514129 - DNA, 15 bp, Homo sapiens
aaaggggtgctttta

SEQ ID NO: 514130 - DNA, 20 bp, Homo sapiens
aaaggtgagtttgagctgcc

SEQ ID NO: 514131 - DNA, 22 bp, Homo sapiens
aaaggtgagtttgagctgcctt

SEQ ID NO: 514132 - DNA, 23 bp, Homo sapiens
aaaggtgagtttgagctgccttc

SEQ ID NO: 514133 - DNA, 19 bp, Homo sapiens
aaagtaccacattccatga

SEQ ID NO: 514134 - DNA, 17 bp, Homo sapiens
aaagtgggttttttagt

SEQ ID NO: 514135 - DNA, 22 bp, Homo sapiens
aaagtgggttttttagttgaat

SEQ ID NO: 514136 - DNA, 13 bp, Homo sapiens
aaagtgtacattt

SEQ ID NO: 514137 - DNA, 19 bp, Homo sapiens
aaagtttatcagatatttt

SEQ ID NO: 514138 - DNA, 16 bp, Homo sapiens
aaataaaaaagatccc

SEQ ID NO: 514139 - DNA, 15 bp, Homo sapiens
aaatataaatgaaaa

SEQ ID NO: 514140 - DNA, 23 bp, Homo sapiens
aaatatatttttttcaactgcca

SEQ ID NO: 514141 - DNA, 13 bp, Homo sapiens
aaatccaggaccc

SEQ ID NO: 514142 - DNA, 21 bp, Homo sapiens
aaatccaggaccctgccaggc

SEQ ID NO: 514143 - DNA, 13 bp, Homo sapiens
aaatctgactttt

SEQ ID NO: 514144 - DNA, 23 bp, Homo sapiens
aaatctgactttttctgtgcgcc

SEQ ID NO: 514145 - DNA, 15 bp, Homo sapiens
aaatggcaagagatc

SEQ ID NO: 514146 - DNA, 20 bp, Homo sapiens
aaatggcaagagatcatatc

SEQ ID NO: 514147 - DNA, 20 bp, Homo sapiens
aaatgtcacttcatatttta

SEQ ID NO: 514148 - DNA, 19 bp, Homo sapiens
aaatgtgggattatgggtc

SEQ ID NO: 514149 - DNA, 15 bp, Homo sapiens
ctgtaaaatgtggga

SEQ ID NO: 514150 - DNA, 21 bp, Homo sapiens
ctgtatttttttttctaagag

SEQ ID NO: 514151 - DNA, 16 bp, Homo sapiens
ctgtgacatggtgcct

SEQ ID NO: 514152 - DNA, 19 bp, Homo sapiens
ctgtggagactgctcctga

SEQ ID NO: 514153 - DNA, 12 bp, Homo sapiens
ctgtgtggagag

SEQ ID NO: 514154 - DNA, 15 bp, Homo sapiens
ctgtgtggagaggga

SEQ ID NO: 514155 - DNA, 22 bp, Homo sapiens
ctgtgtggagagggaatgtgaa

SEQ ID NO: 514156 - DNA, 23 bp, Homo sapiens
ctgtgtggagagggaatgtgaaa

SEQ ID NO: 514157 - DNA, 14 bp, Homo sapiens
ctgttcatttgaaa

SEQ ID NO: 514158 - DNA, 16 bp, Homo sapiens
ctgttctgtttcctgt

SEQ ID NO: 514159 - DNA, 13 bp, Homo sapiens
ctgtttcctgtgt

SEQ ID NO: 514160 - DNA, 14 bp, Homo sapiens
cttaaaaccaaaga

SEQ ID NO: 514161 - DNA, 15 bp, Homo sapiens
cttaaaaccaaagag

SEQ ID NO: 514162 - DNA, 12 bp, Homo sapiens
cttaaaagaaaa

SEQ ID NO: 514163 - DNA, 14 bp, Homo sapiens
cttaaaagaaaaca

SEQ ID NO: 514164 - DNA, 18 bp, Homo sapiens
cttaaattttaaagcctg

SEQ ID NO: 514165 - DNA, 18 bp, Homo sapiens
cttaattaaaaattactg

SEQ ID NO: 514166 - DNA, 12 bp, Homo sapiens
cttaatttttga

SEQ ID NO: 514167 - DNA, 14 bp, Homo sapiens
cttaatttttgaaa

SEQ ID NO: 514168 - DNA, 16 bp, Homo sapiens
cttacacttaaaagaa

SEQ ID NO: 514169 - DNA, 20 bp, Homo sapiens
cttacacttaaaagaaaaca

SEQ ID NO: 514170 - DNA, 20 bp, Homo sapiens
cttatattagagtcagagat

SEQ ID NO: 514171 - DNA, 21 bp, Homo sapiens
cttattttattatttctaaat

SEQ ID NO: 514172 - DNA, 17 bp, Homo sapiens
cttatttttttcccaag

SEQ ID NO: 514173 - DNA, 18 bp, Homo sapiens
cttcaaaaagcattttaa

SEQ ID NO: 514174 - DNA, 13 bp, Homo sapiens
cttcactccaaag

SEQ ID NO: 514175 - DNA, 19 bp, Homo sapiens
cttcactccaaagagaaac

SEQ ID NO: 514176 - DNA, 13 bp, Homo sapiens
cttccagcaggag

SEQ ID NO: 514177 - DNA, 23 bp, Homo sapiens
cttccagcaggagggacagtctc

SEQ ID NO: 514178 - DNA, 13 bp, Homo sapiens
cttccaggaaact

SEQ ID NO: 514179 - DNA, 22 bp, Homo sapiens
cttccctagctttagaccctgg

SEQ ID NO: 514180 - DNA, 21 bp, Homo sapiens
cttcctgaggggagacagagc

SEQ ID NO: 514181 - DNA, 23 bp, Homo sapiens
cttcctggccggtgtgggggccc

SEQ ID NO: 514182 - DNA, 17 bp, Homo sapiens
cttccttttccctgctt

SEQ ID NO: 514183 - DNA, 14 bp, Homo sapiens
cttctcccctgcac

SEQ ID NO: 514184 - DNA, 22 bp, Homo sapiens
cttctcccctgcactgtaaaat

SEQ ID NO: 514185 - DNA, 16 bp, Homo sapiens
cttctgatcagtctgt

SEQ ID NO: 514186 - DNA, 14 bp, Homo sapiens
cttctgcttttctg

SEQ ID NO: 514187 - DNA, 22 bp, Homo sapiens
cttctgcttttctgccctggct

SEQ ID NO: 514188 - DNA, 23 bp, Homo sapiens
cttctgcttttctgccctggctg

SEQ ID NO: 514189 - DNA, 20 bp, Homo sapiens
cttctgtatttttttttcta

SEQ ID NO: 514190 - DNA, 21 bp, Homo sapiens
cttctgttatttatttcagca

SEQ ID NO: 514191 - DNA, 16 bp, Homo sapiens
cttgaagccaaagaaa

SEQ ID NO: 514192 - DNA, 16 bp, Homo sapiens
cttgagaaatttgaaa

SEQ ID NO: 514193 - DNA, 17 bp, Homo sapiens
cttgagaaatttgaaag

SEQ ID NO: 514194 - DNA, 17 bp, Homo sapiens
cttgagccgggcccctg

SEQ ID NO: 514195 - DNA, 19 bp, Homo sapiens
cttgagccgggcccctggg

SEQ ID NO: 514196 - DNA, 20 bp, Homo sapiens
cttgatgtaaaatcttgtca

SEQ ID NO: 514197 - DNA, 22 bp, Homo sapiens
cttgatgtaaaatcttgtcatg

SEQ ID NO: 514198 - DNA, 15 bp, Homo sapiens
cttgcaggcaaactt

SEQ ID NO: 514199 - DNA, 11 bp, Homo sapiens
cttggcccagg

SEQ ID NO: 514200 - DNA, 18 bp, Homo sapiens
cttggcccagggggcttc

SEQ ID NO: 514201 - DNA, 15 bp, Homo sapiens
cttgggggctcagca

SEQ ID NO: 514202 - DNA, 17 bp, Homo sapiens
cttgggggctcagcaag

SEQ ID NO: 514203 - DNA, 20 bp, Homo sapiens
cttgggggctcagcaaggcc

SEQ ID NO: 514204 - DNA, 19 bp, Homo sapiens
cttggtatgggctgttctg

SEQ ID NO: 514205 - DNA, 19 bp, Homo sapiens
cttggttcctggggcatcc

SEQ ID NO: 514206 - DNA, 17 bp, Homo sapiens
cttgtcatgtgtataaa

SEQ ID NO: 514207 - DNA, 19 bp, Homo sapiens
cttgttatatgcagacatg

SEQ ID NO: 514208 - DNA, 18 bp, Homo sapiens
ctttacatatgattgtat

SEQ ID NO: 514209 - DNA, 12 bp, Homo sapiens
ctttccatgaca

SEQ ID NO: 514210 - DNA, 19 bp, Homo sapiens
ctttccatgacacccaagg

SEQ ID NO: 514211 - DNA, 22 bp, Homo sapiens
ctttgtactgtagctaaatgta

SEQ ID NO: 514212 - DNA, 18 bp, Homo sapiens
ctttgtattataaaattt

SEQ ID NO: 514213 - DNA, 20 bp, Homo sapiens
cttttccctgcttccaggaa

SEQ ID NO: 514214 - DNA, 14 bp, Homo sapiens
cttttccttttgca

SEQ ID NO: 514215 - DNA, 21 bp, Homo sapiens
cttttctggtaattttgggtt

SEQ ID NO: 514216 - DNA, 12 bp, Homo sapiens
ctttttgtactg

SEQ ID NO: 514217 - DNA, 12 bp, Homo sapiens
ctttttgtatct

SEQ ID NO: 514218 - DNA, 19 bp, Homo sapiens
gaaaaaaatataaaatttc

SEQ ID NO: 514219 - DNA, 12 bp, Homo sapiens
gaaaaaatggca

SEQ ID NO: 514220 - DNA, 13 bp, Homo sapiens
gaaaaaatggcaa

SEQ ID NO: 514221 - DNA, 21 bp, Homo sapiens
gaaaaaatggcaagagatcat

SEQ ID NO: 514222 - DNA, 15 bp, Homo sapiens
gaaaaacacaagcaa

SEQ ID NO: 514223 - DNA, 13 bp, Homo sapiens
gaaaaagagaaaa

SEQ ID NO: 514224 - DNA, 17 bp, Homo sapiens
gaaaacttcactccaaa

SEQ ID NO: 514225 - DNA, 21 bp, Homo sapiens
gaaaacttcactccaaagaga

SEQ ID NO: 514226 - DNA, 23 bp, Homo sapiens
gaaaacttcactccaaagagaaa

SEQ ID NO: 514227 - DNA, 18 bp, Homo sapiens
gaaaagtttgttttactt

SEQ ID NO: 514228 - DNA, 12 bp, Homo sapiens
gaaaattccaat

SEQ ID NO: 514229 - DNA, 13 bp, Homo sapiens
gaaaattttgcag

SEQ ID NO: 514230 - DNA, 15 bp, Homo sapiens
gaaacaaagaaagag

SEQ ID NO: 514231 - DNA, 16 bp, Homo sapiens
gaaactccacatctgc

SEQ ID NO: 514232 - DNA, 21 bp, Homo sapiens
gaaagagggagggaaatcttt

SEQ ID NO: 514233 - DNA, 18 bp, Homo sapiens
gaaaggggagagcctgct

SEQ ID NO: 514234 - DNA, 19 bp, Homo sapiens
gaacaaggatgtttttaat

SEQ ID NO: 514235 - DNA, 15 bp, Homo sapiens
gaacagccatatctg

SEQ ID NO: 514236 - DNA, 12 bp, Homo sapiens
gaactctatttt

SEQ ID NO: 514237 - DNA, 15 bp, Homo sapiens
gaactctattttgat

SEQ ID NO: 514238 - DNA, 20 bp, Homo sapiens
gaagaaaaaatggcaagaga

SEQ ID NO: 514239 - DNA, 22 bp, Homo sapiens
gaagaaaggcaaatctgacttt

SEQ ID NO: 514240 - DNA, 16 bp, Homo sapiens
gaagaagggagaagaa

SEQ ID NO: 514241 - DNA, 12 bp, Homo sapiens
gaagagccccac

SEQ ID NO: 514242 - DNA, 15 bp, Homo sapiens
gaagagccccactct

SEQ ID NO: 514243 - DNA, 16 bp, Homo sapiens
gaagagccccactctc

SEQ ID NO: 514244 - DNA, 19 bp, Homo sapiens
gaagagccccactctcaga

SEQ ID NO: 514245 - DNA, 10 bp, Homo sapiens
gaagccaaag

SEQ ID NO: 514246 - DNA, 14 bp, Homo sapiens
gaagccaaagaaaa

SEQ ID NO: 514247 - DNA, 15 bp, Homo sapiens
gaagccaagggaaag

SEQ ID NO: 514248 - DNA, 17 bp, Homo sapiens
gaagccaagggaaaggg

SEQ ID NO: 514249 - DNA, 13 bp, Homo sapiens
gaagccaagtggg

SEQ ID NO: 514250 - DNA, 15 bp, Homo sapiens
gaagctatgttttta

SEQ ID NO: 514251 - DNA, 16 bp, Homo sapiens
gaagctatgtttttaa

SEQ ID NO: 514252 - DNA, 24 bp, Homo sapiens
gaaggacacattgttttccagaag

SEQ ID NO: 514253 - DNA, 14 bp, Homo sapiens
gaaggcaagagggg

SEQ ID NO: 514254 - DNA, 22 bp, Homo sapiens
gaaggcaagagggggtggaggg

SEQ ID NO: 514255 - DNA, 17 bp, Homo sapiens
gaagggcactatatttt

SEQ ID NO: 514256 - DNA, 19 bp, Homo sapiens
gaaggggactgccacctcc

SEQ ID NO: 514257 - DNA, 22 bp, Homo sapiens
gaagtgacggttcctacacagg

SEQ ID NO: 514258 - DNA, 21 bp, Homo sapiens
gaagttattttctacagtggt

SEQ ID NO: 514259 - DNA, 11 bp, Homo sapiens
gaatcacaggc

SEQ ID NO: 514260 - DNA, 12 bp, Homo sapiens
gaatcacaggct

SEQ ID NO: 514261 - DNA, 15 bp, Homo sapiens
gaatcagacatttta

SEQ ID NO: 514262 - DNA, 14 bp, Homo sapiens
gaatcatgtatttt

SEQ ID NO: 514263 - DNA, 21 bp, Homo sapiens
ctcctccatccatgtgttcca

SEQ ID NO: 514264 - DNA, 17 bp, Homo sapiens
ctcctccccaaatcaat

SEQ ID NO: 514265 - DNA, 21 bp, Homo sapiens
ctcctctggacggcaggctca

SEQ ID NO: 514266 - DNA, 11 bp, Homo sapiens
ctcctgagccc

SEQ ID NO: 514267 - DNA, 20 bp, Homo sapiens
ctcctgagcccccagcttcc

SEQ ID NO: 514268 - DNA, 19 bp, Homo sapiens
ctcgcccagtcccagcagc

SEQ ID NO: 514269 - DNA, 18 bp, Homo sapiens
ctctagaagccaagggaa

SEQ ID NO: 514270 - DNA, 22 bp, Homo sapiens
ctctagaagccaagggaaaggg

SEQ ID NO: 514271 - DNA, 17 bp, Homo sapiens
ctctcacagacaggacc

SEQ ID NO: 514272 - DNA, 20 bp, Homo sapiens
ctctcacagacaggacccct

SEQ ID NO: 514273 - DNA, 16 bp, Homo sapiens
ctctcaccatttggat

SEQ ID NO: 514274 - DNA, 19 bp, Homo sapiens
ctctcaggaaatgctgacc

SEQ ID NO: 514275 - DNA, 17 bp, Homo sapiens
ctctccgcccctgagcc

SEQ ID NO: 514276 - DNA, 20 bp, Homo sapiens
ctctccgcccctgagcccac

SEQ ID NO: 514277 - DNA, 15 bp, Homo sapiens
ctctcctccccaaat

SEQ ID NO: 514278 - DNA, 11 bp, Homo sapiens
ctctctctttg

SEQ ID NO: 514279 - DNA, 19 bp, Homo sapiens
ctctctctttgttacataa

SEQ ID NO: 514280 - DNA, 19 bp, Homo sapiens
ctctctgaaggaggccacc

SEQ ID NO: 514281 - DNA, 21 bp, Homo sapiens
ctctctgaaggaggccacctc

SEQ ID NO: 514282 - DNA, 17 bp, Homo sapiens
ctctgaaggaggccacc

SEQ ID NO: 514283 - DNA, 21 bp, Homo sapiens
ctctgaaggaggccacctcct

SEQ ID NO: 514284 - DNA, 20 bp, Homo sapiens
ctctgcctgccccgccccca

SEQ ID NO: 514285 - DNA, 16 bp, Homo sapiens
ctctggacggcaggct

SEQ ID NO: 514286 - DNA, 20 bp, Homo sapiens
ctcttatatttttctgggct

SEQ ID NO: 514287 - DNA, 19 bp, Homo sapiens
ctcttttctggtaattttg

SEQ ID NO: 514288 - DNA, 16 bp, Homo sapiens
ctgaaggaaaaacaca

SEQ ID NO: 514289 - DNA, 17 bp, Homo sapiens
ctgaaggaaaaacacaa

SEQ ID NO: 514290 - DNA, 22 bp, Homo sapiens
ctgaaggaaaaacacaagcaaa

SEQ ID NO: 514291 - DNA, 15 bp, Homo sapiens
ctgaaggaggccacc

SEQ ID NO: 514292 - DNA, 17 bp, Homo sapiens
ctgacccatgggcagga

SEQ ID NO: 514293 - DNA, 23 bp, Homo sapiens
ctgactattcttgatgtaaaatc

SEQ ID NO: 514294 - DNA, 23 bp, Homo sapiens
ctgagagctagtacctatatgct

SEQ ID NO: 514295 - DNA, 17 bp, Homo sapiens
ctgagaggcaggcatag

SEQ ID NO: 514296 - DNA, 22 bp, Homo sapiens
ctgagcccccagcttccagcag

SEQ ID NO: 514297 - DNA, 14 bp, Homo sapiens
ctgagccgcagaga

SEQ ID NO: 514298 - DNA, 15 bp, Homo sapiens
ctgagccgcagagaa

SEQ ID NO: 514299 - DNA, 16 bp, Homo sapiens
ctgagccgcagagaag

SEQ ID NO: 514300 - DNA, 14 bp, Homo sapiens
ctgaggggagacag

SEQ ID NO: 514301 - DNA, 15 bp, Homo sapiens
ctgaggggagacaga

SEQ ID NO: 514302 - DNA, 17 bp, Homo sapiens
ctgaggggagacagagc

SEQ ID NO: 514303 - DNA, 19 bp, Homo sapiens
ctgaggggagacagagcaa

SEQ ID NO: 514304 - DNA, 17 bp, Homo sapiens
ctgaggttcctctgcct

SEQ ID NO: 514305 - DNA, 20 bp, Homo sapiens
ctgagtgagaggggaggcca

SEQ ID NO: 514306 - DNA, 15 bp, Homo sapiens
ctgagtgcaggccca

SEQ ID NO: 514307 - DNA, 14 bp, Homo sapiens
ctgcactgtaaaat

SEQ ID NO: 514308 - DNA, 16 bp, Homo sapiens
ctgcactgtaaaatgt

SEQ ID NO: 514309 - DNA, 18 bp, Homo sapiens
ctgcactgtaaaatgtgg

SEQ ID NO: 514310 - DNA, 20 bp, Homo sapiens
ctgcactgtaaaatgtggga

SEQ ID NO: 514311 - DNA, 15 bp, Homo sapiens
ctgcacttgggggct

SEQ ID NO: 514312 - DNA, 10 bp, Homo sapiens
ctgccacctc

SEQ ID NO: 514313 - DNA, 20 bp, Homo sapiens
ctgccacctccccttgccag

SEQ ID NO: 514314 - DNA, 22 bp, Homo sapiens
ctgccacctccccttgccagct

SEQ ID NO: 514315 - DNA, 15 bp, Homo sapiens
ctgccagctcttcct

SEQ ID NO: 514316 - DNA, 17 bp, Homo sapiens
ctgccagctcttcctag

SEQ ID NO: 514317 - DNA, 15 bp, Homo sapiens
ctgccaggcacaggc

SEQ ID NO: 514318 - DNA, 17 bp, Homo sapiens
ctgccaggcacaggcag

SEQ ID NO: 514319 - DNA, 18 bp, Homo sapiens
ctgccaggcacaggcagg

SEQ ID NO: 514320 - DNA, 19 bp, Homo sapiens
ctgccaggcacaggcaggg

SEQ ID NO: 514321 - DNA, 22 bp, Homo sapiens
ctgccaggcacaggcagggcag

SEQ ID NO: 514322 - DNA, 15 bp, Homo sapiens
ctgccaggccagcct

SEQ ID NO: 514323 - DNA, 16 bp, Homo sapiens
ctgccaggccagcctc

SEQ ID NO: 514324 - DNA, 18 bp, Homo sapiens
ctgccaggccagcctccg

SEQ ID NO: 514325 - DNA, 19 bp, Homo sapiens
ctgccaggccagcctccga

SEQ ID NO: 514326 - DNA, 22 bp, Homo sapiens
ctgccaggccagcctccgagag

SEQ ID NO: 514327 - DNA, 16 bp, Homo sapiens
ctgcccccagccccgg

SEQ ID NO: 514328 - DNA, 23 bp, Homo sapiens
ctgccccgcccccagtccccacc

SEQ ID NO: 514329 - DNA, 14 bp, Homo sapiens
ctgccctggctgct

SEQ ID NO: 514330 - DNA, 14 bp, Homo sapiens
ctgcctctccgccc

SEQ ID NO: 514331 - DNA, 22 bp, Homo sapiens
ctgcctctccgcccctgagccc

SEQ ID NO: 514332 - DNA, 14 bp, Homo sapiens
ctgcctgccccgcc

SEQ ID NO: 514333 - DNA, 22 bp, Homo sapiens
ctgcctgccccgcccccagtcc

SEQ ID NO: 514334 - DNA, 17 bp, Homo sapiens
ctgccttaaaaccaaag

SEQ ID NO: 514335 - DNA, 18 bp, Homo sapiens
ctgccttaaaaccaaaga

SEQ ID NO: 514336 - DNA, 16 bp, Homo sapiens
ctgccttccctagctt

SEQ ID NO: 514337 - DNA, 13 bp, Homo sapiens
ctgcgtcctcctc

SEQ ID NO: 514338 - DNA, 14 bp, Homo sapiens
ctgcgtcctcctca

SEQ ID NO: 514339 - DNA, 24 bp, Homo sapiens
ctgcgtcctcctcacctcatgccc

SEQ ID NO: 514340 - DNA, 12 bp, Homo sapiens
ctgctcctgagc

SEQ ID NO: 514341 - DNA, 13 bp, Homo sapiens
ctgctcctgagcc

SEQ ID NO: 514342 - DNA, 16 bp, Homo sapiens
ctgctgtgattccact

SEQ ID NO: 514343 - DNA, 15 bp, Homo sapiens
ctgcttggcccaggg

SEQ ID NO: 514344 - DNA, 16 bp, Homo sapiens
ctgcttggcccagggg

SEQ ID NO: 514345 - DNA, 18 bp, Homo sapiens
ctgcttttctgccctggc

SEQ ID NO: 514346 - DNA, 20 bp, Homo sapiens
ctgcttttctgccctggctg

SEQ ID NO: 514347 - DNA, 22 bp, Homo sapiens
ctgcttttctgccctggctgct

SEQ ID NO: 514348 - DNA, 19 bp, Homo sapiens
ctggaaaggggagagcctg

SEQ ID NO: 514349 - DNA, 21 bp, Homo sapiens
ctggaaaggggagagcctgct

SEQ ID NO: 514350 - DNA, 20 bp, Homo sapiens
ctggaagcagtgcccaggtg

SEQ ID NO: 514351 - DNA, 22 bp, Homo sapiens
ctggaagggcactatatttttg

SEQ ID NO: 514352 - DNA, 19 bp, Homo sapiens
ctggaatagttactttaca

SEQ ID NO: 514353 - DNA, 13 bp, Homo sapiens
ctggaccccagcc

SEQ ID NO: 514354 - DNA, 22 bp, Homo sapiens
ctggacggcaggctcactgcca

SEQ ID NO: 514355 - DNA, 16 bp, Homo sapiens
ctggaggttgaagcca

SEQ ID NO: 514356 - DNA, 12 bp, Homo sapiens
ctggcacagcct

SEQ ID NO: 514357 - DNA, 14 bp, Homo sapiens
ctggcattctcaaa

SEQ ID NO: 514358 - DNA, 16 bp, Homo sapiens
ctggccctctctgaag

SEQ ID NO: 514359 - DNA, 23 bp, Homo sapiens
ctggctgaggttcctctgcctgc

SEQ ID NO: 514360 - DNA, 15 bp, Homo sapiens
ctggctgctgccccc

SEQ ID NO: 514361 - DNA, 19 bp, Homo sapiens
ctgggacctgccaggcagg

SEQ ID NO: 514362 - DNA, 14 bp, Homo sapiens
ctgggaggagggag

SEQ ID NO: 514363 - DNA, 23 bp, Homo sapiens
ctgggaggagggagagggaggtc

SEQ ID NO: 514364 - DNA, 22 bp, Homo sapiens
ctgggattactgacttttcttt

SEQ ID NO: 514365 - DNA, 18 bp, Homo sapiens
ctgggcactgctctcacc

SEQ ID NO: 514366 - DNA, 17 bp, Homo sapiens
ctgggcttggcctgctg

SEQ ID NO: 514367 - DNA, 15 bp, Homo sapiens
ctgggcttttccttt

SEQ ID NO: 514368 - DNA, 19 bp, Homo sapiens
ctggggcatccatggggtc

SEQ ID NO: 514369 - DNA, 12 bp, Homo sapiens
ctgggtctcctt

SEQ ID NO: 514370 - DNA, 14 bp, Homo sapiens
ctgggtgggctctg

SEQ ID NO: 514371 - DNA, 20 bp, Homo sapiens
ctgggttagactgccagctc

SEQ ID NO: 514372 - DNA, 21 bp, Homo sapiens
ctgggttagactgccagctct

SEQ ID NO: 514373 - DNA, 22 bp, Homo sapiens
ctgggttgttgtttttttcttt

SEQ ID NO: 514374 - DNA, 18 bp, Homo sapiens
ctggtaagtggctttttg

SEQ ID NO: 514375 - DNA, 24 bp, Homo sapiens
ggaccctgccaggcacaggcaggg

SEQ ID NO: 514376 - DNA, 23 bp, Homo sapiens
ggaccctgtgacatggtgcctga

SEQ ID NO: 514377 - DNA, 14 bp, Homo sapiens
ggacctgccaggca

SEQ ID NO: 514378 - DNA, 14 bp, Homo sapiens
ggactcaccatgaa

SEQ ID NO: 514379 - DNA, 14 bp, Homo sapiens
ggactgaggcaagc

SEQ ID NO: 514380 - DNA, 10 bp, Homo sapiens
ggactgccac

SEQ ID NO: 514381 - DNA, 17 bp, Homo sapiens
ggagaatcacaggctgg

SEQ ID NO: 514382 - DNA, 18 bp, Homo sapiens
ggagaatcacaggctggg

SEQ ID NO: 514383 - DNA, 19 bp, Homo sapiens
ggagaatcacaggctgggc

SEQ ID NO: 514384 - DNA, 22 bp, Homo sapiens
ggagaatcacaggctgggctgg

SEQ ID NO: 514385 - DNA, 22 bp, Homo sapiens
ggagacagagcaacccctggac

SEQ ID NO: 514386 - DNA, 11 bp, Homo sapiens
ggagacatcac

SEQ ID NO: 514387 - DNA, 20 bp, Homo sapiens
ggagactgctcctgagcccc

SEQ ID NO: 514388 - DNA, 21 bp, Homo sapiens
ggagactgctcctgagccccc

SEQ ID NO: 514389 - DNA, 12 bp, Homo sapiens
ggagagacttgt

SEQ ID NO: 514390 - DNA, 19 bp, Homo sapiens
ggagagagagagagagagg

SEQ ID NO: 514391 - DNA, 11 bp, Homo sapiens
ggagagcctgc

SEQ ID NO: 514392 - DNA, 16 bp, Homo sapiens
ggagagcctgctggca

SEQ ID NO: 514393 - DNA, 12 bp, Homo sapiens
ggagaggagccc

SEQ ID NO: 514394 - DNA, 16 bp, Homo sapiens
ggagaggagccctgcc

SEQ ID NO: 514395 - DNA, 14 bp, Homo sapiens
ggagagggaatgtg

SEQ ID NO: 514396 - DNA, 16 bp, Homo sapiens
ggagattcaggcagac

SEQ ID NO: 514397 - DNA, 22 bp, Homo sapiens
ggagcccatttggagggcctgg

SEQ ID NO: 514398 - DNA, 15 bp, Homo sapiens
ggaggaggaaggcaa

SEQ ID NO: 514399 - DNA, 11 bp, Homo sapiens
ggaggccaaga

SEQ ID NO: 514400 - DNA, 23 bp, Homo sapiens
ggaggccaagagtggccccacct

SEQ ID NO: 514401 - DNA, 13 bp, Homo sapiens
ggaggccacctcc

SEQ ID NO: 514402 - DNA, 15 bp, Homo sapiens
ggaggcttcctgcgt

SEQ ID NO: 514403 - DNA, 13 bp, Homo sapiens
ggagggagaggga

SEQ ID NO: 514404 - DNA, 17 bp, Homo sapiens
ggaggtggaagaaggga

SEQ ID NO: 514405 - DNA, 14 bp, Homo sapiens
ggaggttgaagcca

SEQ ID NO: 514406 - DNA, 16 bp, Homo sapiens
ggatcctgtgtggaga

SEQ ID NO: 514407 - DNA, 23 bp, Homo sapiens
ggatgtatttgtagccagtctcc

SEQ ID NO: 514408 - DNA, 12 bp, Homo sapiens
ggatgtttttaa

SEQ ID NO: 514409 - DNA, 14 bp, Homo sapiens
ggattactgacttt

SEQ ID NO: 514410 - DNA, 19 bp, Homo sapiens
ggattatgggtcacaggaa

SEQ ID NO: 514411 - DNA, 15 bp, Homo sapiens
ggattgtacatattt

SEQ ID NO: 514412 - DNA, 23 bp, Homo sapiens
ggcaaatgccaaagcagggaaac

SEQ ID NO: 514413 - DNA, 13 bp, Homo sapiens
ggcacagcctgca

SEQ ID NO: 514414 - DNA, 15 bp, Homo sapiens
ggcacagcctgcact

SEQ ID NO: 514415 - DNA, 15 bp, Homo sapiens
ggcacaggcagggca

SEQ ID NO: 514416 - DNA, 17 bp, Homo sapiens
ggcacagggcctggccc

SEQ ID NO: 514417 - DNA, 20 bp, Homo sapiens
ggcacagggcctggcccatg

SEQ ID NO: 514418 - DNA, 20 bp, Homo sapiens
ggcacccaccgtggaggagg

SEQ ID NO: 514419 - DNA, 19 bp, Homo sapiens
ggcacgtggttgagtgggg

SEQ ID NO: 514420 - DNA, 13 bp, Homo sapiens
ggcactatatttt

SEQ ID NO: 514421 - DNA, 18 bp, Homo sapiens
ggcaggaccagcccacgc

SEQ ID NO: 514422 - DNA, 23 bp, Homo sapiens
ggcaggagactgtggagactgct

SEQ ID NO: 514423 - DNA, 15 bp, Homo sapiens
ggcaggctcactgcc

SEQ ID NO: 514424 - DNA, 17 bp, Homo sapiens
ggcagggcacagggcct

SEQ ID NO: 514425 - DNA, 19 bp, Homo sapiens
ggcagggcacagggcctgg

SEQ ID NO: 514426 - DNA, 22 bp, Homo sapiens
ggcagggcacagggcctggccc

SEQ ID NO: 514427 - DNA, 15 bp, Homo sapiens
ggcagggcaggacca

SEQ ID NO: 514428 - DNA, 16 bp, Homo sapiens
ggcagggcaggaccag

SEQ ID NO: 514429 - DNA, 16 bp, Homo sapiens
ggcaggggtgggggtg

SEQ ID NO: 514430 - DNA, 16 bp, Homo sapiens
ggcatagaggcttctc

SEQ ID NO: 514431 - DNA, 22 bp, Homo sapiens
ggcatccatggggtctctcaca

SEQ ID NO: 514432 - DNA, 20 bp, Homo sapiens
ggccaagagtggccccacct

SEQ ID NO: 514433 - DNA, 23 bp, Homo sapiens
ggccacctcctaaaaggcccaga

SEQ ID NO: 514434 - DNA, 20 bp, Homo sapiens
ggccagcctccgagagggag

SEQ ID NO: 514435 - DNA, 19 bp, Homo sapiens
ggccaggaagtagcacagg

SEQ ID NO: 514436 - DNA, 21 bp, Homo sapiens
ggccaggaagtagcacaggct

SEQ ID NO: 514437 - DNA, 22 bp, Homo sapiens
ggccaggaagtagcacaggctg

SEQ ID NO: 514438 - DNA, 22 bp, Homo sapiens
ggcccagagagaagagccccac

SEQ ID NO: 514439 - DNA, 19 bp, Homo sapiens
ggcccatgtatggccagga

SEQ ID NO: 514440 - DNA, 21 bp, Homo sapiens
ggcccatgtatggccaggaag

SEQ ID NO: 514441 - DNA, 13 bp, Homo sapiens
ggcccccacatgg

SEQ ID NO: 514442 - DNA, 22 bp, Homo sapiens
ggcccctgggcttggcctgctg

SEQ ID NO: 514443 - DNA, 21 bp, Homo sapiens
ggccctctctgaaggaggcca

SEQ ID NO: 514444 - DNA, 23 bp, Homo sapiens
ggccgccggcaataaaagcccag

SEQ ID NO: 514445 - DNA, 10 bp, Homo sapiens
ggcctgctgt

SEQ ID NO: 514446 - DNA, 19 bp, Homo sapiens
ggcctgctgtgattccact

SEQ ID NO: 514447 - DNA, 23 bp, Homo sapiens
ggcctggctccctcactctcagg

SEQ ID NO: 514448 - DNA, 13 bp, Homo sapiens
ggctcactgccag

SEQ ID NO: 514449 - DNA, 16 bp, Homo sapiens
ggctcactgccaggcc

SEQ ID NO: 514450 - DNA, 13 bp, Homo sapiens
ggctcagcaaggc

SEQ ID NO: 514451 - DNA, 22 bp, Homo sapiens
ggctcagcaaggccacctcttc

SEQ ID NO: 514452 - DNA, 21 bp, Homo sapiens
ggctcccgcctccaacccctc

SEQ ID NO: 514453 - DNA, 15 bp, Homo sapiens
ggctccctcactctc

SEQ ID NO: 514454 - DNA, 17 bp, Homo sapiens
ggctccctcactctcag

SEQ ID NO: 514455 - DNA, 16 bp, Homo sapiens
ggctgaggttcctctg

SEQ ID NO: 514456 - DNA, 18 bp, Homo sapiens
ggctgaggttcctctgcc

SEQ ID NO: 514457 - DNA, 19 bp, Homo sapiens
ggctgaggttcctctgcct

SEQ ID NO: 514458 - DNA, 22 bp, Homo sapiens
ggctgaggttcctctgcctgcc

SEQ ID NO: 514459 - DNA, 15 bp, Homo sapiens
ggctgagtgcaggcc

SEQ ID NO: 514460 - DNA, 13 bp, Homo sapiens
ggctgctgccccc

SEQ ID NO: 514461 - DNA, 14 bp, Homo sapiens
ggctgggcactgct

SEQ ID NO: 514462 - DNA, 20 bp, Homo sapiens
ggctgggcactgctctcacc

SEQ ID NO: 514463 - DNA, 14 bp, Homo sapiens
ggctgggctgggca

SEQ ID NO: 514464 - DNA, 23 bp, Homo sapiens
ggctgttctgtttcctgtgtctc

SEQ ID NO: 514465 - DNA, 19 bp, Homo sapiens
ggcttcctgcgtcctcctc

SEQ ID NO: 514466 - DNA, 23 bp, Homo sapiens
ggcttctccgccagcctcctctg

SEQ ID NO: 514467 - DNA, 12 bp, Homo sapiens
ggcttgaagcca

SEQ ID NO: 514468 - DNA, 12 bp, Homo sapiens
ggcttggcctgc

SEQ ID NO: 514469 - DNA, 16 bp, Homo sapiens
ggcttggcctgctgtg

SEQ ID NO: 514470 - DNA, 12 bp, Homo sapiens
gggaacgcccac

SEQ ID NO: 514471 - DNA, 16 bp, Homo sapiens
gggaacgcccacttcc

SEQ ID NO: 514472 - DNA, 12 bp, Homo sapiens
gggacagtctca

SEQ ID NO: 514473 - DNA, 19 bp, Homo sapiens
gggacctgccaggcagggg

SEQ ID NO: 514474 - DNA, 18 bp, Homo sapiens
gggactgccacctcccct

SEQ ID NO: 514475 - DNA, 12 bp, Homo sapiens
gggagagcctgc

SEQ ID NO: 514476 - DNA, 23 bp, Homo sapiens
gggaggccaagagtggccccacc

SEQ ID NO: 514477 - DNA, 23 bp, Homo sapiens
gggaggtggaagaagggagaaga

SEQ ID NO: 514478 - DNA, 13 bp, Homo sapiens
gggcacagggcct

SEQ ID NO: 514479 - DNA, 14 bp, Homo sapiens
gggcacagggcctg

SEQ ID NO: 514480 - DNA, 16 bp, Homo sapiens
gggcacagggcctggc

SEQ ID NO: 514481 - DNA, 17 bp, Homo sapiens
gggcactgctctcacct

SEQ ID NO: 514482 - DNA, 18 bp, Homo sapiens
gggcaggaccagcccacg

SEQ ID NO: 514483 - DNA, 21 bp, Homo sapiens
gggcaggaccagcccacgctg

SEQ ID NO: 514484 - DNA, 14 bp, Homo sapiens
gggcatccatgggg

SEQ ID NO: 514485 - DNA, 21 bp, Homo sapiens
gggcccctgggcttggcctgc

SEQ ID NO: 514486 - DNA, 14 bp, Homo sapiens
gtgtttttccaaaa

SEQ ID NO: 514487 - DNA, 15 bp, Homo sapiens
gttagactgccagct

SEQ ID NO: 514488 - DNA, 16 bp, Homo sapiens
gttatctcaaatttta

SEQ ID NO: 514489 - DNA, 17 bp, Homo sapiens
gttattttctacagtgg

SEQ ID NO: 514490 - DNA, 16 bp, Homo sapiens
gttcattttgcacctt

SEQ ID NO: 514491 - DNA, 20 bp, Homo sapiens
gttccaaatttgctttacat

SEQ ID NO: 514492 - DNA, 15 bp, Homo sapiens
gttcctacacaggac

SEQ ID NO: 514493 - DNA, 13 bp, Homo sapiens
gttcctctgcctg

SEQ ID NO: 514494 - DNA, 13 bp, Homo sapiens
gttctagaatcat

SEQ ID NO: 514495 - DNA, 12 bp, Homo sapiens
gttcttctgtta

SEQ ID NO: 514496 - DNA, 13 bp, Homo sapiens
gttgaagaaaaaa

SEQ ID NO: 514497 - DNA, 18 bp, Homo sapiens
gttgaagaaaaaatggca

SEQ ID NO: 514498 - DNA, 17 bp, Homo sapiens
gttgaattttattgaaa

SEQ ID NO: 514499 - DNA, 23 bp, Homo sapiens
gttgaattttttttaacattcct

SEQ ID NO: 514500 - DNA, 12 bp, Homo sapiens
gtttaaagagtt

SEQ ID NO: 514501 - DNA, 14 bp, Homo sapiens
gtttcaaagaaaga

SEQ ID NO: 514502 - DNA, 17 bp, Homo sapiens
gtttcaaagaaagactg

SEQ ID NO: 514503 - DNA, 14 bp, Homo sapiens
gtttgagctgcctt

SEQ ID NO: 514504 - DNA, 15 bp, Homo sapiens
gtttgagctgccttc

SEQ ID NO: 514505 - DNA, 18 bp, Homo sapiens
gtttgagctgccttccct

SEQ ID NO: 514506 - DNA, 17 bp, Homo sapiens
gtttgttttttcaagaa

SEQ ID NO: 514507 - DNA, 19 bp, Homo sapiens
gtttgttttttcaagaaaa

SEQ ID NO: 514508 - DNA, 21 bp, Homo sapiens
gttttatactgaaggaaaaac

SEQ ID NO: 514509 - DNA, 13 bp, Homo sapiens
gttttccttttgt

SEQ ID NO: 514510 - DNA, 15 bp, Homo sapiens
gttttgtgtttttcc

SEQ ID NO: 514511 - DNA, 12 bp, Homo sapiens
gtttttccaaaa

SEQ ID NO: 514512 - DNA, 20 bp, Homo sapiens
taaaaagtaccacattccat

SEQ ID NO: 514513 - DNA, 16 bp, Homo sapiens
taaaaataaaaaagat

SEQ ID NO: 514514 - DNA, 23 bp, Homo sapiens
taaaactcactgaatctaaccat

SEQ ID NO: 514515 - DNA, 22 bp, Homo sapiens
taaaatcttgtcatgtgtataa

SEQ ID NO: 514516 - DNA, 24 bp, Homo sapiens
taaacaaaatgtagacaaagtgaa

SEQ ID NO: 514517 - DNA, 13 bp, Homo sapiens
taaacaattcttg

SEQ ID NO: 514518 - DNA, 15 bp, Homo sapiens
taaacaattcttgta

SEQ ID NO: 514519 - DNA, 20 bp, Homo sapiens
taaacaattcttgtaacttt

SEQ ID NO: 514520 - DNA, 22 bp, Homo sapiens
taaagaaaacttacagaagagg

SEQ ID NO: 514521 - DNA, 21 bp, Homo sapiens
taaagagcccttgcctcccca

SEQ ID NO: 514522 - DNA, 15 bp, Homo sapiens
taaagcctgaaaatt

SEQ ID NO: 514523 - DNA, 16 bp, Homo sapiens
taaagcctgaaaattc

SEQ ID NO: 514524 - DNA, 18 bp, Homo sapiens
taaagcctgaaaattcca

SEQ ID NO: 514525 - DNA, 20 bp, Homo sapiens
taaagcctgaaaattccaat

SEQ ID NO: 514526 - DNA, 13 bp, Homo sapiens
taaagtcagtgtt

SEQ ID NO: 514527 - DNA, 16 bp, Homo sapiens
taaagtcagtgttgaa

SEQ ID NO: 514528 - DNA, 17 bp, Homo sapiens
taaagttccctatttgt

SEQ ID NO: 514529 - DNA, 20 bp, Homo sapiens
taaatagaggtctgtaaaga

SEQ ID NO: 514530 - DNA, 20 bp, Homo sapiens
taaatagcccagatcccaag

SEQ ID NO: 514531 - DNA, 21 bp, Homo sapiens
taaatagcccagatcccaaga

SEQ ID NO: 514532 - DNA, 22 bp, Homo sapiens
taaatatatttttttcaactgc

SEQ ID NO: 514533 - DNA, 13 bp, Homo sapiens
taaatttgtacta

SEQ ID NO: 514534 - DNA, 22 bp, Homo sapiens
taaattttaaagcctgaaaatt

SEQ ID NO: 514535 - DNA, 19 bp, Homo sapiens
taacagagaatggtggtat

SEQ ID NO: 514536 - DNA, 14 bp, Homo sapiens
taacataatcacaa

SEQ ID NO: 514537 - DNA, 21 bp, Homo sapiens
taacattcctcatgaatgtaa

SEQ ID NO: 514538 - DNA, 22 bp, Homo sapiens
taacattcctcatgaatgtaaa

SEQ ID NO: 514539 - DNA, 14 bp, Homo sapiens
taactgactattct

SEQ ID NO: 514540 - DNA, 22 bp, Homo sapiens
taactgactattcttgatgtaa

SEQ ID NO: 514541 - DNA, 21 bp, Homo sapiens
taagatatatttgtcattttc

SEQ ID NO: 514542 - DNA, 19 bp, Homo sapiens
taagcaagtggttgtttta

SEQ ID NO: 514543 - DNA, 16 bp, Homo sapiens
taaggtgggaaaaaaa

SEQ ID NO: 514544 - DNA, 16 bp, Homo sapiens
taagtcatcatctcca

SEQ ID NO: 514545 - DNA, 18 bp, Homo sapiens
taagtcatcatctccaaa

SEQ ID NO: 514546 - DNA, 17 bp, Homo sapiens
taatccccttctcccct

SEQ ID NO: 514547 - DNA, 20 bp, Homo sapiens
taatgaaaatgtctcagtat

SEQ ID NO: 514548 - DNA, 23 bp, Homo sapiens
taatgcacgacattgattgctgc

SEQ ID NO: 514549 - DNA, 16 bp, Homo sapiens
taatggtctaaaacag

SEQ ID NO: 514550 - DNA, 14 bp, Homo sapiens
taattcgtttgcta

SEQ ID NO: 514551 - DNA, 11 bp, Homo sapiens
taatttaaagt

SEQ ID NO: 514552 - DNA, 14 bp, Homo sapiens
taatttttgaaaag

SEQ ID NO: 514553 - DNA, 17 bp, Homo sapiens
taattttttttttctca

SEQ ID NO: 514554 - DNA, 17 bp, Homo sapiens
tacaatatgtatttatg

SEQ ID NO: 514555 - DNA, 15 bp, Homo sapiens
tacaatgggaaaact

SEQ ID NO: 514556 - DNA, 16 bp, Homo sapiens
tacaatgggaaaactt

SEQ ID NO: 514557 - DNA, 17 bp, Homo sapiens
tacaatgggaaaacttc

SEQ ID NO: 514558 - DNA, 22 bp, Homo sapiens
tacacaggacaggggttccttc

SEQ ID NO: 514559 - DNA, 23 bp, Homo sapiens
tacacctggctgaggttcctctg

SEQ ID NO: 514560 - DNA, 13 bp, Homo sapiens
tacacttaaaaga

SEQ ID NO: 514561 - DNA, 19 bp, Homo sapiens
tacacttaaaagaaaacaa

SEQ ID NO: 514562 - DNA, 21 bp, Homo sapiens
tacagaagaggcaacaatttg

SEQ ID NO: 514563 - DNA, 22 bp, Homo sapiens
tacagtggttttatactgaagg

SEQ ID NO: 514564 - DNA, 18 bp, Homo sapiens
tacattataccgcagagt

SEQ ID NO: 514565 - DNA, 22 bp, Homo sapiens
tacattataccgcagagtattt

SEQ ID NO: 514566 - DNA, 23 bp, Homo sapiens
tacattttataaagtttatcaga

SEQ ID NO: 514567 - DNA, 14 bp, Homo sapiens
taccagctgcgctt

SEQ ID NO: 514568 - DNA, 12 bp, Homo sapiens
tacccagcagag

SEQ ID NO: 514569 - DNA, 16 bp, Homo sapiens
taccgcagagtatttg

SEQ ID NO: 514570 - DNA, 19 bp, Homo sapiens
taccggttagcatggtttt

SEQ ID NO: 514571 - DNA, 12 bp, Homo sapiens
tactatttaact

SEQ ID NO: 514572 - DNA, 19 bp, Homo sapiens
tagaaagtataatttcagt

SEQ ID NO: 514573 - DNA, 16 bp, Homo sapiens
tagaagccaagggaaa

SEQ ID NO: 514574 - DNA, 15 bp, Homo sapiens
tagaatcatgtattt

SEQ ID NO: 514575 - DNA, 13 bp, Homo sapiens
tagactgccagct

SEQ ID NO: 514576 - DNA, 19 bp, Homo sapiens
tagagatattttgggtata

SEQ ID NO: 514577 - DNA, 18 bp, Homo sapiens
tagaggcttctccgccag

SEQ ID NO: 514578 - DNA, 22 bp, Homo sapiens
tagaggcttctccgccagcctc

SEQ ID NO: 514579 - DNA, 14 bp, Homo sapiens
tagatccaaatgta

SEQ ID NO: 514580 - DNA, 15 bp, Homo sapiens
tagcacaggctgagt

SEQ ID NO: 514581 - DNA, 19 bp, Homo sapiens
tagcacaggctgagtgcag

SEQ ID NO: 514582 - DNA, 23 bp, Homo sapiens
tagctggagaggagccctgcctc

SEQ ID NO: 514583 - DNA, 13 bp, Homo sapiens
tagcttctgcttt

SEQ ID NO: 514584 - DNA, 16 bp, Homo sapiens
tagcttctgcttttct

SEQ ID NO: 514585 - DNA, 17 bp, Homo sapiens
tagctttagaccctggg

SEQ ID NO: 514586 - DNA, 18 bp, Homo sapiens
tagtgcctacaatgggaa

SEQ ID NO: 514587 - DNA, 21 bp, Homo sapiens
tagttcagatagagatatttt

SEQ ID NO: 514588 - DNA, 14 bp, Homo sapiens
tagttttccttttg

SEQ ID NO: 514589 - DNA, 21 bp, Homo sapiens
tataacataatcacaagtaaa

SEQ ID NO: 514590 - DNA, 22 bp, Homo sapiens
tataatttcagtgcagtaattt

SEQ ID NO: 514591 - DNA, 20 bp, Homo sapiens
tatactgaaggaaaaacaca

SEQ ID NO: 514592 - DNA, 18 bp, Homo sapiens
tatcagatattttcatat

SEQ ID NO: 514593 - DNA, 11 bp, Homo sapiens
tatcctttcct

SEQ ID NO: 514594 - DNA, 12 bp, Homo sapiens
tatccttttcta

SEQ ID NO: 514595 - DNA, 14 bp, Homo sapiens
tatctacattatac

SEQ ID NO: 514596 - DNA, 16 bp, Homo sapiens
tatctcaactctgttt

SEQ ID NO: 514597 - DNA, 21 bp, Homo sapiens
tatctcaactctgtttatttg

SEQ ID NO: 514598 - DNA, 12 bp, Homo sapiens
ttcactccaaag

SEQ ID NO: 514599 - DNA, 13 bp, Homo sapiens
ttcagatagagat

SEQ ID NO: 514600 - DNA, 20 bp, Homo sapiens
ttcagtgcagtaatttctga

SEQ ID NO: 514601 - DNA, 14 bp, Homo sapiens
ttcataagacaaga

SEQ ID NO: 514602 - DNA, 13 bp, Homo sapiens
ttcatatttaaag

SEQ ID NO: 514603 - DNA, 11 bp, Homo sapiens
ttcattttgca

SEQ ID NO: 514604 - DNA, 12 bp, Homo sapiens
ttcattttgcac

SEQ ID NO: 514605 - DNA, 16 bp, Homo sapiens
ttccaaatttgcttta

SEQ ID NO: 514606 - DNA, 19 bp, Homo sapiens
ttccaaatttgctttacat

SEQ ID NO: 514607 - DNA, 16 bp, Homo sapiens
ttccactacacctggc

SEQ ID NO: 514608 - DNA, 13 bp, Homo sapiens
ttccagcaggagg

SEQ ID NO: 514609 - DNA, 24 bp, Homo sapiens
ttccaggaaactccacatctgcct

SEQ ID NO: 514610 - DNA, 22 bp, Homo sapiens
ttccctatttgtgaattctggg

SEQ ID NO: 514611 - DNA, 14 bp, Homo sapiens
ttcctacacaggac

SEQ ID NO: 514612 - DNA, 17 bp, Homo sapiens
ttcctacacaggacagg

SEQ ID NO: 514613 - DNA, 14 bp, Homo sapiens
ttcctcatgaatgt

SEQ ID NO: 514614 - DNA, 17 bp, Homo sapiens
ttcctcatgaatgtaaa

SEQ ID NO: 514615 - DNA, 22 bp, Homo sapiens
ttcctcatgaatgtaaatttgt

SEQ ID NO: 514616 - DNA, 12 bp, Homo sapiens
ttcctctgcctg

SEQ ID NO: 514617 - DNA, 15 bp, Homo sapiens
ttcctgcgtcctcct

SEQ ID NO: 514618 - DNA, 19 bp, Homo sapiens
ttcctgcgtcctcctcacc

SEQ ID NO: 514619 - DNA, 15 bp, Homo sapiens
ttcctgtgtctccaa

SEQ ID NO: 514620 - DNA, 12 bp, Homo sapiens
ttccttttgcac

SEQ ID NO: 514621 - DNA, 18 bp, Homo sapiens
ttcgtattgctatgttct

SEQ ID NO: 514622 - DNA, 18 bp, Homo sapiens
ttctaagagaagttattt

SEQ ID NO: 514623 - DNA, 15 bp, Homo sapiens
ttctacagtggtttt

SEQ ID NO: 514624 - DNA, 19 bp, Homo sapiens
ttctcccaggtaccagctg

SEQ ID NO: 514625 - DNA, 20 bp, Homo sapiens
ttctcccctgcactgtaaaa

SEQ ID NO: 514626 - DNA, 13 bp, Homo sapiens
ttctccgccagcc

SEQ ID NO: 514627 - DNA, 17 bp, Homo sapiens
ttctccgccagcctcct

SEQ ID NO: 514628 - DNA, 17 bp, Homo sapiens
ttctctattctttccat

SEQ ID NO: 514629 - DNA, 14 bp, Homo sapiens
ttctctcctcccca

SEQ ID NO: 514630 - DNA, 17 bp, Homo sapiens
ttctctcctccccaaat

SEQ ID NO: 514631 - DNA, 22 bp, Homo sapiens
ttctgataatttattgtcttta

SEQ ID NO: 514632 - DNA, 14 bp, Homo sapiens
ttctgccctggctg

SEQ ID NO: 514633 - DNA, 20 bp, Homo sapiens
ttctgccctggctgctgccc

SEQ ID NO: 514634 - DNA, 17 bp, Homo sapiens
ttctgcttttctgccct

SEQ ID NO: 514635 - DNA, 19 bp, Homo sapiens
ttctgcttttctgccctgg

SEQ ID NO: 514636 - DNA, 22 bp, Homo sapiens
ttctgtatttttttttctaaga

SEQ ID NO: 514637 - DNA, 20 bp, Homo sapiens
ttctgtttcctgtgtctcca

SEQ ID NO: 514638 - DNA, 15 bp, Homo sapiens
ttcttgatgtaaaat

SEQ ID NO: 514639 - DNA, 18 bp, Homo sapiens
ttcttgtaactttcttca

SEQ ID NO: 514640 - DNA, 18 bp, Homo sapiens
ttctttttgggagagact

SEQ ID NO: 514641 - DNA, 19 bp, Homo sapiens
ttgaaccgccggttcattt

SEQ ID NO: 514642 - DNA, 14 bp, Homo sapiens
ttgaagccaaagaa

SEQ ID NO: 514643 - DNA, 20 bp, Homo sapiens
ttgaagccaagtggggtgct

SEQ ID NO: 514644 - DNA, 19 bp, Homo sapiens
ttgaattttattgaaagct

SEQ ID NO: 514645 - DNA, 19 bp, Homo sapiens
ttgagccgggcccctgggc

SEQ ID NO: 514646 - DNA, 12 bp, Homo sapiens
ttgagctgcctt

SEQ ID NO: 514647 - DNA, 14 bp, Homo sapiens
ttgagctgccttcc

SEQ ID NO: 514648 - DNA, 15 bp, Homo sapiens
ttgagctgccttccc

SEQ ID NO: 514649 - DNA, 19 bp, Homo sapiens
ttgattttttttctctctc

SEQ ID NO: 514650 - DNA, 12 bp, Homo sapiens
ttgcaaaggaaa

SEQ ID NO: 514651 - DNA, 14 bp, Homo sapiens
ttgcacattccaaa

SEQ ID NO: 514652 - DNA, 13 bp, Homo sapiens
ttgccttttttat

SEQ ID NO: 514653 - DNA, 12 bp, Homo sapiens
ttgctcttctga

SEQ ID NO: 514654 - DNA, 23 bp, Homo sapiens
ttgctgcattttaccttcaaaat

SEQ ID NO: 514655 - DNA, 21 bp, Homo sapiens
tatttttctgggcttttcctt

SEQ ID NO: 514656 - DNA, 13 bp, Homo sapiens
tcaaaaagcattt

SEQ ID NO: 514657 - DNA, 13 bp, Homo sapiens
tcaaaatatttgt

SEQ ID NO: 514658 - DNA, 14 bp, Homo sapiens
tcaaatccaggacc

SEQ ID NO: 514659 - DNA, 15 bp, Homo sapiens
tcaaatccaggaccc

SEQ ID NO: 514660 - DNA, 19 bp, Homo sapiens
tcaaatccaggaccctgcc

SEQ ID NO: 514661 - DNA, 16 bp, Homo sapiens
tcaagaaaattttgca

SEQ ID NO: 514662 - DNA, 20 bp, Homo sapiens
tcaagatacatgttgtattt

SEQ ID NO: 514663 - DNA, 18 bp, Homo sapiens
tcaagtgcttaggaagga

SEQ ID NO: 514664 - DNA, 15 bp, Homo sapiens
tcaatgaaacaaaga

SEQ ID NO: 514665 - DNA, 17 bp, Homo sapiens
tcaatgaaacaaagaaa

SEQ ID NO: 514666 - DNA, 18 bp, Homo sapiens
tcacaagtaacagttgaa

SEQ ID NO: 514667 - DNA, 17 bp, Homo sapiens
tcacagtgtgattttga

SEQ ID NO: 514668 - DNA, 15 bp, Homo sapiens
tcaccttagggaaga

SEQ ID NO: 514669 - DNA, 11 bp, Homo sapiens
tcactccaaag

SEQ ID NO: 514670 - DNA, 11 bp, Homo sapiens
tcactctcagg

SEQ ID NO: 514671 - DNA, 20 bp, Homo sapiens
tcactgccaggccagcctcc

SEQ ID NO: 514672 - DNA, 21 bp, Homo sapiens
tcactggaaaggggagagcct

SEQ ID NO: 514673 - DNA, 12 bp, Homo sapiens
tcacttgccaat

SEQ ID NO: 514674 - DNA, 12 bp, Homo sapiens
tcagaggcccca

SEQ ID NO: 514675 - DNA, 17 bp, Homo sapiens
tcagatagagatatttt

SEQ ID NO: 514676 - DNA, 14 bp, Homo sapiens
tcagatattttcat

SEQ ID NO: 514677 - DNA, 13 bp, Homo sapiens
tcagcaaggccac

SEQ ID NO: 514678 - DNA, 16 bp, Homo sapiens
tcagcaaggccacctc

SEQ ID NO: 514679 - DNA, 16 bp, Homo sapiens
tcagctgctgctatta

SEQ ID NO: 514680 - DNA, 12 bp, Homo sapiens
tcagtctacccc

SEQ ID NO: 514681 - DNA, 16 bp, Homo sapiens
tcagtgatatgtaaat

SEQ ID NO: 514682 - DNA, 16 bp, Homo sapiens
tcagtgttgaatttta

SEQ ID NO: 514683 - DNA, 13 bp, Homo sapiens
tcataagacaaga

SEQ ID NO: 514684 - DNA, 13 bp, Homo sapiens
tcatgcccacccc

SEQ ID NO: 514685 - DNA, 18 bp, Homo sapiens
tcatgcccaccccctgcc

SEQ ID NO: 514686 - DNA, 20 bp, Homo sapiens
tcatgcccaccccctgccct

SEQ ID NO: 514687 - DNA, 23 bp, Homo sapiens
tcatgcccaccccctgccctgca

SEQ ID NO: 514688 - DNA, 23 bp, Homo sapiens
tcatgggagggggcttgaagcca

SEQ ID NO: 514689 - DNA, 19 bp, Homo sapiens
tcatttccaaattcctaga

SEQ ID NO: 514690 - DNA, 23 bp, Homo sapiens
tcatttctttttgggagagactt

SEQ ID NO: 514691 - DNA, 12 bp, Homo sapiens
tccaaagagaaa

SEQ ID NO: 514692 - DNA, 13 bp, Homo sapiens
tccaaagagaaac

SEQ ID NO: 514693 - DNA, 18 bp, Homo sapiens
tccaacccctcgcccagt

SEQ ID NO: 514694 - DNA, 24 bp, Homo sapiens
tccaacccctcgcccagtcccagc

SEQ ID NO: 514695 - DNA, 18 bp, Homo sapiens
tccacacttgctcttctg

SEQ ID NO: 514696 - DNA, 16 bp, Homo sapiens
tccactacacctggct

SEQ ID NO: 514697 - DNA, 17 bp, Homo sapiens
tccagcaggagggacag

SEQ ID NO: 514698 - DNA, 15 bp, Homo sapiens
tccagcatgaaagat

SEQ ID NO: 514699 - DNA, 23 bp, Homo sapiens
tccaggaaactccacatctgcct

SEQ ID NO: 514700 - DNA, 16 bp, Homo sapiens
tccatccatgtgttcc

SEQ ID NO: 514701 - DNA, 16 bp, Homo sapiens
tccatgacacccaagg

SEQ ID NO: 514702 - DNA, 22 bp, Homo sapiens
tccatggggtctctcacagaca

SEQ ID NO: 514703 - DNA, 15 bp, Homo sapiens
tccattctcccaggt

SEQ ID NO: 514704 - DNA, 16 bp, Homo sapiens
tccattctcccaggta

SEQ ID NO: 514705 - DNA, 14 bp, Homo sapiens
tcccagcagccagc

SEQ ID NO: 514706 - DNA, 15 bp, Homo sapiens
tcccagcagccagcc

SEQ ID NO: 514707 - DNA, 16 bp, Homo sapiens
tcccagcagccagcca

SEQ ID NO: 514708 - DNA, 19 bp, Homo sapiens
tcccaggtaccagctgcgc

SEQ ID NO: 514709 - DNA, 22 bp, Homo sapiens
tccccacccctgcccccagccc

SEQ ID NO: 514710 - DNA, 15 bp, Homo sapiens
tcccctgcactgtaa

SEQ ID NO: 514711 - DNA, 22 bp, Homo sapiens
tcccctgcactgtaaaatgtgg

SEQ ID NO: 514712 - DNA, 17 bp, Homo sapiens
tcccctggaagcagtgc

SEQ ID NO: 514713 - DNA, 19 bp, Homo sapiens
tcccctggaagcagtgccc

SEQ ID NO: 514714 - DNA, 17 bp, Homo sapiens
tccccttgccagctgct

SEQ ID NO: 514715 - DNA, 15 bp, Homo sapiens
tcccgcctccaaccc

SEQ ID NO: 514716 - DNA, 19 bp, Homo sapiens
tccctagctttagaccctg

SEQ ID NO: 514717 - DNA, 17 bp, Homo sapiens
tccctcactctcaggaa

SEQ ID NO: 514718 - DNA, 23 bp, Homo sapiens
tccctgggttagactgccagctc

SEQ ID NO: 514719 - DNA, 18 bp, Homo sapiens
tcccttccttttccctgc

SEQ ID NO: 514720 - DNA, 19 bp, Homo sapiens
tcccttccttttccctgct

SEQ ID NO: 514721 - DNA, 15 bp, Homo sapiens
tccgagagggagaga

SEQ ID NO: 514722 - DNA, 14 bp, Homo sapiens
tccgccagcctcct

SEQ ID NO: 514723 - DNA, 15 bp, Homo sapiens
tccgccagcctcctc

SEQ ID NO: 514724 - DNA, 17 bp, Homo sapiens
tccgccagcctcctctg

SEQ ID NO: 514725 - DNA, 18 bp, Homo sapiens
tccgcccctgagcccact

SEQ ID NO: 514726 - DNA, 20 bp, Homo sapiens
tccgcccctgagcccactgt

SEQ ID NO: 514727 - DNA, 12 bp, Homo sapiens
tcctacacagga

SEQ ID NO: 514728 - DNA, 15 bp, Homo sapiens
tcctacacaggacag

SEQ ID NO: 514729 - DNA, 12 bp, Homo sapiens
tcctcctcacct

SEQ ID NO: 514730 - DNA, 18 bp, Homo sapiens
tcctcctcacctcatgcc

SEQ ID NO: 514731 - DNA, 19 bp, Homo sapiens
tcctctagaagccaaggga

SEQ ID NO: 514732 - DNA, 13 bp, Homo sapiens
attggtgctttgt

SEQ ID NO: 514733 - DNA, 14 bp, Homo sapiens
attggtgctttgtg

SEQ ID NO: 514734 - DNA, 17 bp, Homo sapiens
atttaaagccaaatgta

SEQ ID NO: 514735 - DNA, 21 bp, Homo sapiens
atttaaagccaaatgtaaata

SEQ ID NO: 514736 - DNA, 20 bp, Homo sapiens
atttagacaagagatgggaa

SEQ ID NO: 514737 - DNA, 23 bp, Homo sapiens
atttatggaagaaagagttgtcc

SEQ ID NO: 514738 - DNA, 20 bp, Homo sapiens
atttattgtctttattttta

SEQ ID NO: 514739 - DNA, 14 bp, Homo sapiens
atttccccagggca

SEQ ID NO: 514740 - DNA, 15 bp, Homo sapiens
atttccccagggcac

SEQ ID NO: 514741 - DNA, 17 bp, Homo sapiens
atttctcctcccttcct

SEQ ID NO: 514742 - DNA, 18 bp, Homo sapiens
atttcttacgtacactgt

SEQ ID NO: 514743 - DNA, 20 bp, Homo sapiens
atttctttctaaaacacatt

SEQ ID NO: 514744 - DNA, 21 bp, Homo sapiens
atttctttttgggagagactt

SEQ ID NO: 514745 - DNA, 17 bp, Homo sapiens
atttgctgtctttttgt

SEQ ID NO: 514746 - DNA, 19 bp, Homo sapiens
atttgtactatttaactga

SEQ ID NO: 514747 - DNA, 17 bp, Homo sapiens
attttaaagtcagtgtt

SEQ ID NO: 514748 - DNA, 14 bp, Homo sapiens
attttaatgatatt

SEQ ID NO: 514749 - DNA, 16 bp, Homo sapiens
attttaatgatattgg

SEQ ID NO: 514750 - DNA, 22 bp, Homo sapiens
attttagggtcaatgagagcca

SEQ ID NO: 514751 - DNA, 14 bp, Homo sapiens
attttattatttct

SEQ ID NO: 514752 - DNA, 18 bp, Homo sapiens
attttattatttctaaat

SEQ ID NO: 514753 - DNA, 22 bp, Homo sapiens
attttatttagacaagagatgg

SEQ ID NO: 514754 - DNA, 17 bp, Homo sapiens
attttctctattctttc

SEQ ID NO: 514755 - DNA, 15 bp, Homo sapiens
attttgcagaagcta

SEQ ID NO: 514756 - DNA, 13 bp, Homo sapiens
atttttatcccag

SEQ ID NO: 514757 - DNA, 15 bp, Homo sapiens
atttttatcccagga

SEQ ID NO: 514758 - DNA, 23 bp, Homo sapiens
atttttctgggcttttccttttg

SEQ ID NO: 514759 - DNA, 14 bp, Homo sapiens
attttttttaacat

SEQ ID NO: 514760 - DNA, 18 bp, Homo sapiens
atttttttttctaagaga

SEQ ID NO: 514761 - DNA, 23 bp, Homo sapiens
caaaacaagagcctgattttttg

SEQ ID NO: 514762 - DNA, 14 bp, Homo sapiens
caaaacagttatac

SEQ ID NO: 514763 - DNA, 17 bp, Homo sapiens
caaaactatgacaattt

SEQ ID NO: 514764 - DNA, 20 bp, Homo sapiens
caaaactatgacaatttttg

SEQ ID NO: 514765 - DNA, 11 bp, Homo sapiens
caaaatcataa

SEQ ID NO: 514766 - DNA, 14 bp, Homo sapiens
caaaccaaagagta

SEQ ID NO: 514767 - DNA, 22 bp, Homo sapiens
caaacgctaaagagcccttgcc

SEQ ID NO: 514768 - DNA, 12 bp, Homo sapiens
caaagaaagact

SEQ ID NO: 514769 - DNA, 16 bp, Homo sapiens
caaagagggcttcctc

SEQ ID NO: 514770 - DNA, 12 bp, Homo sapiens
caaagagtattc

SEQ ID NO: 514771 - DNA, 13 bp, Homo sapiens
caaaggaaaataa

SEQ ID NO: 514772 - DNA, 17 bp, Homo sapiens
caaatcaatacactagt

SEQ ID NO: 514773 - DNA, 18 bp, Homo sapiens
caaatccaggaccctgcc

SEQ ID NO: 514774 - DNA, 20 bp, Homo sapiens
caaatccaggaccctgccag

SEQ ID NO: 514775 - DNA, 21 bp, Homo sapiens
caaatccaggaccctgccagg

SEQ ID NO: 514776 - DNA, 22 bp, Homo sapiens
caaatccaggaccctgccaggc

SEQ ID NO: 514777 - DNA, 12 bp, Homo sapiens
caaatctgactt

SEQ ID NO: 514778 - DNA, 14 bp, Homo sapiens
caaatctgactttt

SEQ ID NO: 514779 - DNA, 20 bp, Homo sapiens
caaatctgactttttctgtg

SEQ ID NO: 514780 - DNA, 21 bp, Homo sapiens
caaatgtaaatagaggtctgt

SEQ ID NO: 514781 - DNA, 15 bp, Homo sapiens
caacccctcgcccag

SEQ ID NO: 514782 - DNA, 17 bp, Homo sapiens
caacccctggaccccag

SEQ ID NO: 514783 - DNA, 15 bp, Homo sapiens
caacttatttctgaa

SEQ ID NO: 514784 - DNA, 14 bp, Homo sapiens
caagaaaattttgc

SEQ ID NO: 514785 - DNA, 23 bp, Homo sapiens
caagactctgccttaatttttga

SEQ ID NO: 514786 - DNA, 20 bp, Homo sapiens
caagagatcatatcctcaga

SEQ ID NO: 514787 - DNA, 20 bp, Homo sapiens
caagagtggccccacctggc

SEQ ID NO: 514788 - DNA, 21 bp, Homo sapiens
caagagtggccccacctggcc

SEQ ID NO: 514789 - DNA, 23 bp, Homo sapiens
caagagtggccccacctggccct

SEQ ID NO: 514790 - DNA, 14 bp, Homo sapiens
caagcgccctggcc

SEQ ID NO: 514791 - DNA, 15 bp, Homo sapiens
caagcgccctggccc

SEQ ID NO: 514792 - DNA, 16 bp, Homo sapiens
caagcgccctggcccc

SEQ ID NO: 514793 - DNA, 14 bp, Homo sapiens
caaggatgttttta

SEQ ID NO: 514794 - DNA, 20 bp, Homo sapiens
caaggccacctcttcctggc

SEQ ID NO: 514795 - DNA, 12 bp, Homo sapiens
caagggaaaggg

SEQ ID NO: 514796 - DNA, 17 bp, Homo sapiens
caagtggggtgctggga

SEQ ID NO: 514797 - DNA, 15 bp, Homo sapiens
caagtggttgtttta

SEQ ID NO: 514798 - DNA, 19 bp, Homo sapiens
caatcctaatttctcctcc

SEQ ID NO: 514799 - DNA, 15 bp, Homo sapiens
caatgagagccataa

SEQ ID NO: 514800 - DNA, 14 bp, Homo sapiens
caatggtttcaaag

SEQ ID NO: 514801 - DNA, 18 bp, Homo sapiens
caatggtttcaaagaaag

SEQ ID NO: 514802 - DNA, 17 bp, Homo sapiens
cacaatggtttcaaaga

SEQ ID NO: 514803 - DNA, 20 bp, Homo sapiens
cacacttatttttttcccaa

SEQ ID NO: 514804 - DNA, 10 bp, Homo sapiens
cacagacagg

SEQ ID NO: 514805 - DNA, 13 bp, Homo sapiens
cacagacaggacc

SEQ ID NO: 514806 - DNA, 14 bp, Homo sapiens
cacagacaggaccc

SEQ ID NO: 514807 - DNA, 23 bp, Homo sapiens
cacagcctgcacttgggggctca

SEQ ID NO: 514808 - DNA, 14 bp, Homo sapiens
cacaggcagggcag

SEQ ID NO: 514809 - DNA, 18 bp, Homo sapiens
cacaggcagggcaggacc

SEQ ID NO: 514810 - DNA, 13 bp, Homo sapiens
cacaggctgggct

SEQ ID NO: 514811 - DNA, 16 bp, Homo sapiens
cacaggctgggctggg

SEQ ID NO: 514812 - DNA, 17 bp, Homo sapiens
cacaggctgggctgggc

SEQ ID NO: 514813 - DNA, 14 bp, Homo sapiens
cacagggcctggcc

SEQ ID NO: 514814 - DNA, 17 bp, Homo sapiens
cacagggcctggcccat

SEQ ID NO: 514815 - DNA, 14 bp, Homo sapiens
cacagtgtgatttt

SEQ ID NO: 514816 - DNA, 18 bp, Homo sapiens
cacatagatgttgtagaa

SEQ ID NO: 514817 - DNA, 18 bp, Homo sapiens
catgctgtctggcacagc

SEQ ID NO: 514818 - DNA, 13 bp, Homo sapiens
catggaccatgct

SEQ ID NO: 514819 - DNA, 21 bp, Homo sapiens
catggactgttcatttgaaac

SEQ ID NO: 514820 - DNA, 17 bp, Homo sapiens
catggattgtacatatt

SEQ ID NO: 514821 - DNA, 17 bp, Homo sapiens
catggtgcctgagaggc

SEQ ID NO: 514822 - DNA, 20 bp, Homo sapiens
catgtaacttttttatttta

SEQ ID NO: 514823 - DNA, 15 bp, Homo sapiens
catgtattttgtaaa

SEQ ID NO: 514824 - DNA, 17 bp, Homo sapiens
catgtgtataaaaataa

SEQ ID NO: 514825 - DNA, 13 bp, Homo sapiens
catgtgttccaaa

SEQ ID NO: 514826 - DNA, 21 bp, Homo sapiens
cattaaaaaacagcttgttct

SEQ ID NO: 514827 - DNA, 19 bp, Homo sapiens
cattcctcatgaatgtaaa

SEQ ID NO: 514828 - DNA, 21 bp, Homo sapiens
cattcctcatgaatgtaaatt

SEQ ID NO: 514829 - DNA, 12 bp, Homo sapiens
cattctcccagg

SEQ ID NO: 514830 - DNA, 15 bp, Homo sapiens
cattctcccaggtac

SEQ ID NO: 514831 - DNA, 23 bp, Homo sapiens
cattctcccaggtaccagctgcg

SEQ ID NO: 514832 - DNA, 19 bp, Homo sapiens
cattctttcctaaatataa

SEQ ID NO: 514833 - DNA, 14 bp, Homo sapiens
cattgttttccaga

SEQ ID NO: 514834 - DNA, 11 bp, Homo sapiens
catttccaaat

SEQ ID NO: 514835 - DNA, 17 bp, Homo sapiens
catttcccatctgcacc

SEQ ID NO: 514836 - DNA, 20 bp, Homo sapiens
catttcccatctgcacccct

SEQ ID NO: 514837 - DNA, 18 bp, Homo sapiens
catttgaaacctttttct

SEQ ID NO: 514838 - DNA, 17 bp, Homo sapiens
catttggagggcctggg

SEQ ID NO: 514839 - DNA, 20 bp, Homo sapiens
cattttctctattctttcca

SEQ ID NO: 514840 - DNA, 16 bp, Homo sapiens
ccaaacaaaaatgact

SEQ ID NO: 514841 - DNA, 15 bp, Homo sapiens
ccaaacacacagaag

SEQ ID NO: 514842 - DNA, 14 bp, Homo sapiens
ccaaagagaaacct

SEQ ID NO: 514843 - DNA, 16 bp, Homo sapiens
ccaaagagggcttcct

SEQ ID NO: 514844 - DNA, 19 bp, Homo sapiens
ccaaagagggcttcctcta

SEQ ID NO: 514845 - DNA, 14 bp, Homo sapiens
ccaaatttgcttta

SEQ ID NO: 514846 - DNA, 22 bp, Homo sapiens
ccaaatttgctttacatatgat

SEQ ID NO: 514847 - DNA, 22 bp, Homo sapiens
ccaacccctcgcccagtcccag

SEQ ID NO: 514848 - DNA, 16 bp, Homo sapiens
ccaagagtggccccac

SEQ ID NO: 514849 - DNA, 16 bp, Homo sapiens
ccaagcctctgtcttt

SEQ ID NO: 514850 - DNA, 14 bp, Homo sapiens
ccaataccccatgg

SEQ ID NO: 514851 - DNA, 12 bp, Homo sapiens
ccacatctgcct

SEQ ID NO: 514852 - DNA, 15 bp, Homo sapiens
ccacattccatgacg

SEQ ID NO: 514853 - DNA, 15 bp, Homo sapiens
ccaccccctgccctg

SEQ ID NO: 514854 - DNA, 20 bp, Homo sapiens
ccaccccggggaccctgtga

SEQ ID NO: 514855 - DNA, 21 bp, Homo sapiens
ccaccccggggaccctgtgac

SEQ ID NO: 514856 - DNA, 13 bp, Homo sapiens
ccacccctgcccc

SEQ ID NO: 514857 - DNA, 22 bp, Homo sapiens
ccacccctgcccccagccccgg

SEQ ID NO: 514858 - DNA, 18 bp, Homo sapiens
ccaccctgcttggcccag

SEQ ID NO: 514859 - DNA, 19 bp, Homo sapiens
ccaccctgcttggcccagg

SEQ ID NO: 514860 - DNA, 16 bp, Homo sapiens
ccaccgtggaggagga

SEQ ID NO: 514861 - DNA, 23 bp, Homo sapiens
ccacctcctaaaaggcccagaga

SEQ ID NO: 514862 - DNA, 17 bp, Homo sapiens
ccacctcttcctggccg

SEQ ID NO: 514863 - DNA, 15 bp, Homo sapiens
ccactacacctggct

SEQ ID NO: 514864 - DNA, 19 bp, Homo sapiens
ccactgtgcgtggggctcc

SEQ ID NO: 514865 - DNA, 14 bp, Homo sapiens
ccacttaaaaagac

SEQ ID NO: 514866 - DNA, 17 bp, Homo sapiens
ccagagagaagagcccc

SEQ ID NO: 514867 - DNA, 22 bp, Homo sapiens
ccagagagaagagccccactct

SEQ ID NO: 514868 - DNA, 16 bp, Homo sapiens
ccagcagccagccaaa

SEQ ID NO: 514869 - DNA, 16 bp, Homo sapiens
ccagcaggagggacag

SEQ ID NO: 514870 - DNA, 20 bp, Homo sapiens
ccagcaggagggacagtctc

SEQ ID NO: 514871 - DNA, 21 bp, Homo sapiens
ccagccaaacacacagaaggg

SEQ ID NO: 514872 - DNA, 17 bp, Homo sapiens
ccagccccggggtgagt

SEQ ID NO: 514873 - DNA, 18 bp, Homo sapiens
ccagcctccgagagggag

SEQ ID NO: 514874 - DNA, 21 bp, Homo sapiens
ccagcctccgagagggagaga

SEQ ID NO: 514875 - DNA, 15 bp, Homo sapiens
ccagcctcctctgga

SEQ ID NO: 514876 - DNA, 16 bp, Homo sapiens
ccagcctcctctggac

SEQ ID NO: 514877 - DNA, 18 bp, Homo sapiens
ccagctgcgcttgctttt

SEQ ID NO: 514878 - DNA, 16 bp, Homo sapiens
ccagctgctgagccgc

SEQ ID NO: 514879 - DNA, 23 bp, Homo sapiens
ccagctgctgagccgcagagaag

SEQ ID NO: 514880 - DNA, 21 bp, Homo sapiens
ccaggaaactccacatctgcc

SEQ ID NO: 514881 - DNA, 22 bp, Homo sapiens
ccaggaaactccacatctgcct

SEQ ID NO: 514882 - DNA, 18 bp, Homo sapiens
ccaggaagtagcacaggc

SEQ ID NO: 514883 - DNA, 19 bp, Homo sapiens
ccaggaagtagcacaggct

SEQ ID NO: 514884 - DNA, 21 bp, Homo sapiens
ccaggaagtagcacaggctga

SEQ ID NO: 514885 - DNA, 19 bp, Homo sapiens
ccaggaccctgccaggcac

SEQ ID NO: 514886 - DNA, 20 bp, Homo sapiens
ccaggaccctgccaggcaca

SEQ ID NO: 514887 - DNA, 22 bp, Homo sapiens
ccaggaccctgccaggcacagg

SEQ ID NO: 514888 - DNA, 15 bp, Homo sapiens
ccaggcacaggcagg

SEQ ID NO: 514889 - DNA, 16 bp, Homo sapiens
ccaggcacaggcaggg

SEQ ID NO: 514890 - DNA, 19 bp, Homo sapiens
ccaggcacaggcagggcag

SEQ ID NO: 514891 - DNA, 15 bp, Homo sapiens
ccaggcaggggtggg

SEQ ID NO: 514892 - DNA, 21 bp, Homo sapiens
ccaggcaggggtgggggtgga

SEQ ID NO: 514893 - DNA, 21 bp, Homo sapiens
ccagtccccacccctgccccc

SEQ ID NO: 514894 - DNA, 22 bp, Homo sapiens
ccagtccccacccctgccccca

SEQ ID NO: 514895 - DNA, 14 bp, Homo sapiens
ccatccatgtgttc

SEQ ID NO: 514896 - DNA, 12 bp, Homo sapiens
ccatctgcaccc

SEQ ID NO: 514897 - DNA, 23 bp, Homo sapiens
ccatctgcaccccttctctcctc

SEQ ID NO: 514898 - DNA, 17 bp, Homo sapiens
ccatgacacccaagggt

SEQ ID NO: 514899 - DNA, 13 bp, Homo sapiens
ccatgatgttaat

SEQ ID NO: 514900 - DNA, 21 bp, Homo sapiens
ccatggattgtacatattttt

SEQ ID NO: 514901 - DNA, 14 bp, Homo sapiens
ccatgggcaggaga

SEQ ID NO: 514902 - DNA, 14 bp, Homo sapiens
ccatgtatggccag

SEQ ID NO: 514903 - DNA, 12 bp, Homo sapiens
ccatgtgttcca

SEQ ID NO: 514904 - DNA, 11 bp, Homo sapiens
ccattctccca

SEQ ID NO: 514905 - DNA, 13 bp, Homo sapiens
ccattctcccagg

SEQ ID NO: 514906 - DNA, 13 bp, Homo sapiens
ccatttcccatct

SEQ ID NO: 514907 - DNA, 14 bp, Homo sapiens
ccatttcccatctg

SEQ ID NO: 514908 - DNA, 16 bp, Homo sapiens
ccatttcccatctgca

SEQ ID NO: 514909 - DNA, 17 bp, Homo sapiens
ccatttcccatctgcac

SEQ ID NO: 514910 - DNA, 18 bp, Homo sapiens
ccatttcccatctgcacc

SEQ ID NO: 514911 - DNA, 16 bp, Homo sapiens
ccatttccccagggca

SEQ ID NO: 514912 - DNA, 18 bp, Homo sapiens
ccatttggagggcctggg

SEQ ID NO: 514913 - DNA, 21 bp, Homo sapiens
ctgtattttatttagacaaga

SEQ ID NO: 514914 - DNA, 23 bp, Homo sapiens
ctgtattttatttagacaagaga

SEQ ID NO: 514915 - DNA, 13 bp, Homo sapiens
ctgtctggcacag

SEQ ID NO: 514916 - DNA, 15 bp, Homo sapiens
ctgtctggcacagcc

SEQ ID NO: 514917 - DNA, 20 bp, Homo sapiens
ctgtgacatggtgcctgaga

SEQ ID NO: 514918 - DNA, 15 bp, Homo sapiens
ctgtgcgtggggctc

SEQ ID NO: 514919 - DNA, 22 bp, Homo sapiens
ctgtgcgtggggctcccgcctc

SEQ ID NO: 514920 - DNA, 22 bp, Homo sapiens
ctgtggagactgctcctgagcc

SEQ ID NO: 514921 - DNA, 19 bp, Homo sapiens
ctgttcatttgaaaccttt

SEQ ID NO: 514922 - DNA, 24 bp, Homo sapiens
ctgttctgtttcctgtgtctccaa

SEQ ID NO: 514923 - DNA, 18 bp, Homo sapiens
cttacagaagaggcaaca

SEQ ID NO: 514924 - DNA, 19 bp, Homo sapiens
cttataattacaatgcaca

SEQ ID NO: 514925 - DNA, 13 bp, Homo sapiens
cttatatttttct

SEQ ID NO: 514926 - DNA, 16 bp, Homo sapiens
cttatttttttcccaa

SEQ ID NO: 514927 - DNA, 15 bp, Homo sapiens
cttcaaaaagcattt

SEQ ID NO: 514928 - DNA, 20 bp, Homo sapiens
ccattttctctattctttcc

SEQ ID NO: 514929 - DNA, 22 bp, Homo sapiens
ccattttctctattctttccat

SEQ ID NO: 514930 - DNA, 17 bp, Homo sapiens
ctctctgaaggaggcca

SEQ ID NO: 514931 - DNA, 14 bp, Homo sapiens
ctctgaaggaggcc

SEQ ID NO: 514932 - DNA, 13 bp, Homo sapiens
ctctgcctgcccc

SEQ ID NO: 514933 - DNA, 17 bp, Homo sapiens
ctctggacggcaggctc

SEQ ID NO: 514934 - DNA, 18 bp, Homo sapiens
ctctggacggcaggctca

SEQ ID NO: 514935 - DNA, 20 bp, Homo sapiens
ctctgtgcagtcactggagg

SEQ ID NO: 514936 - DNA, 17 bp, Homo sapiens
ctctgtttatttgatga

SEQ ID NO: 514937 - DNA, 17 bp, Homo sapiens
ctcttatatttttctgg

SEQ ID NO: 514938 - DNA, 14 bp, Homo sapiens
ctcttcctagctgg

SEQ ID NO: 514939 - DNA, 16 bp, Homo sapiens
ctctttacttcctttc

SEQ ID NO: 514940 - DNA, 11 bp, Homo sapiens
ctcttttctgg

SEQ ID NO: 514941 - DNA, 13 bp, Homo sapiens
ctgaaaattccaa

SEQ ID NO: 514942 - DNA, 14 bp, Homo sapiens
ctgaaaattccaat

SEQ ID NO: 514943 - DNA, 17 bp, Homo sapiens
gacccagtggcagggca

SEQ ID NO: 514944 - DNA, 22 bp, Homo sapiens
gacccagtggcagggcacaggg

SEQ ID NO: 514945 - DNA, 15 bp, Homo sapiens
gacccatgggcagga

SEQ ID NO: 514946 - DNA, 20 bp, Homo sapiens
gaccctgccaggcacaggca

SEQ ID NO: 514947 - DNA, 18 bp, Homo sapiens
gaccctgggtgggctctg

SEQ ID NO: 514948 - DNA, 22 bp, Homo sapiens
gaccctgtgacatggtgcctga

SEQ ID NO: 514949 - DNA, 19 bp, Homo sapiens
gacctgccaggcaggggtg

SEQ ID NO: 514950 - DNA, 23 bp, Homo sapiens
gacgcaggagctgtggaaatggt

SEQ ID NO: 514951 - DNA, 16 bp, Homo sapiens
gacggcaggctcactg

SEQ ID NO: 514952 - DNA, 22 bp, Homo sapiens
gactctgccttaatttttgaaa

SEQ ID NO: 514953 - DNA, 13 bp, Homo sapiens
gactgccacctcc

SEQ ID NO: 514954 - DNA, 14 bp, Homo sapiens
gactgccacctccc

SEQ ID NO: 514955 - DNA, 15 bp, Homo sapiens
gactgccacctcccc

SEQ ID NO: 514956 - DNA, 19 bp, Homo sapiens
gactgctcctgagccccca

SEQ ID NO: 514957 - DNA, 22 bp, Homo sapiens
gactgctcctgagcccccagct

SEQ ID NO: 514958 - DNA, 16 bp, Homo sapiens
gactgttcatttgaaa

SEQ ID NO: 514959 - DNA, 23 bp, Homo sapiens
gactgttcatttgaaaccttttt

SEQ ID NO: 514960 - DNA, 19 bp, Homo sapiens
gacttgagaaatttgaaag

SEQ ID NO: 514961 - DNA, 23 bp, Homo sapiens
gagaaaaaaatataaaatttctg

SEQ ID NO: 514962 - DNA, 18 bp, Homo sapiens
gagaaacattctttccta

SEQ ID NO: 514963 - DNA, 15 bp, Homo sapiens
gagaagagccccact

SEQ ID NO: 514964 - DNA, 15 bp, Homo sapiens
gagaatcacaggctg

SEQ ID NO: 514965 - DNA, 16 bp, Homo sapiens
gagaatcacaggctgg

SEQ ID NO: 514966 - DNA, 16 bp, Homo sapiens
gagagaagagccccac

SEQ ID NO: 514967 - DNA, 12 bp, Homo sapiens
gagagacttgtt

SEQ ID NO: 514968 - DNA, 13 bp, Homo sapiens
gagagagagagga

SEQ ID NO: 514969 - DNA, 12 bp, Homo sapiens
gagagagaggac

SEQ ID NO: 514970 - DNA, 13 bp, Homo sapiens
gagagaggacagc

SEQ ID NO: 514971 - DNA, 13 bp, Homo sapiens
gagagcctgctgg

SEQ ID NO: 514972 - DNA, 15 bp, Homo sapiens
gagagcctgctggca

SEQ ID NO: 514973 - DNA, 18 bp, Homo sapiens
gagaggacagcttgagcc

SEQ ID NO: 514974 - DNA, 15 bp, Homo sapiens
gagagggaatgtgaa

SEQ ID NO: 514975 - DNA, 23 bp, Homo sapiens
gagagggaggtcactggaaaggg

SEQ ID NO: 514976 - DNA, 14 bp, Homo sapiens
gagaggggaggcca

SEQ ID NO: 514977 - DNA, 14 bp, Homo sapiens
gagatgttaagcaa

SEQ ID NO: 514978 - DNA, 13 bp, Homo sapiens
gagccccactctc

SEQ ID NO: 514979 - DNA, 17 bp, Homo sapiens
gagccccactctcagag

SEQ ID NO: 514980 - DNA, 18 bp, Homo sapiens
gagccccactctcagagg

SEQ ID NO: 514981 - DNA, 17 bp, Homo sapiens
gagcccccagcttccag

SEQ ID NO: 514982 - DNA, 20 bp, Homo sapiens
gagcccccagcttccagcag

SEQ ID NO: 514983 - DNA, 21 bp, Homo sapiens
gagcccccagcttccagcagg

SEQ ID NO: 514984 - DNA, 22 bp, Homo sapiens
gagccctgcctctccgcccctg

SEQ ID NO: 514985 - DNA, 15 bp, Homo sapiens
gagcccttgcctccc

SEQ ID NO: 514986 - DNA, 13 bp, Homo sapiens
gagccgcagagaa

SEQ ID NO: 514987 - DNA, 15 bp, Homo sapiens
gagccgggcccctgg

SEQ ID NO: 514988 - DNA, 12 bp, Homo sapiens
gagcctgctggc

SEQ ID NO: 514989 - DNA, 11 bp, Homo sapiens
gagctgccttc

SEQ ID NO: 514990 - DNA, 13 bp, Homo sapiens
gagctgccttccc

SEQ ID NO: 514991 - DNA, 14 bp, Homo sapiens
gagctgccttccct

SEQ ID NO: 514992 - DNA, 19 bp, Homo sapiens
gagctgccttccctagctt

SEQ ID NO: 514993 - DNA, 23 bp, Homo sapiens
gagctgccttccctagctttaga

SEQ ID NO: 514994 - DNA, 18 bp, Homo sapiens
gaggagccctgcctctcc

SEQ ID NO: 514995 - DNA, 22 bp, Homo sapiens
gaggccaagagtggccccacct

SEQ ID NO: 514996 - DNA, 13 bp, Homo sapiens
gaggccacctcct

SEQ ID NO: 514997 - DNA, 16 bp, Homo sapiens
gagggacagtctcacc

SEQ ID NO: 514998 - DNA, 15 bp, Homo sapiens
gagggagagagagag

SEQ ID NO: 514999 - DNA, 22 bp, Homo sapiens
gagggagagagagagagagagg

SEQ ID NO: 515000 - DNA, 15 bp, Homo sapiens
gaggtctgtaaagaa

SEQ ID NO: 515001 - DNA, 16 bp, Homo sapiens
gaggtggaagaaggga

SEQ ID NO: 515002 - DNA, 15 bp, Homo sapiens
gaggtgggaggtgga

SEQ ID NO: 515003 - DNA, 18 bp, Homo sapiens
gaggtgggaggtggaaga

SEQ ID NO: 515004 - DNA, 13 bp, Homo sapiens
gagtatgttcttg

SEQ ID NO: 515005 - DNA, 20 bp, Homo sapiens
gagtccattctcccaggtac

SEQ ID NO: 515006 - DNA, 15 bp, Homo sapiens
gagtctagtcagtgt

SEQ ID NO: 515007 - DNA, 16 bp, Homo sapiens
gagtctagtcagtgta

SEQ ID NO: 515008 - DNA, 20 bp, Homo sapiens
gagtgagaggggaggccaag

SEQ ID NO: 515009 - DNA, 14 bp, Homo sapiens
gagtgcaggcccac

SEQ ID NO: 515010 - DNA, 18 bp, Homo sapiens
gagtgcaggcccaccctg

SEQ ID NO: 515011 - DNA, 13 bp, Homo sapiens
gagtggccccacc

SEQ ID NO: 515012 - DNA, 21 bp, Homo sapiens
gataatgcatatttttgcaca

SEQ ID NO: 515013 - DNA, 23 bp, Homo sapiens
gatacagtggagaatgggggtga

SEQ ID NO: 515014 - DNA, 14 bp, Homo sapiens
cttcatattttata

SEQ ID NO: 515015 - DNA, 12 bp, Homo sapiens
cttccagcagga

SEQ ID NO: 515016 - DNA, 18 bp, Homo sapiens
cttccaggaaactccaca

SEQ ID NO: 515017 - DNA, 23 bp, Homo sapiens
cttccaggaaactccacatctgc

SEQ ID NO: 515018 - DNA, 14 bp, Homo sapiens
cttcctagtgccta

SEQ ID NO: 515019 - DNA, 18 bp, Homo sapiens
cttcctgcgtcctcctca

SEQ ID NO: 515020 - DNA, 21 bp, Homo sapiens
cttcctgcgtcctcctcacct

SEQ ID NO: 515021 - DNA, 22 bp, Homo sapiens
cttccttttccctgcttccagg

SEQ ID NO: 515022 - DNA, 19 bp, Homo sapiens
cttctcccctgcactgtaa

SEQ ID NO: 515023 - DNA, 20 bp, Homo sapiens
cttctcccctgcactgtaaa

SEQ ID NO: 515024 - DNA, 15 bp, Homo sapiens
cttctccgccagcct

SEQ ID NO: 515025 - DNA, 23 bp, Homo sapiens
cttctccgccagcctcctctgga

SEQ ID NO: 515026 - DNA, 24 bp, Homo sapiens
cttctccgccagcctcctctggac

SEQ ID NO: 515027 - DNA, 19 bp, Homo sapiens
cttctctttacttcctttc

SEQ ID NO: 515028 - DNA, 23 bp, Homo sapiens
cttctgatcagtctgtctggatt

SEQ ID NO: 515029 - DNA, 20 bp, Homo sapiens
cttctgcttttctgccctgg

SEQ ID NO: 515030 - DNA, 22 bp, Homo sapiens
cttctgtatttttttttctaag

SEQ ID NO: 515031 - DNA, 15 bp, Homo sapiens
cttgaaatcaagaga

SEQ ID NO: 515032 - DNA, 15 bp, Homo sapiens
cttgaagccaaagaa

SEQ ID NO: 515033 - DNA, 19 bp, Homo sapiens
cttgaagccaaagaaaaat

SEQ ID NO: 515034 - DNA, 14 bp, Homo sapiens
cttgatgtaaaatc

SEQ ID NO: 515035 - DNA, 21 bp, Homo sapiens
cttgatgtaaaatcttgtcat

SEQ ID NO: 515036 - DNA, 23 bp, Homo sapiens
cttgatgtaaaatcttgtcatgt

SEQ ID NO: 515037 - DNA, 16 bp, Homo sapiens
cttgccagctgctgag

SEQ ID NO: 515038 - DNA, 18 bp, Homo sapiens
cttgccagctgctgagcc

SEQ ID NO: 515039 - DNA, 21 bp, Homo sapiens
cttgccagctgctgagccgca

SEQ ID NO: 515040 - DNA, 20 bp, Homo sapiens
cttgcctccccatttcccat

SEQ ID NO: 515041 - DNA, 23 bp, Homo sapiens
cttggcccagggggcttcctgag

SEQ ID NO: 515042 - DNA, 12 bp, Homo sapiens
cttggcctgctg

SEQ ID NO: 515043 - DNA, 13 bp, Homo sapiens
cttggcctgctgt

SEQ ID NO: 515044 - DNA, 13 bp, Homo sapiens
cttggttcctggg

SEQ ID NO: 515045 - DNA, 18 bp, Homo sapiens
cttggttcctggggcatc

SEQ ID NO: 515046 - DNA, 16 bp, Homo sapiens
cttgtaactttcttca

SEQ ID NO: 515047 - DNA, 16 bp, Homo sapiens
cttgtcatgtgtataa

SEQ ID NO: 515048 - DNA, 18 bp, Homo sapiens
cttgtcatgtgtataaaa

SEQ ID NO: 515049 - DNA, 19 bp, Homo sapiens
cttgtcatgtgtataaaaa

SEQ ID NO: 515050 - DNA, 22 bp, Homo sapiens
cttgttatatgcagacatgtat

SEQ ID NO: 515051 - DNA, 14 bp, Homo sapiens
cttgttttggatgc

SEQ ID NO: 515052 - DNA, 13 bp, Homo sapiens
ctttccatgacac

SEQ ID NO: 515053 - DNA, 18 bp, Homo sapiens
ctttgaacctcagcaaga

SEQ ID NO: 515054 - DNA, 19 bp, Homo sapiens
ctttggtttttttcttctg

SEQ ID NO: 515055 - DNA, 11 bp, Homo sapiens
ctttgtgtcta

SEQ ID NO: 515056 - DNA, 15 bp, Homo sapiens
ctttgtttttattct

SEQ ID NO: 515057 - DNA, 14 bp, Homo sapiens
cttttaaaaatttt

SEQ ID NO: 515058 - DNA, 15 bp, Homo sapiens
cttttccttttgcac

SEQ ID NO: 515059 - DNA, 15 bp, Homo sapiens
cttttctgccctggc

SEQ ID NO: 515060 - DNA, 17 bp, Homo sapiens
cttttctgccctggctg

SEQ ID NO: 515061 - DNA, 19 bp, Homo sapiens
cttttctgccctggctgct

SEQ ID NO: 515062 - DNA, 15 bp, Homo sapiens
cttttctttttaatt

SEQ ID NO: 515063 - DNA, 20 bp, Homo sapiens
ctttttgggagagacttgtt

SEQ ID NO: 515064 - DNA, 23 bp, Homo sapiens
ctttttgtactgtagttcagata

SEQ ID NO: 515065 - DNA, 17 bp, Homo sapiens
cttttttatggcagagg

SEQ ID NO: 515066 - DNA, 22 bp, Homo sapiens
ctttttttttttttttttaatt

SEQ ID NO: 515067 - DNA, 16 bp, Homo sapiens
gaaaaaatggcaagag

SEQ ID NO: 515068 - DNA, 17 bp, Homo sapiens
gaaaaacacaagcaaaa

SEQ ID NO: 515069 - DNA, 22 bp, Homo sapiens
gaaaacttcactccaaagagaa

SEQ ID NO: 515070 - DNA, 14 bp, Homo sapiens
gaaaagtttgtttt

SEQ ID NO: 515071 - DNA, 23 bp, Homo sapiens
gaaaagtttgttttactttgttt

SEQ ID NO: 515072 - DNA, 16 bp, Homo sapiens
gaaaatgtctcagtat

SEQ ID NO: 515073 - DNA, 11 bp, Homo sapiens
gaaaattccaa

SEQ ID NO: 515074 - DNA, 20 bp, Homo sapiens
gaaacctattaagtcatcat

SEQ ID NO: 515075 - DNA, 13 bp, Homo sapiens
gaaacctttttct

SEQ ID NO: 515076 - DNA, 18 bp, Homo sapiens
gaaactccacatctgcct

SEQ ID NO: 515077 - DNA, 19 bp, Homo sapiens
gaaactccacatctgcctt

SEQ ID NO: 515078 - DNA, 20 bp, Homo sapiens
gaaactccacatctgcctta

SEQ ID NO: 515079 - DNA, 14 bp, Homo sapiens
gaaaggagtagttt

SEQ ID NO: 515080 - DNA, 20 bp, Homo sapiens
gaaaggcaaatctgactttt

SEQ ID NO: 515081 - DNA, 22 bp, Homo sapiens
gaaaggtgagtttgagctgcct

SEQ ID NO: 515082 - DNA, 23 bp, Homo sapiens
gaaatcaataatttgtggtgatt

SEQ ID NO: 515083 - DNA, 22 bp, Homo sapiens
gaaatctttcaacttatttctg

SEQ ID NO: 515084 - DNA, 17 bp, Homo sapiens
gaacaaggatgttttta

SEQ ID NO: 515085 - DNA, 18 bp, Homo sapiens
gaaccgccggttcatttt

SEQ ID NO: 515086 - DNA, 15 bp, Homo sapiens
gaagaaaaaatggca

SEQ ID NO: 515087 - DNA, 14 bp, Homo sapiens
gaagaagggagaag

SEQ ID NO: 515088 - DNA, 18 bp, Homo sapiens
gaagaagggagaagaaag

SEQ ID NO: 515089 - DNA, 21 bp, Homo sapiens
gcccctgggcttggcctgctg

SEQ ID NO: 515090 - DNA, 23 bp, Homo sapiens
gcccctgggcttggcctgctgtg

SEQ ID NO: 515091 - DNA, 20 bp, Homo sapiens
gccctctctgaaggaggcca

SEQ ID NO: 515092 - DNA, 21 bp, Homo sapiens
gccctgcctctccgcccctga

SEQ ID NO: 515093 - DNA, 13 bp, Homo sapiens
gccctggccccca

SEQ ID NO: 515094 - DNA, 17 bp, Homo sapiens
gccctggcccccacatg

SEQ ID NO: 515095 - DNA, 19 bp, Homo sapiens
gccctggctgctgccccca

SEQ ID NO: 515096 - DNA, 22 bp, Homo sapiens
gccctggctgctgcccccaccc

SEQ ID NO: 515097 - DNA, 17 bp, Homo sapiens
gccgggcccctgggctt

SEQ ID NO: 515098 - DNA, 19 bp, Homo sapiens
gccgggcccctgggcttgg

SEQ ID NO: 515099 - DNA, 17 bp, Homo sapiens
gcctacaatgggaaaac

SEQ ID NO: 515100 - DNA, 18 bp, Homo sapiens
gcctacaatgggaaaact

SEQ ID NO: 515101 - DNA, 18 bp, Homo sapiens
gcctcaaatccaggaccc

SEQ ID NO: 515102 - DNA, 22 bp, Homo sapiens
gcctcaaatccaggaccctgcc

SEQ ID NO: 515103 - DNA, 21 bp, Homo sapiens
gcctccaacccctcgcccagt

SEQ ID NO: 515104 - DNA, 22 bp, Homo sapiens
gcctccaacccctcgcccagtc

SEQ ID NO: 515105 - DNA, 13 bp, Homo sapiens
gcctccccatttc

SEQ ID NO: 515106 - DNA, 20 bp, Homo sapiens
gcctccccatttcccatctg

SEQ ID NO: 515107 - DNA, 15 bp, Homo sapiens
gcctccgagagggag

SEQ ID NO: 515108 - DNA, 24 bp, Homo sapiens
gcctctccgcccctgagcccactg

SEQ ID NO: 515109 - DNA, 16 bp, Homo sapiens
gcctgagaggcaggca

SEQ ID NO: 515110 - DNA, 23 bp, Homo sapiens
gcctgcacttgggggctcagcaa

SEQ ID NO: 515111 - DNA, 16 bp, Homo sapiens
gcctgctggcacccac

SEQ ID NO: 515112 - DNA, 17 bp, Homo sapiens
gcctgctggcacccacc

SEQ ID NO: 515113 - DNA, 19 bp, Homo sapiens
gcctgctggcacccaccgt

SEQ ID NO: 515114 - DNA, 22 bp, Homo sapiens
gcctggcccatgtatggccagg

SEQ ID NO: 515115 - DNA, 22 bp, Homo sapiens
gcctggctccctcactctcagg

SEQ ID NO: 515116 - DNA, 23 bp, Homo sapiens
gcctggctccctcactctcagga

SEQ ID NO: 515117 - DNA, 23 bp, Homo sapiens
gccttaaacaattcttgtaactt

SEQ ID NO: 515118 - DNA, 12 bp, Homo sapiens
gccttaattttt

SEQ ID NO: 515119 - DNA, 14 bp, Homo sapiens
gccttaatttttga

SEQ ID NO: 515120 - DNA, 21 bp, Homo sapiens
gccttaatttttgaaaagctg

SEQ ID NO: 515121 - DNA, 24 bp, Homo sapiens
gccttccctagctttagaccctgg

SEQ ID NO: 515122 - DNA, 14 bp, Homo sapiens
gccttgaaatcaag

SEQ ID NO: 515123 - DNA, 18 bp, Homo sapiens
gccttggttcttcctagt

SEQ ID NO: 515124 - DNA, 14 bp, Homo sapiens
gcgccttaaacaat

SEQ ID NO: 515125 - DNA, 21 bp, Homo sapiens
gctagaattgattttttttct

SEQ ID NO: 515126 - DNA, 22 bp, Homo sapiens
gctattaactgccaaaacaaga

SEQ ID NO: 515127 - DNA, 20 bp, Homo sapiens
gctattatgatgttttgcaa

SEQ ID NO: 515128 - DNA, 21 bp, Homo sapiens
gctattatgatgttttgcaaa

SEQ ID NO: 515129 - DNA, 13 bp, Homo sapiens
gctcactgccagg

SEQ ID NO: 515130 - DNA, 14 bp, Homo sapiens
gctcactgccaggc

SEQ ID NO: 515131 - DNA, 17 bp, Homo sapiens
gctcactgccaggccag

SEQ ID NO: 515132 - DNA, 21 bp, Homo sapiens
gctcactgccaggccagcctc

SEQ ID NO: 515133 - DNA, 23 bp, Homo sapiens
gctcactgccaggccagcctccg

SEQ ID NO: 515134 - DNA, 14 bp, Homo sapiens
gctcagcaaggcca

SEQ ID NO: 515135 - DNA, 15 bp, Homo sapiens
gctcagcaaggccac

SEQ ID NO: 515136 - DNA, 17 bp, Homo sapiens
gctcagcaaggccacct

SEQ ID NO: 515137 - DNA, 22 bp, Homo sapiens
gctccatgattagcataaagca

SEQ ID NO: 515138 - DNA, 14 bp, Homo sapiens
gctccctcactctc

SEQ ID NO: 515139 - DNA, 15 bp, Homo sapiens
gtgttgaattttatt

SEQ ID NO: 515140 - DNA, 9 bp, Homo sapiens
gttacataa

SEQ ID NO: 515141 - DNA, 14 bp, Homo sapiens
gttagactgccagc

SEQ ID NO: 515142 - DNA, 22 bp, Homo sapiens
gttagactgccagctcttccta

SEQ ID NO: 515143 - DNA, 12 bp, Homo sapiens
gttattttctac

SEQ ID NO: 515144 - DNA, 13 bp, Homo sapiens
gttcattttgcac

SEQ ID NO: 515145 - DNA, 15 bp, Homo sapiens
gttccctgttcttcg

SEQ ID NO: 515146 - DNA, 16 bp, Homo sapiens
gttcctacacaggaca

SEQ ID NO: 515147 - DNA, 18 bp, Homo sapiens
gttcctacacaggacagg

SEQ ID NO: 515148 - DNA, 15 bp, Homo sapiens
gttcctctgcctgcc

SEQ ID NO: 515149 - DNA, 22 bp, Homo sapiens
gttcctggggcatccatggggt

SEQ ID NO: 515150 - DNA, 19 bp, Homo sapiens
gttctgtcccgtaaatcat

SEQ ID NO: 515151 - DNA, 16 bp, Homo sapiens
gttgggacccagtggc

SEQ ID NO: 515152 - DNA, 21 bp, Homo sapiens
gttgggacccagtggcagggc

SEQ ID NO: 515153 - DNA, 21 bp, Homo sapiens
gttgtaatgcacacttatttt

SEQ ID NO: 515154 - DNA, 15 bp, Homo sapiens
gttgtcatttccaaa

SEQ ID NO: 515155 - DNA, 16 bp, Homo sapiens
gttgtcctgatgtttt

SEQ ID NO: 515156 - DNA, 15 bp, Homo sapiens
gttttaacattttta

SEQ ID NO: 515157 - DNA, 18 bp, Homo sapiens
gttttactttgtttttat

SEQ ID NO: 515158 - DNA, 19 bp, Homo sapiens
gttttagatccaaatgtaa

SEQ ID NO: 515159 - DNA, 15 bp, Homo sapiens
gttttatactgaagg

SEQ ID NO: 515160 - DNA, 14 bp, Homo sapiens
gtttttattctgtt

SEQ ID NO: 515161 - DNA, 21 bp, Homo sapiens
gtttttccaaaacttgaactt

SEQ ID NO: 515162 - DNA, 21 bp, Homo sapiens
gttttttcaagaaaattttgc

SEQ ID NO: 515163 - DNA, 19 bp, Homo sapiens
taaaaaacagcttgttcta

SEQ ID NO: 515164 - DNA, 17 bp, Homo sapiens
taaaaaagatcccaaat

SEQ ID NO: 515165 - DNA, 17 bp, Homo sapiens
taaaaataaaaaagatc

SEQ ID NO: 515166 - DNA, 21 bp, Homo sapiens
taaaaataaaaaagatcccaa

SEQ ID NO: 515167 - DNA, 13 bp, Homo sapiens
taaaaccaaagag

SEQ ID NO: 515168 - DNA, 13 bp, Homo sapiens
taaaagaaaacaa

SEQ ID NO: 515169 - DNA, 12 bp, Homo sapiens
taaaagcccagg

SEQ ID NO: 515170 - DNA, 14 bp, Homo sapiens
taaaagcccaggag

SEQ ID NO: 515171 - DNA, 11 bp, Homo sapiens
taaaatcttgt

SEQ ID NO: 515172 - DNA, 20 bp, Homo sapiens
taaaatcttgtcatgtgtat

SEQ ID NO: 515173 - DNA, 21 bp, Homo sapiens
taaaatcttgtcatgtgtata

SEQ ID NO: 515174 - DNA, 23 bp, Homo sapiens
taaaatgtgggattatgggtcac

SEQ ID NO: 515175 - DNA, 16 bp, Homo sapiens
taaacagaaattgcaa

SEQ ID NO: 515176 - DNA, 13 bp, Homo sapiens
taaacgtggagaa

SEQ ID NO: 515177 - DNA, 13 bp, Homo sapiens
taaagaaaaataa

SEQ ID NO: 515178 - DNA, 15 bp, Homo sapiens
taaagagcccttgcc

SEQ ID NO: 515179 - DNA, 16 bp, Homo sapiens
taaagagcccttgcct

SEQ ID NO: 515180 - DNA, 17 bp, Homo sapiens
taaagagcccttgcctc

SEQ ID NO: 515181 - DNA, 19 bp, Homo sapiens
taaagcctgaaaattccaa

SEQ ID NO: 515182 - DNA, 21 bp, Homo sapiens
taaagtttatcagatattttc

SEQ ID NO: 515183 - DNA, 23 bp, Homo sapiens
taaatagcccagatcccaagaga

SEQ ID NO: 515184 - DNA, 22 bp, Homo sapiens
taaatgtacctgagacatatta

SEQ ID NO: 515185 - DNA, 20 bp, Homo sapiens
taaatttgtactatttaact

SEQ ID NO: 515186 - DNA, 17 bp, Homo sapiens
taacataatcacaagta

SEQ ID NO: 515187 - DNA, 11 bp, Homo sapiens
taacattcctc

SEQ ID NO: 515188 - DNA, 20 bp, Homo sapiens
taacattcctcatgaatgta

SEQ ID NO: 515189 - DNA, 20 bp, Homo sapiens
taaccctttggtttttttct

SEQ ID NO: 515190 - DNA, 14 bp, Homo sapiens
taactttcttcaaa

SEQ ID NO: 515191 - DNA, 20 bp, Homo sapiens
taagaggaagaagaagaaag

SEQ ID NO: 515192 - DNA, 13 bp, Homo sapiens
taagcattttctc

SEQ ID NO: 515193 - DNA, 12 bp, Homo sapiens
taagtggctttt

SEQ ID NO: 515194 - DNA, 22 bp, Homo sapiens
taagttaaactacctaaaataa

SEQ ID NO: 515195 - DNA, 17 bp, Homo sapiens
taatcaaaccaaagagt

SEQ ID NO: 515196 - DNA, 14 bp, Homo sapiens
taatccccttctcc

SEQ ID NO: 515197 - DNA, 21 bp, Homo sapiens
taatccccttctcccctgcac

SEQ ID NO: 515198 - DNA, 22 bp, Homo sapiens
taatgaaaatgtctcagtattt

SEQ ID NO: 515199 - DNA, 16 bp, Homo sapiens
taattcgtttgctaga

SEQ ID NO: 515200 - DNA, 19 bp, Homo sapiens
taatttctcctcccttcct

SEQ ID NO: 515201 - DNA, 18 bp, Homo sapiens
tacaatgggaaaacttca

SEQ ID NO: 515202 - DNA, 14 bp, Homo sapiens
tacacaggacaggg

SEQ ID NO: 515203 - DNA, 14 bp, Homo sapiens
tacactagttgttt

SEQ ID NO: 515204 - DNA, 14 bp, Homo sapiens
tacacttaaaagaa

SEQ ID NO: 515205 - DNA, 21 bp, Homo sapiens
tacataccttgttatatgcag

SEQ ID NO: 515206 - DNA, 14 bp, Homo sapiens
tacatcatttcttt

SEQ ID NO: 515207 - DNA, 22 bp, Homo sapiens
tacatgaacacaaatgtgtatt

SEQ ID NO: 515208 - DNA, 17 bp, Homo sapiens
tacattataccgcagag

SEQ ID NO: 515209 - DNA, 17 bp, Homo sapiens
tacattttataaagttt

SEQ ID NO: 515210 - DNA, 13 bp, Homo sapiens
tacccagcagagg

SEQ ID NO: 515211 - DNA, 14 bp, Homo sapiens
tacccagcagaggg

SEQ ID NO: 515212 - DNA, 19 bp, Homo sapiens
taccccaagcgccctggcc

SEQ ID NO: 515213 - DNA, 16 bp, Homo sapiens
taccccatggaccatg

SEQ ID NO: 515214 - DNA, 17 bp, Homo sapiens
taccgcagagtatttga

SEQ ID NO: 515215 - DNA, 13 bp, Homo sapiens
tccccacccctgc

SEQ ID NO: 515216 - DNA, 12 bp, Homo sapiens
tccccagggcac

SEQ ID NO: 515217 - DNA, 21 bp, Homo sapiens
tccccagggcacgtggttgag

SEQ ID NO: 515218 - DNA, 17 bp, Homo sapiens
tccccatttcccatctg

SEQ ID NO: 515219 - DNA, 16 bp, Homo sapiens
tcccctgcactgtaaa

SEQ ID NO: 515220 - DNA, 17 bp, Homo sapiens
tcccctgcactgtaaaa

SEQ ID NO: 515221 - DNA, 18 bp, Homo sapiens
tcccctgcactgtaaaat

SEQ ID NO: 515222 - DNA, 19 bp, Homo sapiens
tcccctgcactgtaaaatg

SEQ ID NO: 515223 - DNA, 18 bp, Homo sapiens
tccccttctcccctgcac

SEQ ID NO: 515224 - DNA, 23 bp, Homo sapiens
tccctatttgtgaattctgggat

SEQ ID NO: 515225 - DNA, 22 bp, Homo sapiens
tccctcgatccccccattttct

SEQ ID NO: 515226 - DNA, 20 bp, Homo sapiens
tccctgggttagactgccag

SEQ ID NO: 515227 - DNA, 20 bp, Homo sapiens
tcccttccttttccctgctt

SEQ ID NO: 515228 - DNA, 12 bp, Homo sapiens
tccgccagcctc

SEQ ID NO: 515229 - DNA, 18 bp, Homo sapiens
tccgccagcctcctctgg

SEQ ID NO: 515230 - DNA, 15 bp, Homo sapiens
tccgcccctgagccc

SEQ ID NO: 515231 - DNA, 16 bp, Homo sapiens
tccgcccctgagccca

SEQ ID NO: 515232 - DNA, 13 bp, Homo sapiens
tcctaaaaggccc

SEQ ID NO: 515233 - DNA, 16 bp, Homo sapiens
tcctaaaaggcccaga

SEQ ID NO: 515234 - DNA, 21 bp, Homo sapiens
tcctaaaaggcccagagagaa

SEQ ID NO: 515235 - DNA, 16 bp, Homo sapiens
tcctacacaggacagg

SEQ ID NO: 515236 - DNA, 18 bp, Homo sapiens
tcctagaaaagtttgttt

SEQ ID NO: 515237 - DNA, 21 bp, Homo sapiens
tcctagctggagaggagccct

SEQ ID NO: 515238 - DNA, 17 bp, Homo sapiens
tcctatacccagcagag

SEQ ID NO: 515239 - DNA, 18 bp, Homo sapiens
tcctatacccagcagagg

SEQ ID NO: 515240 - DNA, 17 bp, Homo sapiens
tcctatttttaaacaaa

SEQ ID NO: 515241 - DNA, 15 bp, Homo sapiens
tcctcacctcatgcc

SEQ ID NO: 515242 - DNA, 22 bp, Homo sapiens
tcctcagaccaggtggaattac

SEQ ID NO: 515243 - DNA, 14 bp, Homo sapiens
tcctcatgaatgta

SEQ ID NO: 515244 - DNA, 17 bp, Homo sapiens
ttaatttttgaaaagct

SEQ ID NO: 515245 - DNA, 15 bp, Homo sapiens
ttacaattaataaat

SEQ ID NO: 515246 - DNA, 16 bp, Homo sapiens
ttagactgccagctct

SEQ ID NO: 515247 - DNA, 15 bp, Homo sapiens
ttatatattatgtct

SEQ ID NO: 515248 - DNA, 20 bp, Homo sapiens
ttatatctctgtatgccatt

SEQ ID NO: 515249 - DNA, 16 bp, Homo sapiens
ttatattagagtcaga

SEQ ID NO: 515250 - DNA, 16 bp, Homo sapiens
ttatcagatattttca

SEQ ID NO: 515251 - DNA, 23 bp, Homo sapiens
ttatcctatttttaaacaaaatg

SEQ ID NO: 515252 - DNA, 17 bp, Homo sapiens
ttatggaagaaagagtt

SEQ ID NO: 515253 - DNA, 13 bp, Homo sapiens
ttattatttctaa

SEQ ID NO: 515254 - DNA, 14 bp, Homo sapiens
ttattattttccca

SEQ ID NO: 515255 - DNA, 14 bp, Homo sapiens
ttatttagacaaga

SEQ ID NO: 515256 - DNA, 16 bp, Homo sapiens
ttatttagacaagaga

SEQ ID NO: 515257 - DNA, 12 bp, Homo sapiens
ttatttatttca

SEQ ID NO: 515258 - DNA, 18 bp, Homo sapiens
ttatttgatgagttctgt

SEQ ID NO: 515259 - DNA, 21 bp, Homo sapiens
ttattttcccatttgctgtct

SEQ ID NO: 515260 - DNA, 21 bp, Homo sapiens
ttcaaagaaagactgtaagct

SEQ ID NO: 515261 - DNA, 14 bp, Homo sapiens
ttcaacttatttct

SEQ ID NO: 515262 - DNA, 16 bp, Homo sapiens
ttcaacttatttctga

SEQ ID NO: 515263 - DNA, 17 bp, Homo sapiens
ttcaagaaaattttgca

SEQ ID NO: 515264 - DNA, 18 bp, Homo sapiens
ttcaagaaaattttgcag

SEQ ID NO: 515265 - DNA, 21 bp, Homo sapiens
ttcaagaaaattttgcagaag

SEQ ID NO: 515266 - DNA, 14 bp, Homo sapiens
ttcaatgaaacaaa

SEQ ID NO: 515267 - DNA, 23 bp, Homo sapiens
ttcaatgaaacaaagaaagagat

SEQ ID NO: 515268 - DNA, 11 bp, Homo sapiens
ttcactccaaa

SEQ ID NO: 515269 - DNA, 16 bp, Homo sapiens
ttcagatagagatatt

SEQ ID NO: 515270 - DNA, 13 bp, Homo sapiens
ttcatattttata

SEQ ID NO: 515271 - DNA, 15 bp, Homo sapiens
ttcatattttataat

SEQ ID NO: 515272 - DNA, 23 bp, Homo sapiens
ttccagcaggagggacagtctca

SEQ ID NO: 515273 - DNA, 23 bp, Homo sapiens
ttccaggaaactccacatctgcc

SEQ ID NO: 515274 - DNA, 12 bp, Homo sapiens
ttcccatctgca

SEQ ID NO: 515275 - DNA, 14 bp, Homo sapiens
ttccctgcttccag

SEQ ID NO: 515276 - DNA, 15 bp, Homo sapiens
ttccctgcttccagg

SEQ ID NO: 515277 - DNA, 16 bp, Homo sapiens
ttccctgcttccagga

SEQ ID NO: 515278 - DNA, 21 bp, Homo sapiens
ttccctgggttagactgccag

SEQ ID NO: 515279 - DNA, 23 bp, Homo sapiens
ttccctgggttagactgccagct

SEQ ID NO: 515280 - DNA, 14 bp, Homo sapiens
ttcccttttaaaga

SEQ ID NO: 515281 - DNA, 22 bp, Homo sapiens
ttcctagctggagaggagccct

SEQ ID NO: 515282 - DNA, 22 bp, Homo sapiens
ttcctagtgcctacaatgggaa

SEQ ID NO: 515283 - DNA, 18 bp, Homo sapiens
ttcctcatgaatgtaaat

SEQ ID NO: 515284 - DNA, 17 bp, Homo sapiens
ttcctctagaagccaag

SEQ ID NO: 515285 - DNA, 14 bp, Homo sapiens
ttcctctgcctgcc

SEQ ID NO: 515286 - DNA, 15 bp, Homo sapiens
ttcctctgcctgccc

SEQ ID NO: 515287 - DNA, 16 bp, Homo sapiens
ttcctctgcctgcccc

SEQ ID NO: 515288 - DNA, 17 bp, Homo sapiens
ttcctgcgtcctcctca

SEQ ID NO: 515289 - DNA, 12 bp, Homo sapiens
ttcctgtgtctc

SEQ ID NO: 515290 - DNA, 21 bp, Homo sapiens
ttccttttgcacattccaaaa

SEQ ID NO: 515291 - DNA, 13 bp, Homo sapiens
ttctaaaacacat

SEQ ID NO: 515292 - DNA, 16 bp, Homo sapiens
ttctaaataaaaaaat

SEQ ID NO: 515293 - DNA, 18 bp, Homo sapiens
ttctagaatcatgtattt

SEQ ID NO: 515294 - DNA, 20 bp, Homo sapiens
ttctattaagatatatttgt

SEQ ID NO: 515295 - DNA, 18 bp, Homo sapiens
ttctcaaaactgagccat

SEQ ID NO: 515296 - DNA, 14 bp, Homo sapiens
ttctcactgaagct

SEQ ID NO: 515297 - DNA, 20 bp, Homo sapiens
ttctcccaggtaccagctgc

SEQ ID NO: 515298 - DNA, 16 bp, Homo sapiens
ttctccgccagcctcc

SEQ ID NO: 515299 - DNA, 19 bp, Homo sapiens
ttctcctcccttccttttc

SEQ ID NO: 515300 - DNA, 15 bp, Homo sapiens
ttctctctctctttg

SEQ ID NO: 515301 - DNA, 16 bp, Homo sapiens
ttctctctctctttgt

SEQ ID NO: 515302 - DNA, 22 bp, Homo sapiens
ttctctctctctttgttacata

SEQ ID NO: 515303 - DNA, 20 bp, Homo sapiens
ttctctttagggaacaagga

SEQ ID NO: 515304 - DNA, 20 bp, Homo sapiens
ttctgataatttattgtctt

SEQ ID NO: 515305 - DNA, 23 bp, Homo sapiens
ttctgataatttattgtctttat

SEQ ID NO: 515306 - DNA, 18 bp, Homo sapiens
ttctgatttttaatttgt

SEQ ID NO: 515307 - DNA, 13 bp, Homo sapiens
ttctgccctggct

SEQ ID NO: 515308 - DNA, 18 bp, Homo sapiens
ttctgccctggctgctgc

SEQ ID NO: 515309 - DNA, 19 bp, Homo sapiens
ttctgccctggctgctgcc

SEQ ID NO: 515310 - DNA, 15 bp, Homo sapiens
ttctgtttcctgtgt

SEQ ID NO: 515311 - DNA, 17 bp, Homo sapiens
ttctgtttcctgtgtct

SEQ ID NO: 515312 - DNA, 13 bp, Homo sapiens
ttcttctgtattt

SEQ ID NO: 515313 - DNA, 13 bp, Homo sapiens
ttcttgacagtga

SEQ ID NO: 515314 - DNA, 20 bp, Homo sapiens
ttcttgatgtaaaatcttgt

SEQ ID NO: 515315 - DNA, 15 bp, Homo sapiens
ttcttgtaactttct

SEQ ID NO: 515316 - DNA, 22 bp, Homo sapiens
ttgaagaaaggcaaatctgact

SEQ ID NO: 515317 - DNA, 15 bp, Homo sapiens
ttgaagccaaagaaa

SEQ ID NO: 515318 - DNA, 15 bp, Homo sapiens
ttgaattttattgaa

SEQ ID NO: 515319 - DNA, 14 bp, Homo sapiens
ttgacagtgagagg

SEQ ID NO: 515320 - DNA, 13 bp, Homo sapiens
ttgagctgccttc

SEQ ID NO: 515321 - DNA, 17 bp, Homo sapiens
ttgagtcctacagtgtc

SEQ ID NO: 515322 - DNA, 18 bp, Homo sapiens
ttgagtcctacagtgtca

SEQ ID NO: 515323 - DNA, 14 bp, Homo sapiens
ttgagttgtaaaga

SEQ ID NO: 515324 - DNA, 15 bp, Homo sapiens
ttgagttgtaaagaa

SEQ ID NO: 515325 - DNA, 13 bp, Homo sapiens
ttgatgtaaaatc

SEQ ID NO: 515326 - DNA, 16 bp, Homo sapiens
ttgatgtaaaatcttg

SEQ ID NO: 515327 - DNA, 18 bp, Homo sapiens
ttgatttaacttcatttt

SEQ ID NO: 515328 - DNA, 16 bp, Homo sapiens
ttgattttttttctct

SEQ ID NO: 515329 - DNA, 15 bp, Homo sapiens
ttgcacattccaaaa

SEQ ID NO: 515330 - DNA, 14 bp, Homo sapiens
ttgcaccttattca

SEQ ID NO: 515331 - DNA, 20 bp, Homo sapiens
ttgccagctgctgagccgca

SEQ ID NO: 515332 - DNA, 22 bp, Homo sapiens
ttgccagctgctgagccgcaga

SEQ ID NO: 515333 - DNA, 23 bp, Homo sapiens
ttgccatagaaagtataatttca

SEQ ID NO: 515334 - DNA, 17 bp, Homo sapiens
ttgctagaaacataatt

SEQ ID NO: 515335 - DNA, 17 bp, Homo sapiens
ttgctatgttcttctgt

SEQ ID NO: 515336 - DNA, 22 bp, Homo sapiens
ttgctgaacatggatatctaca

SEQ ID NO: 515337 - DNA, 13 bp, Homo sapiens
ttggcctgctgtg

SEQ ID NO: 515338 - DNA, 15 bp, Homo sapiens
ttgggggctcagcaa

SEQ ID NO: 515339 - DNA, 13 bp, Homo sapiens
ttgggggtgggag

SEQ ID NO: 515340 - DNA, 15 bp, Homo sapiens
ttggtgctttgtgtc

SEQ ID NO: 515341 - DNA, 17 bp, Homo sapiens
ttggttcttgacagtga

SEQ ID NO: 515342 - DNA, 13 bp, Homo sapiens
ttgtacatatttt

SEQ ID NO: 515343 - DNA, 19 bp, Homo sapiens
ttgtactatttaactgact

SEQ ID NO: 515344 - DNA, 22 bp, Homo sapiens
ttgtactatttaactgactatt

SEQ ID NO: 515345 - DNA, 15 bp, Homo sapiens
ttgtactgtagttca

SEQ ID NO: 515346 - DNA, 15 bp, Homo sapiens
ttgtatttatggaag

SEQ ID NO: 515347 - DNA, 13 bp, Homo sapiens
ttgtcatgtgtat

SEQ ID NO: 515348 - DNA, 22 bp, Homo sapiens
ttgtcatgtgtataaaaataaa

SEQ ID NO: 515349 - DNA, 15 bp, Homo sapiens
ttgtcatttccaaat

SEQ ID NO: 515350 - DNA, 16 bp, Homo sapiens
ttgtgtttttccaaaa

SEQ ID NO: 515351 - DNA, 13 bp, Homo sapiens
ttgttttgtgttt

SEQ ID NO: 515352 - DNA, 23 bp, Homo sapiens
tttaaagccaaatgtaaatagag

SEQ ID NO: 515353 - DNA, 21 bp, Homo sapiens
tttaaagcctgaaaattccaa

SEQ ID NO: 515354 - DNA, 12 bp, Homo sapiens
tttaacattcct

SEQ ID NO: 515355 - DNA, 22 bp, Homo sapiens
tttaacattcctcatgaatgta

SEQ ID NO: 515356 - DNA, 16 bp, Homo sapiens
tttaacttaatggcac

SEQ ID NO: 515357 - DNA, 22 bp, Homo sapiens
tttaattggagtctcaaaatca

SEQ ID NO: 515358 - DNA, 14 bp, Homo sapiens
tgggagagacttgt

SEQ ID NO: 515359 - DNA, 15 bp, Homo sapiens
tgggagagacttgtt

SEQ ID NO: 515360 - DNA, 21 bp, Homo sapiens
tgggagagacttgttttggat

SEQ ID NO: 515361 - DNA, 14 bp, Homo sapiens
tgggaggagggaga

SEQ ID NO: 515362 - DNA, 19 bp, Homo sapiens
tgggaggtggaagaaggga

SEQ ID NO: 515363 - DNA, 15 bp, Homo sapiens
tgggattatgggtca

SEQ ID NO: 515364 - DNA, 19 bp, Homo sapiens
tgggattatgggtcacagg

SEQ ID NO: 515365 - DNA, 14 bp, Homo sapiens
tgggctctggcaag

SEQ ID NO: 515366 - DNA, 18 bp, Homo sapiens
tgggctctgtgcagtcac

SEQ ID NO: 515367 - DNA, 14 bp, Homo sapiens
tgggctgggcactg

SEQ ID NO: 515368 - DNA, 19 bp, Homo sapiens
tgggctgttctgtttcctg

SEQ ID NO: 515369 - DNA, 14 bp, Homo sapiens
tgggcttggcctgc

SEQ ID NO: 515370 - DNA, 16 bp, Homo sapiens
tgggcttggcctgctg

SEQ ID NO: 515371 - DNA, 17 bp, Homo sapiens
tgggcttggcctgctgt

SEQ ID NO: 515372 - DNA, 23 bp, Homo sapiens
tggggctcccgcctccaacccct

SEQ ID NO: 515373 - DNA, 18 bp, Homo sapiens
tggggctgggggatgggc

SEQ ID NO: 515374 - DNA, 23 bp, Homo sapiens
tgggggccccgtctcaggtctga

SEQ ID NO: 515375 - DNA, 17 bp, Homo sapiens
tgggggctcagcaaggc

SEQ ID NO: 515376 - DNA, 23 bp, Homo sapiens
tgggggctcagcaaggccacctc

SEQ ID NO: 515377 - DNA, 18 bp, Homo sapiens
tggggggggcaagaaaga

SEQ ID NO: 515378 - DNA, 19 bp, Homo sapiens
tgggggtggaggcttcctg

SEQ ID NO: 515379 - DNA, 17 bp, Homo sapiens
tggggtctctcacagac

SEQ ID NO: 515380 - DNA, 13 bp, Homo sapiens
tggggtgctggga

SEQ ID NO: 515381 - DNA, 18 bp, Homo sapiens
tggggtgctgggaggagg

SEQ ID NO: 515382 - DNA, 16 bp, Homo sapiens
tgggtgggctctgtgc

SEQ ID NO: 515383 - DNA, 19 bp, Homo sapiens
tgggttagactgccagctc

SEQ ID NO: 515384 - DNA, 19 bp, Homo sapiens
tgggttgttgtttttttct

SEQ ID NO: 515385 - DNA, 16 bp, Homo sapiens
tggtaagtggcttttt

SEQ ID NO: 515386 - DNA, 18 bp, Homo sapiens
tggtatgggctgttctgt

SEQ ID NO: 515387 - DNA, 18 bp, Homo sapiens
tggtattatatctctgta

SEQ ID NO: 515388 - DNA, 17 bp, Homo sapiens
tggtctctggttcttga

SEQ ID NO: 515389 - DNA, 18 bp, Homo sapiens
tggtctctggttcttgaa

SEQ ID NO: 515390 - DNA, 15 bp, Homo sapiens
tggtgcctgagaggc

SEQ ID NO: 515391 - DNA, 17 bp, Homo sapiens
tggtgcctgagaggcag

SEQ ID NO: 515392 - DNA, 20 bp, Homo sapiens
tggtgcctgagaggcaggca

SEQ ID NO: 515393 - DNA, 20 bp, Homo sapiens
tggtggttgggacccagtgg

SEQ ID NO: 515394 - DNA, 14 bp, Homo sapiens
tggttcctggggca

SEQ ID NO: 515395 - DNA, 15 bp, Homo sapiens
tggttcttgaacagc

SEQ ID NO: 515396 - DNA, 12 bp, Homo sapiens
tgtaaaatcttg

SEQ ID NO: 515397 - DNA, 16 bp, Homo sapiens
tgtaaaatcttgtcat

SEQ ID NO: 515398 - DNA, 18 bp, Homo sapiens
tgtaaaatcttgtcatgt

SEQ ID NO: 515399 - DNA, 22 bp, Homo sapiens
tgtaaaatcttgtcatgtgtat

SEQ ID NO: 515400 - DNA, 13 bp, Homo sapiens
tgtaaacagaaat

SEQ ID NO: 515401 - DNA, 18 bp, Homo sapiens
tgtaaatttgtactattt

SEQ ID NO: 515402 - DNA, 12 bp, Homo sapiens
tgtacacatgtc

SEQ ID NO: 515403 - DNA, 17 bp, Homo sapiens
tgtacattttataaagt

SEQ ID NO: 515404 - DNA, 15 bp, Homo sapiens
tgtagttttcctttt

SEQ ID NO: 515405 - DNA, 22 bp, Homo sapiens
tgtataaaaataaaaaagatcc

SEQ ID NO: 515406 - DNA, 19 bp, Homo sapiens
tgtataggggaaaatatta

SEQ ID NO: 515407 - DNA, 15 bp, Homo sapiens
tgtatggccaggaag

SEQ ID NO: 515408 - DNA, 12 bp, Homo sapiens
tgtatttgtgta

SEQ ID NO: 515409 - DNA, 19 bp, Homo sapiens
tgtattttatttagacaag

SEQ ID NO: 515410 - DNA, 22 bp, Homo sapiens
tgtattttatttagacaagaga

SEQ ID NO: 515411 - DNA, 21 bp, Homo sapiens
tgtcactatggcactgttgtc

SEQ ID NO: 515412 - DNA, 18 bp, Homo sapiens
tgtcacttcatattttat

SEQ ID NO: 515413 - DNA, 11 bp, Homo sapiens
tgtcatgtgta

SEQ ID NO: 515414 - DNA, 20 bp, Homo sapiens
tgtctagggcagagtatgtt

SEQ ID NO: 515415 - DNA, 23 bp, Homo sapiens
tgtctagggcagagtatgttctt

SEQ ID NO: 515416 - DNA, 22 bp, Homo sapiens
tgtcttattttattatttctaa

SEQ ID NO: 515417 - DNA, 22 bp, Homo sapiens
tgtctttatttttatcccagga

SEQ ID NO: 515418 - DNA, 23 bp, Homo sapiens
tgtctttatttttatcccaggaa

SEQ ID NO: 515419 - DNA, 16 bp, Homo sapiens
tgtgacatggtgcctg

SEQ ID NO: 515420 - DNA, 18 bp, Homo sapiens
tgtgacatggtgcctgag

SEQ ID NO: 515421 - DNA, 20 bp, Homo sapiens
tgtgacatggtgcctgagag

SEQ ID NO: 515422 - DNA, 13 bp, Homo sapiens
tgtgatggtctct

SEQ ID NO: 515423 - DNA, 18 bp, Homo sapiens
tgtggagactgctcctga

SEQ ID NO: 515424 - DNA, 16 bp, Homo sapiens
tgtggcagtggttttg

SEQ ID NO: 515425 - DNA, 20 bp, Homo sapiens
tgtggtattggtgctttgtg

SEQ ID NO: 515426 - DNA, 16 bp, Homo sapiens
tgtgtgttgcttctct

SEQ ID NO: 515427 - DNA, 22 bp, Homo sapiens
tgtgttgcttctctattgcaag

SEQ ID NO: 515428 - DNA, 15 bp, Homo sapiens
tgtgtttttccaaaa

SEQ ID NO: 515429 - DNA, 20 bp, Homo sapiens
tgtgtttttccaaaacttga

SEQ ID NO: 515430 - DNA, 22 bp, Homo sapiens
tgttcatttgaaacctttttct

SEQ ID NO: 515431 - DNA, 15 bp, Homo sapiens
tgttccaaatttgct

SEQ ID NO: 515432 - DNA, 17 bp, Homo sapiens
tgttctgtttcctgtgt

SEQ ID NO: 515433 - DNA, 19 bp, Homo sapiens
tgttgaattttattgaaag

SEQ ID NO: 515434 - DNA, 21 bp, Homo sapiens
tgttgaattttattgaaagct

SEQ ID NO: 515435 - DNA, 20 bp, Homo sapiens
tgttgacatcactggcatgg

SEQ ID NO: 515436 - DNA, 18 bp, Homo sapiens
tgttgtttttttcttttc

SEQ ID NO: 515437 - DNA, 20 bp, Homo sapiens
tgttttaagccaatatttta

SEQ ID NO: 515438 - DNA, 21 bp, Homo sapiens
tgttttagatccaaatgtaaa

SEQ ID NO: 515439 - DNA, 20 bp, Homo sapiens
tgttttcagccttcagattt

SEQ ID NO: 515440 - DNA, 20 bp, Homo sapiens
tgttttgcaaaggaaaataa

SEQ ID NO: 515441 - DNA, 17 bp, Homo sapiens
tgttttgtgtttttcca

SEQ ID NO: 515442 - DNA, 13 bp, Homo sapiens
tgtttttaaagtg

SEQ ID NO: 515443 - DNA, 16 bp, Homo sapiens
tgtttttccaaaactt

SEQ ID NO: 515444 - DNA, 22 bp, Homo sapiens
ttaaaaaacagcttgttctaga

SEQ ID NO: 515445 - DNA, 13 bp, Homo sapiens
ttaaaaattactg

SEQ ID NO: 515446 - DNA, 14 bp, Homo sapiens
ttaaaaccaaagag

SEQ ID NO: 515447 - DNA, 21 bp, Homo sapiens
ttaaacaaaatgtagacaaag

SEQ ID NO: 515448 - DNA, 20 bp, Homo sapiens
ttaaatgaagatacagtgga

SEQ ID NO: 515449 - DNA, 23 bp, Homo sapiens
ttaacattcctcatgaatgtaaa

SEQ ID NO: 515450 - DNA, 18 bp, Homo sapiens
ttaactgccaaaacaaga

SEQ ID NO: 515451 - DNA, 14 bp, Homo sapiens
ttaacttaatggca

SEQ ID NO: 515452 - DNA, 22 bp, Homo sapiens
ttaagaggaagaagaagaaagg

SEQ ID NO: 515453 - DNA, 18 bp, Homo sapiens
ttaatggcataacaaagg

SEQ ID NO: 515454 - DNA, 12 bp, Homo sapiens
ttaattaatgta

SEQ ID NO: 515455 - DNA, 16 bp, Homo sapiens
ttaattaatgtacaca

SEQ ID NO: 515456 - DNA, 13 bp, Homo sapiens
tttacttcctttc

SEQ ID NO: 515457 - DNA, 15 bp, Homo sapiens
tttacttcctttctt

SEQ ID NO: 515458 - DNA, 16 bp, Homo sapiens
tttactttgtttttat

SEQ ID NO: 515459 - DNA, 20 bp, Homo sapiens
tttactttgtttttattctg

SEQ ID NO: 515460 - DNA, 14 bp, Homo sapiens
tttagttgaatttt

SEQ ID NO: 515461 - DNA, 22 bp, Homo sapiens
tttatccagaatgcttctcttt

SEQ ID NO: 515462 - DNA, 12 bp, Homo sapiens
tttattcccttt

SEQ ID NO: 515463 - DNA, 17 bp, Homo sapiens
tttattcccttttaaag

SEQ ID NO: 515464 - DNA, 15 bp, Homo sapiens
tttcaaagaaagact

SEQ ID NO: 515465 - DNA, 18 bp, Homo sapiens
tttcaaagaaagactgta

SEQ ID NO: 515466 - DNA, 22 bp, Homo sapiens
tttcaaagaaagactgtaagct

SEQ ID NO: 515467 - DNA, 18 bp, Homo sapiens
tttcaagaaaattttgca

SEQ ID NO: 515468 - DNA, 20 bp, Homo sapiens
tttcaagaaaattttgcaga

SEQ ID NO: 515469 - DNA, 21 bp, Homo sapiens
tttcaatgaaacaaagaaaga

SEQ ID NO: 515470 - DNA, 16 bp, Homo sapiens
tttcacagtgtgattt

SEQ ID NO: 515471 - DNA, 16 bp, Homo sapiens
tttcagtgcagtaatt

SEQ ID NO: 515472 - DNA, 9 bp, Homo sapiens
tttccaaaa

SEQ ID NO: 515473 - DNA, 22 bp, Homo sapiens
tttcccatctgcaccccttctc

SEQ ID NO: 515474 - DNA, 13 bp, Homo sapiens
tttctaagagaag

SEQ ID NO: 515475 - DNA, 14 bp, Homo sapiens
tttctgccctggct

SEQ ID NO: 515476 - DNA, 16 bp, Homo sapiens
tttctgggcttttcct

SEQ ID NO: 515477 - DNA, 20 bp, Homo sapiens
tttctggtgcacaggtttgt

SEQ ID NO: 515478 - DNA, 14 bp, Homo sapiens
tttgagctgccttc

SEQ ID NO: 515479 - DNA, 22 bp, Homo sapiens
tttgaggccagtaattcgtttg

SEQ ID NO: 515480 - DNA, 20 bp, Homo sapiens
tttgatgcagcacttcagat

SEQ ID NO: 515481 - DNA, 12 bp, Homo sapiens
ttttaaagtgta

SEQ ID NO: 515482 - DNA, 22 bp, Homo sapiens
ttttactttgtttttattctgt

SEQ ID NO: 515483 - DNA, 22 bp, Homo sapiens
ttttagggtcaatgagagccat

SEQ ID NO: 515484 - DNA, 13 bp, Homo sapiens
ttttataaagttt

SEQ ID NO: 515485 - DNA, 16 bp, Homo sapiens
ttttatgttttgtttt

SEQ ID NO: 515486 - DNA, 21 bp, Homo sapiens
ttttcaagaaaattttgcaga

SEQ ID NO: 515487 - DNA, 10 bp, Homo sapiens
ttttccaaaa

SEQ ID NO: 515488 - DNA, 19 bp, Homo sapiens
ttttccaaaacttgaactt

SEQ ID NO: 515489 - DNA, 12 bp, Homo sapiens
ttttccttttgc

SEQ ID NO: 515490 - DNA, 13 bp, Homo sapiens
ttttctaagagaa

SEQ ID NO: 515491 - DNA, 15 bp, Homo sapiens
ttttctaagagaagt

SEQ ID NO: 515492 - DNA, 16 bp, Homo sapiens
ttttctggtaattttg

SEQ ID NO: 515493 - DNA, 21 bp, Homo sapiens
ttttcttttcctccatgatgt

SEQ ID NO: 515494 - DNA, 14 bp, Homo sapiens
ttttgcacagtgga

SEQ ID NO: 515495 - DNA, 12 bp, Homo sapiens
ttttgctgtttt

SEQ ID NO: 515496 - DNA, 18 bp, Homo sapiens
ttttgtgtttttccaaaa

SEQ ID NO: 515497 - DNA, 18 bp, Homo sapiens
tttttcaagaaaattttg

SEQ ID NO: 515498 - DNA, 11 bp, Homo sapiens
tttttccaaaa

SEQ ID NO: 515499 - DNA, 13 bp, Homo sapiens
tttttctgggctt

SEQ ID NO: 515500 - DNA, 12 bp, Homo sapiens
ttttttaacatt

SEQ ID NO: 515501 - DNA, 13 bp, Homo sapiens
ttttttagttgaa

SEQ ID NO: 515502 - DNA, 18 bp, Homo sapiens
cccagtccccacccctgc

SEQ ID NO: 515503 - DNA, 19 bp, Homo sapiens
cccagtccccacccctgcc

SEQ ID NO: 515504 - DNA, 23 bp, Homo sapiens
cccagtccccacccctgccccca

SEQ ID NO: 515505 - DNA, 13 bp, Homo sapiens
cccagtggcaggg

SEQ ID NO: 515506 - DNA, 14 bp, Homo sapiens
cccagtggcagggc

SEQ ID NO: 515507 - DNA, 17 bp, Homo sapiens
cccagtggcagggcaca

SEQ ID NO: 515508 - DNA, 20 bp, Homo sapiens
cccagtggcagggcacaggg

SEQ ID NO: 515509 - DNA, 23 bp, Homo sapiens
cccagtggcagggcacagggcct

SEQ ID NO: 515510 - DNA, 14 bp, Homo sapiens
cccatgggcaggag

SEQ ID NO: 515511 - DNA, 20 bp, Homo sapiens
cccatgtatggccaggaagt

SEQ ID NO: 515512 - DNA, 21 bp, Homo sapiens
cccatttgctgtctttttgta

SEQ ID NO: 515513 - DNA, 22 bp, Homo sapiens
ccccaccccggggaccctgtga

SEQ ID NO: 515514 - DNA, 14 bp, Homo sapiens
ccccacctggccct

SEQ ID NO: 515515 - DNA, 14 bp, Homo sapiens
ccccactctcagag

SEQ ID NO: 515516 - DNA, 17 bp, Homo sapiens
ccccagcttccagcagg

SEQ ID NO: 515517 - DNA, 19 bp, Homo sapiens
ccccagcttccagcaggag

SEQ ID NO: 515518 - DNA, 11 bp, Homo sapiens
ccccagggcac

SEQ ID NO: 515519 - DNA, 17 bp, Homo sapiens
ccccatttcccatctgc

SEQ ID NO: 515520 - DNA, 13 bp, Homo sapiens
ccccctgccctgc

SEQ ID NO: 515521 - DNA, 14 bp, Homo sapiens
ccccctgccctgca

SEQ ID NO: 515522 - DNA, 16 bp, Homo sapiens
ccccgcccccagtccc

SEQ ID NO: 515523 - DNA, 13 bp, Homo sapiens
ccccgtctcaggt

SEQ ID NO: 515524 - DNA, 22 bp, Homo sapiens
cccctcgcccagtcccagcagc

SEQ ID NO: 515525 - DNA, 15 bp, Homo sapiens
cccctctcctttcac

SEQ ID NO: 515526 - DNA, 14 bp, Homo sapiens
cccctgagcccact

SEQ ID NO: 515527 - DNA, 20 bp, Homo sapiens
cccctgcagttcccctggaa

SEQ ID NO: 515528 - DNA, 12 bp, Homo sapiens
cccctgccctgc

SEQ ID NO: 515529 - DNA, 13 bp, Homo sapiens
cccctgccctgca

SEQ ID NO: 515530 - DNA, 18 bp, Homo sapiens
cccctggaagcagtgccc

SEQ ID NO: 515531 - DNA, 20 bp, Homo sapiens
cccctggaagcagtgcccag

SEQ ID NO: 515532 - DNA, 21 bp, Homo sapiens
cccctggaagcagtgcccagg

SEQ ID NO: 515533 - DNA, 14 bp, Homo sapiens
cccctggaccccag

SEQ ID NO: 515534 - DNA, 18 bp, Homo sapiens
cccctggaccccagcctc

SEQ ID NO: 515535 - DNA, 22 bp, Homo sapiens
cccctgggcttggcctgctgtg

SEQ ID NO: 515536 - DNA, 23 bp, Homo sapiens
cccctgggcttggcctgctgtga

SEQ ID NO: 515537 - DNA, 12 bp, Homo sapiens
ccccttctcccc

SEQ ID NO: 515538 - DNA, 15 bp, Homo sapiens
ccccttctctcctcc

SEQ ID NO: 515539 - DNA, 16 bp, Homo sapiens
ccccttgccagctgct

SEQ ID NO: 515540 - DNA, 16 bp, Homo sapiens
cccggggaccctgtga

SEQ ID NO: 515541 - DNA, 13 bp, Homo sapiens
ccctcactctcag

SEQ ID NO: 515542 - DNA, 12 bp, Homo sapiens
ccctcgcccagt

SEQ ID NO: 515543 - DNA, 20 bp, Homo sapiens
ccctcgcccagtcccagcag

SEQ ID NO: 515544 - DNA, 22 bp, Homo sapiens
ccctcgcccagtcccagcagcc

SEQ ID NO: 515545 - DNA, 15 bp, Homo sapiens
ccctctcctttcact

SEQ ID NO: 515546 - DNA, 18 bp, Homo sapiens
ccctctctgaaggaggcc

SEQ ID NO: 515547 - DNA, 13 bp, Homo sapiens
ccctgagcccact

SEQ ID NO: 515548 - DNA, 15 bp, Homo sapiens
ccctgcacgtcatgg

SEQ ID NO: 515549 - DNA, 16 bp, Homo sapiens
ccctgcactgtaaaat

SEQ ID NO: 515550 - DNA, 13 bp, Homo sapiens
ccctgccaggcac

SEQ ID NO: 515551 - DNA, 17 bp, Homo sapiens
ccctgccaggcacaggc

SEQ ID NO: 515552 - DNA, 18 bp, Homo sapiens
ccctgccaggcacaggca

SEQ ID NO: 515553 - DNA, 20 bp, Homo sapiens
ccctgccaggcacaggcagg

SEQ ID NO: 515554 - DNA, 12 bp, Homo sapiens
ccctgccctgca

SEQ ID NO: 515555 - DNA, 23 bp, Homo sapiens
ccctgcctctccgcccctgagcc

SEQ ID NO: 515556 - DNA, 18 bp, Homo sapiens
ccctgcttggcccagggg

SEQ ID NO: 515557 - DNA, 18 bp, Homo sapiens
ccctggaagcagtgccca

SEQ ID NO: 515558 - DNA, 21 bp, Homo sapiens
ccctggaagcagtgcccaggt

SEQ ID NO: 515559 - DNA, 14 bp, Homo sapiens
ccctggaccccagc

SEQ ID NO: 515560 - DNA, 18 bp, Homo sapiens
ccctggaccccagcctca

SEQ ID NO: 515561 - DNA, 17 bp, Homo sapiens
ccctgggcttggcctgc

SEQ ID NO: 515562 - DNA, 20 bp, Homo sapiens
ccctgggcttggcctgctgt

SEQ ID NO: 515563 - DNA, 22 bp, Homo sapiens
ccctgggcttggcctgctgtga

SEQ ID NO: 515564 - DNA, 23 bp, Homo sapiens
ccctgggttagactgccagctct

SEQ ID NO: 515565 - DNA, 19 bp, Homo sapiens
ccctgtgacatggtgcctg

SEQ ID NO: 515566 - DNA, 21 bp, Homo sapiens
ccctgtgacatggtgcctgag

SEQ ID NO: 515567 - DNA, 17 bp, Homo sapiens
cccttccttttccctgc

SEQ ID NO: 515568 - DNA, 14 bp, Homo sapiens
cccttgccagctgc

SEQ ID NO: 515569 - DNA, 18 bp, Homo sapiens
cccttgccagctgctgag

SEQ ID NO: 515570 - DNA, 13 bp, Homo sapiens
cccttgcctcccc

SEQ ID NO: 515571 - DNA, 23 bp, Homo sapiens
ccgcagagaagtgacggttccta

SEQ ID NO: 515572 - DNA, 16 bp, Homo sapiens
ccgcagagtatttgaa

SEQ ID NO: 515573 - DNA, 12 bp, Homo sapiens
ccgccagcctcc

SEQ ID NO: 515574 - DNA, 13 bp, Homo sapiens
ccgccagcctcct

SEQ ID NO: 515575 - DNA, 18 bp, Homo sapiens
ccgccagcctcctctgga

SEQ ID NO: 515576 - DNA, 13 bp, Homo sapiens
ccgcccctgagcc

SEQ ID NO: 515577 - DNA, 15 bp, Homo sapiens
ccgcccctgagccca

SEQ ID NO: 515578 - DNA, 19 bp, Homo sapiens
ccgccggttcattttgcac

SEQ ID NO: 515579 - DNA, 15 bp, Homo sapiens
ccggggaccctgtga

SEQ ID NO: 515580 - DNA, 16 bp, Homo sapiens
ccggttcattttgcac

SEQ ID NO: 515581 - DNA, 11 bp, Homo sapiens
ccgtctcaggt

SEQ ID NO: 515582 - DNA, 17 bp, Homo sapiens
cctaatttctcctccct

SEQ ID NO: 515583 - DNA, 17 bp, Homo sapiens
cctacaatgggaaaact

SEQ ID NO: 515584 - DNA, 17 bp, Homo sapiens
cctacacaggacagggg

SEQ ID NO: 515585 - DNA, 23 bp, Homo sapiens
cctacacaggacaggggttcctt

SEQ ID NO: 515586 - DNA, 10 bp, Homo sapiens
cctacagtgt

SEQ ID NO: 515587 - DNA, 12 bp, Homo sapiens
cctagctggaga

SEQ ID NO: 515588 - DNA, 19 bp, Homo sapiens
cctagctggagaggagccc

SEQ ID NO: 515589 - DNA, 20 bp, Homo sapiens
cctagctggagaggagccct

SEQ ID NO: 515590 - DNA, 21 bp, Homo sapiens
cctagctttagaccctgggtg

SEQ ID NO: 515591 - DNA, 22 bp, Homo sapiens
cctagctttagaccctgggtgg

SEQ ID NO: 515592 - DNA, 17 bp, Homo sapiens
cctatacccagcagagg

SEQ ID NO: 515593 - DNA, 16 bp, Homo sapiens
cctcaaatccaggacc

SEQ ID NO: 515594 - DNA, 18 bp, Homo sapiens
cctcaaatccaggaccct

SEQ ID NO: 515595 - DNA, 19 bp, Homo sapiens
cctcaaatccaggaccctg

SEQ ID NO: 515596 - DNA, 14 bp, Homo sapiens
cctcactctcagga

SEQ ID NO: 515597 - DNA, 14 bp, Homo sapiens
cctcagtctacccc

SEQ ID NO: 515598 - DNA, 15 bp, Homo sapiens
cctcatgaatgtaaa

SEQ ID NO: 515599 - DNA, 20 bp, Homo sapiens
cctcatgaatgtaaatttgt

SEQ ID NO: 515600 - DNA, 24 bp, Homo sapiens
cctcatgcccaccccctgccctgc

SEQ ID NO: 515601 - DNA, 20 bp, Homo sapiens
cctccccaaatcaatacact

SEQ ID NO: 515602 - DNA, 22 bp, Homo sapiens
cctccccatttcccatctgcac

SEQ ID NO: 515603 - DNA, 23 bp, Homo sapiens
cctccccatttcccatctgcacc

SEQ ID NO: 515604 - DNA, 22 bp, Homo sapiens
cctcccttccttttccctgctt

SEQ ID NO: 515605 - DNA, 14 bp, Homo sapiens
cctccgagagggag

SEQ ID NO: 515606 - DNA, 15 bp, Homo sapiens
cctcctaaaaggccc

SEQ ID NO: 515607 - DNA, 16 bp, Homo sapiens
cctcctaaaaggccca

SEQ ID NO: 515608 - DNA, 13 bp, Homo sapiens
cctcctcacctca

SEQ ID NO: 515609 - DNA, 21 bp, Homo sapiens
cctcctctggacggcaggctc

SEQ ID NO: 515610 - DNA, 22 bp, Homo sapiens
cctcctctggacggcaggctca

SEQ ID NO: 515611 - DNA, 18 bp, Homo sapiens
cctcgcccagtcccagca

SEQ ID NO: 515612 - DNA, 20 bp, Homo sapiens
cctcgcccagtcccagcagc

SEQ ID NO: 515613 - DNA, 15 bp, Homo sapiens
cctctccgcccctga

SEQ ID NO: 515614 - DNA, 13 bp, Homo sapiens
ctagctggagagg

SEQ ID NO: 515615 - DNA, 22 bp, Homo sapiens
ctagctggagaggagccctgcc

SEQ ID NO: 515616 - DNA, 23 bp, Homo sapiens
ctagctggagaggagccctgcct

SEQ ID NO: 515617 - DNA, 13 bp, Homo sapiens
ctagcttctgctt

SEQ ID NO: 515618 - DNA, 14 bp, Homo sapiens
ctagcttctgcttt

SEQ ID NO: 515619 - DNA, 22 bp, Homo sapiens
ctagcttctgcttttctgccct

SEQ ID NO: 515620 - DNA, 21 bp, Homo sapiens
ctatatttttgggaggagcca

SEQ ID NO: 515621 - DNA, 21 bp, Homo sapiens
ctatctcatctatctcaatcc

SEQ ID NO: 515622 - DNA, 15 bp, Homo sapiens
ctatgtttttaaagt

SEQ ID NO: 515623 - DNA, 21 bp, Homo sapiens
ctattatgatgttttgcaaag

SEQ ID NO: 515624 - DNA, 18 bp, Homo sapiens
ctattcttgatgtaaaat

SEQ ID NO: 515625 - DNA, 19 bp, Homo sapiens
ctattcttgatgtaaaatc

SEQ ID NO: 515626 - DNA, 20 bp, Homo sapiens
ctattcttgatgtaaaatct

SEQ ID NO: 515627 - DNA, 17 bp, Homo sapiens
ctattctttccatgaca

SEQ ID NO: 515628 - DNA, 14 bp, Homo sapiens
ctatttaactgact

SEQ ID NO: 515629 - DNA, 15 bp, Homo sapiens
ctatttaactgacta

SEQ ID NO: 515630 - DNA, 15 bp, Homo sapiens
ctatttgtgaattct

SEQ ID NO: 515631 - DNA, 13 bp, Homo sapiens
ctatttttaaaaa

SEQ ID NO: 515632 - DNA, 18 bp, Homo sapiens
ctcaaaatcaactctctt

SEQ ID NO: 515633 - DNA, 13 bp, Homo sapiens
ctcaaatccagga

SEQ ID NO: 515634 - DNA, 20 bp, Homo sapiens
ctcacagacaggacccctgc

SEQ ID NO: 515635 - DNA, 21 bp, Homo sapiens
ctcaccatgaatatctggggt

SEQ ID NO: 515636 - DNA, 19 bp, Homo sapiens
ctcaccatttccccagggc

SEQ ID NO: 515637 - DNA, 21 bp, Homo sapiens
ctcaccatttccccagggcac

SEQ ID NO: 515638 - DNA, 17 bp, Homo sapiens
ctcacctcatgcccacc

SEQ ID NO: 515639 - DNA, 12 bp, Homo sapiens
ctcactctcagg

SEQ ID NO: 515640 - DNA, 14 bp, Homo sapiens
ctcactgaagctca

SEQ ID NO: 515641 - DNA, 21 bp, Homo sapiens
ctcagaggccccaatacccca

SEQ ID NO: 515642 - DNA, 22 bp, Homo sapiens
ctcagaggccccaataccccat

SEQ ID NO: 515643 - DNA, 18 bp, Homo sapiens
ctcagcaaggccacctct

SEQ ID NO: 515644 - DNA, 22 bp, Homo sapiens
ctcagcaaggccacctcttcct

SEQ ID NO: 515645 - DNA, 21 bp, Homo sapiens
ctcaggaaatgctgacccatg

SEQ ID NO: 515646 - DNA, 13 bp, Homo sapiens
ctcaggtctgagt

SEQ ID NO: 515647 - DNA, 13 bp, Homo sapiens
ctcatgaatgtaa

SEQ ID NO: 515648 - DNA, 20 bp, Homo sapiens
ctcatgcccaccccctgccc

SEQ ID NO: 515649 - DNA, 23 bp, Homo sapiens
ctcatgcccaccccctgccctgc

SEQ ID NO: 515650 - DNA, 16 bp, Homo sapiens
ctccaaagagaaacct

SEQ ID NO: 515651 - DNA, 18 bp, Homo sapiens
ctccaacccctcgcccag

SEQ ID NO: 515652 - DNA, 19 bp, Homo sapiens
ctccaacccctcgcccagt

SEQ ID NO: 515653 - DNA, 20 bp, Homo sapiens
ctccaacccctcgcccagtc

SEQ ID NO: 515654 - DNA, 14 bp, Homo sapiens
ctccacatctgcct

SEQ ID NO: 515655 - DNA, 18 bp, Homo sapiens
ctccatccatgtgttcca

SEQ ID NO: 515656 - DNA, 21 bp, Homo sapiens
ctccatccatgtgttccaaat

SEQ ID NO: 515657 - DNA, 19 bp, Homo sapiens
ctccccatttcccatctgc

SEQ ID NO: 515658 - DNA, 20 bp, Homo sapiens
ctccccatttcccatctgca

SEQ ID NO: 515659 - DNA, 14 bp, Homo sapiens
ctcccctgcactgt

SEQ ID NO: 515660 - DNA, 17 bp, Homo sapiens
ctcccctgcactgtaaa

SEQ ID NO: 515661 - DNA, 21 bp, Homo sapiens
ctcccctgcactgtaaaatgt

SEQ ID NO: 515662 - DNA, 14 bp, Homo sapiens
ctccccttgccagc

SEQ ID NO: 515663 - DNA, 16 bp, Homo sapiens
ctccccttgccagctg

SEQ ID NO: 515664 - DNA, 16 bp, Homo sapiens
ctccctcactctcagg

SEQ ID NO: 515665 - DNA, 12 bp, Homo sapiens
ctcccttccttt

SEQ ID NO: 515666 - DNA, 19 bp, Homo sapiens
ctcccttccttttccctgc

SEQ ID NO: 515667 - DNA, 18 bp, Homo sapiens
ctccgccagcctcctctg

SEQ ID NO: 515668 - DNA, 19 bp, Homo sapiens
ctccgcccctgagcccact

SEQ ID NO: 515669 - DNA, 15 bp, Homo sapiens
ctcctatacccagca

SEQ ID NO: 515670 - DNA, 13 bp, Homo sapiens
ctcctcccttcct

SEQ ID NO: 515671 - DNA, 21 bp, Homo sapiens
ctcctcccttccttttccctg

SEQ ID NO: 515672 - DNA, 13 bp, Homo sapiens
ctcctgagccccc

SEQ ID NO: 515673 - DNA, 22 bp, Homo sapiens
ctcctgagcccccagcttccag

SEQ ID NO: 515674 - DNA, 16 bp, Homo sapiens
ctcgcccagtcccagc

SEQ ID NO: 515675 - DNA, 18 bp, Homo sapiens
ctcgcccagtcccagcag

SEQ ID NO: 515676 - DNA, 20 bp, Homo sapiens
ctcgcccagtcccagcagcc

SEQ ID NO: 515677 - DNA, 19 bp, Homo sapiens
ctctagaagccaagggaaa

SEQ ID NO: 515678 - DNA, 23 bp, Homo sapiens
ctctcaccatttggatcctgtgt

SEQ ID NO: 515679 - DNA, 15 bp, Homo sapiens
ctctcagaggcccca

SEQ ID NO: 515680 - DNA, 21 bp, Homo sapiens
ctctcaggaaatgctgaccca

SEQ ID NO: 515681 - DNA, 20 bp, Homo sapiens
ctctctgaaggaggccacct

SEQ ID NO: 515682 - DNA, 16 bp, Homo sapiens
ctctgaaggaggccac

SEQ ID NO: 515683 - DNA, 18 bp, Homo sapiens
ctctgaaggaggccacct

SEQ ID NO: 515684 - DNA, 23 bp, Homo sapiens
ctctggacggcaggctcactgcc

SEQ ID NO: 515685 - DNA, 23 bp, Homo sapiens
ctcttatggtattatatctctgt

SEQ ID NO: 515686 - DNA, 11 bp, Homo sapiens
ctgaaaaagag

SEQ ID NO: 515687 - DNA, 18 bp, Homo sapiens
ctgaaggaaaaacacaag

SEQ ID NO: 515688 - DNA, 16 bp, Homo sapiens
ctgaaggaggccacct

SEQ ID NO: 515689 - DNA, 17 bp, Homo sapiens
ctgaaggaggccacctc

SEQ ID NO: 515690 - DNA, 15 bp, Homo sapiens
ctgactacagggccg

SEQ ID NO: 515691 - DNA, 22 bp, Homo sapiens
ctgactattcttgatgtaaaat

SEQ ID NO: 515692 - DNA, 21 bp, Homo sapiens
ctgactgattccttctctgga

SEQ ID NO: 515693 - DNA, 12 bp, Homo sapiens
ctgagaggcagg

SEQ ID NO: 515694 - DNA, 14 bp, Homo sapiens
ctgagaggcaggca

SEQ ID NO: 515695 - DNA, 15 bp, Homo sapiens
ctgagaggcaggcat

SEQ ID NO: 515696 - DNA, 22 bp, Homo sapiens
ctgagccatccagcatgaaaga

SEQ ID NO: 515697 - DNA, 15 bp, Homo sapiens
ctgagcccccagctt

SEQ ID NO: 515698 - DNA, 17 bp, Homo sapiens
ctgagcccccagcttcc

SEQ ID NO: 515699 - DNA, 17 bp, Homo sapiens
ctgaggtgttattttca

SEQ ID NO: 515700 - DNA, 20 bp, Homo sapiens
ctgaggtgttattttcaatg

SEQ ID NO: 515701 - DNA, 14 bp, Homo sapiens
ctgaggttcctctg

SEQ ID NO: 515702 - DNA, 16 bp, Homo sapiens
ctgaggttcctctgcc

SEQ ID NO: 515703 - DNA, 21 bp, Homo sapiens
ctgaggttcctctgcctgccc

SEQ ID NO: 515704 - DNA, 23 bp, Homo sapiens
ctgaggttcctctgcctgccccg

SEQ ID NO: 515705 - DNA, 20 bp, Homo sapiens
ctgagtgcaggcccaccctg

SEQ ID NO: 515706 - DNA, 19 bp, Homo sapiens
ctgataatttattgtcttt

SEQ ID NO: 515707 - DNA, 18 bp, Homo sapiens
ctgatgtttttctgtgtt

SEQ ID NO: 515708 - DNA, 23 bp, Homo sapiens
ctgatgtttttctgtgttactta

SEQ ID NO: 515709 - DNA, 13 bp, Homo sapiens
ctgattttttgag

SEQ ID NO: 515710 - DNA, 20 bp, Homo sapiens
ctgattttttgaggccagta

SEQ ID NO: 515711 - DNA, 21 bp, Homo sapiens
ctgattttttgaggccagtaa

SEQ ID NO: 515712 - DNA, 19 bp, Homo sapiens
ctgcaccccttctctcctc

SEQ ID NO: 515713 - DNA, 20 bp, Homo sapiens
ctgcaccccttctctcctcc

SEQ ID NO: 515714 - DNA, 21 bp, Homo sapiens
ctgcaccccttctctcctccc

SEQ ID NO: 515715 - DNA, 15 bp, Homo sapiens
ctgcactgtaaaatg

SEQ ID NO: 515716 - DNA, 20 bp, Homo sapiens
ctgcacttgggggctcagca

SEQ ID NO: 515717 - DNA, 21 bp, Homo sapiens
ctgcagttcccctggaagcag

SEQ ID NO: 515718 - DNA, 17 bp, Homo sapiens
ctgcattttcttcactt

SEQ ID NO: 515719 - DNA, 13 bp, Homo sapiens
ctgccacctcccc

SEQ ID NO: 515720 - DNA, 17 bp, Homo sapiens
ctgccacctccccttgc

SEQ ID NO: 515721 - DNA, 18 bp, Homo sapiens
ctgccacctccccttgcc

SEQ ID NO: 515722 - DNA, 12 bp, Homo sapiens
ctgccagctctt

SEQ ID NO: 515723 - DNA, 13 bp, Homo sapiens
ctgccaggcacag

SEQ ID NO: 515724 - DNA, 21 bp, Homo sapiens
ctgccaggcacaggcagggca

SEQ ID NO: 515725 - DNA, 19 bp, Homo sapiens
gcaggaccagcccacgctg

SEQ ID NO: 515726 - DNA, 22 bp, Homo sapiens
gcaggaccagcccacgctgact

SEQ ID NO: 515727 - DNA, 11 bp, Homo sapiens
gcaggcccacc

SEQ ID NO: 515728 - DNA, 14 bp, Homo sapiens
gcaggcccaccctg

SEQ ID NO: 515729 - DNA, 14 bp, Homo sapiens
gcaggctcactgcc

SEQ ID NO: 515730 - DNA, 23 bp, Homo sapiens
gcaggctcactgccaggccagcc

SEQ ID NO: 515731 - DNA, 12 bp, Homo sapiens
gcagggcacagg

SEQ ID NO: 515732 - DNA, 13 bp, Homo sapiens
gcagggcacaggg

SEQ ID NO: 515733 - DNA, 16 bp, Homo sapiens
gcagggcacagggcct

SEQ ID NO: 515734 - DNA, 17 bp, Homo sapiens
gcaggggtgggggtgga

SEQ ID NO: 515735 - DNA, 23 bp, Homo sapiens
gcagtcactggaggttgaagcca

SEQ ID NO: 515736 - DNA, 14 bp, Homo sapiens
gcagtgcccaggtg

SEQ ID NO: 515737 - DNA, 17 bp, Homo sapiens
gcagtgtagttttcctt

SEQ ID NO: 515738 - DNA, 16 bp, Homo sapiens
gcatagaggcttctcc

SEQ ID NO: 515739 - DNA, 20 bp, Homo sapiens
gcatatttttgcacagtgga

SEQ ID NO: 515740 - DNA, 23 bp, Homo sapiens
gcatccatggggtctctcacaga

SEQ ID NO: 515741 - DNA, 19 bp, Homo sapiens
gcattttaatgatattgga

SEQ ID NO: 515742 - DNA, 14 bp, Homo sapiens
gcattttcttcact

SEQ ID NO: 515743 - DNA, 14 bp, Homo sapiens
gccaagagtggccc

SEQ ID NO: 515744 - DNA, 22 bp, Homo sapiens
gccaagagtggccccacctggc

SEQ ID NO: 515745 - DNA, 20 bp, Homo sapiens
gccaagtggggtgctgggag

SEQ ID NO: 515746 - DNA, 22 bp, Homo sapiens
gccacctccccttgccagctgc

SEQ ID NO: 515747 - DNA, 14 bp, Homo sapiens
gccacctcttcctg

SEQ ID NO: 515748 - DNA, 12 bp, Homo sapiens
gccagcctcctc

SEQ ID NO: 515749 - DNA, 13 bp, Homo sapiens
gccagctcttcct

SEQ ID NO: 515750 - DNA, 18 bp, Homo sapiens
gccagctgctgagccgca

SEQ ID NO: 515751 - DNA, 12 bp, Homo sapiens
gccaggcacagg

SEQ ID NO: 515752 - DNA, 15 bp, Homo sapiens
gccaggccagcctcc

SEQ ID NO: 515753 - DNA, 23 bp, Homo sapiens
gccagtctcctatacccagcaga

SEQ ID NO: 515754 - DNA, 20 bp, Homo sapiens
gccatagaaagtataatttc

SEQ ID NO: 515755 - DNA, 19 bp, Homo sapiens
gccattaaaaaacagcttg

SEQ ID NO: 515756 - DNA, 23 bp, Homo sapiens
gccattaaaaaacagcttgttct

SEQ ID NO: 515757 - DNA, 14 bp, Homo sapiens
gcccaccccctgcc

SEQ ID NO: 515758 - DNA, 17 bp, Homo sapiens
gcccaccccctgccctg

SEQ ID NO: 515759 - DNA, 22 bp, Homo sapiens
gcccaccctgcttggcccaggg

SEQ ID NO: 515760 - DNA, 19 bp, Homo sapiens
gcccacgctgactacaggg

SEQ ID NO: 515761 - DNA, 22 bp, Homo sapiens
gcccacgctgactacagggccg

SEQ ID NO: 515762 - DNA, 16 bp, Homo sapiens
gcccactgtgcgtggg

SEQ ID NO: 515763 - DNA, 23 bp, Homo sapiens
gcccactgtgcgtggggctcccg

SEQ ID NO: 515764 - DNA, 16 bp, Homo sapiens
gcccacttccctgggt

SEQ ID NO: 515765 - DNA, 17 bp, Homo sapiens
gcccagagagaagagcc

SEQ ID NO: 515766 - DNA, 20 bp, Homo sapiens
gcccagagagaagagcccca

SEQ ID NO: 515767 - DNA, 13 bp, Homo sapiens
gcccaggagccca

SEQ ID NO: 515768 - DNA, 14 bp, Homo sapiens
gcccaggagcccat

SEQ ID NO: 515769 - DNA, 15 bp, Homo sapiens
gcccagtcccagcag

SEQ ID NO: 515770 - DNA, 15 bp, Homo sapiens
gcccatgtatggcca

SEQ ID NO: 515771 - DNA, 20 bp, Homo sapiens
gcccatttggagggcctggg

SEQ ID NO: 515772 - DNA, 18 bp, Homo sapiens
gccccacctggccctctc

SEQ ID NO: 515773 - DNA, 19 bp, Homo sapiens
gccccactctcagaggccc

SEQ ID NO: 515774 - DNA, 21 bp, Homo sapiens
gcccccaccccggggaccctg

SEQ ID NO: 515775 - DNA, 22 bp, Homo sapiens
gcccccaccccggggaccctgt

SEQ ID NO: 515776 - DNA, 20 bp, Homo sapiens
gcccccagccccggggtgag

SEQ ID NO: 515777 - DNA, 20 bp, Homo sapiens
gcccccagtccccacccctg

SEQ ID NO: 515778 - DNA, 14 bp, Homo sapiens
gccccgtctcaggt

SEQ ID NO: 515779 - DNA, 11 bp, Homo sapiens
gcccctgagcc

SEQ ID NO: 515780 - DNA, 16 bp, Homo sapiens
gcccctgagcccactg

SEQ ID NO: 515781 - DNA, 11 bp, Homo sapiens
gcccctgggct

SEQ ID NO: 515782 - DNA, 23 bp, Homo sapiens
gccctctctgaaggaggccacct

SEQ ID NO: 515783 - DNA, 13 bp, Homo sapiens
gccctgcctctcc

SEQ ID NO: 515784 - DNA, 17 bp, Homo sapiens
gccctgcctctccgccc

SEQ ID NO: 515785 - DNA, 18 bp, Homo sapiens
gccctgcctctccgcccc

SEQ ID NO: 515786 - DNA, 11 bp, Homo sapiens
gccctggctgc

SEQ ID NO: 515787 - DNA, 16 bp, Homo sapiens
gccctggctgctgccc

SEQ ID NO: 515788 - DNA, 17 bp, Homo sapiens
gccctggctgctgcccc

SEQ ID NO: 515789 - DNA, 13 bp, Homo sapiens
gcccttgcctccc

SEQ ID NO: 515790 - DNA, 22 bp, Homo sapiens
gccgccggcaataaaagcccag

SEQ ID NO: 515791 - DNA, 19 bp, Homo sapiens
gccggcaataaaagcccag

SEQ ID NO: 515792 - DNA, 22 bp, Homo sapiens
gccggcaataaaagcccaggag

SEQ ID NO: 515793 - DNA, 22 bp, Homo sapiens
gcctccacacttgctcttctga

SEQ ID NO: 515794 - DNA, 16 bp, Homo sapiens
gcctccccatttccca

SEQ ID NO: 515795 - DNA, 19 bp, Homo sapiens
gcctccccatttcccatct

SEQ ID NO: 515796 - DNA, 22 bp, Homo sapiens
gcctccccatttcccatctgca

SEQ ID NO: 515797 - DNA, 23 bp, Homo sapiens
gcctccccatttcccatctgcac

SEQ ID NO: 515798 - DNA, 19 bp, Homo sapiens
gcctctccgcccctgagcc

SEQ ID NO: 515799 - DNA, 13 bp, Homo sapiens
gcctgagaggcag

SEQ ID NO: 515800 - DNA, 18 bp, Homo sapiens
gcctgagaggcaggcata

SEQ ID NO: 515801 - DNA, 22 bp, Homo sapiens
gcctgagaggcaggcatagagg

SEQ ID NO: 515802 - DNA, 21 bp, Homo sapiens
gcctgcacttgggggctcagc

SEQ ID NO: 515803 - DNA, 21 bp, Homo sapiens
gcctgccccgcccccagtccc

SEQ ID NO: 515804 - DNA, 13 bp, Homo sapiens
gcctgctggcacc

SEQ ID NO: 515805 - DNA, 12 bp, Homo sapiens
gcctggctccct

SEQ ID NO: 515806 - DNA, 14 bp, Homo sapiens
gcctgggcctggct

SEQ ID NO: 515807 - DNA, 14 bp, Homo sapiens
gccttaaaaccaaa

SEQ ID NO: 515808 - DNA, 15 bp, Homo sapiens
gccttggttcttcct

SEQ ID NO: 515809 - DNA, 18 bp, Homo sapiens
gcgtggggctcccgcctc

SEQ ID NO: 515810 - DNA, 14 bp, Homo sapiens
gctaaagagccctt

SEQ ID NO: 515811 - DNA, 23 bp, Homo sapiens
gctaaagagcccttgcctcccca

SEQ ID NO: 515812 - DNA, 20 bp, Homo sapiens
gctaagcattttctcctgtg

SEQ ID NO: 515813 - DNA, 17 bp, Homo sapiens
gctagaaacataatttt

SEQ ID NO: 515814 - DNA, 12 bp, Homo sapiens
gctagcttctgc

SEQ ID NO: 515815 - DNA, 17 bp, Homo sapiens
gctagcttctgcttttc

SEQ ID NO: 515816 - DNA, 22 bp, Homo sapiens
gctagcttctgcttttctgccc

SEQ ID NO: 515817 - DNA, 21 bp, Homo sapiens
gctatgttcttctgttattta

SEQ ID NO: 515818 - DNA, 12 bp, Homo sapiens
gctcactgccag

SEQ ID NO: 515819 - DNA, 22 bp, Homo sapiens
gctcactgccaggccagcctcc

SEQ ID NO: 515820 - DNA, 16 bp, Homo sapiens
gctcagcaaggccacc

SEQ ID NO: 515821 - DNA, 18 bp, Homo sapiens
gctcagcaaggccacctc

SEQ ID NO: 515822 - DNA, 19 bp, Homo sapiens
gctcagcaaggccacctct

SEQ ID NO: 515823 - DNA, 16 bp, Homo sapiens
gctccctcactctcag

SEQ ID NO: 515824 - DNA, 12 bp, Homo sapiens
gctcctgagccc

SEQ ID NO: 515825 - DNA, 19 bp, Homo sapiens
gctctgtgcagtcactgga

SEQ ID NO: 515826 - DNA, 23 bp, Homo sapiens
gctctgtgggttttaacattttt

SEQ ID NO: 515827 - DNA, 16 bp, Homo sapiens
gctgacccatgggcag

SEQ ID NO: 515828 - DNA, 13 bp, Homo sapiens
gctgaggttcctc

SEQ ID NO: 515829 - DNA, 21 bp, Homo sapiens
gctgaggttcctctgcctgcc

SEQ ID NO: 515830 - DNA, 20 bp, Homo sapiens
gctgagtgcaggcccaccct

SEQ ID NO: 515831 - DNA, 17 bp, Homo sapiens
gctgccacttaaaaaga

SEQ ID NO: 515832 - DNA, 15 bp, Homo sapiens
gctgcccccaccccg

SEQ ID NO: 515833 - DNA, 12 bp, Homo sapiens
gctgccttccct

SEQ ID NO: 515834 - DNA, 16 bp, Homo sapiens
gctgccttccctagct

SEQ ID NO: 515835 - DNA, 12 bp, Homo sapiens
gctgctgagccg

SEQ ID NO: 515836 - DNA, 15 bp, Homo sapiens
gtggggctcccgcct

SEQ ID NO: 515837 - DNA, 18 bp, Homo sapiens
gtgggttttttagttgaa

SEQ ID NO: 515838 - DNA, 11 bp, Homo sapiens
gtgtacatttt

SEQ ID NO: 515839 - DNA, 16 bp, Homo sapiens
gtgtacattttataaa

SEQ ID NO: 515840 - DNA, 13 bp, Homo sapiens
gtgtatttttgtt

SEQ ID NO: 515841 - DNA, 23 bp, Homo sapiens
gtgtctccaagcctctgtctttt

SEQ ID NO: 515842 - DNA, 18 bp, Homo sapiens
gtgtggagagggaatgtg

SEQ ID NO: 515843 - DNA, 14 bp, Homo sapiens
gtgttgaattttat

SEQ ID NO: 515844 - DNA, 12 bp, Homo sapiens
gttagactgcca

SEQ ID NO: 515845 - DNA, 14 bp, Homo sapiens
gttattttctacag

SEQ ID NO: 515846 - DNA, 15 bp, Homo sapiens
gttattttctacagt

SEQ ID NO: 515847 - DNA, 12 bp, Homo sapiens
gttcatttgaaa

SEQ ID NO: 515848 - DNA, 18 bp, Homo sapiens
gttccaaatttgctttac

SEQ ID NO: 515849 - DNA, 21 bp, Homo sapiens
gttcccctggaagcagtgccc

SEQ ID NO: 515850 - DNA, 24 bp, Homo sapiens
gttcccctggaagcagtgcccagg

SEQ ID NO: 515851 - DNA, 17 bp, Homo sapiens
gttcctacacaggacag

SEQ ID NO: 515852 - DNA, 14 bp, Homo sapiens
gttcctctgcctgc

SEQ ID NO: 515853 - DNA, 16 bp, Homo sapiens
gttcctctgcctgccc

SEQ ID NO: 515854 - DNA, 14 bp, Homo sapiens
gttctgtttcctgt

SEQ ID NO: 515855 - DNA, 19 bp, Homo sapiens
gttctttttcactctgtgt

SEQ ID NO: 515856 - DNA, 20 bp, Homo sapiens
gttgaattttattgaaagct

SEQ ID NO: 515857 - DNA, 20 bp, Homo sapiens
gttgaattttttttaacatt

SEQ ID NO: 515858 - DNA, 20 bp, Homo sapiens
gttgggacccagtggcaggg

SEQ ID NO: 515859 - DNA, 23 bp, Homo sapiens
gttgggacccagtggcagggcac

SEQ ID NO: 515860 - DNA, 12 bp, Homo sapiens
gttgtaaagaaa

SEQ ID NO: 515861 - DNA, 16 bp, Homo sapiens
gtttcctgtgtctcca

SEQ ID NO: 515862 - DNA, 13 bp, Homo sapiens
gtttgagctgcct

SEQ ID NO: 515863 - DNA, 23 bp, Homo sapiens
gtttgttttttcaagaaaatttt

SEQ ID NO: 515864 - DNA, 14 bp, Homo sapiens
gttttactttgttt

SEQ ID NO: 515865 - DNA, 20 bp, Homo sapiens
gttttggcaaacgctaaaga

SEQ ID NO: 515866 - DNA, 16 bp, Homo sapiens
gttttttagttgaatt

SEQ ID NO: 515867 - DNA, 19 bp, Homo sapiens
gtttttttcttctgtattt

SEQ ID NO: 515868 - DNA, 21 bp, Homo sapiens
taaaaagtaccacattccatg

SEQ ID NO: 515869 - DNA, 23 bp, Homo sapiens
taaaaattactgtttaattgaca

SEQ ID NO: 515870 - DNA, 14 bp, Homo sapiens
taaaactatttatg

SEQ ID NO: 515871 - DNA, 15 bp, Homo sapiens
taaaagcccaggagc

SEQ ID NO: 515872 - DNA, 17 bp, Homo sapiens
taaaagcccaggagccc

SEQ ID NO: 515873 - DNA, 13 bp, Homo sapiens
taaaaggcccaga

SEQ ID NO: 515874 - DNA, 14 bp, Homo sapiens
taaaaggcccagag

SEQ ID NO: 515875 - DNA, 16 bp, Homo sapiens
taaaataaataccaaa

SEQ ID NO: 515876 - DNA, 18 bp, Homo sapiens
taaaataaataccaaaga

SEQ ID NO: 515877 - DNA, 14 bp, Homo sapiens
taaaatcttgtcat

SEQ ID NO: 515878 - DNA, 15 bp, Homo sapiens
taaaatcttgtcatg

SEQ ID NO: 515879 - DNA, 18 bp, Homo sapiens
taaaatgtgggattatgg

SEQ ID NO: 515880 - DNA, 20 bp, Homo sapiens
taaaatgtgggattatgggt

SEQ ID NO: 515881 - DNA, 14 bp, Homo sapiens
taaacaattcttgt

SEQ ID NO: 515882 - DNA, 23 bp, Homo sapiens
taaacgtggagaatcacaggctg

SEQ ID NO: 515883 - DNA, 13 bp, Homo sapiens
taaagccaaatgt

SEQ ID NO: 515884 - DNA, 17 bp, Homo sapiens
taaagccaaatgtaaat

SEQ ID NO: 515885 - DNA, 14 bp, Homo sapiens
taaataccaaagat

SEQ ID NO: 515886 - DNA, 19 bp, Homo sapiens
taaatgtcacttcatattt

SEQ ID NO: 515887 - DNA, 14 bp, Homo sapiens
taaatttgtactat

SEQ ID NO: 515888 - DNA, 19 bp, Homo sapiens
taaatttgtactatttaac

SEQ ID NO: 515889 - DNA, 21 bp, Homo sapiens
taaatttgtactatttaactg

SEQ ID NO: 515890 - DNA, 14 bp, Homo sapiens
taacaaaggcaaga

SEQ ID NO: 515891 - DNA, 14 bp, Homo sapiens
taacagttgaagaa

SEQ ID NO: 515892 - DNA, 15 bp, Homo sapiens
taacagttgaagaaa

SEQ ID NO: 515893 - DNA, 18 bp, Homo sapiens
taacagttgaagaaaaaa

SEQ ID NO: 515894 - DNA, 23 bp, Homo sapiens
taacattcctcatgaatgtaaat

SEQ ID NO: 515895 - DNA, 18 bp, Homo sapiens
taaccaatttctttctaa

SEQ ID NO: 515896 - DNA, 17 bp, Homo sapiens
taacctcagtctacccc

SEQ ID NO: 515897 - DNA, 19 bp, Homo sapiens
taacctcagtctacccctc

SEQ ID NO: 515898 - DNA, 21 bp, Homo sapiens
taacctcagtctacccctctc

SEQ ID NO: 515899 - DNA, 22 bp, Homo sapiens
taactcctccatccatgtgttc

SEQ ID NO: 515900 - DNA, 21 bp, Homo sapiens
taactgactattcttgatgta

SEQ ID NO: 515901 - DNA, 17 bp, Homo sapiens
taactgccaaaacaaga

SEQ ID NO: 515902 - DNA, 13 bp, Homo sapiens
taacttcattttt

SEQ ID NO: 515903 - DNA, 19 bp, Homo sapiens
taagtcatcatctccaaac

SEQ ID NO: 515904 - DNA, 13 bp, Homo sapiens
taatcaaaccaaa

SEQ ID NO: 515905 - DNA, 18 bp, Homo sapiens
taatccccttctcccctg

SEQ ID NO: 515906 - DNA, 16 bp, Homo sapiens
taatgaaaatgtctca

SEQ ID NO: 515907 - DNA, 16 bp, Homo sapiens
taatgcatatttttgc

SEQ ID NO: 515908 - DNA, 22 bp, Homo sapiens
taatggcataacaaaggcaaga

SEQ ID NO: 515909 - DNA, 17 bp, Homo sapiens
taattgccatagaaagt

SEQ ID NO: 515910 - DNA, 22 bp, Homo sapiens
taattgtgcaagcttttcctaa

SEQ ID NO: 515911 - DNA, 12 bp, Homo sapiens
taattttaaagt

SEQ ID NO: 515912 - DNA, 19 bp, Homo sapiens
tacaatgggaaaacttcac

SEQ ID NO: 515913 - DNA, 16 bp, Homo sapiens
tacacaggcagttttg

SEQ ID NO: 515914 - DNA, 13 bp, Homo sapiens
tacacctggctga

SEQ ID NO: 515915 - DNA, 15 bp, Homo sapiens
tacacctggctgagg

SEQ ID NO: 515916 - DNA, 22 bp, Homo sapiens
tacacctggctgaggttcctct

SEQ ID NO: 515917 - DNA, 21 bp, Homo sapiens
tacagtggttttatactgaag

SEQ ID NO: 515918 - DNA, 12 bp, Homo sapiens
tacatcatttct

SEQ ID NO: 515919 - DNA, 13 bp, Homo sapiens
tacatgaacacaa

SEQ ID NO: 515920 - DNA, 17 bp, Homo sapiens
tacatgaacacaaatgt

SEQ ID NO: 515921 - DNA, 15 bp, Homo sapiens
tacattataccgcag

SEQ ID NO: 515922 - DNA, 16 bp, Homo sapiens
taccaaagataatgca

SEQ ID NO: 515923 - DNA, 15 bp, Homo sapiens
taccacattccatga

SEQ ID NO: 515924 - DNA, 13 bp, Homo sapiens
taccagctgcgct

SEQ ID NO: 515925 - DNA, 21 bp, Homo sapiens
taccagctgcgcttgcttttc

SEQ ID NO: 515926 - DNA, 18 bp, Homo sapiens
tacccctctcctttcact

SEQ ID NO: 515927 - DNA, 14 bp, Homo sapiens
tactatttaactga

SEQ ID NO: 515928 - DNA, 18 bp, Homo sapiens
tactgaaggaaaaacaca

SEQ ID NO: 515929 - DNA, 19 bp, Homo sapiens
tactgtttaattgacatac

SEQ ID NO: 515930 - DNA, 19 bp, Homo sapiens
tacttaaattttaaagcct

SEQ ID NO: 515931 - DNA, 17 bp, Homo sapiens
tagaaaagtttgtttta

SEQ ID NO: 515932 - DNA, 21 bp, Homo sapiens
tagaaaagtttgttttacttt

SEQ ID NO: 515933 - DNA, 12 bp, Homo sapiens
tagaagccaagg

SEQ ID NO: 515934 - DNA, 19 bp, Homo sapiens
tagaagccaagggaaaggg

SEQ ID NO: 515935 - DNA, 20 bp, Homo sapiens
tagaccctgggtgggctctg

SEQ ID NO: 515936 - DNA, 17 bp, Homo sapiens
tagactgccagctcttc

SEQ ID NO: 515937 - DNA, 23 bp, Homo sapiens
tagaggcttctccgccagcctcc

SEQ ID NO: 515938 - DNA, 13 bp, Homo sapiens
tagatccaaatgt

SEQ ID NO: 515939 - DNA, 13 bp, Homo sapiens
tagcacaggctga

SEQ ID NO: 515940 - DNA, 21 bp, Homo sapiens
tagcacaggctgagtgcaggc

SEQ ID NO: 515941 - DNA, 13 bp, Homo sapiens
tagcatggtttta

SEQ ID NO: 515942 - DNA, 18 bp, Homo sapiens
tagcatggttttagcaaa

SEQ ID NO: 515943 - DNA, 21 bp, Homo sapiens
tagcctctgggttgttgtttt

SEQ ID NO: 515944 - DNA, 22 bp, Homo sapiens
tagcttctgcttttctgccctg

SEQ ID NO: 515945 - DNA, 18 bp, Homo sapiens
tagctttagaccctgggt

SEQ ID NO: 515946 - DNA, 21 bp, Homo sapiens
tagggaacaaggatgttttta

SEQ ID NO: 515947 - DNA, 22 bp, Homo sapiens
tagggcagagtatgttcttgaa

SEQ ID NO: 515948 - DNA, 11 bp, Homo sapiens
tggaggggtgt

SEQ ID NO: 515949 - DNA, 18 bp, Homo sapiens
tggaggggtgtggcagtg

SEQ ID NO: 515950 - DNA, 13 bp, Homo sapiens
tggatgtatttgt

SEQ ID NO: 515951 - DNA, 17 bp, Homo sapiens
tggcaaacgctaaagag

SEQ ID NO: 515952 - DNA, 14 bp, Homo sapiens
tggcacagcctgca

SEQ ID NO: 515953 - DNA, 21 bp, Homo sapiens
tggcacccaccgtggaggagg

SEQ ID NO: 515954 - DNA, 13 bp, Homo sapiens
tggcagggcacag

SEQ ID NO: 515955 - DNA, 20 bp, Homo sapiens
tggcagggcacagggcctgg

SEQ ID NO: 515956 - DNA, 19 bp, Homo sapiens
tggcataacaaaggcaaga

SEQ ID NO: 515957 - DNA, 22 bp, Homo sapiens
tggcatggtggttgggacccag

SEQ ID NO: 515958 - DNA, 18 bp, Homo sapiens
tggcattctcaaaactga

SEQ ID NO: 515959 - DNA, 19 bp, Homo sapiens
tggccaggaagtagcacag

SEQ ID NO: 515960 - DNA, 20 bp, Homo sapiens
tggccaggaagtagcacagg

SEQ ID NO: 515961 - DNA, 21 bp, Homo sapiens
tggcccagggggcttcctgag

SEQ ID NO: 515962 - DNA, 17 bp, Homo sapiens
tggcccatgtatggcca

SEQ ID NO: 515963 - DNA, 17 bp, Homo sapiens
tggccccacctggccct

SEQ ID NO: 515964 - DNA, 11 bp, Homo sapiens
tggcctgctgt

SEQ ID NO: 515965 - DNA, 23 bp, Homo sapiens
tggctgaggttcctctgcctgcc

SEQ ID NO: 515966 - DNA, 15 bp, Homo sapiens
tgggaaaaaaaaaag

SEQ ID NO: 515967 - DNA, 14 bp, Homo sapiens
tgggacccagtggc

SEQ ID NO: 515968 - DNA, 17 bp, Homo sapiens
tgggacccagtggcagg

SEQ ID NO: 515969 - DNA, 19 bp, Homo sapiens
tgggacctgccaggcaggg

SEQ ID NO: 515970 - DNA, 13 bp, Homo sapiens
tgggaggagggag

SEQ ID NO: 515971 - DNA, 18 bp, Homo sapiens
tgggaggagggagaggga

SEQ ID NO: 515972 - DNA, 18 bp, Homo sapiens
tgggattatgggtcacag

SEQ ID NO: 515973 - DNA, 20 bp, Homo sapiens
tgggattatgggtcacagga

SEQ ID NO: 515974 - DNA, 21 bp, Homo sapiens
tgggattatgggtcacaggaa

SEQ ID NO: 515975 - DNA, 18 bp, Homo sapiens
tgggcactgctctcacct

SEQ ID NO: 515976 - DNA, 12 bp, Homo sapiens
tgggctgggcac

SEQ ID NO: 515977 - DNA, 18 bp, Homo sapiens
tgggctgttctgtttcct

SEQ ID NO: 515978 - DNA, 19 bp, Homo sapiens
tgggcttggcctgctgtga

SEQ ID NO: 515979 - DNA, 15 bp, Homo sapiens
tggggctcccgcctc

SEQ ID NO: 515980 - DNA, 13 bp, Homo sapiens
tggggctggggga

SEQ ID NO: 515981 - DNA, 16 bp, Homo sapiens
tggggctgggggatgg

SEQ ID NO: 515982 - DNA, 19 bp, Homo sapiens
tggggggaacgcccacttc

SEQ ID NO: 515983 - DNA, 19 bp, Homo sapiens
tgggtgggctctgtgcagt

SEQ ID NO: 515984 - DNA, 14 bp, Homo sapiens
tgggttagactgcc

SEQ ID NO: 515985 - DNA, 15 bp, Homo sapiens
tgggttagactgcca

SEQ ID NO: 515986 - DNA, 18 bp, Homo sapiens
tggtgcacaggtttgttt

SEQ ID NO: 515987 - DNA, 14 bp, Homo sapiens
tggtgcctgagagg

SEQ ID NO: 515988 - DNA, 19 bp, Homo sapiens
tggtgcctgagaggcaggc

SEQ ID NO: 515989 - DNA, 14 bp, Homo sapiens
tggtgctttgtgtc

SEQ ID NO: 515990 - DNA, 15 bp, Homo sapiens
tggtgctttgtgtct

SEQ ID NO: 515991 - DNA, 23 bp, Homo sapiens
tggtggttgggacccagtggcag

SEQ ID NO: 515992 - DNA, 16 bp, Homo sapiens
tggttgagtgggggga

SEQ ID NO: 515993 - DNA, 23 bp, Homo sapiens
tggttgggacccagtggcagggc

SEQ ID NO: 515994 - DNA, 23 bp, Homo sapiens
tggttttatactgaaggaaaaac

SEQ ID NO: 515995 - DNA, 15 bp, Homo sapiens
tgtaaaatcttgtca

SEQ ID NO: 515996 - DNA, 18 bp, Homo sapiens
tgtaaacagaaattgcaa

SEQ ID NO: 515997 - DNA, 21 bp, Homo sapiens
tgtaactcctccatccatgtg

SEQ ID NO: 515998 - DNA, 21 bp, Homo sapiens
tgtaacttttttattttaaga

SEQ ID NO: 515999 - DNA, 16 bp, Homo sapiens
tgtaattttaaagtca

SEQ ID NO: 516000 - DNA, 18 bp, Homo sapiens
tgtactatttaactgact

SEQ ID NO: 516001 - DNA, 14 bp, Homo sapiens
tgtactgtagttca

SEQ ID NO: 516002 - DNA, 14 bp, Homo sapiens
tgtagacaaagtga

SEQ ID NO: 516003 - DNA, 14 bp, Homo sapiens
tgtataaaaataaa

SEQ ID NO: 516004 - DNA, 21 bp, Homo sapiens
tgtattttgtaaactgatgtt

SEQ ID NO: 516005 - DNA, 22 bp, Homo sapiens
tgtattttgtaaactgatgttt

SEQ ID NO: 516006 - DNA, 22 bp, Homo sapiens
tgtatttttgttgcagtgtagt

SEQ ID NO: 516007 - DNA, 15 bp, Homo sapiens
tgtcacttcatattt

SEQ ID NO: 516008 - DNA, 14 bp, Homo sapiens
tgtcatgtgtataa

SEQ ID NO: 516009 - DNA, 20 bp, Homo sapiens
tgtcctgatgtttttctgtg

SEQ ID NO: 516010 - DNA, 16 bp, Homo sapiens
tgtctcagtattttag

SEQ ID NO: 516011 - DNA, 20 bp, Homo sapiens
tgtctccaagcctctgtctt

SEQ ID NO: 516012 - DNA, 17 bp, Homo sapiens
tgtctggcacagcctgc

SEQ ID NO: 516013 - DNA, 16 bp, Homo sapiens
tgtcttctttgctaga

SEQ ID NO: 516014 - DNA, 15 bp, Homo sapiens
tgtctttttgtatct

SEQ ID NO: 516015 - DNA, 15 bp, Homo sapiens
tgtgagatggatgta

SEQ ID NO: 516016 - DNA, 20 bp, Homo sapiens
tgtgagatggatgtatttgt

SEQ ID NO: 516017 - DNA, 19 bp, Homo sapiens
tgtgagctaagcattttct

SEQ ID NO: 516018 - DNA, 18 bp, Homo sapiens
tgtgcaagcttttcctaa

SEQ ID NO: 516019 - DNA, 19 bp, Homo sapiens
tgtgcaagcttttcctaat

SEQ ID NO: 516020 - DNA, 21 bp, Homo sapiens
tgtgcgtggggctcccgcctc

SEQ ID NO: 516021 - DNA, 13 bp, Homo sapiens
tgtggagactgct

SEQ ID NO: 516022 - DNA, 22 bp, Homo sapiens
tgtggagactgctcctgagccc

SEQ ID NO: 516023 - DNA, 20 bp, Homo sapiens
tgtggagagggaatgtgaaa

SEQ ID NO: 516024 - DNA, 12 bp, Homo sapiens
tgtggcagtggt

SEQ ID NO: 516025 - DNA, 15 bp, Homo sapiens
tgtggcagtggtttt

SEQ ID NO: 516026 - DNA, 13 bp, Homo sapiens
tgtgggattatgg

SEQ ID NO: 516027 - DNA, 16 bp, Homo sapiens
tgtgggattatgggtc

SEQ ID NO: 516028 - DNA, 23 bp, Homo sapiens
tgtgggattatgggtcacaggaa

SEQ ID NO: 516029 - DNA, 16 bp, Homo sapiens
tgtgtaattttaaagt

SEQ ID NO: 516030 - DNA, 22 bp, Homo sapiens
tgtgtaattttaaagtcagtgt

SEQ ID NO: 516031 - DNA, 19 bp, Homo sapiens
tgtgtgttgcttctctatt

SEQ ID NO: 516032 - DNA, 23 bp, Homo sapiens
tgttaccccaagcgccctggccc

SEQ ID NO: 516033 - DNA, 14 bp, Homo sapiens
tgttattttcaatg

SEQ ID NO: 516034 - DNA, 21 bp, Homo sapiens
tgttcatttgaaacctttttc

SEQ ID NO: 516035 - DNA, 19 bp, Homo sapiens
tgttccaaatttgctttac

SEQ ID NO: 516036 - DNA, 20 bp, Homo sapiens
tgttccaaatttgctttaca

SEQ ID NO: 516037 - DNA, 20 bp, Homo sapiens
tgttctagaatcatgtattt

SEQ ID NO: 516038 - DNA, 13 bp, Homo sapiens
tgttctgtttcct

SEQ ID NO: 516039 - DNA, 16 bp, Homo sapiens
tgttctgtttcctgtg

SEQ ID NO: 516040 - DNA, 23 bp, Homo sapiens
tgttgtcatttccaaattcctag

SEQ ID NO: 516041 - DNA, 14 bp, Homo sapiens
tgtttcctgtgtct

SEQ ID NO: 516042 - DNA, 15 bp, Homo sapiens
tgtttcctgtgtctc

SEQ ID NO: 516043 - DNA, 22 bp, Homo sapiens
tgtttcctgtgtctccaagcct

SEQ ID NO: 516044 - DNA, 12 bp, Homo sapiens
tgttttgcaaag

SEQ ID NO: 516045 - DNA, 13 bp, Homo sapiens
tgtttttctgtgt

SEQ ID NO: 516046 - DNA, 14 bp, Homo sapiens
tgtttttctgtgtt

SEQ ID NO: 516047 - DNA, 17 bp, Homo sapiens
tgtttttctgtgttact

SEQ ID NO: 516048 - DNA, 14 bp, Homo sapiens
tgttttttcaagaa

SEQ ID NO: 516049 - DNA, 24 bp, Homo sapiens
tgttttttcaagaaaattttgcag

SEQ ID NO: 516050 - DNA, 13 bp, Homo sapiens
ttaaacaaaatgt

SEQ ID NO: 516051 - DNA, 14 bp, Homo sapiens
ttaaagccaaatgt

SEQ ID NO: 516052 - DNA, 16 bp, Homo sapiens
ttaaagccaaatgtaa

SEQ ID NO: 516053 - DNA, 18 bp, Homo sapiens
ttaaagcctgaaaattcc

SEQ ID NO: 516054 - DNA, 16 bp, Homo sapiens
ttaactgccaaaacaa

SEQ ID NO: 516055 - DNA, 15 bp, Homo sapiens
ttaacttaatggcac

SEQ ID NO: 516056 - DNA, 18 bp, Homo sapiens
ttaatgatattggaggaa

SEQ ID NO: 516057 - DNA, 21 bp, Homo sapiens
ttaatgcattctttcttctct

SEQ ID NO: 516058 - DNA, 13 bp, Homo sapiens
ttaattaaaaatt

SEQ ID NO: 516059 - DNA, 17 bp, Homo sapiens
acaaattgaaataaata

SEQ ID NO: 516060 - DNA, 13 bp, Homo sapiens
acaacctaaaaaa

SEQ ID NO: 516061 - DNA, 23 bp, Homo sapiens
acaacttataattacaatgcaca

SEQ ID NO: 516062 - DNA, 19 bp, Homo sapiens
acaatgggaaaacttcact

SEQ ID NO: 516063 - DNA, 19 bp, Homo sapiens
acaatggtttcaaagaaag

SEQ ID NO: 516064 - DNA, 19 bp, Homo sapiens
acaatttttgctgttttca

SEQ ID NO: 516065 - DNA, 21 bp, Homo sapiens
acaatttttgctgttttcagc

SEQ ID NO: 516066 - DNA, 18 bp, Homo sapiens
acacaaatgtgtattttt

SEQ ID NO: 516067 - DNA, 20 bp, Homo sapiens
acacaaatgtgtatttttgt

SEQ ID NO: 516068 - DNA, 22 bp, Homo sapiens
acacattgttttccagaagcct

SEQ ID NO: 516069 - DNA, 23 bp, Homo sapiens
acactcctatctcaactctgttt

SEQ ID NO: 516070 - DNA, 13 bp, Homo sapiens
acacttaaaagaa

SEQ ID NO: 516071 - DNA, 20 bp, Homo sapiens
acacttatttttttcccaag

SEQ ID NO: 516072 - DNA, 16 bp, Homo sapiens
acagagcaacccctgg

SEQ ID NO: 516073 - DNA, 23 bp, Homo sapiens
acagagcaacccctggaccccag

SEQ ID NO: 516074 - DNA, 12 bp, Homo sapiens
acaggcagggca

SEQ ID NO: 516075 - DNA, 18 bp, Homo sapiens
acaggcagggcaggacca

SEQ ID NO: 516076 - DNA, 22 bp, Homo sapiens
acaggcagggcaggaccagccc

SEQ ID NO: 516077 - DNA, 23 bp, Homo sapiens
acaggcagggcaggaccagccca

SEQ ID NO: 516078 - DNA, 21 bp, Homo sapiens
acaggcagttttgaaatgaaa

SEQ ID NO: 516079 - DNA, 22 bp, Homo sapiens
acaggctgagtgcaggcccacc

SEQ ID NO: 516080 - DNA, 23 bp, Homo sapiens
acaggctgagtgcaggcccaccc

SEQ ID NO: 516081 - DNA, 21 bp, Homo sapiens
acaggctgggctgggcactgc

SEQ ID NO: 516082 - DNA, 13 bp, Homo sapiens
acagggcctggcc

SEQ ID NO: 516083 - DNA, 15 bp, Homo sapiens
acagggcctggccca

SEQ ID NO: 516084 - DNA, 17 bp, Homo sapiens
acagggcctggcccatg

SEQ ID NO: 516085 - DNA, 12 bp, Homo sapiens
acaggggttcct

SEQ ID NO: 516086 - DNA, 16 bp, Homo sapiens
acaggggttccttctg

SEQ ID NO: 516087 - DNA, 21 bp, Homo sapiens
acaggggttccttctgggcat

SEQ ID NO: 516088 - DNA, 22 bp, Homo sapiens
acagtgctgccacttaaaaaga

SEQ ID NO: 516089 - DNA, 20 bp, Homo sapiens
acagtggttttatactgaag

SEQ ID NO: 516090 - DNA, 22 bp, Homo sapiens
acataattttttttttctcact

SEQ ID NO: 516091 - DNA, 18 bp, Homo sapiens
acatatgattgtatttgt

SEQ ID NO: 516092 - DNA, 14 bp, Homo sapiens
acatcactggcatg

SEQ ID NO: 516093 - DNA, 16 bp, Homo sapiens
acatcacttgccaatg

SEQ ID NO: 516094 - DNA, 11 bp, Homo sapiens
acatcatttct

SEQ ID NO: 516095 - DNA, 13 bp, Homo sapiens
acatcatttcttt

SEQ ID NO: 516096 - DNA, 21 bp, Homo sapiens
acatcatttctttttgggaga

SEQ ID NO: 516097 - DNA, 22 bp, Homo sapiens
acatcatttctttttgggagag

SEQ ID NO: 516098 - DNA, 11 bp, Homo sapiens
acatctgcctt

SEQ ID NO: 516099 - DNA, 23 bp, Homo sapiens
acatctgccttaaaaccaaagag

SEQ ID NO: 516100 - DNA, 16 bp, Homo sapiens
acatggtgcctgagag

SEQ ID NO: 516101 - DNA, 19 bp, Homo sapiens
acatggtgcctgagaggca

SEQ ID NO: 516102 - DNA, 11 bp, Homo sapiens
acattccaaaa

SEQ ID NO: 516103 - DNA, 15 bp, Homo sapiens
acattctttcctaaa

SEQ ID NO: 516104 - DNA, 22 bp, Homo sapiens
acattgattgctgcattttacc

SEQ ID NO: 516105 - DNA, 14 bp, Homo sapiens
acattttataaagt

SEQ ID NO: 516106 - DNA, 15 bp, Homo sapiens
accaaagagggcttc

SEQ ID NO: 516107 - DNA, 20 bp, Homo sapiens
accaatttctttctaaaaca

SEQ ID NO: 516108 - DNA, 18 bp, Homo sapiens
accactcagtaaaagcaa

SEQ ID NO: 516109 - DNA, 15 bp, Homo sapiens
actgtggagactgct

SEQ ID NO: 516110 - DNA, 17 bp, Homo sapiens
acttaaaagaaaacaaa

SEQ ID NO: 516111 - DNA, 13 bp, Homo sapiens
acttatattagag

SEQ ID NO: 516112 - DNA, 21 bp, Homo sapiens
acttatattagagtcagagat

SEQ ID NO: 516113 - DNA, 15 bp, Homo sapiens
acttcatttttctaa

SEQ ID NO: 516114 - DNA, 21 bp, Homo sapiens
acttccctgggttagactgcc

SEQ ID NO: 516115 - DNA, 22 bp, Homo sapiens
acttccctgggttagactgcca

SEQ ID NO: 516116 - DNA, 21 bp, Homo sapiens
acttctgataatttattgtct

SEQ ID NO: 516117 - DNA, 20 bp, Homo sapiens
acttgccaatgtacatacct

SEQ ID NO: 516118 - DNA, 15 bp, Homo sapiens
acttgggggctcagc

SEQ ID NO: 516119 - DNA, 22 bp, Homo sapiens
acttgggggctcagcaaggcca

SEQ ID NO: 516120 - DNA, 13 bp, Homo sapiens
acttgttttggat

SEQ ID NO: 516121 - DNA, 16 bp, Homo sapiens
acttgttttggatgcc

SEQ ID NO: 516122 - DNA, 22 bp, Homo sapiens
agaaaaaatggcaagagatcat

SEQ ID NO: 516123 - DNA, 14 bp, Homo sapiens
agaaaattttgcag

SEQ ID NO: 516124 - DNA, 13 bp, Homo sapiens
agaaacataattt

SEQ ID NO: 516125 - DNA, 16 bp, Homo sapiens
agaaacataatttttt

SEQ ID NO: 516126 - DNA, 22 bp, Homo sapiens
agaaacataattttttttttct

SEQ ID NO: 516127 - DNA, 18 bp, Homo sapiens
agaaacctattaagtcat

SEQ ID NO: 516128 - DNA, 19 bp, Homo sapiens
agaaacctattaagtcatc

SEQ ID NO: 516129 - DNA, 17 bp, Homo sapiens
agaaaggcaaatctgac

SEQ ID NO: 516130 - DNA, 22 bp, Homo sapiens
agaaaggtgagtttgagctgcc

SEQ ID NO: 516131 - DNA, 18 bp, Homo sapiens
agaaagtataatttcagt

SEQ ID NO: 516132 - DNA, 19 bp, Homo sapiens
agaaagtataatttcagtg

SEQ ID NO: 516133 - DNA, 12 bp, Homo sapiens
agaaatttgaaa

SEQ ID NO: 516134 - DNA, 18 bp, Homo sapiens
agaacttctcttcccata

SEQ ID NO: 516135 - DNA, 13 bp, Homo sapiens
agaagagccccac

SEQ ID NO: 516136 - DNA, 18 bp, Homo sapiens
agaagccaagggaaaggg

SEQ ID NO: 516137 - DNA, 19 bp, Homo sapiens
agaagccaagggaaagggg

SEQ ID NO: 516138 - DNA, 21 bp, Homo sapiens
agaagccaagggaaaggggtg

SEQ ID NO: 516139 - DNA, 16 bp, Homo sapiens
agaagctatgttttta

SEQ ID NO: 516140 - DNA, 14 bp, Homo sapiens
agaagggagaagaa

SEQ ID NO: 516141 - DNA, 15 bp, Homo sapiens
agaagggagaagaaa

SEQ ID NO: 516142 - DNA, 16 bp, Homo sapiens
agaagggagaagaaag

SEQ ID NO: 516143 - DNA, 16 bp, Homo sapiens
agaaggggactgccac

SEQ ID NO: 516144 - DNA, 16 bp, Homo sapiens
agaagtgacggttcct

SEQ ID NO: 516145 - DNA, 17 bp, Homo sapiens
agaatcatgtattttgt

SEQ ID NO: 516146 - DNA, 15 bp, Homo sapiens
agaatctcttttctg

SEQ ID NO: 516147 - DNA, 11 bp, Homo sapiens
agaatttttgc

SEQ ID NO: 516148 - DNA, 21 bp, Homo sapiens
agaatttttgcccatatctgg

SEQ ID NO: 516149 - DNA, 20 bp, Homo sapiens
agacagagcaacccctggac

SEQ ID NO: 516150 - DNA, 18 bp, Homo sapiens
agacatcacttgccaatg

SEQ ID NO: 516151 - DNA, 15 bp, Homo sapiens
agaccaggtggaatt

SEQ ID NO: 516152 - DNA, 17 bp, Homo sapiens
agaccctgggtgggctc

SEQ ID NO: 516153 - DNA, 20 bp, Homo sapiens
aacattcctcatgaatgtaa

SEQ ID NO: 516154 - DNA, 12 bp, Homo sapiens
aacccctcgccc

SEQ ID NO: 516155 - DNA, 23 bp, Homo sapiens
aacccctcgcccagtcccagcag

SEQ ID NO: 516156 - DNA, 20 bp, Homo sapiens
aaccgccggttcattttgca

SEQ ID NO: 516157 - DNA, 17 bp, Homo sapiens
aacgcccacttccctgg

SEQ ID NO: 516158 - DNA, 17 bp, Homo sapiens
aacgctaaagagccctt

SEQ ID NO: 516159 - DNA, 15 bp, Homo sapiens
aactacatgaacaca

SEQ ID NO: 516160 - DNA, 15 bp, Homo sapiens
aactccacatctgcc

SEQ ID NO: 516161 - DNA, 13 bp, Homo sapiens
aacttaatggcac

SEQ ID NO: 516162 - DNA, 22 bp, Homo sapiens
aacttataattacaatgcacaa

SEQ ID NO: 516163 - DNA, 19 bp, Homo sapiens
aacttatttctgaaaaaga

SEQ ID NO: 516164 - DNA, 22 bp, Homo sapiens
aacttatttctgaaaaagagaa

SEQ ID NO: 516165 - DNA, 21 bp, Homo sapiens
aacttcactccaaagagaaac

SEQ ID NO: 516166 - DNA, 17 bp, Homo sapiens
aacttttttattttaag

SEQ ID NO: 516167 - DNA, 22 bp, Homo sapiens
aacttttttattttaagaggaa

SEQ ID NO: 516168 - DNA, 12 bp, Homo sapiens
aagaaaaataat

SEQ ID NO: 516169 - DNA, 11 bp, Homo sapiens
aagaaaatttt

SEQ ID NO: 516170 - DNA, 21 bp, Homo sapiens
aagaaagagttgtcctgatgt

SEQ ID NO: 516171 - DNA, 15 bp, Homo sapiens
aagaagggagaagaa

SEQ ID NO: 516172 - DNA, 11 bp, Homo sapiens
aagaatttttg

SEQ ID NO: 516173 - DNA, 13 bp, Homo sapiens
aagaatttttgcc

SEQ ID NO: 516174 - DNA, 14 bp, Homo sapiens
aagactctgcctta

SEQ ID NO: 516175 - DNA, 22 bp, Homo sapiens
aagactctgccttaatttttga

SEQ ID NO: 516176 - DNA, 14 bp, Homo sapiens
aagagaagttattt

SEQ ID NO: 516177 - DNA, 13 bp, Homo sapiens
aagagccccactc

SEQ ID NO: 516178 - DNA, 17 bp, Homo sapiens
aagagccccactctcag

SEQ ID NO: 516179 - DNA, 18 bp, Homo sapiens
aagagccccactctcaga

SEQ ID NO: 516180 - DNA, 15 bp, Homo sapiens
aagagtggccccacc

SEQ ID NO: 516181 - DNA, 20 bp, Homo sapiens
aagagttgtcctgatgtttt

SEQ ID NO: 516182 - DNA, 15 bp, Homo sapiens
aagataaatgggttt

SEQ ID NO: 516183 - DNA, 23 bp, Homo sapiens
aagcagattccctgttggattta

SEQ ID NO: 516184 - DNA, 16 bp, Homo sapiens
aagcagtgcccaggtg

SEQ ID NO: 516185 - DNA, 18 bp, Homo sapiens
aagcagtgcccaggtggc

SEQ ID NO: 516186 - DNA, 13 bp, Homo sapiens
aagccaaagaaaa

SEQ ID NO: 516187 - DNA, 21 bp, Homo sapiens
aagccaaagaaaaataaccct

SEQ ID NO: 516188 - DNA, 14 bp, Homo sapiens
aagccaagggaaag

SEQ ID NO: 516189 - DNA, 23 bp, Homo sapiens
aagccaagggaaaggggtgcttt

SEQ ID NO: 516190 - DNA, 19 bp, Homo sapiens
aagccaagtggggtgctgg

SEQ ID NO: 516191 - DNA, 16 bp, Homo sapiens
aagcccaggagcccat

SEQ ID NO: 516192 - DNA, 15 bp, Homo sapiens
aagcctctgtctttt

SEQ ID NO: 516193 - DNA, 13 bp, Homo sapiens
aagcgccctggcc

SEQ ID NO: 516194 - DNA, 13 bp, Homo sapiens
aagctatgttttt

SEQ ID NO: 516195 - DNA, 16 bp, Homo sapiens
aaggaaaaacacaagc

SEQ ID NO: 516196 - DNA, 19 bp, Homo sapiens
aaggaaaaacacaagcaaa

SEQ ID NO: 516197 - DNA, 20 bp, Homo sapiens
aaggaaggacacattgtttt

SEQ ID NO: 516198 - DNA, 19 bp, Homo sapiens
aaggacacattgttttcca

SEQ ID NO: 516199 - DNA, 14 bp, Homo sapiens
aaggaggccacctc

SEQ ID NO: 516200 - DNA, 16 bp, Homo sapiens
aaggatgtttttaatg

SEQ ID NO: 516201 - DNA, 17 bp, Homo sapiens
aaggcaaatctgacttt

SEQ ID NO: 516202 - DNA, 21 bp, Homo sapiens
aaggcaagagggggtggaggg

SEQ ID NO: 516203 - DNA, 12 bp, Homo sapiens
aagggagaagaa

SEQ ID NO: 516204 - DNA, 19 bp, Homo sapiens
aaggggactgccacctccc

SEQ ID NO: 516205 - DNA, 14 bp, Homo sapiens
aaggggagagcctg

SEQ ID NO: 516206 - DNA, 16 bp, Homo sapiens
aagggtcgcctatttt

SEQ ID NO: 516207 - DNA, 19 bp, Homo sapiens
aagggtcgcctatttttaa

SEQ ID NO: 516208 - DNA, 20 bp, Homo sapiens
aaggtgagtttgagctgcct

SEQ ID NO: 516209 - DNA, 21 bp, Homo sapiens
aaggtgagtttgagctgcctt

SEQ ID NO: 516210 - DNA, 14 bp, Homo sapiens
aaggtgtttaaaga

SEQ ID NO: 516211 - DNA, 18 bp, Homo sapiens
aagtaccacattccatga

SEQ ID NO: 516212 - DNA, 14 bp, Homo sapiens
aagtagcacaggct

SEQ ID NO: 516213 - DNA, 16 bp, Homo sapiens
aagtagcacaggctga

SEQ ID NO: 516214 - DNA, 15 bp, Homo sapiens
aagtcacactgtaac

SEQ ID NO: 516215 - DNA, 15 bp, Homo sapiens
aagtgcttaggaagg

SEQ ID NO: 516216 - DNA, 21 bp, Homo sapiens
aagtgggttttttagttgaat

SEQ ID NO: 516217 - DNA, 21 bp, Homo sapiens
aagttattttctacagtggtt

SEQ ID NO: 516218 - DNA, 18 bp, Homo sapiens
aagttccctatttgtgaa

SEQ ID NO: 516219 - DNA, 13 bp, Homo sapiens
aataaaagcccag

SEQ ID NO: 516220 - DNA, 17 bp, Homo sapiens
aataagttatgggtttt

SEQ ID NO: 516221 - DNA, 14 bp, Homo sapiens
aataatcaaaccaa

SEQ ID NO: 516222 - DNA, 15 bp, Homo sapiens
aataatcaaaccaaa

SEQ ID NO: 516223 - DNA, 22 bp, Homo sapiens
aataatcataaactatattctg

SEQ ID NO: 516224 - DNA, 12 bp, Homo sapiens
aataatgttaag

SEQ ID NO: 516225 - DNA, 17 bp, Homo sapiens
aataatttgtggtgatt

SEQ ID NO: 516226 - DNA, 18 bp, Homo sapiens
aataccaaagataatgca

SEQ ID NO: 516227 - DNA, 22 bp, Homo sapiens
aatatataccagccttataagg

SEQ ID NO: 516228 - DNA, 20 bp, Homo sapiens
aatcaatacactagttgttt

SEQ ID NO: 516229 - DNA, 13 bp, Homo sapiens
aatcacaggctgg

SEQ ID NO: 516230 - DNA, 21 bp, Homo sapiens
aatcacaggctgggctgggca

SEQ ID NO: 516231 - DNA, 14 bp, Homo sapiens
aatcatgtattttg

SEQ ID NO: 516232 - DNA, 13 bp, Homo sapiens
aatccccttctcc

SEQ ID NO: 516233 - DNA, 23 bp, Homo sapiens
aatccccttctcccctgcactgt

SEQ ID NO: 516234 - DNA, 24 bp, Homo sapiens
aatcctaatttctcctcccttcct

SEQ ID NO: 516235 - DNA, 15 bp, Homo sapiens
aatcctagccattga

SEQ ID NO: 516236 - DNA, 17 bp, Homo sapiens
aatctgactttttctgt

SEQ ID NO: 516237 - DNA, 16 bp, Homo sapiens
aatcttgtcatgtgta

SEQ ID NO: 516238 - DNA, 18 bp, Homo sapiens
aatcttgtcatgtgtata

SEQ ID NO: 516239 - DNA, 19 bp, Homo sapiens
aatcttgtcatgtgtataa

SEQ ID NO: 516240 - DNA, 16 bp, Homo sapiens
aatgcatatttttgca

SEQ ID NO: 516241 - DNA, 13 bp, Homo sapiens
aatgcattctttc

SEQ ID NO: 516242 - DNA, 17 bp, Homo sapiens
aatgctgacccatgggc

SEQ ID NO: 516243 - DNA, 13 bp, Homo sapiens
aatgcttctcttt

SEQ ID NO: 516244 - DNA, 13 bp, Homo sapiens
aatggcaagagat

SEQ ID NO: 516245 - DNA, 18 bp, Homo sapiens
aatggcaagagatcatat

SEQ ID NO: 516246 - DNA, 15 bp, Homo sapiens
aatggcataacaaag

SEQ ID NO: 516247 - DNA, 21 bp, Homo sapiens
aatggcataacaaaggcaaga

SEQ ID NO: 516248 - DNA, 23 bp, Homo sapiens
aatgggggtgaccacaaaagagg

SEQ ID NO: 516249 - DNA, 13 bp, Homo sapiens
aatggtttcaaag

SEQ ID NO: 516250 - DNA, 13 bp, Homo sapiens
aatgtaaatttgt

SEQ ID NO: 516251 - DNA, 17 bp, Homo sapiens
aatgtaaatttgtacta

SEQ ID NO: 516252 - DNA, 12 bp, Homo sapiens
aatgtgtatttt

SEQ ID NO: 516253 - DNA, 15 bp, Homo sapiens
aattaaaaattactg

SEQ ID NO: 516254 - DNA, 21 bp, Homo sapiens
aattacaatatgtatttatgt

SEQ ID NO: 516255 - DNA, 16 bp, Homo sapiens
aattacttaaatttta

SEQ ID NO: 516256 - DNA, 22 bp, Homo sapiens
aattacttaaattttaaagcct

SEQ ID NO: 516257 - DNA, 15 bp, Homo sapiens
aatttattgtcttta

SEQ ID NO: 516258 - DNA, 19 bp, Homo sapiens
aattttaaagcctgaaaat

SEQ ID NO: 516259 - DNA, 12 bp, Homo sapiens
aattttaaagtc

SEQ ID NO: 516260 - DNA, 13 bp, Homo sapiens
aattttaaagtca

SEQ ID NO: 516261 - DNA, 15 bp, Homo sapiens
aattttattgaaagc

SEQ ID NO: 516262 - DNA, 22 bp, Homo sapiens
aattttgcagaagctatgtttt

SEQ ID NO: 516263 - DNA, 18 bp, Homo sapiens
aatttttgctgttttcag

SEQ ID NO: 516264 - DNA, 14 bp, Homo sapiens
aattttttttttct

SEQ ID NO: 516265 - DNA, 14 bp, Homo sapiens
acaaaaatgactct

SEQ ID NO: 516266 - DNA, 22 bp, Homo sapiens
acaaagtgaactctattttgat

SEQ ID NO: 516267 - DNA, 15 bp, Homo sapiens
atactgaaggaaaaa

SEQ ID NO: 516268 - DNA, 21 bp, Homo sapiens
atagaaagtataatttcagtg

SEQ ID NO: 516269 - DNA, 23 bp, Homo sapiens
ataggggaaaatattatttttat

SEQ ID NO: 516270 - DNA, 12 bp, Homo sapiens
atataaaatttc

SEQ ID NO: 516271 - DNA, 21 bp, Homo sapiens
atatattatgtcttattttat

SEQ ID NO: 516272 - DNA, 17 bp, Homo sapiens
atatatttgtcattttc

SEQ ID NO: 516273 - DNA, 12 bp, Homo sapiens
atatttttctgg

SEQ ID NO: 516274 - DNA, 21 bp, Homo sapiens
atatttttttcaactgccaat

SEQ ID NO: 516275 - DNA, 13 bp, Homo sapiens
atcacaggctggg

SEQ ID NO: 516276 - DNA, 22 bp, Homo sapiens
atcacaggctgggctgggcact

SEQ ID NO: 516277 - DNA, 16 bp, Homo sapiens
atcagatattttcata

SEQ ID NO: 516278 - DNA, 19 bp, Homo sapiens
atcagatattttcatattt

SEQ ID NO: 516279 - DNA, 23 bp, Homo sapiens
atcatttctttttgggagagact

SEQ ID NO: 516280 - DNA, 15 bp, Homo sapiens
atccaaatgtaaagg

SEQ ID NO: 516281 - DNA, 16 bp, Homo sapiens
atccagcatgaaagat

SEQ ID NO: 516282 - DNA, 13 bp, Homo sapiens
atccaggaccctg

SEQ ID NO: 516283 - DNA, 21 bp, Homo sapiens
atcccaagagattatgtaact

SEQ ID NO: 516284 - DNA, 22 bp, Homo sapiens
atcccaagagattatgtaactc

SEQ ID NO: 516285 - DNA, 20 bp, Homo sapiens
atccccttctcccctgcact

SEQ ID NO: 516286 - DNA, 23 bp, Homo sapiens
atccccttctcccctgcactgta

SEQ ID NO: 516287 - DNA, 18 bp, Homo sapiens
atcctaatttctcctccc

SEQ ID NO: 516288 - DNA, 14 bp, Homo sapiens
atcctgtgtggaga

SEQ ID NO: 516289 - DNA, 19 bp, Homo sapiens
atcctgtgtggagagggaa

SEQ ID NO: 516290 - DNA, 20 bp, Homo sapiens
atctacattataccgcagag

SEQ ID NO: 516291 - DNA, 19 bp, Homo sapiens
atctatctcatctatctca

SEQ ID NO: 516292 - DNA, 22 bp, Homo sapiens
atctcaactctgtttatttgat

SEQ ID NO: 516293 - DNA, 22 bp, Homo sapiens
atctcttttctggtaattttgg

SEQ ID NO: 516294 - DNA, 18 bp, Homo sapiens
atctgactttttctgtgc

SEQ ID NO: 516295 - DNA, 17 bp, Homo sapiens
atctgccttaaaaccaa

SEQ ID NO: 516296 - DNA, 18 bp, Homo sapiens
atctgccttaaaaccaaa

SEQ ID NO: 516297 - DNA, 16 bp, Homo sapiens
atcttgtcatgtgtat

SEQ ID NO: 516298 - DNA, 17 bp, Homo sapiens
atcttgtcatgtgtata

SEQ ID NO: 516299 - DNA, 12 bp, Homo sapiens
atgaatgtaaat

SEQ ID NO: 516300 - DNA, 13 bp, Homo sapiens
atgaatgtaaatt

SEQ ID NO: 516301 - DNA, 15 bp, Homo sapiens
atgaatgtaaatttg

SEQ ID NO: 516302 - DNA, 15 bp, Homo sapiens
atgacacccaagggt

SEQ ID NO: 516303 - DNA, 14 bp, Homo sapiens
atgaggtgggaggt

SEQ ID NO: 516304 - DNA, 22 bp, Homo sapiens
atgaggtgggaggtggaagaag

SEQ ID NO: 516305 - DNA, 24 bp, Homo sapiens
atgatattggaggaatacttctga

SEQ ID NO: 516306 - DNA, 15 bp, Homo sapiens
atgattgtatttgtg

SEQ ID NO: 516307 - DNA, 21 bp, Homo sapiens
atgcagcacttcagatcaagt

SEQ ID NO: 516308 - DNA, 21 bp, Homo sapiens
atgcattctttcttctcttta

SEQ ID NO: 516309 - DNA, 18 bp, Homo sapiens
atgcccaccccctgccct

SEQ ID NO: 516310 - DNA, 20 bp, Homo sapiens
atgcccaccccctgccctgc

SEQ ID NO: 516311 - DNA, 22 bp, Homo sapiens
atgccccctaatccccttctcc

SEQ ID NO: 516312 - DNA, 22 bp, Homo sapiens
atgcctggtaagtggctttttg

SEQ ID NO: 516313 - DNA, 17 bp, Homo sapiens
atgctgacccatgggca

SEQ ID NO: 516314 - DNA, 19 bp, Homo sapiens
atgctgacccatgggcagg

SEQ ID NO: 516315 - DNA, 22 bp, Homo sapiens
atgctgtctggcacagcctgca

SEQ ID NO: 516316 - DNA, 15 bp, Homo sapiens
atggaactctttttt

SEQ ID NO: 516317 - DNA, 19 bp, Homo sapiens
atggactgttcatttgaaa

SEQ ID NO: 516318 - DNA, 14 bp, Homo sapiens
atggcaagagatca

SEQ ID NO: 516319 - DNA, 15 bp, Homo sapiens
atgggaaaacttcac

SEQ ID NO: 516320 - DNA, 17 bp, Homo sapiens
atgggaatgaggtggga

SEQ ID NO: 516321 - DNA, 18 bp, Homo sapiens
atgggaatgaggtgggag

SEQ ID NO: 516322 - DNA, 22 bp, Homo sapiens
atgggagggggcttgaagccaa

SEQ ID NO: 516323 - DNA, 12 bp, Homo sapiens
atgggcaggaga

SEQ ID NO: 516324 - DNA, 13 bp, Homo sapiens
atgggcaggagac

SEQ ID NO: 516325 - DNA, 19 bp, Homo sapiens
atgggctgttctgtttcct

SEQ ID NO: 516326 - DNA, 19 bp, Homo sapiens
atggggtctctcacagaca

SEQ ID NO: 516327 - DNA, 21 bp, Homo sapiens
atggggtctctcacagacagg

SEQ ID NO: 516328 - DNA, 22 bp, Homo sapiens
atgggttatctcaaattttaag

SEQ ID NO: 516329 - DNA, 14 bp, Homo sapiens
atggtgcctgagag

SEQ ID NO: 516330 - DNA, 17 bp, Homo sapiens
atggtgcctgagaggca

SEQ ID NO: 516331 - DNA, 21 bp, Homo sapiens
atggtgcctgagaggcaggca

SEQ ID NO: 516332 - DNA, 15 bp, Homo sapiens
atggtttcaaagaaa

SEQ ID NO: 516333 - DNA, 12 bp, Homo sapiens
atgtaaaatctt

SEQ ID NO: 516334 - DNA, 21 bp, Homo sapiens
atgtaaaatcttgtcatgtgt

SEQ ID NO: 516335 - DNA, 21 bp, Homo sapiens
atgtaaaggcaggtttgggaa

SEQ ID NO: 516336 - DNA, 17 bp, Homo sapiens
atgtaaattaaatgaag

SEQ ID NO: 516337 - DNA, 19 bp, Homo sapiens
atgtaaatttgtactattt

SEQ ID NO: 516338 - DNA, 21 bp, Homo sapiens
atgtaaatttgtactatttaa

SEQ ID NO: 516339 - DNA, 21 bp, Homo sapiens
atgtaacttttttattttaag

SEQ ID NO: 516340 - DNA, 19 bp, Homo sapiens
atgtcacttcatattttat

SEQ ID NO: 516341 - DNA, 15 bp, Homo sapiens
atgtcttattttatt

SEQ ID NO: 516342 - DNA, 20 bp, Homo sapiens
atgtgggattatgggtcaca

SEQ ID NO: 516343 - DNA, 22 bp, Homo sapiens
atgtgggattatgggtcacagg

SEQ ID NO: 516344 - DNA, 14 bp, Homo sapiens
atgtgttccaaatt

SEQ ID NO: 516345 - DNA, 19 bp, Homo sapiens
atgttgacatcactggcat

SEQ ID NO: 516346 - DNA, 14 bp, Homo sapiens
ctgaaggaaaaaca

SEQ ID NO: 516347 - DNA, 21 bp, Homo sapiens
ctgaaggaaaaacacaagcaa

SEQ ID NO: 516348 - DNA, 13 bp, Homo sapiens
ctgaaggaggcca

SEQ ID NO: 516349 - DNA, 18 bp, Homo sapiens
ctgaaggaggccacctcc

SEQ ID NO: 516350 - DNA, 13 bp, Homo sapiens
ctgacccatgggc

SEQ ID NO: 516351 - DNA, 19 bp, Homo sapiens
ctgacccatgggcaggaga

SEQ ID NO: 516352 - DNA, 19 bp, Homo sapiens
ctgactattcttgatgtaa

SEQ ID NO: 516353 - DNA, 20 bp, Homo sapiens
ctgactattcttgatgtaaa

SEQ ID NO: 516354 - DNA, 15 bp, Homo sapiens
ctgactttttctgtg

SEQ ID NO: 516355 - DNA, 10 bp, Homo sapiens
ctgagcccac

SEQ ID NO: 516356 - DNA, 12 bp, Homo sapiens
ctgagcccactg

SEQ ID NO: 516357 - DNA, 13 bp, Homo sapiens
ctgagcccactgt

SEQ ID NO: 516358 - DNA, 14 bp, Homo sapiens
ctgagcccccagct

SEQ ID NO: 516359 - DNA, 18 bp, Homo sapiens
ctgaggttcctctgcctg

SEQ ID NO: 516360 - DNA, 19 bp, Homo sapiens
ctgaggttcctctgcctgc

SEQ ID NO: 516361 - DNA, 15 bp, Homo sapiens
ctgagtgagagggga

SEQ ID NO: 516362 - DNA, 16 bp, Homo sapiens
ctgagtgagaggggag

SEQ ID NO: 516363 - DNA, 13 bp, Homo sapiens
ctgagtgcaggcc

SEQ ID NO: 516364 - DNA, 17 bp, Homo sapiens
ctgagtgcaggcccacc

SEQ ID NO: 516365 - DNA, 18 bp, Homo sapiens
ctgataatttattgtctt

SEQ ID NO: 516366 - DNA, 15 bp, Homo sapiens
ctgatgtttttctgt

SEQ ID NO: 516367 - DNA, 16 bp, Homo sapiens
ctgatgtttttctgtg

SEQ ID NO: 516368 - DNA, 11 bp, Homo sapiens
ctgcactgtaa

SEQ ID NO: 516369 - DNA, 19 bp, Homo sapiens
ctgcacttgggggctcagc

SEQ ID NO: 516370 - DNA, 21 bp, Homo sapiens
ctgcacttgggggctcagcaa

SEQ ID NO: 516371 - DNA, 23 bp, Homo sapiens
ctgcacttgggggctcagcaagg

SEQ ID NO: 516372 - DNA, 20 bp, Homo sapiens
ctgcagttcccctggaagca

SEQ ID NO: 516373 - DNA, 12 bp, Homo sapiens
ctgccacctccc

SEQ ID NO: 516374 - DNA, 14 bp, Homo sapiens
ctgccagctcttcc

SEQ ID NO: 516375 - DNA, 21 bp, Homo sapiens
ctgccagctcttcctagctgg

SEQ ID NO: 516376 - DNA, 20 bp, Homo sapiens
ctgccaggcacaggcagggc

SEQ ID NO: 516377 - DNA, 12 bp, Homo sapiens
ctgccaggcagg

SEQ ID NO: 516378 - DNA, 13 bp, Homo sapiens
ctgccaggcaggg

SEQ ID NO: 516379 - DNA, 17 bp, Homo sapiens
ctgccaggcaggggtgg

SEQ ID NO: 516380 - DNA, 13 bp, Homo sapiens
ctgccaggccagc

SEQ ID NO: 516381 - DNA, 20 bp, Homo sapiens
ctgccaggccagcctccgag

SEQ ID NO: 516382 - DNA, 14 bp, Homo sapiens
ctgccccgccccca

SEQ ID NO: 516383 - DNA, 18 bp, Homo sapiens
ctgccccgcccccagtcc

SEQ ID NO: 516384 - DNA, 20 bp, Homo sapiens
ctgccctgcacgtcatggga

SEQ ID NO: 516385 - DNA, 18 bp, Homo sapiens
ctgccctggctgctgccc

SEQ ID NO: 516386 - DNA, 19 bp, Homo sapiens
ctgcctctccgcccctgag

SEQ ID NO: 516387 - DNA, 21 bp, Homo sapiens
ctgcctctccgcccctgagcc

SEQ ID NO: 516388 - DNA, 22 bp, Homo sapiens
ctgccttaaaaccaaagagggc

SEQ ID NO: 516389 - DNA, 16 bp, Homo sapiens
ctgccttaatttttga

SEQ ID NO: 516390 - DNA, 15 bp, Homo sapiens
ctgccttccctagct

SEQ ID NO: 516391 - DNA, 13 bp, Homo sapiens
ctgcgcttgcttt

SEQ ID NO: 516392 - DNA, 17 bp, Homo sapiens
ctgcgcttgcttttctg

SEQ ID NO: 516393 - DNA, 15 bp, Homo sapiens
ctgcgtcctcctcac

SEQ ID NO: 516394 - DNA, 18 bp, Homo sapiens
ctgcgtcctcctcacctc

SEQ ID NO: 516395 - DNA, 22 bp, Homo sapiens
ctgctattatgatgttttgcaa

SEQ ID NO: 516396 - DNA, 15 bp, Homo sapiens
ctgctgagccgcaga

SEQ ID NO: 516397 - DNA, 23 bp, Homo sapiens
ctgcttggcccagggggcttcct

SEQ ID NO: 516398 - DNA, 17 bp, Homo sapiens
ctgcttttctgccctgg

SEQ ID NO: 516399 - DNA, 16 bp, Homo sapiens
ctggaaaggggagagc

SEQ ID NO: 516400 - DNA, 18 bp, Homo sapiens
ctggaaaggggagagcct

SEQ ID NO: 516401 - DNA, 20 bp, Homo sapiens
ctggaaaggggagagcctgc

SEQ ID NO: 516402 - DNA, 17 bp, Homo sapiens
ctggaagcagtgcccag

SEQ ID NO: 516403 - DNA, 19 bp, Homo sapiens
ctggaagcagtgcccaggt

SEQ ID NO: 516404 - DNA, 17 bp, Homo sapiens
ctggaccccagcctcaa

SEQ ID NO: 516405 - DNA, 13 bp, Homo sapiens
ctggacggcaggc

SEQ ID NO: 516406 - DNA, 14 bp, Homo sapiens
ctggacggcaggct

SEQ ID NO: 516407 - DNA, 17 bp, Homo sapiens
ctggagaggagccctgc

SEQ ID NO: 516408 - DNA, 23 bp, Homo sapiens
ctggagaggagccctgcctctcc

SEQ ID NO: 516409 - DNA, 17 bp, Homo sapiens
ctggaggttgaagccaa

SEQ ID NO: 516410 - DNA, 19 bp, Homo sapiens
ctggaggttgaagccaagt

SEQ ID NO: 516411 - DNA, 15 bp, Homo sapiens
ctggcacagcctgca

SEQ ID NO: 516412 - DNA, 19 bp, Homo sapiens
ctggcacccaccgtggagg

SEQ ID NO: 516413 - DNA, 19 bp, Homo sapiens
ctggcccatgtatggccag

SEQ ID NO: 516414 - DNA, 13 bp, Homo sapiens
ctggcccccacat

SEQ ID NO: 516415 - DNA, 14 bp, Homo sapiens
ctggcccccacatg

SEQ ID NO: 516416 - DNA, 15 bp, Homo sapiens
ctggcccccacatgg

SEQ ID NO: 516417 - DNA, 15 bp, Homo sapiens
ctggccctctctgaa

SEQ ID NO: 516418 - DNA, 23 bp, Homo sapiens
ctggctgactgccttgctagaaa

SEQ ID NO: 516419 - DNA, 22 bp, Homo sapiens
ctggctgaggttcctctgcctg

SEQ ID NO: 516420 - DNA, 13 bp, Homo sapiens
ctggctgctgccc

SEQ ID NO: 516421 - DNA, 14 bp, Homo sapiens
ctggctgctgcccc

SEQ ID NO: 516422 - DNA, 16 bp, Homo sapiens
ctggctgctgccccca

SEQ ID NO: 516423 - DNA, 17 bp, Homo sapiens
ctggctgctgcccccac

SEQ ID NO: 516424 - DNA, 17 bp, Homo sapiens
ctgggacctgccaggca

SEQ ID NO: 516425 - DNA, 16 bp, Homo sapiens
ctgggaggagggagag

SEQ ID NO: 516426 - DNA, 19 bp, Homo sapiens
ctgggaggagggagaggga

SEQ ID NO: 516427 - DNA, 20 bp, Homo sapiens
ctgggaggagggagagggag

SEQ ID NO: 516428 - DNA, 22 bp, Homo sapiens
ctgggatgtggtattggtgctt

SEQ ID NO: 516429 - DNA, 23 bp, Homo sapiens
ctgggatgtggtattggtgcttt

SEQ ID NO: 516430 - DNA, 12 bp, Homo sapiens
ctgggcctggct

SEQ ID NO: 516431 - DNA, 20 bp, Homo sapiens
ctgggcctggctccctcact

SEQ ID NO: 516432 - DNA, 22 bp, Homo sapiens
ctgggctgggcactgctctcac

SEQ ID NO: 516433 - DNA, 13 bp, Homo sapiens
ctgggcttggcct

SEQ ID NO: 516434 - DNA, 14 bp, Homo sapiens
ctgggcttggcctg

SEQ ID NO: 516435 - DNA, 16 bp, Homo sapiens
ctgggcttggcctgct

SEQ ID NO: 516436 - DNA, 17 bp, Homo sapiens
ctggggcatccatgggg

SEQ ID NO: 516437 - DNA, 13 bp, Homo sapiens
ctgggggatgggc

SEQ ID NO: 516438 - DNA, 16 bp, Homo sapiens
ctggggttgattccca

SEQ ID NO: 516439 - DNA, 13 bp, Homo sapiens
ctgggtgggctct

SEQ ID NO: 516440 - DNA, 18 bp, Homo sapiens
ctgggttagactgccagc

SEQ ID NO: 516441 - DNA, 15 bp, Homo sapiens
ctggtaagtggcttt

SEQ ID NO: 516442 - DNA, 22 bp, Homo sapiens
ctggtaagtggctttttgtact

SEQ ID NO: 516443 - DNA, 19 bp, Homo sapiens
ctggtgcacaggtttgttt

SEQ ID NO: 516444 - DNA, 14 bp, Homo sapiens
cacattaataaaca

SEQ ID NO: 516445 - DNA, 13 bp, Homo sapiens
cacccctgccccc

SEQ ID NO: 516446 - DNA, 18 bp, Homo sapiens
cacccctgcccccagccc

SEQ ID NO: 516447 - DNA, 16 bp, Homo sapiens
caccctgcttggccca

SEQ ID NO: 516448 - DNA, 17 bp, Homo sapiens
caccctgcttggcccag

SEQ ID NO: 516449 - DNA, 18 bp, Homo sapiens
cacctcatgcccaccccc

SEQ ID NO: 516450 - DNA, 19 bp, Homo sapiens
cacctcatgcccaccccct

SEQ ID NO: 516451 - DNA, 20 bp, Homo sapiens
cacctcatgcccaccccctg

SEQ ID NO: 516452 - DNA, 14 bp, Homo sapiens
cacctccccttgcc

SEQ ID NO: 516453 - DNA, 15 bp, Homo sapiens
cacctccccttgcca

SEQ ID NO: 516454 - DNA, 17 bp, Homo sapiens
cacctccccttgccagc

SEQ ID NO: 516455 - DNA, 18 bp, Homo sapiens
cacctccccttgccagct

SEQ ID NO: 516456 - DNA, 20 bp, Homo sapiens
cacctccccttgccagctgc

SEQ ID NO: 516457 - DNA, 22 bp, Homo sapiens
cacctcctaaaaggcccagaga

SEQ ID NO: 516458 - DNA, 16 bp, Homo sapiens
cacctggccctctctg

SEQ ID NO: 516459 - DNA, 21 bp, Homo sapiens
cacctggctgaggttcctctg

SEQ ID NO: 516460 - DNA, 21 bp, Homo sapiens
cactagacgttgtaatgcaca

SEQ ID NO: 516461 - DNA, 12 bp, Homo sapiens
cactatattttt

SEQ ID NO: 516462 - DNA, 13 bp, Homo sapiens
cactgccaggcca

SEQ ID NO: 516463 - DNA, 14 bp, Homo sapiens
cactgccaggccag

SEQ ID NO: 516464 - DNA, 13 bp, Homo sapiens
cactgctctcacc

SEQ ID NO: 516465 - DNA, 23 bp, Homo sapiens
cactgctctcaccttggttcctg

SEQ ID NO: 516466 - DNA, 12 bp, Homo sapiens
cactggaaaggg

SEQ ID NO: 516467 - DNA, 24 bp, Homo sapiens
cactggaaaggggagagcctgctg

SEQ ID NO: 516468 - DNA, 22 bp, Homo sapiens
cactgtgcgtggggctcccgcc

SEQ ID NO: 516469 - DNA, 20 bp, Homo sapiens
cccaaacaaaaatgactcta

SEQ ID NO: 516470 - DNA, 17 bp, Homo sapiens
cccaagcgccctggccc

SEQ ID NO: 516471 - DNA, 22 bp, Homo sapiens
cccaagggtcgcctatttttaa

SEQ ID NO: 516472 - DNA, 23 bp, Homo sapiens
cccaagggtcgcctatttttaaa

SEQ ID NO: 516473 - DNA, 19 bp, Homo sapiens
cccacatggtgatgttgac

SEQ ID NO: 516474 - DNA, 15 bp, Homo sapiens
cccaccccctgccct

SEQ ID NO: 516475 - DNA, 17 bp, Homo sapiens
cccaccccctgccctgc

SEQ ID NO: 516476 - DNA, 18 bp, Homo sapiens
cccaccccctgccctgca

SEQ ID NO: 516477 - DNA, 19 bp, Homo sapiens
cccaccccctgccctgcac

SEQ ID NO: 516478 - DNA, 13 bp, Homo sapiens
cccaccccgggga

SEQ ID NO: 516479 - DNA, 18 bp, Homo sapiens
cccaccccggggaccctg

SEQ ID NO: 516480 - DNA, 20 bp, Homo sapiens
cccaccccggggaccctgtg

SEQ ID NO: 516481 - DNA, 20 bp, Homo sapiens
cccacgctgactacagggcc

SEQ ID NO: 516482 - DNA, 17 bp, Homo sapiens
cccagagagaagagccc

SEQ ID NO: 516483 - DNA, 18 bp, Homo sapiens
cccagagagaagagcccc

SEQ ID NO: 516484 - DNA, 17 bp, Homo sapiens
cccagcagagggataac

SEQ ID NO: 516485 - DNA, 14 bp, Homo sapiens
cccagcagccagcc

SEQ ID NO: 516486 - DNA, 15 bp, Homo sapiens
cccagcagccagcca

SEQ ID NO: 516487 - DNA, 13 bp, Homo sapiens
cccagcttccagc

SEQ ID NO: 516488 - DNA, 15 bp, Homo sapiens
cccagcttccagcag

SEQ ID NO: 516489 - DNA, 12 bp, Homo sapiens
cccaggagccca

SEQ ID NO: 516490 - DNA, 20 bp, Homo sapiens
cccagtccccacccctgccc

SEQ ID NO: 516491 - DNA, 15 bp, Homo sapiens
cccagtggcagggca

SEQ ID NO: 516492 - DNA, 13 bp, Homo sapiens
cccatctgcaccc

SEQ ID NO: 516493 - DNA, 16 bp, Homo sapiens
cccatgggcaggagac

SEQ ID NO: 516494 - DNA, 19 bp, Homo sapiens
cccatgtatggccaggaag

SEQ ID NO: 516495 - DNA, 14 bp, Homo sapiens
cccatttcccatct

SEQ ID NO: 516496 - DNA, 19 bp, Homo sapiens
cccatttggagggcctggg

SEQ ID NO: 516497 - DNA, 21 bp, Homo sapiens
cccattttctctattctttcc

SEQ ID NO: 516498 - DNA, 22 bp, Homo sapiens
cccattttctctattctttcca

SEQ ID NO: 516499 - DNA, 13 bp, Homo sapiens
ccccaagcgccct

SEQ ID NO: 516500 - DNA, 16 bp, Homo sapiens
ccccaataccccatgg

SEQ ID NO: 516501 - DNA, 17 bp, Homo sapiens
ccccacccctgccccca

SEQ ID NO: 516502 - DNA, 20 bp, Homo sapiens
ccccacctggccctctctga

SEQ ID NO: 516503 - DNA, 11 bp, Homo sapiens
ccccactctca

SEQ ID NO: 516504 - DNA, 17 bp, Homo sapiens
ccccactctcagaggcc

SEQ ID NO: 516505 - DNA, 20 bp, Homo sapiens
ccccactctcagaggcccca

SEQ ID NO: 516506 - DNA, 13 bp, Homo sapiens
ccccagccccggg

SEQ ID NO: 516507 - DNA, 14 bp, Homo sapiens
ccccagcttccagc

SEQ ID NO: 516508 - DNA, 18 bp, Homo sapiens
ccccagcttccagcagga

SEQ ID NO: 516509 - DNA, 18 bp, Homo sapiens
ccccagtccccacccctg

SEQ ID NO: 516510 - DNA, 19 bp, Homo sapiens
ccccatttcccatctgcac

SEQ ID NO: 516511 - DNA, 20 bp, Homo sapiens
cccccaccccggggaccctg

SEQ ID NO: 516512 - DNA, 13 bp, Homo sapiens
cccccagccccgg

SEQ ID NO: 516513 - DNA, 18 bp, Homo sapiens
cccccagcttccagcagg

SEQ ID NO: 516514 - DNA, 12 bp, Homo sapiens
ccccgcccccag

SEQ ID NO: 516515 - DNA, 22 bp, Homo sapiens
ccccggggtgagtccattctcc

SEQ ID NO: 516516 - DNA, 23 bp, Homo sapiens
cccctcgcccagtcccagcagcc

SEQ ID NO: 516517 - DNA, 11 bp, Homo sapiens
cccctgagccc

SEQ ID NO: 516518 - DNA, 13 bp, Homo sapiens
cccctgagcccac

SEQ ID NO: 516519 - DNA, 11 bp, Homo sapiens
cccctgcactg

SEQ ID NO: 516520 - DNA, 17 bp, Homo sapiens
cccctggaagcagtgcc

SEQ ID NO: 516521 - DNA, 16 bp, Homo sapiens
cccctgggcttggcct

SEQ ID NO: 516522 - DNA, 18 bp, Homo sapiens
ccccttctcccctgcact

SEQ ID NO: 516523 - DNA, 19 bp, Homo sapiens
ccccttctcccctgcactg

SEQ ID NO: 516524 - DNA, 19 bp, Homo sapiens
ccccttctctcctccccaa

SEQ ID NO: 516525 - DNA, 12 bp, Homo sapiens
ccccttgccagc

SEQ ID NO: 516526 - DNA, 14 bp, Homo sapiens
ccccttgccagctg

SEQ ID NO: 516527 - DNA, 19 bp, Homo sapiens
ccccttgccagctgctgag

SEQ ID NO: 516528 - DNA, 19 bp, Homo sapiens
cccgcctccaacccctcgc

SEQ ID NO: 516529 - DNA, 18 bp, Homo sapiens
cccggggaccctgtgaca

SEQ ID NO: 516530 - DNA, 12 bp, Homo sapiens
cccgtctcaggt

SEQ ID NO: 516531 - DNA, 17 bp, Homo sapiens
ccctagctttagaccct

SEQ ID NO: 516532 - DNA, 19 bp, Homo sapiens
ccctagctttagaccctgg

SEQ ID NO: 516533 - DNA, 18 bp, Homo sapiens
ccctatttgtgaattctg

SEQ ID NO: 516534 - DNA, 21 bp, Homo sapiens
ccctcacaagtaacagttgaa

SEQ ID NO: 516535 - DNA, 12 bp, Homo sapiens
ccctgagcccac

SEQ ID NO: 516536 - DNA, 14 bp, Homo sapiens
ccctgagcccactg

SEQ ID NO: 516537 - DNA, 17 bp, Homo sapiens
ccctgagcccactgtgc

SEQ ID NO: 516538 - DNA, 14 bp, Homo sapiens
ccctgccaggcaca

SEQ ID NO: 516539 - DNA, 15 bp, Homo sapiens
ccctgccaggcacag

SEQ ID NO: 516540 - DNA, 19 bp, Homo sapiens
ccctgccaggcacaggcag

SEQ ID NO: 516541 - DNA, 21 bp, Homo sapiens
ccctgccaggcacaggcaggg

SEQ ID NO: 516542 - DNA, 22 bp, Homo sapiens
ccctgccaggcacaggcagggc

SEQ ID NO: 516543 - DNA, 18 bp, Homo sapiens
ccctgcccccagccccgg

SEQ ID NO: 516544 - DNA, 16 bp, Homo sapiens
ccctgcttccaggaaa

SEQ ID NO: 516545 - DNA, 17 bp, Homo sapiens
ccctggaagcagtgccc

SEQ ID NO: 516546 - DNA, 17 bp, Homo sapiens
ccctggaccccagcctc

SEQ ID NO: 516547 - DNA, 17 bp, Homo sapiens
ccctggcccccacatgg

SEQ ID NO: 516548 - DNA, 13 bp, Homo sapiens
ccctggctgctgc

SEQ ID NO: 516549 - DNA, 14 bp, Homo sapiens
ccctggctgctgcc

SEQ ID NO: 516550 - DNA, 18 bp, Homo sapiens
ccctggctgctgccccca

SEQ ID NO: 516551 - DNA, 21 bp, Homo sapiens
ccctgggcttggcctgctgtg

SEQ ID NO: 516552 - DNA, 20 bp, Homo sapiens
ccctgggtgggctctgtgca

SEQ ID NO: 516553 - DNA, 16 bp, Homo sapiens
ccctgggttagactgc

SEQ ID NO: 516554 - DNA, 19 bp, Homo sapiens
ccctgggttagactgccag

SEQ ID NO: 516555 - DNA, 21 bp, Homo sapiens
ccctgggttagactgccagct

SEQ ID NO: 516556 - DNA, 17 bp, Homo sapiens
ccctgtgacatggtgcc

SEQ ID NO: 516557 - DNA, 18 bp, Homo sapiens
ccctgtgacatggtgcct

SEQ ID NO: 516558 - DNA, 21 bp, Homo sapiens
cccttccttttccctgcttcc

SEQ ID NO: 516559 - DNA, 22 bp, Homo sapiens
cccttccttttccctgcttcca

SEQ ID NO: 516560 - DNA, 15 bp, Homo sapiens
cccttctcccctgca

SEQ ID NO: 516561 - DNA, 21 bp, Homo sapiens
cccttctcccctgcactgtaa

SEQ ID NO: 516562 - DNA, 13 bp, Homo sapiens
cccttgccagctg

SEQ ID NO: 516563 - DNA, 18 bp, Homo sapiens
cccttgcctccccatttc

SEQ ID NO: 516564 - DNA, 17 bp, Homo sapiens
ccgacgtctatcctttc

SEQ ID NO: 516565 - DNA, 11 bp, Homo sapiens
ccgccagcctc

SEQ ID NO: 516566 - DNA, 16 bp, Homo sapiens
ccggcaataaaagccc

SEQ ID NO: 516567 - DNA, 17 bp, Homo sapiens
ccggcaataaaagccca

SEQ ID NO: 516568 - DNA, 18 bp, Homo sapiens
ccggcaataaaagcccag

SEQ ID NO: 516569 - DNA, 20 bp, Homo sapiens
ccggcaataaaagcccagga

SEQ ID NO: 516570 - DNA, 14 bp, Homo sapiens
ccgggcccctgggc

SEQ ID NO: 516571 - DNA, 21 bp, Homo sapiens
ccgggcccctgggcttggcct

SEQ ID NO: 516572 - DNA, 13 bp, Homo sapiens
cctaaaaggccca

SEQ ID NO: 516573 - DNA, 17 bp, Homo sapiens
cctaaaaggcccagaga

SEQ ID NO: 516574 - DNA, 16 bp, Homo sapiens
cctaatccccttctcc

SEQ ID NO: 516575 - DNA, 15 bp, Homo sapiens
cctaatttctcctcc

SEQ ID NO: 516576 - DNA, 11 bp, Homo sapiens
cctagaaaagt

SEQ ID NO: 516577 - DNA, 18 bp, Homo sapiens
cctagctttagaccctgg

SEQ ID NO: 516578 - DNA, 17 bp, Homo sapiens
cctcacctcatgcccac

SEQ ID NO: 516579 - DNA, 19 bp, Homo sapiens
cctcacctcatgcccaccc

SEQ ID NO: 516580 - DNA, 20 bp, Homo sapiens
cggcaataaaagcccaggag

SEQ ID NO: 516581 - DNA, 17 bp, Homo sapiens
cggcaggctcactgcca

SEQ ID NO: 516582 - DNA, 23 bp, Homo sapiens
cggcaggctcactgccaggccag

SEQ ID NO: 516583 - DNA, 15 bp, Homo sapiens
cgggcccctgggctt

SEQ ID NO: 516584 - DNA, 14 bp, Homo sapiens
cggggaccctgtga

SEQ ID NO: 516585 - DNA, 13 bp, Homo sapiens
cggtgtgggggcc

SEQ ID NO: 516586 - DNA, 21 bp, Homo sapiens
ggaccatgctgtctggcacag

SEQ ID NO: 516587 - DNA, 16 bp, Homo sapiens
ggacccagtggcaggg

SEQ ID NO: 516588 - DNA, 17 bp, Homo sapiens
ggacccagtggcagggc

SEQ ID NO: 516589 - DNA, 22 bp, Homo sapiens
ggaccctgtgacatggtgcctg

SEQ ID NO: 516590 - DNA, 15 bp, Homo sapiens
ggactgccacctccc

SEQ ID NO: 516591 - DNA, 15 bp, Homo sapiens
ggactgttcatttga

SEQ ID NO: 516592 - DNA, 19 bp, Homo sapiens
ggagactgctcctgagccc

SEQ ID NO: 516593 - DNA, 12 bp, Homo sapiens
ggagagcctgct

SEQ ID NO: 516594 - DNA, 13 bp, Homo sapiens
ggagagcctgctg

SEQ ID NO: 516595 - DNA, 14 bp, Homo sapiens
ggagagcctgctgg

SEQ ID NO: 516596 - DNA, 20 bp, Homo sapiens
ggagattcaggcagactggt

SEQ ID NO: 516597 - DNA, 20 bp, Homo sapiens
ggagccctgcctctccgccc

SEQ ID NO: 516598 - DNA, 15 bp, Homo sapiens
ggagctgtggaaatg

SEQ ID NO: 516599 - DNA, 22 bp, Homo sapiens
ggaggccaagagtggccccacc

SEQ ID NO: 516600 - DNA, 19 bp, Homo sapiens
ggaggcttgctgaacatgg

SEQ ID NO: 516601 - DNA, 13 bp, Homo sapiens
ggagggacagtct

SEQ ID NO: 516602 - DNA, 22 bp, Homo sapiens
ggagggcctgggcctggctccc

SEQ ID NO: 516603 - DNA, 16 bp, Homo sapiens
ggagggggcttgaagc

SEQ ID NO: 516604 - DNA, 13 bp, Homo sapiens
ggaggtcactgga

SEQ ID NO: 516605 - DNA, 21 bp, Homo sapiens
ggaggtcactggaaaggggag

SEQ ID NO: 516606 - DNA, 22 bp, Homo sapiens
ggattactgacttttcttttta

SEQ ID NO: 516607 - DNA, 18 bp, Homo sapiens
ggattgagttgtaaagaa

SEQ ID NO: 516608 - DNA, 21 bp, Homo sapiens
ggattgagttgtaaagaaaac

SEQ ID NO: 516609 - DNA, 18 bp, Homo sapiens
ggattgtacatattttta

SEQ ID NO: 516610 - DNA, 13 bp, Homo sapiens
ggcaagagatcat

SEQ ID NO: 516611 - DNA, 22 bp, Homo sapiens
ggcaagagatcatatcctcaga

SEQ ID NO: 516612 - DNA, 20 bp, Homo sapiens
ggcaataaaagcccaggagc

SEQ ID NO: 516613 - DNA, 22 bp, Homo sapiens
ggcaataaaagcccaggagccc

SEQ ID NO: 516614 - DNA, 12 bp, Homo sapiens
ggcacagcctgc

SEQ ID NO: 516615 - DNA, 14 bp, Homo sapiens
ggcacaggcagggc

SEQ ID NO: 516616 - DNA, 13 bp, Homo sapiens
ggcacagggcctg

SEQ ID NO: 516617 - DNA, 18 bp, Homo sapiens
ggcacagggcctggccca

SEQ ID NO: 516618 - DNA, 11 bp, Homo sapiens
ggcactgctct

SEQ ID NO: 516619 - DNA, 14 bp, Homo sapiens
ggcaggaccagccc

SEQ ID NO: 516620 - DNA, 13 bp, Homo sapiens
ggcaggctcactg

SEQ ID NO: 516621 - DNA, 14 bp, Homo sapiens
ggcagggcacaggg

SEQ ID NO: 516622 - DNA, 15 bp, Homo sapiens
ggcagggcacagggc

SEQ ID NO: 516623 - DNA, 18 bp, Homo sapiens
ggcagggcacagggcctg

SEQ ID NO: 516624 - DNA, 13 bp, Homo sapiens
ggcaggggtgggg

SEQ ID NO: 516625 - DNA, 14 bp, Homo sapiens
ggcaggggtggggg

SEQ ID NO: 516626 - DNA, 20 bp, Homo sapiens
ggcagttttgaaatgaaaat

SEQ ID NO: 516627 - DNA, 21 bp, Homo sapiens
ggccaagagtggccccacctg

SEQ ID NO: 516628 - DNA, 22 bp, Homo sapiens
ggccaagagtggccccacctgg

SEQ ID NO: 516629 - DNA, 21 bp, Homo sapiens
ggccacctcctaaaaggccca

SEQ ID NO: 516630 - DNA, 16 bp, Homo sapiens
ggccacctcttcctgg

SEQ ID NO: 516631 - DNA, 22 bp, Homo sapiens
ggccacctcttcctggccggtg

SEQ ID NO: 516632 - DNA, 19 bp, Homo sapiens
ggccagcctccgagaggga

SEQ ID NO: 516633 - DNA, 22 bp, Homo sapiens
ggccagcctccgagagggagag

SEQ ID NO: 516634 - DNA, 18 bp, Homo sapiens
ggccaggaagtagcacag

SEQ ID NO: 516635 - DNA, 20 bp, Homo sapiens
ggccaggaagtagcacaggc

SEQ ID NO: 516636 - DNA, 23 bp, Homo sapiens
ggcccaccctgcttggcccaggg

SEQ ID NO: 516637 - DNA, 20 bp, Homo sapiens
ggcccagagagaagagcccc

SEQ ID NO: 516638 - DNA, 22 bp, Homo sapiens
ggcccagggggcttcctgaggg

SEQ ID NO: 516639 - DNA, 20 bp, Homo sapiens
ggcccatgtatggccaggaa

SEQ ID NO: 516640 - DNA, 18 bp, Homo sapiens
ggccccgtctcaggtctg

SEQ ID NO: 516641 - DNA, 19 bp, Homo sapiens
ggccccgtctcaggtctga

SEQ ID NO: 516642 - DNA, 15 bp, Homo sapiens
acttctcttcccata

SEQ ID NO: 516643 - DNA, 24 bp, Homo sapiens
acttctgataatttattgtcttta

SEQ ID NO: 516644 - DNA, 20 bp, Homo sapiens
acttgaacttgcaggcaagc

SEQ ID NO: 516645 - DNA, 15 bp, Homo sapiens
acttgagaaatttga

SEQ ID NO: 516646 - DNA, 17 bp, Homo sapiens
acttgagaaatttgaaa

SEQ ID NO: 516647 - DNA, 20 bp, Homo sapiens
acttgggggctcagcaaggc

SEQ ID NO: 516648 - DNA, 21 bp, Homo sapiens
acttgggggctcagcaaggcc

SEQ ID NO: 516649 - DNA, 18 bp, Homo sapiens
actttgtttttattctgt

SEQ ID NO: 516650 - DNA, 20 bp, Homo sapiens
agaaaaaaatataaaatttc

SEQ ID NO: 516651 - DNA, 22 bp, Homo sapiens
agaaaaaaatataaaatttctg

SEQ ID NO: 516652 - DNA, 13 bp, Homo sapiens
agaaaaaatggca

SEQ ID NO: 516653 - DNA, 16 bp, Homo sapiens
agaaaaaatggcaaga

SEQ ID NO: 516654 - DNA, 15 bp, Homo sapiens
agaaaagtttgtttt

SEQ ID NO: 516655 - DNA, 13 bp, Homo sapiens
agaaaattttgca

SEQ ID NO: 516656 - DNA, 15 bp, Homo sapiens
agaaaggagtagttt

SEQ ID NO: 516657 - DNA, 17 bp, Homo sapiens
agaaaggagtagttttc

SEQ ID NO: 516658 - DNA, 18 bp, Homo sapiens
agaaaggcaaatctgact

SEQ ID NO: 516659 - DNA, 23 bp, Homo sapiens
agaaaggtgagtttgagctgcct

SEQ ID NO: 516660 - DNA, 17 bp, Homo sapiens
agaagagccccactctc

SEQ ID NO: 516661 - DNA, 22 bp, Homo sapiens
agaagagccccactctcagagg

SEQ ID NO: 516662 - DNA, 20 bp, Homo sapiens
agaagctatgtttttaaagt

SEQ ID NO: 516663 - DNA, 19 bp, Homo sapiens
agaaggggactgccacctc

SEQ ID NO: 516664 - DNA, 13 bp, Homo sapiens
agaatcacaggct

SEQ ID NO: 516665 - DNA, 16 bp, Homo sapiens
agaatctcttttctgg

SEQ ID NO: 516666 - DNA, 16 bp, Homo sapiens
agaatgcttctcttta

SEQ ID NO: 516667 - DNA, 14 bp, Homo sapiens
agacaggacccctg

SEQ ID NO: 516668 - DNA, 15 bp, Homo sapiens
agacaggacccctgc

SEQ ID NO: 516669 - DNA, 22 bp, Homo sapiens
agaccctgggtgggctctgtgc

SEQ ID NO: 516670 - DNA, 18 bp, Homo sapiens
agactgccagctcttcct

SEQ ID NO: 516671 - DNA, 22 bp, Homo sapiens
agactgccagctcttcctagct

SEQ ID NO: 516672 - DNA, 19 bp, Homo sapiens
agactgctcctgagccccc

SEQ ID NO: 516673 - DNA, 21 bp, Homo sapiens
agactgctcctgagcccccag

SEQ ID NO: 516674 - DNA, 19 bp, Homo sapiens
agactgtggagactgctcc

SEQ ID NO: 516675 - DNA, 21 bp, Homo sapiens
agacttgagaaatttgaaagg

SEQ ID NO: 516676 - DNA, 18 bp, Homo sapiens
agagaagtgacggttcct

SEQ ID NO: 516677 - DNA, 12 bp, Homo sapiens
agagacttgttt

SEQ ID NO: 516678 - DNA, 16 bp, Homo sapiens
agagacttgttttgga

SEQ ID NO: 516679 - DNA, 13 bp, Homo sapiens
agagagagagagg

SEQ ID NO: 516680 - DNA, 14 bp, Homo sapiens
agagatattttggg

SEQ ID NO: 516681 - DNA, 13 bp, Homo sapiens
agagccccactct

SEQ ID NO: 516682 - DNA, 17 bp, Homo sapiens
agagccccactctcaga

SEQ ID NO: 516683 - DNA, 23 bp, Homo sapiens
agagccccactctcagaggcccc

SEQ ID NO: 516684 - DNA, 14 bp, Homo sapiens
agagcccttgcctc

SEQ ID NO: 516685 - DNA, 23 bp, Homo sapiens
agaggagccctgcctctccgccc

SEQ ID NO: 516686 - DNA, 16 bp, Homo sapiens
agaggctagcttctgc

SEQ ID NO: 516687 - DNA, 20 bp, Homo sapiens
agaggctccccctaaacaca

SEQ ID NO: 516688 - DNA, 17 bp, Homo sapiens
agaggcttctccgccag

SEQ ID NO: 516689 - DNA, 21 bp, Homo sapiens
agaggcttctccgccagcctc

SEQ ID NO: 516690 - DNA, 16 bp, Homo sapiens
agagggaatgtgaaat

SEQ ID NO: 516691 - DNA, 18 bp, Homo sapiens
agagggaatgtgaaattt

SEQ ID NO: 516692 - DNA, 13 bp, Homo sapiens
agagggagagaga

SEQ ID NO: 516693 - DNA, 22 bp, Homo sapiens
agagggaggtcactggaaaggg

SEQ ID NO: 516694 - DNA, 21 bp, Homo sapiens
agagggataacccaaacaaaa

SEQ ID NO: 516695 - DNA, 22 bp, Homo sapiens
agagggcttcctctagaagcca

SEQ ID NO: 516696 - DNA, 12 bp, Homo sapiens
agagggggtgga

SEQ ID NO: 516697 - DNA, 19 bp, Homo sapiens
agagggggtggaggggtgt

SEQ ID NO: 516698 - DNA, 15 bp, Homo sapiens
agaggtctgtaaaga

SEQ ID NO: 516699 - DNA, 13 bp, Homo sapiens
agagtatgttctt

SEQ ID NO: 516700 - DNA, 18 bp, Homo sapiens
agagtatgttcttgaaga

SEQ ID NO: 516701 - DNA, 14 bp, Homo sapiens
agagtattcagtga

SEQ ID NO: 516702 - DNA, 17 bp, Homo sapiens
agatacatgttgtattt

SEQ ID NO: 516703 - DNA, 12 bp, Homo sapiens
agatataccaag

SEQ ID NO: 516704 - DNA, 14 bp, Homo sapiens
agatccaaatgtaa

SEQ ID NO: 516705 - DNA, 15 bp, Homo sapiens
agatccaaatgtaaa

SEQ ID NO: 516706 - DNA, 18 bp, Homo sapiens
agatgggaatgaggtggg

SEQ ID NO: 516707 - DNA, 16 bp, Homo sapiens
agatgggtcaagcaag

SEQ ID NO: 516708 - DNA, 18 bp, Homo sapiens
agcaacccctggacccca

SEQ ID NO: 516709 - DNA, 23 bp, Homo sapiens
agcaacccctggaccccagcctc

SEQ ID NO: 516710 - DNA, 16 bp, Homo sapiens
agcaagcggccacaag

SEQ ID NO: 516711 - DNA, 12 bp, Homo sapiens
agcaaggccacc

SEQ ID NO: 516712 - DNA, 14 bp, Homo sapiens
agcaaggccacctc

SEQ ID NO: 516713 - DNA, 21 bp, Homo sapiens
agcaaggccacctcttcctgg

SEQ ID NO: 516714 - DNA, 22 bp, Homo sapiens
agcacaggctgagtgcaggccc

SEQ ID NO: 516715 - DNA, 21 bp, Homo sapiens
agcacttcagatcaagtgctt

SEQ ID NO: 516716 - DNA, 15 bp, Homo sapiens
agcagattccctgtt

SEQ ID NO: 516717 - DNA, 12 bp, Homo sapiens
agcagccagcca

SEQ ID NO: 516718 - DNA, 18 bp, Homo sapiens
agcaggttactaaggaag

SEQ ID NO: 516719 - DNA, 14 bp, Homo sapiens
agcagtgcccaggt

SEQ ID NO: 516720 - DNA, 16 bp, Homo sapiens
agcagtgcccaggtgg

SEQ ID NO: 516721 - DNA, 13 bp, Homo sapiens
agccaaatgtaaa

SEQ ID NO: 516722 - DNA, 23 bp, Homo sapiens
agccaagggaaaggggtgctttt

SEQ ID NO: 516723 - DNA, 13 bp, Homo sapiens
agccaagtggggt

SEQ ID NO: 516724 - DNA, 23 bp, Homo sapiens
agccagccaaacacacagaaggg

SEQ ID NO: 516725 - DNA, 14 bp, Homo sapiens
agccagtctcctat

SEQ ID NO: 516726 - DNA, 21 bp, Homo sapiens
agcccacgctgactacagggc

SEQ ID NO: 516727 - DNA, 15 bp, Homo sapiens
agcccagatcccaag

SEQ ID NO: 516728 - DNA, 14 bp, Homo sapiens
agcccaggagccca

SEQ ID NO: 516729 - DNA, 17 bp, Homo sapiens
agccccactctcagagg

SEQ ID NO: 516730 - DNA, 24 bp, Homo sapiens
agccccggggtgagtccattctcc

SEQ ID NO: 516731 - DNA, 22 bp, Homo sapiens
agccctgcctctccgcccctga

SEQ ID NO: 516732 - DNA, 13 bp, Homo sapiens
agcccttgcctcc

SEQ ID NO: 516733 - DNA, 16 bp, Homo sapiens
agcctccgagagggag

SEQ ID NO: 516734 - DNA, 18 bp, Homo sapiens
agcctccgagagggagag

SEQ ID NO: 516735 - DNA, 13 bp, Homo sapiens
agcctctgtcttt

SEQ ID NO: 516736 - DNA, 19 bp, Homo sapiens
agcctgattttttgaggcc

SEQ ID NO: 516737 - DNA, 20 bp, Homo sapiens
agcctgcacttgggggctca

SEQ ID NO: 516738 - DNA, 15 bp, Homo sapiens
agctatgtttttaaa

SEQ ID NO: 516739 - DNA, 17 bp, Homo sapiens
agctatgtttttaaagt

SEQ ID NO: 516740 - DNA, 10 bp, Homo sapiens
agctgccttc

SEQ ID NO: 516741 - DNA, 16 bp, Homo sapiens
agctgccttccctagc

SEQ ID NO: 516742 - DNA, 17 bp, Homo sapiens
agctgccttccctagct

SEQ ID NO: 516743 - DNA, 18 bp, Homo sapiens
agctgcgcttgcttttct

SEQ ID NO: 516744 - DNA, 22 bp, Homo sapiens
agctgctaactacatgaacaca

SEQ ID NO: 516745 - DNA, 21 bp, Homo sapiens
agctgctgagccgcagagaag

SEQ ID NO: 516746 - DNA, 15 bp, Homo sapiens
agctggagaggagcc

SEQ ID NO: 516747 - DNA, 16 bp, Homo sapiens
agctggagaggagccc

SEQ ID NO: 516748 - DNA, 17 bp, Homo sapiens
agctggagaggagccct

SEQ ID NO: 516749 - DNA, 13 bp, Homo sapiens
agcttccagcagg

SEQ ID NO: 516750 - DNA, 22 bp, Homo sapiens
agcttctgcttttctgccctgg

SEQ ID NO: 516751 - DNA, 17 bp, Homo sapiens
aggaaaaacacaagcaa

SEQ ID NO: 516752 - DNA, 16 bp, Homo sapiens
aggaaactccacatct

SEQ ID NO: 516753 - DNA, 19 bp, Homo sapiens
aggaaactccacatctgcc

SEQ ID NO: 516754 - DNA, 21 bp, Homo sapiens
aggaaatgctgacccatgggc

SEQ ID NO: 516755 - DNA, 16 bp, Homo sapiens
aacccctggaccccag

SEQ ID NO: 516756 - DNA, 21 bp, Homo sapiens
aaccgccggttcattttgcac

SEQ ID NO: 516757 - DNA, 21 bp, Homo sapiens
aacgctaaagagcccttgcct

SEQ ID NO: 516758 - DNA, 20 bp, Homo sapiens
aacgtggagaatcacaggct

SEQ ID NO: 516759 - DNA, 16 bp, Homo sapiens
aactacctaaaataaa

SEQ ID NO: 516760 - DNA, 17 bp, Homo sapiens
aactacctaaaataaat

SEQ ID NO: 516761 - DNA, 23 bp, Homo sapiens
aactatgacaatttttgctgttt

SEQ ID NO: 516762 - DNA, 14 bp, Homo sapiens
aactccacatctgc

SEQ ID NO: 516763 - DNA, 19 bp, Homo sapiens
aactcctccatccatgtgt

SEQ ID NO: 516764 - DNA, 14 bp, Homo sapiens
aactgccaaaacaa

SEQ ID NO: 516765 - DNA, 14 bp, Homo sapiens
aacttataattaca

SEQ ID NO: 516766 - DNA, 14 bp, Homo sapiens
aacttatttctgaa

SEQ ID NO: 516767 - DNA, 14 bp, Homo sapiens
aacttcactccaaa

SEQ ID NO: 516768 - DNA, 14 bp, Homo sapiens
aacttgcctttttt

SEQ ID NO: 516769 - DNA, 12 bp, Homo sapiens
aactttcttcaa

SEQ ID NO: 516770 - DNA, 17 bp, Homo sapiens
aagaagggagaagaaag

SEQ ID NO: 516771 - DNA, 20 bp, Homo sapiens
aagacttgagaaatttgaaa

SEQ ID NO: 516772 - DNA, 22 bp, Homo sapiens
aagagaaaaaaatataaaattt

SEQ ID NO: 516773 - DNA, 16 bp, Homo sapiens
aagagacaataacttt

SEQ ID NO: 516774 - DNA, 12 bp, Homo sapiens
aagagccccact

SEQ ID NO: 516775 - DNA, 16 bp, Homo sapiens
aagagccccactctca

SEQ ID NO: 516776 - DNA, 14 bp, Homo sapiens
aagagcccttgcct

SEQ ID NO: 516777 - DNA, 14 bp, Homo sapiens
aagagcctgatttt

SEQ ID NO: 516778 - DNA, 17 bp, Homo sapiens
aagagcctgattttttg

SEQ ID NO: 516779 - DNA, 21 bp, Homo sapiens
aagaggcaacaatttggttct

SEQ ID NO: 516780 - DNA, 21 bp, Homo sapiens
aagaggctccccctaaacaca

SEQ ID NO: 516781 - DNA, 13 bp, Homo sapiens
aagagggggtgga

SEQ ID NO: 516782 - DNA, 21 bp, Homo sapiens
aagagtggccccacctggccc

SEQ ID NO: 516783 - DNA, 14 bp, Homo sapiens
acagtgtgattttg

SEQ ID NO: 516784 - DNA, 21 bp, Homo sapiens
acagttgaagaaaaaatggca

SEQ ID NO: 516785 - DNA, 21 bp, Homo sapiens
acataagggcattatgtaaca

SEQ ID NO: 516786 - DNA, 19 bp, Homo sapiens
acataatcacaagtaaagg

SEQ ID NO: 516787 - DNA, 12 bp, Homo sapiens
acatctgcctta

SEQ ID NO: 516788 - DNA, 22 bp, Homo sapiens
acatgaacacaaatgtgtattt

SEQ ID NO: 516789 - DNA, 11 bp, Homo sapiens
acatggtgatg

SEQ ID NO: 516790 - DNA, 18 bp, Homo sapiens
acatggtgcctgagaggc

SEQ ID NO: 516791 - DNA, 20 bp, Homo sapiens
acatgttgtatttatggaag

SEQ ID NO: 516792 - DNA, 15 bp, Homo sapiens
acattataccgcaga

SEQ ID NO: 516793 - DNA, 16 bp, Homo sapiens
acattataccgcagag

SEQ ID NO: 516794 - DNA, 19 bp, Homo sapiens
acattataccgcagagtat

SEQ ID NO: 516795 - DNA, 20 bp, Homo sapiens
acattataccgcagagtatt

SEQ ID NO: 516796 - DNA, 21 bp, Homo sapiens
acattataccgcagagtattt

SEQ ID NO: 516797 - DNA, 15 bp, Homo sapiens
accacattccatgac

SEQ ID NO: 516798 - DNA, 17 bp, Homo sapiens
accagcccacgctgact

SEQ ID NO: 516799 - DNA, 22 bp, Homo sapiens
accagcccacgctgactacagg

SEQ ID NO: 516800 - DNA, 16 bp, Homo sapiens
accagctgcgcttgct

SEQ ID NO: 516801 - DNA, 18 bp, Homo sapiens
accatgctgtctggcaca

SEQ ID NO: 516802 - DNA, 16 bp, Homo sapiens
accatttccccagggc

SEQ ID NO: 516803 - DNA, 21 bp, Homo sapiens
acccaaacaaaaatgactcta

SEQ ID NO: 516804 - DNA, 22 bp, Homo sapiens
acccaccgtggaggaggaaggc

SEQ ID NO: 516805 - DNA, 18 bp, Homo sapiens
acccagtggcagggcaca

SEQ ID NO: 516806 - DNA, 19 bp, Homo sapiens
acccagtggcagggcacag

SEQ ID NO: 516807 - DNA, 14 bp, Homo sapiens
acccatgggcagga

SEQ ID NO: 516808 - DNA, 18 bp, Homo sapiens
acccatgggcaggagact

SEQ ID NO: 516809 - DNA, 19 bp, Homo sapiens
accccaagcgccctggccc

SEQ ID NO: 516810 - DNA, 21 bp, Homo sapiens
accccaagcgccctggccccc

SEQ ID NO: 516811 - DNA, 21 bp, Homo sapiens
accccagcctcaaatccagga

SEQ ID NO: 516812 - DNA, 14 bp, Homo sapiens
accccctgccctgc

SEQ ID NO: 516813 - DNA, 13 bp, Homo sapiens
acccctgccccca

SEQ ID NO: 516814 - DNA, 12 bp, Homo sapiens
acccctggaccc

SEQ ID NO: 516815 - DNA, 18 bp, Homo sapiens
acccctggaccccagcct

SEQ ID NO: 516816 - DNA, 15 bp, Homo sapiens
accccttctctcctc

SEQ ID NO: 516817 - DNA, 14 bp, Homo sapiens
accctgccaggcac

SEQ ID NO: 516818 - DNA, 18 bp, Homo sapiens
accctgccaggcacaggc

SEQ ID NO: 516819 - DNA, 15 bp, Homo sapiens
accctgcttggccca

SEQ ID NO: 516820 - DNA, 16 bp, Homo sapiens
accctgcttggcccag

SEQ ID NO: 516821 - DNA, 19 bp, Homo sapiens
accctgtgacatggtgcct

SEQ ID NO: 516822 - DNA, 22 bp, Homo sapiens
accggttagcatggttttagca

SEQ ID NO: 516823 - DNA, 15 bp, Homo sapiens
accgtggaggaggaa

SEQ ID NO: 516824 - DNA, 13 bp, Homo sapiens
acctcatgcccac

SEQ ID NO: 516825 - DNA, 16 bp, Homo sapiens
acctcatgcccacccc

SEQ ID NO: 516826 - DNA, 22 bp, Homo sapiens
acctcatgcccaccccctgccc

SEQ ID NO: 516827 - DNA, 16 bp, Homo sapiens
acctccccttgccagc

SEQ ID NO: 516828 - DNA, 17 bp, Homo sapiens
acctcctaaaaggccca

SEQ ID NO: 516829 - DNA, 18 bp, Homo sapiens
acctcctaaaaggcccag

SEQ ID NO: 516830 - DNA, 20 bp, Homo sapiens
acctgccaggcaggggtggg

SEQ ID NO: 516831 - DNA, 15 bp, Homo sapiens
acctggccctctctg

SEQ ID NO: 516832 - DNA, 21 bp, Homo sapiens
acctggctgaggttcctctgc

SEQ ID NO: 516833 - DNA, 22 bp, Homo sapiens
acctggctgaggttcctctgcc

SEQ ID NO: 516834 - DNA, 13 bp, Homo sapiens
accttggttcctg

SEQ ID NO: 516835 - DNA, 15 bp, Homo sapiens
accttggttcctggg

SEQ ID NO: 516836 - DNA, 18 bp, Homo sapiens
acgcccacttccctgggt

SEQ ID NO: 516837 - DNA, 18 bp, Homo sapiens
acgctaaagagcccttgc

SEQ ID NO: 516838 - DNA, 16 bp, Homo sapiens
acgctgactacagggc

SEQ ID NO: 516839 - DNA, 18 bp, Homo sapiens
acgctgactacagggccg

SEQ ID NO: 516840 - DNA, 13 bp, Homo sapiens
actaaaccctcac

SEQ ID NO: 516841 - DNA, 14 bp, Homo sapiens
actacctaaaataa

SEQ ID NO: 516842 - DNA, 22 bp, Homo sapiens
actattcttgatgtaaaatctt

SEQ ID NO: 516843 - DNA, 12 bp, Homo sapiens
actatttaactg

SEQ ID NO: 516844 - DNA, 15 bp, Homo sapiens
actatttaactgact

SEQ ID NO: 516845 - DNA, 17 bp, Homo sapiens
actccaaagagaaacct

SEQ ID NO: 516846 - DNA, 13 bp, Homo sapiens
actccacatctgc

SEQ ID NO: 516847 - DNA, 20 bp, Homo sapiens
actcctccatccatgtgttc

SEQ ID NO: 516848 - DNA, 22 bp, Homo sapiens
actcctccatccatgtgttcca

SEQ ID NO: 516849 - DNA, 14 bp, Homo sapiens
actctcagaggccc

SEQ ID NO: 516850 - DNA, 21 bp, Homo sapiens
actctcaggaaatgctgaccc

SEQ ID NO: 516851 - DNA, 21 bp, Homo sapiens
actctgccttaatttttgaaa

SEQ ID NO: 516852 - DNA, 16 bp, Homo sapiens
actcttatatttttct

SEQ ID NO: 516853 - DNA, 23 bp, Homo sapiens
actgactattcttgatgtaaaat

SEQ ID NO: 516854 - DNA, 20 bp, Homo sapiens
actgacttttctttttaatt

SEQ ID NO: 516855 - DNA, 18 bp, Homo sapiens
actgaggtgttattttca

SEQ ID NO: 516856 - DNA, 17 bp, Homo sapiens
actgccagctcttccta

SEQ ID NO: 516857 - DNA, 15 bp, Homo sapiens
actgccaggccagcc

SEQ ID NO: 516858 - DNA, 19 bp, Homo sapiens
actgctcctgagcccccag

SEQ ID NO: 516859 - DNA, 20 bp, Homo sapiens
actgctcctgagcccccagc

SEQ ID NO: 516860 - DNA, 21 bp, Homo sapiens
actgctcctgagcccccagct

SEQ ID NO: 516861 - DNA, 22 bp, Homo sapiens
actgctcctgagcccccagctt

SEQ ID NO: 516862 - DNA, 21 bp, Homo sapiens
actggaaaggggagagcctgc

SEQ ID NO: 516863 - DNA, 22 bp, Homo sapiens
actggaaaggggagagcctgct

SEQ ID NO: 516864 - DNA, 23 bp, Homo sapiens
actggaaaggggagagcctgctg

SEQ ID NO: 516865 - DNA, 18 bp, Homo sapiens
actgtagttcagatagag

SEQ ID NO: 516866 - DNA, 13 bp, Homo sapiens
actgttgtcattt

SEQ ID NO: 516867 - DNA, 18 bp, Homo sapiens
acttaaattttaaagcct

SEQ ID NO: 516868 - DNA, 12 bp, Homo sapiens
acttaatggcac

SEQ ID NO: 516869 - DNA, 12 bp, Homo sapiens
acttatttctga

SEQ ID NO: 516870 - DNA, 18 bp, Homo sapiens
acttatttttttcccaag

SEQ ID NO: 516871 - DNA, 20 bp, Homo sapiens
acttcactccaaagagaaac

SEQ ID NO: 516872 - DNA, 21 bp, Homo sapiens
acttcggatttattccctttt

SEQ ID NO: 516873 - DNA, 23 bp, Homo sapiens
aggaaatgctgacccatgggcag

SEQ ID NO: 516874 - DNA, 18 bp, Homo sapiens
aggaagtagcacaggctg

SEQ ID NO: 516875 - DNA, 12 bp, Homo sapiens
aggaccagccca

SEQ ID NO: 516876 - DNA, 13 bp, Homo sapiens
aggaccctgccag

SEQ ID NO: 516877 - DNA, 14 bp, Homo sapiens
aggaccctgccagg

SEQ ID NO: 516878 - DNA, 15 bp, Homo sapiens
aggaccctgccaggc

SEQ ID NO: 516879 - DNA, 21 bp, Homo sapiens
aggagactgtggagactgctc

SEQ ID NO: 516880 - DNA, 14 bp, Homo sapiens
aggagccctgcctc

SEQ ID NO: 516881 - DNA, 17 bp, Homo sapiens
aggagccctgcctctcc

SEQ ID NO: 516882 - DNA, 19 bp, Homo sapiens
aggagggacagtctcacca

SEQ ID NO: 516883 - DNA, 15 bp, Homo sapiens
aggagggagagggag

SEQ ID NO: 516884 - DNA, 15 bp, Homo sapiens
aggatgtttttaatg

SEQ ID NO: 516885 - DNA, 13 bp, Homo sapiens
aggcacaggcagg

SEQ ID NO: 516886 - DNA, 14 bp, Homo sapiens
aggcacaggcaggg

SEQ ID NO: 516887 - DNA, 16 bp, Homo sapiens
aggcagttttgaaatg

SEQ ID NO: 516888 - DNA, 16 bp, Homo sapiens
aggccaagagtggccc

SEQ ID NO: 516889 - DNA, 18 bp, Homo sapiens
atccaggaccctgccagg

SEQ ID NO: 516890 - DNA, 22 bp, Homo sapiens
atccatggggtctctcacagac

SEQ ID NO: 516891 - DNA, 23 bp, Homo sapiens
atccatggggtctctcacagaca

SEQ ID NO: 516892 - DNA, 16 bp, Homo sapiens
atcccaggaaataaaa

SEQ ID NO: 516893 - DNA, 15 bp, Homo sapiens
atccccttctcccct

SEQ ID NO: 516894 - DNA, 21 bp, Homo sapiens
atccccttctcccctgcactg

SEQ ID NO: 516895 - DNA, 20 bp, Homo sapiens
atcctaatttctcctccctt

SEQ ID NO: 516896 - DNA, 14 bp, Homo sapiens
atcctatttttaaa

SEQ ID NO: 516897 - DNA, 14 bp, Homo sapiens
atctcaactctgtt

SEQ ID NO: 516898 - DNA, 15 bp, Homo sapiens
atctcatctatctca

SEQ ID NO: 516899 - DNA, 13 bp, Homo sapiens
atctcttttctgg

SEQ ID NO: 516900 - DNA, 17 bp, Homo sapiens
atctgcaccccttctct

SEQ ID NO: 516901 - DNA, 18 bp, Homo sapiens
atctgcaccccttctctc

SEQ ID NO: 516902 - DNA, 21 bp, Homo sapiens
atctgcaccccttctctcctc

SEQ ID NO: 516903 - DNA, 19 bp, Homo sapiens
atctgccttaaaaccaaag

SEQ ID NO: 516904 - DNA, 21 bp, Homo sapiens
atctgccttaaaaccaaagag

SEQ ID NO: 516905 - DNA, 21 bp, Homo sapiens
atctggaagggcactatattt

SEQ ID NO: 516906 - DNA, 15 bp, Homo sapiens
atcttgtcatgtgta

SEQ ID NO: 516907 - DNA, 19 bp, Homo sapiens
atcttgtcatgtgtataaa

SEQ ID NO: 516908 - DNA, 16 bp, Homo sapiens
atgaaaatgtctcagt

SEQ ID NO: 516909 - DNA, 14 bp, Homo sapiens
atgaacacaaatgt

SEQ ID NO: 516910 - DNA, 21 bp, Homo sapiens
atgaatgtaaatttgtactat

SEQ ID NO: 516911 - DNA, 14 bp, Homo sapiens
atgacaatttttgc

SEQ ID NO: 516912 - DNA, 13 bp, Homo sapiens
atgaggtgggagg

SEQ ID NO: 516913 - DNA, 22 bp, Homo sapiens
atgagtttcacagtgtgatttt

SEQ ID NO: 516914 - DNA, 19 bp, Homo sapiens
atgatgcgcttcaaagtgg

SEQ ID NO: 516915 - DNA, 9 bp, Homo sapiens
atgatgtta

SEQ ID NO: 516916 - DNA, 15 bp, Homo sapiens
atgatgttttgcaaa

SEQ ID NO: 516917 - DNA, 14 bp, Homo sapiens
atgcatatttttgc

SEQ ID NO: 516918 - DNA, 15 bp, Homo sapiens
atgcatatttttgca

SEQ ID NO: 516919 - DNA, 17 bp, Homo sapiens
atgcccaccccctgccc

SEQ ID NO: 516920 - DNA, 13 bp, Homo sapiens
atgcgcttcaaag

SEQ ID NO: 516921 - DNA, 16 bp, Homo sapiens
atgctgacccatgggc

SEQ ID NO: 516922 - DNA, 14 bp, Homo sapiens
atgcttctctttag

SEQ ID NO: 516923 - DNA, 14 bp, Homo sapiens
atggatgtatttgt

SEQ ID NO: 516924 - DNA, 19 bp, Homo sapiens
atggcactgttgtcatttc

SEQ ID NO: 516925 - DNA, 22 bp, Homo sapiens
atggcagaggatagtaatgaaa

SEQ ID NO: 516926 - DNA, 22 bp, Homo sapiens
atggccaggaagtagcacaggc

SEQ ID NO: 516927 - DNA, 23 bp, Homo sapiens
atggccaggaagtagcacaggct

SEQ ID NO: 516928 - DNA, 17 bp, Homo sapiens
atgggaggcttgctgaa

SEQ ID NO: 516929 - DNA, 23 bp, Homo sapiens
atgggagggggcttgaagccaaa

SEQ ID NO: 516930 - DNA, 23 bp, Homo sapiens
atgggctgttctgtttcctgtgt

SEQ ID NO: 516931 - DNA, 12 bp, Homo sapiens
atgggtcacagg

SEQ ID NO: 516932 - DNA, 14 bp, Homo sapiens
atgggtcacaggaa

SEQ ID NO: 516933 - DNA, 16 bp, Homo sapiens
atggtgcctgagaggc

SEQ ID NO: 516934 - DNA, 20 bp, Homo sapiens
atggtgcctgagaggcaggc

SEQ ID NO: 516935 - DNA, 24 bp, Homo sapiens
atggtggttgggacccagtggcag

SEQ ID NO: 516936 - DNA, 13 bp, Homo sapiens
atgtaaaatcttg

SEQ ID NO: 516937 - DNA, 22 bp, Homo sapiens
atgtaaaatcttgtcatgtgta

SEQ ID NO: 516938 - DNA, 23 bp, Homo sapiens
atgtaaaatcttgtcatgtgtat

SEQ ID NO: 516939 - DNA, 12 bp, Homo sapiens
atgtaaatttgt

SEQ ID NO: 516940 - DNA, 17 bp, Homo sapiens
atgtaaatttgtactat

SEQ ID NO: 516941 - DNA, 20 bp, Homo sapiens
atgtaacttttttattttaa

SEQ ID NO: 516942 - DNA, 19 bp, Homo sapiens
atgtattaaaatatcccaa

SEQ ID NO: 516943 - DNA, 16 bp, Homo sapiens
atgtattttgtaaact

SEQ ID NO: 516944 - DNA, 23 bp, Homo sapiens
atgtattttgtaaactgatgttt

SEQ ID NO: 516945 - DNA, 24 bp, Homo sapiens
atgtgacccgatggcacatagatg

SEQ ID NO: 516946 - DNA, 13 bp, Homo sapiens
atgtgggattatg

SEQ ID NO: 516947 - DNA, 19 bp, Homo sapiens
atgtggtattggtgctttg

SEQ ID NO: 516948 - DNA, 14 bp, Homo sapiens
atgtgtatttttgt

SEQ ID NO: 516949 - DNA, 22 bp, Homo sapiens
atgtgttccaaatttgctttac

SEQ ID NO: 516950 - DNA, 21 bp, Homo sapiens
atgttgacatcactggcatgg

SEQ ID NO: 516951 - DNA, 22 bp, Homo sapiens
atgttttgcaaaggaaaataat

SEQ ID NO: 516952 - DNA, 14 bp, Homo sapiens
attaaaaattactg

SEQ ID NO: 516953 - DNA, 13 bp, Homo sapiens
attaatgtacaca

SEQ ID NO: 516954 - DNA, 19 bp, Homo sapiens
attataccgcagagtattt

SEQ ID NO: 516955 - DNA, 12 bp, Homo sapiens
attatgtaacac

SEQ ID NO: 516956 - DNA, 18 bp, Homo sapiens
attattttcccatttgct

SEQ ID NO: 516957 - DNA, 23 bp, Homo sapiens
attcagtgatatgtaaattaaat

SEQ ID NO: 516958 - DNA, 13 bp, Homo sapiens
attcatttcataa

SEQ ID NO: 516959 - DNA, 14 bp, Homo sapiens
attcttgatgtaaa

SEQ ID NO: 516960 - DNA, 13 bp, Homo sapiens
attctttcctaaa

SEQ ID NO: 516961 - DNA, 21 bp, Homo sapiens
attgattgctgcattttacct

SEQ ID NO: 516962 - DNA, 15 bp, Homo sapiens
attggtgctttgtgt

SEQ ID NO: 516963 - DNA, 17 bp, Homo sapiens
attgtctttatttttat

SEQ ID NO: 516964 - DNA, 18 bp, Homo sapiens
attgttttccagaagcct

SEQ ID NO: 516965 - DNA, 14 bp, Homo sapiens
atttaaagccaaat

SEQ ID NO: 516966 - DNA, 14 bp, Homo sapiens
atttatccagaatg

SEQ ID NO: 516967 - DNA, 18 bp, Homo sapiens
atttatgaatattaaaaa

SEQ ID NO: 516968 - DNA, 16 bp, Homo sapiens
atttatggaagaaaga

SEQ ID NO: 516969 - DNA, 16 bp, Homo sapiens
atttcataagacaaga

SEQ ID NO: 516970 - DNA, 13 bp, Homo sapiens
atttcccttttct

SEQ ID NO: 516971 - DNA, 12 bp, Homo sapiens
atttctcctccc

SEQ ID NO: 516972 - DNA, 19 bp, Homo sapiens
atttctcctcccttccttt

SEQ ID NO: 516973 - DNA, 15 bp, Homo sapiens
atttctgaaaaagag

SEQ ID NO: 516974 - DNA, 20 bp, Homo sapiens
atttctttttgggagagact

SEQ ID NO: 516975 - DNA, 23 bp, Homo sapiens
atttctttttgggagagacttgt

SEQ ID NO: 516976 - DNA, 14 bp, Homo sapiens
atttggttcttgac

SEQ ID NO: 516977 - DNA, 15 bp, Homo sapiens
atttgtggtgatttg

SEQ ID NO: 516978 - DNA, 15 bp, Homo sapiens
attttattatttcta

SEQ ID NO: 516979 - DNA, 17 bp, Homo sapiens
attttattgaaagctca

SEQ ID NO: 516980 - DNA, 17 bp, Homo sapiens
attttcatatttaaagc

SEQ ID NO: 516981 - DNA, 14 bp, Homo sapiens
attttctacagtgg

SEQ ID NO: 516982 - DNA, 16 bp, Homo sapiens
attttctctattcttt

SEQ ID NO: 516983 - DNA, 20 bp, Homo sapiens
attttctctattctttccat

SEQ ID NO: 516984 - DNA, 19 bp, Homo sapiens
attttgggtatattttcaa

SEQ ID NO: 516985 - DNA, 19 bp, Homo sapiens
attttgtaaactgatgttt

SEQ ID NO: 516986 - DNA, 18 bp, Homo sapiens
attttgtcctttcatgta

SEQ ID NO: 516987 - DNA, 18 bp, Homo sapiens
atttttaaacaaaatgta

SEQ ID NO: 516988 - DNA, 19 bp, Homo sapiens
atttttaaacaaaatgtag

SEQ ID NO: 516989 - DNA, 21 bp, Homo sapiens
atttttgaaaagctgctaact

SEQ ID NO: 516990 - DNA, 18 bp, Homo sapiens
attttttgaggccagtaa

SEQ ID NO: 516991 - DNA, 19 bp, Homo sapiens
atttttttttctaagagaa

SEQ ID NO: 516992 - DNA, 21 bp, Homo sapiens
caaagcagggaaacagggagg

SEQ ID NO: 516993 - DNA, 13 bp, Homo sapiens
caaaggcaagact

SEQ ID NO: 516994 - DNA, 18 bp, Homo sapiens
caaagtagaatctctttt

SEQ ID NO: 516995 - DNA, 21 bp, Homo sapiens
caaagtagaatctcttttctg

SEQ ID NO: 516996 - DNA, 14 bp, Homo sapiens
caaatcaatacact

SEQ ID NO: 516997 - DNA, 15 bp, Homo sapiens
caaatcaatacacta

SEQ ID NO: 516998 - DNA, 14 bp, Homo sapiens
caaatccaggaccc

SEQ ID NO: 516999 - DNA, 15 bp, Homo sapiens
caaatgccaaagcag

SEQ ID NO: 517000 - DNA, 15 bp, Homo sapiens
caaatgtaaaggcag

SEQ ID NO: 517001 - DNA, 17 bp, Homo sapiens
caaatgtgtatttttgt

SEQ ID NO: 517002 - DNA, 18 bp, Homo sapiens
caacattggagacatcac

SEQ ID NO: 517003 - DNA, 17 bp, Homo sapiens
caacccctcgcccagtc

SEQ ID NO: 517004 - DNA, 22 bp, Homo sapiens
caacccctcgcccagtcccagc

SEQ ID NO: 517005 - DNA, 12 bp, Homo sapiens
caacccctggac

SEQ ID NO: 517006 - DNA, 18 bp, Homo sapiens
caacccctggaccccagc

SEQ ID NO: 517007 - DNA, 22 bp, Homo sapiens
caacttataattacaatgcaca

SEQ ID NO: 517008 - DNA, 14 bp, Homo sapiens
caacttatttctga

SEQ ID NO: 517009 - DNA, 12 bp, Homo sapiens
caagaaaatttt

SEQ ID NO: 517010 - DNA, 22 bp, Homo sapiens
caagaaagagggagggaaatct

SEQ ID NO: 517011 - DNA, 16 bp, Homo sapiens
caagagatgggaatga

SEQ ID NO: 517012 - DNA, 18 bp, Homo sapiens
caagagggggtggagggg

SEQ ID NO: 517013 - DNA, 21 bp, Homo sapiens
caagagggggtggaggggtgt

SEQ ID NO: 517014 - DNA, 14 bp, Homo sapiens
caagagtggcccca

SEQ ID NO: 517015 - DNA, 16 bp, Homo sapiens
caagagtggccccacc

SEQ ID NO: 517016 - DNA, 17 bp, Homo sapiens
caagagtggccccacct

SEQ ID NO: 517017 - DNA, 20 bp, Homo sapiens
caagcacaatggtttcaaag

SEQ ID NO: 517018 - DNA, 14 bp, Homo sapiens
caagcagattccct

SEQ ID NO: 517019 - DNA, 15 bp, Homo sapiens
caagcctctgtcttt

SEQ ID NO: 517020 - DNA, 19 bp, Homo sapiens
caagcgccctggcccccac

SEQ ID NO: 517021 - DNA, 19 bp, Homo sapiens
caaggccacctcttcctgg

SEQ ID NO: 517022 - DNA, 22 bp, Homo sapiens
caaggccacctcttcctggccg

SEQ ID NO: 517023 - DNA, 18 bp, Homo sapiens
caagggactgaggcaagc

SEQ ID NO: 517024 - DNA, 22 bp, Homo sapiens
caagtaacagttgaagaaaaaa

SEQ ID NO: 517025 - DNA, 15 bp, Homo sapiens
caagtggggtgctgg

SEQ ID NO: 517026 - DNA, 19 bp, Homo sapiens
caagtggggtgctgggagg

SEQ ID NO: 517027 - DNA, 19 bp, Homo sapiens
caataaaagcccaggagcc

SEQ ID NO: 517028 - DNA, 22 bp, Homo sapiens
caataaaagcccaggagcccat

SEQ ID NO: 517029 - DNA, 19 bp, Homo sapiens
caatacactagttgtttct

SEQ ID NO: 517030 - DNA, 21 bp, Homo sapiens
caatcctaatttctcctccct

SEQ ID NO: 517031 - DNA, 18 bp, Homo sapiens
caatcgtgatagttatta

SEQ ID NO: 517032 - DNA, 23 bp, Homo sapiens
cacaaatgtgtatttttgttgca

SEQ ID NO: 517033 - DNA, 22 bp, Homo sapiens
cacaagtaacagttgaagaaaa

SEQ ID NO: 517034 - DNA, 12 bp, Homo sapiens
cacacagaaggg

SEQ ID NO: 517035 - DNA, 15 bp, Homo sapiens
cacagacaggacccc

SEQ ID NO: 517036 - DNA, 22 bp, Homo sapiens
cacagcctgcacttgggggctc

SEQ ID NO: 517037 - DNA, 20 bp, Homo sapiens
cacaggctgagtgcaggccc

SEQ ID NO: 517038 - DNA, 21 bp, Homo sapiens
cacaggctgagtgcaggccca

SEQ ID NO: 517039 - DNA, 18 bp, Homo sapiens
cacaggctgggctgggca

SEQ ID NO: 517040 - DNA, 16 bp, Homo sapiens
cacagggcctggccca

SEQ ID NO: 517041 - DNA, 18 bp, Homo sapiens
cacaggtttgttttttca

SEQ ID NO: 517042 - DNA, 12 bp, Homo sapiens
cacatctgcctt

SEQ ID NO: 517043 - DNA, 13 bp, Homo sapiens
cacatctgcctta

SEQ ID NO: 517044 - DNA, 12 bp, Homo sapiens
cacattccaaaa

SEQ ID NO: 517045 - DNA, 14 bp, Homo sapiens
cacattccatgacg

SEQ ID NO: 517046 - DNA, 19 bp, Homo sapiens
cacattccatgacgcagga

SEQ ID NO: 517047 - DNA, 21 bp, Homo sapiens
cacattgttttccagaagcct

SEQ ID NO: 517048 - DNA, 15 bp, Homo sapiens
caccatttccccagg

SEQ ID NO: 517049 - DNA, 18 bp, Homo sapiens
caccatttccccagggca

SEQ ID NO: 517050 - DNA, 19 bp, Homo sapiens
caccatttccccagggcac

SEQ ID NO: 517051 - DNA, 20 bp, Homo sapiens
caccatttccccagggcacg

SEQ ID NO: 517052 - DNA, 17 bp, Homo sapiens
caccatttggatcctgt

SEQ ID NO: 517053 - DNA, 16 bp, Homo sapiens
cacccaccgtggagga

SEQ ID NO: 517054 - DNA, 16 bp, Homo sapiens
caccccctgccctgca

SEQ ID NO: 517055 - DNA, 18 bp, Homo sapiens
caccccggggaccctgtg

SEQ ID NO: 517056 - DNA, 19 bp, Homo sapiens
caccccggggaccctgtga

SEQ ID NO: 517057 - DNA, 11 bp, Homo sapiens
cacccctgccc

SEQ ID NO: 517058 - DNA, 18 bp, Homo sapiens
caccccttctctcctccc

SEQ ID NO: 517059 - DNA, 21 bp, Homo sapiens
caccccttctctcctccccaa

SEQ ID NO: 517060 - DNA, 22 bp, Homo sapiens
cacctcatgcccaccccctgcc

SEQ ID NO: 517061 - DNA, 17 bp, Homo sapiens
cacctcctaaaaggccc

SEQ ID NO: 517062 - DNA, 17 bp, Homo sapiens
cacctcttcctggccgg

SEQ ID NO: 517063 - DNA, 17 bp, Homo sapiens
cacctggccctctctga

SEQ ID NO: 517064 - DNA, 19 bp, Homo sapiens
cacctggccctctctgaag

SEQ ID NO: 517065 - DNA, 20 bp, Homo sapiens
cacctggctgaggttcctct

SEQ ID NO: 517066 - DNA, 23 bp, Homo sapiens
cacctggctgaggttcctctgcc

SEQ ID NO: 517067 - DNA, 23 bp, Homo sapiens
cactacacctggctgaggttcct

SEQ ID NO: 517068 - DNA, 14 bp, Homo sapiens
cactctcagaggcc

SEQ ID NO: 517069 - DNA, 16 bp, Homo sapiens
cactctcagaggcccc

SEQ ID NO: 517070 - DNA, 22 bp, Homo sapiens
cactctcaggaaatgctgaccc

SEQ ID NO: 517071 - DNA, 12 bp, Homo sapiens
cactgaatctaa

SEQ ID NO: 517072 - DNA, 17 bp, Homo sapiens
cactgccaggccagcct

SEQ ID NO: 517073 - DNA, 21 bp, Homo sapiens
cactgccaggccagcctccga

SEQ ID NO: 517074 - DNA, 14 bp, Homo sapiens
cactgctctcacct

SEQ ID NO: 517075 - DNA, 16 bp, Homo sapiens
cactggaaaggggaga

SEQ ID NO: 517076 - DNA, 12 bp, Homo sapiens
cactgtaaaatg

SEQ ID NO: 517077 - DNA, 13 bp, Homo sapiens
cactgtaacctca

SEQ ID NO: 517078 - DNA, 22 bp, Homo sapiens
cactgtaacctcagtctacccc

SEQ ID NO: 517079 - DNA, 13 bp, Homo sapiens
cacttaaaagaaa

SEQ ID NO: 517080 - DNA, 19 bp, Homo sapiens
cacttgggggctcagcaag

SEQ ID NO: 517081 - DNA, 12 bp, Homo sapiens
cagaaattgcaa

SEQ ID NO: 517082 - DNA, 17 bp, Homo sapiens
cagaagctatgttttta

SEQ ID NO: 517083 - DNA, 19 bp, Homo sapiens
cagaaggggactgccacct

SEQ ID NO: 517084 - DNA, 21 bp, Homo sapiens
cagaaggggactgccacctcc

SEQ ID NO: 517085 - DNA, 15 bp, Homo sapiens
cagacaggacccctg

SEQ ID NO: 517086 - DNA, 20 bp, Homo sapiens
cagagaagtgacggttccta

SEQ ID NO: 517087 - DNA, 18 bp, Homo sapiens
cagagagaagagccccac

SEQ ID NO: 517088 - DNA, 19 bp, Homo sapiens
cagagagaagagccccact

SEQ ID NO: 517089 - DNA, 15 bp, Homo sapiens
cagagcaacccctgg

SEQ ID NO: 517090 - DNA, 21 bp, Homo sapiens
cagagcaacccctggacccca

SEQ ID NO: 517091 - DNA, 22 bp, Homo sapiens
cagagcaacccctggaccccag

SEQ ID NO: 517092 - DNA, 11 bp, Homo sapiens
cagaggcccca

SEQ ID NO: 517093 - DNA, 12 bp, Homo sapiens
cagatagagata

SEQ ID NO: 517094 - DNA, 21 bp, Homo sapiens
cagatagagatattttgggta

SEQ ID NO: 517095 - DNA, 23 bp, Homo sapiens
cagatatttttaacttaatggca

SEQ ID NO: 517096 - DNA, 12 bp, Homo sapiens
cagatcccaaga

SEQ ID NO: 517097 - DNA, 13 bp, Homo sapiens
cagatcccaagag

SEQ ID NO: 517098 - DNA, 13 bp, Homo sapiens
cctgcagttcccc

SEQ ID NO: 517099 - DNA, 19 bp, Homo sapiens
cctgccaggcacaggcagg

SEQ ID NO: 517100 - DNA, 15 bp, Homo sapiens
cctgccaggcagggg

SEQ ID NO: 517101 - DNA, 22 bp, Homo sapiens
cctgccaggcaggggtgggggt

SEQ ID NO: 517102 - DNA, 13 bp, Homo sapiens
cctgccccgcccc

SEQ ID NO: 517103 - DNA, 18 bp, Homo sapiens
cctgccccgcccccagtc

SEQ ID NO: 517104 - DNA, 13 bp, Homo sapiens
cctgccctgcacg

SEQ ID NO: 517105 - DNA, 13 bp, Homo sapiens
cctgcctctccgc

SEQ ID NO: 517106 - DNA, 13 bp, Homo sapiens
cctgcgtcctcct

SEQ ID NO: 517107 - DNA, 16 bp, Homo sapiens
cctgcgtcctcctcac

SEQ ID NO: 517108 - DNA, 20 bp, Homo sapiens
cctgctgtgattccactaca

SEQ ID NO: 517109 - DNA, 14 bp, Homo sapiens
cctgcttccaggaa

SEQ ID NO: 517110 - DNA, 20 bp, Homo sapiens
cctggaagcagtgcccaggt

SEQ ID NO: 517111 - DNA, 12 bp, Homo sapiens
cctggaccccag

SEQ ID NO: 517112 - DNA, 14 bp, Homo sapiens
cctggaccccagcc

SEQ ID NO: 517113 - DNA, 21 bp, Homo sapiens
cctggcccatgtatggccagg

SEQ ID NO: 517114 - DNA, 15 bp, Homo sapiens
cctggcccccacatg

SEQ ID NO: 517115 - DNA, 19 bp, Homo sapiens
cctggctccctcactctca

SEQ ID NO: 517116 - DNA, 21 bp, Homo sapiens
cctggctccctcactctcagg

SEQ ID NO: 517117 - DNA, 22 bp, Homo sapiens
cctggctccctcactctcagga

SEQ ID NO: 517118 - DNA, 22 bp, Homo sapiens
cctggctgaggttcctctgcct

SEQ ID NO: 517119 - DNA, 23 bp, Homo sapiens
cctggctgaggttcctctgcctg

SEQ ID NO: 517120 - DNA, 15 bp, Homo sapiens
cctggctgctgcccc

SEQ ID NO: 517121 - DNA, 15 bp, Homo sapiens
cctgggcctggctcc

SEQ ID NO: 517122 - DNA, 16 bp, Homo sapiens
cctgggcttggcctgc

SEQ ID NO: 517123 - DNA, 19 bp, Homo sapiens
cctgggcttggcctgctgt

SEQ ID NO: 517124 - DNA, 21 bp, Homo sapiens
cctgggcttggcctgctgtga

SEQ ID NO: 517125 - DNA, 12 bp, Homo sapiens
cctggggcatcc

SEQ ID NO: 517126 - DNA, 23 bp, Homo sapiens
cctgtgacatggtgcctgagagg

SEQ ID NO: 517127 - DNA, 13 bp, Homo sapiens
cctgtgtggagag

SEQ ID NO: 517128 - DNA, 20 bp, Homo sapiens
ccttaatttttgaaaagctg

SEQ ID NO: 517129 - DNA, 22 bp, Homo sapiens
ccttaatttttgaaaagctgct

SEQ ID NO: 517130 - DNA, 13 bp, Homo sapiens
ccttccttttccc

SEQ ID NO: 517131 - DNA, 17 bp, Homo sapiens
ccttccttttccctgct

SEQ ID NO: 517132 - DNA, 18 bp, Homo sapiens
ccttccttttccctgctt

SEQ ID NO: 517133 - DNA, 24 bp, Homo sapiens
ccttctcccctgcactgtaaaatg

SEQ ID NO: 517134 - DNA, 17 bp, Homo sapiens
ccttctctcctccccaa

SEQ ID NO: 517135 - DNA, 20 bp, Homo sapiens
ccttgccagctgctgagccg

SEQ ID NO: 517136 - DNA, 12 bp, Homo sapiens
ccttgcctcccc

SEQ ID NO: 517137 - DNA, 14 bp, Homo sapiens
ccttgcctccccat

SEQ ID NO: 517138 - DNA, 17 bp, Homo sapiens
ccttggttcttcctagt

SEQ ID NO: 517139 - DNA, 20 bp, Homo sapiens
ccttttgtgtaattttaaag

SEQ ID NO: 517140 - DNA, 13 bp, Homo sapiens
cgagagggagaga

SEQ ID NO: 517141 - DNA, 14 bp, Homo sapiens
cgagagggagagag

SEQ ID NO: 517142 - DNA, 21 bp, Homo sapiens
cgcagagaagtgacggttcct

SEQ ID NO: 517143 - DNA, 15 bp, Homo sapiens
cgccagcctcctctg

SEQ ID NO: 517144 - DNA, 16 bp, Homo sapiens
cgccagcctcctctgg

SEQ ID NO: 517145 - DNA, 12 bp, Homo sapiens
cgcccacttccc

SEQ ID NO: 517146 - DNA, 18 bp, Homo sapiens
cgcccctgagcccactgt

SEQ ID NO: 517147 - DNA, 17 bp, Homo sapiens
cgccctggcccccacat

SEQ ID NO: 517148 - DNA, 15 bp, Homo sapiens
cgctaaagagccctt

SEQ ID NO: 517149 - DNA, 21 bp, Homo sapiens
cgctaaagagcccttgcctcc

SEQ ID NO: 517150 - DNA, 22 bp, Homo sapiens
cgctaaagagcccttgcctccc

SEQ ID NO: 517151 - DNA, 17 bp, Homo sapiens
cgctgactacagggccg

SEQ ID NO: 517152 - DNA, 22 bp, Homo sapiens
cgctgtgagatggatgtatttg

SEQ ID NO: 517153 - DNA, 22 bp, Homo sapiens
cggatttattcccttttaaaga

SEQ ID NO: 517154 - DNA, 16 bp, Homo sapiens
cggcaataaaagccca

SEQ ID NO: 517155 - DNA, 19 bp, Homo sapiens
cggcaataaaagcccagga

SEQ ID NO: 517156 - DNA, 19 bp, Homo sapiens
cggcaggctcactgccagg

SEQ ID NO: 517157 - DNA, 20 bp, Homo sapiens
cggcaggctcactgccaggc

SEQ ID NO: 517158 - DNA, 23 bp, Homo sapiens
cggggtgagtccattctcccagg

SEQ ID NO: 517159 - DNA, 16 bp, Homo sapiens
cggttcctacacagga

SEQ ID NO: 517160 - DNA, 17 bp, Homo sapiens
cgtggaggaggaaggca

SEQ ID NO: 517161 - DNA, 19 bp, Homo sapiens
ctaaaataaataccaaaga

SEQ ID NO: 517162 - DNA, 16 bp, Homo sapiens
ctaaagagcccttgcc

SEQ ID NO: 517163 - DNA, 19 bp, Homo sapiens
ctaaagagcccttgcctcc

SEQ ID NO: 517164 - DNA, 23 bp, Homo sapiens
ctaaatagcccagatcccaagag

SEQ ID NO: 517165 - DNA, 22 bp, Homo sapiens
ctaagagaagttattttctaca

SEQ ID NO: 517166 - DNA, 15 bp, Homo sapiens
ctaatccccttctcc

SEQ ID NO: 517167 - DNA, 12 bp, Homo sapiens
ctacacctggct

SEQ ID NO: 517168 - DNA, 23 bp, Homo sapiens
ctacattataccgcagagtattt

SEQ ID NO: 517169 - DNA, 22 bp, Homo sapiens
ctacctaaaataaataccaaag

SEQ ID NO: 517170 - DNA, 20 bp, Homo sapiens
ctagaattgattttttttct

SEQ ID NO: 517171 - DNA, 23 bp, Homo sapiens
ctagcttctgcttttctgccctg

SEQ ID NO: 517172 - DNA, 19 bp, Homo sapiens
ctagctttagaccctgggt

SEQ ID NO: 517173 - DNA, 17 bp, Homo sapiens
ctatgacaatttttgct

SEQ ID NO: 517174 - DNA, 17 bp, Homo sapiens
ctatgtttttaaagtgt

SEQ ID NO: 517175 - DNA, 14 bp, Homo sapiens
ctattatgatgttt

SEQ ID NO: 517176 - DNA, 22 bp, Homo sapiens
ctcaaatccaggaccctgccag

SEQ ID NO: 517177 - DNA, 20 bp, Homo sapiens
ctcaatcctaatttctcctc

SEQ ID NO: 517178 - DNA, 23 bp, Homo sapiens
ctcaatcctaatttctcctccct

SEQ ID NO: 517179 - DNA, 12 bp, Homo sapiens
ctcacagacagg

SEQ ID NO: 517180 - DNA, 16 bp, Homo sapiens
ctcacagacaggaccc

SEQ ID NO: 517181 - DNA, 18 bp, Homo sapiens
ctcacagacaggacccct

SEQ ID NO: 517182 - DNA, 14 bp, Homo sapiens
ctcacctcatgccc

SEQ ID NO: 517183 - DNA, 10 bp, Homo sapiens
ctcactctca

SEQ ID NO: 517184 - DNA, 13 bp, Homo sapiens
ctcactgccaggc

SEQ ID NO: 517185 - DNA, 21 bp, Homo sapiens
ctcactgccaggccagcctcc

SEQ ID NO: 517186 - DNA, 17 bp, Homo sapiens
ctcagaccaggtggaat

SEQ ID NO: 517187 - DNA, 22 bp, Homo sapiens
ctcagaccaggtggaattactt

SEQ ID NO: 517188 - DNA, 13 bp, Homo sapiens
ctcagaggcccca

SEQ ID NO: 517189 - DNA, 23 bp, Homo sapiens
ctcagaggccccaataccccatg

SEQ ID NO: 517190 - DNA, 13 bp, Homo sapiens
ctcagcaaggcca

SEQ ID NO: 517191 - DNA, 16 bp, Homo sapiens
ctcagcaaggccacct

SEQ ID NO: 517192 - DNA, 19 bp, Homo sapiens
ctcaggaaatgctgaccca

SEQ ID NO: 517193 - DNA, 22 bp, Homo sapiens
ctcaggaaatgctgacccatgg

SEQ ID NO: 517194 - DNA, 19 bp, Homo sapiens
ctcatgatgcgcttcaaag

SEQ ID NO: 517195 - DNA, 16 bp, Homo sapiens
ctcatgcccaccccct

SEQ ID NO: 517196 - DNA, 12 bp, Homo sapiens
ctccaagcctct

SEQ ID NO: 517197 - DNA, 15 bp, Homo sapiens
ctccacatctgcctt

SEQ ID NO: 517198 - DNA, 16 bp, Homo sapiens
ctccatccatgtgttc

SEQ ID NO: 517199 - DNA, 17 bp, Homo sapiens
ctcccaggtaccagctg

SEQ ID NO: 517200 - DNA, 17 bp, Homo sapiens
ctccccatttcccatct

SEQ ID NO: 517201 - DNA, 19 bp, Homo sapiens
ctcccctgcactgtaaaat

SEQ ID NO: 517202 - DNA, 14 bp, Homo sapiens
ctccgccagcctcc

SEQ ID NO: 517203 - DNA, 15 bp, Homo sapiens
ctccgccagcctcct

SEQ ID NO: 517204 - DNA, 14 bp, Homo sapiens
gaatctcttttctg

SEQ ID NO: 517205 - DNA, 14 bp, Homo sapiens
gaatgaggtgggag

SEQ ID NO: 517206 - DNA, 22 bp, Homo sapiens
gaatgaggtgggaggtggaaga

SEQ ID NO: 517207 - DNA, 14 bp, Homo sapiens
gaatgtaaatttgt

SEQ ID NO: 517208 - DNA, 16 bp, Homo sapiens
gaattttattgaaagc

SEQ ID NO: 517209 - DNA, 11 bp, Homo sapiens
gaatttttgcc

SEQ ID NO: 517210 - DNA, 21 bp, Homo sapiens
gaattttttttaacattcctc

SEQ ID NO: 517211 - DNA, 18 bp, Homo sapiens
gacaagagatgggaatga

SEQ ID NO: 517212 - DNA, 15 bp, Homo sapiens
gacagcttgagccgg

SEQ ID NO: 517213 - DNA, 22 bp, Homo sapiens
gacagcttgagccgggcccctg

SEQ ID NO: 517214 - DNA, 14 bp, Homo sapiens
gacagtctcaccat

SEQ ID NO: 517215 - DNA, 14 bp, Homo sapiens
gacatggtgcctga

SEQ ID NO: 517216 - DNA, 18 bp, Homo sapiens
gacatggtgcctgagagg

SEQ ID NO: 517217 - DNA, 23 bp, Homo sapiens
gacatggtgcctgagaggcaggc

SEQ ID NO: 517218 - DNA, 14 bp, Homo sapiens
gaccacaaaagagg

SEQ ID NO: 517219 - DNA, 12 bp, Homo sapiens
gaccagcccacg

SEQ ID NO: 517220 - DNA, 16 bp, Homo sapiens
gaccagcccacgctga

SEQ ID NO: 517221 - DNA, 20 bp, Homo sapiens
gaccatgctgtctggcacag

SEQ ID NO: 517222 - DNA, 22 bp, Homo sapiens
gaccatgctgtctggcacagcc

SEQ ID NO: 517223 - DNA, 23 bp, Homo sapiens
gaccatgctgtctggcacagcct

SEQ ID NO: 517224 - DNA, 15 bp, Homo sapiens
gacccagtggcaggg

SEQ ID NO: 517225 - DNA, 16 bp, Homo sapiens
gacccagtggcagggc

SEQ ID NO: 517226 - DNA, 19 bp, Homo sapiens
gacccagtggcagggcaca

SEQ ID NO: 517227 - DNA, 23 bp, Homo sapiens
gacccagtggcagggcacagggc

SEQ ID NO: 517228 - DNA, 14 bp, Homo sapiens
gacccatgggcagg

SEQ ID NO: 517229 - DNA, 18 bp, Homo sapiens
gacccatgggcaggagac

SEQ ID NO: 517230 - DNA, 20 bp, Homo sapiens
gacccatgggcaggagactg

SEQ ID NO: 517231 - DNA, 20 bp, Homo sapiens
gacccctgcagttcccctgg

SEQ ID NO: 517232 - DNA, 12 bp, Homo sapiens
gaccctgccagg

SEQ ID NO: 517233 - DNA, 19 bp, Homo sapiens
gaccctgccaggcacaggc

SEQ ID NO: 517234 - DNA, 22 bp, Homo sapiens
gaccctgccaggcacaggcagg

SEQ ID NO: 517235 - DNA, 17 bp, Homo sapiens
gaccctgggtgggctct

SEQ ID NO: 517236 - DNA, 20 bp, Homo sapiens
gaccctgtgacatggtgcct

SEQ ID NO: 517237 - DNA, 15 bp, Homo sapiens
gacctgccaggcagg

SEQ ID NO: 517238 - DNA, 16 bp, Homo sapiens
gacctgccaggcaggg

SEQ ID NO: 517239 - DNA, 20 bp, Homo sapiens
gacctgccaggcaggggtgg

SEQ ID NO: 517240 - DNA, 21 bp, Homo sapiens
gacctgccaggcaggggtggg

SEQ ID NO: 517241 - DNA, 16 bp, Homo sapiens
gacggttcctacacag

SEQ ID NO: 517242 - DNA, 18 bp, Homo sapiens
gacggttcctacacagga

SEQ ID NO: 517243 - DNA, 21 bp, Homo sapiens
gacggttcctacacaggacag

SEQ ID NO: 517244 - DNA, 22 bp, Homo sapiens
gactattcttgatgtaaaatct

SEQ ID NO: 517245 - DNA, 18 bp, Homo sapiens
gactctaaatagcccaga

SEQ ID NO: 517246 - DNA, 22 bp, Homo sapiens
gactctaaatagcccagatccc

SEQ ID NO: 517247 - DNA, 18 bp, Homo sapiens
gactgattccttctctgg

SEQ ID NO: 517248 - DNA, 12 bp, Homo sapiens
gactgccacctc

SEQ ID NO: 517249 - DNA, 13 bp, Homo sapiens
gactgccagctct

SEQ ID NO: 517250 - DNA, 14 bp, Homo sapiens
gactgccagctctt

SEQ ID NO: 517251 - DNA, 15 bp, Homo sapiens
gactgccagctcttc

SEQ ID NO: 517252 - DNA, 18 bp, Homo sapiens
gactgccagctcttccta

SEQ ID NO: 517253 - DNA, 19 bp, Homo sapiens
gactgccagctcttcctag

SEQ ID NO: 517254 - DNA, 17 bp, Homo sapiens
gactgctcctgagcccc

SEQ ID NO: 517255 - DNA, 16 bp, Homo sapiens
gactgtggagactgct

SEQ ID NO: 517256 - DNA, 14 bp, Homo sapiens
gactttttctgtgc

SEQ ID NO: 517257 - DNA, 20 bp, Homo sapiens
gagaagaaaggtgagtttga

SEQ ID NO: 517258 - DNA, 18 bp, Homo sapiens
gagaagtgacggttccta

SEQ ID NO: 517259 - DNA, 19 bp, Homo sapiens
gagactgctcctgagcccc

SEQ ID NO: 517260 - DNA, 20 bp, Homo sapiens
gagactgtggagactgctcc

SEQ ID NO: 517261 - DNA, 21 bp, Homo sapiens
gagactgtggagactgctcct

SEQ ID NO: 517262 - DNA, 14 bp, Homo sapiens
gagagagagagagg

SEQ ID NO: 517263 - DNA, 14 bp, Homo sapiens
gagagcctgctggc

SEQ ID NO: 517264 - DNA, 15 bp, Homo sapiens
gagaggacagcttga

SEQ ID NO: 517265 - DNA, 21 bp, Homo sapiens
gagaggcaggcatagaggctt

SEQ ID NO: 517266 - DNA, 14 bp, Homo sapiens
gagagggagagaga

SEQ ID NO: 517267 - DNA, 16 bp, Homo sapiens
gagaggggaggccaag

SEQ ID NO: 517268 - DNA, 20 bp, Homo sapiens
gagatgggaatgaggtggga

SEQ ID NO: 517269 - DNA, 12 bp, Homo sapiens
gagccccactct

SEQ ID NO: 517270 - DNA, 16 bp, Homo sapiens
gagccccactctcaga

SEQ ID NO: 517271 - DNA, 19 bp, Homo sapiens
gagccccactctcagaggc

SEQ ID NO: 517272 - DNA, 20 bp, Homo sapiens
gagccccactctcagaggcc

SEQ ID NO: 517273 - DNA, 22 bp, Homo sapiens
gagcccccagcttccagcagga

SEQ ID NO: 517274 - DNA, 13 bp, Homo sapiens
gagcctgctggca

SEQ ID NO: 517275 - DNA, 15 bp, Homo sapiens
gagcctgctggcacc

SEQ ID NO: 517276 - DNA, 15 bp, Homo sapiens
gaggacagcttgagc

SEQ ID NO: 517277 - DNA, 18 bp, Homo sapiens
gaggacagcttgagccgg

SEQ ID NO: 517278 - DNA, 13 bp, Homo sapiens
gaggaggaaggca

SEQ ID NO: 517279 - DNA, 17 bp, Homo sapiens
gaggagggagagggagg

SEQ ID NO: 517280 - DNA, 11 bp, Homo sapiens
gaggccacctc

SEQ ID NO: 517281 - DNA, 13 bp, Homo sapiens
gaggcttcctgcg

SEQ ID NO: 517282 - DNA, 21 bp, Homo sapiens
gaggcttcctgcgtcctcctc

SEQ ID NO: 517283 - DNA, 20 bp, Homo sapiens
gaggcttctccgccagcctc

SEQ ID NO: 517284 - DNA, 21 bp, Homo sapiens
gaggcttgctgaacatggata

SEQ ID NO: 517285 - DNA, 23 bp, Homo sapiens
gagggacagtctcaccatttccc

SEQ ID NO: 517286 - DNA, 13 bp, Homo sapiens
gagggagagagag

SEQ ID NO: 517287 - DNA, 16 bp, Homo sapiens
gagggagagagagaga

SEQ ID NO: 517288 - DNA, 13 bp, Homo sapiens
gagggcctgggcc

SEQ ID NO: 517289 - DNA, 20 bp, Homo sapiens
gagggcctgggcctggctcc

SEQ ID NO: 517290 - DNA, 21 bp, Homo sapiens
gagggcttcctctagaagcca

SEQ ID NO: 517291 - DNA, 16 bp, Homo sapiens
gaggggactcaccatg

SEQ ID NO: 517292 - DNA, 13 bp, Homo sapiens
gagggggtggagg

SEQ ID NO: 517293 - DNA, 14 bp, Homo sapiens
gagggggtggaggg

SEQ ID NO: 517294 - DNA, 14 bp, Homo sapiens
gaggggtgtggcag

SEQ ID NO: 517295 - DNA, 17 bp, Homo sapiens
gaggggtgtggcagtgg

SEQ ID NO: 517296 - DNA, 18 bp, Homo sapiens
gaggggtgtggcagtggt

SEQ ID NO: 517297 - DNA, 13 bp, Homo sapiens
gaggtggaagaag

SEQ ID NO: 517298 - DNA, 19 bp, Homo sapiens
gaggtggaagaagggagaa

SEQ ID NO: 517299 - DNA, 17 bp, Homo sapiens
gaggtgttattttcaat

SEQ ID NO: 517300 - DNA, 17 bp, Homo sapiens
gaggttcctctgcctgc

SEQ ID NO: 517301 - DNA, 18 bp, Homo sapiens
gaggttcctctgcctgcc

SEQ ID NO: 517302 - DNA, 19 bp, Homo sapiens
gaggttcctctgcctgccc

SEQ ID NO: 517303 - DNA, 15 bp, Homo sapiens
gaggttgaagccaag

SEQ ID NO: 517304 - DNA, 13 bp, Homo sapiens
gagtagttttcta

SEQ ID NO: 517305 - DNA, 21 bp, Homo sapiens
gagtatgttcttgaagaaagg

SEQ ID NO: 517306 - DNA, 11 bp, Homo sapiens
gagtattcagt

SEQ ID NO: 517307 - DNA, 16 bp, Homo sapiens
gagtctcaaaatcaac

SEQ ID NO: 517308 - DNA, 15 bp, Homo sapiens
gagtgagaggggagg

SEQ ID NO: 517309 - DNA, 13 bp, Homo sapiens
gagtgcaggccca

SEQ ID NO: 517310 - DNA, 17 bp, Homo sapiens
gagtggccccacctggc

SEQ ID NO: 517311 - DNA, 13 bp, Homo sapiens
gatacatgttgta

SEQ ID NO: 517312 - DNA, 22 bp, Homo sapiens
gatagggcggcaaatgccaaag

SEQ ID NO: 517313 - DNA, 15 bp, Homo sapiens
gatatgtaaattaaa

SEQ ID NO: 517314 - DNA, 22 bp, Homo sapiens
gatattttcatatttaaagcca

SEQ ID NO: 517315 - DNA, 22 bp, Homo sapiens
gatcccaagagattatgtaact

SEQ ID NO: 517316 - DNA, 19 bp, Homo sapiens
gatcctgtgtggagaggga

SEQ ID NO: 517317 - DNA, 20 bp, Homo sapiens
gatcctgtgtggagagggaa

SEQ ID NO: 517318 - DNA, 23 bp, Homo sapiens
gatgccccctaatccccttctcc

SEQ ID NO: 517319 - DNA, 13 bp, Homo sapiens
gatggatgtattt

SEQ ID NO: 517320 - DNA, 13 bp, Homo sapiens
gatgggcctgagt

SEQ ID NO: 517321 - DNA, 13 bp, Homo sapiens
gatgtaaaatctt

SEQ ID NO: 517322 - DNA, 16 bp, Homo sapiens
gatgtaaaatcttgtc

SEQ ID NO: 517323 - DNA, 23 bp, Homo sapiens
gatgtactcttatatttttctgg

SEQ ID NO: 517324 - DNA, 22 bp, Homo sapiens
gatgtttgtgatggtctctggt

SEQ ID NO: 517325 - DNA, 14 bp, Homo sapiens
gatgtttttctgtg

SEQ ID NO: 517326 - DNA, 14 bp, Homo sapiens
gattatgggtcaca

SEQ ID NO: 517327 - DNA, 17 bp, Homo sapiens
gattatgggtcacagga

SEQ ID NO: 517328 - DNA, 18 bp, Homo sapiens
gattatgggtcacaggaa

SEQ ID NO: 517329 - DNA, 17 bp, Homo sapiens
gattcaggcagactggt

SEQ ID NO: 517330 - DNA, 17 bp, Homo sapiens
gattccactacacctgg

SEQ ID NO: 517331 - DNA, 21 bp, Homo sapiens
gattccactacacctggctga

SEQ ID NO: 517332 - DNA, 15 bp, Homo sapiens
gattgagttgtaaag

SEQ ID NO: 517333 - DNA, 21 bp, Homo sapiens
gattttttgaggccagtaatt

SEQ ID NO: 517334 - DNA, 16 bp, Homo sapiens
gattttttttctctct

SEQ ID NO: 517335 - DNA, 21 bp, Homo sapiens
gcaaaactatgacaatttttg

SEQ ID NO: 517336 - DNA, 14 bp, Homo sapiens
gcaaacgctaaaga

SEQ ID NO: 517337 - DNA, 12 bp, Homo sapiens
gcaaatgccaaa

SEQ ID NO: 517338 - DNA, 20 bp, Homo sapiens
gcaaggccacctcttcctgg

SEQ ID NO: 517339 - DNA, 23 bp, Homo sapiens
gcacaatggtttcaaagaaagac

SEQ ID NO: 517340 - DNA, 13 bp, Homo sapiens
gcacaggctgagt

SEQ ID NO: 517341 - DNA, 18 bp, Homo sapiens
gcacaggctgagtgcagg

SEQ ID NO: 517342 - DNA, 23 bp, Homo sapiens
gcacaggctgagtgcaggcccac

SEQ ID NO: 517343 - DNA, 14 bp, Homo sapiens
gcacagggcctggc

SEQ ID NO: 517344 - DNA, 16 bp, Homo sapiens
gcacagggcctggccc

SEQ ID NO: 517345 - DNA, 17 bp, Homo sapiens
gcacagggcctggccca

SEQ ID NO: 517346 - DNA, 15 bp, Homo sapiens
gcacaggtttgtttt

SEQ ID NO: 517347 - DNA, 19 bp, Homo sapiens
gcacatagatgttgtagaa

SEQ ID NO: 517348 - DNA, 20 bp, Homo sapiens
gcacccaccgtggaggagga

SEQ ID NO: 517349 - DNA, 12 bp, Homo sapiens
gcaccccttctc

SEQ ID NO: 517350 - DNA, 17 bp, Homo sapiens
gcaccccttctctcctc

SEQ ID NO: 517351 - DNA, 18 bp, Homo sapiens
gcaccccttctctcctcc

SEQ ID NO: 517352 - DNA, 19 bp, Homo sapiens
gcaccccttctctcctccc

SEQ ID NO: 517353 - DNA, 13 bp, Homo sapiens
gcacgtcatggga

SEQ ID NO: 517354 - DNA, 13 bp, Homo sapiens
gcactgctctcac

SEQ ID NO: 517355 - DNA, 14 bp, Homo sapiens
gcactgtaaaatgt

SEQ ID NO: 517356 - DNA, 18 bp, Homo sapiens
gcacttgggggctcagca

SEQ ID NO: 517357 - DNA, 21 bp, Homo sapiens
gcacttgggggctcagcaagg

SEQ ID NO: 517358 - DNA, 21 bp, Homo sapiens
gcagagaagtgacggttccta

SEQ ID NO: 517359 - DNA, 12 bp, Homo sapiens
gcagagtatttg

SEQ ID NO: 517360 - DNA, 13 bp, Homo sapiens
gcaggaccagccc

SEQ ID NO: 517361 - DNA, 16 bp, Homo sapiens
gcaggcccaccctgct

SEQ ID NO: 517362 - DNA, 20 bp, Homo sapiens
gcaggcccaccctgcttggc

SEQ ID NO: 517363 - DNA, 22 bp, Homo sapiens
gcaggctcactgccaggccagc

SEQ ID NO: 517364 - DNA, 14 bp, Homo sapiens
gcagggcaggacca

SEQ ID NO: 517365 - DNA, 20 bp, Homo sapiens
gcaggggtgggggtggaggc

SEQ ID NO: 517366 - DNA, 14 bp, Homo sapiens
gcagtcactggagg

SEQ ID NO: 517367 - DNA, 24 bp, Homo sapiens
gcagtggttttggcaaacgctaaa

SEQ ID NO: 517368 - DNA, 23 bp, Homo sapiens
gcataacaaaggcaagactctgc

SEQ ID NO: 517369 - DNA, 22 bp, Homo sapiens
gcatagaggcttctccgccagc

SEQ ID NO: 517370 - DNA, 21 bp, Homo sapiens
gcatccatggggtctctcaca

SEQ ID NO: 517371 - DNA, 14 bp, Homo sapiens
gcatctatctcatc

SEQ ID NO: 517372 - DNA, 13 bp, Homo sapiens
gccaaacacacag

SEQ ID NO: 517373 - DNA, 18 bp, Homo sapiens
gccaagagtggccccacc

SEQ ID NO: 517374 - DNA, 21 bp, Homo sapiens
gccaagagtggccccacctgg

SEQ ID NO: 517375 - DNA, 18 bp, Homo sapiens
gccaagggaaaggggtgc

SEQ ID NO: 517376 - DNA, 13 bp, Homo sapiens
gccaagtggggtg

SEQ ID NO: 517377 - DNA, 18 bp, Homo sapiens
gccaagtggggtgctggg

SEQ ID NO: 517378 - DNA, 22 bp, Homo sapiens
gccacaagggactgaggcaagc

SEQ ID NO: 517379 - DNA, 18 bp, Homo sapiens
gccacctccccttgccag

SEQ ID NO: 517380 - DNA, 21 bp, Homo sapiens
gccacctcctaaaaggcccag

SEQ ID NO: 517381 - DNA, 15 bp, Homo sapiens
gccacctcttcctgg

SEQ ID NO: 517382 - DNA, 19 bp, Homo sapiens
gccagccaaacacacagaa

SEQ ID NO: 517383 - DNA, 20 bp, Homo sapiens
gccagccaaacacacagaag

SEQ ID NO: 517384 - DNA, 18 bp, Homo sapiens
gccagcctccgagaggga

SEQ ID NO: 517385 - DNA, 20 bp, Homo sapiens
gccagcctccgagagggaga

SEQ ID NO: 517386 - DNA, 13 bp, Homo sapiens
gccagcctcctct

SEQ ID NO: 517387 - DNA, 16 bp, Homo sapiens
gccagcctcctctgga

SEQ ID NO: 517388 - DNA, 19 bp, Homo sapiens
gccagctcttcctagctgg

SEQ ID NO: 517389 - DNA, 17 bp, Homo sapiens
gccaggcacaggcaggg

SEQ ID NO: 517390 - DNA, 19 bp, Homo sapiens
gccaggcacaggcagggca

SEQ ID NO: 517391 - DNA, 14 bp, Homo sapiens
gccaggccagcctc

SEQ ID NO: 517392 - DNA, 18 bp, Homo sapiens
gccagtctcctataccca

SEQ ID NO: 517393 - DNA, 22 bp, Homo sapiens
gccagtctcctatacccagcag

SEQ ID NO: 517394 - DNA, 24 bp, Homo sapiens
gccagtctcctatacccagcagag

SEQ ID NO: 517395 - DNA, 13 bp, Homo sapiens
gcccaaaacagtt

SEQ ID NO: 517396 - DNA, 19 bp, Homo sapiens
gcccaccccctgccctgca

SEQ ID NO: 517397 - DNA, 22 bp, Homo sapiens
gcccaccccctgccctgcacgt

SEQ ID NO: 517398 - DNA, 21 bp, Homo sapiens
gcccaccctgcttggcccagg

SEQ ID NO: 517399 - DNA, 15 bp, Homo sapiens
gcccacgctgactac

SEQ ID NO: 517400 - DNA, 19 bp, Homo sapiens
gcccagagagaagagcccc

SEQ ID NO: 517401 - DNA, 16 bp, Homo sapiens
gcccagatcccaagag

SEQ ID NO: 517402 - DNA, 13 bp, Homo sapiens
gcccagtcccagc

SEQ ID NO: 517403 - DNA, 18 bp, Homo sapiens
gcccagtcccagcagcca

SEQ ID NO: 517404 - DNA, 17 bp, Homo sapiens
gcccatgtatggccagg

SEQ ID NO: 517405 - DNA, 18 bp, Homo sapiens
gcccatttggagggcctg

SEQ ID NO: 517406 - DNA, 14 bp, Homo sapiens
gccccactctcaga

SEQ ID NO: 517407 - DNA, 17 bp, Homo sapiens
gccccactctcagaggc

SEQ ID NO: 517408 - DNA, 19 bp, Homo sapiens
gcccccagcttccagcagg

SEQ ID NO: 517409 - DNA, 13 bp, Homo sapiens
gccccgtctcagg

SEQ ID NO: 517410 - DNA, 13 bp, Homo sapiens
gcccctgagccca

SEQ ID NO: 517411 - DNA, 15 bp, Homo sapiens
gcccctgagcccact

SEQ ID NO: 517412 - DNA, 22 bp, Homo sapiens
gcccctgggcttggcctgctgt

SEQ ID NO: 517413 - DNA, 22 bp, Homo sapiens
gccctctctgaaggaggccacc

SEQ ID NO: 517414 - DNA, 15 bp, Homo sapiens
gccctgcctctccgc

SEQ ID NO: 517415 - DNA, 10 bp, Homo sapiens
gccctggctg

SEQ ID NO: 517416 - DNA, 12 bp, Homo sapiens
gccctggctgct

SEQ ID NO: 517417 - DNA, 15 bp, Homo sapiens
gccctggctgctgcc

SEQ ID NO: 517418 - DNA, 23 bp, Homo sapiens
gccgccggcaataaaagcccagg

SEQ ID NO: 517419 - DNA, 18 bp, Homo sapiens
gccggcaataaaagccca

SEQ ID NO: 517420 - DNA, 21 bp, Homo sapiens
gccggcaataaaagcccagga

SEQ ID NO: 517421 - DNA, 12 bp, Homo sapiens
gccgggcccctg

SEQ ID NO: 517422 - DNA, 16 bp, Homo sapiens
gccggtgtgggggccc

SEQ ID NO: 517423 - DNA, 15 bp, Homo sapiens
gcctcaaatccagga

SEQ ID NO: 517424 - DNA, 19 bp, Homo sapiens
gcctcaaatccaggaccct

SEQ ID NO: 517425 - DNA, 18 bp, Homo sapiens
gcctccgagagggagaga

SEQ ID NO: 517426 - DNA, 20 bp, Homo sapiens
gcctctccgcccctgagccc

SEQ ID NO: 517427 - DNA, 13 bp, Homo sapiens
gcctctgtctttt

SEQ ID NO: 517428 - DNA, 14 bp, Homo sapiens
gcctgagaggcagg

SEQ ID NO: 517429 - DNA, 15 bp, Homo sapiens
gcctgagaggcaggc

SEQ ID NO: 517430 - DNA, 17 bp, Homo sapiens
tatgatgttttgcaaag

SEQ ID NO: 517431 - DNA, 23 bp, Homo sapiens
tatggaagaaagagttgtcctga

SEQ ID NO: 517432 - DNA, 15 bp, Homo sapiens
tatgggctgttctgt

SEQ ID NO: 517433 - DNA, 17 bp, Homo sapiens
tatgggctgttctgttt

SEQ ID NO: 517434 - DNA, 22 bp, Homo sapiens
tatgggctgttctgtttcctgt

SEQ ID NO: 517435 - DNA, 23 bp, Homo sapiens
tatgggctgttctgtttcctgtg

SEQ ID NO: 517436 - DNA, 19 bp, Homo sapiens
tatggggggggcaagaaag

SEQ ID NO: 517437 - DNA, 14 bp, Homo sapiens
tatgggtcacagga

SEQ ID NO: 517438 - DNA, 21 bp, Homo sapiens
tatggtattatatctctgtat

SEQ ID NO: 517439 - DNA, 24 bp, Homo sapiens
tatgtaactcctccatccatgtgt

SEQ ID NO: 517440 - DNA, 14 bp, Homo sapiens
tattaactgccaaa

SEQ ID NO: 517441 - DNA, 22 bp, Homo sapiens
tattatatctctgtatgccatt

SEQ ID NO: 517442 - DNA, 15 bp, Homo sapiens
tattatgtcttattt

SEQ ID NO: 517443 - DNA, 19 bp, Homo sapiens
tattatgtcttattttatt

SEQ ID NO: 517444 - DNA, 22 bp, Homo sapiens
tattcagaaaatagagcatcat

SEQ ID NO: 517445 - DNA, 14 bp, Homo sapiens
tattcttgatgtaa

SEQ ID NO: 517446 - DNA, 12 bp, Homo sapiens
tattctttccat

SEQ ID NO: 517447 - DNA, 17 bp, Homo sapiens
tattctttccatgacac

SEQ ID NO: 517448 - DNA, 15 bp, Homo sapiens
tattgctatgttctt

SEQ ID NO: 517449 - DNA, 18 bp, Homo sapiens
tattggtgctttgtgtct

SEQ ID NO: 517450 - DNA, 19 bp, Homo sapiens
tattggtgctttgtgtcta

SEQ ID NO: 517451 - DNA, 14 bp, Homo sapiens
tatttaaagccaaa

SEQ ID NO: 517452 - DNA, 16 bp, Homo sapiens
tatttaaagccaaatg

SEQ ID NO: 517453 - DNA, 19 bp, Homo sapiens
tatttaaagccaaatgtaa

SEQ ID NO: 517454 - DNA, 15 bp, Homo sapiens
tatttatttcagcat

SEQ ID NO: 517455 - DNA, 22 bp, Homo sapiens
tatttctaaataaaaaaattaa

SEQ ID NO: 517456 - DNA, 20 bp, Homo sapiens
tatttgtgaattctgggatt

SEQ ID NO: 517457 - DNA, 22 bp, Homo sapiens
tattttcaagatacatgttgta

SEQ ID NO: 517458 - DNA, 22 bp, Homo sapiens
tattttgggtatattttcaaga

SEQ ID NO: 517459 - DNA, 15 bp, Homo sapiens
tatttttatcccagg

SEQ ID NO: 517460 - DNA, 20 bp, Homo sapiens
tatttttctgggcttttcct

SEQ ID NO: 517461 - DNA, 14 bp, Homo sapiens
gggcctggcccatg

SEQ ID NO: 517462 - DNA, 15 bp, Homo sapiens
gggcctggctccctc

SEQ ID NO: 517463 - DNA, 17 bp, Homo sapiens
gggcctggctccctcac

SEQ ID NO: 517464 - DNA, 15 bp, Homo sapiens
gggctcagcaaggcc

SEQ ID NO: 517465 - DNA, 19 bp, Homo sapiens
gggctcagcaaggccacct

SEQ ID NO: 517466 - DNA, 21 bp, Homo sapiens
gggctcagcaaggccacctct

SEQ ID NO: 517467 - DNA, 19 bp, Homo sapiens
gggctcccgcctccaaccc

SEQ ID NO: 517468 - DNA, 16 bp, Homo sapiens
gggctgggcactgctc

SEQ ID NO: 517469 - DNA, 17 bp, Homo sapiens
gggctgggcactgctct

SEQ ID NO: 517470 - DNA, 21 bp, Homo sapiens
gggctgggggatgggcctgag

SEQ ID NO: 517471 - DNA, 17 bp, Homo sapiens
gggcttggcctgctgtg

SEQ ID NO: 517472 - DNA, 14 bp, Homo sapiens
ggggactgccacct

SEQ ID NO: 517473 - DNA, 17 bp, Homo sapiens
ggggactgccacctccc

SEQ ID NO: 517474 - DNA, 16 bp, Homo sapiens
ggggccccgtctcagg

SEQ ID NO: 517475 - DNA, 16 bp, Homo sapiens
gggggctcagcaaggc

SEQ ID NO: 517476 - DNA, 20 bp, Homo sapiens
gggggctcagcaaggccacc

SEQ ID NO: 517477 - DNA, 17 bp, Homo sapiens
ggggtctctcacagaca

SEQ ID NO: 517478 - DNA, 19 bp, Homo sapiens
ggggtctctcacagacagg

SEQ ID NO: 517479 - DNA, 23 bp, Homo sapiens
ggggtctctcacagacaggaccc

SEQ ID NO: 517480 - DNA, 18 bp, Homo sapiens
gggtatattttcaagata

SEQ ID NO: 517481 - DNA, 15 bp, Homo sapiens
gggtgctgggaggag

SEQ ID NO: 517482 - DNA, 21 bp, Homo sapiens
gggtgcttttatagaggctag

SEQ ID NO: 517483 - DNA, 13 bp, Homo sapiens
ggtcactggaaag

SEQ ID NO: 517484 - DNA, 23 bp, Homo sapiens
ggtctccttaattaatgtacaca

SEQ ID NO: 517485 - DNA, 21 bp, Homo sapiens
ggtctctcacagacaggaccc

SEQ ID NO: 517486 - DNA, 15 bp, Homo sapiens
ggtgaccacaaaaga

SEQ ID NO: 517487 - DNA, 21 bp, Homo sapiens
ggtgagtttgagctgccttcc

SEQ ID NO: 517488 - DNA, 19 bp, Homo sapiens
ggtgcctgagaggcaggca

SEQ ID NO: 517489 - DNA, 18 bp, Homo sapiens
tctccgccagcctcctct

SEQ ID NO: 517490 - DNA, 20 bp, Homo sapiens
tctccgccagcctcctctgg

SEQ ID NO: 517491 - DNA, 18 bp, Homo sapiens
tctccgcccctgagccca

SEQ ID NO: 517492 - DNA, 20 bp, Homo sapiens
tctccgcccctgagcccact

SEQ ID NO: 517493 - DNA, 15 bp, Homo sapiens
tctctgaaggaggcc

SEQ ID NO: 517494 - DNA, 18 bp, Homo sapiens
tctctgaaggaggccacc

SEQ ID NO: 517495 - DNA, 22 bp, Homo sapiens
tctcttatggtattatatctct

SEQ ID NO: 517496 - DNA, 17 bp, Homo sapiens
tctgaaggaggccacct

SEQ ID NO: 517497 - DNA, 20 bp, Homo sapiens
tctgaaggaggccacctcct

SEQ ID NO: 517498 - DNA, 17 bp, Homo sapiens
tctgactttttctgtgc

SEQ ID NO: 517499 - DNA, 23 bp, Homo sapiens
tctgagttgttaccccaagcgcc

SEQ ID NO: 517500 - DNA, 18 bp, Homo sapiens
tctgcaccccttctctcc

SEQ ID NO: 517501 - DNA, 15 bp, Homo sapiens
tctgccctggctgct

SEQ ID NO: 517502 - DNA, 16 bp, Homo sapiens
tctgccctggctgctg

SEQ ID NO: 517503 - DNA, 14 bp, Homo sapiens
tctgcctgccccgc

SEQ ID NO: 517504 - DNA, 19 bp, Homo sapiens
tctgccttaatttttgaaa

SEQ ID NO: 517505 - DNA, 15 bp, Homo sapiens
tctgcttttctgccc

SEQ ID NO: 517506 - DNA, 19 bp, Homo sapiens
tctgcttttctgccctggc

SEQ ID NO: 517507 - DNA, 20 bp, Homo sapiens
tctgcttttctgccctggct

SEQ ID NO: 517508 - DNA, 21 bp, Homo sapiens
tctggaagggcactatatttt

SEQ ID NO: 517509 - DNA, 21 bp, Homo sapiens
tctggacggcaggctcactgc

SEQ ID NO: 517510 - DNA, 16 bp, Homo sapiens
tctgttatttatttca

SEQ ID NO: 517511 - DNA, 13 bp, Homo sapiens
tctgtttcctgtg

SEQ ID NO: 517512 - DNA, 14 bp, Homo sapiens
tcttatatttttct

SEQ ID NO: 517513 - DNA, 16 bp, Homo sapiens
tcttcaaaaagcattt

SEQ ID NO: 517514 - DNA, 17 bp, Homo sapiens
tcttctgttatttattt

SEQ ID NO: 517515 - DNA, 14 bp, Homo sapiens
tcttgatgtaaaat

SEQ ID NO: 517516 - DNA, 16 bp, Homo sapiens
tcttgatgtaaaatct

SEQ ID NO: 517517 - DNA, 22 bp, Homo sapiens
tcttggtatgggctgttctgtt

SEQ ID NO: 517518 - DNA, 15 bp, Homo sapiens
tcttgtcatgtgtat

SEQ ID NO: 517519 - DNA, 17 bp, Homo sapiens
tctttcaacttatttct

SEQ ID NO: 517520 - DNA, 19 bp, Homo sapiens
tctttcaacttatttctga

SEQ ID NO: 517521 - DNA, 20 bp, Homo sapiens
tctttcctaaatataaatga

SEQ ID NO: 517522 - DNA, 15 bp, Homo sapiens
tctttcttctcttta

SEQ ID NO: 517523 - DNA, 18 bp, Homo sapiens
tctttgaaaaataaagtt

SEQ ID NO: 517524 - DNA, 15 bp, Homo sapiens
tctttttcactctgt

SEQ ID NO: 517525 - DNA, 19 bp, Homo sapiens
tctttttgggagagacttg

SEQ ID NO: 517526 - DNA, 23 bp, Homo sapiens
tctttttttttttttttttaatt

SEQ ID NO: 517527 - DNA, 18 bp, Homo sapiens
tgaaacaaagaaagagat

SEQ ID NO: 517528 - DNA, 23 bp, Homo sapiens
tgaacagatatttttaacttaat

SEQ ID NO: 517529 - DNA, 16 bp, Homo sapiens
tgaacagccatatctg

SEQ ID NO: 517530 - DNA, 22 bp, Homo sapiens
tgaaccgccggttcattttgca

SEQ ID NO: 517531 - DNA, 15 bp, Homo sapiens
tgaactctattttga

SEQ ID NO: 517532 - DNA, 21 bp, Homo sapiens
tgaactctattttgattattg

SEQ ID NO: 517533 - DNA, 16 bp, Homo sapiens
tgaacttgcaggcaag

SEQ ID NO: 517534 - DNA, 17 bp, Homo sapiens
tgaagaaaaaatggcaa

SEQ ID NO: 517535 - DNA, 14 bp, Homo sapiens
tgaagccaagtggg

SEQ ID NO: 517536 - DNA, 15 bp, Homo sapiens
tgaagctcaataatg

SEQ ID NO: 517537 - DNA, 18 bp, Homo sapiens
tgaaggaggccacctcct

SEQ ID NO: 517538 - DNA, 21 bp, Homo sapiens
tgaatgccgtgcctgcaaaac

SEQ ID NO: 517539 - DNA, 15 bp, Homo sapiens
tgaattttttttaac

SEQ ID NO: 517540 - DNA, 16 bp, Homo sapiens
tgaattttttttaaca

SEQ ID NO: 517541 - DNA, 22 bp, Homo sapiens
tgaattttttttaacattcctc

SEQ ID NO: 517542 - DNA, 17 bp, Homo sapiens
tgacatcactggcatgg

SEQ ID NO: 517543 - DNA, 21 bp, Homo sapiens
tgacatggtgcctgagaggca

SEQ ID NO: 517544 - DNA, 13 bp, Homo sapiens
tgactacagggcc

SEQ ID NO: 517545 - DNA, 14 bp, Homo sapiens
tgactacagggccg

SEQ ID NO: 517546 - DNA, 17 bp, Homo sapiens
tgactattcttgatgta

SEQ ID NO: 517547 - DNA, 20 bp, Homo sapiens
tgactattcttgatgtaaaa

SEQ ID NO: 517548 - DNA, 13 bp, Homo sapiens
tgactttttctgt

SEQ ID NO: 517549 - DNA, 14 bp, Homo sapiens
tgagaggcaggcat

SEQ ID NO: 517550 - DNA, 19 bp, Homo sapiens
tgagatggatgtatttgta

SEQ ID NO: 517551 - DNA, 16 bp, Homo sapiens
tgagccgggcccctgg

SEQ ID NO: 517552 - DNA, 19 bp, Homo sapiens
tgagccgggcccctgggct

SEQ ID NO: 517553 - DNA, 16 bp, Homo sapiens
tgagctaagcattttc

SEQ ID NO: 517554 - DNA, 15 bp, Homo sapiens
tgagctgccttccct

SEQ ID NO: 517555 - DNA, 23 bp, Homo sapiens
tgaggggagacagagcaacccct

SEQ ID NO: 517556 - DNA, 18 bp, Homo sapiens
tgaggtgggaggtggaag

SEQ ID NO: 517557 - DNA, 21 bp, Homo sapiens
tgaggtgggaggtggaagaag

SEQ ID NO: 517558 - DNA, 21 bp, Homo sapiens
tgaggttcctctgcctgcccc

SEQ ID NO: 517559 - DNA, 19 bp, Homo sapiens
tgagtccattctcccaggt

SEQ ID NO: 517560 - DNA, 15 bp, Homo sapiens
tgagtgagaggggag

SEQ ID NO: 517561 - DNA, 17 bp, Homo sapiens
tgtgacatggtgcctga

SEQ ID NO: 517562 - DNA, 22 bp, Homo sapiens
tgtgacatggtgcctgagaggc

SEQ ID NO: 517563 - DNA, 13 bp, Homo sapiens
tgtgagatggatg

SEQ ID NO: 517564 - DNA, 18 bp, Homo sapiens
tgtgcagtcactggaggt

SEQ ID NO: 517565 - DNA, 22 bp, Homo sapiens
tgtgcgtggggctcccgcctcc

SEQ ID NO: 517566 - DNA, 18 bp, Homo sapiens
tgtgggattatgggtcac

SEQ ID NO: 517567 - DNA, 15 bp, Homo sapiens
tgtgttgcttctcta

SEQ ID NO: 517568 - DNA, 21 bp, Homo sapiens
tgttaagcaagtggttgtttt

SEQ ID NO: 517569 - DNA, 16 bp, Homo sapiens
tgttaatgcattcttt

SEQ ID NO: 517570 - DNA, 19 bp, Homo sapiens
tgttaatgcattctttctt

SEQ ID NO: 517571 - DNA, 23 bp, Homo sapiens
tgttaatgcattctttcttctct

SEQ ID NO: 517572 - DNA, 19 bp, Homo sapiens
tgttattttcaatgaaaca

SEQ ID NO: 517573 - DNA, 14 bp, Homo sapiens
tgttcatttgaaac

SEQ ID NO: 517574 - DNA, 23 bp, Homo sapiens
tgttctgtttcctgtgtctccaa

SEQ ID NO: 517575 - DNA, 14 bp, Homo sapiens
tgttgaattttatt

SEQ ID NO: 517576 - DNA, 19 bp, Homo sapiens
tgtttcctgtgtctccaag

SEQ ID NO: 517577 - DNA, 17 bp, Homo sapiens
tgtttgtgatggtctct

SEQ ID NO: 517578 - DNA, 15 bp, Homo sapiens
tgttttactttgttt

SEQ ID NO: 517579 - DNA, 20 bp, Homo sapiens
tgttttgtgtttttccaaaa

SEQ ID NO: 517580 - DNA, 19 bp, Homo sapiens
tgtttttaaagtgtacatt

SEQ ID NO: 517581 - DNA, 12 bp, Homo sapiens
ttaaaaagactt

SEQ ID NO: 517582 - DNA, 17 bp, Homo sapiens
ttaaaagaaaacaaagc

SEQ ID NO: 517583 - DNA, 15 bp, Homo sapiens
ttaaacaattcttgt

SEQ ID NO: 517584 - DNA, 17 bp, Homo sapiens
ttaaagccaaatgtaaa

SEQ ID NO: 517585 - DNA, 19 bp, Homo sapiens
ttaaagccaaatgtaaata

SEQ ID NO: 517586 - DNA, 19 bp, Homo sapiens
ttaaagcctgaaaattcca

SEQ ID NO: 517587 - DNA, 14 bp, Homo sapiens
ttaaagtgtacatt

SEQ ID NO: 517588 - DNA, 15 bp, Homo sapiens
ttaaatgaagataca

SEQ ID NO: 517589 - DNA, 18 bp, Homo sapiens
ttaaattttaaagcctga

SEQ ID NO: 517590 - DNA, 11 bp, Homo sapiens
ttaacattcct

SEQ ID NO: 517591 - DNA, 15 bp, Homo sapiens
ttaagtcatcatctc

SEQ ID NO: 517592 - DNA, 23 bp, Homo sapiens
ttaatggcataacaaaggcaaga

SEQ ID NO: 517593 - DNA, 20 bp, Homo sapiens
ttacttaaattttaaagcct

SEQ ID NO: 517594 - DNA, 18 bp, Homo sapiens
ttacttcctttcttacca

SEQ ID NO: 517595 - DNA, 13 bp, Homo sapiens
ttagaccctgggt

SEQ ID NO: 517596 - DNA, 14 bp, Homo sapiens
ttagactgccagct

SEQ ID NO: 517597 - DNA, 17 bp, Homo sapiens
ttagactgccagctctt

SEQ ID NO: 517598 - DNA, 15 bp, Homo sapiens
ttagatccaaatgta

SEQ ID NO: 517599 - DNA, 23 bp, Homo sapiens
ttataaggttcgtattgctatgt

SEQ ID NO: 517600 - DNA, 22 bp, Homo sapiens
ttataataaaccactcagtaaa

SEQ ID NO: 517601 - DNA, 15 bp, Homo sapiens
ttataccgcagagta

SEQ ID NO: 517602 - DNA, 18 bp, Homo sapiens
ttataccgcagagtattt

SEQ ID NO: 517603 - DNA, 18 bp, Homo sapiens
ttatcagatattttcata

SEQ ID NO: 517604 - DNA, 21 bp, Homo sapiens
ttatctcaaattttaagttaa

SEQ ID NO: 517605 - DNA, 13 bp, Homo sapiens
ttatgggtcacag

SEQ ID NO: 517606 - DNA, 15 bp, Homo sapiens
ttatgggtcacagga

SEQ ID NO: 517607 - DNA, 13 bp, Homo sapiens
ttatgggttttta

SEQ ID NO: 517608 - DNA, 14 bp, Homo sapiens
ttatgggtttttat

SEQ ID NO: 517609 - DNA, 14 bp, Homo sapiens
ttatggtattatat

SEQ ID NO: 517610 - DNA, 17 bp, Homo sapiens
ttattagcgttttaaca

SEQ ID NO: 517611 - DNA, 15 bp, Homo sapiens
ttattctgttaatgc

SEQ ID NO: 517612 - DNA, 12 bp, Homo sapiens
ttattgtcttta

SEQ ID NO: 517613 - DNA, 16 bp, Homo sapiens
ttatttctgaaaaaga

SEQ ID NO: 517614 - DNA, 20 bp, Homo sapiens
ttatttgatgagttctgtcc

SEQ ID NO: 517615 - DNA, 16 bp, Homo sapiens
ttattttattatttct

SEQ ID NO: 517616 - DNA, 16 bp, Homo sapiens
ttattttcaatgaaac

SEQ ID NO: 517617 - DNA, 16 bp, Homo sapiens
ttcaaaaagcatttta

SEQ ID NO: 517618 - DNA, 12 bp, Homo sapiens
cacaggcagggc

SEQ ID NO: 517619 - DNA, 13 bp, Homo sapiens
cacaggcagggca

SEQ ID NO: 517620 - DNA, 18 bp, Homo sapiens
cacaggctgagtgcaggc

SEQ ID NO: 517621 - DNA, 22 bp, Homo sapiens
cacaggctgagtgcaggcccac

SEQ ID NO: 517622 - DNA, 19 bp, Homo sapiens
cacaggctgggctgggcac

SEQ ID NO: 517623 - DNA, 15 bp, Homo sapiens
cacagggcctggccc

SEQ ID NO: 517624 - DNA, 18 bp, Homo sapiens
cacagggcctggcccatg

SEQ ID NO: 517625 - DNA, 12 bp, Homo sapiens
cacatggtgatg

SEQ ID NO: 517626 - DNA, 15 bp, Homo sapiens
cacatggtgatgttg

SEQ ID NO: 517627 - DNA, 12 bp, Homo sapiens
cacattccatga

SEQ ID NO: 517628 - DNA, 23 bp, Homo sapiens
cacattgttttccagaagcctcc

SEQ ID NO: 517629 - DNA, 17 bp, Homo sapiens
caccatttccccagggc

SEQ ID NO: 517630 - DNA, 13 bp, Homo sapiens
cacccaccgtgga

SEQ ID NO: 517631 - DNA, 13 bp, Homo sapiens
caccccctgccct

SEQ ID NO: 517632 - DNA, 17 bp, Homo sapiens
caccccggggaccctgt

SEQ ID NO: 517633 - DNA, 20 bp, Homo sapiens
caccccggggaccctgtgac

SEQ ID NO: 517634 - DNA, 14 bp, Homo sapiens
cacccctgccccca

SEQ ID NO: 517635 - DNA, 19 bp, Homo sapiens
cacccctgcccccagcccc

SEQ ID NO: 517636 - DNA, 12 bp, Homo sapiens
caccccttctct

SEQ ID NO: 517637 - DNA, 18 bp, Homo sapiens
caccctgcttggcccagg

SEQ ID NO: 517638 - DNA, 12 bp, Homo sapiens
cacctcatgccc

SEQ ID NO: 517639 - DNA, 15 bp, Homo sapiens
cacctcatgcccacc

SEQ ID NO: 517640 - DNA, 16 bp, Homo sapiens
cacctcatgcccaccc

SEQ ID NO: 517641 - DNA, 17 bp, Homo sapiens
cacctcatgcccacccc

SEQ ID NO: 517642 - DNA, 21 bp, Homo sapiens
cacctcatgcccaccccctgc

SEQ ID NO: 517643 - DNA, 19 bp, Homo sapiens
cacctccccttgccagctg

SEQ ID NO: 517644 - DNA, 18 bp, Homo sapiens
cacctcctaaaaggccca

SEQ ID NO: 517645 - DNA, 19 bp, Homo sapiens
cacctcctaaaaggcccag

SEQ ID NO: 517646 - DNA, 20 bp, Homo sapiens
cacctcctaaaaggcccaga

SEQ ID NO: 517647 - DNA, 15 bp, Homo sapiens
cacctcttcctggcc

SEQ ID NO: 517648 - DNA, 16 bp, Homo sapiens
cacctcttcctggccg

SEQ ID NO: 517649 - DNA, 19 bp, Homo sapiens
cacctggctgaggttcctc

SEQ ID NO: 517650 - DNA, 22 bp, Homo sapiens
cacctggctgaggttcctctgc

SEQ ID NO: 517651 - DNA, 22 bp, Homo sapiens
caccttggttcctggggcatcc

SEQ ID NO: 517652 - DNA, 19 bp, Homo sapiens
cacgctgactacagggccg

SEQ ID NO: 517653 - DNA, 14 bp, Homo sapiens
cacgtcatgggagg

SEQ ID NO: 517654 - DNA, 13 bp, Homo sapiens
cactctcagaggc

SEQ ID NO: 517655 - DNA, 16 bp, Homo sapiens
cactgccaggccagcc

SEQ ID NO: 517656 - DNA, 19 bp, Homo sapiens
cactgccaggccagcctcc

SEQ ID NO: 517657 - DNA, 15 bp, Homo sapiens
cactggaaaggggag

SEQ ID NO: 517658 - DNA, 23 bp, Homo sapiens
cactggaaaggggagagcctgct

SEQ ID NO: 517659 - DNA, 18 bp, Homo sapiens
cactggaggttgaagcca

SEQ ID NO: 517660 - DNA, 20 bp, Homo sapiens
cactggaggttgaagccaag

SEQ ID NO: 517661 - DNA, 13 bp, Homo sapiens
cactgtaaaatgt

SEQ ID NO: 517662 - DNA, 19 bp, Homo sapiens
cacttatttttttcccaag

SEQ ID NO: 517663 - DNA, 21 bp, Homo sapiens
cacttgggggctcagcaaggc

SEQ ID NO: 517664 - DNA, 19 bp, Homo sapiens
cagaagctatgtttttaaa

SEQ ID NO: 517665 - DNA, 20 bp, Homo sapiens
cagaagctatgtttttaaag

SEQ ID NO: 517666 - DNA, 16 bp, Homo sapiens
cagaaggggactgcca

SEQ ID NO: 517667 - DNA, 20 bp, Homo sapiens
cagaaggggactgccacctc

SEQ ID NO: 517668 - DNA, 22 bp, Homo sapiens
cagaaggggactgccacctccc

SEQ ID NO: 517669 - DNA, 16 bp, Homo sapiens
cagagagaagagcccc

SEQ ID NO: 517670 - DNA, 17 bp, Homo sapiens
cagagagaagagcccca

SEQ ID NO: 517671 - DNA, 21 bp, Homo sapiens
cagagagaagagccccactct

SEQ ID NO: 517672 - DNA, 23 bp, Homo sapiens
cagagagaagagccccactctca

SEQ ID NO: 517673 - DNA, 23 bp, Homo sapiens
cagagatcttggtatgggctgtt

SEQ ID NO: 517674 - DNA, 23 bp, Homo sapiens
cagagcaacccctggaccccagc

SEQ ID NO: 517675 - DNA, 23 bp, Homo sapiens
cagaggccccaataccccatgga

SEQ ID NO: 517676 - DNA, 18 bp, Homo sapiens
cagagggataacccaaac

SEQ ID NO: 517677 - DNA, 12 bp, Homo sapiens
cagatattttca

SEQ ID NO: 517678 - DNA, 23 bp, Homo sapiens
cagatgtgtgttgcttctctatt

SEQ ID NO: 517679 - DNA, 14 bp, Homo sapiens
cagcaaggccacct

SEQ ID NO: 517680 - DNA, 15 bp, Homo sapiens
cagcaaggccacctc

SEQ ID NO: 517681 - DNA, 16 bp, Homo sapiens
cagcaaggccacctct

SEQ ID NO: 517682 - DNA, 13 bp, Homo sapiens
agccctgcctctc

SEQ ID NO: 517683 - DNA, 15 bp, Homo sapiens
agccctgcctctccg

SEQ ID NO: 517684 - DNA, 16 bp, Homo sapiens
agccctgcctctccgc

SEQ ID NO: 517685 - DNA, 16 bp, Homo sapiens
agcccttgcctcccca

SEQ ID NO: 517686 - DNA, 14 bp, Homo sapiens
agccgggcccctgg

SEQ ID NO: 517687 - DNA, 14 bp, Homo sapiens
agcctccgagaggg

SEQ ID NO: 517688 - DNA, 17 bp, Homo sapiens
agcctccgagagggaga

SEQ ID NO: 517689 - DNA, 12 bp, Homo sapiens
agcctcctctgg

SEQ ID NO: 517690 - DNA, 13 bp, Homo sapiens
agcctcctctgga

SEQ ID NO: 517691 - DNA, 14 bp, Homo sapiens
agcctcctctggac

SEQ ID NO: 517692 - DNA, 18 bp, Homo sapiens
agcctcctctggacggca

SEQ ID NO: 517693 - DNA, 16 bp, Homo sapiens
agcctgaaaattccaa

SEQ ID NO: 517694 - DNA, 15 bp, Homo sapiens
agcctgattttttga

SEQ ID NO: 517695 - DNA, 10 bp, Homo sapiens
agcctgctgg

SEQ ID NO: 517696 - DNA, 11 bp, Homo sapiens
agcctgctggc

SEQ ID NO: 517697 - DNA, 18 bp, Homo sapiens
agcctgctggcacccacc

SEQ ID NO: 517698 - DNA, 12 bp, Homo sapiens
agccttcagatt

SEQ ID NO: 517699 - DNA, 18 bp, Homo sapiens
agcgctgtgagatggatg

SEQ ID NO: 517700 - DNA, 16 bp, Homo sapiens
agctatgtttttaaag

SEQ ID NO: 517701 - DNA, 22 bp, Homo sapiens
agctatgtttttaaagtgtaca

SEQ ID NO: 517702 - DNA, 19 bp, Homo sapiens
agctatttcccttttctgt

SEQ ID NO: 517703 - DNA, 14 bp, Homo sapiens
agctcttcctagct

SEQ ID NO: 517704 - DNA, 12 bp, Homo sapiens
agctgccttccc

SEQ ID NO: 517705 - DNA, 14 bp, Homo sapiens
agctgccttcccta

SEQ ID NO: 517706 - DNA, 19 bp, Homo sapiens
agctgccttccctagcttt

SEQ ID NO: 517707 - DNA, 17 bp, Homo sapiens
agctgcgcttgcttttc

SEQ ID NO: 517708 - DNA, 17 bp, Homo sapiens
agctgctgagccgcaga

SEQ ID NO: 517709 - DNA, 19 bp, Homo sapiens
agctggagaggagccctgc

SEQ ID NO: 517710 - DNA, 21 bp, Homo sapiens
agctggagaggagccctgcct

SEQ ID NO: 517711 - DNA, 22 bp, Homo sapiens
agctggagaggagccctgcctc

SEQ ID NO: 517712 - DNA, 15 bp, Homo sapiens
agctgtggaaatggt

SEQ ID NO: 517713 - DNA, 17 bp, Homo sapiens
agcttccagcaggaggg

SEQ ID NO: 517714 - DNA, 12 bp, Homo sapiens
agcttctgcttt

SEQ ID NO: 517715 - DNA, 19 bp, Homo sapiens
agcttctgcttttctgccc

SEQ ID NO: 517716 - DNA, 20 bp, Homo sapiens
agcttctgcttttctgccct

SEQ ID NO: 517717 - DNA, 21 bp, Homo sapiens
agcttgagccgggcccctggg

SEQ ID NO: 517718 - DNA, 23 bp, Homo sapiens
agcttgagccgggcccctgggct

SEQ ID NO: 517719 - DNA, 16 bp, Homo sapiens
agctttaaatggcaat

SEQ ID NO: 517720 - DNA, 19 bp, Homo sapiens
aggaaaaacacaagcaaaa

SEQ ID NO: 517721 - DNA, 22 bp, Homo sapiens
aggaaatgctgacccatgggca

SEQ ID NO: 517722 - DNA, 23 bp, Homo sapiens
aggaaggacacattgttttccag

SEQ ID NO: 517723 - DNA, 13 bp, Homo sapiens
aggaaggcaagag

SEQ ID NO: 517724 - DNA, 14 bp, Homo sapiens
aggaaggcaagagg

SEQ ID NO: 517725 - DNA, 16 bp, Homo sapiens
aggaagtagcacaggc

SEQ ID NO: 517726 - DNA, 19 bp, Homo sapiens
aggaagtagcacaggctga

SEQ ID NO: 517727 - DNA, 18 bp, Homo sapiens
aggaccctgccaggcaca

SEQ ID NO: 517728 - DNA, 11 bp, Homo sapiens
aggagccctgc

SEQ ID NO: 517729 - DNA, 13 bp, Homo sapiens
aggagccctgcct

SEQ ID NO: 517730 - DNA, 15 bp, Homo sapiens
aggagccctgcctct

SEQ ID NO: 517731 - DNA, 14 bp, Homo sapiens
aggaggaaggcaag

SEQ ID NO: 517732 - DNA, 11 bp, Homo sapiens
aggaggccacc

SEQ ID NO: 517733 - DNA, 12 bp, Homo sapiens
aggagggagagg

SEQ ID NO: 517734 - DNA, 13 bp, Homo sapiens
aggagggagaggg

SEQ ID NO: 517735 - DNA, 13 bp, Homo sapiens
aggattctgtaat

SEQ ID NO: 517736 - DNA, 16 bp, Homo sapiens
aggcaaatctgacttt

SEQ ID NO: 517737 - DNA, 21 bp, Homo sapiens
aggcaagagggggtggagggg

SEQ ID NO: 517738 - DNA, 22 bp, Homo sapiens
aggcaagcacaatggtttcaaa

SEQ ID NO: 517739 - DNA, 12 bp, Homo sapiens
aggcacaggcag

SEQ ID NO: 517740 - DNA, 15 bp, Homo sapiens
aggcacaggcagggc

SEQ ID NO: 517741 - DNA, 18 bp, Homo sapiens
aggcacaggcagggcagg

SEQ ID NO: 517742 - DNA, 22 bp, Homo sapiens
aggcaggcatagaggcttctcc

SEQ ID NO: 517743 - DNA, 15 bp, Homo sapiens
aggcagggcaggacc

SEQ ID NO: 517744 - DNA, 22 bp, Homo sapiens
aggcagggcaggaccagcccac

SEQ ID NO: 517745 - DNA, 15 bp, Homo sapiens
aggcaggggtggggg

SEQ ID NO: 517746 - DNA, 16 bp, Homo sapiens
aggcaggggtgggggt

SEQ ID NO: 517747 - DNA, 22 bp, Homo sapiens
aggcaggggtgggggtggaggc

SEQ ID NO: 517748 - DNA, 15 bp, Homo sapiens
aggccaagagtggcc

SEQ ID NO: 517749 - DNA, 18 bp, Homo sapiens
aggccaagagtggcccca

SEQ ID NO: 517750 - DNA, 21 bp, Homo sapiens
aggccaagagtggccccacct

SEQ ID NO: 517751 - DNA, 14 bp, Homo sapiens
aggccacctcttcc

SEQ ID NO: 517752 - DNA, 18 bp, Homo sapiens
aggccagcctccgagagg

SEQ ID NO: 517753 - DNA, 22 bp, Homo sapiens
aggccagcctccgagagggaga

SEQ ID NO: 517754 - DNA, 15 bp, Homo sapiens
aggcccaaaacagtt

SEQ ID NO: 517755 - DNA, 12 bp, Homo sapiens
aggcccaccctg

SEQ ID NO: 517756 - DNA, 23 bp, Homo sapiens
aggcccaccctgcttggcccagg

SEQ ID NO: 517757 - DNA, 18 bp, Homo sapiens
aggctagcttctgctttt

SEQ ID NO: 517758 - DNA, 12 bp, Homo sapiens
aggctcactgcc

SEQ ID NO: 517759 - DNA, 13 bp, Homo sapiens
aggctcactgcca

SEQ ID NO: 517760 - DNA, 14 bp, Homo sapiens
aggctcactgccag

SEQ ID NO: 517761 - DNA, 19 bp, Homo sapiens
aggctcactgccaggccag

SEQ ID NO: 517762 - DNA, 21 bp, Homo sapiens
aggctcactgccaggccagcc

SEQ ID NO: 517763 - DNA, 24 bp, Homo sapiens
aggctcactgccaggccagcctcc

SEQ ID NO: 517764 - DNA, 20 bp, Homo sapiens
aggctgagtgcaggcccacc

SEQ ID NO: 517765 - DNA, 24 bp, Homo sapiens
aggctgagtgcaggcccaccctgc

SEQ ID NO: 517766 - DNA, 18 bp, Homo sapiens
aggctgggctgggcactg

SEQ ID NO: 517767 - DNA, 22 bp, Homo sapiens
aggcttcctgcgtcctcctcac

SEQ ID NO: 517768 - DNA, 18 bp, Homo sapiens
aggcttctccgccagcct

SEQ ID NO: 517769 - DNA, 23 bp, Homo sapiens
aggcttctccgccagcctcctct

SEQ ID NO: 517770 - DNA, 18 bp, Homo sapiens
agggaaaggggtgctttt

SEQ ID NO: 517771 - DNA, 13 bp, Homo sapiens
agggaatgtgaaa

SEQ ID NO: 517772 - DNA, 14 bp, Homo sapiens
agggaatgtgaaat

SEQ ID NO: 517773 - DNA, 16 bp, Homo sapiens
agggactgaggcaagc

SEQ ID NO: 517774 - DNA, 16 bp, Homo sapiens
agggagaagaaaggtg

SEQ ID NO: 517775 - DNA, 20 bp, Homo sapiens
agggaggtcactggaaaggg

SEQ ID NO: 517776 - DNA, 13 bp, Homo sapiens
agggcacagggcc

SEQ ID NO: 517777 - DNA, 16 bp, Homo sapiens
agggcacagggcctgg

SEQ ID NO: 517778 - DNA, 16 bp, Homo sapiens
agggcaggaccagccc

SEQ ID NO: 517779 - DNA, 14 bp, Homo sapiens
agggcctggcccat

SEQ ID NO: 517780 - DNA, 17 bp, Homo sapiens
agggcctgggcctggct

SEQ ID NO: 517781 - DNA, 22 bp, Homo sapiens
agggcttcctctagaagccaag

SEQ ID NO: 517782 - DNA, 16 bp, Homo sapiens
aggggactgccacctc

SEQ ID NO: 517783 - DNA, 14 bp, Homo sapiens
aggggagacagagc

SEQ ID NO: 517784 - DNA, 16 bp, Homo sapiens
aggggagacagagcaa

SEQ ID NO: 517785 - DNA, 17 bp, Homo sapiens
aggggagagcctgctgg

SEQ ID NO: 517786 - DNA, 12 bp, Homo sapiens
agggggcttcct

SEQ ID NO: 517787 - DNA, 16 bp, Homo sapiens
aggggtgtggcagtgg

SEQ ID NO: 517788 - DNA, 16 bp, Homo sapiens
aggtaccagctgcgct

SEQ ID NO: 517789 - DNA, 16 bp, Homo sapiens
aggtcactggaaaggg

SEQ ID NO: 517790 - DNA, 13 bp, Homo sapiens
aggtctgagttgt

SEQ ID NO: 517791 - DNA, 23 bp, Homo sapiens
aggtctgagttgttaccccaagc

SEQ ID NO: 517792 - DNA, 20 bp, Homo sapiens
aggtgagtttgagctgcctt

SEQ ID NO: 517793 - DNA, 16 bp, Homo sapiens
aggtggaagaagggag

SEQ ID NO: 517794 - DNA, 22 bp, Homo sapiens
aggtggaagaagggagaagaaa

SEQ ID NO: 517795 - DNA, 22 bp, Homo sapiens
aggtggaattacttaaatttta

SEQ ID NO: 517796 - DNA, 18 bp, Homo sapiens
cagggcacagggcctggc

SEQ ID NO: 517797 - DNA, 19 bp, Homo sapiens
cagggcacagggcctggcc

SEQ ID NO: 517798 - DNA, 18 bp, Homo sapiens
cagggcaggaccagccca

SEQ ID NO: 517799 - DNA, 12 bp, Homo sapiens
cagggcctggcc

SEQ ID NO: 517800 - DNA, 14 bp, Homo sapiens
cagggcctggccca

SEQ ID NO: 517801 - DNA, 15 bp, Homo sapiens
cagggcctggcccat

SEQ ID NO: 517802 - DNA, 18 bp, Homo sapiens
cagggcctggcccatgta

SEQ ID NO: 517803 - DNA, 15 bp, Homo sapiens
cagggggcttcctga

SEQ ID NO: 517804 - DNA, 19 bp, Homo sapiens
caggtaccagctgcgcttg

SEQ ID NO: 517805 - DNA, 19 bp, Homo sapiens
caggtttgttttttcaaga

SEQ ID NO: 517806 - DNA, 14 bp, Homo sapiens
cagtcactggaggt

SEQ ID NO: 517807 - DNA, 17 bp, Homo sapiens
cagtcccagcagccagc

SEQ ID NO: 517808 - DNA, 18 bp, Homo sapiens
cagtccccacccctgccc

SEQ ID NO: 517809 - DNA, 13 bp, Homo sapiens
cagtctacccctc

SEQ ID NO: 517810 - DNA, 17 bp, Homo sapiens
cagtctcaccatttccc

SEQ ID NO: 517811 - DNA, 23 bp, Homo sapiens
cagtctcctatacccagcagagg

SEQ ID NO: 517812 - DNA, 13 bp, Homo sapiens
cagtgcccaggtg

SEQ ID NO: 517813 - DNA, 15 bp, Homo sapiens
cagtggcagggcaca

SEQ ID NO: 517814 - DNA, 18 bp, Homo sapiens
cagtgtagttttcctttt

SEQ ID NO: 517815 - DNA, 17 bp, Homo sapiens
cagttacaagctttaaa

SEQ ID NO: 517816 - DNA, 18 bp, Homo sapiens
cagttttgaaatgaaaat

SEQ ID NO: 517817 - DNA, 16 bp, Homo sapiens
cataacaaaggcaaga

SEQ ID NO: 517818 - DNA, 18 bp, Homo sapiens
catatgattgtatttgtg

SEQ ID NO: 517819 - DNA, 20 bp, Homo sapiens
catatgattgtatttgtgta

SEQ ID NO: 517820 - DNA, 20 bp, Homo sapiens
catcatttctttttgggaga

SEQ ID NO: 517821 - DNA, 19 bp, Homo sapiens
catccatggggtctctcac

SEQ ID NO: 517822 - DNA, 16 bp, Homo sapiens
catctgcaccccttct

SEQ ID NO: 517823 - DNA, 23 bp, Homo sapiens
catgatgttaatgggttatctca

SEQ ID NO: 517824 - DNA, 14 bp, Homo sapiens
catggaccatgctg

SEQ ID NO: 517825 - DNA, 20 bp, Homo sapiens
catggaccatgctgtctggc

SEQ ID NO: 517826 - DNA, 15 bp, Homo sapiens
catggattgtacata

SEQ ID NO: 517827 - DNA, 14 bp, Homo sapiens
catgggagggggct

SEQ ID NO: 517828 - DNA, 22 bp, Homo sapiens
catgggagggggcttgaagcca

SEQ ID NO: 517829 - DNA, 15 bp, Homo sapiens
catggggtctctcac

SEQ ID NO: 517830 - DNA, 23 bp, Homo sapiens
catggggtctctcacagacagga

SEQ ID NO: 517831 - DNA, 14 bp, Homo sapiens
catggtgcctgaga

SEQ ID NO: 517832 - DNA, 16 bp, Homo sapiens
catggtgcctgagagg

SEQ ID NO: 517833 - DNA, 18 bp, Homo sapiens
catggtgcctgagaggca

SEQ ID NO: 517834 - DNA, 22 bp, Homo sapiens
catggtggttgggacccagtgg

SEQ ID NO: 517835 - DNA, 21 bp, Homo sapiens
catgtaacttttttattttaa

SEQ ID NO: 517836 - DNA, 13 bp, Homo sapiens
catgtgtataaaa

SEQ ID NO: 517837 - DNA, 14 bp, Homo sapiens
catgtgtataaaaa

SEQ ID NO: 517838 - DNA, 21 bp, Homo sapiens
catgtgttccaaatttgcttt

SEQ ID NO: 517839 - DNA, 23 bp, Homo sapiens
catgtgttccaaatttgctttac

SEQ ID NO: 517840 - DNA, 20 bp, Homo sapiens
catgttgtatttatggaaga

SEQ ID NO: 517841 - DNA, 22 bp, Homo sapiens
cattataccgcagagtatttga

SEQ ID NO: 517842 - DNA, 23 bp, Homo sapiens
cattccaaaattcatttcataag

SEQ ID NO: 517843 - DNA, 21 bp, Homo sapiens
cattctcccaggtaccagctg

SEQ ID NO: 517844 - DNA, 14 bp, Homo sapiens
cattctttcctaaa

SEQ ID NO: 517845 - DNA, 18 bp, Homo sapiens
cattctttcttctcttta

SEQ ID NO: 517846 - DNA, 16 bp, Homo sapiens
cattgttttccagaag

SEQ ID NO: 517847 - DNA, 15 bp, Homo sapiens
catttctttttggga

SEQ ID NO: 517848 - DNA, 22 bp, Homo sapiens
catttctttttgggagagactt

SEQ ID NO: 517849 - DNA, 17 bp, Homo sapiens
catttgctgtctttttg

SEQ ID NO: 517850 - DNA, 18 bp, Homo sapiens
catttggagggcctgggc

SEQ ID NO: 517851 - DNA, 17 bp, Homo sapiens
cattttctctattcttt

SEQ ID NO: 517852 - DNA, 19 bp, Homo sapiens
cattttctctattctttcc

SEQ ID NO: 517853 - DNA, 21 bp, Homo sapiens
cattttctctattctttccat

SEQ ID NO: 517854 - DNA, 22 bp, Homo sapiens
cattttctctattctttccatg

SEQ ID NO: 517855 - DNA, 13 bp, Homo sapiens
ccaaacacacaga

SEQ ID NO: 517856 - DNA, 18 bp, Homo sapiens
ccaaacacacagaagggg

SEQ ID NO: 517857 - DNA, 19 bp, Homo sapiens
ccaaactaaaccctcacaa

SEQ ID NO: 517858 - DNA, 11 bp, Homo sapiens
ccaaagagaaa

SEQ ID NO: 517859 - DNA, 17 bp, Homo sapiens
ccaaagagggcttcctc

SEQ ID NO: 517860 - DNA, 21 bp, Homo sapiens
ccaaagataatgcatattttt

SEQ ID NO: 517861 - DNA, 23 bp, Homo sapiens
ccaaagataatgcatatttttgc

SEQ ID NO: 517862 - DNA, 17 bp, Homo sapiens
ccaaatttgctttacat

SEQ ID NO: 517863 - DNA, 18 bp, Homo sapiens
ccaacccctcgcccagtc

SEQ ID NO: 517864 - DNA, 15 bp, Homo sapiens
ccaagagtggcccca

SEQ ID NO: 517865 - DNA, 19 bp, Homo sapiens
ccaagagtggccccacctg

SEQ ID NO: 517866 - DNA, 20 bp, Homo sapiens
ccaagagtggccccacctgg

SEQ ID NO: 517867 - DNA, 21 bp, Homo sapiens
ccaagagtggccccacctggc

SEQ ID NO: 517868 - DNA, 15 bp, Homo sapiens
ccaagcctctgtctt

SEQ ID NO: 517869 - DNA, 13 bp, Homo sapiens
ccaagcgccctgg

SEQ ID NO: 517870 - DNA, 16 bp, Homo sapiens
ccaagtggggtgctgg

SEQ ID NO: 517871 - DNA, 16 bp, Homo sapiens
ccaataccccatggac

SEQ ID NO: 517872 - DNA, 13 bp, Homo sapiens
ccacatctgcctt

SEQ ID NO: 517873 - DNA, 22 bp, Homo sapiens
ccacatctgccttaaaaccaaa

SEQ ID NO: 517874 - DNA, 16 bp, Homo sapiens
ccaccccctgccctgc

SEQ ID NO: 517875 - DNA, 17 bp, Homo sapiens
ccaccccctgccctgca

SEQ ID NO: 517876 - DNA, 18 bp, Homo sapiens
ccaccccggggaccctgt

SEQ ID NO: 517877 - DNA, 19 bp, Homo sapiens
ccaccccggggaccctgtg

SEQ ID NO: 517878 - DNA, 17 bp, Homo sapiens
ccacctccccttgccag

SEQ ID NO: 517879 - DNA, 18 bp, Homo sapiens
ccacctccccttgccagc

SEQ ID NO: 517880 - DNA, 19 bp, Homo sapiens
ccacctccccttgccagct

SEQ ID NO: 517881 - DNA, 18 bp, Homo sapiens
ccacctcctaaaaggccc

SEQ ID NO: 517882 - DNA, 22 bp, Homo sapiens
ccacctcctaaaaggcccagag

SEQ ID NO: 517883 - DNA, 17 bp, Homo sapiens
ccacctggccctctctg

SEQ ID NO: 517884 - DNA, 14 bp, Homo sapiens
ccactacacctggc

SEQ ID NO: 517885 - DNA, 11 bp, Homo sapiens
ccactctcaga

SEQ ID NO: 517886 - DNA, 13 bp, Homo sapiens
ccactctcagagg

SEQ ID NO: 517887 - DNA, 15 bp, Homo sapiens
ccactctcagaggcc

SEQ ID NO: 517888 - DNA, 19 bp, Homo sapiens
ccagagagaagagccccac

SEQ ID NO: 517889 - DNA, 23 bp, Homo sapiens
ccagagagaagagccccactctc

SEQ ID NO: 517890 - DNA, 14 bp, Homo sapiens
ccagatcccaagag

SEQ ID NO: 517891 - DNA, 13 bp, Homo sapiens
ccagcagccagcc

SEQ ID NO: 517892 - DNA, 13 bp, Homo sapiens
ccagcaggaggga

SEQ ID NO: 517893 - DNA, 16 bp, Homo sapiens
ccagccaaacacacag

SEQ ID NO: 517894 - DNA, 20 bp, Homo sapiens
ccagccaaacacacagaagg

SEQ ID NO: 517895 - DNA, 13 bp, Homo sapiens
ccagcccacgctg

SEQ ID NO: 517896 - DNA, 21 bp, Homo sapiens
ccagcccacgctgactacagg

SEQ ID NO: 517897 - DNA, 19 bp, Homo sapiens
ccagcctcaaatccaggac

SEQ ID NO: 517898 - DNA, 13 bp, Homo sapiens
ccagcctcctctg

SEQ ID NO: 517899 - DNA, 17 bp, Homo sapiens
ccagctgcgcttgcttt

SEQ ID NO: 517900 - DNA, 15 bp, Homo sapiens
ccagcttccagcagg

SEQ ID NO: 517901 - DNA, 16 bp, Homo sapiens
ccagcttccagcagga

SEQ ID NO: 517902 - DNA, 23 bp, Homo sapiens
ccaggaaactccacatctgcctt

SEQ ID NO: 517903 - DNA, 18 bp, Homo sapiens
ccaggaccctgccaggca

SEQ ID NO: 517904 - DNA, 21 bp, Homo sapiens
ccaggaccctgccaggcacag

SEQ ID NO: 517905 - DNA, 12 bp, Homo sapiens
ccaggcacaggc

SEQ ID NO: 517906 - DNA, 14 bp, Homo sapiens
ccaggcacaggcag

SEQ ID NO: 517907 - DNA, 20 bp, Homo sapiens
ccaggcacaggcagggcagg

SEQ ID NO: 517908 - DNA, 22 bp, Homo sapiens
ccaggcaggggtgggggtggag

SEQ ID NO: 517909 - DNA, 13 bp, Homo sapiens
ccaggccagcctc

SEQ ID NO: 517910 - DNA, 16 bp, Homo sapiens
ccaggccagcctccga

SEQ ID NO: 517911 - DNA, 15 bp, Homo sapiens
ccaggtaccagctgc

SEQ ID NO: 517912 - DNA, 17 bp, Homo sapiens
ccagtcccagcagccag

SEQ ID NO: 517913 - DNA, 15 bp, Homo sapiens
ccagtccccacccct

SEQ ID NO: 517914 - DNA, 17 bp, Homo sapiens
ccagtctcctataccca

SEQ ID NO: 517915 - DNA, 20 bp, Homo sapiens
ccagtctcctatacccagca

SEQ ID NO: 517916 - DNA, 15 bp, Homo sapiens
ccagtggcagggcac

SEQ ID NO: 517917 - DNA, 16 bp, Homo sapiens
ccagtggcagggcaca

SEQ ID NO: 517918 - DNA, 14 bp, Homo sapiens
ccatctgcacccct

SEQ ID NO: 517919 - DNA, 22 bp, Homo sapiens
ccatctgcaccccttctctcct

SEQ ID NO: 517920 - DNA, 16 bp, Homo sapiens
ccatgctgtctggcac

SEQ ID NO: 517921 - DNA, 20 bp, Homo sapiens
ccatgctgtctggcacagcc

SEQ ID NO: 517922 - DNA, 17 bp, Homo sapiens
ccatggggtctctcaca

SEQ ID NO: 517923 - DNA, 23 bp, Homo sapiens
ccatggggtctctcacagacagg

SEQ ID NO: 517924 - DNA, 22 bp, Homo sapiens
ccattctcccaggtaccagctg

SEQ ID NO: 517925 - DNA, 15 bp, Homo sapiens
ccatttcccatctgc

SEQ ID NO: 517926 - DNA, 15 bp, Homo sapiens
ccatttccccagggc

SEQ ID NO: 517927 - DNA, 17 bp, Homo sapiens
ccatttccccagggcac

SEQ ID NO: 517928 - DNA, 18 bp, Homo sapiens
ccattttctctattcttt

SEQ ID NO: 517929 - DNA, 13 bp, Homo sapiens
cccaccccctgcc

SEQ ID NO: 517930 - DNA, 17 bp, Homo sapiens
cccaccccggggaccct

SEQ ID NO: 517931 - DNA, 16 bp, Homo sapiens
cccacccctgccccca

SEQ ID NO: 517932 - DNA, 11 bp, Homo sapiens
cccaccctgct

SEQ ID NO: 517933 - DNA, 12 bp, Homo sapiens
cccacctggccc

SEQ ID NO: 517934 - DNA, 18 bp, Homo sapiens
cccacctggccctctctg

SEQ ID NO: 517935 - DNA, 14 bp, Homo sapiens
cccacgctgactac

SEQ ID NO: 517936 - DNA, 16 bp, Homo sapiens
cccacgctgactacag

SEQ ID NO: 517937 - DNA, 19 bp, Homo sapiens
cccacgctgactacagggc

SEQ ID NO: 517938 - DNA, 21 bp, Homo sapiens
cccacgctgactacagggccg

SEQ ID NO: 517939 - DNA, 21 bp, Homo sapiens
cccagagagaagagccccact

SEQ ID NO: 517940 - DNA, 17 bp, Homo sapiens
cccagatcccaagagat

SEQ ID NO: 517941 - DNA, 14 bp, Homo sapiens
cccagcagagggat

SEQ ID NO: 517942 - DNA, 23 bp, Homo sapiens
cccagcctcaaatccaggaccct

SEQ ID NO: 517943 - DNA, 16 bp, Homo sapiens
cccagcttccagcagg

SEQ ID NO: 517944 - DNA, 18 bp, Homo sapiens
cccagcttccagcaggag

SEQ ID NO: 517945 - DNA, 13 bp, Homo sapiens
cccagggcacgtg

SEQ ID NO: 517946 - DNA, 14 bp, Homo sapiens
cccaggtaccagct

SEQ ID NO: 517947 - DNA, 16 bp, Homo sapiens
cccaggtaccagctgc

SEQ ID NO: 517948 - DNA, 14 bp, Homo sapiens
cccaggtggctgtg

SEQ ID NO: 517949 - DNA, 15 bp, Homo sapiens
cccaggtggctgtgg

SEQ ID NO: 517950 - DNA, 15 bp, Homo sapiens
cccagtcccagcagc

SEQ ID NO: 517951 - DNA, 19 bp, Homo sapiens
cccagtcccagcagccagc

SEQ ID NO: 517952 - DNA, 22 bp, Homo sapiens
cccagtggcagggcacagggcc

SEQ ID NO: 517953 - DNA, 19 bp, Homo sapiens
cccatctgcaccccttctc

SEQ ID NO: 517954 - DNA, 14 bp, Homo sapiens
cccatggaccatgc

SEQ ID NO: 517955 - DNA, 15 bp, Homo sapiens
cccatttcccatctg

SEQ ID NO: 517956 - DNA, 17 bp, Homo sapiens
cccatttcccatctgca

SEQ ID NO: 517957 - DNA, 19 bp, Homo sapiens
cccatttcccatctgcacc

SEQ ID NO: 517958 - DNA, 15 bp, Homo sapiens
ccccaaatcaataca

SEQ ID NO: 517959 - DNA, 17 bp, Homo sapiens
ccccaagcgccctggcc

SEQ ID NO: 517960 - DNA, 19 bp, Homo sapiens
ccccaataccccatggacc

SEQ ID NO: 517961 - DNA, 19 bp, Homo sapiens
ccccaccccggggaccctg

SEQ ID NO: 517962 - DNA, 23 bp, Homo sapiens
ccccaccccggggaccctgtgac

SEQ ID NO: 517963 - DNA, 23 bp, Homo sapiens
ccccacccctgcccccagccccg

SEQ ID NO: 517964 - DNA, 13 bp, Homo sapiens
ccccactctcaga

SEQ ID NO: 517965 - DNA, 16 bp, Homo sapiens
ccccactctcagaggc

SEQ ID NO: 517966 - DNA, 12 bp, Homo sapiens
ccccagggcacg

SEQ ID NO: 517967 - DNA, 16 bp, Homo sapiens
ccccatttcccatctg

SEQ ID NO: 517968 - DNA, 18 bp, Homo sapiens
ccccatttcccatctgca

SEQ ID NO: 517969 - DNA, 22 bp, Homo sapiens
ccccatttcccatctgcacccc

SEQ ID NO: 517970 - DNA, 16 bp, Homo sapiens
cccccacatggtgatg

SEQ ID NO: 517971 - DNA, 15 bp, Homo sapiens
cccccagtccccacc

SEQ ID NO: 517972 - DNA, 20 bp, Homo sapiens
cccccagtccccacccctgc

SEQ ID NO: 517973 - DNA, 22 bp, Homo sapiens
cccccagtccccacccctgccc

SEQ ID NO: 517974 - DNA, 16 bp, Homo sapiens
ccccggggaccctgtg

SEQ ID NO: 517975 - DNA, 17 bp, Homo sapiens
ccccggggaccctgtga

SEQ ID NO: 517976 - DNA, 11 bp, Homo sapiens
ctgccacctcc

SEQ ID NO: 517977 - DNA, 19 bp, Homo sapiens
ctgccacctccccttgcca

SEQ ID NO: 517978 - DNA, 17 bp, Homo sapiens
ctgccacttaaaaagac

SEQ ID NO: 517979 - DNA, 19 bp, Homo sapiens
ctgccagctcttcctagct

SEQ ID NO: 517980 - DNA, 14 bp, Homo sapiens
ctgccaggcacagg

SEQ ID NO: 517981 - DNA, 16 bp, Homo sapiens
ctgccaggcacaggca

SEQ ID NO: 517982 - DNA, 15 bp, Homo sapiens
ctgccaggcaggggt

SEQ ID NO: 517983 - DNA, 17 bp, Homo sapiens
ctgccaggccagcctcc

SEQ ID NO: 517984 - DNA, 15 bp, Homo sapiens
ctgcccccaccccgg

SEQ ID NO: 517985 - DNA, 16 bp, Homo sapiens
ctgccccgcccccagt

SEQ ID NO: 517986 - DNA, 17 bp, Homo sapiens
ctgccccgcccccagtc

SEQ ID NO: 517987 - DNA, 17 bp, Homo sapiens
ctgccctgcacgtcatg

SEQ ID NO: 517988 - DNA, 12 bp, Homo sapiens
ctgccctggctg

SEQ ID NO: 517989 - DNA, 20 bp, Homo sapiens
ctgccctggctgctgccccc

SEQ ID NO: 517990 - DNA, 21 bp, Homo sapiens
ctgccctggctgctgccccca

SEQ ID NO: 517991 - DNA, 23 bp, Homo sapiens
ctgcctctccgcccctgagccca

SEQ ID NO: 517992 - DNA, 15 bp, Homo sapiens
ctgcctgccccgccc

SEQ ID NO: 517993 - DNA, 16 bp, Homo sapiens
cttctcccctgcactg

SEQ ID NO: 517994 - DNA, 23 bp, Homo sapiens
cttctcccctgcactgtaaaatg

SEQ ID NO: 517995 - DNA, 13 bp, Homo sapiens
cttctccgccagc

SEQ ID NO: 517996 - DNA, 16 bp, Homo sapiens
cttctccgccagcctc

SEQ ID NO: 517997 - DNA, 19 bp, Homo sapiens
cttctccgccagcctcctc

SEQ ID NO: 517998 - DNA, 13 bp, Homo sapiens
cttctctattgca

SEQ ID NO: 517999 - DNA, 13 bp, Homo sapiens
cttctctcctccc

SEQ ID NO: 518000 - DNA, 14 bp, Homo sapiens
cttctcttcccata

SEQ ID NO: 518001 - DNA, 18 bp, Homo sapiens
cttctgcttttctgccct

SEQ ID NO: 518002 - DNA, 21 bp, Homo sapiens
cttctgcttttctgccctggc

SEQ ID NO: 518003 - DNA, 13 bp, Homo sapiens
cttgaagccaaag

SEQ ID NO: 518004 - DNA, 17 bp, Homo sapiens
cttgaatcagacatttt

SEQ ID NO: 518005 - DNA, 20 bp, Homo sapiens
cttgagccgggcccctgggc

SEQ ID NO: 518006 - DNA, 15 bp, Homo sapiens
cttgatgtaaaatct

SEQ ID NO: 518007 - DNA, 17 bp, Homo sapiens
cttgatgtaaaatcttg

SEQ ID NO: 518008 - DNA, 18 bp, Homo sapiens
cttgatgtaaaatcttgt

SEQ ID NO: 518009 - DNA, 19 bp, Homo sapiens
cttgccagctgctgagccg

SEQ ID NO: 518010 - DNA, 22 bp, Homo sapiens
cttgccagctgctgagccgcag

SEQ ID NO: 518011 - DNA, 15 bp, Homo sapiens
cttgctgaacatgga

SEQ ID NO: 518012 - DNA, 17 bp, Homo sapiens
cttgcttttctgtattt

SEQ ID NO: 518013 - DNA, 21 bp, Homo sapiens
cttggcccagggggcttcctg

SEQ ID NO: 518014 - DNA, 22 bp, Homo sapiens
cttggcccagggggcttcctga

SEQ ID NO: 518015 - DNA, 15 bp, Homo sapiens
cttggcctgctgtga

SEQ ID NO: 518016 - DNA, 15 bp, Homo sapiens
cttggttcctggggc

SEQ ID NO: 518017 - DNA, 16 bp, Homo sapiens
cttggttcctggggca

SEQ ID NO: 518018 - DNA, 12 bp, Homo sapiens
cttgtcatgtgt

SEQ ID NO: 518019 - DNA, 14 bp, Homo sapiens
ctttcaacttattt

SEQ ID NO: 518020 - DNA, 21 bp, Homo sapiens
ctttcctaaatataaatgaaa

SEQ ID NO: 518021 - DNA, 15 bp, Homo sapiens
ctttgaacctcagca

SEQ ID NO: 518022 - DNA, 11 bp, Homo sapiens
ctttggttttt

SEQ ID NO: 518023 - DNA, 17 bp, Homo sapiens
ctttgtttttattctgt

SEQ ID NO: 518024 - DNA, 20 bp, Homo sapiens
cttttaaaaattttgtcctt

SEQ ID NO: 518025 - DNA, 14 bp, Homo sapiens
cttttccctgcttc

SEQ ID NO: 518026 - DNA, 13 bp, Homo sapiens
cttttctgccctg

SEQ ID NO: 518027 - DNA, 14 bp, Homo sapiens
cttttctgccctgg

SEQ ID NO: 518028 - DNA, 13 bp, Homo sapiens
cttttctgtattt

SEQ ID NO: 518029 - DNA, 18 bp, Homo sapiens
cttttgcacattccaaaa

SEQ ID NO: 518030 - DNA, 22 bp, Homo sapiens
cttttgcacattccaaaattca

SEQ ID NO: 518031 - DNA, 14 bp, Homo sapiens
ctttttcactctgt

SEQ ID NO: 518032 - DNA, 15 bp, Homo sapiens
ctttttcactctgtg

SEQ ID NO: 518033 - DNA, 13 bp, Homo sapiens
ctttttgtactgt

SEQ ID NO: 518034 - DNA, 15 bp, Homo sapiens
cttttttattttaag

SEQ ID NO: 518035 - DNA, 13 bp, Homo sapiens
gaaaaaaaaaagt

SEQ ID NO: 518036 - DNA, 19 bp, Homo sapiens
gaaaaaatggcaagagatc

SEQ ID NO: 518037 - DNA, 14 bp, Homo sapiens
gaaaaacacaagca

SEQ ID NO: 518038 - DNA, 18 bp, Homo sapiens
gaaaacttcactccaaag

SEQ ID NO: 518039 - DNA, 20 bp, Homo sapiens
gaaaacttcactccaaagag

SEQ ID NO: 518040 - DNA, 19 bp, Homo sapiens
gaaaataatcaaaccaaag

SEQ ID NO: 518041 - DNA, 18 bp, Homo sapiens
gaaaatgtctcagtattt

SEQ ID NO: 518042 - DNA, 14 bp, Homo sapiens
gaaaattttgcaga

SEQ ID NO: 518043 - DNA, 14 bp, Homo sapiens
gaaacaaagaaaga

SEQ ID NO: 518044 - DNA, 18 bp, Homo sapiens
gaaacattctttcctaaa

SEQ ID NO: 518045 - DNA, 21 bp, Homo sapiens
gaaacctttttctagttatta

SEQ ID NO: 518046 - DNA, 17 bp, Homo sapiens
gaaactccacatctgcc

SEQ ID NO: 518047 - DNA, 22 bp, Homo sapiens
gaaactgaggtgttattttcaa

SEQ ID NO: 518048 - DNA, 13 bp, Homo sapiens
gaaagagatgtta

SEQ ID NO: 518049 - DNA, 15 bp, Homo sapiens
gaaaggagtagtttt

SEQ ID NO: 518050 - DNA, 15 bp, Homo sapiens
gaaaggggagagcct

SEQ ID NO: 518051 - DNA, 15 bp, Homo sapiens
gaaaggggtgctttt

SEQ ID NO: 518052 - DNA, 14 bp, Homo sapiens
gaaatcaagagaca

SEQ ID NO: 518053 - DNA, 13 bp, Homo sapiens
gaaatctttcaac

SEQ ID NO: 518054 - DNA, 22 bp, Homo sapiens
gaaatgctgacccatgggcagg

SEQ ID NO: 518055 - DNA, 19 bp, Homo sapiens
gaaccgccggttcattttg

SEQ ID NO: 518056 - DNA, 12 bp, Homo sapiens
gaacgcccactt

SEQ ID NO: 518057 - DNA, 16 bp, Homo sapiens
gaacttgcaggcaagc

SEQ ID NO: 518058 - DNA, 17 bp, Homo sapiens
gaagaagggagaagaaa

SEQ ID NO: 518059 - DNA, 20 bp, Homo sapiens
gaagagccccactctcagag

SEQ ID NO: 518060 - DNA, 16 bp, Homo sapiens
gaagccaaagaaaaat

SEQ ID NO: 518061 - DNA, 16 bp, Homo sapiens
gaagccaagggaaagg

SEQ ID NO: 518062 - DNA, 21 bp, Homo sapiens
gaagccaagtggggtgctggg

SEQ ID NO: 518063 - DNA, 17 bp, Homo sapiens
gaaggaggccacctcct

SEQ ID NO: 518064 - DNA, 16 bp, Homo sapiens
gaagggagaagaaagg

SEQ ID NO: 518065 - DNA, 15 bp, Homo sapiens
gaaggtgtttaaaga

SEQ ID NO: 518066 - DNA, 18 bp, Homo sapiens
gaagtagcacaggctgag

SEQ ID NO: 518067 - DNA, 16 bp, Homo sapiens
gaagtgacggttccta

SEQ ID NO: 518068 - DNA, 23 bp, Homo sapiens
gaataagttatgggtttttatgt

SEQ ID NO: 518069 - DNA, 18 bp, Homo sapiens
gaatagttactttacaac

SEQ ID NO: 518070 - DNA, 22 bp, Homo sapiens
gaatcacaggctgggctgggca

SEQ ID NO: 518071 - DNA, 19 bp, Homo sapiens
gaatcatgtattttgtaaa

SEQ ID NO: 518072 - DNA, 15 bp, Homo sapiens
gaatgaggtgggagg

SEQ ID NO: 518073 - DNA, 17 bp, Homo sapiens
gaatgtaaatttgtact

SEQ ID NO: 518074 - DNA, 19 bp, Homo sapiens
gaatttttgcccatatctg

SEQ ID NO: 518075 - DNA, 17 bp, Homo sapiens
gaattttttttaacatt

SEQ ID NO: 518076 - DNA, 19 bp, Homo sapiens
gaattttttttaacattcc

SEQ ID NO: 518077 - DNA, 14 bp, Homo sapiens
gacaagagatggga

SEQ ID NO: 518078 - DNA, 16 bp, Homo sapiens
gacaataactttgaac

SEQ ID NO: 518079 - DNA, 23 bp, Homo sapiens
gacacccaagggtcgcctatttt

SEQ ID NO: 518080 - DNA, 20 bp, Homo sapiens
gacagagcaacccctggacc

SEQ ID NO: 518081 - DNA, 17 bp, Homo sapiens
gacaggacccctgcagt

SEQ ID NO: 518082 - DNA, 14 bp, Homo sapiens
gacaggggttcctt

SEQ ID NO: 518083 - DNA, 20 bp, Homo sapiens
gacaggggttccttctgggc

SEQ ID NO: 518084 - DNA, 21 bp, Homo sapiens
gacaggggttccttctgggca

SEQ ID NO: 518085 - DNA, 13 bp, Homo sapiens
gacagtctcacca

SEQ ID NO: 518086 - DNA, 23 bp, Homo sapiens
gacagtctcaccatttccccagg

SEQ ID NO: 518087 - DNA, 15 bp, Homo sapiens
gacagtgagaggata

SEQ ID NO: 518088 - DNA, 16 bp, Homo sapiens
gacatggtgcctgaga

SEQ ID NO: 518089 - DNA, 21 bp, Homo sapiens
gacatggtgcctgagaggcag

SEQ ID NO: 518090 - DNA, 22 bp, Homo sapiens
gacatggtgcctgagaggcagg

SEQ ID NO: 518091 - DNA, 14 bp, Homo sapiens
gaccagcccacgct

SEQ ID NO: 518092 - DNA, 18 bp, Homo sapiens
gacccagtggcagggcac

SEQ ID NO: 518093 - DNA, 20 bp, Homo sapiens
gacccagtggcagggcacag

SEQ ID NO: 518094 - DNA, 16 bp, Homo sapiens
gacccatgggcaggag

SEQ ID NO: 518095 - DNA, 14 bp, Homo sapiens
gaccccagcctcaa

SEQ ID NO: 518096 - DNA, 13 bp, Homo sapiens
gaccctgccaggc

SEQ ID NO: 518097 - DNA, 14 bp, Homo sapiens
gaccctgccaggca

SEQ ID NO: 518098 - DNA, 15 bp, Homo sapiens
gaccctgccaggcac

SEQ ID NO: 518099 - DNA, 18 bp, Homo sapiens
gaccctgccaggcacagg

SEQ ID NO: 518100 - DNA, 21 bp, Homo sapiens
gaccctgtgacatggtgcctg

SEQ ID NO: 518101 - DNA, 19 bp, Homo sapiens
gacggcaggctcactgcca

SEQ ID NO: 518102 - DNA, 22 bp, Homo sapiens
gacggttcctacacaggacagg

SEQ ID NO: 518103 - DNA, 12 bp, Homo sapiens
gactacagggcc

SEQ ID NO: 518104 - DNA, 20 bp, Homo sapiens
gactctgccttaatttttga

SEQ ID NO: 518105 - DNA, 13 bp, Homo sapiens
gactgaggcaagc

SEQ ID NO: 518106 - DNA, 14 bp, Homo sapiens
gactgctcctgagc

SEQ ID NO: 518107 - DNA, 16 bp, Homo sapiens
cctggaagcagtgccc

SEQ ID NO: 518108 - DNA, 15 bp, Homo sapiens
cctggaccccagcct

SEQ ID NO: 518109 - DNA, 18 bp, Homo sapiens
cctggccggtgtgggggc

SEQ ID NO: 518110 - DNA, 21 bp, Homo sapiens
cctggccggtgtgggggcccc

SEQ ID NO: 518111 - DNA, 12 bp, Homo sapiens
cctggctccctc

SEQ ID NO: 518112 - DNA, 14 bp, Homo sapiens
cctggctccctcac

SEQ ID NO: 518113 - DNA, 16 bp, Homo sapiens
cctggctgaggttcct

SEQ ID NO: 518114 - DNA, 19 bp, Homo sapiens
cctggctgaggttcctctg

SEQ ID NO: 518115 - DNA, 20 bp, Homo sapiens
cctggctgaggttcctctgc

SEQ ID NO: 518116 - DNA, 21 bp, Homo sapiens
cctggctgaggttcctctgcc

SEQ ID NO: 518117 - DNA, 13 bp, Homo sapiens
cctggctgctgcc

SEQ ID NO: 518118 - DNA, 22 bp, Homo sapiens
cctggctgctgcccccaccccg

SEQ ID NO: 518119 - DNA, 13 bp, Homo sapiens
cctgggcctggct

SEQ ID NO: 518120 - DNA, 13 bp, Homo sapiens
cctgggcttggcc

SEQ ID NO: 518121 - DNA, 15 bp, Homo sapiens
cctgggcttggcctg

SEQ ID NO: 518122 - DNA, 17 bp, Homo sapiens
cctgggcttggcctgct

SEQ ID NO: 518123 - DNA, 20 bp, Homo sapiens
cctgggcttggcctgctgtg

SEQ ID NO: 518124 - DNA, 17 bp, Homo sapiens
cctgggtgggctctgtg

SEQ ID NO: 518125 - DNA, 19 bp, Homo sapiens
cctgtgtctccaagcctct

SEQ ID NO: 518126 - DNA, 14 bp, Homo sapiens
cctgtgtggagagg

SEQ ID NO: 518127 - DNA, 19 bp, Homo sapiens
cctgtgtggagagggaatg

SEQ ID NO: 518128 - DNA, 17 bp, Homo sapiens
ccttaaaaccaaagagg

SEQ ID NO: 518129 - DNA, 22 bp, Homo sapiens
ccttaaacaattcttgtaactt

SEQ ID NO: 518130 - DNA, 12 bp, Homo sapiens
ccttattcagaa

SEQ ID NO: 518131 - DNA, 12 bp, Homo sapiens
ccttccctagct

SEQ ID NO: 518132 - DNA, 16 bp, Homo sapiens
ccttccttttccctgc

SEQ ID NO: 518133 - DNA, 21 bp, Homo sapiens
ccttccttttccctgcttcca

SEQ ID NO: 518134 - DNA, 23 bp, Homo sapiens
ccttccttttccctgcttccagg

SEQ ID NO: 518135 - DNA, 15 bp, Homo sapiens
ccttctcccctgcac

SEQ ID NO: 518136 - DNA, 12 bp, Homo sapiens
ccttctgggcat

SEQ ID NO: 518137 - DNA, 15 bp, Homo sapiens
ccttgccagctgctg

SEQ ID NO: 518138 - DNA, 17 bp, Homo sapiens
ccttgcctccccatttc

SEQ ID NO: 518139 - DNA, 22 bp, Homo sapiens
ccttgcctccccatttcccatc

SEQ ID NO: 518140 - DNA, 22 bp, Homo sapiens
ccttgctagaaacataattttt

SEQ ID NO: 518141 - DNA, 12 bp, Homo sapiens
ccttggttcctg

SEQ ID NO: 518142 - DNA, 15 bp, Homo sapiens
ccttggttcttccta

SEQ ID NO: 518143 - DNA, 19 bp, Homo sapiens
cctttcactcctttcctcc

SEQ ID NO: 518144 - DNA, 22 bp, Homo sapiens
cctttcatgtaacttttttatt

SEQ ID NO: 518145 - DNA, 16 bp, Homo sapiens
cctttggtttttttct

SEQ ID NO: 518146 - DNA, 17 bp, Homo sapiens
ccttttaaagaattttt

SEQ ID NO: 518147 - DNA, 16 bp, Homo sapiens
cgagagggagagagag

SEQ ID NO: 518148 - DNA, 13 bp, Homo sapiens
cgccagcctcctc

SEQ ID NO: 518149 - DNA, 18 bp, Homo sapiens
cgccagcctcctctggac

SEQ ID NO: 518150 - DNA, 21 bp, Homo sapiens
cgccagcctcctctggacggc

SEQ ID NO: 518151 - DNA, 13 bp, Homo sapiens
cgcccacttccct

SEQ ID NO: 518152 - DNA, 14 bp, Homo sapiens
cgcccagtcccagc

SEQ ID NO: 518153 - DNA, 15 bp, Homo sapiens
cgcccagtcccagca

SEQ ID NO: 518154 - DNA, 18 bp, Homo sapiens
cgcccagtcccagcagcc

SEQ ID NO: 518155 - DNA, 12 bp, Homo sapiens
cgcccctgagcc

SEQ ID NO: 518156 - DNA, 20 bp, Homo sapiens
cgccggcaataaaagcccag

SEQ ID NO: 518157 - DNA, 21 bp, Homo sapiens
cgccggcaataaaagcccagg

SEQ ID NO: 518158 - DNA, 22 bp, Homo sapiens
cgccggcaataaaagcccagga

SEQ ID NO: 518159 - DNA, 21 bp, Homo sapiens
cgcctccaacccctcgcccag

SEQ ID NO: 518160 - DNA, 16 bp, Homo sapiens
cgctgactacagggcc

SEQ ID NO: 518161 - DNA, 18 bp, Homo sapiens
cggcaataaaagcccagg

SEQ ID NO: 518162 - DNA, 22 bp, Homo sapiens
cggcaataaaagcccaggagcc

SEQ ID NO: 518163 - DNA, 22 bp, Homo sapiens
cggcaggctcactgccaggcca

SEQ ID NO: 518164 - DNA, 23 bp, Homo sapiens
cgggcccctgggcttggcctgct

SEQ ID NO: 518165 - DNA, 12 bp, Homo sapiens
cggggaccctgt

SEQ ID NO: 518166 - DNA, 20 bp, Homo sapiens
cggtgtgggggccccgtctc

SEQ ID NO: 518167 - DNA, 23 bp, Homo sapiens
cggtgtgggggccccgtctcagg

SEQ ID NO: 518168 - DNA, 20 bp, Homo sapiens
cgtaaatcatatttccctta

SEQ ID NO: 518169 - DNA, 17 bp, Homo sapiens
cgtcctcctcacctcat

SEQ ID NO: 518170 - DNA, 21 bp, Homo sapiens
cgtcctcctcacctcatgccc

SEQ ID NO: 518171 - DNA, 17 bp, Homo sapiens
cgtggagaatcacaggc

SEQ ID NO: 518172 - DNA, 18 bp, Homo sapiens
cgtggagaatcacaggct

SEQ ID NO: 518173 - DNA, 23 bp, Homo sapiens
cgtggagaatcacaggctgggct

SEQ ID NO: 518174 - DNA, 15 bp, Homo sapiens
ctaaaacagctattt

SEQ ID NO: 518175 - DNA, 13 bp, Homo sapiens
ctaaaaggcccag

SEQ ID NO: 518176 - DNA, 18 bp, Homo sapiens
ctaaaaggcccagagaga

SEQ ID NO: 518177 - DNA, 15 bp, Homo sapiens
ctaaagagcccttgc

SEQ ID NO: 518178 - DNA, 17 bp, Homo sapiens
ctaaagagcccttgcct

SEQ ID NO: 518179 - DNA, 17 bp, Homo sapiens
ctaaagtcttcctattg

SEQ ID NO: 518180 - DNA, 22 bp, Homo sapiens
ctaaatagcccagatcccaaga

SEQ ID NO: 518181 - DNA, 17 bp, Homo sapiens
ctaactacatgaacaca

SEQ ID NO: 518182 - DNA, 16 bp, Homo sapiens
ctaagagaagttattt

SEQ ID NO: 518183 - DNA, 19 bp, Homo sapiens
ctaagagaagttattttct

SEQ ID NO: 518184 - DNA, 14 bp, Homo sapiens
ctaataatcataaa

SEQ ID NO: 518185 - DNA, 16 bp, Homo sapiens
ctaatccccttctccc

SEQ ID NO: 518186 - DNA, 18 bp, Homo sapiens
ctaatccccttctcccct

SEQ ID NO: 518187 - DNA, 20 bp, Homo sapiens
ctaatccccttctcccctgc

SEQ ID NO: 518188 - DNA, 18 bp, Homo sapiens
ctacaatgggaaaacttc

SEQ ID NO: 518189 - DNA, 21 bp, Homo sapiens
ctacaatgggaaaacttcact

SEQ ID NO: 518190 - DNA, 22 bp, Homo sapiens
ctacaatgggaaaacttcactc

SEQ ID NO: 518191 - DNA, 13 bp, Homo sapiens
ctacacaggacag

SEQ ID NO: 518192 - DNA, 14 bp, Homo sapiens
ctacagtggtttta

SEQ ID NO: 518193 - DNA, 21 bp, Homo sapiens
ctacagtggttttatactgaa

SEQ ID NO: 518194 - DNA, 16 bp, Homo sapiens
ctagaagccaagggaa

SEQ ID NO: 518195 - DNA, 20 bp, Homo sapiens
ctagaagccaagggaaaggg

SEQ ID NO: 518196 - DNA, 19 bp, Homo sapiens
ctagaatcatgtattttgt

SEQ ID NO: 518197 - DNA, 19 bp, Homo sapiens
ctagctggagaggagccct

SEQ ID NO: 518198 - DNA, 21 bp, Homo sapiens
ctagctggagaggagccctgc

SEQ ID NO: 518199 - DNA, 15 bp, Homo sapiens
ctagcttctgctttt

SEQ ID NO: 518200 - DNA, 16 bp, Homo sapiens
ctagcttctgcttttc

SEQ ID NO: 518201 - DNA, 18 bp, Homo sapiens
ctagcttctgcttttctg

SEQ ID NO: 518202 - DNA, 21 bp, Homo sapiens
ctagcttctgcttttctgccc

SEQ ID NO: 518203 - DNA, 15 bp, Homo sapiens
ctagctttagaccct

SEQ ID NO: 518204 - DNA, 18 bp, Homo sapiens
ctagctttagaccctggg

SEQ ID NO: 518205 - DNA, 19 bp, Homo sapiens
ctagtgcctacaatgggaa

SEQ ID NO: 518206 - DNA, 12 bp, Homo sapiens
ctatctcatcta

SEQ ID NO: 518207 - DNA, 19 bp, Homo sapiens
ctatgacaatttttgctgt

SEQ ID NO: 518208 - DNA, 23 bp, Homo sapiens
ctattaagtcatcatctccaaac

SEQ ID NO: 518209 - DNA, 19 bp, Homo sapiens
ctattatgatgttttgcaa

SEQ ID NO: 518210 - DNA, 13 bp, Homo sapiens
ctatttaactgac

SEQ ID NO: 518211 - DNA, 15 bp, Homo sapiens
ctatttttaaaaagt

SEQ ID NO: 518212 - DNA, 14 bp, Homo sapiens
ctcaaatccaggac

SEQ ID NO: 518213 - DNA, 23 bp, Homo sapiens
ctcaaatccaggaccctgccagg

SEQ ID NO: 518214 - DNA, 20 bp, Homo sapiens
ctcaactctgtttatttgat

SEQ ID NO: 518215 - DNA, 18 bp, Homo sapiens
ctcaataatggaactctt

SEQ ID NO: 518216 - DNA, 14 bp, Homo sapiens
ctcaatcctaattt

SEQ ID NO: 518217 - DNA, 23 bp, Homo sapiens
ctcacaagtaacagttgaagaaa

SEQ ID NO: 518218 - DNA, 13 bp, Homo sapiens
ctcacagacagga

SEQ ID NO: 518219 - DNA, 15 bp, Homo sapiens
ctcacagacaggacc

SEQ ID NO: 518220 - DNA, 16 bp, Homo sapiens
ctcaccatttccccag

SEQ ID NO: 518221 - DNA, 18 bp, Homo sapiens
ctcaccatttccccaggg

SEQ ID NO: 518222 - DNA, 20 bp, Homo sapiens
ctcaccatttccccagggca

SEQ ID NO: 518223 - DNA, 15 bp, Homo sapiens
ctcacctcatgccca

SEQ ID NO: 518224 - DNA, 16 bp, Homo sapiens
ctcaccttggttcctg

SEQ ID NO: 518225 - DNA, 13 bp, Homo sapiens
ctcactctcagga

SEQ ID NO: 518226 - DNA, 14 bp, Homo sapiens
ctcactctcaggaa

SEQ ID NO: 518227 - DNA, 21 bp, Homo sapiens
ctcactctcaggaaatgctga

SEQ ID NO: 518228 - DNA, 12 bp, Homo sapiens
ctcactgccagg

SEQ ID NO: 518229 - DNA, 15 bp, Homo sapiens
ctcactgccaggcca

SEQ ID NO: 518230 - DNA, 18 bp, Homo sapiens
ctcactgccaggccagcc

SEQ ID NO: 518231 - DNA, 20 bp, Homo sapiens
ctcactgccaggccagcctc

SEQ ID NO: 518232 - DNA, 16 bp, Homo sapiens
ctcagaccaggtggaa

SEQ ID NO: 518233 - DNA, 18 bp, Homo sapiens
ctcagaccaggtggaatt

SEQ ID NO: 518234 - DNA, 12 bp, Homo sapiens
ctcagaggcccc

SEQ ID NO: 518235 - DNA, 21 bp, Homo sapiens
ctcagcaaagtagaatctctt

SEQ ID NO: 518236 - DNA, 21 bp, Homo sapiens
ctcagcaaggccacctcttcc

SEQ ID NO: 518237 - DNA, 15 bp, Homo sapiens
ctcaggaaatgctga

SEQ ID NO: 518238 - DNA, 17 bp, Homo sapiens
ctcaggataacagagaa

SEQ ID NO: 518239 - DNA, 13 bp, Homo sapiens
ctcagtaaaagca

SEQ ID NO: 518240 - DNA, 14 bp, Homo sapiens
ctcatctatctcaa

SEQ ID NO: 518241 - DNA, 15 bp, Homo sapiens
ctcatgaatgtaaat

SEQ ID NO: 518242 - DNA, 16 bp, Homo sapiens
ctcatgaatgtaaatt

SEQ ID NO: 518243 - DNA, 21 bp, Homo sapiens
ctcatgaatgtaaatttgtac

SEQ ID NO: 518244 - DNA, 13 bp, Homo sapiens
ctcatgcccaccc

SEQ ID NO: 518245 - DNA, 16 bp, Homo sapiens
aaaaacagcttgttct

SEQ ID NO: 518246 - DNA, 11 bp, Homo sapiens
aaaaagatccc

SEQ ID NO: 518247 - DNA, 14 bp, Homo sapiens
aaaaagatcccaaa

SEQ ID NO: 518248 - DNA, 13 bp, Homo sapiens
aaaaccaaagagg

SEQ ID NO: 518249 - DNA, 21 bp, Homo sapiens
aaaactatttatgaatattaa

SEQ ID NO: 518250 - DNA, 15 bp, Homo sapiens
aaaacttcactccaa

SEQ ID NO: 518251 - DNA, 21 bp, Homo sapiens
aaaacttcactccaaagagaa

SEQ ID NO: 518252 - DNA, 18 bp, Homo sapiens
aaaagacttgagaaattt

SEQ ID NO: 518253 - DNA, 14 bp, Homo sapiens
aaaagtttgtttta

SEQ ID NO: 518254 - DNA, 16 bp, Homo sapiens
aaaataaaaaagatcc

SEQ ID NO: 518255 - DNA, 17 bp, Homo sapiens
aaaatataaaatttctg

SEQ ID NO: 518256 - DNA, 12 bp, Homo sapiens
aaaatcttgtca

SEQ ID NO: 518257 - DNA, 13 bp, Homo sapiens
aaaatcttgtcat

SEQ ID NO: 518258 - DNA, 19 bp, Homo sapiens
aaaatcttgtcatgtgtat

SEQ ID NO: 518259 - DNA, 15 bp, Homo sapiens
aaaatggcaagagat

SEQ ID NO: 518260 - DNA, 21 bp, Homo sapiens
aaaatgtgggattatgggtca

SEQ ID NO: 518261 - DNA, 22 bp, Homo sapiens
aaaatgtgggattatgggtcac

SEQ ID NO: 518262 - DNA, 12 bp, Homo sapiens
aaaattttgcag

SEQ ID NO: 518263 - DNA, 12 bp, Homo sapiens
aaatttgtacta

SEQ ID NO: 518264 - DNA, 17 bp, Homo sapiens
aaatttgtactatttaa

SEQ ID NO: 518265 - DNA, 20 bp, Homo sapiens
aaatttgtactatttaactg

SEQ ID NO: 518266 - DNA, 22 bp, Homo sapiens
aaattttaaagcctgaaaattc

SEQ ID NO: 518267 - DNA, 17 bp, Homo sapiens
aaattttgcagaagcta

SEQ ID NO: 518268 - DNA, 12 bp, Homo sapiens
aacaaagaaaga

SEQ ID NO: 518269 - DNA, 21 bp, Homo sapiens
aacaagagcctgattttttga

SEQ ID NO: 518270 - DNA, 13 bp, Homo sapiens
aacacaagcaaaa

SEQ ID NO: 518271 - DNA, 22 bp, Homo sapiens
aacacacagaaggggactgcca

SEQ ID NO: 518272 - DNA, 22 bp, Homo sapiens
aacagctatttcccttttctgt

SEQ ID NO: 518273 - DNA, 19 bp, Homo sapiens
aacataattttttttttct

SEQ ID NO: 518274 - DNA, 21 bp, Homo sapiens
aacataattttttttttctca

SEQ ID NO: 518275 - DNA, 19 bp, Homo sapiens
aacattcctcatgaatgta

SEQ ID NO: 518276 - DNA, 17 bp, Homo sapiens
aacattggagacatcac

SEQ ID NO: 518277 - DNA, 12 bp, Homo sapiens
aacccaattttc

SEQ ID NO: 518278 - DNA, 15 bp, Homo sapiens
aacccctcgcccagt

SEQ ID NO: 518279 - DNA, 20 bp, Homo sapiens
aacccctcgcccagtcccag

SEQ ID NO: 518280 - DNA, 19 bp, Homo sapiens
aactatgacaatttttgct

SEQ ID NO: 518281 - DNA, 16 bp, Homo sapiens
aactccacatctgcct

SEQ ID NO: 518282 - DNA, 17 bp, Homo sapiens
aactccacatctgcctt

SEQ ID NO: 518283 - DNA, 18 bp, Homo sapiens
aactccacatctgcctta

SEQ ID NO: 518284 - DNA, 13 bp, Homo sapiens
aactctattttga

SEQ ID NO: 518285 - DNA, 14 bp, Homo sapiens
aactctattttgat

SEQ ID NO: 518286 - DNA, 20 bp, Homo sapiens
aactgactattcttgatgta

SEQ ID NO: 518287 - DNA, 20 bp, Homo sapiens
aactgaggtgttattttcaa

SEQ ID NO: 518288 - DNA, 16 bp, Homo sapiens
aacttcactccaaaga

SEQ ID NO: 518289 - DNA, 20 bp, Homo sapiens
aacttcactccaaagagaaa

SEQ ID NO: 518290 - DNA, 23 bp, Homo sapiens
aacttcactccaaagagaaacct

SEQ ID NO: 518291 - DNA, 22 bp, Homo sapiens
aacttggctctcaataaacttt

SEQ ID NO: 518292 - DNA, 18 bp, Homo sapiens
aacttttttattttaaga

SEQ ID NO: 518293 - DNA, 14 bp, Homo sapiens
aagaaaaaatggca

SEQ ID NO: 518294 - DNA, 21 bp, Homo sapiens
aagaaaaaatggcaagagatc

SEQ ID NO: 518295 - DNA, 12 bp, Homo sapiens
aagaaaattttg

SEQ ID NO: 518296 - DNA, 15 bp, Homo sapiens
aagaaaattttgcag

SEQ ID NO: 518297 - DNA, 14 bp, Homo sapiens
aagaagggagaaga

SEQ ID NO: 518298 - DNA, 11 bp, Homo sapiens
aagagattatg

SEQ ID NO: 518299 - DNA, 19 bp, Homo sapiens
aagagccccactctcagag

SEQ ID NO: 518300 - DNA, 18 bp, Homo sapiens
aagagcccttgcctcccc

SEQ ID NO: 518301 - DNA, 19 bp, Homo sapiens
aagaggaagaagaagaaag

SEQ ID NO: 518302 - DNA, 14 bp, Homo sapiens
aagagggagggaaa

SEQ ID NO: 518303 - DNA, 16 bp, Homo sapiens
aagagggggtggaggg

SEQ ID NO: 518304 - DNA, 16 bp, Homo sapiens
aagagtggccccacct

SEQ ID NO: 518305 - DNA, 17 bp, Homo sapiens
aagagtggccccacctg

SEQ ID NO: 518306 - DNA, 19 bp, Homo sapiens
aagagtggccccacctggc

SEQ ID NO: 518307 - DNA, 16 bp, Homo sapiens
aagataatgcatattt

SEQ ID NO: 518308 - DNA, 17 bp, Homo sapiens
aagataatgcatatttt

SEQ ID NO: 518309 - DNA, 20 bp, Homo sapiens
aagatatatttgtcattttc

SEQ ID NO: 518310 - DNA, 17 bp, Homo sapiens
aagcaagtggttgtttt

SEQ ID NO: 518311 - DNA, 13 bp, Homo sapiens
aagcagtgcccag

SEQ ID NO: 518312 - DNA, 15 bp, Homo sapiens
aagcagtgcccaggt

SEQ ID NO: 518313 - DNA, 11 bp, Homo sapiens
aagccaaagaa

SEQ ID NO: 518314 - DNA, 15 bp, Homo sapiens
aagccaaagaaaaat

SEQ ID NO: 518315 - DNA, 16 bp, Homo sapiens
aagccaatattttaag

SEQ ID NO: 518316 - DNA, 14 bp, Homo sapiens
aagcccaggagccc

SEQ ID NO: 518317 - DNA, 20 bp, Homo sapiens
aagccccatgggctgccttg

SEQ ID NO: 518318 - DNA, 18 bp, Homo sapiens
aagcctctgtcttttctg

SEQ ID NO: 518319 - DNA, 12 bp, Homo sapiens
aagcctgaaaat

SEQ ID NO: 518320 - DNA, 17 bp, Homo sapiens
aagcctgaaaattccaa

SEQ ID NO: 518321 - DNA, 21 bp, Homo sapiens
aagcctgaaaattccaatttg

SEQ ID NO: 518322 - DNA, 17 bp, Homo sapiens
aagccttggttgggtat

SEQ ID NO: 518323 - DNA, 14 bp, Homo sapiens
aagcgccctggccc

SEQ ID NO: 518324 - DNA, 17 bp, Homo sapiens
aagctatgtttttaaag

SEQ ID NO: 518325 - DNA, 18 bp, Homo sapiens
aagctatgtttttaaagt

SEQ ID NO: 518326 - DNA, 21 bp, Homo sapiens
aagctatgtttttaaagtgta

SEQ ID NO: 518327 - DNA, 16 bp, Homo sapiens
aatggtagcctctggg

SEQ ID NO: 518328 - DNA, 18 bp, Homo sapiens
aatgtaaatttgtactat

SEQ ID NO: 518329 - DNA, 20 bp, Homo sapiens
aatgtcacttcatattttat

SEQ ID NO: 518330 - DNA, 12 bp, Homo sapiens
aattacttaaat

SEQ ID NO: 518331 - DNA, 15 bp, Homo sapiens
aattcttgtaacttt

SEQ ID NO: 518332 - DNA, 19 bp, Homo sapiens
aattgccatagaaagtata

SEQ ID NO: 518333 - DNA, 20 bp, Homo sapiens
aattgccatagaaagtataa

SEQ ID NO: 518334 - DNA, 23 bp, Homo sapiens
aattggggattgagttgtaaaga

SEQ ID NO: 518335 - DNA, 20 bp, Homo sapiens
aattgtaaacagaaattgca

SEQ ID NO: 518336 - DNA, 10 bp, Homo sapiens
aatttaaagt

SEQ ID NO: 518337 - DNA, 11 bp, Homo sapiens
aatttaaagtt

SEQ ID NO: 518338 - DNA, 21 bp, Homo sapiens
aatttattgtctttattttta

SEQ ID NO: 518339 - DNA, 21 bp, Homo sapiens
aatttctttctaaaacacatt

SEQ ID NO: 518340 - DNA, 11 bp, Homo sapiens
aatttgcttta

SEQ ID NO: 518341 - DNA, 19 bp, Homo sapiens
aatttgtactatttaactg

SEQ ID NO: 518342 - DNA, 16 bp, Homo sapiens
aatttgtggtgatttg

SEQ ID NO: 518343 - DNA, 21 bp, Homo sapiens
aattttaaagcctgaaaattc

SEQ ID NO: 518344 - DNA, 14 bp, Homo sapiens
aatttttgaaaagc

SEQ ID NO: 518345 - DNA, 14 bp, Homo sapiens
aattttttttaaca

SEQ ID NO: 518346 - DNA, 17 bp, Homo sapiens
aattttttttaacattc

SEQ ID NO: 518347 - DNA, 19 bp, Homo sapiens
aattttttttaacattcct

SEQ ID NO: 518348 - DNA, 17 bp, Homo sapiens
acaaaatgtagacaaag

SEQ ID NO: 518349 - DNA, 17 bp, Homo sapiens
acaagagcctgattttt

SEQ ID NO: 518350 - DNA, 19 bp, Homo sapiens
acaagtaacagttgaagaa

SEQ ID NO: 518351 - DNA, 20 bp, Homo sapiens
acaatggtttcaaagaaaga

SEQ ID NO: 518352 - DNA, 16 bp, Homo sapiens
acaattaataaatgtc

SEQ ID NO: 518353 - DNA, 18 bp, Homo sapiens
acacaggacaggggttcc

SEQ ID NO: 518354 - DNA, 18 bp, Homo sapiens
acacattaataaacaatc

SEQ ID NO: 518355 - DNA, 14 bp, Homo sapiens
acacttaaaagaaa

SEQ ID NO: 518356 - DNA, 17 bp, Homo sapiens
acacttaaaagaaaaca

SEQ ID NO: 518357 - DNA, 18 bp, Homo sapiens
acacttaaaagaaaacaa

SEQ ID NO: 518358 - DNA, 21 bp, Homo sapiens
acagctatttcccttttctgt

SEQ ID NO: 518359 - DNA, 22 bp, Homo sapiens
acagcttgagccgggcccctgg

SEQ ID NO: 518360 - DNA, 15 bp, Homo sapiens
acaggctgagtgcag

SEQ ID NO: 518361 - DNA, 16 bp, Homo sapiens
acaggctgagtgcagg

SEQ ID NO: 518362 - DNA, 17 bp, Homo sapiens
acaggctgagtgcaggc

SEQ ID NO: 518363 - DNA, 13 bp, Homo sapiens
acaggggttcctt

SEQ ID NO: 518364 - DNA, 18 bp, Homo sapiens
acagtctcaccatttccc

SEQ ID NO: 518365 - DNA, 23 bp, Homo sapiens
acagtgctgccacttaaaaagac

SEQ ID NO: 518366 - DNA, 22 bp, Homo sapiens
acagtggttttatactgaagga

SEQ ID NO: 518367 - DNA, 18 bp, Homo sapiens
acagttacaagctttaaa

SEQ ID NO: 518368 - DNA, 13 bp, Homo sapiens
acagttgaagaaa

SEQ ID NO: 518369 - DNA, 18 bp, Homo sapiens
acataattttttttttct

SEQ ID NO: 518370 - DNA, 21 bp, Homo sapiens
acatactcaggataacagaga

SEQ ID NO: 518371 - DNA, 19 bp, Homo sapiens
acatatgattgtatttgtg

SEQ ID NO: 518372 - DNA, 12 bp, Homo sapiens
acatcactggca

SEQ ID NO: 518373 - DNA, 12 bp, Homo sapiens
acatcatttctt

SEQ ID NO: 518374 - DNA, 13 bp, Homo sapiens
acatggtgcctga

SEQ ID NO: 518375 - DNA, 23 bp, Homo sapiens
acatggtgcctgagaggcaggca

SEQ ID NO: 518376 - DNA, 16 bp, Homo sapiens
acatgttgtatttatg

SEQ ID NO: 518377 - DNA, 17 bp, Homo sapiens
acattataccgcagagt

SEQ ID NO: 518378 - DNA, 13 bp, Homo sapiens
acattccatgacg

SEQ ID NO: 518379 - DNA, 17 bp, Homo sapiens
acattcctcatgaatgt

SEQ ID NO: 518380 - DNA, 20 bp, Homo sapiens
acattcctcatgaatgtaaa

SEQ ID NO: 518381 - DNA, 19 bp, Homo sapiens
acattctttcctaaatata

SEQ ID NO: 518382 - DNA, 11 bp, Homo sapiens
accaaagagta

SEQ ID NO: 518383 - DNA, 19 bp, Homo sapiens
accaaagagtattcagtga

SEQ ID NO: 518384 - DNA, 18 bp, Homo sapiens
accagctgcgcttgcttt

SEQ ID NO: 518385 - DNA, 19 bp, Homo sapiens
accagctgcgcttgctttt

SEQ ID NO: 518386 - DNA, 17 bp, Homo sapiens
accatgctgtctggcac

SEQ ID NO: 518387 - DNA, 21 bp, Homo sapiens
accatgctgtctggcacagcc

SEQ ID NO: 518388 - DNA, 22 bp, Homo sapiens
accatgctgtctggcacagcct

SEQ ID NO: 518389 - DNA, 22 bp, Homo sapiens
accatggattgtacatattttt

SEQ ID NO: 518390 - DNA, 18 bp, Homo sapiens
accatttccccagggcac

SEQ ID NO: 518391 - DNA, 19 bp, Homo sapiens
accatttccccagggcacg

SEQ ID NO: 518392 - DNA, 17 bp, Homo sapiens
acccaagggtcgcctat

SEQ ID NO: 518393 - DNA, 11 bp, Homo sapiens
acccagtggca

SEQ ID NO: 518394 - DNA, 14 bp, Homo sapiens
acccagtggcaggg

SEQ ID NO: 518395 - DNA, 15 bp, Homo sapiens
acccagtggcagggc

SEQ ID NO: 518396 - DNA, 17 bp, Homo sapiens
acccagtggcagggcac

SEQ ID NO: 518397 - DNA, 20 bp, Homo sapiens
acccagtggcagggcacagg

SEQ ID NO: 518398 - DNA, 24 bp, Homo sapiens
acccagtggcagggcacagggcct

SEQ ID NO: 518399 - DNA, 13 bp, Homo sapiens
acccatgggcagg

SEQ ID NO: 518400 - DNA, 16 bp, Homo sapiens
acccatgggcaggaga

SEQ ID NO: 518401 - DNA, 15 bp, Homo sapiens
accccaagcgccctg

SEQ ID NO: 518402 - DNA, 16 bp, Homo sapiens
accccaagcgccctgg

SEQ ID NO: 518403 - DNA, 23 bp, Homo sapiens
accccaagcgccctggcccccac

SEQ ID NO: 518404 - DNA, 20 bp, Homo sapiens
accccagcctcaaatccagg

SEQ ID NO: 518405 - DNA, 17 bp, Homo sapiens
accccggggaccctgtg

SEQ ID NO: 518406 - DNA, 18 bp, Homo sapiens
accccggggaccctgtga

SEQ ID NO: 518407 - DNA, 19 bp, Homo sapiens
acccctcgcccagtcccag

SEQ ID NO: 518408 - DNA, 22 bp, Homo sapiens
acccctcgcccagtcccagcag

SEQ ID NO: 518409 - DNA, 22 bp, Homo sapiens
acccctgcagttcccctggaag

SEQ ID NO: 518410 - DNA, 14 bp, Homo sapiens
acccctggacccca

SEQ ID NO: 518411 - DNA, 17 bp, Homo sapiens
acccctggaccccagcc

SEQ ID NO: 518412 - DNA, 20 bp, Homo sapiens
acccctggaccccagcctca

SEQ ID NO: 518413 - DNA, 17 bp, Homo sapiens
accccttctctcctccc

SEQ ID NO: 518414 - DNA, 23 bp, Homo sapiens
accccttctctcctccccaaatc

SEQ ID NO: 518415 - DNA, 16 bp, Homo sapiens
accctgccaggcacag

SEQ ID NO: 518416 - DNA, 21 bp, Homo sapiens
accctgccaggcacaggcagg

SEQ ID NO: 518417 - DNA, 23 bp, Homo sapiens
accctgccaggcacaggcagggc

SEQ ID NO: 518418 - DNA, 18 bp, Homo sapiens
accctgggtgggctctgt

SEQ ID NO: 518419 - DNA, 12 bp, Homo sapiens
accctttggttt

SEQ ID NO: 518420 - DNA, 21 bp, Homo sapiens
accctttggtttttttcttct

SEQ ID NO: 518421 - DNA, 20 bp, Homo sapiens
accgccggttcattttgcac

SEQ ID NO: 518422 - DNA, 18 bp, Homo sapiens
accgtggaggaggaaggc

SEQ ID NO: 518423 - DNA, 20 bp, Homo sapiens
acctaaaataaataccaaag

SEQ ID NO: 518424 - DNA, 22 bp, Homo sapiens
acctcagtctacccctctcctt

SEQ ID NO: 518425 - DNA, 21 bp, Homo sapiens
acctcatgcccaccccctgcc

SEQ ID NO: 518426 - DNA, 23 bp, Homo sapiens
acctcatgcccaccccctgccct

SEQ ID NO: 518427 - DNA, 17 bp, Homo sapiens
acctccccttgccagct

SEQ ID NO: 518428 - DNA, 15 bp, Homo sapiens
acctgccaggcaggg

SEQ ID NO: 518429 - DNA, 18 bp, Homo sapiens
acctgccaggcaggggtg

SEQ ID NO: 518430 - DNA, 19 bp, Homo sapiens
acctggccctctctgaagg

SEQ ID NO: 518431 - DNA, 17 bp, Homo sapiens
acgctaaagagcccttg

SEQ ID NO: 518432 - DNA, 17 bp, Homo sapiens
acgctgactacagggcc

SEQ ID NO: 518433 - DNA, 15 bp, Homo sapiens
acggcaggctcactg

SEQ ID NO: 518434 - DNA, 17 bp, Homo sapiens
acggttcctacacagga

SEQ ID NO: 518435 - DNA, 19 bp, Homo sapiens
acgtggagaatcacaggct

SEQ ID NO: 518436 - DNA, 21 bp, Homo sapiens
acgtggagaatcacaggctgg

SEQ ID NO: 518437 - DNA, 22 bp, Homo sapiens
acgtggagaatcacaggctggg

SEQ ID NO: 518438 - DNA, 13 bp, Homo sapiens
actacacctggct

SEQ ID NO: 518439 - DNA, 14 bp, Homo sapiens
actacacctggctg

SEQ ID NO: 518440 - DNA, 15 bp, Homo sapiens
actagccgaatggta

SEQ ID NO: 518441 - DNA, 17 bp, Homo sapiens
actatgacaatttttgc

SEQ ID NO: 518442 - DNA, 18 bp, Homo sapiens
actatgacaatttttgct

SEQ ID NO: 518443 - DNA, 17 bp, Homo sapiens
actccacatctgcctta

SEQ ID NO: 518444 - DNA, 16 bp, Homo sapiens
actctaaatagcccag

SEQ ID NO: 518445 - DNA, 18 bp, Homo sapiens
actcttatatttttctgg

SEQ ID NO: 518446 - DNA, 16 bp, Homo sapiens
actgacttttcttttt

SEQ ID NO: 518447 - DNA, 12 bp, Homo sapiens
actgccacctcc

SEQ ID NO: 518448 - DNA, 13 bp, Homo sapiens
actgccacctccc

SEQ ID NO: 518449 - DNA, 12 bp, Homo sapiens
actgccagctct

SEQ ID NO: 518450 - DNA, 19 bp, Homo sapiens
actgccaggccagcctccg

SEQ ID NO: 518451 - DNA, 21 bp, Homo sapiens
actgccttgctagaaacataa

SEQ ID NO: 518452 - DNA, 21 bp, Homo sapiens
actgctctcaccttggttcct

SEQ ID NO: 518453 - DNA, 15 bp, Homo sapiens
actggaaaggggaga

SEQ ID NO: 518454 - DNA, 20 bp, Homo sapiens
actggaaaggggagagcctg

SEQ ID NO: 518455 - DNA, 21 bp, Homo sapiens
actgtaaaatgtgggattatg

SEQ ID NO: 518456 - DNA, 22 bp, Homo sapiens
actgtacttctgtgtgcaattg

SEQ ID NO: 518457 - DNA, 17 bp, Homo sapiens
actgtgcgtggggctcc

SEQ ID NO: 518458 - DNA, 11 bp, Homo sapiens
actgtggagac

SEQ ID NO: 518459 - DNA, 22 bp, Homo sapiens
actgtggagactgctcctgagc

SEQ ID NO: 518460 - DNA, 19 bp, Homo sapiens
actgttgtcatttccaaat

SEQ ID NO: 518461 - DNA, 23 bp, Homo sapiens
acttaaaagaaaacaaagcccca

SEQ ID NO: 518462 - DNA, 17 bp, Homo sapiens
acttcactccaaagaga

SEQ ID NO: 518463 - DNA, 13 bp, Homo sapiens
acttcctttctta

SEQ ID NO: 518464 - DNA, 20 bp, Homo sapiens
acttgaatcagacattttaa

SEQ ID NO: 518465 - DNA, 16 bp, Homo sapiens
acttgggggctcagca

SEQ ID NO: 518466 - DNA, 17 bp, Homo sapiens
acttgggggctcagcaa

SEQ ID NO: 518467 - DNA, 13 bp, Homo sapiens
actttgaacctca

SEQ ID NO: 518468 - DNA, 18 bp, Homo sapiens
agaaaaaatggcaagaga

SEQ ID NO: 518469 - DNA, 12 bp, Homo sapiens
agaaaattttgc

SEQ ID NO: 518470 - DNA, 16 bp, Homo sapiens
agaaaggcaaatctga

SEQ ID NO: 518471 - DNA, 14 bp, Homo sapiens
agaaagtataattt

SEQ ID NO: 518472 - DNA, 13 bp, Homo sapiens
agaagaagaaagg

SEQ ID NO: 518473 - DNA, 12 bp, Homo sapiens
agaagagcccca

SEQ ID NO: 518474 - DNA, 20 bp, Homo sapiens
agaagagccccactctcaga

SEQ ID NO: 518475 - DNA, 15 bp, Homo sapiens
agaaggggactgcca

SEQ ID NO: 518476 - DNA, 20 bp, Homo sapiens
agaaggggactgccacctcc

SEQ ID NO: 518477 - DNA, 17 bp, Homo sapiens
agaagtgacggttccta

SEQ ID NO: 518478 - DNA, 23 bp, Homo sapiens
agaagtgacggttcctacacagg

SEQ ID NO: 518479 - DNA, 22 bp, Homo sapiens
agaagtggagagaaaatacaaa

SEQ ID NO: 518480 - DNA, 16 bp, Homo sapiens
agaatcacaggctggg

SEQ ID NO: 518481 - DNA, 14 bp, Homo sapiens
agaatcatgtattt

SEQ ID NO: 518482 - DNA, 18 bp, Homo sapiens
agaatcatgtattttgta

SEQ ID NO: 518483 - DNA, 22 bp, Homo sapiens
agacaggacccctgcagttccc

SEQ ID NO: 518484 - DNA, 13 bp, Homo sapiens
agacattttaagg

SEQ ID NO: 518485 - DNA, 19 bp, Homo sapiens
agaccaggtggaattactt

SEQ ID NO: 518486 - DNA, 20 bp, Homo sapiens
agaccctgggtgggctctgt

SEQ ID NO: 518487 - DNA, 14 bp, Homo sapiens
agactctgccttaa

SEQ ID NO: 518488 - DNA, 20 bp, Homo sapiens
agactctgccttaatttttg

SEQ ID NO: 518489 - DNA, 16 bp, Homo sapiens
agactgctcctgagcc

SEQ ID NO: 518490 - DNA, 23 bp, Homo sapiens
agactgctcctgagcccccagct

SEQ ID NO: 518491 - DNA, 20 bp, Homo sapiens
agactgtggagactgctcct

SEQ ID NO: 518492 - DNA, 19 bp, Homo sapiens
agacttgagaaatttgaaa

SEQ ID NO: 518493 - DNA, 22 bp, Homo sapiens
agagaaaaaaatataaaatttc

SEQ ID NO: 518494 - DNA, 21 bp, Homo sapiens
agagaaacattctttcctaaa

SEQ ID NO: 518495 - DNA, 14 bp, Homo sapiens
agagaagagcccca

SEQ ID NO: 518496 - DNA, 16 bp, Homo sapiens
agagaagagccccact

SEQ ID NO: 518497 - DNA, 16 bp, Homo sapiens
agagaatggtggtatt

SEQ ID NO: 518498 - DNA, 14 bp, Homo sapiens
agagagaagagccc

SEQ ID NO: 518499 - DNA, 15 bp, Homo sapiens
agagagagagagagg

SEQ ID NO: 518500 - DNA, 14 bp, Homo sapiens
agagagagaggaca

SEQ ID NO: 518501 - DNA, 24 bp, Homo sapiens
agagcaacccctggaccccagcct

SEQ ID NO: 518502 - DNA, 21 bp, Homo sapiens
agagcaggttactaaggaagg

SEQ ID NO: 518503 - DNA, 15 bp, Homo sapiens
agagccccactctca

SEQ ID NO: 518504 - DNA, 16 bp, Homo sapiens
agagccccactctcag

SEQ ID NO: 518505 - DNA, 21 bp, Homo sapiens
agagccccactctcagaggcc

SEQ ID NO: 518506 - DNA, 22 bp, Homo sapiens
agagccccactctcagaggccc

SEQ ID NO: 518507 - DNA, 13 bp, Homo sapiens
agagcctgctggc

SEQ ID NO: 518508 - DNA, 24 bp, Homo sapiens
agagcctgctggcacccaccgtgg

SEQ ID NO: 518509 - DNA, 12 bp, Homo sapiens
agaggagccctg

SEQ ID NO: 518510 - DNA, 13 bp, Homo sapiens
agaggagccctgc

SEQ ID NO: 518511 - DNA, 16 bp, Homo sapiens
agaggcccaaaacagt

SEQ ID NO: 518512 - DNA, 20 bp, Homo sapiens
agaggccccaataccccatg

SEQ ID NO: 518513 - DNA, 19 bp, Homo sapiens
agaggcttctccgccagcc

SEQ ID NO: 518514 - DNA, 13 bp, Homo sapiens
agagggaatgtga

SEQ ID NO: 518515 - DNA, 14 bp, Homo sapiens
agagggaatgtgaa

SEQ ID NO: 518516 - DNA, 12 bp, Homo sapiens
agagggcttcct

SEQ ID NO: 518517 - DNA, 13 bp, Homo sapiens
agagggcttcctc

SEQ ID NO: 518518 - DNA, 15 bp, Homo sapiens
agaggggaggccaag

SEQ ID NO: 518519 - DNA, 22 bp, Homo sapiens
agagtattcagtgatatgtaaa

SEQ ID NO: 518520 - DNA, 18 bp, Homo sapiens
agagtcagagatcttggt

SEQ ID NO: 518521 - DNA, 14 bp, Homo sapiens
agagtggccccacc

SEQ ID NO: 518522 - DNA, 18 bp, Homo sapiens
agataatgcatatttttg

SEQ ID NO: 518523 - DNA, 14 bp, Homo sapiens
agatatatttgtca

SEQ ID NO: 518524 - DNA, 12 bp, Homo sapiens
agatattttcat

SEQ ID NO: 518525 - DNA, 17 bp, Homo sapiens
agatccaaatgtaaagg

SEQ ID NO: 518526 - DNA, 14 bp, Homo sapiens
agatggatgtattt

SEQ ID NO: 518527 - DNA, 13 bp, Homo sapiens
agatgggaatgag

SEQ ID NO: 518528 - DNA, 17 bp, Homo sapiens
agatgggtcaagcaagc

SEQ ID NO: 518529 - DNA, 20 bp, Homo sapiens
agcaacccctggaccccagc

SEQ ID NO: 518530 - DNA, 15 bp, Homo sapiens
agcaaggccacctct

SEQ ID NO: 518531 - DNA, 17 bp, Homo sapiens
agcacaatggtttcaaa

SEQ ID NO: 518532 - DNA, 19 bp, Homo sapiens
agcacaggctgagtgcagg

SEQ ID NO: 518533 - DNA, 21 bp, Homo sapiens
agcacaggctgagtgcaggcc

SEQ ID NO: 518534 - DNA, 23 bp, Homo sapiens
agcacaggctgagtgcaggccca

SEQ ID NO: 518535 - DNA, 13 bp, Homo sapiens
agcacttcagatc

SEQ ID NO: 518536 - DNA, 14 bp, Homo sapiens
agcaggagggacag

SEQ ID NO: 518537 - DNA, 18 bp, Homo sapiens
agcaggagggacagtctc

SEQ ID NO: 518538 - DNA, 19 bp, Homo sapiens
agcaggagggacagtctca

SEQ ID NO: 518539 - DNA, 20 bp, Homo sapiens
agcagtgcccaggtggctgt

SEQ ID NO: 518540 - DNA, 22 bp, Homo sapiens
agcatgaaagataaatgggttt

SEQ ID NO: 518541 - DNA, 22 bp, Homo sapiens
agcatggactgttcatttgaaa

SEQ ID NO: 518542 - DNA, 16 bp, Homo sapiens
agccaagggaaagggg

SEQ ID NO: 518543 - DNA, 16 bp, Homo sapiens
agccaagtggggtgct

SEQ ID NO: 518544 - DNA, 20 bp, Homo sapiens
agccaagtggggtgctggga

SEQ ID NO: 518545 - DNA, 22 bp, Homo sapiens
agccagccaaacacacagaagg

SEQ ID NO: 518546 - DNA, 23 bp, Homo sapiens
agccagtctcctatacccagcag

SEQ ID NO: 518547 - DNA, 23 bp, Homo sapiens
agccataaaaatataacataatc

SEQ ID NO: 518548 - DNA, 20 bp, Homo sapiens
agcccacgctgactacaggg

SEQ ID NO: 518549 - DNA, 15 bp, Homo sapiens
agccccactctcaga

SEQ ID NO: 518550 - DNA, 20 bp, Homo sapiens
agcccccagcttccagcagg

SEQ ID NO: 518551 - DNA, 22 bp, Homo sapiens
agcccccagcttccagcaggag

SEQ ID NO: 518552 - DNA, 12 bp, Homo sapiens
tggccccacctg

SEQ ID NO: 518553 - DNA, 19 bp, Homo sapiens
tggccccacctggccctct

SEQ ID NO: 518554 - DNA, 23 bp, Homo sapiens
tggccccacctggccctctctga

SEQ ID NO: 518555 - DNA, 17 bp, Homo sapiens
tggcccccacatggtga

SEQ ID NO: 518556 - DNA, 14 bp, Homo sapiens
tggctccctcactc

SEQ ID NO: 518557 - DNA, 17 bp, Homo sapiens
tggctccctcactctca

SEQ ID NO: 518558 - DNA, 18 bp, Homo sapiens
tggctgaggttcctctgc

SEQ ID NO: 518559 - DNA, 20 bp, Homo sapiens
tggctgaggttcctctgcct

SEQ ID NO: 518560 - DNA, 16 bp, Homo sapiens
tggctgctgcccccac

SEQ ID NO: 518561 - DNA, 21 bp, Homo sapiens
tggctgtggaataggaacgct

SEQ ID NO: 518562 - DNA, 20 bp, Homo sapiens
tgggaaaacttcactccaaa

SEQ ID NO: 518563 - DNA, 21 bp, Homo sapiens
tgggaaaacttcactccaaag

SEQ ID NO: 518564 - DNA, 21 bp, Homo sapiens
tgggaaggtgtttaaagagtt

SEQ ID NO: 518565 - DNA, 20 bp, Homo sapiens
tgggacccagtggcagggca

SEQ ID NO: 518566 - DNA, 21 bp, Homo sapiens
tgggacccagtggcagggcac

SEQ ID NO: 518567 - DNA, 22 bp, Homo sapiens
tgggacccagtggcagggcaca

SEQ ID NO: 518568 - DNA, 12 bp, Homo sapiens
tgggagagactt

SEQ ID NO: 518569 - DNA, 19 bp, Homo sapiens
tgggaggagggagagggag

SEQ ID NO: 518570 - DNA, 14 bp, Homo sapiens
tgggaggtggaaaa

SEQ ID NO: 518571 - DNA, 18 bp, Homo sapiens
tgggaggtggaagaaggg

SEQ ID NO: 518572 - DNA, 22 bp, Homo sapiens
tgggctgttctgtttcctgtgt

SEQ ID NO: 518573 - DNA, 19 bp, Homo sapiens
tggggattgagttgtaaag

SEQ ID NO: 518574 - DNA, 16 bp, Homo sapiens
tggggctcccgcctcc

SEQ ID NO: 518575 - DNA, 21 bp, Homo sapiens
tggggctgggggatgggcctg

SEQ ID NO: 518576 - DNA, 22 bp, Homo sapiens
tggggctgggggatgggcctga

SEQ ID NO: 518577 - DNA, 17 bp, Homo sapiens
tgggggatgggcctgag

SEQ ID NO: 518578 - DNA, 19 bp, Homo sapiens
tgggggccccgtctcaggt

SEQ ID NO: 518579 - DNA, 22 bp, Homo sapiens
tgggggccccgtctcaggtctg

SEQ ID NO: 518580 - DNA, 18 bp, Homo sapiens
tgggggctcagcaaggcc

SEQ ID NO: 518581 - DNA, 13 bp, Homo sapiens
tggggggaacgcc

SEQ ID NO: 518582 - DNA, 12 bp, Homo sapiens
tgggtcacagga

SEQ ID NO: 518583 - DNA, 16 bp, Homo sapiens
tgggttagactgccag

SEQ ID NO: 518584 - DNA, 14 bp, Homo sapiens
tggtaagtggcttt

SEQ ID NO: 518585 - DNA, 15 bp, Homo sapiens
tggtattggtgcttt

SEQ ID NO: 518586 - DNA, 22 bp, Homo sapiens
tggtgcacaggtttgttttttc

SEQ ID NO: 518587 - DNA, 13 bp, Homo sapiens
tggtgcctgagag

SEQ ID NO: 518588 - DNA, 18 bp, Homo sapiens
tggtgcctgagaggcagg

SEQ ID NO: 518589 - DNA, 18 bp, Homo sapiens
tggttcctggggcatcca

SEQ ID NO: 518590 - DNA, 14 bp, Homo sapiens
tggttgggacccag

SEQ ID NO: 518591 - DNA, 16 bp, Homo sapiens
tggtttcaaagaaaga

SEQ ID NO: 518592 - DNA, 17 bp, Homo sapiens
tgtaaacagaaattgca

SEQ ID NO: 518593 - DNA, 14 bp, Homo sapiens
tgtaaactgatgtt

SEQ ID NO: 518594 - DNA, 17 bp, Homo sapiens
tgtaaactgatgtttgt

SEQ ID NO: 518595 - DNA, 15 bp, Homo sapiens
tgtaaattaaatgaa

SEQ ID NO: 518596 - DNA, 16 bp, Homo sapiens
tgtaacactagccgaa

SEQ ID NO: 518597 - DNA, 19 bp, Homo sapiens
tgtaactcctccatccatg

SEQ ID NO: 518598 - DNA, 14 bp, Homo sapiens
tgtactatttaact

SEQ ID NO: 518599 - DNA, 15 bp, Homo sapiens
tgtactatttaactg

SEQ ID NO: 518600 - DNA, 19 bp, Homo sapiens
tgtactcttatatttttct

SEQ ID NO: 518601 - DNA, 15 bp, Homo sapiens
tgtagacaaagtgaa

SEQ ID NO: 518602 - DNA, 20 bp, Homo sapiens
tgtataggggaaaatattat

SEQ ID NO: 518603 - DNA, 14 bp, Homo sapiens
tgtatgccattaaa

SEQ ID NO: 518604 - DNA, 21 bp, Homo sapiens
tgtatttatggaagaaagagt

SEQ ID NO: 518605 - DNA, 16 bp, Homo sapiens
tgtatttgtagccagt

SEQ ID NO: 518606 - DNA, 18 bp, Homo sapiens
tgtattttatttagacaa

SEQ ID NO: 518607 - DNA, 17 bp, Homo sapiens
tgtattttgtaaactga

SEQ ID NO: 518608 - DNA, 14 bp, Homo sapiens
tgtatttttgttgc

SEQ ID NO: 518609 - DNA, 21 bp, Homo sapiens
tgtatttttttttctaagaga

SEQ ID NO: 518610 - DNA, 14 bp, Homo sapiens
tgtcacttcatatt

SEQ ID NO: 518611 - DNA, 15 bp, Homo sapiens
tgtcatgtgtataaa

SEQ ID NO: 518612 - DNA, 14 bp, Homo sapiens
tgtcatttccaaat

SEQ ID NO: 518613 - DNA, 21 bp, Homo sapiens
tgtcatttccaaattcctaga

SEQ ID NO: 518614 - DNA, 14 bp, Homo sapiens
tgtcattttctctt

SEQ ID NO: 518615 - DNA, 19 bp, Homo sapiens
tgtcctgatgtttttctgt

SEQ ID NO: 518616 - DNA, 21 bp, Homo sapiens
tgtcctgatgtttttctgtgt

SEQ ID NO: 518617 - DNA, 18 bp, Homo sapiens
tgtctggcacagcctgca

SEQ ID NO: 518618 - DNA, 20 bp, Homo sapiens
tccgccagcctcctctggac

SEQ ID NO: 518619 - DNA, 17 bp, Homo sapiens
tccgcccctgagcccac

SEQ ID NO: 518620 - DNA, 19 bp, Homo sapiens
tccgcccctgagcccactg

SEQ ID NO: 518621 - DNA, 18 bp, Homo sapiens
tcctaaaaggcccagaga

SEQ ID NO: 518622 - DNA, 19 bp, Homo sapiens
tcctaatttctcctccctt

SEQ ID NO: 518623 - DNA, 14 bp, Homo sapiens
tcctacacaggaca

SEQ ID NO: 518624 - DNA, 15 bp, Homo sapiens
tcctagaaaagtttg

SEQ ID NO: 518625 - DNA, 19 bp, Homo sapiens
tcctatctcaactctgttt

SEQ ID NO: 518626 - DNA, 15 bp, Homo sapiens
tcctcatgaatgtaa

SEQ ID NO: 518627 - DNA, 20 bp, Homo sapiens
tcctcatgaatgtaaatttg

SEQ ID NO: 518628 - DNA, 21 bp, Homo sapiens
tcctcatgaatgtaaatttgt

SEQ ID NO: 518629 - DNA, 20 bp, Homo sapiens
tcctccatccatgtgttcca

SEQ ID NO: 518630 - DNA, 22 bp, Homo sapiens
tcctcccttccttttccctgct

SEQ ID NO: 518631 - DNA, 18 bp, Homo sapiens
tcctctagaagccaaggg

SEQ ID NO: 518632 - DNA, 13 bp, Homo sapiens
tcctgagccccca

SEQ ID NO: 518633 - DNA, 21 bp, Homo sapiens
tcctgatgtttttctgtgtta

SEQ ID NO: 518634 - DNA, 15 bp, Homo sapiens
tcctgcgtcctcctc

SEQ ID NO: 518635 - DNA, 18 bp, Homo sapiens
tcctgcgtcctcctcacc

SEQ ID NO: 518636 - DNA, 15 bp, Homo sapiens
tcctgtgtctccaag

SEQ ID NO: 518637 - DNA, 15 bp, Homo sapiens
tcctgtgtggagagg

SEQ ID NO: 518638 - DNA, 14 bp, Homo sapiens
tccttttccctgct

SEQ ID NO: 518639 - DNA, 22 bp, Homo sapiens
tcgcatagaaatcaataatttg

SEQ ID NO: 518640 - DNA, 21 bp, Homo sapiens
tcgcccagtcccagcagccag

SEQ ID NO: 518641 - DNA, 13 bp, Homo sapiens
tctaaatagccca

SEQ ID NO: 518642 - DNA, 22 bp, Homo sapiens
tctaaccatagctgacctttgt

SEQ ID NO: 518643 - DNA, 12 bp, Homo sapiens
tctacagtggtt

SEQ ID NO: 518644 - DNA, 21 bp, Homo sapiens
tctacattataccgcagagta

SEQ ID NO: 518645 - DNA, 20 bp, Homo sapiens
tctacccctctcctttcact

SEQ ID NO: 518646 - DNA, 17 bp, Homo sapiens
tctagaagccaagggaa

SEQ ID NO: 518647 - DNA, 21 bp, Homo sapiens
tctagaagccaagggaaaggg

SEQ ID NO: 518648 - DNA, 11 bp, Homo sapiens
tctattctttc

SEQ ID NO: 518649 - DNA, 12 bp, Homo sapiens
tctcaaaactga

SEQ ID NO: 518650 - DNA, 23 bp, Homo sapiens
tctcacagacaggacccctgcag

SEQ ID NO: 518651 - DNA, 18 bp, Homo sapiens
tctcaccatttggatcct

SEQ ID NO: 518652 - DNA, 22 bp, Homo sapiens
tctccaagcctctgtcttttct

SEQ ID NO: 518653 - DNA, 19 bp, Homo sapiens
tctcccaggtaccagctgc

SEQ ID NO: 518654 - DNA, 17 bp, Homo sapiens
tctcccctgcactgtaa

SEQ ID NO: 518655 - DNA, 14 bp, Homo sapiens
tctccgccagcctc

SEQ ID NO: 518656 - DNA, 17 bp, Homo sapiens
tctccgcccctgagccc

SEQ ID NO: 518657 - DNA, 15 bp, Homo sapiens
tctcctatacccagc

SEQ ID NO: 518658 - DNA, 13 bp, Homo sapiens
tctcctcccttcc

SEQ ID NO: 518659 - DNA, 15 bp, Homo sapiens
tctctcacagacagg

SEQ ID NO: 518660 - DNA, 23 bp, Homo sapiens
tctctcacagacaggacccctgc

SEQ ID NO: 518661 - DNA, 14 bp, Homo sapiens
tctctctctctttg

SEQ ID NO: 518662 - DNA, 14 bp, Homo sapiens
tctctctctttgtt

SEQ ID NO: 518663 - DNA, 21 bp, Homo sapiens
tctctgaaggaggccacctcc

SEQ ID NO: 518664 - DNA, 23 bp, Homo sapiens
tctctgaaggaggccacctccta

SEQ ID NO: 518665 - DNA, 15 bp, Homo sapiens
tctctggttcttgaa

SEQ ID NO: 518666 - DNA, 24 bp, Homo sapiens
tctcttatggtattatatctctgt

SEQ ID NO: 518667 - DNA, 19 bp, Homo sapiens
tctgagttgttaccccaag

SEQ ID NO: 518668 - DNA, 18 bp, Homo sapiens
tctgataatttattgtct

SEQ ID NO: 518669 - DNA, 19 bp, Homo sapiens
tctgataatttattgtctt

SEQ ID NO: 518670 - DNA, 20 bp, Homo sapiens
tctgcaccccttctctcctc

SEQ ID NO: 518671 - DNA, 21 bp, Homo sapiens
tctgccctggctgctgccccc

SEQ ID NO: 518672 - DNA, 12 bp, Homo sapiens
tctgcctgcccc

SEQ ID NO: 518673 - DNA, 22 bp, Homo sapiens
tctgccttaatttttgaaaagc

SEQ ID NO: 518674 - DNA, 16 bp, Homo sapiens
tctgcttttctgccct

SEQ ID NO: 518675 - DNA, 22 bp, Homo sapiens
tctgcttttctgccctggctgc

SEQ ID NO: 518676 - DNA, 23 bp, Homo sapiens
tctggacggcaggctcactgcca

SEQ ID NO: 518677 - DNA, 21 bp, Homo sapiens
tctgggacctgccaggcaggg

SEQ ID NO: 518678 - DNA, 15 bp, Homo sapiens
tctgggcttttcctt

SEQ ID NO: 518679 - DNA, 23 bp, Homo sapiens
tctgtattttatttagacaagag

SEQ ID NO: 518680 - DNA, 13 bp, Homo sapiens
tctgtgtgcaatt

SEQ ID NO: 518681 - DNA, 21 bp, Homo sapiens
tctgttaatgcattctttctt

SEQ ID NO: 518682 - DNA, 17 bp, Homo sapiens
tctgttatttatttcag

SEQ ID NO: 518683 - DNA, 13 bp, Homo sapiens
tctgtttatttga

SEQ ID NO: 518684 - DNA, 14 bp, Homo sapiens
tctgtttcctgtgt

SEQ ID NO: 518685 - DNA, 22 bp, Homo sapiens
tcttatggtattatatctctgt

SEQ ID NO: 518686 - DNA, 14 bp, Homo sapiens
tcttattttattat

SEQ ID NO: 518687 - DNA, 16 bp, Homo sapiens
tcttcctagtgcctac

SEQ ID NO: 518688 - DNA, 12 bp, Homo sapiens
tcttcctggccg

SEQ ID NO: 518689 - DNA, 14 bp, Homo sapiens
tcttctgtattttt

SEQ ID NO: 518690 - DNA, 21 bp, Homo sapiens
tcttggtatgggctgttctgt

SEQ ID NO: 518691 - DNA, 15 bp, Homo sapiens
tcttgtaactttctt

SEQ ID NO: 518692 - DNA, 13 bp, Homo sapiens
tcttgtcatgtgt

SEQ ID NO: 518693 - DNA, 17 bp, Homo sapiens
tcttgtcatgtgtataa

SEQ ID NO: 518694 - DNA, 22 bp, Homo sapiens
tctttagggaacaaggatgttt

SEQ ID NO: 518695 - DNA, 21 bp, Homo sapiens
tctttatttttatcccaggaa

SEQ ID NO: 518696 - DNA, 18 bp, Homo sapiens
tctttttcactctgtgtc

SEQ ID NO: 518697 - DNA, 22 bp, Homo sapiens
tctttttgggagagacttgttt

SEQ ID NO: 518698 - DNA, 18 bp, Homo sapiens
tgaaaatgtctcagtatt

SEQ ID NO: 518699 - DNA, 11 bp, Homo sapiens
tgaaaattcca

SEQ ID NO: 518700 - DNA, 14 bp, Homo sapiens
tgaaaattccaatt

SEQ ID NO: 518701 - DNA, 13 bp, Homo sapiens
tgaaacaaagaaa

SEQ ID NO: 518702 - DNA, 17 bp, Homo sapiens
tgaacttgcaggcaagc

SEQ ID NO: 518703 - DNA, 11 bp, Homo sapiens
tgaagccaaag

SEQ ID NO: 518704 - DNA, 21 bp, Homo sapiens
tgaagccaagtggggtgctgg

SEQ ID NO: 518705 - DNA, 22 bp, Homo sapiens
tgaagccaagtggggtgctggg

SEQ ID NO: 518706 - DNA, 23 bp, Homo sapiens
tgaagccaagtggggtgctggga

SEQ ID NO: 518707 - DNA, 18 bp, Homo sapiens
gactgtggagactgctcc

SEQ ID NO: 518708 - DNA, 19 bp, Homo sapiens
gactgtggagactgctcct

SEQ ID NO: 518709 - DNA, 11 bp, Homo sapiens
gagaagagccc

SEQ ID NO: 518710 - DNA, 21 bp, Homo sapiens
gagaagagccccactctcaga

SEQ ID NO: 518711 - DNA, 14 bp, Homo sapiens
gagaatcacaggct

SEQ ID NO: 518712 - DNA, 15 bp, Homo sapiens
gagagaagagcccca

SEQ ID NO: 518713 - DNA, 20 bp, Homo sapiens
gagagacttgttttggatgc

SEQ ID NO: 518714 - DNA, 11 bp, Homo sapiens
gagaggcaggc

SEQ ID NO: 518715 - DNA, 12 bp, Homo sapiens
gagaggcaggca

SEQ ID NO: 518716 - DNA, 15 bp, Homo sapiens
gagaggcaggcatag

SEQ ID NO: 518717 - DNA, 10 bp, Homo sapiens
gagagggaga

SEQ ID NO: 518718 - DNA, 17 bp, Homo sapiens
gagatcatatcctcaga

SEQ ID NO: 518719 - DNA, 11 bp, Homo sapiens
gagatggatgt

SEQ ID NO: 518720 - DNA, 21 bp, Homo sapiens
gagatgggaatgaggtgggag

SEQ ID NO: 518721 - DNA, 14 bp, Homo sapiens
gagccccactctca

SEQ ID NO: 518722 - DNA, 21 bp, Homo sapiens
gagccccactctcagaggccc

SEQ ID NO: 518723 - DNA, 22 bp, Homo sapiens
gagccccactctcagaggcccc

SEQ ID NO: 518724 - DNA, 18 bp, Homo sapiens
gagccctgcctctccgcc

SEQ ID NO: 518725 - DNA, 16 bp, Homo sapiens
gagcccttgcctcccc

SEQ ID NO: 518726 - DNA, 16 bp, Homo sapiens
gagcctgattttttga

SEQ ID NO: 518727 - DNA, 10 bp, Homo sapiens
gagcctgctg

SEQ ID NO: 518728 - DNA, 13 bp, Homo sapiens
gaggaaggcaaga

SEQ ID NO: 518729 - DNA, 21 bp, Homo sapiens
gaggaaggcaagagggggtgg

SEQ ID NO: 518730 - DNA, 15 bp, Homo sapiens
gaggagccctgcctc

SEQ ID NO: 518731 - DNA, 16 bp, Homo sapiens
gaggccaagagtggcc

SEQ ID NO: 518732 - DNA, 19 bp, Homo sapiens
gaggccaagagtggcccca

SEQ ID NO: 518733 - DNA, 19 bp, Homo sapiens
gaggccccaataccccatg

SEQ ID NO: 518734 - DNA, 15 bp, Homo sapiens
gaggcttctccgcca

SEQ ID NO: 518735 - DNA, 18 bp, Homo sapiens
gaggcttctccgccagcc

SEQ ID NO: 518736 - DNA, 19 bp, Homo sapiens
gaggcttctccgccagcct

SEQ ID NO: 518737 - DNA, 21 bp, Homo sapiens
gaggcttctccgccagcctcc

SEQ ID NO: 518738 - DNA, 13 bp, Homo sapiens
gagggagagggag

SEQ ID NO: 518739 - DNA, 15 bp, Homo sapiens
gagggcctgggcctg

SEQ ID NO: 518740 - DNA, 19 bp, Homo sapiens
gagggcttcctctagaagc

SEQ ID NO: 518741 - DNA, 17 bp, Homo sapiens
gagggggcttgaagcca

SEQ ID NO: 518742 - DNA, 15 bp, Homo sapiens
gaggtcactggaaag

SEQ ID NO: 518743 - DNA, 17 bp, Homo sapiens
gaggtcactggaaaggg

SEQ ID NO: 518744 - DNA, 18 bp, Homo sapiens
gaggtcactggaaagggg

SEQ ID NO: 518745 - DNA, 20 bp, Homo sapiens
gaggtcactggaaaggggag

SEQ ID NO: 518746 - DNA, 13 bp, Homo sapiens
gaggttgaagcca

SEQ ID NO: 518747 - DNA, 15 bp, Homo sapiens
gagtccattctccca

SEQ ID NO: 518748 - DNA, 17 bp, Homo sapiens
gagtccattctcccagg

SEQ ID NO: 518749 - DNA, 19 bp, Homo sapiens
gagtctcaaaatcaactct

SEQ ID NO: 518750 - DNA, 18 bp, Homo sapiens
gagtgagaggggaggcca

SEQ ID NO: 518751 - DNA, 19 bp, Homo sapiens
gagtgagaggggaggccaa

SEQ ID NO: 518752 - DNA, 15 bp, Homo sapiens
gagtgcaggcccacc

SEQ ID NO: 518753 - DNA, 16 bp, Homo sapiens
gagtgcaggcccaccc

SEQ ID NO: 518754 - DNA, 21 bp, Homo sapiens
gagtggccccacctggccctc

SEQ ID NO: 518755 - DNA, 20 bp, Homo sapiens
gataatgcatatttttgcac

SEQ ID NO: 518756 - DNA, 23 bp, Homo sapiens
gatccccccattttctctattct

SEQ ID NO: 518757 - DNA, 18 bp, Homo sapiens
gatgggcctgagtgagag

SEQ ID NO: 518758 - DNA, 15 bp, Homo sapiens
gatgttgtagaataa

SEQ ID NO: 518759 - DNA, 12 bp, Homo sapiens
gatgttttgcaa

SEQ ID NO: 518760 - DNA, 14 bp, Homo sapiens
gatgttttgcaaag

SEQ ID NO: 518761 - DNA, 17 bp, Homo sapiens
gatgttttgcaaaggaa

SEQ ID NO: 518762 - DNA, 20 bp, Homo sapiens
gattccactacacctggctg

SEQ ID NO: 518763 - DNA, 20 bp, Homo sapiens
gattgagttgtaaagaaaac

SEQ ID NO: 518764 - DNA, 13 bp, Homo sapiens
gcaaatctgactt

SEQ ID NO: 518765 - DNA, 14 bp, Homo sapiens
gcaacccctggacc

SEQ ID NO: 518766 - DNA, 19 bp, Homo sapiens
gcaacccctggaccccagc

SEQ ID NO: 518767 - DNA, 22 bp, Homo sapiens
gcaacccctggaccccagcctc

SEQ ID NO: 518768 - DNA, 23 bp, Homo sapiens
gcaagaaagagggagggaaatct

SEQ ID NO: 518769 - DNA, 20 bp, Homo sapiens
gcaagactctgccttaattt

SEQ ID NO: 518770 - DNA, 23 bp, Homo sapiens
gcaagactctgccttaatttttg

SEQ ID NO: 518771 - DNA, 20 bp, Homo sapiens
gcaagagggggtggaggggt

SEQ ID NO: 518772 - DNA, 20 bp, Homo sapiens
gcaagcggccacaagggact

SEQ ID NO: 518773 - DNA, 13 bp, Homo sapiens
gcaaggccacctc

SEQ ID NO: 518774 - DNA, 16 bp, Homo sapiens
gcaattgtaaacagaa

SEQ ID NO: 518775 - DNA, 22 bp, Homo sapiens
gcacaatggtttcaaagaaaga

SEQ ID NO: 518776 - DNA, 13 bp, Homo sapiens
gcacaggcagggc

SEQ ID NO: 518777 - DNA, 16 bp, Homo sapiens
gcacaggcagggcagg

SEQ ID NO: 518778 - DNA, 21 bp, Homo sapiens
gcacaggcagggcaggaccag

SEQ ID NO: 518779 - DNA, 20 bp, Homo sapiens
gcacaggctgagtgcaggcc

SEQ ID NO: 518780 - DNA, 21 bp, Homo sapiens
gcacaggtttgttttttcaag

SEQ ID NO: 518781 - DNA, 20 bp, Homo sapiens
gcaccccttctctcctcccc

SEQ ID NO: 518782 - DNA, 16 bp, Homo sapiens
gcactgtaaaatgtgg

SEQ ID NO: 518783 - DNA, 22 bp, Homo sapiens
gcagaagctatgtttttaaagt

SEQ ID NO: 518784 - DNA, 20 bp, Homo sapiens
gcagagaagtgacggttcct

SEQ ID NO: 518785 - DNA, 23 bp, Homo sapiens
gcagcttttgccttggttcttcc

SEQ ID NO: 518786 - DNA, 21 bp, Homo sapiens
gcaggagggacagtctcacca

SEQ ID NO: 518787 - DNA, 15 bp, Homo sapiens
gcaggcccaccctgc

SEQ ID NO: 518788 - DNA, 17 bp, Homo sapiens
gcaggctcactgccagg

SEQ ID NO: 518789 - DNA, 19 bp, Homo sapiens
gcaggctcactgccaggcc

SEQ ID NO: 518790 - DNA, 19 bp, Homo sapiens
gcagggcacagggcctggc

SEQ ID NO: 518791 - DNA, 15 bp, Homo sapiens
gcagggcaggaccag

SEQ ID NO: 518792 - DNA, 19 bp, Homo sapiens
gcagggcaggaccagccca

SEQ ID NO: 518793 - DNA, 21 bp, Homo sapiens
gcaggggtgggggtggaggct

SEQ ID NO: 518794 - DNA, 23 bp, Homo sapiens
gcaggggtgggggtggaggcttc

SEQ ID NO: 518795 - DNA, 15 bp, Homo sapiens
gcagtgcccaggtgg

SEQ ID NO: 518796 - DNA, 15 bp, Homo sapiens
gcatatttttgcaca

SEQ ID NO: 518797 - DNA, 11 bp, Homo sapiens
gcatccatggg

SEQ ID NO: 518798 - DNA, 12 bp, Homo sapiens
gcatccatgggg

SEQ ID NO: 518799 - DNA, 13 bp, Homo sapiens
gcatggtggttgg

SEQ ID NO: 518800 - DNA, 20 bp, Homo sapiens
gcatggtggttgggacccag

SEQ ID NO: 518801 - DNA, 22 bp, Homo sapiens
gcatggtggttgggacccagtg

SEQ ID NO: 518802 - DNA, 18 bp, Homo sapiens
gcattttaccttcaaaat

SEQ ID NO: 518803 - DNA, 23 bp, Homo sapiens
gccaaaacaagagcctgattttt

SEQ ID NO: 518804 - DNA, 20 bp, Homo sapiens
gccaagagtggccccacctg

SEQ ID NO: 518805 - DNA, 19 bp, Homo sapiens
gccaagtggggtgctggga

SEQ ID NO: 518806 - DNA, 23 bp, Homo sapiens
gccaagtggggtgctgggaggag

SEQ ID NO: 518807 - DNA, 20 bp, Homo sapiens
gccacctccccttgccagct

SEQ ID NO: 518808 - DNA, 21 bp, Homo sapiens
gccacctccccttgccagctg

SEQ ID NO: 518809 - DNA, 24 bp, Homo sapiens
gccacctccccttgccagctgctg

SEQ ID NO: 518810 - DNA, 20 bp, Homo sapiens
gccacctcctaaaaggccca

SEQ ID NO: 518811 - DNA, 18 bp, Homo sapiens
gccacctcttcctggccg

SEQ ID NO: 518812 - DNA, 22 bp, Homo sapiens
gccagccaaacacacagaaggg

SEQ ID NO: 518813 - DNA, 14 bp, Homo sapiens
gccagcctcctctg

SEQ ID NO: 518814 - DNA, 16 bp, Homo sapiens
gccagctgctgagccg

SEQ ID NO: 518815 - DNA, 20 bp, Homo sapiens
gccagctgctgagccgcaga

SEQ ID NO: 518816 - DNA, 22 bp, Homo sapiens
gccagctgctgagccgcagaga

SEQ ID NO: 518817 - DNA, 20 bp, Homo sapiens
gccaggaagtagcacaggct

SEQ ID NO: 518818 - DNA, 21 bp, Homo sapiens
gccaggaagtagcacaggctg

SEQ ID NO: 518819 - DNA, 18 bp, Homo sapiens
acaggctgagtgcaggcc

SEQ ID NO: 518820 - DNA, 19 bp, Homo sapiens
acaggctgagtgcaggccc

SEQ ID NO: 518821 - DNA, 20 bp, Homo sapiens
acaggctgagtgcaggccca

SEQ ID NO: 518822 - DNA, 21 bp, Homo sapiens
acaggctgagtgcaggcccac

SEQ ID NO: 518823 - DNA, 15 bp, Homo sapiens
acaggctgggctggg

SEQ ID NO: 518824 - DNA, 17 bp, Homo sapiens
acaggctgggctgggca

SEQ ID NO: 518825 - DNA, 12 bp, Homo sapiens
acagggcctggc

SEQ ID NO: 518826 - DNA, 14 bp, Homo sapiens
acagggcctggccc

SEQ ID NO: 518827 - DNA, 16 bp, Homo sapiens
acagggcctggcccat

SEQ ID NO: 518828 - DNA, 22 bp, Homo sapiens
acagtctcaccatttccccagg

SEQ ID NO: 518829 - DNA, 18 bp, Homo sapiens
acagtggttttatactga

SEQ ID NO: 518830 - DNA, 22 bp, Homo sapiens
acatactcaggataacagagaa

SEQ ID NO: 518831 - DNA, 23 bp, Homo sapiens
acatcactggcatggtggttggg

SEQ ID NO: 518832 - DNA, 20 bp, Homo sapiens
acatggtgcctgagaggcag

SEQ ID NO: 518833 - DNA, 14 bp, Homo sapiens
acattaataaacaa

SEQ ID NO: 518834 - DNA, 19 bp, Homo sapiens
acattccatgacgcaggag

SEQ ID NO: 518835 - DNA, 18 bp, Homo sapiens
acattcctcatgaatgta

SEQ ID NO: 518836 - DNA, 19 bp, Homo sapiens
acattcctcatgaatgtaa

SEQ ID NO: 518837 - DNA, 21 bp, Homo sapiens
acattcctcatgaatgtaaat

SEQ ID NO: 518838 - DNA, 22 bp, Homo sapiens
acattcctcatgaatgtaaatt

SEQ ID NO: 518839 - DNA, 18 bp, Homo sapiens
acattgattgctgcattt

SEQ ID NO: 518840 - DNA, 22 bp, Homo sapiens
acattggagacatcacttgcca

SEQ ID NO: 518841 - DNA, 15 bp, Homo sapiens
acattgttttccaga

SEQ ID NO: 518842 - DNA, 18 bp, Homo sapiens
accaaagagggcttcctc

SEQ ID NO: 518843 - DNA, 13 bp, Homo sapiens
accaaagagtatt

SEQ ID NO: 518844 - DNA, 16 bp, Homo sapiens
accaatttctttctaa

SEQ ID NO: 518845 - DNA, 22 bp, Homo sapiens
accacattccatgacgcaggag

SEQ ID NO: 518846 - DNA, 11 bp, Homo sapiens
accagcccacg

SEQ ID NO: 518847 - DNA, 21 bp, Homo sapiens
accagcccacgctgactacag

SEQ ID NO: 518848 - DNA, 15 bp, Homo sapiens
accatgaatatctgg

SEQ ID NO: 518849 - DNA, 23 bp, Homo sapiens
accatgctgtctggcacagcctg

SEQ ID NO: 518850 - DNA, 17 bp, Homo sapiens
accatttccccagggca

SEQ ID NO: 518851 - DNA, 23 bp, Homo sapiens
accatttggatcctgtgtggaga

SEQ ID NO: 518852 - DNA, 23 bp, Homo sapiens
acccaagggtcgcctatttttaa

SEQ ID NO: 518853 - DNA, 15 bp, Homo sapiens
acccagcagagggat

SEQ ID NO: 518854 - DNA, 22 bp, Homo sapiens
acccagcagagggataacccaa

SEQ ID NO: 518855 - DNA, 13 bp, Homo sapiens
acccagtggcagg

SEQ ID NO: 518856 - DNA, 16 bp, Homo sapiens
acccagtggcagggca

SEQ ID NO: 518857 - DNA, 22 bp, Homo sapiens
acccagtggcagggcacagggc

SEQ ID NO: 518858 - DNA, 17 bp, Homo sapiens
acccatgggcaggagac

SEQ ID NO: 518859 - DNA, 15 bp, Homo sapiens
accccggggaccctg

SEQ ID NO: 518860 - DNA, 18 bp, Homo sapiens
acccctcgcccagtccca

SEQ ID NO: 518861 - DNA, 20 bp, Homo sapiens
acccctgcccccagccccgg

SEQ ID NO: 518862 - DNA, 15 bp, Homo sapiens
acccctggaccccag

SEQ ID NO: 518863 - DNA, 23 bp, Homo sapiens
acccctggaccccagcctcaaat

SEQ ID NO: 518864 - DNA, 17 bp, Homo sapiens
accctgccaggcacagg

SEQ ID NO: 518865 - DNA, 19 bp, Homo sapiens
accctgccaggcacaggca

SEQ ID NO: 518866 - DNA, 22 bp, Homo sapiens
accctgccaggcacaggcaggg

SEQ ID NO: 518867 - DNA, 18 bp, Homo sapiens
accctgcttggcccaggg

SEQ ID NO: 518868 - DNA, 21 bp, Homo sapiens
accctgtgacatggtgcctga

SEQ ID NO: 518869 - DNA, 22 bp, Homo sapiens
accgtggaggaggaaggcaaga

SEQ ID NO: 518870 - DNA, 20 bp, Homo sapiens
acctattaagtcatcatctc

SEQ ID NO: 518871 - DNA, 19 bp, Homo sapiens
acctccccttgccagctgc

SEQ ID NO: 518872 - DNA, 19 bp, Homo sapiens
acctcctaaaaggcccaga

SEQ ID NO: 518873 - DNA, 21 bp, Homo sapiens
acctcctaaaaggcccagaga

SEQ ID NO: 518874 - DNA, 13 bp, Homo sapiens
acctgccaggcag

SEQ ID NO: 518875 - DNA, 18 bp, Homo sapiens
acctggccctctctgaag

SEQ ID NO: 518876 - DNA, 23 bp, Homo sapiens
acctggccctctctgaaggaggc

SEQ ID NO: 518877 - DNA, 13 bp, Homo sapiens
acctggctgaggt

SEQ ID NO: 518878 - DNA, 19 bp, Homo sapiens
accttattcagaaaataga

SEQ ID NO: 518879 - DNA, 13 bp, Homo sapiens
acgcccacttccc

SEQ ID NO: 518880 - DNA, 15 bp, Homo sapiens
acgcccacttccctg

SEQ ID NO: 518881 - DNA, 16 bp, Homo sapiens
acgctaaagagccctt

SEQ ID NO: 518882 - DNA, 20 bp, Homo sapiens
acgctaaagagcccttgcct

SEQ ID NO: 518883 - DNA, 21 bp, Homo sapiens
acgctaaagagcccttgcctc

SEQ ID NO: 518884 - DNA, 20 bp, Homo sapiens
acggcaggctcactgccagg

SEQ ID NO: 518885 - DNA, 22 bp, Homo sapiens
acggcaggctcactgccaggcc

SEQ ID NO: 518886 - DNA, 19 bp, Homo sapiens
actattcttgatgtaaaat

SEQ ID NO: 518887 - DNA, 20 bp, Homo sapiens
actattcttgatgtaaaatc

SEQ ID NO: 518888 - DNA, 23 bp, Homo sapiens
actattcttgatgtaaaatcttg

SEQ ID NO: 518889 - DNA, 13 bp, Homo sapiens
actatttaactga

SEQ ID NO: 518890 - DNA, 14 bp, Homo sapiens
actccacatctgcc

SEQ ID NO: 518891 - DNA, 15 bp, Homo sapiens
actccacatctgcct

SEQ ID NO: 518892 - DNA, 16 bp, Homo sapiens
actccacatctgcctt

SEQ ID NO: 518893 - DNA, 12 bp, Homo sapiens
actctaaatagc

SEQ ID NO: 518894 - DNA, 15 bp, Homo sapiens
actctgccttaattt

SEQ ID NO: 518895 - DNA, 18 bp, Homo sapiens
actgaaggaaaaacacaa

SEQ ID NO: 518896 - DNA, 20 bp, Homo sapiens
actgaaggaaaaacacaagc

SEQ ID NO: 518897 - DNA, 23 bp, Homo sapiens
actgaaggaaaaacacaagcaaa

SEQ ID NO: 518898 - DNA, 20 bp, Homo sapiens
actgactattcttgatgtaa

SEQ ID NO: 518899 - DNA, 11 bp, Homo sapiens
actgccacctc

SEQ ID NO: 518900 - DNA, 23 bp, Homo sapiens
actgccacctccccttgccagct

SEQ ID NO: 518901 - DNA, 16 bp, Homo sapiens
actgccaggccagcct

SEQ ID NO: 518902 - DNA, 18 bp, Homo sapiens
actgccaggccagcctcc

SEQ ID NO: 518903 - DNA, 13 bp, Homo sapiens
actgctcctgagc

SEQ ID NO: 518904 - DNA, 15 bp, Homo sapiens
actgctcctgagccc

SEQ ID NO: 518905 - DNA, 17 bp, Homo sapiens
actgctcctgagccccc

SEQ ID NO: 518906 - DNA, 18 bp, Homo sapiens
actgctcctgagccccca

SEQ ID NO: 518907 - DNA, 13 bp, Homo sapiens
actgctctcacct

SEQ ID NO: 518908 - DNA, 22 bp, Homo sapiens
actgctctcaccttggttcctg

SEQ ID NO: 518909 - DNA, 17 bp, Homo sapiens
actggaaaggggagagc

SEQ ID NO: 518910 - DNA, 16 bp, Homo sapiens
actggaggttgaagcc

SEQ ID NO: 518911 - DNA, 19 bp, Homo sapiens
actggaggttgaagccaag

SEQ ID NO: 518912 - DNA, 16 bp, Homo sapiens
actggtggcagtggag

SEQ ID NO: 518913 - DNA, 22 bp, Homo sapiens
actgtaaaatgtgggattatgg

SEQ ID NO: 518914 - DNA, 19 bp, Homo sapiens
actgtaagctccatgatta

SEQ ID NO: 518915 - DNA, 23 bp, Homo sapiens
actgtgcgtggggctcccgcctc

SEQ ID NO: 518916 - DNA, 17 bp, Homo sapiens
actgtggagactgctcc

SEQ ID NO: 518917 - DNA, 15 bp, Homo sapiens
actgttcatttgaaa

SEQ ID NO: 518918 - DNA, 19 bp, Homo sapiens
acttatattagagtcagag

SEQ ID NO: 518919 - DNA, 13 bp, Homo sapiens
acttcactccaaa

SEQ ID NO: 518920 - DNA, 14 bp, Homo sapiens
acttcactccaaag

SEQ ID NO: 518921 - DNA, 18 bp, Homo sapiens
acttcactccaaagagaa

SEQ ID NO: 518922 - DNA, 15 bp, Homo sapiens
acttcatattttata

SEQ ID NO: 518923 - DNA, 23 bp, Homo sapiens
acttccctgggttagactgccag

SEQ ID NO: 518924 - DNA, 23 bp, Homo sapiens
acttgggggctcagcaaggccac

SEQ ID NO: 518925 - DNA, 13 bp, Homo sapiens
actttcttcaaaa

SEQ ID NO: 518926 - DNA, 19 bp, Homo sapiens
actttcttcaaaaagcatt

SEQ ID NO: 518927 - DNA, 15 bp, Homo sapiens
agaaaaataaccctt

SEQ ID NO: 518928 - DNA, 15 bp, Homo sapiens
agaaaattttgcaga

SEQ ID NO: 518929 - DNA, 19 bp, Homo sapiens
aggaccctgccaggcacag

SEQ ID NO: 518930 - DNA, 23 bp, Homo sapiens
aggaccctgccaggcacaggcag

SEQ ID NO: 518931 - DNA, 21 bp, Homo sapiens
aggagaggaaacttgcctttt

SEQ ID NO: 518932 - DNA, 22 bp, Homo sapiens
aggagcccatttggagggcctg

SEQ ID NO: 518933 - DNA, 17 bp, Homo sapiens
aggaggaaggcaagagg

SEQ ID NO: 518934 - DNA, 13 bp, Homo sapiens
aggaggccacctc

SEQ ID NO: 518935 - DNA, 19 bp, Homo sapiens
aggcaagactctgccttaa

SEQ ID NO: 518936 - DNA, 17 bp, Homo sapiens
aggcaagagggggtgga

SEQ ID NO: 518937 - DNA, 23 bp, Homo sapiens
aggcaagcacaatggtttcaaag

SEQ ID NO: 518938 - DNA, 12 bp, Homo sapiens
aggcagggcagg

SEQ ID NO: 518939 - DNA, 16 bp, Homo sapiens
aggcagggcaggacca

SEQ ID NO: 518940 - DNA, 17 bp, Homo sapiens
aggcagggcaggaccag

SEQ ID NO: 518941 - DNA, 20 bp, Homo sapiens
aggcagggcaggaccagccc

SEQ ID NO: 518942 - DNA, 21 bp, Homo sapiens
aggcagggcaggaccagccca

SEQ ID NO: 518943 - DNA, 19 bp, Homo sapiens
aggcaggggtgggggtgga

SEQ ID NO: 518944 - DNA, 23 bp, Homo sapiens
aggcaggggtgggggtggaggct

SEQ ID NO: 518945 - DNA, 15 bp, Homo sapiens
aggcatagaggcttc

SEQ ID NO: 518946 - DNA, 22 bp, Homo sapiens
aggcatagaggcttctccgcca

SEQ ID NO: 518947 - DNA, 23 bp, Homo sapiens
aggccaagagtggccccacctgg

SEQ ID NO: 518948 - DNA, 13 bp, Homo sapiens
aggccacctccta

SEQ ID NO: 518949 - DNA, 15 bp, Homo sapiens
aggccacctcttcct

SEQ ID NO: 518950 - DNA, 14 bp, Homo sapiens
aggccagcctccga

SEQ ID NO: 518951 - DNA, 17 bp, Homo sapiens
aggccagcctccgagag

SEQ ID NO: 518952 - DNA, 13 bp, Homo sapiens
aggcccaccctgc

SEQ ID NO: 518953 - DNA, 15 bp, Homo sapiens
aggcccaccctgctt

SEQ ID NO: 518954 - DNA, 16 bp, Homo sapiens
aggccccaatacccca

SEQ ID NO: 518955 - DNA, 17 bp, Homo sapiens
aggctagcttctgcttt

SEQ ID NO: 518956 - DNA, 22 bp, Homo sapiens
aggctcactgccaggccagcct

SEQ ID NO: 518957 - DNA, 14 bp, Homo sapiens
aggctgagtgcagg

SEQ ID NO: 518958 - DNA, 16 bp, Homo sapiens
aggctgggctgggcac

SEQ ID NO: 518959 - DNA, 19 bp, Homo sapiens
aggctgggctgggcactgc

SEQ ID NO: 518960 - DNA, 22 bp, Homo sapiens
aggctgggctgggcactgctct

SEQ ID NO: 518961 - DNA, 14 bp, Homo sapiens
aggcttctccgcca

SEQ ID NO: 518962 - DNA, 17 bp, Homo sapiens
aggcttctccgccagcc

SEQ ID NO: 518963 - DNA, 22 bp, Homo sapiens
aggcttctccgccagcctcctc

SEQ ID NO: 518964 - DNA, 15 bp, Homo sapiens
agggaaaggggtgct

SEQ ID NO: 518965 - DNA, 19 bp, Homo sapiens
agggaaaggggtgctttta

SEQ ID NO: 518966 - DNA, 17 bp, Homo sapiens
agggaaatctttcaact

SEQ ID NO: 518967 - DNA, 14 bp, Homo sapiens
agggagagggaggt

SEQ ID NO: 518968 - DNA, 19 bp, Homo sapiens
agggagggaaatctttcaa

SEQ ID NO: 518969 - DNA, 21 bp, Homo sapiens
agggaggtcactggaaagggg

SEQ ID NO: 518970 - DNA, 14 bp, Homo sapiens
agggcacagggcct

SEQ ID NO: 518971 - DNA, 15 bp, Homo sapiens
agggcacagggcctg

SEQ ID NO: 518972 - DNA, 20 bp, Homo sapiens
agggcacagggcctggccca

SEQ ID NO: 518973 - DNA, 13 bp, Homo sapiens
agggcagagtatg

SEQ ID NO: 518974 - DNA, 18 bp, Homo sapiens
agggcagagtatgttctt

SEQ ID NO: 518975 - DNA, 12 bp, Homo sapiens
agggcaggacca

SEQ ID NO: 518976 - DNA, 14 bp, Homo sapiens
agggcaggaccagc

SEQ ID NO: 518977 - DNA, 16 bp, Homo sapiens
agggcctgggcctggc

SEQ ID NO: 518978 - DNA, 21 bp, Homo sapiens
agggcctgggcctggctccct

SEQ ID NO: 518979 - DNA, 15 bp, Homo sapiens
aggggactgccacct

SEQ ID NO: 518980 - DNA, 15 bp, Homo sapiens
aggggagagcctgct

SEQ ID NO: 518981 - DNA, 22 bp, Homo sapiens
aggggagagcctgctggcaccc

SEQ ID NO: 518982 - DNA, 18 bp, Homo sapiens
agggggcttgaagccaaa

SEQ ID NO: 518983 - DNA, 23 bp, Homo sapiens
aggtaccagctgcgcttgctttt

SEQ ID NO: 518984 - DNA, 20 bp, Homo sapiens
aggtctgagttgttacccca

SEQ ID NO: 518985 - DNA, 13 bp, Homo sapiens
aggtctgtaaaga

SEQ ID NO: 518986 - DNA, 15 bp, Homo sapiens
aggtggaagaaggga

SEQ ID NO: 518987 - DNA, 19 bp, Homo sapiens
aggtggaagaagggagaag

SEQ ID NO: 518988 - DNA, 14 bp, Homo sapiens
aggtgtggacaagc

SEQ ID NO: 518989 - DNA, 15 bp, Homo sapiens
aggtgttattttcaa

SEQ ID NO: 518990 - DNA, 12 bp, Homo sapiens
aggttcctctgc

SEQ ID NO: 518991 - DNA, 15 bp, Homo sapiens
aggttcctctgcctg

SEQ ID NO: 518992 - DNA, 12 bp, Homo sapiens
aggttgaagcca

SEQ ID NO: 518993 - DNA, 19 bp, Homo sapiens
aggtttgttttttcaagaa

SEQ ID NO: 518994 - DNA, 12 bp, Homo sapiens
agtaaaggagat

SEQ ID NO: 518995 - DNA, 15 bp, Homo sapiens
agtaaccaatttctt

SEQ ID NO: 518996 - DNA, 16 bp, Homo sapiens
agtaattcgtttgcta

SEQ ID NO: 518997 - DNA, 15 bp, Homo sapiens
agtagaatctctttt

SEQ ID NO: 518998 - DNA, 15 bp, Homo sapiens
agtagcacaggctga

SEQ ID NO: 518999 - DNA, 16 bp, Homo sapiens
agtagcacaggctgag

SEQ ID NO: 519000 - DNA, 12 bp, Homo sapiens
agtcccagcagc

SEQ ID NO: 519001 - DNA, 15 bp, Homo sapiens
agtcccagcagccag

SEQ ID NO: 519002 - DNA, 18 bp, Homo sapiens
agtcccagcagccagcca

SEQ ID NO: 519003 - DNA, 20 bp, Homo sapiens
agtccccacccctgccccca

SEQ ID NO: 519004 - DNA, 14 bp, Homo sapiens
agtctcaaaatcaa

SEQ ID NO: 519005 - DNA, 20 bp, Homo sapiens
agtgacggttcctacacagg

SEQ ID NO: 519006 - DNA, 19 bp, Homo sapiens
agtgagaggggaggccaag

SEQ ID NO: 519007 - DNA, 14 bp, Homo sapiens
agtgagttcttttt

SEQ ID NO: 519008 - DNA, 13 bp, Homo sapiens
agtgcccaggtgg

SEQ ID NO: 519009 - DNA, 19 bp, Homo sapiens
agtgctgccacttaaaaag

SEQ ID NO: 519010 - DNA, 18 bp, Homo sapiens
agtgcttttaaaaatttt

SEQ ID NO: 519011 - DNA, 23 bp, Homo sapiens
agtggagaatgggggtgaccaca

SEQ ID NO: 519012 - DNA, 13 bp, Homo sapiens
agtggcagggcac

SEQ ID NO: 519013 - DNA, 15 bp, Homo sapiens
agtggcagggcacag

SEQ ID NO: 519014 - DNA, 17 bp, Homo sapiens
agtggcagggcacaggg

SEQ ID NO: 519015 - DNA, 18 bp, Homo sapiens
agtggccccacctggccc

SEQ ID NO: 519016 - DNA, 24 bp, Homo sapiens
agtggctttttgtactgtagttca

SEQ ID NO: 519017 - DNA, 17 bp, Homo sapiens
agtggggggaacgccca

SEQ ID NO: 519018 - DNA, 14 bp, Homo sapiens
agtggggtgctggg

SEQ ID NO: 519019 - DNA, 16 bp, Homo sapiens
agtggggtgctgggag

SEQ ID NO: 519020 - DNA, 18 bp, Homo sapiens
agtggggtgctgggagga

SEQ ID NO: 519021 - DNA, 22 bp, Homo sapiens
agtgggttttttagttgaattt

SEQ ID NO: 519022 - DNA, 23 bp, Homo sapiens
agtgggttttttagttgaatttt

SEQ ID NO: 519023 - DNA, 23 bp, Homo sapiens
agtggttttatactgaaggaaaa

SEQ ID NO: 519024 - DNA, 19 bp, Homo sapiens
agtgttgaattttattgaa

SEQ ID NO: 519025 - DNA, 21 bp, Homo sapiens
agtgttgaattttattgaaag

SEQ ID NO: 519026 - DNA, 23 bp, Homo sapiens
agttcccctggaagcagtgccca

SEQ ID NO: 519027 - DNA, 18 bp, Homo sapiens
agttctttttcactctgt

SEQ ID NO: 519028 - DNA, 10 bp, Homo sapiens
agttgaattt

SEQ ID NO: 519029 - DNA, 22 bp, Homo sapiens
agttgtcctgatgtttttctgt

SEQ ID NO: 519030 - DNA, 16 bp, Homo sapiens
ataaaaaagatcccaa

SEQ ID NO: 519031 - DNA, 13 bp, Homo sapiens
ataaaagcccagg

SEQ ID NO: 519032 - DNA, 15 bp, Homo sapiens
ataaaagcccaggag

SEQ ID NO: 519033 - DNA, 13 bp, Homo sapiens
ataaaatttctgg

SEQ ID NO: 519034 - DNA, 23 bp, Homo sapiens
ataaagtttatcagatattttca

SEQ ID NO: 519035 - DNA, 16 bp, Homo sapiens
ataaataccaaagata

SEQ ID NO: 519036 - DNA, 16 bp, Homo sapiens
ataaatgtcacttcat

SEQ ID NO: 519037 - DNA, 18 bp, Homo sapiens
ataagggcattatgtaac

SEQ ID NO: 519038 - DNA, 19 bp, Homo sapiens
ataaggttcgtattgctat

SEQ ID NO: 519039 - DNA, 17 bp, Homo sapiens
ataatcacaagtaaagg

SEQ ID NO: 519040 - DNA, 18 bp, Homo sapiens
ataattttttttttctca

SEQ ID NO: 519041 - DNA, 20 bp, Homo sapiens
atttctaaataaaaaaatta

SEQ ID NO: 519042 - DNA, 13 bp, Homo sapiens
atttctttctaaa

SEQ ID NO: 519043 - DNA, 17 bp, Homo sapiens
atttgaaacctttttct

SEQ ID NO: 519044 - DNA, 22 bp, Homo sapiens
atttgatggcttgggaaactga

SEQ ID NO: 519045 - DNA, 13 bp, Homo sapiens
atttgctttacat

SEQ ID NO: 519046 - DNA, 15 bp, Homo sapiens
atttggagggcctgg

SEQ ID NO: 519047 - DNA, 16 bp, Homo sapiens
atttggagggcctggg

SEQ ID NO: 519048 - DNA, 22 bp, Homo sapiens
atttggagggcctgggcctggc

SEQ ID NO: 519049 - DNA, 20 bp, Homo sapiens
atttgtactatttaactgac

SEQ ID NO: 519050 - DNA, 17 bp, Homo sapiens
attttaaagcctgaaaa

SEQ ID NO: 519051 - DNA, 17 bp, Homo sapiens
attttatttagacaaga

SEQ ID NO: 519052 - DNA, 19 bp, Homo sapiens
attttatttagacaagaga

SEQ ID NO: 519053 - DNA, 15 bp, Homo sapiens
attttcaatgaaaca

SEQ ID NO: 519054 - DNA, 21 bp, Homo sapiens
attttcccatttgctgtcttt

SEQ ID NO: 519055 - DNA, 15 bp, Homo sapiens
attttgtcctttcat

SEQ ID NO: 519056 - DNA, 21 bp, Homo sapiens
attttgtcctttcatgtaact

SEQ ID NO: 519057 - DNA, 14 bp, Homo sapiens
atttttaaacaaaa

SEQ ID NO: 519058 - DNA, 22 bp, Homo sapiens
atttttctgggcttttcctttt

SEQ ID NO: 519059 - DNA, 13 bp, Homo sapiens
atttttgctgttt

SEQ ID NO: 519060 - DNA, 17 bp, Homo sapiens
atttttgggaggagcca

SEQ ID NO: 519061 - DNA, 18 bp, Homo sapiens
atttttgttgcagtgtag

SEQ ID NO: 519062 - DNA, 21 bp, Homo sapiens
caaaactatgacaatttttgc

SEQ ID NO: 519063 - DNA, 17 bp, Homo sapiens
caaaatgtagacaaagt

SEQ ID NO: 519064 - DNA, 20 bp, Homo sapiens
caaaccatggattgtacata

SEQ ID NO: 519065 - DNA, 23 bp, Homo sapiens
caaacgctaaagagcccttgcct

SEQ ID NO: 519066 - DNA, 13 bp, Homo sapiens
caaactaaaccct

SEQ ID NO: 519067 - DNA, 13 bp, Homo sapiens
caaagaaagagat

SEQ ID NO: 519068 - DNA, 22 bp, Homo sapiens
caaagagaaacctattaagtca

SEQ ID NO: 519069 - DNA, 15 bp, Homo sapiens
caaagagggcttcct

SEQ ID NO: 519070 - DNA, 18 bp, Homo sapiens
caaagagggcttcctcta

SEQ ID NO: 519071 - DNA, 22 bp, Homo sapiens
caaagagggcttcctctagaag

SEQ ID NO: 519072 - DNA, 22 bp, Homo sapiens
caaagataatgcatatttttgc

SEQ ID NO: 519073 - DNA, 15 bp, Homo sapiens
caaatgtgtattttt

SEQ ID NO: 519074 - DNA, 22 bp, Homo sapiens
caagagaaacattctttcctaa

SEQ ID NO: 519075 - DNA, 23 bp, Homo sapiens
caagagaaacattctttcctaaa

SEQ ID NO: 519076 - DNA, 12 bp, Homo sapiens
caagagatcata

SEQ ID NO: 519077 - DNA, 20 bp, Homo sapiens
caagagcctgattttttgag

SEQ ID NO: 519078 - DNA, 14 bp, Homo sapiens
caagagggggtgga

SEQ ID NO: 519079 - DNA, 17 bp, Homo sapiens
caagagggggtggaggg

SEQ ID NO: 519080 - DNA, 15 bp, Homo sapiens
caagagtggccccac

SEQ ID NO: 519081 - DNA, 19 bp, Homo sapiens
caagagtggccccacctgg

SEQ ID NO: 519082 - DNA, 22 bp, Homo sapiens
caagagtggccccacctggccc

SEQ ID NO: 519083 - DNA, 16 bp, Homo sapiens
caagcctctgtctttt

SEQ ID NO: 519084 - DNA, 18 bp, Homo sapiens
caagcgccctggccccca

SEQ ID NO: 519085 - DNA, 23 bp, Homo sapiens
caagctttaaatggcaatttttt

SEQ ID NO: 519086 - DNA, 15 bp, Homo sapiens
caagcttttcctaat

SEQ ID NO: 519087 - DNA, 21 bp, Homo sapiens
caaggccacctcttcctggcc

SEQ ID NO: 519088 - DNA, 14 bp, Homo sapiens
caagggaaaggggt

SEQ ID NO: 519089 - DNA, 20 bp, Homo sapiens
caagggaaaggggtgctttt

SEQ ID NO: 519090 - DNA, 21 bp, Homo sapiens
caagggaaaggggtgctttta

SEQ ID NO: 519091 - DNA, 21 bp, Homo sapiens
caagtggggtgctgggaggag

SEQ ID NO: 519092 - DNA, 17 bp, Homo sapiens
caagtggttgttttaga

SEQ ID NO: 519093 - DNA, 14 bp, Homo sapiens
caataaaagcccag

SEQ ID NO: 519094 - DNA, 15 bp, Homo sapiens
caataaaagcccagg

SEQ ID NO: 519095 - DNA, 16 bp, Homo sapiens
caataaaagcccagga

SEQ ID NO: 519096 - DNA, 17 bp, Homo sapiens
caataaaagcccaggag

SEQ ID NO: 519097 - DNA, 17 bp, Homo sapiens
caatacactagttgttt

SEQ ID NO: 519098 - DNA, 20 bp, Homo sapiens
caatcctaatttctcctccc

SEQ ID NO: 519099 - DNA, 22 bp, Homo sapiens
caattgtaaacagaaattgcaa

SEQ ID NO: 519100 - DNA, 12 bp, Homo sapiens
cacaaaagaggc

SEQ ID NO: 519101 - DNA, 22 bp, Homo sapiens
cacaaaccatggattgtacata

SEQ ID NO: 519102 - DNA, 20 bp, Homo sapiens
cacaagggactgaggcaagc

SEQ ID NO: 519103 - DNA, 19 bp, Homo sapiens
cacaatggtttcaaagaaa

SEQ ID NO: 519104 - DNA, 18 bp, Homo sapiens
cacagaaggggactgcca

SEQ ID NO: 519105 - DNA, 19 bp, Homo sapiens
cacagaaggggactgccac

SEQ ID NO: 519106 - DNA, 22 bp, Homo sapiens
cacagaaggggactgccacctc

SEQ ID NO: 519107 - DNA, 17 bp, Homo sapiens
cacagacaggacccctg

SEQ ID NO: 519108 - DNA, 14 bp, Homo sapiens
cacagcctgcactt

SEQ ID NO: 519109 - DNA, 19 bp, Homo sapiens
cacaggacaggggttcctt

SEQ ID NO: 519110 - DNA, 19 bp, Homo sapiens
cacaggcagggcaggacca

SEQ ID NO: 519111 - DNA, 22 bp, Homo sapiens
cacaggcagggcaggaccagcc

SEQ ID NO: 519112 - DNA, 14 bp, Homo sapiens
cacaggctgagtgc

SEQ ID NO: 519113 - DNA, 17 bp, Homo sapiens
cacaggctgagtgcagg

SEQ ID NO: 519114 - DNA, 22 bp, Homo sapiens
cacaggctgggctgggcactgc

SEQ ID NO: 519115 - DNA, 13 bp, Homo sapiens
cacagggcctggc

SEQ ID NO: 519116 - DNA, 19 bp, Homo sapiens
cacagggcctggcccatgt

SEQ ID NO: 519117 - DNA, 16 bp, Homo sapiens
cacattccatgacgca

SEQ ID NO: 519118 - DNA, 14 bp, Homo sapiens
caccccctgccctg

SEQ ID NO: 519119 - DNA, 17 bp, Homo sapiens
caccccctgccctgcac

SEQ ID NO: 519120 - DNA, 17 bp, Homo sapiens
caccgtggaggaggaag

SEQ ID NO: 519121 - DNA, 14 bp, Homo sapiens
cacctcatgcccac

SEQ ID NO: 519122 - DNA, 16 bp, Homo sapiens
cacctccccttgccag

SEQ ID NO: 519123 - DNA, 22 bp, Homo sapiens
cacctccccttgccagctgctg

SEQ ID NO: 519124 - DNA, 14 bp, Homo sapiens
caccttggttcctg

SEQ ID NO: 519125 - DNA, 15 bp, Homo sapiens
cactacacctggctg

SEQ ID NO: 519126 - DNA, 14 bp, Homo sapiens
cactatatttttgg

SEQ ID NO: 519127 - DNA, 15 bp, Homo sapiens
cactccaaagagaaa

SEQ ID NO: 519128 - DNA, 21 bp, Homo sapiens
cactccaaagagaaacctatt

SEQ ID NO: 519129 - DNA, 15 bp, Homo sapiens
cactctcagaggccc

SEQ ID NO: 519130 - DNA, 17 bp, Homo sapiens
cactctcagaggcccca

SEQ ID NO: 519131 - DNA, 12 bp, Homo sapiens
cactgccaggcc

SEQ ID NO: 519132 - DNA, 18 bp, Homo sapiens
cactgccaggccagcctc

SEQ ID NO: 519133 - DNA, 20 bp, Homo sapiens
cactgccaggccagcctccg

SEQ ID NO: 519134 - DNA, 15 bp, Homo sapiens
cactgctctcacctt

SEQ ID NO: 519135 - DNA, 18 bp, Homo sapiens
cactggaaaggggagagc

SEQ ID NO: 519136 - DNA, 19 bp, Homo sapiens
cactggaaaggggagagcc

SEQ ID NO: 519137 - DNA, 22 bp, Homo sapiens
cactggaaaggggagagcctgc

SEQ ID NO: 519138 - DNA, 21 bp, Homo sapiens
cactggaggttgaagccaagt

SEQ ID NO: 519139 - DNA, 20 bp, Homo sapiens
cactgttgtcatttccaaat

SEQ ID NO: 519140 - DNA, 18 bp, Homo sapiens
cagaagaggcaacaattt

SEQ ID NO: 519141 - DNA, 17 bp, Homo sapiens
cagaaggggactgccac

SEQ ID NO: 519142 - DNA, 16 bp, Homo sapiens
cagaatgcttctcttt

SEQ ID NO: 519143 - DNA, 18 bp, Homo sapiens
cagacaggacccctgcag

SEQ ID NO: 519144 - DNA, 23 bp, Homo sapiens
cagacaggacccctgcagttccc

SEQ ID NO: 519145 - DNA, 15 bp, Homo sapiens
cagagagaagagccc

SEQ ID NO: 519146 - DNA, 22 bp, Homo sapiens
cagaggccccaataccccatgg

SEQ ID NO: 519147 - DNA, 16 bp, Homo sapiens
cagagggataacccaa

SEQ ID NO: 519148 - DNA, 14 bp, Homo sapiens
cagagtatgttctt

SEQ ID NO: 519149 - DNA, 17 bp, Homo sapiens
cagagtatgttcttgaa

SEQ ID NO: 519150 - DNA, 13 bp, Homo sapiens
cagagtatttgaa

SEQ ID NO: 519151 - DNA, 17 bp, Homo sapiens
cagatcccaagagatta

SEQ ID NO: 519152 - DNA, 18 bp, Homo sapiens
cattccatgacgcaggag

SEQ ID NO: 519153 - DNA, 13 bp, Homo sapiens
cattctttcctaa

SEQ ID NO: 519154 - DNA, 15 bp, Homo sapiens
catttccccagggca

SEQ ID NO: 519155 - DNA, 22 bp, Homo sapiens
cattttaatgatattggaggaa

SEQ ID NO: 519156 - DNA, 15 bp, Homo sapiens
cattttaccttcaaa

SEQ ID NO: 519157 - DNA, 19 bp, Homo sapiens
cattttataaagtttatca

SEQ ID NO: 519158 - DNA, 22 bp, Homo sapiens
ccaaaacaagagcctgattttt

SEQ ID NO: 519159 - DNA, 17 bp, Homo sapiens
ccaaacacacagaaggg

SEQ ID NO: 519160 - DNA, 22 bp, Homo sapiens
ccaaagataatgcatatttttg

SEQ ID NO: 519161 - DNA, 17 bp, Homo sapiens
ccaacccctcgcccagt

SEQ ID NO: 519162 - DNA, 13 bp, Homo sapiens
ccaagagtggccc

SEQ ID NO: 519163 - DNA, 14 bp, Homo sapiens
ccaagcgccctggc

SEQ ID NO: 519164 - DNA, 16 bp, Homo sapiens
ccaagcgccctggccc

SEQ ID NO: 519165 - DNA, 22 bp, Homo sapiens
ccaagcgccctggcccccacat

SEQ ID NO: 519166 - DNA, 17 bp, Homo sapiens
ccaagggaaaggggtgc

SEQ ID NO: 519167 - DNA, 21 bp, Homo sapiens
ccaagggaaaggggtgctttt

SEQ ID NO: 519168 - DNA, 22 bp, Homo sapiens
ccaagggaaaggggtgctttta

SEQ ID NO: 519169 - DNA, 20 bp, Homo sapiens
ccaagggtcgcctattttta

SEQ ID NO: 519170 - DNA, 15 bp, Homo sapiens
ccaagtggggtgctg

SEQ ID NO: 519171 - DNA, 22 bp, Homo sapiens
ccaagtggggtgctgggaggag

SEQ ID NO: 519172 - DNA, 16 bp, Homo sapiens
ccaatttctttctaaa

SEQ ID NO: 519173 - DNA, 21 bp, Homo sapiens
ccacaagggactgaggcaagc

SEQ ID NO: 519174 - DNA, 14 bp, Homo sapiens
ccacatctgcctta

SEQ ID NO: 519175 - DNA, 23 bp, Homo sapiens
ccacatctgccttaaaaccaaag

SEQ ID NO: 519176 - DNA, 14 bp, Homo sapiens
ccaccccctgccct

SEQ ID NO: 519177 - DNA, 17 bp, Homo sapiens
ccaccctgcttggccca

SEQ ID NO: 519178 - DNA, 20 bp, Homo sapiens
ccaccctgcttggcccaggg

SEQ ID NO: 519179 - DNA, 14 bp, Homo sapiens
ccacctccccttgc

SEQ ID NO: 519180 - DNA, 15 bp, Homo sapiens
ccacctccccttgcc

SEQ ID NO: 519181 - DNA, 20 bp, Homo sapiens
ccacctcctaaaaggcccag

SEQ ID NO: 519182 - DNA, 13 bp, Homo sapiens
ccacctcttcctg

SEQ ID NO: 519183 - DNA, 18 bp, Homo sapiens
ccacctggccctctctga

SEQ ID NO: 519184 - DNA, 19 bp, Homo sapiens
ccacgctgactacagggcc

SEQ ID NO: 519185 - DNA, 20 bp, Homo sapiens
ccacgctgactacagggccg

SEQ ID NO: 519186 - DNA, 13 bp, Homo sapiens
ccactacacctgg

SEQ ID NO: 519187 - DNA, 16 bp, Homo sapiens
ccactacacctggctg

SEQ ID NO: 519188 - DNA, 17 bp, Homo sapiens
ccactacacctggctga

SEQ ID NO: 519189 - DNA, 16 bp, Homo sapiens
ccactctcagaggccc

SEQ ID NO: 519190 - DNA, 17 bp, Homo sapiens
ccactctcagaggcccc

SEQ ID NO: 519191 - DNA, 13 bp, Homo sapiens
ccacttccctggg

SEQ ID NO: 519192 - DNA, 23 bp, Homo sapiens
ccacttccctgggttagactgcc

SEQ ID NO: 519193 - DNA, 16 bp, Homo sapiens
ccagagagaagagccc

SEQ ID NO: 519194 - DNA, 20 bp, Homo sapiens
ccagagagaagagccccact

SEQ ID NO: 519195 - DNA, 12 bp, Homo sapiens
ccagcagccagc

SEQ ID NO: 519196 - DNA, 12 bp, Homo sapiens
ccagcaggaggg

SEQ ID NO: 519197 - DNA, 18 bp, Homo sapiens
ccagcctcaaatccagga

SEQ ID NO: 519198 - DNA, 11 bp, Homo sapiens
ccagcctcctc

SEQ ID NO: 519199 - DNA, 12 bp, Homo sapiens
ccagcctcctct

SEQ ID NO: 519200 - DNA, 19 bp, Homo sapiens
ccagctgcgcttgcttttc

SEQ ID NO: 519201 - DNA, 14 bp, Homo sapiens
ccagctgctgagcc

SEQ ID NO: 519202 - DNA, 17 bp, Homo sapiens
ccagctgctgagccgca

SEQ ID NO: 519203 - DNA, 18 bp, Homo sapiens
ccagctgctgagccgcag

SEQ ID NO: 519204 - DNA, 13 bp, Homo sapiens
ccagcttccagca

SEQ ID NO: 519205 - DNA, 14 bp, Homo sapiens
ccagcttccagcag

SEQ ID NO: 519206 - DNA, 22 bp, Homo sapiens
ccaggaagtagcacaggctgag

SEQ ID NO: 519207 - DNA, 13 bp, Homo sapiens
ccaggaccctgcc

SEQ ID NO: 519208 - DNA, 14 bp, Homo sapiens
ccaggaccctgcca

SEQ ID NO: 519209 - DNA, 15 bp, Homo sapiens
ccaggaccctgccag

SEQ ID NO: 519210 - DNA, 16 bp, Homo sapiens
ccaggaccctgccagg

SEQ ID NO: 519211 - DNA, 17 bp, Homo sapiens
ccaggaccctgccaggc

SEQ ID NO: 519212 - DNA, 23 bp, Homo sapiens
ccaggaccctgccaggcacaggc

SEQ ID NO: 519213 - DNA, 18 bp, Homo sapiens
ccaggcacaggcagggca

SEQ ID NO: 519214 - DNA, 14 bp, Homo sapiens
ccaggccagcctcc

SEQ ID NO: 519215 - DNA, 23 bp, Homo sapiens
ccaggccagcctccgagagggag

SEQ ID NO: 519216 - DNA, 13 bp, Homo sapiens
ccagggggcttcc

SEQ ID NO: 519217 - DNA, 23 bp, Homo sapiens
ccagggggcttcctgaggggaga

SEQ ID NO: 519218 - DNA, 18 bp, Homo sapiens
ccaggtaccagctgcgct

SEQ ID NO: 519219 - DNA, 19 bp, Homo sapiens
ccaggtaccagctgcgctt

SEQ ID NO: 519220 - DNA, 13 bp, Homo sapiens
ccagtcccagcag

SEQ ID NO: 519221 - DNA, 14 bp, Homo sapiens
ccagtcccagcagc

SEQ ID NO: 519222 - DNA, 15 bp, Homo sapiens
ccagtcccagcagcc

SEQ ID NO: 519223 - DNA, 16 bp, Homo sapiens
ccagtccccacccctg

SEQ ID NO: 519224 - DNA, 17 bp, Homo sapiens
ccagtccccacccctgc

SEQ ID NO: 519225 - DNA, 18 bp, Homo sapiens
ccagtccccacccctgcc

SEQ ID NO: 519226 - DNA, 22 bp, Homo sapiens
ccagtctcctatacccagcaga

SEQ ID NO: 519227 - DNA, 13 bp, Homo sapiens
ccagtggcagggc

SEQ ID NO: 519228 - DNA, 18 bp, Homo sapiens
ccagtggcagggcacagg

SEQ ID NO: 519229 - DNA, 22 bp, Homo sapiens
ccagtggcagggcacagggcct

SEQ ID NO: 519230 - DNA, 17 bp, Homo sapiens
ccatctgcaccccttct

SEQ ID NO: 519231 - DNA, 16 bp, Homo sapiens
ccatgacgcaggagct

SEQ ID NO: 519232 - DNA, 21 bp, Homo sapiens
ccatgctgtctggcacagcct

SEQ ID NO: 519233 - DNA, 22 bp, Homo sapiens
ccatgctgtctggcacagcctg

SEQ ID NO: 519234 - DNA, 12 bp, Homo sapiens
ccatgggcagga

SEQ ID NO: 519235 - DNA, 13 bp, Homo sapiens
ccatgggcaggag

SEQ ID NO: 519236 - DNA, 18 bp, Homo sapiens
ccatgtatggccaggaag

SEQ ID NO: 519237 - DNA, 22 bp, Homo sapiens
ccattaaaaaacagcttgttct

SEQ ID NO: 519238 - DNA, 12 bp, Homo sapiens
ccattctcccag

SEQ ID NO: 519239 - DNA, 15 bp, Homo sapiens
ccattctcccaggta

SEQ ID NO: 519240 - DNA, 21 bp, Homo sapiens
ccatttggagggcctgggcct

SEQ ID NO: 519241 - DNA, 23 bp, Homo sapiens
ccatttggatcctgtgtggagag

SEQ ID NO: 519242 - DNA, 19 bp, Homo sapiens
ccattttctctattctttc

SEQ ID NO: 519243 - DNA, 20 bp, Homo sapiens
cccaagagattatgtaactc

SEQ ID NO: 519244 - DNA, 18 bp, Homo sapiens
cccaagcgccctggcccc

SEQ ID NO: 519245 - DNA, 16 bp, Homo sapiens
cccaataccccatgga

SEQ ID NO: 519246 - DNA, 17 bp, Homo sapiens
cccaataccccatggac

SEQ ID NO: 519247 - DNA, 14 bp, Homo sapiens
cccaccccggggac

SEQ ID NO: 519248 - DNA, 20 bp, Homo sapiens
cccaccctgcttggcccagg

SEQ ID NO: 519249 - DNA, 20 bp, Homo sapiens
cccaccgtggaggaggaagg

SEQ ID NO: 519250 - DNA, 11 bp, Homo sapiens
cccactctcag

SEQ ID NO: 519251 - DNA, 14 bp, Homo sapiens
cccactctcagagg

SEQ ID NO: 519252 - DNA, 20 bp, Homo sapiens
cccactgtgcgtggggctcc

SEQ ID NO: 519253 - DNA, 19 bp, Homo sapiens
cccagagagaagagcccca

SEQ ID NO: 519254 - DNA, 22 bp, Homo sapiens
cccagagagaagagccccactc

SEQ ID NO: 519255 - DNA, 15 bp, Homo sapiens
cccagatcccaagag

SEQ ID NO: 519256 - DNA, 12 bp, Homo sapiens
cccagcagaggg

SEQ ID NO: 519257 - DNA, 17 bp, Homo sapiens
cccagcttccagcagga

SEQ ID NO: 519258 - DNA, 19 bp, Homo sapiens
cccagcttccagcaggagg

SEQ ID NO: 519259 - DNA, 22 bp, Homo sapiens
cccagggggcttcctgagggga

SEQ ID NO: 519260 - DNA, 13 bp, Homo sapiens
cccagtcccagca

SEQ ID NO: 519261 - DNA, 14 bp, Homo sapiens
cccagtcccagcag

SEQ ID NO: 519262 - DNA, 13 bp, Homo sapiens
cccagtccccacc

SEQ ID NO: 519263 - DNA, 14 bp, Homo sapiens
cccagtccccaccc

SEQ ID NO: 519264 - DNA, 13 bp, Homo sapiens
aaaaaaaaagtgt

SEQ ID NO: 519265 - DNA, 14 bp, Homo sapiens
aaaaagcattttaa

SEQ ID NO: 519266 - DNA, 21 bp, Homo sapiens
aaaaagtaccacattccatga

SEQ ID NO: 519267 - DNA, 11 bp, Homo sapiens
aaaaatggcaa

SEQ ID NO: 519268 - DNA, 22 bp, Homo sapiens
aaaactatgacaatttttgctg

SEQ ID NO: 519269 - DNA, 17 bp, Homo sapiens
aaaataaataccaaaga

SEQ ID NO: 519270 - DNA, 20 bp, Homo sapiens
aaaataaccctttggttttt

SEQ ID NO: 519271 - DNA, 13 bp, Homo sapiens
aaaataatcaaac

SEQ ID NO: 519272 - DNA, 11 bp, Homo sapiens
aaaatcttgtc

SEQ ID NO: 519273 - DNA, 14 bp, Homo sapiens
aaaatggcaagaga

SEQ ID NO: 519274 - DNA, 20 bp, Homo sapiens
aaaatgtctcagtattttag

SEQ ID NO: 519275 - DNA, 11 bp, Homo sapiens
aaaattttgca

SEQ ID NO: 519276 - DNA, 19 bp, Homo sapiens
aaaccaaagagggcttcct

SEQ ID NO: 519277 - DNA, 17 bp, Homo sapiens
aaactccacatctgcct

SEQ ID NO: 519278 - DNA, 19 bp, Homo sapiens
aaactccacatctgcctta

SEQ ID NO: 519279 - DNA, 16 bp, Homo sapiens
aaacttcactccaaag

SEQ ID NO: 519280 - DNA, 17 bp, Homo sapiens
aaacttgccttttttat

SEQ ID NO: 519281 - DNA, 21 bp, Homo sapiens
aaagaaaaataattgccatag

SEQ ID NO: 519282 - DNA, 13 bp, Homo sapiens
aaagagaaaccta

SEQ ID NO: 519283 - DNA, 19 bp, Homo sapiens
aaagagggcttcctctaga

SEQ ID NO: 519284 - DNA, 17 bp, Homo sapiens
aaagagtattcagtgat

SEQ ID NO: 519285 - DNA, 18 bp, Homo sapiens
aaagataatgcatatttt

SEQ ID NO: 519286 - DNA, 15 bp, Homo sapiens
aaagcctgaaaattc

SEQ ID NO: 519287 - DNA, 20 bp, Homo sapiens
aaagcctgaaaattccaatt

SEQ ID NO: 519288 - DNA, 19 bp, Homo sapiens
aaaggggagagcctgctgg

SEQ ID NO: 519289 - DNA, 21 bp, Homo sapiens
aaaggtgagtttgagctgcct

SEQ ID NO: 519290 - DNA, 14 bp, Homo sapiens
aaagtataatttca

SEQ ID NO: 519291 - DNA, 21 bp, Homo sapiens
aaagtcagtgttgaattttat

SEQ ID NO: 519292 - DNA, 21 bp, Homo sapiens
aaagtgggttttttagttgaa

SEQ ID NO: 519293 - DNA, 21 bp, Homo sapiens
aaagtttatcagatattttca

SEQ ID NO: 519294 - DNA, 16 bp, Homo sapiens
aaataaaaaaattaaa

SEQ ID NO: 519295 - DNA, 15 bp, Homo sapiens
aaataaaaaagatcc

SEQ ID NO: 519296 - DNA, 14 bp, Homo sapiens
aaatcaagagacaa

SEQ ID NO: 519297 - DNA, 21 bp, Homo sapiens
aaatcatatttcccttacaat

SEQ ID NO: 519298 - DNA, 20 bp, Homo sapiens
aaatctgactttttctgtgc

SEQ ID NO: 519299 - DNA, 16 bp, Homo sapiens
aaatcttgtcatgtgt

SEQ ID NO: 519300 - DNA, 12 bp, Homo sapiens
aaatgctgaccc

SEQ ID NO: 519301 - DNA, 19 bp, Homo sapiens
aaatgtcacttcatatttt

SEQ ID NO: 519302 - DNA, 23 bp, Homo sapiens
aaattcctagaaaagtttgtttt

SEQ ID NO: 519303 - DNA, 13 bp, Homo sapiens
aaattgcaatatg

SEQ ID NO: 519304 - DNA, 17 bp, Homo sapiens
aaatttacatcatttct

SEQ ID NO: 519305 - DNA, 19 bp, Homo sapiens
aaatttgtactatttaact

SEQ ID NO: 519306 - DNA, 10 bp, Homo sapiens
aaattttaaa

SEQ ID NO: 519307 - DNA, 21 bp, Homo sapiens
aaattttgtcctttcatgtaa

SEQ ID NO: 519308 - DNA, 18 bp, Homo sapiens
aacaaaaatgactctaaa

SEQ ID NO: 519309 - DNA, 13 bp, Homo sapiens
aacaaaggcaaga

SEQ ID NO: 519310 - DNA, 16 bp, Homo sapiens
aacaagagcctgattt

SEQ ID NO: 519311 - DNA, 17 bp, Homo sapiens
aacacaaatgtgtattt

SEQ ID NO: 519312 - DNA, 16 bp, Homo sapiens
aacacaagcaaaaaaa

SEQ ID NO: 519313 - DNA, 21 bp, Homo sapiens
aacagctatttcccttttctg

SEQ ID NO: 519314 - DNA, 14 bp, Homo sapiens
aacagttatacaga

SEQ ID NO: 519315 - DNA, 18 bp, Homo sapiens
agcgccctggcccccaca

SEQ ID NO: 519316 - DNA, 20 bp, Homo sapiens
agcgccctggcccccacatg

SEQ ID NO: 519317 - DNA, 17 bp, Homo sapiens
agcgctgtgagatggat

SEQ ID NO: 519318 - DNA, 21 bp, Homo sapiens
agctcatgatgcgcttcaaag

SEQ ID NO: 519319 - DNA, 13 bp, Homo sapiens
agctgccttccct

SEQ ID NO: 519320 - DNA, 18 bp, Homo sapiens
agctgccttccctagctt

SEQ ID NO: 519321 - DNA, 23 bp, Homo sapiens
agctgctaactacatgaacacaa

SEQ ID NO: 519322 - DNA, 16 bp, Homo sapiens
agctgctgagccgcag

SEQ ID NO: 519323 - DNA, 12 bp, Homo sapiens
agcttccagcag

SEQ ID NO: 519324 - DNA, 14 bp, Homo sapiens
agcttccagcagga

SEQ ID NO: 519325 - DNA, 17 bp, Homo sapiens
agcttctgcttttctgc

SEQ ID NO: 519326 - DNA, 21 bp, Homo sapiens
agcttctgcttttctgccctg

SEQ ID NO: 519327 - DNA, 16 bp, Homo sapiens
agctttagaccctggg

SEQ ID NO: 519328 - DNA, 22 bp, Homo sapiens
agctttagaccctgggtgggct

SEQ ID NO: 519329 - DNA, 15 bp, Homo sapiens
aggaagtagcacagg

SEQ ID NO: 519330 - DNA, 16 bp, Homo sapiens
aggacaggggttcctt

SEQ ID NO: 519331 - DNA, 18 bp, Homo sapiens
aggaccagcccacgctga

SEQ ID NO: 519332 - DNA, 20 bp, Homo sapiens
aggacccctgcagttcccct

SEQ ID NO: 519333 - DNA, 21 bp, Homo sapiens
aggaccctgccaggcacaggc

SEQ ID NO: 519334 - DNA, 22 bp, Homo sapiens
aggaccctgccaggcacaggca

SEQ ID NO: 519335 - DNA, 20 bp, Homo sapiens
aggagactgtggagactgct

SEQ ID NO: 519336 - DNA, 18 bp, Homo sapiens
aggagctgtggaaatggt

SEQ ID NO: 519337 - DNA, 14 bp, Homo sapiens
aggaggccacctcc

SEQ ID NO: 519338 - DNA, 14 bp, Homo sapiens
aggagggagaggga

SEQ ID NO: 519339 - DNA, 16 bp, Homo sapiens
aggagtagttttctat

SEQ ID NO: 519340 - DNA, 15 bp, Homo sapiens
aggcaacaatttggt

SEQ ID NO: 519341 - DNA, 16 bp, Homo sapiens
aggcacaggcagggca

SEQ ID NO: 519342 - DNA, 17 bp, Homo sapiens
aggcacaggcagggcag

SEQ ID NO: 519343 - DNA, 20 bp, Homo sapiens
aggcaggggtgggggtggag

SEQ ID NO: 519344 - DNA, 19 bp, Homo sapiens
aggccaagagtggccccac

SEQ ID NO: 519345 - DNA, 20 bp, Homo sapiens
aggccaagagtggccccacc

SEQ ID NO: 519346 - DNA, 22 bp, Homo sapiens
aggccaagagtggccccacctg

SEQ ID NO: 519347 - DNA, 21 bp, Homo sapiens
aggccacctcctaaaaggccc

SEQ ID NO: 519348 - DNA, 22 bp, Homo sapiens
aggccacctcctaaaaggccca

SEQ ID NO: 519349 - DNA, 23 bp, Homo sapiens
aggccagcctccgagagggagag

SEQ ID NO: 519350 - DNA, 14 bp, Homo sapiens
aggcccaccctgct

SEQ ID NO: 519351 - DNA, 22 bp, Homo sapiens
aggcccaccctgcttggcccag

SEQ ID NO: 519352 - DNA, 20 bp, Homo sapiens
aggcccagagagaagagccc

SEQ ID NO: 519353 - DNA, 23 bp, Homo sapiens
aggcccagagagaagagccccac

SEQ ID NO: 519354 - DNA, 15 bp, Homo sapiens
aggctcactgccagg

SEQ ID NO: 519355 - DNA, 20 bp, Homo sapiens
aggctcactgccaggccagc

SEQ ID NO: 519356 - DNA, 23 bp, Homo sapiens
aggctcactgccaggccagcctc

SEQ ID NO: 519357 - DNA, 18 bp, Homo sapiens
aggctccccctaaacaca

SEQ ID NO: 519358 - DNA, 15 bp, Homo sapiens
aggctgagtgcaggc

SEQ ID NO: 519359 - DNA, 18 bp, Homo sapiens
aggctgagtgcaggccca

SEQ ID NO: 519360 - DNA, 19 bp, Homo sapiens
aggctgagtgcaggcccac

SEQ ID NO: 519361 - DNA, 21 bp, Homo sapiens
aggctgagtgcaggcccaccc

SEQ ID NO: 519362 - DNA, 15 bp, Homo sapiens
aggctgggctgggca

SEQ ID NO: 519363 - DNA, 21 bp, Homo sapiens
aggctgggctgggcactgctc

SEQ ID NO: 519364 - DNA, 21 bp, Homo sapiens
aggcttcctgcgtcctcctca

SEQ ID NO: 519365 - DNA, 15 bp, Homo sapiens
aggcttctccgccag

SEQ ID NO: 519366 - DNA, 19 bp, Homo sapiens
aggcttctccgccagcctc

SEQ ID NO: 519367 - DNA, 13 bp, Homo sapiens
agggacagtctca

SEQ ID NO: 519368 - DNA, 20 bp, Homo sapiens
agggactgaggcaagcacaa

SEQ ID NO: 519369 - DNA, 22 bp, Homo sapiens
agggagagagagagagagagga

SEQ ID NO: 519370 - DNA, 18 bp, Homo sapiens
agggcacagggcctggcc

SEQ ID NO: 519371 - DNA, 19 bp, Homo sapiens
agggcacagggcctggccc

SEQ ID NO: 519372 - DNA, 13 bp, Homo sapiens
agggcaggaccag

SEQ ID NO: 519373 - DNA, 17 bp, Homo sapiens
agggcaggaccagccca

SEQ ID NO: 519374 - DNA, 13 bp, Homo sapiens
aggggactgccac

SEQ ID NO: 519375 - DNA, 17 bp, Homo sapiens
aggggactgccacctcc

SEQ ID NO: 519376 - DNA, 16 bp, Homo sapiens
aggggagagcctgctg

SEQ ID NO: 519377 - DNA, 12 bp, Homo sapiens
aggggaggccaa

SEQ ID NO: 519378 - DNA, 19 bp, Homo sapiens
agggggcttgaagccaaag

SEQ ID NO: 519379 - DNA, 19 bp, Homo sapiens
aggggtgggggtggaggct

SEQ ID NO: 519380 - DNA, 13 bp, Homo sapiens
aggtaccagctgc

SEQ ID NO: 519381 - DNA, 21 bp, Homo sapiens
aggtcactggaaaggggagag

SEQ ID NO: 519382 - DNA, 22 bp, Homo sapiens
aggtgagtttgagctgccttcc

SEQ ID NO: 519383 - DNA, 19 bp, Homo sapiens
aggtggaaaaggaacccaa

SEQ ID NO: 519384 - DNA, 14 bp, Homo sapiens
aggtggaattactt

SEQ ID NO: 519385 - DNA, 12 bp, Homo sapiens
aggtgttatttt

SEQ ID NO: 519386 - DNA, 16 bp, Homo sapiens
aggtgttattttcaat

SEQ ID NO: 519387 - DNA, 20 bp, Homo sapiens
aggtgttattttcaatgaaa

SEQ ID NO: 519388 - DNA, 16 bp, Homo sapiens
aggttcctctgcctgc

SEQ ID NO: 519389 - DNA, 20 bp, Homo sapiens
aggttcctctgcctgccccg

SEQ ID NO: 519390 - DNA, 15 bp, Homo sapiens
aggttgaagccaagt

SEQ ID NO: 519391 - DNA, 23 bp, Homo sapiens
aggttgaagccaagtggggtgct

SEQ ID NO: 519392 - DNA, 16 bp, Homo sapiens
aggtttgttttttcaa

SEQ ID NO: 519393 - DNA, 13 bp, Homo sapiens
agtaatttctgag

SEQ ID NO: 519394 - DNA, 16 bp, Homo sapiens
agtaccacattccatg

SEQ ID NO: 519395 - DNA, 17 bp, Homo sapiens
agtagaatctcttttct

SEQ ID NO: 519396 - DNA, 19 bp, Homo sapiens
agtagagtgagttcttttt

SEQ ID NO: 519397 - DNA, 14 bp, Homo sapiens
agtagcacaggctg

SEQ ID NO: 519398 - DNA, 21 bp, Homo sapiens
agtagcacaggctgagtgcag

SEQ ID NO: 519399 - DNA, 11 bp, Homo sapiens
agtatgttctt

SEQ ID NO: 519400 - DNA, 21 bp, Homo sapiens
agtcactggaggttgaagcca

SEQ ID NO: 519401 - DNA, 23 bp, Homo sapiens
agtcactggaggttgaagccaag

SEQ ID NO: 519402 - DNA, 16 bp, Homo sapiens
agtcatcatctccaaa

SEQ ID NO: 519403 - DNA, 14 bp, Homo sapiens
agtccattctccca

SEQ ID NO: 519404 - DNA, 15 bp, Homo sapiens
agtccattctcccag

SEQ ID NO: 519405 - DNA, 16 bp, Homo sapiens
agtcccagcagccagc

SEQ ID NO: 519406 - DNA, 12 bp, Homo sapiens
agtccccacccc

SEQ ID NO: 519407 - DNA, 18 bp, Homo sapiens
agtccccacccctgcccc

SEQ ID NO: 519408 - DNA, 18 bp, Homo sapiens
agtctacccctctccttt

SEQ ID NO: 519409 - DNA, 16 bp, Homo sapiens
agtctagtcagtgtag

SEQ ID NO: 519410 - DNA, 23 bp, Homo sapiens
agtctcaaaatcaactctcttat

SEQ ID NO: 519411 - DNA, 20 bp, Homo sapiens
agtctcaccatttccccagg

SEQ ID NO: 519412 - DNA, 13 bp, Homo sapiens
agtcttcctattg

SEQ ID NO: 519413 - DNA, 14 bp, Homo sapiens
agtgacggttccta

SEQ ID NO: 519414 - DNA, 17 bp, Homo sapiens
agtgagaggggaggcca

SEQ ID NO: 519415 - DNA, 13 bp, Homo sapiens
agtgagttctttt

SEQ ID NO: 519416 - DNA, 17 bp, Homo sapiens
agtgcaggcccaccctg

SEQ ID NO: 519417 - DNA, 18 bp, Homo sapiens
agtgcaggcccaccctgc

SEQ ID NO: 519418 - DNA, 22 bp, Homo sapiens
agtgctgccacttaaaaagact

SEQ ID NO: 519419 - DNA, 20 bp, Homo sapiens
agtggcagggcacagggcct

SEQ ID NO: 519420 - DNA, 13 bp, Homo sapiens
agtggccccacct

SEQ ID NO: 519421 - DNA, 16 bp, Homo sapiens
agtggccccacctggc

SEQ ID NO: 519422 - DNA, 19 bp, Homo sapiens
agtggccccacctggccct

SEQ ID NO: 519423 - DNA, 22 bp, Homo sapiens
agtggggggaacgcccacttcc

SEQ ID NO: 519424 - DNA, 21 bp, Homo sapiens
agtggggtgctgggaggaggg

SEQ ID NO: 519425 - DNA, 12 bp, Homo sapiens
agtgggtttttt

SEQ ID NO: 519426 - DNA, 21 bp, Homo sapiens
agtgggttttttagttgaatt

SEQ ID NO: 519427 - DNA, 17 bp, Homo sapiens
agacgttgtaatgcaca

SEQ ID NO: 519428 - DNA, 12 bp, Homo sapiens
agactgccagct

SEQ ID NO: 519429 - DNA, 13 bp, Homo sapiens
agactgccagctc

SEQ ID NO: 519430 - DNA, 14 bp, Homo sapiens
agactgccagctct

SEQ ID NO: 519431 - DNA, 17 bp, Homo sapiens
agactgctcctgagccc

SEQ ID NO: 519432 - DNA, 18 bp, Homo sapiens
agactgtggagactgctc

SEQ ID NO: 519433 - DNA, 13 bp, Homo sapiens
agagaagagcccc

SEQ ID NO: 519434 - DNA, 19 bp, Homo sapiens
agagaagtgacggttccta

SEQ ID NO: 519435 - DNA, 18 bp, Homo sapiens
agagacttgttttggatg

SEQ ID NO: 519436 - DNA, 16 bp, Homo sapiens
agagagaagagcccca

SEQ ID NO: 519437 - DNA, 13 bp, Homo sapiens
agagaggacagct

SEQ ID NO: 519438 - DNA, 13 bp, Homo sapiens
agagatattttgg

SEQ ID NO: 519439 - DNA, 17 bp, Homo sapiens
agagatcatatcctcag

SEQ ID NO: 519440 - DNA, 19 bp, Homo sapiens
agagatgggaatgaggtgg

SEQ ID NO: 519441 - DNA, 12 bp, Homo sapiens
agagatgttaag

SEQ ID NO: 519442 - DNA, 18 bp, Homo sapiens
agagcaacccctggaccc

SEQ ID NO: 519443 - DNA, 15 bp, Homo sapiens
agagcaggttactaa

SEQ ID NO: 519444 - DNA, 23 bp, Homo sapiens
agagccataaaaatataacataa

SEQ ID NO: 519445 - DNA, 17 bp, Homo sapiens
agagcctgattttttga

SEQ ID NO: 519446 - DNA, 11 bp, Homo sapiens
agagcctgctg

SEQ ID NO: 519447 - DNA, 19 bp, Homo sapiens
agagcctgctggcacccac

SEQ ID NO: 519448 - DNA, 14 bp, Homo sapiens
agaggagccctgcc

SEQ ID NO: 519449 - DNA, 17 bp, Homo sapiens
agaggctagcttctgct

SEQ ID NO: 519450 - DNA, 19 bp, Homo sapiens
agaggctagcttctgcttt

SEQ ID NO: 519451 - DNA, 22 bp, Homo sapiens
agaggcttctccgccagcctcc

SEQ ID NO: 519452 - DNA, 12 bp, Homo sapiens
agagggagagag

SEQ ID NO: 519453 - DNA, 13 bp, Homo sapiens
agaggtctgtaaa

SEQ ID NO: 519454 - DNA, 12 bp, Homo sapiens
agagtcagagat

SEQ ID NO: 519455 - DNA, 19 bp, Homo sapiens
agagtggccccacctggcc

SEQ ID NO: 519456 - DNA, 21 bp, Homo sapiens
agagtggccccacctggccct

SEQ ID NO: 519457 - DNA, 21 bp, Homo sapiens
agataatgcatatttttgcac

SEQ ID NO: 519458 - DNA, 14 bp, Homo sapiens
agatattttcatat

SEQ ID NO: 519459 - DNA, 22 bp, Homo sapiens
agatatttttaacttaatggca

SEQ ID NO: 519460 - DNA, 18 bp, Homo sapiens
agatggatgtatttgtag

SEQ ID NO: 519461 - DNA, 22 bp, Homo sapiens
agatggatgtatttgtagccag

SEQ ID NO: 519462 - DNA, 23 bp, Homo sapiens
agcaaaaaaaaaaaaaagcatct

SEQ ID NO: 519463 - DNA, 21 bp, Homo sapiens
agcaacccctggaccccagcc

SEQ ID NO: 519464 - DNA, 19 bp, Homo sapiens
agcaaggccacctcttcct

SEQ ID NO: 519465 - DNA, 22 bp, Homo sapiens
agcaaggccacctcttcctggc

SEQ ID NO: 519466 - DNA, 12 bp, Homo sapiens
agcacaggctga

SEQ ID NO: 519467 - DNA, 13 bp, Homo sapiens
agcagtgcccagg

SEQ ID NO: 519468 - DNA, 18 bp, Homo sapiens
agcatggactgttcattt

SEQ ID NO: 519469 - DNA, 13 bp, Homo sapiens
agcattttctcct

SEQ ID NO: 519470 - DNA, 18 bp, Homo sapiens
agccaaacacacagaagg

SEQ ID NO: 519471 - DNA, 13 bp, Homo sapiens
agccaaagaaaaa

SEQ ID NO: 519472 - DNA, 13 bp, Homo sapiens
agccaatatttta

SEQ ID NO: 519473 - DNA, 22 bp, Homo sapiens
agcccacgctgactacagggcc

SEQ ID NO: 519474 - DNA, 23 bp, Homo sapiens
agcccacgctgactacagggccg

SEQ ID NO: 519475 - DNA, 17 bp, Homo sapiens
agcccagatcccaagag

SEQ ID NO: 519476 - DNA, 16 bp, Homo sapiens
agcccaggagcccatt

SEQ ID NO: 519477 - DNA, 17 bp, Homo sapiens
agcccatttggagggcc

SEQ ID NO: 519478 - DNA, 21 bp, Homo sapiens
agcccatttggagggcctggg

SEQ ID NO: 519479 - DNA, 14 bp, Homo sapiens
agccccactctcag

SEQ ID NO: 519480 - DNA, 16 bp, Homo sapiens
agccccactctcagag

SEQ ID NO: 519481 - DNA, 22 bp, Homo sapiens
agccccactctcagaggcccca

SEQ ID NO: 519482 - DNA, 16 bp, Homo sapiens
agcccccagcttccag

SEQ ID NO: 519483 - DNA, 21 bp, Homo sapiens
agcccccagcttccagcagga

SEQ ID NO: 519484 - DNA, 18 bp, Homo sapiens
agccctgcctctccgccc

SEQ ID NO: 519485 - DNA, 12 bp, Homo sapiens
agcccttgcctc

SEQ ID NO: 519486 - DNA, 14 bp, Homo sapiens
agcccttgcctccc

SEQ ID NO: 519487 - DNA, 23 bp, Homo sapiens
agcccttgcctccccatttccca

SEQ ID NO: 519488 - DNA, 16 bp, Homo sapiens
agccgggcccctgggc

SEQ ID NO: 519489 - DNA, 17 bp, Homo sapiens
agccgggcccctgggct

SEQ ID NO: 519490 - DNA, 18 bp, Homo sapiens
agccgggcccctgggctt

SEQ ID NO: 519491 - DNA, 16 bp, Homo sapiens
agcctcaaatccagga

SEQ ID NO: 519492 - DNA, 21 bp, Homo sapiens
agcctcaaatccaggaccctg

SEQ ID NO: 519493 - DNA, 14 bp, Homo sapiens
agcctgaaaattcc

SEQ ID NO: 519494 - DNA, 23 bp, Homo sapiens
agcctgcacttgggggctcagca

SEQ ID NO: 519495 - DNA, 13 bp, Homo sapiens
agcgccctggccc

SEQ ID NO: 519496 - DNA, 20 bp, Homo sapiens
accagctgcgcttgcttttc

SEQ ID NO: 519497 - DNA, 20 bp, Homo sapiens
accatgctgtctggcacagc

SEQ ID NO: 519498 - DNA, 21 bp, Homo sapiens
acccaagggtcgcctattttt

SEQ ID NO: 519499 - DNA, 15 bp, Homo sapiens
acccaccgtggagga

SEQ ID NO: 519500 - DNA, 13 bp, Homo sapiens
accccctgccctg

SEQ ID NO: 519501 - DNA, 15 bp, Homo sapiens
accccctgccctgca

SEQ ID NO: 519502 - DNA, 16 bp, Homo sapiens
accccggggaccctgt

SEQ ID NO: 519503 - DNA, 14 bp, Homo sapiens
acccctcgcccagt

SEQ ID NO: 519504 - DNA, 23 bp, Homo sapiens
acccctcgcccagtcccagcagc

SEQ ID NO: 519505 - DNA, 24 bp, Homo sapiens
acccctcgcccagtcccagcagcc

SEQ ID NO: 519506 - DNA, 10 bp, Homo sapiens
acccctgccc

SEQ ID NO: 519507 - DNA, 12 bp, Homo sapiens
acccctgccccc

SEQ ID NO: 519508 - DNA, 17 bp, Homo sapiens
acccctgcccccagccc

SEQ ID NO: 519509 - DNA, 15 bp, Homo sapiens
accctgccaggcaca

SEQ ID NO: 519510 - DNA, 17 bp, Homo sapiens
accctgcttggcccagg

SEQ ID NO: 519511 - DNA, 19 bp, Homo sapiens
accctgggtgggctctgtg

SEQ ID NO: 519512 - DNA, 20 bp, Homo sapiens
accctgggtgggctctgtgc

SEQ ID NO: 519513 - DNA, 23 bp, Homo sapiens
accctttggtttttttcttctgt

SEQ ID NO: 519514 - DNA, 13 bp, Homo sapiens
accgcagagtatt

SEQ ID NO: 519515 - DNA, 20 bp, Homo sapiens
acctcatgcccaccccctgc

SEQ ID NO: 519516 - DNA, 15 bp, Homo sapiens
acctccccttgccag

SEQ ID NO: 519517 - DNA, 22 bp, Homo sapiens
acctcctaaaaggcccagagag

SEQ ID NO: 519518 - DNA, 17 bp, Homo sapiens
acctcttcctggccggt

SEQ ID NO: 519519 - DNA, 15 bp, Homo sapiens
acctgagacatatta

SEQ ID NO: 519520 - DNA, 19 bp, Homo sapiens
acctggctgaggttcctct

SEQ ID NO: 519521 - DNA, 23 bp, Homo sapiens
acctggctgaggttcctctgcct

SEQ ID NO: 519522 - DNA, 13 bp, Homo sapiens
accttagggaaga

SEQ ID NO: 519523 - DNA, 17 bp, Homo sapiens
accttattcagaaaata

SEQ ID NO: 519524 - DNA, 14 bp, Homo sapiens
acgcaggagctgtg

SEQ ID NO: 519525 - DNA, 17 bp, Homo sapiens
acggcaggctcactgcc

SEQ ID NO: 519526 - DNA, 18 bp, Homo sapiens
acggcaggctcactgcca

SEQ ID NO: 519527 - DNA, 10 bp, Homo sapiens
acggttccta

SEQ ID NO: 519528 - DNA, 18 bp, Homo sapiens
acggttcctacacaggac

SEQ ID NO: 519529 - DNA, 20 bp, Homo sapiens
acggttcctacacaggacag

SEQ ID NO: 519530 - DNA, 18 bp, Homo sapiens
actacagggccgccggca

SEQ ID NO: 519531 - DNA, 23 bp, Homo sapiens
actacctaaaataaataccaaag

SEQ ID NO: 519532 - DNA, 22 bp, Homo sapiens
actatatttttgggaggagcca

SEQ ID NO: 519533 - DNA, 17 bp, Homo sapiens
actattcttgatgtaaa

SEQ ID NO: 519534 - DNA, 14 bp, Homo sapiens
actatttaactgac

SEQ ID NO: 519535 - DNA, 16 bp, Homo sapiens
actatttaactgacta

SEQ ID NO: 519536 - DNA, 17 bp, Homo sapiens
actatttaactgactat

SEQ ID NO: 519537 - DNA, 13 bp, Homo sapiens
actccaaagagaa

SEQ ID NO: 519538 - DNA, 14 bp, Homo sapiens
actccaaagagaaa

SEQ ID NO: 519539 - DNA, 15 bp, Homo sapiens
actccaaagagaaac

SEQ ID NO: 519540 - DNA, 15 bp, Homo sapiens
actctcagaggcccc

SEQ ID NO: 519541 - DNA, 16 bp, Homo sapiens
actctcagaggcccca

SEQ ID NO: 519542 - DNA, 17 bp, Homo sapiens
actctcagaggccccaa

SEQ ID NO: 519543 - DNA, 22 bp, Homo sapiens
actctcaggaaatgctgaccca

SEQ ID NO: 519544 - DNA, 23 bp, Homo sapiens
actctgccttaatttttgaaaag

SEQ ID NO: 519545 - DNA, 22 bp, Homo sapiens
actgaaggaaaaacacaagcaa

SEQ ID NO: 519546 - DNA, 18 bp, Homo sapiens
actgactattcttgatgt

SEQ ID NO: 519547 - DNA, 22 bp, Homo sapiens
actgactattcttgatgtaaaa

SEQ ID NO: 519548 - DNA, 24 bp, Homo sapiens
actgactattcttgatgtaaaatc

SEQ ID NO: 519549 - DNA, 19 bp, Homo sapiens
actgacttttctttttaat

SEQ ID NO: 519550 - DNA, 16 bp, Homo sapiens
actgccagctcttcct

SEQ ID NO: 519551 - DNA, 17 bp, Homo sapiens
actgccaggccagcctc

SEQ ID NO: 519552 - DNA, 23 bp, Homo sapiens
actgccaggccagcctccgagag

SEQ ID NO: 519553 - DNA, 16 bp, Homo sapiens
actgctcctgagcccc

SEQ ID NO: 519554 - DNA, 11 bp, Homo sapiens
actgctctcac

SEQ ID NO: 519555 - DNA, 17 bp, Homo sapiens
actggaggttgaagcca

SEQ ID NO: 519556 - DNA, 18 bp, Homo sapiens
actggaggttgaagccaa

SEQ ID NO: 519557 - DNA, 16 bp, Homo sapiens
actgtaaaatgtggga

SEQ ID NO: 519558 - DNA, 17 bp, Homo sapiens
agtggttttatactgaa

SEQ ID NO: 519559 - DNA, 15 bp, Homo sapiens
agtgtacattttata

SEQ ID NO: 519560 - DNA, 17 bp, Homo sapiens
agtgtagttttcctttt

SEQ ID NO: 519561 - DNA, 21 bp, Homo sapiens
agtgtagttttccttttgtgt

SEQ ID NO: 519562 - DNA, 23 bp, Homo sapiens
agttattttctacagtggtttta

SEQ ID NO: 519563 - DNA, 24 bp, Homo sapiens
agttcccctggaagcagtgcccag

SEQ ID NO: 519564 - DNA, 14 bp, Homo sapiens
agttgaagaaaaaa

SEQ ID NO: 519565 - DNA, 20 bp, Homo sapiens
agttgaagaaaaaatggcaa

SEQ ID NO: 519566 - DNA, 18 bp, Homo sapiens
agttgaattttttttaac

SEQ ID NO: 519567 - DNA, 23 bp, Homo sapiens
agttgaattttttttaacattcc

SEQ ID NO: 519568 - DNA, 17 bp, Homo sapiens
agttgtcctgatgtttt

SEQ ID NO: 519569 - DNA, 22 bp, Homo sapiens
agttgttaccccaagcgccctg

SEQ ID NO: 519570 - DNA, 15 bp, Homo sapiens
agtttgagctgcctt

SEQ ID NO: 519571 - DNA, 16 bp, Homo sapiens
agtttgagctgccttc

SEQ ID NO: 519572 - DNA, 23 bp, Homo sapiens
agtttgagctgccttccctagct

SEQ ID NO: 519573 - DNA, 17 bp, Homo sapiens
agtttgttttactttgt

SEQ ID NO: 519574 - DNA, 14 bp, Homo sapiens
agttttgaaatgaa

SEQ ID NO: 519575 - DNA, 18 bp, Homo sapiens
agttttgaaatgaaaatc

SEQ ID NO: 519576 - DNA, 15 bp, Homo sapiens
ataaaaaagatccca

SEQ ID NO: 519577 - DNA, 17 bp, Homo sapiens
ataaaaaagatcccaaa

SEQ ID NO: 519578 - DNA, 14 bp, Homo sapiens
ataaaccactcagt

SEQ ID NO: 519579 - DNA, 18 bp, Homo sapiens
ataaaccactcagtaaaa

SEQ ID NO: 519580 - DNA, 22 bp, Homo sapiens
ataaacgtggagaatcacaggc

SEQ ID NO: 519581 - DNA, 16 bp, Homo sapiens
ataaactatattctgt

SEQ ID NO: 519582 - DNA, 18 bp, Homo sapiens
ataaagtttatcagatat

SEQ ID NO: 519583 - DNA, 19 bp, Homo sapiens
ataaagtttatcagatatt

SEQ ID NO: 519584 - DNA, 21 bp, Homo sapiens
ataagttatgggtttttatgt

SEQ ID NO: 519585 - DNA, 19 bp, Homo sapiens
ataatgcatatttttgcac

SEQ ID NO: 519586 - DNA, 15 bp, Homo sapiens
ataccaaagataatg

SEQ ID NO: 519587 - DNA, 22 bp, Homo sapiens
ataccaaagataatgcatattt

SEQ ID NO: 519588 - DNA, 20 bp, Homo sapiens
atactcaggataacagagaa

SEQ ID NO: 519589 - DNA, 20 bp, Homo sapiens
atactctcaccatttggatc

SEQ ID NO: 519590 - DNA, 21 bp, Homo sapiens
ggcccctgggcttggcctgct

SEQ ID NO: 519591 - DNA, 15 bp, Homo sapiens
ggcctggcccatgta

SEQ ID NO: 519592 - DNA, 12 bp, Homo sapiens
ggcctgggcctg

SEQ ID NO: 519593 - DNA, 15 bp, Homo sapiens
ggcctgggcctggct

SEQ ID NO: 519594 - DNA, 17 bp, Homo sapiens
ggcctgggcctggctcc

SEQ ID NO: 519595 - DNA, 18 bp, Homo sapiens
ggcctgggcctggctccc

SEQ ID NO: 519596 - DNA, 15 bp, Homo sapiens
ggctcactgccaggc

SEQ ID NO: 519597 - DNA, 18 bp, Homo sapiens
ggctcactgccaggccag

SEQ ID NO: 519598 - DNA, 19 bp, Homo sapiens
ggctcactgccaggccagc

SEQ ID NO: 519599 - DNA, 15 bp, Homo sapiens
ggctcagcaaggcca

SEQ ID NO: 519600 - DNA, 18 bp, Homo sapiens
ggctcagcaaggccacct

SEQ ID NO: 519601 - DNA, 15 bp, Homo sapiens
ggctcccgcctccaa

SEQ ID NO: 519602 - DNA, 16 bp, Homo sapiens
ggctccctcactctca

SEQ ID NO: 519603 - DNA, 19 bp, Homo sapiens
ggctccctcactctcagga

SEQ ID NO: 519604 - DNA, 14 bp, Homo sapiens
ggctgaggttcctc

SEQ ID NO: 519605 - DNA, 17 bp, Homo sapiens
ggctgaggttcctctgc

SEQ ID NO: 519606 - DNA, 23 bp, Homo sapiens
ggctgaggttcctctgcctgccc

SEQ ID NO: 519607 - DNA, 13 bp, Homo sapiens
ggctgagtgcagg

SEQ ID NO: 519608 - DNA, 19 bp, Homo sapiens
ggctgagtgcaggcccacc

SEQ ID NO: 519609 - DNA, 20 bp, Homo sapiens
ggctgagtgcaggcccaccc

SEQ ID NO: 519610 - DNA, 17 bp, Homo sapiens
ggctgctgcccccaccc

SEQ ID NO: 519611 - DNA, 18 bp, Homo sapiens
ggctgggctgggcactgc

SEQ ID NO: 519612 - DNA, 18 bp, Homo sapiens
ggctgggggatgggcctg

SEQ ID NO: 519613 - DNA, 21 bp, Homo sapiens
ggctgttctgtttcctgtgtc

SEQ ID NO: 519614 - DNA, 22 bp, Homo sapiens
ggctgttctgtttcctgtgtct

SEQ ID NO: 519615 - DNA, 21 bp, Homo sapiens
ggcttcctctagaagccaagg

SEQ ID NO: 519616 - DNA, 17 bp, Homo sapiens
ggcttcctgaggggaga

SEQ ID NO: 519617 - DNA, 18 bp, Homo sapiens
ggcttctccgccagcctc

SEQ ID NO: 519618 - DNA, 21 bp, Homo sapiens
ggcttctccgccagcctcctc

SEQ ID NO: 519619 - DNA, 15 bp, Homo sapiens
ggcttgaagccaaag

SEQ ID NO: 519620 - DNA, 16 bp, Homo sapiens
ggcttgaagccaaaga

SEQ ID NO: 519621 - DNA, 13 bp, Homo sapiens
ggcttggcctgct

SEQ ID NO: 519622 - DNA, 15 bp, Homo sapiens
ggcttggcctgctgt

SEQ ID NO: 519623 - DNA, 19 bp, Homo sapiens
gggaaaacttcactccaaa

SEQ ID NO: 519624 - DNA, 19 bp, Homo sapiens
gggaacgcccacttccctg

SEQ ID NO: 519625 - DNA, 15 bp, Homo sapiens
gggacccagtggcag

SEQ ID NO: 519626 - DNA, 17 bp, Homo sapiens
gggacccagtggcaggg

SEQ ID NO: 519627 - DNA, 23 bp, Homo sapiens
gggaccctgtgacatggtgcctg

SEQ ID NO: 519628 - DNA, 18 bp, Homo sapiens
gggacctgccaggcaggg

SEQ ID NO: 519629 - DNA, 22 bp, Homo sapiens
gggactgccacctccccttgcc

SEQ ID NO: 519630 - DNA, 14 bp, Homo sapiens
gggagagagagaga

SEQ ID NO: 519631 - DNA, 14 bp, Homo sapiens
gggaggagggagag

SEQ ID NO: 519632 - DNA, 17 bp, Homo sapiens
gggaggagggagaggga

SEQ ID NO: 519633 - DNA, 22 bp, Homo sapiens
gggaggccaagagtggccccac

SEQ ID NO: 519634 - DNA, 14 bp, Homo sapiens
gggatggggctggg

SEQ ID NO: 519635 - DNA, 22 bp, Homo sapiens
gggatgtggtattggtgctttg

SEQ ID NO: 519636 - DNA, 12 bp, Homo sapiens
gggcaagaaaga

SEQ ID NO: 519637 - DNA, 18 bp, Homo sapiens
gggcacagggcctggccc

SEQ ID NO: 519638 - DNA, 20 bp, Homo sapiens
atgttgtatttatggaagaa

SEQ ID NO: 519639 - DNA, 13 bp, Homo sapiens
atgttttgcaaag

SEQ ID NO: 519640 - DNA, 16 bp, Homo sapiens
atgttttgttttgtgt

SEQ ID NO: 519641 - DNA, 22 bp, Homo sapiens
atgttttgttttgtgtttttcc

SEQ ID NO: 519642 - DNA, 18 bp, Homo sapiens
atgtttttctgtgttact

SEQ ID NO: 519643 - DNA, 17 bp, Homo sapiens
attaactgccaaaacaa

SEQ ID NO: 519644 - DNA, 13 bp, Homo sapiens
attaataaatgtc

SEQ ID NO: 519645 - DNA, 16 bp, Homo sapiens
attactgacttttctt

SEQ ID NO: 519646 - DNA, 24 bp, Homo sapiens
attactgtttaattgacatactca

SEQ ID NO: 519647 - DNA, 15 bp, Homo sapiens
attagaatgcagacg

SEQ ID NO: 519648 - DNA, 20 bp, Homo sapiens
attataccgcagagtatttg

SEQ ID NO: 519649 - DNA, 18 bp, Homo sapiens
attatgatgttttgcaaa

SEQ ID NO: 519650 - DNA, 16 bp, Homo sapiens
attatgggtcacagga

SEQ ID NO: 519651 - DNA, 15 bp, Homo sapiens
attatgtaacactag

SEQ ID NO: 519652 - DNA, 23 bp, Homo sapiens
attcaacccatttactttggtca

SEQ ID NO: 519653 - DNA, 17 bp, Homo sapiens
attccactacacctggc

SEQ ID NO: 519654 - DNA, 17 bp, Homo sapiens
attccatgacgcaggag

SEQ ID NO: 519655 - DNA, 24 bp, Homo sapiens
attcctagaaaagtttgttttact

SEQ ID NO: 519656 - DNA, 23 bp, Homo sapiens
attcctcatgaatgtaaatttgt

SEQ ID NO: 519657 - DNA, 18 bp, Homo sapiens
attcctggttatcctatt

SEQ ID NO: 519658 - DNA, 20 bp, Homo sapiens
attctcccaggtaccagctg

SEQ ID NO: 519659 - DNA, 24 bp, Homo sapiens
attctcccaggtaccagctgcgct

SEQ ID NO: 519660 - DNA, 16 bp, Homo sapiens
attcttgatgtaaaat

SEQ ID NO: 519661 - DNA, 18 bp, Homo sapiens
attcttgatgtaaaatct

SEQ ID NO: 519662 - DNA, 19 bp, Homo sapiens
attcttgatgtaaaatctt

SEQ ID NO: 519663 - DNA, 15 bp, Homo sapiens
attctttccatgaca

SEQ ID NO: 519664 - DNA, 17 bp, Homo sapiens
attgattttttttctct

SEQ ID NO: 519665 - DNA, 14 bp, Homo sapiens
attgctatgttctt

SEQ ID NO: 519666 - DNA, 12 bp, Homo sapiens
cacttaaaaaga

SEQ ID NO: 519667 - DNA, 13 bp, Homo sapiens
cacttaaaaagac

SEQ ID NO: 519668 - DNA, 17 bp, Homo sapiens
cacttgggggctcagca

SEQ ID NO: 519669 - DNA, 18 bp, Homo sapiens
cacttgggggctcagcaa

SEQ ID NO: 519670 - DNA, 20 bp, Homo sapiens
cacttgggggctcagcaagg

SEQ ID NO: 519671 - DNA, 15 bp, Homo sapiens
cagaaggggactgcc

SEQ ID NO: 519672 - DNA, 23 bp, Homo sapiens
cagaaggggactgccacctcccc

SEQ ID NO: 519673 - DNA, 16 bp, Homo sapiens
cagacaggacccctgc

SEQ ID NO: 519674 - DNA, 22 bp, Homo sapiens
cagagagaagagccccactctc

SEQ ID NO: 519675 - DNA, 18 bp, Homo sapiens
cagagcaacccctggacc

SEQ ID NO: 519676 - DNA, 15 bp, Homo sapiens
cagagtatgttcttg

SEQ ID NO: 519677 - DNA, 15 bp, Homo sapiens
cagatagagatattt

SEQ ID NO: 519678 - DNA, 22 bp, Homo sapiens
cagatattttcatatttaaagc

SEQ ID NO: 519679 - DNA, 14 bp, Homo sapiens
cagcagccagccaa

SEQ ID NO: 519680 - DNA, 18 bp, Homo sapiens
cagccaaacacacagaag

SEQ ID NO: 519681 - DNA, 19 bp, Homo sapiens
cagccaaacacacagaagg

SEQ ID NO: 519682 - DNA, 13 bp, Homo sapiens
cagcccacgctga

SEQ ID NO: 519683 - DNA, 19 bp, Homo sapiens
cagcctcaaatccaggacc

SEQ ID NO: 519684 - DNA, 17 bp, Homo sapiens
cagcctccgagagggag

SEQ ID NO: 519685 - DNA, 22 bp, Homo sapiens
cagcctcctctggacggcaggc

SEQ ID NO: 519686 - DNA, 23 bp, Homo sapiens
cagcctgcacttgggggctcagc

SEQ ID NO: 519687 - DNA, 20 bp, Homo sapiens
cagctatttcccttttctgt

SEQ ID NO: 519688 - DNA, 22 bp, Homo sapiens
cagctcttcctagctggagagg

SEQ ID NO: 519689 - DNA, 19 bp, Homo sapiens
cagctgcgcttgcttttct

SEQ ID NO: 519690 - DNA, 16 bp, Homo sapiens
cagctgctgagccgca

SEQ ID NO: 519691 - DNA, 18 bp, Homo sapiens
cagctgctgagccgcaga

SEQ ID NO: 519692 - DNA, 20 bp, Homo sapiens
cagctgctgagccgcagaga

SEQ ID NO: 519693 - DNA, 14 bp, Homo sapiens
cagcttccagcagg

SEQ ID NO: 519694 - DNA, 22 bp, Homo sapiens
cagcttgagccgggcccctggg

SEQ ID NO: 519695 - DNA, 19 bp, Homo sapiens
caggaaactccacatctgc

SEQ ID NO: 519696 - DNA, 20 bp, Homo sapiens
caggaaactccacatctgcc

SEQ ID NO: 519697 - DNA, 15 bp, Homo sapiens
caggaagtagcacag

SEQ ID NO: 519698 - DNA, 17 bp, Homo sapiens
caggaagtagcacaggc

SEQ ID NO: 519699 - DNA, 21 bp, Homo sapiens
caggaagtagcacaggctgag

SEQ ID NO: 519700 - DNA, 14 bp, Homo sapiens
caggaccagcccac

SEQ ID NO: 519701 - DNA, 15 bp, Homo sapiens
caggaccagcccacg

SEQ ID NO: 519702 - DNA, 21 bp, Homo sapiens
caggaccagcccacgctgact

SEQ ID NO: 519703 - DNA, 15 bp, Homo sapiens
caggacccctgcagt

SEQ ID NO: 519704 - DNA, 17 bp, Homo sapiens
caggaccctgccaggca

SEQ ID NO: 519705 - DNA, 21 bp, Homo sapiens
caggaccctgccaggcacagg

SEQ ID NO: 519706 - DNA, 22 bp, Homo sapiens
caggaccctgccaggcacaggc

SEQ ID NO: 519707 - DNA, 21 bp, Homo sapiens
caggagactgtggagactgct

SEQ ID NO: 519708 - DNA, 11 bp, Homo sapiens
caggagcccat

SEQ ID NO: 519709 - DNA, 23 bp, Homo sapiens
caggagcccatttggagggcctg

SEQ ID NO: 519710 - DNA, 21 bp, Homo sapiens
caggagctgtggaaatggtga

SEQ ID NO: 519711 - DNA, 17 bp, Homo sapiens
caggagggacagtctca

SEQ ID NO: 519712 - DNA, 20 bp, Homo sapiens
caggagggacagtctcacca

SEQ ID NO: 519713 - DNA, 15 bp, Homo sapiens
caggataacagagaa

SEQ ID NO: 519714 - DNA, 13 bp, Homo sapiens
caggcacaggcag

SEQ ID NO: 519715 - DNA, 14 bp, Homo sapiens
caggcagggcagga

SEQ ID NO: 519716 - DNA, 12 bp, Homo sapiens
caggcaggggtg

SEQ ID NO: 519717 - DNA, 23 bp, Homo sapiens
caggcagttttgaaatgaaaatc

SEQ ID NO: 519718 - DNA, 18 bp, Homo sapiens
caggcatagaggcttctc

SEQ ID NO: 519719 - DNA, 19 bp, Homo sapiens
caggcatagaggcttctcc

SEQ ID NO: 519720 - DNA, 12 bp, Homo sapiens
caggccagcctc

SEQ ID NO: 519721 - DNA, 19 bp, Homo sapiens
caggccagcctccgagagg

SEQ ID NO: 519722 - DNA, 13 bp, Homo sapiens
caggctcactgcc

SEQ ID NO: 519723 - DNA, 14 bp, Homo sapiens
caggctcactgcca

SEQ ID NO: 519724 - DNA, 15 bp, Homo sapiens
caggctgagtgcagg

SEQ ID NO: 519725 - DNA, 21 bp, Homo sapiens
caggctgagtgcaggcccacc

SEQ ID NO: 519726 - DNA, 14 bp, Homo sapiens
caggctgggctggg

SEQ ID NO: 519727 - DNA, 12 bp, Homo sapiens
cagggcacaggg

SEQ ID NO: 519728 - DNA, 17 bp, Homo sapiens
cagggcacagggcctgg

SEQ ID NO: 519729 - DNA, 22 bp, Homo sapiens
cagggcacagggcctggcccat

SEQ ID NO: 519730 - DNA, 20 bp, Homo sapiens
cagggcaggaccagcccacg

SEQ ID NO: 519731 - DNA, 17 bp, Homo sapiens
cagggcctggcccatgt

SEQ ID NO: 519732 - DNA, 12 bp, Homo sapiens
caggggttcctt

SEQ ID NO: 519733 - DNA, 18 bp, Homo sapiens
caggtaccagctgcgctt

SEQ ID NO: 519734 - DNA, 21 bp, Homo sapiens
caggtaccagctgcgcttgct

SEQ ID NO: 519735 - DNA, 14 bp, Homo sapiens
cagtaaaagcaaaa

SEQ ID NO: 519736 - DNA, 11 bp, Homo sapiens
cagtattttag

SEQ ID NO: 519737 - DNA, 23 bp, Homo sapiens
cagtcactggaggttgaagccaa

SEQ ID NO: 519738 - DNA, 13 bp, Homo sapiens
cagtcccagcagc

SEQ ID NO: 519739 - DNA, 18 bp, Homo sapiens
cagtcccagcagccagcc

SEQ ID NO: 519740 - DNA, 19 bp, Homo sapiens
cagtcccagcagccagcca

SEQ ID NO: 519741 - DNA, 14 bp, Homo sapiens
cagtccccacccct

SEQ ID NO: 519742 - DNA, 16 bp, Homo sapiens
cagtccccacccctgc

SEQ ID NO: 519743 - DNA, 17 bp, Homo sapiens
cagtccccacccctgcc

SEQ ID NO: 519744 - DNA, 20 bp, Homo sapiens
cagtccccacccctgccccc

SEQ ID NO: 519745 - DNA, 21 bp, Homo sapiens
cagtccccacccctgccccca

SEQ ID NO: 519746 - DNA, 22 bp, Homo sapiens
cagtgatatgtaaattaaatga

SEQ ID NO: 519747 - DNA, 17 bp, Homo sapiens
cagtgcagtaatttctg

SEQ ID NO: 519748 - DNA, 11 bp, Homo sapiens
cagtgcccagg

SEQ ID NO: 519749 - DNA, 15 bp, Homo sapiens
cagtgcccaggtggc

SEQ ID NO: 519750 - DNA, 14 bp, Homo sapiens
cagtggcagggcac

SEQ ID NO: 519751 - DNA, 16 bp, Homo sapiens
cagtggcagggcacag

SEQ ID NO: 519752 - DNA, 19 bp, Homo sapiens
cagtggcagggcacagggc

SEQ ID NO: 519753 - DNA, 21 bp, Homo sapiens
cagtggttttatactgaagga

SEQ ID NO: 519754 - DNA, 14 bp, Homo sapiens
gatatgtaaattaa

SEQ ID NO: 519755 - DNA, 20 bp, Homo sapiens
gatattttgggtatattttc

SEQ ID NO: 519756 - DNA, 14 bp, Homo sapiens
gatgagttctgtcc

SEQ ID NO: 519757 - DNA, 14 bp, Homo sapiens
gatgcgcttcaaag

SEQ ID NO: 519758 - DNA, 10 bp, Homo sapiens
gatgggcctg

SEQ ID NO: 519759 - DNA, 12 bp, Homo sapiens
gatggggctggg

SEQ ID NO: 519760 - DNA, 14 bp, Homo sapiens
gatgggtcaagcaa

SEQ ID NO: 519761 - DNA, 14 bp, Homo sapiens
gatgtaaaatcttg

SEQ ID NO: 519762 - DNA, 15 bp, Homo sapiens
gatgtaaaatcttgt

SEQ ID NO: 519763 - DNA, 20 bp, Homo sapiens
gatgtaaaatcttgtcatgt

SEQ ID NO: 519764 - DNA, 22 bp, Homo sapiens
gatgtggtattggtgctttgtg

SEQ ID NO: 519765 - DNA, 13 bp, Homo sapiens
gatgttttgcaaa

SEQ ID NO: 519766 - DNA, 21 bp, Homo sapiens
gattcctggttatcctatttt

SEQ ID NO: 519767 - DNA, 15 bp, Homo sapiens
gattgtacatatttt

SEQ ID NO: 519768 - DNA, 12 bp, Homo sapiens
gattgtatttgt

SEQ ID NO: 519769 - DNA, 21 bp, Homo sapiens
gcaaagtagaatctcttttct

SEQ ID NO: 519770 - DNA, 15 bp, Homo sapiens
gcaaatctgactttt

SEQ ID NO: 519771 - DNA, 21 bp, Homo sapiens
gcaacccctggaccccagcct

SEQ ID NO: 519772 - DNA, 22 bp, Homo sapiens
gcaagagggggtggaggggtgt

SEQ ID NO: 519773 - DNA, 22 bp, Homo sapiens
gcaagcacaatggtttcaaaga

SEQ ID NO: 519774 - DNA, 14 bp, Homo sapiens
gcaaggccacctct

SEQ ID NO: 519775 - DNA, 15 bp, Homo sapiens
gcaagtatttggcta

SEQ ID NO: 519776 - DNA, 16 bp, Homo sapiens
gcaataaaagcccagg

SEQ ID NO: 519777 - DNA, 23 bp, Homo sapiens
gcaattgtaaacagaaattgcaa

SEQ ID NO: 519778 - DNA, 15 bp, Homo sapiens
gcacaggcagggcag

SEQ ID NO: 519779 - DNA, 17 bp, Homo sapiens
gcacaggctgagtgcag

SEQ ID NO: 519780 - DNA, 19 bp, Homo sapiens
gcacaggctgagtgcaggc

SEQ ID NO: 519781 - DNA, 21 bp, Homo sapiens
gcacaggctgagtgcaggccc

SEQ ID NO: 519782 - DNA, 18 bp, Homo sapiens
gcacagggcctggcccat

SEQ ID NO: 519783 - DNA, 13 bp, Homo sapiens
gcacattccaaaa

SEQ ID NO: 519784 - DNA, 19 bp, Homo sapiens
gcacccaccgtggaggagg

SEQ ID NO: 519785 - DNA, 12 bp, Homo sapiens
gcactgtaaaat

SEQ ID NO: 519786 - DNA, 13 bp, Homo sapiens
gcactgtaaaatg

SEQ ID NO: 519787 - DNA, 21 bp, Homo sapiens
gcactgttgtcatttccaaat

SEQ ID NO: 519788 - DNA, 15 bp, Homo sapiens
gcagaagctatgttt

SEQ ID NO: 519789 - DNA, 18 bp, Homo sapiens
gcagaagctatgttttta

SEQ ID NO: 519790 - DNA, 21 bp, Homo sapiens
gcagaagctatgtttttaaag

SEQ ID NO: 519791 - DNA, 21 bp, Homo sapiens
gcagccagccaaacacacaga

SEQ ID NO: 519792 - DNA, 14 bp, Homo sapiens
gcaggaccagccca

SEQ ID NO: 519793 - DNA, 15 bp, Homo sapiens
gcaggaccagcccac

SEQ ID NO: 519794 - DNA, 22 bp, Homo sapiens
gcaggagctgtggaaatggtga

SEQ ID NO: 519795 - DNA, 17 bp, Homo sapiens
gcaggcatagaggcttc

SEQ ID NO: 519796 - DNA, 15 bp, Homo sapiens
gcaggctcactgcca

SEQ ID NO: 519797 - DNA, 18 bp, Homo sapiens
gcaggctcactgccaggc

SEQ ID NO: 519798 - DNA, 21 bp, Homo sapiens
gcaggctcactgccaggccag

SEQ ID NO: 519799 - DNA, 14 bp, Homo sapiens
gcagggcacagggc

SEQ ID NO: 519800 - DNA, 22 bp, Homo sapiens
gcagggcacagggcctggccca

SEQ ID NO: 519801 - DNA, 16 bp, Homo sapiens
gcagggcaggaccagc

SEQ ID NO: 519802 - DNA, 17 bp, Homo sapiens
gcagggcaggaccagcc

SEQ ID NO: 519803 - DNA, 18 bp, Homo sapiens
gcagggcaggaccagccc

SEQ ID NO: 519804 - DNA, 21 bp, Homo sapiens
gcagggcaggaccagcccacg

SEQ ID NO: 519805 - DNA, 17 bp, Homo sapiens
gcagttcccctggaagc

SEQ ID NO: 519806 - DNA, 23 bp, Homo sapiens
gcagttcccctggaagcagtgcc

SEQ ID NO: 519807 - DNA, 13 bp, Homo sapiens
gcatatttttgca

SEQ ID NO: 519808 - DNA, 14 bp, Homo sapiens
gcatatttttgcac

SEQ ID NO: 519809 - DNA, 22 bp, Homo sapiens
gcatccatggggtctctcacag

SEQ ID NO: 519810 - DNA, 16 bp, Homo sapiens
gcatggttttagcaaa

SEQ ID NO: 519811 - DNA, 22 bp, Homo sapiens
gcattctttcttctctttactt

SEQ ID NO: 519812 - DNA, 24 bp, Homo sapiens
gcattttaccttcaaaatatttgt

SEQ ID NO: 519813 - DNA, 12 bp, Homo sapiens
gccaagggaaag

SEQ ID NO: 519814 - DNA, 22 bp, Homo sapiens
gccaagggaaaggggtgctttt

SEQ ID NO: 519815 - DNA, 22 bp, Homo sapiens
gccacctcctaaaaggcccaga

SEQ ID NO: 519816 - DNA, 23 bp, Homo sapiens
gccacctcctaaaaggcccagag

SEQ ID NO: 519817 - DNA, 17 bp, Homo sapiens
gccacttaaaaagactt

SEQ ID NO: 519818 - DNA, 21 bp, Homo sapiens
gccagccaaacacacagaagg

SEQ ID NO: 519819 - DNA, 21 bp, Homo sapiens
gccagcctccgagagggagag

SEQ ID NO: 519820 - DNA, 15 bp, Homo sapiens
gccagcctcctctgg

SEQ ID NO: 519821 - DNA, 17 bp, Homo sapiens
gccagcctcctctggac

SEQ ID NO: 519822 - DNA, 17 bp, Homo sapiens
gccagctcttcctagct

SEQ ID NO: 519823 - DNA, 21 bp, Homo sapiens
gccagctcttcctagctggag

SEQ ID NO: 519824 - DNA, 15 bp, Homo sapiens
gccagctgctgagcc

SEQ ID NO: 519825 - DNA, 19 bp, Homo sapiens
gccagctgctgagccgcag

SEQ ID NO: 519826 - DNA, 17 bp, Homo sapiens
gccaggaagtagcacag

SEQ ID NO: 519827 - DNA, 18 bp, Homo sapiens
gccaggaagtagcacagg

SEQ ID NO: 519828 - DNA, 19 bp, Homo sapiens
gccaggaagtagcacaggc

SEQ ID NO: 519829 - DNA, 13 bp, Homo sapiens
gccaggcacaggc

SEQ ID NO: 519830 - DNA, 16 bp, Homo sapiens
gccaggcacaggcagg

SEQ ID NO: 519831 - DNA, 14 bp, Homo sapiens
gccaggcaggggtg

SEQ ID NO: 519832 - DNA, 15 bp, Homo sapiens
gccaggcaggggtgg

SEQ ID NO: 519833 - DNA, 19 bp, Homo sapiens
gccaggccagcctccgaga

SEQ ID NO: 519834 - DNA, 13 bp, Homo sapiens
gccattaaaaaac

SEQ ID NO: 519835 - DNA, 18 bp, Homo sapiens
gcccaccccctgccctgc

SEQ ID NO: 519836 - DNA, 20 bp, Homo sapiens
gcccaccccctgccctgcac

SEQ ID NO: 519837 - DNA, 18 bp, Homo sapiens
gcccacgctgactacagg

SEQ ID NO: 519838 - DNA, 11 bp, Homo sapiens
gcccacttccc

SEQ ID NO: 519839 - DNA, 23 bp, Homo sapiens
gcccagagagaagagccccactc

SEQ ID NO: 519840 - DNA, 15 bp, Homo sapiens
gcccagatcccaaga

SEQ ID NO: 519841 - DNA, 12 bp, Homo sapiens
gcccagtcccag

SEQ ID NO: 519842 - DNA, 16 bp, Homo sapiens
gcccatgtatggccag

SEQ ID NO: 519843 - DNA, 20 bp, Homo sapiens
gcccatgtatggccaggaag

SEQ ID NO: 519844 - DNA, 16 bp, Homo sapiens
gcccatttggagggcc

SEQ ID NO: 519845 - DNA, 17 bp, Homo sapiens
gcccatttggagggcct

SEQ ID NO: 519846 - DNA, 14 bp, Homo sapiens
gccccacctggccc

SEQ ID NO: 519847 - DNA, 12 bp, Homo sapiens
gccccactctca

SEQ ID NO: 519848 - DNA, 16 bp, Homo sapiens
gccccactctcagagg

SEQ ID NO: 519849 - DNA, 17 bp, Homo sapiens
gcccccaccccggggac

SEQ ID NO: 519850 - DNA, 15 bp, Homo sapiens
gcccccagtccccac

SEQ ID NO: 519851 - DNA, 17 bp, Homo sapiens
gcccccagtccccaccc

SEQ ID NO: 519852 - DNA, 18 bp, Homo sapiens
gcccccagtccccacccc

SEQ ID NO: 519853 - DNA, 21 bp, Homo sapiens
gcccccagtccccacccctgc

SEQ ID NO: 519854 - DNA, 17 bp, Homo sapiens
gccccgtctcaggtctg

SEQ ID NO: 519855 - DNA, 12 bp, Homo sapiens
gcccctgagccc

SEQ ID NO: 519856 - DNA, 12 bp, Homo sapiens
gcccctgggctt

SEQ ID NO: 519857 - DNA, 18 bp, Homo sapiens
gcccctgggcttggcctg

SEQ ID NO: 519858 - DNA, 19 bp, Homo sapiens
gcccctgggcttggcctgc

SEQ ID NO: 519859 - DNA, 15 bp, Homo sapiens
tatgatgttttgcaa

SEQ ID NO: 519860 - DNA, 14 bp, Homo sapiens
tatgccattaaaaa

SEQ ID NO: 519861 - DNA, 21 bp, Homo sapiens
tatgtaactcctccatccatg

SEQ ID NO: 519862 - DNA, 14 bp, Homo sapiens
tatgttcttgaaga

SEQ ID NO: 519863 - DNA, 20 bp, Homo sapiens
tatgttttgttttgtgtttt

SEQ ID NO: 519864 - DNA, 21 bp, Homo sapiens
tatgttttgttttgtgttttt

SEQ ID NO: 519865 - DNA, 17 bp, Homo sapiens
tattaaatgtaagtcgt

SEQ ID NO: 519866 - DNA, 18 bp, Homo sapiens
tattatgatgttttgcaa

SEQ ID NO: 519867 - DNA, 14 bp, Homo sapiens
tattattaaatgta

SEQ ID NO: 519868 - DNA, 17 bp, Homo sapiens
tattgctatgttcttct

SEQ ID NO: 519869 - DNA, 13 bp, Homo sapiens
tattggtgctttg

SEQ ID NO: 519870 - DNA, 13 bp, Homo sapiens
tatttaactgact

SEQ ID NO: 519871 - DNA, 13 bp, Homo sapiens
tatttagacaaga

SEQ ID NO: 519872 - DNA, 20 bp, Homo sapiens
tatttagacaagagatggga

SEQ ID NO: 519873 - DNA, 19 bp, Homo sapiens
tatttcagcatggactgtt

SEQ ID NO: 519874 - DNA, 16 bp, Homo sapiens
tatttctgaaaaagag

SEQ ID NO: 519875 - DNA, 14 bp, Homo sapiens
tatttggctattaa

SEQ ID NO: 519876 - DNA, 15 bp, Homo sapiens
tatttgtccttattg

SEQ ID NO: 519877 - DNA, 20 bp, Homo sapiens
tattttagggtcaatgagag

SEQ ID NO: 519878 - DNA, 20 bp, Homo sapiens
tattttatttagacaagaga

SEQ ID NO: 519879 - DNA, 19 bp, Homo sapiens
tattttcaagatacatgtt

SEQ ID NO: 519880 - DNA, 23 bp, Homo sapiens
tattttcaagatacatgttgtat

SEQ ID NO: 519881 - DNA, 13 bp, Homo sapiens
tattttcatattt

SEQ ID NO: 519882 - DNA, 15 bp, Homo sapiens
tattttctacagtgg

SEQ ID NO: 519883 - DNA, 16 bp, Homo sapiens
tatttttttttctaag

SEQ ID NO: 519884 - DNA, 15 bp, Homo sapiens
tcaaagaaagactgt

SEQ ID NO: 519885 - DNA, 16 bp, Homo sapiens
tcaaatccaggaccct

SEQ ID NO: 519886 - DNA, 21 bp, Homo sapiens
tcaaatccaggaccctgccag

SEQ ID NO: 519887 - DNA, 20 bp, Homo sapiens
tcaacattggagacatcact

SEQ ID NO: 519888 - DNA, 22 bp, Homo sapiens
tcaacttatttctgaaaaagag

SEQ ID NO: 519889 - DNA, 20 bp, Homo sapiens
tcaagaaaattttgcagaag

SEQ ID NO: 519890 - DNA, 14 bp, Homo sapiens
tcaagagccaagac

SEQ ID NO: 519891 - DNA, 21 bp, Homo sapiens
tcaagagccaagacacaggta

SEQ ID NO: 519892 - DNA, 18 bp, Homo sapiens
tcaatacactagttgttt

SEQ ID NO: 519893 - DNA, 22 bp, Homo sapiens
tcaatcctaatttctcctccct

SEQ ID NO: 519894 - DNA, 18 bp, Homo sapiens
tcaatgaaacaaagaaag

SEQ ID NO: 519895 - DNA, 19 bp, Homo sapiens
tcaatgaaacaaagaaaga

SEQ ID NO: 519896 - DNA, 21 bp, Homo sapiens
tcaatgaaacaaagaaagaga

SEQ ID NO: 519897 - DNA, 17 bp, Homo sapiens
tcacactgtaacctcag

SEQ ID NO: 519898 - DNA, 15 bp, Homo sapiens
tcacagacaggaccc

SEQ ID NO: 519899 - DNA, 14 bp, Homo sapiens
tcacaggctgggct

SEQ ID NO: 519900 - DNA, 18 bp, Homo sapiens
tcacaggctgggctgggc

SEQ ID NO: 519901 - DNA, 20 bp, Homo sapiens
tcacaggctgggctgggcac

SEQ ID NO: 519902 - DNA, 17 bp, Homo sapiens
tcaccatttccccaggg

SEQ ID NO: 519903 - DNA, 20 bp, Homo sapiens
tcacctcatgcccaccccct

SEQ ID NO: 519904 - DNA, 22 bp, Homo sapiens
tcaccttagggaagatgccaca

SEQ ID NO: 519905 - DNA, 17 bp, Homo sapiens
tcactaagtatgatcta

SEQ ID NO: 519906 - DNA, 17 bp, Homo sapiens
tcactccaaagagaaac

SEQ ID NO: 519907 - DNA, 12 bp, Homo sapiens
tcactctcagga

SEQ ID NO: 519908 - DNA, 15 bp, Homo sapiens
tcactgccaggccag

SEQ ID NO: 519909 - DNA, 23 bp, Homo sapiens
tcactggaaaggggagagcctgc

SEQ ID NO: 519910 - DNA, 20 bp, Homo sapiens
tcagaccaggtggaattact

SEQ ID NO: 519911 - DNA, 17 bp, Homo sapiens
tcagaggcccaaaacag

SEQ ID NO: 519912 - DNA, 15 bp, Homo sapiens
tcagcaaggccacct

SEQ ID NO: 519913 - DNA, 17 bp, Homo sapiens
tcagcaaggccacctct

SEQ ID NO: 519914 - DNA, 18 bp, Homo sapiens
tcagcaaggccacctctt

SEQ ID NO: 519915 - DNA, 16 bp, Homo sapiens
tcagtgcagtaatttc

SEQ ID NO: 519916 - DNA, 14 bp, Homo sapiens
tcagtgttgaattt

SEQ ID NO: 519917 - DNA, 18 bp, Homo sapiens
tcagtgttgaattttatt

SEQ ID NO: 519918 - DNA, 13 bp, Homo sapiens
tcatgaatgtaaa

SEQ ID NO: 519919 - DNA, 15 bp, Homo sapiens
tcatgcccaccccct

SEQ ID NO: 519920 - DNA, 19 bp, Homo sapiens
tcatgcccaccccctgccc

SEQ ID NO: 519921 - DNA, 22 bp, Homo sapiens
tcatgcccaccccctgccctgc

SEQ ID NO: 519922 - DNA, 14 bp, Homo sapiens
tcatgtgtataaaa

SEQ ID NO: 519923 - DNA, 16 bp, Homo sapiens
tccaaagagaaaccta

SEQ ID NO: 519924 - DNA, 16 bp, Homo sapiens
tccaaatttgctttac

SEQ ID NO: 519925 - DNA, 19 bp, Homo sapiens
tccaacccctcgcccagtc

SEQ ID NO: 519926 - DNA, 13 bp, Homo sapiens
tccacatctgcct

SEQ ID NO: 519927 - DNA, 18 bp, Homo sapiens
tccactacacctggctga

SEQ ID NO: 519928 - DNA, 12 bp, Homo sapiens
tccagcaggagg

SEQ ID NO: 519929 - DNA, 14 bp, Homo sapiens
tccaggaccctgcc

SEQ ID NO: 519930 - DNA, 15 bp, Homo sapiens
tccaggaccctgcca

SEQ ID NO: 519931 - DNA, 21 bp, Homo sapiens
tccaggaccctgccaggcaca

SEQ ID NO: 519932 - DNA, 22 bp, Homo sapiens
tccaggaccctgccaggcacag

SEQ ID NO: 519933 - DNA, 15 bp, Homo sapiens
tccatgacacccaag

SEQ ID NO: 519934 - DNA, 16 bp, Homo sapiens
tccatgacgcaggagc

SEQ ID NO: 519935 - DNA, 23 bp, Homo sapiens
tccatggggtctctcacagacag

SEQ ID NO: 519936 - DNA, 14 bp, Homo sapiens
tccattctcccagg

SEQ ID NO: 519937 - DNA, 16 bp, Homo sapiens
tcccaggtaccagctg

SEQ ID NO: 519938 - DNA, 21 bp, Homo sapiens
tcccaggtaccagctgcgctt

SEQ ID NO: 519939 - DNA, 19 bp, Homo sapiens
gaagaagggagaagaaagg

SEQ ID NO: 519940 - DNA, 13 bp, Homo sapiens
gaagagccccact

SEQ ID NO: 519941 - DNA, 23 bp, Homo sapiens
gaagagccccactctcagaggcc

SEQ ID NO: 519942 - DNA, 16 bp, Homo sapiens
gaagcagtgcccaggt

SEQ ID NO: 519943 - DNA, 18 bp, Homo sapiens
gaagcagtgcccaggtgg

SEQ ID NO: 519944 - DNA, 12 bp, Homo sapiens
gaagccaaagaa

SEQ ID NO: 519945 - DNA, 13 bp, Homo sapiens
gaagccaaagaaa

SEQ ID NO: 519946 - DNA, 14 bp, Homo sapiens
gaagccaagggaaa

SEQ ID NO: 519947 - DNA, 19 bp, Homo sapiens
gaagccaagggaaaggggt

SEQ ID NO: 519948 - DNA, 20 bp, Homo sapiens
gaagccaagggaaaggggtg

SEQ ID NO: 519949 - DNA, 21 bp, Homo sapiens
gaagccaagggaaaggggtgc

SEQ ID NO: 519950 - DNA, 22 bp, Homo sapiens
gaagccaagtggggtgctggga

SEQ ID NO: 519951 - DNA, 16 bp, Homo sapiens
gaaggaggccacctcc

SEQ ID NO: 519952 - DNA, 16 bp, Homo sapiens
gaaggtgtttaaagag

SEQ ID NO: 519953 - DNA, 15 bp, Homo sapiens
gaagtagcacaggct

SEQ ID NO: 519954 - DNA, 16 bp, Homo sapiens
gaagtagcacaggctg

SEQ ID NO: 519955 - DNA, 21 bp, Homo sapiens
gaataagttatgggtttttat

SEQ ID NO: 519956 - DNA, 15 bp, Homo sapiens
gaatcacaggctggg

SEQ ID NO: 519957 - DNA, 15 bp, Homo sapiens
gaatctcttttctgg

SEQ ID NO: 519958 - DNA, 22 bp, Homo sapiens
gaatctcttttctggtaatttt

SEQ ID NO: 519959 - DNA, 15 bp, Homo sapiens
gaatgcttctcttta

SEQ ID NO: 519960 - DNA, 22 bp, Homo sapiens
gaatgtgagctaagcattttct

SEQ ID NO: 519961 - DNA, 15 bp, Homo sapiens
gaattttattgaaag

SEQ ID NO: 519962 - DNA, 15 bp, Homo sapiens
gaattttttttaaca

SEQ ID NO: 519963 - DNA, 20 bp, Homo sapiens
gaattttttttaacattcct

SEQ ID NO: 519964 - DNA, 20 bp, Homo sapiens
gacaaagtgaactctatttt

SEQ ID NO: 519965 - DNA, 17 bp, Homo sapiens
gacaatcgtgatagtta

SEQ ID NO: 519966 - DNA, 18 bp, Homo sapiens
gacacattgttttccaga

SEQ ID NO: 519967 - DNA, 12 bp, Homo sapiens
gacacccaaggg

SEQ ID NO: 519968 - DNA, 21 bp, Homo sapiens
gacaggacccctgcagttccc

SEQ ID NO: 519969 - DNA, 13 bp, Homo sapiens
gacatcactggca

SEQ ID NO: 519970 - DNA, 17 bp, Homo sapiens
gacatggtgcctgagag

SEQ ID NO: 519971 - DNA, 21 bp, Homo sapiens
gacattgattgctgcatttta

SEQ ID NO: 519972 - DNA, 17 bp, Homo sapiens
gaccaggtggaattact

SEQ ID NO: 519973 - DNA, 18 bp, Homo sapiens
gaccaggtggaattactt

SEQ ID NO: 519974 - DNA, 12 bp, Homo sapiens
gacccagtggca

SEQ ID NO: 519975 - DNA, 14 bp, Homo sapiens
gacccagtggcagg

SEQ ID NO: 519976 - DNA, 21 bp, Homo sapiens
tgagccatccagcatgaaaga

SEQ ID NO: 519977 - DNA, 22 bp, Homo sapiens
tgagccatccagcatgaaagat

SEQ ID NO: 519978 - DNA, 19 bp, Homo sapiens
tgagcccactgtgcgtggg

SEQ ID NO: 519979 - DNA, 13 bp, Homo sapiens
tgagcccccagct

SEQ ID NO: 519980 - DNA, 17 bp, Homo sapiens
tgagcccccagcttcca

SEQ ID NO: 519981 - DNA, 22 bp, Homo sapiens
tgagcccccagcttccagcagg

SEQ ID NO: 519982 - DNA, 14 bp, Homo sapiens
tgagccgcagagaa

SEQ ID NO: 519983 - DNA, 17 bp, Homo sapiens
tgagccgggcccctggg

SEQ ID NO: 519984 - DNA, 16 bp, Homo sapiens
tgagctgccttcccta

SEQ ID NO: 519985 - DNA, 22 bp, Homo sapiens
tgaggtgggaggtggaagaagg

SEQ ID NO: 519986 - DNA, 17 bp, Homo sapiens
tgagtccattctcccag

SEQ ID NO: 519987 - DNA, 22 bp, Homo sapiens
tgagtccattctcccaggtacc

SEQ ID NO: 519988 - DNA, 13 bp, Homo sapiens
tgagtgcaggccc

SEQ ID NO: 519989 - DNA, 13 bp, Homo sapiens
tgagttctttttc

SEQ ID NO: 519990 - DNA, 19 bp, Homo sapiens
tgagtttgagctgccttcc

SEQ ID NO: 519991 - DNA, 22 bp, Homo sapiens
tgatatgtaaattaaatgaaga

SEQ ID NO: 519992 - DNA, 11 bp, Homo sapiens
tgatgtaaaat

SEQ ID NO: 519993 - DNA, 13 bp, Homo sapiens
tgatgttttgcaa

SEQ ID NO: 519994 - DNA, 12 bp, Homo sapiens
tgatgtttttct

SEQ ID NO: 519995 - DNA, 20 bp, Homo sapiens
tgattccactacacctggct

SEQ ID NO: 519996 - DNA, 22 bp, Homo sapiens
tgattccactacacctggctga

SEQ ID NO: 519997 - DNA, 16 bp, Homo sapiens
tgattcccagatgtgt

SEQ ID NO: 519998 - DNA, 15 bp, Homo sapiens
tgattccttctctgg

SEQ ID NO: 519999 - DNA, 17 bp, Homo sapiens
tgcaagcttttcctaat

SEQ ID NO: 520000 - DNA, 22 bp, Homo sapiens
tgcacaggtttgttttttcaag

SEQ ID NO: 520001 - DNA, 14 bp, Homo sapiens
tgcactgtaaaatg

SEQ ID NO: 520002 - DNA, 15 bp, Homo sapiens
tgcactgtaaaatgt

SEQ ID NO: 520003 - DNA, 22 bp, Homo sapiens
tgcagaagctatgtttttaaag

SEQ ID NO: 520004 - DNA, 12 bp, Homo sapiens
tgcaggcccacc

SEQ ID NO: 520005 - DNA, 13 bp, Homo sapiens
tgcaggcccaccc

SEQ ID NO: 520006 - DNA, 14 bp, Homo sapiens
tgcagtcactggag

SEQ ID NO: 520007 - DNA, 10 bp, Homo sapiens
tgccacctcc

SEQ ID NO: 520008 - DNA, 18 bp, Homo sapiens
tgccacctccccttgcca

SEQ ID NO: 520009 - DNA, 16 bp, Homo sapiens
tgccacttaaaaagac

SEQ ID NO: 520010 - DNA, 20 bp, Homo sapiens
tgccagctcttcctagctgg

SEQ ID NO: 520011 - DNA, 23 bp, Homo sapiens
tgccagctcttcctagctggaga

SEQ ID NO: 520012 - DNA, 20 bp, Homo sapiens
tgccaggcacaggcagggca

SEQ ID NO: 520013 - DNA, 12 bp, Homo sapiens
tgccaggcaggg

SEQ ID NO: 520014 - DNA, 15 bp, Homo sapiens
tgccaggcaggggtg

SEQ ID NO: 520015 - DNA, 15 bp, Homo sapiens
tgccaggccagcctc

SEQ ID NO: 520016 - DNA, 18 bp, Homo sapiens
tgccaggccagcctccga

SEQ ID NO: 520017 - DNA, 22 bp, Homo sapiens
tgccctgcacgtcatgggaggg

SEQ ID NO: 520018 - DNA, 12 bp, Homo sapiens
tgccctggctgc

SEQ ID NO: 520019 - DNA, 22 bp, Homo sapiens
tgcctacaatgggaaaacttca

SEQ ID NO: 520020 - DNA, 21 bp, Homo sapiens
tgcctccccatttcccatctg

SEQ ID NO: 520021 - DNA, 22 bp, Homo sapiens
tgcctccccatttcccatctgc

SEQ ID NO: 520022 - DNA, 23 bp, Homo sapiens
tgcctccccatttcccatctgca

SEQ ID NO: 520023 - DNA, 20 bp, Homo sapiens
tgcctctccgcccctgagcc

SEQ ID NO: 520024 - DNA, 13 bp, Homo sapiens
tgcctgagaggca

SEQ ID NO: 520025 - DNA, 16 bp, Homo sapiens
tgcctgagaggcaggc

SEQ ID NO: 520026 - DNA, 14 bp, Homo sapiens
tgcctggtaagtgg

SEQ ID NO: 520027 - DNA, 15 bp, Homo sapiens
tgccttaaaaccaaa

SEQ ID NO: 520028 - DNA, 14 bp, Homo sapiens
tgccttgaaatcaa

SEQ ID NO: 520029 - DNA, 15 bp, Homo sapiens
tgccttgaaatcaag

SEQ ID NO: 520030 - DNA, 21 bp, Homo sapiens
tgccttgctagaaacataatt

SEQ ID NO: 520031 - DNA, 16 bp, Homo sapiens
tgccttggttcttcct

SEQ ID NO: 520032 - DNA, 22 bp, Homo sapiens
tgcgtcctcctcacctcatgcc

SEQ ID NO: 520033 - DNA, 17 bp, Homo sapiens
tgctagaattgattttt

SEQ ID NO: 520034 - DNA, 22 bp, Homo sapiens
tgctagaattgattttttttct

SEQ ID NO: 520035 - DNA, 15 bp, Homo sapiens
tgctgcccccacccc

SEQ ID NO: 520036 - DNA, 14 bp, Homo sapiens
tgcttggcccaggg

SEQ ID NO: 520037 - DNA, 22 bp, Homo sapiens
tgctttgtgtctagggcagagt

SEQ ID NO: 520038 - DNA, 19 bp, Homo sapiens
tgcttttaaaaattttgtc

SEQ ID NO: 520039 - DNA, 18 bp, Homo sapiens
tgcttttctgccctggct

SEQ ID NO: 520040 - DNA, 17 bp, Homo sapiens
tgcttttctgtatttta

SEQ ID NO: 520041 - DNA, 13 bp, Homo sapiens
tggaaaggggaga

SEQ ID NO: 520042 - DNA, 12 bp, Homo sapiens
tggaagaaggga

SEQ ID NO: 520043 - DNA, 17 bp, Homo sapiens
tggaagcagtgcccagg

SEQ ID NO: 520044 - DNA, 19 bp, Homo sapiens
tggaagcagtgcccaggtg

SEQ ID NO: 520045 - DNA, 13 bp, Homo sapiens
tggaccccagcct

SEQ ID NO: 520046 - DNA, 15 bp, Homo sapiens
tggaccccagcctca

SEQ ID NO: 520047 - DNA, 20 bp, Homo sapiens
tggacggcaggctcactgcc

SEQ ID NO: 520048 - DNA, 22 bp, Homo sapiens
tggacggcaggctcactgccag

SEQ ID NO: 520049 - DNA, 16 bp, Homo sapiens
tggagaatcacaggct

SEQ ID NO: 520050 - DNA, 23 bp, Homo sapiens
tggagaatcacaggctgggctgg

SEQ ID NO: 520051 - DNA, 20 bp, Homo sapiens
tggagactgctcctgagccc

SEQ ID NO: 520052 - DNA, 17 bp, Homo sapiens
tggagaggagccctgcc

SEQ ID NO: 520053 - DNA, 18 bp, Homo sapiens
tggagaggagccctgcct

SEQ ID NO: 520054 - DNA, 15 bp, Homo sapiens
tggagagggaatgtg

SEQ ID NO: 520055 - DNA, 17 bp, Homo sapiens
tggagagggaatgtgaa

SEQ ID NO: 520056 - DNA, 13 bp, Homo sapiens
tggaggaggaagg

SEQ ID NO: 520057 - DNA, 16 bp, Homo sapiens
tggaggaggaaggcaa

SEQ ID NO: 520058 - DNA, 16 bp, Homo sapiens
tggaggcttcctgcgt

SEQ ID NO: 520059 - DNA, 13 bp, Homo sapiens
tggagggcctggg

SEQ ID NO: 520060 - DNA, 19 bp, Homo sapiens
tggaggggtgtggcagtgg

SEQ ID NO: 520061 - DNA, 15 bp, Homo sapiens
tggaggttgaagcca

SEQ ID NO: 520062 - DNA, 16 bp, Homo sapiens
tggatatctacattat

SEQ ID NO: 520063 - DNA, 17 bp, Homo sapiens
tggatcctgtgtggaga

SEQ ID NO: 520064 - DNA, 20 bp, Homo sapiens
tggcacccaccgtggaggag

SEQ ID NO: 520065 - DNA, 23 bp, Homo sapiens
tggcactgttgtcatttccaaat

SEQ ID NO: 520066 - DNA, 16 bp, Homo sapiens
tggcagggcacagggc

SEQ ID NO: 520067 - DNA, 21 bp, Homo sapiens
tggccaggaagtagcacaggc

SEQ ID NO: 520068 - DNA, 13 bp, Homo sapiens
tggccccacctgg

SEQ ID NO: 520069 - DNA, 12 bp, Homo sapiens
aaaaaaagtgtg

SEQ ID NO: 520070 - DNA, 20 bp, Homo sapiens
aaaaagtgggttttttagtt

SEQ ID NO: 520071 - DNA, 19 bp, Homo sapiens
aaaaagttgttttatccat

SEQ ID NO: 520072 - DNA, 11 bp, Homo sapiens
aaaaattactg

SEQ ID NO: 520073 - DNA, 11 bp, Homo sapiens
aaaaattttgt

SEQ ID NO: 520074 - DNA, 15 bp, Homo sapiens
aaaacacaagcaaaa

SEQ ID NO: 520075 - DNA, 22 bp, Homo sapiens
aaaaccaaagagggcttcctct

SEQ ID NO: 520076 - DNA, 19 bp, Homo sapiens
aaaactatgacaatttttg

SEQ ID NO: 520077 - DNA, 21 bp, Homo sapiens
aaaactatgacaatttttgct

SEQ ID NO: 520078 - DNA, 17 bp, Homo sapiens
aaaacttcactccaaag

SEQ ID NO: 520079 - DNA, 10 bp, Homo sapiens
aaaagatccc

SEQ ID NO: 520080 - DNA, 17 bp, Homo sapiens
aaaagcccaggagccca

SEQ ID NO: 520081 - DNA, 11 bp, Homo sapiens
aaaaggcccag

SEQ ID NO: 520082 - DNA, 21 bp, Homo sapiens
aaaataaaaaagatcccaaat

SEQ ID NO: 520083 - DNA, 19 bp, Homo sapiens
aaaataatcaaaccaaaga

SEQ ID NO: 520084 - DNA, 12 bp, Homo sapiens
aaaatcaattta

SEQ ID NO: 520085 - DNA, 18 bp, Homo sapiens
aaaatggcaagagatcat

SEQ ID NO: 520086 - DNA, 16 bp, Homo sapiens
aaaatgtctcagtatt

SEQ ID NO: 520087 - DNA, 19 bp, Homo sapiens
aaaatgtctcagtatttta

SEQ ID NO: 520088 - DNA, 21 bp, Homo sapiens
aaaatgtctcagtattttagg

SEQ ID NO: 520089 - DNA, 18 bp, Homo sapiens
aaaattttgcagaagcta

SEQ ID NO: 520090 - DNA, 17 bp, Homo sapiens
aaacaaaaatgactcta

SEQ ID NO: 520091 - DNA, 19 bp, Homo sapiens
aaacaattcttgtaacttt

SEQ ID NO: 520092 - DNA, 15 bp, Homo sapiens
aaacagaaattgcaa

SEQ ID NO: 520093 - DNA, 22 bp, Homo sapiens
aaacctattaagtcatcatctc

SEQ ID NO: 520094 - DNA, 18 bp, Homo sapiens
aaactccacatctgcctt

SEQ ID NO: 520095 - DNA, 20 bp, Homo sapiens
aaacttcactccaaagagaa

SEQ ID NO: 520096 - DNA, 23 bp, Homo sapiens
aaagaatttttgcccatatctgg

SEQ ID NO: 520097 - DNA, 21 bp, Homo sapiens
aaagagggagggaaatctttc

SEQ ID NO: 520098 - DNA, 15 bp, Homo sapiens
aaagagggcttcctc

SEQ ID NO: 520099 - DNA, 18 bp, Homo sapiens
aaagagttgtcctgatgt

SEQ ID NO: 520100 - DNA, 21 bp, Homo sapiens
aaagataatgcatatttttgc

SEQ ID NO: 520101 - DNA, 13 bp, Homo sapiens
aaagatcccaaat

SEQ ID NO: 520102 - DNA, 22 bp, Homo sapiens
aaagcattttaatgatattgga

SEQ ID NO: 520103 - DNA, 14 bp, Homo sapiens
aaagccaaatgtaa

SEQ ID NO: 520104 - DNA, 16 bp, Homo sapiens
aaagccaaatgtaaat

SEQ ID NO: 520105 - DNA, 15 bp, Homo sapiens
aaagcccaggagccc

SEQ ID NO: 520106 - DNA, 15 bp, Homo sapiens
aaagcctctcactaa

SEQ ID NO: 520107 - DNA, 17 bp, Homo sapiens
aaagcctgaaaattcca

SEQ ID NO: 520108 - DNA, 16 bp, Homo sapiens
aaaggggagagcctgc

SEQ ID NO: 520109 - DNA, 17 bp, Homo sapiens
aaagtataatttcagtg

SEQ ID NO: 520110 - DNA, 16 bp, Homo sapiens
aaagtgtacattttat

SEQ ID NO: 520111 - DNA, 16 bp, Homo sapiens
aaataatcaaaccaaa

SEQ ID NO: 520112 - DNA, 15 bp, Homo sapiens
aaatcaatacactag

SEQ ID NO: 520113 - DNA, 11 bp, Homo sapiens
aaatcatattt

SEQ ID NO: 520114 - DNA, 12 bp, Homo sapiens
aaatcatatttc

SEQ ID NO: 520115 - DNA, 21 bp, Homo sapiens
aaatcttgtcatgtgtataaa

SEQ ID NO: 520116 - DNA, 16 bp, Homo sapiens
aaatgctgacccatgg

SEQ ID NO: 520117 - DNA, 12 bp, Homo sapiens
aaatggcaagag

SEQ ID NO: 520118 - DNA, 13 bp, Homo sapiens
aaatggcaagaga

SEQ ID NO: 520119 - DNA, 20 bp, Homo sapiens
aaatgtgggattatgggtca

SEQ ID NO: 520120 - DNA, 22 bp, Homo sapiens
aaatgtgggattatgggtcaca

SEQ ID NO: 520121 - DNA, 13 bp, Homo sapiens
aaatgtgtatttt

SEQ ID NO: 520122 - DNA, 20 bp, Homo sapiens
aaatgtgtatttttgttgca

SEQ ID NO: 520123 - DNA, 16 bp, Homo sapiens
aaattcctagaaaagt

SEQ ID NO: 520124 - DNA, 12 bp, Homo sapiens
aaatttgcttta

SEQ ID NO: 520125 - DNA, 11 bp, Homo sapiens
aaatttgtact

SEQ ID NO: 520126 - DNA, 14 bp, Homo sapiens
aaattttaagttaa

SEQ ID NO: 520127 - DNA, 15 bp, Homo sapiens
aacaagagcctgatt

SEQ ID NO: 520128 - DNA, 12 bp, Homo sapiens
aacacaagcaaa

SEQ ID NO: 520129 - DNA, 20 bp, Homo sapiens
aacacatttaaaattttaaa

SEQ ID NO: 520130 - DNA, 15 bp, Homo sapiens
aacagccatatctga

SEQ ID NO: 520131 - DNA, 21 bp, Homo sapiens
aacattcctcatgaatgtaaa

SEQ ID NO: 520132 - DNA, 22 bp, Homo sapiens
aacattcctcatgaatgtaaat

SEQ ID NO: 520133 - DNA, 20 bp, Homo sapiens
aacattctttcctaaatata

SEQ ID NO: 520134 - DNA, 19 bp, Homo sapiens
aaccaaagagggcttcctc

SEQ ID NO: 520135 - DNA, 19 bp, Homo sapiens
aaccactcagtaaaagcaa

SEQ ID NO: 520136 - DNA, 21 bp, Homo sapiens
aaccactcagtaaaagcaaaa

SEQ ID NO: 520137 - DNA, 22 bp, Homo sapiens
aacccaaacaaaaatgactcta

SEQ ID NO: 520138 - DNA, 14 bp, Homo sapiens
aagagttgtcctga

SEQ ID NO: 520139 - DNA, 21 bp, Homo sapiens
aagatacatgttgtatttatg

SEQ ID NO: 520140 - DNA, 16 bp, Homo sapiens
aagcaagtggttgttt

SEQ ID NO: 520141 - DNA, 22 bp, Homo sapiens
aagcacaatggtttcaaagaaa

SEQ ID NO: 520142 - DNA, 19 bp, Homo sapiens
aagcagttgagattctcta

SEQ ID NO: 520143 - DNA, 12 bp, Homo sapiens
aagccaaagaaa

SEQ ID NO: 520144 - DNA, 16 bp, Homo sapiens
aagccaagggaaaggg

SEQ ID NO: 520145 - DNA, 13 bp, Homo sapiens
aagccaagtgggg

SEQ ID NO: 520146 - DNA, 14 bp, Homo sapiens
aagcctctgtcttt

SEQ ID NO: 520147 - DNA, 17 bp, Homo sapiens
aagcctctgtcttttct

SEQ ID NO: 520148 - DNA, 16 bp, Homo sapiens
aagcctgaaaattcca

SEQ ID NO: 520149 - DNA, 15 bp, Homo sapiens
aagcgccctggcccc

SEQ ID NO: 520150 - DNA, 19 bp, Homo sapiens
aagcgccctggcccccaca

SEQ ID NO: 520151 - DNA, 21 bp, Homo sapiens
aagcgccctggcccccacatg

SEQ ID NO: 520152 - DNA, 14 bp, Homo sapiens
aagctatgttttta

SEQ ID NO: 520153 - DNA, 22 bp, Homo sapiens
aagctatgtttttaaagtgtac

SEQ ID NO: 520154 - DNA, 12 bp, Homo sapiens
aaggaaaataat

SEQ ID NO: 520155 - DNA, 16 bp, Homo sapiens
aaggagtagttttcta

SEQ ID NO: 520156 - DNA, 14 bp, Homo sapiens
aaggatgtttttaa

SEQ ID NO: 520157 - DNA, 19 bp, Homo sapiens
aaggcaagagggggtggag

SEQ ID NO: 520158 - DNA, 18 bp, Homo sapiens
aaggcaggtttgggaagg

SEQ ID NO: 520159 - DNA, 21 bp, Homo sapiens
aaggccacctcttcctggccg

SEQ ID NO: 520160 - DNA, 15 bp, Homo sapiens
aagggagaagaaagg

SEQ ID NO: 520161 - DNA, 16 bp, Homo sapiens
aagggagaagaaaggt

SEQ ID NO: 520162 - DNA, 17 bp, Homo sapiens
aaggggtgcttttatag

SEQ ID NO: 520163 - DNA, 20 bp, Homo sapiens
aaggtgggaaaaaaaaaagt

SEQ ID NO: 520164 - DNA, 23 bp, Homo sapiens
aaggtgggaaaaaaaaaagtgtg

SEQ ID NO: 520165 - DNA, 17 bp, Homo sapiens
aaggtgtttaaagagtt

SEQ ID NO: 520166 - DNA, 18 bp, Homo sapiens
aagtaacagttgaagaaa

SEQ ID NO: 520167 - DNA, 21 bp, Homo sapiens
aagtaacagttgaagaaaaaa

SEQ ID NO: 520168 - DNA, 20 bp, Homo sapiens
aagtagaatctcttttctgg

SEQ ID NO: 520169 - DNA, 22 bp, Homo sapiens
aagtagagtgagttctttttca

SEQ ID NO: 520170 - DNA, 17 bp, Homo sapiens
aagtcatcatctccaaa

SEQ ID NO: 520171 - DNA, 17 bp, Homo sapiens
aagtgacggttcctaca

SEQ ID NO: 520172 - DNA, 14 bp, Homo sapiens
aagtgtacatttta

SEQ ID NO: 520173 - DNA, 13 bp, Homo sapiens
aagttatgggttt

SEQ ID NO: 520174 - DNA, 18 bp, Homo sapiens
aagttattttctacagtg

SEQ ID NO: 520175 - DNA, 19 bp, Homo sapiens
aagttccctatttgtgaat

SEQ ID NO: 520176 - DNA, 19 bp, Homo sapiens
aagtttatcagatattttc

SEQ ID NO: 520177 - DNA, 14 bp, Homo sapiens
aataaaagcccagg

SEQ ID NO: 520178 - DNA, 17 bp, Homo sapiens
aataaaagcccaggagc

SEQ ID NO: 520179 - DNA, 15 bp, Homo sapiens
aataaataccaaaga

SEQ ID NO: 520180 - DNA, 18 bp, Homo sapiens
aataaataccaaagataa

SEQ ID NO: 520181 - DNA, 20 bp, Homo sapiens
aataatcaaaccaaagagta

SEQ ID NO: 520182 - DNA, 22 bp, Homo sapiens
aataattgccatagaaagtata

SEQ ID NO: 520183 - DNA, 16 bp, Homo sapiens
aatacactagttgttt

SEQ ID NO: 520184 - DNA, 18 bp, Homo sapiens
aatataacataatcacaa

SEQ ID NO: 520185 - DNA, 13 bp, Homo sapiens
aatcaaaccaaag

SEQ ID NO: 520186 - DNA, 17 bp, Homo sapiens
aatcaaaccaaagagta

SEQ ID NO: 520187 - DNA, 14 bp, Homo sapiens
aatcaatacactag

SEQ ID NO: 520188 - DNA, 18 bp, Homo sapiens
aatcaatacactagttgt

SEQ ID NO: 520189 - DNA, 12 bp, Homo sapiens
aatcacaggctg

SEQ ID NO: 520190 - DNA, 14 bp, Homo sapiens
aatcagacatttta

SEQ ID NO: 520191 - DNA, 19 bp, Homo sapiens
aatccaggaccctgccagg

SEQ ID NO: 520192 - DNA, 23 bp, Homo sapiens
aatccaggaccctgccaggcaca

SEQ ID NO: 520193 - DNA, 14 bp, Homo sapiens
aatccccttctccc

SEQ ID NO: 520194 - DNA, 15 bp, Homo sapiens
aatccccttctcccc

SEQ ID NO: 520195 - DNA, 17 bp, Homo sapiens
aatccccttctcccctg

SEQ ID NO: 520196 - DNA, 23 bp, Homo sapiens
aatctttcaacttatttctgaaa

SEQ ID NO: 520197 - DNA, 20 bp, Homo sapiens
aatgaaacaaagaaagagat

SEQ ID NO: 520198 - DNA, 21 bp, Homo sapiens
aatgagtttcacagtgtgatt

SEQ ID NO: 520199 - DNA, 17 bp, Homo sapiens
aatgcatatttttgcac

SEQ ID NO: 520200 - DNA, 20 bp, Homo sapiens
aatgcatatttttgcacagt

SEQ ID NO: 520201 - DNA, 14 bp, Homo sapiens
aatgcattctttct

SEQ ID NO: 520202 - DNA, 23 bp, Homo sapiens
aatgctgacccatgggcaggaga

SEQ ID NO: 520203 - DNA, 22 bp, Homo sapiens
aatgggttatctcaaattttaa

SEQ ID NO: 520204 - DNA, 14 bp, Homo sapiens
aatgtaaatttgta

SEQ ID NO: 520205 - DNA, 15 bp, Homo sapiens
aatgtaaatttgtac

SEQ ID NO: 520206 - DNA, 16 bp, Homo sapiens
aatgtagacaaagtga

SEQ ID NO: 520207 - DNA, 17 bp, Homo sapiens
aatgtagacaaagtgaa

SEQ ID NO: 520208 - DNA, 17 bp, Homo sapiens
aatgtcacttcatattt

SEQ ID NO: 520209 - DNA, 18 bp, Homo sapiens
aatgtcacttcatatttt

SEQ ID NO: 520210 - DNA, 21 bp, Homo sapiens
aatgtcacttcatattttata

SEQ ID NO: 520211 - DNA, 14 bp, Homo sapiens
aatgtgggattatg

SEQ ID NO: 520212 - DNA, 22 bp, Homo sapiens
aattggagtctcaaaatcaact

SEQ ID NO: 520213 - DNA, 22 bp, Homo sapiens
aattggggattgagttgtaaag

SEQ ID NO: 520214 - DNA, 16 bp, Homo sapiens
aattgtaaacagaaat

SEQ ID NO: 520215 - DNA, 23 bp, Homo sapiens
aattgtaaacagaaattgcaata

SEQ ID NO: 520216 - DNA, 16 bp, Homo sapiens
aatttacatcatttct

SEQ ID NO: 520217 - DNA, 12 bp, Homo sapiens
aatttctcctcc

SEQ ID NO: 520218 - DNA, 14 bp, Homo sapiens
aatttctcctccct

SEQ ID NO: 520219 - DNA, 17 bp, Homo sapiens
aatttctggtgcacagg

SEQ ID NO: 520220 - DNA, 15 bp, Homo sapiens
aatttgctttacata

SEQ ID NO: 520221 - DNA, 13 bp, Homo sapiens
aattttaaagcct

SEQ ID NO: 520222 - DNA, 23 bp, Homo sapiens
aattttaaagcctgaaaattcca

SEQ ID NO: 520223 - DNA, 19 bp, Homo sapiens
ggtgcttttatagaggcta

SEQ ID NO: 520224 - DNA, 19 bp, Homo sapiens
ggtggaagaagggagaaga

SEQ ID NO: 520225 - DNA, 16 bp, Homo sapiens
ggtgggggtggaggct

SEQ ID NO: 520226 - DNA, 15 bp, Homo sapiens
ggtgtgggggccccg

SEQ ID NO: 520227 - DNA, 17 bp, Homo sapiens
ggttatctcaaatttta

SEQ ID NO: 520228 - DNA, 19 bp, Homo sapiens
ggttatctcaaattttaag

SEQ ID NO: 520229 - DNA, 14 bp, Homo sapiens
ggttcattttgcac

SEQ ID NO: 520230 - DNA, 15 bp, Homo sapiens
ggttcctctgcctgc

SEQ ID NO: 520231 - DNA, 16 bp, Homo sapiens
ggttccttctgggcat

SEQ ID NO: 520232 - DNA, 21 bp, Homo sapiens
gtaaaatcttgtcatgtgtat

SEQ ID NO: 520233 - DNA, 14 bp, Homo sapiens
gtaaactgatgttt

SEQ ID NO: 520234 - DNA, 19 bp, Homo sapiens
gtaaatcatatttccctta

SEQ ID NO: 520235 - DNA, 13 bp, Homo sapiens
gtaaatttgtact

SEQ ID NO: 520236 - DNA, 17 bp, Homo sapiens
gtaacagttgaagaaaa

SEQ ID NO: 520237 - DNA, 23 bp, Homo sapiens
gtaaggttttttttatctttaaa

SEQ ID NO: 520238 - DNA, 14 bp, Homo sapiens
gtacatatttttat

SEQ ID NO: 520239 - DNA, 18 bp, Homo sapiens
gtaccacattccatgacg

SEQ ID NO: 520240 - DNA, 14 bp, Homo sapiens
gtactatttaactg

SEQ ID NO: 520241 - DNA, 15 bp, Homo sapiens
gtactatttaactga

SEQ ID NO: 520242 - DNA, 15 bp, Homo sapiens
gtactcttatatttt

SEQ ID NO: 520243 - DNA, 14 bp, Homo sapiens
gtactgtagttcag

SEQ ID NO: 520244 - DNA, 12 bp, Homo sapiens
gtagcacaggct

SEQ ID NO: 520245 - DNA, 20 bp, Homo sapiens
gtagcacaggctgagtgcag

SEQ ID NO: 520246 - DNA, 14 bp, Homo sapiens
gtagtgcttttaaa

SEQ ID NO: 520247 - DNA, 21 bp, Homo sapiens
gtatgggctgttctgtttcct

SEQ ID NO: 520248 - DNA, 16 bp, Homo sapiens
gtattatatctctgta

SEQ ID NO: 520249 - DNA, 20 bp, Homo sapiens
gtattgctatgttcttctgt

SEQ ID NO: 520250 - DNA, 14 bp, Homo sapiens
gtatttatggaaga

SEQ ID NO: 520251 - DNA, 14 bp, Homo sapiens
gtattttgtaaact

SEQ ID NO: 520252 - DNA, 15 bp, Homo sapiens
gtcacaggaaaaagt

SEQ ID NO: 520253 - DNA, 18 bp, Homo sapiens
gtcactggaggttgaagc

SEQ ID NO: 520254 - DNA, 15 bp, Homo sapiens
gtcatcatctccaaa

SEQ ID NO: 520255 - DNA, 15 bp, Homo sapiens
gtcccagcagccagc

SEQ ID NO: 520256 - DNA, 12 bp, Homo sapiens
gtccccacccct

SEQ ID NO: 520257 - DNA, 14 bp, Homo sapiens
gtccccacccctgc

SEQ ID NO: 520258 - DNA, 13 bp, Homo sapiens
gtcctcctcacct

SEQ ID NO: 520259 - DNA, 15 bp, Homo sapiens
gtcctcctcacctca

SEQ ID NO: 520260 - DNA, 22 bp, Homo sapiens
gtctaaaacagctatttccctt

SEQ ID NO: 520261 - DNA, 17 bp, Homo sapiens
gtctagggcagagtatg

SEQ ID NO: 520262 - DNA, 13 bp, Homo sapiens
gtctcaaaatcaa

SEQ ID NO: 520263 - DNA, 15 bp, Homo sapiens
gtctcaccatttccc

SEQ ID NO: 520264 - DNA, 18 bp, Homo sapiens
gtctcaccatttccccag

SEQ ID NO: 520265 - DNA, 22 bp, Homo sapiens
gtctcaccatttccccagggca

SEQ ID NO: 520266 - DNA, 14 bp, Homo sapiens
gtctctcacagaca

SEQ ID NO: 520267 - DNA, 16 bp, Homo sapiens
gtctctcacagacagg

SEQ ID NO: 520268 - DNA, 23 bp, Homo sapiens
gtctctcacagacaggacccctg

SEQ ID NO: 520269 - DNA, 21 bp, Homo sapiens
gtctgagttgttaccccaagc

SEQ ID NO: 520270 - DNA, 13 bp, Homo sapiens
gtctggcacagcc

SEQ ID NO: 520271 - DNA, 13 bp, Homo sapiens
gtcttattttatt

SEQ ID NO: 520272 - DNA, 16 bp, Homo sapiens
gtcttcctattgtact

SEQ ID NO: 520273 - DNA, 20 bp, Homo sapiens
gtgaaatttacatcatttct

SEQ ID NO: 520274 - DNA, 22 bp, Homo sapiens
gtgaaatttacatcatttcttt

SEQ ID NO: 520275 - DNA, 15 bp, Homo sapiens
gtgacatggtgcctg

SEQ ID NO: 520276 - DNA, 20 bp, Homo sapiens
gtgacatggtgcctgagagg

SEQ ID NO: 520277 - DNA, 22 bp, Homo sapiens
gtgacatggtgcctgagaggca

SEQ ID NO: 520278 - DNA, 24 bp, Homo sapiens
gtgacggttcctacacaggacagg

SEQ ID NO: 520279 - DNA, 15 bp, Homo sapiens
gtgagtccattctcc

SEQ ID NO: 520280 - DNA, 15 bp, Homo sapiens
gtgagtttgagctgc

SEQ ID NO: 520281 - DNA, 17 bp, Homo sapiens
gtgagtttgagctgcct

SEQ ID NO: 520282 - DNA, 13 bp, Homo sapiens
gtgatttggatct

SEQ ID NO: 520283 - DNA, 19 bp, Homo sapiens
gtgcaattgtaaacagaaa

SEQ ID NO: 520284 - DNA, 13 bp, Homo sapiens
gtgcaggcccacc

SEQ ID NO: 520285 - DNA, 16 bp, Homo sapiens
gtgcaggcccaccctg

SEQ ID NO: 520286 - DNA, 19 bp, Homo sapiens
gtgcaggcccaccctgctt

SEQ ID NO: 520287 - DNA, 17 bp, Homo sapiens
gtgcctgagaggcaggc

SEQ ID NO: 520288 - DNA, 18 bp, Homo sapiens
gtgcttttatagaggcta

SEQ ID NO: 520289 - DNA, 15 bp, Homo sapiens
gtggagactgctcct

SEQ ID NO: 520290 - DNA, 18 bp, Homo sapiens
gtggagagggaatgtgaa

SEQ ID NO: 520291 - DNA, 17 bp, Homo sapiens
gtggaggaggaaggcaa

SEQ ID NO: 520292 - DNA, 19 bp, Homo sapiens
gtggaggaggaaggcaaga

SEQ ID NO: 520293 - DNA, 15 bp, Homo sapiens
gtggaggggtgtggc

SEQ ID NO: 520294 - DNA, 23 bp, Homo sapiens
gtggaggggtgtggcagtggttt

SEQ ID NO: 520295 - DNA, 15 bp, Homo sapiens
gtggcagggcacagg

SEQ ID NO: 520296 - DNA, 22 bp, Homo sapiens
gtggccccacctggccctctct

SEQ ID NO: 520297 - DNA, 22 bp, Homo sapiens
gtgggattatgggtcacaggaa

SEQ ID NO: 520298 - DNA, 18 bp, Homo sapiens
gtgggctctgtgcagtca

SEQ ID NO: 520299 - DNA, 20 bp, Homo sapiens
gtggttttatactgaaggaa

SEQ ID NO: 520300 - DNA, 18 bp, Homo sapiens
gtgtaattttaaagtcag

SEQ ID NO: 520301 - DNA, 21 bp, Homo sapiens
gtgtacattttataaagttta

SEQ ID NO: 520302 - DNA, 23 bp, Homo sapiens
gtgtagtgcttttaaaaattttg

SEQ ID NO: 520303 - DNA, 18 bp, Homo sapiens
gtgtataaaaataaaaaa

SEQ ID NO: 520304 - DNA, 15 bp, Homo sapiens
gtgtgcaattgtaaa

SEQ ID NO: 520305 - DNA, 14 bp, Homo sapiens
gtgtggcagtggtt

SEQ ID NO: 520306 - DNA, 14 bp, Homo sapiens
tcctctgcctgccc

SEQ ID NO: 520307 - DNA, 17 bp, Homo sapiens
tcctctggacggcaggc

SEQ ID NO: 520308 - DNA, 20 bp, Homo sapiens
tcctctggacggcaggctca

SEQ ID NO: 520309 - DNA, 11 bp, Homo sapiens
tcctgagcccc

SEQ ID NO: 520310 - DNA, 17 bp, Homo sapiens
tcctgagcccccagctt

SEQ ID NO: 520311 - DNA, 20 bp, Homo sapiens
tcctgaggggagacagagca

SEQ ID NO: 520312 - DNA, 23 bp, Homo sapiens
tcctgaggggagacagagcaacc

SEQ ID NO: 520313 - DNA, 16 bp, Homo sapiens
tcctgatgtttttctg

SEQ ID NO: 520314 - DNA, 19 bp, Homo sapiens
tcctgatgtttttctgtgt

SEQ ID NO: 520315 - DNA, 13 bp, Homo sapiens
tcctgcgtcctcc

SEQ ID NO: 520316 - DNA, 19 bp, Homo sapiens
tcctggggcatccatgggg

SEQ ID NO: 520317 - DNA, 16 bp, Homo sapiens
tcctgtgtggagaggg

SEQ ID NO: 520318 - DNA, 18 bp, Homo sapiens
tcctgtgtggagagggaa

SEQ ID NO: 520319 - DNA, 18 bp, Homo sapiens
tcctttcactcctttcct

SEQ ID NO: 520320 - DNA, 13 bp, Homo sapiens
tccttttccctgc

SEQ ID NO: 520321 - DNA, 14 bp, Homo sapiens
tcgcccagtcccag

SEQ ID NO: 520322 - DNA, 19 bp, Homo sapiens
tcgcccagtcccagcagcc

SEQ ID NO: 520323 - DNA, 22 bp, Homo sapiens
tcggatttattcccttttaaag

SEQ ID NO: 520324 - DNA, 21 bp, Homo sapiens
tcgtgatagttattattttcc

SEQ ID NO: 520325 - DNA, 22 bp, Homo sapiens
tctaaatagcccagatcccaag

SEQ ID NO: 520326 - DNA, 13 bp, Homo sapiens
tctacagtggttt

SEQ ID NO: 520327 - DNA, 21 bp, Homo sapiens
tctacagtggttttatactga

SEQ ID NO: 520328 - DNA, 23 bp, Homo sapiens
tctacagtggttttatactgaag

SEQ ID NO: 520329 - DNA, 18 bp, Homo sapiens
tctacattataccgcaga

SEQ ID NO: 520330 - DNA, 20 bp, Homo sapiens
tctagaagccaagggaaagg

SEQ ID NO: 520331 - DNA, 23 bp, Homo sapiens
tctagaagccaagggaaaggggt

SEQ ID NO: 520332 - DNA, 18 bp, Homo sapiens
tctagggcagagtatgtt

SEQ ID NO: 520333 - DNA, 14 bp, Homo sapiens
tctatcctttcctg

SEQ ID NO: 520334 - DNA, 15 bp, Homo sapiens
tctattctttccatg

SEQ ID NO: 520335 - DNA, 22 bp, Homo sapiens
tctcaatcctaatttctcctcc

SEQ ID NO: 520336 - DNA, 14 bp, Homo sapiens
tctcacagacagga

SEQ ID NO: 520337 - DNA, 20 bp, Homo sapiens
tctcacagacaggacccctg

SEQ ID NO: 520338 - DNA, 12 bp, Homo sapiens
tctcccctgcac

SEQ ID NO: 520339 - DNA, 21 bp, Homo sapiens
tctcccctgcactgtaaaatg

SEQ ID NO: 520340 - DNA, 13 bp, Homo sapiens
tctccgccagcct

SEQ ID NO: 520341 - DNA, 15 bp, Homo sapiens
tctccgccagcctcc

SEQ ID NO: 520342 - DNA, 11 bp, Homo sapiens
aattttaaagt

SEQ ID NO: 520343 - DNA, 19 bp, Homo sapiens
aattttaaagtcagtgttg

SEQ ID NO: 520344 - DNA, 13 bp, Homo sapiens
aattttgcagaag

SEQ ID NO: 520345 - DNA, 23 bp, Homo sapiens
aatttttgaaaagctgctaacta

SEQ ID NO: 520346 - DNA, 15 bp, Homo sapiens
aattttttttaacat

SEQ ID NO: 520347 - DNA, 18 bp, Homo sapiens
aattttttttaacattcc

SEQ ID NO: 520348 - DNA, 14 bp, Homo sapiens
acaaaatgtagaca

SEQ ID NO: 520349 - DNA, 21 bp, Homo sapiens
acaaatgtgtatttttgttgc

SEQ ID NO: 520350 - DNA, 23 bp, Homo sapiens
acaagctttaaatggcaattttt

SEQ ID NO: 520351 - DNA, 14 bp, Homo sapiens
acaatggtttcaaa

SEQ ID NO: 520352 - DNA, 14 bp, Homo sapiens
acaatttttgctgt

SEQ ID NO: 520353 - DNA, 16 bp, Homo sapiens
acaatttttgctgttt

SEQ ID NO: 520354 - DNA, 15 bp, Homo sapiens
acacattaataaaca

SEQ ID NO: 520355 - DNA, 17 bp, Homo sapiens
acacattgttttccaga

SEQ ID NO: 520356 - DNA, 19 bp, Homo sapiens
acacctggctgaggttcct

SEQ ID NO: 520357 - DNA, 17 bp, Homo sapiens
acagaaggggactgcca

SEQ ID NO: 520358 - DNA, 23 bp, Homo sapiens
acagaaggggactgccacctccc

SEQ ID NO: 520359 - DNA, 16 bp, Homo sapiens
acagcttgagccgggc

SEQ ID NO: 520360 - DNA, 21 bp, Homo sapiens
acaggcagggcaggaccagcc

SEQ ID NO: 520361 - DNA, 19 bp, Homo sapiens
acagggcctggcccatgta

SEQ ID NO: 520362 - DNA, 18 bp, Homo sapiens
acaggtttgttttttcaa

SEQ ID NO: 520363 - DNA, 19 bp, Homo sapiens
acaggtttgttttttcaag

SEQ ID NO: 520364 - DNA, 12 bp, Homo sapiens
acagtctcacca

SEQ ID NO: 520365 - DNA, 19 bp, Homo sapiens
gcctgcacttgggggctca

SEQ ID NO: 520366 - DNA, 22 bp, Homo sapiens
gcctgcacttgggggctcagca

SEQ ID NO: 520367 - DNA, 20 bp, Homo sapiens
gcctgccccgcccccagtcc

SEQ ID NO: 520368 - DNA, 22 bp, Homo sapiens
gcctgctggcacccaccgtgga

SEQ ID NO: 520369 - DNA, 22 bp, Homo sapiens
gcctgctgtgattccactacac

SEQ ID NO: 520370 - DNA, 12 bp, Homo sapiens
gcctggcccatg

SEQ ID NO: 520371 - DNA, 16 bp, Homo sapiens
gcctggctccctcact

SEQ ID NO: 520372 - DNA, 21 bp, Homo sapiens
gcctggctccctcactctcag

SEQ ID NO: 520373 - DNA, 15 bp, Homo sapiens
gcctgggcctggctc

SEQ ID NO: 520374 - DNA, 17 bp, Homo sapiens
gccttaaaaccaaagag

SEQ ID NO: 520375 - DNA, 16 bp, Homo sapiens
gccttaatttttgaaa

SEQ ID NO: 520376 - DNA, 23 bp, Homo sapiens
gccttccctagctttagaccctg

SEQ ID NO: 520377 - DNA, 12 bp, Homo sapiens
gcgccctggccc

SEQ ID NO: 520378 - DNA, 14 bp, Homo sapiens
gcgccctggccccc

SEQ ID NO: 520379 - DNA, 15 bp, Homo sapiens
gcgccctggccccca

SEQ ID NO: 520380 - DNA, 15 bp, Homo sapiens
gcgctgtgagatgga

SEQ ID NO: 520381 - DNA, 13 bp, Homo sapiens
gcgtggggctccc

SEQ ID NO: 520382 - DNA, 18 bp, Homo sapiens
gctaaagagcccttgcct

SEQ ID NO: 520383 - DNA, 16 bp, Homo sapiens
gctaactacatgaaca

SEQ ID NO: 520384 - DNA, 15 bp, Homo sapiens
gctagcttctgcttt

SEQ ID NO: 520385 - DNA, 23 bp, Homo sapiens
gctagcttctgcttttctgccct

SEQ ID NO: 520386 - DNA, 16 bp, Homo sapiens
gctatttcccttttct

SEQ ID NO: 520387 - DNA, 19 bp, Homo sapiens
gctatttcccttttctgtg

SEQ ID NO: 520388 - DNA, 20 bp, Homo sapiens
gctcactgccaggccagcct

SEQ ID NO: 520389 - DNA, 15 bp, Homo sapiens
gctccctcactctca

SEQ ID NO: 520390 - DNA, 16 bp, Homo sapiens
gctcctgagcccccag

SEQ ID NO: 520391 - DNA, 19 bp, Homo sapiens
gctctcaccttggttcctg

SEQ ID NO: 520392 - DNA, 21 bp, Homo sapiens
gctcttctgatcagtctgtct

SEQ ID NO: 520393 - DNA, 20 bp, Homo sapiens
gctgacccatgggcaggaga

SEQ ID NO: 520394 - DNA, 16 bp, Homo sapiens
gctgaggttcctctgc

SEQ ID NO: 520395 - DNA, 18 bp, Homo sapiens
gctgaggttcctctgcct

SEQ ID NO: 520396 - DNA, 14 bp, Homo sapiens
gctgagtgcaggcc

SEQ ID NO: 520397 - DNA, 15 bp, Homo sapiens
gctgagtgcaggccc

SEQ ID NO: 520398 - DNA, 21 bp, Homo sapiens
gctgagtgcaggcccaccctg

SEQ ID NO: 520399 - DNA, 22 bp, Homo sapiens
gctgagtgcaggcccaccctgc

SEQ ID NO: 520400 - DNA, 15 bp, Homo sapiens
gctgccttgaaatca

SEQ ID NO: 520401 - DNA, 17 bp, Homo sapiens
gctgcgcttgcttttct

SEQ ID NO: 520402 - DNA, 14 bp, Homo sapiens
gctgctgagccgca

SEQ ID NO: 520403 - DNA, 18 bp, Homo sapiens
gctgctgagccgcagaga

SEQ ID NO: 520404 - DNA, 18 bp, Homo sapiens
gctgggaggagggagagg

SEQ ID NO: 520405 - DNA, 22 bp, Homo sapiens
gctgggaggagggagagggagg

SEQ ID NO: 520406 - DNA, 15 bp, Homo sapiens
gctgggcactgctct

SEQ ID NO: 520407 - DNA, 20 bp, Homo sapiens
gctgggcactgctctcacct

SEQ ID NO: 520408 - DNA, 15 bp, Homo sapiens
gctgtctggcacagc

SEQ ID NO: 520409 - DNA, 22 bp, Homo sapiens
gctgtgagatggatgtatttgt

SEQ ID NO: 520410 - DNA, 24 bp, Homo sapiens
gctgttctgtttcctgtgtctcca

SEQ ID NO: 520411 - DNA, 12 bp, Homo sapiens
gcttccagcagg

SEQ ID NO: 520412 - DNA, 13 bp, Homo sapiens
gcttccagcagga

SEQ ID NO: 520413 - DNA, 17 bp, Homo sapiens
gcttccagcaggaggga

SEQ ID NO: 520414 - DNA, 15 bp, Homo sapiens
gcttcctctagaagc

SEQ ID NO: 520415 - DNA, 23 bp, Homo sapiens
gcttcctctagaagccaagggaa

SEQ ID NO: 520416 - DNA, 14 bp, Homo sapiens
gcttctccgccagc

SEQ ID NO: 520417 - DNA, 18 bp, Homo sapiens
gcttctccgccagcctcc

SEQ ID NO: 520418 - DNA, 21 bp, Homo sapiens
gcttctccgccagcctcctct

SEQ ID NO: 520419 - DNA, 13 bp, Homo sapiens
gcttctgcttttc

SEQ ID NO: 520420 - DNA, 23 bp, Homo sapiens
gcttctgcttttctgccctggct

SEQ ID NO: 520421 - DNA, 12 bp, Homo sapiens
gcttgaagccaa

SEQ ID NO: 520422 - DNA, 15 bp, Homo sapiens
gcttgaagccaaaga

SEQ ID NO: 520423 - DNA, 17 bp, Homo sapiens
gcttgagccgggcccct

SEQ ID NO: 520424 - DNA, 16 bp, Homo sapiens
gcttgctgaacatgga

SEQ ID NO: 520425 - DNA, 13 bp, Homo sapiens
gcttgttctagaa

SEQ ID NO: 520426 - DNA, 15 bp, Homo sapiens
gctttagaccctggg

SEQ ID NO: 520427 - DNA, 16 bp, Homo sapiens
gctttagaccctgggt

SEQ ID NO: 520428 - DNA, 21 bp, Homo sapiens
gcttttaaaaattttgtcctt

SEQ ID NO: 520429 - DNA, 19 bp, Homo sapiens
gcttttatagaggctagct

SEQ ID NO: 520430 - DNA, 14 bp, Homo sapiens
gcttttctgtattt

SEQ ID NO: 520431 - DNA, 13 bp, Homo sapiens
ggaaaaacacaag

SEQ ID NO: 520432 - DNA, 21 bp, Homo sapiens
ggaaaataatcaaaccaaaga

SEQ ID NO: 520433 - DNA, 21 bp, Homo sapiens
ggaaactccacatctgcctta

SEQ ID NO: 520434 - DNA, 20 bp, Homo sapiens
ggaaactgaggtgttatttt

SEQ ID NO: 520435 - DNA, 17 bp, Homo sapiens
ggaaacttgcctttttt

SEQ ID NO: 520436 - DNA, 12 bp, Homo sapiens
ggaaaggggaga

SEQ ID NO: 520437 - DNA, 14 bp, Homo sapiens
ggaaaggggagagc

SEQ ID NO: 520438 - DNA, 20 bp, Homo sapiens
ggaaatctttcaacttattt

SEQ ID NO: 520439 - DNA, 19 bp, Homo sapiens
ggaacaaggatgtttttaa

SEQ ID NO: 520440 - DNA, 13 bp, Homo sapiens
ggaactctttttt

SEQ ID NO: 520441 - DNA, 16 bp, Homo sapiens
ggaagcagtgcccagg

SEQ ID NO: 520442 - DNA, 17 bp, Homo sapiens
ggaaggacacattgttt

SEQ ID NO: 520443 - DNA, 17 bp, Homo sapiens
ggaagggcactatattt

SEQ ID NO: 520444 - DNA, 21 bp, Homo sapiens
ggaatgaggtgggaggtggaa

SEQ ID NO: 520445 - DNA, 19 bp, Homo sapiens
ggacagcttgagccgggcc

SEQ ID NO: 520446 - DNA, 11 bp, Homo sapiens
ggacccagtgg

SEQ ID NO: 520447 - DNA, 18 bp, Homo sapiens
ggacccagtggcagggca

SEQ ID NO: 520448 - DNA, 21 bp, Homo sapiens
ggacccagtggcagggcacag

SEQ ID NO: 520449 - DNA, 12 bp, Homo sapiens
ggaccccagcct

SEQ ID NO: 520450 - DNA, 13 bp, Homo sapiens
ggaccccagcctc

SEQ ID NO: 520451 - DNA, 20 bp, Homo sapiens
ggaccctgccaggcacaggc

SEQ ID NO: 520452 - DNA, 22 bp, Homo sapiens
tgggaggtggaagaagggagaa

SEQ ID NO: 520453 - DNA, 14 bp, Homo sapiens
tgggcaggagactg

SEQ ID NO: 520454 - DNA, 13 bp, Homo sapiens
tgggcctgagtga

SEQ ID NO: 520455 - DNA, 19 bp, Homo sapiens
tgggcctggctccctcact

SEQ ID NO: 520456 - DNA, 21 bp, Homo sapiens
tgggcctggctccctcactct

SEQ ID NO: 520457 - DNA, 12 bp, Homo sapiens
tgggctctgtgc

SEQ ID NO: 520458 - DNA, 17 bp, Homo sapiens
tgggctctgtgcagtca

SEQ ID NO: 520459 - DNA, 18 bp, Homo sapiens
tgggctgccttgaaatca

SEQ ID NO: 520460 - DNA, 15 bp, Homo sapiens
tgggcttggcctgct

SEQ ID NO: 520461 - DNA, 18 bp, Homo sapiens
tgggcttggcctgctgtg

SEQ ID NO: 520462 - DNA, 22 bp, Homo sapiens
tggggattgagttgtaaagaaa

SEQ ID NO: 520463 - DNA, 16 bp, Homo sapiens
tgggggatgggcctga

SEQ ID NO: 520464 - DNA, 18 bp, Homo sapiens
tgggggccccgtctcagg

SEQ ID NO: 520465 - DNA, 20 bp, Homo sapiens
tggggggaacgcccacttcc

SEQ ID NO: 520466 - DNA, 21 bp, Homo sapiens
tggggggaacgcccacttccc

SEQ ID NO: 520467 - DNA, 18 bp, Homo sapiens
tgggggtggaggcttcct

SEQ ID NO: 520468 - DNA, 21 bp, Homo sapiens
tggggtctctcacagacagga

SEQ ID NO: 520469 - DNA, 13 bp, Homo sapiens
tgggtcacaggaa

SEQ ID NO: 520470 - DNA, 15 bp, Homo sapiens
tgggtgggctctgtg

SEQ ID NO: 520471 - DNA, 20 bp, Homo sapiens
tgggttagactgccagctct

SEQ ID NO: 520472 - DNA, 22 bp, Homo sapiens
tggtcaagatgggtcaagcaag

SEQ ID NO: 520473 - DNA, 22 bp, Homo sapiens
tggtctaaaacagctatttccc

SEQ ID NO: 520474 - DNA, 23 bp, Homo sapiens
tggtgcacaggtttgttttttca

SEQ ID NO: 520475 - DNA, 20 bp, Homo sapiens
tggttcttgacagtgagagg

SEQ ID NO: 520476 - DNA, 21 bp, Homo sapiens
tggttgggacccagtggcagg

SEQ ID NO: 520477 - DNA, 11 bp, Homo sapiens
tggtttcaaag

SEQ ID NO: 520478 - DNA, 16 bp, Homo sapiens
tggttttatactgaag

SEQ ID NO: 520479 - DNA, 19 bp, Homo sapiens
tgtaaaatcttgtcatgtg

SEQ ID NO: 520480 - DNA, 20 bp, Homo sapiens
tgtaaaatcttgtcatgtgt

SEQ ID NO: 520481 - DNA, 15 bp, Homo sapiens
tgtaaagaaaactta

SEQ ID NO: 520482 - DNA, 13 bp, Homo sapiens
tgtaaatttgtac

SEQ ID NO: 520483 - DNA, 14 bp, Homo sapiens
tgtaaatttgtact

SEQ ID NO: 520484 - DNA, 19 bp, Homo sapiens
tgtaacttttttattttaa

SEQ ID NO: 520485 - DNA, 14 bp, Homo sapiens
tgtaattttaaagt

SEQ ID NO: 520486 - DNA, 13 bp, Homo sapiens
tgtacattttata

SEQ ID NO: 520487 - DNA, 20 bp, Homo sapiens
tgtactcttatatttttctg

SEQ ID NO: 520488 - DNA, 18 bp, Homo sapiens
tgtagttcagatagagat

SEQ ID NO: 520489 - DNA, 22 bp, Homo sapiens
tgtatttttttttctaagagaa

SEQ ID NO: 520490 - DNA, 14 bp, Homo sapiens
tgtcaagagccaag

SEQ ID NO: 520491 - DNA, 13 bp, Homo sapiens
tgtcatgtgtata

SEQ ID NO: 520492 - DNA, 19 bp, Homo sapiens
tgtcccgtaaatcatattt

SEQ ID NO: 520493 - DNA, 13 bp, Homo sapiens
tgtgacatgctaa

SEQ ID NO: 520494 - DNA, 21 bp, Homo sapiens
ggctgaggttcctctgcctgc

SEQ ID NO: 520495 - DNA, 16 bp, Homo sapiens
ggctgagtgcaggccc

SEQ ID NO: 520496 - DNA, 18 bp, Homo sapiens
ggctgagtgcaggcccac

SEQ ID NO: 520497 - DNA, 21 bp, Homo sapiens
ggctgagtgcaggcccaccct

SEQ ID NO: 520498 - DNA, 22 bp, Homo sapiens
ggctgagtgcaggcccaccctg

SEQ ID NO: 520499 - DNA, 15 bp, Homo sapiens
gtgcctgagaggcag

SEQ ID NO: 520500 - DNA, 18 bp, Homo sapiens
gtgcctgagaggcaggca

SEQ ID NO: 520501 - DNA, 17 bp, Homo sapiens
gtgctgggaggagggag

SEQ ID NO: 520502 - DNA, 19 bp, Homo sapiens
gtggagaatcacaggctgg

SEQ ID NO: 520503 - DNA, 20 bp, Homo sapiens
gtggagaatcacaggctggg

SEQ ID NO: 520504 - DNA, 14 bp, Homo sapiens
gtggagagggaatg

SEQ ID NO: 520505 - DNA, 14 bp, Homo sapiens
gtggaggcttcctg

SEQ ID NO: 520506 - DNA, 15 bp, Homo sapiens
gtggaggcttcctgc

SEQ ID NO: 520507 - DNA, 16 bp, Homo sapiens
gtggaggggtgtggca

SEQ ID NO: 520508 - DNA, 14 bp, Homo sapiens
gtggcagggcacag

SEQ ID NO: 520509 - DNA, 20 bp, Homo sapiens
gtggcagggcacagggcctg

SEQ ID NO: 520510 - DNA, 21 bp, Homo sapiens
gtggcagtggttttggcaaac

SEQ ID NO: 520511 - DNA, 13 bp, Homo sapiens
gtggccccacctg

SEQ ID NO: 520512 - DNA, 15 bp, Homo sapiens
gtgggggtggaggct

SEQ ID NO: 520513 - DNA, 21 bp, Homo sapiens
gtggtcttgccttctgatttt

SEQ ID NO: 520514 - DNA, 20 bp, Homo sapiens
gtgtctagggcagagtatgt

SEQ ID NO: 520515 - DNA, 20 bp, Homo sapiens
gtgtggagagggaatgtgaa

SEQ ID NO: 520516 - DNA, 21 bp, Homo sapiens
gtgtggagagggaatgtgaaa

SEQ ID NO: 520517 - DNA, 12 bp, Homo sapiens
gtgtggcagtgg

SEQ ID NO: 520518 - DNA, 14 bp, Homo sapiens
gtgtgggggccccg

SEQ ID NO: 520519 - DNA, 19 bp, Homo sapiens
gtgtgggggccccgtctca

SEQ ID NO: 520520 - DNA, 17 bp, Homo sapiens
gttaatgcattctttct

SEQ ID NO: 520521 - DNA, 21 bp, Homo sapiens
gttaatgcattctttcttctc

SEQ ID NO: 520522 - DNA, 22 bp, Homo sapiens
gttacataagggcattatgtaa

SEQ ID NO: 520523 - DNA, 17 bp, Homo sapiens
gttagactgccagctct

SEQ ID NO: 520524 - DNA, 15 bp, Homo sapiens
gttatgggtttttat

SEQ ID NO: 520525 - DNA, 22 bp, Homo sapiens
gttattagcgttttaacagtta

SEQ ID NO: 520526 - DNA, 20 bp, Homo sapiens
gttattttctacagtggttt

SEQ ID NO: 520527 - DNA, 16 bp, Homo sapiens
gttccaaatttgcttt

SEQ ID NO: 520528 - DNA, 17 bp, Homo sapiens
gttccaaatttgcttta

SEQ ID NO: 520529 - DNA, 12 bp, Homo sapiens
gttcccctggaa

SEQ ID NO: 520530 - DNA, 12 bp, Homo sapiens
gttcctctgcct

SEQ ID NO: 520531 - DNA, 15 bp, Homo sapiens
gttccttctgggcat

SEQ ID NO: 520532 - DNA, 19 bp, Homo sapiens
gttgaagaaaaaatggcaa

SEQ ID NO: 520533 - DNA, 21 bp, Homo sapiens
gttgaattttttttaacattc

SEQ ID NO: 520534 - DNA, 19 bp, Homo sapiens
gttgacatcactggcatgg

SEQ ID NO: 520535 - DNA, 22 bp, Homo sapiens
gttgggacccagtggcagggca

SEQ ID NO: 520536 - DNA, 16 bp, Homo sapiens
gttgtcatttccaaat

SEQ ID NO: 520537 - DNA, 22 bp, Homo sapiens
gtttatttgatgagttctgtcc

SEQ ID NO: 520538 - DNA, 19 bp, Homo sapiens
gtttcctgtgtctccaagc

SEQ ID NO: 520539 - DNA, 21 bp, Homo sapiens
gtttgggaaggtgtttaaaga

SEQ ID NO: 520540 - DNA, 12 bp, Homo sapiens
gtttgttttact

SEQ ID NO: 520541 - DNA, 20 bp, Homo sapiens
gttttgcaaaggaaaataat

SEQ ID NO: 520542 - DNA, 16 bp, Homo sapiens
gtttttaatggcataa

SEQ ID NO: 520543 - DNA, 14 bp, Homo sapiens
gtttttctgtgtta

SEQ ID NO: 520544 - DNA, 23 bp, Homo sapiens
gttttttcaagaaaattttgcag

SEQ ID NO: 520545 - DNA, 19 bp, Homo sapiens
taaaaataaaaaagatccc

SEQ ID NO: 520546 - DNA, 18 bp, Homo sapiens
taaaaatataacataatc

SEQ ID NO: 520547 - DNA, 22 bp, Homo sapiens
taaaaattttgtcctttcatgt

SEQ ID NO: 520548 - DNA, 11 bp, Homo sapiens
taaaaccaaag

SEQ ID NO: 520549 - DNA, 16 bp, Homo sapiens
taaaagcccaggagcc

SEQ ID NO: 520550 - DNA, 18 bp, Homo sapiens
taaaagcccaggagccca

SEQ ID NO: 520551 - DNA, 19 bp, Homo sapiens
taaaagcccaggagcccat

SEQ ID NO: 520552 - DNA, 12 bp, Homo sapiens
taaaaggcccag

SEQ ID NO: 520553 - DNA, 17 bp, Homo sapiens
taaaataaataccaaag

SEQ ID NO: 520554 - DNA, 12 bp, Homo sapiens
taaaatcttgtc

SEQ ID NO: 520555 - DNA, 16 bp, Homo sapiens
taaaatcttgtcatgt

SEQ ID NO: 520556 - DNA, 18 bp, Homo sapiens
taaaatcttgtcatgtgt

SEQ ID NO: 520557 - DNA, 19 bp, Homo sapiens
taaaatcttgtcatgtgta

SEQ ID NO: 520558 - DNA, 23 bp, Homo sapiens
taaaatcttgtcatgtgtataaa

SEQ ID NO: 520559 - DNA, 19 bp, Homo sapiens
taaagagcccttgcctccc

SEQ ID NO: 520560 - DNA, 14 bp, Homo sapiens
taaagccaaatgta

SEQ ID NO: 520561 - DNA, 13 bp, Homo sapiens
taaagcctgaaaa

SEQ ID NO: 520562 - DNA, 14 bp, Homo sapiens
taaagcctgaaaat

SEQ ID NO: 520563 - DNA, 15 bp, Homo sapiens
taaataccaaagata

SEQ ID NO: 520564 - DNA, 22 bp, Homo sapiens
taaatttgtactatttaactga

SEQ ID NO: 520565 - DNA, 19 bp, Homo sapiens
taacagttgaagaaaaaat

SEQ ID NO: 520566 - DNA, 23 bp, Homo sapiens
taacagttgaagaaaaaatggca

SEQ ID NO: 520567 - DNA, 10 bp, Homo sapiens
taacattcct

SEQ ID NO: 520568 - DNA, 13 bp, Homo sapiens
taaccatgtctcc

SEQ ID NO: 520569 - DNA, 20 bp, Homo sapiens
taactacatgaacacaaatg

SEQ ID NO: 520570 - DNA, 13 bp, Homo sapiens
taactgccaaaac

SEQ ID NO: 520571 - DNA, 13 bp, Homo sapiens
taacttaatggca

SEQ ID NO: 520572 - DNA, 14 bp, Homo sapiens
taacttaatggcac

SEQ ID NO: 520573 - DNA, 14 bp, Homo sapiens
taacttcatttttc

SEQ ID NO: 520574 - DNA, 20 bp, Homo sapiens
taacttcatttttctaataa

SEQ ID NO: 520575 - DNA, 15 bp, Homo sapiens
taatcaaaccaaaga

SEQ ID NO: 520576 - DNA, 15 bp, Homo sapiens
taatccccttctccc

SEQ ID NO: 520577 - DNA, 18 bp, Homo sapiens
taatgcatatttttgcac

SEQ ID NO: 520578 - DNA, 15 bp, Homo sapiens
taattaatgtacaca

SEQ ID NO: 520579 - DNA, 13 bp, Homo sapiens
taatttctcctcc

SEQ ID NO: 520580 - DNA, 14 bp, Homo sapiens
taatttctcctccc

SEQ ID NO: 520581 - DNA, 17 bp, Homo sapiens
taatttgtggtgatttg

SEQ ID NO: 520582 - DNA, 13 bp, Homo sapiens
taattttaaagtc

SEQ ID NO: 520583 - DNA, 15 bp, Homo sapiens
taatttttgaaaagc

SEQ ID NO: 520584 - DNA, 20 bp, Homo sapiens
tacaatgggaaaacttcact

SEQ ID NO: 520585 - DNA, 21 bp, Homo sapiens
tacacaggacaggggttcctt

SEQ ID NO: 520586 - DNA, 12 bp, Homo sapiens
tacacctggctg

SEQ ID NO: 520587 - DNA, 14 bp, Homo sapiens
tacacctggctgag

SEQ ID NO: 520588 - DNA, 12 bp, Homo sapiens
tacacttaaaag

SEQ ID NO: 520589 - DNA, 11 bp, Homo sapiens
tacagtggttt

SEQ ID NO: 520590 - DNA, 13 bp, Homo sapiens
tacatcatttctt

SEQ ID NO: 520591 - DNA, 20 bp, Homo sapiens
tacatcatttctttttggga

SEQ ID NO: 520592 - DNA, 21 bp, Homo sapiens
taccaaagataatgcatattt

SEQ ID NO: 520593 - DNA, 14 bp, Homo sapiens
taccacattccatg

SEQ ID NO: 520594 - DNA, 22 bp, Homo sapiens
taccagctgcgcttgcttttct

SEQ ID NO: 520595 - DNA, 19 bp, Homo sapiens
tactatttaactgactatt

SEQ ID NO: 520596 - DNA, 13 bp, Homo sapiens
tactgaaggaaaa

SEQ ID NO: 520597 - DNA, 14 bp, Homo sapiens
tactgaaggaaaaa

SEQ ID NO: 520598 - DNA, 19 bp, Homo sapiens
tactgaaggaaaaacacaa

SEQ ID NO: 520599 - DNA, 20 bp, Homo sapiens
tactgaaggaaaaacacaag

SEQ ID NO: 520600 - DNA, 23 bp, Homo sapiens
tactgaaggaaaaacacaagcaa

SEQ ID NO: 520601 - DNA, 20 bp, Homo sapiens
tactgacttttctttttaat

SEQ ID NO: 520602 - DNA, 19 bp, Homo sapiens
tggagaatcacaggctggg

SEQ ID NO: 520603 - DNA, 20 bp, Homo sapiens
tggagaatcacaggctgggc

SEQ ID NO: 520604 - DNA, 16 bp, Homo sapiens
tggagagggaatgtga

SEQ ID NO: 520605 - DNA, 18 bp, Homo sapiens
tggagagggaatgtgaaa

SEQ ID NO: 520606 - DNA, 19 bp, Homo sapiens
tggagagggaatgtgaaat

SEQ ID NO: 520607 - DNA, 15 bp, Homo sapiens
tggaggaggaaggca

SEQ ID NO: 520608 - DNA, 13 bp, Homo sapiens
tggaggcttcctg

SEQ ID NO: 520609 - DNA, 20 bp, Homo sapiens
tggaggcttcctgcgtcctc

SEQ ID NO: 520610 - DNA, 15 bp, Homo sapiens
tggagggcctgggcc

SEQ ID NO: 520611 - DNA, 17 bp, Homo sapiens
tggagggcctgggcctg

SEQ ID NO: 520612 - DNA, 14 bp, Homo sapiens
tggaggggtgtggc

SEQ ID NO: 520613 - DNA, 17 bp, Homo sapiens
tggaggggtgtggcagt

SEQ ID NO: 520614 - DNA, 17 bp, Homo sapiens
tggaggttgaagccaag

SEQ ID NO: 520615 - DNA, 18 bp, Homo sapiens
tggaggttgaagccaagt

SEQ ID NO: 520616 - DNA, 22 bp, Homo sapiens
tggaggttgaagccaagtgggg

SEQ ID NO: 520617 - DNA, 16 bp, Homo sapiens
tggatcctgtgtggag

SEQ ID NO: 520618 - DNA, 24 bp, Homo sapiens
tggcaaacgctaaagagcccttgc

SEQ ID NO: 520619 - DNA, 17 bp, Homo sapiens
tggcacagcctgcactt

SEQ ID NO: 520620 - DNA, 14 bp, Homo sapiens
tggcagggcacagg

SEQ ID NO: 520621 - DNA, 17 bp, Homo sapiens
tggcagggcacagggcc

SEQ ID NO: 520622 - DNA, 21 bp, Homo sapiens
tggcagggcacagggcctggc

SEQ ID NO: 520623 - DNA, 12 bp, Homo sapiens
tggcagtggttt

SEQ ID NO: 520624 - DNA, 22 bp, Homo sapiens
tggccaggaagtagcacaggct

SEQ ID NO: 520625 - DNA, 19 bp, Homo sapiens
tggcccagggggcttcctg

SEQ ID NO: 520626 - DNA, 21 bp, Homo sapiens
tggcccatgtatggccaggaa

SEQ ID NO: 520627 - DNA, 15 bp, Homo sapiens
tccccatttcccatc

SEQ ID NO: 520628 - DNA, 16 bp, Homo sapiens
tccccatttcccatct

SEQ ID NO: 520629 - DNA, 19 bp, Homo sapiens
tccccatttcccatctgca

SEQ ID NO: 520630 - DNA, 14 bp, Homo sapiens
tccccccattttct

SEQ ID NO: 520631 - DNA, 15 bp, Homo sapiens
tccccccattttctc

SEQ ID NO: 520632 - DNA, 20 bp, Homo sapiens
tcccctggaagcagtgccca

SEQ ID NO: 520633 - DNA, 23 bp, Homo sapiens
tcccctggaagcagtgcccaggt

SEQ ID NO: 520634 - DNA, 14 bp, Homo sapiens
tccccttctcccct

SEQ ID NO: 520635 - DNA, 20 bp, Homo sapiens
tccccttctcccctgcactg

SEQ ID NO: 520636 - DNA, 14 bp, Homo sapiens
tccccttgccagct

SEQ ID NO: 520637 - DNA, 22 bp, Homo sapiens
tccccttgccagctgctgagcc

SEQ ID NO: 520638 - DNA, 21 bp, Homo sapiens
tcccgcctccaacccctcgcc

SEQ ID NO: 520639 - DNA, 22 bp, Homo sapiens
tccctagctttagaccctgggt

SEQ ID NO: 520640 - DNA, 12 bp, Homo sapiens
tccctgcttcca

SEQ ID NO: 520641 - DNA, 14 bp, Homo sapiens
tccctgcttccagg

SEQ ID NO: 520642 - DNA, 17 bp, Homo sapiens
tcccttccttttccctg

SEQ ID NO: 520643 - DNA, 13 bp, Homo sapiens
tcccttttaaaga

SEQ ID NO: 520644 - DNA, 15 bp, Homo sapiens
tcccttttaaagaat

SEQ ID NO: 520645 - DNA, 14 bp, Homo sapiens
tccgagagggagag

SEQ ID NO: 520646 - DNA, 13 bp, Homo sapiens
tccgccagcctcc

SEQ ID NO: 520647 - DNA, 15 bp, Homo sapiens
tttgggaggagccat

SEQ ID NO: 520648 - DNA, 9 bp, Homo sapiens
tttgtcaag

SEQ ID NO: 520649 - DNA, 12 bp, Homo sapiens
tttgtcattttc

SEQ ID NO: 520650 - DNA, 17 bp, Homo sapiens
tttgtgatggtctctgg

SEQ ID NO: 520651 - DNA, 13 bp, Homo sapiens
tttgtggtgattt

SEQ ID NO: 520652 - DNA, 22 bp, Homo sapiens
ttttaaagtcagtgttgaattt

SEQ ID NO: 520653 - DNA, 13 bp, Homo sapiens
ttttaacattcct

SEQ ID NO: 520654 - DNA, 15 bp, Homo sapiens
ttttagatccaaatg

SEQ ID NO: 520655 - DNA, 13 bp, Homo sapiens
ttttattatttct

SEQ ID NO: 520656 - DNA, 20 bp, Homo sapiens
ttttattctgttaatgcatt

SEQ ID NO: 520657 - DNA, 15 bp, Homo sapiens
ttttcaagaaaattt

SEQ ID NO: 520658 - DNA, 17 bp, Homo sapiens
ttttcaagaaaattttg

SEQ ID NO: 520659 - DNA, 18 bp, Homo sapiens
ttttcaagaaaattttgc

SEQ ID NO: 520660 - DNA, 19 bp, Homo sapiens
ttttccgctcttaattaaa

SEQ ID NO: 520661 - DNA, 19 bp, Homo sapiens
ttttccttttgtgtaattt

SEQ ID NO: 520662 - DNA, 14 bp, Homo sapiens
ttttctacagtggt

SEQ ID NO: 520663 - DNA, 12 bp, Homo sapiens
ttttctgccctg

SEQ ID NO: 520664 - DNA, 16 bp, Homo sapiens
ttttctgccctggctg

SEQ ID NO: 520665 - DNA, 23 bp, Homo sapiens
ttttctgggcttttccttttgca

SEQ ID NO: 520666 - DNA, 14 bp, Homo sapiens
ttttctgtgttact

SEQ ID NO: 520667 - DNA, 17 bp, Homo sapiens
ttttgcacattccaaaa

SEQ ID NO: 520668 - DNA, 20 bp, Homo sapiens
ttttgtaaactgatgtttgt

SEQ ID NO: 520669 - DNA, 13 bp, Homo sapiens
tttttaaagtgta

SEQ ID NO: 520670 - DNA, 17 bp, Homo sapiens
tttttatctttaaatag

SEQ ID NO: 520671 - DNA, 15 bp, Homo sapiens
tttttccaaaacttg

SEQ ID NO: 520672 - DNA, 10 bp, Homo sapiens
tttttttgtc

SEQ ID NO: 520673 - DNA, 22 bp, Homo sapiens
cctctccgcccctgagcccact

SEQ ID NO: 520674 - DNA, 20 bp, Homo sapiens
cctctctgaaggaggccacc

SEQ ID NO: 520675 - DNA, 22 bp, Homo sapiens
cctctctgaaggaggccacctc

SEQ ID NO: 520676 - DNA, 23 bp, Homo sapiens
cctctctgaaggaggccacctcc

SEQ ID NO: 520677 - DNA, 12 bp, Homo sapiens
cctctgcctgcc

SEQ ID NO: 520678 - DNA, 21 bp, Homo sapiens
cctctgcctgccccgccccca

SEQ ID NO: 520679 - DNA, 22 bp, Homo sapiens
cctctggacggcaggctcactg

SEQ ID NO: 520680 - DNA, 14 bp, Homo sapiens
cctcttcctggccg

SEQ ID NO: 520681 - DNA, 11 bp, Homo sapiens
cctgaaaattc

SEQ ID NO: 520682 - DNA, 16 bp, Homo sapiens
cctgaaaattccaatt

SEQ ID NO: 520683 - DNA, 18 bp, Homo sapiens
cctgagaggcaggcatag

SEQ ID NO: 520684 - DNA, 12 bp, Homo sapiens
cctgagcccact

SEQ ID NO: 520685 - DNA, 20 bp, Homo sapiens
cctgaggggagacagagcaa

SEQ ID NO: 520686 - DNA, 15 bp, Homo sapiens
cctgagtgagagggg

SEQ ID NO: 520687 - DNA, 23 bp, Homo sapiens
cctgagtgagaggggaggccaag

SEQ ID NO: 520688 - DNA, 15 bp, Homo sapiens
cctgatgtttttctg

SEQ ID NO: 520689 - DNA, 18 bp, Homo sapiens
cctgcacgtcatgggagg

SEQ ID NO: 520690 - DNA, 23 bp, Homo sapiens
cctgcacgtcatgggagggggct

SEQ ID NO: 520691 - DNA, 13 bp, Homo sapiens
cctgcactgtaaa

SEQ ID NO: 520692 - DNA, 14 bp, Homo sapiens
cctgcactgtaaaa

SEQ ID NO: 520693 - DNA, 15 bp, Homo sapiens
cctgcactgtaaaat

SEQ ID NO: 520694 - DNA, 16 bp, Homo sapiens
cctgcactgtaaaatg

SEQ ID NO: 520695 - DNA, 15 bp, Homo sapiens
cctgcacttgggggc

SEQ ID NO: 520696 - DNA, 13 bp, Homo sapiens
cctgccaggcaca

SEQ ID NO: 520697 - DNA, 14 bp, Homo sapiens
cctgccaggcacag

SEQ ID NO: 520698 - DNA, 21 bp, Homo sapiens
cctgccaggcacaggcagggc

SEQ ID NO: 520699 - DNA, 23 bp, Homo sapiens
cctgccaggcacaggcagggcag

SEQ ID NO: 520700 - DNA, 19 bp, Homo sapiens
cctgccaggcaggggtggg

SEQ ID NO: 520701 - DNA, 13 bp, Homo sapiens
cctgcccccagcc

SEQ ID NO: 520702 - DNA, 18 bp, Homo sapiens
cctgcccccagccccggg

SEQ ID NO: 520703 - DNA, 16 bp, Homo sapiens
cctgcctctccgcccc

SEQ ID NO: 520704 - DNA, 21 bp, Homo sapiens
cctgcctctccgcccctgagc

SEQ ID NO: 520705 - DNA, 19 bp, Homo sapiens
cctgcgtcctcctcacctc

SEQ ID NO: 520706 - DNA, 20 bp, Homo sapiens
cctgcgtcctcctcacctca

SEQ ID NO: 520707 - DNA, 22 bp, Homo sapiens
cctgcgtcctcctcacctcatg

SEQ ID NO: 520708 - DNA, 19 bp, Homo sapiens
cctgctggcacccaccgtg

SEQ ID NO: 520709 - DNA, 21 bp, Homo sapiens
cctgcttccaggaaactccac

SEQ ID NO: 520710 - DNA, 13 bp, Homo sapiens
cctggaccccagc

SEQ ID NO: 520711 - DNA, 16 bp, Homo sapiens
cctggaccccagcctc

SEQ ID NO: 520712 - DNA, 13 bp, Homo sapiens
cctggcccatgta

SEQ ID NO: 520713 - DNA, 14 bp, Homo sapiens
cctggctgctgccc

SEQ ID NO: 520714 - DNA, 17 bp, Homo sapiens
cctggctgctgccccca

SEQ ID NO: 520715 - DNA, 18 bp, Homo sapiens
cctggctgctgcccccac

SEQ ID NO: 520716 - DNA, 12 bp, Homo sapiens
cctgggcctggc

SEQ ID NO: 520717 - DNA, 14 bp, Homo sapiens
cctgggcctggctc

SEQ ID NO: 520718 - DNA, 16 bp, Homo sapiens
cctgggcctggctccc

SEQ ID NO: 520719 - DNA, 14 bp, Homo sapiens
cctgggcttggcct

SEQ ID NO: 520720 - DNA, 18 bp, Homo sapiens
cctgggcttggcctgctg

SEQ ID NO: 520721 - DNA, 17 bp, Homo sapiens
cctggggcatccatggg

SEQ ID NO: 520722 - DNA, 18 bp, Homo sapiens
cctggggcatccatgggg

SEQ ID NO: 520723 - DNA, 16 bp, Homo sapiens
cctgggtgggctctgt

SEQ ID NO: 520724 - DNA, 19 bp, Homo sapiens
cctgggttagactgccagc

SEQ ID NO: 520725 - DNA, 21 bp, Homo sapiens
cctgggttagactgccagctc

SEQ ID NO: 520726 - DNA, 19 bp, Homo sapiens
cctgtgacatggtgcctga

SEQ ID NO: 520727 - DNA, 22 bp, Homo sapiens
cctgtgacatggtgcctgagag

SEQ ID NO: 520728 - DNA, 24 bp, Homo sapiens
cctgtgtctccaagcctctgtctt

SEQ ID NO: 520729 - DNA, 22 bp, Homo sapiens
cctgtgtggagagggaatgtga

SEQ ID NO: 520730 - DNA, 15 bp, Homo sapiens
ccttaaaaccaaaga

SEQ ID NO: 520731 - DNA, 15 bp, Homo sapiens
ccttccttttccctg

SEQ ID NO: 520732 - DNA, 19 bp, Homo sapiens
ccttccttttccctgcttc

SEQ ID NO: 520733 - DNA, 13 bp, Homo sapiens
ccttctcccctgc

SEQ ID NO: 520734 - DNA, 17 bp, Homo sapiens
ccttctcccctgcactg

SEQ ID NO: 520735 - DNA, 23 bp, Homo sapiens
ccttctcccctgcactgtaaaat

SEQ ID NO: 520736 - DNA, 16 bp, Homo sapiens
ccttctctcctcccca

SEQ ID NO: 520737 - DNA, 22 bp, Homo sapiens
ccttgaaccgccggttcatttt

SEQ ID NO: 520738 - DNA, 19 bp, Homo sapiens
ccttgccagctgctgagcc

SEQ ID NO: 520739 - DNA, 23 bp, Homo sapiens
ccttgccagctgctgagccgcag

SEQ ID NO: 520740 - DNA, 17 bp, Homo sapiens
ccttggttcctggggca

SEQ ID NO: 520741 - DNA, 17 bp, Homo sapiens
cctttcactcctttcct

SEQ ID NO: 520742 - DNA, 19 bp, Homo sapiens
cctttcatgtaactttttt

SEQ ID NO: 520743 - DNA, 23 bp, Homo sapiens
cctttcctccctccctcgatccc

SEQ ID NO: 520744 - DNA, 15 bp, Homo sapiens
ccttttccctgcttc

SEQ ID NO: 520745 - DNA, 12 bp, Homo sapiens
cctttttctagt

SEQ ID NO: 520746 - DNA, 22 bp, Homo sapiens
cgcagagaagtgacggttccta

SEQ ID NO: 520747 - DNA, 14 bp, Homo sapiens
cgccagcctcctct

SEQ ID NO: 520748 - DNA, 17 bp, Homo sapiens
cgcccagtcccagcagc

SEQ ID NO: 520749 - DNA, 21 bp, Homo sapiens
cgcccagtcccagcagccagc

SEQ ID NO: 520750 - DNA, 18 bp, Homo sapiens
cgcccccagtccccaccc

SEQ ID NO: 520751 - DNA, 22 bp, Homo sapiens
cgcccccagtccccacccctgc

SEQ ID NO: 520752 - DNA, 13 bp, Homo sapiens
cgcccctgagccc

SEQ ID NO: 520753 - DNA, 14 bp, Homo sapiens
cgccctggccccca

SEQ ID NO: 520754 - DNA, 19 bp, Homo sapiens
cgcctccaacccctcgccc

SEQ ID NO: 520755 - DNA, 22 bp, Homo sapiens
cgcctccaacccctcgcccagt

SEQ ID NO: 520756 - DNA, 19 bp, Homo sapiens
cgctaaagagcccttgcct

SEQ ID NO: 520757 - DNA, 15 bp, Homo sapiens
cgctgactacagggc

SEQ ID NO: 520758 - DNA, 17 bp, Homo sapiens
cggcaataaaagcccag

SEQ ID NO: 520759 - DNA, 14 bp, Homo sapiens
cggcaggctcactg

SEQ ID NO: 520760 - DNA, 18 bp, Homo sapiens
cggcaggctcactgccag

SEQ ID NO: 520761 - DNA, 22 bp, Homo sapiens
cggggtgagtccattctcccag

SEQ ID NO: 520762 - DNA, 15 bp, Homo sapiens
cggttcattttgcac

SEQ ID NO: 520763 - DNA, 20 bp, Homo sapiens
cgtggagaatcacaggctgg

SEQ ID NO: 520764 - DNA, 14 bp, Homo sapiens
cgttgtaatgcaca

SEQ ID NO: 520765 - DNA, 23 bp, Homo sapiens
ctaaaaggcccagagagaagagc

SEQ ID NO: 520766 - DNA, 18 bp, Homo sapiens
ctaaagagcccttgcctc

SEQ ID NO: 520767 - DNA, 22 bp, Homo sapiens
ctaaagagcccttgcctcccca

SEQ ID NO: 520768 - DNA, 23 bp, Homo sapiens
ctaaagagcccttgcctccccat

SEQ ID NO: 520769 - DNA, 17 bp, Homo sapiens
ctaaataaaaaaattaa

SEQ ID NO: 520770 - DNA, 11 bp, Homo sapiens
ctaagagaagt

SEQ ID NO: 520771 - DNA, 14 bp, Homo sapiens
ctaatttctcctcc

SEQ ID NO: 520772 - DNA, 18 bp, Homo sapiens
ctaatttctcctcccttc

SEQ ID NO: 520773 - DNA, 19 bp, Homo sapiens
ctaatttctcctcccttcc

SEQ ID NO: 520774 - DNA, 20 bp, Homo sapiens
ctaatttctcctcccttcct

SEQ ID NO: 520775 - DNA, 17 bp, Homo sapiens
ctacaatgggaaaactt

SEQ ID NO: 520776 - DNA, 15 bp, Homo sapiens
ctacacaggacaggg

SEQ ID NO: 520777 - DNA, 19 bp, Homo sapiens
ctacattataccgcagagt

SEQ ID NO: 520778 - DNA, 12 bp, Homo sapiens
ctagaagccaag

SEQ ID NO: 520779 - DNA, 13 bp, Homo sapiens
ctagaagccaagg

SEQ ID NO: 520780 - DNA, 21 bp, Homo sapiens
ctagaagccaagggaaagggg

SEQ ID NO: 520781 - DNA, 17 bp, Homo sapiens
ctagaatcatgtatttt

SEQ ID NO: 520782 - DNA, 22 bp, Homo sapiens
ctagaatcatgtattttgtaaa

SEQ ID NO: 520783 - DNA, 15 bp, Homo sapiens
ctagaattgattttt

SEQ ID NO: 520784 - DNA, 16 bp, Homo sapiens
cttggcctgctgtgat

SEQ ID NO: 520785 - DNA, 21 bp, Homo sapiens
cttgggggctcagcaaggcca

SEQ ID NO: 520786 - DNA, 17 bp, Homo sapiens
cttggttcctggggcat

SEQ ID NO: 520787 - DNA, 21 bp, Homo sapiens
cttggttcttcctagtgccta

SEQ ID NO: 520788 - DNA, 18 bp, Homo sapiens
cttgtaactttcttcaaa

SEQ ID NO: 520789 - DNA, 13 bp, Homo sapiens
cttgtcatgtgta

SEQ ID NO: 520790 - DNA, 14 bp, Homo sapiens
cttgtcatgtgtat

SEQ ID NO: 520791 - DNA, 15 bp, Homo sapiens
cttgtcatgtgtata

SEQ ID NO: 520792 - DNA, 16 bp, Homo sapiens
cttgttctagaatcat

SEQ ID NO: 520793 - DNA, 19 bp, Homo sapiens
cttgttctagaatcatgta

SEQ ID NO: 520794 - DNA, 22 bp, Homo sapiens
cttgttctagaatcatgtattt

SEQ ID NO: 520795 - DNA, 13 bp, Homo sapiens
cttgttttggatg

SEQ ID NO: 520796 - DNA, 14 bp, Homo sapiens
ctttacatatgatt

SEQ ID NO: 520797 - DNA, 15 bp, Homo sapiens
ctttacttcctttct

SEQ ID NO: 520798 - DNA, 17 bp, Homo sapiens
ctttacttcctttctta

SEQ ID NO: 520799 - DNA, 14 bp, Homo sapiens
ctttagaccctggg

SEQ ID NO: 520800 - DNA, 16 bp, Homo sapiens
ctttagaccctgggtg

SEQ ID NO: 520801 - DNA, 23 bp, Homo sapiens
ctttagaccctgggtgggctctg

SEQ ID NO: 520802 - DNA, 20 bp, Homo sapiens
ctttatttttatcccaggaa

SEQ ID NO: 520803 - DNA, 18 bp, Homo sapiens
ctttcaacttatttctga

SEQ ID NO: 520804 - DNA, 21 bp, Homo sapiens
ctttcttcaaaaagcatttta

SEQ ID NO: 520805 - DNA, 13 bp, Homo sapiens
ctttcttctcttt

SEQ ID NO: 520806 - DNA, 17 bp, Homo sapiens
ctttggtttttttcttc

SEQ ID NO: 520807 - DNA, 23 bp, Homo sapiens
ctttggtttttttcttctgtatt

SEQ ID NO: 520808 - DNA, 20 bp, Homo sapiens
ctttgtgtctagggcagagt

SEQ ID NO: 520809 - DNA, 21 bp, Homo sapiens
cttttaaaaattttgtccttt

SEQ ID NO: 520810 - DNA, 13 bp, Homo sapiens
cttttccctgctt

SEQ ID NO: 520811 - DNA, 15 bp, Homo sapiens
cttttccctgcttcc

SEQ ID NO: 520812 - DNA, 18 bp, Homo sapiens
cttttccctgcttccagg

SEQ ID NO: 520813 - DNA, 11 bp, Homo sapiens
cttttcctttt

SEQ ID NO: 520814 - DNA, 12 bp, Homo sapiens
cttttccttttg

SEQ ID NO: 520815 - DNA, 14 bp, Homo sapiens
cttttctgggatgt

SEQ ID NO: 520816 - DNA, 18 bp, Homo sapiens
cttttctggtaattttgg

SEQ ID NO: 520817 - DNA, 16 bp, Homo sapiens
cttttctgtgtgcata

SEQ ID NO: 520818 - DNA, 19 bp, Homo sapiens
cttttgtgtaattttaaag

SEQ ID NO: 520819 - DNA, 20 bp, Homo sapiens
cttttgtgtaattttaaagt

SEQ ID NO: 520820 - DNA, 20 bp, Homo sapiens
ctttttctgtgcgccttaaa

SEQ ID NO: 520821 - DNA, 17 bp, Homo sapiens
ctttttgggagagactt

SEQ ID NO: 520822 - DNA, 19 bp, Homo sapiens
ctttttgggagagacttgt

SEQ ID NO: 520823 - DNA, 17 bp, Homo sapiens
ctttttgtatctaaagt

SEQ ID NO: 520824 - DNA, 17 bp, Homo sapiens
gaaaaaatggcaagaga

SEQ ID NO: 520825 - DNA, 19 bp, Homo sapiens
gaaaacttcactccaaaga

SEQ ID NO: 520826 - DNA, 20 bp, Homo sapiens
gaaaataatcaaaccaaaga

SEQ ID NO: 520827 - DNA, 22 bp, Homo sapiens
gaaaataatcaaaccaaagagt

SEQ ID NO: 520828 - DNA, 20 bp, Homo sapiens
gaaaatgtctcagtatttta

SEQ ID NO: 520829 - DNA, 15 bp, Homo sapiens
gaaacataatttttt

SEQ ID NO: 520830 - DNA, 21 bp, Homo sapiens
gaaacataattttttttttct

SEQ ID NO: 520831 - DNA, 16 bp, Homo sapiens
gaaacattctttccta

SEQ ID NO: 520832 - DNA, 17 bp, Homo sapiens
gaaacattctttcctaa

SEQ ID NO: 520833 - DNA, 19 bp, Homo sapiens
gaaacctttttctagttat

SEQ ID NO: 520834 - DNA, 23 bp, Homo sapiens
gaaactgaggtgttattttcaat

SEQ ID NO: 520835 - DNA, 17 bp, Homo sapiens
gaaaggcaaatctgact

SEQ ID NO: 520836 - DNA, 20 bp, Homo sapiens
gaaaggggagagcctgctgg

SEQ ID NO: 520837 - DNA, 21 bp, Homo sapiens
gaaaggggagagcctgctggc

SEQ ID NO: 520838 - DNA, 12 bp, Homo sapiens
gaaagggggtgg

SEQ ID NO: 520839 - DNA, 14 bp, Homo sapiens
gaaaggggtgcttt

SEQ ID NO: 520840 - DNA, 23 bp, Homo sapiens
gaaaggtgagtttgagctgcctt

SEQ ID NO: 520841 - DNA, 23 bp, Homo sapiens
gaaatctttcaacttatttctga

SEQ ID NO: 520842 - DNA, 14 bp, Homo sapiens
gaaatgctgaccca

SEQ ID NO: 520843 - DNA, 12 bp, Homo sapiens
gaacccaatttt

SEQ ID NO: 520844 - DNA, 21 bp, Homo sapiens
gaagaaaaaatggcaagagat

SEQ ID NO: 520845 - DNA, 15 bp, Homo sapiens
gaagaagggagaaga

SEQ ID NO: 520846 - DNA, 12 bp, Homo sapiens
gaagcagtgccc

SEQ ID NO: 520847 - DNA, 15 bp, Homo sapiens
gaagcagtgcccagg

SEQ ID NO: 520848 - DNA, 19 bp, Homo sapiens
gaagccaagtggggtgctg

SEQ ID NO: 520849 - DNA, 23 bp, Homo sapiens
gaagccaagtggggtgctgggag

SEQ ID NO: 520850 - DNA, 19 bp, Homo sapiens
gaagctatgtttttaaagt

SEQ ID NO: 520851 - DNA, 12 bp, Homo sapiens
gaaggaggccac

SEQ ID NO: 520852 - DNA, 15 bp, Homo sapiens
gaaggaggccacctc

SEQ ID NO: 520853 - DNA, 16 bp, Homo sapiens
gaaggcaagagggggt

SEQ ID NO: 520854 - DNA, 17 bp, Homo sapiens
gaaggcaagagggggtg

SEQ ID NO: 520855 - DNA, 23 bp, Homo sapiens
gaaggcaagagggggtggagggg

SEQ ID NO: 520856 - DNA, 15 bp, Homo sapiens
gaaggggactgccac

SEQ ID NO: 520857 - DNA, 18 bp, Homo sapiens
gaaggggactgccacctc

SEQ ID NO: 520858 - DNA, 17 bp, Homo sapiens
gaaggtgtttaaagagt

SEQ ID NO: 520859 - DNA, 12 bp, Homo sapiens
gaagtagcacag

SEQ ID NO: 520860 - DNA, 13 bp, Homo sapiens
gaagtagcacagg

SEQ ID NO: 520861 - DNA, 14 bp, Homo sapiens
gaatcacaggctgg

SEQ ID NO: 520862 - DNA, 17 bp, Homo sapiens
gaatcacaggctgggct

SEQ ID NO: 520863 - DNA, 18 bp, Homo sapiens
gaatcacaggctgggctg

SEQ ID NO: 520864 - DNA, 22 bp, Homo sapiens
gaattggggattgagttgtaaa

SEQ ID NO: 520865 - DNA, 16 bp, Homo sapiens
gaattttttttaacat

SEQ ID NO: 520866 - DNA, 20 bp, Homo sapiens
gacaagagatgggaatgagg

SEQ ID NO: 520867 - DNA, 18 bp, Homo sapiens
gacaatcgtgatagttat

SEQ ID NO: 520868 - DNA, 13 bp, Homo sapiens
gacaatttttgct

SEQ ID NO: 520869 - DNA, 19 bp, Homo sapiens
gacacattgttttccagaa

SEQ ID NO: 520870 - DNA, 14 bp, Homo sapiens
gacaggacccctgc

SEQ ID NO: 520871 - DNA, 19 bp, Homo sapiens
gacatggtgcctgagaggc

SEQ ID NO: 520872 - DNA, 20 bp, Homo sapiens
gacatggtgcctgagaggca

SEQ ID NO: 520873 - DNA, 11 bp, Homo sapiens
gaccagcccac

SEQ ID NO: 520874 - DNA, 23 bp, Homo sapiens
gaccagcccacgctgactacagg

SEQ ID NO: 520875 - DNA, 15 bp, Homo sapiens
gaccatgctgtctgg

SEQ ID NO: 520876 - DNA, 19 bp, Homo sapiens
gaccatgctgtctggcaca

SEQ ID NO: 520877 - DNA, 17 bp, Homo sapiens
gacccatgggcaggaga

SEQ ID NO: 520878 - DNA, 12 bp, Homo sapiens
gaccccagcctc

SEQ ID NO: 520879 - DNA, 16 bp, Homo sapiens
gaccctgccaggcaca

SEQ ID NO: 520880 - DNA, 17 bp, Homo sapiens
gaccctgccaggcacag

SEQ ID NO: 520881 - DNA, 21 bp, Homo sapiens
gaccctgccaggcacaggcag

SEQ ID NO: 520882 - DNA, 23 bp, Homo sapiens
gaccctgccaggcacaggcaggg

SEQ ID NO: 520883 - DNA, 19 bp, Homo sapiens
gaccctgggtgggctctgt

SEQ ID NO: 520884 - DNA, 21 bp, Homo sapiens
gaccctgggtgggctctgtgc

SEQ ID NO: 520885 - DNA, 22 bp, Homo sapiens
gaccctgggtgggctctgtgca

SEQ ID NO: 520886 - DNA, 17 bp, Homo sapiens
gacctgccaggcagggg

SEQ ID NO: 520887 - DNA, 18 bp, Homo sapiens
gacctgccaggcaggggt

SEQ ID NO: 520888 - DNA, 11 bp, Homo sapiens
gacggcaggct

SEQ ID NO: 520889 - DNA, 20 bp, Homo sapiens
gacggcaggctcactgccag

SEQ ID NO: 520890 - DNA, 11 bp, Homo sapiens
gacggttccta

SEQ ID NO: 520891 - DNA, 19 bp, Homo sapiens
gacggttcctacacaggac

SEQ ID NO: 520892 - DNA, 13 bp, Homo sapiens
gactacagggccg

SEQ ID NO: 520893 - DNA, 21 bp, Homo sapiens
gactattcttgatgtaaaatc

SEQ ID NO: 520894 - DNA, 17 bp, Homo sapiens
gactctgccttaatttt

SEQ ID NO: 520895 - DNA, 16 bp, Homo sapiens
gactgccacctcccct

SEQ ID NO: 520896 - DNA, 21 bp, Homo sapiens
gactgccagctcttcctagct

SEQ ID NO: 520897 - DNA, 14 bp, Homo sapiens
gactgttcatttga

SEQ ID NO: 520898 - DNA, 18 bp, Homo sapiens
gacttgagaaatttgaaa

SEQ ID NO: 520899 - DNA, 14 bp, Homo sapiens
gacttttcttttta

SEQ ID NO: 520900 - DNA, 22 bp, Homo sapiens
gagaaaaaaatataaaatttct

SEQ ID NO: 520901 - DNA, 20 bp, Homo sapiens
gagaaacattctttcctaaa

SEQ ID NO: 520902 - DNA, 19 bp, Homo sapiens
gagacagagcaacccctgg

SEQ ID NO: 520903 - DNA, 17 bp, Homo sapiens
gagactgctcctgagcc

SEQ ID NO: 520904 - DNA, 18 bp, Homo sapiens
gagactgctcctgagccc

SEQ ID NO: 520905 - DNA, 11 bp, Homo sapiens
gagacttgttt

SEQ ID NO: 520906 - DNA, 14 bp, Homo sapiens
gagagaagagcccc

SEQ ID NO: 520907 - DNA, 14 bp, Homo sapiens
gagagagagagaga

SEQ ID NO: 520908 - DNA, 14 bp, Homo sapiens
gagagagagaggac

SEQ ID NO: 520909 - DNA, 13 bp, Homo sapiens
gagagagaggaca

SEQ ID NO: 520910 - DNA, 12 bp, Homo sapiens
gagagcctgctg

SEQ ID NO: 520911 - DNA, 10 bp, Homo sapiens
gagaggacag

SEQ ID NO: 520912 - DNA, 15 bp, Homo sapiens
gagaggagccctgcc

SEQ ID NO: 520913 - DNA, 14 bp, Homo sapiens
gagagggaatgtga

SEQ ID NO: 520914 - DNA, 15 bp, Homo sapiens
gagatggatgtattt

SEQ ID NO: 520915 - DNA, 14 bp, Homo sapiens
gagatggtgatgta

SEQ ID NO: 520916 - DNA, 21 bp, Homo sapiens
gagcaacccctggaccccagc

SEQ ID NO: 520917 - DNA, 22 bp, Homo sapiens
gagcaacccctggaccccagcc

SEQ ID NO: 520918 - DNA, 18 bp, Homo sapiens
gagcaggttactaaggaa

SEQ ID NO: 520919 - DNA, 13 bp, Homo sapiens
gagcccactgtgc

SEQ ID NO: 520920 - DNA, 18 bp, Homo sapiens
gagcccatttggagggcc

SEQ ID NO: 520921 - DNA, 23 bp, Homo sapiens
gagccccactctcagaggcccca

SEQ ID NO: 520922 - DNA, 17 bp, Homo sapiens
gagcccttgcctcccca

SEQ ID NO: 520923 - DNA, 22 bp, Homo sapiens
gagcccttgcctccccatttcc

SEQ ID NO: 520924 - DNA, 16 bp, Homo sapiens
gagccgggcccctggg

SEQ ID NO: 520925 - DNA, 11 bp, Homo sapiens
gagcctgctgg

SEQ ID NO: 520926 - DNA, 13 bp, Homo sapiens
gaggagccctgcc

SEQ ID NO: 520927 - DNA, 16 bp, Homo sapiens
gaggaggaaggcaaga

SEQ ID NO: 520928 - DNA, 11 bp, Homo sapiens
gaggagggaga

SEQ ID NO: 520929 - DNA, 17 bp, Homo sapiens
gaggccaagagtggccc

SEQ ID NO: 520930 - DNA, 20 bp, Homo sapiens
gaggccaagagtggccccac

SEQ ID NO: 520931 - DNA, 21 bp, Homo sapiens
gaggccaagagtggccccacc

SEQ ID NO: 520932 - DNA, 12 bp, Homo sapiens
gaggccacctcc

SEQ ID NO: 520933 - DNA, 15 bp, Homo sapiens
gaggcttcctgcgtc

SEQ ID NO: 520934 - DNA, 22 bp, Homo sapiens
gaggcttctccgccagcctcct

SEQ ID NO: 520935 - DNA, 23 bp, Homo sapiens
gaggcttctccgccagcctcctc

SEQ ID NO: 520936 - DNA, 19 bp, Homo sapiens
gaggcttgctgaacatgga

SEQ ID NO: 520937 - DNA, 14 bp, Homo sapiens
gagggaatgtgaaa

SEQ ID NO: 520938 - DNA, 17 bp, Homo sapiens
gagggcctgggcctggc

SEQ ID NO: 520939 - DNA, 17 bp, Homo sapiens
gaggggatggggctggg

SEQ ID NO: 520940 - DNA, 21 bp, Homo sapiens
gagggggcttgaagccaaaga

SEQ ID NO: 520941 - DNA, 16 bp, Homo sapiens
gaggtcactggaaagg

SEQ ID NO: 520942 - DNA, 21 bp, Homo sapiens
gaggtcactggaaaggggaga

SEQ ID NO: 520943 - DNA, 15 bp, Homo sapiens
gaggtggaagaaggg

SEQ ID NO: 520944 - DNA, 17 bp, Homo sapiens
gaggtggaagaagggag

SEQ ID NO: 520945 - DNA, 18 bp, Homo sapiens
gaggtggaagaagggaga

SEQ ID NO: 520946 - DNA, 16 bp, Homo sapiens
gaggttcctctgcctg

SEQ ID NO: 520947 - DNA, 16 bp, Homo sapiens
gagtccattctcccag

SEQ ID NO: 520948 - DNA, 18 bp, Homo sapiens
gagtccattctcccaggt

SEQ ID NO: 520949 - DNA, 16 bp, Homo sapiens
gagtcctacagtgtca

SEQ ID NO: 520950 - DNA, 19 bp, Homo sapiens
gagtggccccacctggccc

SEQ ID NO: 520951 - DNA, 20 bp, Homo sapiens
gagtggccccacctggccct

SEQ ID NO: 520952 - DNA, 19 bp, Homo sapiens
gagttgtcctgatgttttt

SEQ ID NO: 520953 - DNA, 18 bp, Homo sapiens
gagtttcacagtgtgatt

SEQ ID NO: 520954 - DNA, 17 bp, Homo sapiens
gagtttgagctgccttc

SEQ ID NO: 520955 - DNA, 22 bp, Homo sapiens
gataacccaaacaaaaatgact

SEQ ID NO: 520956 - DNA, 21 bp, Homo sapiens
gatatttttaacttaatggca

SEQ ID NO: 520957 - DNA, 14 bp, Homo sapiens
gatcagtctgtctg

SEQ ID NO: 520958 - DNA, 23 bp, Homo sapiens
gatggcacatagatgttgtagaa

SEQ ID NO: 520959 - DNA, 23 bp, Homo sapiens
gatgggaatgaggtgggaggtgg

SEQ ID NO: 520960 - DNA, 12 bp, Homo sapiens
gatgggcctgag

SEQ ID NO: 520961 - DNA, 18 bp, Homo sapiens
gatgtgtgttgcttctct

SEQ ID NO: 520962 - DNA, 19 bp, Homo sapiens
gatgttgacatcactggca

SEQ ID NO: 520963 - DNA, 19 bp, Homo sapiens
gattactgacttttctttt

SEQ ID NO: 520964 - DNA, 13 bp, Homo sapiens
gattatgggtcac

SEQ ID NO: 520965 - DNA, 16 bp, Homo sapiens
gattatgggtcacagg

SEQ ID NO: 520966 - DNA, 18 bp, Homo sapiens
gattgagtcctacagtgt

SEQ ID NO: 520967 - DNA, 17 bp, Homo sapiens
gattgagttgtaaagaa

SEQ ID NO: 520968 - DNA, 19 bp, Homo sapiens
gatttattcccttttaaag

SEQ ID NO: 520969 - DNA, 18 bp, Homo sapiens
gcaaaaaaaaaaaaaagc

SEQ ID NO: 520970 - DNA, 13 bp, Homo sapiens
gcaacccctggac

SEQ ID NO: 520971 - DNA, 21 bp, Homo sapiens
gcaagagatcatatcctcaga

SEQ ID NO: 520972 - DNA, 23 bp, Homo sapiens
gcaagagggggtggaggggtgtg

SEQ ID NO: 520973 - DNA, 18 bp, Homo sapiens
gcaagcacaatggtttca

SEQ ID NO: 520974 - DNA, 22 bp, Homo sapiens
gcaaggccacctcttcctggcc

SEQ ID NO: 520975 - DNA, 15 bp, Homo sapiens
gcaagtggttgtttt

SEQ ID NO: 520976 - DNA, 13 bp, Homo sapiens
gcaagttgaacaa

SEQ ID NO: 520977 - DNA, 17 bp, Homo sapiens
gcaataaaagcccagga

SEQ ID NO: 520978 - DNA, 18 bp, Homo sapiens
gcaataaaagcccaggag

SEQ ID NO: 520979 - DNA, 19 bp, Homo sapiens
gcaataaaagcccaggagc

SEQ ID NO: 520980 - DNA, 22 bp, Homo sapiens
gcaataaaagcccaggagccca

SEQ ID NO: 520981 - DNA, 22 bp, Homo sapiens
gcaattgtaaacagaaattgca

SEQ ID NO: 520982 - DNA, 14 bp, Homo sapiens
gcacaggcagggca

SEQ ID NO: 520983 - DNA, 20 bp, Homo sapiens
gcacaggcagggcaggacca

SEQ ID NO: 520984 - DNA, 22 bp, Homo sapiens
gcacaggctgagtgcaggccca

SEQ ID NO: 520985 - DNA, 11 bp, Homo sapiens
gcacagggcct

SEQ ID NO: 520986 - DNA, 19 bp, Homo sapiens
gcacagggcctggcccatg

SEQ ID NO: 520987 - DNA, 18 bp, Homo sapiens
gcacaggtttgttttttc

SEQ ID NO: 520988 - DNA, 22 bp, Homo sapiens
gcacattccaaaattcatttca

SEQ ID NO: 520989 - DNA, 18 bp, Homo sapiens
gcacccaccgtggaggag

SEQ ID NO: 520990 - DNA, 13 bp, Homo sapiens
gcaccccttctct

SEQ ID NO: 520991 - DNA, 21 bp, Homo sapiens
gcaccccttctctcctcccca

SEQ ID NO: 520992 - DNA, 22 bp, Homo sapiens
gcaccccttctctcctccccaa

SEQ ID NO: 520993 - DNA, 15 bp, Homo sapiens
gcactgctctcacct

SEQ ID NO: 520994 - DNA, 9 bp, Homo sapiens
gcactgtaa

SEQ ID NO: 520995 - DNA, 23 bp, Homo sapiens
gcactgtaaaatgtgggattatg

SEQ ID NO: 520996 - DNA, 17 bp, Homo sapiens
gcactgttgtcatttcc

SEQ ID NO: 520997 - DNA, 20 bp, Homo sapiens
gcactgttgtcatttccaaa

SEQ ID NO: 520998 - DNA, 14 bp, Homo sapiens
gcacttcagatcaa

SEQ ID NO: 520999 - DNA, 19 bp, Homo sapiens
gcacttgggggctcagcaa

SEQ ID NO: 521000 - DNA, 22 bp, Homo sapiens
gcacttgggggctcagcaaggc

SEQ ID NO: 521001 - DNA, 23 bp, Homo sapiens
gcacttgggggctcagcaaggcc

SEQ ID NO: 521002 - DNA, 19 bp, Homo sapiens
gcagaggatagtaatgaaa

SEQ ID NO: 521003 - DNA, 17 bp, Homo sapiens
gcagagggataacccaa

SEQ ID NO: 521004 - DNA, 16 bp, Homo sapiens
gcaggaccagcccacg

SEQ ID NO: 521005 - DNA, 18 bp, Homo sapiens
gcaggaccagcccacgct

SEQ ID NO: 521006 - DNA, 13 bp, Homo sapiens
gggagacagagca

SEQ ID NO: 521007 - DNA, 13 bp, Homo sapiens
gggagagcctgct

SEQ ID NO: 521008 - DNA, 16 bp, Homo sapiens
gggagagcctgctggc

SEQ ID NO: 521009 - DNA, 17 bp, Homo sapiens
gggagagggaggtcact

SEQ ID NO: 521010 - DNA, 18 bp, Homo sapiens
gggaggagggagagggag

SEQ ID NO: 521011 - DNA, 15 bp, Homo sapiens
gggaggtcactggaa

SEQ ID NO: 521012 - DNA, 22 bp, Homo sapiens
gggataacccaaacaaaaatga

SEQ ID NO: 521013 - DNA, 14 bp, Homo sapiens
gggatgggcctgag

SEQ ID NO: 521014 - DNA, 17 bp, Homo sapiens
gggattatgggtcacag

SEQ ID NO: 521015 - DNA, 18 bp, Homo sapiens
gggattatgggtcacagg

SEQ ID NO: 521016 - DNA, 19 bp, Homo sapiens
gggcacgtggttgagtggg

SEQ ID NO: 521017 - DNA, 23 bp, Homo sapiens
gggcatccatggggtctctcaca

SEQ ID NO: 521018 - DNA, 13 bp, Homo sapiens
gggctcagcaagg

SEQ ID NO: 521019 - DNA, 16 bp, Homo sapiens
gggctcagcaaggcca

SEQ ID NO: 521020 - DNA, 18 bp, Homo sapiens
gggctcagcaaggccacc

SEQ ID NO: 521021 - DNA, 13 bp, Homo sapiens
gggcttgaagcca

SEQ ID NO: 521022 - DNA, 17 bp, Homo sapiens
gggcttgaagccaaaga

SEQ ID NO: 521023 - DNA, 11 bp, Homo sapiens
ggggaccctgt

SEQ ID NO: 521024 - DNA, 20 bp, Homo sapiens
ggggccccgtctcaggtctg

SEQ ID NO: 521025 - DNA, 14 bp, Homo sapiens
ggggctcagcaagg

SEQ ID NO: 521026 - DNA, 20 bp, Homo sapiens
ggggctcagcaaggccacct

SEQ ID NO: 521027 - DNA, 21 bp, Homo sapiens
ggggctcagcaaggccacctc

SEQ ID NO: 521028 - DNA, 17 bp, Homo sapiens
ggggcttgaagccaaag

SEQ ID NO: 521029 - DNA, 19 bp, Homo sapiens
gggggctcagcaaggccac

SEQ ID NO: 521030 - DNA, 18 bp, Homo sapiens
ggggttccttctgggcat

SEQ ID NO: 521031 - DNA, 21 bp, Homo sapiens
gggtatggggggggcaagaaa

SEQ ID NO: 521032 - DNA, 21 bp, Homo sapiens
gggtcgcctatttttaaaaag

SEQ ID NO: 521033 - DNA, 19 bp, Homo sapiens
gggtgagtccattctccca

SEQ ID NO: 521034 - DNA, 18 bp, Homo sapiens
gggtgctgggaggaggga

SEQ ID NO: 521035 - DNA, 22 bp, Homo sapiens
gggtgcttttatagaggctagc

SEQ ID NO: 521036 - DNA, 14 bp, Homo sapiens
gggtggaggggtgt

SEQ ID NO: 521037 - DNA, 12 bp, Homo sapiens
gggtgtggcagt

SEQ ID NO: 521038 - DNA, 18 bp, Homo sapiens
gggttagactgccagctc

SEQ ID NO: 521039 - DNA, 20 bp, Homo sapiens
gggttatctcaaattttaag

SEQ ID NO: 521040 - DNA, 11 bp, Homo sapiens
ggtaattttgg

SEQ ID NO: 521041 - DNA, 14 bp, Homo sapiens
ggtaccagctgcgc

SEQ ID NO: 521042 - DNA, 15 bp, Homo sapiens
ggtaccagctgcgct

SEQ ID NO: 521043 - DNA, 15 bp, Homo sapiens
ggtagcctctgggtt

SEQ ID NO: 521044 - DNA, 17 bp, Homo sapiens
ggtatgggctgttctgt

SEQ ID NO: 521045 - DNA, 22 bp, Homo sapiens
ggtatgggctgttctgtttcct

SEQ ID NO: 521046 - DNA, 17 bp, Homo sapiens
ggtattatatctctgta

SEQ ID NO: 521047 - DNA, 23 bp, Homo sapiens
ggtctaaaacagctatttccctt

SEQ ID NO: 521048 - DNA, 23 bp, Homo sapiens
ggtctctcacagacaggacccct

SEQ ID NO: 521049 - DNA, 18 bp, Homo sapiens
ggtgagtccattctccca

SEQ ID NO: 521050 - DNA, 23 bp, Homo sapiens
ggtgtgggggccccgtctcaggt

SEQ ID NO: 521051 - DNA, 15 bp, Homo sapiens
ggttatcctattttt

SEQ ID NO: 521052 - DNA, 17 bp, Homo sapiens
ggttcctacacaggaca

SEQ ID NO: 521053 - DNA, 18 bp, Homo sapiens
ggttcctacacaggacag

SEQ ID NO: 521054 - DNA, 23 bp, Homo sapiens
ggttgggacccagtggcagggca

SEQ ID NO: 521055 - DNA, 15 bp, Homo sapiens
ggttgttgttttttt

SEQ ID NO: 521056 - DNA, 16 bp, Homo sapiens
gtaaaatcttgtcatg

SEQ ID NO: 521057 - DNA, 22 bp, Homo sapiens
gtaaaatcttgtcatgtgtata

SEQ ID NO: 521058 - DNA, 18 bp, Homo sapiens
gtaaaatgtgggattatg

SEQ ID NO: 521059 - DNA, 23 bp, Homo sapiens
gtaaaatgtgggattatgggtca

SEQ ID NO: 521060 - DNA, 15 bp, Homo sapiens
gtaaatttgtactat

SEQ ID NO: 521061 - DNA, 20 bp, Homo sapiens
gtaaatttgtactatttaac

SEQ ID NO: 521062 - DNA, 22 bp, Homo sapiens
gtaaatttgtactatttaactg

SEQ ID NO: 521063 - DNA, 17 bp, Homo sapiens
gtaattcgtttgctaga

SEQ ID NO: 521064 - DNA, 11 bp, Homo sapiens
gtaattttaaa

SEQ ID NO: 521065 - DNA, 14 bp, Homo sapiens
gtacattttataaa

SEQ ID NO: 521066 - DNA, 19 bp, Homo sapiens
gtaccagctgcgcttgctt

SEQ ID NO: 521067 - DNA, 17 bp, Homo sapiens
gtagaatctcttttctg

SEQ ID NO: 521068 - DNA, 14 bp, Homo sapiens
gtagcacaggctga

SEQ ID NO: 521069 - DNA, 13 bp, Homo sapiens
gtagttttccttt

SEQ ID NO: 521070 - DNA, 19 bp, Homo sapiens
gtataaaaataaaaaagat

SEQ ID NO: 521071 - DNA, 23 bp, Homo sapiens
gtataaaaataaaaaagatccca

SEQ ID NO: 521072 - DNA, 21 bp, Homo sapiens
gtataggggaaaatattattt

SEQ ID NO: 521073 - DNA, 20 bp, Homo sapiens
gtattggtgctttgtgtcta

SEQ ID NO: 521074 - DNA, 23 bp, Homo sapiens
gtatttggctattaactgccaaa

SEQ ID NO: 521075 - DNA, 11 bp, Homo sapiens
gtatttgtgta

SEQ ID NO: 521076 - DNA, 13 bp, Homo sapiens
gtattttgtaaac

SEQ ID NO: 521077 - DNA, 19 bp, Homo sapiens
gtatttttgttgcagtgta

SEQ ID NO: 521078 - DNA, 16 bp, Homo sapiens
gtatttttttttctaa

SEQ ID NO: 521079 - DNA, 18 bp, Homo sapiens
gtcactggaaaggggaga

SEQ ID NO: 521080 - DNA, 14 bp, Homo sapiens
gtcatgtgtataaa

SEQ ID NO: 521081 - DNA, 13 bp, Homo sapiens
gtccattctccca

SEQ ID NO: 521082 - DNA, 15 bp, Homo sapiens
gtccattctcccagg

SEQ ID NO: 521083 - DNA, 17 bp, Homo sapiens
gtcccagcagccagcca

SEQ ID NO: 521084 - DNA, 13 bp, Homo sapiens
gtcctgatgtttt

SEQ ID NO: 521085 - DNA, 21 bp, Homo sapiens
gtctacccctctcctttcact

SEQ ID NO: 521086 - DNA, 22 bp, Homo sapiens
gtctagggcagagtatgttctt

SEQ ID NO: 521087 - DNA, 22 bp, Homo sapiens
gtctcaaaatcaactctcttat

SEQ ID NO: 521088 - DNA, 19 bp, Homo sapiens
gtctcaccatttccccagg

SEQ ID NO: 521089 - DNA, 15 bp, Homo sapiens
gtctcagtattttag

SEQ ID NO: 521090 - DNA, 12 bp, Homo sapiens
gtctctcacaga

SEQ ID NO: 521091 - DNA, 22 bp, Homo sapiens
gtcttattttattatttctaaa

SEQ ID NO: 521092 - DNA, 21 bp, Homo sapiens
gtctttatttttatcccagga

SEQ ID NO: 521093 - DNA, 16 bp, Homo sapiens
gtcttttctgggatgt

SEQ ID NO: 521094 - DNA, 19 bp, Homo sapiens
gtgacatggtgcctgagag

SEQ ID NO: 521095 - DNA, 24 bp, Homo sapiens
gtgacatggtgcctgagaggcagg

SEQ ID NO: 521096 - DNA, 17 bp, Homo sapiens
gtgagaggggaggccaa

SEQ ID NO: 521097 - DNA, 21 bp, Homo sapiens
gtgagtttgagctgccttccc

SEQ ID NO: 521098 - DNA, 22 bp, Homo sapiens
gtgattccactacacctggctg

SEQ ID NO: 521099 - DNA, 23 bp, Homo sapiens
gtgattccactacacctggctga

SEQ ID NO: 521100 - DNA, 14 bp, Homo sapiens
gtgcagtcactgga

SEQ ID NO: 521101 - DNA, 16 bp, Homo sapiens
gtgcctgagaggcagg

SEQ ID NO: 521102 - DNA, 18 bp, Homo sapiens
gtgctgggaggagggaga

SEQ ID NO: 521103 - DNA, 23 bp, Homo sapiens
gtgctgggaggagggagagggag

SEQ ID NO: 521104 - DNA, 12 bp, Homo sapiens
gtgctttgtgtc

SEQ ID NO: 521105 - DNA, 13 bp, Homo sapiens
gtgctttgtgtct

SEQ ID NO: 521106 - DNA, 22 bp, Homo sapiens
gtgcttttaaaaattttgtcct

SEQ ID NO: 521107 - DNA, 15 bp, Homo sapiens
gtggaagaagggaga

SEQ ID NO: 521108 - DNA, 15 bp, Homo sapiens
gtggaattacttaaa

SEQ ID NO: 521109 - DNA, 18 bp, Homo sapiens
gtggagaatcacaggctg

SEQ ID NO: 521110 - DNA, 22 bp, Homo sapiens
gtggagactgctcctgagcccc

SEQ ID NO: 521111 - DNA, 12 bp, Homo sapiens
gtggagagggaa

SEQ ID NO: 521112 - DNA, 15 bp, Homo sapiens
gtggagagggaatgt

SEQ ID NO: 521113 - DNA, 12 bp, Homo sapiens
gtggaggggtgt

SEQ ID NO: 521114 - DNA, 18 bp, Homo sapiens
gtggcagggcacagggcc

SEQ ID NO: 521115 - DNA, 19 bp, Homo sapiens
gtggcagggcacagggcct

SEQ ID NO: 521116 - DNA, 17 bp, Homo sapiens
gtgggaggtggaagaag

SEQ ID NO: 521117 - DNA, 15 bp, Homo sapiens
tccccttgccagctg

SEQ ID NO: 521118 - DNA, 16 bp, Homo sapiens
tccccttgccagctgc

SEQ ID NO: 521119 - DNA, 20 bp, Homo sapiens
tccctagctttagaccctgg

SEQ ID NO: 521120 - DNA, 14 bp, Homo sapiens
tccctcactctcag

SEQ ID NO: 521121 - DNA, 15 bp, Homo sapiens
tccctcactctcagg

SEQ ID NO: 521122 - DNA, 18 bp, Homo sapiens
tccctgcttccaggaaac

SEQ ID NO: 521123 - DNA, 21 bp, Homo sapiens
tccctgggttagactgccagc

SEQ ID NO: 521124 - DNA, 22 bp, Homo sapiens
tccctgggttagactgccagct

SEQ ID NO: 521125 - DNA, 13 bp, Homo sapiens
tccgagagggaga

SEQ ID NO: 521126 - DNA, 11 bp, Homo sapiens
tccgccagcct

SEQ ID NO: 521127 - DNA, 16 bp, Homo sapiens
tccgccagcctcctct

SEQ ID NO: 521128 - DNA, 14 bp, Homo sapiens
tccgcccctgagcc

SEQ ID NO: 521129 - DNA, 21 bp, Homo sapiens
tccgcccctgagcccactgtg

SEQ ID NO: 521130 - DNA, 15 bp, Homo sapiens
tcctaaaaggcccag

SEQ ID NO: 521131 - DNA, 15 bp, Homo sapiens
tcctaatttctcctc

SEQ ID NO: 521132 - DNA, 16 bp, Homo sapiens
tcctaatttctcctcc

SEQ ID NO: 521133 - DNA, 22 bp, Homo sapiens
tcctagctggagaggagccctg

SEQ ID NO: 521134 - DNA, 23 bp, Homo sapiens
tcctagctggagaggagccctgc

SEQ ID NO: 521135 - DNA, 24 bp, Homo sapiens
tcctagctggagaggagccctgcc

SEQ ID NO: 521136 - DNA, 16 bp, Homo sapiens
tcctcacctcatgccc

SEQ ID NO: 521137 - DNA, 21 bp, Homo sapiens
tcctcacctcatgcccacccc

SEQ ID NO: 521138 - DNA, 19 bp, Homo sapiens
tcctcagaccaggtggaat

SEQ ID NO: 521139 - DNA, 23 bp, Homo sapiens
tcctcagaccaggtggaattact

SEQ ID NO: 521140 - DNA, 19 bp, Homo sapiens
tcctccatccatgtgttcc

SEQ ID NO: 521141 - DNA, 22 bp, Homo sapiens
tcctccatccatgtgttccaaa

SEQ ID NO: 521142 - DNA, 13 bp, Homo sapiens
tcctcccttcctt

SEQ ID NO: 521143 - DNA, 19 bp, Homo sapiens
tcctcccttccttttccct

SEQ ID NO: 521144 - DNA, 21 bp, Homo sapiens
tcctcccttccttttccctgc

SEQ ID NO: 521145 - DNA, 14 bp, Homo sapiens
tcctctagaagcca

SEQ ID NO: 521146 - DNA, 16 bp, Homo sapiens
tcctctagaagccaag

SEQ ID NO: 521147 - DNA, 11 bp, Homo sapiens
tcctctgcctg

SEQ ID NO: 521148 - DNA, 15 bp, Homo sapiens
tcctctggacggcag

SEQ ID NO: 521149 - DNA, 18 bp, Homo sapiens
tcctctggacggcaggct

SEQ ID NO: 521150 - DNA, 24 bp, Homo sapiens
tcctctggacggcaggctcactgc

SEQ ID NO: 521151 - DNA, 16 bp, Homo sapiens
tcctgagaagtagagt

SEQ ID NO: 521152 - DNA, 19 bp, Homo sapiens
tcctgagcccccagcttcc

SEQ ID NO: 521153 - DNA, 14 bp, Homo sapiens
tcctgcgtcctcct

SEQ ID NO: 521154 - DNA, 16 bp, Homo sapiens
tcctgcgtcctcctca

SEQ ID NO: 521155 - DNA, 19 bp, Homo sapiens
tcctggccggtgtgggggc

SEQ ID NO: 521156 - DNA, 18 bp, Homo sapiens
tccttattgactgggtct

SEQ ID NO: 521157 - DNA, 13 bp, Homo sapiens
tccttctgggcat

SEQ ID NO: 521158 - DNA, 16 bp, Homo sapiens
tcctttcctccctccc

SEQ ID NO: 521159 - DNA, 11 bp, Homo sapiens
tccttttgcac

SEQ ID NO: 521160 - DNA, 14 bp, Homo sapiens
tccttttgcacatt

SEQ ID NO: 521161 - DNA, 18 bp, Homo sapiens
tcgcccagtcccagcagc

SEQ ID NO: 521162 - DNA, 15 bp, Homo sapiens
tctaaaacagctatt

SEQ ID NO: 521163 - DNA, 22 bp, Homo sapiens
tctaaagtcttcctattgtact

SEQ ID NO: 521164 - DNA, 15 bp, Homo sapiens
tctaaatagcccaga

SEQ ID NO: 521165 - DNA, 16 bp, Homo sapiens
tctaaatagcccagat

SEQ ID NO: 521166 - DNA, 22 bp, Homo sapiens
tctaagttgcatctttaatcct

SEQ ID NO: 521167 - DNA, 15 bp, Homo sapiens
tctagtcagtgtagt

SEQ ID NO: 521168 - DNA, 15 bp, Homo sapiens
tctcaaattttaagt

SEQ ID NO: 521169 - DNA, 19 bp, Homo sapiens
tctcacagacaggacccct

SEQ ID NO: 521170 - DNA, 22 bp, Homo sapiens
tctcacagacaggacccctgca

SEQ ID NO: 521171 - DNA, 20 bp, Homo sapiens
tctcaccatttccccagggc

SEQ ID NO: 521172 - DNA, 21 bp, Homo sapiens
tctcaccatttccccagggca

SEQ ID NO: 521173 - DNA, 13 bp, Homo sapiens
tctcactgaagct

SEQ ID NO: 521174 - DNA, 16 bp, Homo sapiens
tctcaggtctgagttg

SEQ ID NO: 521175 - DNA, 17 bp, Homo sapiens
tctcccaggtaccagct

SEQ ID NO: 521176 - DNA, 18 bp, Homo sapiens
tctcccaggtaccagctg

SEQ ID NO: 521177 - DNA, 13 bp, Homo sapiens
tctcccctgcact

SEQ ID NO: 521178 - DNA, 21 bp, Homo sapiens
tctccgccagcctcctctgga

SEQ ID NO: 521179 - DNA, 16 bp, Homo sapiens
tctccgcccctgagcc

SEQ ID NO: 521180 - DNA, 21 bp, Homo sapiens
tctccgcccctgagcccactg

SEQ ID NO: 521181 - DNA, 19 bp, Homo sapiens
tctcctatacccagcagag

SEQ ID NO: 521182 - DNA, 15 bp, Homo sapiens
tctctattctttcca

SEQ ID NO: 521183 - DNA, 20 bp, Homo sapiens
tctctattctttccatgaca

SEQ ID NO: 521184 - DNA, 19 bp, Homo sapiens
tctctcacagacaggaccc

SEQ ID NO: 521185 - DNA, 20 bp, Homo sapiens
tctctgaaggaggccacctc

SEQ ID NO: 521186 - DNA, 18 bp, Homo sapiens
tctgaaggaggccacctc

SEQ ID NO: 521187 - DNA, 19 bp, Homo sapiens
tctgaaggaggccacctcc

SEQ ID NO: 521188 - DNA, 20 bp, Homo sapiens
tctgataatttattgtcttt

SEQ ID NO: 521189 - DNA, 15 bp, Homo sapiens
tctgcaccccttctc

SEQ ID NO: 521190 - DNA, 21 bp, Homo sapiens
tctgcaccccttctctcctcc

SEQ ID NO: 521191 - DNA, 13 bp, Homo sapiens
tctgccctggctg

SEQ ID NO: 521192 - DNA, 17 bp, Homo sapiens
tctgccctggctgctgc

SEQ ID NO: 521193 - DNA, 16 bp, Homo sapiens
tctgccttaaaaccaa

SEQ ID NO: 521194 - DNA, 15 bp, Homo sapiens
tctgccttaattttt

SEQ ID NO: 521195 - DNA, 21 bp, Homo sapiens
tctgcttttctgccctggctg

SEQ ID NO: 521196 - DNA, 14 bp, Homo sapiens
tctggacggcaggc

SEQ ID NO: 521197 - DNA, 17 bp, Homo sapiens
tctggacggcaggctca

SEQ ID NO: 521198 - DNA, 19 bp, Homo sapiens
tctggacggcaggctcact

SEQ ID NO: 521199 - DNA, 14 bp, Homo sapiens
tctggcacagcctg

SEQ ID NO: 521200 - DNA, 15 bp, Homo sapiens
tctggcacagcctgc

SEQ ID NO: 521201 - DNA, 16 bp, Homo sapiens
tctggcacagcctgca

SEQ ID NO: 521202 - DNA, 17 bp, Homo sapiens
tctggcacagcctgcac

SEQ ID NO: 521203 - DNA, 22 bp, Homo sapiens
tctgggacctgccaggcagggg

SEQ ID NO: 521204 - DNA, 22 bp, Homo sapiens
tctgggatgtggtattggtgct

SEQ ID NO: 521205 - DNA, 21 bp, Homo sapiens
tctgggcttttccttttgcac

SEQ ID NO: 521206 - DNA, 23 bp, Homo sapiens
tctgtcccgtaaatcatatttcc

SEQ ID NO: 521207 - DNA, 14 bp, Homo sapiens
tctgtcttttctgg

SEQ ID NO: 521208 - DNA, 17 bp, Homo sapiens
tctgtttcctgtgtctc

SEQ ID NO: 521209 - DNA, 14 bp, Homo sapiens
tcttctctttactt

SEQ ID NO: 521210 - DNA, 22 bp, Homo sapiens
tcttctgtatttttttttctaa

SEQ ID NO: 521211 - DNA, 18 bp, Homo sapiens
tcttgaagaaaggcaaat

SEQ ID NO: 521212 - DNA, 15 bp, Homo sapiens
tcttgatgtaaaatc

SEQ ID NO: 521213 - DNA, 13 bp, Homo sapiens
tctttacttcctt

SEQ ID NO: 521214 - DNA, 20 bp, Homo sapiens
tctttccatgacacccaagg

SEQ ID NO: 521215 - DNA, 23 bp, Homo sapiens
tcttttctgggatgtggtattgg

SEQ ID NO: 521216 - DNA, 15 bp, Homo sapiens
tgaaaaagagaaaaa

SEQ ID NO: 521217 - DNA, 20 bp, Homo sapiens
tgaaaatgtctcagtatttt

SEQ ID NO: 521218 - DNA, 21 bp, Homo sapiens
tgaaaatgtctcagtatttta

SEQ ID NO: 521219 - DNA, 15 bp, Homo sapiens
tgaaacaaagaaaga

SEQ ID NO: 521220 - DNA, 17 bp, Homo sapiens
tgaaacctttttctagt

SEQ ID NO: 521221 - DNA, 19 bp, Homo sapiens
tgaacacaaatgtgtattt

SEQ ID NO: 521222 - DNA, 16 bp, Homo sapiens
tgaactctattttgat

SEQ ID NO: 521223 - DNA, 22 bp, Homo sapiens
tgaagaaaaaatggcaagagat

SEQ ID NO: 521224 - DNA, 23 bp, Homo sapiens
tgaaggaaaaacacaagcaaaaa

SEQ ID NO: 521225 - DNA, 17 bp, Homo sapiens
tgaaggaggccacctcc

SEQ ID NO: 521226 - DNA, 15 bp, Homo sapiens
tgaatgtaaatttgt

SEQ ID NO: 521227 - DNA, 20 bp, Homo sapiens
tgaattttattgaaagctca

SEQ ID NO: 521228 - DNA, 15 bp, Homo sapiens
ttaattaatgtacac

SEQ ID NO: 521229 - DNA, 21 bp, Homo sapiens
ttaatttttgaaaagctgcta

SEQ ID NO: 521230 - DNA, 13 bp, Homo sapiens
ttacatcatttct

SEQ ID NO: 521231 - DNA, 14 bp, Homo sapiens
ttacatcatttctt

SEQ ID NO: 521232 - DNA, 21 bp, Homo sapiens
ttactttgtttttattctgtt

SEQ ID NO: 521233 - DNA, 22 bp, Homo sapiens
ttactttgtttttattctgtta

SEQ ID NO: 521234 - DNA, 13 bp, Homo sapiens
ttagactgccagc

SEQ ID NO: 521235 - DNA, 15 bp, Homo sapiens
ttagagtcagagatc

SEQ ID NO: 521236 - DNA, 16 bp, Homo sapiens
ttagatccaaatgtaa

SEQ ID NO: 521237 - DNA, 19 bp, Homo sapiens
ttagatccaaatgtaaagg

SEQ ID NO: 521238 - DNA, 22 bp, Homo sapiens
ttagggaacaaggatgttttta

SEQ ID NO: 521239 - DNA, 13 bp, Homo sapiens
ttataccgcagag

SEQ ID NO: 521240 - DNA, 13 bp, Homo sapiens
ttatatctctgta

SEQ ID NO: 521241 - DNA, 19 bp, Homo sapiens
ttatattagagtcagagat

SEQ ID NO: 521242 - DNA, 15 bp, Homo sapiens
ttatttagacaagag

SEQ ID NO: 521243 - DNA, 12 bp, Homo sapiens
ttattttctaca

SEQ ID NO: 521244 - DNA, 12 bp, Homo sapiens
ttcaaagaaaga

SEQ ID NO: 521245 - DNA, 17 bp, Homo sapiens
ttcaacttatttctgaa

SEQ ID NO: 521246 - DNA, 20 bp, Homo sapiens
ttcaatgaaacaaagaaaga

SEQ ID NO: 521247 - DNA, 21 bp, Homo sapiens
ttcactctgtgtctaataatg

SEQ ID NO: 521248 - DNA, 19 bp, Homo sapiens
ttcatatttaaagccaaat

SEQ ID NO: 521249 - DNA, 14 bp, Homo sapiens
ttcatttgaaacct

SEQ ID NO: 521250 - DNA, 18 bp, Homo sapiens
ttccactacacctggctg

SEQ ID NO: 521251 - DNA, 22 bp, Homo sapiens
ttccactacacctggctgaggt

SEQ ID NO: 521252 - DNA, 21 bp, Homo sapiens
ttccaggaaactccacatctg

SEQ ID NO: 521253 - DNA, 20 bp, Homo sapiens
ttccctatttgtgaattctg

SEQ ID NO: 521254 - DNA, 21 bp, Homo sapiens
ttcccttttaaagaatttttg

SEQ ID NO: 521255 - DNA, 23 bp, Homo sapiens
ttcccttttaaagaatttttgcc

SEQ ID NO: 521256 - DNA, 18 bp, Homo sapiens
ttcctaaatataaatgaa

SEQ ID NO: 521257 - DNA, 15 bp, Homo sapiens
ttcctacacaggaca

SEQ ID NO: 521258 - DNA, 15 bp, Homo sapiens
ttcctcatgaatgta

SEQ ID NO: 521259 - DNA, 19 bp, Homo sapiens
ttcctggggcatccatggg

SEQ ID NO: 521260 - DNA, 14 bp, Homo sapiens
ttcctgtgtctcca

SEQ ID NO: 521261 - DNA, 14 bp, Homo sapiens
ttccttttccctgc

SEQ ID NO: 521262 - DNA, 15 bp, Homo sapiens
ttccttttccctgct

SEQ ID NO: 521263 - DNA, 16 bp, Homo sapiens
ttccttttccctgctt

SEQ ID NO: 521264 - DNA, 17 bp, Homo sapiens
ttctagaatcatgtatt

SEQ ID NO: 521265 - DNA, 12 bp, Homo sapiens
ttctagttatta

SEQ ID NO: 521266 - DNA, 19 bp, Homo sapiens
ttctcccctgcactgtaaa

SEQ ID NO: 521267 - DNA, 21 bp, Homo sapiens
ttctcccctgcactgtaaaat

SEQ ID NO: 521268 - DNA, 14 bp, Homo sapiens
ttctccgccagcct

SEQ ID NO: 521269 - DNA, 18 bp, Homo sapiens
ttctccgccagcctcctc

SEQ ID NO: 521270 - DNA, 19 bp, Homo sapiens
ttctccgccagcctcctct

SEQ ID NO: 521271 - DNA, 20 bp, Homo sapiens
ttctccgccagcctcctctg

SEQ ID NO: 521272 - DNA, 21 bp, Homo sapiens
ttctccgccagcctcctctgg

SEQ ID NO: 521273 - DNA, 15 bp, Homo sapiens
ttctctcctccccaa

SEQ ID NO: 521274 - DNA, 13 bp, Homo sapiens
ttctgaaaaagag

SEQ ID NO: 521275 - DNA, 17 bp, Homo sapiens
ttctgatcagtctgtct

SEQ ID NO: 521276 - DNA, 20 bp, Homo sapiens
ttctgatcagtctgtctgga

SEQ ID NO: 521277 - DNA, 16 bp, Homo sapiens
ttctgccctggctgct

SEQ ID NO: 521278 - DNA, 22 bp, Homo sapiens
ttctgggcttttccttttgcac

SEQ ID NO: 521279 - DNA, 20 bp, Homo sapiens
ttctgtatttttttttctaa

SEQ ID NO: 521280 - DNA, 14 bp, Homo sapiens
ttctgtttcctgtg

SEQ ID NO: 521281 - DNA, 19 bp, Homo sapiens
ttcttcaaaaagcatttta

SEQ ID NO: 521282 - DNA, 12 bp, Homo sapiens
ttcttctcttta

SEQ ID NO: 521283 - DNA, 11 bp, Homo sapiens
ttctttcctaa

SEQ ID NO: 521284 - DNA, 17 bp, Homo sapiens
ttctttctaaaacacat

SEQ ID NO: 521285 - DNA, 18 bp, Homo sapiens
ttctttctaaaacacatt

SEQ ID NO: 521286 - DNA, 19 bp, Homo sapiens
ttcttttcctccatgatgt

SEQ ID NO: 521287 - DNA, 19 bp, Homo sapiens
ttctttttgggagagactt

SEQ ID NO: 521288 - DNA, 21 bp, Homo sapiens
ttctttttgggagagacttgt

SEQ ID NO: 521289 - DNA, 14 bp, Homo sapiens
ttgaaaagctgcta

SEQ ID NO: 521290 - DNA, 19 bp, Homo sapiens
ttgaattttttttaacatt

SEQ ID NO: 521291 - DNA, 22 bp, Homo sapiens
ttgaattttttttaacattcct

SEQ ID NO: 521292 - DNA, 20 bp, Homo sapiens
ttgagccgggcccctgggct

SEQ ID NO: 521293 - DNA, 16 bp, Homo sapiens
ttgagctgccttccct

SEQ ID NO: 521294 - DNA, 22 bp, Homo sapiens
ttgagtggggggaacgcccact

SEQ ID NO: 521295 - DNA, 15 bp, Homo sapiens
ttgatgtaaaatctt

SEQ ID NO: 521296 - DNA, 21 bp, Homo sapiens
ttgatgtaaaatcttgtcatg

SEQ ID NO: 521297 - DNA, 12 bp, Homo sapiens
ttgcaggcaagc

SEQ ID NO: 521298 - DNA, 14 bp, Homo sapiens
ttgcaggcaagcct

SEQ ID NO: 521299 - DNA, 22 bp, Homo sapiens
ttgcctccccatttcccatctg

SEQ ID NO: 521300 - DNA, 20 bp, Homo sapiens
ttgcttctctattgcaagca

SEQ ID NO: 521301 - DNA, 13 bp, Homo sapiens
ttggatcctgtgt

SEQ ID NO: 521302 - DNA, 22 bp, Homo sapiens
ttggcatcctggcattctcaaa

SEQ ID NO: 521303 - DNA, 21 bp, Homo sapiens
ttggcccagggggcttcctga

SEQ ID NO: 521304 - DNA, 12 bp, Homo sapiens
ttggcctgctgt

SEQ ID NO: 521305 - DNA, 15 bp, Homo sapiens
ttgggacccagtggc

SEQ ID NO: 521306 - DNA, 17 bp, Homo sapiens
ttggtgctttgtgtcta

SEQ ID NO: 521307 - DNA, 19 bp, Homo sapiens
ttggttcttgacagtgaga

SEQ ID NO: 521308 - DNA, 14 bp, Homo sapiens
ttgtacatattttt

SEQ ID NO: 521309 - DNA, 16 bp, Homo sapiens
ttgtacatatttttat

SEQ ID NO: 521310 - DNA, 14 bp, Homo sapiens
ttgtcatgtgtata

SEQ ID NO: 521311 - DNA, 14 bp, Homo sapiens
ttgtcatttccaaa

SEQ ID NO: 521312 - DNA, 17 bp, Homo sapiens
ttgtgtaattttaaagt

SEQ ID NO: 521313 - DNA, 14 bp, Homo sapiens
ttgttttgtgtttt

SEQ ID NO: 521314 - DNA, 18 bp, Homo sapiens
ttgtttttattctgttaa

SEQ ID NO: 521315 - DNA, 16 bp, Homo sapiens
ttgtttttttcttttc

SEQ ID NO: 521316 - DNA, 23 bp, Homo sapiens
tttaaacccttgctgctgaattt

SEQ ID NO: 521317 - DNA, 20 bp, Homo sapiens
tttaaagcctgaaaattcca

SEQ ID NO: 521318 - DNA, 11 bp, Homo sapiens
tttaactgact

SEQ ID NO: 521319 - DNA, 19 bp, Homo sapiens
tttaacttcatttttctaa

SEQ ID NO: 521320 - DNA, 11 bp, Homo sapiens
tttagttgaat

SEQ ID NO: 521321 - DNA, 13 bp, Homo sapiens
tttataaagttta

SEQ ID NO: 521322 - DNA, 17 bp, Homo sapiens
tttataaagtttatcag

SEQ ID NO: 521323 - DNA, 16 bp, Homo sapiens
tttatatattatgtct

SEQ ID NO: 521324 - DNA, 17 bp, Homo sapiens
tttatatattatgtctt

SEQ ID NO: 521325 - DNA, 13 bp, Homo sapiens
tttattgaaagct

SEQ ID NO: 521326 - DNA, 13 bp, Homo sapiens
tttcaacttattt

SEQ ID NO: 521327 - DNA, 18 bp, Homo sapiens
tttcaacttatttctgaa

SEQ ID NO: 521328 - DNA, 20 bp, Homo sapiens
tttcacagtgtgattttgat

SEQ ID NO: 521329 - DNA, 21 bp, Homo sapiens
tttcagtgcagtaatttctga

SEQ ID NO: 521330 - DNA, 17 bp, Homo sapiens
tttcatatttaaagcca

SEQ ID NO: 521331 - DNA, 21 bp, Homo sapiens
tttcatgtaacttttttattt

SEQ ID NO: 521332 - DNA, 17 bp, Homo sapiens
tttccaaattcctagaa

SEQ ID NO: 521333 - DNA, 14 bp, Homo sapiens
tttccccagggcac

SEQ ID NO: 521334 - DNA, 16 bp, Homo sapiens
tttcccttttctgtgt

SEQ ID NO: 521335 - DNA, 15 bp, Homo sapiens
tttcctgtgtctcca

SEQ ID NO: 521336 - DNA, 15 bp, Homo sapiens
tttctcactgaagct

SEQ ID NO: 521337 - DNA, 17 bp, Homo sapiens
tttctctattctttcca

SEQ ID NO: 521338 - DNA, 13 bp, Homo sapiens
tttctgccctggc

SEQ ID NO: 521339 - DNA, 20 bp, Homo sapiens
tttctgccctggctgctgcc

SEQ ID NO: 521340 - DNA, 12 bp, Homo sapiens
aaaaaataatat

SEQ ID NO: 521341 - DNA, 13 bp, Homo sapiens
aaaaaatatgaga

SEQ ID NO: 521342 - DNA, 23 bp, Homo sapiens
aaaaactttccatgacagtagca

SEQ ID NO: 521343 - DNA, 14 bp, Homo sapiens
aaaaagacttcaaa

SEQ ID NO: 521344 - DNA, 16 bp, Homo sapiens
aaaaataatataaatg

SEQ ID NO: 521345 - DNA, 20 bp, Homo sapiens
aaaaataatataaatgaatg

SEQ ID NO: 521346 - DNA, 16 bp, Homo sapiens
aaaaattatctttaaa

SEQ ID NO: 521347 - DNA, 20 bp, Homo sapiens
aaaaattatctttaaaactt

SEQ ID NO: 521348 - DNA, 19 bp, Homo sapiens
aaaaattgaagagagatat

SEQ ID NO: 521349 - DNA, 22 bp, Homo sapiens
aaaactgtgacattccacagag

SEQ ID NO: 521350 - DNA, 12 bp, Homo sapiens
aaaactttccat

SEQ ID NO: 521351 - DNA, 15 bp, Homo sapiens
aaaactttccatgac

SEQ ID NO: 521352 - DNA, 22 bp, Homo sapiens
aaaactttccatgacagtagca

SEQ ID NO: 521353 - DNA, 14 bp, Homo sapiens
aaaagacatccaca

SEQ ID NO: 521354 - DNA, 22 bp, Homo sapiens
aaaagatggatttgacacactc

SEQ ID NO: 521355 - DNA, 21 bp, Homo sapiens
aaaagtgatgtgatttatgca

SEQ ID NO: 521356 - DNA, 15 bp, Homo sapiens
aaaataatataaatg

SEQ ID NO: 521357 - DNA, 15 bp, Homo sapiens
aaaatagctataaat

SEQ ID NO: 521358 - DNA, 19 bp, Homo sapiens
aaaatatgagattggaaaa

SEQ ID NO: 521359 - DNA, 22 bp, Homo sapiens
aaaattatctttaaaacttact

SEQ ID NO: 521360 - DNA, 19 bp, Homo sapiens
aaaattattaaaaattata

SEQ ID NO: 521361 - DNA, 20 bp, Homo sapiens
aaaattattaaaaattatag

SEQ ID NO: 521362 - DNA, 21 bp, Homo sapiens
aaaattattaaaaattataga

SEQ ID NO: 521363 - DNA, 15 bp, Homo sapiens
aaacaaaaactttcc

SEQ ID NO: 521364 - DNA, 17 bp, Homo sapiens
aaacaaaaactttccat

SEQ ID NO: 521365 - DNA, 20 bp, Homo sapiens
aaacaaattcaagaatgcag

SEQ ID NO: 521366 - DNA, 15 bp, Homo sapiens
aaacaaattccttcc

SEQ ID NO: 521367 - DNA, 12 bp, Homo sapiens
aaacaacagcaa

SEQ ID NO: 521368 - DNA, 13 bp, Homo sapiens
aaacaattcaaag

SEQ ID NO: 521369 - DNA, 17 bp, Homo sapiens
aaacatttccctgctga

SEQ ID NO: 521370 - DNA, 13 bp, Homo sapiens
aaactgatgcttt

SEQ ID NO: 521371 - DNA, 14 bp, Homo sapiens
accggcactgtgca

SEQ ID NO: 521372 - DNA, 22 bp, Homo sapiens
accggggtggagtcagggctgt

SEQ ID NO: 521373 - DNA, 22 bp, Homo sapiens
acctaccctggaccgagtggac

SEQ ID NO: 521374 - DNA, 16 bp, Homo sapiens
acctactcctccccct

SEQ ID NO: 521375 - DNA, 15 bp, Homo sapiens
acctcgccgtgtctt

SEQ ID NO: 521376 - DNA, 23 bp, Homo sapiens
acctcgtccatttaaacccggct

SEQ ID NO: 521377 - DNA, 19 bp, Homo sapiens
acctctctgaactgcaaca

SEQ ID NO: 521378 - DNA, 20 bp, Homo sapiens
acctgtaatagcctcacctt

SEQ ID NO: 521379 - DNA, 22 bp, Homo sapiens
accttctgtgcatctggcctgg

SEQ ID NO: 521380 - DNA, 23 bp, Homo sapiens
accttctgtgcatctggcctggg

SEQ ID NO: 521381 - DNA, 21 bp, Homo sapiens
accttgcattttagctaattt

SEQ ID NO: 521382 - DNA, 20 bp, Homo sapiens
accttttaaaaaaataatat

SEQ ID NO: 521383 - DNA, 22 bp, Homo sapiens
accttttaaaaaaataatataa

SEQ ID NO: 521384 - DNA, 15 bp, Homo sapiens
acgaggcggcaaaga

SEQ ID NO: 521385 - DNA, 15 bp, Homo sapiens
acgcatgcagggccc

SEQ ID NO: 521386 - DNA, 23 bp, Homo sapiens
acggcctgagaggagcgtgtcct

SEQ ID NO: 521387 - DNA, 21 bp, Homo sapiens
actaaaagtgatgtgatttat

SEQ ID NO: 521388 - DNA, 21 bp, Homo sapiens
actaccccaggacgcatgcag

SEQ ID NO: 521389 - DNA, 18 bp, Homo sapiens
actatttattaaaaccat

SEQ ID NO: 521390 - DNA, 22 bp, Homo sapiens
actcaccatttaatcatttcca

SEQ ID NO: 521391 - DNA, 15 bp, Homo sapiens
actcaggcagcctgt

SEQ ID NO: 521392 - DNA, 23 bp, Homo sapiens
actcaggtttccggctactgaca

SEQ ID NO: 521393 - DNA, 13 bp, Homo sapiens
actcatgtgattt

SEQ ID NO: 521394 - DNA, 19 bp, Homo sapiens
actcctccccctcctccat

SEQ ID NO: 521395 - DNA, 20 bp, Homo sapiens
actgatgagacaacacacac

SEQ ID NO: 521396 - DNA, 21 bp, Homo sapiens
actgatgagacaacacacaca

SEQ ID NO: 521397 - DNA, 14 bp, Homo sapiens
actgcaacactgga

SEQ ID NO: 521398 - DNA, 21 bp, Homo sapiens
actgcccctgcacctgcttct

SEQ ID NO: 521399 - DNA, 23 bp, Homo sapiens
actgcccctgcacctgcttctca

SEQ ID NO: 521400 - DNA, 14 bp, Homo sapiens
actgctttgagaaa

SEQ ID NO: 521401 - DNA, 19 bp, Homo sapiens
actgtcccggagctcaggc

SEQ ID NO: 521402 - DNA, 19 bp, Homo sapiens
actgtgacattccacagag

SEQ ID NO: 521403 - DNA, 21 bp, Homo sapiens
actgtgacattccacagagtt

SEQ ID NO: 521404 - DNA, 19 bp, Homo sapiens
actgtgagataaatatcat

SEQ ID NO: 521405 - DNA, 20 bp, Homo sapiens
actgttcatgaatacgtaaa

SEQ ID NO: 521406 - DNA, 13 bp, Homo sapiens
actgttttgtgcg

SEQ ID NO: 521407 - DNA, 20 bp, Homo sapiens
acttaaacaaaaactttcca

SEQ ID NO: 521408 - DNA, 14 bp, Homo sapiens
acttactatggtat

SEQ ID NO: 521409 - DNA, 22 bp, Homo sapiens
acttctattttcaagtggaaac

SEQ ID NO: 521410 - DNA, 15 bp, Homo sapiens
acttctcaaatgcta

SEQ ID NO: 521411 - DNA, 21 bp, Homo sapiens
acttctcaaatgctactcagt

SEQ ID NO: 521412 - DNA, 20 bp, Homo sapiens
acttctttactaacactggc

SEQ ID NO: 521413 - DNA, 23 bp, Homo sapiens
acttgaaattatatctgtggtct

SEQ ID NO: 521414 - DNA, 14 bp, Homo sapiens
acttgctgtgactt

SEQ ID NO: 521415 - DNA, 15 bp, Homo sapiens
acttgggctggcacc

SEQ ID NO: 521416 - DNA, 14 bp, Homo sapiens
actttccatgacag

SEQ ID NO: 521417 - DNA, 17 bp, Homo sapiens
actttccatgacagtag

SEQ ID NO: 521418 - DNA, 16 bp, Homo sapiens
actttggatcaggaaa

SEQ ID NO: 521419 - DNA, 21 bp, Homo sapiens
actttgtgtcttttgttctct

SEQ ID NO: 521420 - DNA, 23 bp, Homo sapiens
actttgtgtcttttgttctctct

SEQ ID NO: 521421 - DNA, 15 bp, Homo sapiens
agaaacaatttctgt

SEQ ID NO: 521422 - DNA, 21 bp, Homo sapiens
agaaattagggctctaatttc

SEQ ID NO: 521423 - DNA, 12 bp, Homo sapiens
agaacaacaaca

SEQ ID NO: 521424 - DNA, 20 bp, Homo sapiens
agaactaaatagatttttag

SEQ ID NO: 521425 - DNA, 16 bp, Homo sapiens
agaagtgaaaaagact

SEQ ID NO: 521426 - DNA, 21 bp, Homo sapiens
agaagtgaaaaagacttcaaa

SEQ ID NO: 521427 - DNA, 23 bp, Homo sapiens
agaataaagccttgtgatcactt

SEQ ID NO: 521428 - DNA, 16 bp, Homo sapiens
agaatcaagtctgtga

SEQ ID NO: 521429 - DNA, 23 bp, Homo sapiens
agaatgttgaaactgacttgctg

SEQ ID NO: 521430 - DNA, 13 bp, Homo sapiens
agaattttaaaaa

SEQ ID NO: 521431 - DNA, 14 bp, Homo sapiens
agacaacacacaca

SEQ ID NO: 521432 - DNA, 18 bp, Homo sapiens
agacaagtctagtggaac

SEQ ID NO: 521433 - DNA, 22 bp, Homo sapiens
agacaatgtggaattacataac

SEQ ID NO: 521434 - DNA, 12 bp, Homo sapiens
agacactgtcaa

SEQ ID NO: 521435 - DNA, 16 bp, Homo sapiens
agacatccacaatgga

SEQ ID NO: 521436 - DNA, 14 bp, Homo sapiens
agaccacgcccctg

SEQ ID NO: 521437 - DNA, 18 bp, Homo sapiens
agaccacgcccctgcctg

SEQ ID NO: 521438 - DNA, 19 bp, Homo sapiens
agaccacgcccctgcctga

SEQ ID NO: 521439 - DNA, 19 bp, Homo sapiens
agacccctttgccttcccc

SEQ ID NO: 521440 - DNA, 14 bp, Homo sapiens
agaccggggtggag

SEQ ID NO: 521441 - DNA, 23 bp, Homo sapiens
agaccggggtggagtcagggctg

SEQ ID NO: 521442 - DNA, 21 bp, Homo sapiens
agagagcaatcttgctgtgaa

SEQ ID NO: 521443 - DNA, 22 bp, Homo sapiens
agagagcaatcttgctgtgaaa

SEQ ID NO: 521444 - DNA, 18 bp, Homo sapiens
agagagggggagacccct

SEQ ID NO: 521445 - DNA, 20 bp, Homo sapiens
agagatagccgggctccagg

SEQ ID NO: 521446 - DNA, 16 bp, Homo sapiens
agagatatatctgaaa

SEQ ID NO: 521447 - DNA, 19 bp, Homo sapiens
agagcaatcttgctgtgaa

SEQ ID NO: 521448 - DNA, 16 bp, Homo sapiens
agagctatgcacacca

SEQ ID NO: 521449 - DNA, 22 bp, Homo sapiens
agagctatgcacaccaaattgc

SEQ ID NO: 521450 - DNA, 23 bp, Homo sapiens
agaggacggcttccccatcgcct

SEQ ID NO: 521451 - DNA, 14 bp, Homo sapiens
agaggagcaaacag

SEQ ID NO: 521452 - DNA, 18 bp, Homo sapiens
agaggagcaaacaggaaa

SEQ ID NO: 521453 - DNA, 15 bp, Homo sapiens
agaggagcgtgtcct

SEQ ID NO: 521454 - DNA, 20 bp, Homo sapiens
agataattaaatgaaatact

SEQ ID NO: 521455 - DNA, 20 bp, Homo sapiens
agatagccgggctccaggga

SEQ ID NO: 521456 - DNA, 23 bp, Homo sapiens
agatatgagaaatataaaaataa

SEQ ID NO: 521457 - DNA, 15 bp, Homo sapiens
agatcaactcatgtt

SEQ ID NO: 521458 - DNA, 21 bp, Homo sapiens
agatgtttagtagctgataaa

SEQ ID NO: 521459 - DNA, 18 bp, Homo sapiens
agattcctacttaaacaa

SEQ ID NO: 521460 - DNA, 21 bp, Homo sapiens
agattcctacttaaacaaaaa

SEQ ID NO: 521461 - DNA, 13 bp, Homo sapiens
agatttttagatt

SEQ ID NO: 521462 - DNA, 13 bp, Homo sapiens
agcaaaatatatg

SEQ ID NO: 521463 - DNA, 13 bp, Homo sapiens
agcaatcttgctg

SEQ ID NO: 521464 - DNA, 19 bp, Homo sapiens
agcaatcttgctgtgaaac

SEQ ID NO: 521465 - DNA, 21 bp, Homo sapiens
agcacagagagcggcttcccc

SEQ ID NO: 521466 - DNA, 22 bp, Homo sapiens
agcacagagagcggcttcccca

SEQ ID NO: 521467 - DNA, 13 bp, Homo sapiens
agcaccagcttgc

SEQ ID NO: 521468 - DNA, 16 bp, Homo sapiens
agcagtaaatgtatat

SEQ ID NO: 521469 - DNA, 20 bp, Homo sapiens
agcagttttcttttaatttt

SEQ ID NO: 521470 - DNA, 16 bp, Homo sapiens
agcatgctcagtattg

SEQ ID NO: 521471 - DNA, 22 bp, Homo sapiens
agtttgtgaagtgattgacatt

SEQ ID NO: 521472 - DNA, 16 bp, Homo sapiens
ataaaaataattaaaa

SEQ ID NO: 521473 - DNA, 15 bp, Homo sapiens
ataaaatctgtattg

SEQ ID NO: 521474 - DNA, 18 bp, Homo sapiens
ataaacacagattatttg

SEQ ID NO: 521475 - DNA, 10 bp, Homo sapiens
ataaactgtg

SEQ ID NO: 521476 - DNA, 16 bp, Homo sapiens
ataaactgtgagataa

SEQ ID NO: 521477 - DNA, 15 bp, Homo sapiens
ataaagaaacctttt

SEQ ID NO: 521478 - DNA, 22 bp, Homo sapiens
ataaatagtgaaaattttattg

SEQ ID NO: 521479 - DNA, 16 bp, Homo sapiens
ataaatatcattatag

SEQ ID NO: 521480 - DNA, 12 bp, Homo sapiens
ataacacacatc

SEQ ID NO: 521481 - DNA, 16 bp, Homo sapiens
ataaggcctcatcctc

SEQ ID NO: 521482 - DNA, 14 bp, Homo sapiens
ataatataaatgaa

SEQ ID NO: 521483 - DNA, 18 bp, Homo sapiens
ataatataaatgaatgaa

SEQ ID NO: 521484 - DNA, 19 bp, Homo sapiens
ataatggcctcttaaaaat

SEQ ID NO: 521485 - DNA, 13 bp, Homo sapiens
ataattaaaacaa

SEQ ID NO: 521486 - DNA, 14 bp, Homo sapiens
ataccattttgaaa

SEQ ID NO: 521487 - DNA, 16 bp, Homo sapiens
atactatttattaaaa

SEQ ID NO: 521488 - DNA, 21 bp, Homo sapiens
atactgatgagacaacacaca

SEQ ID NO: 521489 - DNA, 20 bp, Homo sapiens
atacttatttataacattgt

SEQ ID NO: 521490 - DNA, 18 bp, Homo sapiens
atacttgacaacattttt

SEQ ID NO: 521491 - DNA, 13 bp, Homo sapiens
atacttggtcctt

SEQ ID NO: 521492 - DNA, 17 bp, Homo sapiens
atacttggtccttaaaa

SEQ ID NO: 521493 - DNA, 17 bp, Homo sapiens
atagagacttctaaatc

SEQ ID NO: 521494 - DNA, 18 bp, Homo sapiens
atagataccattttgaaa

SEQ ID NO: 521495 - DNA, 14 bp, Homo sapiens
atagatttttagat

SEQ ID NO: 521496 - DNA, 17 bp, Homo sapiens
atagccgggctccaggg

SEQ ID NO: 521497 - DNA, 17 bp, Homo sapiens
atagctataaatagtga

SEQ ID NO: 521498 - DNA, 23 bp, Homo sapiens
atagctccttcatgcttttctca

SEQ ID NO: 521499 - DNA, 16 bp, Homo sapiens
atagtttgaattcatg

SEQ ID NO: 521500 - DNA, 12 bp, Homo sapiens
atataaactgtg

SEQ ID NO: 521501 - DNA, 14 bp, Homo sapiens
atataaactgtgag

SEQ ID NO: 521502 - DNA, 14 bp, Homo sapiens
atataaatgaatga

SEQ ID NO: 521503 - DNA, 18 bp, Homo sapiens
atataatggcctcttaaa

SEQ ID NO: 521504 - DNA, 21 bp, Homo sapiens
atatagagacttctaaatcat

SEQ ID NO: 521505 - DNA, 18 bp, Homo sapiens
atatatctgaaaactgga

SEQ ID NO: 521506 - DNA, 19 bp, Homo sapiens
atatatgaaaactaagttc

SEQ ID NO: 521507 - DNA, 17 bp, Homo sapiens
atatcattatagcatgt

SEQ ID NO: 521508 - DNA, 16 bp, Homo sapiens
atatctgaaaactgga

SEQ ID NO: 521509 - DNA, 17 bp, Homo sapiens
atatctgtttgcttcta

SEQ ID NO: 521510 - DNA, 16 bp, Homo sapiens
atatgaaaactaagtt

SEQ ID NO: 521511 - DNA, 19 bp, Homo sapiens
atatgagaaatataaaaat

SEQ ID NO: 521512 - DNA, 22 bp, Homo sapiens
atatgagaaatataaaaataat

SEQ ID NO: 521513 - DNA, 13 bp, Homo sapiens
atatgtctttaaa

SEQ ID NO: 521514 - DNA, 15 bp, Homo sapiens
atatgtttggctgaa

SEQ ID NO: 521515 - DNA, 19 bp, Homo sapiens
atatgtttggctgaaatta

SEQ ID NO: 521516 - DNA, 23 bp, Homo sapiens
atattaaaaagccaagtgtcctg

SEQ ID NO: 521517 - DNA, 23 bp, Homo sapiens
atattatttgctaattaaaaagt

SEQ ID NO: 521518 - DNA, 18 bp, Homo sapiens
atattgatgtaactgtgt

SEQ ID NO: 521519 - DNA, 19 bp, Homo sapiens
atattttctgagtagcata

SEQ ID NO: 521520 - DNA, 12 bp, Homo sapiens
atattttgaaag

SEQ ID NO: 521521 - DNA, 18 bp, Homo sapiens
atcaccgggaacgccccc

SEQ ID NO: 521522 - DNA, 20 bp, Homo sapiens
atcacctaattaatttcagt

SEQ ID NO: 521523 - DNA, 23 bp, Homo sapiens
atcagtacaattctttgttgctt

SEQ ID NO: 521524 - DNA, 22 bp, Homo sapiens
atcagtccacccccattgtgaa

SEQ ID NO: 521525 - DNA, 15 bp, Homo sapiens
atcatgtgtttctgt

SEQ ID NO: 521526 - DNA, 21 bp, Homo sapiens
attatgtcaaatggatgtaat

SEQ ID NO: 521527 - DNA, 15 bp, Homo sapiens
attattaaaaattat

SEQ ID NO: 521528 - DNA, 14 bp, Homo sapiens
attcaaagaatcac

SEQ ID NO: 521529 - DNA, 18 bp, Homo sapiens
attcaataactattgctg

SEQ ID NO: 521530 - DNA, 14 bp, Homo sapiens
attcacttttattg

SEQ ID NO: 521531 - DNA, 15 bp, Homo sapiens
attcacttttattgt

SEQ ID NO: 521532 - DNA, 21 bp, Homo sapiens
attcagcatcgtgtgggtccc

SEQ ID NO: 521533 - DNA, 22 bp, Homo sapiens
attcccatggtagactgtgaca

SEQ ID NO: 521534 - DNA, 18 bp, Homo sapiens
attcccttcaatgcaaaa

SEQ ID NO: 521535 - DNA, 13 bp, Homo sapiens
attcctacttaaa

SEQ ID NO: 521536 - DNA, 14 bp, Homo sapiens
attcctacttaaac

SEQ ID NO: 521537 - DNA, 15 bp, Homo sapiens
attcctacttaaaca

SEQ ID NO: 521538 - DNA, 19 bp, Homo sapiens
attcctacttaaacaaaaa

SEQ ID NO: 521539 - DNA, 22 bp, Homo sapiens
attcctacttaaacaaaaactt

SEQ ID NO: 521540 - DNA, 13 bp, Homo sapiens
attcctcccctgg

SEQ ID NO: 521541 - DNA, 14 bp, Homo sapiens
attcctcccctgga

SEQ ID NO: 521542 - DNA, 17 bp, Homo sapiens
attcctgaccctcactt

SEQ ID NO: 521543 - DNA, 21 bp, Homo sapiens
attctgtttatgttcttgcag

SEQ ID NO: 521544 - DNA, 18 bp, Homo sapiens
attctttcaatccacagt

SEQ ID NO: 521545 - DNA, 22 bp, Homo sapiens
attctttcaatccacagtattg

SEQ ID NO: 521546 - DNA, 14 bp, Homo sapiens
attctttgttgctt

SEQ ID NO: 521547 - DNA, 12 bp, Homo sapiens
attgacaagttt

SEQ ID NO: 521548 - DNA, 17 bp, Homo sapiens
attgagacactgtcaag

SEQ ID NO: 521549 - DNA, 22 bp, Homo sapiens
attgagttggttacctattgct

SEQ ID NO: 521550 - DNA, 18 bp, Homo sapiens
attgcactaaaagtgatg

SEQ ID NO: 521551 - DNA, 15 bp, Homo sapiens
attgctccattcctg

SEQ ID NO: 521552 - DNA, 13 bp, Homo sapiens
attgctgagatgt

SEQ ID NO: 521553 - DNA, 21 bp, Homo sapiens
attgctgtaaataaaaatagc

SEQ ID NO: 521554 - DNA, 22 bp, Homo sapiens
attgctgtaaataaaaatagct

SEQ ID NO: 521555 - DNA, 15 bp, Homo sapiens
attggaaaaaattag

SEQ ID NO: 521556 - DNA, 18 bp, Homo sapiens
attgtcttttgtcatgtg

SEQ ID NO: 521557 - DNA, 20 bp, Homo sapiens
attgtcttttgtcatgtggc

SEQ ID NO: 521558 - DNA, 21 bp, Homo sapiens
atttaatcatttccagcaaaa

SEQ ID NO: 521559 - DNA, 22 bp, Homo sapiens
atttaggaatgctcaatgtgct

SEQ ID NO: 521560 - DNA, 15 bp, Homo sapiens
atttatgcatgagaa

SEQ ID NO: 521561 - DNA, 12 bp, Homo sapiens
atttatgcattt

SEQ ID NO: 521562 - DNA, 18 bp, Homo sapiens
atttatgcatttatgcat

SEQ ID NO: 521563 - DNA, 14 bp, Homo sapiens
atttattctaatta

SEQ ID NO: 521564 - DNA, 11 bp, Homo sapiens
atttattctgg

SEQ ID NO: 521565 - DNA, 21 bp, Homo sapiens
atttcagtaagatcaagctcc

SEQ ID NO: 521566 - DNA, 16 bp, Homo sapiens
atttcatgattagaca

SEQ ID NO: 521567 - DNA, 17 bp, Homo sapiens
atttcatgattagacaa

SEQ ID NO: 521568 - DNA, 16 bp, Homo sapiens
cactttgggaggctga

SEQ ID NO: 521569 - DNA, 16 bp, Homo sapiens
cagaagcagttgcaat

SEQ ID NO: 521570 - DNA, 20 bp, Homo sapiens
cagaccacactctgcctggc

SEQ ID NO: 521571 - DNA, 18 bp, Homo sapiens
cagaccggggtggagtca

SEQ ID NO: 521572 - DNA, 14 bp, Homo sapiens
cagaggatggcttc

SEQ ID NO: 521573 - DNA, 13 bp, Homo sapiens
cagcaaaatatat

SEQ ID NO: 521574 - DNA, 18 bp, Homo sapiens
cagcaaaatatatgtttg

SEQ ID NO: 521575 - DNA, 15 bp, Homo sapiens
cagcacagagagcgg

SEQ ID NO: 521576 - DNA, 24 bp, Homo sapiens
cagcaggttgtgtgtgtgtgcagt

SEQ ID NO: 521577 - DNA, 14 bp, Homo sapiens
cagccctccgccag

SEQ ID NO: 521578 - DNA, 12 bp, Homo sapiens
cagccctgcacg

SEQ ID NO: 521579 - DNA, 14 bp, Homo sapiens
cagcctgcacagtg

SEQ ID NO: 521580 - DNA, 19 bp, Homo sapiens
cagcctgtgaactgccagg

SEQ ID NO: 521581 - DNA, 23 bp, Homo sapiens
cagcgcaacagctgtgtgtgccc

SEQ ID NO: 521582 - DNA, 17 bp, Homo sapiens
cagcgctgaacagaccg

SEQ ID NO: 521583 - DNA, 19 bp, Homo sapiens
cagctaagcctgatgatgg

SEQ ID NO: 521584 - DNA, 20 bp, Homo sapiens
cagctacaggggaggctgag

SEQ ID NO: 521585 - DNA, 22 bp, Homo sapiens
cagctcaggctactgccactca

SEQ ID NO: 521586 - DNA, 20 bp, Homo sapiens
cagctccgcgctcggggctg

SEQ ID NO: 521587 - DNA, 15 bp, Homo sapiens
cagctctgggagccc

SEQ ID NO: 521588 - DNA, 23 bp, Homo sapiens
cagctgcagttagcacagaggat

SEQ ID NO: 521589 - DNA, 15 bp, Homo sapiens
cagctttcctgggtc

SEQ ID NO: 521590 - DNA, 19 bp, Homo sapiens
caggaagtcatcctgcaat

SEQ ID NO: 521591 - DNA, 18 bp, Homo sapiens
caggaatcaaaaattgaa

SEQ ID NO: 521592 - DNA, 16 bp, Homo sapiens
caggacgcatgcaggg

SEQ ID NO: 521593 - DNA, 17 bp, Homo sapiens
caggacgcatgcagggc

SEQ ID NO: 521594 - DNA, 15 bp, Homo sapiens
caggagcgtgtccta

SEQ ID NO: 521595 - DNA, 16 bp, Homo sapiens
caggagcttggcagag

SEQ ID NO: 521596 - DNA, 23 bp, Homo sapiens
caggagcttggcagagagatagc

SEQ ID NO: 521597 - DNA, 19 bp, Homo sapiens
caggatgaaggggccagac

SEQ ID NO: 521598 - DNA, 16 bp, Homo sapiens
caggatgcatgcaggg

SEQ ID NO: 521599 - DNA, 18 bp, Homo sapiens
caggcaccatgctgggcc

SEQ ID NO: 521600 - DNA, 21 bp, Homo sapiens
caggcattgcactaaaagtga

SEQ ID NO: 521601 - DNA, 16 bp, Homo sapiens
caggcctcagggacca

SEQ ID NO: 521602 - DNA, 15 bp, Homo sapiens
caggctcccactgcc

SEQ ID NO: 521603 - DNA, 21 bp, Homo sapiens
caggctcccactgcccctgca

SEQ ID NO: 521604 - DNA, 14 bp, Homo sapiens
cagggacagcctgc

SEQ ID NO: 521605 - DNA, 19 bp, Homo sapiens
cagggacagcctgcacagt

SEQ ID NO: 521606 - DNA, 14 bp, Homo sapiens
cagggaccaaggag

SEQ ID NO: 521607 - DNA, 19 bp, Homo sapiens
cagggatgctatctcgcta

SEQ ID NO: 521608 - DNA, 17 bp, Homo sapiens
cagggcccccacaggag

SEQ ID NO: 521609 - DNA, 15 bp, Homo sapiens
cagggcccccatgca

SEQ ID NO: 521610 - DNA, 18 bp, Homo sapiens
cagggcccccatgcaggc

SEQ ID NO: 521611 - DNA, 14 bp, Homo sapiens
caggggaggctgag

SEQ ID NO: 521612 - DNA, 18 bp, Homo sapiens
caggggagggtgcggcag

SEQ ID NO: 521613 - DNA, 15 bp, Homo sapiens
cagggtccagccctc

SEQ ID NO: 521614 - DNA, 19 bp, Homo sapiens
cagggtcctgggggctgct

SEQ ID NO: 521615 - DNA, 13 bp, Homo sapiens
cagtattgagaca

SEQ ID NO: 521616 - DNA, 13 bp, Homo sapiens
cagtcagcacaga

SEQ ID NO: 521617 - DNA, 16 bp, Homo sapiens
cagtcagcacagagag

SEQ ID NO: 521618 - DNA, 15 bp, Homo sapiens
cagtctgttcagagg

SEQ ID NO: 521619 - DNA, 13 bp, Homo sapiens
cagttctgatgag

SEQ ID NO: 521620 - DNA, 11 bp, Homo sapiens
cagtttccaag

SEQ ID NO: 521621 - DNA, 12 bp, Homo sapiens
cagtttgtgaag

SEQ ID NO: 521622 - DNA, 22 bp, Homo sapiens
cagtttgtgaagtgattgacat

SEQ ID NO: 521623 - DNA, 11 bp, Homo sapiens
cataacacaca

SEQ ID NO: 521624 - DNA, 12 bp, Homo sapiens
cataacacacat

SEQ ID NO: 521625 - DNA, 14 bp, Homo sapiens
cataacacacatca

SEQ ID NO: 521626 - DNA, 22 bp, Homo sapiens
cataacaggcattgcactaaaa

SEQ ID NO: 521627 - DNA, 21 bp, Homo sapiens
cataatcatccttttttaaaa

SEQ ID NO: 521628 - DNA, 16 bp, Homo sapiens
catactgatgagacaa

SEQ ID NO: 521629 - DNA, 18 bp, Homo sapiens
catactgatgagacaaca

SEQ ID NO: 521630 - DNA, 19 bp, Homo sapiens
cctgtgggctcacaccggc

SEQ ID NO: 521631 - DNA, 15 bp, Homo sapiens
cctgtgggtccttgc

SEQ ID NO: 521632 - DNA, 21 bp, Homo sapiens
cctgtggtttgttatcagtac

SEQ ID NO: 521633 - DNA, 13 bp, Homo sapiens
cctgtgtcatctg

SEQ ID NO: 521634 - DNA, 14 bp, Homo sapiens
cctgtgtcatctgt

SEQ ID NO: 521635 - DNA, 13 bp, Homo sapiens
cctgttccgcctc

SEQ ID NO: 521636 - DNA, 17 bp, Homo sapiens
cctgttccgcctcactg

SEQ ID NO: 521637 - DNA, 19 bp, Homo sapiens
cctgttccgcctcactggg

SEQ ID NO: 521638 - DNA, 23 bp, Homo sapiens
ccttaagtcttactgttttgtgc

SEQ ID NO: 521639 - DNA, 14 bp, Homo sapiens
ccttatcataaatt

SEQ ID NO: 521640 - DNA, 16 bp, Homo sapiens
ccttatcataaattca

SEQ ID NO: 521641 - DNA, 17 bp, Homo sapiens
ccttccctgacactgtc

SEQ ID NO: 521642 - DNA, 21 bp, Homo sapiens
ccttccctgacactgtctgct

SEQ ID NO: 521643 - DNA, 18 bp, Homo sapiens
ccttctggctgctgcagt

SEQ ID NO: 521644 - DNA, 20 bp, Homo sapiens
ccttctggctgctgcagtca

SEQ ID NO: 521645 - DNA, 24 bp, Homo sapiens
ccttctggggagggacacagagga

SEQ ID NO: 521646 - DNA, 13 bp, Homo sapiens
ccttctgtgcatc

SEQ ID NO: 521647 - DNA, 18 bp, Homo sapiens
ccttgaaaccagctcagg

SEQ ID NO: 521648 - DNA, 21 bp, Homo sapiens
ccttgcattttagctaattta

SEQ ID NO: 521649 - DNA, 18 bp, Homo sapiens
ccttgtgatcactttctg

SEQ ID NO: 521650 - DNA, 21 bp, Homo sapiens
cctttcccgatgcgtggctcc

SEQ ID NO: 521651 - DNA, 18 bp, Homo sapiens
cctttccgtgccgggagc

SEQ ID NO: 521652 - DNA, 16 bp, Homo sapiens
cctttctagcaattgc

SEQ ID NO: 521653 - DNA, 21 bp, Homo sapiens
cgacggaggcaggaccaggca

SEQ ID NO: 521654 - DNA, 20 bp, Homo sapiens
cgatccccatggaacagccc

SEQ ID NO: 521655 - DNA, 21 bp, Homo sapiens
cgatccccatggaacagccct

SEQ ID NO: 521656 - DNA, 22 bp, Homo sapiens
cgatccccatggaacagccctg

SEQ ID NO: 521657 - DNA, 14 bp, Homo sapiens
cgatgcgtggctcc

SEQ ID NO: 521658 - DNA, 23 bp, Homo sapiens
cgcatgcagggcccccactggag

SEQ ID NO: 521659 - DNA, 15 bp, Homo sapiens
cgccccgctgctccc

SEQ ID NO: 521660 - DNA, 20 bp, Homo sapiens
cgcccttccctgacactgtc

SEQ ID NO: 521661 - DNA, 24 bp, Homo sapiens
cgcctgggaaattgctccattcct

SEQ ID NO: 521662 - DNA, 19 bp, Homo sapiens
cgccttctggctgctgcag

SEQ ID NO: 521663 - DNA, 13 bp, Homo sapiens
cgccttctgggga

SEQ ID NO: 521664 - DNA, 15 bp, Homo sapiens
cgctgcagtcagcac

SEQ ID NO: 521665 - DNA, 23 bp, Homo sapiens
cgcttaaacatttccctgctgag

SEQ ID NO: 521666 - DNA, 23 bp, Homo sapiens
cgcttttgtacgttaattaaaca

SEQ ID NO: 521667 - DNA, 12 bp, Homo sapiens
cggcagggcagg

SEQ ID NO: 521668 - DNA, 17 bp, Homo sapiens
cggcagggcaggagctt

SEQ ID NO: 521669 - DNA, 19 bp, Homo sapiens
cggccaggcacggaggctc

SEQ ID NO: 521670 - DNA, 19 bp, Homo sapiens
cggcctgatggccaggcct

SEQ ID NO: 521671 - DNA, 19 bp, Homo sapiens
cggcgtccctgagggccct

SEQ ID NO: 521672 - DNA, 21 bp, Homo sapiens
cggcttccccattgccttctg

SEQ ID NO: 521673 - DNA, 21 bp, Homo sapiens
cgggcacccccggacgccccc

SEQ ID NO: 521674 - DNA, 13 bp, Homo sapiens
cgggctccaggga

SEQ ID NO: 521675 - DNA, 16 bp, Homo sapiens
cgggctccagggagtg

SEQ ID NO: 521676 - DNA, 19 bp, Homo sapiens
cgggctccagggagtgggg

SEQ ID NO: 521677 - DNA, 23 bp, Homo sapiens
cgggctccagggagtggggagga

SEQ ID NO: 521678 - DNA, 22 bp, Homo sapiens
cggggatggattggcctccagg

SEQ ID NO: 521679 - DNA, 15 bp, Homo sapiens
cggggcttctgggcg

SEQ ID NO: 521680 - DNA, 19 bp, Homo sapiens
cgggggagctttcccagag

SEQ ID NO: 521681 - DNA, 17 bp, Homo sapiens
cgggtgccccccatgcc

SEQ ID NO: 521682 - DNA, 16 bp, Homo sapiens
cggtccaatccagcct

SEQ ID NO: 521683 - DNA, 17 bp, Homo sapiens
cggtggggccagcgctg

SEQ ID NO: 521684 - DNA, 15 bp, Homo sapiens
cgtcagcctgtgaac

SEQ ID NO: 521685 - DNA, 19 bp, Homo sapiens
cgtccctgagggcccttcc

SEQ ID NO: 521686 - DNA, 16 bp, Homo sapiens
cgtggctttgtgctta

SEQ ID NO: 521687 - DNA, 23 bp, Homo sapiens
cgtggtgaggttgtgctgcctgt

SEQ ID NO: 521688 - DNA, 14 bp, Homo sapiens
cgtgtttcacagtg

SEQ ID NO: 521689 - DNA, 16 bp, Homo sapiens
cgtgtttcacagtggg

SEQ ID NO: 521690 - DNA, 21 bp, Homo sapiens
cgttgtgtgggtttactctgt

SEQ ID NO: 521691 - DNA, 15 bp, Homo sapiens
cgttgttgtccctgc

SEQ ID NO: 521692 - DNA, 12 bp, Homo sapiens
ctaaaagtgatg

SEQ ID NO: 521693 - DNA, 18 bp, Homo sapiens
ctaaaagtgatgtgattt

SEQ ID NO: 521694 - DNA, 18 bp, Homo sapiens
ctaaatagatttttagat

SEQ ID NO: 521695 - DNA, 13 bp, Homo sapiens
ctaaatcataatc

SEQ ID NO: 521696 - DNA, 15 bp, Homo sapiens
ctaaatcataatcat

SEQ ID NO: 521697 - DNA, 12 bp, Homo sapiens
ctaaatgcaaag

SEQ ID NO: 521698 - DNA, 12 bp, Homo sapiens
ctaacactggct

SEQ ID NO: 521699 - DNA, 13 bp, Homo sapiens
ctttatgatttca

SEQ ID NO: 521700 - DNA, 15 bp, Homo sapiens
ctttatgatttcatg

SEQ ID NO: 521701 - DNA, 15 bp, Homo sapiens
ctttcaatccacagt

SEQ ID NO: 521702 - DNA, 23 bp, Homo sapiens
ctttccgcgtggttctgccactt

SEQ ID NO: 521703 - DNA, 11 bp, Homo sapiens
ctttctttcca

SEQ ID NO: 521704 - DNA, 15 bp, Homo sapiens
ctttctttccaaagg

SEQ ID NO: 521705 - DNA, 16 bp, Homo sapiens
ctttggcttaattcca

SEQ ID NO: 521706 - DNA, 17 bp, Homo sapiens
ctttggttcctcatggc

SEQ ID NO: 521707 - DNA, 22 bp, Homo sapiens
ctttgttgcttaatctagagct

SEQ ID NO: 521708 - DNA, 11 bp, Homo sapiens
cttttaatttt

SEQ ID NO: 521709 - DNA, 17 bp, Homo sapiens
cttttattgtataatta

SEQ ID NO: 521710 - DNA, 13 bp, Homo sapiens
cttttctcatggt

SEQ ID NO: 521711 - DNA, 14 bp, Homo sapiens
cttttctcatggta

SEQ ID NO: 521712 - DNA, 17 bp, Homo sapiens
cttttgatggctatgtt

SEQ ID NO: 521713 - DNA, 14 bp, Homo sapiens
cttttgttctctct

SEQ ID NO: 521714 - DNA, 17 bp, Homo sapiens
cttttgttctctcttgg

SEQ ID NO: 521715 - DNA, 14 bp, Homo sapiens
cttttttaaaaaaa

SEQ ID NO: 521716 - DNA, 16 bp, Homo sapiens
cttttttcctgtcaat

SEQ ID NO: 521717 - DNA, 11 bp, Homo sapiens
gaaaaaattag

SEQ ID NO: 521718 - DNA, 17 bp, Homo sapiens
gaaaactggaataagaa

SEQ ID NO: 521719 - DNA, 24 bp, Homo sapiens
gaaacaaagcatttgactttctgt

SEQ ID NO: 521720 - DNA, 11 bp, Homo sapiens
gcaaggatcac

SEQ ID NO: 521721 - DNA, 17 bp, Homo sapiens
gcaataaactcagtcaa

SEQ ID NO: 521722 - DNA, 17 bp, Homo sapiens
gcacacataacacacat

SEQ ID NO: 521723 - DNA, 21 bp, Homo sapiens
gcacaccaaattgctgagatg

SEQ ID NO: 521724 - DNA, 18 bp, Homo sapiens
gcacactgccctctgcca

SEQ ID NO: 521725 - DNA, 11 bp, Homo sapiens
gcaccagcttg

SEQ ID NO: 521726 - DNA, 12 bp, Homo sapiens
gcacctgcttct

SEQ ID NO: 521727 - DNA, 15 bp, Homo sapiens
gcacgcctgccttct

SEQ ID NO: 521728 - DNA, 23 bp, Homo sapiens
gcactctactctgcgacgatccc

SEQ ID NO: 521729 - DNA, 11 bp, Homo sapiens
gcactgccctc

SEQ ID NO: 521730 - DNA, 13 bp, Homo sapiens
gcactgccctccg

SEQ ID NO: 521731 - DNA, 16 bp, Homo sapiens
gcactttgggaggctg

SEQ ID NO: 521732 - DNA, 22 bp, Homo sapiens
gcagaccacactctgcctggcc

SEQ ID NO: 521733 - DNA, 21 bp, Homo sapiens
gcaggagcttggcagagagat

SEQ ID NO: 521734 - DNA, 14 bp, Homo sapiens
gcagggacagcctg

SEQ ID NO: 521735 - DNA, 17 bp, Homo sapiens
gcagggcccccactgga

SEQ ID NO: 521736 - DNA, 18 bp, Homo sapiens
gcaggggccgtgcagggc

SEQ ID NO: 521737 - DNA, 18 bp, Homo sapiens
gcagttagcacagaggat

SEQ ID NO: 521738 - DNA, 16 bp, Homo sapiens
gcagttgcaataaact

SEQ ID NO: 521739 - DNA, 12 bp, Homo sapiens
gcatctggcctg

SEQ ID NO: 521740 - DNA, 13 bp, Homo sapiens
gcatgaagataaa

SEQ ID NO: 521741 - DNA, 15 bp, Homo sapiens
gcatgagaactaaat

SEQ ID NO: 521742 - DNA, 17 bp, Homo sapiens
gcatgagaactaaatag

SEQ ID NO: 521743 - DNA, 18 bp, Homo sapiens
gcatgagaactaaataga

SEQ ID NO: 521744 - DNA, 20 bp, Homo sapiens
gcattgcactaaaagtgatg

SEQ ID NO: 521745 - DNA, 13 bp, Homo sapiens
gcatttatgcatg

SEQ ID NO: 521746 - DNA, 16 bp, Homo sapiens
gcatttatgcatgaga

SEQ ID NO: 521747 - DNA, 23 bp, Homo sapiens
gcatttatgcatgagaactaaat

SEQ ID NO: 521748 - DNA, 24 bp, Homo sapiens
gcatttatgcatgagaactaaata

SEQ ID NO: 521749 - DNA, 22 bp, Homo sapiens
gcatttgctgaataacaacaat

SEQ ID NO: 521750 - DNA, 16 bp, Homo sapiens
gccaataaagctcaca

SEQ ID NO: 521751 - DNA, 18 bp, Homo sapiens
gccaataaagctcacact

SEQ ID NO: 521752 - DNA, 21 bp, Homo sapiens
gccaatgtccaggtcacaggc

SEQ ID NO: 521753 - DNA, 20 bp, Homo sapiens
gccaatttctcttaagtact

SEQ ID NO: 521754 - DNA, 20 bp, Homo sapiens
gccacttagggagtgtgcct

SEQ ID NO: 521755 - DNA, 12 bp, Homo sapiens
gccagccctgtt

SEQ ID NO: 521756 - DNA, 19 bp, Homo sapiens
gccatatattttctgagta

SEQ ID NO: 521757 - DNA, 17 bp, Homo sapiens
gccatttcacattcctg

SEQ ID NO: 521758 - DNA, 23 bp, Homo sapiens
gcccacctaaagggaagccctga

SEQ ID NO: 521759 - DNA, 20 bp, Homo sapiens
gcccccatgcaggcagcctg

SEQ ID NO: 521760 - DNA, 17 bp, Homo sapiens
gccccccggcctgatgg

SEQ ID NO: 521761 - DNA, 19 bp, Homo sapiens
gcccctgcacctgcttctc

SEQ ID NO: 521762 - DNA, 16 bp, Homo sapiens
gcccctgcctgagacc

SEQ ID NO: 521763 - DNA, 16 bp, Homo sapiens
gccctccctgctgcca

SEQ ID NO: 521764 - DNA, 19 bp, Homo sapiens
gccctccgccagccctgtt

SEQ ID NO: 521765 - DNA, 21 bp, Homo sapiens
gccctgttccgcctcactggg

SEQ ID NO: 521766 - DNA, 21 bp, Homo sapiens
gcccttccctgacactgtctg

SEQ ID NO: 521767 - DNA, 13 bp, Homo sapiens
gcctcttaaaaat

SEQ ID NO: 521768 - DNA, 14 bp, Homo sapiens
gcctgagaccacgg

SEQ ID NO: 521769 - DNA, 13 bp, Homo sapiens
gcctgatggccag

SEQ ID NO: 521770 - DNA, 22 bp, Homo sapiens
gcctgcacagtggtccagggtc

SEQ ID NO: 521771 - DNA, 21 bp, Homo sapiens
gcctggaggagaaggaggaac

SEQ ID NO: 521772 - DNA, 21 bp, Homo sapiens
gcctggatccagctctgggag

SEQ ID NO: 521773 - DNA, 23 bp, Homo sapiens
gcctggccttgagccgtgacctc

SEQ ID NO: 521774 - DNA, 14 bp, Homo sapiens
gccttctcccctcc

SEQ ID NO: 521775 - DNA, 15 bp, Homo sapiens
gcgagcctgcttgct

SEQ ID NO: 521776 - DNA, 15 bp, Homo sapiens
gcgctcggggctggg

SEQ ID NO: 521777 - DNA, 18 bp, Homo sapiens
gcgctcggggctgggcag

SEQ ID NO: 521778 - DNA, 14 bp, Homo sapiens
gcggcttccctgcg

SEQ ID NO: 521779 - DNA, 19 bp, Homo sapiens
gcgtccctgagggcccttc

SEQ ID NO: 521780 - DNA, 14 bp, Homo sapiens
gcgtggttctgcca

SEQ ID NO: 521781 - DNA, 15 bp, Homo sapiens
gcgtggttctgccac

SEQ ID NO: 521782 - DNA, 23 bp, Homo sapiens
gctaagataattaaatgaaatac

SEQ ID NO: 521783 - DNA, 15 bp, Homo sapiens
gctaattaaaaagtt

SEQ ID NO: 521784 - DNA, 16 bp, Homo sapiens
gctacaaaatgtgtgc

SEQ ID NO: 521785 - DNA, 16 bp, Homo sapiens
gctacaggggaggctg

SEQ ID NO: 521786 - DNA, 19 bp, Homo sapiens
gctagttagagactcgcct

SEQ ID NO: 521787 - DNA, 17 bp, Homo sapiens
gctagtttaaaattatt

SEQ ID NO: 521788 - DNA, 22 bp, Homo sapiens
gctatgcacaccaaattgctga

SEQ ID NO: 521789 - DNA, 23 bp, Homo sapiens
gctatgcacaccaaattgctgag

SEQ ID NO: 521790 - DNA, 17 bp, Homo sapiens
gctatgctgttcattga

SEQ ID NO: 521791 - DNA, 19 bp, Homo sapiens
gctcaatgtgctgttgatt

SEQ ID NO: 521792 - DNA, 13 bp, Homo sapiens
gctcagaggagag

SEQ ID NO: 521793 - DNA, 16 bp, Homo sapiens
gctcagaggagaggag

SEQ ID NO: 521794 - DNA, 16 bp, Homo sapiens
gctccattcctgagta

SEQ ID NO: 521795 - DNA, 15 bp, Homo sapiens
gctcccacctcggac

SEQ ID NO: 521796 - DNA, 12 bp, Homo sapiens
gctcccactgcc

SEQ ID NO: 521797 - DNA, 15 bp, Homo sapiens
gctcccactgcccct

SEQ ID NO: 521798 - DNA, 19 bp, Homo sapiens
gctcccactgcccctgcac

SEQ ID NO: 521799 - DNA, 16 bp, Homo sapiens
gctcccggtgtgcagc

SEQ ID NO: 521800 - DNA, 14 bp, Homo sapiens
gctccctgcctgga

SEQ ID NO: 521801 - DNA, 20 bp, Homo sapiens
gctccttcatgcttttctca

SEQ ID NO: 521802 - DNA, 22 bp, Homo sapiens
gctcggccaggcacggaggctc

SEQ ID NO: 521803 - DNA, 16 bp, Homo sapiens
ggggaggctgagacgc

SEQ ID NO: 521804 - DNA, 16 bp, Homo sapiens
ggggccgtgcagggcc

SEQ ID NO: 521805 - DNA, 13 bp, Homo sapiens
ggggctgggcaga

SEQ ID NO: 521806 - DNA, 14 bp, Homo sapiens
gggtccagccctcc

SEQ ID NO: 521807 - DNA, 17 bp, Homo sapiens
ggtaacttgctgtgaaa

SEQ ID NO: 521808 - DNA, 15 bp, Homo sapiens
ggtccaatccagcct

SEQ ID NO: 521809 - DNA, 16 bp, Homo sapiens
ggtccaatccagcctt

SEQ ID NO: 521810 - DNA, 24 bp, Homo sapiens
ggtccagccctccgccagccctgt

SEQ ID NO: 521811 - DNA, 17 bp, Homo sapiens
ggtccagggtccagccc

SEQ ID NO: 521812 - DNA, 19 bp, Homo sapiens
ggtcccgggtgccccccat

SEQ ID NO: 521813 - DNA, 17 bp, Homo sapiens
ggtcctgggggctgctg

SEQ ID NO: 521814 - DNA, 21 bp, Homo sapiens
ggtcctgtcctggctcccagg

SEQ ID NO: 521815 - DNA, 21 bp, Homo sapiens
ggtccttaaaaaaaaaaatga

SEQ ID NO: 521816 - DNA, 15 bp, Homo sapiens
ggtctctttctttcc

SEQ ID NO: 521817 - DNA, 17 bp, Homo sapiens
ggtctctttctttccaa

SEQ ID NO: 521818 - DNA, 20 bp, Homo sapiens
gttcaccttctgtgcatctg

SEQ ID NO: 521819 - DNA, 16 bp, Homo sapiens
gttcacgcaacttgaa

SEQ ID NO: 521820 - DNA, 18 bp, Homo sapiens
gttcttcctcttacctgt

SEQ ID NO: 521821 - DNA, 21 bp, Homo sapiens
gttcttgtaaaactgtgacat

SEQ ID NO: 521822 - DNA, 21 bp, Homo sapiens
gttgacacattgcacacacag

SEQ ID NO: 521823 - DNA, 13 bp, Homo sapiens
gttgattctttca

SEQ ID NO: 521824 - DNA, 15 bp, Homo sapiens
gttgattctttcaat

SEQ ID NO: 521825 - DNA, 15 bp, Homo sapiens
gttgtacatagtggt

SEQ ID NO: 521826 - DNA, 18 bp, Homo sapiens
gttgtcctgtgtcatctg

SEQ ID NO: 521827 - DNA, 16 bp, Homo sapiens
gttgtcctttctgatc

SEQ ID NO: 521828 - DNA, 16 bp, Homo sapiens
gttgttgtccctgcag

SEQ ID NO: 521829 - DNA, 21 bp, Homo sapiens
gtttagaatcaagtctgtgaa

SEQ ID NO: 521830 - DNA, 15 bp, Homo sapiens
gtttcactgttcatg

SEQ ID NO: 521831 - DNA, 19 bp, Homo sapiens
gtttgcttctaaaggtttc

SEQ ID NO: 521832 - DNA, 17 bp, Homo sapiens
gtttggctgaaattatg

SEQ ID NO: 521833 - DNA, 13 bp, Homo sapiens
gtttgtttgctgc

SEQ ID NO: 521834 - DNA, 20 bp, Homo sapiens
gttttccccaattatcctcc

SEQ ID NO: 521835 - DNA, 16 bp, Homo sapiens
gttttcttttaatttt

SEQ ID NO: 521836 - DNA, 18 bp, Homo sapiens
gtttttgttcaccttctg

SEQ ID NO: 521837 - DNA, 17 bp, Homo sapiens
taaaaattatctttaaa

SEQ ID NO: 521838 - DNA, 13 bp, Homo sapiens
taaaactgtgaca

SEQ ID NO: 521839 - DNA, 17 bp, Homo sapiens
taaaacttactatggta

SEQ ID NO: 521840 - DNA, 22 bp, Homo sapiens
taaaatacttctttttacaatg

SEQ ID NO: 521841 - DNA, 18 bp, Homo sapiens
taaaatctgtattgctaa

SEQ ID NO: 521842 - DNA, 22 bp, Homo sapiens
taaaattattaaaaattataga

SEQ ID NO: 521843 - DNA, 14 bp, Homo sapiens
taaacaaaaacttt

SEQ ID NO: 521844 - DNA, 18 bp, Homo sapiens
taaacaaaaactttccat

SEQ ID NO: 521845 - DNA, 16 bp, Homo sapiens
taaacaattcaagtga

SEQ ID NO: 521846 - DNA, 12 bp, Homo sapiens
taaactgtgaga

SEQ ID NO: 521847 - DNA, 14 bp, Homo sapiens
taaactgtgagata

SEQ ID NO: 521848 - DNA, 18 bp, Homo sapiens
taaactgtgagataaata

SEQ ID NO: 521849 - DNA, 13 bp, Homo sapiens
taaagaaaccttt

SEQ ID NO: 521850 - DNA, 18 bp, Homo sapiens
taaagaccatttagtcct

SEQ ID NO: 521851 - DNA, 21 bp, Homo sapiens
taaagcaagctcacttgcttt

SEQ ID NO: 521852 - DNA, 14 bp, Homo sapiens
taaagctcacactt

SEQ ID NO: 521853 - DNA, 20 bp, Homo sapiens
taaagttccatgaagacaaa

SEQ ID NO: 521854 - DNA, 13 bp, Homo sapiens
taaataaaaatag

SEQ ID NO: 521855 - DNA, 14 bp, Homo sapiens
taaatagtgaaaat

SEQ ID NO: 521856 - DNA, 20 bp, Homo sapiens
taaatatcattatagcatgt

SEQ ID NO: 521857 - DNA, 15 bp, Homo sapiens
taaatgaaatacttg

SEQ ID NO: 521858 - DNA, 15 bp, Homo sapiens
taaatgaatgaaata

SEQ ID NO: 521859 - DNA, 22 bp, Homo sapiens
taaatgaatgaaatataaactg

SEQ ID NO: 521860 - DNA, 19 bp, Homo sapiens
taaatgatatgtctttaaa

SEQ ID NO: 521861 - DNA, 23 bp, Homo sapiens
taaattttataaggctgactctt

SEQ ID NO: 521862 - DNA, 15 bp, Homo sapiens
taacattctatttca

SEQ ID NO: 521863 - DNA, 12 bp, Homo sapiens
taacattgtaaa

SEQ ID NO: 521864 - DNA, 17 bp, Homo sapiens
taacattgtaaatgata

SEQ ID NO: 521865 - DNA, 20 bp, Homo sapiens
taaccaccatttcccctgtg

SEQ ID NO: 521866 - DNA, 18 bp, Homo sapiens
taacttgctgtgaaatga

SEQ ID NO: 521867 - DNA, 19 bp, Homo sapiens
taacttgctgtgaaatgac

SEQ ID NO: 521868 - DNA, 13 bp, Homo sapiens
taagcctgatgat

SEQ ID NO: 521869 - DNA, 19 bp, Homo sapiens
taaggtcagtgttataaaa

SEQ ID NO: 521870 - DNA, 13 bp, Homo sapiens
taaggttcttgct

SEQ ID NO: 521871 - DNA, 18 bp, Homo sapiens
taagttataccagcaaaa

SEQ ID NO: 521872 - DNA, 15 bp, Homo sapiens
taatagcctcacctt

SEQ ID NO: 521873 - DNA, 14 bp, Homo sapiens
taatataaatgaat

SEQ ID NO: 521874 - DNA, 21 bp, Homo sapiens
taatataaatgaatgaaatat

SEQ ID NO: 521875 - DNA, 21 bp, Homo sapiens
taatctagagctatgcacacc

SEQ ID NO: 521876 - DNA, 23 bp, Homo sapiens
taatctagagctatgcacaccaa

SEQ ID NO: 521877 - DNA, 20 bp, Homo sapiens
taatgagccaataaagctca

SEQ ID NO: 521878 - DNA, 21 bp, Homo sapiens
taattaaacaaattccttccc

SEQ ID NO: 521879 - DNA, 16 bp, Homo sapiens
taattaaatgaaatac

SEQ ID NO: 521880 - DNA, 19 bp, Homo sapiens
tacaattctttgttgctta

SEQ ID NO: 521881 - DNA, 16 bp, Homo sapiens
tacataacaggcattg

SEQ ID NO: 521882 - DNA, 21 bp, Homo sapiens
tacataacaggcattgcacta

SEQ ID NO: 521883 - DNA, 15 bp, Homo sapiens
tacatatgataaatt

SEQ ID NO: 521884 - DNA, 15 bp, Homo sapiens
tacatgatgatttca

SEQ ID NO: 521885 - DNA, 14 bp, Homo sapiens
taccaaatgccttt

SEQ ID NO: 521886 - DNA, 18 bp, Homo sapiens
taccagcaaaagtgcagt

SEQ ID NO: 521887 - DNA, 16 bp, Homo sapiens
taccattttgaaatat

SEQ ID NO: 521888 - DNA, 19 bp, Homo sapiens
taccccaggatgcatgcag

SEQ ID NO: 521889 - DNA, 17 bp, Homo sapiens
tacctgtgaatcaaaac

SEQ ID NO: 521890 - DNA, 15 bp, Homo sapiens
tactaaccaccattt

SEQ ID NO: 521891 - DNA, 16 bp, Homo sapiens
tactaaccaccatttc

SEQ ID NO: 521892 - DNA, 22 bp, Homo sapiens
tactagaaccttctaatccatg

SEQ ID NO: 521893 - DNA, 24 bp, Homo sapiens
tactcctccccctcctccatgctg

SEQ ID NO: 521894 - DNA, 20 bp, Homo sapiens
tactgatgagacaacacaca

SEQ ID NO: 521895 - DNA, 14 bp, Homo sapiens
tactgttttgtgcg

SEQ ID NO: 521896 - DNA, 17 bp, Homo sapiens
tacttaaacaaaaactt

SEQ ID NO: 521897 - DNA, 19 bp, Homo sapiens
tacttaaacaaaaactttc

SEQ ID NO: 521898 - DNA, 21 bp, Homo sapiens
tacttaaacaaaaactttcca

SEQ ID NO: 521899 - DNA, 17 bp, Homo sapiens
tacttatttataacatt

SEQ ID NO: 521900 - DNA, 23 bp, Homo sapiens
tagaaattttatctcttcttcct

SEQ ID NO: 521901 - DNA, 13 bp, Homo sapiens
tagaaccttctaa

SEQ ID NO: 521902 - DNA, 18 bp, Homo sapiens
tagaatcaagtctgtgaa

SEQ ID NO: 521903 - DNA, 12 bp, Homo sapiens
tagacaatgtgg

SEQ ID NO: 521904 - DNA, 17 bp, Homo sapiens
tagacaatgtggaatta

SEQ ID NO: 521905 - DNA, 23 bp, Homo sapiens
tagacaatgtggaattacataac

SEQ ID NO: 521906 - DNA, 19 bp, Homo sapiens
tagagacttctaaatcata

SEQ ID NO: 521907 - DNA, 19 bp, Homo sapiens
ctcaccttccctagttctt

SEQ ID NO: 521908 - DNA, 15 bp, Homo sapiens
ctcactgatatattt

SEQ ID NO: 521909 - DNA, 22 bp, Homo sapiens
ctcactgatatattttccaggg

SEQ ID NO: 521910 - DNA, 16 bp, Homo sapiens
ctcactgggtgtggcc

SEQ ID NO: 521911 - DNA, 16 bp, Homo sapiens
ctcagctgtctgtggc

SEQ ID NO: 521912 - DNA, 21 bp, Homo sapiens
ctcagtgcagggacagcctgc

SEQ ID NO: 521913 - DNA, 21 bp, Homo sapiens
ctcatcaggtaaactgatgct

SEQ ID NO: 521914 - DNA, 22 bp, Homo sapiens
ctcatctgtaaaaccaggctga

SEQ ID NO: 521915 - DNA, 12 bp, Homo sapiens
ctcatggctgtt

SEQ ID NO: 521916 - DNA, 22 bp, Homo sapiens
ctcatggctgttatctgtcttt

SEQ ID NO: 521917 - DNA, 23 bp, Homo sapiens
ctcatggctgttatctgtcttta

SEQ ID NO: 521918 - DNA, 16 bp, Homo sapiens
ctccaaagttatccag

SEQ ID NO: 521919 - DNA, 13 bp, Homo sapiens
ctccaaatgctgt

SEQ ID NO: 521920 - DNA, 18 bp, Homo sapiens
ctccagccacttatttcc

SEQ ID NO: 521921 - DNA, 22 bp, Homo sapiens
ctccaggaagggaccccactgg

SEQ ID NO: 521922 - DNA, 23 bp, Homo sapiens
ctccagggagtggggaggagaga

SEQ ID NO: 521923 - DNA, 14 bp, Homo sapiens
ctccatgctgtccc

SEQ ID NO: 521924 - DNA, 19 bp, Homo sapiens
ctccatgctgtccctgtgg

SEQ ID NO: 521925 - DNA, 21 bp, Homo sapiens
ctccatgctgtccctgtgggc

SEQ ID NO: 521926 - DNA, 11 bp, Homo sapiens
ctccattcctg

SEQ ID NO: 521927 - DNA, 15 bp, Homo sapiens
ctccattcctgagta

SEQ ID NO: 521928 - DNA, 22 bp, Homo sapiens
ctcccagggtcctgggggctgc

SEQ ID NO: 521929 - DNA, 13 bp, Homo sapiens
ctccccctcctcc

SEQ ID NO: 521930 - DNA, 14 bp, Homo sapiens
ctccccctcctcca

SEQ ID NO: 521931 - DNA, 13 bp, Homo sapiens
ctcccctccaagt

SEQ ID NO: 521932 - DNA, 19 bp, Homo sapiens
ctcccctggtcctgcactg

SEQ ID NO: 521933 - DNA, 14 bp, Homo sapiens
ctcccggctctgag

SEQ ID NO: 521934 - DNA, 14 bp, Homo sapiens
ctcccggtgtgcag

SEQ ID NO: 521935 - DNA, 16 bp, Homo sapiens
ctccctccctccctgc

SEQ ID NO: 521936 - DNA, 19 bp, Homo sapiens
ctccctgctccctgctccc

SEQ ID NO: 521937 - DNA, 22 bp, Homo sapiens
ctccctgctgccaggctcccac

SEQ ID NO: 521938 - DNA, 19 bp, Homo sapiens
ctccctttatcatgtgttt

SEQ ID NO: 521939 - DNA, 15 bp, Homo sapiens
ctcctccaaatgctg

SEQ ID NO: 521940 - DNA, 20 bp, Homo sapiens
ctcctccagttctgatgagg

SEQ ID NO: 521941 - DNA, 20 bp, Homo sapiens
ctcctccccctcctccatgc

SEQ ID NO: 521942 - DNA, 16 bp, Homo sapiens
ctcctcggtggcattt

SEQ ID NO: 521943 - DNA, 22 bp, Homo sapiens
ctcctcggtggcatttgctgaa

SEQ ID NO: 521944 - DNA, 21 bp, Homo sapiens
ctcctctgtcagtttgtgaag

SEQ ID NO: 521945 - DNA, 16 bp, Homo sapiens
ctcctgctgaccttct

SEQ ID NO: 521946 - DNA, 18 bp, Homo sapiens
ctcctgtctcctctgtca

SEQ ID NO: 521947 - DNA, 13 bp, Homo sapiens
ctcggacaccatc

SEQ ID NO: 521948 - DNA, 19 bp, Homo sapiens
ctcggtggcatttgctgaa

SEQ ID NO: 521949 - DNA, 14 bp, Homo sapiens
ctcgtgcatgtaat

SEQ ID NO: 521950 - DNA, 13 bp, Homo sapiens
ctctcaaaatgtg

SEQ ID NO: 521951 - DNA, 13 bp, Homo sapiens
ctctcctcggtgg

SEQ ID NO: 521952 - DNA, 13 bp, Homo sapiens
ctctctcacccag

SEQ ID NO: 521953 - DNA, 15 bp, Homo sapiens
ctctctcacccagcc

SEQ ID NO: 521954 - DNA, 20 bp, Homo sapiens
ctctctgaactgcaacactg

SEQ ID NO: 521955 - DNA, 13 bp, Homo sapiens
ctctcttggtctc

SEQ ID NO: 521956 - DNA, 19 bp, Homo sapiens
ctctcttggtctctttctt

SEQ ID NO: 521957 - DNA, 16 bp, Homo sapiens
ctctgaatctctcaaa

SEQ ID NO: 521958 - DNA, 19 bp, Homo sapiens
ctctgaatctctcaaaatg

SEQ ID NO: 521959 - DNA, 20 bp, Homo sapiens
ctctgaatctctcaaaatgt

SEQ ID NO: 521960 - DNA, 21 bp, Homo sapiens
ctctgaatctctcaaaatgtg

SEQ ID NO: 521961 - DNA, 22 bp, Homo sapiens
ctctgaatctctcaaaatgtgc

SEQ ID NO: 521962 - DNA, 19 bp, Homo sapiens
ctctgcgacgatccccatg

SEQ ID NO: 521963 - DNA, 13 bp, Homo sapiens
ctctgggagccct

SEQ ID NO: 521964 - DNA, 23 bp, Homo sapiens
ctctgtcagtttgtgaagtgatt

SEQ ID NO: 521965 - DNA, 19 bp, Homo sapiens
ctcttactaaccaccattt

SEQ ID NO: 521966 - DNA, 21 bp, Homo sapiens
ctcttcttactgtatttggga

SEQ ID NO: 521967 - DNA, 20 bp, Homo sapiens
ctcttcttccttttgtatcc

SEQ ID NO: 521968 - DNA, 14 bp, Homo sapiens
ctctttctttccaa

SEQ ID NO: 521969 - DNA, 15 bp, Homo sapiens
ctgaaaactggaata

SEQ ID NO: 521970 - DNA, 11 bp, Homo sapiens
ctgaaattatg

SEQ ID NO: 521971 - DNA, 23 bp, Homo sapiens
ctgaaattatgtcaaatggatgt

SEQ ID NO: 521972 - DNA, 15 bp, Homo sapiens
ctgaataacaacaat

SEQ ID NO: 521973 - DNA, 22 bp, Homo sapiens
ctgaataacaacaatttaggaa

SEQ ID NO: 521974 - DNA, 21 bp, Homo sapiens
ctgaatctctcaaaatgtgcc

SEQ ID NO: 521975 - DNA, 21 bp, Homo sapiens
ctgacatgctaacctctctga

SEQ ID NO: 521976 - DNA, 13 bp, Homo sapiens
ctgaccttctgcg

SEQ ID NO: 521977 - DNA, 15 bp, Homo sapiens
ctgacttctccagga

SEQ ID NO: 521978 - DNA, 15 bp, Homo sapiens
tcagtattgagacac

SEQ ID NO: 521979 - DNA, 19 bp, Homo sapiens
tcagtattgagacactgtc

SEQ ID NO: 521980 - DNA, 21 bp, Homo sapiens
tcagtccacccccattgtgaa

SEQ ID NO: 521981 - DNA, 20 bp, Homo sapiens
tcagtgcagggacagcctgc

SEQ ID NO: 521982 - DNA, 17 bp, Homo sapiens
tcagtgctagcttattt

SEQ ID NO: 521983 - DNA, 22 bp, Homo sapiens
tcagttaggattaggtttagaa

SEQ ID NO: 521984 - DNA, 18 bp, Homo sapiens
tcagtttgtgaagtgatt

SEQ ID NO: 521985 - DNA, 14 bp, Homo sapiens
tcatagataccatt

SEQ ID NO: 521986 - DNA, 22 bp, Homo sapiens
tctgacagcatttcagctgtga

SEQ ID NO: 521987 - DNA, 14 bp, Homo sapiens
tctgatcctctctt

SEQ ID NO: 521988 - DNA, 15 bp, Homo sapiens
tctgcacacataaca

SEQ ID NO: 521989 - DNA, 19 bp, Homo sapiens
tctgcacacataacacaca

SEQ ID NO: 521990 - DNA, 20 bp, Homo sapiens
tctgcacacataacacacat

SEQ ID NO: 521991 - DNA, 23 bp, Homo sapiens
tctgccggtggggccagcgctga

SEQ ID NO: 521992 - DNA, 18 bp, Homo sapiens
tctggccgctgcagtcag

SEQ ID NO: 521993 - DNA, 18 bp, Homo sapiens
tctgggaatcctggacag

SEQ ID NO: 521994 - DNA, 19 bp, Homo sapiens
tctgggacaggcaccatgc

SEQ ID NO: 521995 - DNA, 15 bp, Homo sapiens
tctggggagggacac

SEQ ID NO: 521996 - DNA, 17 bp, Homo sapiens
tctgtaaaaccaggctg

SEQ ID NO: 521997 - DNA, 13 bp, Homo sapiens
tctgtattgctaa

SEQ ID NO: 521998 - DNA, 16 bp, Homo sapiens
tctgtcagcttcccaa

SEQ ID NO: 521999 - DNA, 21 bp, Homo sapiens
tctgtcagcttcccaacaata

SEQ ID NO: 522000 - DNA, 17 bp, Homo sapiens
tctgtcagtttgtgaag

SEQ ID NO: 522001 - DNA, 13 bp, Homo sapiens
tctgtctttatga

SEQ ID NO: 522002 - DNA, 19 bp, Homo sapiens
tctgtctttatgatttcat

SEQ ID NO: 522003 - DNA, 23 bp, Homo sapiens
tctgtgaaagtctcctgtatcat

SEQ ID NO: 522004 - DNA, 15 bp, Homo sapiens
tctgtgcatctggcc

SEQ ID NO: 522005 - DNA, 17 bp, Homo sapiens
tctgtgctaagttgtct

SEQ ID NO: 522006 - DNA, 18 bp, Homo sapiens
tcttaaaaattatcttta

SEQ ID NO: 522007 - DNA, 20 bp, Homo sapiens
tcttacctgtaatagcctca

SEQ ID NO: 522008 - DNA, 14 bp, Homo sapiens
tcttactgtatttg

SEQ ID NO: 522009 - DNA, 14 bp, Homo sapiens
tcttcatacaaagg

SEQ ID NO: 522010 - DNA, 19 bp, Homo sapiens
tcttccttttgtatcctcc

SEQ ID NO: 522011 - DNA, 18 bp, Homo sapiens
tcttcttttcccatttac

SEQ ID NO: 522012 - DNA, 19 bp, Homo sapiens
tcttgagtttcatttttca

SEQ ID NO: 522013 - DNA, 12 bp, Homo sapiens
tcttgctgtgaa

SEQ ID NO: 522014 - DNA, 15 bp, Homo sapiens
tcttgtaaaactgtg

SEQ ID NO: 522015 - DNA, 21 bp, Homo sapiens
tcttgtaaaactgtgacattc

SEQ ID NO: 522016 - DNA, 23 bp, Homo sapiens
tcttgtaaaactgtgacattcca

SEQ ID NO: 522017 - DNA, 18 bp, Homo sapiens
tctttactaacactggct

SEQ ID NO: 522018 - DNA, 14 bp, Homo sapiens
tctttatgatttca

SEQ ID NO: 522019 - DNA, 17 bp, Homo sapiens
tctttcaatccacagta

SEQ ID NO: 522020 - DNA, 20 bp, Homo sapiens
tctttccaaaggttgtacat

SEQ ID NO: 522021 - DNA, 13 bp, Homo sapiens
tctttctttccaa

SEQ ID NO: 522022 - DNA, 14 bp, Homo sapiens
tctttctttccaaa

SEQ ID NO: 522023 - DNA, 16 bp, Homo sapiens
tgaaaactaagttctc

SEQ ID NO: 522024 - DNA, 20 bp, Homo sapiens
tgaaacagtgtggatgtaaa

SEQ ID NO: 522025 - DNA, 17 bp, Homo sapiens
tgaaactgacttgctgt

SEQ ID NO: 522026 - DNA, 14 bp, Homo sapiens
tgaaagtcagttta

SEQ ID NO: 522027 - DNA, 22 bp, Homo sapiens
tgaaatacatatgataaatttg

SEQ ID NO: 522028 - DNA, 16 bp, Homo sapiens
tgaaatataaactgtg

SEQ ID NO: 522029 - DNA, 18 bp, Homo sapiens
tgaaatataaactgtgag

SEQ ID NO: 522030 - DNA, 20 bp, Homo sapiens
tgaaatataaactgtgagat

SEQ ID NO: 522031 - DNA, 14 bp, Homo sapiens
tgaaattatatctg

SEQ ID NO: 522032 - DNA, 15 bp, Homo sapiens
tgaaattatatctgt

SEQ ID NO: 522033 - DNA, 15 bp, Homo sapiens
tgaaattatgtcaaa

SEQ ID NO: 522034 - DNA, 14 bp, Homo sapiens
tgaaattcacaaag

SEQ ID NO: 522035 - DNA, 18 bp, Homo sapiens
tgaaattcacaaagttaa

SEQ ID NO: 522036 - DNA, 21 bp, Homo sapiens
tgaagagagatatatctgaaa

SEQ ID NO: 522037 - DNA, 15 bp, Homo sapiens
tgaaggtgccagacg

SEQ ID NO: 522038 - DNA, 16 bp, Homo sapiens
tgaatgaaatataaac

SEQ ID NO: 522039 - DNA, 20 bp, Homo sapiens
tgaatgaaatataaactgtg

SEQ ID NO: 522040 - DNA, 22 bp, Homo sapiens
tgaatgagtttccagctaagcc

SEQ ID NO: 522041 - DNA, 18 bp, Homo sapiens
tgaattttttcctaccat

SEQ ID NO: 522042 - DNA, 12 bp, Homo sapiens
tgacaacatttt

SEQ ID NO: 522043 - DNA, 16 bp, Homo sapiens
tgacacattgcacaca

SEQ ID NO: 522044 - DNA, 17 bp, Homo sapiens
tgacattttgtagctag

SEQ ID NO: 522045 - DNA, 20 bp, Homo sapiens
tgacattttgtagctagttt

SEQ ID NO: 522046 - DNA, 17 bp, Homo sapiens
tgaccttctgcggctcc

SEQ ID NO: 522047 - DNA, 16 bp, Homo sapiens
tgactgtagtttttgt

SEQ ID NO: 522048 - DNA, 16 bp, Homo sapiens
tgagaactaaatagat

SEQ ID NO: 522049 - DNA, 14 bp, Homo sapiens
tgagacactgtcaa

SEQ ID NO: 522050 - DNA, 16 bp, Homo sapiens
tgagagaagagagtat

SEQ ID NO: 522051 - DNA, 21 bp, Homo sapiens
tgagagggtgtgggtgccctg

SEQ ID NO: 522052 - DNA, 19 bp, Homo sapiens
tgagatgtttagtagctga

SEQ ID NO: 522053 - DNA, 21 bp, Homo sapiens
tgagatgtttagtagctgata

SEQ ID NO: 522054 - DNA, 18 bp, Homo sapiens
tgagattggaaaaaatta

SEQ ID NO: 522055 - DNA, 22 bp, Homo sapiens
tgagccaataaagctcacactt

SEQ ID NO: 522056 - DNA, 14 bp, Homo sapiens
tgagccgtgacctc

SEQ ID NO: 522057 - DNA, 23 bp, Homo sapiens
tgagccgtgacctccaggaaggg

SEQ ID NO: 522058 - DNA, 12 bp, Homo sapiens
tgagtagcatat

SEQ ID NO: 522059 - DNA, 19 bp, Homo sapiens
tgagttggttacctattgc

SEQ ID NO: 522060 - DNA, 18 bp, Homo sapiens
tgagtttccagctaagcc

SEQ ID NO: 522061 - DNA, 16 bp, Homo sapiens
tgataaagaaaccttt

SEQ ID NO: 522062 - DNA, 15 bp, Homo sapiens
tgatatgtctttaaa

SEQ ID NO: 522063 - DNA, 16 bp, Homo sapiens
tgatatgtctttaaaa

SEQ ID NO: 522064 - DNA, 20 bp, Homo sapiens
tgatatgtctttaaaatgat

SEQ ID NO: 522065 - DNA, 14 bp, Homo sapiens
tgatgagacaacac

SEQ ID NO: 522066 - DNA, 18 bp, Homo sapiens
tgatgagacaacacacac

SEQ ID NO: 522067 - DNA, 16 bp, Homo sapiens
tgatgtgatttatgca

SEQ ID NO: 522068 - DNA, 17 bp, Homo sapiens
tgatgtgatttatgcat

SEQ ID NO: 522069 - DNA, 18 bp, Homo sapiens
tgatgtgatttatgcatt

SEQ ID NO: 522070 - DNA, 18 bp, Homo sapiens
tgatgtgctcatcagaaa

SEQ ID NO: 522071 - DNA, 17 bp, Homo sapiens
tgattaactcagtcctg

SEQ ID NO: 522072 - DNA, 22 bp, Homo sapiens
tgattgacattttgtagctagt

SEQ ID NO: 522073 - DNA, 18 bp, Homo sapiens
tgatttattctggtgtct

SEQ ID NO: 522074 - DNA, 13 bp, Homo sapiens
tgatttcagaaac

SEQ ID NO: 522075 - DNA, 23 bp, Homo sapiens
tgcaaaatacatgatgatttcag

SEQ ID NO: 522076 - DNA, 12 bp, Homo sapiens
tgcaacactgga

SEQ ID NO: 522077 - DNA, 20 bp, Homo sapiens
tgcacacataacacacatca

SEQ ID NO: 522078 - DNA, 18 bp, Homo sapiens
tgcacaccaaattgctga

SEQ ID NO: 522079 - DNA, 19 bp, Homo sapiens
tgcacaccaaattgctgag

SEQ ID NO: 522080 - DNA, 16 bp, Homo sapiens
tgcactaaaagtgatg

SEQ ID NO: 522081 - DNA, 14 bp, Homo sapiens
tgcaggaatcaaaa

SEQ ID NO: 522082 - DNA, 21 bp, Homo sapiens
ttccccatcgccttctgggga

SEQ ID NO: 522083 - DNA, 18 bp, Homo sapiens
ttccccattgccttctgg

SEQ ID NO: 522084 - DNA, 15 bp, Homo sapiens
ttccctgacactgtc

SEQ ID NO: 522085 - DNA, 23 bp, Homo sapiens
ttcctcccctggaagttgtcctt

SEQ ID NO: 522086 - DNA, 17 bp, Homo sapiens
ttcctcctgtctcctct

SEQ ID NO: 522087 - DNA, 13 bp, Homo sapiens
ttcctgaccctca

SEQ ID NO: 522088 - DNA, 15 bp, Homo sapiens
ttcctgaccctcact

SEQ ID NO: 522089 - DNA, 11 bp, Homo sapiens
ttcctgtcaat

SEQ ID NO: 522090 - DNA, 23 bp, Homo sapiens
ttcgtccttagaatactgtattg

SEQ ID NO: 522091 - DNA, 20 bp, Homo sapiens
ttctacttcttgtgctttac

SEQ ID NO: 522092 - DNA, 16 bp, Homo sapiens
ttctagatatgagaaa

SEQ ID NO: 522093 - DNA, 23 bp, Homo sapiens
ttctcatctgtaaaaccaggctg

SEQ ID NO: 522094 - DNA, 17 bp, Homo sapiens
ttctcctccaaatgctg

SEQ ID NO: 522095 - DNA, 18 bp, Homo sapiens
ttctcctccaaatgctgt

SEQ ID NO: 522096 - DNA, 13 bp, Homo sapiens
ttctctctgtgct

SEQ ID NO: 522097 - DNA, 19 bp, Homo sapiens
ttctggggagggacacaga

SEQ ID NO: 522098 - DNA, 21 bp, Homo sapiens
ttctggggagggacacagagg

SEQ ID NO: 522099 - DNA, 23 bp, Homo sapiens
ttctgtgcatctggcctgggggc

SEQ ID NO: 522100 - DNA, 21 bp, Homo sapiens
ttcttcccccagggtcccctg

SEQ ID NO: 522101 - DNA, 18 bp, Homo sapiens
ttcttgcagtcatcagaa

SEQ ID NO: 522102 - DNA, 14 bp, Homo sapiens
ttcttggtatgatc

SEQ ID NO: 522103 - DNA, 12 bp, Homo sapiens
ttctttgttgct

SEQ ID NO: 522104 - DNA, 23 bp, Homo sapiens
ttgaaaggagaaaaaaaaagcca

SEQ ID NO: 522105 - DNA, 14 bp, Homo sapiens
ttgaaattatatct

SEQ ID NO: 522106 - DNA, 17 bp, Homo sapiens
ttgaaattatatctgtg

SEQ ID NO: 522107 - DNA, 20 bp, Homo sapiens
ttgaagagagatatatctga

SEQ ID NO: 522108 - DNA, 17 bp, Homo sapiens
ttgacacactcaccatt

SEQ ID NO: 522109 - DNA, 20 bp, Homo sapiens
ttgacacattgcacacacag

SEQ ID NO: 522110 - DNA, 13 bp, Homo sapiens
ttgagacactgtc

SEQ ID NO: 522111 - DNA, 21 bp, Homo sapiens
ttgagacactgtcaagattaa

SEQ ID NO: 522112 - DNA, 13 bp, Homo sapiens
ttgagtcatttta

SEQ ID NO: 522113 - DNA, 17 bp, Homo sapiens
ttgcactaaaagtgatg

SEQ ID NO: 522114 - DNA, 17 bp, Homo sapiens
ttgcagtcatcagaagt

SEQ ID NO: 522115 - DNA, 15 bp, Homo sapiens
ttgctgtaaataaaa

SEQ ID NO: 522116 - DNA, 23 bp, Homo sapiens
ttgctgtaaataaaaatagctat

SEQ ID NO: 522117 - DNA, 18 bp, Homo sapiens
ttgcttaatctagagcta

SEQ ID NO: 522118 - DNA, 20 bp, Homo sapiens
ttggaaaacgatttaattta

SEQ ID NO: 522119 - DNA, 19 bp, Homo sapiens
ttggaacagtaatcagttt

SEQ ID NO: 522120 - DNA, 15 bp, Homo sapiens
ttggctgaaattatg

SEQ ID NO: 522121 - DNA, 19 bp, Homo sapiens
ttggtaacttgctgtgaaa

SEQ ID NO: 522122 - DNA, 16 bp, Homo sapiens
ttggtctctttctttc

SEQ ID NO: 522123 - DNA, 23 bp, Homo sapiens
ttgtaaaactgtgacattccaca

SEQ ID NO: 522124 - DNA, 21 bp, Homo sapiens
ttgtaacattctatttcaact

SEQ ID NO: 522125 - DNA, 20 bp, Homo sapiens
ttgtcctgtgtcatctgtca

SEQ ID NO: 522126 - DNA, 17 bp, Homo sapiens
ttgtgaagtgattgaca

SEQ ID NO: 522127 - DNA, 23 bp, Homo sapiens
ttgtgtgggtttactctgtgcta

SEQ ID NO: 522128 - DNA, 22 bp, Homo sapiens
ttgttatcagtacaattctttg

SEQ ID NO: 522129 - DNA, 19 bp, Homo sapiens
ttgtttgttaataaagtgc

SEQ ID NO: 522130 - DNA, 22 bp, Homo sapiens
tttaaaaaaataatataaatga

SEQ ID NO: 522131 - DNA, 23 bp, Homo sapiens
tttaaaaaaataatataaatgaa

SEQ ID NO: 522132 - DNA, 19 bp, Homo sapiens
tttaaaagccctttccaaa

SEQ ID NO: 522133 - DNA, 20 bp, Homo sapiens
tttaaaagccctttccaaag

SEQ ID NO: 522134 - DNA, 13 bp, Homo sapiens
tttaaaattatta

SEQ ID NO: 522135 - DNA, 14 bp, Homo sapiens
tttaaaattattaa

SEQ ID NO: 522136 - DNA, 21 bp, Homo sapiens
tttaaaattattaaaaattat

SEQ ID NO: 522137 - DNA, 18 bp, Homo sapiens
tttaaacttcttaactgg

SEQ ID NO: 522138 - DNA, 10 bp, Homo sapiens
tttaatcatt

SEQ ID NO: 522139 - DNA, 13 bp, Homo sapiens
tttagctgtgcag

SEQ ID NO: 522140 - DNA, 16 bp, Homo sapiens
tttaggaatgctcaat

SEQ ID NO: 522141 - DNA, 16 bp, Homo sapiens
tttagtcctcaccttc

SEQ ID NO: 522142 - DNA, 15 bp, Homo sapiens
tttataacattgtaa

SEQ ID NO: 522143 - DNA, 19 bp, Homo sapiens
tttatgcatgagaactaaa

SEQ ID NO: 522144 - DNA, 20 bp, Homo sapiens
tttatgcatgagaactaaat

SEQ ID NO: 522145 - DNA, 14 bp, Homo sapiens
tttcacattcctga

SEQ ID NO: 522146 - DNA, 16 bp, Homo sapiens
tttcacctatctggaa

SEQ ID NO: 522147 - DNA, 16 bp, Homo sapiens
tttcagtaagatcaag

SEQ ID NO: 522148 - DNA, 15 bp, Homo sapiens
tttcatgattagaca

SEQ ID NO: 522149 - DNA, 15 bp, Homo sapiens
tttccagtgctgctc

SEQ ID NO: 522150 - DNA, 23 bp, Homo sapiens
tttccatgacagtagcatactga

SEQ ID NO: 522151 - DNA, 18 bp, Homo sapiens
tttccccaattatcctcc

SEQ ID NO: 522152 - DNA, 21 bp, Homo sapiens
tttctgagtagcatatataat

SEQ ID NO: 522153 - DNA, 18 bp, Homo sapiens
tttgagtgtcaggctctg

SEQ ID NO: 522154 - DNA, 21 bp, Homo sapiens
tttgagtgtcaggctctgaat

SEQ ID NO: 522155 - DNA, 13 bp, Homo sapiens
tttgctaattaaa

SEQ ID NO: 522156 - DNA, 14 bp, Homo sapiens
tttgctaattaaaa

SEQ ID NO: 522157 - DNA, 20 bp, Homo sapiens
tttgctgaataacaacaatt

SEQ ID NO: 522158 - DNA, 13 bp, Homo sapiens
tttggtggctcta

SEQ ID NO: 522159 - DNA, 17 bp, Homo sapiens
tttgtacgttaattaaa

SEQ ID NO: 522160 - DNA, 23 bp, Homo sapiens
tttgtcagtgtagatcaactcat

SEQ ID NO: 522161 - DNA, 18 bp, Homo sapiens
tttgttatcagtacaatt

SEQ ID NO: 522162 - DNA, 15 bp, Homo sapiens
tttgttctctcttgg

SEQ ID NO: 522163 - DNA, 13 bp, Homo sapiens
ttttagattccta

SEQ ID NO: 522164 - DNA, 23 bp, Homo sapiens
ttttagattcctacttaaacaaa

SEQ ID NO: 522165 - DNA, 20 bp, Homo sapiens
ttttataaggctgactctta

SEQ ID NO: 522166 - DNA, 18 bp, Homo sapiens
ttttgtacgttaattaaa

SEQ ID NO: 522167 - DNA, 19 bp, Homo sapiens
ttttgtacgttaattaaac

SEQ ID NO: 522168 - DNA, 17 bp, Homo sapiens
ttttgttcaccttctgt

SEQ ID NO: 522169 - DNA, 14 bp, Homo sapiens
ttttgttgattaaa

SEQ ID NO: 522170 - DNA, 14 bp, Homo sapiens
tttttagattccta

SEQ ID NO: 522171 - DNA, 14 bp, Homo sapiens
tttttcctgtcaat

SEQ ID NO: 522172 - DNA, 16 bp, Homo sapiens
acccctttgccttccc

SEQ ID NO: 522173 - DNA, 18 bp, Homo sapiens
acccggctgactcagtgc

SEQ ID NO: 522174 - DNA, 13 bp, Homo sapiens
acccgtgttctcc

SEQ ID NO: 522175 - DNA, 16 bp, Homo sapiens
acccgtgttctcctcc

SEQ ID NO: 522176 - DNA, 19 bp, Homo sapiens
accggacgcatgcagggcc

SEQ ID NO: 522177 - DNA, 20 bp, Homo sapiens
accggacgcatgcagggccc

SEQ ID NO: 522178 - DNA, 13 bp, Homo sapiens
accggcactgtgc

SEQ ID NO: 522179 - DNA, 19 bp, Homo sapiens
acctaaagggaagccctga

SEQ ID NO: 522180 - DNA, 19 bp, Homo sapiens
acctaagagccacaataag

SEQ ID NO: 522181 - DNA, 19 bp, Homo sapiens
acctactcctccccctcct

SEQ ID NO: 522182 - DNA, 12 bp, Homo sapiens
acctcgccgtgt

SEQ ID NO: 522183 - DNA, 12 bp, Homo sapiens
acctcttgtttt

SEQ ID NO: 522184 - DNA, 18 bp, Homo sapiens
acctttggcttaattcca

SEQ ID NO: 522185 - DNA, 16 bp, Homo sapiens
accttttaaaaaaata

SEQ ID NO: 522186 - DNA, 17 bp, Homo sapiens
accttttaaaaaaataa

SEQ ID NO: 522187 - DNA, 14 bp, Homo sapiens
acgatttaatttat

SEQ ID NO: 522188 - DNA, 22 bp, Homo sapiens
acgcccaggatgaaggggccag

SEQ ID NO: 522189 - DNA, 13 bp, Homo sapiens
acgcccctgcctg

SEQ ID NO: 522190 - DNA, 19 bp, Homo sapiens
acgtctaacttcatgctgt

SEQ ID NO: 522191 - DNA, 12 bp, Homo sapiens
acgtgtgaggat

SEQ ID NO: 522192 - DNA, 14 bp, Homo sapiens
actaaatagatttt

SEQ ID NO: 522193 - DNA, 18 bp, Homo sapiens
actaaatagatttttaga

SEQ ID NO: 522194 - DNA, 19 bp, Homo sapiens
actaaatagatttttagat

SEQ ID NO: 522195 - DNA, 18 bp, Homo sapiens
actatggtatatattttg

SEQ ID NO: 522196 - DNA, 20 bp, Homo sapiens
actatggtatatattttgaa

SEQ ID NO: 522197 - DNA, 22 bp, Homo sapiens
actatggtatatattttgaaag

SEQ ID NO: 522198 - DNA, 18 bp, Homo sapiens
actcagctgtctgtggct

SEQ ID NO: 522199 - DNA, 22 bp, Homo sapiens
actcaggcagcctgtgggtcct

SEQ ID NO: 522200 - DNA, 21 bp, Homo sapiens
actcagtgcagggacagcctg

SEQ ID NO: 522201 - DNA, 14 bp, Homo sapiens
actcctccccctcc

SEQ ID NO: 522202 - DNA, 18 bp, Homo sapiens
actcctccccctcctcca

SEQ ID NO: 522203 - DNA, 22 bp, Homo sapiens
actcgcctgggaaattgctcca

SEQ ID NO: 522204 - DNA, 20 bp, Homo sapiens
actctcttcttactgtattt

SEQ ID NO: 522205 - DNA, 23 bp, Homo sapiens
actcttttgagcagtaaatgtat

SEQ ID NO: 522206 - DNA, 14 bp, Homo sapiens
actgatatattttc

SEQ ID NO: 522207 - DNA, 12 bp, Homo sapiens
actgcaacactg

SEQ ID NO: 522208 - DNA, 22 bp, Homo sapiens
actgcccctgcacctgcttctc

SEQ ID NO: 522209 - DNA, 22 bp, Homo sapiens
actggaattttatttctctcag

SEQ ID NO: 522210 - DNA, 17 bp, Homo sapiens
actgtgacacagctgag

SEQ ID NO: 522211 - DNA, 15 bp, Homo sapiens
actgtgagataaata

SEQ ID NO: 522212 - DNA, 17 bp, Homo sapiens
actgtgagataaatatc

SEQ ID NO: 522213 - DNA, 21 bp, Homo sapiens
actgttttgtgcggtgtgtct

SEQ ID NO: 522214 - DNA, 16 bp, Homo sapiens
acttaaacaaaaactt

SEQ ID NO: 522215 - DNA, 19 bp, Homo sapiens
aggctctgaatctctcaaa

SEQ ID NO: 522216 - DNA, 23 bp, Homo sapiens
aggctgatgccgtgcgggctaat

SEQ ID NO: 522217 - DNA, 17 bp, Homo sapiens
aggctgcagtgagccaa

SEQ ID NO: 522218 - DNA, 13 bp, Homo sapiens
agggaccaaggag

SEQ ID NO: 522219 - DNA, 14 bp, Homo sapiens
agggaccaaggaga

SEQ ID NO: 522220 - DNA, 15 bp, Homo sapiens
agggcagccctgcct

SEQ ID NO: 522221 - DNA, 23 bp, Homo sapiens
agggcaggggccgtgcagggcca

SEQ ID NO: 522222 - DNA, 18 bp, Homo sapiens
agggcccttcccaacctc

SEQ ID NO: 522223 - DNA, 23 bp, Homo sapiens
agggcccttcccaacctcccctg

SEQ ID NO: 522224 - DNA, 13 bp, Homo sapiens
agggctgacttct

SEQ ID NO: 522225 - DNA, 11 bp, Homo sapiens
aggggaggctg

SEQ ID NO: 522226 - DNA, 17 bp, Homo sapiens
aggggctgcttctgggg

SEQ ID NO: 522227 - DNA, 16 bp, Homo sapiens
agggggcaaggagaaa

SEQ ID NO: 522228 - DNA, 13 bp, Homo sapiens
agggtcccctgca

SEQ ID NO: 522229 - DNA, 18 bp, Homo sapiens
agggtcctgggggctgct

SEQ ID NO: 522230 - DNA, 14 bp, Homo sapiens
agggttgtgatttt

SEQ ID NO: 522231 - DNA, 15 bp, Homo sapiens
aggtcctgtcctggc

SEQ ID NO: 522232 - DNA, 18 bp, Homo sapiens
aggtcttgagtttcattt

SEQ ID NO: 522233 - DNA, 21 bp, Homo sapiens
aggtcttgagtttcatttttc

SEQ ID NO: 522234 - DNA, 20 bp, Homo sapiens
aggtttagaatcaagtctgt

SEQ ID NO: 522235 - DNA, 17 bp, Homo sapiens
aggtttcactgttcatg

SEQ ID NO: 522236 - DNA, 15 bp, Homo sapiens
agtacaattctttgt

SEQ ID NO: 522237 - DNA, 22 bp, Homo sapiens
agtacaattctttgttgcttaa

SEQ ID NO: 522238 - DNA, 23 bp, Homo sapiens
agtacaattctttgttgcttaat

SEQ ID NO: 522239 - DNA, 15 bp, Homo sapiens
agtagctgataaaga

SEQ ID NO: 522240 - DNA, 22 bp, Homo sapiens
agtatccctgatttattctggt

SEQ ID NO: 522241 - DNA, 19 bp, Homo sapiens
agtattgagacactgtcaa

SEQ ID NO: 522242 - DNA, 20 bp, Homo sapiens
agtattgagacactgtcaag

SEQ ID NO: 522243 - DNA, 21 bp, Homo sapiens
agtattgagacactgtcaaga

SEQ ID NO: 522244 - DNA, 23 bp, Homo sapiens
agtattgttcttgtaaaactgtg

SEQ ID NO: 522245 - DNA, 13 bp, Homo sapiens
agtcagcacagag

SEQ ID NO: 522246 - DNA, 19 bp, Homo sapiens
agtccacccccattgtgaa

SEQ ID NO: 522247 - DNA, 20 bp, Homo sapiens
agtccacccccattgtgaat

SEQ ID NO: 522248 - DNA, 21 bp, Homo sapiens
agtccacccccattgtgaatg

SEQ ID NO: 522249 - DNA, 20 bp, Homo sapiens
agtgaatgagtttccagcta

SEQ ID NO: 522250 - DNA, 16 bp, Homo sapiens
agtgatgtgatttatg

SEQ ID NO: 522251 - DNA, 19 bp, Homo sapiens
agtgatgtgatttatgcat

SEQ ID NO: 522252 - DNA, 21 bp, Homo sapiens
agtgcagggacagcctgcaca

SEQ ID NO: 522253 - DNA, 16 bp, Homo sapiens
agtgctgctcccttta

SEQ ID NO: 522254 - DNA, 16 bp, Homo sapiens
agtggtccagggtcca

SEQ ID NO: 522255 - DNA, 15 bp, Homo sapiens
agtgtgccttgggcg

SEQ ID NO: 522256 - DNA, 21 bp, Homo sapiens
agtgtggatgtaaattttata

SEQ ID NO: 522257 - DNA, 15 bp, Homo sapiens
agtgttataaaatct

SEQ ID NO: 522258 - DNA, 17 bp, Homo sapiens
agtgttataaaatctgt

SEQ ID NO: 522259 - DNA, 23 bp, Homo sapiens
agtgttataaaatctgtattgct

SEQ ID NO: 522260 - DNA, 19 bp, Homo sapiens
agttagagactcgcctggg

SEQ ID NO: 522261 - DNA, 14 bp, Homo sapiens
agttagcacagagg

SEQ ID NO: 522262 - DNA, 13 bp, Homo sapiens
agttgcagtaaag

SEQ ID NO: 522263 - DNA, 21 bp, Homo sapiens
agttgtaacattctatttcaa

SEQ ID NO: 522264 - DNA, 17 bp, Homo sapiens
agttgtcctttctgatc

SEQ ID NO: 522265 - DNA, 22 bp, Homo sapiens
agtttattgccctcaaaatctt

SEQ ID NO: 522266 - DNA, 14 bp, Homo sapiens
agtttcatttttca

SEQ ID NO: 522267 - DNA, 19 bp, Homo sapiens
agtttccagctaagcctga

SEQ ID NO: 522268 - DNA, 14 bp, Homo sapiens
ataaactcagtcaa

SEQ ID NO: 522269 - DNA, 19 bp, Homo sapiens
ataaactcagtcaaatgta

SEQ ID NO: 522270 - DNA, 12 bp, Homo sapiens
ataaactgtgag

SEQ ID NO: 522271 - DNA, 20 bp, Homo sapiens
ataaactgtgagataaatat

SEQ ID NO: 522272 - DNA, 11 bp, Homo sapiens
ataacaacaat

SEQ ID NO: 522273 - DNA, 21 bp, Homo sapiens
ataacaggcattgcactaaaa

SEQ ID NO: 522274 - DNA, 14 bp, Homo sapiens
aacagtaatcagtt

SEQ ID NO: 522275 - DNA, 15 bp, Homo sapiens
aacagtttttatgtt

SEQ ID NO: 522276 - DNA, 17 bp, Homo sapiens
aacctcccctggtcctg

SEQ ID NO: 522277 - DNA, 18 bp, Homo sapiens
aacctcccctggtcctgc

SEQ ID NO: 522278 - DNA, 19 bp, Homo sapiens
aacctcccctggtcctgca

SEQ ID NO: 522279 - DNA, 21 bp, Homo sapiens
aaccttttaaaaaaataatat

SEQ ID NO: 522280 - DNA, 23 bp, Homo sapiens
aacgtgatgtgctcatcagaaac

SEQ ID NO: 522281 - DNA, 14 bp, Homo sapiens
aactgatgctttca

SEQ ID NO: 522282 - DNA, 16 bp, Homo sapiens
aactgatgctttcaga

SEQ ID NO: 522283 - DNA, 15 bp, Homo sapiens
aactgcaacactgga

SEQ ID NO: 522284 - DNA, 20 bp, Homo sapiens
aactgccaggcagctgcagt

SEQ ID NO: 522285 - DNA, 21 bp, Homo sapiens
aactggaataagaagcaaata

SEQ ID NO: 522286 - DNA, 17 bp, Homo sapiens
aactgtgagataaatat

SEQ ID NO: 522287 - DNA, 20 bp, Homo sapiens
aactgtgagataaatatcat

SEQ ID NO: 522288 - DNA, 20 bp, Homo sapiens
aacttactatggtatatatt

SEQ ID NO: 522289 - DNA, 19 bp, Homo sapiens
aacttgaaattatatctgt

SEQ ID NO: 522290 - DNA, 19 bp, Homo sapiens
aactttccatgacagtagc

SEQ ID NO: 522291 - DNA, 13 bp, Homo sapiens
aagaaacctttta

SEQ ID NO: 522292 - DNA, 21 bp, Homo sapiens
aagaaattagggctctaattt

SEQ ID NO: 522293 - DNA, 16 bp, Homo sapiens
aagaagcaaataaata

SEQ ID NO: 522294 - DNA, 19 bp, Homo sapiens
aagaagctaaaatgaaaaa

SEQ ID NO: 522295 - DNA, 13 bp, Homo sapiens
aagactcaatcat

SEQ ID NO: 522296 - DNA, 16 bp, Homo sapiens
aagagagatatatctg

SEQ ID NO: 522297 - DNA, 19 bp, Homo sapiens
aagataattaaatgaaata

SEQ ID NO: 522298 - DNA, 21 bp, Homo sapiens
aagataattaaatgaaatact

SEQ ID NO: 522299 - DNA, 20 bp, Homo sapiens
aagatggatttgacacactc

SEQ ID NO: 522300 - DNA, 15 bp, Homo sapiens
aagatgtaagaagct

SEQ ID NO: 522301 - DNA, 20 bp, Homo sapiens
aagcacaataaaagacatcc

SEQ ID NO: 522302 - DNA, 16 bp, Homo sapiens
aagcatgccaatttct

SEQ ID NO: 522303 - DNA, 19 bp, Homo sapiens
aagcatgccaatttctctt

SEQ ID NO: 522304 - DNA, 12 bp, Homo sapiens
aagcatgctcag

SEQ ID NO: 522305 - DNA, 16 bp, Homo sapiens
aagctccatcttattt

SEQ ID NO: 522306 - DNA, 18 bp, Homo sapiens
aaggagatggggagggcg

SEQ ID NO: 522307 - DNA, 13 bp, Homo sapiens
aagggaagccctg

SEQ ID NO: 522308 - DNA, 19 bp, Homo sapiens
aagggctgacttctccagg

SEQ ID NO: 522309 - DNA, 15 bp, Homo sapiens
aaggttgtacatagt

SEQ ID NO: 522310 - DNA, 16 bp, Homo sapiens
aaggtttcactgttca

SEQ ID NO: 522311 - DNA, 22 bp, Homo sapiens
aagtcctttcccgatgcgtggc

SEQ ID NO: 522312 - DNA, 22 bp, Homo sapiens
aagtgatgtgatttatgcattt

SEQ ID NO: 522313 - DNA, 13 bp, Homo sapiens
aagtgattgacat

SEQ ID NO: 522314 - DNA, 14 bp, Homo sapiens
aagtgattgacatt

SEQ ID NO: 522315 - DNA, 15 bp, Homo sapiens
aagtgattgacattt

SEQ ID NO: 522316 - DNA, 18 bp, Homo sapiens
aagttataccagcaaaag

SEQ ID NO: 522317 - DNA, 15 bp, Homo sapiens
aagttgtcctttctg

SEQ ID NO: 522318 - DNA, 12 bp, Homo sapiens
aataaacacaga

SEQ ID NO: 522319 - DNA, 13 bp, Homo sapiens
aataactattgct

SEQ ID NO: 522320 - DNA, 12 bp, Homo sapiens
aataattaaaac

SEQ ID NO: 522321 - DNA, 12 bp, Homo sapiens
aatacatgcctt

SEQ ID NO: 522322 - DNA, 12 bp, Homo sapiens
aatactgtattg

SEQ ID NO: 522323 - DNA, 18 bp, Homo sapiens
aatactgtattgttacag

SEQ ID NO: 522324 - DNA, 14 bp, Homo sapiens
aatacttcttttta

SEQ ID NO: 522325 - DNA, 14 bp, Homo sapiens
aatactttgtgtct

SEQ ID NO: 522326 - DNA, 17 bp, Homo sapiens
aatataaaaataattaa

SEQ ID NO: 522327 - DNA, 12 bp, Homo sapiens
aatataaactgt

SEQ ID NO: 522328 - DNA, 16 bp, Homo sapiens
aatataaactgtgaga

SEQ ID NO: 522329 - DNA, 21 bp, Homo sapiens
aatataaactgtgagataaat

SEQ ID NO: 522330 - DNA, 15 bp, Homo sapiens
aatataaatgaatga

SEQ ID NO: 522331 - DNA, 18 bp, Homo sapiens
attattaaaaattataga

SEQ ID NO: 522332 - DNA, 15 bp, Homo sapiens
attcaaacctaagtt

SEQ ID NO: 522333 - DNA, 18 bp, Homo sapiens
attcacttttattgtata

SEQ ID NO: 522334 - DNA, 21 bp, Homo sapiens
attccacagagttactgccac

SEQ ID NO: 522335 - DNA, 12 bp, Homo sapiens
attcctcctgtc

SEQ ID NO: 522336 - DNA, 13 bp, Homo sapiens
attcctcctgtct

SEQ ID NO: 522337 - DNA, 22 bp, Homo sapiens
attcctcctgtctcctctgtca

SEQ ID NO: 522338 - DNA, 13 bp, Homo sapiens
attcctgaccctc

SEQ ID NO: 522339 - DNA, 16 bp, Homo sapiens
attcctgaccctcact

SEQ ID NO: 522340 - DNA, 18 bp, Homo sapiens
attcctgaccctcacttt

SEQ ID NO: 522341 - DNA, 21 bp, Homo sapiens
attgaagagagatatatctga

SEQ ID NO: 522342 - DNA, 14 bp, Homo sapiens
attgacaagtttaa

SEQ ID NO: 522343 - DNA, 15 bp, Homo sapiens
attgagacactgtca

SEQ ID NO: 522344 - DNA, 16 bp, Homo sapiens
attgagacactgtcaa

SEQ ID NO: 522345 - DNA, 13 bp, Homo sapiens
attgagtgtacat

SEQ ID NO: 522346 - DNA, 13 bp, Homo sapiens
attgatagaataa

SEQ ID NO: 522347 - DNA, 19 bp, Homo sapiens
attgcacacacagtctgtt

SEQ ID NO: 522348 - DNA, 20 bp, Homo sapiens
attgcacacacagtctgttc

SEQ ID NO: 522349 - DNA, 14 bp, Homo sapiens
attgcttctctaaa

SEQ ID NO: 522350 - DNA, 20 bp, Homo sapiens
attggaggatgggggtcctg

SEQ ID NO: 522351 - DNA, 12 bp, Homo sapiens
attggcttgttt

SEQ ID NO: 522352 - DNA, 13 bp, Homo sapiens
attgtatcttcat

SEQ ID NO: 522353 - DNA, 20 bp, Homo sapiens
attgttcttgtaaaactgtg

SEQ ID NO: 522354 - DNA, 14 bp, Homo sapiens
atttaatcatttcc

SEQ ID NO: 522355 - DNA, 22 bp, Homo sapiens
atttaatcatttccagcaaaat

SEQ ID NO: 522356 - DNA, 19 bp, Homo sapiens
atttaggaatgctcaatgt

SEQ ID NO: 522357 - DNA, 15 bp, Homo sapiens
atttataacattgta

SEQ ID NO: 522358 - DNA, 13 bp, Homo sapiens
atttatgcatgag

SEQ ID NO: 522359 - DNA, 22 bp, Homo sapiens
atttatgcatgagaactaaata

SEQ ID NO: 522360 - DNA, 13 bp, Homo sapiens
atttatgcattta

SEQ ID NO: 522361 - DNA, 16 bp, Homo sapiens
atttatgcatttatgc

SEQ ID NO: 522362 - DNA, 23 bp, Homo sapiens
atttcatgattagacaatgtgga

SEQ ID NO: 522363 - DNA, 13 bp, Homo sapiens
atttccagcaaaa

SEQ ID NO: 522364 - DNA, 16 bp, Homo sapiens
atttcccctgtggttt

SEQ ID NO: 522365 - DNA, 23 bp, Homo sapiens
atttctagatatgagaaatataa

SEQ ID NO: 522366 - DNA, 18 bp, Homo sapiens
atttctgtgtcctgtttt

SEQ ID NO: 522367 - DNA, 14 bp, Homo sapiens
atttgacacactca

SEQ ID NO: 522368 - DNA, 15 bp, Homo sapiens
atttgctgcatttca

SEQ ID NO: 522369 - DNA, 22 bp, Homo sapiens
atttgtcagtgtagatcaactc

SEQ ID NO: 522370 - DNA, 15 bp, Homo sapiens
attttagctaattta

SEQ ID NO: 522371 - DNA, 16 bp, Homo sapiens
attttagctaatttag

SEQ ID NO: 522372 - DNA, 20 bp, Homo sapiens
attttataaggctgactctt

SEQ ID NO: 522373 - DNA, 15 bp, Homo sapiens
attttattgaatata

SEQ ID NO: 522374 - DNA, 16 bp, Homo sapiens
attttattgaatataa

SEQ ID NO: 522375 - DNA, 16 bp, Homo sapiens
attttatttctctcag

SEQ ID NO: 522376 - DNA, 11 bp, Homo sapiens
attttcatgtt

SEQ ID NO: 522377 - DNA, 17 bp, Homo sapiens
attttccagggcaatca

SEQ ID NO: 522378 - DNA, 15 bp, Homo sapiens
attttcgcccaccta

SEQ ID NO: 522379 - DNA, 14 bp, Homo sapiens
attttctctcctcg

SEQ ID NO: 522380 - DNA, 14 bp, Homo sapiens
attttttcctacca

SEQ ID NO: 522381 - DNA, 14 bp, Homo sapiens
caaaaactttccat

SEQ ID NO: 522382 - DNA, 21 bp, Homo sapiens
caaaaactttccatgacagta

SEQ ID NO: 522383 - DNA, 10 bp, Homo sapiens
caaaacaaca

SEQ ID NO: 522384 - DNA, 16 bp, Homo sapiens
caaaacaacagcaaca

SEQ ID NO: 522385 - DNA, 21 bp, Homo sapiens
caaaaggatgatttaacatta

SEQ ID NO: 522386 - DNA, 18 bp, Homo sapiens
caaaatatatgtttggct

SEQ ID NO: 522387 - DNA, 14 bp, Homo sapiens
caaacaacaaagca

SEQ ID NO: 522388 - DNA, 15 bp, Homo sapiens
caaacaggaaaatga

SEQ ID NO: 522389 - DNA, 14 bp, Homo sapiens
caaacgaaatggct

SEQ ID NO: 522390 - DNA, 14 bp, Homo sapiens
caaagcatgctcag

SEQ ID NO: 522391 - DNA, 20 bp, Homo sapiens
caaagcatgctcagtattga

SEQ ID NO: 522392 - DNA, 21 bp, Homo sapiens
caaagttaaacgtgatgtgct

SEQ ID NO: 522393 - DNA, 13 bp, Homo sapiens
caaagttatccag

SEQ ID NO: 522394 - DNA, 21 bp, Homo sapiens
caaatgttattcaataactat

SEQ ID NO: 522395 - DNA, 13 bp, Homo sapiens
cagtacaattctt

SEQ ID NO: 522396 - DNA, 14 bp, Homo sapiens
cagtacaattcttt

SEQ ID NO: 522397 - DNA, 17 bp, Homo sapiens
cagtacaattctttgtt

SEQ ID NO: 522398 - DNA, 19 bp, Homo sapiens
cagtagcatactgatgaga

SEQ ID NO: 522399 - DNA, 13 bp, Homo sapiens
cagtattgttctt

SEQ ID NO: 522400 - DNA, 19 bp, Homo sapiens
cagtcagcacagagagcgg

SEQ ID NO: 522401 - DNA, 21 bp, Homo sapiens
cagtccacccccattgtgaat

SEQ ID NO: 522402 - DNA, 15 bp, Homo sapiens
cagtgcagggacagc

SEQ ID NO: 522403 - DNA, 18 bp, Homo sapiens
cagtgcagggacagcctg

SEQ ID NO: 522404 - DNA, 19 bp, Homo sapiens
cagtgcagggacagcctgc

SEQ ID NO: 522405 - DNA, 18 bp, Homo sapiens
cagtgggcggcttccctg

SEQ ID NO: 522406 - DNA, 19 bp, Homo sapiens
cagtggtccagggtccagc

SEQ ID NO: 522407 - DNA, 22 bp, Homo sapiens
cagtggtccagggtccagccct

SEQ ID NO: 522408 - DNA, 16 bp, Homo sapiens
cagtgtggatgtaaat

SEQ ID NO: 522409 - DNA, 19 bp, Homo sapiens
cagttagcacagaggatgg

SEQ ID NO: 522410 - DNA, 22 bp, Homo sapiens
cagttgacacattgcacacaca

SEQ ID NO: 522411 - DNA, 22 bp, Homo sapiens
cagttgcaataaactcagtcaa

SEQ ID NO: 522412 - DNA, 22 bp, Homo sapiens
cagttgtaacattctatttcaa

SEQ ID NO: 522413 - DNA, 16 bp, Homo sapiens
cataaatcttccaaag

SEQ ID NO: 522414 - DNA, 13 bp, Homo sapiens
cataacaggcatt

SEQ ID NO: 522415 - DNA, 16 bp, Homo sapiens
cataacaggcattgca

SEQ ID NO: 522416 - DNA, 17 bp, Homo sapiens
cataacaggcattgcac

SEQ ID NO: 522417 - DNA, 22 bp, Homo sapiens
cataatcatccttttttaaaaa

SEQ ID NO: 522418 - DNA, 23 bp, Homo sapiens
catactgatgagacaacacacac

SEQ ID NO: 522419 - DNA, 20 bp, Homo sapiens
catagataccattttgaaat

SEQ ID NO: 522420 - DNA, 21 bp, Homo sapiens
catagtttgaattcatgcctc

SEQ ID NO: 522421 - DNA, 14 bp, Homo sapiens
catattatatcaga

SEQ ID NO: 522422 - DNA, 16 bp, Homo sapiens
catatttacctgtgaa

SEQ ID NO: 522423 - DNA, 14 bp, Homo sapiens
catcagaagtggta

SEQ ID NO: 522424 - DNA, 22 bp, Homo sapiens
catcgccttctggccgctgcag

SEQ ID NO: 522425 - DNA, 15 bp, Homo sapiens
catcgccttctgggg

SEQ ID NO: 522426 - DNA, 22 bp, Homo sapiens
catcgccttctggggaggggct

SEQ ID NO: 522427 - DNA, 17 bp, Homo sapiens
catctggcctgggggct

SEQ ID NO: 522428 - DNA, 18 bp, Homo sapiens
catctgtaaaaccaggct

SEQ ID NO: 522429 - DNA, 19 bp, Homo sapiens
catctgtaaaaccaggctg

SEQ ID NO: 522430 - DNA, 21 bp, Homo sapiens
catcttgggattcctcccctg

SEQ ID NO: 522431 - DNA, 15 bp, Homo sapiens
catgacagtagcata

SEQ ID NO: 522432 - DNA, 18 bp, Homo sapiens
catgacagtagcatactg

SEQ ID NO: 522433 - DNA, 22 bp, Homo sapiens
catgacttctttactaacactg

SEQ ID NO: 522434 - DNA, 18 bp, Homo sapiens
catgattagacaatgtgg

SEQ ID NO: 522435 - DNA, 21 bp, Homo sapiens
catgattagacaatgtggaat

SEQ ID NO: 522436 - DNA, 12 bp, Homo sapiens
catgcagggccc

SEQ ID NO: 522437 - DNA, 22 bp, Homo sapiens
catgcagggcccccacaggagc

SEQ ID NO: 522438 - DNA, 16 bp, Homo sapiens
catgccaatgtccagg

SEQ ID NO: 522439 - DNA, 17 bp, Homo sapiens
catgctaacctctctga

SEQ ID NO: 522440 - DNA, 14 bp, Homo sapiens
catgctcagtattg

SEQ ID NO: 522441 - DNA, 22 bp, Homo sapiens
catgctgtccctgtgggctcac

SEQ ID NO: 522442 - DNA, 17 bp, Homo sapiens
catgcttttctcatggt

SEQ ID NO: 522443 - DNA, 15 bp, Homo sapiens
catggaacagccctg

SEQ ID NO: 522444 - DNA, 18 bp, Homo sapiens
catggcacactgccctct

SEQ ID NO: 522445 - DNA, 15 bp, Homo sapiens
catggctgtcccctg

SEQ ID NO: 522446 - DNA, 17 bp, Homo sapiens
catggctgtcccctgca

SEQ ID NO: 522447 - DNA, 18 bp, Homo sapiens
catggctgtcccctgcaa

SEQ ID NO: 522448 - DNA, 21 bp, Homo sapiens
catggctgtcccctgcaagtg

SEQ ID NO: 522449 - DNA, 18 bp, Homo sapiens
catggctgttatctgtct

SEQ ID NO: 522450 - DNA, 14 bp, Homo sapiens
catgtaatattaaa

SEQ ID NO: 522451 - DNA, 15 bp, Homo sapiens
catgtaatattaaat

SEQ ID NO: 522452 - DNA, 18 bp, Homo sapiens
catgttaattgatagaat

SEQ ID NO: 522453 - DNA, 16 bp, Homo sapiens
catgttcttgcagtca

SEQ ID NO: 522454 - DNA, 13 bp, Homo sapiens
cattatagcatgt

SEQ ID NO: 522455 - DNA, 18 bp, Homo sapiens
cattatagcatgtaatat

SEQ ID NO: 522456 - DNA, 16 bp, Homo sapiens
cattatggctttgtgc

SEQ ID NO: 522457 - DNA, 13 bp, Homo sapiens
cattgcactaaaa

SEQ ID NO: 522458 - DNA, 20 bp, Homo sapiens
cattgtgaatgttgtcctgt

SEQ ID NO: 522459 - DNA, 14 bp, Homo sapiens
catttagtcctcac

SEQ ID NO: 522460 - DNA, 15 bp, Homo sapiens
catttagtcctcacc

SEQ ID NO: 522461 - DNA, 16 bp, Homo sapiens
catttagtcctcacct

SEQ ID NO: 522462 - DNA, 17 bp, Homo sapiens
catttagtcctcacctt

SEQ ID NO: 522463 - DNA, 18 bp, Homo sapiens
catttagtcctcaccttc

SEQ ID NO: 522464 - DNA, 14 bp, Homo sapiens
catttatgcatgag

SEQ ID NO: 522465 - DNA, 22 bp, Homo sapiens
catttatgcatgagaactaaat

SEQ ID NO: 522466 - DNA, 23 bp, Homo sapiens
catttatgcatgagaactaaata

SEQ ID NO: 522467 - DNA, 13 bp, Homo sapiens
catttccctgctg

SEQ ID NO: 522468 - DNA, 11 bp, Homo sapiens
catttgctgaa

SEQ ID NO: 522469 - DNA, 12 bp, Homo sapiens
catttgctgaat

SEQ ID NO: 522470 - DNA, 15 bp, Homo sapiens
cattttgaaatattc

SEQ ID NO: 522471 - DNA, 13 bp, Homo sapiens
cattttgtagcta

SEQ ID NO: 522472 - DNA, 17 bp, Homo sapiens
ccaaaggttgtacatag

SEQ ID NO: 522473 - DNA, 13 bp, Homo sapiens
ccaaattgctgag

SEQ ID NO: 522474 - DNA, 21 bp, Homo sapiens
ccaacctcccctggtcctgca

SEQ ID NO: 522475 - DNA, 24 bp, Homo sapiens
ccaacctcccctggtcctgcactg

SEQ ID NO: 522476 - DNA, 23 bp, Homo sapiens
ccaagggctgacttctccaggac

SEQ ID NO: 522477 - DNA, 17 bp, Homo sapiens
ccaataaagctcacact

SEQ ID NO: 522478 - DNA, 20 bp, Homo sapiens
ccacaagggtgcccacctct

SEQ ID NO: 522479 - DNA, 20 bp, Homo sapiens
ccacaggagcgtgtcctatc

SEQ ID NO: 522480 - DNA, 15 bp, Homo sapiens
ccacccgtgttctcc

SEQ ID NO: 522481 - DNA, 19 bp, Homo sapiens
ccacctaaagggaagccct

SEQ ID NO: 522482 - DNA, 15 bp, Homo sapiens
ccacgacctcgtcca

SEQ ID NO: 522483 - DNA, 19 bp, Homo sapiens
ccacggtccaatccagcct

SEQ ID NO: 522484 - DNA, 14 bp, Homo sapiens
ccacggtcctttga

SEQ ID NO: 522485 - DNA, 16 bp, Homo sapiens
ccactcaggcagcctg

SEQ ID NO: 522486 - DNA, 18 bp, Homo sapiens
ccactcaggcagcctgtg

SEQ ID NO: 522487 - DNA, 18 bp, Homo sapiens
ccacttagggagtgtgcc

SEQ ID NO: 522488 - DNA, 17 bp, Homo sapiens
ccagaacgcatgcaggg

SEQ ID NO: 522489 - DNA, 23 bp, Homo sapiens
ccagagaaatgaaagtcagttta

SEQ ID NO: 522490 - DNA, 21 bp, Homo sapiens
ccagccctccgccagccctgt

SEQ ID NO: 522491 - DNA, 22 bp, Homo sapiens
ccagccctgttccgcctcactg

SEQ ID NO: 522492 - DNA, 14 bp, Homo sapiens
ccagccttcttccc

SEQ ID NO: 522493 - DNA, 15 bp, Homo sapiens
ccagcgctgaacaga

SEQ ID NO: 522494 - DNA, 18 bp, Homo sapiens
ccagcgctgaacagaccg

SEQ ID NO: 522495 - DNA, 16 bp, Homo sapiens
ccagctgcaggaatca

SEQ ID NO: 522496 - DNA, 16 bp, Homo sapiens
cccatcgccttctggg

SEQ ID NO: 522497 - DNA, 17 bp, Homo sapiens
cccatgcaggcagcctg

SEQ ID NO: 522498 - DNA, 16 bp, Homo sapiens
cccatgccaatgtcca

SEQ ID NO: 522499 - DNA, 18 bp, Homo sapiens
cccatggaacagccctgc

SEQ ID NO: 522500 - DNA, 22 bp, Homo sapiens
cccatggaacagccctgcacgc

SEQ ID NO: 522501 - DNA, 22 bp, Homo sapiens
cccatgtctttctccaaagtta

SEQ ID NO: 522502 - DNA, 19 bp, Homo sapiens
ccccacaggagcgtgtcct

SEQ ID NO: 522503 - DNA, 20 bp, Homo sapiens
ccccacaggagcgtgtccta

SEQ ID NO: 522504 - DNA, 19 bp, Homo sapiens
ccccactggagcgtgtact

SEQ ID NO: 522505 - DNA, 20 bp, Homo sapiens
ccccaggggcactgtgttct

SEQ ID NO: 522506 - DNA, 19 bp, Homo sapiens
ccccagggtcccctgcatg

SEQ ID NO: 522507 - DNA, 20 bp, Homo sapiens
ccccatgccaatgtccaggt

SEQ ID NO: 522508 - DNA, 15 bp, Homo sapiens
ccccatgccctccct

SEQ ID NO: 522509 - DNA, 15 bp, Homo sapiens
ccccatggaacagcc

SEQ ID NO: 522510 - DNA, 18 bp, Homo sapiens
ccccatggaacagccctg

SEQ ID NO: 522511 - DNA, 19 bp, Homo sapiens
ccccattgccttctgggga

SEQ ID NO: 522512 - DNA, 20 bp, Homo sapiens
cccccattgtgaatgttgtc

SEQ ID NO: 522513 - DNA, 17 bp, Homo sapiens
ccccgccccgctgctcc

SEQ ID NO: 522514 - DNA, 17 bp, Homo sapiens
ccccggcctgatggcca

SEQ ID NO: 522515 - DNA, 13 bp, Homo sapiens
ccccgtgctcaca

SEQ ID NO: 522516 - DNA, 19 bp, Homo sapiens
ccccgttgttgtccctgca

SEQ ID NO: 522517 - DNA, 16 bp, Homo sapiens
cccctcctccatgctg

SEQ ID NO: 522518 - DNA, 14 bp, Homo sapiens
cccctgcacctgct

SEQ ID NO: 522519 - DNA, 14 bp, Homo sapiens
cccctgcatggctg

SEQ ID NO: 522520 - DNA, 18 bp, Homo sapiens
cccctggaagttgtcctt

SEQ ID NO: 522521 - DNA, 18 bp, Homo sapiens
cccgcccccgccccgctg

SEQ ID NO: 522522 - DNA, 21 bp, Homo sapiens
cccgccccgctgctcccggtg

SEQ ID NO: 522523 - DNA, 15 bp, Homo sapiens
cccgctgctcccggt

SEQ ID NO: 522524 - DNA, 17 bp, Homo sapiens
cccgctgctcccggtgt

SEQ ID NO: 522525 - DNA, 19 bp, Homo sapiens
cccggacgcatgcagggcc

SEQ ID NO: 522526 - DNA, 12 bp, Homo sapiens
cccgtgctcaca

SEQ ID NO: 522527 - DNA, 23 bp, Homo sapiens
cccgttgtgtgggtttactctgt

SEQ ID NO: 522528 - DNA, 16 bp, Homo sapiens
ccctccgccagccctg

SEQ ID NO: 522529 - DNA, 14 bp, Homo sapiens
ccctccgcccttcc

SEQ ID NO: 522530 - DNA, 13 bp, Homo sapiens
ccctgagggccct

SEQ ID NO: 522531 - DNA, 14 bp, Homo sapiens
ccctgagggccctt

SEQ ID NO: 522532 - DNA, 16 bp, Homo sapiens
ccctgagggcccttcc

SEQ ID NO: 522533 - DNA, 16 bp, Homo sapiens
ccctgatttattctgg

SEQ ID NO: 522534 - DNA, 13 bp, Homo sapiens
ccctgcatggctg

SEQ ID NO: 522535 - DNA, 20 bp, Homo sapiens
ccctgccgaggtgtggctgt

SEQ ID NO: 522536 - DNA, 13 bp, Homo sapiens
ccctgcctgagac

SEQ ID NO: 522537 - DNA, 21 bp, Homo sapiens
ccctgctgccaggctcccact

SEQ ID NO: 522538 - DNA, 23 bp, Homo sapiens
ccctggaagttgtcctttctgat

SEQ ID NO: 522539 - DNA, 14 bp, Homo sapiens
ccctgtgggctcac

SEQ ID NO: 522540 - DNA, 16 bp, Homo sapiens
ccctgtgggctcacac

SEQ ID NO: 522541 - DNA, 21 bp, Homo sapiens
ccctgtgggctcacaccggca

SEQ ID NO: 522542 - DNA, 20 bp, Homo sapiens
ccctgttccgcctcactggg

SEQ ID NO: 522543 - DNA, 11 bp, Homo sapiens
cccttcccaac

SEQ ID NO: 522544 - DNA, 16 bp, Homo sapiens
cccttccctgacactg

SEQ ID NO: 522545 - DNA, 15 bp, Homo sapiens
ccgaggcctgcgccc

SEQ ID NO: 522546 - DNA, 12 bp, Homo sapiens
ccgccagccctg

SEQ ID NO: 522547 - DNA, 13 bp, Homo sapiens
ccgcctcactggg

SEQ ID NO: 522548 - DNA, 14 bp, Homo sapiens
ccgcctcactgggt

SEQ ID NO: 522549 - DNA, 17 bp, Homo sapiens
ccgcgctcggggctggg

SEQ ID NO: 522550 - DNA, 21 bp, Homo sapiens
ccgctgcagtcagcacagaga

SEQ ID NO: 522551 - DNA, 14 bp, Homo sapiens
ccggcactgtgcac

SEQ ID NO: 522552 - DNA, 22 bp, Homo sapiens
ccgggagcgcacctcgccgtgt

SEQ ID NO: 522553 - DNA, 12 bp, Homo sapiens
ccgggctccagg

SEQ ID NO: 522554 - DNA, 13 bp, Homo sapiens
ccgggctccaggg

SEQ ID NO: 522555 - DNA, 14 bp, Homo sapiens
ccggggtgtggaat

SEQ ID NO: 522556 - DNA, 21 bp, Homo sapiens
ccgtctgggaatcctggacag

SEQ ID NO: 522557 - DNA, 23 bp, Homo sapiens
ccgtctttggttcctcatggctg

SEQ ID NO: 522558 - DNA, 11 bp, Homo sapiens
ccgtgttctcc

SEQ ID NO: 522559 - DNA, 23 bp, Homo sapiens
ccgttgtgtgggtttactctgtg

SEQ ID NO: 522560 - DNA, 19 bp, Homo sapiens
cctaaagggaagccctgac

SEQ ID NO: 522561 - DNA, 13 bp, Homo sapiens
cctaaatgcaaag

SEQ ID NO: 522562 - DNA, 19 bp, Homo sapiens
cctaagtaaatctaaatta

SEQ ID NO: 522563 - DNA, 13 bp, Homo sapiens
cctacgtgctgcc

SEQ ID NO: 522564 - DNA, 20 bp, Homo sapiens
ctatcaccaaaagacgaggc

SEQ ID NO: 522565 - DNA, 14 bp, Homo sapiens
ctatctggaaaaaa

SEQ ID NO: 522566 - DNA, 20 bp, Homo sapiens
ctatctggaaaaaaaaaaat

SEQ ID NO: 522567 - DNA, 13 bp, Homo sapiens
ctattgctgtaaa

SEQ ID NO: 522568 - DNA, 20 bp, Homo sapiens
ctattgctgtaaataaaaat

SEQ ID NO: 522569 - DNA, 18 bp, Homo sapiens
ctatttcaacttcaggaa

SEQ ID NO: 522570 - DNA, 13 bp, Homo sapiens
ctcaaaatgtgcc

SEQ ID NO: 522571 - DNA, 19 bp, Homo sapiens
ctcaagtcggtgggcctgc

SEQ ID NO: 522572 - DNA, 16 bp, Homo sapiens
ctcaatcatgacttct

SEQ ID NO: 522573 - DNA, 12 bp, Homo sapiens
ctcaatgtgctg

SEQ ID NO: 522574 - DNA, 20 bp, Homo sapiens
ctcaatgtgctgttgattct

SEQ ID NO: 522575 - DNA, 17 bp, Homo sapiens
ctcacaccggcactgtg

SEQ ID NO: 522576 - DNA, 16 bp, Homo sapiens
ctcacacttgggctgg

SEQ ID NO: 522577 - DNA, 17 bp, Homo sapiens
ctcacacttgggctggc

SEQ ID NO: 522578 - DNA, 17 bp, Homo sapiens
ctcaccaggaaattctg

SEQ ID NO: 522579 - DNA, 21 bp, Homo sapiens
ctcaccatttaatcatttcca

SEQ ID NO: 522580 - DNA, 15 bp, Homo sapiens
ctcaccttctgtttt

SEQ ID NO: 522581 - DNA, 19 bp, Homo sapiens
ctcagaagtgaaaaagact

SEQ ID NO: 522582 - DNA, 22 bp, Homo sapiens
ctcagaagtgaaaaagacttca

SEQ ID NO: 522583 - DNA, 15 bp, Homo sapiens
ctcagaggagaggag

SEQ ID NO: 522584 - DNA, 18 bp, Homo sapiens
ctcagaggagaggagcaa

SEQ ID NO: 522585 - DNA, 20 bp, Homo sapiens
ctcagcaaggggctgcttct

SEQ ID NO: 522586 - DNA, 13 bp, Homo sapiens
ctcaggcagcctg

SEQ ID NO: 522587 - DNA, 14 bp, Homo sapiens
ctcaggcagcctgt

SEQ ID NO: 522588 - DNA, 16 bp, Homo sapiens
ctcaggcagcctgtgg

SEQ ID NO: 522589 - DNA, 13 bp, Homo sapiens
ctcaggctactgc

SEQ ID NO: 522590 - DNA, 17 bp, Homo sapiens
ctcagggaccaaggaga

SEQ ID NO: 522591 - DNA, 16 bp, Homo sapiens
ctcaggtgcgtgccac

SEQ ID NO: 522592 - DNA, 19 bp, Homo sapiens
ctcagtgcagggacagcct

SEQ ID NO: 522593 - DNA, 24 bp, Homo sapiens
ctcagtgcagggacagcctgcaca

SEQ ID NO: 522594 - DNA, 14 bp, Homo sapiens
ctcatcaacaaaga

SEQ ID NO: 522595 - DNA, 15 bp, Homo sapiens
ctcatcaacaaagaa

SEQ ID NO: 522596 - DNA, 20 bp, Homo sapiens
ctcatctgtaaaaccaggct

SEQ ID NO: 522597 - DNA, 21 bp, Homo sapiens
ctcatctgtaaaaccaggctg

SEQ ID NO: 522598 - DNA, 18 bp, Homo sapiens
ctcatggctgttatctgt

SEQ ID NO: 522599 - DNA, 19 bp, Homo sapiens
ctccagggcgcaggggagg

SEQ ID NO: 522600 - DNA, 14 bp, Homo sapiens
ctcccagcagaggc

SEQ ID NO: 522601 - DNA, 13 bp, Homo sapiens
ctcccagggtcct

SEQ ID NO: 522602 - DNA, 16 bp, Homo sapiens
ctcccagggtcctggg

SEQ ID NO: 522603 - DNA, 16 bp, Homo sapiens
ctcccctggtcctgca

SEQ ID NO: 522604 - DNA, 15 bp, Homo sapiens
ctcccggtgtgcagc

SEQ ID NO: 522605 - DNA, 22 bp, Homo sapiens
ctccctgcctggatccagctct

SEQ ID NO: 522606 - DNA, 14 bp, Homo sapiens
ctccctgctccctg

SEQ ID NO: 522607 - DNA, 16 bp, Homo sapiens
ctccctgctccctgct

SEQ ID NO: 522608 - DNA, 15 bp, Homo sapiens
ctccctgctgccagg

SEQ ID NO: 522609 - DNA, 14 bp, Homo sapiens
ctccgcccttccct

SEQ ID NO: 522610 - DNA, 12 bp, Homo sapiens
ctcctccaaatg

SEQ ID NO: 522611 - DNA, 13 bp, Homo sapiens
ctcctccatgctg

SEQ ID NO: 522612 - DNA, 17 bp, Homo sapiens
ctcctccccctcctcca

SEQ ID NO: 522613 - DNA, 22 bp, Homo sapiens
ctcctccccctcctccatgctg

SEQ ID NO: 522614 - DNA, 20 bp, Homo sapiens
ctcctcggtggcatttgctg

SEQ ID NO: 522615 - DNA, 18 bp, Homo sapiens
ctcctgctgaccttctgc

SEQ ID NO: 522616 - DNA, 21 bp, Homo sapiens
ctcctgctgaccttctgcggc

SEQ ID NO: 522617 - DNA, 13 bp, Homo sapiens
ctcctgtctcctc

SEQ ID NO: 522618 - DNA, 20 bp, Homo sapiens
ctccttgaaaccagctcagg

SEQ ID NO: 522619 - DNA, 15 bp, Homo sapiens
ctcgggctctctcac

SEQ ID NO: 522620 - DNA, 16 bp, Homo sapiens
ctcgtgtttcacagtg

SEQ ID NO: 522621 - DNA, 14 bp, Homo sapiens
ctctcaaaatgtgc

SEQ ID NO: 522622 - DNA, 16 bp, Homo sapiens
ctctcaaaatgtgccg

SEQ ID NO: 522623 - DNA, 16 bp, Homo sapiens
ctctcacccagcctgg

SEQ ID NO: 522624 - DNA, 17 bp, Homo sapiens
ctctcctcggtggcatt

SEQ ID NO: 522625 - DNA, 18 bp, Homo sapiens
ctctcctcggtggcattt

SEQ ID NO: 522626 - DNA, 23 bp, Homo sapiens
ctctcctcggtggcatttgctga

SEQ ID NO: 522627 - DNA, 16 bp, Homo sapiens
ctctcgggctctctca

SEQ ID NO: 522628 - DNA, 17 bp, Homo sapiens
ctctcgggctctctcac

SEQ ID NO: 522629 - DNA, 21 bp, Homo sapiens
ctctctgaactgcaacactgg

SEQ ID NO: 522630 - DNA, 13 bp, Homo sapiens
ctctcttcttact

SEQ ID NO: 522631 - DNA, 19 bp, Homo sapiens
ctctgtgctaagttgtctt

SEQ ID NO: 522632 - DNA, 20 bp, Homo sapiens
ctctgtgctaagttgtctta

SEQ ID NO: 522633 - DNA, 22 bp, Homo sapiens
ctcttacctgtaatagcctcac

SEQ ID NO: 522634 - DNA, 18 bp, Homo sapiens
ctcttggtctctttcttt

SEQ ID NO: 522635 - DNA, 17 bp, Homo sapiens
ctgaaattatgtcaaat

SEQ ID NO: 522636 - DNA, 20 bp, Homo sapiens
ctgaaattatgtcaaatgga

SEQ ID NO: 522637 - DNA, 22 bp, Homo sapiens
ctgaacagaccggggtggagtc

SEQ ID NO: 522638 - DNA, 18 bp, Homo sapiens
ctgaactgcaacactgga

SEQ ID NO: 522639 - DNA, 17 bp, Homo sapiens
ctgcagttagcacagag

SEQ ID NO: 522640 - DNA, 14 bp, Homo sapiens
ctgcatggctgaga

SEQ ID NO: 522641 - DNA, 22 bp, Homo sapiens
ctgccactcaggcagcctgtgg

SEQ ID NO: 522642 - DNA, 17 bp, Homo sapiens
ctgccaggctcccactg

SEQ ID NO: 522643 - DNA, 18 bp, Homo sapiens
ctgcccgagggcaggggc

SEQ ID NO: 522644 - DNA, 22 bp, Homo sapiens
ctgcccgagggcaggggccgtg

SEQ ID NO: 522645 - DNA, 16 bp, Homo sapiens
ctgccctccgcccttc

SEQ ID NO: 522646 - DNA, 18 bp, Homo sapiens
ctgccctctgccactgac

SEQ ID NO: 522647 - DNA, 17 bp, Homo sapiens
ctgccgaggtgtggctg

SEQ ID NO: 522648 - DNA, 20 bp, Homo sapiens
ctgccggtggggccagcgct

SEQ ID NO: 522649 - DNA, 15 bp, Homo sapiens
ctgcctgagaccacg

SEQ ID NO: 522650 - DNA, 22 bp, Homo sapiens
ctgcctggaggagaaggaggaa

SEQ ID NO: 522651 - DNA, 13 bp, Homo sapiens
ctgcctggccttg

SEQ ID NO: 522652 - DNA, 22 bp, Homo sapiens
ctgcctgtggtgaggtcctgtc

SEQ ID NO: 522653 - DNA, 15 bp, Homo sapiens
ctgctcccggtgtgc

SEQ ID NO: 522654 - DNA, 22 bp, Homo sapiens
ctgctcccggtgtgcagcgggt

SEQ ID NO: 522655 - DNA, 19 bp, Homo sapiens
ctgctgaccttctgcggct

SEQ ID NO: 522656 - DNA, 12 bp, Homo sapiens
ctgctgcactgc

SEQ ID NO: 522657 - DNA, 13 bp, Homo sapiens
ctgctgcactgcc

SEQ ID NO: 522658 - DNA, 17 bp, Homo sapiens
ctgctgcactgccctcc

SEQ ID NO: 522659 - DNA, 17 bp, Homo sapiens
ctgctgcagtcagcaca

SEQ ID NO: 522660 - DNA, 19 bp, Homo sapiens
ctgctgcagtcagcacaga

SEQ ID NO: 522661 - DNA, 23 bp, Homo sapiens
ctgcttagtatctcatcaacaaa

SEQ ID NO: 522662 - DNA, 17 bp, Homo sapiens
ctgcttagtgtccctta

SEQ ID NO: 522663 - DNA, 14 bp, Homo sapiens
ctgcttctggggct

SEQ ID NO: 522664 - DNA, 13 bp, Homo sapiens
ctgcttttgatgg

SEQ ID NO: 522665 - DNA, 19 bp, Homo sapiens
ctggaataagaagcaaata

SEQ ID NO: 522666 - DNA, 14 bp, Homo sapiens
ctggacatattccc

SEQ ID NO: 522667 - DNA, 16 bp, Homo sapiens
ctggacgcatgcaggg

SEQ ID NO: 522668 - DNA, 19 bp, Homo sapiens
ctggaggagaaggaggaac

SEQ ID NO: 522669 - DNA, 13 bp, Homo sapiens
ctggcacccactg

SEQ ID NO: 522670 - DNA, 15 bp, Homo sapiens
ctggctcccagggtc

SEQ ID NO: 522671 - DNA, 14 bp, Homo sapiens
ctgggcagaagggg

SEQ ID NO: 522672 - DNA, 14 bp, Homo sapiens
ctggggagggacac

SEQ ID NO: 522673 - DNA, 15 bp, Homo sapiens
ctggggagggacaca

SEQ ID NO: 522674 - DNA, 17 bp, Homo sapiens
ctggggagggacacaga

SEQ ID NO: 522675 - DNA, 16 bp, Homo sapiens
ctggggaggggctccg

SEQ ID NO: 522676 - DNA, 18 bp, Homo sapiens
ctggggctccctgcctgg

SEQ ID NO: 522677 - DNA, 12 bp, Homo sapiens
ctgggtcccggg

SEQ ID NO: 522678 - DNA, 15 bp, Homo sapiens
ctggtcctgcactgt

SEQ ID NO: 522679 - DNA, 20 bp, Homo sapiens
ctgtaaaatacatggtatct

SEQ ID NO: 522680 - DNA, 18 bp, Homo sapiens
ctgtaaataaaaatagct

SEQ ID NO: 522681 - DNA, 17 bp, Homo sapiens
ctgtaatagcctcacct

SEQ ID NO: 522682 - DNA, 19 bp, Homo sapiens
ctgtattgttacagctgaa

SEQ ID NO: 522683 - DNA, 16 bp, Homo sapiens
ctgtcagcttcccaac

SEQ ID NO: 522684 - DNA, 19 bp, Homo sapiens
ctgtcagcttcccaacaat

SEQ ID NO: 522685 - DNA, 20 bp, Homo sapiens
ctgtcagcttcccaacaata

SEQ ID NO: 522686 - DNA, 14 bp, Homo sapiens
ctgtcagtttgtga

SEQ ID NO: 522687 - DNA, 21 bp, Homo sapiens
ctgtcccggagctcaggccct

SEQ ID NO: 522688 - DNA, 14 bp, Homo sapiens
ctgtccctgtgggc

SEQ ID NO: 522689 - DNA, 18 bp, Homo sapiens
ctgtccctgtgggctcac

SEQ ID NO: 522690 - DNA, 19 bp, Homo sapiens
ctgtccctgtgggctcaca

SEQ ID NO: 522691 - DNA, 20 bp, Homo sapiens
ctgtccctgtgggctcacac

SEQ ID NO: 522692 - DNA, 23 bp, Homo sapiens
ctgtccctgtgggctcacaccgg

SEQ ID NO: 522693 - DNA, 14 bp, Homo sapiens
ctgtcctggctccc

SEQ ID NO: 522694 - DNA, 12 bp, Homo sapiens
ctgtctcctctg

SEQ ID NO: 522695 - DNA, 20 bp, Homo sapiens
ctgtctctacaaaaaaaatc

SEQ ID NO: 522696 - DNA, 12 bp, Homo sapiens
ctgtctgtggct

SEQ ID NO: 522697 - DNA, 18 bp, Homo sapiens
ctgtgaaagtctcctgta

SEQ ID NO: 522698 - DNA, 16 bp, Homo sapiens
ctgtgaaatgactgca

SEQ ID NO: 522699 - DNA, 18 bp, Homo sapiens
ctgtgacacagctgagct

SEQ ID NO: 522700 - DNA, 19 bp, Homo sapiens
ctgtgagataaatatcatt

SEQ ID NO: 522701 - DNA, 15 bp, Homo sapiens
ctgtgcatctggcct

SEQ ID NO: 522702 - DNA, 15 bp, Homo sapiens
ctgtgctaagttgtc

SEQ ID NO: 522703 - DNA, 22 bp, Homo sapiens
ctgtgctggtgggggcctcttt

SEQ ID NO: 522704 - DNA, 20 bp, Homo sapiens
ctgtggcttcccatgtcttt

SEQ ID NO: 522705 - DNA, 14 bp, Homo sapiens
ctgtgggctcacac

SEQ ID NO: 522706 - DNA, 15 bp, Homo sapiens
ctgtgggctcacacc

SEQ ID NO: 522707 - DNA, 22 bp, Homo sapiens
ctgtgggctcacaccggcactg

SEQ ID NO: 522708 - DNA, 23 bp, Homo sapiens
ctgtgtagtagctcgtgtgctta

SEQ ID NO: 522709 - DNA, 15 bp, Homo sapiens
ctgtgtcatctgtca

SEQ ID NO: 522710 - DNA, 21 bp, Homo sapiens
ctgttaaggcatccacttcac

SEQ ID NO: 522711 - DNA, 14 bp, Homo sapiens
ctgttatctgtctt

SEQ ID NO: 522712 - DNA, 20 bp, Homo sapiens
ctgttatctgtctttatgat

SEQ ID NO: 522713 - DNA, 22 bp, Homo sapiens
ctgttatctgtctttatgattt

SEQ ID NO: 522714 - DNA, 18 bp, Homo sapiens
ctgttgacctaccctgga

SEQ ID NO: 522715 - DNA, 19 bp, Homo sapiens
ctgttgacctaccctggac

SEQ ID NO: 522716 - DNA, 23 bp, Homo sapiens
ctgttgattctttcaatccacag

SEQ ID NO: 522717 - DNA, 15 bp, Homo sapiens
cttaaacaaaaactt

SEQ ID NO: 522718 - DNA, 22 bp, Homo sapiens
cttaaacaaaaactttccatga

SEQ ID NO: 522719 - DNA, 12 bp, Homo sapiens
cttaagaagtat

SEQ ID NO: 522720 - DNA, 15 bp, Homo sapiens
cttaagtcttactgt

SEQ ID NO: 522721 - DNA, 23 bp, Homo sapiens
cttaggcaatggtgaactgtcat

SEQ ID NO: 522722 - DNA, 22 bp, Homo sapiens
cttagtatctcatcaacaaaga

SEQ ID NO: 522723 - DNA, 17 bp, Homo sapiens
cttagtgtcccttacct

SEQ ID NO: 522724 - DNA, 23 bp, Homo sapiens
cttatgtcatttcttctctctgt

SEQ ID NO: 522725 - DNA, 14 bp, Homo sapiens
cttcatgctgtctg

SEQ ID NO: 522726 - DNA, 16 bp, Homo sapiens
cttcatgctgtctgtg

SEQ ID NO: 522727 - DNA, 14 bp, Homo sapiens
cttcatggaactca

SEQ ID NO: 522728 - DNA, 21 bp, Homo sapiens
cttcccaacaatactttgtgt

SEQ ID NO: 522729 - DNA, 21 bp, Homo sapiens
cttcccatgtctttctccaaa

SEQ ID NO: 522730 - DNA, 14 bp, Homo sapiens
cttccctagttctt

SEQ ID NO: 522731 - DNA, 16 bp, Homo sapiens
cttccctgacactgtc

SEQ ID NO: 522732 - DNA, 24 bp, Homo sapiens
cttccctgacactgtctgctgccc

SEQ ID NO: 522733 - DNA, 23 bp, Homo sapiens
cttctaaaggtttcactgttcat

SEQ ID NO: 522734 - DNA, 20 bp, Homo sapiens
cttctaaatcataatcatcc

SEQ ID NO: 522735 - DNA, 21 bp, Homo sapiens
cttctaatccatgtgctgctg

SEQ ID NO: 522736 - DNA, 21 bp, Homo sapiens
cttctcaaatgctactcagta

SEQ ID NO: 522737 - DNA, 16 bp, Homo sapiens
cttctggctgctgcag

SEQ ID NO: 522738 - DNA, 15 bp, Homo sapiens
cttctggggagggac

SEQ ID NO: 522739 - DNA, 22 bp, Homo sapiens
cttctggggagggacacagagg

SEQ ID NO: 522740 - DNA, 22 bp, Homo sapiens
gcctgggaaattgctccattcc

SEQ ID NO: 522741 - DNA, 19 bp, Homo sapiens
gcctgtggtgaggtcctgt

SEQ ID NO: 522742 - DNA, 20 bp, Homo sapiens
gcggcagggcaggagcttgg

SEQ ID NO: 522743 - DNA, 13 bp, Homo sapiens
gcggcttccctgc

SEQ ID NO: 522744 - DNA, 20 bp, Homo sapiens
gcgtccctgagggcccttcc

SEQ ID NO: 522745 - DNA, 14 bp, Homo sapiens
gctagtttaaaatt

SEQ ID NO: 522746 - DNA, 21 bp, Homo sapiens
gctagtttaaaattattaaaa

SEQ ID NO: 522747 - DNA, 12 bp, Homo sapiens
gctatgcacacc

SEQ ID NO: 522748 - DNA, 18 bp, Homo sapiens
gctatgcacaccaaattg

SEQ ID NO: 522749 - DNA, 17 bp, Homo sapiens
gctcaaggctgcagtga

SEQ ID NO: 522750 - DNA, 14 bp, Homo sapiens
gctcaatgtgctgt

SEQ ID NO: 522751 - DNA, 20 bp, Homo sapiens
gctcacacttgggctggcac

SEQ ID NO: 522752 - DNA, 14 bp, Homo sapiens
gctcagaggagagg

SEQ ID NO: 522753 - DNA, 23 bp, Homo sapiens
gctcagtattgagacactgtcaa

SEQ ID NO: 522754 - DNA, 15 bp, Homo sapiens
gctcatcagaaacaa

SEQ ID NO: 522755 - DNA, 17 bp, Homo sapiens
gctccagggagtgggga

SEQ ID NO: 522756 - DNA, 14 bp, Homo sapiens
gctccatcttattt

SEQ ID NO: 522757 - DNA, 16 bp, Homo sapiens
gctcccagcagaggcc

SEQ ID NO: 522758 - DNA, 10 bp, Homo sapiens
gctccctgct

SEQ ID NO: 522759 - DNA, 17 bp, Homo sapiens
gtggctctaactccttg

SEQ ID NO: 522760 - DNA, 19 bp, Homo sapiens
gtgggagcacagctttcct

SEQ ID NO: 522761 - DNA, 12 bp, Homo sapiens
gtgggctcacac

SEQ ID NO: 522762 - DNA, 13 bp, Homo sapiens
gtgggctcacacc

SEQ ID NO: 522763 - DNA, 22 bp, Homo sapiens
gtgggctcacaccggcactgtg

SEQ ID NO: 522764 - DNA, 22 bp, Homo sapiens
gtgggctccagggactggagtg

SEQ ID NO: 522765 - DNA, 15 bp, Homo sapiens
gtggggccagcgctg

SEQ ID NO: 522766 - DNA, 19 bp, Homo sapiens
gtggtcttcaaattgtctt

SEQ ID NO: 522767 - DNA, 23 bp, Homo sapiens
gtggtcttcaaattgtcttttgt

SEQ ID NO: 522768 - DNA, 20 bp, Homo sapiens
gtggtgaggttgtgctgcct

SEQ ID NO: 522769 - DNA, 14 bp, Homo sapiens
gtggttctgccact

SEQ ID NO: 522770 - DNA, 18 bp, Homo sapiens
gtgtacatttatgtgtga

SEQ ID NO: 522771 - DNA, 15 bp, Homo sapiens
gtgtcacttttttcc

SEQ ID NO: 522772 - DNA, 14 bp, Homo sapiens
gtgtcatctgtcag

SEQ ID NO: 522773 - DNA, 16 bp, Homo sapiens
gtgtcatctgtcagct

SEQ ID NO: 522774 - DNA, 15 bp, Homo sapiens
gtgtggcctggcttc

SEQ ID NO: 522775 - DNA, 13 bp, Homo sapiens
gttaattaaacaa

SEQ ID NO: 522776 - DNA, 22 bp, Homo sapiens
gttaggattaggtttagaatca

SEQ ID NO: 522777 - DNA, 14 bp, Homo sapiens
gttatctgtcttta

SEQ ID NO: 522778 - DNA, 15 bp, Homo sapiens
gttcacgcaacttga

SEQ ID NO: 522779 - DNA, 18 bp, Homo sapiens
gttctcctccaaatgctg

SEQ ID NO: 522780 - DNA, 21 bp, Homo sapiens
gttctctcttggtctctttct

SEQ ID NO: 522781 - DNA, 15 bp, Homo sapiens
gttctgccacttagg

SEQ ID NO: 522782 - DNA, 15 bp, Homo sapiens
gttcttgcagcagag

SEQ ID NO: 522783 - DNA, 18 bp, Homo sapiens
gttcttgcagcagagaga

SEQ ID NO: 522784 - DNA, 16 bp, Homo sapiens
gttcttgtaaaactgt

SEQ ID NO: 522785 - DNA, 18 bp, Homo sapiens
gttcttgtaaaactgtga

SEQ ID NO: 522786 - DNA, 17 bp, Homo sapiens
gttgcttaatctagagc

SEQ ID NO: 522787 - DNA, 12 bp, Homo sapiens
gttgtccctgca

SEQ ID NO: 522788 - DNA, 14 bp, Homo sapiens
gttgtccctgcagg

SEQ ID NO: 522789 - DNA, 21 bp, Homo sapiens
gttgtcctgtgtcatctgtca

SEQ ID NO: 522790 - DNA, 20 bp, Homo sapiens
gttgtgtgggtttactctgt

SEQ ID NO: 522791 - DNA, 15 bp, Homo sapiens
gttgttgtccctgca

SEQ ID NO: 522792 - DNA, 13 bp, Homo sapiens
gtttaaaattatt

SEQ ID NO: 522793 - DNA, 21 bp, Homo sapiens
gtttcatttttcattttctct

SEQ ID NO: 522794 - DNA, 19 bp, Homo sapiens
gtttccagctaagcctgat

SEQ ID NO: 522795 - DNA, 17 bp, Homo sapiens
gtttgctgcttttgatg

SEQ ID NO: 522796 - DNA, 13 bp, Homo sapiens
gtttgcttctaaa

SEQ ID NO: 522797 - DNA, 14 bp, Homo sapiens
taaaaaaataatat

SEQ ID NO: 522798 - DNA, 15 bp, Homo sapiens
taaaaaaataatata

SEQ ID NO: 522799 - DNA, 21 bp, Homo sapiens
taaaaaagatggatttgacac

SEQ ID NO: 522800 - DNA, 19 bp, Homo sapiens
taaaaagccaagtgtcctg

SEQ ID NO: 522801 - DNA, 21 bp, Homo sapiens
taaaaatagctataaatagtg

SEQ ID NO: 522802 - DNA, 18 bp, Homo sapiens
taaaaattatctttaaaa

SEQ ID NO: 522803 - DNA, 20 bp, Homo sapiens
taaaacattatagattttca

SEQ ID NO: 522804 - DNA, 10 bp, Homo sapiens
taaaactgtg

SEQ ID NO: 522805 - DNA, 14 bp, Homo sapiens
taaaactgtgacat

SEQ ID NO: 522806 - DNA, 18 bp, Homo sapiens
taaaactgtgacattcca

SEQ ID NO: 522807 - DNA, 18 bp, Homo sapiens
taaaacttactatggtat

SEQ ID NO: 522808 - DNA, 13 bp, Homo sapiens
taaaatacttctt

SEQ ID NO: 522809 - DNA, 17 bp, Homo sapiens
taaaatctgtattgcta

SEQ ID NO: 522810 - DNA, 15 bp, Homo sapiens
taaaattattaaaaa

SEQ ID NO: 522811 - DNA, 20 bp, Homo sapiens
taaaattattaaaaattata

SEQ ID NO: 522812 - DNA, 15 bp, Homo sapiens
taaacaaaaactttc

SEQ ID NO: 522813 - DNA, 17 bp, Homo sapiens
taaacaaaaactttcca

SEQ ID NO: 522814 - DNA, 22 bp, Homo sapiens
taaacaaaaactttccatgaca

SEQ ID NO: 522815 - DNA, 23 bp, Homo sapiens
taaacaaaaactttccatgacag

SEQ ID NO: 522816 - DNA, 11 bp, Homo sapiens
taaacaaatgg

SEQ ID NO: 522817 - DNA, 17 bp, Homo sapiens
taaacacagattatttg

SEQ ID NO: 522818 - DNA, 18 bp, Homo sapiens
taaacacagattatttgt

SEQ ID NO: 522819 - DNA, 10 bp, Homo sapiens
taaactgtga

SEQ ID NO: 522820 - DNA, 11 bp, Homo sapiens
taaactgtgag

SEQ ID NO: 522821 - DNA, 13 bp, Homo sapiens
taaactgtgagat

SEQ ID NO: 522822 - DNA, 17 bp, Homo sapiens
taaactgtgagataaat

SEQ ID NO: 522823 - DNA, 19 bp, Homo sapiens
taaactgtgagataaatat

SEQ ID NO: 522824 - DNA, 16 bp, Homo sapiens
taaagggaagccctga

SEQ ID NO: 522825 - DNA, 21 bp, Homo sapiens
taaatatcattatagcatgta

SEQ ID NO: 522826 - DNA, 17 bp, Homo sapiens
taaatctaaattaactt

SEQ ID NO: 522827 - DNA, 12 bp, Homo sapiens
taaatgaaatac

SEQ ID NO: 522828 - DNA, 14 bp, Homo sapiens
taaatgaaatactt

SEQ ID NO: 522829 - DNA, 12 bp, Homo sapiens
taaatgaatgaa

SEQ ID NO: 522830 - DNA, 14 bp, Homo sapiens
taaatgcctaataa

SEQ ID NO: 522831 - DNA, 15 bp, Homo sapiens
taaattaacttctat

SEQ ID NO: 522832 - DNA, 15 bp, Homo sapiens
taaattcaaacctaa

SEQ ID NO: 522833 - DNA, 16 bp, Homo sapiens
taaattcctcctgtct

SEQ ID NO: 522834 - DNA, 13 bp, Homo sapiens
taacaaagtgaga

SEQ ID NO: 522835 - DNA, 23 bp, Homo sapiens
taactgtcctttttcttccctta

SEQ ID NO: 522836 - DNA, 16 bp, Homo sapiens
taacttgctgtgaaat

SEQ ID NO: 522837 - DNA, 18 bp, Homo sapiens
taagataattaaatgaaa

SEQ ID NO: 522838 - DNA, 21 bp, Homo sapiens
taagataattaaatgaaatac

SEQ ID NO: 522839 - DNA, 11 bp, Homo sapiens
taagtcttact

SEQ ID NO: 522840 - DNA, 14 bp, Homo sapiens
taagttgtcttaca

SEQ ID NO: 522841 - DNA, 12 bp, Homo sapiens
taatataaatga

SEQ ID NO: 522842 - DNA, 14 bp, Homo sapiens
taatatagggtttg

SEQ ID NO: 522843 - DNA, 16 bp, Homo sapiens
taatatagggtttgtt

SEQ ID NO: 522844 - DNA, 15 bp, Homo sapiens
taatattaaattcct

SEQ ID NO: 522845 - DNA, 20 bp, Homo sapiens
taatcatccttttttaaaaa

SEQ ID NO: 522846 - DNA, 16 bp, Homo sapiens
taatccatgtgctgct

SEQ ID NO: 522847 - DNA, 16 bp, Homo sapiens
taatctagagctatgc

SEQ ID NO: 522848 - DNA, 22 bp, Homo sapiens
tcaatgttcacgcaacttgaaa

SEQ ID NO: 522849 - DNA, 19 bp, Homo sapiens
tcacactctcttcttactg

SEQ ID NO: 522850 - DNA, 14 bp, Homo sapiens
tcacacttgggctg

SEQ ID NO: 522851 - DNA, 19 bp, Homo sapiens
tcacacttgggctggcacc

SEQ ID NO: 522852 - DNA, 14 bp, Homo sapiens
tcacagtgggcggc

SEQ ID NO: 522853 - DNA, 13 bp, Homo sapiens
tcacattcctgac

SEQ ID NO: 522854 - DNA, 15 bp, Homo sapiens
tcaccatttaatcat

SEQ ID NO: 522855 - DNA, 23 bp, Homo sapiens
tcaccgagaggaaaaaggcttct

SEQ ID NO: 522856 - DNA, 20 bp, Homo sapiens
tcaccttctgttttagagtt

SEQ ID NO: 522857 - DNA, 16 bp, Homo sapiens
tcacttgtttgtgttt

SEQ ID NO: 522858 - DNA, 20 bp, Homo sapiens
tcgcctgggaaattgctcca

SEQ ID NO: 522859 - DNA, 15 bp, Homo sapiens
tcgccttctggctgc

SEQ ID NO: 522860 - DNA, 19 bp, Homo sapiens
tcggacaccatcttgggat

SEQ ID NO: 522861 - DNA, 13 bp, Homo sapiens
tcggccgaggcct

SEQ ID NO: 522862 - DNA, 14 bp, Homo sapiens
tcggccgaggcctg

SEQ ID NO: 522863 - DNA, 19 bp, Homo sapiens
tcgtccatttaaacccggc

SEQ ID NO: 522864 - DNA, 16 bp, Homo sapiens
tcgtgtgcttagaaac

SEQ ID NO: 522865 - DNA, 22 bp, Homo sapiens
tctaaaggtttcactgttcatg

SEQ ID NO: 522866 - DNA, 16 bp, Homo sapiens
tctaatccatgtgctg

SEQ ID NO: 522867 - DNA, 22 bp, Homo sapiens
tctagagctatgcacaccaaat

SEQ ID NO: 522868 - DNA, 14 bp, Homo sapiens
tctcaaaatgtgcc

SEQ ID NO: 522869 - DNA, 18 bp, Homo sapiens
tctcaaaatgtgccgtct

SEQ ID NO: 522870 - DNA, 23 bp, Homo sapiens
tctcatggtattatctagtaggt

SEQ ID NO: 522871 - DNA, 16 bp, Homo sapiens
tctccacaacctcctc

SEQ ID NO: 522872 - DNA, 16 bp, Homo sapiens
tctcctccaaatgctg

SEQ ID NO: 522873 - DNA, 18 bp, Homo sapiens
tctcctccaaatgctgtc

SEQ ID NO: 522874 - DNA, 23 bp, Homo sapiens
tctcctcggtggcatttgctgaa

SEQ ID NO: 522875 - DNA, 12 bp, Homo sapiens
tctcctctgtca

SEQ ID NO: 522876 - DNA, 22 bp, Homo sapiens
tctcctctgtcagtttgtgaag

SEQ ID NO: 522877 - DNA, 14 bp, Homo sapiens
tctctcaaaatgtg

SEQ ID NO: 522878 - DNA, 16 bp, Homo sapiens
tctctcaaaatgtgcc

SEQ ID NO: 522879 - DNA, 16 bp, Homo sapiens
tctctcttggtctctt

SEQ ID NO: 522880 - DNA, 22 bp, Homo sapiens
tctctcttggtctctttctttc

SEQ ID NO: 522881 - DNA, 21 bp, Homo sapiens
tctctgaactgcaacactgga

SEQ ID NO: 522882 - DNA, 17 bp, Homo sapiens
tctcttcttactgtatt

SEQ ID NO: 522883 - DNA, 17 bp, Homo sapiens
tctcttggtctctttct

SEQ ID NO: 522884 - DNA, 13 bp, Homo sapiens
tctctttctttcc

SEQ ID NO: 522885 - DNA, 12 bp, Homo sapiens
tctgaaaactgg

SEQ ID NO: 522886 - DNA, 19 bp, Homo sapiens
tctgaactgcaacactgga

SEQ ID NO: 522887 - DNA, 18 bp, Homo sapiens
tctgaatctctcaaaatg

SEQ ID NO: 522888 - DNA, 21 bp, Homo sapiens
tctgatacttatttataacat

SEQ ID NO: 522889 - DNA, 22 bp, Homo sapiens
tctgccggtggggccagcgctg

SEQ ID NO: 522890 - DNA, 18 bp, Homo sapiens
tctgcgacgatccccatg

SEQ ID NO: 522891 - DNA, 20 bp, Homo sapiens
tctggggagggacacagagg

SEQ ID NO: 522892 - DNA, 17 bp, Homo sapiens
tctggtgtctaataaac

SEQ ID NO: 522893 - DNA, 14 bp, Homo sapiens
tctgtcaatgaaaa

SEQ ID NO: 522894 - DNA, 15 bp, Homo sapiens
tctgtcagtttgtga

SEQ ID NO: 522895 - DNA, 18 bp, Homo sapiens
tctgtgcatctggcctgg

SEQ ID NO: 522896 - DNA, 19 bp, Homo sapiens
tctgtgcatctggcctggg

SEQ ID NO: 522897 - DNA, 23 bp, Homo sapiens
tctgtgtagtagctcgtgtgctt

SEQ ID NO: 522898 - DNA, 21 bp, Homo sapiens
tctgtttatgttcttgcagca

SEQ ID NO: 522899 - DNA, 13 bp, Homo sapiens
tcttaaaaattat

SEQ ID NO: 522900 - DNA, 15 bp, Homo sapiens
tcttctacttcttgt

SEQ ID NO: 522901 - DNA, 15 bp, Homo sapiens
tcttctctctgtgct

SEQ ID NO: 522902 - DNA, 16 bp, Homo sapiens
tcttctctctgtgctg

SEQ ID NO: 522903 - DNA, 15 bp, Homo sapiens
tcttcttttcccatt

SEQ ID NO: 522904 - DNA, 15 bp, Homo sapiens
tcttggtatgatcat

SEQ ID NO: 522905 - DNA, 19 bp, Homo sapiens
tcttgtaaaactgtgacat

SEQ ID NO: 522906 - DNA, 16 bp, Homo sapiens
tctttatgatttcatg

SEQ ID NO: 522907 - DNA, 19 bp, Homo sapiens
tctttccaaaggttgtaca

SEQ ID NO: 522908 - DNA, 17 bp, Homo sapiens
tctttctccaaagttat

SEQ ID NO: 522909 - DNA, 15 bp, Homo sapiens
tctttctttccaaag

SEQ ID NO: 522910 - DNA, 14 bp, Homo sapiens
tctttggttcctca

SEQ ID NO: 522911 - DNA, 12 bp, Homo sapiens
tctttgttgctt

SEQ ID NO: 522912 - DNA, 12 bp, Homo sapiens
tcttttgttctc

SEQ ID NO: 522913 - DNA, 14 bp, Homo sapiens
tcttttgttctctc

SEQ ID NO: 522914 - DNA, 18 bp, Homo sapiens
tgaaaaagacttcaaatg

SEQ ID NO: 522915 - DNA, 20 bp, Homo sapiens
tgaaaaatagtgtgtccatg

SEQ ID NO: 522916 - DNA, 23 bp, Homo sapiens
tgaaaactggaataagaagcaaa

SEQ ID NO: 522917 - DNA, 20 bp, Homo sapiens
tgaaagtctcctgtatcatt

SEQ ID NO: 522918 - DNA, 17 bp, Homo sapiens
tgaaatataaactgtga

SEQ ID NO: 522919 - DNA, 23 bp, Homo sapiens
tgaaatataaactgtgagataaa

SEQ ID NO: 522920 - DNA, 14 bp, Homo sapiens
tgaaattatgtcaa

SEQ ID NO: 522921 - DNA, 18 bp, Homo sapiens
tgaaattatgtcaaatgg

SEQ ID NO: 522922 - DNA, 14 bp, Homo sapiens
tgaactgcaacact

SEQ ID NO: 522923 - DNA, 15 bp, Homo sapiens
tgaactgcaacactg

SEQ ID NO: 522924 - DNA, 12 bp, Homo sapiens
tgaaggggccag

SEQ ID NO: 522925 - DNA, 16 bp, Homo sapiens
tgaagtgattgacatt

SEQ ID NO: 522926 - DNA, 14 bp, Homo sapiens
tgaataacaacaat

SEQ ID NO: 522927 - DNA, 18 bp, Homo sapiens
tgaatctctcaaaatgtg

SEQ ID NO: 522928 - DNA, 20 bp, Homo sapiens
tgaatctctcaaaatgtgcc

SEQ ID NO: 522929 - DNA, 21 bp, Homo sapiens
tgaatctctcaaaatgtgccg

SEQ ID NO: 522930 - DNA, 22 bp, Homo sapiens
tgaatgaaatataaactgtgag

SEQ ID NO: 522931 - DNA, 17 bp, Homo sapiens
tgacaagtttaaaggct

SEQ ID NO: 522932 - DNA, 17 bp, Homo sapiens
tgacacactcaccattt

SEQ ID NO: 522933 - DNA, 20 bp, Homo sapiens
tgacagcatttcagctgtga

SEQ ID NO: 522934 - DNA, 16 bp, Homo sapiens
tgacagtagcatactg

SEQ ID NO: 522935 - DNA, 21 bp, Homo sapiens
tgacagtagcatactgatgag

SEQ ID NO: 522936 - DNA, 12 bp, Homo sapiens
tgacattccaca

SEQ ID NO: 522937 - DNA, 16 bp, Homo sapiens
tgacattttgtagcta

SEQ ID NO: 522938 - DNA, 23 bp, Homo sapiens
tgacattttgtagctagtttaaa

SEQ ID NO: 522939 - DNA, 14 bp, Homo sapiens
tgacctaccctgga

SEQ ID NO: 522940 - DNA, 15 bp, Homo sapiens
tgactcagtgcaggg

SEQ ID NO: 522941 - DNA, 23 bp, Homo sapiens
tgactcttactaaccaccatttc

SEQ ID NO: 522942 - DNA, 15 bp, Homo sapiens
tgacttctccaggac

SEQ ID NO: 522943 - DNA, 14 bp, Homo sapiens
tgagacaacacaca

SEQ ID NO: 522944 - DNA, 16 bp, Homo sapiens
tgagacaacacacaca

SEQ ID NO: 522945 - DNA, 15 bp, Homo sapiens
tgagacactgtcaag

SEQ ID NO: 522946 - DNA, 18 bp, Homo sapiens
tgagaggagcgtgtccta

SEQ ID NO: 522947 - DNA, 20 bp, Homo sapiens
tgagagggtgtgggtgccct

SEQ ID NO: 522948 - DNA, 16 bp, Homo sapiens
tgagataaatatcatt

SEQ ID NO: 522949 - DNA, 17 bp, Homo sapiens
tgagataaatatcatta

SEQ ID NO: 522950 - DNA, 17 bp, Homo sapiens
tgagatgtttagtagct

SEQ ID NO: 522951 - DNA, 19 bp, Homo sapiens
tggcagaagcagttgcaat

SEQ ID NO: 522952 - DNA, 14 bp, Homo sapiens
tggcatttgctgaa

SEQ ID NO: 522953 - DNA, 21 bp, Homo sapiens
tggccgctgcagtcagcacag

SEQ ID NO: 522954 - DNA, 20 bp, Homo sapiens
tggcctccagggcgcagggg

SEQ ID NO: 522955 - DNA, 14 bp, Homo sapiens
tggctgaaattatg

SEQ ID NO: 522956 - DNA, 19 bp, Homo sapiens
tggctgaaattatgtcaaa

SEQ ID NO: 522957 - DNA, 14 bp, Homo sapiens
tggcttctgggaca

SEQ ID NO: 522958 - DNA, 19 bp, Homo sapiens
aatgttcacgcaacttgaa

SEQ ID NO: 522959 - DNA, 16 bp, Homo sapiens
aatgttgaagaactca

SEQ ID NO: 522960 - DNA, 16 bp, Homo sapiens
aattaaatgaaatact

SEQ ID NO: 522961 - DNA, 14 bp, Homo sapiens
aattacataacagg

SEQ ID NO: 522962 - DNA, 19 bp, Homo sapiens
aattacctaagagccacaa

SEQ ID NO: 522963 - DNA, 21 bp, Homo sapiens
aattagattttaaaacttcat

SEQ ID NO: 522964 - DNA, 18 bp, Homo sapiens
aattatgtcaaatggatg

SEQ ID NO: 522965 - DNA, 17 bp, Homo sapiens
aattattaaaaattata

SEQ ID NO: 522966 - DNA, 13 bp, Homo sapiens
aattcaaacctaa

SEQ ID NO: 522967 - DNA, 18 bp, Homo sapiens
aattcctcctgtctcctc

SEQ ID NO: 522968 - DNA, 17 bp, Homo sapiens
aattgaagagagatata

SEQ ID NO: 522969 - DNA, 14 bp, Homo sapiens
aattgctgagatgt

SEQ ID NO: 522970 - DNA, 20 bp, Homo sapiens
aattgctgagatgtttagta

SEQ ID NO: 522971 - DNA, 14 bp, Homo sapiens
aattgcttctctaa

SEQ ID NO: 522972 - DNA, 20 bp, Homo sapiens
aattgcttctctaaaacagc

SEQ ID NO: 522973 - DNA, 13 bp, Homo sapiens
aattggcttgttt

SEQ ID NO: 522974 - DNA, 21 bp, Homo sapiens
aattttaaaaaagatggattt

SEQ ID NO: 522975 - DNA, 21 bp, Homo sapiens
aattttataaggctgactctt

SEQ ID NO: 522976 - DNA, 20 bp, Homo sapiens
acaaaaactttccatgacag

SEQ ID NO: 522977 - DNA, 21 bp, Homo sapiens
acaaaaactttccatgacagt

SEQ ID NO: 522978 - DNA, 20 bp, Homo sapiens
acaaaatccttgccttcaaa

SEQ ID NO: 522979 - DNA, 22 bp, Homo sapiens
acaaaatgtgtgcttggaaaat

SEQ ID NO: 522980 - DNA, 23 bp, Homo sapiens
acaaaatgtgtgcttggaaaatg

SEQ ID NO: 522981 - DNA, 15 bp, Homo sapiens
acaaagcatgctcag

SEQ ID NO: 522982 - DNA, 21 bp, Homo sapiens
acaaagcatgctcagtattga

SEQ ID NO: 522983 - DNA, 23 bp, Homo sapiens
acaacaaagcatgctcagtattg

SEQ ID NO: 522984 - DNA, 14 bp, Homo sapiens
acaacacacacaca

SEQ ID NO: 522985 - DNA, 19 bp, Homo sapiens
acaatactttgtgtctttt

SEQ ID NO: 522986 - DNA, 22 bp, Homo sapiens
acaatactttgtgtcttttgtt

SEQ ID NO: 522987 - DNA, 17 bp, Homo sapiens
acaatgtggaattacat

SEQ ID NO: 522988 - DNA, 20 bp, Homo sapiens
acaatgtggaattacataac

SEQ ID NO: 522989 - DNA, 14 bp, Homo sapiens
acacacacaaaaca

SEQ ID NO: 522990 - DNA, 14 bp, Homo sapiens
acacacacacacaa

SEQ ID NO: 522991 - DNA, 15 bp, Homo sapiens
acacacacacacaca

SEQ ID NO: 522992 - DNA, 20 bp, Homo sapiens
acacagaggacggcttcccc

SEQ ID NO: 522993 - DNA, 14 bp, Homo sapiens
acacagtctggtgc

SEQ ID NO: 522994 - DNA, 14 bp, Homo sapiens
acacattgcacaca

SEQ ID NO: 522995 - DNA, 15 bp, Homo sapiens
acaccggcactgtgc

SEQ ID NO: 522996 - DNA, 15 bp, Homo sapiens
acacgttggagtata

SEQ ID NO: 522997 - DNA, 16 bp, Homo sapiens
acacttgggctggcac

SEQ ID NO: 522998 - DNA, 22 bp, Homo sapiens
acacttgggctggcacccactg

SEQ ID NO: 522999 - DNA, 23 bp, Homo sapiens
acacttgggtaattaaaaataaa

SEQ ID NO: 523000 - DNA, 15 bp, Homo sapiens
acagcaacaacaaca

SEQ ID NO: 523001 - DNA, 19 bp, Homo sapiens
acagcatttcagctgtgag

SEQ ID NO: 523002 - DNA, 13 bp, Homo sapiens
acagccctgcacg

SEQ ID NO: 523003 - DNA, 19 bp, Homo sapiens
acagctgaaagacagtaaa

SEQ ID NO: 523004 - DNA, 18 bp, Homo sapiens
acaggcaccatgctgggc

SEQ ID NO: 523005 - DNA, 22 bp, Homo sapiens
acaggcatccgctgcgctccca

SEQ ID NO: 523006 - DNA, 19 bp, Homo sapiens
acaggcattgcactaaaag

SEQ ID NO: 523007 - DNA, 16 bp, Homo sapiens
acaggggaggctgaga

SEQ ID NO: 523008 - DNA, 18 bp, Homo sapiens
acagtagcttcctagacc

SEQ ID NO: 523009 - DNA, 19 bp, Homo sapiens
acagtattgttcttgtaaa

SEQ ID NO: 523010 - DNA, 22 bp, Homo sapiens
acagtattgttcttgtaaaact

SEQ ID NO: 523011 - DNA, 23 bp, Homo sapiens
acagtggtccagggtccagccct

SEQ ID NO: 523012 - DNA, 17 bp, Homo sapiens
acataacaggcattgca

SEQ ID NO: 523013 - DNA, 23 bp, Homo sapiens
acatcagtccacccccattgtga

SEQ ID NO: 523014 - DNA, 13 bp, Homo sapiens
acatctctgtaaa

SEQ ID NO: 523015 - DNA, 20 bp, Homo sapiens
acatggttacctctgcataa

SEQ ID NO: 523016 - DNA, 11 bp, Homo sapiens
acattcctgac

SEQ ID NO: 523017 - DNA, 13 bp, Homo sapiens
acattcctgaccc

SEQ ID NO: 523018 - DNA, 18 bp, Homo sapiens
acattctatttcaacttc

SEQ ID NO: 523019 - DNA, 13 bp, Homo sapiens
acatttccctgct

SEQ ID NO: 523020 - DNA, 17 bp, Homo sapiens
accaaattgctgagatg

SEQ ID NO: 523021 - DNA, 16 bp, Homo sapiens
accacactctgcctgg

SEQ ID NO: 523022 - DNA, 12 bp, Homo sapiens
accacgcccctg

SEQ ID NO: 523023 - DNA, 19 bp, Homo sapiens
accatagcttaagaagtat

SEQ ID NO: 523024 - DNA, 19 bp, Homo sapiens
accatgctgggccggggtg

SEQ ID NO: 523025 - DNA, 15 bp, Homo sapiens
accattatggctttg

SEQ ID NO: 523026 - DNA, 19 bp, Homo sapiens
accatttagtcctcacctt

SEQ ID NO: 523027 - DNA, 16 bp, Homo sapiens
accatttcccctgtgg

SEQ ID NO: 523028 - DNA, 11 bp, Homo sapiens
acccagcctgg

SEQ ID NO: 523029 - DNA, 14 bp, Homo sapiens
acccccattgtgaa

SEQ ID NO: 523030 - DNA, 18 bp, Homo sapiens
accggacgcatgcagggc

SEQ ID NO: 523031 - DNA, 21 bp, Homo sapiens
accggggtggagtcagggctg

SEQ ID NO: 523032 - DNA, 15 bp, Homo sapiens
acctaattaatttca

SEQ ID NO: 523033 - DNA, 16 bp, Homo sapiens
acctcggacaccatct

SEQ ID NO: 523034 - DNA, 18 bp, Homo sapiens
acctcggccgaggcctgc

SEQ ID NO: 523035 - DNA, 22 bp, Homo sapiens
acctgcttctcagcgcaacagc

SEQ ID NO: 523036 - DNA, 23 bp, Homo sapiens
accttctaatccatgtgctgctg

SEQ ID NO: 523037 - DNA, 15 bp, Homo sapiens
acctttggcttaatt

SEQ ID NO: 523038 - DNA, 13 bp, Homo sapiens
acgatttaattta

SEQ ID NO: 523039 - DNA, 18 bp, Homo sapiens
acggaggcaggaccaggc

SEQ ID NO: 523040 - DNA, 10 bp, Homo sapiens
acggaggctc

SEQ ID NO: 523041 - DNA, 17 bp, Homo sapiens
acggtccaatccagcct

SEQ ID NO: 523042 - DNA, 21 bp, Homo sapiens
acgtgatgtgctcatcagaaa

SEQ ID NO: 523043 - DNA, 15 bp, Homo sapiens
acgtggggtggaatt

SEQ ID NO: 523044 - DNA, 13 bp, Homo sapiens
acgttaattaaac

SEQ ID NO: 523045 - DNA, 14 bp, Homo sapiens
actaaccaccattt

SEQ ID NO: 523046 - DNA, 20 bp, Homo sapiens
actaccccagaacgcatgca

SEQ ID NO: 523047 - DNA, 21 bp, Homo sapiens
actaccccagaacgcatgcag

SEQ ID NO: 523048 - DNA, 21 bp, Homo sapiens
actaccccaggatgcatgcag

SEQ ID NO: 523049 - DNA, 19 bp, Homo sapiens
actacctttggcttaattc

SEQ ID NO: 523050 - DNA, 14 bp, Homo sapiens
actcagtcaaatgt

SEQ ID NO: 523051 - DNA, 16 bp, Homo sapiens
actcctccccctcctc

SEQ ID NO: 523052 - DNA, 21 bp, Homo sapiens
actccttgaaaccagctcagg

SEQ ID NO: 523053 - DNA, 14 bp, Homo sapiens
actctcttcttact

SEQ ID NO: 523054 - DNA, 16 bp, Homo sapiens
actctgcgacgatccc

SEQ ID NO: 523055 - DNA, 18 bp, Homo sapiens
actcttttgagcagtaaa

SEQ ID NO: 523056 - DNA, 15 bp, Homo sapiens
atttgactgttattt

SEQ ID NO: 523057 - DNA, 10 bp, Homo sapiens
atttgctgaa

SEQ ID NO: 523058 - DNA, 13 bp, Homo sapiens
atttgctgaataa

SEQ ID NO: 523059 - DNA, 19 bp, Homo sapiens
atttgctgaataacaacaa

SEQ ID NO: 523060 - DNA, 20 bp, Homo sapiens
atttgctgaataacaacaat

SEQ ID NO: 523061 - DNA, 14 bp, Homo sapiens
atttggtggctcta

SEQ ID NO: 523062 - DNA, 23 bp, Homo sapiens
attttaaaacttcatctgtctgt

SEQ ID NO: 523063 - DNA, 14 bp, Homo sapiens
attttatctcttct

SEQ ID NO: 523064 - DNA, 23 bp, Homo sapiens
attttattgaatataatggcctc

SEQ ID NO: 523065 - DNA, 18 bp, Homo sapiens
attttctctcctcggtgg

SEQ ID NO: 523066 - DNA, 16 bp, Homo sapiens
attttggacgtgtgag

SEQ ID NO: 523067 - DNA, 12 bp, Homo sapiens
attttgtagcta

SEQ ID NO: 523068 - DNA, 20 bp, Homo sapiens
attttgtctgcttagtatct

SEQ ID NO: 523069 - DNA, 15 bp, Homo sapiens
atttttcattttctc

SEQ ID NO: 523070 - DNA, 16 bp, Homo sapiens
caaaaactttccatga

SEQ ID NO: 523071 - DNA, 23 bp, Homo sapiens
caaaaactttccatgacagtagc

SEQ ID NO: 523072 - DNA, 12 bp, Homo sapiens
caaaacaacagc

SEQ ID NO: 523073 - DNA, 21 bp, Homo sapiens
caaaacaacagcaacaacaac

SEQ ID NO: 523074 - DNA, 14 bp, Homo sapiens
caaaaggatgattt

SEQ ID NO: 523075 - DNA, 19 bp, Homo sapiens
caaaatacatgatgatttc

SEQ ID NO: 523076 - DNA, 22 bp, Homo sapiens
caaaatacatgatgatttcaga

SEQ ID NO: 523077 - DNA, 18 bp, Homo sapiens
caaagcatgctcagtatt

SEQ ID NO: 523078 - DNA, 15 bp, Homo sapiens
caaaggttgtacata

SEQ ID NO: 523079 - DNA, 16 bp, Homo sapiens
caaaggttgtacatag

SEQ ID NO: 523080 - DNA, 14 bp, Homo sapiens
caaagtcctttccc

SEQ ID NO: 523081 - DNA, 14 bp, Homo sapiens
caaatacatgcctt

SEQ ID NO: 523082 - DNA, 23 bp, Homo sapiens
caaatccaacgcttttcccacct

SEQ ID NO: 523083 - DNA, 16 bp, Homo sapiens
caaatgatttcgtgac

SEQ ID NO: 523084 - DNA, 15 bp, Homo sapiens
caaatgctactcagt

SEQ ID NO: 523085 - DNA, 16 bp, Homo sapiens
caaatgctactcagta

SEQ ID NO: 523086 - DNA, 18 bp, Homo sapiens
caaatggatgtaatatag

SEQ ID NO: 523087 - DNA, 17 bp, Homo sapiens
caaatgtacccagccta

SEQ ID NO: 523088 - DNA, 19 bp, Homo sapiens
caacaaagcatgctcagta

SEQ ID NO: 523089 - DNA, 13 bp, Homo sapiens
caacacacacaca

SEQ ID NO: 523090 - DNA, 21 bp, Homo sapiens
caacacacacacacacaaaac

SEQ ID NO: 523091 - DNA, 18 bp, Homo sapiens
caacagcaacaacaacag

SEQ ID NO: 523092 - DNA, 19 bp, Homo sapiens
caacctcccctggtcctgc

SEQ ID NO: 523093 - DNA, 13 bp, Homo sapiens
caactctgactgt

SEQ ID NO: 523094 - DNA, 23 bp, Homo sapiens
caacttgaaattatatctgtggt

SEQ ID NO: 523095 - DNA, 18 bp, Homo sapiens
caagctcacttgctttag

SEQ ID NO: 523096 - DNA, 15 bp, Homo sapiens
caagtctagtggaac

SEQ ID NO: 523097 - DNA, 13 bp, Homo sapiens
caagtctgtgaaa

SEQ ID NO: 523098 - DNA, 20 bp, Homo sapiens
caataaactcagtcaaatgt

SEQ ID NO: 523099 - DNA, 15 bp, Homo sapiens
caataaagctcacac

SEQ ID NO: 523100 - DNA, 17 bp, Homo sapiens
caatactttgtgtcttt

SEQ ID NO: 523101 - DNA, 18 bp, Homo sapiens
caatactttgtgtctttt

SEQ ID NO: 523102 - DNA, 17 bp, Homo sapiens
caatccacagtattgtt

SEQ ID NO: 523103 - DNA, 23 bp, Homo sapiens
caatggtgaactgtcattacaga

SEQ ID NO: 523104 - DNA, 20 bp, Homo sapiens
caatgtccaggtcacaggca

SEQ ID NO: 523105 - DNA, 23 bp, Homo sapiens
caatgtgctgttgattctttcaa

SEQ ID NO: 523106 - DNA, 17 bp, Homo sapiens
caatgtggaattacata

SEQ ID NO: 523107 - DNA, 20 bp, Homo sapiens
caatgtggaattacataaca

SEQ ID NO: 523108 - DNA, 11 bp, Homo sapiens
cacaaaacaac

SEQ ID NO: 523109 - DNA, 16 bp, Homo sapiens
cacaaaacaacagcaa

SEQ ID NO: 523110 - DNA, 23 bp, Homo sapiens
cacaaaacaacagcaacaacaac

SEQ ID NO: 523111 - DNA, 18 bp, Homo sapiens
cacaacctcctcctccag

SEQ ID NO: 523112 - DNA, 14 bp, Homo sapiens
cacacaaaacaaca

SEQ ID NO: 523113 - DNA, 13 bp, Homo sapiens
cacacacaaaaca

SEQ ID NO: 523114 - DNA, 14 bp, Homo sapiens
cacacacaaaacaa

SEQ ID NO: 523115 - DNA, 16 bp, Homo sapiens
cacacacacacacaaa

SEQ ID NO: 523116 - DNA, 15 bp, Homo sapiens
cacacataacacaca

SEQ ID NO: 523117 - DNA, 13 bp, Homo sapiens
cacaccggcactg

SEQ ID NO: 523118 - DNA, 18 bp, Homo sapiens
cacaccggcactgtgcac

SEQ ID NO: 523119 - DNA, 14 bp, Homo sapiens
cacactcaccattt

SEQ ID NO: 523120 - DNA, 18 bp, Homo sapiens
cacactgccctctgccac

SEQ ID NO: 523121 - DNA, 16 bp, Homo sapiens
cacagaggacggcttc

SEQ ID NO: 523122 - DNA, 16 bp, Homo sapiens
cacagaggatggcttc

SEQ ID NO: 523123 - DNA, 14 bp, Homo sapiens
cacagattatttgt

SEQ ID NO: 523124 - DNA, 19 bp, Homo sapiens
cacagctttcctgggtctg

SEQ ID NO: 523125 - DNA, 18 bp, Homo sapiens
cacaggagcatgtcctat

SEQ ID NO: 523126 - DNA, 15 bp, Homo sapiens
cacaggagcgtgtac

SEQ ID NO: 523127 - DNA, 19 bp, Homo sapiens
cacagtgggcggcttccct

SEQ ID NO: 523128 - DNA, 20 bp, Homo sapiens
cacagtgggcggcttccctg

SEQ ID NO: 523129 - DNA, 14 bp, Homo sapiens
cacataacacacat

SEQ ID NO: 523130 - DNA, 18 bp, Homo sapiens
caccatttcccctgtggt

SEQ ID NO: 523131 - DNA, 22 bp, Homo sapiens
caccccgttgttgtccctgcag

SEQ ID NO: 523132 - DNA, 20 bp, Homo sapiens
atagcatgtaatattaaatt

SEQ ID NO: 523133 - DNA, 19 bp, Homo sapiens
atagctccttcatgctttt

SEQ ID NO: 523134 - DNA, 19 bp, Homo sapiens
atagtgaaaattttattga

SEQ ID NO: 523135 - DNA, 22 bp, Homo sapiens
atataaaaataattaaaacaaa

SEQ ID NO: 523136 - DNA, 16 bp, Homo sapiens
atataaactgtgagat

SEQ ID NO: 523137 - DNA, 14 bp, Homo sapiens
atatagggtttgtt

SEQ ID NO: 523138 - DNA, 13 bp, Homo sapiens
atatattttgaaa

SEQ ID NO: 523139 - DNA, 17 bp, Homo sapiens
atatctgaaaactggaa

SEQ ID NO: 523140 - DNA, 23 bp, Homo sapiens
atatctgaaaactggaataagaa

SEQ ID NO: 523141 - DNA, 14 bp, Homo sapiens
atatgagattggaa

SEQ ID NO: 523142 - DNA, 16 bp, Homo sapiens
atatgagattggaaaa

SEQ ID NO: 523143 - DNA, 18 bp, Homo sapiens
atatgagattggaaaaaa

SEQ ID NO: 523144 - DNA, 14 bp, Homo sapiens
atattcccatggta

SEQ ID NO: 523145 - DNA, 19 bp, Homo sapiens
atcaaaaattgaagagaga

SEQ ID NO: 523146 - DNA, 15 bp, Homo sapiens
atcaacaaagaaata

SEQ ID NO: 523147 - DNA, 13 bp, Homo sapiens
atcaactcatgtt

SEQ ID NO: 523148 - DNA, 21 bp, Homo sapiens
atcaatgttcacgcaacttga

SEQ ID NO: 523149 - DNA, 22 bp, Homo sapiens
atcaatgttcacgcaacttgaa

SEQ ID NO: 523150 - DNA, 22 bp, Homo sapiens
atcaccgggaacgcccccgccc

SEQ ID NO: 523151 - DNA, 15 bp, Homo sapiens
cctggcttctgggac

SEQ ID NO: 523152 - DNA, 16 bp, Homo sapiens
cctggcttctgggaca

SEQ ID NO: 523153 - DNA, 23 bp, Homo sapiens
cctgggggctgctgcactgccct

SEQ ID NO: 523154 - DNA, 20 bp, Homo sapiens
cctgggggctgttagctcag

SEQ ID NO: 523155 - DNA, 21 bp, Homo sapiens
cctgggtaacaaagtgagacc

SEQ ID NO: 523156 - DNA, 20 bp, Homo sapiens
cctggtatgtctcaccagga

SEQ ID NO: 523157 - DNA, 14 bp, Homo sapiens
cctggtcctgcact

SEQ ID NO: 523158 - DNA, 20 bp, Homo sapiens
cctggtcctgcactgtcccg

SEQ ID NO: 523159 - DNA, 19 bp, Homo sapiens
cctgtaatagcctcacctt

SEQ ID NO: 523160 - DNA, 14 bp, Homo sapiens
cctgtctcctctgt

SEQ ID NO: 523161 - DNA, 17 bp, Homo sapiens
cctgtctcctctgtcag

SEQ ID NO: 523162 - DNA, 18 bp, Homo sapiens
cctgtgaactgccaggca

SEQ ID NO: 523163 - DNA, 15 bp, Homo sapiens
cctgtgggctcacac

SEQ ID NO: 523164 - DNA, 16 bp, Homo sapiens
cctgtgggctcacacc

SEQ ID NO: 523165 - DNA, 20 bp, Homo sapiens
cctgtggtgaggtcctgtcc

SEQ ID NO: 523166 - DNA, 13 bp, Homo sapiens
cctgtggtttgtt

SEQ ID NO: 523167 - DNA, 16 bp, Homo sapiens
cctgtgtcatctgtca

SEQ ID NO: 523168 - DNA, 17 bp, Homo sapiens
cctgtgtcatctgtcag

SEQ ID NO: 523169 - DNA, 18 bp, Homo sapiens
cctgttccgcctcactgg

SEQ ID NO: 523170 - DNA, 21 bp, Homo sapiens
cctgttgacctaccctggacc

SEQ ID NO: 523171 - DNA, 18 bp, Homo sapiens
ccttcactccctgtcata

SEQ ID NO: 523172 - DNA, 21 bp, Homo sapiens
ccttcatgcttttctcatggt

SEQ ID NO: 523173 - DNA, 20 bp, Homo sapiens
ccttccctagttctttgcat

SEQ ID NO: 523174 - DNA, 12 bp, Homo sapiens
ccttctccacag

SEQ ID NO: 523175 - DNA, 12 bp, Homo sapiens
ccttctcccctc

SEQ ID NO: 523176 - DNA, 21 bp, Homo sapiens
ccttctgtgcatctggcctgg

SEQ ID NO: 523177 - DNA, 22 bp, Homo sapiens
ccttctgtgcatctggcctggg

SEQ ID NO: 523178 - DNA, 18 bp, Homo sapiens
ccttgagccgtgacctcc

SEQ ID NO: 523179 - DNA, 20 bp, Homo sapiens
ccttgtgatcactttctgaa

SEQ ID NO: 523180 - DNA, 16 bp, Homo sapiens
cctttccagtgctgct

SEQ ID NO: 523181 - DNA, 14 bp, Homo sapiens
cctttgccttcccc

SEQ ID NO: 523182 - DNA, 23 bp, Homo sapiens
ccttttaaaaaaataatataaat

SEQ ID NO: 523183 - DNA, 17 bp, Homo sapiens
ccttttgtatcctccat

SEQ ID NO: 523184 - DNA, 23 bp, Homo sapiens
cgatccccatggaacagccctgc

SEQ ID NO: 523185 - DNA, 20 bp, Homo sapiens
cgcaacagctgtgtgtgccc

SEQ ID NO: 523186 - DNA, 22 bp, Homo sapiens
cgcaggggagggtgcggcaggg

SEQ ID NO: 523187 - DNA, 11 bp, Homo sapiens
cgcatgcaggg

SEQ ID NO: 523188 - DNA, 21 bp, Homo sapiens
cgcatgcagggcccccacagg

SEQ ID NO: 523189 - DNA, 21 bp, Homo sapiens
cgcatgcagggcccccactgg

SEQ ID NO: 523190 - DNA, 21 bp, Homo sapiens
cgccagccctgttccgcctca

SEQ ID NO: 523191 - DNA, 22 bp, Homo sapiens
cgcccaggatgaaggggccaga

SEQ ID NO: 523192 - DNA, 13 bp, Homo sapiens
cgccggttccacg

SEQ ID NO: 523193 - DNA, 13 bp, Homo sapiens
cgcctcactgggt

SEQ ID NO: 523194 - DNA, 14 bp, Homo sapiens
cgcctcactgggtg

SEQ ID NO: 523195 - DNA, 19 bp, Homo sapiens
cgccttctggccgctgcag

SEQ ID NO: 523196 - DNA, 14 bp, Homo sapiens
cgccttctggggag

SEQ ID NO: 523197 - DNA, 20 bp, Homo sapiens
cgcgctcggggctgggcaga

SEQ ID NO: 523198 - DNA, 17 bp, Homo sapiens
cgcgtggttctgccact

SEQ ID NO: 523199 - DNA, 17 bp, Homo sapiens
cgctcggggctgggcag

SEQ ID NO: 523200 - DNA, 16 bp, Homo sapiens
cgctgcagtcagcaca

SEQ ID NO: 523201 - DNA, 18 bp, Homo sapiens
cgctgcagtcagcacaga

SEQ ID NO: 523202 - DNA, 14 bp, Homo sapiens
cgctgcgctcccac

SEQ ID NO: 523203 - DNA, 14 bp, Homo sapiens
cggacgccccccgg

SEQ ID NO: 523204 - DNA, 12 bp, Homo sapiens
cggcccccctct

SEQ ID NO: 523205 - DNA, 23 bp, Homo sapiens
cggcctgagaggagcgtgtccta

SEQ ID NO: 523206 - DNA, 16 bp, Homo sapiens
agctatgcacaccaaa

SEQ ID NO: 523207 - DNA, 17 bp, Homo sapiens
agctatgcacaccaaat

SEQ ID NO: 523208 - DNA, 15 bp, Homo sapiens
agctcaaggctgcag

SEQ ID NO: 523209 - DNA, 19 bp, Homo sapiens
agctcacacttgggctggc

SEQ ID NO: 523210 - DNA, 17 bp, Homo sapiens
agctccttcatgctttt

SEQ ID NO: 523211 - DNA, 21 bp, Homo sapiens
agctccttcatgcttttctca

SEQ ID NO: 523212 - DNA, 16 bp, Homo sapiens
agctgcaggaatcaaa

SEQ ID NO: 523213 - DNA, 22 bp, Homo sapiens
agctgcaggaatcaaaaattga

SEQ ID NO: 523214 - DNA, 23 bp, Homo sapiens
agctgcaggaatcaaaaattgaa

SEQ ID NO: 523215 - DNA, 19 bp, Homo sapiens
agctgcagttagcacagag

SEQ ID NO: 523216 - DNA, 16 bp, Homo sapiens
agctgtctgtggcttc

SEQ ID NO: 523217 - DNA, 19 bp, Homo sapiens
agcttaagaagtatccctg

SEQ ID NO: 523218 - DNA, 18 bp, Homo sapiens
agcttcccaacaatactt

SEQ ID NO: 523219 - DNA, 20 bp, Homo sapiens
agcttcttgctgccaggccc

SEQ ID NO: 523220 - DNA, 20 bp, Homo sapiens
aggaaagcctcactgatata

SEQ ID NO: 523221 - DNA, 17 bp, Homo sapiens
aggaatcaaaaattgaa

SEQ ID NO: 523222 - DNA, 16 bp, Homo sapiens
aggaatgctcaatgtg

SEQ ID NO: 523223 - DNA, 21 bp, Homo sapiens
ttttgttcaccttctgtgcat

SEQ ID NO: 523224 - DNA, 12 bp, Homo sapiens
tttttcctacca

SEQ ID NO: 523225 - DNA, 14 bp, Homo sapiens
ttttttcctgtcaa

SEQ ID NO: 523226 - DNA, 12 bp, Homo sapiens
acaaaacaacag

SEQ ID NO: 523227 - DNA, 13 bp, Homo sapiens
acaaaacaacagc

SEQ ID NO: 523228 - DNA, 17 bp, Homo sapiens
acaaaacaacagcaaca

SEQ ID NO: 523229 - DNA, 18 bp, Homo sapiens
acaaaacaacagcaacaa

SEQ ID NO: 523230 - DNA, 21 bp, Homo sapiens
acaaaacaacagcaacaacaa

SEQ ID NO: 523231 - DNA, 16 bp, Homo sapiens
acaaacaacaaagcag

SEQ ID NO: 523232 - DNA, 20 bp, Homo sapiens
acaaagcatgctcagtattg

SEQ ID NO: 523233 - DNA, 23 bp, Homo sapiens
acaaatgatttcgtgactgtagt

SEQ ID NO: 523234 - DNA, 14 bp, Homo sapiens
acaaattccttccc

SEQ ID NO: 523235 - DNA, 18 bp, Homo sapiens
acaacaaagcatgctcag

SEQ ID NO: 523236 - DNA, 15 bp, Homo sapiens
acaacaacaaagcat

SEQ ID NO: 523237 - DNA, 14 bp, Homo sapiens
acaacaacagaaca

SEQ ID NO: 523238 - DNA, 23 bp, Homo sapiens
acaacacacacacacacaaaaca

SEQ ID NO: 523239 - DNA, 14 bp, Homo sapiens
acaataagccactg

SEQ ID NO: 523240 - DNA, 18 bp, Homo sapiens
acaatactttgtgtcttt

SEQ ID NO: 523241 - DNA, 17 bp, Homo sapiens
acaatcatctattgagt

SEQ ID NO: 523242 - DNA, 14 bp, Homo sapiens
acaatgtggaatta

SEQ ID NO: 523243 - DNA, 13 bp, Homo sapiens
acaatttctgtgt

SEQ ID NO: 523244 - DNA, 13 bp, Homo sapiens
acacaaaacaaca

SEQ ID NO: 523245 - DNA, 13 bp, Homo sapiens
acacacacaaaac

SEQ ID NO: 523246 - DNA, 14 bp, Homo sapiens
acacagattatttg

SEQ ID NO: 523247 - DNA, 15 bp, Homo sapiens
acacataacacacat

SEQ ID NO: 523248 - DNA, 15 bp, Homo sapiens
acaccaaattgctga

SEQ ID NO: 523249 - DNA, 18 bp, Homo sapiens
acaccaaattgctgagat

SEQ ID NO: 523250 - DNA, 20 bp, Homo sapiens
acaccaaattgctgagatgt

SEQ ID NO: 523251 - DNA, 21 bp, Homo sapiens
acaccaaattgctgagatgtt

SEQ ID NO: 523252 - DNA, 14 bp, Homo sapiens
acaccggcactgtg

SEQ ID NO: 523253 - DNA, 17 bp, Homo sapiens
acaccggcactgtgcac

SEQ ID NO: 523254 - DNA, 20 bp, Homo sapiens
acaccggcactgtgcactct

SEQ ID NO: 523255 - DNA, 13 bp, Homo sapiens
acactaccactcc

SEQ ID NO: 523256 - DNA, 14 bp, Homo sapiens
acactcaccattta

SEQ ID NO: 523257 - DNA, 16 bp, Homo sapiens
acactcatcaggtaaa

SEQ ID NO: 523258 - DNA, 22 bp, Homo sapiens
acactctcttcttactgtattt

SEQ ID NO: 523259 - DNA, 16 bp, Homo sapiens
acactgtctgctgccc

SEQ ID NO: 523260 - DNA, 17 bp, Homo sapiens
acacttgggctggcacc

SEQ ID NO: 523261 - DNA, 20 bp, Homo sapiens
acacttgggctggcacccac

SEQ ID NO: 523262 - DNA, 13 bp, Homo sapiens
acagaccggggtg

SEQ ID NO: 523263 - DNA, 13 bp, Homo sapiens
acagattatttgt

SEQ ID NO: 523264 - DNA, 13 bp, Homo sapiens
acagcaacaacaa

SEQ ID NO: 523265 - DNA, 22 bp, Homo sapiens
acagctccgcgctcggggctgg

SEQ ID NO: 523266 - DNA, 18 bp, Homo sapiens
acaggaaagtggatgcca

SEQ ID NO: 523267 - DNA, 16 bp, Homo sapiens
acaggagcgtgtacta

SEQ ID NO: 523268 - DNA, 14 bp, Homo sapiens
acaggggaggctga

SEQ ID NO: 523269 - DNA, 22 bp, Homo sapiens
acagtagcatactgatgagaca

SEQ ID NO: 523270 - DNA, 18 bp, Homo sapiens
acataacaggcattgcac

SEQ ID NO: 523271 - DNA, 15 bp, Homo sapiens
acatagtggtcattt

SEQ ID NO: 523272 - DNA, 18 bp, Homo sapiens
acatctctgtaaaaagca

SEQ ID NO: 523273 - DNA, 21 bp, Homo sapiens
acatgcctttccagtgctgct

SEQ ID NO: 523274 - DNA, 16 bp, Homo sapiens
acattttgtagctagt

SEQ ID NO: 523275 - DNA, 14 bp, Homo sapiens
accaaattgctgag

SEQ ID NO: 523276 - DNA, 23 bp, Homo sapiens
accagcttgcttctctgccggtg

SEQ ID NO: 523277 - DNA, 22 bp, Homo sapiens
accaggaaattctgtttatgtt

SEQ ID NO: 523278 - DNA, 15 bp, Homo sapiens
accatagcttaagaa

SEQ ID NO: 523279 - DNA, 21 bp, Homo sapiens
accccaggaagtcatcctgca

SEQ ID NO: 523280 - DNA, 19 bp, Homo sapiens
acccccatgccaatgtcca

SEQ ID NO: 523281 - DNA, 14 bp, Homo sapiens
accctatcatcagt

SEQ ID NO: 523282 - DNA, 21 bp, Homo sapiens
accgagaggaaaaaggcttct

SEQ ID NO: 523283 - DNA, 20 bp, Homo sapiens
accggggtggagtcagggct

SEQ ID NO: 523284 - DNA, 14 bp, Homo sapiens
acctaattaatttc

SEQ ID NO: 523285 - DNA, 14 bp, Homo sapiens
acctaccctggacc

SEQ ID NO: 523286 - DNA, 22 bp, Homo sapiens
acctactcctccccctcctcca

SEQ ID NO: 523287 - DNA, 22 bp, Homo sapiens
acctattgctgtaaataaaaat

SEQ ID NO: 523288 - DNA, 23 bp, Homo sapiens
acctccaggaagggaccccactg

SEQ ID NO: 523289 - DNA, 16 bp, Homo sapiens
acctcccctggtcctg

SEQ ID NO: 523290 - DNA, 17 bp, Homo sapiens
acctcccctggtcctgc

SEQ ID NO: 523291 - DNA, 18 bp, Homo sapiens
acctcccctggtcctgca

SEQ ID NO: 523292 - DNA, 20 bp, Homo sapiens
acctccctgtctctacaaaa

SEQ ID NO: 523293 - DNA, 17 bp, Homo sapiens
accttccctagttcttt

SEQ ID NO: 523294 - DNA, 20 bp, Homo sapiens
accttctaatccatgtgctg

SEQ ID NO: 523295 - DNA, 19 bp, Homo sapiens
accttttaaaaaaataata

SEQ ID NO: 523296 - DNA, 22 bp, Homo sapiens
acgatccccatggaacagccct

SEQ ID NO: 523297 - DNA, 21 bp, Homo sapiens
acgcacacacacgcaaataca

SEQ ID NO: 523298 - DNA, 16 bp, Homo sapiens
acgcatgcagggcccc

SEQ ID NO: 523299 - DNA, 18 bp, Homo sapiens
acgccccccggcctgatg

SEQ ID NO: 523300 - DNA, 23 bp, Homo sapiens
acgcccccgcccccgccccgctg

SEQ ID NO: 523301 - DNA, 22 bp, Homo sapiens
acggcttccccatcgccttctg

SEQ ID NO: 523302 - DNA, 19 bp, Homo sapiens
acgggggagctttcccaga

SEQ ID NO: 523303 - DNA, 18 bp, Homo sapiens
acggtccaatccagcctt

SEQ ID NO: 523304 - DNA, 17 bp, Homo sapiens
acgtgaagataccataa

SEQ ID NO: 523305 - DNA, 14 bp, Homo sapiens
acgttaattaaaca

SEQ ID NO: 523306 - DNA, 13 bp, Homo sapiens
actaaaagtgatg

SEQ ID NO: 523307 - DNA, 17 bp, Homo sapiens
actaaatagatttttag

SEQ ID NO: 523308 - DNA, 12 bp, Homo sapiens
actaacactggc

SEQ ID NO: 523309 - DNA, 13 bp, Homo sapiens
actcaaggcctcc

SEQ ID NO: 523310 - DNA, 17 bp, Homo sapiens
actcaccatttaatcat

SEQ ID NO: 523311 - DNA, 18 bp, Homo sapiens
actcaccatttaatcatt

SEQ ID NO: 523312 - DNA, 17 bp, Homo sapiens
actcaggcagcctgtgg

SEQ ID NO: 523313 - DNA, 22 bp, Homo sapiens
actcagtgcagggacagcctgc

SEQ ID NO: 523314 - DNA, 14 bp, Homo sapiens
actcatgttaattg

SEQ ID NO: 523315 - DNA, 15 bp, Homo sapiens
actcctccccctcct

SEQ ID NO: 523316 - DNA, 17 bp, Homo sapiens
actcctccccctcctcc

SEQ ID NO: 523317 - DNA, 22 bp, Homo sapiens
actcctccccctcctccatgct

SEQ ID NO: 523318 - DNA, 23 bp, Homo sapiens
actcctccccctcctccatgctg

SEQ ID NO: 523319 - DNA, 22 bp, Homo sapiens
actctgcgacgatccccatgga

SEQ ID NO: 523320 - DNA, 14 bp, Homo sapiens
actgatgagacaac

SEQ ID NO: 523321 - DNA, 19 bp, Homo sapiens
actgatgagacaacacaca

SEQ ID NO: 523322 - DNA, 19 bp, Homo sapiens
actgccatttcctcctggg

SEQ ID NO: 523323 - DNA, 18 bp, Homo sapiens
actgccctccgcccttcc

SEQ ID NO: 523324 - DNA, 15 bp, Homo sapiens
actgccctctgccac

SEQ ID NO: 523325 - DNA, 23 bp, Homo sapiens
actggaataagaagcaaataaat

SEQ ID NO: 523326 - DNA, 17 bp, Homo sapiens
actggctagctatatta

SEQ ID NO: 523327 - DNA, 14 bp, Homo sapiens
agcgtgtcctatcc

SEQ ID NO: 523328 - DNA, 15 bp, Homo sapiens
agctaagcctgatga

SEQ ID NO: 523329 - DNA, 17 bp, Homo sapiens
agctagtttaaaattat

SEQ ID NO: 523330 - DNA, 19 bp, Homo sapiens
agctagtttaaaattatta

SEQ ID NO: 523331 - DNA, 21 bp, Homo sapiens
agctagtttaaaattattaaa

SEQ ID NO: 523332 - DNA, 22 bp, Homo sapiens
agctagtttaaaattattaaaa

SEQ ID NO: 523333 - DNA, 22 bp, Homo sapiens
agctatgcacaccaaattgctg

SEQ ID NO: 523334 - DNA, 17 bp, Homo sapiens
agctcacacttgggctg

SEQ ID NO: 523335 - DNA, 20 bp, Homo sapiens
agctccgcgctcggggctgg

SEQ ID NO: 523336 - DNA, 13 bp, Homo sapiens
agctccttcatgc

SEQ ID NO: 523337 - DNA, 18 bp, Homo sapiens
agctcgtgtgcttagaaa

SEQ ID NO: 523338 - DNA, 21 bp, Homo sapiens
agctcgtgtgcttagaaacct

SEQ ID NO: 523339 - DNA, 20 bp, Homo sapiens
agctgcaggaatcaaaaatt

SEQ ID NO: 523340 - DNA, 14 bp, Homo sapiens
agcttcccaacaat

SEQ ID NO: 523341 - DNA, 15 bp, Homo sapiens
agcttcccaacaata

SEQ ID NO: 523342 - DNA, 16 bp, Homo sapiens
agcttgcttctctgcc

SEQ ID NO: 523343 - DNA, 18 bp, Homo sapiens
agctttcccagagacccg

SEQ ID NO: 523344 - DNA, 19 bp, Homo sapiens
agctttcctgggtctggat

SEQ ID NO: 523345 - DNA, 16 bp, Homo sapiens
aggaaagcctcactga

SEQ ID NO: 523346 - DNA, 16 bp, Homo sapiens
aggaagtcatcctgca

SEQ ID NO: 523347 - DNA, 17 bp, Homo sapiens
aggaatgctcaatgtgc

SEQ ID NO: 523348 - DNA, 18 bp, Homo sapiens
aggaatgctcaatgtgct

SEQ ID NO: 523349 - DNA, 16 bp, Homo sapiens
aggacatctctgtaaa

SEQ ID NO: 523350 - DNA, 20 bp, Homo sapiens
aggagcatgtcctatccctg

SEQ ID NO: 523351 - DNA, 15 bp, Homo sapiens
aggagcgtgtcctat

SEQ ID NO: 523352 - DNA, 22 bp, Homo sapiens
aggatgaaggggccagaccacg

SEQ ID NO: 523353 - DNA, 19 bp, Homo sapiens
aggattaggtttagaatca

SEQ ID NO: 523354 - DNA, 19 bp, Homo sapiens
aggcacactgagcaagttt

SEQ ID NO: 523355 - DNA, 18 bp, Homo sapiens
aggcagcctgtgggtcct

SEQ ID NO: 523356 - DNA, 19 bp, Homo sapiens
aggcagcctgtgggtcctt

SEQ ID NO: 523357 - DNA, 13 bp, Homo sapiens
aggcagctgcagt

SEQ ID NO: 523358 - DNA, 16 bp, Homo sapiens
aggcctcagggaccaa

SEQ ID NO: 523359 - DNA, 17 bp, Homo sapiens
aggctcccactgcccct

SEQ ID NO: 523360 - DNA, 20 bp, Homo sapiens
aggctcccactgcccctgca

SEQ ID NO: 523361 - DNA, 15 bp, Homo sapiens
aggctctgaatctct

SEQ ID NO: 523362 - DNA, 22 bp, Homo sapiens
aggctgactcttactaaccacc

SEQ ID NO: 523363 - DNA, 19 bp, Homo sapiens
aggctgagacgcaaggatc

SEQ ID NO: 523364 - DNA, 22 bp, Homo sapiens
aggctgatgccgtgcgggctaa

SEQ ID NO: 523365 - DNA, 12 bp, Homo sapiens
aggcttctccac

SEQ ID NO: 523366 - DNA, 13 bp, Homo sapiens
agggagtgtgcct

SEQ ID NO: 523367 - DNA, 22 bp, Homo sapiens
agggatgctatctcgctagcca

SEQ ID NO: 523368 - DNA, 14 bp, Homo sapiens
agggcccttcccaa

SEQ ID NO: 523369 - DNA, 20 bp, Homo sapiens
agggcccttcccaacctccc

SEQ ID NO: 523370 - DNA, 17 bp, Homo sapiens
agggctgacttctccag

SEQ ID NO: 523371 - DNA, 18 bp, Homo sapiens
agggctgacttctccagg

SEQ ID NO: 523372 - DNA, 16 bp, Homo sapiens
aggggccagaccacgc

SEQ ID NO: 523373 - DNA, 16 bp, Homo sapiens
aggggctgcttctggg

SEQ ID NO: 523374 - DNA, 13 bp, Homo sapiens
agggggagacccc

SEQ ID NO: 523375 - DNA, 15 bp, Homo sapiens
agggggcaaggagaa

SEQ ID NO: 523376 - DNA, 13 bp, Homo sapiens
agggtccagccct

SEQ ID NO: 523377 - DNA, 17 bp, Homo sapiens
agggtccagccctccgc

SEQ ID NO: 523378 - DNA, 23 bp, Homo sapiens
agggtcctgggggctgctgcact

SEQ ID NO: 523379 - DNA, 21 bp, Homo sapiens
agggtttgtttgctgcttttg

SEQ ID NO: 523380 - DNA, 21 bp, Homo sapiens
aggtcagtgttataaaatctg

SEQ ID NO: 523381 - DNA, 13 bp, Homo sapiens
aggtcctgtcctg

SEQ ID NO: 523382 - DNA, 22 bp, Homo sapiens
aggtctgcacacataacacaca

SEQ ID NO: 523383 - DNA, 23 bp, Homo sapiens
aggtctgcacacataacacacat

SEQ ID NO: 523384 - DNA, 14 bp, Homo sapiens
aggtgttgtccgtg

SEQ ID NO: 523385 - DNA, 22 bp, Homo sapiens
aggtttagaatcaagtctgtga

SEQ ID NO: 523386 - DNA, 17 bp, Homo sapiens
agtaaatctaaattaac

SEQ ID NO: 523387 - DNA, 20 bp, Homo sapiens
agtagcatactgatgagaca

SEQ ID NO: 523388 - DNA, 14 bp, Homo sapiens
agtaggtctgcaca

SEQ ID NO: 523389 - DNA, 17 bp, Homo sapiens
agtaggtctgcacacat

SEQ ID NO: 523390 - DNA, 21 bp, Homo sapiens
agtatctcatcaacaaagaaa

SEQ ID NO: 523391 - DNA, 14 bp, Homo sapiens
agtcagcacagaga

SEQ ID NO: 523392 - DNA, 16 bp, Homo sapiens
agtcagggctgtgctt

SEQ ID NO: 523393 - DNA, 18 bp, Homo sapiens
agtcatggctgtcccctg

SEQ ID NO: 523394 - DNA, 19 bp, Homo sapiens
agtcctcaccttctgtttt

SEQ ID NO: 523395 - DNA, 14 bp, Homo sapiens
agtctcctgtatca

SEQ ID NO: 523396 - DNA, 19 bp, Homo sapiens
agtgaaaaagacttcaaat

SEQ ID NO: 523397 - DNA, 20 bp, Homo sapiens
agtgaaaaagacttcaaatg

SEQ ID NO: 523398 - DNA, 22 bp, Homo sapiens
agtgaagccagctgcaggaatc

SEQ ID NO: 523399 - DNA, 23 bp, Homo sapiens
agtgagacctccctgtctctaca

SEQ ID NO: 523400 - DNA, 23 bp, Homo sapiens
agtgatgtggtgggagcacagct

SEQ ID NO: 523401 - DNA, 22 bp, Homo sapiens
agtgattgacattttgtagcta

SEQ ID NO: 523402 - DNA, 17 bp, Homo sapiens
agtgcagggacagcctg

SEQ ID NO: 523403 - DNA, 15 bp, Homo sapiens
agtggggaggagaga

SEQ ID NO: 523404 - DNA, 16 bp, Homo sapiens
agtgtcacttttttcc

SEQ ID NO: 523405 - DNA, 16 bp, Homo sapiens
agtgtggatgtaaatt

SEQ ID NO: 523406 - DNA, 20 bp, Homo sapiens
agtgtggatgtaaattttat

SEQ ID NO: 523407 - DNA, 15 bp, Homo sapiens
agttataccagcaaa

SEQ ID NO: 523408 - DNA, 21 bp, Homo sapiens
agttatccagagggttgtgat

SEQ ID NO: 523409 - DNA, 21 bp, Homo sapiens
agttgcaataaactcagtcaa

SEQ ID NO: 523410 - DNA, 22 bp, Homo sapiens
agttgccgcatattatatcaga

SEQ ID NO: 523411 - DNA, 13 bp, Homo sapiens
agttgtcttacac

SEQ ID NO: 523412 - DNA, 20 bp, Homo sapiens
agtttcatttttcattttct

SEQ ID NO: 523413 - DNA, 16 bp, Homo sapiens
agtttgtgaagtgatt

SEQ ID NO: 523414 - DNA, 13 bp, Homo sapiens
ataaaaataatta

SEQ ID NO: 523415 - DNA, 20 bp, Homo sapiens
ataaaactccttgaaaccag

SEQ ID NO: 523416 - DNA, 22 bp, Homo sapiens
ataaactgtgagataaatatca

SEQ ID NO: 523417 - DNA, 14 bp, Homo sapiens
ataaagaaaccttt

SEQ ID NO: 523418 - DNA, 14 bp, Homo sapiens
ataaagctcacact

SEQ ID NO: 523419 - DNA, 13 bp, Homo sapiens
ataaatatcatta

SEQ ID NO: 523420 - DNA, 18 bp, Homo sapiens
ataaatcttccaaagttt

SEQ ID NO: 523421 - DNA, 18 bp, Homo sapiens
ataaatgaatgaaatata

SEQ ID NO: 523422 - DNA, 12 bp, Homo sapiens
ataacaacaatt

SEQ ID NO: 523423 - DNA, 14 bp, Homo sapiens
ataacaacaattta

SEQ ID NO: 523424 - DNA, 19 bp, Homo sapiens
ataacaggcattgcactaa

SEQ ID NO: 523425 - DNA, 23 bp, Homo sapiens
ataacaggcattgcactaaaagt

SEQ ID NO: 523426 - DNA, 17 bp, Homo sapiens
ataacattgtaaatgat

SEQ ID NO: 523427 - DNA, 14 bp, Homo sapiens
ataagaagcaaata

SEQ ID NO: 523428 - DNA, 14 bp, Homo sapiens
cacacttgggctgg

SEQ ID NO: 523429 - DNA, 15 bp, Homo sapiens
cacacttgggctggc

SEQ ID NO: 523430 - DNA, 16 bp, Homo sapiens
cacagagagcggcttc

SEQ ID NO: 523431 - DNA, 19 bp, Homo sapiens
cacagagagcggcttcccc

SEQ ID NO: 523432 - DNA, 19 bp, Homo sapiens
cacagaggacggcttcccc

SEQ ID NO: 523433 - DNA, 19 bp, Homo sapiens
cacagaggatggcttcccc

SEQ ID NO: 523434 - DNA, 17 bp, Homo sapiens
cacagctgagctggcct

SEQ ID NO: 523435 - DNA, 16 bp, Homo sapiens
cacaggagcgtgtcct

SEQ ID NO: 523436 - DNA, 18 bp, Homo sapiens
cacaggagcgtgtcctat

SEQ ID NO: 523437 - DNA, 14 bp, Homo sapiens
cacagtgggcggct

SEQ ID NO: 523438 - DNA, 16 bp, Homo sapiens
cacagtgggcggcttc

SEQ ID NO: 523439 - DNA, 15 bp, Homo sapiens
cacattcctgaccct

SEQ ID NO: 523440 - DNA, 20 bp, Homo sapiens
cacattcctgaccctcactt

SEQ ID NO: 523441 - DNA, 20 bp, Homo sapiens
caccaaattgctgagatgtt

SEQ ID NO: 523442 - DNA, 23 bp, Homo sapiens
caccaaattgctgagatgtttag

SEQ ID NO: 523443 - DNA, 15 bp, Homo sapiens
caccagcttgcttct

SEQ ID NO: 523444 - DNA, 15 bp, Homo sapiens
caccatgctgggccg

SEQ ID NO: 523445 - DNA, 22 bp, Homo sapiens
caccatttaatcatttccagca

SEQ ID NO: 523446 - DNA, 17 bp, Homo sapiens
caccatttcccctgtgg

SEQ ID NO: 523447 - DNA, 11 bp, Homo sapiens
cacccagcctg

SEQ ID NO: 523448 - DNA, 19 bp, Homo sapiens
caccccgttgttgtccctg

SEQ ID NO: 523449 - DNA, 21 bp, Homo sapiens
caccccgttgttgtccctgca

SEQ ID NO: 523450 - DNA, 18 bp, Homo sapiens
cacccgtgttctcctcca

SEQ ID NO: 523451 - DNA, 14 bp, Homo sapiens
caccggcactgtgc

SEQ ID NO: 523452 - DNA, 16 bp, Homo sapiens
caccggcactgtgcac

SEQ ID NO: 523453 - DNA, 15 bp, Homo sapiens
cacctgcttctcagc

SEQ ID NO: 523454 - DNA, 22 bp, Homo sapiens
caccttctgtgcatctggcctg

SEQ ID NO: 523455 - DNA, 13 bp, Homo sapiens
cacgcaacttgaa

SEQ ID NO: 523456 - DNA, 21 bp, Homo sapiens
cacggaggctcgtgcatgtaa

SEQ ID NO: 523457 - DNA, 21 bp, Homo sapiens
cacggtccaatccagccttct

SEQ ID NO: 523458 - DNA, 17 bp, Homo sapiens
cactaaaagtgatgtga

SEQ ID NO: 523459 - DNA, 15 bp, Homo sapiens
cactgccctctgcca

SEQ ID NO: 523460 - DNA, 18 bp, Homo sapiens
cactgccctctgccactg

SEQ ID NO: 523461 - DNA, 17 bp, Homo sapiens
cactgtcaagattaagt

SEQ ID NO: 523462 - DNA, 16 bp, Homo sapiens
cactgtgcactctact

SEQ ID NO: 523463 - DNA, 14 bp, Homo sapiens
cacttatttccatg

SEQ ID NO: 523464 - DNA, 19 bp, Homo sapiens
cacttttattgtataatta

SEQ ID NO: 523465 - DNA, 16 bp, Homo sapiens
cagaacgcatgcaggg

SEQ ID NO: 523466 - DNA, 19 bp, Homo sapiens
cagaacgcatgcagggccc

SEQ ID NO: 523467 - DNA, 23 bp, Homo sapiens
cagaccggggtggagtcagggct

SEQ ID NO: 523468 - DNA, 20 bp, Homo sapiens
cagaggcattggaggatggg

SEQ ID NO: 523469 - DNA, 12 bp, Homo sapiens
cagcaacaacaa

SEQ ID NO: 523470 - DNA, 13 bp, Homo sapiens
cagcaacaacaac

SEQ ID NO: 523471 - DNA, 17 bp, Homo sapiens
cagcaacaacaacagaa

SEQ ID NO: 523472 - DNA, 17 bp, Homo sapiens
cagcatcgtgtgggtcc

SEQ ID NO: 523473 - DNA, 19 bp, Homo sapiens
cagcatcgtgtgggtccct

SEQ ID NO: 523474 - DNA, 13 bp, Homo sapiens
cagccctccgcca

SEQ ID NO: 523475 - DNA, 21 bp, Homo sapiens
cagccctccgccagccctgtt

SEQ ID NO: 523476 - DNA, 18 bp, Homo sapiens
cagccctgttccgcctca

SEQ ID NO: 523477 - DNA, 20 bp, Homo sapiens
cagccctgttccgcctcact

SEQ ID NO: 523478 - DNA, 22 bp, Homo sapiens
cagccctgttccgcctcactgg

SEQ ID NO: 523479 - DNA, 12 bp, Homo sapiens
cagcctgcacag

SEQ ID NO: 523480 - DNA, 18 bp, Homo sapiens
cagcctgtgaactgccag

SEQ ID NO: 523481 - DNA, 15 bp, Homo sapiens
cagcctgtgggtcct

SEQ ID NO: 523482 - DNA, 18 bp, Homo sapiens
cagcctgtgggtccttgc

SEQ ID NO: 523483 - DNA, 14 bp, Homo sapiens
cagcgctgaacaga

SEQ ID NO: 523484 - DNA, 15 bp, Homo sapiens
cagcggggcttctgg

SEQ ID NO: 523485 - DNA, 15 bp, Homo sapiens
cagctaagcctgatg

SEQ ID NO: 523486 - DNA, 18 bp, Homo sapiens
cagctaagcctgatgatg

SEQ ID NO: 523487 - DNA, 19 bp, Homo sapiens
cagctacaggggaggctga

SEQ ID NO: 523488 - DNA, 20 bp, Homo sapiens
cagctcaggctactgccact

SEQ ID NO: 523489 - DNA, 12 bp, Homo sapiens
cagctctgggag

SEQ ID NO: 523490 - DNA, 15 bp, Homo sapiens
cagctgagctggcct

SEQ ID NO: 523491 - DNA, 14 bp, Homo sapiens
cagctgtgagcttt

SEQ ID NO: 523492 - DNA, 16 bp, Homo sapiens
cagcttcccaacaata

SEQ ID NO: 523493 - DNA, 11 bp, Homo sapiens
caggaaaatga

SEQ ID NO: 523494 - DNA, 21 bp, Homo sapiens
caggaaattctgtttatgttc

SEQ ID NO: 523495 - DNA, 15 bp, Homo sapiens
caggagcatgtccta

SEQ ID NO: 523496 - DNA, 14 bp, Homo sapiens
caggagcgtgtact

SEQ ID NO: 523497 - DNA, 16 bp, Homo sapiens
caggagcgtgtactac

SEQ ID NO: 523498 - DNA, 16 bp, Homo sapiens
caggagcgtgtcctat

SEQ ID NO: 523499 - DNA, 17 bp, Homo sapiens
caggagcgtgtcctatc

SEQ ID NO: 523500 - DNA, 23 bp, Homo sapiens
caggatgaaggggccagaccacg

SEQ ID NO: 523501 - DNA, 15 bp, Homo sapiens
caggatgcatgcagg

SEQ ID NO: 523502 - DNA, 19 bp, Homo sapiens
caggcaccatgctgggccg

SEQ ID NO: 523503 - DNA, 18 bp, Homo sapiens
caggcagcctgtgggtcc

SEQ ID NO: 523504 - DNA, 17 bp, Homo sapiens
caggcatttagctagtt

SEQ ID NO: 523505 - DNA, 14 bp, Homo sapiens
caggcctcagggac

SEQ ID NO: 523506 - DNA, 18 bp, Homo sapiens
caggctcccactgcccct

SEQ ID NO: 523507 - DNA, 22 bp, Homo sapiens
caggctcccactgcccctgcac

SEQ ID NO: 523508 - DNA, 16 bp, Homo sapiens
caggctctgaatctct

SEQ ID NO: 523509 - DNA, 17 bp, Homo sapiens
cagggacagcctgcaca

SEQ ID NO: 523510 - DNA, 18 bp, Homo sapiens
cagggacagcctgcacag

SEQ ID NO: 523511 - DNA, 15 bp, Homo sapiens
cagggaccaaggaga

SEQ ID NO: 523512 - DNA, 14 bp, Homo sapiens
cagggagtggggag

SEQ ID NO: 523513 - DNA, 20 bp, Homo sapiens
cagggagtggggaggagaga

SEQ ID NO: 523514 - DNA, 22 bp, Homo sapiens
cagggagtggggaggagagagg

SEQ ID NO: 523515 - DNA, 17 bp, Homo sapiens
cagggcaggagcttggc

SEQ ID NO: 523516 - DNA, 20 bp, Homo sapiens
cagggcaggagcttggcaga

SEQ ID NO: 523517 - DNA, 15 bp, Homo sapiens
cagggcccccacagg

SEQ ID NO: 523518 - DNA, 17 bp, Homo sapiens
cagggcgcaggggaggg

SEQ ID NO: 523519 - DNA, 13 bp, Homo sapiens
caggggaggctga

SEQ ID NO: 523520 - DNA, 17 bp, Homo sapiens
caggggcactgtgttct

SEQ ID NO: 523521 - DNA, 22 bp, Homo sapiens
cagggtcctgggggctgctgca

SEQ ID NO: 523522 - DNA, 14 bp, Homo sapiens
cagtaaatgtatat

SEQ ID NO: 523523 - DNA, 20 bp, Homo sapiens
cagtacaattctttgttgct

SEQ ID NO: 523524 - DNA, 21 bp, Homo sapiens
cagtacaattctttgttgctt

SEQ ID NO: 523525 - DNA, 21 bp, Homo sapiens
cagtagcatactgatgagaca

SEQ ID NO: 523526 - DNA, 17 bp, Homo sapiens
cagtattgagacactgt

SEQ ID NO: 523527 - DNA, 21 bp, Homo sapiens
cagtattgagacactgtcaag

SEQ ID NO: 523528 - DNA, 22 bp, Homo sapiens
cagtattgttcttgtaaaactg

SEQ ID NO: 523529 - DNA, 21 bp, Homo sapiens
ccatttaatcatttccagcaa

SEQ ID NO: 523530 - DNA, 16 bp, Homo sapiens
ccatttcacattcctg

SEQ ID NO: 523531 - DNA, 17 bp, Homo sapiens
cccacaggagcgtgtcc

SEQ ID NO: 523532 - DNA, 19 bp, Homo sapiens
cccacaggagcgtgtccta

SEQ ID NO: 523533 - DNA, 19 bp, Homo sapiens
cccactgcccctgcacctg

SEQ ID NO: 523534 - DNA, 12 bp, Homo sapiens
cccagagacccg

SEQ ID NO: 523535 - DNA, 23 bp, Homo sapiens
cccaggacgcatgcagggccccc

SEQ ID NO: 523536 - DNA, 15 bp, Homo sapiens
cccagggtcccctgc

SEQ ID NO: 523537 - DNA, 13 bp, Homo sapiens
cccagggtcctgg

SEQ ID NO: 523538 - DNA, 18 bp, Homo sapiens
cccatgcaggcagcctgc

SEQ ID NO: 523539 - DNA, 20 bp, Homo sapiens
cccatgccctccctgctgcc

SEQ ID NO: 523540 - DNA, 17 bp, Homo sapiens
cccatggaacagccctg

SEQ ID NO: 523541 - DNA, 17 bp, Homo sapiens
cccatggtagactgtga

SEQ ID NO: 523542 - DNA, 16 bp, Homo sapiens
cccattgccttctggg

SEQ ID NO: 523543 - DNA, 23 bp, Homo sapiens
cccattgtgaatgttgtcctgtg

SEQ ID NO: 523544 - DNA, 11 bp, Homo sapiens
ccccactggaa

SEQ ID NO: 523545 - DNA, 20 bp, Homo sapiens
ccccaggaagtcatcctgca

SEQ ID NO: 523546 - DNA, 17 bp, Homo sapiens
ccccatcgccttctggc

SEQ ID NO: 523547 - DNA, 19 bp, Homo sapiens
ccccatcgccttctgggga

SEQ ID NO: 523548 - DNA, 18 bp, Homo sapiens
cccccatgccctccctgc

SEQ ID NO: 523549 - DNA, 13 bp, Homo sapiens
cccccattgtgaa

SEQ ID NO: 523550 - DNA, 21 bp, Homo sapiens
cccccctcagcaaggggctgc

SEQ ID NO: 523551 - DNA, 15 bp, Homo sapiens
ccccggcccccctct

SEQ ID NO: 523552 - DNA, 18 bp, Homo sapiens
ccccgtgctcacagtagc

SEQ ID NO: 523553 - DNA, 16 bp, Homo sapiens
ccccgttgttgtccct

SEQ ID NO: 523554 - DNA, 18 bp, Homo sapiens
cccctcagcaaggggctg

SEQ ID NO: 523555 - DNA, 19 bp, Homo sapiens
cccctgcacctgcttctca

SEQ ID NO: 523556 - DNA, 17 bp, Homo sapiens
cccctggtcctgcactg

SEQ ID NO: 523557 - DNA, 21 bp, Homo sapiens
cccgatgcgtggctcccagca

SEQ ID NO: 523558 - DNA, 14 bp, Homo sapiens
cccggacgggggag

SEQ ID NO: 523559 - DNA, 12 bp, Homo sapiens
cccggcctgatg

SEQ ID NO: 523560 - DNA, 15 bp, Homo sapiens
cccggcctgatggcc

SEQ ID NO: 523561 - DNA, 16 bp, Homo sapiens
cccggcctgatggcca

SEQ ID NO: 523562 - DNA, 19 bp, Homo sapiens
cccggcctgatggccaggc

SEQ ID NO: 523563 - DNA, 22 bp, Homo sapiens
cccgtctgggaatcctggacag

SEQ ID NO: 523564 - DNA, 18 bp, Homo sapiens
cccgttgttgtccctgca

SEQ ID NO: 523565 - DNA, 14 bp, Homo sapiens
ccctccctccctgc

SEQ ID NO: 523566 - DNA, 11 bp, Homo sapiens
ccctccctgct

SEQ ID NO: 523567 - DNA, 18 bp, Homo sapiens
ccctccgccagccctgtt

SEQ ID NO: 523568 - DNA, 16 bp, Homo sapiens
ccctcctccatgctgt

SEQ ID NO: 523569 - DNA, 13 bp, Homo sapiens
ccctgacactgtc

SEQ ID NO: 523570 - DNA, 18 bp, Homo sapiens
ccctgagggcccttccca

SEQ ID NO: 523571 - DNA, 20 bp, Homo sapiens
ccctgagggcccttcccaac

SEQ ID NO: 523572 - DNA, 12 bp, Homo sapiens
ccctgcagggca

SEQ ID NO: 523573 - DNA, 17 bp, Homo sapiens
ccctgctcccggctctg

SEQ ID NO: 523574 - DNA, 21 bp, Homo sapiens
ccctgctcccggctctgaggc

SEQ ID NO: 523575 - DNA, 14 bp, Homo sapiens
ccctgctccctgct

SEQ ID NO: 523576 - DNA, 23 bp, Homo sapiens
ccctgctgccaggctcccactgc

SEQ ID NO: 523577 - DNA, 19 bp, Homo sapiens
ccctgttgacctaccctgg

SEQ ID NO: 523578 - DNA, 20 bp, Homo sapiens
ccgcctcactgggtgtggcc

SEQ ID NO: 523579 - DNA, 16 bp, Homo sapiens
ccgcgctcggggctgg

SEQ ID NO: 523580 - DNA, 18 bp, Homo sapiens
ccgcgctcggggctgggc

SEQ ID NO: 523581 - DNA, 18 bp, Homo sapiens
ccggacgcatgcagggcc

SEQ ID NO: 523582 - DNA, 19 bp, Homo sapiens
ccggacgcatgcagggccc

SEQ ID NO: 523583 - DNA, 20 bp, Homo sapiens
ccggcactgtgcactctact

SEQ ID NO: 523584 - DNA, 16 bp, Homo sapiens
ccggcccccctctcgg

SEQ ID NO: 523585 - DNA, 14 bp, Homo sapiens
ccggctgactcagt

SEQ ID NO: 523586 - DNA, 17 bp, Homo sapiens
ccgggctccagggagtg

SEQ ID NO: 523587 - DNA, 22 bp, Homo sapiens
ccgggctccagggagtggggag

SEQ ID NO: 523588 - DNA, 17 bp, Homo sapiens
ccggtggggccagcgct

SEQ ID NO: 523589 - DNA, 13 bp, Homo sapiens
ccggttccacgtg

SEQ ID NO: 523590 - DNA, 14 bp, Homo sapiens
ccggttccacgtgg

SEQ ID NO: 523591 - DNA, 22 bp, Homo sapiens
ccggttccacgtggggtggaat

SEQ ID NO: 523592 - DNA, 18 bp, Homo sapiens
ccgtctgaccaagggctg

SEQ ID NO: 523593 - DNA, 18 bp, Homo sapiens
ccgttgttgtccctgcag

SEQ ID NO: 523594 - DNA, 14 bp, Homo sapiens
cctaattaatttca

SEQ ID NO: 523595 - DNA, 17 bp, Homo sapiens
cctaattaatttcagta

SEQ ID NO: 523596 - DNA, 19 bp, Homo sapiens
cctactcctccccctcctc

SEQ ID NO: 523597 - DNA, 23 bp, Homo sapiens
cctatcatcagttaggattaggt

SEQ ID NO: 523598 - DNA, 16 bp, Homo sapiens
cctcactgggtgtggc

SEQ ID NO: 523599 - DNA, 22 bp, Homo sapiens
cctcactgggtgtggcctggct

SEQ ID NO: 523600 - DNA, 17 bp, Homo sapiens
cctcatggctgttatct

SEQ ID NO: 523601 - DNA, 15 bp, Homo sapiens
cctccatgctgtccc

SEQ ID NO: 523602 - DNA, 18 bp, Homo sapiens
cctccatgctgtccctgt

SEQ ID NO: 523603 - DNA, 23 bp, Homo sapiens
cctccatgctgtccctgtgggct

SEQ ID NO: 523604 - DNA, 17 bp, Homo sapiens
cctcccctggtcctgca

SEQ ID NO: 523605 - DNA, 18 bp, Homo sapiens
cctcccctggtcctgcac

SEQ ID NO: 523606 - DNA, 19 bp, Homo sapiens
cctcccctggtcctgcact

SEQ ID NO: 523607 - DNA, 14 bp, Homo sapiens
cctccctgctccct

SEQ ID NO: 523608 - DNA, 15 bp, Homo sapiens
cctccctgctccctg

SEQ ID NO: 523609 - DNA, 14 bp, Homo sapiens
cctccctgctgcca

SEQ ID NO: 523610 - DNA, 12 bp, Homo sapiens
cctccgccagcc

SEQ ID NO: 523611 - DNA, 14 bp, Homo sapiens
cctccgccagccct

SEQ ID NO: 523612 - DNA, 16 bp, Homo sapiens
cctccgccagccctgt

SEQ ID NO: 523613 - DNA, 14 bp, Homo sapiens
cctcctccatgctg

SEQ ID NO: 523614 - DNA, 21 bp, Homo sapiens
cctcctgtctcctctgtcagt

SEQ ID NO: 523615 - DNA, 21 bp, Homo sapiens
cctccttcactccctgtcata

SEQ ID NO: 523616 - DNA, 20 bp, Homo sapiens
cctcggacaccatcttggga

SEQ ID NO: 523617 - DNA, 17 bp, Homo sapiens
cctctcgggctctctca

SEQ ID NO: 523618 - DNA, 19 bp, Homo sapiens
cctctcgggctctctcacc

SEQ ID NO: 523619 - DNA, 17 bp, Homo sapiens
cctctgccactgacagg

SEQ ID NO: 523620 - DNA, 19 bp, Homo sapiens
cctctgccactgacaggaa

SEQ ID NO: 523621 - DNA, 15 bp, Homo sapiens
cctgacatgctaacc

SEQ ID NO: 523622 - DNA, 13 bp, Homo sapiens
cctgaccctcact

SEQ ID NO: 523623 - DNA, 20 bp, Homo sapiens
cctgagaggagcgtgtccta

SEQ ID NO: 523624 - DNA, 21 bp, Homo sapiens
cctgcacagtggtccagggtc

SEQ ID NO: 523625 - DNA, 17 bp, Homo sapiens
cctgcacctgcttctca

SEQ ID NO: 523626 - DNA, 21 bp, Homo sapiens
cctgctcccggctctgaggct

SEQ ID NO: 523627 - DNA, 16 bp, Homo sapiens
cctgctccctgctccc

SEQ ID NO: 523628 - DNA, 13 bp, Homo sapiens
cctgcttctcagc

SEQ ID NO: 523629 - DNA, 18 bp, Homo sapiens
cctggaccgagtggacca

SEQ ID NO: 523630 - DNA, 20 bp, Homo sapiens
ctcatcagaaacaatttctg

SEQ ID NO: 523631 - DNA, 16 bp, Homo sapiens
ctcatctgtaaaacca

SEQ ID NO: 523632 - DNA, 14 bp, Homo sapiens
ctcatgtgatttac

SEQ ID NO: 523633 - DNA, 12 bp, Homo sapiens
ctcattttattc

SEQ ID NO: 523634 - DNA, 23 bp, Homo sapiens
ctccacagggacacagtctggtg

SEQ ID NO: 523635 - DNA, 23 bp, Homo sapiens
ctccaggaagggaccccactgga

SEQ ID NO: 523636 - DNA, 17 bp, Homo sapiens
ctccagggagtggggag

SEQ ID NO: 523637 - DNA, 18 bp, Homo sapiens
ctccatgctgtccctgtg

SEQ ID NO: 523638 - DNA, 22 bp, Homo sapiens
ctccatgctgtccctgtgggct

SEQ ID NO: 523639 - DNA, 17 bp, Homo sapiens
ctcccactgcccctgca

SEQ ID NO: 523640 - DNA, 15 bp, Homo sapiens
ctcccagcagaggcc

SEQ ID NO: 523641 - DNA, 14 bp, Homo sapiens
ctcccctggtcctg

SEQ ID NO: 523642 - DNA, 18 bp, Homo sapiens
ctcccggtgtgcagcggg

SEQ ID NO: 523643 - DNA, 14 bp, Homo sapiens
ctccctgcctggat

SEQ ID NO: 523644 - DNA, 13 bp, Homo sapiens
ctccctgctgcca

SEQ ID NO: 523645 - DNA, 14 bp, Homo sapiens
ctccgccagccctg

SEQ ID NO: 523646 - DNA, 15 bp, Homo sapiens
ctccgccagccctgt

SEQ ID NO: 523647 - DNA, 20 bp, Homo sapiens
ctccgcccttccctgacact

SEQ ID NO: 523648 - DNA, 16 bp, Homo sapiens
ctcctccatgctgtcc

SEQ ID NO: 523649 - DNA, 19 bp, Homo sapiens
ctcctgtctcctctgtcag

SEQ ID NO: 523650 - DNA, 13 bp, Homo sapiens
ctccttcatgctt

SEQ ID NO: 523651 - DNA, 19 bp, Homo sapiens
ctccttgaaaccagctcag

SEQ ID NO: 523652 - DNA, 12 bp, Homo sapiens
ctcgcctgggaa

SEQ ID NO: 523653 - DNA, 21 bp, Homo sapiens
ctcgcctgggaaattgctcca

SEQ ID NO: 523654 - DNA, 16 bp, Homo sapiens
ctcggggctgggcaga

SEQ ID NO: 523655 - DNA, 13 bp, Homo sapiens
ctcggtggcattt

SEQ ID NO: 523656 - DNA, 14 bp, Homo sapiens
ctcgtgtttcacag

SEQ ID NO: 523657 - DNA, 17 bp, Homo sapiens
ctctactgaaaacacaa

SEQ ID NO: 523658 - DNA, 17 bp, Homo sapiens
ctctaggtaaactagca

SEQ ID NO: 523659 - DNA, 19 bp, Homo sapiens
ctctcgggctctctcaccc

SEQ ID NO: 523660 - DNA, 15 bp, Homo sapiens
ctctctgaactgcaa

SEQ ID NO: 523661 - DNA, 23 bp, Homo sapiens
ctctcttggtctctttctttcca

SEQ ID NO: 523662 - DNA, 15 bp, Homo sapiens
ctctgaactgcaaca

SEQ ID NO: 523663 - DNA, 18 bp, Homo sapiens
ctctgaactgcaacactg

SEQ ID NO: 523664 - DNA, 15 bp, Homo sapiens
ctctgaatctctcaa

SEQ ID NO: 523665 - DNA, 22 bp, Homo sapiens
ctctgccggtggggccagcgct

SEQ ID NO: 523666 - DNA, 18 bp, Homo sapiens
ctctgcgacgatccccat

SEQ ID NO: 523667 - DNA, 11 bp, Homo sapiens
ctcttcttcct

SEQ ID NO: 523668 - DNA, 12 bp, Homo sapiens
ctcttcttcctt

SEQ ID NO: 523669 - DNA, 12 bp, Homo sapiens
ctcttggtctct

SEQ ID NO: 523670 - DNA, 13 bp, Homo sapiens
ctcttggtctctt

SEQ ID NO: 523671 - DNA, 15 bp, Homo sapiens
ctcttggtctctttc

SEQ ID NO: 523672 - DNA, 21 bp, Homo sapiens
ctcttggtctctttctttcca

SEQ ID NO: 523673 - DNA, 15 bp, Homo sapiens
ctctttctttccaaa

SEQ ID NO: 523674 - DNA, 19 bp, Homo sapiens
ctgaaaactggaataagaa

SEQ ID NO: 523675 - DNA, 21 bp, Homo sapiens
ctgaaaactggaataagaagc

SEQ ID NO: 523676 - DNA, 22 bp, Homo sapiens
ctgaaaactggaataagaagca

SEQ ID NO: 523677 - DNA, 17 bp, Homo sapiens
ctgaacagaccggggtg

SEQ ID NO: 523678 - DNA, 16 bp, Homo sapiens
ctgaataacaacaatt

SEQ ID NO: 523679 - DNA, 19 bp, Homo sapiens
ctgaatctctcaaaatgtg

SEQ ID NO: 523680 - DNA, 17 bp, Homo sapiens
ctgacaggaaagtggat

SEQ ID NO: 523681 - DNA, 12 bp, Homo sapiens
ctgaccctcact

SEQ ID NO: 523682 - DNA, 21 bp, Homo sapiens
ctgactcagtgcagggacagc

SEQ ID NO: 523683 - DNA, 21 bp, Homo sapiens
ctgactgtttacacctttccg

SEQ ID NO: 523684 - DNA, 21 bp, Homo sapiens
ctgagaatccccgtgctcaca

SEQ ID NO: 523685 - DNA, 23 bp, Homo sapiens
ctgagaccacggtccaatccagc

SEQ ID NO: 523686 - DNA, 17 bp, Homo sapiens
ctgagacgcaaggatca

SEQ ID NO: 523687 - DNA, 18 bp, Homo sapiens
ctgagatgtttagtagct

SEQ ID NO: 523688 - DNA, 18 bp, Homo sapiens
ctgagggcccttcccaac

SEQ ID NO: 523689 - DNA, 20 bp, Homo sapiens
ctgagtggctcgtgtttcac

SEQ ID NO: 523690 - DNA, 21 bp, Homo sapiens
ctgagtggctcgtgtttcaca

SEQ ID NO: 523691 - DNA, 24 bp, Homo sapiens
ctgagtggctcgtgtttcacagtg

SEQ ID NO: 523692 - DNA, 21 bp, Homo sapiens
ctgatacttatttataacatt

SEQ ID NO: 523693 - DNA, 13 bp, Homo sapiens
ctgatgagacaac

SEQ ID NO: 523694 - DNA, 16 bp, Homo sapiens
ctgatgagacaacaca

SEQ ID NO: 523695 - DNA, 15 bp, Homo sapiens
ctgatgatggaaggg

SEQ ID NO: 523696 - DNA, 19 bp, Homo sapiens
ctgatttattctggtgtct

SEQ ID NO: 523697 - DNA, 12 bp, Homo sapiens
ctgcaacactgg

SEQ ID NO: 523698 - DNA, 13 bp, Homo sapiens
ctgcaatgggaga

SEQ ID NO: 523699 - DNA, 18 bp, Homo sapiens
ctgcacctgcttctcagc

SEQ ID NO: 523700 - DNA, 14 bp, Homo sapiens
ctgcactgccctcc

SEQ ID NO: 523701 - DNA, 15 bp, Homo sapiens
ctgcaggaatcaaaa

SEQ ID NO: 523702 - DNA, 22 bp, Homo sapiens
ctgcaggaatcaaaaattgaag

SEQ ID NO: 523703 - DNA, 13 bp, Homo sapiens
ctgcagtcagcac

SEQ ID NO: 523704 - DNA, 18 bp, Homo sapiens
ctgcagtcagcacagaga

SEQ ID NO: 523705 - DNA, 22 bp, Homo sapiens
ctgccaggctcccactgcccct

SEQ ID NO: 523706 - DNA, 20 bp, Homo sapiens
ctgccagggggcaaggagaa

SEQ ID NO: 523707 - DNA, 22 bp, Homo sapiens
ctgccagggggcaaggagaaag

SEQ ID NO: 523708 - DNA, 16 bp, Homo sapiens
ctgccgaggtgtggct

SEQ ID NO: 523709 - DNA, 21 bp, Homo sapiens
ctgccggtggggccagcgctg

SEQ ID NO: 523710 - DNA, 19 bp, Homo sapiens
ctgcgctcccacctcggac

SEQ ID NO: 523711 - DNA, 18 bp, Homo sapiens
ctgcgtaggagagaacag

SEQ ID NO: 523712 - DNA, 22 bp, Homo sapiens
ctgctatgctgttcattgatga

SEQ ID NO: 523713 - DNA, 20 bp, Homo sapiens
ctgctcccggctctgaggct

SEQ ID NO: 523714 - DNA, 16 bp, Homo sapiens
ctgctgcactgccctc

SEQ ID NO: 523715 - DNA, 12 bp, Homo sapiens
ctgctgccaggc

SEQ ID NO: 523716 - DNA, 16 bp, Homo sapiens
ctgctgcctcaggaat

SEQ ID NO: 523717 - DNA, 12 bp, Homo sapiens
ctgcttctgggg

SEQ ID NO: 523718 - DNA, 21 bp, Homo sapiens
ctgcttttgatggctatgttt

SEQ ID NO: 523719 - DNA, 17 bp, Homo sapiens
ctggaaaaaaaaaaata

SEQ ID NO: 523720 - DNA, 21 bp, Homo sapiens
ctggaataagaagcaaataaa

SEQ ID NO: 523721 - DNA, 16 bp, Homo sapiens
ctggaccgagtggacc

SEQ ID NO: 523722 - DNA, 23 bp, Homo sapiens
ctggaccgagtggaccacgacct

SEQ ID NO: 523723 - DNA, 14 bp, Homo sapiens
ctggaggagaagga

SEQ ID NO: 523724 - DNA, 20 bp, Homo sapiens
ctggatccagctctgggagc

SEQ ID NO: 523725 - DNA, 12 bp, Homo sapiens
ctggatttaact

SEQ ID NO: 523726 - DNA, 16 bp, Homo sapiens
ctgggaaattgctcca

SEQ ID NO: 523727 - DNA, 21 bp, Homo sapiens
ctgggaaattgctccattcct

SEQ ID NO: 523728 - DNA, 19 bp, Homo sapiens
ctgggacaggcaccatgct

SEQ ID NO: 523729 - DNA, 21 bp, Homo sapiens
ctgggccggggtgtggaatca

SEQ ID NO: 523730 - DNA, 18 bp, Homo sapiens
ctgggcgccggttccacg

SEQ ID NO: 523731 - DNA, 19 bp, Homo sapiens
gcaggaatcaaaaattgaa

SEQ ID NO: 523732 - DNA, 13 bp, Homo sapiens
gcaggaccaggca

SEQ ID NO: 523733 - DNA, 22 bp, Homo sapiens
gcaggttgtgtgtgtgtgcagt

SEQ ID NO: 523734 - DNA, 18 bp, Homo sapiens
gcagtcagcacagagagc

SEQ ID NO: 523735 - DNA, 18 bp, Homo sapiens
gcatcgtgtgggtcccta

SEQ ID NO: 523736 - DNA, 17 bp, Homo sapiens
gcatctggcctgggggc

SEQ ID NO: 523737 - DNA, 13 bp, Homo sapiens
gcatgcagggccc

SEQ ID NO: 523738 - DNA, 21 bp, Homo sapiens
gcatgcagggcccccacagga

SEQ ID NO: 523739 - DNA, 22 bp, Homo sapiens
gcatgcagggcccccatgcagg

SEQ ID NO: 523740 - DNA, 14 bp, Homo sapiens
gcatgctcagtatt

SEQ ID NO: 523741 - DNA, 17 bp, Homo sapiens
gcatgtaatattaaatt

SEQ ID NO: 523742 - DNA, 15 bp, Homo sapiens
gcattgcactaaaag

SEQ ID NO: 523743 - DNA, 17 bp, Homo sapiens
gcattgcactaaaagtg

SEQ ID NO: 523744 - DNA, 10 bp, Homo sapiens
gcatttatgc

SEQ ID NO: 523745 - DNA, 15 bp, Homo sapiens
gcatttgctgaataa

SEQ ID NO: 523746 - DNA, 17 bp, Homo sapiens
gccaataaagctcacac

SEQ ID NO: 523747 - DNA, 14 bp, Homo sapiens
gccactaaggtcag

SEQ ID NO: 523748 - DNA, 20 bp, Homo sapiens
gccagccctgttccgcctca

SEQ ID NO: 523749 - DNA, 20 bp, Homo sapiens
gccagctgcaggaatcaaaa

SEQ ID NO: 523750 - DNA, 20 bp, Homo sapiens
gccaggcctcagggaccaag

SEQ ID NO: 523751 - DNA, 15 bp, Homo sapiens
gccatttcacattcc

SEQ ID NO: 523752 - DNA, 23 bp, Homo sapiens
gcccacccgtgttctcctccaaa

SEQ ID NO: 523753 - DNA, 22 bp, Homo sapiens
gcccacctaaagggaagccctg

SEQ ID NO: 523754 - DNA, 14 bp, Homo sapiens
gcccccacaggagc

SEQ ID NO: 523755 - DNA, 15 bp, Homo sapiens
gcccccacaggagcg

SEQ ID NO: 523756 - DNA, 21 bp, Homo sapiens
gcccccacaggagcgtgtcct

SEQ ID NO: 523757 - DNA, 18 bp, Homo sapiens
gccctccctgctgccagg

SEQ ID NO: 523758 - DNA, 17 bp, Homo sapiens
gccctccgccagccctg

SEQ ID NO: 523759 - DNA, 18 bp, Homo sapiens
gccctccgccagccctgt

SEQ ID NO: 523760 - DNA, 14 bp, Homo sapiens
gccctccgcccttc

SEQ ID NO: 523761 - DNA, 15 bp, Homo sapiens
gccctccgcccttcc

SEQ ID NO: 523762 - DNA, 18 bp, Homo sapiens
gccctccgcccttccctg

SEQ ID NO: 523763 - DNA, 22 bp, Homo sapiens
gccctgttccgcctcactgggt

SEQ ID NO: 523764 - DNA, 20 bp, Homo sapiens
gcccttcccaacctcccctg

SEQ ID NO: 523765 - DNA, 19 bp, Homo sapiens
gccgctgcagtcagcacag

SEQ ID NO: 523766 - DNA, 23 bp, Homo sapiens
gccgctgcagtcagcacagagag

SEQ ID NO: 523767 - DNA, 22 bp, Homo sapiens
gccgcttaaacatttccctgct

SEQ ID NO: 523768 - DNA, 14 bp, Homo sapiens
gccgggctccaggg

SEQ ID NO: 523769 - DNA, 19 bp, Homo sapiens
gccgggctccagggagtgg

SEQ ID NO: 523770 - DNA, 19 bp, Homo sapiens
gccggtggggccagcgctg

SEQ ID NO: 523771 - DNA, 14 bp, Homo sapiens
gccgtgcagggcca

SEQ ID NO: 523772 - DNA, 13 bp, Homo sapiens
gcctcactgggtg

SEQ ID NO: 523773 - DNA, 21 bp, Homo sapiens
gcctccagggcgcaggggagg

SEQ ID NO: 523774 - DNA, 14 bp, Homo sapiens
gcctgatggccagg

SEQ ID NO: 523775 - DNA, 16 bp, Homo sapiens
gcctggaggagaagga

SEQ ID NO: 523776 - DNA, 19 bp, Homo sapiens
gcctggaggagaaggagga

SEQ ID NO: 523777 - DNA, 13 bp, Homo sapiens
gcctggcttctgg

SEQ ID NO: 523778 - DNA, 16 bp, Homo sapiens
gccttaagtcttactg

SEQ ID NO: 523779 - DNA, 13 bp, Homo sapiens
gccttctcccctc

SEQ ID NO: 523780 - DNA, 18 bp, Homo sapiens
gccttctggccgctgcag

SEQ ID NO: 523781 - DNA, 18 bp, Homo sapiens
gccttctggctgctgcag

SEQ ID NO: 523782 - DNA, 23 bp, Homo sapiens
gccttctggggagggacacagag

SEQ ID NO: 523783 - DNA, 15 bp, Homo sapiens
gcgccggttccacgt

SEQ ID NO: 523784 - DNA, 16 bp, Homo sapiens
gcgccggttccacgtg

SEQ ID NO: 523785 - DNA, 18 bp, Homo sapiens
gcgccggttccacgtggg

SEQ ID NO: 523786 - DNA, 17 bp, Homo sapiens
gcggcaaagatccagcg

SEQ ID NO: 523787 - DNA, 18 bp, Homo sapiens
gcggcccggacgggggag

SEQ ID NO: 523788 - DNA, 13 bp, Homo sapiens
gcggggcttctgg

SEQ ID NO: 523789 - DNA, 12 bp, Homo sapiens
gcgtaggagaga

SEQ ID NO: 523790 - DNA, 18 bp, Homo sapiens
gcgtgtcctatccccgga

SEQ ID NO: 523791 - DNA, 19 bp, Homo sapiens
gctaaatgcctaataaaca

SEQ ID NO: 523792 - DNA, 22 bp, Homo sapiens
gctaagataattaaatgaaata

SEQ ID NO: 523793 - DNA, 16 bp, Homo sapiens
gctaagcctgatgatg

SEQ ID NO: 523794 - DNA, 17 bp, Homo sapiens
gctacaggggaggctga

SEQ ID NO: 523795 - DNA, 14 bp, Homo sapiens
gctagccatatatt

SEQ ID NO: 523796 - DNA, 18 bp, Homo sapiens
gctataaatagtgaaaat

SEQ ID NO: 523797 - DNA, 17 bp, Homo sapiens
gctatgcacaccaaatt

SEQ ID NO: 523798 - DNA, 23 bp, Homo sapiens
gctatgttttggagagagcaatc

SEQ ID NO: 523799 - DNA, 19 bp, Homo sapiens
gctcacaccggcactgtgc

SEQ ID NO: 523800 - DNA, 16 bp, Homo sapiens
gctcacacttgggctg

SEQ ID NO: 523801 - DNA, 17 bp, Homo sapiens
gctcacacttgggctgg

SEQ ID NO: 523802 - DNA, 12 bp, Homo sapiens
gctccagggact

SEQ ID NO: 523803 - DNA, 12 bp, Homo sapiens
gctccagggagt

SEQ ID NO: 523804 - DNA, 23 bp, Homo sapiens
gctccagggagtggggaggagag

SEQ ID NO: 523805 - DNA, 14 bp, Homo sapiens
gctccattcctgag

SEQ ID NO: 523806 - DNA, 18 bp, Homo sapiens
gctcccactgcccctgca

SEQ ID NO: 523807 - DNA, 15 bp, Homo sapiens
gctcccggctctgag

SEQ ID NO: 523808 - DNA, 18 bp, Homo sapiens
gctccctccctccctgct

SEQ ID NO: 523809 - DNA, 17 bp, Homo sapiens
gctcgtgtttcacagtg

SEQ ID NO: 523810 - DNA, 23 bp, Homo sapiens
gctcgtgtttcacagtgggcggc

SEQ ID NO: 523811 - DNA, 22 bp, Homo sapiens
gctctgaatctctcaaaatgtg

SEQ ID NO: 523812 - DNA, 19 bp, Homo sapiens
gctctgaggctgccccagg

SEQ ID NO: 523813 - DNA, 15 bp, Homo sapiens
gctgaataacaacaa

SEQ ID NO: 523814 - DNA, 18 bp, Homo sapiens
gctgaataacaacaattt

SEQ ID NO: 523815 - DNA, 15 bp, Homo sapiens
gctgactcagtgcag

SEQ ID NO: 523816 - DNA, 23 bp, Homo sapiens
gctgagacgcaaggatcacttga

SEQ ID NO: 523817 - DNA, 23 bp, Homo sapiens
gctgagatgggaggatcacttga

SEQ ID NO: 523818 - DNA, 16 bp, Homo sapiens
gctgcaggaatcaaaa

SEQ ID NO: 523819 - DNA, 22 bp, Homo sapiens
gctgcaggaatcaaaaattgaa

SEQ ID NO: 523820 - DNA, 18 bp, Homo sapiens
gctgccaggctcccactg

SEQ ID NO: 523821 - DNA, 12 bp, Homo sapiens
gctgccaggggg

SEQ ID NO: 523822 - DNA, 17 bp, Homo sapiens
gctgccagggggcaagg

SEQ ID NO: 523823 - DNA, 14 bp, Homo sapiens
gctgctcccggtgt

SEQ ID NO: 523824 - DNA, 17 bp, Homo sapiens
gctgctgcactgccctc

SEQ ID NO: 523825 - DNA, 22 bp, Homo sapiens
gctgctgcagtcagcacagaga

SEQ ID NO: 523826 - DNA, 15 bp, Homo sapiens
gctgctgtggcatca

SEQ ID NO: 523827 - DNA, 16 bp, Homo sapiens
gctgctttccatggca

SEQ ID NO: 523828 - DNA, 14 bp, Homo sapiens
gctggcacccactg

SEQ ID NO: 523829 - DNA, 14 bp, Homo sapiens
gctgggcagaaggg

SEQ ID NO: 523830 - DNA, 13 bp, Homo sapiens
gctgtccctgtgg

SEQ ID NO: 523831 - DNA, 15 bp, Homo sapiens
gctgtgaaacagtgt

SEQ ID NO: 523832 - DNA, 14 bp, Homo sapiens
gctgtgaaatgact

SEQ ID NO: 523833 - DNA, 22 bp, Homo sapiens
gctgtgatttttgttgattaaa

SEQ ID NO: 523834 - DNA, 14 bp, Homo sapiens
gctgttagctcaga

SEQ ID NO: 523835 - DNA, 15 bp, Homo sapiens
gctgttgattctttc

SEQ ID NO: 523836 - DNA, 22 bp, Homo sapiens
gcttaatctagagctatgcaca

SEQ ID NO: 523837 - DNA, 14 bp, Homo sapiens
gcttagtatctcat

SEQ ID NO: 523838 - DNA, 20 bp, Homo sapiens
gcttccccatcgccttctgg

SEQ ID NO: 523839 - DNA, 14 bp, Homo sapiens
gcttccccattgcc

SEQ ID NO: 523840 - DNA, 20 bp, Homo sapiens
gcttccccattgccttctgg

SEQ ID NO: 523841 - DNA, 19 bp, Homo sapiens
gcttccctgcgacggaggc

SEQ ID NO: 523842 - DNA, 22 bp, Homo sapiens
gcttctctgccggtggggccag

SEQ ID NO: 523843 - DNA, 14 bp, Homo sapiens
gcttgcttctctgc

SEQ ID NO: 523844 - DNA, 14 bp, Homo sapiens
gctttcctgggtct

SEQ ID NO: 523845 - DNA, 20 bp, Homo sapiens
gcttttgtacgttaattaaa

SEQ ID NO: 523846 - DNA, 13 bp, Homo sapiens
ggaaaaaggcttc

SEQ ID NO: 523847 - DNA, 14 bp, Homo sapiens
ggaaatgctgattt

SEQ ID NO: 523848 - DNA, 13 bp, Homo sapiens
ggaacagccctgc

SEQ ID NO: 523849 - DNA, 20 bp, Homo sapiens
ggaataagaagcaaataaat

SEQ ID NO: 523850 - DNA, 16 bp, Homo sapiens
ggaatgctcaatgtgc

SEQ ID NO: 523851 - DNA, 17 bp, Homo sapiens
ggaatgctcaatgtgct

SEQ ID NO: 523852 - DNA, 21 bp, Homo sapiens
ggaattacataacaggcattg

SEQ ID NO: 523853 - DNA, 20 bp, Homo sapiens
ggaattattagcaccagctt

SEQ ID NO: 523854 - DNA, 23 bp, Homo sapiens
ggacacagaggacggcttcccca

SEQ ID NO: 523855 - DNA, 18 bp, Homo sapiens
ggacagcctgcacagtgg

SEQ ID NO: 523856 - DNA, 22 bp, Homo sapiens
ggacagctccgcgctcggggct

SEQ ID NO: 523857 - DNA, 18 bp, Homo sapiens
ggaccaaggagatgggga

SEQ ID NO: 523858 - DNA, 11 bp, Homo sapiens
ggaccggacgc

SEQ ID NO: 523859 - DNA, 18 bp, Homo sapiens
ggacgcatgcagggcccc

SEQ ID NO: 523860 - DNA, 21 bp, Homo sapiens
ggagacccctttgccttcccc

SEQ ID NO: 523861 - DNA, 23 bp, Homo sapiens
ggagagagcaatcttgctgtgaa

SEQ ID NO: 523862 - DNA, 20 bp, Homo sapiens
ggagatggggagggcgcttt

SEQ ID NO: 523863 - DNA, 15 bp, Homo sapiens
ggagcaaacaggaaa

SEQ ID NO: 523864 - DNA, 21 bp, Homo sapiens
ggagcatgtcctatccctgga

SEQ ID NO: 523865 - DNA, 13 bp, Homo sapiens
ggagcgtgtccta

SEQ ID NO: 523866 - DNA, 14 bp, Homo sapiens
ggagctttcccaga

SEQ ID NO: 523867 - DNA, 19 bp, Homo sapiens
ggaggagaaggaggaaccc

SEQ ID NO: 523868 - DNA, 21 bp, Homo sapiens
ggaggctgagacgcaaggatc

SEQ ID NO: 523869 - DNA, 20 bp, Homo sapiens
ggaggctgagatgggaggat

SEQ ID NO: 523870 - DNA, 17 bp, Homo sapiens
ggatcacttgagcccag

SEQ ID NO: 523871 - DNA, 14 bp, Homo sapiens
ggatgatttaacat

SEQ ID NO: 523872 - DNA, 14 bp, Homo sapiens
ggattcctcccctg

SEQ ID NO: 523873 - DNA, 17 bp, Homo sapiens
ggattcctcccctggaa

SEQ ID NO: 523874 - DNA, 14 bp, Homo sapiens
ggcaactgtggaag

SEQ ID NO: 523875 - DNA, 17 bp, Homo sapiens
ggcaagatagctccttc

SEQ ID NO: 523876 - DNA, 12 bp, Homo sapiens
ggcacccactgg

SEQ ID NO: 523877 - DNA, 11 bp, Homo sapiens
ggcagcctgtg

SEQ ID NO: 523878 - DNA, 15 bp, Homo sapiens
ggcatcaggaaagga

SEQ ID NO: 523879 - DNA, 16 bp, Homo sapiens
ggcattgcactaaaag

SEQ ID NO: 523880 - DNA, 12 bp, Homo sapiens
ggcccccacagg

SEQ ID NO: 523881 - DNA, 23 bp, Homo sapiens
ggcccccacaggagcatgtccta

SEQ ID NO: 523882 - DNA, 22 bp, Homo sapiens
ggccgctgcagtcagcacagag

SEQ ID NO: 523883 - DNA, 16 bp, Homo sapiens
ggcctcagggaccaag

SEQ ID NO: 523884 - DNA, 17 bp, Homo sapiens
ggcctgatggccaggcc

SEQ ID NO: 523885 - DNA, 13 bp, Homo sapiens
ggctactgccact

SEQ ID NO: 523886 - DNA, 15 bp, Homo sapiens
ggctccctgcctgga

SEQ ID NO: 523887 - DNA, 18 bp, Homo sapiens
ggctccgggctgtgtcct

SEQ ID NO: 523888 - DNA, 18 bp, Homo sapiens
ggctgacttctccaggac

SEQ ID NO: 523889 - DNA, 23 bp, Homo sapiens
ggctgagagggtgtgggtgccct

SEQ ID NO: 523890 - DNA, 19 bp, Homo sapiens
ggctgctgcactgccctcc

SEQ ID NO: 523891 - DNA, 23 bp, Homo sapiens
ggctgctgcagtcagcacagaga

SEQ ID NO: 523892 - DNA, 17 bp, Homo sapiens
ggctgcttctggggctc

SEQ ID NO: 523893 - DNA, 19 bp, Homo sapiens
ggctggcacccactggagg

SEQ ID NO: 523894 - DNA, 15 bp, Homo sapiens
ggctgttagctcaga

SEQ ID NO: 523895 - DNA, 18 bp, Homo sapiens
ggctgttatctgtcttta

SEQ ID NO: 523896 - DNA, 20 bp, Homo sapiens
ggcttagcgttctgtttcac

SEQ ID NO: 523897 - DNA, 16 bp, Homo sapiens
ggcttctgggacaggc

SEQ ID NO: 523898 - DNA, 18 bp, Homo sapiens
gggaaatgctgatttaaa

SEQ ID NO: 523899 - DNA, 12 bp, Homo sapiens
gggaagccctga

SEQ ID NO: 523900 - DNA, 12 bp, Homo sapiens
gggaatcctgga

SEQ ID NO: 523901 - DNA, 20 bp, Homo sapiens
gggacctactcctccccctc

SEQ ID NO: 523902 - DNA, 12 bp, Homo sapiens
gggaggctgaga

SEQ ID NO: 523903 - DNA, 19 bp, Homo sapiens
gggccatttcacattcctg

SEQ ID NO: 523904 - DNA, 21 bp, Homo sapiens
gggccatttcacattcctgac

SEQ ID NO: 523905 - DNA, 16 bp, Homo sapiens
gggcgctgcctgctct

SEQ ID NO: 523906 - DNA, 17 bp, Homo sapiens
gggctccagggagtggg

SEQ ID NO: 523907 - DNA, 15 bp, Homo sapiens
gggctggcacccact

SEQ ID NO: 523908 - DNA, 18 bp, Homo sapiens
gggctgttagctcagagg

SEQ ID NO: 523909 - DNA, 20 bp, Homo sapiens
gggctgttagctcagaggag

SEQ ID NO: 523910 - DNA, 19 bp, Homo sapiens
ggggccagaccacgcccct

SEQ ID NO: 523911 - DNA, 21 bp, Homo sapiens
ggggctgctgcactgccctcc

SEQ ID NO: 523912 - DNA, 19 bp, Homo sapiens
ggggctgcttctggggctc

SEQ ID NO: 523913 - DNA, 12 bp, Homo sapiens
gggggagacccc

SEQ ID NO: 523914 - DNA, 17 bp, Homo sapiens
gggtaacaaagtgagac

SEQ ID NO: 523915 - DNA, 16 bp, Homo sapiens
gggtgccccccatgcc

SEQ ID NO: 523916 - DNA, 14 bp, Homo sapiens
ggtatctctttctc

SEQ ID NO: 523917 - DNA, 12 bp, Homo sapiens
ggtatgatcatt

SEQ ID NO: 523918 - DNA, 17 bp, Homo sapiens
ggtattatctagtaggt

SEQ ID NO: 523919 - DNA, 17 bp, Homo sapiens
ggtcatttggtggctct

SEQ ID NO: 523920 - DNA, 17 bp, Homo sapiens
ggtccaatccagccttc

SEQ ID NO: 523921 - DNA, 23 bp, Homo sapiens
ggtccaccccgttgttgtccctg

SEQ ID NO: 523922 - DNA, 23 bp, Homo sapiens
ggtccagccctccgccagccctg

SEQ ID NO: 523923 - DNA, 11 bp, Homo sapiens
ggtccttaaaa

SEQ ID NO: 523924 - DNA, 12 bp, Homo sapiens
ggtctgcacaca

SEQ ID NO: 523925 - DNA, 21 bp, Homo sapiens
ggtggagtcagggctgtgctt

SEQ ID NO: 523926 - DNA, 16 bp, Homo sapiens
ggtggggccagcgctg

SEQ ID NO: 523927 - DNA, 17 bp, Homo sapiens
ggtgtgggtgccctgtt

SEQ ID NO: 523928 - DNA, 12 bp, Homo sapiens
ggtttactctgt

SEQ ID NO: 523929 - DNA, 14 bp, Homo sapiens
gtaaaaccaggctg

SEQ ID NO: 523930 - DNA, 15 bp, Homo sapiens
gtaaaactgtgacat

SEQ ID NO: 523931 - DNA, 19 bp, Homo sapiens
gtaacttgctgtgaaatga

SEQ ID NO: 523932 - DNA, 16 bp, Homo sapiens
gtaatagcctcacctt

SEQ ID NO: 523933 - DNA, 20 bp, Homo sapiens
gtaatcacactctcttctta

SEQ ID NO: 523934 - DNA, 22 bp, Homo sapiens
tagtttttgttcaccttctgtg

SEQ ID NO: 523935 - DNA, 11 bp, Homo sapiens
tataaaaataa

SEQ ID NO: 523936 - DNA, 12 bp, Homo sapiens
tataaactgtga

SEQ ID NO: 523937 - DNA, 13 bp, Homo sapiens
tataaactgtgag

SEQ ID NO: 523938 - DNA, 22 bp, Homo sapiens
tataatggcctcttaaaaatta

SEQ ID NO: 523939 - DNA, 13 bp, Homo sapiens
tatagcatgtaat

SEQ ID NO: 523940 - DNA, 13 bp, Homo sapiens
tatagggtttgtt

SEQ ID NO: 523941 - DNA, 21 bp, Homo sapiens
tatatagagacttctaaatca

SEQ ID NO: 523942 - DNA, 19 bp, Homo sapiens
tatatattttgaaaggaga

SEQ ID NO: 523943 - DNA, 21 bp, Homo sapiens
tatatcagactgctttgagaa

SEQ ID NO: 523944 - DNA, 19 bp, Homo sapiens
tatcagtacaattctttgt

SEQ ID NO: 523945 - DNA, 17 bp, Homo sapiens
tatcattatagcatgta

SEQ ID NO: 523946 - DNA, 19 bp, Homo sapiens
tatccctggacgcatgcag

SEQ ID NO: 523947 - DNA, 16 bp, Homo sapiens
tatctagtaggtctgc

SEQ ID NO: 523948 - DNA, 21 bp, Homo sapiens
tatctagtaggtctgcacaca

SEQ ID NO: 523949 - DNA, 23 bp, Homo sapiens
tatctagtaggtctgcacacata

SEQ ID NO: 523950 - DNA, 14 bp, Homo sapiens
tatctcatcaacaa

SEQ ID NO: 523951 - DNA, 23 bp, Homo sapiens
tatctcatcaacaaagaaatatt

SEQ ID NO: 523952 - DNA, 12 bp, Homo sapiens
tatctgaaaact

SEQ ID NO: 523953 - DNA, 15 bp, Homo sapiens
tatctgaaaactgga

SEQ ID NO: 523954 - DNA, 16 bp, Homo sapiens
tatctgaaaactggaa

SEQ ID NO: 523955 - DNA, 12 bp, Homo sapiens
tatctgtcttta

SEQ ID NO: 523956 - DNA, 14 bp, Homo sapiens
tatctgtctttatg

SEQ ID NO: 523957 - DNA, 21 bp, Homo sapiens
tatgatttcatgattagacaa

SEQ ID NO: 523958 - DNA, 20 bp, Homo sapiens
tatgcacaccaaattgctga

SEQ ID NO: 523959 - DNA, 19 bp, Homo sapiens
tatgcatgagaactaaata

SEQ ID NO: 523960 - DNA, 15 bp, Homo sapiens
tatgctgttcattga

SEQ ID NO: 523961 - DNA, 22 bp, Homo sapiens
tatggctttgtgcttgttcttc

SEQ ID NO: 523962 - DNA, 20 bp, Homo sapiens
tatggtgctgggtccttaaa

SEQ ID NO: 523963 - DNA, 12 bp, Homo sapiens
tatgtctttaaa

SEQ ID NO: 523964 - DNA, 16 bp, Homo sapiens
tatgtctttaaaatga

SEQ ID NO: 523965 - DNA, 16 bp, Homo sapiens
tatgtttggctgaaat

SEQ ID NO: 523966 - DNA, 11 bp, Homo sapiens
tatgttttgga

SEQ ID NO: 523967 - DNA, 15 bp, Homo sapiens
tattaaattcctcct

SEQ ID NO: 523968 - DNA, 15 bp, Homo sapiens
tattgagacactgtc

SEQ ID NO: 523969 - DNA, 21 bp, Homo sapiens
tattgctgtaaataaaaatag

SEQ ID NO: 523970 - DNA, 16 bp, Homo sapiens
tattgttacagctgaa

SEQ ID NO: 523971 - DNA, 22 bp, Homo sapiens
tattgttcttgtaaaactgtga

SEQ ID NO: 523972 - DNA, 15 bp, Homo sapiens
tatttgctaattaaa

SEQ ID NO: 523973 - DNA, 23 bp, Homo sapiens
tatttgctaattaaaaagttaat

SEQ ID NO: 523974 - DNA, 21 bp, Homo sapiens
tcaaaaattgaagagagatat

SEQ ID NO: 523975 - DNA, 16 bp, Homo sapiens
tcaaatggatgtaata

SEQ ID NO: 523976 - DNA, 18 bp, Homo sapiens
tcaaatggatgtaatata

SEQ ID NO: 523977 - DNA, 18 bp, Homo sapiens
tcaaatgttattcaataa

SEQ ID NO: 523978 - DNA, 14 bp, Homo sapiens
tcaacaaagaaata

SEQ ID NO: 523979 - DNA, 16 bp, Homo sapiens
tcaacaaagaaatatt

SEQ ID NO: 523980 - DNA, 18 bp, Homo sapiens
tcaacaaagaaatattat

SEQ ID NO: 523981 - DNA, 15 bp, Homo sapiens
tcaaggctgcagtga

SEQ ID NO: 523982 - DNA, 21 bp, Homo sapiens
tcaatatatagagacttctaa

SEQ ID NO: 523983 - DNA, 22 bp, Homo sapiens
tcaatatatagagacttctaaa

SEQ ID NO: 523984 - DNA, 20 bp, Homo sapiens
tcaatccacagtattgttct

SEQ ID NO: 523985 - DNA, 17 bp, Homo sapiens
tcacaccactgccattt

SEQ ID NO: 523986 - DNA, 16 bp, Homo sapiens
tcacaccggcactgtg

SEQ ID NO: 523987 - DNA, 21 bp, Homo sapiens
tcacagtgggcggcttccctg

SEQ ID NO: 523988 - DNA, 22 bp, Homo sapiens
tcacagtgggcggcttccctgc

SEQ ID NO: 523989 - DNA, 15 bp, Homo sapiens
tcacattcctgaccc

SEQ ID NO: 523990 - DNA, 16 bp, Homo sapiens
tcacattcctgaccct

SEQ ID NO: 523991 - DNA, 16 bp, Homo sapiens
tcacctaattaatttc

SEQ ID NO: 523992 - DNA, 17 bp, Homo sapiens
tcacctaattaatttca

SEQ ID NO: 523993 - DNA, 16 bp, Homo sapiens
tcacctatctggaaaa

SEQ ID NO: 523994 - DNA, 19 bp, Homo sapiens
tcaccttccctagttcttt

SEQ ID NO: 523995 - DNA, 16 bp, Homo sapiens
tcaccttctgtgcatc

SEQ ID NO: 523996 - DNA, 14 bp, Homo sapiens
tcaccttctgtttt

SEQ ID NO: 523997 - DNA, 15 bp, Homo sapiens
tcacgcaacttgaaa

SEQ ID NO: 523998 - DNA, 16 bp, Homo sapiens
tcacttttattgtata

SEQ ID NO: 523999 - DNA, 16 bp, Homo sapiens
tcacttttctcatctg

SEQ ID NO: 524000 - DNA, 15 bp, Homo sapiens
tcacttttttcctgt

SEQ ID NO: 524001 - DNA, 14 bp, Homo sapiens
tcagaagtgaaaaa

SEQ ID NO: 524002 - DNA, 18 bp, Homo sapiens
tcagaagtgaaaaagact

SEQ ID NO: 524003 - DNA, 13 bp, Homo sapiens
tcagcttcccaac

SEQ ID NO: 524004 - DNA, 16 bp, Homo sapiens
tcagcttcccaacaat

SEQ ID NO: 524005 - DNA, 17 bp, Homo sapiens
tcagcttcccaacaata

SEQ ID NO: 524006 - DNA, 14 bp, Homo sapiens
tcaggcagcctgtg

SEQ ID NO: 524007 - DNA, 15 bp, Homo sapiens
tcaggctctgaatct

SEQ ID NO: 524008 - DNA, 16 bp, Homo sapiens
tcaggctctgaatctc

SEQ ID NO: 524009 - DNA, 15 bp, Homo sapiens
tcagggaccaaggag

SEQ ID NO: 524010 - DNA, 19 bp, Homo sapiens
tcagggaccaaggagatgg

SEQ ID NO: 524011 - DNA, 16 bp, Homo sapiens
tcaggtgcgtgccaca

SEQ ID NO: 524012 - DNA, 22 bp, Homo sapiens
tcagtacaattctttgttgctt

SEQ ID NO: 524013 - DNA, 18 bp, Homo sapiens
tcagtattgagacactgt

SEQ ID NO: 524014 - DNA, 22 bp, Homo sapiens
tcagtccacccccattgtgaat

SEQ ID NO: 524015 - DNA, 23 bp, Homo sapiens
tcagtccacccccattgtgaatg

SEQ ID NO: 524016 - DNA, 13 bp, Homo sapiens
tcagtgttataaa

SEQ ID NO: 524017 - DNA, 13 bp, Homo sapiens
tcataaattcaaa

SEQ ID NO: 524018 - DNA, 15 bp, Homo sapiens
tcatagataccattt

SEQ ID NO: 524019 - DNA, 15 bp, Homo sapiens
tcatatttacctgtg

SEQ ID NO: 524020 - DNA, 16 bp, Homo sapiens
tcatcaacaaagaaat

SEQ ID NO: 524021 - DNA, 13 bp, Homo sapiens
tcatcagaagtgg

SEQ ID NO: 524022 - DNA, 22 bp, Homo sapiens
tcatcagaagtggtaggaaagc

SEQ ID NO: 524023 - DNA, 15 bp, Homo sapiens
tcatctgtaaaacca

SEQ ID NO: 524024 - DNA, 20 bp, Homo sapiens
tcatctgtaaaaccaggctg

SEQ ID NO: 524025 - DNA, 11 bp, Homo sapiens
tcatctgtcag

SEQ ID NO: 524026 - DNA, 12 bp, Homo sapiens
tcatctgtcagc

SEQ ID NO: 524027 - DNA, 19 bp, Homo sapiens
tcatgattagacaatgtgg

SEQ ID NO: 524028 - DNA, 19 bp, Homo sapiens
tcatggctgtcccctgcaa

SEQ ID NO: 524029 - DNA, 17 bp, Homo sapiens
tcattagctgtgatttt

SEQ ID NO: 524030 - DNA, 14 bp, Homo sapiens
tcattatagcatgt

SEQ ID NO: 524031 - DNA, 20 bp, Homo sapiens
tcatttccagcaaaatatat

SEQ ID NO: 524032 - DNA, 22 bp, Homo sapiens
tcattttatatatgaaaactaa

SEQ ID NO: 524033 - DNA, 21 bp, Homo sapiens
tcattttattctgtcaatgaa

SEQ ID NO: 524034 - DNA, 11 bp, Homo sapiens
tcattttctct

SEQ ID NO: 524035 - DNA, 13 bp, Homo sapiens
tcattttctctcc

SEQ ID NO: 524036 - DNA, 12 bp, Homo sapiens
tctgtttatgtt

SEQ ID NO: 524037 - DNA, 20 bp, Homo sapiens
tcttaaaaattatctttaaa

SEQ ID NO: 524038 - DNA, 13 bp, Homo sapiens
tcttactgttttg

SEQ ID NO: 524039 - DNA, 22 bp, Homo sapiens
tcttgaatgttgaagaactcat

SEQ ID NO: 524040 - DNA, 13 bp, Homo sapiens
tcttgctgtgaaa

SEQ ID NO: 524041 - DNA, 14 bp, Homo sapiens
tcttgggattcctc

SEQ ID NO: 524042 - DNA, 23 bp, Homo sapiens
tcttgggattcctcccctggaag

SEQ ID NO: 524043 - DNA, 12 bp, Homo sapiens
tcttggtctctt

SEQ ID NO: 524044 - DNA, 20 bp, Homo sapiens
tcttggtctctttctttcca

SEQ ID NO: 524045 - DNA, 21 bp, Homo sapiens
tcttggtctctttctttccaa

SEQ ID NO: 524046 - DNA, 16 bp, Homo sapiens
tcttgtaaaactgtga

SEQ ID NO: 524047 - DNA, 18 bp, Homo sapiens
tcttgtaaaactgtgaca

SEQ ID NO: 524048 - DNA, 20 bp, Homo sapiens
tcttgtaaaactgtgacatt

SEQ ID NO: 524049 - DNA, 13 bp, Homo sapiens
tctttatgatttc

SEQ ID NO: 524050 - DNA, 17 bp, Homo sapiens
tctttatgatttcatga

SEQ ID NO: 524051 - DNA, 21 bp, Homo sapiens
tctttcaatccacagtattgt

SEQ ID NO: 524052 - DNA, 21 bp, Homo sapiens
tctttctccaaagttatccag

SEQ ID NO: 524053 - DNA, 12 bp, Homo sapiens
tctttctttcca

SEQ ID NO: 524054 - DNA, 16 bp, Homo sapiens
tctttgcattcgtcct

SEQ ID NO: 524055 - DNA, 14 bp, Homo sapiens
tctttgttgcttaa

SEQ ID NO: 524056 - DNA, 13 bp, Homo sapiens
tcttttgttctct

SEQ ID NO: 524057 - DNA, 13 bp, Homo sapiens
tgaaaactggaat

SEQ ID NO: 524058 - DNA, 21 bp, Homo sapiens
tgaaaactggaataagaagca

SEQ ID NO: 524059 - DNA, 18 bp, Homo sapiens
tgaaaattttattgaata

SEQ ID NO: 524060 - DNA, 15 bp, Homo sapiens
tgaaagacagtaaag

SEQ ID NO: 524061 - DNA, 21 bp, Homo sapiens
tgaaagtcagtttaagaggct

SEQ ID NO: 524062 - DNA, 10 bp, Homo sapiens
tgaaatataa

SEQ ID NO: 524063 - DNA, 13 bp, Homo sapiens
tgaaatataaact

SEQ ID NO: 524064 - DNA, 19 bp, Homo sapiens
tgaaatataaactgtgaga

SEQ ID NO: 524065 - DNA, 21 bp, Homo sapiens
tgaaatataaactgtgagata

SEQ ID NO: 524066 - DNA, 17 bp, Homo sapiens
tgaactgcaacactgga

SEQ ID NO: 524067 - DNA, 15 bp, Homo sapiens
tgaagagagatatat

SEQ ID NO: 524068 - DNA, 22 bp, Homo sapiens
tgaagagagatatatctgaaaa

SEQ ID NO: 524069 - DNA, 23 bp, Homo sapiens
tgaagataaatccaactctgact

SEQ ID NO: 524070 - DNA, 15 bp, Homo sapiens
tgaagccctaagtaa

SEQ ID NO: 524071 - DNA, 17 bp, Homo sapiens
tgaaggggccagaccac

SEQ ID NO: 524072 - DNA, 18 bp, Homo sapiens
tgaaggggccagaccacg

SEQ ID NO: 524073 - DNA, 15 bp, Homo sapiens
tgaagtgattgacat

SEQ ID NO: 524074 - DNA, 18 bp, Homo sapiens
tgaagtgattgacatttt

SEQ ID NO: 524075 - DNA, 12 bp, Homo sapiens
tgaataacaaca

SEQ ID NO: 524076 - DNA, 15 bp, Homo sapiens
tgaataacaacaatt

SEQ ID NO: 524077 - DNA, 15 bp, Homo sapiens
tgaatgaaatataaa

SEQ ID NO: 524078 - DNA, 18 bp, Homo sapiens
tgacacactcaccattta

SEQ ID NO: 524079 - DNA, 16 bp, Homo sapiens
tgacactgtctgctgc

SEQ ID NO: 524080 - DNA, 18 bp, Homo sapiens
tgacactgtctgctgccc

SEQ ID NO: 524081 - DNA, 15 bp, Homo sapiens
tgacagtagcatact

SEQ ID NO: 524082 - DNA, 22 bp, Homo sapiens
tgacatgctaacctctctgaac

SEQ ID NO: 524083 - DNA, 13 bp, Homo sapiens
tgaccataaaatt

SEQ ID NO: 524084 - DNA, 22 bp, Homo sapiens
tgaccctcacttttctcatctg

SEQ ID NO: 524085 - DNA, 15 bp, Homo sapiens
tgacctaccctggac

SEQ ID NO: 524086 - DNA, 22 bp, Homo sapiens
tgactcagtgcagggacagcct

SEQ ID NO: 524087 - DNA, 23 bp, Homo sapiens
tgactgtagtttttgttcacctt

SEQ ID NO: 524088 - DNA, 20 bp, Homo sapiens
tgacttctttactaacactg

SEQ ID NO: 524089 - DNA, 18 bp, Homo sapiens
tgagaaatataaaaataa

SEQ ID NO: 524090 - DNA, 13 bp, Homo sapiens
tgagacactgtca

SEQ ID NO: 524091 - DNA, 16 bp, Homo sapiens
tgagacactgtcaaga

SEQ ID NO: 524092 - DNA, 22 bp, Homo sapiens
tgagacactgtcaagattaagt

SEQ ID NO: 524093 - DNA, 23 bp, Homo sapiens
tgagagggtgtgggtgccctgtt

SEQ ID NO: 524094 - DNA, 14 bp, Homo sapiens
tgagataaatatca

SEQ ID NO: 524095 - DNA, 20 bp, Homo sapiens
tgagattggaaaaaattaga

SEQ ID NO: 524096 - DNA, 21 bp, Homo sapiens
tgagcaaactgaagcccacag

SEQ ID NO: 524097 - DNA, 21 bp, Homo sapiens
tgagcagtaaatgtatattga

SEQ ID NO: 524098 - DNA, 20 bp, Homo sapiens
tgagccaataaagctcacac

SEQ ID NO: 524099 - DNA, 23 bp, Homo sapiens
tgagcccagaagctcaaggctgc

SEQ ID NO: 524100 - DNA, 19 bp, Homo sapiens
tgaggtcttgagtttcatt

SEQ ID NO: 524101 - DNA, 15 bp, Homo sapiens
tgagtagcatatata

SEQ ID NO: 524102 - DNA, 16 bp, Homo sapiens
tgagtttcatttttca

SEQ ID NO: 524103 - DNA, 17 bp, Homo sapiens
tgataaatttgactgtt

SEQ ID NO: 524104 - DNA, 21 bp, Homo sapiens
tgatacttatttataacattg

SEQ ID NO: 524105 - DNA, 14 bp, Homo sapiens
tgatatattttcca

SEQ ID NO: 524106 - DNA, 19 bp, Homo sapiens
tgatatctgtttgcttcta

SEQ ID NO: 524107 - DNA, 24 bp, Homo sapiens
tgatcactttctgaaattcacaaa

SEQ ID NO: 524108 - DNA, 15 bp, Homo sapiens
tgatgatttcagaaa

SEQ ID NO: 524109 - DNA, 14 bp, Homo sapiens
tgatggccaggcct

SEQ ID NO: 524110 - DNA, 19 bp, Homo sapiens
tgatgtgctcatcagaaac

SEQ ID NO: 524111 - DNA, 22 bp, Homo sapiens
tgattctttcaatccacagtat

SEQ ID NO: 524112 - DNA, 12 bp, Homo sapiens
tgattgacattt

SEQ ID NO: 524113 - DNA, 13 bp, Homo sapiens
tgatttaacatta

SEQ ID NO: 524114 - DNA, 13 bp, Homo sapiens
tgatttatgcatt

SEQ ID NO: 524115 - DNA, 19 bp, Homo sapiens
tgatttttgttgattaaaa

SEQ ID NO: 524116 - DNA, 14 bp, Homo sapiens
tgcaaagcacacct

SEQ ID NO: 524117 - DNA, 22 bp, Homo sapiens
tgcaagtggacgtgggctccag

SEQ ID NO: 524118 - DNA, 23 bp, Homo sapiens
tgcaagtggacgtgggctccagg

SEQ ID NO: 524119 - DNA, 23 bp, Homo sapiens
tgcacacacagtctgttcagagg

SEQ ID NO: 524120 - DNA, 13 bp, Homo sapiens
tgcacacataaca

SEQ ID NO: 524121 - DNA, 18 bp, Homo sapiens
tgcactaaaagtgatgtg

SEQ ID NO: 524122 - DNA, 22 bp, Homo sapiens
tgcactaaaagtgatgtgattt

SEQ ID NO: 524123 - DNA, 17 bp, Homo sapiens
tgcactctactctgcga

SEQ ID NO: 524124 - DNA, 18 bp, Homo sapiens
tgcactcttttgagcagt

SEQ ID NO: 524125 - DNA, 21 bp, Homo sapiens
tgcactcttttgagcagtaaa

SEQ ID NO: 524126 - DNA, 15 bp, Homo sapiens
tgcagcgaggtccac

SEQ ID NO: 524127 - DNA, 13 bp, Homo sapiens
tgcaggcagcctg

SEQ ID NO: 524128 - DNA, 14 bp, Homo sapiens
tgcaggcagcctgc

SEQ ID NO: 524129 - DNA, 17 bp, Homo sapiens
tgcagggacagcctgca

SEQ ID NO: 524130 - DNA, 23 bp, Homo sapiens
tgcagtatccgcgagcctgcttg

SEQ ID NO: 524131 - DNA, 16 bp, Homo sapiens
tgcagtcagcacagag

SEQ ID NO: 524132 - DNA, 15 bp, Homo sapiens
tgcagtcatcagaag

SEQ ID NO: 524133 - DNA, 14 bp, Homo sapiens
tgcatgcagggccc

SEQ ID NO: 524134 - DNA, 23 bp, Homo sapiens
tgcatgcagggcccccacaggag

SEQ ID NO: 524135 - DNA, 15 bp, Homo sapiens
tgccaatgtccaggt

SEQ ID NO: 524136 - DNA, 18 bp, Homo sapiens
tgccactcaggcagcctg

SEQ ID NO: 524137 - DNA, 15 bp, Homo sapiens
ttcctacttaaacaa

SEQ ID NO: 524138 - DNA, 16 bp, Homo sapiens
ttcctacttaaacaaa

SEQ ID NO: 524139 - DNA, 22 bp, Homo sapiens
ttcctcatggctgttatctgtc

SEQ ID NO: 524140 - DNA, 15 bp, Homo sapiens
ttcctcccctggaag

SEQ ID NO: 524141 - DNA, 16 bp, Homo sapiens
ttcctcttacctgtaa

SEQ ID NO: 524142 - DNA, 18 bp, Homo sapiens
ttctaaaggtttcactgt

SEQ ID NO: 524143 - DNA, 16 bp, Homo sapiens
ttctaattagattaac

SEQ ID NO: 524144 - DNA, 14 bp, Homo sapiens
ttctagcaattgct

SEQ ID NO: 524145 - DNA, 19 bp, Homo sapiens
ttctcaaatgctactcagt

SEQ ID NO: 524146 - DNA, 15 bp, Homo sapiens
ttctcagaagtgaaa

SEQ ID NO: 524147 - DNA, 22 bp, Homo sapiens
ttctcagaagtgaaaaagactt

SEQ ID NO: 524148 - DNA, 18 bp, Homo sapiens
ttctcatggtattatcta

SEQ ID NO: 524149 - DNA, 15 bp, Homo sapiens
ttctcctccaaatgc

SEQ ID NO: 524150 - DNA, 22 bp, Homo sapiens
ttctctcaggtgcgtgccacat

SEQ ID NO: 524151 - DNA, 20 bp, Homo sapiens
ttctctgccggtggggccag

SEQ ID NO: 524152 - DNA, 22 bp, Homo sapiens
ttctgggacaggcaccatgctg

SEQ ID NO: 524153 - DNA, 15 bp, Homo sapiens
ttctgttttagagtt

SEQ ID NO: 524154 - DNA, 16 bp, Homo sapiens
ttcttctctctgtgct

SEQ ID NO: 524155 - DNA, 20 bp, Homo sapiens
ttcttgtaaaactgtgacat

SEQ ID NO: 524156 - DNA, 15 bp, Homo sapiens
ttctttgttgcttaa

SEQ ID NO: 524157 - DNA, 13 bp, Homo sapiens
ttcttttcccatt

SEQ ID NO: 524158 - DNA, 16 bp, Homo sapiens
ttgaaattatatctgt

SEQ ID NO: 524159 - DNA, 18 bp, Homo sapiens
ttgaagagagatatatct

SEQ ID NO: 524160 - DNA, 21 bp, Homo sapiens
ttgacacactcaccatttaat

SEQ ID NO: 524161 - DNA, 14 bp, Homo sapiens
ttgacattttgtag

SEQ ID NO: 524162 - DNA, 15 bp, Homo sapiens
ttgagacactgtcaa

SEQ ID NO: 524163 - DNA, 16 bp, Homo sapiens
ttgagacactgtcaag

SEQ ID NO: 524164 - DNA, 17 bp, Homo sapiens
ttgagacactgtcaaga

SEQ ID NO: 524165 - DNA, 23 bp, Homo sapiens
ttgagacactgtcaagattaagt

SEQ ID NO: 524166 - DNA, 22 bp, Homo sapiens
ttgagcagtaaatgtatattga

SEQ ID NO: 524167 - DNA, 12 bp, Homo sapiens
ttgattctttca

SEQ ID NO: 524168 - DNA, 20 bp, Homo sapiens
ttgcactaaaagtgatgtga

SEQ ID NO: 524169 - DNA, 22 bp, Homo sapiens
ttgcactaaaagtgatgtgatt

SEQ ID NO: 524170 - DNA, 16 bp, Homo sapiens
ttgctaattaaaaagt

SEQ ID NO: 524171 - DNA, 14 bp, Homo sapiens
ttgctgaataacaa

SEQ ID NO: 524172 - DNA, 20 bp, Homo sapiens
ttgctgaataacaacaattt

SEQ ID NO: 524173 - DNA, 21 bp, Homo sapiens
ttgctgaataacaacaattta

SEQ ID NO: 524174 - DNA, 16 bp, Homo sapiens
ttgctgagatgtttag

SEQ ID NO: 524175 - DNA, 14 bp, Homo sapiens
ttgctgtgaaacag

SEQ ID NO: 524176 - DNA, 17 bp, Homo sapiens
ttgctgtgaaatgactg

SEQ ID NO: 524177 - DNA, 17 bp, Homo sapiens
ttgcttaatctagagct

SEQ ID NO: 524178 - DNA, 22 bp, Homo sapiens
ttggaaaatgttctgacagcat

SEQ ID NO: 524179 - DNA, 13 bp, Homo sapiens
ttggcagagagat

SEQ ID NO: 524180 - DNA, 11 bp, Homo sapiens
ttgggaggctg

SEQ ID NO: 524181 - DNA, 15 bp, Homo sapiens
ttgggctggcaccca

SEQ ID NO: 524182 - DNA, 13 bp, Homo sapiens
ttgtaaaactgtg

SEQ ID NO: 524183 - DNA, 17 bp, Homo sapiens
ttgtaaaactgtgacat

SEQ ID NO: 524184 - DNA, 18 bp, Homo sapiens
ttgtacgttaattaaaca

SEQ ID NO: 524185 - DNA, 16 bp, Homo sapiens
ttgtagctagtttaaa

SEQ ID NO: 524186 - DNA, 20 bp, Homo sapiens
ttgtagctagtttaaaatta

SEQ ID NO: 524187 - DNA, 15 bp, Homo sapiens
ttgtataattatgaa

SEQ ID NO: 524188 - DNA, 13 bp, Homo sapiens
ttgtcatgtggct

SEQ ID NO: 524189 - DNA, 19 bp, Homo sapiens
ttgtgaagtgattgacatt

SEQ ID NO: 524190 - DNA, 20 bp, Homo sapiens
ttgtgaagtgattgacattt

SEQ ID NO: 524191 - DNA, 16 bp, Homo sapiens
ttgtgaatgttgtcct

SEQ ID NO: 524192 - DNA, 15 bp, Homo sapiens
ttgtgcggtgtgtct

SEQ ID NO: 524193 - DNA, 14 bp, Homo sapiens
ttgtgtcttttgtt

SEQ ID NO: 524194 - DNA, 18 bp, Homo sapiens
ttgttcagtcacttgttt

SEQ ID NO: 524195 - DNA, 14 bp, Homo sapiens
ttgtttgctgcttt

SEQ ID NO: 524196 - DNA, 14 bp, Homo sapiens
tttaaaaaaataat

SEQ ID NO: 524197 - DNA, 19 bp, Homo sapiens
tttaaaaaaataatataaa

SEQ ID NO: 524198 - DNA, 18 bp, Homo sapiens
tttaaaaaagatggattt

SEQ ID NO: 524199 - DNA, 13 bp, Homo sapiens
tttaaacaaatgg

SEQ ID NO: 524200 - DNA, 16 bp, Homo sapiens
tttactaacactggct

SEQ ID NO: 524201 - DNA, 20 bp, Homo sapiens
tttagattcctacttaaaca

SEQ ID NO: 524202 - DNA, 21 bp, Homo sapiens
tttaggaatgctcaatgtgct

SEQ ID NO: 524203 - DNA, 16 bp, Homo sapiens
tttagtagctgataaa

SEQ ID NO: 524204 - DNA, 20 bp, Homo sapiens
tttataacattgtaaatgat

SEQ ID NO: 524205 - DNA, 16 bp, Homo sapiens
tttatctcttcttcct

SEQ ID NO: 524206 - DNA, 17 bp, Homo sapiens
tttatgatttcatgatt

SEQ ID NO: 524207 - DNA, 23 bp, Homo sapiens
tttatgcatgagaactaaataga

SEQ ID NO: 524208 - DNA, 17 bp, Homo sapiens
tttattaaaaccattct

SEQ ID NO: 524209 - DNA, 21 bp, Homo sapiens
tttattctgtcaatgaaaagc

SEQ ID NO: 524210 - DNA, 23 bp, Homo sapiens
tttcaatccacagtattgttctt

SEQ ID NO: 524211 - DNA, 23 bp, Homo sapiens
tttcacagtgggcggcttccctg

SEQ ID NO: 524212 - DNA, 18 bp, Homo sapiens
tttcacattcctgaccct

SEQ ID NO: 524213 - DNA, 19 bp, Homo sapiens
tttcacattcctgaccctc

SEQ ID NO: 524214 - DNA, 13 bp, Homo sapiens
tttcattttctct

SEQ ID NO: 524215 - DNA, 15 bp, Homo sapiens
tttcattttctctcc

SEQ ID NO: 524216 - DNA, 18 bp, Homo sapiens
tttcattttctctcctcg

SEQ ID NO: 524217 - DNA, 16 bp, Homo sapiens
tttcatttttcatttt

SEQ ID NO: 524218 - DNA, 20 bp, Homo sapiens
tttccaagtttattgccctc

SEQ ID NO: 524219 - DNA, 17 bp, Homo sapiens
tttccagcaaaatatat

SEQ ID NO: 524220 - DNA, 14 bp, Homo sapiens
tttccagtgctgct

SEQ ID NO: 524221 - DNA, 16 bp, Homo sapiens
tttgatggctatgttt

SEQ ID NO: 524222 - DNA, 19 bp, Homo sapiens
tttgctaattaaaaagtta

SEQ ID NO: 524223 - DNA, 21 bp, Homo sapiens
tttggaaaacgatttaattta

SEQ ID NO: 524224 - DNA, 16 bp, Homo sapiens
tttggacgtgtgagga

SEQ ID NO: 524225 - DNA, 14 bp, Homo sapiens
tttggctgaaatta

SEQ ID NO: 524226 - DNA, 12 bp, Homo sapiens
tttgtatcctcc

SEQ ID NO: 524227 - DNA, 19 bp, Homo sapiens
tttgtgaagtgattgacat

SEQ ID NO: 524228 - DNA, 16 bp, Homo sapiens
tttgtgcttgttcttc

SEQ ID NO: 524229 - DNA, 12 bp, Homo sapiens
tttgtgtctttt

SEQ ID NO: 524230 - DNA, 19 bp, Homo sapiens
tttgttcaccttctgtgca

SEQ ID NO: 524231 - DNA, 12 bp, Homo sapiens
tttgtttgctgc

SEQ ID NO: 524232 - DNA, 18 bp, Homo sapiens
ttttagattcctacttaa

SEQ ID NO: 524233 - DNA, 15 bp, Homo sapiens
ttttcattttctctc

SEQ ID NO: 524234 - DNA, 17 bp, Homo sapiens
ttttcccacctctttgg

SEQ ID NO: 524235 - DNA, 12 bp, Homo sapiens
ttttcctgtcaa

SEQ ID NO: 524236 - DNA, 22 bp, Homo sapiens
ttttggaaaacgatttaattta

SEQ ID NO: 524237 - DNA, 12 bp, Homo sapiens
ttttgtagctag

SEQ ID NO: 524238 - DNA, 15 bp, Homo sapiens
ttttgttgattaaaa

SEQ ID NO: 524239 - DNA, 15 bp, Homo sapiens
tttttcattttctct

SEQ ID NO: 524240 - DNA, 13 bp, Homo sapiens
tttttcctgtcaa

SEQ ID NO: 524241 - DNA, 23 bp, Homo sapiens
aatgagccaataaagctcacact

SEQ ID NO: 524242 - DNA, 20 bp, Homo sapiens
aatgagtttccagctaagcc

SEQ ID NO: 524243 - DNA, 21 bp, Homo sapiens
aatgcctttctagcaattgct

SEQ ID NO: 524244 - DNA, 20 bp, Homo sapiens
aatgctacaaaatgtgtgct

SEQ ID NO: 524245 - DNA, 13 bp, Homo sapiens
aatgctgatttaa

SEQ ID NO: 524246 - DNA, 14 bp, Homo sapiens
aatggatgtaatat

SEQ ID NO: 524247 - DNA, 14 bp, Homo sapiens
aatggcctcttaaa

SEQ ID NO: 524248 - DNA, 16 bp, Homo sapiens
aatggcctcttaaaaa

SEQ ID NO: 524249 - DNA, 22 bp, Homo sapiens
aatggtgaactgtcattacaga

SEQ ID NO: 524250 - DNA, 14 bp, Homo sapiens
aatgtgctgttgat

SEQ ID NO: 524251 - DNA, 15 bp, Homo sapiens
aatgtggaattacat

SEQ ID NO: 524252 - DNA, 12 bp, Homo sapiens
aatgttgtcctg

SEQ ID NO: 524253 - DNA, 18 bp, Homo sapiens
aatgttgtcctgtgtcat

SEQ ID NO: 524254 - DNA, 19 bp, Homo sapiens
aattaaacaaattccttcc

SEQ ID NO: 524255 - DNA, 16 bp, Homo sapiens
aattacataacaggca

SEQ ID NO: 524256 - DNA, 19 bp, Homo sapiens
aattacataacaggcattg

SEQ ID NO: 524257 - DNA, 13 bp, Homo sapiens
aattagattttaa

SEQ ID NO: 524258 - DNA, 20 bp, Homo sapiens
aattagggctctaatttcct

SEQ ID NO: 524259 - DNA, 12 bp, Homo sapiens
aattatatctgt

SEQ ID NO: 524260 - DNA, 21 bp, Homo sapiens
aattatatctgtggtcttcaa

SEQ ID NO: 524261 - DNA, 12 bp, Homo sapiens
aattatctttaa

SEQ ID NO: 524262 - DNA, 15 bp, Homo sapiens
aattatctttaaaac

SEQ ID NO: 524263 - DNA, 19 bp, Homo sapiens
aattatgtcaaatggatgt

SEQ ID NO: 524264 - DNA, 13 bp, Homo sapiens
aattattaaaaat

SEQ ID NO: 524265 - DNA, 18 bp, Homo sapiens
aattattagcaccagctt

SEQ ID NO: 524266 - DNA, 15 bp, Homo sapiens
aattctgtttatgtt

SEQ ID NO: 524267 - DNA, 23 bp, Homo sapiens
aattgaagagagatatatctgaa

SEQ ID NO: 524268 - DNA, 15 bp, Homo sapiens
aattgctccattcct

SEQ ID NO: 524269 - DNA, 21 bp, Homo sapiens
aattgcttctctaaaacagca

SEQ ID NO: 524270 - DNA, 17 bp, Homo sapiens
aatttaggaatgctcaa

SEQ ID NO: 524271 - DNA, 23 bp, Homo sapiens
aatttctcttaagtactgaaata

SEQ ID NO: 524272 - DNA, 13 bp, Homo sapiens
aattttattgctg

SEQ ID NO: 524273 - DNA, 15 bp, Homo sapiens
acaaaaactttccat

SEQ ID NO: 524274 - DNA, 14 bp, Homo sapiens
acaaaacaacagca

SEQ ID NO: 524275 - DNA, 21 bp, Homo sapiens
acaaaatgtgtgcttggaaaa

SEQ ID NO: 524276 - DNA, 16 bp, Homo sapiens
acaaagcatgctcagt

SEQ ID NO: 524277 - DNA, 15 bp, Homo sapiens
acaacaaagcatgct

SEQ ID NO: 524278 - DNA, 19 bp, Homo sapiens
acaacaaagcatgctcagt

SEQ ID NO: 524279 - DNA, 14 bp, Homo sapiens
acaacaacaaagca

SEQ ID NO: 524280 - DNA, 23 bp, Homo sapiens
acaacaatttaggaatgctcaat

SEQ ID NO: 524281 - DNA, 12 bp, Homo sapiens
acaacagcaaca

SEQ ID NO: 524282 - DNA, 14 bp, Homo sapiens
acaacagcaacaac

SEQ ID NO: 524283 - DNA, 22 bp, Homo sapiens
acaaggttgctggcatttgctg

SEQ ID NO: 524284 - DNA, 15 bp, Homo sapiens
acaatcatctattga

SEQ ID NO: 524285 - DNA, 18 bp, Homo sapiens
acaatgtggaattacata

SEQ ID NO: 524286 - DNA, 12 bp, Homo sapiens
acaattctttgt

SEQ ID NO: 524287 - DNA, 13 bp, Homo sapiens
acaattctttgtt

SEQ ID NO: 524288 - DNA, 20 bp, Homo sapiens
acaattctttgttgcttaat

SEQ ID NO: 524289 - DNA, 22 bp, Homo sapiens
acaattctttgttgcttaatct

SEQ ID NO: 524290 - DNA, 19 bp, Homo sapiens
acaatttaggaatgctcaa

SEQ ID NO: 524291 - DNA, 20 bp, Homo sapiens
acacaaaacaacagcaacaa

SEQ ID NO: 524292 - DNA, 19 bp, Homo sapiens
agcatgtcctatccctgga

SEQ ID NO: 524293 - DNA, 22 bp, Homo sapiens
agccctaagtaaatctaaatta

SEQ ID NO: 524294 - DNA, 18 bp, Homo sapiens
agccctccgccagccctg

SEQ ID NO: 524295 - DNA, 20 bp, Homo sapiens
agccctccgccagccctgtt

SEQ ID NO: 524296 - DNA, 19 bp, Homo sapiens
agccctgttccgcctcact

SEQ ID NO: 524297 - DNA, 15 bp, Homo sapiens
agccgggctccaggg

SEQ ID NO: 524298 - DNA, 16 bp, Homo sapiens
agccgggctccaggga

SEQ ID NO: 524299 - DNA, 11 bp, Homo sapiens
agcctcacctt

SEQ ID NO: 524300 - DNA, 17 bp, Homo sapiens
agccttaagtcttactg

SEQ ID NO: 524301 - DNA, 21 bp, Homo sapiens
agccttaagtcttactgtttt

SEQ ID NO: 524302 - DNA, 21 bp, Homo sapiens
agcgtgtcctatccccggacc

SEQ ID NO: 524303 - DNA, 17 bp, Homo sapiens
agctacaggggaggctg

SEQ ID NO: 524304 - DNA, 23 bp, Homo sapiens
agctagttagagactcgcctggg

SEQ ID NO: 524305 - DNA, 14 bp, Homo sapiens
agctcaaggctgca

SEQ ID NO: 524306 - DNA, 17 bp, Homo sapiens
agctcagaggagaggag

SEQ ID NO: 524307 - DNA, 15 bp, Homo sapiens
agctccttcatgctt

SEQ ID NO: 524308 - DNA, 16 bp, Homo sapiens
agctccttcatgcttt

SEQ ID NO: 524309 - DNA, 13 bp, Homo sapiens
agctgagctggcc

SEQ ID NO: 524310 - DNA, 17 bp, Homo sapiens
agctgcaggaatcaaaa

SEQ ID NO: 524311 - DNA, 18 bp, Homo sapiens
agctgcagttagcacaga

SEQ ID NO: 524312 - DNA, 20 bp, Homo sapiens
agctgcagttagcacagagg

SEQ ID NO: 524313 - DNA, 15 bp, Homo sapiens
agctttcctgggtct

SEQ ID NO: 524314 - DNA, 16 bp, Homo sapiens
agctttctgatactta

SEQ ID NO: 524315 - DNA, 16 bp, Homo sapiens
aggaaagtggatgcca

SEQ ID NO: 524316 - DNA, 17 bp, Homo sapiens
aggaagtcatcctgcaa

SEQ ID NO: 524317 - DNA, 12 bp, Homo sapiens
aggaatgctcaa

SEQ ID NO: 524318 - DNA, 15 bp, Homo sapiens
aggaatgctcaatgt

SEQ ID NO: 524319 - DNA, 21 bp, Homo sapiens
aggaatgctcaatgtgctgtt

SEQ ID NO: 524320 - DNA, 13 bp, Homo sapiens
aggacgcatgcag

SEQ ID NO: 524321 - DNA, 14 bp, Homo sapiens
aggacgcatgcagg

SEQ ID NO: 524322 - DNA, 18 bp, Homo sapiens
aggacgcatgcagggccc

SEQ ID NO: 524323 - DNA, 21 bp, Homo sapiens
aggactctcacgatatgcaag

SEQ ID NO: 524324 - DNA, 17 bp, Homo sapiens
aggagatggggagggcg

SEQ ID NO: 524325 - DNA, 13 bp, Homo sapiens
aggagcaaacagg

SEQ ID NO: 524326 - DNA, 19 bp, Homo sapiens
aggatcacttgagcccaga

SEQ ID NO: 524327 - DNA, 18 bp, Homo sapiens
aggatgcatgcagggccc

SEQ ID NO: 524328 - DNA, 19 bp, Homo sapiens
aggatgcatgcagggcccc

SEQ ID NO: 524329 - DNA, 16 bp, Homo sapiens
aggatgtggatggagg

SEQ ID NO: 524330 - DNA, 13 bp, Homo sapiens
aggcaccatgctg

SEQ ID NO: 524331 - DNA, 18 bp, Homo sapiens
aggcaccatgctgggccg

SEQ ID NO: 524332 - DNA, 16 bp, Homo sapiens
aggcagcctgcagacc

SEQ ID NO: 524333 - DNA, 21 bp, Homo sapiens
aggccaagagtttgagaccaa

SEQ ID NO: 524334 - DNA, 18 bp, Homo sapiens
aggcctcagggaccaagg

SEQ ID NO: 524335 - DNA, 13 bp, Homo sapiens
aggctactgccac

SEQ ID NO: 524336 - DNA, 14 bp, Homo sapiens
aggctactgccact

SEQ ID NO: 524337 - DNA, 18 bp, Homo sapiens
aggctcccactgcccctg

SEQ ID NO: 524338 - DNA, 20 bp, Homo sapiens
aggctccctccctccctgct

SEQ ID NO: 524339 - DNA, 13 bp, Homo sapiens
agggaagccctga

SEQ ID NO: 524340 - DNA, 13 bp, Homo sapiens
agggacacagagg

SEQ ID NO: 524341 - DNA, 19 bp, Homo sapiens
agggagtggggaggagaga

SEQ ID NO: 524342 - DNA, 23 bp, Homo sapiens
agggatgctatctcgctagccat

SEQ ID NO: 524343 - DNA, 19 bp, Homo sapiens
agggccagtcatggctgtc

SEQ ID NO: 524344 - DNA, 24 bp, Homo sapiens
agggccagtcatggctgtcccctg

SEQ ID NO: 524345 - DNA, 12 bp, Homo sapiens
catagataccat

SEQ ID NO: 524346 - DNA, 22 bp, Homo sapiens
catagataccattttgaaatat

SEQ ID NO: 524347 - DNA, 16 bp, Homo sapiens
catattatatcagact

SEQ ID NO: 524348 - DNA, 23 bp, Homo sapiens
catattatatcagactgctttga

SEQ ID NO: 524349 - DNA, 16 bp, Homo sapiens
catcctgccttcatgg

SEQ ID NO: 524350 - DNA, 14 bp, Homo sapiens
catctggcctgggg

SEQ ID NO: 524351 - DNA, 16 bp, Homo sapiens
catctggcctgggggc

SEQ ID NO: 524352 - DNA, 14 bp, Homo sapiens
catgattagacaat

SEQ ID NO: 524353 - DNA, 16 bp, Homo sapiens
catgcaaagtcctttc

SEQ ID NO: 524354 - DNA, 17 bp, Homo sapiens
catgcagggcccccaca

SEQ ID NO: 524355 - DNA, 20 bp, Homo sapiens
catgcagggcccccacagga

SEQ ID NO: 524356 - DNA, 19 bp, Homo sapiens
catgcagggcccccatgca

SEQ ID NO: 524357 - DNA, 11 bp, Homo sapiens
catgccctccc

SEQ ID NO: 524358 - DNA, 9 bp, Homo sapiens
catgctcag

SEQ ID NO: 524359 - DNA, 12 bp, Homo sapiens
catgctgggccg

SEQ ID NO: 524360 - DNA, 20 bp, Homo sapiens
catgctgtccctgtgggctc

SEQ ID NO: 524361 - DNA, 22 bp, Homo sapiens
catgctgtctgtgtgaggctcc

SEQ ID NO: 524362 - DNA, 23 bp, Homo sapiens
catgctgtctgtgtgaggctccc

SEQ ID NO: 524363 - DNA, 15 bp, Homo sapiens
catggtagactgtga

SEQ ID NO: 524364 - DNA, 15 bp, Homo sapiens
catgtcctatccctg

SEQ ID NO: 524365 - DNA, 20 bp, Homo sapiens
catgtctttctccaaagtta

SEQ ID NO: 524366 - DNA, 21 bp, Homo sapiens
catgtctttctccaaagttat

SEQ ID NO: 524367 - DNA, 19 bp, Homo sapiens
cattatagattttcatgtt

SEQ ID NO: 524368 - DNA, 17 bp, Homo sapiens
cattatagcatgtaata

SEQ ID NO: 524369 - DNA, 21 bp, Homo sapiens
cattatagcatgtaatattaa

SEQ ID NO: 524370 - DNA, 20 bp, Homo sapiens
cattatggctttgtgcttgt

SEQ ID NO: 524371 - DNA, 18 bp, Homo sapiens
cattcctgaccctcactt

SEQ ID NO: 524372 - DNA, 19 bp, Homo sapiens
cattcctgaccctcacttt

SEQ ID NO: 524373 - DNA, 14 bp, Homo sapiens
cattgcactaaaag

SEQ ID NO: 524374 - DNA, 16 bp, Homo sapiens
cattgcactaaaagtg

SEQ ID NO: 524375 - DNA, 17 bp, Homo sapiens
cattgcactaaaagtga

SEQ ID NO: 524376 - DNA, 21 bp, Homo sapiens
cattgcactaaaagtgatgtg

SEQ ID NO: 524377 - DNA, 12 bp, Homo sapiens
cattgccttctg

SEQ ID NO: 524378 - DNA, 13 bp, Homo sapiens
cattgccttctgg

SEQ ID NO: 524379 - DNA, 17 bp, Homo sapiens
cattgggccatgtttaa

SEQ ID NO: 524380 - DNA, 15 bp, Homo sapiens
cattgtgaatgttgt

SEQ ID NO: 524381 - DNA, 22 bp, Homo sapiens
cattgtgaatgttgtcctgtgt

SEQ ID NO: 524382 - DNA, 13 bp, Homo sapiens
catttaatcattt

SEQ ID NO: 524383 - DNA, 13 bp, Homo sapiens
catttatgcatga

SEQ ID NO: 524384 - DNA, 15 bp, Homo sapiens
catttatgcatgaga

SEQ ID NO: 524385 - DNA, 17 bp, Homo sapiens
catttatgcatgagaac

SEQ ID NO: 524386 - DNA, 17 bp, Homo sapiens
catttcacattcctgac

SEQ ID NO: 524387 - DNA, 20 bp, Homo sapiens
catttcacattcctgaccct

SEQ ID NO: 524388 - DNA, 12 bp, Homo sapiens
catttccctgct

SEQ ID NO: 524389 - DNA, 21 bp, Homo sapiens
catttgctgcatttcaagtta

SEQ ID NO: 524390 - DNA, 14 bp, Homo sapiens
cattttctctcctc

SEQ ID NO: 524391 - DNA, 17 bp, Homo sapiens
catttttcattttctct

SEQ ID NO: 524392 - DNA, 15 bp, Homo sapiens
ccaaaagctgctttc

SEQ ID NO: 524393 - DNA, 22 bp, Homo sapiens
ccaaaagctgctttccatggca

SEQ ID NO: 524394 - DNA, 18 bp, Homo sapiens
ccaaattgctgagatgtt

SEQ ID NO: 524395 - DNA, 13 bp, Homo sapiens
ccaacctcccctg

SEQ ID NO: 524396 - DNA, 22 bp, Homo sapiens
ccaagggctgacttctccagga

SEQ ID NO: 524397 - DNA, 13 bp, Homo sapiens
ccaagtgtcctgc

SEQ ID NO: 524398 - DNA, 19 bp, Homo sapiens
ccaatgtccaggtcacagg

SEQ ID NO: 524399 - DNA, 22 bp, Homo sapiens
ccaatgtccaggtcacaggcat

SEQ ID NO: 524400 - DNA, 13 bp, Homo sapiens
ccacaaattcatg

SEQ ID NO: 524401 - DNA, 15 bp, Homo sapiens
ccacaggagcgtgta

SEQ ID NO: 524402 - DNA, 18 bp, Homo sapiens
ccacaggagcgtgtccta

SEQ ID NO: 524403 - DNA, 22 bp, Homo sapiens
ccacaggagcgtgtcctatccc

SEQ ID NO: 524404 - DNA, 16 bp, Homo sapiens
ccacagtattgttctt

SEQ ID NO: 524405 - DNA, 21 bp, Homo sapiens
ccacctaaagggaagccctga

SEQ ID NO: 524406 - DNA, 14 bp, Homo sapiens
ccacctcggacacc

SEQ ID NO: 524407 - DNA, 17 bp, Homo sapiens
ccacctcggacaccatc

SEQ ID NO: 524408 - DNA, 16 bp, Homo sapiens
ccacgacctcgtccat

SEQ ID NO: 524409 - DNA, 17 bp, Homo sapiens
ccacgacctcgtccatt

SEQ ID NO: 524410 - DNA, 16 bp, Homo sapiens
ccacgcccctgcctga

SEQ ID NO: 524411 - DNA, 20 bp, Homo sapiens
ccactcaggcagcctgtggg

SEQ ID NO: 524412 - DNA, 14 bp, Homo sapiens
ccactgcccctgca

SEQ ID NO: 524413 - DNA, 17 bp, Homo sapiens
ccacttatttccatgga

SEQ ID NO: 524414 - DNA, 18 bp, Homo sapiens
ccagagacccggggatgg

SEQ ID NO: 524415 - DNA, 14 bp, Homo sapiens
ccagcaaaatatat

SEQ ID NO: 524416 - DNA, 13 bp, Homo sapiens
ccagccctccgcc

SEQ ID NO: 524417 - DNA, 23 bp, Homo sapiens
ccagccctgttccgcctcactgg

SEQ ID NO: 524418 - DNA, 24 bp, Homo sapiens
ccagccctgttccgcctcactggg

SEQ ID NO: 524419 - DNA, 16 bp, Homo sapiens
ccagcgctgaacagac

SEQ ID NO: 524420 - DNA, 23 bp, Homo sapiens
ccagcgctgaacagaccggggtg

SEQ ID NO: 524421 - DNA, 19 bp, Homo sapiens
ccagctgcaggaatcaaaa

SEQ ID NO: 524422 - DNA, 18 bp, Homo sapiens
ccaggaagtcatcctgca

SEQ ID NO: 524423 - DNA, 22 bp, Homo sapiens
ccaggacctagtcggggggtgg

SEQ ID NO: 524424 - DNA, 16 bp, Homo sapiens
ccaggacgcatgcagg

SEQ ID NO: 524425 - DNA, 18 bp, Homo sapiens
ccaggatgaaggggccag

SEQ ID NO: 524426 - DNA, 14 bp, Homo sapiens
ccaggatgcatgca

SEQ ID NO: 524427 - DNA, 17 bp, Homo sapiens
ccagggtccagccctcc

SEQ ID NO: 524428 - DNA, 18 bp, Homo sapiens
ccagggtccagccctccg

SEQ ID NO: 524429 - DNA, 13 bp, Homo sapiens
ccagttctgatga

SEQ ID NO: 524430 - DNA, 21 bp, Homo sapiens
ccatgcaggcagcctgcagac

SEQ ID NO: 524431 - DNA, 12 bp, Homo sapiens
ccatgctgggcc

SEQ ID NO: 524432 - DNA, 13 bp, Homo sapiens
ccatgctgtccct

SEQ ID NO: 524433 - DNA, 17 bp, Homo sapiens
ccatggaacagccctgc

SEQ ID NO: 524434 - DNA, 20 bp, Homo sapiens
ccatggaacagccctgcacg

SEQ ID NO: 524435 - DNA, 15 bp, Homo sapiens
ccatggtagactgtg

SEQ ID NO: 524436 - DNA, 16 bp, Homo sapiens
ccatggtagactgtga

SEQ ID NO: 524437 - DNA, 17 bp, Homo sapiens
ccatggtagactgtgac

SEQ ID NO: 524438 - DNA, 12 bp, Homo sapiens
ccatgtgctgct

SEQ ID NO: 524439 - DNA, 15 bp, Homo sapiens
ccatgtgctgctgtg

SEQ ID NO: 524440 - DNA, 18 bp, Homo sapiens
ccattatggctttgtgct

SEQ ID NO: 524441 - DNA, 13 bp, Homo sapiens
ccattgccttctg

SEQ ID NO: 524442 - DNA, 22 bp, Homo sapiens
ccatttaatcatttccagcaaa

SEQ ID NO: 524443 - DNA, 18 bp, Homo sapiens
ccatttagtcctcacctt

SEQ ID NO: 524444 - DNA, 23 bp, Homo sapiens
ccatttcacattcctgaccctca

SEQ ID NO: 524445 - DNA, 14 bp, Homo sapiens
ccattttgaaatat

SEQ ID NO: 524446 - DNA, 23 bp, Homo sapiens
cccaacaatactttgtgtctttt

SEQ ID NO: 524447 - DNA, 17 bp, Homo sapiens
tagataccattttgaaa

SEQ ID NO: 524448 - DNA, 16 bp, Homo sapiens
tagattcctacttaaa

SEQ ID NO: 524449 - DNA, 19 bp, Homo sapiens
tagattcctacttaaacaa

SEQ ID NO: 524450 - DNA, 23 bp, Homo sapiens
tagattcctacttaaacaaaaac

SEQ ID NO: 524451 - DNA, 13 bp, Homo sapiens
tagatttttagat

SEQ ID NO: 524452 - DNA, 23 bp, Homo sapiens
tagcaaaaggatgatttaacatt

SEQ ID NO: 524453 - DNA, 11 bp, Homo sapiens
tagcaccagct

SEQ ID NO: 524454 - DNA, 13 bp, Homo sapiens
tagcaccagcttg

SEQ ID NO: 524455 - DNA, 23 bp, Homo sapiens
tagcatactgatgagacaacaca

SEQ ID NO: 524456 - DNA, 18 bp, Homo sapiens
tagcatatataattttat

SEQ ID NO: 524457 - DNA, 23 bp, Homo sapiens
tcatatctgtatgcctcatttta

SEQ ID NO: 524458 - DNA, 18 bp, Homo sapiens
tcatcaacaaagaaatat

SEQ ID NO: 524459 - DNA, 15 bp, Homo sapiens
tcatcctgccttcat

SEQ ID NO: 524460 - DNA, 18 bp, Homo sapiens
tcatctgtaaaaccaggc

SEQ ID NO: 524461 - DNA, 16 bp, Homo sapiens
tcatgattagacaatg

SEQ ID NO: 524462 - DNA, 14 bp, Homo sapiens
tcatgctgtctgtg

SEQ ID NO: 524463 - DNA, 15 bp, Homo sapiens
tcatggctgttatct

SEQ ID NO: 524464 - DNA, 20 bp, Homo sapiens
tcatggctgttatctgtctt

SEQ ID NO: 524465 - DNA, 18 bp, Homo sapiens
tcatgttaattgatagaa

SEQ ID NO: 524466 - DNA, 22 bp, Homo sapiens
tcattaaccttatcataaattc

SEQ ID NO: 524467 - DNA, 13 bp, Homo sapiens
tcattagctgtga

SEQ ID NO: 524468 - DNA, 16 bp, Homo sapiens
tccaaaggtttcaact

SEQ ID NO: 524469 - DNA, 23 bp, Homo sapiens
tccacagtattgttcttgtaaaa

SEQ ID NO: 524470 - DNA, 18 bp, Homo sapiens
tccacccccattgtgaat

SEQ ID NO: 524471 - DNA, 20 bp, Homo sapiens
tccagagggttgtgattttg

SEQ ID NO: 524472 - DNA, 18 bp, Homo sapiens
tccagccctccgccagcc

SEQ ID NO: 524473 - DNA, 22 bp, Homo sapiens
tccagctaagcctgatgatgga

SEQ ID NO: 524474 - DNA, 13 bp, Homo sapiens
tccagggtccagc

SEQ ID NO: 524475 - DNA, 18 bp, Homo sapiens
tccagggtccagccctcc

SEQ ID NO: 524476 - DNA, 15 bp, Homo sapiens
tccaggtcacaggca

SEQ ID NO: 524477 - DNA, 22 bp, Homo sapiens
tccaggtcacaggcatccgctg

SEQ ID NO: 524478 - DNA, 23 bp, Homo sapiens
tccaggtcacaggcatccgctgc

SEQ ID NO: 524479 - DNA, 15 bp, Homo sapiens
tccagttctgatgag

SEQ ID NO: 524480 - DNA, 23 bp, Homo sapiens
tccatgacagtagcatactgatg

SEQ ID NO: 524481 - DNA, 14 bp, Homo sapiens
tccatgctgtccct

SEQ ID NO: 524482 - DNA, 13 bp, Homo sapiens
tccattgtatctt

SEQ ID NO: 524483 - DNA, 19 bp, Homo sapiens
tcccaacaatactttgtgt

SEQ ID NO: 524484 - DNA, 17 bp, Homo sapiens
tcccacctcggacacca

SEQ ID NO: 524485 - DNA, 15 bp, Homo sapiens
tcccacctctttgga

SEQ ID NO: 524486 - DNA, 21 bp, Homo sapiens
tcccagagacccggggatgga

SEQ ID NO: 524487 - DNA, 22 bp, Homo sapiens
tcccagctacaggggaggctga

SEQ ID NO: 524488 - DNA, 18 bp, Homo sapiens
tccccatggaacagccct

SEQ ID NO: 524489 - DNA, 21 bp, Homo sapiens
tccccatggaacagccctgca

SEQ ID NO: 524490 - DNA, 16 bp, Homo sapiens
tccccattgccttctg

SEQ ID NO: 524491 - DNA, 14 bp, Homo sapiens
tccccctcctccat

SEQ ID NO: 524492 - DNA, 19 bp, Homo sapiens
tccccgtgctcacagtagc

SEQ ID NO: 524493 - DNA, 15 bp, Homo sapiens
tcccctggtcctgca

SEQ ID NO: 524494 - DNA, 16 bp, Homo sapiens
tcccctggtcctgcac

SEQ ID NO: 524495 - DNA, 19 bp, Homo sapiens
tcccggctctgaggctgcc

SEQ ID NO: 524496 - DNA, 13 bp, Homo sapiens
tccctagttcttt

SEQ ID NO: 524497 - DNA, 15 bp, Homo sapiens
tccctccctgctccc

SEQ ID NO: 524498 - DNA, 21 bp, Homo sapiens
tccctgagggcccttcccaac

SEQ ID NO: 524499 - DNA, 16 bp, Homo sapiens
tccctgctgccaggct

SEQ ID NO: 524500 - DNA, 20 bp, Homo sapiens
tccctggacgcatgcagggc

SEQ ID NO: 524501 - DNA, 15 bp, Homo sapiens
tccctgtgggctcac

SEQ ID NO: 524502 - DNA, 21 bp, Homo sapiens
tccctgtgggctcacaccggc

SEQ ID NO: 524503 - DNA, 20 bp, Homo sapiens
tccctttatcatgtgtttct

SEQ ID NO: 524504 - DNA, 13 bp, Homo sapiens
tccgcgagcctgc

SEQ ID NO: 524505 - DNA, 18 bp, Homo sapiens
tccgctgcgctcccacct

SEQ ID NO: 524506 - DNA, 12 bp, Homo sapiens
tccgtgtctgtt

SEQ ID NO: 524507 - DNA, 14 bp, Homo sapiens
tcctacttaaacaa

SEQ ID NO: 524508 - DNA, 13 bp, Homo sapiens
tcctatccccgga

SEQ ID NO: 524509 - DNA, 13 bp, Homo sapiens
tcctatccctgga

SEQ ID NO: 524510 - DNA, 21 bp, Homo sapiens
tcctatgagagaagagagtat

SEQ ID NO: 524511 - DNA, 17 bp, Homo sapiens
tcctccaaatgctgtcg

SEQ ID NO: 524512 - DNA, 20 bp, Homo sapiens
tcctccatgctgtccctgtg

SEQ ID NO: 524513 - DNA, 13 bp, Homo sapiens
tcctccccctcct

SEQ ID NO: 524514 - DNA, 17 bp, Homo sapiens
tcctccccctcctccat

SEQ ID NO: 524515 - DNA, 21 bp, Homo sapiens
tcctccccctcctccatgctg

SEQ ID NO: 524516 - DNA, 16 bp, Homo sapiens
tcctcctgtctcctct

SEQ ID NO: 524517 - DNA, 14 bp, Homo sapiens
tcctcggtggcatt

SEQ ID NO: 524518 - DNA, 21 bp, Homo sapiens
tcctcggtggcatttgctgaa

SEQ ID NO: 524519 - DNA, 22 bp, Homo sapiens
tcctcggtggcatttgctgaat

SEQ ID NO: 524520 - DNA, 18 bp, Homo sapiens
tcctctgtcagtttgtga

SEQ ID NO: 524521 - DNA, 22 bp, Homo sapiens
tcctctgtcagtttgtgaagtg

SEQ ID NO: 524522 - DNA, 13 bp, Homo sapiens
tcctcttacctgt

SEQ ID NO: 524523 - DNA, 14 bp, Homo sapiens
tcctcttacctgta

SEQ ID NO: 524524 - DNA, 15 bp, Homo sapiens
tcctgcaatgggaga

SEQ ID NO: 524525 - DNA, 14 bp, Homo sapiens
tcctgcactgtccc

SEQ ID NO: 524526 - DNA, 17 bp, Homo sapiens
tcctgcactgtcccgga

SEQ ID NO: 524527 - DNA, 17 bp, Homo sapiens
tcctgctgaccttctgc

SEQ ID NO: 524528 - DNA, 14 bp, Homo sapiens
tcctggctcccagg

SEQ ID NO: 524529 - DNA, 14 bp, Homo sapiens
tcctgggggctgct

SEQ ID NO: 524530 - DNA, 17 bp, Homo sapiens
tcctgggggctgctgca

SEQ ID NO: 524531 - DNA, 13 bp, Homo sapiens
tcctgtcctggct

SEQ ID NO: 524532 - DNA, 15 bp, Homo sapiens
tcctgtctcctctgt

SEQ ID NO: 524533 - DNA, 16 bp, Homo sapiens
tcctgtctcctctgtc

SEQ ID NO: 524534 - DNA, 17 bp, Homo sapiens
tcctgtctcctctgtca

SEQ ID NO: 524535 - DNA, 14 bp, Homo sapiens
tcctgtgtcatctg

SEQ ID NO: 524536 - DNA, 16 bp, Homo sapiens
tcctgtgtcatctgtc

SEQ ID NO: 524537 - DNA, 22 bp, Homo sapiens
tccttcactccctgtcatagtt

SEQ ID NO: 524538 - DNA, 11 bp, Homo sapiens
tcgcccaccta

SEQ ID NO: 524539 - DNA, 23 bp, Homo sapiens
tcgcccacctaaagggaagccct

SEQ ID NO: 524540 - DNA, 12 bp, Homo sapiens
tcgccttctggc

SEQ ID NO: 524541 - DNA, 14 bp, Homo sapiens
tcgccttctggctg

SEQ ID NO: 524542 - DNA, 22 bp, Homo sapiens
tcgggctctctcacccagcctg

SEQ ID NO: 524543 - DNA, 23 bp, Homo sapiens
tcggtgggagccgtcagcctgtg

SEQ ID NO: 524544 - DNA, 17 bp, Homo sapiens
tcgtgtttcacagtggg

SEQ ID NO: 524545 - DNA, 16 bp, Homo sapiens
tctagagctatgcaca

SEQ ID NO: 524546 - DNA, 17 bp, Homo sapiens
tctagatatgagaaata

SEQ ID NO: 524547 - DNA, 21 bp, Homo sapiens
tctagtaggtctgcacacata

SEQ ID NO: 524548 - DNA, 22 bp, Homo sapiens
tctccacagggacacagtctgg

SEQ ID NO: 524549 - DNA, 24 bp, Homo sapiens
tctcctcggtggcatttgctgaat

SEQ ID NO: 524550 - DNA, 15 bp, Homo sapiens
tctcctgtatcattt

SEQ ID NO: 524551 - DNA, 16 bp, Homo sapiens
ctggaagttgtccttt

SEQ ID NO: 524552 - DNA, 16 bp, Homo sapiens
ctggaatctactagaa

SEQ ID NO: 524553 - DNA, 21 bp, Homo sapiens
ctggagcgtgtactaccccag

SEQ ID NO: 524554 - DNA, 14 bp, Homo sapiens
ctggatccagctct

SEQ ID NO: 524555 - DNA, 17 bp, Homo sapiens
ctggatccagctctggg

SEQ ID NO: 524556 - DNA, 20 bp, Homo sapiens
ctggattcccgtggctttgt

SEQ ID NO: 524557 - DNA, 21 bp, Homo sapiens
ctggattcccgtggctttgtg

SEQ ID NO: 524558 - DNA, 19 bp, Homo sapiens
ctggcttagcgttctgttt

SEQ ID NO: 524559 - DNA, 18 bp, Homo sapiens
ctgggaatcctggacagc

SEQ ID NO: 524560 - DNA, 20 bp, Homo sapiens
ctgggcgccggttccacgtg

SEQ ID NO: 524561 - DNA, 12 bp, Homo sapiens
ctgggggctgct

SEQ ID NO: 524562 - DNA, 16 bp, Homo sapiens
ctgggggctgctgcac

SEQ ID NO: 524563 - DNA, 12 bp, Homo sapiens
ctggtcctgcac

SEQ ID NO: 524564 - DNA, 16 bp, Homo sapiens
ctgtaaataaaaatag

SEQ ID NO: 524565 - DNA, 12 bp, Homo sapiens
ctgtaactgtcc

SEQ ID NO: 524566 - DNA, 19 bp, Homo sapiens
ctgtaatagcctcaccttc

SEQ ID NO: 524567 - DNA, 20 bp, Homo sapiens
ctgtaatcacactctcttct

SEQ ID NO: 524568 - DNA, 19 bp, Homo sapiens
ctgtcaagattaagttata

SEQ ID NO: 524569 - DNA, 21 bp, Homo sapiens
ctgtcagtttgtgaagtgatt

SEQ ID NO: 524570 - DNA, 12 bp, Homo sapiens
ctgtccctgtgg

SEQ ID NO: 524571 - DNA, 16 bp, Homo sapiens
ctgtcctggctcccag

SEQ ID NO: 524572 - DNA, 22 bp, Homo sapiens
ctgtctctacaaaaaaaatcaa

SEQ ID NO: 524573 - DNA, 19 bp, Homo sapiens
ctgtctgtgtgaggctccc

SEQ ID NO: 524574 - DNA, 22 bp, Homo sapiens
ctgtgaaagtctcctgtatcat

SEQ ID NO: 524575 - DNA, 18 bp, Homo sapiens
ctgtgaatcaaaacaaat

SEQ ID NO: 524576 - DNA, 14 bp, Homo sapiens
ctgtgcactctact

SEQ ID NO: 524577 - DNA, 23 bp, Homo sapiens
ctgtgcatctggcctgggggctg

SEQ ID NO: 524578 - DNA, 18 bp, Homo sapiens
ctgtgctaagttgtctta

SEQ ID NO: 524579 - DNA, 12 bp, Homo sapiens
ctgtgctttccg

SEQ ID NO: 524580 - DNA, 12 bp, Homo sapiens
ctgtgggctcac

SEQ ID NO: 524581 - DNA, 18 bp, Homo sapiens
ctgtgggctcacaccggc

SEQ ID NO: 524582 - DNA, 12 bp, Homo sapiens
ctgtgtcatctg

SEQ ID NO: 524583 - DNA, 15 bp, Homo sapiens
ctgttccgcctcact

SEQ ID NO: 524584 - DNA, 17 bp, Homo sapiens
ctgttccgcctcactgg

SEQ ID NO: 524585 - DNA, 14 bp, Homo sapiens
cttaaacaaaaact

SEQ ID NO: 524586 - DNA, 20 bp, Homo sapiens
cttaaacaaaaactttccat

SEQ ID NO: 524587 - DNA, 23 bp, Homo sapiens
cttaaacaaaaactttccatgac

SEQ ID NO: 524588 - DNA, 19 bp, Homo sapiens
cttaaacatttccctgctg

SEQ ID NO: 524589 - DNA, 21 bp, Homo sapiens
cttaagaagtatccctgattt

SEQ ID NO: 524590 - DNA, 15 bp, Homo sapiens
cttactgattaactc

SEQ ID NO: 524591 - DNA, 17 bp, Homo sapiens
cttagaatactgtattg

SEQ ID NO: 524592 - DNA, 15 bp, Homo sapiens
cttagcgttctgttt

SEQ ID NO: 524593 - DNA, 13 bp, Homo sapiens
cttagtatctcat

SEQ ID NO: 524594 - DNA, 17 bp, Homo sapiens
cttagtatctcatcaac

SEQ ID NO: 524595 - DNA, 19 bp, Homo sapiens
cttagtatctcatcaacaa

SEQ ID NO: 524596 - DNA, 14 bp, Homo sapiens
cttatgtcatttct

SEQ ID NO: 524597 - DNA, 18 bp, Homo sapiens
cttatttgtatttttcct

SEQ ID NO: 524598 - DNA, 16 bp, Homo sapiens
cttcaaacgaaatggc

SEQ ID NO: 524599 - DNA, 17 bp, Homo sapiens
cttcaaattgtcttttg

SEQ ID NO: 524600 - DNA, 21 bp, Homo sapiens
cttcaggaaagcagcagtttt

SEQ ID NO: 524601 - DNA, 18 bp, Homo sapiens
cttcatgcttttctcatg

SEQ ID NO: 524602 - DNA, 22 bp, Homo sapiens
cttcccaacctcccctggtcct

SEQ ID NO: 524603 - DNA, 23 bp, Homo sapiens
cttcccccctcagcaaggggctg

SEQ ID NO: 524604 - DNA, 23 bp, Homo sapiens
cttccctgacactgtctgctgcc

SEQ ID NO: 524605 - DNA, 13 bp, Homo sapiens
cttctattttcaa

SEQ ID NO: 524606 - DNA, 15 bp, Homo sapiens
cttctctctgtgctg

SEQ ID NO: 524607 - DNA, 15 bp, Homo sapiens
cttctgactgtttac

SEQ ID NO: 524608 - DNA, 16 bp, Homo sapiens
cttctggggagggaca

SEQ ID NO: 524609 - DNA, 18 bp, Homo sapiens
cttctggggagggacaca

SEQ ID NO: 524610 - DNA, 21 bp, Homo sapiens
cttctggggagggacacagag

SEQ ID NO: 524611 - DNA, 21 bp, Homo sapiens
cttctggggaggggctccgtg

SEQ ID NO: 524612 - DNA, 12 bp, Homo sapiens
cttctgtgcatc

SEQ ID NO: 524613 - DNA, 19 bp, Homo sapiens
cttctgtgcatctggcctg

SEQ ID NO: 524614 - DNA, 15 bp, Homo sapiens
cttcttactgtattt

SEQ ID NO: 524615 - DNA, 13 bp, Homo sapiens
cttcttcccccag

SEQ ID NO: 524616 - DNA, 17 bp, Homo sapiens
cttctttactaacactg

SEQ ID NO: 524617 - DNA, 17 bp, Homo sapiens
cttgaaattatatctgt

SEQ ID NO: 524618 - DNA, 21 bp, Homo sapiens
cttgaaattatatctgtggtc

SEQ ID NO: 524619 - DNA, 14 bp, Homo sapiens
cttgagtttcattt

SEQ ID NO: 524620 - DNA, 13 bp, Homo sapiens
cttgctgtgaaac

SEQ ID NO: 524621 - DNA, 16 bp, Homo sapiens
cttgggattcctcccc

SEQ ID NO: 524622 - DNA, 23 bp, Homo sapiens
cttgggcgggccatttcacattc

SEQ ID NO: 524623 - DNA, 19 bp, Homo sapiens
cttgggctggcacccactg

SEQ ID NO: 524624 - DNA, 11 bp, Homo sapiens
cttggtctctt

SEQ ID NO: 524625 - DNA, 20 bp, Homo sapiens
cttggtctctttctttccaa

SEQ ID NO: 524626 - DNA, 22 bp, Homo sapiens
cttggtctctttctttccaaag

SEQ ID NO: 524627 - DNA, 19 bp, Homo sapiens
cttggtgcctaatgttcca

SEQ ID NO: 524628 - DNA, 19 bp, Homo sapiens
ctttatcatgtgtttctgt

SEQ ID NO: 524629 - DNA, 20 bp, Homo sapiens
atcattatagcatgtaatat

SEQ ID NO: 524630 - DNA, 20 bp, Homo sapiens
atcattggtatctgatatct

SEQ ID NO: 524631 - DNA, 17 bp, Homo sapiens
atccacagtattgttct

SEQ ID NO: 524632 - DNA, 13 bp, Homo sapiens
atccagcggggct

SEQ ID NO: 524633 - DNA, 21 bp, Homo sapiens
atccagcggggcttctgggcg

SEQ ID NO: 524634 - DNA, 14 bp, Homo sapiens
atccagctctggga

SEQ ID NO: 524635 - DNA, 19 bp, Homo sapiens
atccatcggtttatactat

SEQ ID NO: 524636 - DNA, 19 bp, Homo sapiens
atccatgtgctgctgtggc

SEQ ID NO: 524637 - DNA, 18 bp, Homo sapiens
atccccatggaacagccc

SEQ ID NO: 524638 - DNA, 23 bp, Homo sapiens
atccccatggaacagccctgcac

SEQ ID NO: 524639 - DNA, 19 bp, Homo sapiens
atccccgtgctcacagtag

SEQ ID NO: 524640 - DNA, 21 bp, Homo sapiens
atcctgccttcatggaactca

SEQ ID NO: 524641 - DNA, 16 bp, Homo sapiens
atcctggacagctccg

SEQ ID NO: 524642 - DNA, 20 bp, Homo sapiens
atctagagctatgcacacca

SEQ ID NO: 524643 - DNA, 22 bp, Homo sapiens
atctagtaggtctgcacacata

SEQ ID NO: 524644 - DNA, 17 bp, Homo sapiens
atctctcaaaatgtgcc

SEQ ID NO: 524645 - DNA, 15 bp, Homo sapiens
atctgaaaactggaa

SEQ ID NO: 524646 - DNA, 18 bp, Homo sapiens
atctgtaaaaccaggctg

SEQ ID NO: 524647 - DNA, 13 bp, Homo sapiens
atctgtatgcctc

SEQ ID NO: 524648 - DNA, 14 bp, Homo sapiens
atctgtcagcttcc

SEQ ID NO: 524649 - DNA, 15 bp, Homo sapiens
atctgtcagcttccc

SEQ ID NO: 524650 - DNA, 17 bp, Homo sapiens
atctgtcagcttcccaa

SEQ ID NO: 524651 - DNA, 22 bp, Homo sapiens
atctgtcagcttcccaacaata

SEQ ID NO: 524652 - DNA, 11 bp, Homo sapiens
atctgtcttta

SEQ ID NO: 524653 - DNA, 14 bp, Homo sapiens
atctgtctttatga

SEQ ID NO: 524654 - DNA, 15 bp, Homo sapiens
atctgtctttatgat

SEQ ID NO: 524655 - DNA, 21 bp, Homo sapiens
atcttcctagtgggccacccc

SEQ ID NO: 524656 - DNA, 23 bp, Homo sapiens
atcttgggattcctcccctggaa

SEQ ID NO: 524657 - DNA, 19 bp, Homo sapiens
atgaaaaccaccctatcat

SEQ ID NO: 524658 - DNA, 16 bp, Homo sapiens
atgaaagtcagtttaa

SEQ ID NO: 524659 - DNA, 17 bp, Homo sapiens
atgaaatataaactgtg

SEQ ID NO: 524660 - DNA, 19 bp, Homo sapiens
atgaaatataaactgtgag

SEQ ID NO: 524661 - DNA, 21 bp, Homo sapiens
atgaaatataaactgtgagat

SEQ ID NO: 524662 - DNA, 21 bp, Homo sapiens
atgaagccctaagtaaatcta

SEQ ID NO: 524663 - DNA, 22 bp, Homo sapiens
atgaaggggccagaccacgccc

SEQ ID NO: 524664 - DNA, 20 bp, Homo sapiens
atgaatacgtaaactgcgta

SEQ ID NO: 524665 - DNA, 15 bp, Homo sapiens
atgaatgaaatataa

SEQ ID NO: 524666 - DNA, 14 bp, Homo sapiens
atgacagtagcata

SEQ ID NO: 524667 - DNA, 15 bp, Homo sapiens
atgacagtagcatac

SEQ ID NO: 524668 - DNA, 20 bp, Homo sapiens
atgacttctttactaacact

SEQ ID NO: 524669 - DNA, 16 bp, Homo sapiens
atgagaaatataaaaa

SEQ ID NO: 524670 - DNA, 13 bp, Homo sapiens
atgagaactaaat

SEQ ID NO: 524671 - DNA, 12 bp, Homo sapiens
atgagattggaa

SEQ ID NO: 524672 - DNA, 19 bp, Homo sapiens
atgagattggaaaaaatta

SEQ ID NO: 524673 - DNA, 20 bp, Homo sapiens
cccaacctcccctggtcctg

SEQ ID NO: 524674 - DNA, 19 bp, Homo sapiens
cccaattatcctccttcac

SEQ ID NO: 524675 - DNA, 19 bp, Homo sapiens
cccacaggagcatgtccta

SEQ ID NO: 524676 - DNA, 20 bp, Homo sapiens
cccacctaaagggaagccct

SEQ ID NO: 524677 - DNA, 22 bp, Homo sapiens
cccacctaaagggaagccctga

SEQ ID NO: 524678 - DNA, 16 bp, Homo sapiens
cccactgcccctgcac

SEQ ID NO: 524679 - DNA, 15 bp, Homo sapiens
cccagaacgcatgca

SEQ ID NO: 524680 - DNA, 17 bp, Homo sapiens
cccagaacgcatgcagg

SEQ ID NO: 524681 - DNA, 23 bp, Homo sapiens
cccagaacgcatgcagggccccc

SEQ ID NO: 524682 - DNA, 17 bp, Homo sapiens
cccaggatgcatgcagg

SEQ ID NO: 524683 - DNA, 21 bp, Homo sapiens
cccaggggcactgtgttctca

SEQ ID NO: 524684 - DNA, 12 bp, Homo sapiens
cccagggtcctg

SEQ ID NO: 524685 - DNA, 16 bp, Homo sapiens
cccaggtgttgtccgt

SEQ ID NO: 524686 - DNA, 18 bp, Homo sapiens
cccatcgccttctggctg

SEQ ID NO: 524687 - DNA, 14 bp, Homo sapiens
cccatgccaatgtc

SEQ ID NO: 524688 - DNA, 13 bp, Homo sapiens
cccatgccctccc

SEQ ID NO: 524689 - DNA, 19 bp, Homo sapiens
cccatggaacagccctgca

SEQ ID NO: 524690 - DNA, 21 bp, Homo sapiens
cccatggaacagccctgcacg

SEQ ID NO: 524691 - DNA, 14 bp, Homo sapiens
cccattgccttctg

SEQ ID NO: 524692 - DNA, 22 bp, Homo sapiens
cccattgtgaatgttgtcctgt

SEQ ID NO: 524693 - DNA, 19 bp, Homo sapiens
ccccaggatgcatgcaggg

SEQ ID NO: 524694 - DNA, 21 bp, Homo sapiens
ccccagggtcccctgcatggc

SEQ ID NO: 524695 - DNA, 19 bp, Homo sapiens
ccccatgccaatgtccagg

SEQ ID NO: 524696 - DNA, 16 bp, Homo sapiens
ccccatgccctccctg

SEQ ID NO: 524697 - DNA, 17 bp, Homo sapiens
ccccatggaacagccct

SEQ ID NO: 524698 - DNA, 19 bp, Homo sapiens
ccccatggaacagccctgc

SEQ ID NO: 524699 - DNA, 22 bp, Homo sapiens
ccccatggaacagccctgcacg

SEQ ID NO: 524700 - DNA, 18 bp, Homo sapiens
ccccattgtgaatgttgt

SEQ ID NO: 524701 - DNA, 12 bp, Homo sapiens
cccccacaggag

SEQ ID NO: 524702 - DNA, 22 bp, Homo sapiens
cccccatgccctccctgctgcc

SEQ ID NO: 524703 - DNA, 14 bp, Homo sapiens
ccccggcctgatgg

SEQ ID NO: 524704 - DNA, 21 bp, Homo sapiens
ccccggcctgatggccaggcc

SEQ ID NO: 524705 - DNA, 17 bp, Homo sapiens
ccccgttgttgtccctg

SEQ ID NO: 524706 - DNA, 18 bp, Homo sapiens
ccccgttgttgtccctgc

SEQ ID NO: 524707 - DNA, 17 bp, Homo sapiens
gaaaccttttaaaaaaa

SEQ ID NO: 524708 - DNA, 20 bp, Homo sapiens
gaaaccttttaaaaaaataa

SEQ ID NO: 524709 - DNA, 18 bp, Homo sapiens
gaaagcctcactgatata

SEQ ID NO: 524710 - DNA, 16 bp, Homo sapiens
gaaatataaaaataat

SEQ ID NO: 524711 - DNA, 14 bp, Homo sapiens
gaaatataaactgt

SEQ ID NO: 524712 - DNA, 17 bp, Homo sapiens
gaaatataaactgtgag

SEQ ID NO: 524713 - DNA, 18 bp, Homo sapiens
gaaatataaactgtgaga

SEQ ID NO: 524714 - DNA, 22 bp, Homo sapiens
gaaatgctgatttaaacttctt

SEQ ID NO: 524715 - DNA, 22 bp, Homo sapiens
gaacaacaacaaagcatgctca

SEQ ID NO: 524716 - DNA, 14 bp, Homo sapiens
gaacagccctgcac

SEQ ID NO: 524717 - DNA, 15 bp, Homo sapiens
gaacagccctgcacg

SEQ ID NO: 524718 - DNA, 15 bp, Homo sapiens
gaacgcccccgcccc

SEQ ID NO: 524719 - DNA, 22 bp, Homo sapiens
gaactaaatagatttttagatt

SEQ ID NO: 524720 - DNA, 21 bp, Homo sapiens
gaactcagctgtctgtggctt

SEQ ID NO: 524721 - DNA, 18 bp, Homo sapiens
gaagagagatatatctga

SEQ ID NO: 524722 - DNA, 23 bp, Homo sapiens
gaagagagatatatctgaaaact

SEQ ID NO: 524723 - DNA, 16 bp, Homo sapiens
gaagttgtcctttctg

SEQ ID NO: 524724 - DNA, 16 bp, Homo sapiens
gaataacaacaattta

SEQ ID NO: 524725 - DNA, 13 bp, Homo sapiens
gaatactgtattg

SEQ ID NO: 524726 - DNA, 24 bp, Homo sapiens
gaatactgtattgttacagctgaa

SEQ ID NO: 524727 - DNA, 15 bp, Homo sapiens
gaatcaaaaattgaa

SEQ ID NO: 524728 - DNA, 21 bp, Homo sapiens
gaatcaaaaattgaagagaga

SEQ ID NO: 524729 - DNA, 16 bp, Homo sapiens
gaatcaagtctgtgaa

SEQ ID NO: 524730 - DNA, 18 bp, Homo sapiens
gaatcacctaattaattt

SEQ ID NO: 524731 - DNA, 20 bp, Homo sapiens
gaatcacctaattaatttca

SEQ ID NO: 524732 - DNA, 18 bp, Homo sapiens
gaatcctggacagctccg

SEQ ID NO: 524733 - DNA, 16 bp, Homo sapiens
gaatctctcaaaatgt

SEQ ID NO: 524734 - DNA, 18 bp, Homo sapiens
gaatgaaatataaactgt

SEQ ID NO: 524735 - DNA, 19 bp, Homo sapiens
gaatgaaatataaactgtg

SEQ ID NO: 524736 - DNA, 20 bp, Homo sapiens
gaatgaaatataaactgtga

SEQ ID NO: 524737 - DNA, 21 bp, Homo sapiens
gaatgaaatataaactgtgag

SEQ ID NO: 524738 - DNA, 16 bp, Homo sapiens
gaatgctcaatgtgct

SEQ ID NO: 524739 - DNA, 18 bp, Homo sapiens
gaatgctcaatgtgctgt

SEQ ID NO: 524740 - DNA, 19 bp, Homo sapiens
gaatgttgtcctgtgtcat

SEQ ID NO: 524741 - DNA, 12 bp, Homo sapiens
gaattgattttt

SEQ ID NO: 524742 - DNA, 20 bp, Homo sapiens
gaattttaaaaaagatggat

SEQ ID NO: 524743 - DNA, 13 bp, Homo sapiens
gacaacacacaca

SEQ ID NO: 524744 - DNA, 23 bp, Homo sapiens
gacaatgtggaattacataacag

SEQ ID NO: 524745 - DNA, 21 bp, Homo sapiens
gacacagaggacggcttcccc

SEQ ID NO: 524746 - DNA, 14 bp, Homo sapiens
gacactgtctgctg

SEQ ID NO: 524747 - DNA, 18 bp, Homo sapiens
gacactgtctgctgcccc

SEQ ID NO: 524748 - DNA, 15 bp, Homo sapiens
gacaggcaccatgct

SEQ ID NO: 524749 - DNA, 14 bp, Homo sapiens
gacagtagcatact

SEQ ID NO: 524750 - DNA, 19 bp, Homo sapiens
gacatgctaacctctctga

SEQ ID NO: 524751 - DNA, 18 bp, Homo sapiens
gacattttgtagctagtt

SEQ ID NO: 524752 - DNA, 22 bp, Homo sapiens
gacattttgtagctagtttaaa

SEQ ID NO: 524753 - DNA, 19 bp, Homo sapiens
gaccacggtccaatccagc

SEQ ID NO: 524754 - DNA, 20 bp, Homo sapiens
gaccacggtccaatccagcc

SEQ ID NO: 524755 - DNA, 11 bp, Homo sapiens
gaccctcactt

SEQ ID NO: 524756 - DNA, 15 bp, Homo sapiens
gaccggacgcatgca

SEQ ID NO: 524757 - DNA, 15 bp, Homo sapiens
gacctaccctggacc

SEQ ID NO: 524758 - DNA, 16 bp, Homo sapiens
gactttcctatgacac

SEQ ID NO: 524759 - DNA, 22 bp, Homo sapiens
gagacaacacacacacacacaa

SEQ ID NO: 524760 - DNA, 14 bp, Homo sapiens
gagagagcaatctt

SEQ ID NO: 524761 - DNA, 15 bp, Homo sapiens
gagagagggggagac

SEQ ID NO: 524762 - DNA, 22 bp, Homo sapiens
gagagatagccgggctccaggg

SEQ ID NO: 524763 - DNA, 17 bp, Homo sapiens
gagagatatatctgaaa

SEQ ID NO: 524764 - DNA, 15 bp, Homo sapiens
gagagcggcttcccc

SEQ ID NO: 524765 - DNA, 15 bp, Homo sapiens
gagagtatggtgctg

SEQ ID NO: 524766 - DNA, 19 bp, Homo sapiens
gagatagccgggctccagg

SEQ ID NO: 524767 - DNA, 17 bp, Homo sapiens
gagattggaaaaaatta

SEQ ID NO: 524768 - DNA, 20 bp, Homo sapiens
gagcaatcttgctgtgaaac

SEQ ID NO: 524769 - DNA, 21 bp, Homo sapiens
gagcccagaagctcaaggctg

SEQ ID NO: 524770 - DNA, 12 bp, Homo sapiens
gagcgtgtccta

SEQ ID NO: 524771 - DNA, 16 bp, Homo sapiens
gagcgtgtcctatccc

SEQ ID NO: 524772 - DNA, 23 bp, Homo sapiens
gagcgtgtcctatccccggacgc

SEQ ID NO: 524773 - DNA, 22 bp, Homo sapiens
gagctatgcacaccaaattgct

SEQ ID NO: 524774 - DNA, 14 bp, Homo sapiens
gagctttcccagag

SEQ ID NO: 524775 - DNA, 14 bp, Homo sapiens
gaggaacccccatg

SEQ ID NO: 524776 - DNA, 21 bp, Homo sapiens
gaggatggcttccccattgcc

SEQ ID NO: 524777 - DNA, 19 bp, Homo sapiens
gaggctgccccaggggcac

SEQ ID NO: 524778 - DNA, 14 bp, Homo sapiens
gagggacacagagg

SEQ ID NO: 524779 - DNA, 16 bp, Homo sapiens
gagtcagggctgtgct

SEQ ID NO: 524780 - DNA, 17 bp, Homo sapiens
gataaatatcattatag

SEQ ID NO: 524781 - DNA, 19 bp, Homo sapiens
gataattaaatgaaatact

SEQ ID NO: 524782 - DNA, 14 bp, Homo sapiens
gatagctccttcat

SEQ ID NO: 524783 - DNA, 12 bp, Homo sapiens
gatatatctgaa

SEQ ID NO: 524784 - DNA, 16 bp, Homo sapiens
gatatatctgaaaact

SEQ ID NO: 524785 - DNA, 13 bp, Homo sapiens
gatatgtctttaa

SEQ ID NO: 524786 - DNA, 18 bp, Homo sapiens
gatatgtctttaaaatga

SEQ ID NO: 524787 - DNA, 14 bp, Homo sapiens
gatcactttctgaa

SEQ ID NO: 524788 - DNA, 17 bp, Homo sapiens
gctctgaatctctcaaa

SEQ ID NO: 524789 - DNA, 16 bp, Homo sapiens
gctgaaagacagtaaa

SEQ ID NO: 524790 - DNA, 12 bp, Homo sapiens
gctgaaattatg

SEQ ID NO: 524791 - DNA, 16 bp, Homo sapiens
gctgaaattatgtcaa

SEQ ID NO: 524792 - DNA, 18 bp, Homo sapiens
gctgaaattatgtcaaat

SEQ ID NO: 524793 - DNA, 20 bp, Homo sapiens
gctgaaattatgtcaaatgg

SEQ ID NO: 524794 - DNA, 14 bp, Homo sapiens
gctgactcttacta

SEQ ID NO: 524795 - DNA, 19 bp, Homo sapiens
gctgagatgggaggatcac

SEQ ID NO: 524796 - DNA, 19 bp, Homo sapiens
gctgagatgtttagtagct

SEQ ID NO: 524797 - DNA, 14 bp, Homo sapiens
gctgagctggccta

SEQ ID NO: 524798 - DNA, 14 bp, Homo sapiens
gctgcactgccctc

SEQ ID NO: 524799 - DNA, 19 bp, Homo sapiens
gctgcagtcagcacagaga

SEQ ID NO: 524800 - DNA, 20 bp, Homo sapiens
gctgcagtcagcacagagag

SEQ ID NO: 524801 - DNA, 14 bp, Homo sapiens
gctgcatttcaagt

SEQ ID NO: 524802 - DNA, 16 bp, Homo sapiens
gctgccaggctcccac

SEQ ID NO: 524803 - DNA, 17 bp, Homo sapiens
gctgcgctcccacctcg

SEQ ID NO: 524804 - DNA, 14 bp, Homo sapiens
gctgctatgctgtt

SEQ ID NO: 524805 - DNA, 21 bp, Homo sapiens
gtgtcttttgttctctcttgg

SEQ ID NO: 524806 - DNA, 23 bp, Homo sapiens
gtgtcttttgttctctcttggtc

SEQ ID NO: 524807 - DNA, 14 bp, Homo sapiens
gtgtgaggctccct

SEQ ID NO: 524808 - DNA, 16 bp, Homo sapiens
gtgtgggtgccctgtt

SEQ ID NO: 524809 - DNA, 18 bp, Homo sapiens
gtgtgggtttactctgtg

SEQ ID NO: 524810 - DNA, 13 bp, Homo sapiens
gtgtgtgtgtgca

SEQ ID NO: 524811 - DNA, 14 bp, Homo sapiens
gttaatcttcatgg

SEQ ID NO: 524812 - DNA, 20 bp, Homo sapiens
gttaattctcagaagtgaaa

SEQ ID NO: 524813 - DNA, 13 bp, Homo sapiens
gttataaaatctg

SEQ ID NO: 524814 - DNA, 21 bp, Homo sapiens
gttataaaatctgtattgcta

SEQ ID NO: 524815 - DNA, 16 bp, Homo sapiens
gttataccagcaaaag

SEQ ID NO: 524816 - DNA, 21 bp, Homo sapiens
gttattcaataactattgctg

SEQ ID NO: 524817 - DNA, 21 bp, Homo sapiens
gttcaatgctacaaaatgtgt

SEQ ID NO: 524818 - DNA, 14 bp, Homo sapiens
acaaagcatgctca

SEQ ID NO: 524819 - DNA, 22 bp, Homo sapiens
acaaatggcttgttcagtcact

SEQ ID NO: 524820 - DNA, 22 bp, Homo sapiens
acaacaatttaggaatgctcaa

SEQ ID NO: 524821 - DNA, 14 bp, Homo sapiens
acaataaaagacat

SEQ ID NO: 524822 - DNA, 21 bp, Homo sapiens
acaatgtggaattacataaca

SEQ ID NO: 524823 - DNA, 23 bp, Homo sapiens
acaatgtggaattacataacagg

SEQ ID NO: 524824 - DNA, 19 bp, Homo sapiens
acaattcaaagaatcacct

SEQ ID NO: 524825 - DNA, 20 bp, Homo sapiens
acaatttaggaatgctcaat

SEQ ID NO: 524826 - DNA, 16 bp, Homo sapiens
acacaaaacaacagca

SEQ ID NO: 524827 - DNA, 17 bp, Homo sapiens
acacaaaacaacagcaa

SEQ ID NO: 524828 - DNA, 15 bp, Homo sapiens
acacacacacacaaa

SEQ ID NO: 524829 - DNA, 20 bp, Homo sapiens
acacagaggacagcttcccc

SEQ ID NO: 524830 - DNA, 14 bp, Homo sapiens
acacataacacaca

SEQ ID NO: 524831 - DNA, 16 bp, Homo sapiens
acacataacacacatc

SEQ ID NO: 524832 - DNA, 16 bp, Homo sapiens
acaccaaattgctgag

SEQ ID NO: 524833 - DNA, 17 bp, Homo sapiens
acactcaccgagaggaa

SEQ ID NO: 524834 - DNA, 16 bp, Homo sapiens
acactgtcaagattaa

SEQ ID NO: 524835 - DNA, 18 bp, Homo sapiens
acactgtcaagattaagt

SEQ ID NO: 524836 - DNA, 18 bp, Homo sapiens
acacttgggctggcaccc

SEQ ID NO: 524837 - DNA, 15 bp, Homo sapiens
acagaacaacaacaa

SEQ ID NO: 524838 - DNA, 17 bp, Homo sapiens
acagaacaacaacaaag

SEQ ID NO: 524839 - DNA, 18 bp, Homo sapiens
acagcatttcagctgtga

SEQ ID NO: 524840 - DNA, 12 bp, Homo sapiens
acagcctgcaca

SEQ ID NO: 524841 - DNA, 13 bp, Homo sapiens
acagcctgcacag

SEQ ID NO: 524842 - DNA, 16 bp, Homo sapiens
acagcctgcacagtgg

SEQ ID NO: 524843 - DNA, 22 bp, Homo sapiens
acagcttccccatcgccttctg

SEQ ID NO: 524844 - DNA, 16 bp, Homo sapiens
acaggagcgtgtccta

SEQ ID NO: 524845 - DNA, 20 bp, Homo sapiens
acaggcaccatgctgggccg

SEQ ID NO: 524846 - DNA, 22 bp, Homo sapiens
acaggcattgcactaaaagtga

SEQ ID NO: 524847 - DNA, 17 bp, Homo sapiens
acagggacacagtctgg

SEQ ID NO: 524848 - DNA, 17 bp, Homo sapiens
acagtaaagaccattta

SEQ ID NO: 524849 - DNA, 13 bp, Homo sapiens
acagtaatcagtt

SEQ ID NO: 524850 - DNA, 18 bp, Homo sapiens
acagtagcatactgatga

SEQ ID NO: 524851 - DNA, 16 bp, Homo sapiens
acagtggtccagggtc

SEQ ID NO: 524852 - DNA, 12 bp, Homo sapiens
acataacacaca

SEQ ID NO: 524853 - DNA, 13 bp, Homo sapiens
acataacaggcat

SEQ ID NO: 524854 - DNA, 14 bp, Homo sapiens
acataacaggcatt

SEQ ID NO: 524855 - DNA, 22 bp, Homo sapiens
acatattcccatggtagactgt

SEQ ID NO: 524856 - DNA, 14 bp, Homo sapiens
acatgcctttccag

SEQ ID NO: 524857 - DNA, 12 bp, Homo sapiens
acattttgtagc

SEQ ID NO: 524858 - DNA, 15 bp, Homo sapiens
accaaattgctgaga

SEQ ID NO: 524859 - DNA, 13 bp, Homo sapiens
accaccatttccc

SEQ ID NO: 524860 - DNA, 13 bp, Homo sapiens
accacgcccctgc

SEQ ID NO: 524861 - DNA, 16 bp, Homo sapiens
accacgcccctgcctg

SEQ ID NO: 524862 - DNA, 20 bp, Homo sapiens
accacggtccaatccagcct

SEQ ID NO: 524863 - DNA, 17 bp, Homo sapiens
accagcttgcttctctg

SEQ ID NO: 524864 - DNA, 23 bp, Homo sapiens
accatcttgggattcctcccctg

SEQ ID NO: 524865 - DNA, 14 bp, Homo sapiens
accatgctgggccg

SEQ ID NO: 524866 - DNA, 19 bp, Homo sapiens
accattatggctttgtgct

SEQ ID NO: 524867 - DNA, 15 bp, Homo sapiens
accatttaatcattt

SEQ ID NO: 524868 - DNA, 22 bp, Homo sapiens
accatttcccctgtggtttgtt

SEQ ID NO: 524869 - DNA, 15 bp, Homo sapiens
accattttgaaatat

SEQ ID NO: 524870 - DNA, 11 bp, Homo sapiens
accccactgga

SEQ ID NO: 524871 - DNA, 22 bp, Homo sapiens
accccaggacgcatgcagggcc

SEQ ID NO: 524872 - DNA, 15 bp, Homo sapiens
accccgttgttgtcc

SEQ ID NO: 524873 - DNA, 18 bp, Homo sapiens
accccgttgttgtccctg

SEQ ID NO: 524874 - DNA, 20 bp, Homo sapiens
accccgttgttgtccctgca

SEQ ID NO: 524875 - DNA, 22 bp, Homo sapiens
accccgttgttgtccctgcagg

SEQ ID NO: 524876 - DNA, 21 bp, Homo sapiens
agcacagaggatggcttcccc

SEQ ID NO: 524877 - DNA, 22 bp, Homo sapiens
agcaccagcttgcttctctgcc

SEQ ID NO: 524878 - DNA, 21 bp, Homo sapiens
agcagtaaatgtatattgatg

SEQ ID NO: 524879 - DNA, 12 bp, Homo sapiens
agcatactgatg

SEQ ID NO: 524880 - DNA, 20 bp, Homo sapiens
agcatactgatgagacaaca

SEQ ID NO: 524881 - DNA, 11 bp, Homo sapiens
agcatatataa

SEQ ID NO: 524882 - DNA, 16 bp, Homo sapiens
agcatcgtgtgggtcc

SEQ ID NO: 524883 - DNA, 18 bp, Homo sapiens
agcatcgtgtgggtccct

SEQ ID NO: 524884 - DNA, 12 bp, Homo sapiens
agcatgtaatat

SEQ ID NO: 524885 - DNA, 17 bp, Homo sapiens
agcatgtaatattaaat

SEQ ID NO: 524886 - DNA, 15 bp, Homo sapiens
agcatgtcctatccc

SEQ ID NO: 524887 - DNA, 19 bp, Homo sapiens
agccacttatttccatgga

SEQ ID NO: 524888 - DNA, 15 bp, Homo sapiens
agccgtcagcctgtg

SEQ ID NO: 524889 - DNA, 15 bp, Homo sapiens
agcctgtgggtcctt

SEQ ID NO: 524890 - DNA, 20 bp, Homo sapiens
agcgcacctcgccgtgtctt

SEQ ID NO: 524891 - DNA, 19 bp, Homo sapiens
agcgtgtactaccccagaa

SEQ ID NO: 524892 - DNA, 12 bp, Homo sapiens
agcgtgtcctat

SEQ ID NO: 524893 - DNA, 15 bp, Homo sapiens
agcgtgtcctatccc

SEQ ID NO: 524894 - DNA, 18 bp, Homo sapiens
agctagttagagactcgc

SEQ ID NO: 524895 - DNA, 20 bp, Homo sapiens
agctagtttaaaattattaa

SEQ ID NO: 524896 - DNA, 12 bp, Homo sapiens
agctataaatag

SEQ ID NO: 524897 - DNA, 14 bp, Homo sapiens
agctcacacttggg

SEQ ID NO: 524898 - DNA, 22 bp, Homo sapiens
agctcacacttgggctggcacc

SEQ ID NO: 524899 - DNA, 16 bp, Homo sapiens
agctcaggccctggtg

SEQ ID NO: 524900 - DNA, 22 bp, Homo sapiens
agctccttcatgcttttctcat

SEQ ID NO: 524901 - DNA, 13 bp, Homo sapiens
agctcgtgtgctt

SEQ ID NO: 524902 - DNA, 14 bp, Homo sapiens
agctcgtgtgctta

SEQ ID NO: 524903 - DNA, 17 bp, Homo sapiens
agctcgtgtgcttagaa

SEQ ID NO: 524904 - DNA, 14 bp, Homo sapiens
agctgagctggcct

SEQ ID NO: 524905 - DNA, 19 bp, Homo sapiens
agctgataaagaaaccttt

SEQ ID NO: 524906 - DNA, 12 bp, Homo sapiens
agctgtgatttt

SEQ ID NO: 524907 - DNA, 13 bp, Homo sapiens
agctttcccagag

SEQ ID NO: 524908 - DNA, 12 bp, Homo sapiens
agctttcctggg

SEQ ID NO: 524909 - DNA, 23 bp, Homo sapiens
aggacctagtcggggggtggctg

SEQ ID NO: 524910 - DNA, 12 bp, Homo sapiens
aggacgcatgca

SEQ ID NO: 524911 - DNA, 14 bp, Homo sapiens
aggagaaggaggaa

SEQ ID NO: 524912 - DNA, 22 bp, Homo sapiens
aggagcatgtcctatccctgga

SEQ ID NO: 524913 - DNA, 14 bp, Homo sapiens
aggagcttggcaga

SEQ ID NO: 524914 - DNA, 14 bp, Homo sapiens
aggatgcatgcagg

SEQ ID NO: 524915 - DNA, 17 bp, Homo sapiens
aggcaccatgctgggcc

SEQ ID NO: 524916 - DNA, 12 bp, Homo sapiens
aggcagcctgtg

SEQ ID NO: 524917 - DNA, 19 bp, Homo sapiens
aggcattgcactaaaagtg

SEQ ID NO: 524918 - DNA, 21 bp, Homo sapiens
aggcattgcactaaaagtgat

SEQ ID NO: 524919 - DNA, 12 bp, Homo sapiens
ataacattgtaa

SEQ ID NO: 524920 - DNA, 13 bp, Homo sapiens
ataacattgtaaa

SEQ ID NO: 524921 - DNA, 13 bp, Homo sapiens
ataactattgctg

SEQ ID NO: 524922 - DNA, 13 bp, Homo sapiens
ataatataaatga

SEQ ID NO: 524923 - DNA, 15 bp, Homo sapiens
ataatataaatgaat

SEQ ID NO: 524924 - DNA, 21 bp, Homo sapiens
ataatcatccttttttaaaaa

SEQ ID NO: 524925 - DNA, 17 bp, Homo sapiens
ataatggcctcttaaaa

SEQ ID NO: 524926 - DNA, 12 bp, Homo sapiens
ataattaaaaca

SEQ ID NO: 524927 - DNA, 14 bp, Homo sapiens
ataattaaaacaaa

SEQ ID NO: 524928 - DNA, 16 bp, Homo sapiens
atacatgatgatttca

SEQ ID NO: 524929 - DNA, 15 bp, Homo sapiens
ataccagcaaaagtg

SEQ ID NO: 524930 - DNA, 17 bp, Homo sapiens
ataccagcaaaagtgca

SEQ ID NO: 524931 - DNA, 17 bp, Homo sapiens
ataccattttgaaatat

SEQ ID NO: 524932 - DNA, 13 bp, Homo sapiens
atactgatgagac

SEQ ID NO: 524933 - DNA, 18 bp, Homo sapiens
atactgatgagacaacac

SEQ ID NO: 524934 - DNA, 22 bp, Homo sapiens
atactgatgagacaacacacac

SEQ ID NO: 524935 - DNA, 16 bp, Homo sapiens
atactttgtgtctttt

SEQ ID NO: 524936 - DNA, 23 bp, Homo sapiens
atactttgtgtcttttgttctct

SEQ ID NO: 524937 - DNA, 22 bp, Homo sapiens
atagataccattttgaaatatt

SEQ ID NO: 524938 - DNA, 17 bp, Homo sapiens
atagcctcaccttccct

SEQ ID NO: 524939 - DNA, 18 bp, Homo sapiens
atagctataaatagtgaa

SEQ ID NO: 524940 - DNA, 12 bp, Homo sapiens
atagtgaaaatt

SEQ ID NO: 524941 - DNA, 17 bp, Homo sapiens
atagtggtcatttggtg

SEQ ID NO: 524942 - DNA, 13 bp, Homo sapiens
atataaaaataat

SEQ ID NO: 524943 - DNA, 20 bp, Homo sapiens
atataaaaataattaaaaca

SEQ ID NO: 524944 - DNA, 15 bp, Homo sapiens
atataaatgaatgaa

SEQ ID NO: 524945 - DNA, 21 bp, Homo sapiens
atataatggcctcttaaaaat

SEQ ID NO: 524946 - DNA, 18 bp, Homo sapiens
atatattttgaaaggaga

SEQ ID NO: 524947 - DNA, 13 bp, Homo sapiens
atatcattatagc

SEQ ID NO: 524948 - DNA, 18 bp, Homo sapiens
atatcattatagcatgta

SEQ ID NO: 524949 - DNA, 22 bp, Homo sapiens
atatgagattggaaaaaattag

SEQ ID NO: 524950 - DNA, 21 bp, Homo sapiens
atatgtttggctgaaattatg

SEQ ID NO: 524951 - DNA, 13 bp, Homo sapiens
atattatatcaga

SEQ ID NO: 524952 - DNA, 21 bp, Homo sapiens
atattgacaagtttaaaggct

SEQ ID NO: 524953 - DNA, 13 bp, Homo sapiens
atatttaaagtct

SEQ ID NO: 524954 - DNA, 13 bp, Homo sapiens
atcaagtctgtga

SEQ ID NO: 524955 - DNA, 14 bp, Homo sapiens
atcaagtctgtgaa

SEQ ID NO: 524956 - DNA, 23 bp, Homo sapiens
atcaatgttcacgcaacttgaaa

SEQ ID NO: 524957 - DNA, 22 bp, Homo sapiens
atcaggaaaggaagatgtaaga

SEQ ID NO: 524958 - DNA, 13 bp, Homo sapiens
atcagtacaattc

SEQ ID NO: 524959 - DNA, 14 bp, Homo sapiens
atcagtacaattct

SEQ ID NO: 524960 - DNA, 13 bp, Homo sapiens
atcatgtgtttct

SEQ ID NO: 524961 - DNA, 17 bp, Homo sapiens
atcatgtgtttctgtgt

SEQ ID NO: 524962 - DNA, 21 bp, Homo sapiens
gatccagcggggcttctgggc

SEQ ID NO: 524963 - DNA, 22 bp, Homo sapiens
gatccccatggaacagccctgc

SEQ ID NO: 524964 - DNA, 14 bp, Homo sapiens
gatgagacaacaca

SEQ ID NO: 524965 - DNA, 16 bp, Homo sapiens
gatgagacaacacaca

SEQ ID NO: 524966 - DNA, 12 bp, Homo sapiens
gatgatttcaga

SEQ ID NO: 524967 - DNA, 14 bp, Homo sapiens
gatgccgtgcgggc

SEQ ID NO: 524968 - DNA, 14 bp, Homo sapiens
gatggatttgacac

SEQ ID NO: 524969 - DNA, 12 bp, Homo sapiens
gatggccaggcc

SEQ ID NO: 524970 - DNA, 19 bp, Homo sapiens
gatgtggatggaggtgatg

SEQ ID NO: 524971 - DNA, 14 bp, Homo sapiens
gattagacaatgtg

SEQ ID NO: 524972 - DNA, 19 bp, Homo sapiens
gattcccgtggctttgtgc

SEQ ID NO: 524973 - DNA, 22 bp, Homo sapiens
gattcccgtggctttgtgctta

SEQ ID NO: 524974 - DNA, 12 bp, Homo sapiens
gattgacatttt

SEQ ID NO: 524975 - DNA, 18 bp, Homo sapiens
gattgacattttgtagct

SEQ ID NO: 524976 - DNA, 19 bp, Homo sapiens
gatttcatgattagacaat

SEQ ID NO: 524977 - DNA, 22 bp, Homo sapiens
gcaaatttctagatatgagaaa

SEQ ID NO: 524978 - DNA, 18 bp, Homo sapiens
gcaacaacaacagaacaa

SEQ ID NO: 524979 - DNA, 15 bp, Homo sapiens
gcaacttgaaattat

SEQ ID NO: 524980 - DNA, 22 bp, Homo sapiens
gcaagatagctccttcatgctt

SEQ ID NO: 524981 - DNA, 12 bp, Homo sapiens
gcaaggggctgc

SEQ ID NO: 524982 - DNA, 22 bp, Homo sapiens
gcaaggggctgcttctggggct

SEQ ID NO: 524983 - DNA, 21 bp, Homo sapiens
gcaataaactcagtcaaatgt

SEQ ID NO: 524984 - DNA, 17 bp, Homo sapiens
gcaatcttgctgtgaaa

SEQ ID NO: 524985 - DNA, 19 bp, Homo sapiens
gcacacacacgcaaataca

SEQ ID NO: 524986 - DNA, 18 bp, Homo sapiens
gcacaccaaattgctgag

SEQ ID NO: 524987 - DNA, 23 bp, Homo sapiens
gcacacctcggccgaggcctgcg

SEQ ID NO: 524988 - DNA, 14 bp, Homo sapiens
gcaccatgctgggc

SEQ ID NO: 524989 - DNA, 16 bp, Homo sapiens
gcaccatgctgggccg

SEQ ID NO: 524990 - DNA, 12 bp, Homo sapiens
gcacccactgga

SEQ ID NO: 524991 - DNA, 22 bp, Homo sapiens
gcacccgtctgggaatcctgga

SEQ ID NO: 524992 - DNA, 19 bp, Homo sapiens
gcactcttttgagcagtaa

SEQ ID NO: 524993 - DNA, 20 bp, Homo sapiens
gcactgccctccgcccttcc

SEQ ID NO: 524994 - DNA, 22 bp, Homo sapiens
gcagctgcagttagcacagagg

SEQ ID NO: 524995 - DNA, 15 bp, Homo sapiens
gcaggagcttggcag

SEQ ID NO: 524996 - DNA, 15 bp, Homo sapiens
gcaggcagcctgcag

SEQ ID NO: 524997 - DNA, 16 bp, Homo sapiens
gcagtcagcacagaga

SEQ ID NO: 524998 - DNA, 19 bp, Homo sapiens
gcagtcagcacagagagcg

SEQ ID NO: 524999 - DNA, 14 bp, Homo sapiens
gcagtcatcagaag

SEQ ID NO: 525000 - DNA, 15 bp, Homo sapiens
gcagtgatgtggtgg

SEQ ID NO: 525001 - DNA, 16 bp, Homo sapiens
gcagttagcacagagg

SEQ ID NO: 525002 - DNA, 19 bp, Homo sapiens
gcatactgatgagacaaca

SEQ ID NO: 525003 - DNA, 21 bp, Homo sapiens
gcatactgatgagacaacaca

SEQ ID NO: 525004 - DNA, 18 bp, Homo sapiens
gcatccgctgcgctccca

SEQ ID NO: 525005 - DNA, 13 bp, Homo sapiens
gcatctggcctgg

SEQ ID NO: 525006 - DNA, 16 bp, Homo sapiens
gcatctggcctggggg

SEQ ID NO: 525007 - DNA, 16 bp, Homo sapiens
gcatgctcagtattga

SEQ ID NO: 525008 - DNA, 18 bp, Homo sapiens
gcatgtcctatccctgga

SEQ ID NO: 525009 - DNA, 14 bp, Homo sapiens
gcattgcactaaaa

SEQ ID NO: 525010 - DNA, 23 bp, Homo sapiens
gcattgcactaaaagtgatgtga

SEQ ID NO: 525011 - DNA, 14 bp, Homo sapiens
gcatttatgcatga

SEQ ID NO: 525012 - DNA, 22 bp, Homo sapiens
gcatttatgcatgagaactaaa

SEQ ID NO: 525013 - DNA, 14 bp, Homo sapiens
gcatttcagctgtg

SEQ ID NO: 525014 - DNA, 13 bp, Homo sapiens
gccaagtgtcctg

SEQ ID NO: 525015 - DNA, 15 bp, Homo sapiens
gccaagtgtcctgct

SEQ ID NO: 525016 - DNA, 14 bp, Homo sapiens
gccaatgtccaggt

SEQ ID NO: 525017 - DNA, 17 bp, Homo sapiens
gccactcaggcagcctg

SEQ ID NO: 525018 - DNA, 16 bp, Homo sapiens
gccacttatttccatg

SEQ ID NO: 525019 - DNA, 22 bp, Homo sapiens
gccagcgctgaacagaccgggg

SEQ ID NO: 525020 - DNA, 19 bp, Homo sapiens
gccatttcacattcctgac

SEQ ID NO: 525021 - DNA, 21 bp, Homo sapiens
gccatttcacattcctgaccc

SEQ ID NO: 525022 - DNA, 12 bp, Homo sapiens
gcccccactgga

SEQ ID NO: 525023 - DNA, 14 bp, Homo sapiens
gcccccatgcaggc

SEQ ID NO: 525024 - DNA, 14 bp, Homo sapiens
gccccccatgccct

SEQ ID NO: 525025 - DNA, 16 bp, Homo sapiens
gccccccatgccctcc

SEQ ID NO: 525026 - DNA, 21 bp, Homo sapiens
gccccccatgccctccctgct

SEQ ID NO: 525027 - DNA, 15 bp, Homo sapiens
gcccctgcctgagac

SEQ ID NO: 525028 - DNA, 22 bp, Homo sapiens
gcccgtggtgaggttgtgctgc

SEQ ID NO: 525029 - DNA, 13 bp, Homo sapiens
gccctccctgctg

SEQ ID NO: 525030 - DNA, 16 bp, Homo sapiens
gccctccgccagccct

SEQ ID NO: 525031 - DNA, 13 bp, Homo sapiens
gccctctgccact

SEQ ID NO: 525032 - DNA, 18 bp, Homo sapiens
gccctctgccactgacag

SEQ ID NO: 525033 - DNA, 21 bp, Homo sapiens
gccctgacatgctaacctctc

SEQ ID NO: 525034 - DNA, 15 bp, Homo sapiens
gcccttcccaacctc

SEQ ID NO: 525035 - DNA, 18 bp, Homo sapiens
gcccttcccaacctcccc

SEQ ID NO: 525036 - DNA, 16 bp, Homo sapiens
gccggggtgtggaatc

SEQ ID NO: 525037 - DNA, 13 bp, Homo sapiens
gccgtcagcctgt

SEQ ID NO: 525038 - DNA, 21 bp, Homo sapiens
gccgtctttggttcctcatgg

SEQ ID NO: 525039 - DNA, 15 bp, Homo sapiens
gccgtgcagggccag

SEQ ID NO: 525040 - DNA, 22 bp, Homo sapiens
gcctcactgatatattttccag

SEQ ID NO: 525041 - DNA, 19 bp, Homo sapiens
gcctcactgggtgtggcct

SEQ ID NO: 525042 - DNA, 21 bp, Homo sapiens
gcctcagggaccaaggagatg

SEQ ID NO: 525043 - DNA, 22 bp, Homo sapiens
gcctcttaaaaattatctttaa

SEQ ID NO: 525044 - DNA, 22 bp, Homo sapiens
gcctggaggagaaggaggaacc

SEQ ID NO: 525045 - DNA, 13 bp, Homo sapiens
ctgaatctctcaa

SEQ ID NO: 525046 - DNA, 17 bp, Homo sapiens
ctgaatctctcaaaatg

SEQ ID NO: 525047 - DNA, 18 bp, Homo sapiens
ctgaatctctcaaaatgt

SEQ ID NO: 525048 - DNA, 20 bp, Homo sapiens
ctgaatctctcaaaatgtgc

SEQ ID NO: 525049 - DNA, 13 bp, Homo sapiens
ctgacatgctaac

SEQ ID NO: 525050 - DNA, 11 bp, Homo sapiens
ctgagaccacg

SEQ ID NO: 525051 - DNA, 21 bp, Homo sapiens
ctgagagggtgtgggtgccct

SEQ ID NO: 525052 - DNA, 17 bp, Homo sapiens
ctgagatgggaggatca

SEQ ID NO: 525053 - DNA, 21 bp, Homo sapiens
ctgaggctgccccaggggcac

SEQ ID NO: 525054 - DNA, 12 bp, Homo sapiens
ctgagggccctt

SEQ ID NO: 525055 - DNA, 16 bp, Homo sapiens
ctgagggcccttccca

SEQ ID NO: 525056 - DNA, 18 bp, Homo sapiens
ctgagtaaacagatattt

SEQ ID NO: 525057 - DNA, 13 bp, Homo sapiens
ctgagtggctcgt

SEQ ID NO: 525058 - DNA, 17 bp, Homo sapiens
ctgataaagaaaccttt

SEQ ID NO: 525059 - DNA, 20 bp, Homo sapiens
ctgatatctgtttgcttcta

SEQ ID NO: 525060 - DNA, 22 bp, Homo sapiens
ctgatatctgtttgcttctaaa

SEQ ID NO: 525061 - DNA, 13 bp, Homo sapiens
ctgatcctctctt

SEQ ID NO: 525062 - DNA, 14 bp, Homo sapiens
ctgatttattctgg

SEQ ID NO: 525063 - DNA, 14 bp, Homo sapiens
ctgcacctgcttct

SEQ ID NO: 525064 - DNA, 15 bp, Homo sapiens
ctgcacctgcttctc

SEQ ID NO: 525065 - DNA, 14 bp, Homo sapiens
ctgcacgcccagga

SEQ ID NO: 525066 - DNA, 12 bp, Homo sapiens
ctgcactgccct

SEQ ID NO: 525067 - DNA, 15 bp, Homo sapiens
ctgcactgccctccg

SEQ ID NO: 525068 - DNA, 14 bp, Homo sapiens
cttctggggctccc

SEQ ID NO: 525069 - DNA, 14 bp, Homo sapiens
cttctgtgcatctg

SEQ ID NO: 525070 - DNA, 19 bp, Homo sapiens
cttctttactaacactggc

SEQ ID NO: 525071 - DNA, 17 bp, Homo sapiens
cttgaaaccagctcagg

SEQ ID NO: 525072 - DNA, 20 bp, Homo sapiens
cttgaaattatatctgtggt

SEQ ID NO: 525073 - DNA, 19 bp, Homo sapiens
cttgagtttcatttttcat

SEQ ID NO: 525074 - DNA, 13 bp, Homo sapiens
cttgcagcagaga

SEQ ID NO: 525075 - DNA, 15 bp, Homo sapiens
cttgcagtcatcaga

SEQ ID NO: 525076 - DNA, 16 bp, Homo sapiens
cttgcagtcatcagaa

SEQ ID NO: 525077 - DNA, 13 bp, Homo sapiens
cttggtccttaaa

SEQ ID NO: 525078 - DNA, 19 bp, Homo sapiens
cttggtctctttctttcca

SEQ ID NO: 525079 - DNA, 19 bp, Homo sapiens
cttgtaaaactgtgacatt

SEQ ID NO: 525080 - DNA, 12 bp, Homo sapiens
cttgttcttcct

SEQ ID NO: 525081 - DNA, 16 bp, Homo sapiens
ctttaaaacttactat

SEQ ID NO: 525082 - DNA, 23 bp, Homo sapiens
ctttaaaatgattcacttttatt

SEQ ID NO: 525083 - DNA, 14 bp, Homo sapiens
ctttcaatccacag

SEQ ID NO: 525084 - DNA, 16 bp, Homo sapiens
ctttcaatccacagta

SEQ ID NO: 525085 - DNA, 20 bp, Homo sapiens
ctttcaatccacagtattgt

SEQ ID NO: 525086 - DNA, 15 bp, Homo sapiens
ctttccaaaggttgt

SEQ ID NO: 525087 - DNA, 15 bp, Homo sapiens
ctttccagtgctgct

SEQ ID NO: 525088 - DNA, 16 bp, Homo sapiens
ctttccagtgctgctc

SEQ ID NO: 525089 - DNA, 12 bp, Homo sapiens
ctttccatgaca

SEQ ID NO: 525090 - DNA, 19 bp, Homo sapiens
ctttccatgacagtagcat

SEQ ID NO: 525091 - DNA, 14 bp, Homo sapiens
ctttctccaaagtt

SEQ ID NO: 525092 - DNA, 15 bp, Homo sapiens
ctttctccaaagtta

SEQ ID NO: 525093 - DNA, 23 bp, Homo sapiens
ctttctccaaagttatccagagg

SEQ ID NO: 525094 - DNA, 19 bp, Homo sapiens
ctttctttccaaaggttgt

SEQ ID NO: 525095 - DNA, 17 bp, Homo sapiens
ctttgagtgtcaggctc

SEQ ID NO: 525096 - DNA, 20 bp, Homo sapiens
ctttgagtgtcaggctctga

SEQ ID NO: 525097 - DNA, 18 bp, Homo sapiens
cttttaaaaaaataatat

SEQ ID NO: 525098 - DNA, 18 bp, Homo sapiens
cttttattcattagctgt

SEQ ID NO: 525099 - DNA, 15 bp, Homo sapiens
cttttgagcagtaaa

SEQ ID NO: 525100 - DNA, 13 bp, Homo sapiens
cttttgatggcta

SEQ ID NO: 525101 - DNA, 15 bp, Homo sapiens
cttttgggaaatgct

SEQ ID NO: 525102 - DNA, 14 bp, Homo sapiens
cttttgtatcctcc

SEQ ID NO: 525103 - DNA, 12 bp, Homo sapiens
cttttgttctct

SEQ ID NO: 525104 - DNA, 17 bp, Homo sapiens
cttttttcctgtcaata

SEQ ID NO: 525105 - DNA, 19 bp, Homo sapiens
cttttttcctgtcaatata

SEQ ID NO: 525106 - DNA, 15 bp, Homo sapiens
gaaatataaactgtg

SEQ ID NO: 525107 - DNA, 13 bp, Homo sapiens
gaaattatgtcaa

SEQ ID NO: 525108 - DNA, 15 bp, Homo sapiens
gaaattttatctctt

SEQ ID NO: 525109 - DNA, 16 bp, Homo sapiens
gaaattttatctcttc

SEQ ID NO: 525110 - DNA, 13 bp, Homo sapiens
gaacgcatgcagg

SEQ ID NO: 525111 - DNA, 14 bp, Homo sapiens
gaacgcatgcaggg

SEQ ID NO: 525112 - DNA, 16 bp, Homo sapiens
gaactcagctgtctgt

SEQ ID NO: 525113 - DNA, 20 bp, Homo sapiens
gaactcagctgtctgtggct

SEQ ID NO: 525114 - DNA, 19 bp, Homo sapiens
gaagagagatatatctgaa

SEQ ID NO: 525115 - DNA, 14 bp, Homo sapiens
gaagagtatggatt

SEQ ID NO: 525116 - DNA, 14 bp, Homo sapiens
gaagcaaataaata

SEQ ID NO: 525117 - DNA, 15 bp, Homo sapiens
gaagctcaaggctgc

SEQ ID NO: 525118 - DNA, 23 bp, Homo sapiens
gaatcacctaattaatttcagta

SEQ ID NO: 525119 - DNA, 22 bp, Homo sapiens
gaatgaaatataaactgtgaga

SEQ ID NO: 525120 - DNA, 23 bp, Homo sapiens
gaatgaaatataaactgtgagat

SEQ ID NO: 525121 - DNA, 20 bp, Homo sapiens
gaattattagcaccagcttg

SEQ ID NO: 525122 - DNA, 18 bp, Homo sapiens
gaattttatttctctcag

SEQ ID NO: 525123 - DNA, 22 bp, Homo sapiens
gacacactcaccatttaatcat

SEQ ID NO: 525124 - DNA, 20 bp, Homo sapiens
gacagctccgcgctcggggc

SEQ ID NO: 525125 - DNA, 23 bp, Homo sapiens
gacagctccgcgctcggggctgg

SEQ ID NO: 525126 - DNA, 12 bp, Homo sapiens
gacagcttcccc

SEQ ID NO: 525127 - DNA, 14 bp, Homo sapiens
gacattttgtagct

SEQ ID NO: 525128 - DNA, 21 bp, Homo sapiens
gaccaacgatcctatgagaga

SEQ ID NO: 525129 - DNA, 18 bp, Homo sapiens
gaccaagggctgacttct

SEQ ID NO: 525130 - DNA, 20 bp, Homo sapiens
gaccacactctgcctggcct

SEQ ID NO: 525131 - DNA, 16 bp, Homo sapiens
gacccctttgccttcc

SEQ ID NO: 525132 - DNA, 20 bp, Homo sapiens
gacctccctgtctctacaaa

SEQ ID NO: 525133 - DNA, 22 bp, Homo sapiens
gaccttctgcggctccgggctg

SEQ ID NO: 525134 - DNA, 20 bp, Homo sapiens
gacggcttccccatcgcctt

SEQ ID NO: 525135 - DNA, 19 bp, Homo sapiens
gacttctttactaacactg

SEQ ID NO: 525136 - DNA, 24 bp, Homo sapiens
gagaaaaaaaaagccactaaggtc

SEQ ID NO: 525137 - DNA, 18 bp, Homo sapiens
gagacttctaaatcataa

SEQ ID NO: 525138 - DNA, 15 bp, Homo sapiens
gagagaacagggatg

SEQ ID NO: 525139 - DNA, 22 bp, Homo sapiens
gagagagcaatcttgctgtgaa

SEQ ID NO: 525140 - DNA, 18 bp, Homo sapiens
gagagatatatctgaaaa

SEQ ID NO: 525141 - DNA, 18 bp, Homo sapiens
gagatatatctgaaaact

SEQ ID NO: 525142 - DNA, 19 bp, Homo sapiens
gagattggaaaaaattaga

SEQ ID NO: 525143 - DNA, 21 bp, Homo sapiens
gagccaataaagctcacactt

SEQ ID NO: 525144 - DNA, 21 bp, Homo sapiens
gagccctgccgaggtgtggct

SEQ ID NO: 525145 - DNA, 22 bp, Homo sapiens
gagccgtgacctccaggaaggg

SEQ ID NO: 525146 - DNA, 16 bp, Homo sapiens
gagcgcacctcgccgt

SEQ ID NO: 525147 - DNA, 17 bp, Homo sapiens
tgaggacataaatcttc

SEQ ID NO: 525148 - DNA, 22 bp, Homo sapiens
tgaggtcagggttttagagagc

SEQ ID NO: 525149 - DNA, 21 bp, Homo sapiens
tgaggtcttgagtttcatttt

SEQ ID NO: 525150 - DNA, 22 bp, Homo sapiens
tgagtgtacatttatgtgtgaa

SEQ ID NO: 525151 - DNA, 14 bp, Homo sapiens
tgatatgtctttaa

SEQ ID NO: 525152 - DNA, 19 bp, Homo sapiens
tgatgagacaacacacaca

SEQ ID NO: 525153 - DNA, 14 bp, Homo sapiens
tgatgccgtgcggg

SEQ ID NO: 525154 - DNA, 15 bp, Homo sapiens
tgatggaagggcctt

SEQ ID NO: 525155 - DNA, 21 bp, Homo sapiens
tggcttctgggacaggcacca

SEQ ID NO: 525156 - DNA, 12 bp, Homo sapiens
tggctttgtgct

SEQ ID NO: 525157 - DNA, 23 bp, Homo sapiens
tgggaaatgctgatttaaacttc

SEQ ID NO: 525158 - DNA, 23 bp, Homo sapiens
tgggaaattgctccattcctgag

SEQ ID NO: 525159 - DNA, 16 bp, Homo sapiens
tgggattcctcccctg

SEQ ID NO: 525160 - DNA, 17 bp, Homo sapiens
tgggcgggccatttcac

SEQ ID NO: 525161 - DNA, 14 bp, Homo sapiens
tgggctggcaccca

SEQ ID NO: 525162 - DNA, 15 bp, Homo sapiens
tgggctggcacccac

SEQ ID NO: 525163 - DNA, 19 bp, Homo sapiens
tgggctggcacccactgga

SEQ ID NO: 525164 - DNA, 18 bp, Homo sapiens
tggggagggacacagagg

SEQ ID NO: 525165 - DNA, 11 bp, Homo sapiens
tgggggctgct

SEQ ID NO: 525166 - DNA, 23 bp, Homo sapiens
tgggtccctaagcacaataaaag

SEQ ID NO: 525167 - DNA, 11 bp, Homo sapiens
tgggtgccctg

SEQ ID NO: 525168 - DNA, 18 bp, Homo sapiens
tggtcatttggtggctct

SEQ ID NO: 525169 - DNA, 21 bp, Homo sapiens
tggtcatttggtggctctaac

SEQ ID NO: 525170 - DNA, 13 bp, Homo sapiens
tggtctctttctt

SEQ ID NO: 525171 - DNA, 19 bp, Homo sapiens
tggtcttcaaattgtcttt

SEQ ID NO: 525172 - DNA, 22 bp, Homo sapiens
tggtgcccagactcaaggcctc

SEQ ID NO: 525173 - DNA, 21 bp, Homo sapiens
tggtgggagcacagctttcct

SEQ ID NO: 525174 - DNA, 16 bp, Homo sapiens
tgtaaaactgtgacat

SEQ ID NO: 525175 - DNA, 17 bp, Homo sapiens
tgtaaataaaaatagct

SEQ ID NO: 525176 - DNA, 21 bp, Homo sapiens
tgtaaatgatatgtctttaaa

SEQ ID NO: 525177 - DNA, 22 bp, Homo sapiens
tgtaaatgatatgtctttaaaa

SEQ ID NO: 525178 - DNA, 17 bp, Homo sapiens
tgtaatattaaattcct

SEQ ID NO: 525179 - DNA, 20 bp, Homo sapiens
tgtaatcacactctcttctt

SEQ ID NO: 525180 - DNA, 16 bp, Homo sapiens
tgtacatagtggtcat

SEQ ID NO: 525181 - DNA, 23 bp, Homo sapiens
tgtacatagtggtcatttggtgg

SEQ ID NO: 525182 - DNA, 13 bp, Homo sapiens
tgtactaccccag

SEQ ID NO: 525183 - DNA, 21 bp, Homo sapiens
tgtagggaacggcctgagagg

SEQ ID NO: 525184 - DNA, 19 bp, Homo sapiens
tgtatcctccattgtatct

SEQ ID NO: 525185 - DNA, 19 bp, Homo sapiens
tgtcaaatggatgtaatat

SEQ ID NO: 525186 - DNA, 15 bp, Homo sapiens
tgtcacttttttcct

SEQ ID NO: 525187 - DNA, 19 bp, Homo sapiens
tgtcacttttttcctgtca

SEQ ID NO: 525188 - DNA, 21 bp, Homo sapiens
tgtcacttttttcctgtcaat

SEQ ID NO: 525189 - DNA, 22 bp, Homo sapiens
tgtcacttttttcctgtcaata

SEQ ID NO: 525190 - DNA, 14 bp, Homo sapiens
tgtcagcttcccaa

SEQ ID NO: 525191 - DNA, 15 bp, Homo sapiens
tgtcagtttgtgaag

SEQ ID NO: 525192 - DNA, 16 bp, Homo sapiens
tgtcatctgtcagctt

SEQ ID NO: 525193 - DNA, 15 bp, Homo sapiens
tgtccctgtgggctc

SEQ ID NO: 525194 - DNA, 16 bp, Homo sapiens
tgtcctaaatgcaaag

SEQ ID NO: 525195 - DNA, 15 bp, Homo sapiens
tgtcctatccctgga

SEQ ID NO: 525196 - DNA, 12 bp, Homo sapiens
tgtcctgtgtca

SEQ ID NO: 525197 - DNA, 23 bp, Homo sapiens
tgtctgcttagtatctcatcaac

SEQ ID NO: 525198 - DNA, 14 bp, Homo sapiens
tgtctttatgattt

SEQ ID NO: 525199 - DNA, 17 bp, Homo sapiens
tgtctttctccaaagtt

SEQ ID NO: 525200 - DNA, 13 bp, Homo sapiens
tgtcttttgtcat

SEQ ID NO: 525201 - DNA, 15 bp, Homo sapiens
tgtgaaagtctcctg

SEQ ID NO: 525202 - DNA, 16 bp, Homo sapiens
tgtgaagtgattgaca

SEQ ID NO: 525203 - DNA, 19 bp, Homo sapiens
tgtgaagtgattgacattt

SEQ ID NO: 525204 - DNA, 14 bp, Homo sapiens
tgtgacattccaca

SEQ ID NO: 525205 - DNA, 15 bp, Homo sapiens
tgtgacattccacag

SEQ ID NO: 525206 - DNA, 12 bp, Homo sapiens
tgtgagataaat

SEQ ID NO: 525207 - DNA, 14 bp, Homo sapiens
tgtgagataaatat

SEQ ID NO: 525208 - DNA, 19 bp, Homo sapiens
tgtgaggatgtggatggag

SEQ ID NO: 525209 - DNA, 15 bp, Homo sapiens
tgtgatttatgcatt

SEQ ID NO: 525210 - DNA, 16 bp, Homo sapiens
tgtgcatctggcctgg

SEQ ID NO: 525211 - DNA, 16 bp, Homo sapiens
tgtgcccgtggtgagg

SEQ ID NO: 525212 - DNA, 16 bp, Homo sapiens
tgtgctcatcagaaac

SEQ ID NO: 525213 - DNA, 19 bp, Homo sapiens
tgtgctgttgattctttca

SEQ ID NO: 525214 - DNA, 17 bp, Homo sapiens
tgtggaattacataaca

SEQ ID NO: 525215 - DNA, 23 bp, Homo sapiens
tgtggaattacataacaggcatt

SEQ ID NO: 525216 - DNA, 23 bp, Homo sapiens
tgtggatggaggtgatgaaaacc

SEQ ID NO: 525217 - DNA, 21 bp, Homo sapiens
tgtggctaaatgcctaataaa

SEQ ID NO: 525218 - DNA, 16 bp, Homo sapiens
tgtgggtccctaagca

SEQ ID NO: 525219 - DNA, 23 bp, Homo sapiens
tgtggtgaggtcctgtcctggct

SEQ ID NO: 525220 - DNA, 16 bp, Homo sapiens
tgtgtcatctgtcagc

SEQ ID NO: 525221 - DNA, 16 bp, Homo sapiens
tgtgtctccagctgat

SEQ ID NO: 525222 - DNA, 17 bp, Homo sapiens
tgtgtcttttgttctct

SEQ ID NO: 525223 - DNA, 18 bp, Homo sapiens
tgtgtttgaattgatttt

SEQ ID NO: 525224 - DNA, 22 bp, Homo sapiens
tgttaataaagtgcactgccac

SEQ ID NO: 525225 - DNA, 19 bp, Homo sapiens
tgttattcaataactattg

SEQ ID NO: 525226 - DNA, 20 bp, Homo sapiens
tgttattcaataactattgc

SEQ ID NO: 525227 - DNA, 21 bp, Homo sapiens
tgttattcaataactattgct

SEQ ID NO: 525228 - DNA, 17 bp, Homo sapiens
tgttcacgcaacttgaa

SEQ ID NO: 525229 - DNA, 14 bp, Homo sapiens
tgttcagtcacttg

SEQ ID NO: 525230 - DNA, 16 bp, Homo sapiens
tgttctcctccaaatg

SEQ ID NO: 525231 - DNA, 20 bp, Homo sapiens
tgttctctcttggtctcttt

SEQ ID NO: 525232 - DNA, 16 bp, Homo sapiens
tgttcttgcagcagag

SEQ ID NO: 525233 - DNA, 14 bp, Homo sapiens
tgttgacctaccct

SEQ ID NO: 525234 - DNA, 15 bp, Homo sapiens
tgttgacctaccctg

SEQ ID NO: 525235 - DNA, 14 bp, Homo sapiens
tgttgattctttca

SEQ ID NO: 525236 - DNA, 15 bp, Homo sapiens
tgttgattctttcaa

SEQ ID NO: 525237 - DNA, 20 bp, Homo sapiens
tgttgcttaatctagagcta

SEQ ID NO: 525238 - DNA, 13 bp, Homo sapiens
tgttgtccctgca

SEQ ID NO: 525239 - DNA, 16 bp, Homo sapiens
tgttgtcctgtgtcat

SEQ ID NO: 525240 - DNA, 21 bp, Homo sapiens
tgttgtcctgtgtcatctgtc

SEQ ID NO: 525241 - DNA, 16 bp, Homo sapiens
tgtttagtagctgata

SEQ ID NO: 525242 - DNA, 22 bp, Homo sapiens
tgtttagtagctgataaagaaa

SEQ ID NO: 525243 - DNA, 15 bp, Homo sapiens
tgtttcaccagtttc

SEQ ID NO: 525244 - DNA, 22 bp, Homo sapiens
tgttttgtgcggtgtgtctcca

SEQ ID NO: 525245 - DNA, 19 bp, Homo sapiens
ttaaaaaaataatataaat

SEQ ID NO: 525246 - DNA, 15 bp, Homo sapiens
ttaaaaaagatggat

SEQ ID NO: 525247 - DNA, 14 bp, Homo sapiens
ttaaaacttcatct

SEQ ID NO: 525248 - DNA, 19 bp, Homo sapiens
ttaaacaaaaactttccat

SEQ ID NO: 525249 - DNA, 12 bp, Homo sapiens
ttaaatgaaata

SEQ ID NO: 525250 - DNA, 22 bp, Homo sapiens
taatctagagctatgcacacca

SEQ ID NO: 525251 - DNA, 23 bp, Homo sapiens
taatgagccaataaagctcacac

SEQ ID NO: 525252 - DNA, 15 bp, Homo sapiens
taattaaaaagttaa

SEQ ID NO: 525253 - DNA, 18 bp, Homo sapiens
taattaaaaagttaatct

SEQ ID NO: 525254 - DNA, 12 bp, Homo sapiens
taattaaatgaa

SEQ ID NO: 525255 - DNA, 18 bp, Homo sapiens
taattaaatgaaatactt

SEQ ID NO: 525256 - DNA, 11 bp, Homo sapiens
taattaatttc

SEQ ID NO: 525257 - DNA, 13 bp, Homo sapiens
taattaatttcag

SEQ ID NO: 525258 - DNA, 14 bp, Homo sapiens
taattaatttcagt

SEQ ID NO: 525259 - DNA, 23 bp, Homo sapiens
taattctcagaagtgaaaaagac

SEQ ID NO: 525260 - DNA, 22 bp, Homo sapiens
tcagaaacaaagcatttgactt

SEQ ID NO: 525261 - DNA, 22 bp, Homo sapiens
tcaggaaaggaagatgtaagaa

SEQ ID NO: 525262 - DNA, 23 bp, Homo sapiens
tcaggattgaggatgaactcagg

SEQ ID NO: 525263 - DNA, 21 bp, Homo sapiens
tcaggctctgaatctctcaaa

SEQ ID NO: 525264 - DNA, 14 bp, Homo sapiens
tcagggctgtgctt

SEQ ID NO: 525265 - DNA, 21 bp, Homo sapiens
tcagtattgagacactgtcaa

SEQ ID NO: 525266 - DNA, 19 bp, Homo sapiens
tcagtgcagggacagcctg

SEQ ID NO: 525267 - DNA, 14 bp, Homo sapiens
tcagtttgtgaagt

SEQ ID NO: 525268 - DNA, 20 bp, Homo sapiens
tcagtttgtgaagtgattga

SEQ ID NO: 525269 - DNA, 24 bp, Homo sapiens
tcataaattcaaacctaagttgct

SEQ ID NO: 525270 - DNA, 21 bp, Homo sapiens
tcatacaaaggacagtacaca

SEQ ID NO: 525271 - DNA, 17 bp, Homo sapiens
tcatcctgccttcatgg

SEQ ID NO: 525272 - DNA, 23 bp, Homo sapiens
tcatcctgccttcatggaactca

SEQ ID NO: 525273 - DNA, 18 bp, Homo sapiens
tcatgcttttctcatggt

SEQ ID NO: 525274 - DNA, 13 bp, Homo sapiens
tcatggctgtccc

SEQ ID NO: 525275 - DNA, 18 bp, Homo sapiens
tcatggctgtcccctgca

SEQ ID NO: 525276 - DNA, 19 bp, Homo sapiens
tcatggctgttatctgtct

SEQ ID NO: 525277 - DNA, 18 bp, Homo sapiens
tcattagctgtgattttt

SEQ ID NO: 525278 - DNA, 18 bp, Homo sapiens
tcattatagcatgtaata

SEQ ID NO: 525279 - DNA, 22 bp, Homo sapiens
tcattgggccatgtttaagtgt

SEQ ID NO: 525280 - DNA, 15 bp, Homo sapiens
tcattgttaaagtaa

SEQ ID NO: 525281 - DNA, 12 bp, Homo sapiens
tcatttccagca

SEQ ID NO: 525282 - DNA, 21 bp, Homo sapiens
tcatttccagcaaaatatatg

SEQ ID NO: 525283 - DNA, 15 bp, Homo sapiens
tcatttggtggctct

SEQ ID NO: 525284 - DNA, 18 bp, Homo sapiens
tcatttttcattttctct

SEQ ID NO: 525285 - DNA, 16 bp, Homo sapiens
tccaaaggttgtacat

SEQ ID NO: 525286 - DNA, 21 bp, Homo sapiens
tccaaaggttgtacatagtgg

SEQ ID NO: 525287 - DNA, 23 bp, Homo sapiens
tccaaatgctgtcgggcaagata

SEQ ID NO: 525288 - DNA, 18 bp, Homo sapiens
tccacagagttactgcca

SEQ ID NO: 525289 - DNA, 21 bp, Homo sapiens
tccacagggacacagtctggt

SEQ ID NO: 525290 - DNA, 17 bp, Homo sapiens
tccacagtattgttctt

SEQ ID NO: 525291 - DNA, 21 bp, Homo sapiens
tccacagtattgttcttgtaa

SEQ ID NO: 525292 - DNA, 22 bp, Homo sapiens
tccacagtattgttcttgtaaa

SEQ ID NO: 525293 - DNA, 17 bp, Homo sapiens
tccacccccattgtgaa

SEQ ID NO: 525294 - DNA, 11 bp, Homo sapiens
tccagcaaaat

SEQ ID NO: 525295 - DNA, 12 bp, Homo sapiens
tccagccctccg

SEQ ID NO: 525296 - DNA, 16 bp, Homo sapiens
tccagccctccgccag

SEQ ID NO: 525297 - DNA, 22 bp, Homo sapiens
tccagccctccgccagccctgt

SEQ ID NO: 525298 - DNA, 19 bp, Homo sapiens
tccagccttcttcccccag

SEQ ID NO: 525299 - DNA, 21 bp, Homo sapiens
tccagcggggcttctgggcgc

SEQ ID NO: 525300 - DNA, 22 bp, Homo sapiens
tccagctgattttaactttttt

SEQ ID NO: 525301 - DNA, 21 bp, Homo sapiens
tccagggagtggggaggagag

SEQ ID NO: 525302 - DNA, 19 bp, Homo sapiens
tccagggcgcaggggaggg

SEQ ID NO: 525303 - DNA, 16 bp, Homo sapiens
tccagggtccagccct

SEQ ID NO: 525304 - DNA, 14 bp, Homo sapiens
tccaggtcacaggc

SEQ ID NO: 525305 - DNA, 19 bp, Homo sapiens
tccagtgctgctcccttta

SEQ ID NO: 525306 - DNA, 22 bp, Homo sapiens
tccagtgtggtcttgtttaata

SEQ ID NO: 525307 - DNA, 17 bp, Homo sapiens
tccagttctgatgaggc

SEQ ID NO: 525308 - DNA, 19 bp, Homo sapiens
tccatgacagtagcatact

SEQ ID NO: 525309 - DNA, 15 bp, Homo sapiens
tccatgctgtccctg

SEQ ID NO: 525310 - DNA, 18 bp, Homo sapiens
tccatgctgtccctgtgg

SEQ ID NO: 525311 - DNA, 22 bp, Homo sapiens
tccatgctgtccctgtgggctc

SEQ ID NO: 525312 - DNA, 15 bp, Homo sapiens
tcccaacctcccctg

SEQ ID NO: 525313 - DNA, 20 bp, Homo sapiens
tcccaacctcccctggtcct

SEQ ID NO: 525314 - DNA, 17 bp, Homo sapiens
tcccatggtagactgtg

SEQ ID NO: 525315 - DNA, 20 bp, Homo sapiens
tcccatggtagactgtgaca

SEQ ID NO: 525316 - DNA, 18 bp, Homo sapiens
tccccatcgccttctggc

SEQ ID NO: 525317 - DNA, 19 bp, Homo sapiens
tccccatggaacagccctg

SEQ ID NO: 525318 - DNA, 20 bp, Homo sapiens
tccccatggaacagccctgc

SEQ ID NO: 525319 - DNA, 18 bp, Homo sapiens
tcccccagggtcccctgc

SEQ ID NO: 525320 - DNA, 17 bp, Homo sapiens
tccccctcctccatgct

SEQ ID NO: 525321 - DNA, 18 bp, Homo sapiens
tccccggacgcatgcagg

SEQ ID NO: 525322 - DNA, 20 bp, Homo sapiens
tccccggacgcatgcagggc

SEQ ID NO: 525323 - DNA, 16 bp, Homo sapiens
tccccgtgctcacagt

SEQ ID NO: 525324 - DNA, 13 bp, Homo sapiens
tcccctccctttt

SEQ ID NO: 525325 - DNA, 14 bp, Homo sapiens
tcccctggtcctgc

SEQ ID NO: 525326 - DNA, 20 bp, Homo sapiens
tcccctggtcctgcactgtc

SEQ ID NO: 525327 - DNA, 17 bp, Homo sapiens
tcccctgtggtttgtta

SEQ ID NO: 525328 - DNA, 19 bp, Homo sapiens
tcccgtggctttgtgctta

SEQ ID NO: 525329 - DNA, 22 bp, Homo sapiens
tccctgacactgtctgctgccc

SEQ ID NO: 525330 - DNA, 14 bp, Homo sapiens
tccctgagggccct

SEQ ID NO: 525331 - DNA, 16 bp, Homo sapiens
tccctgagggcccttc

SEQ ID NO: 525332 - DNA, 18 bp, Homo sapiens
tccctgagggcccttccc

SEQ ID NO: 525333 - DNA, 18 bp, Homo sapiens
tccctggacgcatgcagg

SEQ ID NO: 525334 - DNA, 22 bp, Homo sapiens
tccctggacgcatgcagggccc

SEQ ID NO: 525335 - DNA, 18 bp, Homo sapiens
tccctgtgggctcacacc

SEQ ID NO: 525336 - DNA, 13 bp, Homo sapiens
tccgcctcactgg

SEQ ID NO: 525337 - DNA, 16 bp, Homo sapiens
tccgcgctcggggctg

SEQ ID NO: 525338 - DNA, 19 bp, Homo sapiens
tccgcgctcggggctgggc

SEQ ID NO: 525339 - DNA, 17 bp, Homo sapiens
tccgcgtggttctgcca

SEQ ID NO: 525340 - DNA, 15 bp, Homo sapiens
tcctaccattatggc

SEQ ID NO: 525341 - DNA, 16 bp, Homo sapiens
tcctacttaaacaaaa

SEQ ID NO: 525342 - DNA, 19 bp, Homo sapiens
tcctaggacatctctgtaa

SEQ ID NO: 525343 - DNA, 18 bp, Homo sapiens
tcctcaccttctgtttta

SEQ ID NO: 525344 - DNA, 23 bp, Homo sapiens
tcctcatggctgttatctgtctt

SEQ ID NO: 525345 - DNA, 18 bp, Homo sapiens
tcctccatgctgtccctg

SEQ ID NO: 525346 - DNA, 14 bp, Homo sapiens
tcctcccctggaag

SEQ ID NO: 525347 - DNA, 23 bp, Homo sapiens
tcctcttacctgtaatagcctca

SEQ ID NO: 525348 - DNA, 15 bp, Homo sapiens
tcctgaccctcactt

SEQ ID NO: 525349 - DNA, 16 bp, Homo sapiens
tcctggctcccagggt

SEQ ID NO: 525350 - DNA, 21 bp, Homo sapiens
tcctgggcaacagagtgagac

SEQ ID NO: 525351 - DNA, 12 bp, Homo sapiens
ggggaggctgag

SEQ ID NO: 525352 - DNA, 22 bp, Homo sapiens
ggggatggattggcctccaggg

SEQ ID NO: 525353 - DNA, 14 bp, Homo sapiens
ggggcaaggagaaa

SEQ ID NO: 525354 - DNA, 16 bp, Homo sapiens
ggggcaaggagaaagc

SEQ ID NO: 525355 - DNA, 12 bp, Homo sapiens
ggggccagacca

SEQ ID NO: 525356 - DNA, 18 bp, Homo sapiens
ggggctgcttctggggct

SEQ ID NO: 525357 - DNA, 11 bp, Homo sapiens
ggtcacaggca

SEQ ID NO: 525358 - DNA, 19 bp, Homo sapiens
ggtcagtgttataaaatct

SEQ ID NO: 525359 - DNA, 18 bp, Homo sapiens
ggtccaatccagccttct

SEQ ID NO: 525360 - DNA, 14 bp, Homo sapiens
ggtccagccctccg

SEQ ID NO: 525361 - DNA, 15 bp, Homo sapiens
ggtccagccctccgc

SEQ ID NO: 525362 - DNA, 22 bp, Homo sapiens
ggtcccagctacaggggaggct

SEQ ID NO: 525363 - DNA, 18 bp, Homo sapiens
ggtcctgggggctgctgc

SEQ ID NO: 525364 - DNA, 21 bp, Homo sapiens
ggtcctgggggctgctgcact

SEQ ID NO: 525365 - DNA, 17 bp, Homo sapiens
ggtcctttgagtgtcag

SEQ ID NO: 525366 - DNA, 20 bp, Homo sapiens
ggtctgcacacataacacac

SEQ ID NO: 525367 - DNA, 21 bp, Homo sapiens
ggtctgcacacataacacaca

SEQ ID NO: 525368 - DNA, 22 bp, Homo sapiens
ggtctgcacacataacacacat

SEQ ID NO: 525369 - DNA, 16 bp, Homo sapiens
ggtggagtcagggctg

SEQ ID NO: 525370 - DNA, 16 bp, Homo sapiens
ggtggcatttgctgaa

SEQ ID NO: 525371 - DNA, 15 bp, Homo sapiens
ggtggggccagcgct

SEQ ID NO: 525372 - DNA, 19 bp, Homo sapiens
ggtgtgaggacataaatct

SEQ ID NO: 525373 - DNA, 13 bp, Homo sapiens
ggttccacgtggg

SEQ ID NO: 525374 - DNA, 19 bp, Homo sapiens
ggttgtacatagtggtcat

SEQ ID NO: 525375 - DNA, 22 bp, Homo sapiens
ggttgtacatagtggtcatttg

SEQ ID NO: 525376 - DNA, 22 bp, Homo sapiens
ggtttactctgtgctaagttgt

SEQ ID NO: 525377 - DNA, 15 bp, Homo sapiens
ggtttagctgtgcag

SEQ ID NO: 525378 - DNA, 19 bp, Homo sapiens
ggtttgttatcagtacaat

SEQ ID NO: 525379 - DNA, 14 bp, Homo sapiens
ggtttgtttgctgc

SEQ ID NO: 525380 - DNA, 13 bp, Homo sapiens
gtaaaactgtgac

SEQ ID NO: 525381 - DNA, 14 bp, Homo sapiens
gtaaataaaaatag

SEQ ID NO: 525382 - DNA, 17 bp, Homo sapiens
gtaacattctatttcaa

SEQ ID NO: 525383 - DNA, 13 bp, Homo sapiens
gtaatattaaatt

SEQ ID NO: 525384 - DNA, 21 bp, Homo sapiens
gtacatttatgtgtgaagcaa

SEQ ID NO: 525385 - DNA, 16 bp, Homo sapiens
gtacgttaattaaaca

SEQ ID NO: 525386 - DNA, 18 bp, Homo sapiens
gtactaccccaggacgca

SEQ ID NO: 525387 - DNA, 22 bp, Homo sapiens
gtactaccccaggatgcatgca

SEQ ID NO: 525388 - DNA, 18 bp, Homo sapiens
gtagctagtttaaaatta

SEQ ID NO: 525389 - DNA, 16 bp, Homo sapiens
gtagctcgtgtgctta

SEQ ID NO: 525390 - DNA, 23 bp, Homo sapiens
gtagggaacggcctgagaggagc

SEQ ID NO: 525391 - DNA, 15 bp, Homo sapiens
gtatggtgctgggtc

SEQ ID NO: 525392 - DNA, 18 bp, Homo sapiens
gtattgagacactgtcaa

SEQ ID NO: 525393 - DNA, 19 bp, Homo sapiens
gtattgagacactgtcaag

SEQ ID NO: 525394 - DNA, 17 bp, Homo sapiens
gtattgttcttgtaaaa

SEQ ID NO: 525395 - DNA, 21 bp, Homo sapiens
gtattgttcttgtaaaactgt

SEQ ID NO: 525396 - DNA, 19 bp, Homo sapiens
gtcacttttttcctgtcaa

SEQ ID NO: 525397 - DNA, 15 bp, Homo sapiens
gtcagggctgtgctt

SEQ ID NO: 525398 - DNA, 13 bp, Homo sapiens
gtcagtttgtgaa

SEQ ID NO: 525399 - DNA, 19 bp, Homo sapiens
gtcagtttgtgaagtgatt

SEQ ID NO: 525400 - DNA, 12 bp, Homo sapiens
gtcatgtggcta

SEQ ID NO: 525401 - DNA, 22 bp, Homo sapiens
gtcatttcttctctctgtgctg

SEQ ID NO: 525402 - DNA, 17 bp, Homo sapiens
gtcatttggtggctcta

SEQ ID NO: 525403 - DNA, 13 bp, Homo sapiens
gtccaatccagcc

SEQ ID NO: 525404 - DNA, 18 bp, Homo sapiens
gtccagggtccagccctc

SEQ ID NO: 525405 - DNA, 15 bp, Homo sapiens
gtccaggtcacaggc

SEQ ID NO: 525406 - DNA, 20 bp, Homo sapiens
gtccctaagcacaataaaag

SEQ ID NO: 525407 - DNA, 20 bp, Homo sapiens
gtccctgagggcccttccca

SEQ ID NO: 525408 - DNA, 17 bp, Homo sapiens
gtccctgtgggctcaca

SEQ ID NO: 525409 - DNA, 17 bp, Homo sapiens
gtcccttacctggctta

SEQ ID NO: 525410 - DNA, 14 bp, Homo sapiens
gtcctatccccgga

SEQ ID NO: 525411 - DNA, 17 bp, Homo sapiens
gtcctatccccggacgc

SEQ ID NO: 525412 - DNA, 22 bp, Homo sapiens
gtcctatccccggacgcatgca

SEQ ID NO: 525413 - DNA, 22 bp, Homo sapiens
gtcctatccctggacgcatgca

SEQ ID NO: 525414 - DNA, 15 bp, Homo sapiens
gtcctgggggctgct

SEQ ID NO: 525415 - DNA, 12 bp, Homo sapiens
gtcctgtgtcat

SEQ ID NO: 525416 - DNA, 16 bp, Homo sapiens
gtcctgtgtcatctgt

SEQ ID NO: 525417 - DNA, 18 bp, Homo sapiens
gtccttagaatactgtat

SEQ ID NO: 525418 - DNA, 14 bp, Homo sapiens
gtctcctctgtcag

SEQ ID NO: 525419 - DNA, 15 bp, Homo sapiens
gtctctttctttcca

SEQ ID NO: 525420 - DNA, 20 bp, Homo sapiens
gtctgcacacataacacaca

SEQ ID NO: 525421 - DNA, 18 bp, Homo sapiens
gtcttgtttaatatttgt

SEQ ID NO: 525422 - DNA, 14 bp, Homo sapiens
gtctttaaaatgat

SEQ ID NO: 525423 - DNA, 13 bp, Homo sapiens
gtctttatgattt

SEQ ID NO: 525424 - DNA, 19 bp, Homo sapiens
gtctttatgatttcatgat

SEQ ID NO: 525425 - DNA, 16 bp, Homo sapiens
gtctttggttcctcat

SEQ ID NO: 525426 - DNA, 19 bp, Homo sapiens
gtctttggttcctcatggc

SEQ ID NO: 525427 - DNA, 14 bp, Homo sapiens
gtcttttgttctct

SEQ ID NO: 525428 - DNA, 21 bp, Homo sapiens
gtgaacttggtgcctaatgtt

SEQ ID NO: 525429 - DNA, 14 bp, Homo sapiens
gtgaagtgattgac

SEQ ID NO: 525430 - DNA, 21 bp, Homo sapiens
gtgaatgttgtcctgtgtcat

SEQ ID NO: 525431 - DNA, 21 bp, Homo sapiens
gtgaggctccctccctccctg

SEQ ID NO: 525432 - DNA, 16 bp, Homo sapiens
gtgaggttgtgctgcc

SEQ ID NO: 525433 - DNA, 20 bp, Homo sapiens
gtgattgacattttgtagct

SEQ ID NO: 525434 - DNA, 21 bp, Homo sapiens
gtgcagaaggtgaaatggagg

SEQ ID NO: 525435 - DNA, 19 bp, Homo sapiens
tttcatgattagacaatgt

SEQ ID NO: 525436 - DNA, 13 bp, Homo sapiens
tttccaaaggttg

SEQ ID NO: 525437 - DNA, 18 bp, Homo sapiens
tttccaaaggttgtacat

SEQ ID NO: 525438 - DNA, 15 bp, Homo sapiens
cacacacacaaaaca

SEQ ID NO: 525439 - DNA, 15 bp, Homo sapiens
cacacacacacacaa

SEQ ID NO: 525440 - DNA, 18 bp, Homo sapiens
cacacataacacacatca

SEQ ID NO: 525441 - DNA, 19 bp, Homo sapiens
cacaccaaattgctgagat

SEQ ID NO: 525442 - DNA, 14 bp, Homo sapiens
cacactctcttctt

SEQ ID NO: 525443 - DNA, 14 bp, Homo sapiens
cacactgccctctg

SEQ ID NO: 525444 - DNA, 19 bp, Homo sapiens
cacagaggacagcttcccc

SEQ ID NO: 525445 - DNA, 21 bp, Homo sapiens
cacaggagcgtgtactacccc

SEQ ID NO: 525446 - DNA, 17 bp, Homo sapiens
cacaggagcgtgtccta

SEQ ID NO: 525447 - DNA, 15 bp, Homo sapiens
cacagtattgttctt

SEQ ID NO: 525448 - DNA, 19 bp, Homo sapiens
cacagtattgttcttgtaa

SEQ ID NO: 525449 - DNA, 14 bp, Homo sapiens
cacattcctgaccc

SEQ ID NO: 525450 - DNA, 13 bp, Homo sapiens
cacattgcacaca

SEQ ID NO: 525451 - DNA, 15 bp, Homo sapiens
caccaaattgctgag

SEQ ID NO: 525452 - DNA, 18 bp, Homo sapiens
caccaaattgctgagatg

SEQ ID NO: 525453 - DNA, 13 bp, Homo sapiens
caccatgctgggc

SEQ ID NO: 525454 - DNA, 20 bp, Homo sapiens
caccatttaatcatttccag

SEQ ID NO: 525455 - DNA, 23 bp, Homo sapiens
caccatttaatcatttccagcaa

SEQ ID NO: 525456 - DNA, 16 bp, Homo sapiens
caccatttcccctgtg

SEQ ID NO: 525457 - DNA, 19 bp, Homo sapiens
caccatttcccctgtggtt

SEQ ID NO: 525458 - DNA, 21 bp, Homo sapiens
caccatttcccctgtggtttg

SEQ ID NO: 525459 - DNA, 15 bp, Homo sapiens
caccccgttgttgtc

SEQ ID NO: 525460 - DNA, 15 bp, Homo sapiens
cacctaattaatttc

SEQ ID NO: 525461 - DNA, 13 bp, Homo sapiens
cacctgcttctca

SEQ ID NO: 525462 - DNA, 15 bp, Homo sapiens
caccttctgtgcatc

SEQ ID NO: 525463 - DNA, 19 bp, Homo sapiens
caccttctgtgcatctggc

SEQ ID NO: 525464 - DNA, 15 bp, Homo sapiens
cacgcccctgcctga

SEQ ID NO: 525465 - DNA, 21 bp, Homo sapiens
cacggcgtccctgagggccct

SEQ ID NO: 525466 - DNA, 18 bp, Homo sapiens
cacggtccaatccagcct

SEQ ID NO: 525467 - DNA, 19 bp, Homo sapiens
cacggtccaatccagcctt

SEQ ID NO: 525468 - DNA, 15 bp, Homo sapiens
cacgtggggtggaat

SEQ ID NO: 525469 - DNA, 14 bp, Homo sapiens
cactaaaagtgatg

SEQ ID NO: 525470 - DNA, 18 bp, Homo sapiens
cactaaaagtgatgtgat

SEQ ID NO: 525471 - DNA, 17 bp, Homo sapiens
cactctcttcttactgt

SEQ ID NO: 525472 - DNA, 18 bp, Homo sapiens
cactgatatattttccag

SEQ ID NO: 525473 - DNA, 20 bp, Homo sapiens
cactgccctccgcccttccc

SEQ ID NO: 525474 - DNA, 18 bp, Homo sapiens
cactgggtgtggcctggc

SEQ ID NO: 525475 - DNA, 13 bp, Homo sapiens
cactgtctgctgc

SEQ ID NO: 525476 - DNA, 16 bp, Homo sapiens
cacttgggctggcacc

SEQ ID NO: 525477 - DNA, 23 bp, Homo sapiens
cacttgggctggcacccactgga

SEQ ID NO: 525478 - DNA, 13 bp, Homo sapiens
ctgcttctggggc

SEQ ID NO: 525479 - DNA, 18 bp, Homo sapiens
ctggaaaaaaaaaaatat

SEQ ID NO: 525480 - DNA, 13 bp, Homo sapiens
ctggaataagaag

SEQ ID NO: 525481 - DNA, 15 bp, Homo sapiens
ctggaggagaaggag

SEQ ID NO: 525482 - DNA, 17 bp, Homo sapiens
ctggaggagaaggagga

SEQ ID NO: 525483 - DNA, 18 bp, Homo sapiens
ctggaggagaaggaggaa

SEQ ID NO: 525484 - DNA, 14 bp, Homo sapiens
ctggcctgggggct

SEQ ID NO: 525485 - DNA, 17 bp, Homo sapiens
ctggctcccagggtcct

SEQ ID NO: 525486 - DNA, 14 bp, Homo sapiens
ctggcttctgggac

SEQ ID NO: 525487 - DNA, 14 bp, Homo sapiens
ctgggaatcctgga

SEQ ID NO: 525488 - DNA, 18 bp, Homo sapiens
ctgggacaggcaccatgc

SEQ ID NO: 525489 - DNA, 23 bp, Homo sapiens
ctgggccggggtgtggaatcacc

SEQ ID NO: 525490 - DNA, 22 bp, Homo sapiens
ctgggcgccggttccacgtggg

SEQ ID NO: 525491 - DNA, 19 bp, Homo sapiens
ctggggagggacacagagg

SEQ ID NO: 525492 - DNA, 21 bp, Homo sapiens
ctggggagggacacagaggac

SEQ ID NO: 525493 - DNA, 20 bp, Homo sapiens
ctgggtgtggcctggcttct

SEQ ID NO: 525494 - DNA, 22 bp, Homo sapiens
ctgggtgtggcctggcttctgg

SEQ ID NO: 525495 - DNA, 14 bp, Homo sapiens
ctggtcctgcactg

SEQ ID NO: 525496 - DNA, 17 bp, Homo sapiens
ctgtaaataaaaatagc

SEQ ID NO: 525497 - DNA, 20 bp, Homo sapiens
ctgtagtttttgttcacctt

SEQ ID NO: 525498 - DNA, 14 bp, Homo sapiens
ctgtcagcttccca

SEQ ID NO: 525499 - DNA, 16 bp, Homo sapiens
ctgtcagtttgtgaag

SEQ ID NO: 525500 - DNA, 17 bp, Homo sapiens
ctgtcccctgcaagtgg

SEQ ID NO: 525501 - DNA, 17 bp, Homo sapiens
ctgtcccggagctcagg

SEQ ID NO: 525502 - DNA, 15 bp, Homo sapiens
ctgtccctgtgggct

SEQ ID NO: 525503 - DNA, 17 bp, Homo sapiens
ctgtccctgtgggctca

SEQ ID NO: 525504 - DNA, 21 bp, Homo sapiens
ctgtccctgtgggctcacacc

SEQ ID NO: 525505 - DNA, 19 bp, Homo sapiens
ctgtctgtcccagttaact

SEQ ID NO: 525506 - DNA, 21 bp, Homo sapiens
ctgtctgtgtgaggctccctc

SEQ ID NO: 525507 - DNA, 15 bp, Homo sapiens
ctgtctttatgattt

SEQ ID NO: 525508 - DNA, 15 bp, Homo sapiens
ctgtgaactgccagg

SEQ ID NO: 525509 - DNA, 23 bp, Homo sapiens
ctgtgaactgccaggcagctgca

SEQ ID NO: 525510 - DNA, 16 bp, Homo sapiens
ctgtgacacagctgag

SEQ ID NO: 525511 - DNA, 17 bp, Homo sapiens
ctgtgacacagctgagc

SEQ ID NO: 525512 - DNA, 16 bp, Homo sapiens
ctgtgacattccacag

SEQ ID NO: 525513 - DNA, 16 bp, Homo sapiens
ctgtgagataaatatc

SEQ ID NO: 525514 - DNA, 16 bp, Homo sapiens
ctgtgcatctggcctg

SEQ ID NO: 525515 - DNA, 17 bp, Homo sapiens
ctgtgctaagttgtctt

SEQ ID NO: 525516 - DNA, 17 bp, Homo sapiens
ctgtgggctcacaccgg

SEQ ID NO: 525517 - DNA, 20 bp, Homo sapiens
ctgtggtgaggtcctgtcct

SEQ ID NO: 525518 - DNA, 17 bp, Homo sapiens
ctgtggtttgttatcag

SEQ ID NO: 525519 - DNA, 22 bp, Homo sapiens
ctgtgtagtagctcgtgtgctt

SEQ ID NO: 525520 - DNA, 13 bp, Homo sapiens
ctgttccgcctca

SEQ ID NO: 525521 - DNA, 21 bp, Homo sapiens
gcattgcactaaaagtgatgt

SEQ ID NO: 525522 - DNA, 12 bp, Homo sapiens
gcatttgctgaa

SEQ ID NO: 525523 - DNA, 20 bp, Homo sapiens
gcatttgctgaataacaaca

SEQ ID NO: 525524 - DNA, 15 bp, Homo sapiens
gccaagaattagatt

SEQ ID NO: 525525 - DNA, 21 bp, Homo sapiens
gccaataaagctcacacttgg

SEQ ID NO: 525526 - DNA, 15 bp, Homo sapiens
gccaatgtccaggtc

SEQ ID NO: 525527 - DNA, 16 bp, Homo sapiens
gccagaccacgcccct

SEQ ID NO: 525528 - DNA, 19 bp, Homo sapiens
gccagaccacgcccctgcc

SEQ ID NO: 525529 - DNA, 22 bp, Homo sapiens
gccagccctgttccgcctcact

SEQ ID NO: 525530 - DNA, 23 bp, Homo sapiens
gccagccctgttccgcctcactg

SEQ ID NO: 525531 - DNA, 14 bp, Homo sapiens
gccagcgctgaaca

SEQ ID NO: 525532 - DNA, 17 bp, Homo sapiens
gccaggcacggaggctc

SEQ ID NO: 525533 - DNA, 18 bp, Homo sapiens
gccaggcctcagggacca

SEQ ID NO: 525534 - DNA, 20 bp, Homo sapiens
gcccacccgtgttctcctcc

SEQ ID NO: 525535 - DNA, 21 bp, Homo sapiens
gcccccacaggagcatgtcct

SEQ ID NO: 525536 - DNA, 14 bp, Homo sapiens
gccccgctgctccc

SEQ ID NO: 525537 - DNA, 14 bp, Homo sapiens
gccctccgccagcc

SEQ ID NO: 525538 - DNA, 20 bp, Homo sapiens
gccctgacaacaactatcac

SEQ ID NO: 525539 - DNA, 16 bp, Homo sapiens
gccctgacatgctaac

SEQ ID NO: 525540 - DNA, 18 bp, Homo sapiens
gccctgttccgcctcact

SEQ ID NO: 525541 - DNA, 19 bp, Homo sapiens
gccctgttccgcctcactg

SEQ ID NO: 525542 - DNA, 14 bp, Homo sapiens
gcccttcccaacct

SEQ ID NO: 525543 - DNA, 22 bp, Homo sapiens
gccgctgcagtcagcacagaga

SEQ ID NO: 525544 - DNA, 21 bp, Homo sapiens
gccgcttaaacatttccctgc

SEQ ID NO: 525545 - DNA, 13 bp, Homo sapiens
gccgggctccagg

SEQ ID NO: 525546 - DNA, 15 bp, Homo sapiens
gccgggctccaggga

SEQ ID NO: 525547 - DNA, 19 bp, Homo sapiens
gccgtctttggttcctcat

SEQ ID NO: 525548 - DNA, 15 bp, Homo sapiens
gcctaataaacaatt

SEQ ID NO: 525549 - DNA, 16 bp, Homo sapiens
gcctatcctaagagct

SEQ ID NO: 525550 - DNA, 18 bp, Homo sapiens
gcctcaagtcggtgggcc

SEQ ID NO: 525551 - DNA, 22 bp, Homo sapiens
gcctcaccttccctagttcttt

SEQ ID NO: 525552 - DNA, 15 bp, Homo sapiens
gcctcagggaccaag

SEQ ID NO: 525553 - DNA, 22 bp, Homo sapiens
gcctccagggcgcaggggaggg

SEQ ID NO: 525554 - DNA, 14 bp, Homo sapiens
gcctcttaaaaatt

SEQ ID NO: 525555 - DNA, 21 bp, Homo sapiens
gcctgagaggagcgtgtccta

SEQ ID NO: 525556 - DNA, 13 bp, Homo sapiens
gcctggaggagaa

SEQ ID NO: 525557 - DNA, 17 bp, Homo sapiens
gcctggcttctgggaca

SEQ ID NO: 525558 - DNA, 19 bp, Homo sapiens
gcctgggaaattgctccat

SEQ ID NO: 525559 - DNA, 17 bp, Homo sapiens
gcctttccagtgctgct

SEQ ID NO: 525560 - DNA, 17 bp, Homo sapiens
gcgacggaggcaggacc

SEQ ID NO: 525561 - DNA, 16 bp, Homo sapiens
gcggcttccctgcgac

SEQ ID NO: 525562 - DNA, 22 bp, Homo sapiens
gcgggccatttcacattcctga

SEQ ID NO: 525563 - DNA, 18 bp, Homo sapiens
gctaaatgcctaataaac

SEQ ID NO: 525564 - DNA, 14 bp, Homo sapiens
gctaacctctctga

SEQ ID NO: 525565 - DNA, 17 bp, Homo sapiens
gctaagttgtcttacac

SEQ ID NO: 525566 - DNA, 23 bp, Homo sapiens
gctaagttgtcttacacttctca

SEQ ID NO: 525567 - DNA, 14 bp, Homo sapiens
gctaattaaaaagt

SEQ ID NO: 525568 - DNA, 16 bp, Homo sapiens
gctataaatagtgaaa

SEQ ID NO: 525569 - DNA, 13 bp, Homo sapiens
gctatgcacacca

SEQ ID NO: 525570 - DNA, 12 bp, Homo sapiens
gctcaatgtgct

SEQ ID NO: 525571 - DNA, 13 bp, Homo sapiens
gctcaatgtgctg

SEQ ID NO: 525572 - DNA, 20 bp, Homo sapiens
gctcacaccggcactgtgca

SEQ ID NO: 525573 - DNA, 21 bp, Homo sapiens
gctcacaccggcactgtgcac

SEQ ID NO: 525574 - DNA, 13 bp, Homo sapiens
gctcacacttggg

SEQ ID NO: 525575 - DNA, 14 bp, Homo sapiens
gctcacacttgggc

SEQ ID NO: 525576 - DNA, 11 bp, Homo sapiens
gctcagtattg

SEQ ID NO: 525577 - DNA, 15 bp, Homo sapiens
gctcagtattgagac

SEQ ID NO: 525578 - DNA, 22 bp, Homo sapiens
gctcagtattgagacactgtca

SEQ ID NO: 525579 - DNA, 22 bp, Homo sapiens
gctcatcagaaacaatttctgt

SEQ ID NO: 525580 - DNA, 21 bp, Homo sapiens
gctccagggagtggggaggag

SEQ ID NO: 525581 - DNA, 12 bp, Homo sapiens
gctccattcctg

SEQ ID NO: 525582 - DNA, 14 bp, Homo sapiens
gctcccagggtcct

SEQ ID NO: 525583 - DNA, 23 bp, Homo sapiens
gctcccagggtcctgggggctgc

SEQ ID NO: 525584 - DNA, 18 bp, Homo sapiens
gctccgcgctcggggctg

SEQ ID NO: 525585 - DNA, 23 bp, Homo sapiens
gctccgcgctcggggctgggcag

SEQ ID NO: 525586 - DNA, 17 bp, Homo sapiens
gctccttcatgcttttc

SEQ ID NO: 525587 - DNA, 21 bp, Homo sapiens
gctcggccaggcacggaggct

SEQ ID NO: 525588 - DNA, 14 bp, Homo sapiens
gctcgtgcatgtaa

SEQ ID NO: 525589 - DNA, 16 bp, Homo sapiens
gctctctcacccagcc

SEQ ID NO: 525590 - DNA, 23 bp, Homo sapiens
gctctctcacccagcctggtact

SEQ ID NO: 525591 - DNA, 14 bp, Homo sapiens
gctctgaatctctc

SEQ ID NO: 525592 - DNA, 15 bp, Homo sapiens
gctctgaatctctca

SEQ ID NO: 525593 - DNA, 16 bp, Homo sapiens
gctctgaatctctcaa

SEQ ID NO: 525594 - DNA, 21 bp, Homo sapiens
gctctgaatctctcaaaatgt

SEQ ID NO: 525595 - DNA, 17 bp, Homo sapiens
gctgaaattatgtcaaa

SEQ ID NO: 525596 - DNA, 12 bp, Homo sapiens
gctgaataacaa

SEQ ID NO: 525597 - DNA, 14 bp, Homo sapiens
gctgactcagtgca

SEQ ID NO: 525598 - DNA, 23 bp, Homo sapiens
gctgactcttactaaccaccatt

SEQ ID NO: 525599 - DNA, 15 bp, Homo sapiens
gctgacttctccagg

SEQ ID NO: 525600 - DNA, 22 bp, Homo sapiens
gctgagaatccccgtgctcaca

SEQ ID NO: 525601 - DNA, 19 bp, Homo sapiens
gctgagagggtgtgggtgc

SEQ ID NO: 525602 - DNA, 18 bp, Homo sapiens
gctgagatgtttagtagc

SEQ ID NO: 525603 - DNA, 16 bp, Homo sapiens
gctgcactgccctccg

SEQ ID NO: 525604 - DNA, 18 bp, Homo sapiens
gctgcagtcagcacagag

SEQ ID NO: 525605 - DNA, 18 bp, Homo sapiens
gctgcagttagcacagag

SEQ ID NO: 525606 - DNA, 12 bp, Homo sapiens
gctgctgcactg

SEQ ID NO: 525607 - DNA, 19 bp, Homo sapiens
gctgtaaataaaaatagct

SEQ ID NO: 525608 - DNA, 13 bp, Homo sapiens
gctgtcccctgca

SEQ ID NO: 525609 - DNA, 16 bp, Homo sapiens
gctgtcccctgcaagt

SEQ ID NO: 525610 - DNA, 23 bp, Homo sapiens
gctgtccctgtgggctcacaccg

SEQ ID NO: 525611 - DNA, 14 bp, Homo sapiens
gctgtctgtggctt

SEQ ID NO: 525612 - DNA, 20 bp, Homo sapiens
gctgtgaaacagtgtggatg

SEQ ID NO: 525613 - DNA, 20 bp, Homo sapiens
gctgtgaaatgactgcatca

SEQ ID NO: 525614 - DNA, 13 bp, Homo sapiens
gctgttatctgtc

SEQ ID NO: 525615 - DNA, 16 bp, Homo sapiens
gctgttgattctttca

SEQ ID NO: 525616 - DNA, 19 bp, Homo sapiens
gcttaaacatttccctgct

SEQ ID NO: 525617 - DNA, 20 bp, Homo sapiens
gcttaaacatttccctgctg

SEQ ID NO: 525618 - DNA, 13 bp, Homo sapiens
ctcaatgtgctgt

SEQ ID NO: 525619 - DNA, 15 bp, Homo sapiens
ctcaatgtgctgttg

SEQ ID NO: 525620 - DNA, 22 bp, Homo sapiens
ctcaccatttaatcatttccag

SEQ ID NO: 525621 - DNA, 13 bp, Homo sapiens
ctcacccagcctg

SEQ ID NO: 525622 - DNA, 17 bp, Homo sapiens
ctcactgggtgtggcct

SEQ ID NO: 525623 - DNA, 22 bp, Homo sapiens
ctcactgggtgtggcctggctt

SEQ ID NO: 525624 - DNA, 17 bp, Homo sapiens
ctcacttttctcatctg

SEQ ID NO: 525625 - DNA, 17 bp, Homo sapiens
ctcagaggagaggagca

SEQ ID NO: 525626 - DNA, 18 bp, Homo sapiens
ctcagctgtctgtggctt

SEQ ID NO: 525627 - DNA, 15 bp, Homo sapiens
ctcaggcagcctgtg

SEQ ID NO: 525628 - DNA, 21 bp, Homo sapiens
ctcagtattgagacactgtca

SEQ ID NO: 525629 - DNA, 13 bp, Homo sapiens
ctcagtcaaatgt

SEQ ID NO: 525630 - DNA, 20 bp, Homo sapiens
ctcagtgcagggacagcctg

SEQ ID NO: 525631 - DNA, 18 bp, Homo sapiens
ctcatcaacaaagaaata

SEQ ID NO: 525632 - DNA, 19 bp, Homo sapiens
ctcatctgtaaaaccaggc

SEQ ID NO: 525633 - DNA, 17 bp, Homo sapiens
ctccatgctgtccctgt

SEQ ID NO: 525634 - DNA, 13 bp, Homo sapiens
ctccattcctgag

SEQ ID NO: 525635 - DNA, 18 bp, Homo sapiens
ctcccacctcggacacca

SEQ ID NO: 525636 - DNA, 13 bp, Homo sapiens
ctcccctggaagt

SEQ ID NO: 525637 - DNA, 13 bp, Homo sapiens
ctcccctggtcct

SEQ ID NO: 525638 - DNA, 15 bp, Homo sapiens
ctcccctggtcctgc

SEQ ID NO: 525639 - DNA, 13 bp, Homo sapiens
ctccctccctgct

SEQ ID NO: 525640 - DNA, 16 bp, Homo sapiens
ctccgcgctcggggct

SEQ ID NO: 525641 - DNA, 13 bp, Homo sapiens
ctcctccaaatgc

SEQ ID NO: 525642 - DNA, 12 bp, Homo sapiens
ctcctccccctc

SEQ ID NO: 525643 - DNA, 15 bp, Homo sapiens
ctcctccccctcctc

SEQ ID NO: 525644 - DNA, 18 bp, Homo sapiens
ctcctccccctcctccat

SEQ ID NO: 525645 - DNA, 21 bp, Homo sapiens
ctcctccccctcctccatgct

SEQ ID NO: 525646 - DNA, 13 bp, Homo sapiens
ctcctcctccagt

SEQ ID NO: 525647 - DNA, 12 bp, Homo sapiens
ctcctctgtcag

SEQ ID NO: 525648 - DNA, 13 bp, Homo sapiens
ctcctctgtcagt

SEQ ID NO: 525649 - DNA, 14 bp, Homo sapiens
ctccttcatgcttt

SEQ ID NO: 525650 - DNA, 16 bp, Homo sapiens
ctccttcatgcttttc

SEQ ID NO: 525651 - DNA, 19 bp, Homo sapiens
ctccttcatgcttttctca

SEQ ID NO: 525652 - DNA, 20 bp, Homo sapiens
ctcggccgaggcctgcgccc

SEQ ID NO: 525653 - DNA, 17 bp, Homo sapiens
ctcgggctctctcaccc

SEQ ID NO: 525654 - DNA, 18 bp, Homo sapiens
ctcggtggcatttgctga

SEQ ID NO: 525655 - DNA, 17 bp, Homo sapiens
ctcgtgtttcacagtgg

SEQ ID NO: 525656 - DNA, 11 bp, Homo sapiens
ctctaatttcc

SEQ ID NO: 525657 - DNA, 15 bp, Homo sapiens
ctctacaaaaaaaat

SEQ ID NO: 525658 - DNA, 15 bp, Homo sapiens
ctctcaaaatgtgcc

SEQ ID NO: 525659 - DNA, 18 bp, Homo sapiens
ctctctgaactgcaacac

SEQ ID NO: 525660 - DNA, 15 bp, Homo sapiens
ctctcttcttactgt

SEQ ID NO: 525661 - DNA, 15 bp, Homo sapiens
ctctcttggtctctt

SEQ ID NO: 525662 - DNA, 24 bp, Homo sapiens
ctctcttggtctctttctttccaa

SEQ ID NO: 525663 - DNA, 20 bp, Homo sapiens
ctctgaactgcaacactgga

SEQ ID NO: 525664 - DNA, 16 bp, Homo sapiens
ctctgtcagtttgtga

SEQ ID NO: 525665 - DNA, 22 bp, Homo sapiens
ggggctgttagctcagaggaga

SEQ ID NO: 525666 - DNA, 21 bp, Homo sapiens
gggggagctttcccagagacc

SEQ ID NO: 525667 - DNA, 23 bp, Homo sapiens
gggggctgttagctcagaggaga

SEQ ID NO: 525668 - DNA, 21 bp, Homo sapiens
ggggtggaattattagcacca

SEQ ID NO: 525669 - DNA, 23 bp, Homo sapiens
gggtggaattattagcaccagct

SEQ ID NO: 525670 - DNA, 21 bp, Homo sapiens
ggtaaactgatgctttcagat

SEQ ID NO: 525671 - DNA, 12 bp, Homo sapiens
ggtccagccctc

SEQ ID NO: 525672 - DNA, 19 bp, Homo sapiens
ggtccagccctccgccagc

SEQ ID NO: 525673 - DNA, 18 bp, Homo sapiens
ggtccagggtccagccct

SEQ ID NO: 525674 - DNA, 19 bp, Homo sapiens
ggtccagggtccagccctc

SEQ ID NO: 525675 - DNA, 15 bp, Homo sapiens
ggtcctgggggctgc

SEQ ID NO: 525676 - DNA, 22 bp, Homo sapiens
ggtcctgggggctgctgcactg

SEQ ID NO: 525677 - DNA, 21 bp, Homo sapiens
ggtgcccagactcaaggcctc

SEQ ID NO: 525678 - DNA, 19 bp, Homo sapiens
ggtgccccccatgccctcc

SEQ ID NO: 525679 - DNA, 22 bp, Homo sapiens
ggtgcggcagggcaggagcttg

SEQ ID NO: 525680 - DNA, 15 bp, Homo sapiens
ggtggcatttgctga

SEQ ID NO: 525681 - DNA, 21 bp, Homo sapiens
ggtgggagcacagctttcctg

SEQ ID NO: 525682 - DNA, 12 bp, Homo sapiens
gtaaaactgtga

SEQ ID NO: 525683 - DNA, 19 bp, Homo sapiens
gtaaaactgtgacattcca

SEQ ID NO: 525684 - DNA, 21 bp, Homo sapiens
gtaacttgctgtgaaatgact

SEQ ID NO: 525685 - DNA, 14 bp, Homo sapiens
gtaatattaaattc

SEQ ID NO: 525686 - DNA, 13 bp, Homo sapiens
gtacaattctttg

SEQ ID NO: 525687 - DNA, 21 bp, Homo sapiens
gtacaattctttgttgcttaa

SEQ ID NO: 525688 - DNA, 14 bp, Homo sapiens
gtactaccccagga

SEQ ID NO: 525689 - DNA, 14 bp, Homo sapiens
gtactggatttaac

SEQ ID NO: 525690 - DNA, 15 bp, Homo sapiens
tcatgattagacaat

SEQ ID NO: 525691 - DNA, 14 bp, Homo sapiens
tcatgcttttctca

SEQ ID NO: 525692 - DNA, 15 bp, Homo sapiens
tcattatagcatgta

SEQ ID NO: 525693 - DNA, 15 bp, Homo sapiens
tcatttccagcaaaa

SEQ ID NO: 525694 - DNA, 16 bp, Homo sapiens
tcatttccagcaaaat

SEQ ID NO: 525695 - DNA, 23 bp, Homo sapiens
tcatttccagcaaaatatatgtt

SEQ ID NO: 525696 - DNA, 15 bp, Homo sapiens
tccaatccagccttc

SEQ ID NO: 525697 - DNA, 17 bp, Homo sapiens
tccacaacctcctcctc

SEQ ID NO: 525698 - DNA, 18 bp, Homo sapiens
tccacaatcatctattga

SEQ ID NO: 525699 - DNA, 13 bp, Homo sapiens
tccacagtattgt

SEQ ID NO: 525700 - DNA, 16 bp, Homo sapiens
tccacagtattgttct

SEQ ID NO: 525701 - DNA, 23 bp, Homo sapiens
tccacccccattgtgaatgttgt

SEQ ID NO: 525702 - DNA, 11 bp, Homo sapiens
tccagccctcc

SEQ ID NO: 525703 - DNA, 15 bp, Homo sapiens
tccagccctccgcca

SEQ ID NO: 525704 - DNA, 18 bp, Homo sapiens
tccagcggggcttctggg

SEQ ID NO: 525705 - DNA, 18 bp, Homo sapiens
tccagggagtggggagga

SEQ ID NO: 525706 - DNA, 14 bp, Homo sapiens
tccagttctgatga

SEQ ID NO: 525707 - DNA, 12 bp, Homo sapiens
tccatgctgtcc

SEQ ID NO: 525708 - DNA, 14 bp, Homo sapiens
tccattcctgagta

SEQ ID NO: 525709 - DNA, 22 bp, Homo sapiens
tcccaacaatactttgtgtctt

SEQ ID NO: 525710 - DNA, 16 bp, Homo sapiens
tcccaacctcccctgg

SEQ ID NO: 525711 - DNA, 19 bp, Homo sapiens
tcccactgcccctgcacct

SEQ ID NO: 525712 - DNA, 14 bp, Homo sapiens
tcccagctacaggg

SEQ ID NO: 525713 - DNA, 23 bp, Homo sapiens
tcccatggtagactgtgacacag

SEQ ID NO: 525714 - DNA, 16 bp, Homo sapiens
tccccatcgccttctg

SEQ ID NO: 525715 - DNA, 18 bp, Homo sapiens
tccccattgccttctggg

SEQ ID NO: 525716 - DNA, 22 bp, Homo sapiens
tccccggaccggacgcatgcag

SEQ ID NO: 525717 - DNA, 17 bp, Homo sapiens
tccccggacgcatgcag

SEQ ID NO: 525718 - DNA, 16 bp, Homo sapiens
tcccctgcatggctga

SEQ ID NO: 525719 - DNA, 17 bp, Homo sapiens
tcccctgcatggctgag

SEQ ID NO: 525720 - DNA, 18 bp, Homo sapiens
tcccggagctcaggccct

SEQ ID NO: 525721 - DNA, 22 bp, Homo sapiens
tcccgggtgccccccatgccct

SEQ ID NO: 525722 - DNA, 15 bp, Homo sapiens
tccctgcgacggagg

SEQ ID NO: 525723 - DNA, 24 bp, Homo sapiens
tccctgcgacggaggcaggaccag

SEQ ID NO: 525724 - DNA, 16 bp, Homo sapiens
tccctgctgagtggct

SEQ ID NO: 525725 - DNA, 17 bp, Homo sapiens
tccctgctgccaggctc

SEQ ID NO: 525726 - DNA, 13 bp, Homo sapiens
tccctgtcatagt

SEQ ID NO: 525727 - DNA, 14 bp, Homo sapiens
tccctgtgggctca

SEQ ID NO: 525728 - DNA, 16 bp, Homo sapiens
tccctgtgggctcaca

SEQ ID NO: 525729 - DNA, 17 bp, Homo sapiens
tccctgtgggctcacac

SEQ ID NO: 525730 - DNA, 22 bp, Homo sapiens
tccctgtgggctcacaccggca

SEQ ID NO: 525731 - DNA, 23 bp, Homo sapiens
tccctttatcatgtgtttctgtg

SEQ ID NO: 525732 - DNA, 19 bp, Homo sapiens
tccctttttaaacaaatgg

SEQ ID NO: 525733 - DNA, 15 bp, Homo sapiens
tccgccagccctgtt

SEQ ID NO: 525734 - DNA, 13 bp, Homo sapiens
tccgcccttccct

SEQ ID NO: 525735 - DNA, 15 bp, Homo sapiens
tcctacttaaacaaa

SEQ ID NO: 525736 - DNA, 22 bp, Homo sapiens
tcctacttaaacaaaaactttc

SEQ ID NO: 525737 - DNA, 16 bp, Homo sapiens
tcctatgagagaagag

SEQ ID NO: 525738 - DNA, 16 bp, Homo sapiens
tcctccccctcctcca

SEQ ID NO: 525739 - DNA, 15 bp, Homo sapiens
tcctcccctggaagt

SEQ ID NO: 525740 - DNA, 19 bp, Homo sapiens
tcctccttcactccctgtc

SEQ ID NO: 525741 - DNA, 20 bp, Homo sapiens
tcctcggtggcatttgctga

SEQ ID NO: 525742 - DNA, 12 bp, Homo sapiens
tcctctgtcagt

SEQ ID NO: 525743 - DNA, 19 bp, Homo sapiens
tcctctgtcagtttgtgaa

SEQ ID NO: 525744 - DNA, 12 bp, Homo sapiens
tcctcttacctg

SEQ ID NO: 525745 - DNA, 22 bp, Homo sapiens
tcctgggggctgctgcactgcc

SEQ ID NO: 525746 - DNA, 17 bp, Homo sapiens
tcctgtcctggctccca

SEQ ID NO: 525747 - DNA, 18 bp, Homo sapiens
tcctgtctcctctgtcag

SEQ ID NO: 525748 - DNA, 19 bp, Homo sapiens
tcctgtctcctctgtcagt

SEQ ID NO: 525749 - DNA, 18 bp, Homo sapiens
tcctgtgtcatctgtcag

SEQ ID NO: 525750 - DNA, 20 bp, Homo sapiens
tccttagaatactgtattgt

SEQ ID NO: 525751 - DNA, 21 bp, Homo sapiens
tccttcatgcttttctcatgg

SEQ ID NO: 525752 - DNA, 13 bp, Homo sapiens
tccttgtcagttg

SEQ ID NO: 525753 - DNA, 21 bp, Homo sapiens
tcgaagaattggcagaagcag

SEQ ID NO: 525754 - DNA, 12 bp, Homo sapiens
tcgccttctggg

SEQ ID NO: 525755 - DNA, 13 bp, Homo sapiens
tcgccttctgggg

SEQ ID NO: 525756 - DNA, 21 bp, Homo sapiens
tcgggctctctcacccagcct

SEQ ID NO: 525757 - DNA, 13 bp, Homo sapiens
tcgtgcatgtaat

SEQ ID NO: 525758 - DNA, 15 bp, Homo sapiens
tcgtgtttcacagtg

SEQ ID NO: 525759 - DNA, 16 bp, Homo sapiens
tctaaatcataatcat

SEQ ID NO: 525760 - DNA, 19 bp, Homo sapiens
tctaactccttgaggtctt

SEQ ID NO: 525761 - DNA, 20 bp, Homo sapiens
tctacaaaaaaaatcaaaaa

SEQ ID NO: 525762 - DNA, 19 bp, Homo sapiens
tctagagctatgcacacca

SEQ ID NO: 525763 - DNA, 20 bp, Homo sapiens
tctagagctatgcacaccaa

SEQ ID NO: 525764 - DNA, 15 bp, Homo sapiens
tctagatatgagaaa

SEQ ID NO: 525765 - DNA, 16 bp, Homo sapiens
tctagtaggtctgcac

SEQ ID NO: 525766 - DNA, 18 bp, Homo sapiens
tctattagcttactgatt

SEQ ID NO: 525767 - DNA, 20 bp, Homo sapiens
tctattagcttactgattaa

SEQ ID NO: 525768 - DNA, 14 bp, Homo sapiens
tctcacccagcctg

SEQ ID NO: 525769 - DNA, 15 bp, Homo sapiens
tctcacccagcctgg

SEQ ID NO: 525770 - DNA, 19 bp, Homo sapiens
tctcagaagtgaaaaagac

SEQ ID NO: 525771 - DNA, 22 bp, Homo sapiens
tctcatctgtaaaaccaggctg

SEQ ID NO: 525772 - DNA, 12 bp, Homo sapiens
tctccagctgat

SEQ ID NO: 525773 - DNA, 15 bp, Homo sapiens
tctccagctgatttt

SEQ ID NO: 525774 - DNA, 14 bp, Homo sapiens
tctcctccaaatgc

SEQ ID NO: 525775 - DNA, 22 bp, Homo sapiens
tctcctcggtggcatttgctga

SEQ ID NO: 525776 - DNA, 13 bp, Homo sapiens
tctcctctgtcag

SEQ ID NO: 525777 - DNA, 14 bp, Homo sapiens
tctctaaaacagca

SEQ ID NO: 525778 - DNA, 13 bp, Homo sapiens
tctctcaaaatgt

SEQ ID NO: 525779 - DNA, 17 bp, Homo sapiens
tctctcacccagcctgg

SEQ ID NO: 525780 - DNA, 14 bp, Homo sapiens
tctctcttggtctc

SEQ ID NO: 525781 - DNA, 19 bp, Homo sapiens
tctctgaactgcaacactg

SEQ ID NO: 525782 - DNA, 15 bp, Homo sapiens
tctctgtaaaaagca

SEQ ID NO: 525783 - DNA, 20 bp, Homo sapiens
tctctgtaaaaagcaggtga

SEQ ID NO: 525784 - DNA, 13 bp, Homo sapiens
tctcttggtctct

SEQ ID NO: 525785 - DNA, 15 bp, Homo sapiens
tctctttctttccaa

SEQ ID NO: 525786 - DNA, 14 bp, Homo sapiens
tctgaaaactggaa

SEQ ID NO: 525787 - DNA, 17 bp, Homo sapiens
tctgaatctctcaaaat

SEQ ID NO: 525788 - DNA, 19 bp, Homo sapiens
tctgaatctctcaaaatgt

SEQ ID NO: 525789 - DNA, 13 bp, Homo sapiens
tctgcacacataa

SEQ ID NO: 525790 - DNA, 22 bp, Homo sapiens
tgcggcagggcaggagcttggc

SEQ ID NO: 525791 - DNA, 13 bp, Homo sapiens
tgcggtgtgtctc

SEQ ID NO: 525792 - DNA, 17 bp, Homo sapiens
tgctatctcgctagcca

SEQ ID NO: 525793 - DNA, 18 bp, Homo sapiens
tgctatgctgttcattga

SEQ ID NO: 525794 - DNA, 13 bp, Homo sapiens
tgctcaatgtgct

SEQ ID NO: 525795 - DNA, 14 bp, Homo sapiens
tgctcaatgtgctg

SEQ ID NO: 525796 - DNA, 12 bp, Homo sapiens
tgctcagtattg

SEQ ID NO: 525797 - DNA, 19 bp, Homo sapiens
tgctgaataacaacaattt

SEQ ID NO: 525798 - DNA, 20 bp, Homo sapiens
tgctgagatgtttagtagct

SEQ ID NO: 525799 - DNA, 22 bp, Homo sapiens
tgctgagatgtttagtagctga

SEQ ID NO: 525800 - DNA, 16 bp, Homo sapiens
tgctgccaggctccca

SEQ ID NO: 525801 - DNA, 18 bp, Homo sapiens
tgctgccaggctcccact

SEQ ID NO: 525802 - DNA, 20 bp, Homo sapiens
tgctgcttttgatggctatg

SEQ ID NO: 525803 - DNA, 23 bp, Homo sapiens
tgctgggccggggtgtggaatca

SEQ ID NO: 525804 - DNA, 14 bp, Homo sapiens
tgctgtccctgtgg

SEQ ID NO: 525805 - DNA, 19 bp, Homo sapiens
tgctgtccctgtgggctca

SEQ ID NO: 525806 - DNA, 23 bp, Homo sapiens
tgctgtcgggcaagatagctcct

SEQ ID NO: 525807 - DNA, 18 bp, Homo sapiens
tgctgtctgtgtgaggct

SEQ ID NO: 525808 - DNA, 21 bp, Homo sapiens
tgctgtctgtgtgaggctccc

SEQ ID NO: 525809 - DNA, 16 bp, Homo sapiens
tgctgttgattctttc

SEQ ID NO: 525810 - DNA, 23 bp, Homo sapiens
tgcttaatctagagctatgcaca

SEQ ID NO: 525811 - DNA, 21 bp, Homo sapiens
tgcttagtatctcatcaacaa

SEQ ID NO: 525812 - DNA, 16 bp, Homo sapiens
tgcttctctaaaacag

SEQ ID NO: 525813 - DNA, 24 bp, Homo sapiens
tgcttctggggctccctgcctgga

SEQ ID NO: 525814 - DNA, 14 bp, Homo sapiens
tgcttttctcatgg

SEQ ID NO: 525815 - DNA, 15 bp, Homo sapiens
tgcttttctcatggt

SEQ ID NO: 525816 - DNA, 17 bp, Homo sapiens
tggaaaaaaaaaaatat

SEQ ID NO: 525817 - DNA, 20 bp, Homo sapiens
tggaagttgtcctttctgat

SEQ ID NO: 525818 - DNA, 18 bp, Homo sapiens
tggaatctactagaacct

SEQ ID NO: 525819 - DNA, 21 bp, Homo sapiens
tggaattattagcaccagctt

SEQ ID NO: 525820 - DNA, 16 bp, Homo sapiens
tggacgtgggctccag

SEQ ID NO: 525821 - DNA, 18 bp, Homo sapiens
tggatccttgtcagttgt

SEQ ID NO: 525822 - DNA, 16 bp, Homo sapiens
tggattggcctccagg

SEQ ID NO: 525823 - DNA, 16 bp, Homo sapiens
tggatttgacacactc

SEQ ID NO: 525824 - DNA, 15 bp, Homo sapiens
tggcatttgctgaat

SEQ ID NO: 525825 - DNA, 22 bp, Homo sapiens
tggctatgttttggagagagca

SEQ ID NO: 525826 - DNA, 14 bp, Homo sapiens
tggctcccagcaga

SEQ ID NO: 525827 - DNA, 16 bp, Homo sapiens
tggctcgtgtttcaca

SEQ ID NO: 525828 - DNA, 19 bp, Homo sapiens
tggctcgtgtttcacagtg

SEQ ID NO: 525829 - DNA, 17 bp, Homo sapiens
tggctgtcccctgcaag

SEQ ID NO: 525830 - DNA, 23 bp, Homo sapiens
tggctgttatctgtctttatgat

SEQ ID NO: 525831 - DNA, 13 bp, Homo sapiens
tggctttgtgctt

SEQ ID NO: 525832 - DNA, 14 bp, Homo sapiens
tggctttgtgctta

SEQ ID NO: 525833 - DNA, 18 bp, Homo sapiens
tgggacaggcaccatgct

SEQ ID NO: 525834 - DNA, 19 bp, Homo sapiens
tgggacaggcaccatgctg

SEQ ID NO: 525835 - DNA, 21 bp, Homo sapiens
tgggattcctcccctggaagt

SEQ ID NO: 525836 - DNA, 14 bp, Homo sapiens
tgggcaagcaagga

SEQ ID NO: 525837 - DNA, 21 bp, Homo sapiens
tgggctcacaccggcactgtg

SEQ ID NO: 525838 - DNA, 20 bp, Homo sapiens
tgggctggcacccactggag

SEQ ID NO: 525839 - DNA, 17 bp, Homo sapiens
tggggagggcgcttttg

SEQ ID NO: 525840 - DNA, 13 bp, Homo sapiens
tggggccagcgct

SEQ ID NO: 525841 - DNA, 22 bp, Homo sapiens
tgggggctgttagctcagagga

SEQ ID NO: 525842 - DNA, 19 bp, Homo sapiens
tggtccagggtccagccct

SEQ ID NO: 525843 - DNA, 15 bp, Homo sapiens
tggtctctttctttc

SEQ ID NO: 525844 - DNA, 17 bp, Homo sapiens
tggtctctttctttcca

SEQ ID NO: 525845 - DNA, 18 bp, Homo sapiens
tggtctctttctttccaa

SEQ ID NO: 525846 - DNA, 19 bp, Homo sapiens
tggtcttgtttaatatttg

SEQ ID NO: 525847 - DNA, 15 bp, Homo sapiens
tggttacctattgct

SEQ ID NO: 525848 - DNA, 19 bp, Homo sapiens
tggttacctattgctgtaa

SEQ ID NO: 525849 - DNA, 14 bp, Homo sapiens
tggttcctcatggc

SEQ ID NO: 525850 - DNA, 16 bp, Homo sapiens
tggttcctcatggctg

SEQ ID NO: 525851 - DNA, 22 bp, Homo sapiens
tgtaaaactgtgacattccaca

SEQ ID NO: 525852 - DNA, 16 bp, Homo sapiens
tgtaaatgatatgtct

SEQ ID NO: 525853 - DNA, 17 bp, Homo sapiens
tgtaacattctatttca

SEQ ID NO: 525854 - DNA, 22 bp, Homo sapiens
tgtaagaagctaaaatgaaaaa

SEQ ID NO: 525855 - DNA, 17 bp, Homo sapiens
tgtaatcacactctctt

SEQ ID NO: 525856 - DNA, 17 bp, Homo sapiens
tgtacatagtggtcatt

SEQ ID NO: 525857 - DNA, 20 bp, Homo sapiens
tgtacatagtggtcatttgg

SEQ ID NO: 525858 - DNA, 16 bp, Homo sapiens
tgtacatttatgtgtg

SEQ ID NO: 525859 - DNA, 18 bp, Homo sapiens
tgtacatttatgtgtgaa

SEQ ID NO: 525860 - DNA, 20 bp, Homo sapiens
tgtacatttatgtgtgaagc

SEQ ID NO: 525861 - DNA, 17 bp, Homo sapiens
tgtacgttaattaaaca

SEQ ID NO: 525862 - DNA, 16 bp, Homo sapiens
tgtactaccccaggac

SEQ ID NO: 525863 - DNA, 17 bp, Homo sapiens
tgtagacgcacctgctg

SEQ ID NO: 525864 - DNA, 20 bp, Homo sapiens
tgtagatcaactcatgttaa

SEQ ID NO: 525865 - DNA, 21 bp, Homo sapiens
tgtatattgatgtaactgtgt

SEQ ID NO: 525866 - DNA, 20 bp, Homo sapiens
tgtcacttttttcctgtcaa

SEQ ID NO: 525867 - DNA, 15 bp, Homo sapiens
tgtcagcttcccaac

SEQ ID NO: 525868 - DNA, 15 bp, Homo sapiens
tgtcaggctctgaat

SEQ ID NO: 525869 - DNA, 23 bp, Homo sapiens
tgtcaggctctgaatctctcaaa

SEQ ID NO: 525870 - DNA, 19 bp, Homo sapiens
tgtcagtttgtgaagtgat

SEQ ID NO: 525871 - DNA, 13 bp, Homo sapiens
tgtccaggtcaca

SEQ ID NO: 525872 - DNA, 17 bp, Homo sapiens
tgtccaggtcacaggca

SEQ ID NO: 525873 - DNA, 19 bp, Homo sapiens
tgtccctgtgggctcacac

SEQ ID NO: 525874 - DNA, 15 bp, Homo sapiens
tgtcccttacctggc

SEQ ID NO: 525875 - DNA, 21 bp, Homo sapiens
tgtcctatccctggacgcatg

SEQ ID NO: 525876 - DNA, 21 bp, Homo sapiens
tgtcgggcaagatagctcctt

SEQ ID NO: 525877 - DNA, 16 bp, Homo sapiens
tgtctccagctgattt

SEQ ID NO: 525878 - DNA, 14 bp, Homo sapiens
tgtctcctctgtca

SEQ ID NO: 525879 - DNA, 15 bp, Homo sapiens
tgtctcctctgtcag

SEQ ID NO: 525880 - DNA, 23 bp, Homo sapiens
tgtctgtaatcacactctcttct

SEQ ID NO: 525881 - DNA, 18 bp, Homo sapiens
tgtgaaacagtgtggatg

SEQ ID NO: 525882 - DNA, 14 bp, Homo sapiens
tgtgaactatgttt

SEQ ID NO: 525883 - DNA, 14 bp, Homo sapiens
tgtgaagtgattga

SEQ ID NO: 525884 - DNA, 13 bp, Homo sapiens
tgtgagataaata

SEQ ID NO: 525885 - DNA, 23 bp, Homo sapiens
tgtgaggctccctccctccctgc

SEQ ID NO: 525886 - DNA, 21 bp, Homo sapiens
tgtgcatctggcctgggggct

SEQ ID NO: 525887 - DNA, 21 bp, Homo sapiens
tgtgcccacccgtgttctcct

SEQ ID NO: 525888 - DNA, 20 bp, Homo sapiens
tgtgccgtctttggttcctc

SEQ ID NO: 525889 - DNA, 21 bp, Homo sapiens
ttctcagaagtgaaaaagact

SEQ ID NO: 525890 - DNA, 13 bp, Homo sapiens
ttctcctccaaat

SEQ ID NO: 525891 - DNA, 16 bp, Homo sapiens
ttctgatcctctcttc

SEQ ID NO: 525892 - DNA, 17 bp, Homo sapiens
ttctgtgcatctggcct

SEQ ID NO: 525893 - DNA, 18 bp, Homo sapiens
ttctgtgcatctggcctg

SEQ ID NO: 525894 - DNA, 22 bp, Homo sapiens
tctgcacacataacacacatca

SEQ ID NO: 525895 - DNA, 16 bp, Homo sapiens
tctgccggtggggcca

SEQ ID NO: 525896 - DNA, 17 bp, Homo sapiens
tctgcgacgatccccat

SEQ ID NO: 525897 - DNA, 18 bp, Homo sapiens
tctggaaaaaaaaaaata

SEQ ID NO: 525898 - DNA, 19 bp, Homo sapiens
tctggaaaaaaaaaaatat

SEQ ID NO: 525899 - DNA, 19 bp, Homo sapiens
tctgggggactagaacaca

SEQ ID NO: 525900 - DNA, 18 bp, Homo sapiens
tctgtaaaaagcaggtga

SEQ ID NO: 525901 - DNA, 15 bp, Homo sapiens
tctgtaaaaccaggc

SEQ ID NO: 525902 - DNA, 18 bp, Homo sapiens
tctgtcccagttaactgt

SEQ ID NO: 525903 - DNA, 14 bp, Homo sapiens
tctgtctttatgat

SEQ ID NO: 525904 - DNA, 23 bp, Homo sapiens
tctgtctttatgatttcatgatt

SEQ ID NO: 525905 - DNA, 21 bp, Homo sapiens
tctgtgaaagtctcctgtatc

SEQ ID NO: 525906 - DNA, 16 bp, Homo sapiens
tcttactgttttgtgc

SEQ ID NO: 525907 - DNA, 17 bp, Homo sapiens
tcttactgttttgtgcg

SEQ ID NO: 525908 - DNA, 14 bp, Homo sapiens
tcttcctcttacct

SEQ ID NO: 525909 - DNA, 15 bp, Homo sapiens
tcttgcagcagagag

SEQ ID NO: 525910 - DNA, 11 bp, Homo sapiens
tcttgctgtga

SEQ ID NO: 525911 - DNA, 23 bp, Homo sapiens
tctttaaaatgattcacttttat

SEQ ID NO: 525912 - DNA, 14 bp, Homo sapiens
tctttactaacact

SEQ ID NO: 525913 - DNA, 15 bp, Homo sapiens
tctttactaacactg

SEQ ID NO: 525914 - DNA, 12 bp, Homo sapiens
tctttatgattt

SEQ ID NO: 525915 - DNA, 20 bp, Homo sapiens
tctttcaatccacagtattg

SEQ ID NO: 525916 - DNA, 15 bp, Homo sapiens
tctttggttcctcat

SEQ ID NO: 525917 - DNA, 18 bp, Homo sapiens
tctttggttcctcatggc

SEQ ID NO: 525918 - DNA, 15 bp, Homo sapiens
tctttgttgcttaat

SEQ ID NO: 525919 - DNA, 21 bp, Homo sapiens
tcttttcccatttacaaatga

SEQ ID NO: 525920 - DNA, 16 bp, Homo sapiens
tcttttgttctctctt

SEQ ID NO: 525921 - DNA, 12 bp, Homo sapiens
tgaaaactggaa

SEQ ID NO: 525922 - DNA, 14 bp, Homo sapiens
tgaaaactggaata

SEQ ID NO: 525923 - DNA, 19 bp, Homo sapiens
tgaaattatgtcaaatgga

SEQ ID NO: 525924 - DNA, 20 bp, Homo sapiens
tgaaattatgtcaaatggat

SEQ ID NO: 525925 - DNA, 22 bp, Homo sapiens
tgaaattatgtcaaatggatgt

SEQ ID NO: 525926 - DNA, 19 bp, Homo sapiens
tgaatctctcaaaatgtgc

SEQ ID NO: 525927 - DNA, 21 bp, Homo sapiens
tgaatgaaatataaactgtga

SEQ ID NO: 525928 - DNA, 21 bp, Homo sapiens
tgaatgttgtcctgtgtcatc

SEQ ID NO: 525929 - DNA, 23 bp, Homo sapiens
tgacacactcaccatttaatcat

SEQ ID NO: 525930 - DNA, 19 bp, Homo sapiens
tgacacattgcacacacag

SEQ ID NO: 525931 - DNA, 18 bp, Homo sapiens
tgacactcatcaggtaaa

SEQ ID NO: 525932 - DNA, 21 bp, Homo sapiens
tgacagcatttcagctgtgag

SEQ ID NO: 525933 - DNA, 18 bp, Homo sapiens
tgacattttgtagctagt

SEQ ID NO: 525934 - DNA, 12 bp, Homo sapiens
tgaccctcactt

SEQ ID NO: 525935 - DNA, 21 bp, Homo sapiens
tgaccctcacttttctcatct

SEQ ID NO: 525936 - DNA, 22 bp, Homo sapiens
tgacttctttactaacactggc

SEQ ID NO: 525937 - DNA, 23 bp, Homo sapiens
tgacttctttactaacactggct

SEQ ID NO: 525938 - DNA, 16 bp, Homo sapiens
tgactttcctatgaca

SEQ ID NO: 525939 - DNA, 15 bp, Homo sapiens
tgagaaatataaaaa

SEQ ID NO: 525940 - DNA, 13 bp, Homo sapiens
tgagaactaaata

SEQ ID NO: 525941 - DNA, 15 bp, Homo sapiens
tgagaactaaataga

SEQ ID NO: 525942 - DNA, 15 bp, Homo sapiens
tgagacaacacacac

SEQ ID NO: 525943 - DNA, 21 bp, Homo sapiens
tgagccaataaagctcacact

SEQ ID NO: 525944 - DNA, 21 bp, Homo sapiens
tgagcgttcagttgacacatt

SEQ ID NO: 525945 - DNA, 21 bp, Homo sapiens
tgagttggttacctattgctg

SEQ ID NO: 525946 - DNA, 15 bp, Homo sapiens
tgatatctgtttgct

SEQ ID NO: 525947 - DNA, 17 bp, Homo sapiens
tgatgagacaacacaca

SEQ ID NO: 525948 - DNA, 14 bp, Homo sapiens
tgatgatggaaggg

SEQ ID NO: 525949 - DNA, 16 bp, Homo sapiens
tgatgatttcagaaac

SEQ ID NO: 525950 - DNA, 17 bp, Homo sapiens
tgatggctatgttttgg

SEQ ID NO: 525951 - DNA, 13 bp, Homo sapiens
tgatgtgatttat

SEQ ID NO: 525952 - DNA, 14 bp, Homo sapiens
tgatttatgcattt

SEQ ID NO: 525953 - DNA, 18 bp, Homo sapiens
tgatttcatgattagaca

SEQ ID NO: 525954 - DNA, 16 bp, Homo sapiens
tgcaataaactcagtc

SEQ ID NO: 525955 - DNA, 23 bp, Homo sapiens
tgcaataaactcagtcaaatgta

SEQ ID NO: 525956 - DNA, 17 bp, Homo sapiens
tgcacaccaaattgctg

SEQ ID NO: 525957 - DNA, 20 bp, Homo sapiens
tgcacaccaaattgctgaga

SEQ ID NO: 525958 - DNA, 22 bp, Homo sapiens
tgcacaccaaattgctgagatg

SEQ ID NO: 525959 - DNA, 15 bp, Homo sapiens
tgcacagtggtccag

SEQ ID NO: 525960 - DNA, 13 bp, Homo sapiens
tgcacctgcttct

SEQ ID NO: 525961 - DNA, 15 bp, Homo sapiens
tgcactaaaagtgat

SEQ ID NO: 525962 - DNA, 21 bp, Homo sapiens
tgcactaaaagtgatgtgatt

SEQ ID NO: 525963 - DNA, 14 bp, Homo sapiens
tgcactctactctg

SEQ ID NO: 525964 - DNA, 20 bp, Homo sapiens
tgcagaccacactctgcctg

SEQ ID NO: 525965 - DNA, 14 bp, Homo sapiens
tgcagaccctcaga

SEQ ID NO: 525966 - DNA, 21 bp, Homo sapiens
tgcagcagagagaaataaaac

SEQ ID NO: 525967 - DNA, 12 bp, Homo sapiens
tgcaggaatcaa

SEQ ID NO: 525968 - DNA, 21 bp, Homo sapiens
tgcaggaatcaaaaattgaag

SEQ ID NO: 525969 - DNA, 17 bp, Homo sapiens
tgcaggcagcctgcaga

SEQ ID NO: 525970 - DNA, 20 bp, Homo sapiens
tgcagggacagcctgcacag

SEQ ID NO: 525971 - DNA, 18 bp, Homo sapiens
tgcagggcccccacagga

SEQ ID NO: 525972 - DNA, 17 bp, Homo sapiens
tgcagtcagcacagaga

SEQ ID NO: 525973 - DNA, 16 bp, Homo sapiens
tgcagttagcacagag

SEQ ID NO: 525974 - DNA, 17 bp, Homo sapiens
tgcagttagcacagagg

SEQ ID NO: 525975 - DNA, 18 bp, Homo sapiens
tgcagttagcacagagga

SEQ ID NO: 525976 - DNA, 16 bp, Homo sapiens
tgcatgagaactaaat

SEQ ID NO: 525977 - DNA, 21 bp, Homo sapiens
tgccaatgtccaggtcacagg

SEQ ID NO: 525978 - DNA, 23 bp, Homo sapiens
tgccaatgtccaggtcacaggca

SEQ ID NO: 525979 - DNA, 19 bp, Homo sapiens
tgccaggctcccactgccc

SEQ ID NO: 525980 - DNA, 19 bp, Homo sapiens
tgccagggggcaaggagaa

SEQ ID NO: 525981 - DNA, 14 bp, Homo sapiens
tgccccccatgccc

SEQ ID NO: 525982 - DNA, 17 bp, Homo sapiens
tgccccccatgccctcc

SEQ ID NO: 525983 - DNA, 13 bp, Homo sapiens
tgcccctgcacct

SEQ ID NO: 525984 - DNA, 18 bp, Homo sapiens
tgcccctgcacctgcttc

SEQ ID NO: 525985 - DNA, 20 bp, Homo sapiens
tgcccctgcacctgcttctc

SEQ ID NO: 525986 - DNA, 15 bp, Homo sapiens
tgccctccgcccttc

SEQ ID NO: 525987 - DNA, 19 bp, Homo sapiens
tgccggtggggccagcgct

SEQ ID NO: 525988 - DNA, 19 bp, Homo sapiens
tgccgtctttggttcctca

SEQ ID NO: 525989 - DNA, 21 bp, Homo sapiens
tgcctggaggagaaggaggaa

SEQ ID NO: 525990 - DNA, 22 bp, Homo sapiens
tgcctggatccagctctgggag

SEQ ID NO: 525991 - DNA, 22 bp, Homo sapiens
tgcctgtggtgaggtcctgtcc

SEQ ID NO: 525992 - DNA, 16 bp, Homo sapiens
tgccttgggcgggcca

SEQ ID NO: 525993 - DNA, 22 bp, Homo sapiens
tgcgacggaggcaggaccaggc

SEQ ID NO: 525994 - DNA, 23 bp, Homo sapiens
tgcgacggaggcaggaccaggca

SEQ ID NO: 525995 - DNA, 13 bp, Homo sapiens
aaaaaaaatgata

SEQ ID NO: 525996 - DNA, 12 bp, Homo sapiens
aaaaaaatcaaa

SEQ ID NO: 525997 - DNA, 22 bp, Homo sapiens
aaaaactttccatgacagtagc

SEQ ID NO: 525998 - DNA, 18 bp, Homo sapiens
aaaaatcaaaaaattatc

SEQ ID NO: 525999 - DNA, 13 bp, Homo sapiens
aaaaatgatactt

SEQ ID NO: 526000 - DNA, 16 bp, Homo sapiens
aaaaattatagactcc

SEQ ID NO: 526001 - DNA, 13 bp, Homo sapiens
aaaaattgaagag

SEQ ID NO: 526002 - DNA, 15 bp, Homo sapiens
aaaacaacagcaaca

SEQ ID NO: 526003 - DNA, 15 bp, Homo sapiens
aaaacgatttaattt

SEQ ID NO: 526004 - DNA, 16 bp, Homo sapiens
aaaacgatttaattta

SEQ ID NO: 526005 - DNA, 13 bp, Homo sapiens
aaaactaagttct

SEQ ID NO: 526006 - DNA, 15 bp, Homo sapiens
aaaactgtgacattc

SEQ ID NO: 526007 - DNA, 17 bp, Homo sapiens
aaaactttccatgacag

SEQ ID NO: 526008 - DNA, 23 bp, Homo sapiens
aaaactttccatgacagtagcat

SEQ ID NO: 526009 - DNA, 17 bp, Homo sapiens
aaaagccaagtgtcctg

SEQ ID NO: 526010 - DNA, 19 bp, Homo sapiens
aaaagcggggttcaatgct

SEQ ID NO: 526011 - DNA, 19 bp, Homo sapiens
aaaagtgatgtgatttatg

SEQ ID NO: 526012 - DNA, 17 bp, Homo sapiens
aaaatcatatttacctg

SEQ ID NO: 526013 - DNA, 18 bp, Homo sapiens
aaaatgtgtgcttggaaa

SEQ ID NO: 526014 - DNA, 18 bp, Homo sapiens
aaaattattaaaaattat

SEQ ID NO: 526015 - DNA, 14 bp, Homo sapiens
aaacaaaaactttc

SEQ ID NO: 526016 - DNA, 23 bp, Homo sapiens
aaacaaaaactttccatgacagt

SEQ ID NO: 526017 - DNA, 22 bp, Homo sapiens
aaacaaaatccttgccttcaaa

SEQ ID NO: 526018 - DNA, 20 bp, Homo sapiens
aaacagtgtggatgtaaatt

SEQ ID NO: 526019 - DNA, 20 bp, Homo sapiens
aaacattatagattttcatg

SEQ ID NO: 526020 - DNA, 16 bp, Homo sapiens
aaacatttccctgctg

SEQ ID NO: 526021 - DNA, 20 bp, Homo sapiens
aaacatttccctgctgagtg

SEQ ID NO: 526022 - DNA, 16 bp, Homo sapiens
aaacccggctgactca

SEQ ID NO: 526023 - DNA, 12 bp, Homo sapiens
aaactgtgacat

SEQ ID NO: 526024 - DNA, 21 bp, Homo sapiens
aaactgtgacattccacagag

SEQ ID NO: 526025 - DNA, 17 bp, Homo sapiens
aaactgtgagataaata

SEQ ID NO: 526026 - DNA, 23 bp, Homo sapiens
aaacttactatggtatatatttt

SEQ ID NO: 526027 - DNA, 13 bp, Homo sapiens
aaagacatccaca

SEQ ID NO: 526028 - DNA, 21 bp, Homo sapiens
aaagatggatttgacacactc

SEQ ID NO: 526029 - DNA, 22 bp, Homo sapiens
aaagatggatttgacacactca

SEQ ID NO: 526030 - DNA, 19 bp, Homo sapiens
aaagcatgctcagtattga

SEQ ID NO: 526031 - DNA, 22 bp, Homo sapiens
aaagcatgctcagtattgagac

SEQ ID NO: 526032 - DNA, 16 bp, Homo sapiens
aaaggatgatttaaca

SEQ ID NO: 526033 - DNA, 14 bp, Homo sapiens
aaagtctcctgtat

SEQ ID NO: 526034 - DNA, 12 bp, Homo sapiens
aaataaatatca

SEQ ID NO: 526035 - DNA, 13 bp, Homo sapiens
aaataatataaat

SEQ ID NO: 526036 - DNA, 18 bp, Homo sapiens
aaataatataaatgaatg

SEQ ID NO: 526037 - DNA, 15 bp, Homo sapiens
aaataattaaaacaa

SEQ ID NO: 526038 - DNA, 21 bp, Homo sapiens
aaatacatgcctttccagtgc

SEQ ID NO: 526039 - DNA, 13 bp, Homo sapiens
aaatagctataaa

SEQ ID NO: 526040 - DNA, 18 bp, Homo sapiens
aaatagtgtgtccatgca

SEQ ID NO: 526041 - DNA, 18 bp, Homo sapiens
aaatataaactgtgagat

SEQ ID NO: 526042 - DNA, 19 bp, Homo sapiens
aaatatcattatagcatgt

SEQ ID NO: 526043 - DNA, 17 bp, Homo sapiens
aaatatgagattggaaa

SEQ ID NO: 526044 - DNA, 15 bp, Homo sapiens
aaatcataatcatcc

SEQ ID NO: 526045 - DNA, 15 bp, Homo sapiens
aaatctaaattaact

SEQ ID NO: 526046 - DNA, 15 bp, Homo sapiens
aaatctgtattgcta

SEQ ID NO: 526047 - DNA, 12 bp, Homo sapiens
aaatgaaatact

SEQ ID NO: 526048 - DNA, 17 bp, Homo sapiens
aaatgcaaagcacacct

SEQ ID NO: 526049 - DNA, 14 bp, Homo sapiens
aaatgctgatttaa

SEQ ID NO: 526050 - DNA, 21 bp, Homo sapiens
aaatgctgatttaaacttctt

SEQ ID NO: 526051 - DNA, 17 bp, Homo sapiens
aaatgtgtgcttggaaa

SEQ ID NO: 526052 - DNA, 18 bp, Homo sapiens
aaatgttattcaataact

SEQ ID NO: 526053 - DNA, 17 bp, Homo sapiens
aaattatctttaaaact

SEQ ID NO: 526054 - DNA, 12 bp, Homo sapiens
aaattgaagaga

SEQ ID NO: 526055 - DNA, 20 bp, Homo sapiens
aaattgctgagatgtttagt

SEQ ID NO: 526056 - DNA, 20 bp, Homo sapiens
aaatttctagatatgagaaa

SEQ ID NO: 526057 - DNA, 20 bp, Homo sapiens
aaattttatctcttcttcct

SEQ ID NO: 526058 - DNA, 12 bp, Homo sapiens
aaattttattga

SEQ ID NO: 526059 - DNA, 12 bp, Homo sapiens
aacaaaaacttt

SEQ ID NO: 526060 - DNA, 15 bp, Homo sapiens
aacaaaaactttcca

SEQ ID NO: 526061 - DNA, 21 bp, Homo sapiens
aacaaaaactttccatgacag

SEQ ID NO: 526062 - DNA, 14 bp, Homo sapiens
aacaaagcatgctc

SEQ ID NO: 526063 - DNA, 15 bp, Homo sapiens
aacaaagcatgctca

SEQ ID NO: 526064 - DNA, 22 bp, Homo sapiens
aacaaagcatgctcagtattga

SEQ ID NO: 526065 - DNA, 13 bp, Homo sapiens
aacaacaaagcat

SEQ ID NO: 526066 - DNA, 17 bp, Homo sapiens
aacaacaaagcatgctc

SEQ ID NO: 526067 - DNA, 18 bp, Homo sapiens
aacaacaaagcatgctca

SEQ ID NO: 526068 - DNA, 20 bp, Homo sapiens
aacaatttaggaatgctcaa

SEQ ID NO: 526069 - DNA, 22 bp, Homo sapiens
aacaggcattgcactaaaagtg

SEQ ID NO: 526070 - DNA, 17 bp, Homo sapiens
aacagtgtggatgtaaa

SEQ ID NO: 526071 - DNA, 21 bp, Homo sapiens
aacattatagattttcatgtt

SEQ ID NO: 526072 - DNA, 15 bp, Homo sapiens
aaccacaaattcatg

SEQ ID NO: 526073 - DNA, 15 bp, Homo sapiens
aacccaggtgttgtc

SEQ ID NO: 526074 - DNA, 19 bp, Homo sapiens
aacccaggtgttgtccgtg

SEQ ID NO: 526075 - DNA, 17 bp, Homo sapiens
aacctctactgaaaaca

SEQ ID NO: 526076 - DNA, 19 bp, Homo sapiens
aacctctctgaactgcaac

SEQ ID NO: 526077 - DNA, 22 bp, Homo sapiens
aacctctctgaactgcaacact

SEQ ID NO: 526078 - DNA, 22 bp, Homo sapiens
aaccttttaaaaaaataatata

SEQ ID NO: 526079 - DNA, 12 bp, Homo sapiens
aactgcaacact

SEQ ID NO: 526080 - DNA, 18 bp, Homo sapiens
aactgtgacattccacag

SEQ ID NO: 526081 - DNA, 18 bp, Homo sapiens
aactgtgagataaatatc

SEQ ID NO: 526082 - DNA, 14 bp, Homo sapiens
aacttgctgtgaaa

SEQ ID NO: 526083 - DNA, 10 bp, Homo sapiens
aactttccat

SEQ ID NO: 526084 - DNA, 13 bp, Homo sapiens
aactttccatgac

SEQ ID NO: 526085 - DNA, 14 bp, Homo sapiens
aactttccatgaca

SEQ ID NO: 526086 - DNA, 15 bp, Homo sapiens
aactttccatgacag

SEQ ID NO: 526087 - DNA, 20 bp, Homo sapiens
aactttccatgacagtagca

SEQ ID NO: 526088 - DNA, 21 bp, Homo sapiens
aactttccatgacagtagcat

SEQ ID NO: 526089 - DNA, 17 bp, Homo sapiens
aagaaaccttttaaaaa

SEQ ID NO: 526090 - DNA, 14 bp, Homo sapiens
aagaattttaaaaa

SEQ ID NO: 526091 - DNA, 17 bp, Homo sapiens
aagagagatatatctga

SEQ ID NO: 526092 - DNA, 20 bp, Homo sapiens
aagagagatatatctgaaaa

SEQ ID NO: 526093 - DNA, 21 bp, Homo sapiens
aagatagctccttcatgcttt

SEQ ID NO: 526094 - DNA, 20 bp, Homo sapiens
aagattaagttataccagca

SEQ ID NO: 526095 - DNA, 13 bp, Homo sapiens
aagcaaataaata

SEQ ID NO: 526096 - DNA, 15 bp, Homo sapiens
aagcatgctcagtat

SEQ ID NO: 526097 - DNA, 15 bp, Homo sapiens
aagccaagtgtcctg

SEQ ID NO: 526098 - DNA, 22 bp, Homo sapiens
aagctcacacttgggctggcac

SEQ ID NO: 526099 - DNA, 16 bp, Homo sapiens
aagctcacttgcttta

SEQ ID NO: 526100 - DNA, 12 bp, Homo sapiens
aaggagaaaaaa

SEQ ID NO: 526101 - DNA, 21 bp, Homo sapiens
aaggagccccccaaagacact

SEQ ID NO: 526102 - DNA, 13 bp, Homo sapiens
aaggcttctccac

SEQ ID NO: 526103 - DNA, 14 bp, Homo sapiens
aagggccttctcca

SEQ ID NO: 526104 - DNA, 15 bp, Homo sapiens
aaggggaattaacaa

SEQ ID NO: 526105 - DNA, 13 bp, Homo sapiens
aaggggccagacc

SEQ ID NO: 526106 - DNA, 22 bp, Homo sapiens
aaggggctgcttctggggctcc

SEQ ID NO: 526107 - DNA, 22 bp, Homo sapiens
aaggtcagtgttataaaatctg

SEQ ID NO: 526108 - DNA, 13 bp, Homo sapiens
aaggttgtacata

SEQ ID NO: 526109 - DNA, 16 bp, Homo sapiens
aaggttgtacatagtg

SEQ ID NO: 526110 - DNA, 20 bp, Homo sapiens
aagtgaaaaagacttcaaat

SEQ ID NO: 526111 - DNA, 17 bp, Homo sapiens
aagtgatgtgatttatg

SEQ ID NO: 526112 - DNA, 15 bp, Homo sapiens
aagtgtactggattt

SEQ ID NO: 526113 - DNA, 22 bp, Homo sapiens
aagtttcgagagaaaggagggc

SEQ ID NO: 526114 - DNA, 11 bp, Homo sapiens
aataaaaatag

SEQ ID NO: 526115 - DNA, 13 bp, Homo sapiens
aataaaaatagct

SEQ ID NO: 526116 - DNA, 24 bp, Homo sapiens
aataaaaatagctataaatagtga

SEQ ID NO: 526117 - DNA, 21 bp, Homo sapiens
aataattaaaacaaaatcctt

SEQ ID NO: 526118 - DNA, 23 bp, Homo sapiens
aatactgtattgttacagctgaa

SEQ ID NO: 526119 - DNA, 15 bp, Homo sapiens
aatacttgacaacat

SEQ ID NO: 526120 - DNA, 15 bp, Homo sapiens
aatactttgtgtctt

SEQ ID NO: 526121 - DNA, 18 bp, Homo sapiens
aatagatttttagattcc

SEQ ID NO: 526122 - DNA, 19 bp, Homo sapiens
aatagtgaaaattttattg

SEQ ID NO: 526123 - DNA, 16 bp, Homo sapiens
aatataaaaataatta

SEQ ID NO: 526124 - DNA, 14 bp, Homo sapiens
aatataaactgtga

SEQ ID NO: 526125 - DNA, 19 bp, Homo sapiens
aatataaactgtgagataa

SEQ ID NO: 526126 - DNA, 22 bp, Homo sapiens
aatataaatgaatgaaatataa

SEQ ID NO: 526127 - DNA, 20 bp, Homo sapiens
aatataatggcctcttaaaa

SEQ ID NO: 526128 - DNA, 21 bp, Homo sapiens
aatatatgtttggctgaaatt

SEQ ID NO: 526129 - DNA, 15 bp, Homo sapiens
aatatcattatagca

SEQ ID NO: 526130 - DNA, 16 bp, Homo sapiens
aatatcattatagcat

SEQ ID NO: 526131 - DNA, 18 bp, Homo sapiens
aatatcattatagcatgt

SEQ ID NO: 526132 - DNA, 22 bp, Homo sapiens
aatatcattatagcatgtaata

SEQ ID NO: 526133 - DNA, 13 bp, Homo sapiens
aatcaaaaaatta

SEQ ID NO: 526134 - DNA, 14 bp, Homo sapiens
aatcaaaaaattat

SEQ ID NO: 526135 - DNA, 14 bp, Homo sapiens
aatcaaaaattgaa

SEQ ID NO: 526136 - DNA, 17 bp, Homo sapiens
aatcaaaaattgaagag

SEQ ID NO: 526137 - DNA, 18 bp, Homo sapiens
aatcaagtctgtgaaagt

SEQ ID NO: 526138 - DNA, 12 bp, Homo sapiens
aatcatctattg

SEQ ID NO: 526139 - DNA, 15 bp, Homo sapiens
aatcatctattgagt

SEQ ID NO: 526140 - DNA, 21 bp, Homo sapiens
aatcatttccagcaaaatata

SEQ ID NO: 526141 - DNA, 22 bp, Homo sapiens
aatcatttccagcaaaatatat

SEQ ID NO: 526142 - DNA, 16 bp, Homo sapiens
aatccttgccttcaaa

SEQ ID NO: 526143 - DNA, 14 bp, Homo sapiens
aatctaaattaact

SEQ ID NO: 526144 - DNA, 15 bp, Homo sapiens
aatctctcaaaatgt

SEQ ID NO: 526145 - DNA, 19 bp, Homo sapiens
aatctctcaaaatgtgccg

SEQ ID NO: 526146 - DNA, 16 bp, Homo sapiens
aatcttgctgtgaaac

SEQ ID NO: 526147 - DNA, 22 bp, Homo sapiens
aatgaaatataaactgtgagat

SEQ ID NO: 526148 - DNA, 22 bp, Homo sapiens
aatgagccaataaagctcacac

SEQ ID NO: 526149 - DNA, 16 bp, Homo sapiens
aatgatatgtctttaa

SEQ ID NO: 526150 - DNA, 19 bp, Homo sapiens
aatgattcacttttattgt

SEQ ID NO: 526151 - DNA, 17 bp, Homo sapiens
aatgctcaatgtgctgt

SEQ ID NO: 526152 - DNA, 18 bp, Homo sapiens
aatgctcaatgtgctgtt

SEQ ID NO: 526153 - DNA, 13 bp, Homo sapiens
aatggatgtaata

SEQ ID NO: 526154 - DNA, 17 bp, Homo sapiens
aatgtatattgatgtaa

SEQ ID NO: 526155 - DNA, 20 bp, Homo sapiens
aatgtccaggtcacaggcat

SEQ ID NO: 526156 - DNA, 21 bp, Homo sapiens
aatgtgctgttgattctttca

SEQ ID NO: 526157 - DNA, 18 bp, Homo sapiens
atcatgacttctttacta

SEQ ID NO: 526158 - DNA, 13 bp, Homo sapiens
atccacagtattg

SEQ ID NO: 526159 - DNA, 15 bp, Homo sapiens
atccagccttcttcc

SEQ ID NO: 526160 - DNA, 17 bp, Homo sapiens
atccatgtgctgctgtg

SEQ ID NO: 526161 - DNA, 21 bp, Homo sapiens
atcctctcttcttttcccatt

SEQ ID NO: 526162 - DNA, 16 bp, Homo sapiens
atctaaattaacttct

SEQ ID NO: 526163 - DNA, 14 bp, Homo sapiens
atctactagaacct

SEQ ID NO: 526164 - DNA, 16 bp, Homo sapiens
atctcatcaacaaaga

SEQ ID NO: 526165 - DNA, 19 bp, Homo sapiens
atctctcaaaatgtgccgt

SEQ ID NO: 526166 - DNA, 13 bp, Homo sapiens
atctcttcttcct

SEQ ID NO: 526167 - DNA, 14 bp, Homo sapiens
atctcttcttcctt

SEQ ID NO: 526168 - DNA, 14 bp, Homo sapiens
atctgaaaactgga

SEQ ID NO: 526169 - DNA, 20 bp, Homo sapiens
atctggaaaaaaaaaaatat

SEQ ID NO: 526170 - DNA, 16 bp, Homo sapiens
atctggcctgggggct

SEQ ID NO: 526171 - DNA, 16 bp, Homo sapiens
atctgtggtcttcaaa

SEQ ID NO: 526172 - DNA, 14 bp, Homo sapiens
atctgtttgcttct

SEQ ID NO: 526173 - DNA, 16 bp, Homo sapiens
atctgtttgcttctaa

SEQ ID NO: 526174 - DNA, 19 bp, Homo sapiens
atcttggccctgttaaggc

SEQ ID NO: 526175 - DNA, 13 bp, Homo sapiens
atgaatgaaatat

SEQ ID NO: 526176 - DNA, 21 bp, Homo sapiens
atgacagtagcatactgatga

SEQ ID NO: 526177 - DNA, 17 bp, Homo sapiens
atgagaactaaatagat

SEQ ID NO: 526178 - DNA, 17 bp, Homo sapiens
atgagacaacacacaca

SEQ ID NO: 526179 - DNA, 20 bp, Homo sapiens
atgatatgtctttaaaatga

SEQ ID NO: 526180 - DNA, 14 bp, Homo sapiens
atgattagacaatg

SEQ ID NO: 526181 - DNA, 12 bp, Homo sapiens
atgatttaacat

SEQ ID NO: 526182 - DNA, 13 bp, Homo sapiens
atgatttcagaaa

SEQ ID NO: 526183 - DNA, 15 bp, Homo sapiens
atgatttcagaaaca

SEQ ID NO: 526184 - DNA, 19 bp, Homo sapiens
atgatttcatgattagaca

SEQ ID NO: 526185 - DNA, 17 bp, Homo sapiens
atgcaaagcacacctcg

SEQ ID NO: 526186 - DNA, 18 bp, Homo sapiens
atgcacaccaaattgctg

SEQ ID NO: 526187 - DNA, 19 bp, Homo sapiens
atgcacaccaaattgctga

SEQ ID NO: 526188 - DNA, 12 bp, Homo sapiens
atgcatttatgc

SEQ ID NO: 526189 - DNA, 17 bp, Homo sapiens
atgccaatgtccaggtc

SEQ ID NO: 526190 - DNA, 21 bp, Homo sapiens
atgccctccctgctgccaggc

SEQ ID NO: 526191 - DNA, 22 bp, Homo sapiens
atgcctttctagcaattgcttc

SEQ ID NO: 526192 - DNA, 18 bp, Homo sapiens
atgctatctcgctagcca

SEQ ID NO: 526193 - DNA, 13 bp, Homo sapiens
atgctcaatgtgc

SEQ ID NO: 526194 - DNA, 17 bp, Homo sapiens
atgctcaatgtgctgtt

SEQ ID NO: 526195 - DNA, 12 bp, Homo sapiens
atgctgtccctg

SEQ ID NO: 526196 - DNA, 20 bp, Homo sapiens
atgctgtccctgtgggctca

SEQ ID NO: 526197 - DNA, 16 bp, Homo sapiens
atgcttttctcatggt

SEQ ID NO: 526198 - DNA, 18 bp, Homo sapiens
atggaggtgatgaaaacc

SEQ ID NO: 526199 - DNA, 18 bp, Homo sapiens
atggatttgacacactca

SEQ ID NO: 526200 - DNA, 21 bp, Homo sapiens
atggctgtcccctgcaagtgg

SEQ ID NO: 526201 - DNA, 23 bp, Homo sapiens
atggtagaaattttatctcttct

SEQ ID NO: 526202 - DNA, 15 bp, Homo sapiens
atggtagactgtgac

SEQ ID NO: 526203 - DNA, 13 bp, Homo sapiens
atggtatatattt

SEQ ID NO: 526204 - DNA, 19 bp, Homo sapiens
atgtaatatagggtttgtt

SEQ ID NO: 526205 - DNA, 16 bp, Homo sapiens
atgtaatattaaattc

SEQ ID NO: 526206 - DNA, 16 bp, Homo sapiens
atgtccaggtcacagg

SEQ ID NO: 526207 - DNA, 14 bp, Homo sapiens
atgtcctatccctg

SEQ ID NO: 526208 - DNA, 15 bp, Homo sapiens
atgtctttaaaatga

SEQ ID NO: 526209 - DNA, 16 bp, Homo sapiens
atgtgctcatcagaaa

SEQ ID NO: 526210 - DNA, 14 bp, Homo sapiens
atgtgctgctgtgg

SEQ ID NO: 526211 - DNA, 20 bp, Homo sapiens
atgtgctgttgattctttca

SEQ ID NO: 526212 - DNA, 21 bp, Homo sapiens
atgtgctgttgattctttcaa

SEQ ID NO: 526213 - DNA, 15 bp, Homo sapiens
atgtggaattacata

SEQ ID NO: 526214 - DNA, 19 bp, Homo sapiens
atgttctgacagcatttca

SEQ ID NO: 526215 - DNA, 21 bp, Homo sapiens
atgtttagtagctgataaaga

SEQ ID NO: 526216 - DNA, 17 bp, Homo sapiens
atgtttgcgaatggctt

SEQ ID NO: 526217 - DNA, 19 bp, Homo sapiens
atgtttggctgaaattatg

SEQ ID NO: 526218 - DNA, 17 bp, Homo sapiens
atgttttggagagagca

SEQ ID NO: 526219 - DNA, 19 bp, Homo sapiens
atgttttggagagagcaat

SEQ ID NO: 526220 - DNA, 13 bp, Homo sapiens
attaaaaagttaa

SEQ ID NO: 526221 - DNA, 13 bp, Homo sapiens
attaaatgaaata

SEQ ID NO: 526222 - DNA, 17 bp, Homo sapiens
attaaatgaaatacttg

SEQ ID NO: 526223 - DNA, 21 bp, Homo sapiens
attaagaaaccccctcatgga

SEQ ID NO: 526224 - DNA, 20 bp, Homo sapiens
attacataacaggcattgca

SEQ ID NO: 526225 - DNA, 15 bp, Homo sapiens
attatagcatgtaat

SEQ ID NO: 526226 - DNA, 18 bp, Homo sapiens
attatatcagactgcttt

SEQ ID NO: 526227 - DNA, 21 bp, Homo sapiens
attatggctttgtgcttgttc

SEQ ID NO: 526228 - DNA, 22 bp, Homo sapiens
attcaataactattgctgcttt

SEQ ID NO: 526229 - DNA, 17 bp, Homo sapiens
attcacttttattgtat

SEQ ID NO: 526230 - DNA, 15 bp, Homo sapiens
attcatgcctcaagt

SEQ ID NO: 526231 - DNA, 21 bp, Homo sapiens
attcccatggtagactgtgac

SEQ ID NO: 526232 - DNA, 23 bp, Homo sapiens
attcctcctgtctcctctgtcag

SEQ ID NO: 526233 - DNA, 21 bp, Homo sapiens
attctatttcaacttcaggaa

SEQ ID NO: 526234 - DNA, 19 bp, Homo sapiens
attctcagaagtgaaaaag

SEQ ID NO: 526235 - DNA, 17 bp, Homo sapiens
attctgtcaatgaaaag

SEQ ID NO: 526236 - DNA, 21 bp, Homo sapiens
attctttcaatccacagtatt

SEQ ID NO: 526237 - DNA, 19 bp, Homo sapiens
attgaagagagatatatct

SEQ ID NO: 526238 - DNA, 10 bp, Homo sapiens
attgacattt

SEQ ID NO: 526239 - DNA, 22 bp, Homo sapiens
attgagtcattttatatatgaa

SEQ ID NO: 526240 - DNA, 13 bp, Homo sapiens
attgcactaaaag

SEQ ID NO: 526241 - DNA, 14 bp, Homo sapiens
attgcactaaaagt

SEQ ID NO: 526242 - DNA, 17 bp, Homo sapiens
attgctgagatgtttag

SEQ ID NO: 526243 - DNA, 22 bp, Homo sapiens
attgctgagatgtttagtagct

SEQ ID NO: 526244 - DNA, 14 bp, Homo sapiens
attgctgtaaataa

SEQ ID NO: 526245 - DNA, 20 bp, Homo sapiens
attgctgtaaataaaaatag

SEQ ID NO: 526246 - DNA, 17 bp, Homo sapiens
attgcttctctaaaaca

SEQ ID NO: 526247 - DNA, 13 bp, Homo sapiens
attggcctccagg

SEQ ID NO: 526248 - DNA, 15 bp, Homo sapiens
attggcctccagggc

SEQ ID NO: 526249 - DNA, 21 bp, Homo sapiens
attgttcttgtaaaactgtga

SEQ ID NO: 526250 - DNA, 15 bp, Homo sapiens
atttagtcctcacct

SEQ ID NO: 526251 - DNA, 16 bp, Homo sapiens
atttagtcctcacctt

SEQ ID NO: 526252 - DNA, 16 bp, Homo sapiens
atttataacattgtaa

SEQ ID NO: 526253 - DNA, 17 bp, Homo sapiens
atttataacattgtaaa

SEQ ID NO: 526254 - DNA, 12 bp, Homo sapiens
atttatgtgtga

SEQ ID NO: 526255 - DNA, 15 bp, Homo sapiens
atttatgtgtgaagc

SEQ ID NO: 526256 - DNA, 21 bp, Homo sapiens
atttccatggattcccctgga

SEQ ID NO: 526257 - DNA, 19 bp, Homo sapiens
atttcttggtatgatcatt

SEQ ID NO: 526258 - DNA, 20 bp, Homo sapiens
atttgacacactcaccattt

SEQ ID NO: 526259 - DNA, 15 bp, Homo sapiens
ccgtcagcctgtgaa

SEQ ID NO: 526260 - DNA, 18 bp, Homo sapiens
ccgtctttggttcctcat

SEQ ID NO: 526261 - DNA, 21 bp, Homo sapiens
ccgtggtgaggttgtgctgcc

SEQ ID NO: 526262 - DNA, 18 bp, Homo sapiens
cctaaagggaagccctga

SEQ ID NO: 526263 - DNA, 12 bp, Homo sapiens
cctaaatgcaaa

SEQ ID NO: 526264 - DNA, 14 bp, Homo sapiens
cctaaatgcaaagc

SEQ ID NO: 526265 - DNA, 13 bp, Homo sapiens
cctaccctggacc

SEQ ID NO: 526266 - DNA, 18 bp, Homo sapiens
cctaccctggaccgagtg

SEQ ID NO: 526267 - DNA, 15 bp, Homo sapiens
cctacttaaacaaaa

SEQ ID NO: 526268 - DNA, 21 bp, Homo sapiens
cctagcactttgggaggctga

SEQ ID NO: 526269 - DNA, 13 bp, Homo sapiens
cctagttctttgc

SEQ ID NO: 526270 - DNA, 22 bp, Homo sapiens
cctagttctttgcattcgtcct

SEQ ID NO: 526271 - DNA, 13 bp, Homo sapiens
cctatccctggac

SEQ ID NO: 526272 - DNA, 16 bp, Homo sapiens
cctatgaccataaaat

SEQ ID NO: 526273 - DNA, 23 bp, Homo sapiens
cctattgctgtaaataaaaatag

SEQ ID NO: 526274 - DNA, 13 bp, Homo sapiens
cctcatggctgtt

SEQ ID NO: 526275 - DNA, 19 bp, Homo sapiens
cctcatggctgttatctgt

SEQ ID NO: 526276 - DNA, 20 bp, Homo sapiens
cctccagccacttatttcca

SEQ ID NO: 526277 - DNA, 12 bp, Homo sapiens
cctccatgctgt

SEQ ID NO: 526278 - DNA, 14 bp, Homo sapiens
cctccctccctgct

SEQ ID NO: 526279 - DNA, 16 bp, Homo sapiens
cctccctccctgctcc

SEQ ID NO: 526280 - DNA, 15 bp, Homo sapiens
cctccctgctgccag

SEQ ID NO: 526281 - DNA, 22 bp, Homo sapiens
cctccctgctgccaggctccca

SEQ ID NO: 526282 - DNA, 15 bp, Homo sapiens
cctccgccagccctg

SEQ ID NO: 526283 - DNA, 17 bp, Homo sapiens
cctccgccagccctgtt

SEQ ID NO: 526284 - DNA, 18 bp, Homo sapiens
cctctaggtaaactagca

SEQ ID NO: 526285 - DNA, 21 bp, Homo sapiens
cctctctgaactgcaacactg

SEQ ID NO: 526286 - DNA, 19 bp, Homo sapiens
cctgacactgtctgctgcc

SEQ ID NO: 526287 - DNA, 15 bp, Homo sapiens
cctgagggcccttcc

SEQ ID NO: 526288 - DNA, 17 bp, Homo sapiens
cctgagggcccttccca

SEQ ID NO: 526289 - DNA, 23 bp, Homo sapiens
cctgatggccaggcctcagggac

SEQ ID NO: 526290 - DNA, 22 bp, Homo sapiens
cctgcaagtggacgtgggctcc

SEQ ID NO: 526291 - DNA, 15 bp, Homo sapiens
cctgccgaggtgtgg

SEQ ID NO: 526292 - DNA, 17 bp, Homo sapiens
cctgcctacgtgctgcc

SEQ ID NO: 526293 - DNA, 21 bp, Homo sapiens
cctgcctgagaccacggtcca

SEQ ID NO: 526294 - DNA, 19 bp, Homo sapiens
cctgcctggaggagaagga

SEQ ID NO: 526295 - DNA, 21 bp, Homo sapiens
cctgcgacggaggcaggacca

SEQ ID NO: 526296 - DNA, 21 bp, Homo sapiens
cctgcgccctgacatgctaac

SEQ ID NO: 526297 - DNA, 23 bp, Homo sapiens
cctgctgagaatccccgtgctca

SEQ ID NO: 526298 - DNA, 20 bp, Homo sapiens
cctgctgagtggctcgtgtt

SEQ ID NO: 526299 - DNA, 20 bp, Homo sapiens
cctggacgcatgcagggccc

SEQ ID NO: 526300 - DNA, 15 bp, Homo sapiens
cctggaggagaagga

SEQ ID NO: 526301 - DNA, 19 bp, Homo sapiens
cctggatccagctctggga

SEQ ID NO: 526302 - DNA, 14 bp, Homo sapiens
cctggctcccaggg

SEQ ID NO: 526303 - DNA, 16 bp, Homo sapiens
cctggctcccagggtc

SEQ ID NO: 526304 - DNA, 16 bp, Homo sapiens
catagtggtcatttgg

SEQ ID NO: 526305 - DNA, 22 bp, Homo sapiens
catcagtccacccccattgtga

SEQ ID NO: 526306 - DNA, 22 bp, Homo sapiens
catcctgccttcatggaactca

SEQ ID NO: 526307 - DNA, 18 bp, Homo sapiens
catccttttttaaaaaaa

SEQ ID NO: 526308 - DNA, 14 bp, Homo sapiens
catcgccttctggc

SEQ ID NO: 526309 - DNA, 22 bp, Homo sapiens
catcgccttctggctgctgcag

SEQ ID NO: 526310 - DNA, 12 bp, Homo sapiens
catctctgtaaa

SEQ ID NO: 526311 - DNA, 17 bp, Homo sapiens
catctctgtaaaaagca

SEQ ID NO: 526312 - DNA, 11 bp, Homo sapiens
catctggcctg

SEQ ID NO: 526313 - DNA, 20 bp, Homo sapiens
catctgtaaaaccaggctga

SEQ ID NO: 526314 - DNA, 13 bp, Homo sapiens
catctgtcagctt

SEQ ID NO: 526315 - DNA, 19 bp, Homo sapiens
catctgtcagcttcccaac

SEQ ID NO: 526316 - DNA, 18 bp, Homo sapiens
catgagaactaaatagat

SEQ ID NO: 526317 - DNA, 16 bp, Homo sapiens
catgatgatttcagaa

SEQ ID NO: 526318 - DNA, 18 bp, Homo sapiens
catgcaggcagcctgcag

SEQ ID NO: 526319 - DNA, 15 bp, Homo sapiens
catgcagggccccca

SEQ ID NO: 526320 - DNA, 21 bp, Homo sapiens
catgcagggcccccacaggag

SEQ ID NO: 526321 - DNA, 19 bp, Homo sapiens
catgctaacctctctgaac

SEQ ID NO: 526322 - DNA, 15 bp, Homo sapiens
catgctcagtattga

SEQ ID NO: 526323 - DNA, 15 bp, Homo sapiens
catgctgtccctgtg

SEQ ID NO: 526324 - DNA, 17 bp, Homo sapiens
catgctgtccctgtggg

SEQ ID NO: 526325 - DNA, 18 bp, Homo sapiens
catgctgtccctgtgggc

SEQ ID NO: 526326 - DNA, 19 bp, Homo sapiens
catgctgtccctgtgggct

SEQ ID NO: 526327 - DNA, 23 bp, Homo sapiens
catgctgtccctgtgggctcaca

SEQ ID NO: 526328 - DNA, 15 bp, Homo sapiens
catggctgagagggt

SEQ ID NO: 526329 - DNA, 13 bp, Homo sapiens
catggctgtcccc

SEQ ID NO: 526330 - DNA, 21 bp, Homo sapiens
catggctgttatctgtcttta

SEQ ID NO: 526331 - DNA, 17 bp, Homo sapiens
catggtagactgtgaca

SEQ ID NO: 526332 - DNA, 14 bp, Homo sapiens
catggtatctcttt

SEQ ID NO: 526333 - DNA, 18 bp, Homo sapiens
ctctgtcagtttgtgaag

SEQ ID NO: 526334 - DNA, 22 bp, Homo sapiens
ctcttaaaaattatctttaaaa

SEQ ID NO: 526335 - DNA, 20 bp, Homo sapiens
ctcttacctgtaatagcctc

SEQ ID NO: 526336 - DNA, 16 bp, Homo sapiens
ctcttcttttcccatt

SEQ ID NO: 526337 - DNA, 22 bp, Homo sapiens
ctcttggtctctttctttccaa

SEQ ID NO: 526338 - DNA, 23 bp, Homo sapiens
ctcttggtctctttctttccaaa

SEQ ID NO: 526339 - DNA, 12 bp, Homo sapiens
ctctttctttcc

SEQ ID NO: 526340 - DNA, 16 bp, Homo sapiens
ctctttctttccaaag

SEQ ID NO: 526341 - DNA, 19 bp, Homo sapiens
ctgaaaacacaaacaacaa

SEQ ID NO: 526342 - DNA, 13 bp, Homo sapiens
ctgaaaactggaa

SEQ ID NO: 526343 - DNA, 23 bp, Homo sapiens
ctgaaaactggaataagaagcaa

SEQ ID NO: 526344 - DNA, 18 bp, Homo sapiens
ctgaaattatgtcaaatg

SEQ ID NO: 526345 - DNA, 16 bp, Homo sapiens
ctgaactgcaacactg

SEQ ID NO: 526346 - DNA, 14 bp, Homo sapiens
ctgaataacaacaa

SEQ ID NO: 526347 - DNA, 20 bp, Homo sapiens
ctgaccaagggctgacttct

SEQ ID NO: 526348 - DNA, 13 bp, Homo sapiens
ctgaccctcactt

SEQ ID NO: 526349 - DNA, 24 bp, Homo sapiens
ctgaccctcacttttctcatctgt

SEQ ID NO: 526350 - DNA, 22 bp, Homo sapiens
ctgaccttctgcggctccgggc

SEQ ID NO: 526351 - DNA, 14 bp, Homo sapiens
ctgactcagtgcag

SEQ ID NO: 526352 - DNA, 16 bp, Homo sapiens
ctgactcagtgcaggg

SEQ ID NO: 526353 - DNA, 23 bp, Homo sapiens
ctgactcagtgcagggacagcct

SEQ ID NO: 526354 - DNA, 14 bp, Homo sapiens
ctgacttctccagg

SEQ ID NO: 526355 - DNA, 19 bp, Homo sapiens
ctgagaggagcgtgtccta

SEQ ID NO: 526356 - DNA, 13 bp, Homo sapiens
ctgagctggccta

SEQ ID NO: 526357 - DNA, 16 bp, Homo sapiens
ctgagtggctcgtgtt

SEQ ID NO: 526358 - DNA, 15 bp, Homo sapiens
ctgataaagaaacct

SEQ ID NO: 526359 - DNA, 19 bp, Homo sapiens
ctgatatctgtttgcttct

SEQ ID NO: 526360 - DNA, 19 bp, Homo sapiens
ctgatgagacaacacacac

SEQ ID NO: 526361 - DNA, 12 bp, Homo sapiens
ctgatggccagg

SEQ ID NO: 526362 - DNA, 15 bp, Homo sapiens
ctgatggccaggcct

SEQ ID NO: 526363 - DNA, 14 bp, Homo sapiens
ctgcacacataaca

SEQ ID NO: 526364 - DNA, 19 bp, Homo sapiens
ctgcacacataacacacat

SEQ ID NO: 526365 - DNA, 15 bp, Homo sapiens
ctgcacagtggtcca

SEQ ID NO: 526366 - DNA, 15 bp, Homo sapiens
ctgcacgcccaggat

SEQ ID NO: 526367 - DNA, 18 bp, Homo sapiens
ctgcagaccacactctgc

SEQ ID NO: 526368 - DNA, 20 bp, Homo sapiens
ctgcaggaatcaaaaattga

SEQ ID NO: 526369 - DNA, 15 bp, Homo sapiens
ctgcagtcagcacag

SEQ ID NO: 526370 - DNA, 17 bp, Homo sapiens
ctgcagtcagcacagag

SEQ ID NO: 526371 - DNA, 16 bp, Homo sapiens
ctgcagttagcacaga

SEQ ID NO: 526372 - DNA, 18 bp, Homo sapiens
ctgcagttagcacagagg

SEQ ID NO: 526373 - DNA, 14 bp, Homo sapiens
ctgcataaccgcac

SEQ ID NO: 526374 - DNA, 21 bp, Homo sapiens
ctgccactcaggcagcctgtg

SEQ ID NO: 526375 - DNA, 23 bp, Homo sapiens
ctgccaggctcccactgcccctg

SEQ ID NO: 526376 - DNA, 19 bp, Homo sapiens
ctgccccaggggcactgtg

SEQ ID NO: 526377 - DNA, 13 bp, Homo sapiens
ctgcccctgcacc

SEQ ID NO: 526378 - DNA, 20 bp, Homo sapiens
ctgcccctgcacctgcttct

SEQ ID NO: 526379 - DNA, 19 bp, Homo sapiens
ctgccctccgcccttccct

SEQ ID NO: 526380 - DNA, 19 bp, Homo sapiens
ctgcctggatccagctctg

SEQ ID NO: 526381 - DNA, 19 bp, Homo sapiens
ctgccttctcccctccaag

SEQ ID NO: 526382 - DNA, 21 bp, Homo sapiens
ctgctcccggtgtgcagcggg

SEQ ID NO: 526383 - DNA, 21 bp, Homo sapiens
ctgctgcagtcagcacagaga

SEQ ID NO: 526384 - DNA, 22 bp, Homo sapiens
ctgctgccaggctcccactgcc

SEQ ID NO: 526385 - DNA, 23 bp, Homo sapiens
ctgctgtggcatcaggaaaggaa

SEQ ID NO: 526386 - DNA, 12 bp, Homo sapiens
ctgcttagtgtc

SEQ ID NO: 526387 - DNA, 16 bp, Homo sapiens
ctgcttagtgtccctt

SEQ ID NO: 526388 - DNA, 13 bp, Homo sapiens
ctttgggaggctg

SEQ ID NO: 526389 - DNA, 11 bp, Homo sapiens
ctttgtgctta

SEQ ID NO: 526390 - DNA, 14 bp, Homo sapiens
ctttgtgcttgttc

SEQ ID NO: 526391 - DNA, 15 bp, Homo sapiens
ctttgtgtcttttgt

SEQ ID NO: 526392 - DNA, 19 bp, Homo sapiens
ctttgtgtcttttgttctc

SEQ ID NO: 526393 - DNA, 20 bp, Homo sapiens
ctttgtgtcttttgttctct

SEQ ID NO: 526394 - DNA, 21 bp, Homo sapiens
ctttgttgcttaatctagagc

SEQ ID NO: 526395 - DNA, 12 bp, Homo sapiens
cttttaaaaaaa

SEQ ID NO: 526396 - DNA, 16 bp, Homo sapiens
cttttgttctctcttg

SEQ ID NO: 526397 - DNA, 19 bp, Homo sapiens
ctttttaaacaaatggctt

SEQ ID NO: 526398 - DNA, 22 bp, Homo sapiens
cttttttcctgtcaatatatag

SEQ ID NO: 526399 - DNA, 18 bp, Homo sapiens
gaaaacgatttaatttat

SEQ ID NO: 526400 - DNA, 12 bp, Homo sapiens
gaaaactaagtt

SEQ ID NO: 526401 - DNA, 19 bp, Homo sapiens
gaaaattttattgaatata

SEQ ID NO: 526402 - DNA, 20 bp, Homo sapiens
gaaacagtgtggatgtaaat

SEQ ID NO: 526403 - DNA, 16 bp, Homo sapiens
gaaactgacttgctgt

SEQ ID NO: 526404 - DNA, 21 bp, Homo sapiens
gaaaggaagatgtaagaagct

SEQ ID NO: 526405 - DNA, 20 bp, Homo sapiens
gaaatacttgacaacatttt

SEQ ID NO: 526406 - DNA, 16 bp, Homo sapiens
gaaatataaactgtga

SEQ ID NO: 526407 - DNA, 22 bp, Homo sapiens
gaaatataaactgtgagataaa

SEQ ID NO: 526408 - DNA, 17 bp, Homo sapiens
gaaatattcacaaggtt

SEQ ID NO: 526409 - DNA, 20 bp, Homo sapiens
gaaatctaagtttcgagaga

SEQ ID NO: 526410 - DNA, 13 bp, Homo sapiens
gaaattatatctg

SEQ ID NO: 526411 - DNA, 21 bp, Homo sapiens
gaaattatgtcaaatggatgt

SEQ ID NO: 526412 - DNA, 17 bp, Homo sapiens
gaacgcatgcagggccc

SEQ ID NO: 526413 - DNA, 14 bp, Homo sapiens
gaagaattggcaga

SEQ ID NO: 526414 - DNA, 19 bp, Homo sapiens
gaagagagtatggtgctgg

SEQ ID NO: 526415 - DNA, 15 bp, Homo sapiens
gaagcaaataaatat

SEQ ID NO: 526416 - DNA, 16 bp, Homo sapiens
gaaggcacactgagca

SEQ ID NO: 526417 - DNA, 13 bp, Homo sapiens
gaaggggcggccc

SEQ ID NO: 526418 - DNA, 19 bp, Homo sapiens
gaagtatccctgatttatt

SEQ ID NO: 526419 - DNA, 18 bp, Homo sapiens
gaagtggtaggaaagcct

SEQ ID NO: 526420 - DNA, 19 bp, Homo sapiens
gaatataatggcctcttaa

SEQ ID NO: 526421 - DNA, 19 bp, Homo sapiens
gaatcacctaattaatttc

SEQ ID NO: 526422 - DNA, 16 bp, Homo sapiens
gaatcctggacagctc

SEQ ID NO: 526423 - DNA, 13 bp, Homo sapiens
gaatgaaatataa

SEQ ID NO: 526424 - DNA, 15 bp, Homo sapiens
gaatgctcaatgtgc

SEQ ID NO: 526425 - DNA, 17 bp, Homo sapiens
gaatgctcaatgtgctg

SEQ ID NO: 526426 - DNA, 18 bp, Homo sapiens
gaatgttgtcctgtgtca

SEQ ID NO: 526427 - DNA, 14 bp, Homo sapiens
gaattacataacag

SEQ ID NO: 526428 - DNA, 17 bp, Homo sapiens
gaattcatgcctcaagt

SEQ ID NO: 526429 - DNA, 16 bp, Homo sapiens
gacacactcaccattt

SEQ ID NO: 526430 - DNA, 19 bp, Homo sapiens
gacacagctgagctggcct

SEQ ID NO: 526431 - DNA, 22 bp, Homo sapiens
gacagctccgcgctcggggctg

SEQ ID NO: 526432 - DNA, 13 bp, Homo sapiens
gacatctctgtaa

SEQ ID NO: 526433 - DNA, 13 bp, Homo sapiens
gacattttgtagc

SEQ ID NO: 526434 - DNA, 15 bp, Homo sapiens
gaccaaggagatggg

SEQ ID NO: 526435 - DNA, 18 bp, Homo sapiens
gaccacgacctcgtccat

SEQ ID NO: 526436 - DNA, 15 bp, Homo sapiens
gaccacgcccctgcc

SEQ ID NO: 526437 - DNA, 18 bp, Homo sapiens
gaccatttagtcctcacc

SEQ ID NO: 526438 - DNA, 19 bp, Homo sapiens
gaccatttagtcctcacct

SEQ ID NO: 526439 - DNA, 20 bp, Homo sapiens
gaccatttagtcctcacctt

SEQ ID NO: 526440 - DNA, 22 bp, Homo sapiens
gacccggggatggattggcctc

SEQ ID NO: 526441 - DNA, 23 bp, Homo sapiens
gacccggggatggattggcctcc

SEQ ID NO: 526442 - DNA, 12 bp, Homo sapiens
gaccctcacttt

SEQ ID NO: 526443 - DNA, 23 bp, Homo sapiens
gacctactcctccccctcctcca

SEQ ID NO: 526444 - DNA, 13 bp, Homo sapiens
gacgcatgcaggg

SEQ ID NO: 526445 - DNA, 16 bp, Homo sapiens
gacgcatgcagggccc

SEQ ID NO: 526446 - DNA, 18 bp, Homo sapiens
gacggaggcaggaccagg

SEQ ID NO: 526447 - DNA, 19 bp, Homo sapiens
gactcagtgcagggacagc

SEQ ID NO: 526448 - DNA, 20 bp, Homo sapiens
gactcagtgcagggacagcc

SEQ ID NO: 526449 - DNA, 22 bp, Homo sapiens
gactcagtgcagggacagcctg

SEQ ID NO: 526450 - DNA, 23 bp, Homo sapiens
gactcagtgcagggacagcctgc

SEQ ID NO: 526451 - DNA, 21 bp, Homo sapiens
gactcttactaaccaccattt

SEQ ID NO: 526452 - DNA, 14 bp, Homo sapiens
gagacactgtcaag

SEQ ID NO: 526453 - DNA, 15 bp, Homo sapiens
gagagaaaggagggc

SEQ ID NO: 526454 - DNA, 14 bp, Homo sapiens
gagagatatatctg

SEQ ID NO: 526455 - DNA, 21 bp, Homo sapiens
gagagcggcttccccatcgcc

SEQ ID NO: 526456 - DNA, 21 bp, Homo sapiens
gagagcggcttccccattgcc

SEQ ID NO: 526457 - DNA, 22 bp, Homo sapiens
gagagggtgtgggtgccctgtt

SEQ ID NO: 526458 - DNA, 21 bp, Homo sapiens
gagatggggagggcgcttttg

SEQ ID NO: 526459 - DNA, 20 bp, Homo sapiens
gagcaaactgaagcccacag

SEQ ID NO: 526460 - DNA, 20 bp, Homo sapiens
gagcacagctttcctgggtc

SEQ ID NO: 526461 - DNA, 14 bp, Homo sapiens
gagcagtggcagag

SEQ ID NO: 526462 - DNA, 18 bp, Homo sapiens
gagccaataaagctcaca

SEQ ID NO: 526463 - DNA, 20 bp, Homo sapiens
gagccaataaagctcacact

SEQ ID NO: 526464 - DNA, 18 bp, Homo sapiens
gagcgtgtactaccccag

SEQ ID NO: 526465 - DNA, 23 bp, Homo sapiens
gagctatgcacaccaaattgctg

SEQ ID NO: 526466 - DNA, 13 bp, Homo sapiens
gagcttggcagag

SEQ ID NO: 526467 - DNA, 16 bp, Homo sapiens
gaggagagagggggag

SEQ ID NO: 526468 - DNA, 21 bp, Homo sapiens
gaggagagagggggagacccc

SEQ ID NO: 526469 - DNA, 21 bp, Homo sapiens
gaggagcaaacaggaaaatga

SEQ ID NO: 526470 - DNA, 15 bp, Homo sapiens
gaggagcgtgtccta

SEQ ID NO: 526471 - DNA, 16 bp, Homo sapiens
gagggcccttcccaac

SEQ ID NO: 526472 - DNA, 15 bp, Homo sapiens
gagggcgcttttgta

SEQ ID NO: 526473 - DNA, 17 bp, Homo sapiens
gagtcagggctgtgctt

SEQ ID NO: 526474 - DNA, 14 bp, Homo sapiens
gagtggctcgtgtt

SEQ ID NO: 526475 - DNA, 13 bp, Homo sapiens
gagtggggaggag

SEQ ID NO: 526476 - DNA, 13 bp, Homo sapiens
gagtgtcaggctc

SEQ ID NO: 526477 - DNA, 20 bp, Homo sapiens
gataaagaaaccttttaaaa

SEQ ID NO: 526478 - DNA, 14 bp, Homo sapiens
gataattaaatgaa

SEQ ID NO: 526479 - DNA, 16 bp, Homo sapiens
gataccattttgaaat

SEQ ID NO: 526480 - DNA, 17 bp, Homo sapiens
gatagccgggctccagg

SEQ ID NO: 526481 - DNA, 13 bp, Homo sapiens
gatagctccttca

SEQ ID NO: 526482 - DNA, 14 bp, Homo sapiens
gatatatctgaaaa

SEQ ID NO: 526483 - DNA, 15 bp, Homo sapiens
gatccagcggggctt

SEQ ID NO: 526484 - DNA, 16 bp, Homo sapiens
gatccagctctgggag

SEQ ID NO: 526485 - DNA, 17 bp, Homo sapiens
gatccagctctgggagc

SEQ ID NO: 526486 - DNA, 20 bp, Homo sapiens
gatccccatggaacagccct

SEQ ID NO: 526487 - DNA, 12 bp, Homo sapiens
gatgcatgcagg

SEQ ID NO: 526488 - DNA, 16 bp, Homo sapiens
gatgcatgcagggccc

SEQ ID NO: 526489 - DNA, 21 bp, Homo sapiens
gatggccaggcctcagggacc

SEQ ID NO: 526490 - DNA, 14 bp, Homo sapiens
gatggggagggcgc

SEQ ID NO: 526491 - DNA, 14 bp, Homo sapiens
gatgtttagtagct

SEQ ID NO: 526492 - DNA, 20 bp, Homo sapiens
gatgtttagtagctgataaa

SEQ ID NO: 526493 - DNA, 18 bp, Homo sapiens
gattaagttataccagca

SEQ ID NO: 526494 - DNA, 22 bp, Homo sapiens
gattaagttataccagcaaaag

SEQ ID NO: 526495 - DNA, 17 bp, Homo sapiens
gattcctacttaaacaa

SEQ ID NO: 526496 - DNA, 13 bp, Homo sapiens
gatttatgcattt

SEQ ID NO: 526497 - DNA, 12 bp, Homo sapiens
gatttcagaaac

SEQ ID NO: 526498 - DNA, 18 bp, Homo sapiens
gatttcatgattagacaa

SEQ ID NO: 526499 - DNA, 18 bp, Homo sapiens
gcaaaatacatgatgatt

SEQ ID NO: 526500 - DNA, 13 bp, Homo sapiens
gcaaagatccagc

SEQ ID NO: 526501 - DNA, 19 bp, Homo sapiens
gcaaagatccagcggggct

SEQ ID NO: 526502 - DNA, 24 bp, Homo sapiens
gcaaatttctagatatgagaaata

SEQ ID NO: 526503 - DNA, 16 bp, Homo sapiens
gcaacagctgtgtgtg

SEQ ID NO: 526504 - DNA, 19 bp, Homo sapiens
gcaacttgaaattatatct

SEQ ID NO: 526505 - DNA, 15 bp, Homo sapiens
gcaataaactcagtc

SEQ ID NO: 526506 - DNA, 16 bp, Homo sapiens
gcaatcttgctgtgaa

SEQ ID NO: 526507 - DNA, 20 bp, Homo sapiens
gcacacaactgtggtcccag

SEQ ID NO: 526508 - DNA, 16 bp, Homo sapiens
gcacacacagtctgtt

SEQ ID NO: 526509 - DNA, 14 bp, Homo sapiens
gcacacataacaca

SEQ ID NO: 526510 - DNA, 20 bp, Homo sapiens
gcacagaggatggcttcccc

SEQ ID NO: 526511 - DNA, 20 bp, Homo sapiens
gcaccatgctgggccggggt

SEQ ID NO: 526512 - DNA, 15 bp, Homo sapiens
gcacccccggacgcc

SEQ ID NO: 526513 - DNA, 14 bp, Homo sapiens
gcacctgcttctca

SEQ ID NO: 526514 - DNA, 15 bp, Homo sapiens
gcactgccctccgcc

SEQ ID NO: 526515 - DNA, 17 bp, Homo sapiens
gcactttgggaggctga

SEQ ID NO: 526516 - DNA, 23 bp, Homo sapiens
gcagcctgcagaccacactctgc

SEQ ID NO: 526517 - DNA, 14 bp, Homo sapiens
gcagcgaggtccac

SEQ ID NO: 526518 - DNA, 23 bp, Homo sapiens
gcagggccagtcatggctgtccc

SEQ ID NO: 526519 - DNA, 17 bp, Homo sapiens
gcagggcccccacagga

SEQ ID NO: 526520 - DNA, 22 bp, Homo sapiens
gcagtcagcacagagagcggct

SEQ ID NO: 526521 - DNA, 14 bp, Homo sapiens
gcatactgatgaga

SEQ ID NO: 526522 - DNA, 14 bp, Homo sapiens
gcatctggcctggg

SEQ ID NO: 526523 - DNA, 23 bp, Homo sapiens
gcatgcagggcccccacaggagc

SEQ ID NO: 526524 - DNA, 11 bp, Homo sapiens
gcatgctcagt

SEQ ID NO: 526525 - DNA, 15 bp, Homo sapiens
gcatgctcagtattg

SEQ ID NO: 526526 - DNA, 14 bp, Homo sapiens
gcttaatctagagc

SEQ ID NO: 526527 - DNA, 15 bp, Homo sapiens
gcttaatctagagct

SEQ ID NO: 526528 - DNA, 22 bp, Homo sapiens
gcttagtatctcatcaacaaag

SEQ ID NO: 526529 - DNA, 23 bp, Homo sapiens
gcttagtatctcatcaacaaaga

SEQ ID NO: 526530 - DNA, 15 bp, Homo sapiens
gcttccccatcgcct

SEQ ID NO: 526531 - DNA, 22 bp, Homo sapiens
gcttggtttagctgtgcagaag

SEQ ID NO: 526532 - DNA, 11 bp, Homo sapiens
gcttgttcttc

SEQ ID NO: 526533 - DNA, 22 bp, Homo sapiens
gctttccgcgtggttctgccac

SEQ ID NO: 526534 - DNA, 14 bp, Homo sapiens
gcttttgatggcta

SEQ ID NO: 526535 - DNA, 17 bp, Homo sapiens
gcttttgatggctatgt

SEQ ID NO: 526536 - DNA, 19 bp, Homo sapiens
gcttttgtacgttaattaa

SEQ ID NO: 526537 - DNA, 12 bp, Homo sapiens
ggaacagccctg

SEQ ID NO: 526538 - DNA, 15 bp, Homo sapiens
ggaagtcatcctgca

SEQ ID NO: 526539 - DNA, 17 bp, Homo sapiens
ggaataagaagcaaata

SEQ ID NO: 526540 - DNA, 11 bp, Homo sapiens
ggacacagagg

SEQ ID NO: 526541 - DNA, 23 bp, Homo sapiens
ggacacagaggacagcttcccca

SEQ ID NO: 526542 - DNA, 14 bp, Homo sapiens
ggacctagtcgggg

SEQ ID NO: 526543 - DNA, 14 bp, Homo sapiens
ggacgcatgcaggg

SEQ ID NO: 526544 - DNA, 21 bp, Homo sapiens
ggacgccccccggcctgatgg

SEQ ID NO: 526545 - DNA, 16 bp, Homo sapiens
ggacgtgggctccagg

SEQ ID NO: 526546 - DNA, 22 bp, Homo sapiens
ggagtcagggctgtgctttccg

SEQ ID NO: 526547 - DNA, 18 bp, Homo sapiens
ggatccagctctgggagc

SEQ ID NO: 526548 - DNA, 14 bp, Homo sapiens
ggatgcatgcaggg

SEQ ID NO: 526549 - DNA, 16 bp, Homo sapiens
ggatgcatgcagggcc

SEQ ID NO: 526550 - DNA, 23 bp, Homo sapiens
ggatgggggtcctggtatgtctc

SEQ ID NO: 526551 - DNA, 14 bp, Homo sapiens
ggatgtaatatagg

SEQ ID NO: 526552 - DNA, 16 bp, Homo sapiens
ggcaacagagtgagac

SEQ ID NO: 526553 - DNA, 13 bp, Homo sapiens
ggcacggaggctc

SEQ ID NO: 526554 - DNA, 15 bp, Homo sapiens
ggcagcctgcagacc

SEQ ID NO: 526555 - DNA, 15 bp, Homo sapiens
ggcatccacttcaca

SEQ ID NO: 526556 - DNA, 18 bp, Homo sapiens
ggccatttcacattcctg

SEQ ID NO: 526557 - DNA, 23 bp, Homo sapiens
ggcccccacaggagcgtgtccta

SEQ ID NO: 526558 - DNA, 16 bp, Homo sapiens
ggcccggacgggggag

SEQ ID NO: 526559 - DNA, 17 bp, Homo sapiens
ggccgctgcagtcagca

SEQ ID NO: 526560 - DNA, 21 bp, Homo sapiens
ggccgctgcagtcagcacaga

SEQ ID NO: 526561 - DNA, 22 bp, Homo sapiens
ggcctcagggaccaaggagatg

SEQ ID NO: 526562 - DNA, 13 bp, Homo sapiens
ggcctgatggcca

SEQ ID NO: 526563 - DNA, 14 bp, Homo sapiens
ggcctgatggccag

SEQ ID NO: 526564 - DNA, 18 bp, Homo sapiens
ggcctgatggccaggcct

SEQ ID NO: 526565 - DNA, 14 bp, Homo sapiens
ggcctggcttctgg

SEQ ID NO: 526566 - DNA, 23 bp, Homo sapiens
ggcctgggggctgttagctcaga

SEQ ID NO: 526567 - DNA, 14 bp, Homo sapiens
ggcgcaggggaggg

SEQ ID NO: 526568 - DNA, 18 bp, Homo sapiens
ggcgccggttccacgtgg

SEQ ID NO: 526569 - DNA, 21 bp, Homo sapiens
ggcgtccctgagggcccttcc

SEQ ID NO: 526570 - DNA, 20 bp, Homo sapiens
ggctaaatgcctaataaaca

SEQ ID NO: 526571 - DNA, 20 bp, Homo sapiens
ggctcacaccggcactgtgc

SEQ ID NO: 526572 - DNA, 23 bp, Homo sapiens
ggctcacaccggcactgtgcact

SEQ ID NO: 526573 - DNA, 16 bp, Homo sapiens
ggctcccagcagaggc

SEQ ID NO: 526574 - DNA, 23 bp, Homo sapiens
ggctccctccctccctgctccct

SEQ ID NO: 526575 - DNA, 17 bp, Homo sapiens
ggctcgtgtttcacagt

SEQ ID NO: 526576 - DNA, 20 bp, Homo sapiens
ggctcgtgtttcacagtggg

SEQ ID NO: 526577 - DNA, 14 bp, Homo sapiens
ggctgaaattatgt

SEQ ID NO: 526578 - DNA, 22 bp, Homo sapiens
ggctgaaattatgtcaaatgga

SEQ ID NO: 526579 - DNA, 22 bp, Homo sapiens
ggctgccagggggcaaggagaa

SEQ ID NO: 526580 - DNA, 17 bp, Homo sapiens
ggctgctgcagtcagca

SEQ ID NO: 526581 - DNA, 15 bp, Homo sapiens
ggctgtcccctgcaa

SEQ ID NO: 526582 - DNA, 13 bp, Homo sapiens
ggctgttatctgt

SEQ ID NO: 526583 - DNA, 16 bp, Homo sapiens
gggagggacacagagg

SEQ ID NO: 526584 - DNA, 16 bp, Homo sapiens
gggagtggggaggaga

SEQ ID NO: 526585 - DNA, 21 bp, Homo sapiens
gggatgctatctcgctagcca

SEQ ID NO: 526586 - DNA, 20 bp, Homo sapiens
gggatggattggcctccagg

SEQ ID NO: 526587 - DNA, 15 bp, Homo sapiens
gggcccccacaggag

SEQ ID NO: 526588 - DNA, 21 bp, Homo sapiens
gggcccttcccaacctcccct

SEQ ID NO: 526589 - DNA, 15 bp, Homo sapiens
gggctccctgcctgg

SEQ ID NO: 526590 - DNA, 16 bp, Homo sapiens
gggctccctgcctgga

SEQ ID NO: 526591 - DNA, 21 bp, Homo sapiens
gggctctctcacccagcctgg

SEQ ID NO: 526592 - DNA, 18 bp, Homo sapiens
gggctgacttctccagga

SEQ ID NO: 526593 - DNA, 14 bp, Homo sapiens
gggctgggcagaag

SEQ ID NO: 526594 - DNA, 12 bp, Homo sapiens
ggggagggcgct

SEQ ID NO: 526595 - DNA, 13 bp, Homo sapiens
ggggcaaggagaa

SEQ ID NO: 526596 - DNA, 15 bp, Homo sapiens
ggggctgcttctggg

SEQ ID NO: 526597 - DNA, 18 bp, Homo sapiens
gtgggcggcttccctgcg

SEQ ID NO: 526598 - DNA, 20 bp, Homo sapiens
gtggtccagggtccagccct

SEQ ID NO: 526599 - DNA, 14 bp, Homo sapiens
gtggtgaggtcctg

SEQ ID NO: 526600 - DNA, 22 bp, Homo sapiens
gtggtgaggtcctgtcctggct

SEQ ID NO: 526601 - DNA, 21 bp, Homo sapiens
gtggtgaggttgtgctgcctg

SEQ ID NO: 526602 - DNA, 14 bp, Homo sapiens
gtgtcccgttgtgt

SEQ ID NO: 526603 - DNA, 20 bp, Homo sapiens
gtgtcttttgttctctcttg

SEQ ID NO: 526604 - DNA, 19 bp, Homo sapiens
tagggtttgtttgctgctt

SEQ ID NO: 526605 - DNA, 23 bp, Homo sapiens
tagggtttgtttgctgcttttga

SEQ ID NO: 526606 - DNA, 19 bp, Homo sapiens
taggtctgcacacataaca

SEQ ID NO: 526607 - DNA, 18 bp, Homo sapiens
tagtagctgataaagaaa

SEQ ID NO: 526608 - DNA, 18 bp, Homo sapiens
tagtgaaaattttattga

SEQ ID NO: 526609 - DNA, 19 bp, Homo sapiens
tagtgaaaattttattgaa

SEQ ID NO: 526610 - DNA, 18 bp, Homo sapiens
tagtgtcacttttttcct

SEQ ID NO: 526611 - DNA, 22 bp, Homo sapiens
tagtgtcacttttttcctgtca

SEQ ID NO: 526612 - DNA, 15 bp, Homo sapiens
tagtgtcccttacct

SEQ ID NO: 526613 - DNA, 20 bp, Homo sapiens
tagtgtcccttacctggctt

SEQ ID NO: 526614 - DNA, 16 bp, Homo sapiens
tataaactgtgagata

SEQ ID NO: 526615 - DNA, 18 bp, Homo sapiens
tataaactgtgagataaa

SEQ ID NO: 526616 - DNA, 14 bp, Homo sapiens
tataaatgaatgaa

SEQ ID NO: 526617 - DNA, 20 bp, Homo sapiens
tataaatgaatgaaatataa

SEQ ID NO: 526618 - DNA, 18 bp, Homo sapiens
tataattttattgctgga

SEQ ID NO: 526619 - DNA, 13 bp, Homo sapiens
tataccagcaaaa

SEQ ID NO: 526620 - DNA, 16 bp, Homo sapiens
tataccagcaaaagtg

SEQ ID NO: 526621 - DNA, 23 bp, Homo sapiens
tatactatttattaaaaccattc

SEQ ID NO: 526622 - DNA, 15 bp, Homo sapiens
tatagcatgtaatat

SEQ ID NO: 526623 - DNA, 17 bp, Homo sapiens
tatagggtttgtttgct

SEQ ID NO: 526624 - DNA, 18 bp, Homo sapiens
tatataattttattgctg

SEQ ID NO: 526625 - DNA, 18 bp, Homo sapiens
tatatctgaaaactggaa

SEQ ID NO: 526626 - DNA, 16 bp, Homo sapiens
tatcagtacaattctt

SEQ ID NO: 526627 - DNA, 16 bp, Homo sapiens
tatcattatagcatgt

SEQ ID NO: 526628 - DNA, 21 bp, Homo sapiens
tatccccggacgcatgcaggg

SEQ ID NO: 526629 - DNA, 15 bp, Homo sapiens
tatctgtctttatga

SEQ ID NO: 526630 - DNA, 16 bp, Homo sapiens
tatctgtctttatgat

SEQ ID NO: 526631 - DNA, 23 bp, Homo sapiens
tatgaagccctaagtaaatctaa

SEQ ID NO: 526632 - DNA, 18 bp, Homo sapiens
tatgagaaatataaaaat

SEQ ID NO: 526633 - DNA, 20 bp, Homo sapiens
tatgagaaatataaaaataa

SEQ ID NO: 526634 - DNA, 20 bp, Homo sapiens
tatgagattggaaaaaatta

SEQ ID NO: 526635 - DNA, 22 bp, Homo sapiens
tatgagattggaaaaaattaga

SEQ ID NO: 526636 - DNA, 12 bp, Homo sapiens
tatgatttcatg

SEQ ID NO: 526637 - DNA, 18 bp, Homo sapiens
tatgatttcatgattaga

SEQ ID NO: 526638 - DNA, 21 bp, Homo sapiens
tatgcacaccaaattgctgag

SEQ ID NO: 526639 - DNA, 22 bp, Homo sapiens
tatgcacaccaaattgctgaga

SEQ ID NO: 526640 - DNA, 16 bp, Homo sapiens
tatgcatgagaactaa

SEQ ID NO: 526641 - DNA, 21 bp, Homo sapiens
tatgcatgagaactaaataga

SEQ ID NO: 526642 - DNA, 12 bp, Homo sapiens
tatgcatttatg

SEQ ID NO: 526643 - DNA, 15 bp, Homo sapiens
tatgcatttatgcat

SEQ ID NO: 526644 - DNA, 17 bp, Homo sapiens
tatgcatttatgcatga

SEQ ID NO: 526645 - DNA, 18 bp, Homo sapiens
tatgcatttatgcatgag

SEQ ID NO: 526646 - DNA, 19 bp, Homo sapiens
tatgcatttatgcatgaga

SEQ ID NO: 526647 - DNA, 14 bp, Homo sapiens
tatggctttgtgct

SEQ ID NO: 526648 - DNA, 17 bp, Homo sapiens
tatggctttgtgcttgt

SEQ ID NO: 526649 - DNA, 14 bp, Homo sapiens
tatggtatatattt

SEQ ID NO: 526650 - DNA, 13 bp, Homo sapiens
tatgtcaaatgga

SEQ ID NO: 526651 - DNA, 20 bp, Homo sapiens
tatgtcaaatggatgtaata

SEQ ID NO: 526652 - DNA, 20 bp, Homo sapiens
tatgtttggctgaaattatg

SEQ ID NO: 526653 - DNA, 14 bp, Homo sapiens
tattagcaccagct

SEQ ID NO: 526654 - DNA, 15 bp, Homo sapiens
tattatctagtaggt

SEQ ID NO: 526655 - DNA, 16 bp, Homo sapiens
tattgagacactgtca

SEQ ID NO: 526656 - DNA, 17 bp, Homo sapiens
tattgagacactgtcaa

SEQ ID NO: 526657 - DNA, 14 bp, Homo sapiens
tattgctgtaaata

SEQ ID NO: 526658 - DNA, 19 bp, Homo sapiens
tattgctgtaaataaaaat

SEQ ID NO: 526659 - DNA, 14 bp, Homo sapiens
tattgttcttgtaa

SEQ ID NO: 526660 - DNA, 15 bp, Homo sapiens
tattgttcttgtaaa

SEQ ID NO: 526661 - DNA, 20 bp, Homo sapiens
tattgttcttgtaaaactgt

SEQ ID NO: 526662 - DNA, 23 bp, Homo sapiens
tattgttcttgtaaaactgtgac

SEQ ID NO: 526663 - DNA, 15 bp, Homo sapiens
tatttataacattgt

SEQ ID NO: 526664 - DNA, 18 bp, Homo sapiens
tcaaaaattgaagagaga

SEQ ID NO: 526665 - DNA, 21 bp, Homo sapiens
tcaacaaagaaatattatttg

SEQ ID NO: 526666 - DNA, 18 bp, Homo sapiens
tcaagctccatcttattt

SEQ ID NO: 526667 - DNA, 16 bp, Homo sapiens
tcaagtggaaaccttg

SEQ ID NO: 526668 - DNA, 13 bp, Homo sapiens
tcaatccacagta

SEQ ID NO: 526669 - DNA, 17 bp, Homo sapiens
tcaatccacagtattgt

SEQ ID NO: 526670 - DNA, 18 bp, Homo sapiens
tcaatccacagtattgtt

SEQ ID NO: 526671 - DNA, 14 bp, Homo sapiens
tcacaccggcactg

SEQ ID NO: 526672 - DNA, 16 bp, Homo sapiens
tcacactctcttctta

SEQ ID NO: 526673 - DNA, 18 bp, Homo sapiens
tcacactctcttcttact

SEQ ID NO: 526674 - DNA, 12 bp, Homo sapiens
tcacacttgggc

SEQ ID NO: 526675 - DNA, 15 bp, Homo sapiens
tcacacttgggctgg

SEQ ID NO: 526676 - DNA, 21 bp, Homo sapiens
tcaccatttaatcatttccag

SEQ ID NO: 526677 - DNA, 17 bp, Homo sapiens
tcaccgtcacaataaaa

SEQ ID NO: 526678 - DNA, 15 bp, Homo sapiens
tcaccttctgtttta

SEQ ID NO: 526679 - DNA, 16 bp, Homo sapiens
tcacgcaacttgaaat

SEQ ID NO: 526680 - DNA, 15 bp, Homo sapiens
tcactccctgtcata

SEQ ID NO: 526681 - DNA, 17 bp, Homo sapiens
tcacttttttcctgtca

SEQ ID NO: 526682 - DNA, 19 bp, Homo sapiens
tcacttttttcctgtcaat

SEQ ID NO: 526683 - DNA, 14 bp, Homo sapiens
tcagcaaggggctg

SEQ ID NO: 526684 - DNA, 19 bp, Homo sapiens
tcagcatcgtgtgggtccc

SEQ ID NO: 526685 - DNA, 17 bp, Homo sapiens
tcagctgtctgtggctt

SEQ ID NO: 526686 - DNA, 12 bp, Homo sapiens
tcaggctctgaa

SEQ ID NO: 526687 - DNA, 14 bp, Homo sapiens
tcagggaccaagga

SEQ ID NO: 526688 - DNA, 22 bp, Homo sapiens
tcagggttttagagagcagtgg

SEQ ID NO: 526689 - DNA, 15 bp, Homo sapiens
tcaggtaaactgatg

SEQ ID NO: 526690 - DNA, 21 bp, Homo sapiens
tcaggtttccggctactgaca

SEQ ID NO: 526691 - DNA, 20 bp, Homo sapiens
tcagtattgagacactgtca

SEQ ID NO: 526692 - DNA, 22 bp, Homo sapiens
tcagtattgagacactgtcaag

SEQ ID NO: 526693 - DNA, 18 bp, Homo sapiens
tcagtgcagggacagcct

SEQ ID NO: 526694 - DNA, 15 bp, Homo sapiens
tcagtgttataaaat

SEQ ID NO: 526695 - DNA, 18 bp, Homo sapiens
tcagtgttataaaatctg

SEQ ID NO: 526696 - DNA, 12 bp, Homo sapiens
tcagtttgtgaa

SEQ ID NO: 526697 - DNA, 13 bp, Homo sapiens
tcagtttgtgaag

SEQ ID NO: 526698 - DNA, 20 bp, Homo sapiens
tcatagataccattttgaaa

SEQ ID NO: 526699 - DNA, 22 bp, Homo sapiens
tcatagataccattttgaaata

SEQ ID NO: 526700 - DNA, 12 bp, Homo sapiens
tcatatctgtat

SEQ ID NO: 526701 - DNA, 17 bp, Homo sapiens
tcatatttacctgtgaa

SEQ ID NO: 526702 - DNA, 16 bp, Homo sapiens
ttcttcccccagggtc

SEQ ID NO: 526703 - DNA, 18 bp, Homo sapiens
ttcttcctcttacctgta

SEQ ID NO: 526704 - DNA, 20 bp, Homo sapiens
ttcttccttttgtatcctcc

SEQ ID NO: 526705 - DNA, 19 bp, Homo sapiens
ttcttgcagtcatcagaag

SEQ ID NO: 526706 - DNA, 16 bp, Homo sapiens
ttcttggtatgatcat

SEQ ID NO: 526707 - DNA, 16 bp, Homo sapiens
ttcttgtaaaactgtg

SEQ ID NO: 526708 - DNA, 19 bp, Homo sapiens
ttcttgtaaaactgtgaca

SEQ ID NO: 526709 - DNA, 14 bp, Homo sapiens
ttctttccaaaggt

SEQ ID NO: 526710 - DNA, 13 bp, Homo sapiens
ttcttttaatttt

SEQ ID NO: 526711 - DNA, 20 bp, Homo sapiens
ttgaaaggagaaaaaaaaag

SEQ ID NO: 526712 - DNA, 19 bp, Homo sapiens
ttgaaattatatctgtggt

SEQ ID NO: 526713 - DNA, 21 bp, Homo sapiens
ttgaagagagatatatctgaa

SEQ ID NO: 526714 - DNA, 17 bp, Homo sapiens
ttgagtttcatttttca

SEQ ID NO: 526715 - DNA, 19 bp, Homo sapiens
ttgatggctatgttttgga

SEQ ID NO: 526716 - DNA, 19 bp, Homo sapiens
ttgatggtagaaattttat

SEQ ID NO: 526717 - DNA, 23 bp, Homo sapiens
ttgatggtagaaattttatctct

SEQ ID NO: 526718 - DNA, 20 bp, Homo sapiens
ttgcacacacagtctgttca

SEQ ID NO: 526719 - DNA, 21 bp, Homo sapiens
ttgcactaaaagtgatgtgat

SEQ ID NO: 526720 - DNA, 13 bp, Homo sapiens
ttgcagtaaagtt

SEQ ID NO: 526721 - DNA, 23 bp, Homo sapiens
ttgccttcccccctcagcaaggg

SEQ ID NO: 526722 - DNA, 14 bp, Homo sapiens
ttgccttctgggga

SEQ ID NO: 526723 - DNA, 22 bp, Homo sapiens
ttgctaagataattaaatgaaa

SEQ ID NO: 526724 - DNA, 23 bp, Homo sapiens
ttgctaagataattaaatgaaat

SEQ ID NO: 526725 - DNA, 16 bp, Homo sapiens
ttgctgatattgcagt

SEQ ID NO: 526726 - DNA, 17 bp, Homo sapiens
ttgctgtgaaacagtgt

SEQ ID NO: 526727 - DNA, 12 bp, Homo sapiens
ttgctgtgaaat

SEQ ID NO: 526728 - DNA, 13 bp, Homo sapiens
ttgcttctctgcc

SEQ ID NO: 526729 - DNA, 20 bp, Homo sapiens
ttggaacagtaatcagtttg

SEQ ID NO: 526730 - DNA, 14 bp, Homo sapiens
ttggcctccagggc

SEQ ID NO: 526731 - DNA, 20 bp, Homo sapiens
ttgggattcctcccctggaa

SEQ ID NO: 526732 - DNA, 14 bp, Homo sapiens
ttggtctctttctt

SEQ ID NO: 526733 - DNA, 19 bp, Homo sapiens
ttggtctctttctttccaa

SEQ ID NO: 526734 - DNA, 15 bp, Homo sapiens
ttggttcctcatggc

SEQ ID NO: 526735 - DNA, 14 bp, Homo sapiens
ttgtaaaactgtga

SEQ ID NO: 526736 - DNA, 18 bp, Homo sapiens
ttgtaaaactgtgacatt

SEQ ID NO: 526737 - DNA, 19 bp, Homo sapiens
ttgtaaaactgtgacattc

SEQ ID NO: 526738 - DNA, 21 bp, Homo sapiens
ttgtagctagtttaaaattat

SEQ ID NO: 526739 - DNA, 13 bp, Homo sapiens
ttgtcctgtgtca

SEQ ID NO: 526740 - DNA, 18 bp, Homo sapiens
ttgtcctttctgatcctc

SEQ ID NO: 526741 - DNA, 13 bp, Homo sapiens
ttgtgaagtgatt

SEQ ID NO: 526742 - DNA, 21 bp, Homo sapiens
ttgtgaagtgattgacatttt

SEQ ID NO: 526743 - DNA, 21 bp, Homo sapiens
ttgtgcggtgtgtctccagct

SEQ ID NO: 526744 - DNA, 19 bp, Homo sapiens
ttgtgcttatgtcatttct

SEQ ID NO: 526745 - DNA, 19 bp, Homo sapiens
ttgtgtgggtttactctgt

SEQ ID NO: 526746 - DNA, 21 bp, Homo sapiens
ttgtgtgggtttactctgtgc

SEQ ID NO: 526747 - DNA, 15 bp, Homo sapiens
ttgttcaccttctgt

SEQ ID NO: 526748 - DNA, 18 bp, Homo sapiens
ttgttcaccttctgtgca

SEQ ID NO: 526749 - DNA, 19 bp, Homo sapiens
ttgttcttgtaaaactgtg

SEQ ID NO: 526750 - DNA, 11 bp, Homo sapiens
ttgtttgctgc

SEQ ID NO: 526751 - DNA, 23 bp, Homo sapiens
tttaaaattattaaaaattatag

SEQ ID NO: 526752 - DNA, 18 bp, Homo sapiens
tttaagtgtactggattt

SEQ ID NO: 526753 - DNA, 23 bp, Homo sapiens
tttacaaatgatttcgtgactgt

SEQ ID NO: 526754 - DNA, 19 bp, Homo sapiens
tttagaatcaagtctgtga

SEQ ID NO: 526755 - DNA, 21 bp, Homo sapiens
tttagattcctacttaaacaa

SEQ ID NO: 526756 - DNA, 15 bp, Homo sapiens
tttaggaatgctcaa

SEQ ID NO: 526757 - DNA, 13 bp, Homo sapiens
tttagtagctgat

SEQ ID NO: 526758 - DNA, 19 bp, Homo sapiens
tttagtagctgataaagaa

SEQ ID NO: 526759 - DNA, 21 bp, Homo sapiens
tttagtagctgataaagaaac

SEQ ID NO: 526760 - DNA, 21 bp, Homo sapiens
tttatgcatgagaactaaata

SEQ ID NO: 526761 - DNA, 11 bp, Homo sapiens
tttatgcattt

SEQ ID NO: 526762 - DNA, 19 bp, Homo sapiens
tttatgcatttatgcatga

SEQ ID NO: 526763 - DNA, 15 bp, Homo sapiens
tttcaatccacagta

SEQ ID NO: 526764 - DNA, 16 bp, Homo sapiens
tttcatgattagacaa

SEQ ID NO: 526765 - DNA, 18 bp, Homo sapiens
tttcatgattagacaatg

SEQ ID NO: 526766 - DNA, 21 bp, Homo sapiens
tttcatgattagacaatgtgg

SEQ ID NO: 526767 - DNA, 18 bp, Homo sapiens
tttcccctgtggtttgtt

SEQ ID NO: 526768 - DNA, 12 bp, Homo sapiens
tttccctgctga

SEQ ID NO: 526769 - DNA, 14 bp, Homo sapiens
tttcctcctgggca

SEQ ID NO: 526770 - DNA, 12 bp, Homo sapiens
tttcctgtcaat

SEQ ID NO: 526771 - DNA, 15 bp, Homo sapiens
tttcctgtcaatata

SEQ ID NO: 526772 - DNA, 16 bp, Homo sapiens
tttcctgtcaatatat

SEQ ID NO: 526773 - DNA, 13 bp, Homo sapiens
tttctcatctgta

SEQ ID NO: 526774 - DNA, 14 bp, Homo sapiens
tttctccgttgtgg

SEQ ID NO: 526775 - DNA, 22 bp, Homo sapiens
tttctgagtagcatatataatt

SEQ ID NO: 526776 - DNA, 13 bp, Homo sapiens
tttgacacactca

SEQ ID NO: 526777 - DNA, 19 bp, Homo sapiens
tttgagaccaacctgggta

SEQ ID NO: 526778 - DNA, 19 bp, Homo sapiens
tttgagtgtcaggctctga

SEQ ID NO: 526779 - DNA, 15 bp, Homo sapiens
tttggttcctcatgg

SEQ ID NO: 526780 - DNA, 20 bp, Homo sapiens
tttgtacgttaattaaacaa

SEQ ID NO: 526781 - DNA, 22 bp, Homo sapiens
tttgtagctagtttaaaattat

SEQ ID NO: 526782 - DNA, 23 bp, Homo sapiens
tttgtagctagtttaaaattatt

SEQ ID NO: 526783 - DNA, 14 bp, Homo sapiens
tttgtgaagtgatt

SEQ ID NO: 526784 - DNA, 20 bp, Homo sapiens
tttgtgaagtgattgacatt

SEQ ID NO: 526785 - DNA, 18 bp, Homo sapiens
tttgtgcttgttcttcct

SEQ ID NO: 526786 - DNA, 15 bp, Homo sapiens
tttgttcaccttctg

SEQ ID NO: 526787 - DNA, 17 bp, Homo sapiens
tttgttcaccttctgtg

SEQ ID NO: 526788 - DNA, 20 bp, Homo sapiens
tttgttcaccttctgtgcat

SEQ ID NO: 526789 - DNA, 21 bp, Homo sapiens
tttgttcaccttctgtgcatc

SEQ ID NO: 526790 - DNA, 13 bp, Homo sapiens
tttgtttgctgct

SEQ ID NO: 526791 - DNA, 18 bp, Homo sapiens
ttttaaaaaaataatata

SEQ ID NO: 526792 - DNA, 19 bp, Homo sapiens
ttttataaggctgactctt

SEQ ID NO: 526793 - DNA, 13 bp, Homo sapiens
ttttattgctgga

SEQ ID NO: 526794 - DNA, 20 bp, Homo sapiens
ttttccagggcaatcaatgt

SEQ ID NO: 526795 - DNA, 19 bp, Homo sapiens
ttttccccaattatcctcc

SEQ ID NO: 526796 - DNA, 15 bp, Homo sapiens
ccagtcatggctgtc

SEQ ID NO: 526797 - DNA, 17 bp, Homo sapiens
ccagtcatggctgtccc

SEQ ID NO: 526798 - DNA, 18 bp, Homo sapiens
ccagtcatggctgtcccc

SEQ ID NO: 526799 - DNA, 16 bp, Homo sapiens
ccatcgccttctgggg

SEQ ID NO: 526800 - DNA, 12 bp, Homo sapiens
ccatcttgggat

SEQ ID NO: 526801 - DNA, 23 bp, Homo sapiens
ccatcttgggattcctcccctgg

SEQ ID NO: 526802 - DNA, 14 bp, Homo sapiens
ccatgacagtagca

SEQ ID NO: 526803 - DNA, 16 bp, Homo sapiens
ccatgacagtagcata

SEQ ID NO: 526804 - DNA, 13 bp, Homo sapiens
ccatgctgggccg

SEQ ID NO: 526805 - DNA, 12 bp, Homo sapiens
ccatggaacagc

SEQ ID NO: 526806 - DNA, 16 bp, Homo sapiens
ccatggaacagccctg

SEQ ID NO: 526807 - DNA, 18 bp, Homo sapiens
ccatggaacagccctgca

SEQ ID NO: 526808 - DNA, 18 bp, Homo sapiens
ccatggtagactgtgaca

SEQ ID NO: 526809 - DNA, 15 bp, Homo sapiens
ccatgtctttctcca

SEQ ID NO: 526810 - DNA, 15 bp, Homo sapiens
ccattgccttctggg

SEQ ID NO: 526811 - DNA, 21 bp, Homo sapiens
ccattgtgaatgttgtcctgt

SEQ ID NO: 526812 - DNA, 22 bp, Homo sapiens
ccattgtgaatgttgtcctgtg

SEQ ID NO: 526813 - DNA, 16 bp, Homo sapiens
ccatttaatcatttcc

SEQ ID NO: 526814 - DNA, 15 bp, Homo sapiens
ccatttcctcctggg

SEQ ID NO: 526815 - DNA, 21 bp, Homo sapiens
cccaacaatactttgtgtctt

SEQ ID NO: 526816 - DNA, 16 bp, Homo sapiens
cccacccgtgttctcc

SEQ ID NO: 526817 - DNA, 20 bp, Homo sapiens
cccacccgtgttctcctcca

SEQ ID NO: 526818 - DNA, 21 bp, Homo sapiens
cccagctacaggggaggctga

SEQ ID NO: 526819 - DNA, 19 bp, Homo sapiens
cccaggaagtcatcctgca

SEQ ID NO: 526820 - DNA, 15 bp, Homo sapiens
cccaggacgcatgca

SEQ ID NO: 526821 - DNA, 19 bp, Homo sapiens
cccaggaggactccctgct

SEQ ID NO: 526822 - DNA, 15 bp, Homo sapiens
cccaggatgcatgca

SEQ ID NO: 526823 - DNA, 20 bp, Homo sapiens
cccaggatgcatgcagggcc

SEQ ID NO: 526824 - DNA, 20 bp, Homo sapiens
cccagggtcccctgcatggc

SEQ ID NO: 526825 - DNA, 14 bp, Homo sapiens
cccaggtgttgtcc

SEQ ID NO: 526826 - DNA, 14 bp, Homo sapiens
cccatcgccttctg

SEQ ID NO: 526827 - DNA, 15 bp, Homo sapiens
cccatgccaatgtcc

SEQ ID NO: 526828 - DNA, 12 bp, Homo sapiens
cccatgccctcc

SEQ ID NO: 526829 - DNA, 16 bp, Homo sapiens
cccatggaacagccct

SEQ ID NO: 526830 - DNA, 18 bp, Homo sapiens
cccattgtgaatgttgtc

SEQ ID NO: 526831 - DNA, 19 bp, Homo sapiens
cccattgtgaatgttgtcc

SEQ ID NO: 526832 - DNA, 19 bp, Homo sapiens
ccccaggacgcatgcaggg

SEQ ID NO: 526833 - DNA, 18 bp, Homo sapiens
ccccagggtcccctgcat

SEQ ID NO: 526834 - DNA, 21 bp, Homo sapiens
ccccatcgccttctggctgct

SEQ ID NO: 526835 - DNA, 17 bp, Homo sapiens
ccccatcgccttctggg

SEQ ID NO: 526836 - DNA, 14 bp, Homo sapiens
ccccatgccctccc

SEQ ID NO: 526837 - DNA, 16 bp, Homo sapiens
tgtgcttatgtcattt

SEQ ID NO: 526838 - DNA, 19 bp, Homo sapiens
tgtgcttgttcttcctctt

SEQ ID NO: 526839 - DNA, 22 bp, Homo sapiens
tgtggaaggcacactgagcaag

SEQ ID NO: 526840 - DNA, 23 bp, Homo sapiens
tgtggaatcaccgggaacgcccc

SEQ ID NO: 526841 - DNA, 17 bp, Homo sapiens
tgtggcatcaggaaagg

SEQ ID NO: 526842 - DNA, 19 bp, Homo sapiens
tgtgggtttactctgtgct

SEQ ID NO: 526843 - DNA, 21 bp, Homo sapiens
tgtgtagtagctcgtgtgctt

SEQ ID NO: 526844 - DNA, 15 bp, Homo sapiens
tgtgtcatctgtcag

SEQ ID NO: 526845 - DNA, 23 bp, Homo sapiens
tgtgtctccagctgattttaact

SEQ ID NO: 526846 - DNA, 18 bp, Homo sapiens
tgtgtcttttgttctctc

SEQ ID NO: 526847 - DNA, 21 bp, Homo sapiens
tgtgtgggtttactctgtgct

SEQ ID NO: 526848 - DNA, 15 bp, Homo sapiens
tgttaaataaggcct

SEQ ID NO: 526849 - DNA, 13 bp, Homo sapiens
tgttataaaatct

SEQ ID NO: 526850 - DNA, 21 bp, Homo sapiens
tgttataaaatctgtattgct

SEQ ID NO: 526851 - DNA, 16 bp, Homo sapiens
tgttatctgtctttat

SEQ ID NO: 526852 - DNA, 20 bp, Homo sapiens
tgttatctgtctttatgatt

SEQ ID NO: 526853 - DNA, 23 bp, Homo sapiens
tgttatctgtctttatgatttca

SEQ ID NO: 526854 - DNA, 15 bp, Homo sapiens
tgttcaccttctgtg

SEQ ID NO: 526855 - DNA, 17 bp, Homo sapiens
tgttcaccttctgtgca

SEQ ID NO: 526856 - DNA, 18 bp, Homo sapiens
tgttcacgcaacttgaaa

SEQ ID NO: 526857 - DNA, 20 bp, Homo sapiens
tgttctcctccaaatgctgt

SEQ ID NO: 526858 - DNA, 17 bp, Homo sapiens
tgttcttgtaaaactgt

SEQ ID NO: 526859 - DNA, 22 bp, Homo sapiens
tgttcttgtaaaactgtgacat

SEQ ID NO: 526860 - DNA, 13 bp, Homo sapiens
tgttgattaaaac

SEQ ID NO: 526861 - DNA, 14 bp, Homo sapiens
tgttgattaaaaca

SEQ ID NO: 526862 - DNA, 21 bp, Homo sapiens
tgttgattctttcaatccaca

SEQ ID NO: 526863 - DNA, 14 bp, Homo sapiens
tgttgcttaatcta

SEQ ID NO: 526864 - DNA, 21 bp, Homo sapiens
tgttgcttaatctagagctat

SEQ ID NO: 526865 - DNA, 12 bp, Homo sapiens
tgttgtccctgc

SEQ ID NO: 526866 - DNA, 12 bp, Homo sapiens
tgtttagtagct

SEQ ID NO: 526867 - DNA, 15 bp, Homo sapiens
tgtttagtagctgat

SEQ ID NO: 526868 - DNA, 20 bp, Homo sapiens
tgtttagtagctgataaaga

SEQ ID NO: 526869 - DNA, 20 bp, Homo sapiens
ttaaaaagccaagtgtcctg

SEQ ID NO: 526870 - DNA, 20 bp, Homo sapiens
ttaaaaattatctttaaaac

SEQ ID NO: 526871 - DNA, 13 bp, Homo sapiens
ttaaaacaaaatc

SEQ ID NO: 526872 - DNA, 23 bp, Homo sapiens
ttaaaatgattcacttttattgt

SEQ ID NO: 526873 - DNA, 13 bp, Homo sapiens
ttaaaattattaa

SEQ ID NO: 526874 - DNA, 17 bp, Homo sapiens
ttaaattggcttgttta

SEQ ID NO: 526875 - DNA, 15 bp, Homo sapiens
ttaagtcttactgtt

SEQ ID NO: 526876 - DNA, 13 bp, Homo sapiens
ttaatctagagct

SEQ ID NO: 526877 - DNA, 14 bp, Homo sapiens
ttaatctagagcta

SEQ ID NO: 526878 - DNA, 16 bp, Homo sapiens
ttaatctagagctatg

SEQ ID NO: 526879 - DNA, 20 bp, Homo sapiens
ttaatctagagctatgcaca

SEQ ID NO: 526880 - DNA, 13 bp, Homo sapiens
ttaatcttcatgg

SEQ ID NO: 526881 - DNA, 15 bp, Homo sapiens
ttaattaaacaaatt

SEQ ID NO: 526882 - DNA, 22 bp, Homo sapiens
ttacataacaggcattgcacta

SEQ ID NO: 526883 - DNA, 21 bp, Homo sapiens
ttacctaagagccacaataag

SEQ ID NO: 526884 - DNA, 22 bp, Homo sapiens
ttacctgtaatagcctcacctt

SEQ ID NO: 526885 - DNA, 14 bp, Homo sapiens
ttactaacactggc

SEQ ID NO: 526886 - DNA, 16 bp, Homo sapiens
ttactaaccaccattt

SEQ ID NO: 526887 - DNA, 23 bp, Homo sapiens
ttactgtatttgggatatgagtt

SEQ ID NO: 526888 - DNA, 12 bp, Homo sapiens
ttagacaatgtg

SEQ ID NO: 526889 - DNA, 21 bp, Homo sapiens
ttagacaatgtggaattacat

SEQ ID NO: 526890 - DNA, 18 bp, Homo sapiens
ttagagagcagtggcaga

SEQ ID NO: 526891 - DNA, 18 bp, Homo sapiens
ttagattcctacttaaac

SEQ ID NO: 526892 - DNA, 12 bp, Homo sapiens
ttagcacagagg

SEQ ID NO: 526893 - DNA, 14 bp, Homo sapiens
ttagcaccagcttg

SEQ ID NO: 526894 - DNA, 15 bp, Homo sapiens
ttagcgttctgtttc

SEQ ID NO: 526895 - DNA, 19 bp, Homo sapiens
ttagctagttagagactcg

SEQ ID NO: 526896 - DNA, 21 bp, Homo sapiens
ttagctcagaggagaggagca

SEQ ID NO: 526897 - DNA, 17 bp, Homo sapiens
ttaggaatgctcaatgt

SEQ ID NO: 526898 - DNA, 14 bp, Homo sapiens
ttagtcctcacctt

SEQ ID NO: 526899 - DNA, 14 bp, Homo sapiens
ttataacattgtaa

SEQ ID NO: 526900 - DNA, 15 bp, Homo sapiens
ttataccagcaaaag

SEQ ID NO: 526901 - DNA, 17 bp, Homo sapiens
ttatatcagactgcttt

SEQ ID NO: 526902 - DNA, 11 bp, Homo sapiens
ttatcatgtgt

SEQ ID NO: 526903 - DNA, 13 bp, Homo sapiens
ttatctcttcttc

SEQ ID NO: 526904 - DNA, 11 bp, Homo sapiens
ttatgcatgag

SEQ ID NO: 526905 - DNA, 19 bp, Homo sapiens
ttatgcatgagaactaaat

SEQ ID NO: 526906 - DNA, 20 bp, Homo sapiens
ttatgcatgagaactaaata

SEQ ID NO: 526907 - DNA, 15 bp, Homo sapiens
ttatgtcaaatggat

SEQ ID NO: 526908 - DNA, 16 bp, Homo sapiens
ttatgtcaaatggatg

SEQ ID NO: 526909 - DNA, 18 bp, Homo sapiens
ttattagcaccagcttgc

SEQ ID NO: 526910 - DNA, 12 bp, Homo sapiens
ttattctaatta

SEQ ID NO: 526911 - DNA, 15 bp, Homo sapiens
ttatttataacattg

SEQ ID NO: 526912 - DNA, 15 bp, Homo sapiens
ttatttgtcagtgta

SEQ ID NO: 526913 - DNA, 16 bp, Homo sapiens
ttcaatccacagtatt

SEQ ID NO: 526914 - DNA, 15 bp, Homo sapiens
ttcacattcctgacc

SEQ ID NO: 526915 - DNA, 17 bp, Homo sapiens
ttcaccttctgtgcatc

SEQ ID NO: 526916 - DNA, 16 bp, Homo sapiens
ttcacgcaacttgaaa

SEQ ID NO: 526917 - DNA, 19 bp, Homo sapiens
ttcaggaaagcagcagttt

SEQ ID NO: 526918 - DNA, 22 bp, Homo sapiens
ttcagtcacttgtttgtgtttg

SEQ ID NO: 526919 - DNA, 13 bp, Homo sapiens
ttcatgcttttct

SEQ ID NO: 526920 - DNA, 16 bp, Homo sapiens
ttcatgcttttctcat

SEQ ID NO: 526921 - DNA, 12 bp, Homo sapiens
ttcattttctct

SEQ ID NO: 526922 - DNA, 17 bp, Homo sapiens
ttcattttctctcctcg

SEQ ID NO: 526923 - DNA, 24 bp, Homo sapiens
ttccagcaaaatatatgtttggct

SEQ ID NO: 526924 - DNA, 16 bp, Homo sapiens
ttcccaacctcccctg

SEQ ID NO: 526925 - DNA, 14 bp, Homo sapiens
ttcccagagacccg

SEQ ID NO: 526926 - DNA, 19 bp, Homo sapiens
ttccccattgccttctggg

SEQ ID NO: 526927 - DNA, 18 bp, Homo sapiens
ttcccccagggtcccctg

SEQ ID NO: 526928 - DNA, 19 bp, Homo sapiens
ttcccgtggctttgtgctt

SEQ ID NO: 526929 - DNA, 17 bp, Homo sapiens
ttccctagttctttgca

SEQ ID NO: 526930 - DNA, 12 bp, Homo sapiens
ttccgcctcact

SEQ ID NO: 526931 - DNA, 14 bp, Homo sapiens
ttcctacttaaaca

SEQ ID NO: 526932 - DNA, 22 bp, Homo sapiens
ttcctacttaaacaaaaacttt

SEQ ID NO: 526933 - DNA, 11 bp, Homo sapiens
ttcctcatggc

SEQ ID NO: 526934 - DNA, 12 bp, Homo sapiens
ttcctgaccctc

SEQ ID NO: 526935 - DNA, 14 bp, Homo sapiens
ttctaatccatgtg

SEQ ID NO: 526936 - DNA, 18 bp, Homo sapiens
atcatgtgtttctgtgta

SEQ ID NO: 526937 - DNA, 19 bp, Homo sapiens
atcattggtatctgatatc

SEQ ID NO: 526938 - DNA, 22 bp, Homo sapiens
atcattggtatctgatatctgt

SEQ ID NO: 526939 - DNA, 17 bp, Homo sapiens
atcatttccagcaaaat

SEQ ID NO: 526940 - DNA, 19 bp, Homo sapiens
atcatttccagcaaaatat

SEQ ID NO: 526941 - DNA, 14 bp, Homo sapiens
atccacagtattgt

SEQ ID NO: 526942 - DNA, 20 bp, Homo sapiens
atccagagggttgtgatttt

SEQ ID NO: 526943 - DNA, 17 bp, Homo sapiens
atccagcggggcttctg

SEQ ID NO: 526944 - DNA, 20 bp, Homo sapiens
atccccatggaacagccctg

SEQ ID NO: 526945 - DNA, 16 bp, Homo sapiens
atccccgtgctcacag

SEQ ID NO: 526946 - DNA, 19 bp, Homo sapiens
atccctggacgcatgcagg

SEQ ID NO: 526947 - DNA, 23 bp, Homo sapiens
atcctagcactttgggaggctga

SEQ ID NO: 526948 - DNA, 17 bp, Homo sapiens
atcctgccttcatggaa

SEQ ID NO: 526949 - DNA, 15 bp, Homo sapiens
atccttgtcagttgt

SEQ ID NO: 526950 - DNA, 20 bp, Homo sapiens
atctagtaggtctgcacaca

SEQ ID NO: 526951 - DNA, 16 bp, Homo sapiens
atctctcaaaatgtgc

SEQ ID NO: 526952 - DNA, 12 bp, Homo sapiens
atctctgtaaaa

SEQ ID NO: 526953 - DNA, 17 bp, Homo sapiens
atctgtaaaaccaggct

SEQ ID NO: 526954 - DNA, 13 bp, Homo sapiens
atctgtctttatg

SEQ ID NO: 526955 - DNA, 15 bp, Homo sapiens
atctgtttgcttcta

SEQ ID NO: 526956 - DNA, 17 bp, Homo sapiens
atctgtttgcttctaaa

SEQ ID NO: 526957 - DNA, 12 bp, Homo sapiens
atcttgctgtga

SEQ ID NO: 526958 - DNA, 14 bp, Homo sapiens
atcttgctgtgaaa

SEQ ID NO: 526959 - DNA, 21 bp, Homo sapiens
atgaaaaatagtgtgtccatg

SEQ ID NO: 526960 - DNA, 19 bp, Homo sapiens
atgaaatacttgacaacat

SEQ ID NO: 526961 - DNA, 20 bp, Homo sapiens
atgaaatataaactgtgaga

SEQ ID NO: 526962 - DNA, 22 bp, Homo sapiens
atgaactcaggtttccggctac

SEQ ID NO: 526963 - DNA, 20 bp, Homo sapiens
atgaagccctaagtaaatct

SEQ ID NO: 526964 - DNA, 19 bp, Homo sapiens
atgaaggggccagaccacg

SEQ ID NO: 526965 - DNA, 12 bp, Homo sapiens
atgaatgaaata

SEQ ID NO: 526966 - DNA, 14 bp, Homo sapiens
atgaatgaaatata

SEQ ID NO: 526967 - DNA, 16 bp, Homo sapiens
atgaatgaaatataaa

SEQ ID NO: 526968 - DNA, 22 bp, Homo sapiens
atgaatgaaatataaactgtga

SEQ ID NO: 526969 - DNA, 23 bp, Homo sapiens
atgaatgaaatataaactgtgag

SEQ ID NO: 526970 - DNA, 17 bp, Homo sapiens
atgacagtagcatactg

SEQ ID NO: 526971 - DNA, 20 bp, Homo sapiens
atgaccataaaattagacat

SEQ ID NO: 526972 - DNA, 16 bp, Homo sapiens
atgagaactaaataga

SEQ ID NO: 526973 - DNA, 21 bp, Homo sapiens
atgagccaataaagctcacac

SEQ ID NO: 526974 - DNA, 20 bp, Homo sapiens
atgaggcacgcctgccttct

SEQ ID NO: 526975 - DNA, 16 bp, Homo sapiens
atgatatgtctttaaa

SEQ ID NO: 526976 - DNA, 13 bp, Homo sapiens
atgattagacaat

SEQ ID NO: 526977 - DNA, 16 bp, Homo sapiens
atgattagacaatgtg

SEQ ID NO: 526978 - DNA, 21 bp, Homo sapiens
atgattagacaatgtggaatt

SEQ ID NO: 526979 - DNA, 17 bp, Homo sapiens
atgattcacttttattg

SEQ ID NO: 526980 - DNA, 14 bp, Homo sapiens
atgatttcagaaac

SEQ ID NO: 526981 - DNA, 15 bp, Homo sapiens
atgcatgagaactaa

SEQ ID NO: 526982 - DNA, 16 bp, Homo sapiens
atgcatgagaactaaa

SEQ ID NO: 526983 - DNA, 21 bp, Homo sapiens
atgcatgagaactaaatagat

SEQ ID NO: 526984 - DNA, 16 bp, Homo sapiens
atgcatttatgcatga

SEQ ID NO: 526985 - DNA, 13 bp, Homo sapiens
atgccaatgtcca

SEQ ID NO: 526986 - DNA, 16 bp, Homo sapiens
atgccaatgtccaggt

SEQ ID NO: 526987 - DNA, 13 bp, Homo sapiens
atgccgtgcgggc

SEQ ID NO: 526988 - DNA, 13 bp, Homo sapiens
atgcctaataaac

SEQ ID NO: 526989 - DNA, 16 bp, Homo sapiens
atgctactcagtatat

SEQ ID NO: 526990 - DNA, 21 bp, Homo sapiens
atgctatctcgctagccatat

SEQ ID NO: 526991 - DNA, 23 bp, Homo sapiens
atgctgtccctgtgggctcacac

SEQ ID NO: 526992 - DNA, 18 bp, Homo sapiens
atggattcccctggacat

SEQ ID NO: 526993 - DNA, 23 bp, Homo sapiens
atggattgggtatcaaaatgaat

SEQ ID NO: 526994 - DNA, 13 bp, Homo sapiens
atggccaggcctc

SEQ ID NO: 526995 - DNA, 10 bp, Homo sapiens
aaactgtgag

SEQ ID NO: 526996 - DNA, 22 bp, Homo sapiens
aaacttactatggtatatattt

SEQ ID NO: 526997 - DNA, 22 bp, Homo sapiens
aaagaatcacctaattaatttc

SEQ ID NO: 526998 - DNA, 14 bp, Homo sapiens
aaagacatgaaatt

SEQ ID NO: 526999 - DNA, 12 bp, Homo sapiens
aaagatggattt

SEQ ID NO: 527000 - DNA, 17 bp, Homo sapiens
aaagcatgccaatttct

SEQ ID NO: 527001 - DNA, 18 bp, Homo sapiens
aaagcatgctcagtattg

SEQ ID NO: 527002 - DNA, 19 bp, Homo sapiens
aaagctgctttccatggca

SEQ ID NO: 527003 - DNA, 14 bp, Homo sapiens
aaaggcttctccac

SEQ ID NO: 527004 - DNA, 22 bp, Homo sapiens
aaaggtttcactgttcatgaat

SEQ ID NO: 527005 - DNA, 17 bp, Homo sapiens
aaagtctcctgtatcat

SEQ ID NO: 527006 - DNA, 20 bp, Homo sapiens
aaagttaaacgtgatgtgct

SEQ ID NO: 527007 - DNA, 13 bp, Homo sapiens
aaagttttgccta

SEQ ID NO: 527008 - DNA, 16 bp, Homo sapiens
aaatagatttttagat

SEQ ID NO: 527009 - DNA, 14 bp, Homo sapiens
aaatagctataaat

SEQ ID NO: 527010 - DNA, 13 bp, Homo sapiens
aaatagtgaaaat

SEQ ID NO: 527011 - DNA, 15 bp, Homo sapiens
aaatataaaaataat

SEQ ID NO: 527012 - DNA, 15 bp, Homo sapiens
aaatataaactgtga

SEQ ID NO: 527013 - DNA, 17 bp, Homo sapiens
aaatccttgccttcaaa

SEQ ID NO: 527014 - DNA, 13 bp, Homo sapiens
aaatgaaatactt

SEQ ID NO: 527015 - DNA, 17 bp, Homo sapiens
aaatgaaatacttgaca

SEQ ID NO: 527016 - DNA, 23 bp, Homo sapiens
aaatgaatgaaatataaactgtg

SEQ ID NO: 527017 - DNA, 19 bp, Homo sapiens
aaatgatatgtctttaaaa

SEQ ID NO: 527018 - DNA, 20 bp, Homo sapiens
aaatgatatgtctttaaaat

SEQ ID NO: 527019 - DNA, 22 bp, Homo sapiens
aaatgattcacttttattgtat

SEQ ID NO: 527020 - DNA, 17 bp, Homo sapiens
aaattaacttctatttt

SEQ ID NO: 527021 - DNA, 18 bp, Homo sapiens
aaattagggctctaattt

SEQ ID NO: 527022 - DNA, 19 bp, Homo sapiens
aaattagggctctaatttc

SEQ ID NO: 527023 - DNA, 20 bp, Homo sapiens
aaattagggctctaatttcc

SEQ ID NO: 527024 - DNA, 13 bp, Homo sapiens
aaattatctttaa

SEQ ID NO: 527025 - DNA, 14 bp, Homo sapiens
aaattatctttaaa

SEQ ID NO: 527026 - DNA, 19 bp, Homo sapiens
aaattatgtcaaatggatg

SEQ ID NO: 527027 - DNA, 21 bp, Homo sapiens
aaattgaagagagatatatct

SEQ ID NO: 527028 - DNA, 11 bp, Homo sapiens
aaattgctgag

SEQ ID NO: 527029 - DNA, 13 bp, Homo sapiens
aaattgctgagat

SEQ ID NO: 527030 - DNA, 16 bp, Homo sapiens
aaattttattgaatat

SEQ ID NO: 527031 - DNA, 19 bp, Homo sapiens
aaattttattgaatataat

SEQ ID NO: 527032 - DNA, 16 bp, Homo sapiens
aacaaaaactttccat

SEQ ID NO: 527033 - DNA, 12 bp, Homo sapiens
aacaaagaaata

SEQ ID NO: 527034 - DNA, 14 bp, Homo sapiens
aacaaagaaatatt

SEQ ID NO: 527035 - DNA, 22 bp, Homo sapiens
aacaacaaagcatgctcagtat

SEQ ID NO: 527036 - DNA, 14 bp, Homo sapiens
aacaacaacaaagc

SEQ ID NO: 527037 - DNA, 15 bp, Homo sapiens
aacaacagcaacaac

SEQ ID NO: 527038 - DNA, 20 bp, Homo sapiens
aacaattcaaagaatcacct

SEQ ID NO: 527039 - DNA, 13 bp, Homo sapiens
aacacagattatt

SEQ ID NO: 527040 - DNA, 15 bp, Homo sapiens
aacagcaggttgtgt

SEQ ID NO: 527041 - DNA, 17 bp, Homo sapiens
acttaaacaaaaacttt

SEQ ID NO: 527042 - DNA, 16 bp, Homo sapiens
acttagggagtgtgcc

SEQ ID NO: 527043 - DNA, 22 bp, Homo sapiens
acttagggagtgtgccttgggc

SEQ ID NO: 527044 - DNA, 17 bp, Homo sapiens
acttatttataacattg

SEQ ID NO: 527045 - DNA, 16 bp, Homo sapiens
acttcttgtgctttac

SEQ ID NO: 527046 - DNA, 16 bp, Homo sapiens
acttgaaattatatct

SEQ ID NO: 527047 - DNA, 13 bp, Homo sapiens
actttccatgaca

SEQ ID NO: 527048 - DNA, 15 bp, Homo sapiens
actttccatgacagt

SEQ ID NO: 527049 - DNA, 19 bp, Homo sapiens
actttccatgacagtagca

SEQ ID NO: 527050 - DNA, 20 bp, Homo sapiens
actttccatgacagtagcat

SEQ ID NO: 527051 - DNA, 14 bp, Homo sapiens
actttcctatgaca

SEQ ID NO: 527052 - DNA, 14 bp, Homo sapiens
actttgtgtctttt

SEQ ID NO: 527053 - DNA, 18 bp, Homo sapiens
acttttttcctgtcaata

SEQ ID NO: 527054 - DNA, 13 bp, Homo sapiens
agaaacaatttct

SEQ ID NO: 527055 - DNA, 14 bp, Homo sapiens
agaaacaatttctg

SEQ ID NO: 527056 - DNA, 13 bp, Homo sapiens
agaaaggagggca

SEQ ID NO: 527057 - DNA, 15 bp, Homo sapiens
agaaaggagggcaac

SEQ ID NO: 527058 - DNA, 17 bp, Homo sapiens
agaaatataaaaataat

SEQ ID NO: 527059 - DNA, 14 bp, Homo sapiens
agaacgcatgcagg

SEQ ID NO: 527060 - DNA, 18 bp, Homo sapiens
agaactcatgtgatttac

SEQ ID NO: 527061 - DNA, 14 bp, Homo sapiens
agaaggaggaaccc

SEQ ID NO: 527062 - DNA, 23 bp, Homo sapiens
agaagtatccctgatttattctg

SEQ ID NO: 527063 - DNA, 14 bp, Homo sapiens
agaagtgaaaaaga

SEQ ID NO: 527064 - DNA, 14 bp, Homo sapiens
agaatactgtattg

SEQ ID NO: 527065 - DNA, 20 bp, Homo sapiens
agaatagttaaattggcttg

SEQ ID NO: 527066 - DNA, 21 bp, Homo sapiens
agacaagtctagtggaaccaa

SEQ ID NO: 527067 - DNA, 14 bp, Homo sapiens
agacaatgtggaat

SEQ ID NO: 527068 - DNA, 20 bp, Homo sapiens
agacaatgtggaattacata

SEQ ID NO: 527069 - DNA, 17 bp, Homo sapiens
agaccacgcccctgcct

SEQ ID NO: 527070 - DNA, 22 bp, Homo sapiens
agaccacggtccaatccagcct

SEQ ID NO: 527071 - DNA, 16 bp, Homo sapiens
agactgctttgagaaa

SEQ ID NO: 527072 - DNA, 12 bp, Homo sapiens
agagaaatgaaa

SEQ ID NO: 527073 - DNA, 16 bp, Homo sapiens
agagagcaatcttgct

SEQ ID NO: 527074 - DNA, 15 bp, Homo sapiens
agagagcagtggcag

SEQ ID NO: 527075 - DNA, 16 bp, Homo sapiens
agagagtatggtgctg

SEQ ID NO: 527076 - DNA, 21 bp, Homo sapiens
agagatagccgggctccaggg

SEQ ID NO: 527077 - DNA, 14 bp, Homo sapiens
agagatatatctga

SEQ ID NO: 527078 - DNA, 16 bp, Homo sapiens
agagcaatcttgctgt

SEQ ID NO: 527079 - DNA, 13 bp, Homo sapiens
agagctatgcaca

SEQ ID NO: 527080 - DNA, 14 bp, Homo sapiens
agagctatgcacac

SEQ ID NO: 527081 - DNA, 16 bp, Homo sapiens
agaggagcgtgtccta

SEQ ID NO: 527082 - DNA, 19 bp, Homo sapiens
agagggtgtgggtgccctg

SEQ ID NO: 527083 - DNA, 22 bp, Homo sapiens
agagttactgccacggtccttt

SEQ ID NO: 527084 - DNA, 15 bp, Homo sapiens
agagttgcagtaaag

SEQ ID NO: 527085 - DNA, 16 bp, Homo sapiens
agataaatatcattat

SEQ ID NO: 527086 - DNA, 15 bp, Homo sapiens
agataattaaatgaa

SEQ ID NO: 527087 - DNA, 18 bp, Homo sapiens
agataattaaatgaaata

SEQ ID NO: 527088 - DNA, 17 bp, Homo sapiens
agatatatctgaaaact

SEQ ID NO: 527089 - DNA, 20 bp, Homo sapiens
agatatatctgaaaactgga

SEQ ID NO: 527090 - DNA, 21 bp, Homo sapiens
agatatatctgaaaactggaa

SEQ ID NO: 527091 - DNA, 20 bp, Homo sapiens
agatggggagggcgcttttg

SEQ ID NO: 527092 - DNA, 17 bp, Homo sapiens
agatgtaagaagctaaa

SEQ ID NO: 527093 - DNA, 23 bp, Homo sapiens
agattaagttataccagcaaaag

SEQ ID NO: 527094 - DNA, 14 bp, Homo sapiens
agattcctacttaa

SEQ ID NO: 527095 - DNA, 19 bp, Homo sapiens
agattcctacttaaacaaa

SEQ ID NO: 527096 - DNA, 18 bp, Homo sapiens
agattggaaaaaattaga

SEQ ID NO: 527097 - DNA, 16 bp, Homo sapiens
agatttttagattcct

SEQ ID NO: 527098 - DNA, 20 bp, Homo sapiens
agcaaagcatgccaatttct

SEQ ID NO: 527099 - DNA, 18 bp, Homo sapiens
agcaatcttgctgtgaaa

SEQ ID NO: 527100 - DNA, 13 bp, Homo sapiens
caacaaagaaata

SEQ ID NO: 527101 - DNA, 14 bp, Homo sapiens
caacaaagaaatat

SEQ ID NO: 527102 - DNA, 15 bp, Homo sapiens
caacaaagcatgctc

SEQ ID NO: 527103 - DNA, 13 bp, Homo sapiens
caacaacaacaga

SEQ ID NO: 527104 - DNA, 19 bp, Homo sapiens
caacaacagaacaacaaca

SEQ ID NO: 527105 - DNA, 16 bp, Homo sapiens
caacaatactttgtgt

SEQ ID NO: 527106 - DNA, 18 bp, Homo sapiens
caacaatactttgtgtct

SEQ ID NO: 527107 - DNA, 20 bp, Homo sapiens
caacaatactttgtgtcttt

SEQ ID NO: 527108 - DNA, 18 bp, Homo sapiens
caacacacacacacacaa

SEQ ID NO: 527109 - DNA, 14 bp, Homo sapiens
caacagaacaacaa

SEQ ID NO: 527110 - DNA, 21 bp, Homo sapiens
caacagaacaacaacaaagca

SEQ ID NO: 527111 - DNA, 16 bp, Homo sapiens
caacagcaacaacaac

SEQ ID NO: 527112 - DNA, 16 bp, Homo sapiens
caacccaggtgttgtc

SEQ ID NO: 527113 - DNA, 22 bp, Homo sapiens
caacccaggtgttgtccgtgtc

SEQ ID NO: 527114 - DNA, 24 bp, Homo sapiens
caacttgaaattatatctgtggtc

SEQ ID NO: 527115 - DNA, 12 bp, Homo sapiens
caagaatgcagt

SEQ ID NO: 527116 - DNA, 15 bp, Homo sapiens
caagggctgacttct

SEQ ID NO: 527117 - DNA, 18 bp, Homo sapiens
caaggggctgcttctggg

SEQ ID NO: 527118 - DNA, 20 bp, Homo sapiens
caagtgaatgagtttccagc

SEQ ID NO: 527119 - DNA, 11 bp, Homo sapiens
caagtgtcctg

SEQ ID NO: 527120 - DNA, 16 bp, Homo sapiens
caataaactcagtcaa

SEQ ID NO: 527121 - DNA, 16 bp, Homo sapiens
caatactttgtgtctt

SEQ ID NO: 527122 - DNA, 14 bp, Homo sapiens
caatccacagtatt

SEQ ID NO: 527123 - DNA, 13 bp, Homo sapiens
caatccagccttc

SEQ ID NO: 527124 - DNA, 14 bp, Homo sapiens
caatccagccttct

SEQ ID NO: 527125 - DNA, 17 bp, Homo sapiens
caatcttgctgtgaaac

SEQ ID NO: 527126 - DNA, 20 bp, Homo sapiens
caatgctacaaaatgtgtgc

SEQ ID NO: 527127 - DNA, 12 bp, Homo sapiens
caatgtccaggt

SEQ ID NO: 527128 - DNA, 15 bp, Homo sapiens
cacaaaacaacagca

SEQ ID NO: 527129 - DNA, 22 bp, Homo sapiens
cacaaaacaacagcaacaacaa

SEQ ID NO: 527130 - DNA, 23 bp, Homo sapiens
cacacaaaacaacagcaacaaca

SEQ ID NO: 527131 - DNA, 19 bp, Homo sapiens
cacacacaaaacaacagca

SEQ ID NO: 527132 - DNA, 13 bp, Homo sapiens
cacacacacaaaa

SEQ ID NO: 527133 - DNA, 13 bp, Homo sapiens
cacacataacaca

SEQ ID NO: 527134 - DNA, 15 bp, Homo sapiens
cacaccggcactgtg

SEQ ID NO: 527135 - DNA, 17 bp, Homo sapiens
cacacttgggctggcac

SEQ ID NO: 527136 - DNA, 18 bp, Homo sapiens
cacagctgagctggccta

SEQ ID NO: 527137 - DNA, 22 bp, Homo sapiens
cacaggagcgtgtcctatcccc

SEQ ID NO: 527138 - DNA, 16 bp, Homo sapiens
cacagtggtccagggt

SEQ ID NO: 527139 - DNA, 18 bp, Homo sapiens
gagcgtgtcctatccccg

SEQ ID NO: 527140 - DNA, 17 bp, Homo sapiens
gagctatgcacaccaaa

SEQ ID NO: 527141 - DNA, 21 bp, Homo sapiens
gagctatgcacaccaaattgc

SEQ ID NO: 527142 - DNA, 14 bp, Homo sapiens
gaggacagcttccc

SEQ ID NO: 527143 - DNA, 21 bp, Homo sapiens
gaggacagcttccccatcgcc

SEQ ID NO: 527144 - DNA, 14 bp, Homo sapiens
gaggacggcttccc

SEQ ID NO: 527145 - DNA, 21 bp, Homo sapiens
gaggacggcttccccatcgcc

SEQ ID NO: 527146 - DNA, 14 bp, Homo sapiens
gaggagaaggagga

SEQ ID NO: 527147 - DNA, 17 bp, Homo sapiens
gaggctcgtgcatgtaa

SEQ ID NO: 527148 - DNA, 14 bp, Homo sapiens
gagggggagacccc

SEQ ID NO: 527149 - DNA, 17 bp, Homo sapiens
gagtatggtgctgggtc

SEQ ID NO: 527150 - DNA, 13 bp, Homo sapiens
gagtggaccacga

SEQ ID NO: 527151 - DNA, 16 bp, Homo sapiens
gagtggggaggagaga

SEQ ID NO: 527152 - DNA, 19 bp, Homo sapiens
gagtggggaggagagaggg

SEQ ID NO: 527153 - DNA, 22 bp, Homo sapiens
gataaatatcattatagcatgt

SEQ ID NO: 527154 - DNA, 18 bp, Homo sapiens
gataaatccaactctgac

SEQ ID NO: 527155 - DNA, 19 bp, Homo sapiens
gatagccgggctccaggga

SEQ ID NO: 527156 - DNA, 18 bp, Homo sapiens
gatatatctgaaaactgg

SEQ ID NO: 527157 - DNA, 20 bp, Homo sapiens
gatatgagaaatataaaaat

SEQ ID NO: 527158 - DNA, 24 bp, Homo sapiens
gctccgcgctcggggctgggcaga

SEQ ID NO: 527159 - DNA, 19 bp, Homo sapiens
gctcctgctgaccttctgc

SEQ ID NO: 527160 - DNA, 14 bp, Homo sapiens
gctccttcatgctt

SEQ ID NO: 527161 - DNA, 16 bp, Homo sapiens
gctcggggctgggcag

SEQ ID NO: 527162 - DNA, 13 bp, Homo sapiens
gctcgtgcatgta

SEQ ID NO: 527163 - DNA, 19 bp, Homo sapiens
gctctctcacccagcctgg

SEQ ID NO: 527164 - DNA, 23 bp, Homo sapiens
gctctgaatctctcaaaatgtgc

SEQ ID NO: 527165 - DNA, 23 bp, Homo sapiens
gctctgaggctgccccaggggca

SEQ ID NO: 527166 - DNA, 16 bp, Homo sapiens
gctgacttctccagga

SEQ ID NO: 527167 - DNA, 21 bp, Homo sapiens
gctgagagggtgtgggtgccc

SEQ ID NO: 527168 - DNA, 20 bp, Homo sapiens
gctgagatgtttagtagctg

SEQ ID NO: 527169 - DNA, 15 bp, Homo sapiens
gctgcaggaatcaaa

SEQ ID NO: 527170 - DNA, 21 bp, Homo sapiens
gctgcaggaatcaaaaattga

SEQ ID NO: 527171 - DNA, 19 bp, Homo sapiens
gctgcagttagcacagagg

SEQ ID NO: 527172 - DNA, 15 bp, Homo sapiens
gctgccaggctccca

SEQ ID NO: 527173 - DNA, 21 bp, Homo sapiens
gctgccagggggcaaggagaa

SEQ ID NO: 527174 - DNA, 23 bp, Homo sapiens
gctgccagggggcaaggagaaag

SEQ ID NO: 527175 - DNA, 20 bp, Homo sapiens
gctgcctgtggtgaggtcct

SEQ ID NO: 527176 - DNA, 20 bp, Homo sapiens
gctgcgctcccacctcggac

SEQ ID NO: 527177 - DNA, 23 bp, Homo sapiens
gctgcgctcccacctcggacacc

SEQ ID NO: 527178 - DNA, 15 bp, Homo sapiens
gctgctcccggtgtg

SEQ ID NO: 527179 - DNA, 21 bp, Homo sapiens
gctgctgcagtcagcacagag

SEQ ID NO: 527180 - DNA, 15 bp, Homo sapiens
gctgcttctggggct

SEQ ID NO: 527181 - DNA, 16 bp, Homo sapiens
gctgcttctggggctc

SEQ ID NO: 527182 - DNA, 13 bp, Homo sapiens
gctgcttttgatg

SEQ ID NO: 527183 - DNA, 16 bp, Homo sapiens
gctggcacccactgga

SEQ ID NO: 527184 - DNA, 17 bp, Homo sapiens
gctgggtcccgggtgcc

SEQ ID NO: 527185 - DNA, 16 bp, Homo sapiens
gctgtaaataaaaata

SEQ ID NO: 527186 - DNA, 17 bp, Homo sapiens
gctgtaaataaaaatag

SEQ ID NO: 527187 - DNA, 15 bp, Homo sapiens
gctgtccctgtgggc

SEQ ID NO: 527188 - DNA, 22 bp, Homo sapiens
gctgtccctgtgggctcacacc

SEQ ID NO: 527189 - DNA, 19 bp, Homo sapiens
gctgtggcatcaggaaagg

SEQ ID NO: 527190 - DNA, 17 bp, Homo sapiens
gctgttatctgtcttta

SEQ ID NO: 527191 - DNA, 16 bp, Homo sapiens
gctgttcattgatgac

SEQ ID NO: 527192 - DNA, 19 bp, Homo sapiens
gcttaatctagagctatgc

SEQ ID NO: 527193 - DNA, 14 bp, Homo sapiens
gcttccccatcgcc

SEQ ID NO: 527194 - DNA, 23 bp, Homo sapiens
gcttctccacaacctcctcctcc

SEQ ID NO: 527195 - DNA, 24 bp, Homo sapiens
gcttctgggacaggcaccatgctg

SEQ ID NO: 527196 - DNA, 24 bp, Homo sapiens
gcttctgggcgccggttccacgtg

SEQ ID NO: 527197 - DNA, 23 bp, Homo sapiens
gcttggaaaatgttctgacagca

SEQ ID NO: 527198 - DNA, 15 bp, Homo sapiens
gcttgttcagtcact

SEQ ID NO: 527199 - DNA, 22 bp, Homo sapiens
gcttgttcttcctcttacctgt

SEQ ID NO: 527200 - DNA, 21 bp, Homo sapiens
gcttgtttaaggttcttgctg

SEQ ID NO: 527201 - DNA, 24 bp, Homo sapiens
gctttccgcgtggttctgccactt

SEQ ID NO: 527202 - DNA, 13 bp, Homo sapiens
gcttttctcatgg

SEQ ID NO: 527203 - DNA, 14 bp, Homo sapiens
gcttttctcatggt

SEQ ID NO: 527204 - DNA, 20 bp, Homo sapiens
gcttttgatggctatgtttt

SEQ ID NO: 527205 - DNA, 22 bp, Homo sapiens
gcttttgtacgttaattaaaca

SEQ ID NO: 527206 - DNA, 15 bp, Homo sapiens
ggaaaacgatttaat

SEQ ID NO: 527207 - DNA, 21 bp, Homo sapiens
ggaataagaagcaaataaata

SEQ ID NO: 527208 - DNA, 14 bp, Homo sapiens
ggaatcaaaaattg

SEQ ID NO: 527209 - DNA, 11 bp, Homo sapiens
ggaatgctcaa

SEQ ID NO: 527210 - DNA, 19 bp, Homo sapiens
ggaattattagcaccagct

SEQ ID NO: 527211 - DNA, 22 bp, Homo sapiens
ggaattattagcaccagcttgc

SEQ ID NO: 527212 - DNA, 14 bp, Homo sapiens
ggagaaggaggaac

SEQ ID NO: 527213 - DNA, 16 bp, Homo sapiens
ggagagagggggagac

SEQ ID NO: 527214 - DNA, 21 bp, Homo sapiens
ggagaggagcaaacaggaaaa

SEQ ID NO: 527215 - DNA, 23 bp, Homo sapiens
ggagccctgccgaggtgtggctg

SEQ ID NO: 527216 - DNA, 14 bp, Homo sapiens
ggagcttggcagag

SEQ ID NO: 527217 - DNA, 18 bp, Homo sapiens
ggagcttggcagagagat

SEQ ID NO: 527218 - DNA, 17 bp, Homo sapiens
ggaggagaaggaggaac

SEQ ID NO: 527219 - DNA, 12 bp, Homo sapiens
ggaggctgagat

SEQ ID NO: 527220 - DNA, 15 bp, Homo sapiens
ggagggacacagagg

SEQ ID NO: 527221 - DNA, 13 bp, Homo sapiens
ggagggcgctttt

SEQ ID NO: 527222 - DNA, 16 bp, Homo sapiens
ggagtggggaggagag

SEQ ID NO: 527223 - DNA, 15 bp, Homo sapiens
ggatccagctctggg

SEQ ID NO: 527224 - DNA, 17 bp, Homo sapiens
ggatccagctctgggag

SEQ ID NO: 527225 - DNA, 13 bp, Homo sapiens
ggatgcatgcagg

SEQ ID NO: 527226 - DNA, 21 bp, Homo sapiens
ggatgtaatatagggtttgtt

SEQ ID NO: 527227 - DNA, 16 bp, Homo sapiens
ggatttgacacactca

SEQ ID NO: 527228 - DNA, 16 bp, Homo sapiens
ggcactgtgcactcta

SEQ ID NO: 527229 - DNA, 13 bp, Homo sapiens
ggcagcctgcaga

SEQ ID NO: 527230 - DNA, 18 bp, Homo sapiens
ggcagcctgtgggtcctt

SEQ ID NO: 527231 - DNA, 22 bp, Homo sapiens
ggcagctgcagttagcacagag

SEQ ID NO: 527232 - DNA, 23 bp, Homo sapiens
ggcagctgcagttagcacagagg

SEQ ID NO: 527233 - DNA, 23 bp, Homo sapiens
ggcattggaggatgggggtcctg

SEQ ID NO: 527234 - DNA, 21 bp, Homo sapiens
ggcatttgctgaataacaaca

SEQ ID NO: 527235 - DNA, 19 bp, Homo sapiens
ggccagaccacgcccctgc

SEQ ID NO: 527236 - DNA, 19 bp, Homo sapiens
ggcctgatggccaggcctc

SEQ ID NO: 527237 - DNA, 23 bp, Homo sapiens
ggcgtccctgagggcccttccca

SEQ ID NO: 527238 - DNA, 22 bp, Homo sapiens
ggctcacaccggcactgtgcac

SEQ ID NO: 527239 - DNA, 19 bp, Homo sapiens
ggctcccactgcccctgca

SEQ ID NO: 527240 - DNA, 14 bp, Homo sapiens
ggctcccagcagag

SEQ ID NO: 527241 - DNA, 23 bp, Homo sapiens
ggctccctgcctggatccagctc

SEQ ID NO: 527242 - DNA, 20 bp, Homo sapiens
ggctctctcacccagcctgg

SEQ ID NO: 527243 - DNA, 17 bp, Homo sapiens
ggctctgaatctctcaa

SEQ ID NO: 527244 - DNA, 13 bp, Homo sapiens
ggctgaaattatg

SEQ ID NO: 527245 - DNA, 14 bp, Homo sapiens
ggctgactcagtgc

SEQ ID NO: 527246 - DNA, 20 bp, Homo sapiens
ggctgagagggtgtgggtgc

SEQ ID NO: 527247 - DNA, 20 bp, Homo sapiens
ggctgtgtcctaaatgcaaa

SEQ ID NO: 527248 - DNA, 20 bp, Homo sapiens
gggagacccctttgccttcc

SEQ ID NO: 527249 - DNA, 12 bp, Homo sapiens
gggagtggggag

SEQ ID NO: 527250 - DNA, 13 bp, Homo sapiens
gggagtggggagg

SEQ ID NO: 527251 - DNA, 17 bp, Homo sapiens
gggatggattggcctcc

SEQ ID NO: 527252 - DNA, 20 bp, Homo sapiens
gggattcctcccctggaagt

SEQ ID NO: 527253 - DNA, 20 bp, Homo sapiens
gggccagtcatggctgtccc

SEQ ID NO: 527254 - DNA, 22 bp, Homo sapiens
gggctcacaccggcactgtgca

SEQ ID NO: 527255 - DNA, 14 bp, Homo sapiens
gggctgctgcactg

SEQ ID NO: 527256 - DNA, 16 bp, Homo sapiens
gggctgctgcactgcc

SEQ ID NO: 527257 - DNA, 13 bp, Homo sapiens
gggctgggcagaa

SEQ ID NO: 527258 - DNA, 20 bp, Homo sapiens
tcctgggggctgctgcactg

SEQ ID NO: 527259 - DNA, 12 bp, Homo sapiens
tcctgtctcctc

SEQ ID NO: 527260 - DNA, 20 bp, Homo sapiens
tcctgtctcctctgtcagtt

SEQ ID NO: 527261 - DNA, 17 bp, Homo sapiens
tcctgtgtcatctgtca

SEQ ID NO: 527262 - DNA, 15 bp, Homo sapiens
tccttcatgcttttc

SEQ ID NO: 527263 - DNA, 17 bp, Homo sapiens
tccttcatgcttttctc

SEQ ID NO: 527264 - DNA, 15 bp, Homo sapiens
tccttgccttcaaac

SEQ ID NO: 527265 - DNA, 20 bp, Homo sapiens
tccttgtagacgcacctgct

SEQ ID NO: 527266 - DNA, 15 bp, Homo sapiens
tccttttgtatcctc

SEQ ID NO: 527267 - DNA, 13 bp, Homo sapiens
tgatggccaggcc

SEQ ID NO: 527268 - DNA, 15 bp, Homo sapiens
tgatggccaggcctc

SEQ ID NO: 527269 - DNA, 14 bp, Homo sapiens
tgatggctatgttt

SEQ ID NO: 527270 - DNA, 23 bp, Homo sapiens
tgatggtagaaattttatctctt

SEQ ID NO: 527271 - DNA, 19 bp, Homo sapiens
tgatgtgatttatgcattt

SEQ ID NO: 527272 - DNA, 16 bp, Homo sapiens
tgattagacaatgtgg

SEQ ID NO: 527273 - DNA, 14 bp, Homo sapiens
tgattcacttttat

SEQ ID NO: 527274 - DNA, 21 bp, Homo sapiens
tgattctttcaatccacagta

SEQ ID NO: 527275 - DNA, 20 bp, Homo sapiens
tgattgacattttgtagcta

SEQ ID NO: 527276 - DNA, 13 bp, Homo sapiens
tgatttaaacttc

SEQ ID NO: 527277 - DNA, 21 bp, Homo sapiens
tgatttaaacttcttaactgg

SEQ ID NO: 527278 - DNA, 12 bp, Homo sapiens
tgatttaacatt

SEQ ID NO: 527279 - DNA, 15 bp, Homo sapiens
tgatttatgcattta

SEQ ID NO: 527280 - DNA, 12 bp, Homo sapiens
tgatttattctg

SEQ ID NO: 527281 - DNA, 22 bp, Homo sapiens
tgatttcatgattagacaatgt

SEQ ID NO: 527282 - DNA, 13 bp, Homo sapiens
tgattttaacttt

SEQ ID NO: 527283 - DNA, 14 bp, Homo sapiens
tgatttttgttgat

SEQ ID NO: 527284 - DNA, 22 bp, Homo sapiens
tgcaataaactcagtcaaatgt

SEQ ID NO: 527285 - DNA, 17 bp, Homo sapiens
tgcacacataacacaca

SEQ ID NO: 527286 - DNA, 21 bp, Homo sapiens
tgcacacataacacacatcag

SEQ ID NO: 527287 - DNA, 13 bp, Homo sapiens
tgcacaccaaatt

SEQ ID NO: 527288 - DNA, 21 bp, Homo sapiens
tgcacaccaaattgctgagat

SEQ ID NO: 527289 - DNA, 18 bp, Homo sapiens
tgcacagtggtccagggt

SEQ ID NO: 527290 - DNA, 14 bp, Homo sapiens
tgcacctgcttctc

SEQ ID NO: 527291 - DNA, 15 bp, Homo sapiens
tgcacctgcttctca

SEQ ID NO: 527292 - DNA, 17 bp, Homo sapiens
tgcactgccctccgccc

SEQ ID NO: 527293 - DNA, 22 bp, Homo sapiens
tgcactgtcccggagctcaggc

SEQ ID NO: 527294 - DNA, 15 bp, Homo sapiens
tgcaggaatcaaaaa

SEQ ID NO: 527295 - DNA, 19 bp, Homo sapiens
tgcaggaatcaaaaattga

SEQ ID NO: 527296 - DNA, 15 bp, Homo sapiens
tgcaggcagcctgca

SEQ ID NO: 527297 - DNA, 14 bp, Homo sapiens
tgcagggacagcct

SEQ ID NO: 527298 - DNA, 15 bp, Homo sapiens
tgcagggacagcctg

SEQ ID NO: 527299 - DNA, 16 bp, Homo sapiens
tgcagtagtgtcactt

SEQ ID NO: 527300 - DNA, 14 bp, Homo sapiens
tgcatctggcctgg

SEQ ID NO: 527301 - DNA, 15 bp, Homo sapiens
tgcatctggcctggg

SEQ ID NO: 527302 - DNA, 22 bp, Homo sapiens
tgcatgagaactaaatagattt

SEQ ID NO: 527303 - DNA, 15 bp, Homo sapiens
tgccaggcagctgca

SEQ ID NO: 527304 - DNA, 21 bp, Homo sapiens
tgccaggctcccactgcccct

SEQ ID NO: 527305 - DNA, 23 bp, Homo sapiens
tgccatttcctcctgggcaacag

SEQ ID NO: 527306 - DNA, 21 bp, Homo sapiens
tgcccacccgtgttctcctcc

SEQ ID NO: 527307 - DNA, 19 bp, Homo sapiens
tgcccctgcacctgcttct

SEQ ID NO: 527308 - DNA, 23 bp, Homo sapiens
tgcccgtggtgaggttgtgctgc

SEQ ID NO: 527309 - DNA, 15 bp, Homo sapiens
tgccctccctgctgc

SEQ ID NO: 527310 - DNA, 14 bp, Homo sapiens
tgccctctgccact

SEQ ID NO: 527311 - DNA, 22 bp, Homo sapiens
tgccgcttaaacatttccctgc

SEQ ID NO: 527312 - DNA, 12 bp, Homo sapiens
tgccgtctttgg

SEQ ID NO: 527313 - DNA, 14 bp, Homo sapiens
tgccgtggcaactg

SEQ ID NO: 527314 - DNA, 22 bp, Homo sapiens
tgcctggaggagaaggaggaac

SEQ ID NO: 527315 - DNA, 21 bp, Homo sapiens
tgcctgtggtgaggtcctgtc

SEQ ID NO: 527316 - DNA, 14 bp, Homo sapiens
tgccttctggggag

SEQ ID NO: 527317 - DNA, 24 bp, Homo sapiens
tgccttgggcgggccatttcacat

SEQ ID NO: 527318 - DNA, 17 bp, Homo sapiens
tgcggcagggcaggagc

SEQ ID NO: 527319 - DNA, 22 bp, Homo sapiens
tgcgtgccacatcaataacaac

SEQ ID NO: 527320 - DNA, 15 bp, Homo sapiens
tgctacaaaatgtgt

SEQ ID NO: 527321 - DNA, 12 bp, Homo sapiens
tgctcaatgtgc

SEQ ID NO: 527322 - DNA, 16 bp, Homo sapiens
tgctcaatgtgctgtt

SEQ ID NO: 527323 - DNA, 18 bp, Homo sapiens
tgctcaatgtgctgttga

SEQ ID NO: 527324 - DNA, 19 bp, Homo sapiens
tgctcaatgtgctgttgat

SEQ ID NO: 527325 - DNA, 20 bp, Homo sapiens
tgctcaatgtgctgttgatt

SEQ ID NO: 527326 - DNA, 22 bp, Homo sapiens
tgctcaatgtgctgttgattct

SEQ ID NO: 527327 - DNA, 16 bp, Homo sapiens
tgctccattcctgagt

SEQ ID NO: 527328 - DNA, 14 bp, Homo sapiens
tgctccctgctccc

SEQ ID NO: 527329 - DNA, 18 bp, Homo sapiens
tgctgaataacaacaatt

SEQ ID NO: 527330 - DNA, 21 bp, Homo sapiens
tgctgagatgtttagtagctg

SEQ ID NO: 527331 - DNA, 17 bp, Homo sapiens
tgctgcactgccctccg

SEQ ID NO: 527332 - DNA, 20 bp, Homo sapiens
tgctgcagtcagcacagaga

SEQ ID NO: 527333 - DNA, 17 bp, Homo sapiens
tgctgccccacaacaca

SEQ ID NO: 527334 - DNA, 13 bp, Homo sapiens
tgctgcttttgat

SEQ ID NO: 527335 - DNA, 18 bp, Homo sapiens
tgctgtaaataaaaatag

SEQ ID NO: 527336 - DNA, 13 bp, Homo sapiens
tgctgtccctgtg

SEQ ID NO: 527337 - DNA, 15 bp, Homo sapiens
tgctgtccctgtggg

SEQ ID NO: 527338 - DNA, 17 bp, Homo sapiens
tgctgtccctgtgggct

SEQ ID NO: 527339 - DNA, 18 bp, Homo sapiens
tgctgtccctgtgggctc

SEQ ID NO: 527340 - DNA, 15 bp, Homo sapiens
tgctgtgaaatgact

SEQ ID NO: 527341 - DNA, 17 bp, Homo sapiens
tgctgttgattctttca

SEQ ID NO: 527342 - DNA, 15 bp, Homo sapiens
tgcttagtgtccctt

SEQ ID NO: 527343 - DNA, 20 bp, Homo sapiens
tgcttagtgtcccttacctg

SEQ ID NO: 527344 - DNA, 19 bp, Homo sapiens
tgcttttgatggctatgtt

SEQ ID NO: 527345 - DNA, 14 bp, Homo sapiens
tggaacagccctgc

SEQ ID NO: 527346 - DNA, 15 bp, Homo sapiens
tggaacagccctgca

SEQ ID NO: 527347 - DNA, 18 bp, Homo sapiens
tggaattacataacaggc

SEQ ID NO: 527348 - DNA, 21 bp, Homo sapiens
tggaattacataacaggcatt

SEQ ID NO: 527349 - DNA, 17 bp, Homo sapiens
tggaccgagtggaccac

SEQ ID NO: 527350 - DNA, 14 bp, Homo sapiens
tggacgtgtgagga

SEQ ID NO: 527351 - DNA, 21 bp, Homo sapiens
tggagctgaggactctcacga

SEQ ID NO: 527352 - DNA, 13 bp, Homo sapiens
tggaggagaagga

SEQ ID NO: 527353 - DNA, 20 bp, Homo sapiens
tggaggagaaggaggaaccc

SEQ ID NO: 527354 - DNA, 12 bp, Homo sapiens
tggaggtgatga

SEQ ID NO: 527355 - DNA, 14 bp, Homo sapiens
tggagtcagggctg

SEQ ID NO: 527356 - DNA, 19 bp, Homo sapiens
tggagtcagggctgtgctt

SEQ ID NO: 527357 - DNA, 18 bp, Homo sapiens
tggatccagctctgggag

SEQ ID NO: 527358 - DNA, 19 bp, Homo sapiens
tggatccagctctgggagc

SEQ ID NO: 527359 - DNA, 15 bp, Homo sapiens
tggatttgacacact

SEQ ID NO: 527360 - DNA, 14 bp, Homo sapiens
tggcaactgtggaa

SEQ ID NO: 527361 - DNA, 21 bp, Homo sapiens
gtgcagggacagcctgcacag

SEQ ID NO: 527362 - DNA, 13 bp, Homo sapiens
gtgcatctggcct

SEQ ID NO: 527363 - DNA, 17 bp, Homo sapiens
gtgcatctggcctgggg

SEQ ID NO: 527364 - DNA, 22 bp, Homo sapiens
gtgcccacccgtgttctcctcc

SEQ ID NO: 527365 - DNA, 15 bp, Homo sapiens
gtgccccccatgccc

SEQ ID NO: 527366 - DNA, 11 bp, Homo sapiens
gtgccttgggc

SEQ ID NO: 527367 - DNA, 18 bp, Homo sapiens
gtgctgcccgagggcagg

SEQ ID NO: 527368 - DNA, 17 bp, Homo sapiens
gtgctgctgtggcatca

SEQ ID NO: 527369 - DNA, 23 bp, Homo sapiens
gtggaattacataacaggcattg

SEQ ID NO: 527370 - DNA, 21 bp, Homo sapiens
gtggaattattagcaccagct

SEQ ID NO: 527371 - DNA, 17 bp, Homo sapiens
gtggcacacaactgtgg

SEQ ID NO: 527372 - DNA, 21 bp, Homo sapiens
gtggcctggcttctgggacag

SEQ ID NO: 527373 - DNA, 22 bp, Homo sapiens
gtggctaaatgcctaataaaca

SEQ ID NO: 527374 - DNA, 16 bp, Homo sapiens
gtggctcccagcagag

SEQ ID NO: 527375 - DNA, 11 bp, Homo sapiens
taatttttcct

SEQ ID NO: 527376 - DNA, 15 bp, Homo sapiens
tacaaaaaaaatcaa

SEQ ID NO: 527377 - DNA, 21 bp, Homo sapiens
tacaaaatgtgtgcttggaaa

SEQ ID NO: 527378 - DNA, 15 bp, Homo sapiens
tacaggggaggctga

SEQ ID NO: 527379 - DNA, 16 bp, Homo sapiens
tacatagtggtcattt

SEQ ID NO: 527380 - DNA, 17 bp, Homo sapiens
tacatgatgatttcaga

SEQ ID NO: 527381 - DNA, 12 bp, Homo sapiens
taccagcaaaag

SEQ ID NO: 527382 - DNA, 19 bp, Homo sapiens
taccccagaacgcatgcag

SEQ ID NO: 527383 - DNA, 18 bp, Homo sapiens
tacctattgctgtaaata

SEQ ID NO: 527384 - DNA, 14 bp, Homo sapiens
tactaacactggct

SEQ ID NO: 527385 - DNA, 14 bp, Homo sapiens
tactcctccccctc

SEQ ID NO: 527386 - DNA, 15 bp, Homo sapiens
tactctgtgctaagt

SEQ ID NO: 527387 - DNA, 21 bp, Homo sapiens
tactgatgagacaacacacac

SEQ ID NO: 527388 - DNA, 21 bp, Homo sapiens
tactgccacggtcctttgagt

SEQ ID NO: 527389 - DNA, 21 bp, Homo sapiens
tactgttttgtgcggtgtgtc

SEQ ID NO: 527390 - DNA, 18 bp, Homo sapiens
tacttaaacaaaaacttt

SEQ ID NO: 527391 - DNA, 15 bp, Homo sapiens
tagaatcaagtctgt

SEQ ID NO: 527392 - DNA, 17 bp, Homo sapiens
tagaatcaagtctgtga

SEQ ID NO: 527393 - DNA, 19 bp, Homo sapiens
tagataccattttgaaata

SEQ ID NO: 527394 - DNA, 22 bp, Homo sapiens
tagatcaactcatgttaattga

SEQ ID NO: 527395 - DNA, 14 bp, Homo sapiens
tagatttttagatt

SEQ ID NO: 527396 - DNA, 16 bp, Homo sapiens
tagcacagaggatggc

SEQ ID NO: 527397 - DNA, 21 bp, Homo sapiens
tagcaccagcttgcttctctg

SEQ ID NO: 527398 - DNA, 19 bp, Homo sapiens
tagcactttgggaggctga

SEQ ID NO: 527399 - DNA, 17 bp, Homo sapiens
tagcatgtaatattaaa

SEQ ID NO: 527400 - DNA, 18 bp, Homo sapiens
tagcatgtaatattaaat

SEQ ID NO: 527401 - DNA, 21 bp, Homo sapiens
tagcatgtaatattaaattcc

SEQ ID NO: 527402 - DNA, 22 bp, Homo sapiens
tagcatgtaatattaaattcct

SEQ ID NO: 527403 - DNA, 17 bp, Homo sapiens
tagccgggctccaggga

SEQ ID NO: 527404 - DNA, 17 bp, Homo sapiens
tagctagtttaaaatta

SEQ ID NO: 527405 - DNA, 22 bp, Homo sapiens
tagctagtttaaaattattaaa

SEQ ID NO: 527406 - DNA, 14 bp, Homo sapiens
tagctccttcatgc

SEQ ID NO: 527407 - DNA, 21 bp, Homo sapiens
taggaaagcctcactgatata

SEQ ID NO: 527408 - DNA, 22 bp, Homo sapiens
taggaatgctcaatgtgctgtt

SEQ ID NO: 527409 - DNA, 23 bp, Homo sapiens
taggacatctctgtaaaaagcag

SEQ ID NO: 527410 - DNA, 15 bp, Homo sapiens
taggtctgcacacat

SEQ ID NO: 527411 - DNA, 16 bp, Homo sapiens
taggtctgcacacata

SEQ ID NO: 527412 - DNA, 21 bp, Homo sapiens
taggtttagaatcaagtctgt

SEQ ID NO: 527413 - DNA, 23 bp, Homo sapiens
taggtttagaatcaagtctgtga

SEQ ID NO: 527414 - DNA, 14 bp, Homo sapiens
tagtagctgataaa

SEQ ID NO: 527415 - DNA, 16 bp, Homo sapiens
tagtagctgataaaga

SEQ ID NO: 527416 - DNA, 19 bp, Homo sapiens
tagtagctgataaagaaac

SEQ ID NO: 527417 - DNA, 21 bp, Homo sapiens
tagtgtcacttttttcctgtc

SEQ ID NO: 527418 - DNA, 15 bp, Homo sapiens
tagttaaattggctt

SEQ ID NO: 527419 - DNA, 14 bp, Homo sapiens
tagttgttaagttt

SEQ ID NO: 527420 - DNA, 14 bp, Homo sapiens
tataaactgtgaga

SEQ ID NO: 527421 - DNA, 16 bp, Homo sapiens
tataaatgaatgaaat

SEQ ID NO: 527422 - DNA, 19 bp, Homo sapiens
tataacattgtaaatgata

SEQ ID NO: 527423 - DNA, 17 bp, Homo sapiens
tataatggcctcttaaa

SEQ ID NO: 527424 - DNA, 18 bp, Homo sapiens
tataatggcctcttaaaa

SEQ ID NO: 527425 - DNA, 17 bp, Homo sapiens
tataccagcaaaagtgc

SEQ ID NO: 527426 - DNA, 15 bp, Homo sapiens
tatatcagactgctt

SEQ ID NO: 527427 - DNA, 12 bp, Homo sapiens
tatatctgaaaa

SEQ ID NO: 527428 - DNA, 14 bp, Homo sapiens
tatatctgtggtct

SEQ ID NO: 527429 - DNA, 18 bp, Homo sapiens
tatatctgtggtcttcaa

SEQ ID NO: 527430 - DNA, 14 bp, Homo sapiens
tatatgaaaactaa

SEQ ID NO: 527431 - DNA, 16 bp, Homo sapiens
tatatgtttggctgaa

SEQ ID NO: 527432 - DNA, 22 bp, Homo sapiens
tatatgtttggctgaaattatg

SEQ ID NO: 527433 - DNA, 13 bp, Homo sapiens
tatcatgtgtttc

SEQ ID NO: 527434 - DNA, 21 bp, Homo sapiens
tatcattatagcatgtaatat

SEQ ID NO: 527435 - DNA, 17 bp, Homo sapiens
tatctcgctagccatat

SEQ ID NO: 527436 - DNA, 20 bp, Homo sapiens
tatctcgctagccatatatt

SEQ ID NO: 527437 - DNA, 14 bp, Homo sapiens
tatctgaaaactgg

SEQ ID NO: 527438 - DNA, 15 bp, Homo sapiens
tatctgatatctgtt

SEQ ID NO: 527439 - DNA, 22 bp, Homo sapiens
tatctggaaaaaaaaaaatatg

SEQ ID NO: 527440 - DNA, 20 bp, Homo sapiens
tatctgtctttatgatttca

SEQ ID NO: 527441 - DNA, 21 bp, Homo sapiens
tatctgtctttatgatttcat

SEQ ID NO: 527442 - DNA, 13 bp, Homo sapiens
tatctgtggtctt

SEQ ID NO: 527443 - DNA, 15 bp, Homo sapiens
tatctttaaaactta

SEQ ID NO: 527444 - DNA, 23 bp, Homo sapiens
tatgagattggaaaaaattagac

SEQ ID NO: 527445 - DNA, 15 bp, Homo sapiens
tatgcatgagaacta

SEQ ID NO: 527446 - DNA, 14 bp, Homo sapiens
tatgcatttatgca

SEQ ID NO: 527447 - DNA, 22 bp, Homo sapiens
tatgcatttatgcatgagaact

SEQ ID NO: 527448 - DNA, 23 bp, Homo sapiens
tatggaggagagtgtttaactga

SEQ ID NO: 527449 - DNA, 19 bp, Homo sapiens
tatgttttggagagagcaa

SEQ ID NO: 527450 - DNA, 17 bp, Homo sapiens
tattaaaaattatagac

SEQ ID NO: 527451 - DNA, 18 bp, Homo sapiens
tattgagacactgtcaag

SEQ ID NO: 527452 - DNA, 14 bp, Homo sapiens
tattgagtgtacat

SEQ ID NO: 527453 - DNA, 18 bp, Homo sapiens
tattgctggaatctacta

SEQ ID NO: 527454 - DNA, 20 bp, Homo sapiens
tattgctgtaaataaaaata

SEQ ID NO: 527455 - DNA, 17 bp, Homo sapiens
tatttataacattgtaa

SEQ ID NO: 527456 - DNA, 11 bp, Homo sapiens
tatttccatgg

SEQ ID NO: 527457 - DNA, 22 bp, Homo sapiens
tatttggtaacttgctgtgaaa

SEQ ID NO: 527458 - DNA, 20 bp, Homo sapiens
tatttgtcagtgtagatcaa

SEQ ID NO: 527459 - DNA, 19 bp, Homo sapiens
tattttggacgtgtgagga

SEQ ID NO: 527460 - DNA, 12 bp, Homo sapiens
tcaaaatgtgcc

SEQ ID NO: 527461 - DNA, 20 bp, Homo sapiens
tcaaatgctactcagtatat

SEQ ID NO: 527462 - DNA, 14 bp, Homo sapiens
tcaacttcaggaaa

SEQ ID NO: 527463 - DNA, 13 bp, Homo sapiens
tcaaggctgcagt

SEQ ID NO: 527464 - DNA, 15 bp, Homo sapiens
tcaataactattgct

SEQ ID NO: 527465 - DNA, 20 bp, Homo sapiens
tcaatgttcacgcaacttga

SEQ ID NO: 527466 - DNA, 21 bp, Homo sapiens
tcaatgttcacgcaacttgaa

SEQ ID NO: 527467 - DNA, 17 bp, Homo sapiens
ttaacttctattttcaa

SEQ ID NO: 527468 - DNA, 18 bp, Homo sapiens
ttaagtcttactgttttg

SEQ ID NO: 527469 - DNA, 14 bp, Homo sapiens
ttaatcatttccag

SEQ ID NO: 527470 - DNA, 16 bp, Homo sapiens
ttaatcatttccagca

SEQ ID NO: 527471 - DNA, 11 bp, Homo sapiens
ttacataacag

SEQ ID NO: 527472 - DNA, 21 bp, Homo sapiens
ttacataacaggcattgcact

SEQ ID NO: 527473 - DNA, 21 bp, Homo sapiens
ttacctgtaatagcctcacct

SEQ ID NO: 527474 - DNA, 17 bp, Homo sapiens
aaactgatgctttcaga

SEQ ID NO: 527475 - DNA, 14 bp, Homo sapiens
aaactggaataaga

SEQ ID NO: 527476 - DNA, 15 bp, Homo sapiens
aaactggaataagaa

SEQ ID NO: 527477 - DNA, 14 bp, Homo sapiens
aaactgtgagataa

SEQ ID NO: 527478 - DNA, 20 bp, Homo sapiens
aaactgtgagataaatatca

SEQ ID NO: 527479 - DNA, 22 bp, Homo sapiens
aaagaaattagggctctaattt

SEQ ID NO: 527480 - DNA, 13 bp, Homo sapiens
aaagcatgctcag

SEQ ID NO: 527481 - DNA, 15 bp, Homo sapiens
aaagggaagccctga

SEQ ID NO: 527482 - DNA, 19 bp, Homo sapiens
aaaggtttcactgttcatg

SEQ ID NO: 527483 - DNA, 22 bp, Homo sapiens
aaagtgatgtgatttatgcatt

SEQ ID NO: 527484 - DNA, 16 bp, Homo sapiens
aaagttaatcttcatg

SEQ ID NO: 527485 - DNA, 13 bp, Homo sapiens
aaataattaaaac

SEQ ID NO: 527486 - DNA, 14 bp, Homo sapiens
aaatacatgatgat

SEQ ID NO: 527487 - DNA, 20 bp, Homo sapiens
aaatacatgatgatttcaga

SEQ ID NO: 527488 - DNA, 18 bp, Homo sapiens
aaatagctataaatagtg

SEQ ID NO: 527489 - DNA, 20 bp, Homo sapiens
aaatagctataaatagtgaa

SEQ ID NO: 527490 - DNA, 17 bp, Homo sapiens
aaatataaactgtgaga

SEQ ID NO: 527491 - DNA, 17 bp, Homo sapiens
aaatatatgtttggctg

SEQ ID NO: 527492 - DNA, 19 bp, Homo sapiens
aaatatatgtttggctgaa

SEQ ID NO: 527493 - DNA, 14 bp, Homo sapiens
aaatatcattatag

SEQ ID NO: 527494 - DNA, 17 bp, Homo sapiens
aaatatcattatagcat

SEQ ID NO: 527495 - DNA, 22 bp, Homo sapiens
aaatatcattatagcatgtaat

SEQ ID NO: 527496 - DNA, 22 bp, Homo sapiens
aaatcatatttacctgtgaatc

SEQ ID NO: 527497 - DNA, 14 bp, Homo sapiens
aaatctcatcccta

SEQ ID NO: 527498 - DNA, 13 bp, Homo sapiens
aaatgaatgaaat

SEQ ID NO: 527499 - DNA, 18 bp, Homo sapiens
aaatgtgtgcttggaaaa

SEQ ID NO: 527500 - DNA, 16 bp, Homo sapiens
aaattaacttctattt

SEQ ID NO: 527501 - DNA, 15 bp, Homo sapiens
aaattatctttaaaa

SEQ ID NO: 527502 - DNA, 16 bp, Homo sapiens
aaattcacaaagttaa

SEQ ID NO: 527503 - DNA, 17 bp, Homo sapiens
aaattgaagagagatat

SEQ ID NO: 527504 - DNA, 18 bp, Homo sapiens
aaattgctgagatgttta

SEQ ID NO: 527505 - DNA, 18 bp, Homo sapiens
aaattgtcttttgtcatg

SEQ ID NO: 527506 - DNA, 22 bp, Homo sapiens
aacaaagcatttgactttctgt

SEQ ID NO: 527507 - DNA, 14 bp, Homo sapiens
aacaaatggcttgt

SEQ ID NO: 527508 - DNA, 15 bp, Homo sapiens
aacaacaacagaaca

SEQ ID NO: 527509 - DNA, 19 bp, Homo sapiens
aacaatttaggaatgctca

SEQ ID NO: 527510 - DNA, 17 bp, Homo sapiens
aacagcaacaacaacag

SEQ ID NO: 527511 - DNA, 21 bp, Homo sapiens
aacagtgtggatgtaaatttt

SEQ ID NO: 527512 - DNA, 14 bp, Homo sapiens
aacctcccctggtc

SEQ ID NO: 527513 - DNA, 15 bp, Homo sapiens
aacgatttaatttat

SEQ ID NO: 527514 - DNA, 20 bp, Homo sapiens
aactaaatagatttttagat

SEQ ID NO: 527515 - DNA, 14 bp, Homo sapiens
aactggaataagaa

SEQ ID NO: 527516 - DNA, 15 bp, Homo sapiens
aactggaataagaag

SEQ ID NO: 527517 - DNA, 15 bp, Homo sapiens
aactgtcattacaga

SEQ ID NO: 527518 - DNA, 13 bp, Homo sapiens
aactgtgagataa

SEQ ID NO: 527519 - DNA, 12 bp, Homo sapiens
aacttcaggaaa

SEQ ID NO: 527520 - DNA, 18 bp, Homo sapiens
aacttcatgctgtctgtg

SEQ ID NO: 527521 - DNA, 16 bp, Homo sapiens
aacttctactcttcaa

SEQ ID NO: 527522 - DNA, 17 bp, Homo sapiens
agggcccccacaggagc

SEQ ID NO: 527523 - DNA, 13 bp, Homo sapiens
agggcccccactg

SEQ ID NO: 527524 - DNA, 19 bp, Homo sapiens
agggctgacttctccagga

SEQ ID NO: 527525 - DNA, 12 bp, Homo sapiens
aggggaggctga

SEQ ID NO: 527526 - DNA, 14 bp, Homo sapiens
aggggccagaccac

SEQ ID NO: 527527 - DNA, 12 bp, Homo sapiens
agggggagaccc

SEQ ID NO: 527528 - DNA, 17 bp, Homo sapiens
agggggcaaggagaaag

SEQ ID NO: 527529 - DNA, 16 bp, Homo sapiens
agggtccagccctccg

SEQ ID NO: 527530 - DNA, 17 bp, Homo sapiens
agggtgtgggtgccctg

SEQ ID NO: 527531 - DNA, 19 bp, Homo sapiens
agggtgtgggtgccctgtt

SEQ ID NO: 527532 - DNA, 22 bp, Homo sapiens
agggttgtgattttgtctgctt

SEQ ID NO: 527533 - DNA, 20 bp, Homo sapiens
aggtcagtgttataaaatct

SEQ ID NO: 527534 - DNA, 16 bp, Homo sapiens
aggtctgcacacataa

SEQ ID NO: 527535 - DNA, 14 bp, Homo sapiens
aggtgaaatggagg

SEQ ID NO: 527536 - DNA, 13 bp, Homo sapiens
aggttcttgctgc

SEQ ID NO: 527537 - DNA, 15 bp, Homo sapiens
aggttgtgctgcctg

SEQ ID NO: 527538 - DNA, 16 bp, Homo sapiens
aggtttcactgttcat

SEQ ID NO: 527539 - DNA, 19 bp, Homo sapiens
aggtttcactgttcatgaa

SEQ ID NO: 527540 - DNA, 14 bp, Homo sapiens
agtacaattctttg

SEQ ID NO: 527541 - DNA, 19 bp, Homo sapiens
agtacaattctttgttgct

SEQ ID NO: 527542 - DNA, 16 bp, Homo sapiens
agtagctgataaagaa

SEQ ID NO: 527543 - DNA, 15 bp, Homo sapiens
agtaggtctgcacac

SEQ ID NO: 527544 - DNA, 10 bp, Homo sapiens
agtatctcat

SEQ ID NO: 527545 - DNA, 22 bp, Homo sapiens
agtattgttcttgtaaaactgt

SEQ ID NO: 527546 - DNA, 12 bp, Homo sapiens
agtcagcacaga

SEQ ID NO: 527547 - DNA, 21 bp, Homo sapiens
agtctcagtgctagcttattt

SEQ ID NO: 527548 - DNA, 16 bp, Homo sapiens
agtctcctgtatcatt

SEQ ID NO: 527549 - DNA, 15 bp, Homo sapiens
agtcttactgttttg

SEQ ID NO: 527550 - DNA, 23 bp, Homo sapiens
agtgaaaaagacttcaaatgtta

SEQ ID NO: 527551 - DNA, 14 bp, Homo sapiens
agtgatgtgattta

SEQ ID NO: 527552 - DNA, 14 bp, Homo sapiens
agtgattgacattt

SEQ ID NO: 527553 - DNA, 16 bp, Homo sapiens
agtgggcggcttccct

SEQ ID NO: 527554 - DNA, 16 bp, Homo sapiens
agtggggaggagagag

SEQ ID NO: 527555 - DNA, 20 bp, Homo sapiens
agtggtcatttggtggctct

SEQ ID NO: 527556 - DNA, 21 bp, Homo sapiens
agtggtccagggtccagccct

SEQ ID NO: 527557 - DNA, 16 bp, Homo sapiens
agtgtactggatttaa

SEQ ID NO: 527558 - DNA, 21 bp, Homo sapiens
agtgtcacttttttcctgtca

SEQ ID NO: 527559 - DNA, 22 bp, Homo sapiens
agtgtcacttttttcctgtcaa

SEQ ID NO: 527560 - DNA, 23 bp, Homo sapiens
agtgtcacttttttcctgtcaat

SEQ ID NO: 527561 - DNA, 19 bp, Homo sapiens
agtgttataaaatctgtat

SEQ ID NO: 527562 - DNA, 21 bp, Homo sapiens
agttactgccacggtcctttg

SEQ ID NO: 527563 - DNA, 12 bp, Homo sapiens
agttctgatgag

SEQ ID NO: 527564 - DNA, 19 bp, Homo sapiens
agttggttacctattgctg

SEQ ID NO: 527565 - DNA, 19 bp, Homo sapiens
agttgtcctttctgatcct

SEQ ID NO: 527566 - DNA, 14 bp, Homo sapiens
agtttaaaattatt

SEQ ID NO: 527567 - DNA, 17 bp, Homo sapiens
agtttaaaattattaaa

SEQ ID NO: 527568 - DNA, 22 bp, Homo sapiens
agtttcatttttcattttctct

SEQ ID NO: 527569 - DNA, 20 bp, Homo sapiens
atgagtttccagctaagcct

SEQ ID NO: 527570 - DNA, 15 bp, Homo sapiens
atgatatgtctttaa

SEQ ID NO: 527571 - DNA, 22 bp, Homo sapiens
atgatggaagggccttctccac

SEQ ID NO: 527572 - DNA, 19 bp, Homo sapiens
atgattagacaatgtggaa

SEQ ID NO: 527573 - DNA, 18 bp, Homo sapiens
atgattcacttttattgt

SEQ ID NO: 527574 - DNA, 13 bp, Homo sapiens
atgatttcatgat

SEQ ID NO: 527575 - DNA, 17 bp, Homo sapiens
atgcaggcagcctgcag

SEQ ID NO: 527576 - DNA, 21 bp, Homo sapiens
atgcagggcccccacaggagc

SEQ ID NO: 527577 - DNA, 17 bp, Homo sapiens
atgcatgagaactaaat

SEQ ID NO: 527578 - DNA, 18 bp, Homo sapiens
atgcatgagaactaaata

SEQ ID NO: 527579 - DNA, 20 bp, Homo sapiens
atgcatttatgcatgagaac

SEQ ID NO: 527580 - DNA, 23 bp, Homo sapiens
atgccaatgtccaggtcacaggc

SEQ ID NO: 527581 - DNA, 20 bp, Homo sapiens
atgccagtccagatgtgcct

SEQ ID NO: 527582 - DNA, 16 bp, Homo sapiens
atgccctccctgctgc

SEQ ID NO: 527583 - DNA, 19 bp, Homo sapiens
atgccctccctgctgccag

SEQ ID NO: 527584 - DNA, 16 bp, Homo sapiens
atgcctcattttattc

SEQ ID NO: 527585 - DNA, 19 bp, Homo sapiens
atgcctttctagcaattgc

SEQ ID NO: 527586 - DNA, 16 bp, Homo sapiens
atgctaacctctctga

SEQ ID NO: 527587 - DNA, 18 bp, Homo sapiens
atgctacaaaatgtgtgc

SEQ ID NO: 527588 - DNA, 20 bp, Homo sapiens
atgctcaatgtgctgttgat

SEQ ID NO: 527589 - DNA, 18 bp, Homo sapiens
atgctcagtattgagaca

SEQ ID NO: 527590 - DNA, 14 bp, Homo sapiens
atgcttttctcatg

SEQ ID NO: 527591 - DNA, 18 bp, Homo sapiens
atgcttttctcatggtat

SEQ ID NO: 527592 - DNA, 14 bp, Homo sapiens
atggaacagccctg

SEQ ID NO: 527593 - DNA, 22 bp, Homo sapiens
atggaactcagctgtctgtggc

SEQ ID NO: 527594 - DNA, 23 bp, Homo sapiens
atggaactcagctgtctgtggct

SEQ ID NO: 527595 - DNA, 17 bp, Homo sapiens
atggaggagagtgttta

SEQ ID NO: 527596 - DNA, 13 bp, Homo sapiens
atggatgtaatat

SEQ ID NO: 527597 - DNA, 15 bp, Homo sapiens
atggatgtaatatag

SEQ ID NO: 527598 - DNA, 18 bp, Homo sapiens
atggattggcctccaggg

SEQ ID NO: 527599 - DNA, 19 bp, Homo sapiens
atggattggcctccagggc

SEQ ID NO: 527600 - DNA, 19 bp, Homo sapiens
atggcctcttaaaaattat

SEQ ID NO: 527601 - DNA, 16 bp, Homo sapiens
atggctgtcccctgca

SEQ ID NO: 527602 - DNA, 16 bp, Homo sapiens
atggtagactgtgaca

SEQ ID NO: 527603 - DNA, 14 bp, Homo sapiens
atgtacccagccta

SEQ ID NO: 527604 - DNA, 15 bp, Homo sapiens
atgtcaaatggatgt

SEQ ID NO: 527605 - DNA, 16 bp, Homo sapiens
atgtgctgctgtggca

SEQ ID NO: 527606 - DNA, 19 bp, Homo sapiens
atgtgctgttgattctttc

SEQ ID NO: 527607 - DNA, 17 bp, Homo sapiens
atgtggaattacataac

SEQ ID NO: 527608 - DNA, 16 bp, Homo sapiens
atgttattcaataact

SEQ ID NO: 527609 - DNA, 17 bp, Homo sapiens
atgttcacgcaacttga

SEQ ID NO: 527610 - DNA, 12 bp, Homo sapiens
atgttcttgcag

SEQ ID NO: 527611 - DNA, 19 bp, Homo sapiens
atgttcttgcagtcatcag

SEQ ID NO: 527612 - DNA, 17 bp, Homo sapiens
atgttgtcctgtgtcat

SEQ ID NO: 527613 - DNA, 22 bp, Homo sapiens
atgttttggagagagcaatctt

SEQ ID NO: 527614 - DNA, 13 bp, Homo sapiens
attaaaacaaaat

SEQ ID NO: 527615 - DNA, 14 bp, Homo sapiens
attaaatgaaatac

SEQ ID NO: 527616 - DNA, 23 bp, Homo sapiens
attaaatgaaatacttgacaaca

SEQ ID NO: 527617 - DNA, 23 bp, Homo sapiens
attaaattcctcctgtctcctct

SEQ ID NO: 527618 - DNA, 17 bp, Homo sapiens
attaagttataccagca

SEQ ID NO: 527619 - DNA, 15 bp, Homo sapiens
attacataacaggca

SEQ ID NO: 527620 - DNA, 22 bp, Homo sapiens
attagacaatgtggaattacat

SEQ ID NO: 527621 - DNA, 14 bp, Homo sapiens
attagcaccagctt

SEQ ID NO: 527622 - DNA, 15 bp, Homo sapiens
attagcaccagcttg

SEQ ID NO: 527623 - DNA, 22 bp, Homo sapiens
attagcaccagcttgcttctct

SEQ ID NO: 527624 - DNA, 15 bp, Homo sapiens
attatgtcaaatgga

SEQ ID NO: 527625 - DNA, 16 bp, Homo sapiens
attatgtcaaatggat

SEQ ID NO: 527626 - DNA, 12 bp, Homo sapiens
acacacaaaaca

SEQ ID NO: 527627 - DNA, 21 bp, Homo sapiens
acacacaaaacaacagcaaca

SEQ ID NO: 527628 - DNA, 15 bp, Homo sapiens
acacactcaccattt

SEQ ID NO: 527629 - DNA, 15 bp, Homo sapiens
acacagattatttgt

SEQ ID NO: 527630 - DNA, 21 bp, Homo sapiens
acacagctgagctggcctatt

SEQ ID NO: 527631 - DNA, 23 bp, Homo sapiens
acacattgcacacacagtctgtt

SEQ ID NO: 527632 - DNA, 19 bp, Homo sapiens
acaccaaattgctgagatg

SEQ ID NO: 527633 - DNA, 13 bp, Homo sapiens
acactgtcaagat

SEQ ID NO: 527634 - DNA, 22 bp, Homo sapiens
acactgtcaagattaagttata

SEQ ID NO: 527635 - DNA, 18 bp, Homo sapiens
acactgtctgctgcccca

SEQ ID NO: 527636 - DNA, 15 bp, Homo sapiens
acacttgggctggca

SEQ ID NO: 527637 - DNA, 14 bp, Homo sapiens
acagaacaacaaca

SEQ ID NO: 527638 - DNA, 19 bp, Homo sapiens
acagatattttcgcccacc

SEQ ID NO: 527639 - DNA, 15 bp, Homo sapiens
acaggcaccatgctg

SEQ ID NO: 527640 - DNA, 18 bp, Homo sapiens
acaggcattgcactaaaa

SEQ ID NO: 527641 - DNA, 20 bp, Homo sapiens
acagggacacagtctggtgc

SEQ ID NO: 527642 - DNA, 20 bp, Homo sapiens
acagtagcatactgatgaga

SEQ ID NO: 527643 - DNA, 16 bp, Homo sapiens
acagtattgttcttgt

SEQ ID NO: 527644 - DNA, 18 bp, Homo sapiens
acagtgtggatgtaaatt

SEQ ID NO: 527645 - DNA, 13 bp, Homo sapiens
acataacacacat

SEQ ID NO: 527646 - DNA, 22 bp, Homo sapiens
acataacaggcattgcactaaa

SEQ ID NO: 527647 - DNA, 23 bp, Homo sapiens
acatctctgtaaaaagcaggtga

SEQ ID NO: 527648 - DNA, 16 bp, Homo sapiens
acatgatgatttcaga

SEQ ID NO: 527649 - DNA, 17 bp, Homo sapiens
acatgcctttccagtgc

SEQ ID NO: 527650 - DNA, 20 bp, Homo sapiens
acatgctaacctctctgaac

SEQ ID NO: 527651 - DNA, 15 bp, Homo sapiens
acattatagattttc

SEQ ID NO: 527652 - DNA, 19 bp, Homo sapiens
acattcctgaccctcactt

SEQ ID NO: 527653 - DNA, 14 bp, Homo sapiens
acatttatgtgtga

SEQ ID NO: 527654 - DNA, 13 bp, Homo sapiens
accaaattgctga

SEQ ID NO: 527655 - DNA, 16 bp, Homo sapiens
accaaattgctgagat

SEQ ID NO: 527656 - DNA, 23 bp, Homo sapiens
accaagggctgacttctccagga

SEQ ID NO: 527657 - DNA, 23 bp, Homo sapiens
accaccctatcatcagttaggat

SEQ ID NO: 527658 - DNA, 15 bp, Homo sapiens
accacgacctcgtcc

SEQ ID NO: 527659 - DNA, 16 bp, Homo sapiens
accacgacctcgtcca

SEQ ID NO: 527660 - DNA, 23 bp, Homo sapiens
accacggtccaatccagccttct

SEQ ID NO: 527661 - DNA, 22 bp, Homo sapiens
accagctcaggctactgccact

SEQ ID NO: 527662 - DNA, 17 bp, Homo sapiens
accaggctgatgccgtg

SEQ ID NO: 527663 - DNA, 21 bp, Homo sapiens
accatcttgggattcctcccc

SEQ ID NO: 527664 - DNA, 14 bp, Homo sapiens
accatttaatcatt

SEQ ID NO: 527665 - DNA, 18 bp, Homo sapiens
accatttaatcatttcca

SEQ ID NO: 527666 - DNA, 20 bp, Homo sapiens
accatttcccctgtggtttg

SEQ ID NO: 527667 - DNA, 22 bp, Homo sapiens
accattttgaaatattcacaag

SEQ ID NO: 527668 - DNA, 15 bp, Homo sapiens
acccaggtgttgtcc

SEQ ID NO: 527669 - DNA, 22 bp, Homo sapiens
accccagaacgcatgcagggcc

SEQ ID NO: 527670 - DNA, 22 bp, Homo sapiens
accccaggatgcatgcagggcc

SEQ ID NO: 527671 - DNA, 15 bp, Homo sapiens
acccccatgccaatg

SEQ ID NO: 527672 - DNA, 21 bp, Homo sapiens
accccgttgttgtccctgcag

SEQ ID NO: 527673 - DNA, 21 bp, Homo sapiens
acccggctgactcagtgcagg

SEQ ID NO: 527674 - DNA, 17 bp, Homo sapiens
atttccagcaaaatata

SEQ ID NO: 527675 - DNA, 22 bp, Homo sapiens
atttccagcaaaatatatgttt

SEQ ID NO: 527676 - DNA, 13 bp, Homo sapiens
atttgacacactc

SEQ ID NO: 527677 - DNA, 16 bp, Homo sapiens
atttgctgaataacaa

SEQ ID NO: 527678 - DNA, 20 bp, Homo sapiens
attttaaaaaagatggattt

SEQ ID NO: 527679 - DNA, 24 bp, Homo sapiens
attttaaaaaagatggatttgaca

SEQ ID NO: 527680 - DNA, 13 bp, Homo sapiens
attttatctcttc

SEQ ID NO: 527681 - DNA, 13 bp, Homo sapiens
attttattgaata

SEQ ID NO: 527682 - DNA, 16 bp, Homo sapiens
attttcaagtggaaac

SEQ ID NO: 527683 - DNA, 20 bp, Homo sapiens
attttcaagtggaaaccttg

SEQ ID NO: 527684 - DNA, 18 bp, Homo sapiens
attttctgagtagcatat

SEQ ID NO: 527685 - DNA, 19 bp, Homo sapiens
attttgaaaggagaaaaaa

SEQ ID NO: 527686 - DNA, 12 bp, Homo sapiens
attttgaaatat

SEQ ID NO: 527687 - DNA, 14 bp, Homo sapiens
attttgtagctagt

SEQ ID NO: 527688 - DNA, 18 bp, Homo sapiens
caaaaactttccatgaca

SEQ ID NO: 527689 - DNA, 24 bp, Homo sapiens
caaaaactttccatgacagtagca

SEQ ID NO: 527690 - DNA, 13 bp, Homo sapiens
caaaacaacagca

SEQ ID NO: 527691 - DNA, 20 bp, Homo sapiens
caaaacaacagcaacaacaa

SEQ ID NO: 527692 - DNA, 19 bp, Homo sapiens
caaaagtgcagtagtgtca

SEQ ID NO: 527693 - DNA, 22 bp, Homo sapiens
caaaagtgcagtagtgtcactt

SEQ ID NO: 527694 - DNA, 15 bp, Homo sapiens
caaaatatatgtttg

SEQ ID NO: 527695 - DNA, 21 bp, Homo sapiens
caaaatatatgtttggctgaa

SEQ ID NO: 527696 - DNA, 11 bp, Homo sapiens
caaaatgtgcc

SEQ ID NO: 527697 - DNA, 21 bp, Homo sapiens
caaaatgtgccgtctttggtt

SEQ ID NO: 527698 - DNA, 19 bp, Homo sapiens
caaagatccagcggggctt

SEQ ID NO: 527699 - DNA, 19 bp, Homo sapiens
caaagcatgctcagtattg

SEQ ID NO: 527700 - DNA, 17 bp, Homo sapiens
caaaggttgtacatagt

SEQ ID NO: 527701 - DNA, 15 bp, Homo sapiens
caaatggatgtaata

SEQ ID NO: 527702 - DNA, 13 bp, Homo sapiens
caaattccttccc

SEQ ID NO: 527703 - DNA, 12 bp, Homo sapiens
caaattgctgag

SEQ ID NO: 527704 - DNA, 14 bp, Homo sapiens
caacaaagcatgct

SEQ ID NO: 527705 - DNA, 17 bp, Homo sapiens
caacaaagcatgctcag

SEQ ID NO: 527706 - DNA, 22 bp, Homo sapiens
caacaaagcatgctcagtattg

SEQ ID NO: 527707 - DNA, 13 bp, Homo sapiens
caacaacaaagca

SEQ ID NO: 527708 - DNA, 15 bp, Homo sapiens
caacagcaacaacaa

SEQ ID NO: 527709 - DNA, 23 bp, Homo sapiens
caactgtggtcccagctacaggg

SEQ ID NO: 527710 - DNA, 21 bp, Homo sapiens
caagattaagttataccagca

SEQ ID NO: 527711 - DNA, 22 bp, Homo sapiens
caagattaagttataccagcaa

SEQ ID NO: 527712 - DNA, 22 bp, Homo sapiens
caaggaatgaattttttcctac

SEQ ID NO: 527713 - DNA, 22 bp, Homo sapiens
caaggagccccccaaagacact

SEQ ID NO: 527714 - DNA, 16 bp, Homo sapiens
caaggcctccagccac

SEQ ID NO: 527715 - DNA, 21 bp, Homo sapiens
caagggctgacttctccagga

SEQ ID NO: 527716 - DNA, 15 bp, Homo sapiens
caaggggctgcttct

SEQ ID NO: 527717 - DNA, 11 bp, Homo sapiens
caagtctgtga

SEQ ID NO: 527718 - DNA, 12 bp, Homo sapiens
caagtctgtgaa

SEQ ID NO: 527719 - DNA, 17 bp, Homo sapiens
caagtggacgtgggctc

SEQ ID NO: 527720 - DNA, 12 bp, Homo sapiens
caagtgtcctgc

SEQ ID NO: 527721 - DNA, 16 bp, Homo sapiens
caataaagctcacact

SEQ ID NO: 527722 - DNA, 16 bp, Homo sapiens
caatccacagtattgt

SEQ ID NO: 527723 - DNA, 13 bp, Homo sapiens
caatcttgctgtg

SEQ ID NO: 527724 - DNA, 15 bp, Homo sapiens
caatcttgctgtgaa

SEQ ID NO: 527725 - DNA, 22 bp, Homo sapiens
caatcttgctgtgaaacagtgt

SEQ ID NO: 527726 - DNA, 16 bp, Homo sapiens
caatgtgctgttgatt

SEQ ID NO: 527727 - DNA, 22 bp, Homo sapiens
caatgtgctgttgattctttca

SEQ ID NO: 527728 - DNA, 16 bp, Homo sapiens
caatgtggaattacat

SEQ ID NO: 527729 - DNA, 18 bp, Homo sapiens
caatttaggaatgctcaa

SEQ ID NO: 527730 - DNA, 23 bp, Homo sapiens
caatttaggaatgctcaatgtgc

SEQ ID NO: 527731 - DNA, 19 bp, Homo sapiens
cacaataaaagacatccac

SEQ ID NO: 527732 - DNA, 15 bp, Homo sapiens
cacacaaaacaacag

SEQ ID NO: 527733 - DNA, 10 bp, Homo sapiens
cacacacaaa

SEQ ID NO: 527734 - DNA, 23 bp, Homo sapiens
cccctccctttttaaacaaatgg

SEQ ID NO: 527735 - DNA, 15 bp, Homo sapiens
cccctcctccatgct

SEQ ID NO: 527736 - DNA, 20 bp, Homo sapiens
cccctcctccatgctgtccc

SEQ ID NO: 527737 - DNA, 22 bp, Homo sapiens
cccctcctccatgctgtccctg

SEQ ID NO: 527738 - DNA, 13 bp, Homo sapiens
cccctggtcctgc

SEQ ID NO: 527739 - DNA, 21 bp, Homo sapiens
cccctggtcctgcactgtccc

SEQ ID NO: 527740 - DNA, 14 bp, Homo sapiens
cccgccccgctgct

SEQ ID NO: 527741 - DNA, 16 bp, Homo sapiens
cccgccccgctgctcc

SEQ ID NO: 527742 - DNA, 12 bp, Homo sapiens
cccgctgctccc

SEQ ID NO: 527743 - DNA, 18 bp, Homo sapiens
cccgctgctcccggtgtg

SEQ ID NO: 527744 - DNA, 17 bp, Homo sapiens
cccggacgggggagctt

SEQ ID NO: 527745 - DNA, 22 bp, Homo sapiens
cccggacgggggagctttccca

SEQ ID NO: 527746 - DNA, 17 bp, Homo sapiens
cccggctctgaggctgc

SEQ ID NO: 527747 - DNA, 12 bp, Homo sapiens
cccggctgactc

SEQ ID NO: 527748 - DNA, 20 bp, Homo sapiens
cccggctgactcagtgcagg

SEQ ID NO: 527749 - DNA, 14 bp, Homo sapiens
cccggtgtgcagcg

SEQ ID NO: 527750 - DNA, 13 bp, Homo sapiens
ccctagttctttg

SEQ ID NO: 527751 - DNA, 15 bp, Homo sapiens
ccctccctccctgct

SEQ ID NO: 527752 - DNA, 15 bp, Homo sapiens
ccctccgccagccct

SEQ ID NO: 527753 - DNA, 17 bp, Homo sapiens
ccctccgccagccctgt

SEQ ID NO: 527754 - DNA, 15 bp, Homo sapiens
ccctcctccatgctg

SEQ ID NO: 527755 - DNA, 23 bp, Homo sapiens
ccctcctccatgctgtccctgtg

SEQ ID NO: 527756 - DNA, 12 bp, Homo sapiens
ccctctgccact

SEQ ID NO: 527757 - DNA, 13 bp, Homo sapiens
ccctctgccactg

SEQ ID NO: 527758 - DNA, 20 bp, Homo sapiens
ccctgacaacaactatcacc

SEQ ID NO: 527759 - DNA, 21 bp, Homo sapiens
ccctgacaacaactatcacca

SEQ ID NO: 527760 - DNA, 15 bp, Homo sapiens
ccctgacatgctaac

SEQ ID NO: 527761 - DNA, 23 bp, Homo sapiens
ccctgagggcccttcccaacctc

SEQ ID NO: 527762 - DNA, 16 bp, Homo sapiens
ccctgcacctgcttct

SEQ ID NO: 527763 - DNA, 20 bp, Homo sapiens
ccctgcatggctgagagggt

SEQ ID NO: 527764 - DNA, 21 bp, Homo sapiens
ccctgcctggatccagctctg

SEQ ID NO: 527765 - DNA, 18 bp, Homo sapiens
ccctggaagttgtccttt

SEQ ID NO: 527766 - DNA, 20 bp, Homo sapiens
ccctggaccgagtggaccac

SEQ ID NO: 527767 - DNA, 12 bp, Homo sapiens
ccctggtcctgc

SEQ ID NO: 527768 - DNA, 13 bp, Homo sapiens
ccctgtgggctca

SEQ ID NO: 527769 - DNA, 17 bp, Homo sapiens
ccctgtgggctcacacc

SEQ ID NO: 527770 - DNA, 14 bp, Homo sapiens
ccctgttccgcctc

SEQ ID NO: 527771 - DNA, 22 bp, Homo sapiens
ccctgttccgcctcactgggtg

SEQ ID NO: 527772 - DNA, 17 bp, Homo sapiens
ccctgttgacctaccct

SEQ ID NO: 527773 - DNA, 13 bp, Homo sapiens
cccttacctggct

SEQ ID NO: 527774 - DNA, 14 bp, Homo sapiens
ccgccagccctgtt

SEQ ID NO: 527775 - DNA, 16 bp, Homo sapiens
ccgccccgctgctccc

SEQ ID NO: 527776 - DNA, 15 bp, Homo sapiens
ccgcctcactgggtg

SEQ ID NO: 527777 - DNA, 18 bp, Homo sapiens
ccgcgtggttctgccact

SEQ ID NO: 527778 - DNA, 19 bp, Homo sapiens
ccgctgcagtcagcacaga

SEQ ID NO: 527779 - DNA, 13 bp, Homo sapiens
ccggcactgtgca

SEQ ID NO: 527780 - DNA, 13 bp, Homo sapiens
ccggcccccctct

SEQ ID NO: 527781 - DNA, 12 bp, Homo sapiens
ccggctgactca

SEQ ID NO: 527782 - DNA, 20 bp, Homo sapiens
ccggggtggagtcagggctg

SEQ ID NO: 527783 - DNA, 21 bp, Homo sapiens
ccgggtgccccccatgccctc

SEQ ID NO: 527784 - DNA, 23 bp, Homo sapiens
ccgggtgccccccatgccctccc

SEQ ID NO: 527785 - DNA, 13 bp, Homo sapiens
ccggtggggccag

SEQ ID NO: 527786 - DNA, 18 bp, Homo sapiens
ccggttccacgtggggtg

SEQ ID NO: 527787 - DNA, 13 bp, Homo sapiens
ccgtcagcctgtg

SEQ ID NO: 527788 - DNA, 18 bp, Homo sapiens
ccgtctgggaatcctgga

SEQ ID NO: 527789 - DNA, 21 bp, Homo sapiens
ccgtctttggttcctcatggc

SEQ ID NO: 527790 - DNA, 15 bp, Homo sapiens
ccgtgctcacagtag

SEQ ID NO: 527791 - DNA, 16 bp, Homo sapiens
ccgttgttgtccctgc

SEQ ID NO: 527792 - DNA, 17 bp, Homo sapiens
cctaaagggaagccctg

SEQ ID NO: 527793 - DNA, 16 bp, Homo sapiens
cctactcctccccctc

SEQ ID NO: 527794 - DNA, 20 bp, Homo sapiens
cctactcctccccctcctcc

SEQ ID NO: 527795 - DNA, 23 bp, Homo sapiens
cctactcctccccctcctccatg

SEQ ID NO: 527796 - DNA, 13 bp, Homo sapiens
cctacttaaacaa

SEQ ID NO: 527797 - DNA, 14 bp, Homo sapiens
cctacttaaacaaa

SEQ ID NO: 527798 - DNA, 16 bp, Homo sapiens
cctacttaaacaaaaa

SEQ ID NO: 527799 - DNA, 15 bp, Homo sapiens
cctatgagagaagag

SEQ ID NO: 527800 - DNA, 12 bp, Homo sapiens
cctcatggctgt

SEQ ID NO: 527801 - DNA, 15 bp, Homo sapiens
cctccaaatgctgtc

SEQ ID NO: 527802 - DNA, 16 bp, Homo sapiens
cctccaaatgctgtcg

SEQ ID NO: 527803 - DNA, 19 bp, Homo sapiens
cctccagttctgatgaggc

SEQ ID NO: 527804 - DNA, 18 bp, Homo sapiens
cctccctccctgctccct

SEQ ID NO: 527805 - DNA, 13 bp, Homo sapiens
cctccctgctgcc

SEQ ID NO: 527806 - DNA, 21 bp, Homo sapiens
cctccctttttaaacaaatgg

SEQ ID NO: 527807 - DNA, 13 bp, Homo sapiens
cctccgcccttcc

SEQ ID NO: 527808 - DNA, 21 bp, Homo sapiens
cctcctccagttctgatgagg

SEQ ID NO: 527809 - DNA, 18 bp, Homo sapiens
cctcctccatgctgtccc

SEQ ID NO: 527810 - DNA, 22 bp, Homo sapiens
cctcctccatgctgtccctgtg

SEQ ID NO: 527811 - DNA, 20 bp, Homo sapiens
cctcctgtctcctctgtcag

SEQ ID NO: 527812 - DNA, 23 bp, Homo sapiens
cctctaggtaaactagcaaaagg

SEQ ID NO: 527813 - DNA, 16 bp, Homo sapiens
cctctgcataaatatt

SEQ ID NO: 527814 - DNA, 15 bp, Homo sapiens
cctctgtcagtttgt

SEQ ID NO: 527815 - DNA, 22 bp, Homo sapiens
cctgacatgctaacctctctga

SEQ ID NO: 527816 - DNA, 14 bp, Homo sapiens
cctgaccctcactt

SEQ ID NO: 527817 - DNA, 15 bp, Homo sapiens
cctgatggccaggcc

SEQ ID NO: 527818 - DNA, 15 bp, Homo sapiens
cctgatttattctgg

SEQ ID NO: 527819 - DNA, 17 bp, Homo sapiens
cctgcaagtggacgtgg

SEQ ID NO: 527820 - DNA, 20 bp, Homo sapiens
cctgcacagtggtccagggt

SEQ ID NO: 527821 - DNA, 22 bp, Homo sapiens
cctgcagaccacactctgcctg

SEQ ID NO: 527822 - DNA, 14 bp, Homo sapiens
cctgcctgagacca

SEQ ID NO: 527823 - DNA, 14 bp, Homo sapiens
cctgccttcatgga

SEQ ID NO: 527824 - DNA, 18 bp, Homo sapiens
cctgctcccggctctgag

SEQ ID NO: 527825 - DNA, 20 bp, Homo sapiens
cctgctgccaggctcccact

SEQ ID NO: 527826 - DNA, 16 bp, Homo sapiens
cctggacatattccca

SEQ ID NO: 527827 - DNA, 19 bp, Homo sapiens
cctggaggagaaggaggaa

SEQ ID NO: 527828 - DNA, 16 bp, Homo sapiens
cctgggggctgctgca

SEQ ID NO: 527829 - DNA, 19 bp, Homo sapiens
cctgggggctgctgcactg

SEQ ID NO: 527830 - DNA, 23 bp, Homo sapiens
cctgtcaatatatagagacttct

SEQ ID NO: 527831 - DNA, 16 bp, Homo sapiens
cctgtcctggctccca

SEQ ID NO: 527832 - DNA, 15 bp, Homo sapiens
cctgtgaactgccag

SEQ ID NO: 527833 - DNA, 14 bp, Homo sapiens
cctgtgggctcaca

SEQ ID NO: 527834 - DNA, 19 bp, Homo sapiens
ctaactccttgaggtcttg

SEQ ID NO: 527835 - DNA, 16 bp, Homo sapiens
ctaattaaaaagttaa

SEQ ID NO: 527836 - DNA, 17 bp, Homo sapiens
ctaattaatttcagtaa

SEQ ID NO: 527837 - DNA, 23 bp, Homo sapiens
ctacaaaaaaaatcaaaaaatta

SEQ ID NO: 527838 - DNA, 15 bp, Homo sapiens
ctacaaaatgtgtgc

SEQ ID NO: 527839 - DNA, 16 bp, Homo sapiens
ctacaggggaggctga

SEQ ID NO: 527840 - DNA, 20 bp, Homo sapiens
ctaccccaggacgcatgcag

SEQ ID NO: 527841 - DNA, 20 bp, Homo sapiens
ctacctttggcttaattcca

SEQ ID NO: 527842 - DNA, 17 bp, Homo sapiens
ctactcctccccctcct

SEQ ID NO: 527843 - DNA, 23 bp, Homo sapiens
ctactgccactcaggcagcctgt

SEQ ID NO: 527844 - DNA, 13 bp, Homo sapiens
ctacttaaacaaa

SEQ ID NO: 527845 - DNA, 15 bp, Homo sapiens
ctacttaaacaaaaa

SEQ ID NO: 527846 - DNA, 13 bp, Homo sapiens
ctagccatatatt

SEQ ID NO: 527847 - DNA, 22 bp, Homo sapiens
ctaggacatctctgtaaaaagc

SEQ ID NO: 527848 - DNA, 15 bp, Homo sapiens
ctagtttaaaattat

SEQ ID NO: 527849 - DNA, 21 bp, Homo sapiens
ctagtttaaaattattaaaaa

SEQ ID NO: 527850 - DNA, 19 bp, Homo sapiens
ctataaatagtgaaaattt

SEQ ID NO: 527851 - DNA, 20 bp, Homo sapiens
ctatccccggacgcatgcag

SEQ ID NO: 527852 - DNA, 22 bp, Homo sapiens
ctatccccggacgcatgcaggg

SEQ ID NO: 527853 - DNA, 20 bp, Homo sapiens
ctatccctggacgcatgcag

SEQ ID NO: 527854 - DNA, 22 bp, Homo sapiens
ctatccctggacgcatgcaggg

SEQ ID NO: 527855 - DNA, 22 bp, Homo sapiens
ctatgcacaccaaattgctgag

SEQ ID NO: 527856 - DNA, 14 bp, Homo sapiens
ctatgtgtgtgctt

SEQ ID NO: 527857 - DNA, 14 bp, Homo sapiens
ctatttattaaaac

SEQ ID NO: 527858 - DNA, 14 bp, Homo sapiens
ctcaaggcctccag

SEQ ID NO: 527859 - DNA, 21 bp, Homo sapiens
ctcaaggctgcagtgagccaa

SEQ ID NO: 527860 - DNA, 11 bp, Homo sapiens
ctcaatgtgct

SEQ ID NO: 527861 - DNA, 22 bp, Homo sapiens
ctcacaccggcactgtgcactc

SEQ ID NO: 527862 - DNA, 19 bp, Homo sapiens
ctcacacttgggctggcac

SEQ ID NO: 527863 - DNA, 23 bp, Homo sapiens
ctcacacttgggctggcacccac

SEQ ID NO: 527864 - DNA, 16 bp, Homo sapiens
ctgacttctccaggac

SEQ ID NO: 527865 - DNA, 22 bp, Homo sapiens
ctgagaatccccgtgctcacag

SEQ ID NO: 527866 - DNA, 16 bp, Homo sapiens
ctgatatattttccag

SEQ ID NO: 527867 - DNA, 18 bp, Homo sapiens
ctgatgagacaacacaca

SEQ ID NO: 527868 - DNA, 13 bp, Homo sapiens
ctgcaacactgga

SEQ ID NO: 527869 - DNA, 15 bp, Homo sapiens
ctgcacacataacac

SEQ ID NO: 527870 - DNA, 18 bp, Homo sapiens
ctgcacacataacacaca

SEQ ID NO: 527871 - DNA, 16 bp, Homo sapiens
ctgcacctgcttctca

SEQ ID NO: 527872 - DNA, 13 bp, Homo sapiens
ctgcactgccctc

SEQ ID NO: 527873 - DNA, 16 bp, Homo sapiens
ctgcagtcagcacaga

SEQ ID NO: 527874 - DNA, 20 bp, Homo sapiens
ctgcagttagcacagaggat

SEQ ID NO: 527875 - DNA, 21 bp, Homo sapiens
ctgccactgacaggaaagtgg

SEQ ID NO: 527876 - DNA, 21 bp, Homo sapiens
ctgccaggctcccactgcccc

SEQ ID NO: 527877 - DNA, 15 bp, Homo sapiens
ctgccccacaacaca

SEQ ID NO: 527878 - DNA, 16 bp, Homo sapiens
ctgccggtggggccag

SEQ ID NO: 527879 - DNA, 17 bp, Homo sapiens
ctgcctacgtgctgccc

SEQ ID NO: 527880 - DNA, 19 bp, Homo sapiens
ctgcctggaggagaaggag

SEQ ID NO: 527881 - DNA, 19 bp, Homo sapiens
ctgcctgtggtgaggtcct

SEQ ID NO: 527882 - DNA, 23 bp, Homo sapiens
ctgcgacggaggcaggaccaggc

SEQ ID NO: 527883 - DNA, 14 bp, Homo sapiens
ctgctcccggtgtg

SEQ ID NO: 527884 - DNA, 17 bp, Homo sapiens
ctgctcccggtgtgcag

SEQ ID NO: 527885 - DNA, 18 bp, Homo sapiens
ctgctgcactgccctccg

SEQ ID NO: 527886 - DNA, 14 bp, Homo sapiens
ctgctgtggcatca

SEQ ID NO: 527887 - DNA, 18 bp, Homo sapiens
ctgcttggtttagctgtg

SEQ ID NO: 527888 - DNA, 20 bp, Homo sapiens
gatcattggtatctgatatc

SEQ ID NO: 527889 - DNA, 15 bp, Homo sapiens
gatccagctctggga

SEQ ID NO: 527890 - DNA, 21 bp, Homo sapiens
gatccccatggaacagccctg

SEQ ID NO: 527891 - DNA, 21 bp, Homo sapiens
gatcctctcttcttttcccat

SEQ ID NO: 527892 - DNA, 21 bp, Homo sapiens
gatctgtgcagcgaggtccac

SEQ ID NO: 527893 - DNA, 17 bp, Homo sapiens
gatgagacaacacacac

SEQ ID NO: 527894 - DNA, 15 bp, Homo sapiens
gatgcgtggctccca

SEQ ID NO: 527895 - DNA, 20 bp, Homo sapiens
gatggattggcctccagggc

SEQ ID NO: 527896 - DNA, 15 bp, Homo sapiens
gatggatttgacaca

SEQ ID NO: 527897 - DNA, 14 bp, Homo sapiens
gatggccaggcctc

SEQ ID NO: 527898 - DNA, 17 bp, Homo sapiens
gatgtgatttatgcatt

SEQ ID NO: 527899 - DNA, 20 bp, Homo sapiens
gattaagttataccagcaaa

SEQ ID NO: 527900 - DNA, 21 bp, Homo sapiens
gattcccgtggctttgtgctt

SEQ ID NO: 527901 - DNA, 21 bp, Homo sapiens
gattgacattttgtagctagt

SEQ ID NO: 527902 - DNA, 14 bp, Homo sapiens
gattggcctccagg

SEQ ID NO: 527903 - DNA, 15 bp, Homo sapiens
gattttcatgttctt

SEQ ID NO: 527904 - DNA, 21 bp, Homo sapiens
gcaaaatacatgatgatttca

SEQ ID NO: 527905 - DNA, 21 bp, Homo sapiens
gcaaaatatatgtttggctga

SEQ ID NO: 527906 - DNA, 21 bp, Homo sapiens
gcaaagatccagcggggcttc

SEQ ID NO: 527907 - DNA, 16 bp, Homo sapiens
gctgctgcactgccct

SEQ ID NO: 527908 - DNA, 23 bp, Homo sapiens
gctgctgcagtcagcacagagag

SEQ ID NO: 527909 - DNA, 19 bp, Homo sapiens
gctgcttttgatggctatg

SEQ ID NO: 527910 - DNA, 14 bp, Homo sapiens
gctgggtcccgggt

SEQ ID NO: 527911 - DNA, 20 bp, Homo sapiens
gctgtccctgtgggctcaca

SEQ ID NO: 527912 - DNA, 15 bp, Homo sapiens
gctgtctgtggcttc

SEQ ID NO: 527913 - DNA, 17 bp, Homo sapiens
gctgtctgtgtgaggct

SEQ ID NO: 527914 - DNA, 18 bp, Homo sapiens
gctgtggcatcaggaaag

SEQ ID NO: 527915 - DNA, 14 bp, Homo sapiens
gctgttatctgtct

SEQ ID NO: 527916 - DNA, 13 bp, Homo sapiens
gcttaagaagtat

SEQ ID NO: 527917 - DNA, 13 bp, Homo sapiens
gcttaattccaat

SEQ ID NO: 527918 - DNA, 17 bp, Homo sapiens
gcttagcgttctgtttc

SEQ ID NO: 527919 - DNA, 14 bp, Homo sapiens
gcttcccaacaata

SEQ ID NO: 527920 - DNA, 17 bp, Homo sapiens
gcttcccatgtctttct

SEQ ID NO: 527921 - DNA, 15 bp, Homo sapiens
gcttccccattgcct

SEQ ID NO: 527922 - DNA, 23 bp, Homo sapiens
gcttctgggacaggcaccatgct

SEQ ID NO: 527923 - DNA, 20 bp, Homo sapiens
gcttgtttaaggttcttgct

SEQ ID NO: 527924 - DNA, 21 bp, Homo sapiens
gctttactctgaatttccagt

SEQ ID NO: 527925 - DNA, 13 bp, Homo sapiens
gctttgtgcttat

SEQ ID NO: 527926 - DNA, 17 bp, Homo sapiens
gcttttcccacctcttt

SEQ ID NO: 527927 - DNA, 15 bp, Homo sapiens
gcttttctcatggta

SEQ ID NO: 527928 - DNA, 19 bp, Homo sapiens
ggaagtcatcctgcaatgg

SEQ ID NO: 527929 - DNA, 12 bp, Homo sapiens
ggaatgctcaat

SEQ ID NO: 527930 - DNA, 21 bp, Homo sapiens
ggaattattagcaccagcttg

SEQ ID NO: 527931 - DNA, 14 bp, Homo sapiens
ggacagcctgcaca

SEQ ID NO: 527932 - DNA, 17 bp, Homo sapiens
ggaccggacgcatgcag

SEQ ID NO: 527933 - DNA, 21 bp, Homo sapiens
ggacctactcctccccctcct

SEQ ID NO: 527934 - DNA, 17 bp, Homo sapiens
ggacgcatgcagggccc

SEQ ID NO: 527935 - DNA, 19 bp, Homo sapiens
ggacgggggagctttccca

SEQ ID NO: 527936 - DNA, 13 bp, Homo sapiens
ggagaaggaggaa

SEQ ID NO: 527937 - DNA, 21 bp, Homo sapiens
ggaggagagagggggagaccc

SEQ ID NO: 527938 - DNA, 18 bp, Homo sapiens
ggagtggggaggagagag

SEQ ID NO: 527939 - DNA, 19 bp, Homo sapiens
ggatggattggcctccagg

SEQ ID NO: 527940 - DNA, 16 bp, Homo sapiens
ggattcccctggacat

SEQ ID NO: 527941 - DNA, 22 bp, Homo sapiens
ggattcccgtggctttgtgctt

SEQ ID NO: 527942 - DNA, 14 bp, Homo sapiens
ggattgaggatgaa

SEQ ID NO: 527943 - DNA, 15 bp, Homo sapiens
ggcaatcaatgttca

SEQ ID NO: 527944 - DNA, 14 bp, Homo sapiens
ggcacactgagcaa

SEQ ID NO: 527945 - DNA, 17 bp, Homo sapiens
ggcaccatgctgggccg

SEQ ID NO: 527946 - DNA, 21 bp, Homo sapiens
ggcagctgcagttagcacaga

SEQ ID NO: 527947 - DNA, 21 bp, Homo sapiens
ggcaggagcttggcagagaga

SEQ ID NO: 527948 - DNA, 21 bp, Homo sapiens
ggcaggggccgtgcagggcca

SEQ ID NO: 527949 - DNA, 13 bp, Homo sapiens
ggcatttgctgaa

SEQ ID NO: 527950 - DNA, 14 bp, Homo sapiens
ggcatttgctgaat

SEQ ID NO: 527951 - DNA, 22 bp, Homo sapiens
ggccagaccacgcccctgcctg

SEQ ID NO: 527952 - DNA, 13 bp, Homo sapiens
ggccatttcacat

SEQ ID NO: 527953 - DNA, 14 bp, Homo sapiens
ggcccccctctcgg

SEQ ID NO: 527954 - DNA, 20 bp, Homo sapiens
ggcccttcccaacctcccct

SEQ ID NO: 527955 - DNA, 13 bp, Homo sapiens
ggccgaggcctgc

SEQ ID NO: 527956 - DNA, 23 bp, Homo sapiens
ggccgctgcagtcagcacagaga

SEQ ID NO: 527957 - DNA, 15 bp, Homo sapiens
ggccgtgcagggcca

SEQ ID NO: 527958 - DNA, 12 bp, Homo sapiens
ggcctccagggc

SEQ ID NO: 527959 - DNA, 20 bp, Homo sapiens
ggcctgcctacgtgctgccc

SEQ ID NO: 527960 - DNA, 14 bp, Homo sapiens
ggcggcttccctgc

SEQ ID NO: 527961 - DNA, 17 bp, Homo sapiens
ggctccagggagtgggg

SEQ ID NO: 527962 - DNA, 15 bp, Homo sapiens
ggctcccagcagagg

SEQ ID NO: 527963 - DNA, 19 bp, Homo sapiens
ggctccctccctccctgct

SEQ ID NO: 527964 - DNA, 18 bp, Homo sapiens
ggctcgtgtttcacagtg

SEQ ID NO: 527965 - DNA, 13 bp, Homo sapiens
ggctctaatttcc

SEQ ID NO: 527966 - DNA, 19 bp, Homo sapiens
ggctctctcacccagcctg

SEQ ID NO: 527967 - DNA, 21 bp, Homo sapiens
ggctctgaatctctcaaaatg

SEQ ID NO: 527968 - DNA, 16 bp, Homo sapiens
ggctgacttctccagg

SEQ ID NO: 527969 - DNA, 14 bp, Homo sapiens
ggctgcagtgagcc

SEQ ID NO: 527970 - DNA, 17 bp, Homo sapiens
ggctgccccaggggcac

SEQ ID NO: 527971 - DNA, 21 bp, Homo sapiens
ggctgctgcagtcagcacaga

SEQ ID NO: 527972 - DNA, 22 bp, Homo sapiens
ggctgctgcagtcagcacagag

SEQ ID NO: 527973 - DNA, 15 bp, Homo sapiens
ggctgcttctggggc

SEQ ID NO: 527974 - DNA, 14 bp, Homo sapiens
ggctgtcccctgca

SEQ ID NO: 527975 - DNA, 17 bp, Homo sapiens
ggctgtcccctgcaagt

SEQ ID NO: 527976 - DNA, 20 bp, Homo sapiens
ggctgttagctcagaggaga

SEQ ID NO: 527977 - DNA, 24 bp, Homo sapiens
ggcttctgggacaggcaccatgct

SEQ ID NO: 527978 - DNA, 13 bp, Homo sapiens
ggcttctgggcgc

SEQ ID NO: 527979 - DNA, 12 bp, Homo sapiens
gggacagcctgc

SEQ ID NO: 527980 - DNA, 17 bp, Homo sapiens
gggacaggcaccatgct

SEQ ID NO: 527981 - DNA, 17 bp, Homo sapiens
gggagacccctttgcct

SEQ ID NO: 527982 - DNA, 13 bp, Homo sapiens
gggagctttccca

SEQ ID NO: 527983 - DNA, 16 bp, Homo sapiens
gggagctttcccagag

SEQ ID NO: 527984 - DNA, 11 bp, Homo sapiens
gggaggctgag

SEQ ID NO: 527985 - DNA, 18 bp, Homo sapiens
gggagtggggaggagaga

SEQ ID NO: 527986 - DNA, 14 bp, Homo sapiens
gggcccccatgcag

SEQ ID NO: 527987 - DNA, 20 bp, Homo sapiens
gggcccttcccaacctcccc

SEQ ID NO: 527988 - DNA, 16 bp, Homo sapiens
gggctccagggagtgg

SEQ ID NO: 527989 - DNA, 20 bp, Homo sapiens
gggctctctcacccagcctg

SEQ ID NO: 527990 - DNA, 17 bp, Homo sapiens
gggctgttagctcagag

SEQ ID NO: 527991 - DNA, 22 bp, Homo sapiens
ggggagctttcccagagacccg

SEQ ID NO: 527992 - DNA, 19 bp, Homo sapiens
ggtctgctgcctcaggaat

SEQ ID NO: 527993 - DNA, 22 bp, Homo sapiens
ggtgccccccatgccctccctg

SEQ ID NO: 527994 - DNA, 23 bp, Homo sapiens
ggtgccctgttgacctaccctgg

SEQ ID NO: 527995 - DNA, 18 bp, Homo sapiens
ggtgctgggtccttaaaa

SEQ ID NO: 527996 - DNA, 22 bp, Homo sapiens
ggtggaattattagcaccagct

SEQ ID NO: 527997 - DNA, 23 bp, Homo sapiens
ggtggaattattagcaccagctt

SEQ ID NO: 527998 - DNA, 20 bp, Homo sapiens
ggtgtagggaacggcctgag

SEQ ID NO: 527999 - DNA, 15 bp, Homo sapiens
ggtgtggcctggctt

SEQ ID NO: 528000 - DNA, 19 bp, Homo sapiens
ggtgtggcctggcttctgg

SEQ ID NO: 528001 - DNA, 13 bp, Homo sapiens
ggttcctcatggc

SEQ ID NO: 528002 - DNA, 11 bp, Homo sapiens
gtaaaactgtg

SEQ ID NO: 528003 - DNA, 16 bp, Homo sapiens
gtaaaactgtgacatt

SEQ ID NO: 528004 - DNA, 15 bp, Homo sapiens
gtaaataaaaatagc

SEQ ID NO: 528005 - DNA, 15 bp, Homo sapiens
gtaaatgatatgtct

SEQ ID NO: 528006 - DNA, 15 bp, Homo sapiens
gtaatagcctcacct

SEQ ID NO: 528007 - DNA, 23 bp, Homo sapiens
gtaatatagggtttgtttgctgc

SEQ ID NO: 528008 - DNA, 12 bp, Homo sapiens
gtaatattaaat

SEQ ID NO: 528009 - DNA, 23 bp, Homo sapiens
gtaatattaaattcctcctgtct

SEQ ID NO: 528010 - DNA, 14 bp, Homo sapiens
gtacaattctttgt

SEQ ID NO: 528011 - DNA, 22 bp, Homo sapiens
gtacaattctttgttgcttaat

SEQ ID NO: 528012 - DNA, 14 bp, Homo sapiens
gtacatttatgtgt

SEQ ID NO: 528013 - DNA, 22 bp, Homo sapiens
gtactaccccagaacgcatgca

SEQ ID NO: 528014 - DNA, 22 bp, Homo sapiens
gtactaccccaggacgcatgca

SEQ ID NO: 528015 - DNA, 20 bp, Homo sapiens
gtagaaattttatctcttct

SEQ ID NO: 528016 - DNA, 22 bp, Homo sapiens
gtagaaattttatctcttcttc

SEQ ID NO: 528017 - DNA, 17 bp, Homo sapiens
gtagagtcctaggacat

SEQ ID NO: 528018 - DNA, 13 bp, Homo sapiens
gtagcatatataa

SEQ ID NO: 528019 - DNA, 22 bp, Homo sapiens
gtagccccctaaatgggcaagc

SEQ ID NO: 528020 - DNA, 17 bp, Homo sapiens
gtagctcgtgtgcttag

SEQ ID NO: 528021 - DNA, 15 bp, Homo sapiens
gtaggtctgcacaca

SEQ ID NO: 528022 - DNA, 18 bp, Homo sapiens
gtatatattttgaaagga

SEQ ID NO: 528023 - DNA, 22 bp, Homo sapiens
gtattgttcttgtaaaactgtg

SEQ ID NO: 528024 - DNA, 20 bp, Homo sapiens
gtcaagattaagttatacca

SEQ ID NO: 528025 - DNA, 13 bp, Homo sapiens
gtcaatgaaaagc

SEQ ID NO: 528026 - DNA, 20 bp, Homo sapiens
gtcacttttttcctgtcaat

SEQ ID NO: 528027 - DNA, 18 bp, Homo sapiens
gtcagcttcccaacaata

SEQ ID NO: 528028 - DNA, 21 bp, Homo sapiens
gtcaggctctgaatctctcaa

SEQ ID NO: 528029 - DNA, 11 bp, Homo sapiens
gtcatctgtca

SEQ ID NO: 528030 - DNA, 19 bp, Homo sapiens
gtcatttggtggctctaac

SEQ ID NO: 528031 - DNA, 14 bp, Homo sapiens
gtccaatccagcct

SEQ ID NO: 528032 - DNA, 16 bp, Homo sapiens
gtccaatccagccttc

SEQ ID NO: 528033 - DNA, 23 bp, Homo sapiens
gtccacccccattgtgaatgttg

SEQ ID NO: 528034 - DNA, 15 bp, Homo sapiens
gtccagccctccgcc

SEQ ID NO: 528035 - DNA, 16 bp, Homo sapiens
gtccagggtccagccc

SEQ ID NO: 528036 - DNA, 19 bp, Homo sapiens
gtccagggtccagccctcc

SEQ ID NO: 528037 - DNA, 16 bp, Homo sapiens
gtccaggtcacaggca

SEQ ID NO: 528038 - DNA, 23 bp, Homo sapiens
gtccatttaaacccggctgactc

SEQ ID NO: 528039 - DNA, 15 bp, Homo sapiens
gtcccggagctcagg

SEQ ID NO: 528040 - DNA, 18 bp, Homo sapiens
gtccctgtgggctcacac

SEQ ID NO: 528041 - DNA, 19 bp, Homo sapiens
gtccctgtgggctcacacc

SEQ ID NO: 528042 - DNA, 13 bp, Homo sapiens
gtcctgcactgtc

SEQ ID NO: 528043 - DNA, 20 bp, Homo sapiens
gtcctggctcccagggtcct

SEQ ID NO: 528044 - DNA, 14 bp, Homo sapiens
gtcctgggggctgc

SEQ ID NO: 528045 - DNA, 18 bp, Homo sapiens
gtcctgggggctgctgca

SEQ ID NO: 528046 - DNA, 17 bp, Homo sapiens
gtcctgtcctggctccc

SEQ ID NO: 528047 - DNA, 21 bp, Homo sapiens
gtcctgtcctggctcccaggg

SEQ ID NO: 528048 - DNA, 21 bp, Homo sapiens
gtccttaaaaaatatgctctc

SEQ ID NO: 528049 - DNA, 22 bp, Homo sapiens
gtcctttgagtgtcaggctctg

SEQ ID NO: 528050 - DNA, 12 bp, Homo sapiens
gtctaataaaca

SEQ ID NO: 528051 - DNA, 20 bp, Homo sapiens
gtctctttctttccaaaggt

SEQ ID NO: 528052 - DNA, 16 bp, Homo sapiens
gtctgaccaagggctg

SEQ ID NO: 528053 - DNA, 12 bp, Homo sapiens
gtctgctgcccc

SEQ ID NO: 528054 - DNA, 20 bp, Homo sapiens
gtcttgagtttcatttttca

SEQ ID NO: 528055 - DNA, 16 bp, Homo sapiens
gtctttctccaaagtt

SEQ ID NO: 528056 - DNA, 17 bp, Homo sapiens
gtctttggttcctcatg

SEQ ID NO: 528057 - DNA, 18 bp, Homo sapiens
gtcttttgttctctcttg

SEQ ID NO: 528058 - DNA, 17 bp, Homo sapiens
gtgaaaattttattgaa

SEQ ID NO: 528059 - DNA, 17 bp, Homo sapiens
gtgaaacagtgtggatg

SEQ ID NO: 528060 - DNA, 20 bp, Homo sapiens
gtgacacagctgagctggcc

SEQ ID NO: 528061 - DNA, 14 bp, Homo sapiens
gtgagataaatatc

SEQ ID NO: 528062 - DNA, 23 bp, Homo sapiens
gtgaggctccctccctccctgct

SEQ ID NO: 528063 - DNA, 19 bp, Homo sapiens
gtgaggtcctgtcctggct

SEQ ID NO: 528064 - DNA, 17 bp, Homo sapiens
gtgaggttgtgctgcct

SEQ ID NO: 528065 - DNA, 22 bp, Homo sapiens
gtgatttatgcatttatgcatg

SEQ ID NO: 528066 - DNA, 18 bp, Homo sapiens
gtgcagggacagcctgca

SEQ ID NO: 528067 - DNA, 15 bp, Homo sapiens
gtgccagacgtgctc

SEQ ID NO: 528068 - DNA, 14 bp, Homo sapiens
gtgctaagttgtct

SEQ ID NO: 528069 - DNA, 15 bp, Homo sapiens
gtgctcatcagaaac

SEQ ID NO: 528070 - DNA, 18 bp, Homo sapiens
gtgcttatgtcatttctt

SEQ ID NO: 528071 - DNA, 22 bp, Homo sapiens
gtggaattacataacaggcatt

SEQ ID NO: 528072 - DNA, 20 bp, Homo sapiens
gtggacgtgggctccaggga

SEQ ID NO: 528073 - DNA, 17 bp, Homo sapiens
gtgggctccagggactg

SEQ ID NO: 528074 - DNA, 14 bp, Homo sapiens
gtgggtgccctgtt

SEQ ID NO: 528075 - DNA, 16 bp, Homo sapiens
gtggttctgccactta

SEQ ID NO: 528076 - DNA, 23 bp, Homo sapiens
gtggtttgttatcagtacaattc

SEQ ID NO: 528077 - DNA, 16 bp, Homo sapiens
gtgtcacttttttcct

SEQ ID NO: 528078 - DNA, 21 bp, Homo sapiens
tgtagtttttgttcaccttct

SEQ ID NO: 528079 - DNA, 21 bp, Homo sapiens
aacaaaatccttgccttcaaa

SEQ ID NO: 528080 - DNA, 13 bp, Homo sapiens
aacaaagaaatat

SEQ ID NO: 528081 - DNA, 16 bp, Homo sapiens
aacaaagcatgctcag

SEQ ID NO: 528082 - DNA, 21 bp, Homo sapiens
aacaaagcatgctcagtattg

SEQ ID NO: 528083 - DNA, 15 bp, Homo sapiens
aacacacacacacac

SEQ ID NO: 528084 - DNA, 11 bp, Homo sapiens
aacagcaacaa

SEQ ID NO: 528085 - DNA, 11 bp, Homo sapiens
aacagccctgc

SEQ ID NO: 528086 - DNA, 19 bp, Homo sapiens
aacaggcattgcactaaaa

SEQ ID NO: 528087 - DNA, 14 bp, Homo sapiens
aacattctatttca

SEQ ID NO: 528088 - DNA, 15 bp, Homo sapiens
aacattctatttcaa

SEQ ID NO: 528089 - DNA, 15 bp, Homo sapiens
aacatttccctgctg

SEQ ID NO: 528090 - DNA, 17 bp, Homo sapiens
aaccagctcaggctact

SEQ ID NO: 528091 - DNA, 17 bp, Homo sapiens
aacgatcatatctgtat

SEQ ID NO: 528092 - DNA, 22 bp, Homo sapiens
aactagcaaaaggatgatttaa

SEQ ID NO: 528093 - DNA, 13 bp, Homo sapiens
aactgacttgctg

SEQ ID NO: 528094 - DNA, 15 bp, Homo sapiens
aactgtaaaatactt

SEQ ID NO: 528095 - DNA, 13 bp, Homo sapiens
aactgtgacattc

SEQ ID NO: 528096 - DNA, 17 bp, Homo sapiens
aactgtgacattccaca

SEQ ID NO: 528097 - DNA, 14 bp, Homo sapiens
aactgtgagataaa

SEQ ID NO: 528098 - DNA, 16 bp, Homo sapiens
aacttcatctgtctgt

SEQ ID NO: 528099 - DNA, 16 bp, Homo sapiens
aactttccatgacagt

SEQ ID NO: 528100 - DNA, 17 bp, Homo sapiens
aactttccatgacagta

SEQ ID NO: 528101 - DNA, 18 bp, Homo sapiens
aagaccccaggaagtcat

SEQ ID NO: 528102 - DNA, 22 bp, Homo sapiens
aagacttcaaatgttattcaat

SEQ ID NO: 528103 - DNA, 22 bp, Homo sapiens
aagataattaaatgaaatactt

SEQ ID NO: 528104 - DNA, 14 bp, Homo sapiens
aagcaaataaatat

SEQ ID NO: 528105 - DNA, 17 bp, Homo sapiens
aagcatgctcagtattg

SEQ ID NO: 528106 - DNA, 20 bp, Homo sapiens
aagcatgctcagtattgaga

SEQ ID NO: 528107 - DNA, 14 bp, Homo sapiens
aagccaagtgtcct

SEQ ID NO: 528108 - DNA, 17 bp, Homo sapiens
aagctaaaatgaaaaat

SEQ ID NO: 528109 - DNA, 19 bp, Homo sapiens
aagctcaaggctgcagtga

SEQ ID NO: 528110 - DNA, 17 bp, Homo sapiens
aaggggctgcttctggg

SEQ ID NO: 528111 - DNA, 18 bp, Homo sapiens
aaggtcagtgttataaaa

SEQ ID NO: 528112 - DNA, 22 bp, Homo sapiens
aagtatccctgatttattctgg

SEQ ID NO: 528113 - DNA, 15 bp, Homo sapiens
aagtcttactgtttt

SEQ ID NO: 528114 - DNA, 14 bp, Homo sapiens
aagtgatgtgattt

SEQ ID NO: 528115 - DNA, 15 bp, Homo sapiens
aagtgatgtgattta

SEQ ID NO: 528116 - DNA, 19 bp, Homo sapiens
aagtgatgtgatttatgca

SEQ ID NO: 528117 - DNA, 23 bp, Homo sapiens
aagtgatgtgatttatgcattta

SEQ ID NO: 528118 - DNA, 22 bp, Homo sapiens
aagtgattgacattttgtagct

SEQ ID NO: 528119 - DNA, 21 bp, Homo sapiens
aataacaacagtttttatgtt

SEQ ID NO: 528120 - DNA, 15 bp, Homo sapiens
aataagaagcaaata

SEQ ID NO: 528121 - DNA, 17 bp, Homo sapiens
aatacatgatgatttca

SEQ ID NO: 528122 - DNA, 19 bp, Homo sapiens
aatacttgacaacattttt

SEQ ID NO: 528123 - DNA, 17 bp, Homo sapiens
aatactttgtgtctttt

SEQ ID NO: 528124 - DNA, 18 bp, Homo sapiens
aatagctataaatagtga

SEQ ID NO: 528125 - DNA, 22 bp, Homo sapiens
aatagctataaatagtgaaaat

SEQ ID NO: 528126 - DNA, 13 bp, Homo sapiens
aatagtgaaaatt

SEQ ID NO: 528127 - DNA, 13 bp, Homo sapiens
aatataaactgtg

SEQ ID NO: 528128 - DNA, 15 bp, Homo sapiens
aatataaactgtgag

SEQ ID NO: 528129 - DNA, 17 bp, Homo sapiens
aatataaactgtgagat

SEQ ID NO: 528130 - DNA, 19 bp, Homo sapiens
aatataaatgaatgaaata

SEQ ID NO: 528131 - DNA, 23 bp, Homo sapiens
aatatagggtttgtttgctgctt

SEQ ID NO: 528132 - DNA, 22 bp, Homo sapiens
aatatatgtttggctgaaatta

SEQ ID NO: 528133 - DNA, 20 bp, Homo sapiens
aatcaagtctgtgaaagtct

SEQ ID NO: 528134 - DNA, 20 bp, Homo sapiens
aatcacctaattaatttcag

SEQ ID NO: 528135 - DNA, 12 bp, Homo sapiens
aatcataatcat

SEQ ID NO: 528136 - DNA, 19 bp, Homo sapiens
aatcatccttttttaaaaa

SEQ ID NO: 528137 - DNA, 17 bp, Homo sapiens
aatcatttccagcaaaa

SEQ ID NO: 528138 - DNA, 19 bp, Homo sapiens
aatccacagtattgttctt

SEQ ID NO: 528139 - DNA, 12 bp, Homo sapiens
aatccagccttc

SEQ ID NO: 528140 - DNA, 21 bp, Homo sapiens
aatccagccttcttcccccag

SEQ ID NO: 528141 - DNA, 14 bp, Homo sapiens
aatcctggacagct

SEQ ID NO: 528142 - DNA, 18 bp, Homo sapiens
aatcctggacagctccgc

SEQ ID NO: 528143 - DNA, 12 bp, Homo sapiens
aatctaaattaa

SEQ ID NO: 528144 - DNA, 15 bp, Homo sapiens
aatcttgctgtgaaa

SEQ ID NO: 528145 - DNA, 23 bp, Homo sapiens
aatcttgctgtgaaacagtgtgg

SEQ ID NO: 528146 - DNA, 12 bp, Homo sapiens
aatgaaatataa

SEQ ID NO: 528147 - DNA, 20 bp, Homo sapiens
aatgaaatataaactgtgag

SEQ ID NO: 528148 - DNA, 18 bp, Homo sapiens
aatgaatgaaatataaac

SEQ ID NO: 528149 - DNA, 17 bp, Homo sapiens
aatgatatgtctttaaa

SEQ ID NO: 528150 - DNA, 18 bp, Homo sapiens
aatgatatgtctttaaaa

SEQ ID NO: 528151 - DNA, 21 bp, Homo sapiens
aatgatatgtctttaaaatga

SEQ ID NO: 528152 - DNA, 23 bp, Homo sapiens
aatgcagtatccgcgagcctgct

SEQ ID NO: 528153 - DNA, 17 bp, Homo sapiens
aatggatgtaatatagg

SEQ ID NO: 528154 - DNA, 15 bp, Homo sapiens
aatggcctcttaaaa

SEQ ID NO: 528155 - DNA, 19 bp, Homo sapiens
aatggcctcttaaaaatta

SEQ ID NO: 528156 - DNA, 17 bp, Homo sapiens
aatgtccaggtcacagg

SEQ ID NO: 528157 - DNA, 19 bp, Homo sapiens
aatgtccaggtcacaggca

SEQ ID NO: 528158 - DNA, 22 bp, Homo sapiens
aatgtgccgtctttggttcctc

SEQ ID NO: 528159 - DNA, 18 bp, Homo sapiens
aatgtgctgttgattctt

SEQ ID NO: 528160 - DNA, 17 bp, Homo sapiens
aatgttgtcctgtgtca

SEQ ID NO: 528161 - DNA, 17 bp, Homo sapiens
aattaaatgaaatactt

SEQ ID NO: 528162 - DNA, 18 bp, Homo sapiens
aattaacttctattttca

SEQ ID NO: 528163 - DNA, 12 bp, Homo sapiens
aattaatttcag

SEQ ID NO: 528164 - DNA, 13 bp, Homo sapiens
aattaatttcagt

SEQ ID NO: 528165 - DNA, 18 bp, Homo sapiens
aattagggctctaatttc

SEQ ID NO: 528166 - DNA, 19 bp, Homo sapiens
aattagggctctaatttcc

SEQ ID NO: 528167 - DNA, 13 bp, Homo sapiens
aattatctttaaa

SEQ ID NO: 528168 - DNA, 16 bp, Homo sapiens
aattatctttaaaact

SEQ ID NO: 528169 - DNA, 14 bp, Homo sapiens
aattatgtcaaatg

SEQ ID NO: 528170 - DNA, 15 bp, Homo sapiens
aattattaaaaatta

SEQ ID NO: 528171 - DNA, 16 bp, Homo sapiens
aattcaaacctaagtt

SEQ ID NO: 528172 - DNA, 14 bp, Homo sapiens
aattcctcctgtct

SEQ ID NO: 528173 - DNA, 17 bp, Homo sapiens
aattctcagaagtgaaa

SEQ ID NO: 528174 - DNA, 23 bp, Homo sapiens
aattctttgttgcttaatctaga

SEQ ID NO: 528175 - DNA, 21 bp, Homo sapiens
aattgatttttaaacagcagg

SEQ ID NO: 528176 - DNA, 20 bp, Homo sapiens
aattgtcttttgtcatgtgg

SEQ ID NO: 528177 - DNA, 16 bp, Homo sapiens
aatttaggaatgctca

SEQ ID NO: 528178 - DNA, 19 bp, Homo sapiens
aatttaggaatgctcaatg

SEQ ID NO: 528179 - DNA, 19 bp, Homo sapiens
acaaaaactttccatgaca

SEQ ID NO: 528180 - DNA, 17 bp, Homo sapiens
ataatataaatgaatga

SEQ ID NO: 528181 - DNA, 23 bp, Homo sapiens
ataatggcctcttaaaaattatc

SEQ ID NO: 528182 - DNA, 21 bp, Homo sapiens
ataattaaaacaaaatccttg

SEQ ID NO: 528183 - DNA, 15 bp, Homo sapiens
ataattaaatgaaat

SEQ ID NO: 528184 - DNA, 16 bp, Homo sapiens
ataattaaatgaaata

SEQ ID NO: 528185 - DNA, 18 bp, Homo sapiens
ataattaaatgaaatact

SEQ ID NO: 528186 - DNA, 17 bp, Homo sapiens
ataattttattgctgga

SEQ ID NO: 528187 - DNA, 15 bp, Homo sapiens
ataccattttgaaat

SEQ ID NO: 528188 - DNA, 16 bp, Homo sapiens
ataccattttgaaata

SEQ ID NO: 528189 - DNA, 17 bp, Homo sapiens
atactatttattaaaac

SEQ ID NO: 528190 - DNA, 14 bp, Homo sapiens
atactgatgagaca

SEQ ID NO: 528191 - DNA, 14 bp, Homo sapiens
atactttgtgtctt

SEQ ID NO: 528192 - DNA, 17 bp, Homo sapiens
atagataccattttgaa

SEQ ID NO: 528193 - DNA, 14 bp, Homo sapiens
atagctataaatag

SEQ ID NO: 528194 - DNA, 16 bp, Homo sapiens
atagcttaagaagtat

SEQ ID NO: 528195 - DNA, 14 bp, Homo sapiens
atagtgtgtccatg

SEQ ID NO: 528196 - DNA, 19 bp, Homo sapiens
atagttaccgatggtgtcc

SEQ ID NO: 528197 - DNA, 12 bp, Homo sapiens
atataaaaataa

SEQ ID NO: 528198 - DNA, 13 bp, Homo sapiens
atataaactgtga

SEQ ID NO: 528199 - DNA, 15 bp, Homo sapiens
atataaactgtgaga

SEQ ID NO: 528200 - DNA, 12 bp, Homo sapiens
atatatctgaaa

SEQ ID NO: 528201 - DNA, 15 bp, Homo sapiens
atatatgtttggctg

SEQ ID NO: 528202 - DNA, 11 bp, Homo sapiens
atatctgaaaa

SEQ ID NO: 528203 - DNA, 18 bp, Homo sapiens
atatctgtggtcttcaaa

SEQ ID NO: 528204 - DNA, 14 bp, Homo sapiens
atatgtctttaaaa

SEQ ID NO: 528205 - DNA, 14 bp, Homo sapiens
atattgatgtaact

SEQ ID NO: 528206 - DNA, 17 bp, Homo sapiens
atcacctaattaatttc

SEQ ID NO: 528207 - DNA, 18 bp, Homo sapiens
atcaggtaaactgatgct

SEQ ID NO: 528208 - DNA, 18 bp, Homo sapiens
atcagtacaattctttgt

SEQ ID NO: 528209 - DNA, 23 bp, Homo sapiens
atcagtccacccccattgtgaat

SEQ ID NO: 528210 - DNA, 13 bp, Homo sapiens
atcatatctgtat

SEQ ID NO: 528211 - DNA, 16 bp, Homo sapiens
atcatatctgtatgcc

SEQ ID NO: 528212 - DNA, 19 bp, Homo sapiens
atcatctattgagtgtaca

SEQ ID NO: 528213 - DNA, 19 bp, Homo sapiens
atcattatagcatgtaata

SEQ ID NO: 528214 - DNA, 13 bp, Homo sapiens
atcatttccagca

SEQ ID NO: 528215 - DNA, 16 bp, Homo sapiens
atcatttccagcaaaa

SEQ ID NO: 528216 - DNA, 20 bp, Homo sapiens
atcatttccagcaaaatata

SEQ ID NO: 528217 - DNA, 21 bp, Homo sapiens
atcatttccagcaaaatatat

SEQ ID NO: 528218 - DNA, 14 bp, Homo sapiens
atccagccttcttc

SEQ ID NO: 528219 - DNA, 21 bp, Homo sapiens
atccccatggaacagccctgc

SEQ ID NO: 528220 - DNA, 19 bp, Homo sapiens
atctaaattaacttctatt

SEQ ID NO: 528221 - DNA, 19 bp, Homo sapiens
atctactagaaccttctaa

SEQ ID NO: 528222 - DNA, 18 bp, Homo sapiens
atctagagctatgcacac

SEQ ID NO: 528223 - DNA, 13 bp, Homo sapiens
atctcgctagcca

SEQ ID NO: 528224 - DNA, 14 bp, Homo sapiens
atctctcaaaatgt

SEQ ID NO: 528225 - DNA, 15 bp, Homo sapiens
atctctcaaaatgtg

SEQ ID NO: 528226 - DNA, 13 bp, Homo sapiens
atctgaaaactgg

SEQ ID NO: 528227 - DNA, 16 bp, Homo sapiens
atctgtaaaaccaggc

SEQ ID NO: 528228 - DNA, 18 bp, Homo sapiens
atctgtcagcttcccaac

SEQ ID NO: 528229 - DNA, 19 bp, Homo sapiens
atctgtctttatgatttca

SEQ ID NO: 528230 - DNA, 21 bp, Homo sapiens
atctgtctttatgatttcatg

SEQ ID NO: 528231 - DNA, 15 bp, Homo sapiens
atcttgctgtgaaac

SEQ ID NO: 528232 - DNA, 20 bp, Homo sapiens
atcttgggattcctcccctg

SEQ ID NO: 528233 - DNA, 15 bp, Homo sapiens
atgaaatataaactg

SEQ ID NO: 528234 - DNA, 18 bp, Homo sapiens
atgaaatataaactgtga

SEQ ID NO: 528235 - DNA, 21 bp, Homo sapiens
atgaatgaaatataaactgtg

SEQ ID NO: 528236 - DNA, 23 bp, Homo sapiens
atgacttctttactaacactggc

SEQ ID NO: 528237 - DNA, 19 bp, Homo sapiens
atgagaaatataaaaataa

SEQ ID NO: 528238 - DNA, 15 bp, Homo sapiens
atgagacaacacaca

SEQ ID NO: 528239 - DNA, 16 bp, Homo sapiens
atgagacaacacacac

SEQ ID NO: 528240 - DNA, 22 bp, Homo sapiens
atgagattggaaaaaattagac

SEQ ID NO: 528241 - DNA, 15 bp, Homo sapiens
atgatacttggtcct

SEQ ID NO: 528242 - DNA, 14 bp, Homo sapiens
atgatgatttcaga

SEQ ID NO: 528243 - DNA, 17 bp, Homo sapiens
atgattagacaatgtgg

SEQ ID NO: 528244 - DNA, 21 bp, Homo sapiens
atgattcacttttattgtata

SEQ ID NO: 528245 - DNA, 13 bp, Homo sapiens
atgatttaacatt

SEQ ID NO: 528246 - DNA, 16 bp, Homo sapiens
atgatttcagaaacaa

SEQ ID NO: 528247 - DNA, 17 bp, Homo sapiens
atgatttcgtgactgta

SEQ ID NO: 528248 - DNA, 13 bp, Homo sapiens
atgcacaccaaat

SEQ ID NO: 528249 - DNA, 17 bp, Homo sapiens
atgcacaccaaattgct

SEQ ID NO: 528250 - DNA, 20 bp, Homo sapiens
atgcacaccaaattgctgag

SEQ ID NO: 528251 - DNA, 21 bp, Homo sapiens
atgcacaccaaattgctgaga

SEQ ID NO: 528252 - DNA, 22 bp, Homo sapiens
atgcacaccaaattgctgagat

SEQ ID NO: 528253 - DNA, 17 bp, Homo sapiens
atgcactcttttgagca

SEQ ID NO: 528254 - DNA, 18 bp, Homo sapiens
atgcagggcccccacagg

SEQ ID NO: 528255 - DNA, 20 bp, Homo sapiens
atgcatgagaactaaataga

SEQ ID NO: 528256 - DNA, 18 bp, Homo sapiens
atgcatgcactcttttga

SEQ ID NO: 528257 - DNA, 15 bp, Homo sapiens
atgcatttatgcatg

SEQ ID NO: 528258 - DNA, 19 bp, Homo sapiens
atgcatttatgcatgagaa

SEQ ID NO: 528259 - DNA, 17 bp, Homo sapiens
atgcgtggctcccagca

SEQ ID NO: 528260 - DNA, 19 bp, Homo sapiens
atgctaacctctctgaact

SEQ ID NO: 528261 - DNA, 16 bp, Homo sapiens
atgctacaaaatgtgt

SEQ ID NO: 528262 - DNA, 19 bp, Homo sapiens
atgctatctcgctagccat

SEQ ID NO: 528263 - DNA, 14 bp, Homo sapiens
atgctcaatgtgct

SEQ ID NO: 528264 - DNA, 15 bp, Homo sapiens
atgctcaatgtgctg

SEQ ID NO: 528265 - DNA, 16 bp, Homo sapiens
atgctcaatgtgctgt

SEQ ID NO: 528266 - DNA, 21 bp, Homo sapiens
atgctcaatgtgctgttgatt

SEQ ID NO: 528267 - DNA, 13 bp, Homo sapiens
atgctcagtattg

SEQ ID NO: 528268 - DNA, 14 bp, Homo sapiens
atgctcagtattga

SEQ ID NO: 528269 - DNA, 15 bp, Homo sapiens
atgctgtccctgtgg

SEQ ID NO: 528270 - DNA, 21 bp, Homo sapiens
atgctgtccctgtgggctcac

SEQ ID NO: 528271 - DNA, 14 bp, Homo sapiens
atgctgttcattga

SEQ ID NO: 528272 - DNA, 13 bp, Homo sapiens
atgcttttctcat

SEQ ID NO: 528273 - DNA, 15 bp, Homo sapiens
atggaacagccctgc

SEQ ID NO: 528274 - DNA, 19 bp, Homo sapiens
atggaagggccttctccac

SEQ ID NO: 528275 - DNA, 23 bp, Homo sapiens
atggatgggggttacctagccct

SEQ ID NO: 528276 - DNA, 14 bp, Homo sapiens
atggatttgacaca

SEQ ID NO: 528277 - DNA, 16 bp, Homo sapiens
atggatttgacacact

SEQ ID NO: 528278 - DNA, 19 bp, Homo sapiens
atggctgttatctgtcttt

SEQ ID NO: 528279 - DNA, 20 bp, Homo sapiens
atggctgttatctgtcttta

SEQ ID NO: 528280 - DNA, 16 bp, Homo sapiens
atggtgaactgtcatt

SEQ ID NO: 528281 - DNA, 14 bp, Homo sapiens
atgtaatattaaat

SEQ ID NO: 528282 - DNA, 15 bp, Homo sapiens
cagtcagcacagaga

SEQ ID NO: 528283 - DNA, 20 bp, Homo sapiens
cagtcatggctgtcccctgc

SEQ ID NO: 528284 - DNA, 20 bp, Homo sapiens
cagtccacccccattgtgaa

SEQ ID NO: 528285 - DNA, 22 bp, Homo sapiens
cagtccacccccattgtgaatg

SEQ ID NO: 528286 - DNA, 19 bp, Homo sapiens
cagtgggcggcttccctgc

SEQ ID NO: 528287 - DNA, 20 bp, Homo sapiens
cagtgggcggcttccctgcg

SEQ ID NO: 528288 - DNA, 19 bp, Homo sapiens
cagtgtggatgtaaatttt

SEQ ID NO: 528289 - DNA, 13 bp, Homo sapiens
cagttagcacaga

SEQ ID NO: 528290 - DNA, 15 bp, Homo sapiens
cagttagcacagagg

SEQ ID NO: 528291 - DNA, 20 bp, Homo sapiens
cagttgcaataaactcagtc

SEQ ID NO: 528292 - DNA, 21 bp, Homo sapiens
cataacaggcattgcactaaa

SEQ ID NO: 528293 - DNA, 17 bp, Homo sapiens
cataatcatcctttttt

SEQ ID NO: 528294 - DNA, 22 bp, Homo sapiens
catactgatgagacaacacaca

SEQ ID NO: 528295 - DNA, 18 bp, Homo sapiens
catagataccattttgaa

SEQ ID NO: 528296 - DNA, 21 bp, Homo sapiens
catagataccattttgaaata

SEQ ID NO: 528297 - DNA, 16 bp, Homo sapiens
catcaacaaagaaata

SEQ ID NO: 528298 - DNA, 18 bp, Homo sapiens
catccgctgcgctcccac

SEQ ID NO: 528299 - DNA, 22 bp, Homo sapiens
catccttttttaaaaaaaagaa

SEQ ID NO: 528300 - DNA, 12 bp, Homo sapiens
catcgccttctg

SEQ ID NO: 528301 - DNA, 12 bp, Homo sapiens
catctggcctgg

SEQ ID NO: 528302 - DNA, 11 bp, Homo sapiens
catctgtcagc

SEQ ID NO: 528303 - DNA, 17 bp, Homo sapiens
catctgtcagcttccca

SEQ ID NO: 528304 - DNA, 21 bp, Homo sapiens
catgaatacgtaaactgcgta

SEQ ID NO: 528305 - DNA, 22 bp, Homo sapiens
catgacagtagcatactgatga

SEQ ID NO: 528306 - DNA, 15 bp, Homo sapiens
catgagaactaaata

SEQ ID NO: 528307 - DNA, 16 bp, Homo sapiens
catgattagacaatgt

SEQ ID NO: 528308 - DNA, 20 bp, Homo sapiens
catgattagacaatgtggaa

SEQ ID NO: 528309 - DNA, 18 bp, Homo sapiens
catgccaatgtccaggtc

SEQ ID NO: 528310 - DNA, 21 bp, Homo sapiens
catgccctccctgctgccagg

SEQ ID NO: 528311 - DNA, 14 bp, Homo sapiens
catgcttttctcat

SEQ ID NO: 528312 - DNA, 16 bp, Homo sapiens
catggaacagccctgc

SEQ ID NO: 528313 - DNA, 17 bp, Homo sapiens
catggaacagccctgca

SEQ ID NO: 528314 - DNA, 23 bp, Homo sapiens
catggaacagccctgcacgccca

SEQ ID NO: 528315 - DNA, 16 bp, Homo sapiens
catgtaatattaaatt

SEQ ID NO: 528316 - DNA, 19 bp, Homo sapiens
catgtaatattaaattcct

SEQ ID NO: 528317 - DNA, 15 bp, Homo sapiens
catgtgctgctgtgg

SEQ ID NO: 528318 - DNA, 15 bp, Homo sapiens
catgtgtttctgtgt

SEQ ID NO: 528319 - DNA, 13 bp, Homo sapiens
cattccacagagt

SEQ ID NO: 528320 - DNA, 16 bp, Homo sapiens
cattcctgaccctcac

SEQ ID NO: 528321 - DNA, 17 bp, Homo sapiens
cattcctgaccctcact

SEQ ID NO: 528322 - DNA, 12 bp, Homo sapiens
cattgcactaaa

SEQ ID NO: 528323 - DNA, 15 bp, Homo sapiens
cattgccttctgggg

SEQ ID NO: 528324 - DNA, 22 bp, Homo sapiens
catttatgtgtgaagcaaattt

SEQ ID NO: 528325 - DNA, 18 bp, Homo sapiens
catttcacattcctgacc

SEQ ID NO: 528326 - DNA, 15 bp, Homo sapiens
catttccagcaaaat

SEQ ID NO: 528327 - DNA, 18 bp, Homo sapiens
catttcccctgtggtttg

SEQ ID NO: 528328 - DNA, 20 bp, Homo sapiens
catttcttctctctgtgctg

SEQ ID NO: 528329 - DNA, 20 bp, Homo sapiens
catttgctgaataacaacaa

SEQ ID NO: 528330 - DNA, 15 bp, Homo sapiens
catttggtggctcta

SEQ ID NO: 528331 - DNA, 16 bp, Homo sapiens
ccaaaagctgctttcc

SEQ ID NO: 528332 - DNA, 23 bp, Homo sapiens
ccaaatgctgtcgggcaagatag

SEQ ID NO: 528333 - DNA, 15 bp, Homo sapiens
ccaaattgctgagat

SEQ ID NO: 528334 - DNA, 21 bp, Homo sapiens
ccaagggctgacttctccagg

SEQ ID NO: 528335 - DNA, 16 bp, Homo sapiens
ccaataaagctcacac

SEQ ID NO: 528336 - DNA, 13 bp, Homo sapiens
ccaatccagcctt

SEQ ID NO: 528337 - DNA, 17 bp, Homo sapiens
ccaatgtccaggtcaca

SEQ ID NO: 528338 - DNA, 10 bp, Homo sapiens
ccaatttctc

SEQ ID NO: 528339 - DNA, 18 bp, Homo sapiens
ccacagagttactgccac

SEQ ID NO: 528340 - DNA, 20 bp, Homo sapiens
ccacaggagcatgtcctatc

SEQ ID NO: 528341 - DNA, 16 bp, Homo sapiens
ccacaggagcgtgtac

SEQ ID NO: 528342 - DNA, 17 bp, Homo sapiens
ccacaggagcgtgtact

SEQ ID NO: 528343 - DNA, 11 bp, Homo sapiens
ccacagtattg

SEQ ID NO: 528344 - DNA, 20 bp, Homo sapiens
ccacctaaagggaagccctg

SEQ ID NO: 528345 - DNA, 13 bp, Homo sapiens
ccacgcccctgcc

SEQ ID NO: 528346 - DNA, 15 bp, Homo sapiens
ccacgcccctgcctg

SEQ ID NO: 528347 - DNA, 18 bp, Homo sapiens
ccacggtccaatccagcc

SEQ ID NO: 528348 - DNA, 20 bp, Homo sapiens
ccacggtccaatccagcctt

SEQ ID NO: 528349 - DNA, 17 bp, Homo sapiens
ccactggagcgtgtact

SEQ ID NO: 528350 - DNA, 14 bp, Homo sapiens
ccacttatttccat

SEQ ID NO: 528351 - DNA, 18 bp, Homo sapiens
ccagaagctcaaggctgc

SEQ ID NO: 528352 - DNA, 19 bp, Homo sapiens
ccagaagctcaaggctgca

SEQ ID NO: 528353 - DNA, 10 bp, Homo sapiens
ccagcaaaag

SEQ ID NO: 528354 - DNA, 10 bp, Homo sapiens
ccagcaaaat

SEQ ID NO: 528355 - DNA, 19 bp, Homo sapiens
ccagccctccgccagccct

SEQ ID NO: 528356 - DNA, 14 bp, Homo sapiens
ccagcgctgaacag

SEQ ID NO: 528357 - DNA, 16 bp, Homo sapiens
ccagcggggcttctgg

SEQ ID NO: 528358 - DNA, 19 bp, Homo sapiens
ccagcggggcttctgggcg

SEQ ID NO: 528359 - DNA, 20 bp, Homo sapiens
ccagctcaggctactgccac

SEQ ID NO: 528360 - DNA, 21 bp, Homo sapiens
ccagctcaggctactgccact

SEQ ID NO: 528361 - DNA, 13 bp, Homo sapiens
ccagctctgggag

SEQ ID NO: 528362 - DNA, 14 bp, Homo sapiens
ccagctctgggagc

SEQ ID NO: 528363 - DNA, 21 bp, Homo sapiens
ccaggatgaaggggccagacc

SEQ ID NO: 528364 - DNA, 22 bp, Homo sapiens
ccaggatgaaggggccagacca

SEQ ID NO: 528365 - DNA, 16 bp, Homo sapiens
ccaggatgcatgcagg

SEQ ID NO: 528366 - DNA, 14 bp, Homo sapiens
ccagggtccagccc

SEQ ID NO: 528367 - DNA, 14 bp, Homo sapiens
ccaggtcacaggca

SEQ ID NO: 528368 - DNA, 21 bp, Homo sapiens
ccagtcatggctgtcccctgc

SEQ ID NO: 528369 - DNA, 22 bp, Homo sapiens
ccagtcatggctgtcccctgca

SEQ ID NO: 528370 - DNA, 18 bp, Homo sapiens
ccatagtttgaattcatg

SEQ ID NO: 528371 - DNA, 13 bp, Homo sapiens
ccatcgccttctg

SEQ ID NO: 528372 - DNA, 16 bp, Homo sapiens
ccatgcaggcagcctg

SEQ ID NO: 528373 - DNA, 17 bp, Homo sapiens
ccatgccaatgtccagg

SEQ ID NO: 528374 - DNA, 11 bp, Homo sapiens
ccatgccctcc

SEQ ID NO: 528375 - DNA, 14 bp, Homo sapiens
ccatgccctccctg

SEQ ID NO: 528376 - DNA, 17 bp, Homo sapiens
ccatgccctccctgctg

SEQ ID NO: 528377 - DNA, 18 bp, Homo sapiens
ccatgctgtccctgtggg

SEQ ID NO: 528378 - DNA, 22 bp, Homo sapiens
ccatgctgtccctgtgggctca

SEQ ID NO: 528379 - DNA, 23 bp, Homo sapiens
ccatgctgtccctgtgggctcac

SEQ ID NO: 528380 - DNA, 15 bp, Homo sapiens
ccatggaacagccct

SEQ ID NO: 528381 - DNA, 16 bp, Homo sapiens
ccatggattcccctgg

SEQ ID NO: 528382 - DNA, 21 bp, Homo sapiens
ccatgtctttctccaaagtta

SEQ ID NO: 528383 - DNA, 16 bp, Homo sapiens
ccattgccttctgggg

SEQ ID NO: 528384 - DNA, 19 bp, Homo sapiens
ctggggctccctgcctgga

SEQ ID NO: 528385 - DNA, 13 bp, Homo sapiens
ctgggtgtggcct

SEQ ID NO: 528386 - DNA, 18 bp, Homo sapiens
ctgggtgtggcctggctt

SEQ ID NO: 528387 - DNA, 23 bp, Homo sapiens
ctgtaaaatacatggtatctctt

SEQ ID NO: 528388 - DNA, 18 bp, Homo sapiens
ctgtaatagcctcacctt

SEQ ID NO: 528389 - DNA, 22 bp, Homo sapiens
ctgtagtttttgttcaccttct

SEQ ID NO: 528390 - DNA, 14 bp, Homo sapiens
ctgtatcatttctt

SEQ ID NO: 528391 - DNA, 11 bp, Homo sapiens
ctgtattgcta

SEQ ID NO: 528392 - DNA, 15 bp, Homo sapiens
ctgtcagcttcccaa

SEQ ID NO: 528393 - DNA, 17 bp, Homo sapiens
ctgtcagtttgtgaagt

SEQ ID NO: 528394 - DNA, 20 bp, Homo sapiens
ctgtcagtttgtgaagtgat

SEQ ID NO: 528395 - DNA, 17 bp, Homo sapiens
ctgtcctggctcccagg

SEQ ID NO: 528396 - DNA, 16 bp, Homo sapiens
ctgtctcctctgtcag

SEQ ID NO: 528397 - DNA, 22 bp, Homo sapiens
ctgtctgtgtgaggctccctcc

SEQ ID NO: 528398 - DNA, 17 bp, Homo sapiens
ctgtctttatgatttca

SEQ ID NO: 528399 - DNA, 12 bp, Homo sapiens
ctgtgaaacagt

SEQ ID NO: 528400 - DNA, 21 bp, Homo sapiens
ctgtgaaagtctcctgtatca

SEQ ID NO: 528401 - DNA, 15 bp, Homo sapiens
ctgtgagataaatat

SEQ ID NO: 528402 - DNA, 21 bp, Homo sapiens
ctgtgagataaatatcattat

SEQ ID NO: 528403 - DNA, 22 bp, Homo sapiens
ctgtgagataaatatcattata

SEQ ID NO: 528404 - DNA, 17 bp, Homo sapiens
ctgtgcatctggcctgg

SEQ ID NO: 528405 - DNA, 20 bp, Homo sapiens
ctgtgctaagttgtcttaca

SEQ ID NO: 528406 - DNA, 22 bp, Homo sapiens
ctgtggtcttcaaattgtcttt

SEQ ID NO: 528407 - DNA, 17 bp, Homo sapiens
ctgtggtgaggtcctgt

SEQ ID NO: 528408 - DNA, 23 bp, Homo sapiens
ctgtggtgaggtcctgtcctggc

SEQ ID NO: 528409 - DNA, 14 bp, Homo sapiens
ctgtggtttgttat

SEQ ID NO: 528410 - DNA, 16 bp, Homo sapiens
ctgtgtcatctgtcag

SEQ ID NO: 528411 - DNA, 19 bp, Homo sapiens
ctgtgtcctaaatgcaaag

SEQ ID NO: 528412 - DNA, 17 bp, Homo sapiens
ctgttagctcagaggag

SEQ ID NO: 528413 - DNA, 15 bp, Homo sapiens
ctgttatctgtcttt

SEQ ID NO: 528414 - DNA, 16 bp, Homo sapiens
ctgttatctgtcttta

SEQ ID NO: 528415 - DNA, 13 bp, Homo sapiens
ctgttcagaggca

SEQ ID NO: 528416 - DNA, 18 bp, Homo sapiens
ctgttccgcctcactggg

SEQ ID NO: 528417 - DNA, 15 bp, Homo sapiens
ctgttgattctttca

SEQ ID NO: 528418 - DNA, 17 bp, Homo sapiens
cttaaacatttccctgc

SEQ ID NO: 528419 - DNA, 20 bp, Homo sapiens
cttactaaccaccatttccc

SEQ ID NO: 528420 - DNA, 22 bp, Homo sapiens
cttagggagtgtgccttgggcg

SEQ ID NO: 528421 - DNA, 19 bp, Homo sapiens
cttcatggccatagctttt

SEQ ID NO: 528422 - DNA, 17 bp, Homo sapiens
cttcccatgtctttctc

SEQ ID NO: 528423 - DNA, 19 bp, Homo sapiens
cttccccatcgccttctgg

SEQ ID NO: 528424 - DNA, 19 bp, Homo sapiens
cttccccattgccttctgg

SEQ ID NO: 528425 - DNA, 19 bp, Homo sapiens
cttccttttgtatcctcca

SEQ ID NO: 528426 - DNA, 13 bp, Homo sapiens
cttctaaatcata

SEQ ID NO: 528427 - DNA, 20 bp, Homo sapiens
cttctaatccatgtgctgct

SEQ ID NO: 528428 - DNA, 16 bp, Homo sapiens
cttctctaaaacagca

SEQ ID NO: 528429 - DNA, 14 bp, Homo sapiens
cttctctctgtgct

SEQ ID NO: 528430 - DNA, 14 bp, Homo sapiens
cttctggctgctgc

SEQ ID NO: 528431 - DNA, 22 bp, Homo sapiens
cttctgggacaggcaccatgct

SEQ ID NO: 528432 - DNA, 23 bp, Homo sapiens
cttctgggacaggcaccatgctg

SEQ ID NO: 528433 - DNA, 23 bp, Homo sapiens
cttctgggcgccggttccacgtg

SEQ ID NO: 528434 - DNA, 15 bp, Homo sapiens
cttctggggaggggc

SEQ ID NO: 528435 - DNA, 15 bp, Homo sapiens
cttcttcccccaggg

SEQ ID NO: 528436 - DNA, 17 bp, Homo sapiens
cttcttcccccagggtc

SEQ ID NO: 528437 - DNA, 16 bp, Homo sapiens
cttgcattttagctaa

SEQ ID NO: 528438 - DNA, 17 bp, Homo sapiens
cttgctgtgaaacagtg

SEQ ID NO: 528439 - DNA, 15 bp, Homo sapiens
cttgctgtgacttat

SEQ ID NO: 528440 - DNA, 16 bp, Homo sapiens
cttgggctggcaccca

SEQ ID NO: 528441 - DNA, 18 bp, Homo sapiens
cttgggctggcacccact

SEQ ID NO: 528442 - DNA, 18 bp, Homo sapiens
cttggtctctttctttcc

SEQ ID NO: 528443 - DNA, 21 bp, Homo sapiens
cttggtctctttctttccaaa

SEQ ID NO: 528444 - DNA, 15 bp, Homo sapiens
cttgtaaaactgtga

SEQ ID NO: 528445 - DNA, 20 bp, Homo sapiens
cttgtaaaactgtgacattc

SEQ ID NO: 528446 - DNA, 18 bp, Homo sapiens
cttgtagacgcacctgct

SEQ ID NO: 528447 - DNA, 13 bp, Homo sapiens
cttgttcttcctc

SEQ ID NO: 528448 - DNA, 20 bp, Homo sapiens
cttgtttaaggttcttgctg

SEQ ID NO: 528449 - DNA, 19 bp, Homo sapiens
ctttaccatagcttaagaa

SEQ ID NO: 528450 - DNA, 14 bp, Homo sapiens
ctttactaacactg

SEQ ID NO: 528451 - DNA, 16 bp, Homo sapiens
ctttactaacactggc

SEQ ID NO: 528452 - DNA, 22 bp, Homo sapiens
ctttagaatagttaaattggct

SEQ ID NO: 528453 - DNA, 17 bp, Homo sapiens
ctttatcatgtgtttct

SEQ ID NO: 528454 - DNA, 14 bp, Homo sapiens
ctttatgatttcat

SEQ ID NO: 528455 - DNA, 16 bp, Homo sapiens
ctttatgatttcatga

SEQ ID NO: 528456 - DNA, 21 bp, Homo sapiens
ctttgagtgtcaggctctgaa

SEQ ID NO: 528457 - DNA, 12 bp, Homo sapiens
ctttgccttccc

SEQ ID NO: 528458 - DNA, 14 bp, Homo sapiens
ctttgggaggctga

SEQ ID NO: 528459 - DNA, 15 bp, Homo sapiens
ctttgtgcttgttct

SEQ ID NO: 528460 - DNA, 13 bp, Homo sapiens
ctttgtgtctttt

SEQ ID NO: 528461 - DNA, 22 bp, Homo sapiens
ctttgtgtcttttgttctctct

SEQ ID NO: 528462 - DNA, 18 bp, Homo sapiens
cttttcccacctctttgg

SEQ ID NO: 528463 - DNA, 14 bp, Homo sapiens
cttttctcatctgt

SEQ ID NO: 528464 - DNA, 20 bp, Homo sapiens
cttttgatggctatgttttg

SEQ ID NO: 528465 - DNA, 21 bp, Homo sapiens
cttttgtacgttaattaaaca

SEQ ID NO: 528466 - DNA, 22 bp, Homo sapiens
cttttgtacgttaattaaacaa

SEQ ID NO: 528467 - DNA, 17 bp, Homo sapiens
cttttgtcatgtggcta

SEQ ID NO: 528468 - DNA, 23 bp, Homo sapiens
cttttgttctctcttggtctctt

SEQ ID NO: 528469 - DNA, 12 bp, Homo sapiens
cttttttcctgt

SEQ ID NO: 528470 - DNA, 14 bp, Homo sapiens
gaaacaatttctgt

SEQ ID NO: 528471 - DNA, 15 bp, Homo sapiens
gaaacagtgtggatg

SEQ ID NO: 528472 - DNA, 12 bp, Homo sapiens
gaaagacagtaa

SEQ ID NO: 528473 - DNA, 19 bp, Homo sapiens
gaaatataaaaataattaa

SEQ ID NO: 528474 - DNA, 15 bp, Homo sapiens
gaaattatatctgtg

SEQ ID NO: 528475 - DNA, 19 bp, Homo sapiens
gaaattatatctgtggtct

SEQ ID NO: 528476 - DNA, 23 bp, Homo sapiens
gaacaacaacaaagcatgctcag

SEQ ID NO: 528477 - DNA, 16 bp, Homo sapiens
gaacagaccggggtgg

SEQ ID NO: 528478 - DNA, 13 bp, Homo sapiens
gaacagccctgca

SEQ ID NO: 528479 - DNA, 14 bp, Homo sapiens
gaactgcaacactg

SEQ ID NO: 528480 - DNA, 16 bp, Homo sapiens
gaactgcaacactgga

SEQ ID NO: 528481 - DNA, 19 bp, Homo sapiens
gaacttggtgcctaatgtt

SEQ ID NO: 528482 - DNA, 17 bp, Homo sapiens
gaagaactcatgtgatt

SEQ ID NO: 528483 - DNA, 19 bp, Homo sapiens
gaagccctaagtaaatcta

SEQ ID NO: 528484 - DNA, 18 bp, Homo sapiens
gaagctcaaggctgcagt

SEQ ID NO: 528485 - DNA, 18 bp, Homo sapiens
gtacaattctttgttgct

SEQ ID NO: 528486 - DNA, 19 bp, Homo sapiens
gtacaattctttgttgctt

SEQ ID NO: 528487 - DNA, 15 bp, Homo sapiens
gtacatttatgtgtg

SEQ ID NO: 528488 - DNA, 13 bp, Homo sapiens
gtagactgtgaca

SEQ ID NO: 528489 - DNA, 20 bp, Homo sapiens
gtagcaacccaggtgttgtc

SEQ ID NO: 528490 - DNA, 18 bp, Homo sapiens
gtagctgataaagaaacc

SEQ ID NO: 528491 - DNA, 17 bp, Homo sapiens
gtaggtctgcacacata

SEQ ID NO: 528492 - DNA, 13 bp, Homo sapiens
gtataattatgaa

SEQ ID NO: 528493 - DNA, 21 bp, Homo sapiens
gtatattgatgtaactgtgtc

SEQ ID NO: 528494 - DNA, 22 bp, Homo sapiens
gtattgagacactgtcaagatt

SEQ ID NO: 528495 - DNA, 18 bp, Homo sapiens
gtcacttttttcctgtca

SEQ ID NO: 528496 - DNA, 13 bp, Homo sapiens
gtcagcacagaga

SEQ ID NO: 528497 - DNA, 13 bp, Homo sapiens
gtcagcttcccaa

SEQ ID NO: 528498 - DNA, 16 bp, Homo sapiens
gtcagtgtagatcaac

SEQ ID NO: 528499 - DNA, 20 bp, Homo sapiens
gtcatctgtcagcttcccaa

SEQ ID NO: 528500 - DNA, 19 bp, Homo sapiens
gtccacccccattgtgaat

SEQ ID NO: 528501 - DNA, 20 bp, Homo sapiens
gtccacccccattgtgaatg

SEQ ID NO: 528502 - DNA, 13 bp, Homo sapiens
gtccagccctccg

SEQ ID NO: 528503 - DNA, 22 bp, Homo sapiens
gtccagccctccgccagccctg

SEQ ID NO: 528504 - DNA, 23 bp, Homo sapiens
gtcccagctacaggggaggctga

SEQ ID NO: 528505 - DNA, 23 bp, Homo sapiens
gtcccgggtgccccccatgccct

SEQ ID NO: 528506 - DNA, 15 bp, Homo sapiens
gtccctgagggccct

SEQ ID NO: 528507 - DNA, 18 bp, Homo sapiens
gtccctgagggcccttcc

SEQ ID NO: 528508 - DNA, 21 bp, Homo sapiens
gtccctgtgggctcacaccgg

SEQ ID NO: 528509 - DNA, 22 bp, Homo sapiens
gtccctgtgggctcacaccggc

SEQ ID NO: 528510 - DNA, 14 bp, Homo sapiens
gtcctaaatgcaaa

SEQ ID NO: 528511 - DNA, 14 bp, Homo sapiens
gtcctatccctgga

SEQ ID NO: 528512 - DNA, 20 bp, Homo sapiens
gtcctgggggctgctgcact

SEQ ID NO: 528513 - DNA, 20 bp, Homo sapiens
gtcctttctgatcctctctt

SEQ ID NO: 528514 - DNA, 13 bp, Homo sapiens
gtctccagctgat

SEQ ID NO: 528515 - DNA, 21 bp, Homo sapiens
gtctcctctgtcagtttgtga

SEQ ID NO: 528516 - DNA, 15 bp, Homo sapiens
gtctcctgtatcatt

SEQ ID NO: 528517 - DNA, 18 bp, Homo sapiens
gtctcctgtatcatttct

SEQ ID NO: 528518 - DNA, 20 bp, Homo sapiens
gtctctacaaaaaaaatcaa

SEQ ID NO: 528519 - DNA, 14 bp, Homo sapiens
gtctctttctttcc

SEQ ID NO: 528520 - DNA, 16 bp, Homo sapiens
gtctctttctttccaa

SEQ ID NO: 528521 - DNA, 17 bp, Homo sapiens
gtctctttctttccaaa

SEQ ID NO: 528522 - DNA, 19 bp, Homo sapiens
gtctctttctttccaaagg

SEQ ID NO: 528523 - DNA, 11 bp, Homo sapiens
gtctgcacaca

SEQ ID NO: 528524 - DNA, 22 bp, Homo sapiens
gtctggattcccgtggctttgt

SEQ ID NO: 528525 - DNA, 19 bp, Homo sapiens
gtctgggaatcctggacag

SEQ ID NO: 528526 - DNA, 21 bp, Homo sapiens
gtctgtgaaagtctcctgtat

SEQ ID NO: 528527 - DNA, 17 bp, Homo sapiens
gtcttcaaattgtcttt

SEQ ID NO: 528528 - DNA, 20 bp, Homo sapiens
gtctttggttcctcatggct

SEQ ID NO: 528529 - DNA, 12 bp, Homo sapiens
gtgaaacagtgt

SEQ ID NO: 528530 - DNA, 17 bp, Homo sapiens
gtgaatgttgtcctgtg

SEQ ID NO: 528531 - DNA, 16 bp, Homo sapiens
gtgagataaatatcat

SEQ ID NO: 528532 - DNA, 14 bp, Homo sapiens
gtgatcactttctg

SEQ ID NO: 528533 - DNA, 17 bp, Homo sapiens
gtgatgtgatttatgca

SEQ ID NO: 528534 - DNA, 20 bp, Homo sapiens
gtgatgtgatttatgcattt

SEQ ID NO: 528535 - DNA, 15 bp, Homo sapiens
gtgatttatgcattt

SEQ ID NO: 528536 - DNA, 15 bp, Homo sapiens
gtgcagtagtgtcac

SEQ ID NO: 528537 - DNA, 16 bp, Homo sapiens
gtgcatctggcctggg

SEQ ID NO: 528538 - DNA, 19 bp, Homo sapiens
gtgcatctggcctgggggc

SEQ ID NO: 528539 - DNA, 19 bp, Homo sapiens
gtgcccacccgtgttctcc

SEQ ID NO: 528540 - DNA, 20 bp, Homo sapiens
gtgcccacccgtgttctcct

SEQ ID NO: 528541 - DNA, 23 bp, Homo sapiens
gtgccgcttaaacatttccctgc

SEQ ID NO: 528542 - DNA, 14 bp, Homo sapiens
gtgctgttgattct

SEQ ID NO: 528543 - DNA, 13 bp, Homo sapiens
gtggaccacgacc

SEQ ID NO: 528544 - DNA, 14 bp, Homo sapiens
gtggatgtaaattt

SEQ ID NO: 528545 - DNA, 13 bp, Homo sapiens
gtggcaactgtgg

SEQ ID NO: 528546 - DNA, 16 bp, Homo sapiens
gtggcatttgctgaat

SEQ ID NO: 528547 - DNA, 20 bp, Homo sapiens
gtggctcgtgtttcacagtg

SEQ ID NO: 528548 - DNA, 16 bp, Homo sapiens
gtggctgccagggggc

SEQ ID NO: 528549 - DNA, 14 bp, Homo sapiens
gtggggaggagaga

SEQ ID NO: 528550 - DNA, 16 bp, Homo sapiens
gtggggaggagagagg

SEQ ID NO: 528551 - DNA, 14 bp, Homo sapiens
gtggggccagcgct

SEQ ID NO: 528552 - DNA, 15 bp, Homo sapiens
gtggtccagggtcca

SEQ ID NO: 528553 - DNA, 18 bp, Homo sapiens
gtggtccagggtccagcc

SEQ ID NO: 528554 - DNA, 17 bp, Homo sapiens
gtgtacatttatgtgtg

SEQ ID NO: 528555 - DNA, 19 bp, Homo sapiens
gtgtcaggattgaggatga

SEQ ID NO: 528556 - DNA, 13 bp, Homo sapiens
gtgtcatctgtca

SEQ ID NO: 528557 - DNA, 15 bp, Homo sapiens
gtgtcctaaatgcaa

SEQ ID NO: 528558 - DNA, 20 bp, Homo sapiens
gtgtgcccacccgtgttctc

SEQ ID NO: 528559 - DNA, 13 bp, Homo sapiens
gtgtggaatcacc

SEQ ID NO: 528560 - DNA, 14 bp, Homo sapiens
gtgtggctgtgagg

SEQ ID NO: 528561 - DNA, 12 bp, Homo sapiens
gtgttctcctcc

SEQ ID NO: 528562 - DNA, 13 bp, Homo sapiens
gtgttctcctcca

SEQ ID NO: 528563 - DNA, 12 bp, Homo sapiens
gtgtttaactga

SEQ ID NO: 528564 - DNA, 17 bp, Homo sapiens
gtgtttgaattgatttt

SEQ ID NO: 528565 - DNA, 12 bp, Homo sapiens
gttacagctgaa

SEQ ID NO: 528566 - DNA, 14 bp, Homo sapiens
gttagagactcgcc

SEQ ID NO: 528567 - DNA, 16 bp, Homo sapiens
gttagcacagaggatg

SEQ ID NO: 528568 - DNA, 19 bp, Homo sapiens
gttaggattaggtttagaa

SEQ ID NO: 528569 - DNA, 19 bp, Homo sapiens
gttatctgtctttatgatt

SEQ ID NO: 528570 - DNA, 17 bp, Homo sapiens
gttcaccttctgtgcat

SEQ ID NO: 528571 - DNA, 12 bp, Homo sapiens
gttcctcatggc

SEQ ID NO: 528572 - DNA, 19 bp, Homo sapiens
gttctctcttggtctcttt

SEQ ID NO: 528573 - DNA, 17 bp, Homo sapiens
gttcttgcagcagagag

SEQ ID NO: 528574 - DNA, 17 bp, Homo sapiens
gttcttgtaaaactgtg

SEQ ID NO: 528575 - DNA, 19 bp, Homo sapiens
gttcttgtaaaactgtgac

SEQ ID NO: 528576 - DNA, 17 bp, Homo sapiens
gttgacctaccctggac

SEQ ID NO: 528577 - DNA, 14 bp, Homo sapiens
gttgattctttcaa

SEQ ID NO: 528578 - DNA, 18 bp, Homo sapiens
gttggttacctattgctg

SEQ ID NO: 528579 - DNA, 13 bp, Homo sapiens
gttgtgctgcctg

SEQ ID NO: 528580 - DNA, 17 bp, Homo sapiens
gtttaaaattattaaaa

SEQ ID NO: 528581 - DNA, 12 bp, Homo sapiens
gtttactctgtg

SEQ ID NO: 528582 - DNA, 13 bp, Homo sapiens
gtttactctgtgc

SEQ ID NO: 528583 - DNA, 18 bp, Homo sapiens
gtttagtagctgataaag

SEQ ID NO: 528584 - DNA, 22 bp, Homo sapiens
gtttccagctaagcctgatgat

SEQ ID NO: 528585 - DNA, 17 bp, Homo sapiens
gtttgtgaagtgattga

SEQ ID NO: 528586 - DNA, 19 bp, Homo sapiens
gtttgttatcagtacaatt

SEQ ID NO: 528587 - DNA, 15 bp, Homo sapiens
tcattttctctcctc

SEQ ID NO: 528588 - DNA, 16 bp, Homo sapiens
tcattttctctcctcg

SEQ ID NO: 528589 - DNA, 13 bp, Homo sapiens
tccaatccagcct

SEQ ID NO: 528590 - DNA, 14 bp, Homo sapiens
tccaatccagcctt

SEQ ID NO: 528591 - DNA, 16 bp, Homo sapiens
tccaatccagccttct

SEQ ID NO: 528592 - DNA, 23 bp, Homo sapiens
tccacagggacacagtctggtgc

SEQ ID NO: 528593 - DNA, 12 bp, Homo sapiens
tccacagtattg

SEQ ID NO: 528594 - DNA, 21 bp, Homo sapiens
tccagccctccgccagccctg

SEQ ID NO: 528595 - DNA, 22 bp, Homo sapiens
tccagccttcttcccccagggt

SEQ ID NO: 528596 - DNA, 19 bp, Homo sapiens
tccagcggggcttctgggc

SEQ ID NO: 528597 - DNA, 20 bp, Homo sapiens
tccagcggggcttctgggcg

SEQ ID NO: 528598 - DNA, 19 bp, Homo sapiens
tccagctaagcctgatgat

SEQ ID NO: 528599 - DNA, 18 bp, Homo sapiens
tccagctctgggagccct

SEQ ID NO: 528600 - DNA, 17 bp, Homo sapiens
tccagggagtggggagg

SEQ ID NO: 528601 - DNA, 19 bp, Homo sapiens
tccagggagtggggaggag

SEQ ID NO: 528602 - DNA, 18 bp, Homo sapiens
tccagggcgcaggggagg

SEQ ID NO: 528603 - DNA, 16 bp, Homo sapiens
tccaggtcacaggcat

SEQ ID NO: 528604 - DNA, 16 bp, Homo sapiens
tccagtgctgctccct

SEQ ID NO: 528605 - DNA, 17 bp, Homo sapiens
tccatgtgctgctgtgg

SEQ ID NO: 528606 - DNA, 12 bp, Homo sapiens
tccattcctgag

SEQ ID NO: 528607 - DNA, 17 bp, Homo sapiens
tccatttaaacccggct

SEQ ID NO: 528608 - DNA, 14 bp, Homo sapiens
tcccaacctcccct

SEQ ID NO: 528609 - DNA, 23 bp, Homo sapiens
tcccaacctcccctggtcctgca

SEQ ID NO: 528610 - DNA, 15 bp, Homo sapiens
tcccactgcccctgc

SEQ ID NO: 528611 - DNA, 12 bp, Homo sapiens
tcccagggtcct

SEQ ID NO: 528612 - DNA, 18 bp, Homo sapiens
tccccatcgccttctggg

SEQ ID NO: 528613 - DNA, 19 bp, Homo sapiens
tccccattgccttctgggg

SEQ ID NO: 528614 - DNA, 12 bp, Homo sapiens
tcccccagggtc

SEQ ID NO: 528615 - DNA, 17 bp, Homo sapiens
tcccccagggtcccctg

SEQ ID NO: 528616 - DNA, 19 bp, Homo sapiens
tcccccagggtcccctgca

SEQ ID NO: 528617 - DNA, 21 bp, Homo sapiens
tcccccagggtcccctgcatg

SEQ ID NO: 528618 - DNA, 15 bp, Homo sapiens
tccccctcctccatg

SEQ ID NO: 528619 - DNA, 21 bp, Homo sapiens
tccccgtctgaccaagggctg

SEQ ID NO: 528620 - DNA, 16 bp, Homo sapiens
tcccctgcaagtggac

SEQ ID NO: 528621 - DNA, 20 bp, Homo sapiens
tcccctggaagttgtccttt

SEQ ID NO: 528622 - DNA, 17 bp, Homo sapiens
tcccctggtcctgcact

SEQ ID NO: 528623 - DNA, 18 bp, Homo sapiens
tcccctggtcctgcactg

SEQ ID NO: 528624 - DNA, 18 bp, Homo sapiens
tcccctgtggtttgttat

SEQ ID NO: 528625 - DNA, 22 bp, Homo sapiens
tcccgatgcgtggctcccagca

SEQ ID NO: 528626 - DNA, 14 bp, Homo sapiens
tcccggtgtgcagc

SEQ ID NO: 528627 - DNA, 15 bp, Homo sapiens
tcccggtgtgcagcg

SEQ ID NO: 528628 - DNA, 18 bp, Homo sapiens
tcccgtggctttgtgctt

SEQ ID NO: 528629 - DNA, 16 bp, Homo sapiens
tccctccctccctgct

SEQ ID NO: 528630 - DNA, 19 bp, Homo sapiens
tccctgagggcccttccca

SEQ ID NO: 528631 - DNA, 23 bp, Homo sapiens
tccctgagggcccttcccaacct

SEQ ID NO: 528632 - DNA, 15 bp, Homo sapiens
tccctgctgccaggc

SEQ ID NO: 528633 - DNA, 22 bp, Homo sapiens
tccctgctgccaggctcccact

SEQ ID NO: 528634 - DNA, 14 bp, Homo sapiens
tccgccagccctgt

SEQ ID NO: 528635 - DNA, 15 bp, Homo sapiens
tccgcctcactgggt

SEQ ID NO: 528636 - DNA, 19 bp, Homo sapiens
tccgcgtggttctgccact

SEQ ID NO: 528637 - DNA, 22 bp, Homo sapiens
tcctagcactttgggaggctga

SEQ ID NO: 528638 - DNA, 22 bp, Homo sapiens
tcctcatggctgttatctgtct

SEQ ID NO: 528639 - DNA, 14 bp, Homo sapiens
tcctccaaatgctg

SEQ ID NO: 528640 - DNA, 16 bp, Homo sapiens
tcctccaaatgctgtc

SEQ ID NO: 528641 - DNA, 16 bp, Homo sapiens
tcctccattgtatctt

SEQ ID NO: 528642 - DNA, 15 bp, Homo sapiens
tcctccccctcctcc

SEQ ID NO: 528643 - DNA, 18 bp, Homo sapiens
tcctccccctcctccatg

SEQ ID NO: 528644 - DNA, 19 bp, Homo sapiens
tcctcctgtctcctctgtc

SEQ ID NO: 528645 - DNA, 14 bp, Homo sapiens
tcctgaccctcact

SEQ ID NO: 528646 - DNA, 15 bp, Homo sapiens
tcctgcactgtcccg

SEQ ID NO: 528647 - DNA, 15 bp, Homo sapiens
tcctggctcccaggg

SEQ ID NO: 528648 - DNA, 19 bp, Homo sapiens
tcctgggggctgctgcact

SEQ ID NO: 528649 - DNA, 16 bp, Homo sapiens
tcctgtcctggctccc

SEQ ID NO: 528650 - DNA, 19 bp, Homo sapiens
tcctgtcctggctcccagg

SEQ ID NO: 528651 - DNA, 19 bp, Homo sapiens
tcctgtgtcatctgtcagc

SEQ ID NO: 528652 - DNA, 19 bp, Homo sapiens
tccttaaaaaaaaaaatga

SEQ ID NO: 528653 - DNA, 15 bp, Homo sapiens
tccttcactccctgt

SEQ ID NO: 528654 - DNA, 16 bp, Homo sapiens
tccttcatgcttttct

SEQ ID NO: 528655 - DNA, 18 bp, Homo sapiens
tccttcatgcttttctca

SEQ ID NO: 528656 - DNA, 17 bp, Homo sapiens
tcctttctgatcctctc

SEQ ID NO: 528657 - DNA, 16 bp, Homo sapiens
tccttttgtatcctcc

SEQ ID NO: 528658 - DNA, 15 bp, Homo sapiens
tcggggctgggcaga

SEQ ID NO: 528659 - DNA, 18 bp, Homo sapiens
tcggtggcatttgctgaa

SEQ ID NO: 528660 - DNA, 13 bp, Homo sapiens
tctaaatcataat

SEQ ID NO: 528661 - DNA, 18 bp, Homo sapiens
tctagagctatgcacacc

SEQ ID NO: 528662 - DNA, 20 bp, Homo sapiens
tctcagaagtgaaaaagact

SEQ ID NO: 528663 - DNA, 20 bp, Homo sapiens
tctcatctgtaaaaccaggc

SEQ ID NO: 528664 - DNA, 21 bp, Homo sapiens
tctcatctgtaaaaccaggct

SEQ ID NO: 528665 - DNA, 12 bp, Homo sapiens
tctcatggtatt

SEQ ID NO: 528666 - DNA, 14 bp, Homo sapiens
tctcctgtatcatt

SEQ ID NO: 528667 - DNA, 13 bp, Homo sapiens
tctctctgtgctg

SEQ ID NO: 528668 - DNA, 13 bp, Homo sapiens
tctctcttggtct

SEQ ID NO: 528669 - DNA, 17 bp, Homo sapiens
tctctcttggtctcttt

SEQ ID NO: 528670 - DNA, 16 bp, Homo sapiens
tctgaactgcaacact

SEQ ID NO: 528671 - DNA, 17 bp, Homo sapiens
tctgaggctgccccagg

SEQ ID NO: 528672 - DNA, 22 bp, Homo sapiens
tctgccacttagggagtgtgcc

SEQ ID NO: 528673 - DNA, 18 bp, Homo sapiens
tctggctgctgcagtcag

SEQ ID NO: 528674 - DNA, 22 bp, Homo sapiens
tctgggacaggcaccatgctgg

SEQ ID NO: 528675 - DNA, 21 bp, Homo sapiens
tctgggcgccggttccacgtg

SEQ ID NO: 528676 - DNA, 14 bp, Homo sapiens
tctgtaaaaccagg

SEQ ID NO: 528677 - DNA, 21 bp, Homo sapiens
tctgtaatcacactctcttct

SEQ ID NO: 528678 - DNA, 23 bp, Homo sapiens
tctgtaatcacactctcttctta

SEQ ID NO: 528679 - DNA, 15 bp, Homo sapiens
tctgtcagcttccca

SEQ ID NO: 528680 - DNA, 16 bp, Homo sapiens
tctgtcagtttgtgaa

SEQ ID NO: 528681 - DNA, 18 bp, Homo sapiens
tctgtcagtttgtgaagt

SEQ ID NO: 528682 - DNA, 16 bp, Homo sapiens
tctgtctttatgattt

SEQ ID NO: 528683 - DNA, 22 bp, Homo sapiens
tctgtgaaagtctcctgtatca

SEQ ID NO: 528684 - DNA, 17 bp, Homo sapiens
tctgtgcatctggcctg

SEQ ID NO: 528685 - DNA, 22 bp, Homo sapiens
tctgtgcatctggcctgggggc

SEQ ID NO: 528686 - DNA, 21 bp, Homo sapiens
tctgtggcttcccatgtcttt

SEQ ID NO: 528687 - DNA, 22 bp, Homo sapiens
tctgttgaccaatctctattca

SEQ ID NO: 528688 - DNA, 16 bp, Homo sapiens
tgtccctgtgggctca

SEQ ID NO: 528689 - DNA, 18 bp, Homo sapiens
tgtccctgtgggctcaca

SEQ ID NO: 528690 - DNA, 22 bp, Homo sapiens
tgtccctgtgggctcacaccgg

SEQ ID NO: 528691 - DNA, 14 bp, Homo sapiens
tgtcctggctccca

SEQ ID NO: 528692 - DNA, 21 bp, Homo sapiens
tgtcctggctcccagggtcct

SEQ ID NO: 528693 - DNA, 14 bp, Homo sapiens
tgtctccagctgat

SEQ ID NO: 528694 - DNA, 16 bp, Homo sapiens
tgtctcctctgtcagt

SEQ ID NO: 528695 - DNA, 20 bp, Homo sapiens
tgtctctacaaaaaaaatca

SEQ ID NO: 528696 - DNA, 16 bp, Homo sapiens
tgtctgtcccagttaa

SEQ ID NO: 528697 - DNA, 16 bp, Homo sapiens
tgtcttgtgttgctgt

SEQ ID NO: 528698 - DNA, 15 bp, Homo sapiens
tgtctttaaaatgat

SEQ ID NO: 528699 - DNA, 19 bp, Homo sapiens
tgtctttctccaaagttat

SEQ ID NO: 528700 - DNA, 15 bp, Homo sapiens
tgtcttttgttctct

SEQ ID NO: 528701 - DNA, 13 bp, Homo sapiens
tgtgaaacagtgt

SEQ ID NO: 528702 - DNA, 22 bp, Homo sapiens
tgtgaaacagtgtggatgtaaa

SEQ ID NO: 528703 - DNA, 14 bp, Homo sapiens
tgtgaactgccagg

SEQ ID NO: 528704 - DNA, 23 bp, Homo sapiens
tgtgaatgttgtcctgtgtcatc

SEQ ID NO: 528705 - DNA, 15 bp, Homo sapiens
tgtgagataaatatc

SEQ ID NO: 528706 - DNA, 14 bp, Homo sapiens
tgtgatttatgcat

SEQ ID NO: 528707 - DNA, 16 bp, Homo sapiens
tgtgatttatgcattt

SEQ ID NO: 528708 - DNA, 19 bp, Homo sapiens
tgtgatttatgcatttatg

SEQ ID NO: 528709 - DNA, 15 bp, Homo sapiens
tgtgcatctggcctg

SEQ ID NO: 528710 - DNA, 20 bp, Homo sapiens
tgtgcatctggcctgggggc

SEQ ID NO: 528711 - DNA, 20 bp, Homo sapiens
tgtgcccacccgtgttctcc

SEQ ID NO: 528712 - DNA, 22 bp, Homo sapiens
tgtgcccacccgtgttctcctc

SEQ ID NO: 528713 - DNA, 19 bp, Homo sapiens
tgtgccgtctttggttcct

SEQ ID NO: 528714 - DNA, 12 bp, Homo sapiens
tgtgccttgggc

SEQ ID NO: 528715 - DNA, 18 bp, Homo sapiens
tgtgctgctgtggcatca

SEQ ID NO: 528716 - DNA, 17 bp, Homo sapiens
tgtgctgttgattcttt

SEQ ID NO: 528717 - DNA, 18 bp, Homo sapiens
tgtgcttatgtcatttct

SEQ ID NO: 528718 - DNA, 12 bp, Homo sapiens
tgtgcttgttct

SEQ ID NO: 528719 - DNA, 13 bp, Homo sapiens
tgtgggctcacac

SEQ ID NO: 528720 - DNA, 14 bp, Homo sapiens
tgtgggtgccctgt

SEQ ID NO: 528721 - DNA, 18 bp, Homo sapiens
tgtgtcatctgtcagctt

SEQ ID NO: 528722 - DNA, 17 bp, Homo sapiens
tgttataaaatctgtat

SEQ ID NO: 528723 - DNA, 20 bp, Homo sapiens
tgttataaaatctgtattgc

SEQ ID NO: 528724 - DNA, 20 bp, Homo sapiens
tgttatcagtacaattcttt

SEQ ID NO: 528725 - DNA, 12 bp, Homo sapiens
tgttatctgtct

SEQ ID NO: 528726 - DNA, 13 bp, Homo sapiens
tgttatctgtctt

SEQ ID NO: 528727 - DNA, 18 bp, Homo sapiens
tgttcaccttctgtgcat

SEQ ID NO: 528728 - DNA, 14 bp, Homo sapiens
tgttccgcctcact

SEQ ID NO: 528729 - DNA, 11 bp, Homo sapiens
tgttctcctcc

SEQ ID NO: 528730 - DNA, 12 bp, Homo sapiens
tgttcttgtaaa

SEQ ID NO: 528731 - DNA, 23 bp, Homo sapiens
tgttcttgtaaaactgtgacatt

SEQ ID NO: 528732 - DNA, 22 bp, Homo sapiens
tgttgtcctgtgtcatctgtca

SEQ ID NO: 528733 - DNA, 16 bp, Homo sapiens
tgtttaaggttcttgc

SEQ ID NO: 528734 - DNA, 21 bp, Homo sapiens
tgttttccccaattatcctcc

SEQ ID NO: 528735 - DNA, 15 bp, Homo sapiens
ttaaaaaaataatat

SEQ ID NO: 528736 - DNA, 20 bp, Homo sapiens
ttaaaaagttaatcttcatg

SEQ ID NO: 528737 - DNA, 12 bp, Homo sapiens
ttaaacaaatgg

SEQ ID NO: 528738 - DNA, 13 bp, Homo sapiens
ttaaatgaaatac

SEQ ID NO: 528739 - DNA, 15 bp, Homo sapiens
ttaaatgaaatactt

SEQ ID NO: 528740 - DNA, 20 bp, Homo sapiens
ttaatcatttccagcaaaat

SEQ ID NO: 528741 - DNA, 17 bp, Homo sapiens
ttaattgatagaataaa

SEQ ID NO: 528742 - DNA, 14 bp, Homo sapiens
ttaatttcagtaag

SEQ ID NO: 528743 - DNA, 12 bp, Homo sapiens
ttacataacagg

SEQ ID NO: 528744 - DNA, 15 bp, Homo sapiens
ttacataacaggcat

SEQ ID NO: 528745 - DNA, 19 bp, Homo sapiens
ttacctgtaatagcctcac

SEQ ID NO: 528746 - DNA, 13 bp, Homo sapiens
ttactttgcccat

SEQ ID NO: 528747 - DNA, 20 bp, Homo sapiens
ttagaatcaagtctgtgaaa

SEQ ID NO: 528748 - DNA, 20 bp, Homo sapiens
ttagattcctacttaaacaa

SEQ ID NO: 528749 - DNA, 15 bp, Homo sapiens
ttaggaatgctcaat

SEQ ID NO: 528750 - DNA, 20 bp, Homo sapiens
ttaggaatgctcaatgtgct

SEQ ID NO: 528751 - DNA, 15 bp, Homo sapiens
ttagtagctgataaa

SEQ ID NO: 528752 - DNA, 16 bp, Homo sapiens
ttagtagctgataaag

SEQ ID NO: 528753 - DNA, 13 bp, Homo sapiens
ttagtcctcacct

SEQ ID NO: 528754 - DNA, 19 bp, Homo sapiens
ttagtcctcaccttctgtt

SEQ ID NO: 528755 - DNA, 15 bp, Homo sapiens
ttataaaatctgtat

SEQ ID NO: 528756 - DNA, 15 bp, Homo sapiens
ttataacattgtaaa

SEQ ID NO: 528757 - DNA, 17 bp, Homo sapiens
ttataacattgtaaatg

SEQ ID NO: 528758 - DNA, 19 bp, Homo sapiens
ttatactatttattaaaac

SEQ ID NO: 528759 - DNA, 22 bp, Homo sapiens
ttatatcagactgctttgagaa

SEQ ID NO: 528760 - DNA, 20 bp, Homo sapiens
ttatcagtacaattctttgt

SEQ ID NO: 528761 - DNA, 13 bp, Homo sapiens
ttatctgtcttta

SEQ ID NO: 528762 - DNA, 16 bp, Homo sapiens
ttatctgtctttatga

SEQ ID NO: 528763 - DNA, 16 bp, Homo sapiens
ttatgatttcatgatt

SEQ ID NO: 528764 - DNA, 22 bp, Homo sapiens
ttatgatttcatgattagacaa

SEQ ID NO: 528765 - DNA, 23 bp, Homo sapiens
ttatgcatgagaactaaatagat

SEQ ID NO: 528766 - DNA, 16 bp, Homo sapiens
ttattagcaccagctt

SEQ ID NO: 528767 - DNA, 17 bp, Homo sapiens
ttattcattagctgtga

SEQ ID NO: 528768 - DNA, 16 bp, Homo sapiens
ttcaaattgtcttttg

SEQ ID NO: 528769 - DNA, 16 bp, Homo sapiens
ttcaatgctacaaaat

SEQ ID NO: 528770 - DNA, 15 bp, Homo sapiens
ttcacagtgggcggc

SEQ ID NO: 528771 - DNA, 22 bp, Homo sapiens
ttcaccagtttccaagtttatt

SEQ ID NO: 528772 - DNA, 16 bp, Homo sapiens
ttcaccttctgtgcat

SEQ ID NO: 528773 - DNA, 21 bp, Homo sapiens
ttcaccttctgtgcatctggc

SEQ ID NO: 528774 - DNA, 20 bp, Homo sapiens
ttcagcatcgtgtgggtccc

SEQ ID NO: 528775 - DNA, 20 bp, Homo sapiens
ttcagtcacttgtttgtgtt

SEQ ID NO: 528776 - DNA, 18 bp, Homo sapiens
ttcatgattagacaatgt

SEQ ID NO: 528777 - DNA, 19 bp, Homo sapiens
ttcatgcttttctcatggt

SEQ ID NO: 528778 - DNA, 21 bp, Homo sapiens
ttccagctaagcctgatgatg

SEQ ID NO: 528779 - DNA, 14 bp, Homo sapiens
ttccagggcaatca

SEQ ID NO: 528780 - DNA, 14 bp, Homo sapiens
ttccagtgctgctc

SEQ ID NO: 528781 - DNA, 16 bp, Homo sapiens
ttccatggcacactgc

SEQ ID NO: 528782 - DNA, 19 bp, Homo sapiens
ttcccatggtagactgtga

SEQ ID NO: 528783 - DNA, 14 bp, Homo sapiens
ttccctagttcttt

SEQ ID NO: 528784 - DNA, 21 bp, Homo sapiens
ttccctgacactgtctgctgc

SEQ ID NO: 528785 - DNA, 22 bp, Homo sapiens
ttccctgacactgtctgctgcc

SEQ ID NO: 528786 - DNA, 11 bp, Homo sapiens
ttccctgctga

SEQ ID NO: 528787 - DNA, 15 bp, Homo sapiens
ttccctgctgagtgg

SEQ ID NO: 528788 - DNA, 14 bp, Homo sapiens
ttccgcctcactgg

SEQ ID NO: 528789 - DNA, 23 bp, Homo sapiens
ttcctaccattatggctttgtgc

SEQ ID NO: 528790 - DNA, 12 bp, Homo sapiens
aacttgctgtga

SEQ ID NO: 528791 - DNA, 15 bp, Homo sapiens
aacttgctgtgaaat

SEQ ID NO: 528792 - DNA, 21 bp, Homo sapiens
aagaatcacctaattaatttc

SEQ ID NO: 528793 - DNA, 22 bp, Homo sapiens
aagaccatttagtcctcacctt

SEQ ID NO: 528794 - DNA, 13 bp, Homo sapiens
aagacttcaaatg

SEQ ID NO: 528795 - DNA, 19 bp, Homo sapiens
aagaggaaaatattgacaa

SEQ ID NO: 528796 - DNA, 20 bp, Homo sapiens
aagataaatccaactctgac

SEQ ID NO: 528797 - DNA, 12 bp, Homo sapiens
aagatagctcct

SEQ ID NO: 528798 - DNA, 19 bp, Homo sapiens
aagatggatttgacacact

SEQ ID NO: 528799 - DNA, 21 bp, Homo sapiens
aagatggatttgacacactca

SEQ ID NO: 528800 - DNA, 16 bp, Homo sapiens
aagcaaataaatatca

SEQ ID NO: 528801 - DNA, 20 bp, Homo sapiens
aagcaaatttctagatatga

SEQ ID NO: 528802 - DNA, 15 bp, Homo sapiens
aagcaccgacaatct

SEQ ID NO: 528803 - DNA, 18 bp, Homo sapiens
aagcatgctcagtattga

SEQ ID NO: 528804 - DNA, 15 bp, Homo sapiens
aagctcaaggctgca

SEQ ID NO: 528805 - DNA, 16 bp, Homo sapiens
aaggagaaagcaccga

SEQ ID NO: 528806 - DNA, 22 bp, Homo sapiens
aaggagatggggagggcgcttt

SEQ ID NO: 528807 - DNA, 17 bp, Homo sapiens
aaggctgactcttacta

SEQ ID NO: 528808 - DNA, 12 bp, Homo sapiens
aaggttgtacat

SEQ ID NO: 528809 - DNA, 17 bp, Homo sapiens
aaggtttcactgttcat

SEQ ID NO: 528810 - DNA, 15 bp, Homo sapiens
aagtctcctgtatca

SEQ ID NO: 528811 - DNA, 12 bp, Homo sapiens
aagtgaaaaaga

SEQ ID NO: 528812 - DNA, 20 bp, Homo sapiens
aagtgatgtgatttatgcat

SEQ ID NO: 528813 - DNA, 21 bp, Homo sapiens
aagtgatgtgatttatgcatt

SEQ ID NO: 528814 - DNA, 15 bp, Homo sapiens
aagttataccagcaa

SEQ ID NO: 528815 - DNA, 17 bp, Homo sapiens
aagttataccagcaaaa

SEQ ID NO: 528816 - DNA, 21 bp, Homo sapiens
aataaagccttgtgatcactt

SEQ ID NO: 528817 - DNA, 14 bp, Homo sapiens
aataaagctcacac

SEQ ID NO: 528818 - DNA, 19 bp, Homo sapiens
aataacaacaatttaggaa

SEQ ID NO: 528819 - DNA, 15 bp, Homo sapiens
aatagatttttagat

SEQ ID NO: 528820 - DNA, 14 bp, Homo sapiens
aatagcctcacctt

SEQ ID NO: 528821 - DNA, 21 bp, Homo sapiens
aatagtgaaaattttattgaa

SEQ ID NO: 528822 - DNA, 18 bp, Homo sapiens
aatatagggtttgtttgc

SEQ ID NO: 528823 - DNA, 14 bp, Homo sapiens
aatatatgtttggc

SEQ ID NO: 528824 - DNA, 23 bp, Homo sapiens
aatcaatgttcacgcaacttgaa

SEQ ID NO: 528825 - DNA, 19 bp, Homo sapiens
aatcacctaattaatttca

SEQ ID NO: 528826 - DNA, 15 bp, Homo sapiens
aatccacagtattgt

SEQ ID NO: 528827 - DNA, 15 bp, Homo sapiens
aatccatgtgctgct

SEQ ID NO: 528828 - DNA, 21 bp, Homo sapiens
aatccccgtgctcacagtagc

SEQ ID NO: 528829 - DNA, 15 bp, Homo sapiens
aatctactagaacct

SEQ ID NO: 528830 - DNA, 12 bp, Homo sapiens
aatctagagcta

SEQ ID NO: 528831 - DNA, 15 bp, Homo sapiens
aatctagagctatgc

SEQ ID NO: 528832 - DNA, 17 bp, Homo sapiens
aatctctcaaaatgtgc

SEQ ID NO: 528833 - DNA, 18 bp, Homo sapiens
aatctctcaaaatgtgcc

SEQ ID NO: 528834 - DNA, 18 bp, Homo sapiens
aatcttgctgtgaaacag

SEQ ID NO: 528835 - DNA, 22 bp, Homo sapiens
aatgaaatacttgacaacattt

SEQ ID NO: 528836 - DNA, 17 bp, Homo sapiens
aatgaaatataaactgt

SEQ ID NO: 528837 - DNA, 19 bp, Homo sapiens
aatgaaatataaactgtga

SEQ ID NO: 528838 - DNA, 21 bp, Homo sapiens
aatgaaatataaactgtgaga

SEQ ID NO: 528839 - DNA, 15 bp, Homo sapiens
aatgaatgaaatata

SEQ ID NO: 528840 - DNA, 22 bp, Homo sapiens
aatgaatgaaatataaactgtg

SEQ ID NO: 528841 - DNA, 19 bp, Homo sapiens
tagctagtttaaaattatt

SEQ ID NO: 528842 - DNA, 18 bp, Homo sapiens
tagctcagaggagaggag

SEQ ID NO: 528843 - DNA, 14 bp, Homo sapiens
tagctcgtgtgctt

SEQ ID NO: 528844 - DNA, 15 bp, Homo sapiens
tagctcgtgtgctta

SEQ ID NO: 528845 - DNA, 13 bp, Homo sapiens
taggaatgctcaa

SEQ ID NO: 528846 - DNA, 14 bp, Homo sapiens
taggaatgctcaat

SEQ ID NO: 528847 - DNA, 18 bp, Homo sapiens
taggacatctctgtaaaa

SEQ ID NO: 528848 - DNA, 18 bp, Homo sapiens
tagggtttgtttgctgct

SEQ ID NO: 528849 - DNA, 13 bp, Homo sapiens
tagtcctcacctt

SEQ ID NO: 528850 - DNA, 23 bp, Homo sapiens
tagtgtcacttttttcctgtcaa

SEQ ID NO: 528851 - DNA, 13 bp, Homo sapiens
tagtgtgtccatg

SEQ ID NO: 528852 - DNA, 20 bp, Homo sapiens
tataaaaataattaaaacaa

SEQ ID NO: 528853 - DNA, 14 bp, Homo sapiens
tataaaatctgtat

SEQ ID NO: 528854 - DNA, 11 bp, Homo sapiens
tataaactgtg

SEQ ID NO: 528855 - DNA, 15 bp, Homo sapiens
tataaactgtgagat

SEQ ID NO: 528856 - DNA, 15 bp, Homo sapiens
tataaatgaatgaaa

SEQ ID NO: 528857 - DNA, 22 bp, Homo sapiens
tataaatgaatgaaatataaac

SEQ ID NO: 528858 - DNA, 17 bp, Homo sapiens
tataacattgtaaatga

SEQ ID NO: 528859 - DNA, 19 bp, Homo sapiens
tataattttattgctggaa

SEQ ID NO: 528860 - DNA, 16 bp, Homo sapiens
tatagagacttctaaa

SEQ ID NO: 528861 - DNA, 17 bp, Homo sapiens
tatagagacttctaaat

SEQ ID NO: 528862 - DNA, 14 bp, Homo sapiens
tatatattttgaaa

SEQ ID NO: 528863 - DNA, 17 bp, Homo sapiens
tatatattttgaaagga

SEQ ID NO: 528864 - DNA, 16 bp, Homo sapiens
tatatctgaaaactgg

SEQ ID NO: 528865 - DNA, 17 bp, Homo sapiens
tatatctgaaaactgga

SEQ ID NO: 528866 - DNA, 15 bp, Homo sapiens
tatattttgaaagga

SEQ ID NO: 528867 - DNA, 17 bp, Homo sapiens
tatcagtacaattcttt

SEQ ID NO: 528868 - DNA, 20 bp, Homo sapiens
tatcagtacaattctttgtt

SEQ ID NO: 528869 - DNA, 24 bp, Homo sapiens
tatccctgatttattctggtgtct

SEQ ID NO: 528870 - DNA, 13 bp, Homo sapiens
tatctgaaaactg

SEQ ID NO: 528871 - DNA, 21 bp, Homo sapiens
tatctgggggactagaacaca

SEQ ID NO: 528872 - DNA, 17 bp, Homo sapiens
tatctgtttgcttctaa

SEQ ID NO: 528873 - DNA, 13 bp, Homo sapiens
tatgataaatttg

SEQ ID NO: 528874 - DNA, 23 bp, Homo sapiens
tatgcacaccaaattgctgagat

SEQ ID NO: 528875 - DNA, 18 bp, Homo sapiens
tatgcatgagaactaaat

SEQ ID NO: 528876 - DNA, 13 bp, Homo sapiens
tatgcatttatgc

SEQ ID NO: 528877 - DNA, 16 bp, Homo sapiens
tatgcatttatgcatg

SEQ ID NO: 528878 - DNA, 15 bp, Homo sapiens
tatggctttgtgctt

SEQ ID NO: 528879 - DNA, 17 bp, Homo sapiens
tatgtttggctgaaatt

SEQ ID NO: 528880 - DNA, 18 bp, Homo sapiens
tatgtttggctgaaatta

SEQ ID NO: 528881 - DNA, 21 bp, Homo sapiens
tattcccatggtagactgtga

SEQ ID NO: 528882 - DNA, 23 bp, Homo sapiens
tattcccatggtagactgtgaca

SEQ ID NO: 528883 - DNA, 14 bp, Homo sapiens
tattgaatataatg

SEQ ID NO: 528884 - DNA, 22 bp, Homo sapiens
tattgctgtaaataaaaatagc

SEQ ID NO: 528885 - DNA, 16 bp, Homo sapiens
tattgttcttgtaaaa

SEQ ID NO: 528886 - DNA, 21 bp, Homo sapiens
tattgttcttgtaaaactgtg

SEQ ID NO: 528887 - DNA, 21 bp, Homo sapiens
tatttataacattgtaaatga

SEQ ID NO: 528888 - DNA, 15 bp, Homo sapiens
tattttcgcccacct

SEQ ID NO: 528889 - DNA, 22 bp, Homo sapiens
tattttctgagtagcatatata

SEQ ID NO: 528890 - DNA, 16 bp, Homo sapiens
tcaaaaattgaagaga

SEQ ID NO: 528891 - DNA, 11 bp, Homo sapiens
tcaaaatgtgc

SEQ ID NO: 528892 - DNA, 15 bp, Homo sapiens
tcaaacgaaatggct

SEQ ID NO: 528893 - DNA, 23 bp, Homo sapiens
tcaaagaatcacctaattaattt

SEQ ID NO: 528894 - DNA, 15 bp, Homo sapiens
tcaacaaagaaatat

SEQ ID NO: 528895 - DNA, 22 bp, Homo sapiens
tcaagattaagttataccagca

SEQ ID NO: 528896 - DNA, 11 bp, Homo sapiens
tcaagtctgtg

SEQ ID NO: 528897 - DNA, 12 bp, Homo sapiens
tcaagtctgtga

SEQ ID NO: 528898 - DNA, 14 bp, Homo sapiens
tcaagtctgtgaaa

SEQ ID NO: 528899 - DNA, 23 bp, Homo sapiens
tcaataacaacagtttttatgtt

SEQ ID NO: 528900 - DNA, 16 bp, Homo sapiens
tcaataactattgctg

SEQ ID NO: 528901 - DNA, 16 bp, Homo sapiens
tcaatccacagtattg

SEQ ID NO: 528902 - DNA, 21 bp, Homo sapiens
tcaatccacagtattgttctt

SEQ ID NO: 528903 - DNA, 15 bp, Homo sapiens
tcaatgctacaaaat

SEQ ID NO: 528904 - DNA, 16 bp, Homo sapiens
tcaatgctacaaaatg

SEQ ID NO: 528905 - DNA, 19 bp, Homo sapiens
tcaatgtgctgttgattct

SEQ ID NO: 528906 - DNA, 20 bp, Homo sapiens
tcaatgtgctgttgattctt

SEQ ID NO: 528907 - DNA, 17 bp, Homo sapiens
tcacaccggcactgtgc

SEQ ID NO: 528908 - DNA, 19 bp, Homo sapiens
tcacaccggcactgtgcac

SEQ ID NO: 528909 - DNA, 20 bp, Homo sapiens
tcacaccggcactgtgcact

SEQ ID NO: 528910 - DNA, 14 bp, Homo sapiens
tcacattcctgacc

SEQ ID NO: 528911 - DNA, 21 bp, Homo sapiens
tcacattcctgaccctcactt

SEQ ID NO: 528912 - DNA, 16 bp, Homo sapiens
tcaccaaaagacgagg

SEQ ID NO: 528913 - DNA, 20 bp, Homo sapiens
tcaccatttaatcatttcca

SEQ ID NO: 528914 - DNA, 23 bp, Homo sapiens
tcaccatttaatcatttccagca

SEQ ID NO: 528915 - DNA, 13 bp, Homo sapiens
tcacccagcctgg

SEQ ID NO: 528916 - DNA, 14 bp, Homo sapiens
tcaccttctgtgca

SEQ ID NO: 528917 - DNA, 15 bp, Homo sapiens
tcaccttctgtgcat

SEQ ID NO: 528918 - DNA, 14 bp, Homo sapiens
tcactgttcatgaa

SEQ ID NO: 528919 - DNA, 13 bp, Homo sapiens
tcacttttttcct

SEQ ID NO: 528920 - DNA, 18 bp, Homo sapiens
tcacttttttcctgtcaa

SEQ ID NO: 528921 - DNA, 21 bp, Homo sapiens
tcacttttttcctgtcaatat

SEQ ID NO: 528922 - DNA, 22 bp, Homo sapiens
tcacttttttcctgtcaatata

SEQ ID NO: 528923 - DNA, 24 bp, Homo sapiens
tcagaaacaaagcatttgactttc

SEQ ID NO: 528924 - DNA, 16 bp, Homo sapiens
tcagaaacaatttctg

SEQ ID NO: 528925 - DNA, 17 bp, Homo sapiens
tcagaagtgaaaaagac

SEQ ID NO: 528926 - DNA, 16 bp, Homo sapiens
tcagactgctttgaga

SEQ ID NO: 528927 - DNA, 14 bp, Homo sapiens
tcagaggagaggag

SEQ ID NO: 528928 - DNA, 16 bp, Homo sapiens
tcagaggagaggagca

SEQ ID NO: 528929 - DNA, 12 bp, Homo sapiens
tcagcacagaga

SEQ ID NO: 528930 - DNA, 12 bp, Homo sapiens
tcagcctgtgaa

SEQ ID NO: 528931 - DNA, 21 bp, Homo sapiens
tcagcttcccaacaatacttt

SEQ ID NO: 528932 - DNA, 14 bp, Homo sapiens
tcagtattgagaca

SEQ ID NO: 528933 - DNA, 12 bp, Homo sapiens
tctctcacccag

SEQ ID NO: 528934 - DNA, 15 bp, Homo sapiens
tctctctgtgctggt

SEQ ID NO: 528935 - DNA, 24 bp, Homo sapiens
tctctgccggtggggccagcgctg

SEQ ID NO: 528936 - DNA, 16 bp, Homo sapiens
tctcttggtctctttc

SEQ ID NO: 528937 - DNA, 15 bp, Homo sapiens
tctgaatctctcaaa

SEQ ID NO: 528938 - DNA, 20 bp, Homo sapiens
tctgaatctctcaaaatgtg

SEQ ID NO: 528939 - DNA, 20 bp, Homo sapiens
tgcaggaatcaaaaattgaa

SEQ ID NO: 528940 - DNA, 16 bp, Homo sapiens
tgcagggacagcctgc

SEQ ID NO: 528941 - DNA, 14 bp, Homo sapiens
tgcagtcagcacag

SEQ ID NO: 528942 - DNA, 16 bp, Homo sapiens
tgcagtcatcagaagt

SEQ ID NO: 528943 - DNA, 13 bp, Homo sapiens
tgcatctggcctg

SEQ ID NO: 528944 - DNA, 15 bp, Homo sapiens
tgcatttatgcatga

SEQ ID NO: 528945 - DNA, 16 bp, Homo sapiens
tgcatttatgcatgag

SEQ ID NO: 528946 - DNA, 20 bp, Homo sapiens
tgccacttagggagtgtgcc

SEQ ID NO: 528947 - DNA, 17 bp, Homo sapiens
tgccagacgtgctcctg

SEQ ID NO: 528948 - DNA, 16 bp, Homo sapiens
tgccaggcagctgcag

SEQ ID NO: 528949 - DNA, 17 bp, Homo sapiens
tgccatttcctcctggg

SEQ ID NO: 528950 - DNA, 18 bp, Homo sapiens
tgccccccatgccctccc

SEQ ID NO: 528951 - DNA, 19 bp, Homo sapiens
tgccccccatgccctccct

SEQ ID NO: 528952 - DNA, 17 bp, Homo sapiens
tgccctccctgctgcca

SEQ ID NO: 528953 - DNA, 19 bp, Homo sapiens
tgccctccctgctgccagg

SEQ ID NO: 528954 - DNA, 22 bp, Homo sapiens
tgccctccctgctgccaggctc

SEQ ID NO: 528955 - DNA, 17 bp, Homo sapiens
tgccctccgcccttccc

SEQ ID NO: 528956 - DNA, 18 bp, Homo sapiens
tgccctccgcccttccct

SEQ ID NO: 528957 - DNA, 23 bp, Homo sapiens
tgccgcttaaacatttccctgct

SEQ ID NO: 528958 - DNA, 15 bp, Homo sapiens
tgccggtggggccag

SEQ ID NO: 528959 - DNA, 17 bp, Homo sapiens
tgccgtctttggttcct

SEQ ID NO: 528960 - DNA, 14 bp, Homo sapiens
tgcctgagaccacg

SEQ ID NO: 528961 - DNA, 14 bp, Homo sapiens
tgcctgtggtgagg

SEQ ID NO: 528962 - DNA, 20 bp, Homo sapiens
tgcctgtggtgaggtcctgt

SEQ ID NO: 528963 - DNA, 13 bp, Homo sapiens
tgccttctgggga

SEQ ID NO: 528964 - DNA, 22 bp, Homo sapiens
tgccttctggggagggacacag

SEQ ID NO: 528965 - DNA, 20 bp, Homo sapiens
tgcctttccagtgctgctcc

SEQ ID NO: 528966 - DNA, 15 bp, Homo sapiens
tgcctttctagcaat

SEQ ID NO: 528967 - DNA, 17 bp, Homo sapiens
tgcgacgatccccatgg

SEQ ID NO: 528968 - DNA, 19 bp, Homo sapiens
tgcgccctgacatgctaac

SEQ ID NO: 528969 - DNA, 15 bp, Homo sapiens
tgctaattaaaaagt

SEQ ID NO: 528970 - DNA, 12 bp, Homo sapiens
tgctactcagta

SEQ ID NO: 528971 - DNA, 13 bp, Homo sapiens
tgctactcagtat

SEQ ID NO: 528972 - DNA, 13 bp, Homo sapiens
tgctcagtattga

SEQ ID NO: 528973 - DNA, 14 bp, Homo sapiens
tgctccattcctga

SEQ ID NO: 528974 - DNA, 15 bp, Homo sapiens
tgctccattcctgag

SEQ ID NO: 528975 - DNA, 19 bp, Homo sapiens
tgctcccggctctgaggct

SEQ ID NO: 528976 - DNA, 23 bp, Homo sapiens
tgctctcccctccctttttaaac

SEQ ID NO: 528977 - DNA, 16 bp, Homo sapiens
tgctgaataacaacaa

SEQ ID NO: 528978 - DNA, 19 bp, Homo sapiens
tgctgagatgtttagtagc

SEQ ID NO: 528979 - DNA, 17 bp, Homo sapiens
tgctgagtggctcgtgt

SEQ ID NO: 528980 - DNA, 21 bp, Homo sapiens
tgctgcagtcagcacagagag

SEQ ID NO: 528981 - DNA, 16 bp, Homo sapiens
tgctgtccctgtgggc

SEQ ID NO: 528982 - DNA, 21 bp, Homo sapiens
tgctgtccctgtgggctcaca

SEQ ID NO: 528983 - DNA, 14 bp, Homo sapiens
tgctgtgaaacagt

SEQ ID NO: 528984 - DNA, 16 bp, Homo sapiens
tgctgtgaaacagtgt

SEQ ID NO: 528985 - DNA, 13 bp, Homo sapiens
tgctgtggcatca

SEQ ID NO: 528986 - DNA, 13 bp, Homo sapiens
tgctgttcattga

SEQ ID NO: 528987 - DNA, 18 bp, Homo sapiens
tgctgttgattctttcaa

SEQ ID NO: 528988 - DNA, 17 bp, Homo sapiens
tgcttaatctagagcta

SEQ ID NO: 528989 - DNA, 19 bp, Homo sapiens
tgcttaatctagagctatg

SEQ ID NO: 528990 - DNA, 21 bp, Homo sapiens
tgctttccgcgtggttctgcc

SEQ ID NO: 528991 - DNA, 16 bp, Homo sapiens
tgcttttgatggctat

SEQ ID NO: 528992 - DNA, 23 bp, Homo sapiens
tggaactcagctgtctgtggctt

SEQ ID NO: 528993 - DNA, 18 bp, Homo sapiens
tggaagggccttctccac

SEQ ID NO: 528994 - DNA, 13 bp, Homo sapiens
tggaattacataa

SEQ ID NO: 528995 - DNA, 19 bp, Homo sapiens
tggaattacataacaggca

SEQ ID NO: 528996 - DNA, 20 bp, Homo sapiens
tggaattacataacaggcat

SEQ ID NO: 528997 - DNA, 20 bp, Homo sapiens
tggaattattagcaccagct

SEQ ID NO: 528998 - DNA, 15 bp, Homo sapiens
tggagtcagggctgt

SEQ ID NO: 528999 - DNA, 12 bp, Homo sapiens
tggatcaggaaa

SEQ ID NO: 529000 - DNA, 17 bp, Homo sapiens
tggatggaggtgatgaa

SEQ ID NO: 529001 - DNA, 17 bp, Homo sapiens
tggatgtaatatagggt

SEQ ID NO: 529002 - DNA, 14 bp, Homo sapiens
tggattcccctgga

SEQ ID NO: 529003 - DNA, 17 bp, Homo sapiens
tggatttgacacactca

SEQ ID NO: 529004 - DNA, 20 bp, Homo sapiens
tggcacccactggaggtggg

SEQ ID NO: 529005 - DNA, 21 bp, Homo sapiens
tggcatttgctgaataacaac

SEQ ID NO: 529006 - DNA, 23 bp, Homo sapiens
tggcctattttggacgtgtgagg

SEQ ID NO: 529007 - DNA, 13 bp, Homo sapiens
tggcctccagggc

SEQ ID NO: 529008 - DNA, 16 bp, Homo sapiens
tggcctggcttctggg

SEQ ID NO: 529009 - DNA, 20 bp, Homo sapiens
tggctaaatgcctaataaac

SEQ ID NO: 529010 - DNA, 17 bp, Homo sapiens
tggctctaactccttga

SEQ ID NO: 529011 - DNA, 21 bp, Homo sapiens
tggctgaaattatgtcaaatg

SEQ ID NO: 529012 - DNA, 13 bp, Homo sapiens
tggctgctgcagt

SEQ ID NO: 529013 - DNA, 16 bp, Homo sapiens
tggctgtcccctgcaa

SEQ ID NO: 529014 - DNA, 18 bp, Homo sapiens
tggctgtcccctgcaagt

SEQ ID NO: 529015 - DNA, 11 bp, Homo sapiens
tggcttaattc

SEQ ID NO: 529016 - DNA, 18 bp, Homo sapiens
tggcttagcgttctgttt

SEQ ID NO: 529017 - DNA, 15 bp, Homo sapiens
tgggaatcctggaca

SEQ ID NO: 529018 - DNA, 23 bp, Homo sapiens
tgggagccctgccgaggtgtggc

SEQ ID NO: 529019 - DNA, 22 bp, Homo sapiens
tgggcgccggttccacgtgggg

SEQ ID NO: 529020 - DNA, 17 bp, Homo sapiens
tgggctggcacccactg

SEQ ID NO: 529021 - DNA, 23 bp, Homo sapiens
tggggaggagagagggggagacc

SEQ ID NO: 529022 - DNA, 23 bp, Homo sapiens
tggggagggacacagaggacggc

SEQ ID NO: 529023 - DNA, 21 bp, Homo sapiens
tggggccagcgctgaacagac

SEQ ID NO: 529024 - DNA, 15 bp, Homo sapiens
tgggtgccctgttga

SEQ ID NO: 529025 - DNA, 15 bp, Homo sapiens
tgggtttactctgtg

SEQ ID NO: 529026 - DNA, 20 bp, Homo sapiens
tggtccagggtccagccctc

SEQ ID NO: 529027 - DNA, 12 bp, Homo sapiens
tggtcctgcact

SEQ ID NO: 529028 - DNA, 13 bp, Homo sapiens
tggtcctgcactg

SEQ ID NO: 529029 - DNA, 16 bp, Homo sapiens
tggtctctttctttcc

SEQ ID NO: 529030 - DNA, 20 bp, Homo sapiens
tggtctctttctttccaaag

SEQ ID NO: 529031 - DNA, 19 bp, Homo sapiens
tggtgaggttgtgctgcct

SEQ ID NO: 529032 - DNA, 15 bp, Homo sapiens
tgtaaaaccaggctg

SEQ ID NO: 529033 - DNA, 13 bp, Homo sapiens
tgtaaaactgtga

SEQ ID NO: 529034 - DNA, 19 bp, Homo sapiens
tgtaaaactgtgacattcc

SEQ ID NO: 529035 - DNA, 15 bp, Homo sapiens
tgtaaataaaaatag

SEQ ID NO: 529036 - DNA, 20 bp, Homo sapiens
tgtaaatgatatgtctttaa

SEQ ID NO: 529037 - DNA, 20 bp, Homo sapiens
tgtaaattttataaggctga

SEQ ID NO: 529038 - DNA, 23 bp, Homo sapiens
tgtaatcacactctcttcttact

SEQ ID NO: 529039 - DNA, 18 bp, Homo sapiens
tgtagctagtttaaaatt

SEQ ID NO: 529040 - DNA, 21 bp, Homo sapiens
tgtagctagtttaaaattatt

SEQ ID NO: 529041 - DNA, 13 bp, Homo sapiens
tgtcaaatggatg

SEQ ID NO: 529042 - DNA, 15 bp, Homo sapiens
tgtcaatatatagag

SEQ ID NO: 529043 - DNA, 13 bp, Homo sapiens
tgtcagcttccca

SEQ ID NO: 529044 - DNA, 14 bp, Homo sapiens
tgtcaggctctgaa

SEQ ID NO: 529045 - DNA, 19 bp, Homo sapiens
tgtcaggctctgaatctct

SEQ ID NO: 529046 - DNA, 18 bp, Homo sapiens
tgtcagtttgtgaagtga

SEQ ID NO: 529047 - DNA, 14 bp, Homo sapiens
tgtcatctgtcagc

SEQ ID NO: 529048 - DNA, 14 bp, Homo sapiens
tgtccctgcagggc

SEQ ID NO: 529049 - DNA, 20 bp, Homo sapiens
tgtccctgtgggctcacacc

SEQ ID NO: 529050 - DNA, 22 bp, Homo sapiens
tgtcctaaatgcaaagcacacc

SEQ ID NO: 529051 - DNA, 15 bp, Homo sapiens
tgtcctatccccgga

SEQ ID NO: 529052 - DNA, 16 bp, Homo sapiens
tgtcctatccccggac

SEQ ID NO: 529053 - DNA, 21 bp, Homo sapiens
tgtcctatccccggacgcatg

SEQ ID NO: 529054 - DNA, 16 bp, Homo sapiens
tgtcctatccctggac

SEQ ID NO: 529055 - DNA, 17 bp, Homo sapiens
tgtcctgtgtcatctgt

SEQ ID NO: 529056 - DNA, 19 bp, Homo sapiens
tgtcctgtgtcatctgtca

SEQ ID NO: 529057 - DNA, 21 bp, Homo sapiens
tgtctctacaaaaaaaatcaa

SEQ ID NO: 529058 - DNA, 11 bp, Homo sapiens
tgtctttaaaa

SEQ ID NO: 529059 - DNA, 17 bp, Homo sapiens
tgtcttttgttctctct

SEQ ID NO: 529060 - DNA, 17 bp, Homo sapiens
tgtgaagtgattgacat

SEQ ID NO: 529061 - DNA, 16 bp, Homo sapiens
tgtgacattccacaga

SEQ ID NO: 529062 - DNA, 22 bp, Homo sapiens
tgtgagataaatatcattatag

SEQ ID NO: 529063 - DNA, 13 bp, Homo sapiens
tgtgatttatgca

SEQ ID NO: 529064 - DNA, 16 bp, Homo sapiens
tgtgcactctactctg

SEQ ID NO: 529065 - DNA, 14 bp, Homo sapiens
tgtgcatctggcct

SEQ ID NO: 529066 - DNA, 18 bp, Homo sapiens
tgtgcatctggcctgggg

SEQ ID NO: 529067 - DNA, 16 bp, Homo sapiens
tgtgctaagttgtctt

SEQ ID NO: 529068 - DNA, 15 bp, Homo sapiens
tgtgctgctgtggca

SEQ ID NO: 529069 - DNA, 14 bp, Homo sapiens
tgtgcttgttcttc

SEQ ID NO: 529070 - DNA, 16 bp, Homo sapiens
tgtgcttgttcttcct

SEQ ID NO: 529071 - DNA, 20 bp, Homo sapiens
tgtgggtttactctgtgcta

SEQ ID NO: 529072 - DNA, 22 bp, Homo sapiens
tgtggtgaggtcctgtcctggc

SEQ ID NO: 529073 - DNA, 18 bp, Homo sapiens
tgtgtcctaaatgcaaag

SEQ ID NO: 529074 - DNA, 18 bp, Homo sapiens
tgtgtctccagctgattt

SEQ ID NO: 529075 - DNA, 18 bp, Homo sapiens
tgtgtgggtttactctgt

SEQ ID NO: 529076 - DNA, 15 bp, Homo sapiens
tgttagctcagagga

SEQ ID NO: 529077 - DNA, 24 bp, Homo sapiens
tgttagctcagaggagaggagcaa

SEQ ID NO: 529078 - DNA, 14 bp, Homo sapiens
tgttataaaatctg

SEQ ID NO: 529079 - DNA, 22 bp, Homo sapiens
tgttatcagtacaattctttgt

SEQ ID NO: 529080 - DNA, 19 bp, Homo sapiens
tgttcaccttctgtgcatc

SEQ ID NO: 529081 - DNA, 12 bp, Homo sapiens
tgttctctcttg

SEQ ID NO: 529082 - DNA, 16 bp, Homo sapiens
tgttctgacagcattt

SEQ ID NO: 529083 - DNA, 19 bp, Homo sapiens
tgttcttgtaaaactgtga

SEQ ID NO: 529084 - DNA, 20 bp, Homo sapiens
tgttcttgtaaaactgtgac

SEQ ID NO: 529085 - DNA, 21 bp, Homo sapiens
tgttcttgtaaaactgtgaca

SEQ ID NO: 529086 - DNA, 16 bp, Homo sapiens
tgttgattctttcaat

SEQ ID NO: 529087 - DNA, 22 bp, Homo sapiens
tgttgattctttcaatccacag

SEQ ID NO: 529088 - DNA, 19 bp, Homo sapiens
tgttgcttaatctagagct

SEQ ID NO: 529089 - DNA, 15 bp, Homo sapiens
tgttgtccctgcagg

SEQ ID NO: 529090 - DNA, 16 bp, Homo sapiens
tgtttgaattgatttt

SEQ ID NO: 529091 - DNA, 21 bp, Homo sapiens
tgtttgaattgatttttaaac

SEQ ID NO: 529092 - DNA, 15 bp, Homo sapiens
tgtttgctgcttttg

SEQ ID NO: 529093 - DNA, 16 bp, Homo sapiens
ttaaaaaaaaaaatga

SEQ ID NO: 529094 - DNA, 20 bp, Homo sapiens
ttaaaaaaataatataaatg

SEQ ID NO: 529095 - DNA, 21 bp, Homo sapiens
ttaaaaaaataatataaatga

SEQ ID NO: 529096 - DNA, 20 bp, Homo sapiens
ttaaaaaagatggatttgac

SEQ ID NO: 529097 - DNA, 13 bp, Homo sapiens
ttaaaaattatag

SEQ ID NO: 529098 - DNA, 23 bp, Homo sapiens
ttaaaatcatatttacctgtgaa

SEQ ID NO: 529099 - DNA, 22 bp, Homo sapiens
ttaatcatttccagcaaaatat

SEQ ID NO: 529100 - DNA, 22 bp, Homo sapiens
ttaatctagagctatgcacacc

SEQ ID NO: 529101 - DNA, 20 bp, Homo sapiens
ttacaaatgatttcgtgact

SEQ ID NO: 529102 - DNA, 23 bp, Homo sapiens
ttacacttctcaaatgctactca

SEQ ID NO: 529103 - DNA, 11 bp, Homo sapiens
ttacagctgaa

SEQ ID NO: 529104 - DNA, 17 bp, Homo sapiens
ttacataacaggcattg

SEQ ID NO: 529105 - DNA, 17 bp, Homo sapiens
ttacctattgctgtaaa

SEQ ID NO: 529106 - DNA, 20 bp, Homo sapiens
ttacctgtaatagcctcacc

SEQ ID NO: 529107 - DNA, 18 bp, Homo sapiens
ttagaatcaagtctgtga

SEQ ID NO: 529108 - DNA, 13 bp, Homo sapiens
ttagaatgttgaa

SEQ ID NO: 529109 - DNA, 23 bp, Homo sapiens
ttagacaatgtggaattacataa

SEQ ID NO: 529110 - DNA, 15 bp, Homo sapiens
ttagagagcagtggc

SEQ ID NO: 529111 - DNA, 17 bp, Homo sapiens
ttagattcctacttaaa

SEQ ID NO: 529112 - DNA, 22 bp, Homo sapiens
ttagattcctacttaaacaaaa

SEQ ID NO: 529113 - DNA, 19 bp, Homo sapiens
ttagcaccagcttgcttct

SEQ ID NO: 529114 - DNA, 21 bp, Homo sapiens
ttagctagttagagactcgcc

SEQ ID NO: 529115 - DNA, 15 bp, Homo sapiens
ttaggagttttgaga

SEQ ID NO: 529116 - DNA, 15 bp, Homo sapiens
ttagggctctaattt

SEQ ID NO: 529117 - DNA, 13 bp, Homo sapiens
ttagtagctgata

SEQ ID NO: 529118 - DNA, 17 bp, Homo sapiens
ttataaggctgactctt

SEQ ID NO: 529119 - DNA, 21 bp, Homo sapiens
ttataaggctgactcttacta

SEQ ID NO: 529120 - DNA, 12 bp, Homo sapiens
ttatctttaaaa

SEQ ID NO: 529121 - DNA, 14 bp, Homo sapiens
ttatgatttcatga

SEQ ID NO: 529122 - DNA, 18 bp, Homo sapiens
ttatgcatttatgcatga

SEQ ID NO: 529123 - DNA, 16 bp, Homo sapiens
ttattcattagctgtg

SEQ ID NO: 529124 - DNA, 16 bp, Homo sapiens
ttcaacttcaggaaag

SEQ ID NO: 529125 - DNA, 22 bp, Homo sapiens
ttcaatccacagtattgttctt

SEQ ID NO: 529126 - DNA, 12 bp, Homo sapiens
ttcacattcctg

SEQ ID NO: 529127 - DNA, 14 bp, Homo sapiens
ttcacgcaacttga

SEQ ID NO: 529128 - DNA, 22 bp, Homo sapiens
ttcacgcaacttgaaattatat

SEQ ID NO: 529129 - DNA, 22 bp, Homo sapiens
ttcagaaacaaagcatttgact

SEQ ID NO: 529130 - DNA, 14 bp, Homo sapiens
ttcagttgacacat

SEQ ID NO: 529131 - DNA, 14 bp, Homo sapiens
ttcatgattagaca

SEQ ID NO: 529132 - DNA, 16 bp, Homo sapiens
ttcatgattagacaat

SEQ ID NO: 529133 - DNA, 17 bp, Homo sapiens
ttcatgcttttctcatg

SEQ ID NO: 529134 - DNA, 14 bp, Homo sapiens
ttcattagctgtga

SEQ ID NO: 529135 - DNA, 13 bp, Homo sapiens
ttcattttctctc

SEQ ID NO: 529136 - DNA, 19 bp, Homo sapiens
ttccagctaagcctgatga

SEQ ID NO: 529137 - DNA, 18 bp, Homo sapiens
ttccatgacagtagcata

SEQ ID NO: 529138 - DNA, 21 bp, Homo sapiens
ttcccaacctcccctggtcct

SEQ ID NO: 529139 - DNA, 20 bp, Homo sapiens
ttcccatggtagactgtgac

SEQ ID NO: 529140 - DNA, 18 bp, Homo sapiens
ttccccatcgccttctgg

SEQ ID NO: 529141 - DNA, 19 bp, Homo sapiens
ttccccatcgccttctggg

SEQ ID NO: 529142 - DNA, 11 bp, Homo sapiens
aaaaaaatcaa

SEQ ID NO: 529143 - DNA, 13 bp, Homo sapiens
aaaaactttccat

SEQ ID NO: 529144 - DNA, 15 bp, Homo sapiens
aaaaactttccatga

SEQ ID NO: 529145 - DNA, 17 bp, Homo sapiens
aaaaactttccatgaca

SEQ ID NO: 529146 - DNA, 20 bp, Homo sapiens
aaaaactttccatgacagta

SEQ ID NO: 529147 - DNA, 24 bp, Homo sapiens
aaaaactttccatgacagtagcat

SEQ ID NO: 529148 - DNA, 21 bp, Homo sapiens
aaaaagatggatttgacacac

SEQ ID NO: 529149 - DNA, 22 bp, Homo sapiens
aaaaagatggatttgacacact

SEQ ID NO: 529150 - DNA, 15 bp, Homo sapiens
aaaaattatctttaa

SEQ ID NO: 529151 - DNA, 14 bp, Homo sapiens
aaaacaaaatcctt

SEQ ID NO: 529152 - DNA, 23 bp, Homo sapiens
aaaacaaaatccttgccttcaaa

SEQ ID NO: 529153 - DNA, 22 bp, Homo sapiens
aaaacaacagcaacaacaacag

SEQ ID NO: 529154 - DNA, 17 bp, Homo sapiens
aaaactggaataagaag

SEQ ID NO: 529155 - DNA, 21 bp, Homo sapiens
aaaactggaataagaagcaaa

SEQ ID NO: 529156 - DNA, 17 bp, Homo sapiens
aaaactgtgacattcca

SEQ ID NO: 529157 - DNA, 21 bp, Homo sapiens
aaaactgtgacattccacaga

SEQ ID NO: 529158 - DNA, 21 bp, Homo sapiens
aaaactttccatgacagtagc

SEQ ID NO: 529159 - DNA, 13 bp, Homo sapiens
aaaagacttcaaa

SEQ ID NO: 529160 - DNA, 12 bp, Homo sapiens
aaaagtgatgtg

SEQ ID NO: 529161 - DNA, 17 bp, Homo sapiens
aaaagtgatgtgattta

SEQ ID NO: 529162 - DNA, 22 bp, Homo sapiens
aaaagtgatgtgatttatgcat

SEQ ID NO: 529163 - DNA, 16 bp, Homo sapiens
aaaagtgcagtagtgt

SEQ ID NO: 529164 - DNA, 18 bp, Homo sapiens
aaaatccttgccttcaaa

SEQ ID NO: 529165 - DNA, 18 bp, Homo sapiens
aaaatgtgccgtctttgg

SEQ ID NO: 529166 - DNA, 15 bp, Homo sapiens
aaaatgtgtgcttgg

SEQ ID NO: 529167 - DNA, 19 bp, Homo sapiens
aaaatgtgtgcttggaaaa

SEQ ID NO: 529168 - DNA, 22 bp, Homo sapiens
aaaattgaagagagatatatct

SEQ ID NO: 529169 - DNA, 19 bp, Homo sapiens
aaaattttattgaatataa

SEQ ID NO: 529170 - DNA, 18 bp, Homo sapiens
aaacaaaaactttccatg

SEQ ID NO: 529171 - DNA, 21 bp, Homo sapiens
aaacaaaaactttccatgaca

SEQ ID NO: 529172 - DNA, 13 bp, Homo sapiens
aaacaacagcaac

SEQ ID NO: 529173 - DNA, 19 bp, Homo sapiens
aaaccttgctgctatgctg

SEQ ID NO: 529174 - DNA, 18 bp, Homo sapiens
aaactgcgtaggagagaa

SEQ ID NO: 529175 - DNA, 15 bp, Homo sapiens
aatatgagattggaa

SEQ ID NO: 529176 - DNA, 16 bp, Homo sapiens
aatcaaaaaattatct

SEQ ID NO: 529177 - DNA, 13 bp, Homo sapiens
aatcataatcatc

SEQ ID NO: 529178 - DNA, 14 bp, Homo sapiens
aatccacagtattg

SEQ ID NO: 529179 - DNA, 19 bp, Homo sapiens
aatccatgtgctgctgtgg

SEQ ID NO: 529180 - DNA, 17 bp, Homo sapiens
aatctagagctatgcac

SEQ ID NO: 529181 - DNA, 19 bp, Homo sapiens
aatctagagctatgcacac

SEQ ID NO: 529182 - DNA, 22 bp, Homo sapiens
aatctctcaaaatgtgccgtct

SEQ ID NO: 529183 - DNA, 12 bp, Homo sapiens
aatgaaatactt

SEQ ID NO: 529184 - DNA, 16 bp, Homo sapiens
aatgaaatacttgaca

SEQ ID NO: 529185 - DNA, 12 bp, Homo sapiens
aatgaatgaaat

SEQ ID NO: 529186 - DNA, 13 bp, Homo sapiens
aatgaatgaaata

SEQ ID NO: 529187 - DNA, 23 bp, Homo sapiens
aatgaatgaaatataaactgtga

SEQ ID NO: 529188 - DNA, 15 bp, Homo sapiens
aatgcctaataaaca

SEQ ID NO: 529189 - DNA, 16 bp, Homo sapiens
aatgcctaataaacaa

SEQ ID NO: 529190 - DNA, 14 bp, Homo sapiens
aatgctcaatgtgc

SEQ ID NO: 529191 - DNA, 15 bp, Homo sapiens
aatgctcaatgtgct

SEQ ID NO: 529192 - DNA, 16 bp, Homo sapiens
aatgctcaatgtgctg

SEQ ID NO: 529193 - DNA, 15 bp, Homo sapiens
aatggatgtaatata

SEQ ID NO: 529194 - DNA, 13 bp, Homo sapiens
aatggcctcttaa

SEQ ID NO: 529195 - DNA, 20 bp, Homo sapiens
aatggcctcttaaaaattat

SEQ ID NO: 529196 - DNA, 22 bp, Homo sapiens
aatgtgctgttgattctttcaa

SEQ ID NO: 529197 - DNA, 21 bp, Homo sapiens
aatgtggaattacataacagg

SEQ ID NO: 529198 - DNA, 16 bp, Homo sapiens
aatgtgtgcttggaaa

SEQ ID NO: 529199 - DNA, 23 bp, Homo sapiens
aatgttgaagaactcatgtgatt

SEQ ID NO: 529200 - DNA, 17 bp, Homo sapiens
aattaaaacaaaatcct

SEQ ID NO: 529201 - DNA, 20 bp, Homo sapiens
aattaaacaaattccttccc

SEQ ID NO: 529202 - DNA, 14 bp, Homo sapiens
aattaaatgaaata

SEQ ID NO: 529203 - DNA, 15 bp, Homo sapiens
aattaaatgaaatac

SEQ ID NO: 529204 - DNA, 13 bp, Homo sapiens
aattacataacag

SEQ ID NO: 529205 - DNA, 18 bp, Homo sapiens
aattacataacaggcatt

SEQ ID NO: 529206 - DNA, 20 bp, Homo sapiens
aattatgaagccctaagtaa

SEQ ID NO: 529207 - DNA, 18 bp, Homo sapiens
aattattaaaaattatag

SEQ ID NO: 529208 - DNA, 17 bp, Homo sapiens
aattattagcaccagct

SEQ ID NO: 529209 - DNA, 14 bp, Homo sapiens
aattcaaagaatca

SEQ ID NO: 529210 - DNA, 15 bp, Homo sapiens
aattcacaaagttaa

SEQ ID NO: 529211 - DNA, 13 bp, Homo sapiens
aattgctgagatg

SEQ ID NO: 529212 - DNA, 15 bp, Homo sapiens
aattgcttctctaaa

SEQ ID NO: 529213 - DNA, 23 bp, Homo sapiens
aattggcttgtttaaggttcttg

SEQ ID NO: 529214 - DNA, 22 bp, Homo sapiens
aatttaggaatgctcaatgtgc

SEQ ID NO: 529215 - DNA, 16 bp, Homo sapiens
aatttcagtaagatca

SEQ ID NO: 529216 - DNA, 20 bp, Homo sapiens
aatttctagatatgagaaat

SEQ ID NO: 529217 - DNA, 17 bp, Homo sapiens
acaaaaactttccatga

SEQ ID NO: 529218 - DNA, 12 bp, Homo sapiens
acaaagaaatat

SEQ ID NO: 529219 - DNA, 12 bp, Homo sapiens
acaaagcatgct

SEQ ID NO: 529220 - DNA, 18 bp, Homo sapiens
atggccaggcctcaggga

SEQ ID NO: 529221 - DNA, 17 bp, Homo sapiens
atggctgttatctgtct

SEQ ID NO: 529222 - DNA, 21 bp, Homo sapiens
atggcttccccattgccttct

SEQ ID NO: 529223 - DNA, 18 bp, Homo sapiens
atggtagaaattttatct

SEQ ID NO: 529224 - DNA, 17 bp, Homo sapiens
atggtatatattttgaa

SEQ ID NO: 529225 - DNA, 13 bp, Homo sapiens
atggtatctcttt

SEQ ID NO: 529226 - DNA, 16 bp, Homo sapiens
atggtgctgggtcctt

SEQ ID NO: 529227 - DNA, 21 bp, Homo sapiens
atggttacctctgcataaata

SEQ ID NO: 529228 - DNA, 18 bp, Homo sapiens
atgtccaggtcacaggca

SEQ ID NO: 529229 - DNA, 22 bp, Homo sapiens
atgtctcaccaggaaattctgt

SEQ ID NO: 529230 - DNA, 13 bp, Homo sapiens
atgtctttaaaat

SEQ ID NO: 529231 - DNA, 16 bp, Homo sapiens
atgtctttaaaatgat

SEQ ID NO: 529232 - DNA, 18 bp, Homo sapiens
atgtctttctccaaagtt

SEQ ID NO: 529233 - DNA, 13 bp, Homo sapiens
atgtgatttatgc

SEQ ID NO: 529234 - DNA, 14 bp, Homo sapiens
atgtgccgtctttg

SEQ ID NO: 529235 - DNA, 23 bp, Homo sapiens
atgtgccgtctttggttcctcat

SEQ ID NO: 529236 - DNA, 17 bp, Homo sapiens
atgtgctcatcagaaac

SEQ ID NO: 529237 - DNA, 22 bp, Homo sapiens
atgtgctgttgattctttcaat

SEQ ID NO: 529238 - DNA, 14 bp, Homo sapiens
atgtggaattacat

SEQ ID NO: 529239 - DNA, 18 bp, Homo sapiens
atgtggatggaggtgatg

SEQ ID NO: 529240 - DNA, 19 bp, Homo sapiens
atgttaattgatagaataa

SEQ ID NO: 529241 - DNA, 16 bp, Homo sapiens
atgttgtcctgtgtca

SEQ ID NO: 529242 - DNA, 18 bp, Homo sapiens
atgttgtcctgtgtcatc

SEQ ID NO: 529243 - DNA, 23 bp, Homo sapiens
atgttgtcctgtgtcatctgtca

SEQ ID NO: 529244 - DNA, 21 bp, Homo sapiens
atgttttccccaattatcctc

SEQ ID NO: 529245 - DNA, 17 bp, Homo sapiens
attaaaaagttaatctt

SEQ ID NO: 529246 - DNA, 13 bp, Homo sapiens
attaaaaattata

SEQ ID NO: 529247 - DNA, 15 bp, Homo sapiens
attaaaaattataga

SEQ ID NO: 529248 - DNA, 15 bp, Homo sapiens
attaaatgaaatact

SEQ ID NO: 529249 - DNA, 18 bp, Homo sapiens
attaacttctattttcaa

SEQ ID NO: 529250 - DNA, 20 bp, Homo sapiens
attaacttctattttcaagt

SEQ ID NO: 529251 - DNA, 12 bp, Homo sapiens
attaagaaaccc

SEQ ID NO: 529252 - DNA, 12 bp, Homo sapiens
attagcaccagc

SEQ ID NO: 529253 - DNA, 22 bp, Homo sapiens
attagctgtgatttttgttgat

SEQ ID NO: 529254 - DNA, 16 bp, Homo sapiens
attaggtttagaatca

SEQ ID NO: 529255 - DNA, 13 bp, Homo sapiens
attatagcatgta

SEQ ID NO: 529256 - DNA, 18 bp, Homo sapiens
attatatctgtggtcttc

SEQ ID NO: 529257 - DNA, 15 bp, Homo sapiens
attatctttaaaact

SEQ ID NO: 529258 - DNA, 17 bp, Homo sapiens
attattaaaaattatag

SEQ ID NO: 529259 - DNA, 13 bp, Homo sapiens
cacataacacaca

SEQ ID NO: 529260 - DNA, 17 bp, Homo sapiens
cacattgcacacacagt

SEQ ID NO: 529261 - DNA, 20 bp, Homo sapiens
cacattgcacacacagtctg

SEQ ID NO: 529262 - DNA, 12 bp, Homo sapiens
cacccagcctgg

SEQ ID NO: 529263 - DNA, 15 bp, Homo sapiens
cacccccattgtgaa

SEQ ID NO: 529264 - DNA, 15 bp, Homo sapiens
caccggcactgtgca

SEQ ID NO: 529265 - DNA, 18 bp, Homo sapiens
cacctaaagggaagccct

SEQ ID NO: 529266 - DNA, 14 bp, Homo sapiens
cacctgcttctcag

SEQ ID NO: 529267 - DNA, 13 bp, Homo sapiens
caccttctgtttt

SEQ ID NO: 529268 - DNA, 15 bp, Homo sapiens
cacgcaacttgaaat

SEQ ID NO: 529269 - DNA, 20 bp, Homo sapiens
cacggtccaatccagccttc

SEQ ID NO: 529270 - DNA, 19 bp, Homo sapiens
cacggtcctttgagtgtca

SEQ ID NO: 529271 - DNA, 17 bp, Homo sapiens
cactctgcctggccttg

SEQ ID NO: 529272 - DNA, 14 bp, Homo sapiens
cactgaagagtatg

SEQ ID NO: 529273 - DNA, 14 bp, Homo sapiens
cactgccctccgcc

SEQ ID NO: 529274 - DNA, 23 bp, Homo sapiens
cactgccctctgccactgacagg

SEQ ID NO: 529275 - DNA, 19 bp, Homo sapiens
cactgggtgtggcctggct

SEQ ID NO: 529276 - DNA, 19 bp, Homo sapiens
cactgtcccggagctcagg

SEQ ID NO: 529277 - DNA, 14 bp, Homo sapiens
cactgtctgctgcc

SEQ ID NO: 529278 - DNA, 15 bp, Homo sapiens
cacttgggctggcac

SEQ ID NO: 529279 - DNA, 19 bp, Homo sapiens
cacttgggctggcacccac

SEQ ID NO: 529280 - DNA, 20 bp, Homo sapiens
cacttgggctggcacccact

SEQ ID NO: 529281 - DNA, 15 bp, Homo sapiens
cacttttctcatctg

SEQ ID NO: 529282 - DNA, 15 bp, Homo sapiens
cagaacgcatgcagg

SEQ ID NO: 529283 - DNA, 19 bp, Homo sapiens
cagaagctcaaggctgcag

SEQ ID NO: 529284 - DNA, 14 bp, Homo sapiens
cagaagtgaaaaag

SEQ ID NO: 529285 - DNA, 18 bp, Homo sapiens
cagaccacgcccctgcct

SEQ ID NO: 529286 - DNA, 13 bp, Homo sapiens
cagaggagaggag

SEQ ID NO: 529287 - DNA, 19 bp, Homo sapiens
cagaggcattggaggatgg

SEQ ID NO: 529288 - DNA, 17 bp, Homo sapiens
cagagggttgtgatttt

SEQ ID NO: 529289 - DNA, 13 bp, Homo sapiens
cagatccatcggt

SEQ ID NO: 529290 - DNA, 17 bp, Homo sapiens
cagcaaaatatatgttt

SEQ ID NO: 529291 - DNA, 14 bp, Homo sapiens
cagcaacaacaaca

SEQ ID NO: 529292 - DNA, 18 bp, Homo sapiens
cagcatcgtgtgggtccc

SEQ ID NO: 529293 - DNA, 19 bp, Homo sapiens
cagccctccgccagccctg

SEQ ID NO: 529294 - DNA, 20 bp, Homo sapiens
cagccctccgccagccctgt

SEQ ID NO: 529295 - DNA, 21 bp, Homo sapiens
cagccctgttccgcctcactg

SEQ ID NO: 529296 - DNA, 15 bp, Homo sapiens
cagcctgcacagtgg

SEQ ID NO: 529297 - DNA, 23 bp, Homo sapiens
cagcctgcacagtggtccagggt

SEQ ID NO: 529298 - DNA, 17 bp, Homo sapiens
cagctaagcctgatgat

SEQ ID NO: 529299 - DNA, 20 bp, Homo sapiens
cagctgcagttagcacagag

SEQ ID NO: 529300 - DNA, 23 bp, Homo sapiens
cagcttagaagttcgaaaactca

SEQ ID NO: 529301 - DNA, 17 bp, Homo sapiens
cagcttcccaacaatac

SEQ ID NO: 529302 - DNA, 15 bp, Homo sapiens
caggaaaggaagatg

SEQ ID NO: 529303 - DNA, 19 bp, Homo sapiens
caggacgcatgcagggccc

SEQ ID NO: 529304 - DNA, 16 bp, Homo sapiens
caggagcatgtcctat

SEQ ID NO: 529305 - DNA, 14 bp, Homo sapiens
caggagcgtgtcct

SEQ ID NO: 529306 - DNA, 17 bp, Homo sapiens
caggatgcatgcagggc

SEQ ID NO: 529307 - DNA, 19 bp, Homo sapiens
caggatgcatgcagggccc

SEQ ID NO: 529308 - DNA, 17 bp, Homo sapiens
caggcaccatgctgggc

SEQ ID NO: 529309 - DNA, 15 bp, Homo sapiens
caggcacggaggctc

SEQ ID NO: 529310 - DNA, 13 bp, Homo sapiens
caggcctcaggga

SEQ ID NO: 529311 - DNA, 20 bp, Homo sapiens
caggctgatgccgtgcgggc

SEQ ID NO: 529312 - DNA, 13 bp, Homo sapiens
cagggacagcctg

SEQ ID NO: 529313 - DNA, 19 bp, Homo sapiens
cagggaccaaggagatggg

SEQ ID NO: 529314 - DNA, 16 bp, Homo sapiens
cagggagtggggagga

SEQ ID NO: 529315 - DNA, 17 bp, Homo sapiens
cagggcaatcaatgttc

SEQ ID NO: 529316 - DNA, 18 bp, Homo sapiens
cagggcccccacaggagc

SEQ ID NO: 529317 - DNA, 17 bp, Homo sapiens
cagggcccccatgcagg

SEQ ID NO: 529318 - DNA, 13 bp, Homo sapiens
cagggctgtgctt

SEQ ID NO: 529319 - DNA, 14 bp, Homo sapiens
cagggtccagccct

SEQ ID NO: 529320 - DNA, 16 bp, Homo sapiens
cagggtccagccctcc

SEQ ID NO: 529321 - DNA, 22 bp, Homo sapiens
cagggtccagccctccgccagc

SEQ ID NO: 529322 - DNA, 17 bp, Homo sapiens
cagtaaatgtatattga

SEQ ID NO: 529323 - DNA, 20 bp, Homo sapiens
ccagctgcaggaatcaaaaa

SEQ ID NO: 529324 - DNA, 23 bp, Homo sapiens
ccagctgcaggaatcaaaaattg

SEQ ID NO: 529325 - DNA, 15 bp, Homo sapiens
ccagcttgcttctct

SEQ ID NO: 529326 - DNA, 16 bp, Homo sapiens
ccagcttgcttctctg

SEQ ID NO: 529327 - DNA, 20 bp, Homo sapiens
ccaggaagtcatcctgcaat

SEQ ID NO: 529328 - DNA, 18 bp, Homo sapiens
ccaggcacggaggctcgt

SEQ ID NO: 529329 - DNA, 18 bp, Homo sapiens
ccagggagtggggaggag

SEQ ID NO: 529330 - DNA, 20 bp, Homo sapiens
ccagggggcaaggagaaagc

SEQ ID NO: 529331 - DNA, 15 bp, Homo sapiens
ccaggtcacaggcat

SEQ ID NO: 529332 - DNA, 14 bp, Homo sapiens
ccagttctgatgag

SEQ ID NO: 529333 - DNA, 20 bp, Homo sapiens
ccatgcaggcagcctgcaga

SEQ ID NO: 529334 - DNA, 13 bp, Homo sapiens
ccatgccaatgtc

SEQ ID NO: 529335 - DNA, 11 bp, Homo sapiens
ccatgctgggc

SEQ ID NO: 529336 - DNA, 24 bp, Homo sapiens
ccatgctgggccggggtgtggaat

SEQ ID NO: 529337 - DNA, 15 bp, Homo sapiens
ccatgctgtccctgt

SEQ ID NO: 529338 - DNA, 17 bp, Homo sapiens
ccatgctgtccctgtgg

SEQ ID NO: 529339 - DNA, 19 bp, Homo sapiens
ccatgctgtccctgtgggc

SEQ ID NO: 529340 - DNA, 20 bp, Homo sapiens
ccatggattcccctggacat

SEQ ID NO: 529341 - DNA, 11 bp, Homo sapiens
ccattcctgag

SEQ ID NO: 529342 - DNA, 22 bp, Homo sapiens
ccatttagtcctcaccttctgt

SEQ ID NO: 529343 - DNA, 18 bp, Homo sapiens
ccatttcacattcctgac

SEQ ID NO: 529344 - DNA, 14 bp, Homo sapiens
ccatttcccctgtg

SEQ ID NO: 529345 - DNA, 20 bp, Homo sapiens
cccaacaatactttgtgtct

SEQ ID NO: 529346 - DNA, 17 bp, Homo sapiens
cccacaggagcatgtcc

SEQ ID NO: 529347 - DNA, 21 bp, Homo sapiens
cccacctaaagggaagccctg

SEQ ID NO: 529348 - DNA, 20 bp, Homo sapiens
cccagaagctcaaggctgca

SEQ ID NO: 529349 - DNA, 17 bp, Homo sapiens
cccaggacgcatgcagg

SEQ ID NO: 529350 - DNA, 20 bp, Homo sapiens
cccaggacgcatgcagggcc

SEQ ID NO: 529351 - DNA, 23 bp, Homo sapiens
cccaggatgaaggggccagacca

SEQ ID NO: 529352 - DNA, 23 bp, Homo sapiens
cccaggatgcatgcagggccccc

SEQ ID NO: 529353 - DNA, 18 bp, Homo sapiens
cccaggggcactgtgttc

SEQ ID NO: 529354 - DNA, 14 bp, Homo sapiens
cccagggtcccctg

SEQ ID NO: 529355 - DNA, 21 bp, Homo sapiens
cccagggtcccctgcatggct

SEQ ID NO: 529356 - DNA, 23 bp, Homo sapiens
cccaggtgttgtccgtgtctgtt

SEQ ID NO: 529357 - DNA, 18 bp, Homo sapiens
cctacttaaacaaaaact

SEQ ID NO: 529358 - DNA, 20 bp, Homo sapiens
cctacttaaacaaaaacttt

SEQ ID NO: 529359 - DNA, 15 bp, Homo sapiens
cctatcatcagttag

SEQ ID NO: 529360 - DNA, 23 bp, Homo sapiens
cctatctggaaaaaaaaaaatat

SEQ ID NO: 529361 - DNA, 21 bp, Homo sapiens
cctattgctgtaaataaaaat

SEQ ID NO: 529362 - DNA, 24 bp, Homo sapiens
cctattgctgtaaataaaaatagc

SEQ ID NO: 529363 - DNA, 20 bp, Homo sapiens
cctattttggacgtgtgagg

SEQ ID NO: 529364 - DNA, 21 bp, Homo sapiens
cctcactgggtgtggcctggc

SEQ ID NO: 529365 - DNA, 17 bp, Homo sapiens
cctcagggaccaaggag

SEQ ID NO: 529366 - DNA, 23 bp, Homo sapiens
cctcagggaccaaggagatgggg

SEQ ID NO: 529367 - DNA, 13 bp, Homo sapiens
cctccaaatgctg

SEQ ID NO: 529368 - DNA, 10 bp, Homo sapiens
cctccagggc

SEQ ID NO: 529369 - DNA, 16 bp, Homo sapiens
cctccagttctgatga

SEQ ID NO: 529370 - DNA, 16 bp, Homo sapiens
cctccatgctgtccct

SEQ ID NO: 529371 - DNA, 22 bp, Homo sapiens
cctccatgctgtccctgtgggc

SEQ ID NO: 529372 - DNA, 12 bp, Homo sapiens
cctccccctcct

SEQ ID NO: 529373 - DNA, 14 bp, Homo sapiens
cctcccctggaagt

SEQ ID NO: 529374 - DNA, 14 bp, Homo sapiens
cctcccctggtcct

SEQ ID NO: 529375 - DNA, 22 bp, Homo sapiens
cctcccctggtcctgcactgtc

SEQ ID NO: 529376 - DNA, 15 bp, Homo sapiens
cctccctccctgctc

SEQ ID NO: 529377 - DNA, 14 bp, Homo sapiens
cctccgcccttccc

SEQ ID NO: 529378 - DNA, 12 bp, Homo sapiens
cctcctccatgc

SEQ ID NO: 529379 - DNA, 10 bp, Homo sapiens
cctcctgtct

SEQ ID NO: 529380 - DNA, 15 bp, Homo sapiens
cctcctgtctcctct

SEQ ID NO: 529381 - DNA, 17 bp, Homo sapiens
cctcctgtctcctctgt

SEQ ID NO: 529382 - DNA, 20 bp, Homo sapiens
cctcggtggcatttgctgaa

SEQ ID NO: 529383 - DNA, 15 bp, Homo sapiens
cctctcttctgactg

SEQ ID NO: 529384 - DNA, 22 bp, Homo sapiens
cctctgtcagtttgtgaagtga

SEQ ID NO: 529385 - DNA, 20 bp, Homo sapiens
cctgacactgtctgctgccc

SEQ ID NO: 529386 - DNA, 16 bp, Homo sapiens
cctgatggccaggcct

SEQ ID NO: 529387 - DNA, 16 bp, Homo sapiens
cctgcacagtggtcca

SEQ ID NO: 529388 - DNA, 20 bp, Homo sapiens
cctgcactgtcccggagctc

SEQ ID NO: 529389 - DNA, 23 bp, Homo sapiens
cctgcctggaggagaaggaggaa

SEQ ID NO: 529390 - DNA, 11 bp, Homo sapiens
cctgctccctg

SEQ ID NO: 529391 - DNA, 13 bp, Homo sapiens
cctgctccctgct

SEQ ID NO: 529392 - DNA, 12 bp, Homo sapiens
cctgctgccagg

SEQ ID NO: 529393 - DNA, 20 bp, Homo sapiens
cctggaagttgtcctttctg

SEQ ID NO: 529394 - DNA, 22 bp, Homo sapiens
cctggaagttgtcctttctgat

SEQ ID NO: 529395 - DNA, 19 bp, Homo sapiens
cctggacgcatgcagggcc

SEQ ID NO: 529396 - DNA, 18 bp, Homo sapiens
cctggatccagctctggg

SEQ ID NO: 529397 - DNA, 20 bp, Homo sapiens
cctggatccagctctgggag

SEQ ID NO: 529398 - DNA, 21 bp, Homo sapiens
cctggatccagctctgggagc

SEQ ID NO: 529399 - DNA, 12 bp, Homo sapiens
cctggccttgag

SEQ ID NO: 529400 - DNA, 18 bp, Homo sapiens
cctggcttctgggacagg

SEQ ID NO: 529401 - DNA, 23 bp, Homo sapiens
cctggcttctgggacaggcacca

SEQ ID NO: 529402 - DNA, 13 bp, Homo sapiens
cctgggggctgct

SEQ ID NO: 529403 - DNA, 18 bp, Homo sapiens
cctgggggctgctgcact

SEQ ID NO: 529404 - DNA, 13 bp, Homo sapiens
cctgtcaatatat

SEQ ID NO: 529405 - DNA, 12 bp, Homo sapiens
cctgtcctggct

SEQ ID NO: 529406 - DNA, 14 bp, Homo sapiens
cctgtcctggctcc

SEQ ID NO: 529407 - DNA, 16 bp, Homo sapiens
cctgtctcctctgtca

SEQ ID NO: 529408 - DNA, 21 bp, Homo sapiens
cctgtctctacaaaaaaaatc

SEQ ID NO: 529409 - DNA, 16 bp, Homo sapiens
cctgtgaactgccagg

SEQ ID NO: 529410 - DNA, 13 bp, Homo sapiens
cctgtgggctcac

SEQ ID NO: 529411 - DNA, 18 bp, Homo sapiens
cctgtggtgaggtcctgt

SEQ ID NO: 529412 - DNA, 12 bp, Homo sapiens
cctgttccgcct

SEQ ID NO: 529413 - DNA, 16 bp, Homo sapiens
cctgttgacctaccct

SEQ ID NO: 529414 - DNA, 18 bp, Homo sapiens
cctgttgacctaccctgg

SEQ ID NO: 529415 - DNA, 20 bp, Homo sapiens
ccttaaaaaatatgctctcc

SEQ ID NO: 529416 - DNA, 17 bp, Homo sapiens
ccttcatgcttttctca

SEQ ID NO: 529417 - DNA, 15 bp, Homo sapiens
ccttcccaacctccc

SEQ ID NO: 529418 - DNA, 17 bp, Homo sapiens
ccttcccaacctcccct

SEQ ID NO: 529419 - DNA, 22 bp, Homo sapiens
ccttctaatccatgtgctgctg

SEQ ID NO: 529420 - DNA, 17 bp, Homo sapiens
ccttctggccgctgcag

SEQ ID NO: 529421 - DNA, 20 bp, Homo sapiens
ccttctggccgctgcagtca

SEQ ID NO: 529422 - DNA, 20 bp, Homo sapiens
ccttctggggaggggctccg

SEQ ID NO: 529423 - DNA, 20 bp, Homo sapiens
ccttctgtgcatctggcctg

SEQ ID NO: 529424 - DNA, 18 bp, Homo sapiens
ccttcttcccccagggtc

SEQ ID NO: 529425 - DNA, 14 bp, Homo sapiens
ccttgggcgggcca

SEQ ID NO: 529426 - DNA, 19 bp, Homo sapiens
ccttgtagacgcacctgct

SEQ ID NO: 529427 - DNA, 22 bp, Homo sapiens
ccttgtagacgcacctgctgag

SEQ ID NO: 529428 - DNA, 18 bp, Homo sapiens
ccttttttaaaaaaaaga

SEQ ID NO: 529429 - DNA, 15 bp, Homo sapiens
cgaacaaaccaagga

SEQ ID NO: 529430 - DNA, 18 bp, Homo sapiens
cgatcatatctgtatgcc

SEQ ID NO: 529431 - DNA, 13 bp, Homo sapiens
cgatccccatgga

SEQ ID NO: 529432 - DNA, 22 bp, Homo sapiens
cgcaaggatcacttgagcccag

SEQ ID NO: 529433 - DNA, 13 bp, Homo sapiens
cgccagccctgtt

SEQ ID NO: 529434 - DNA, 20 bp, Homo sapiens
cgccagccctgttccgcctc

SEQ ID NO: 529435 - DNA, 22 bp, Homo sapiens
cgcccacctaaagggaagccct

SEQ ID NO: 529436 - DNA, 13 bp, Homo sapiens
cgcccctgcctga

SEQ ID NO: 529437 - DNA, 17 bp, Homo sapiens
cgcccctgcctgagacc

SEQ ID NO: 529438 - DNA, 23 bp, Homo sapiens
cgcccttccctgacactgtctgc

SEQ ID NO: 529439 - DNA, 12 bp, Homo sapiens
cgcctcactggg

SEQ ID NO: 529440 - DNA, 20 bp, Homo sapiens
cgcctgggaaattgctccat

SEQ ID NO: 529441 - DNA, 15 bp, Homo sapiens
cgcgtggttctgcca

SEQ ID NO: 529442 - DNA, 14 bp, Homo sapiens
cgctgaacagaccg

SEQ ID NO: 529443 - DNA, 15 bp, Homo sapiens
cggacgcatgcaggg

SEQ ID NO: 529444 - DNA, 19 bp, Homo sapiens
cggacgggggagctttccc

SEQ ID NO: 529445 - DNA, 20 bp, Homo sapiens
cggacgggggagctttccca

SEQ ID NO: 529446 - DNA, 15 bp, Homo sapiens
cggaggcaggaccag

SEQ ID NO: 529447 - DNA, 15 bp, Homo sapiens
cggcactgtgcactc

SEQ ID NO: 529448 - DNA, 17 bp, Homo sapiens
cggcccggacgggggag

SEQ ID NO: 529449 - DNA, 22 bp, Homo sapiens
cgggccatttcacattcctgac

SEQ ID NO: 529450 - DNA, 21 bp, Homo sapiens
cgggctccagggagtggggag

SEQ ID NO: 529451 - DNA, 23 bp, Homo sapiens
cggggatggattggcctccaggg

SEQ ID NO: 529452 - DNA, 13 bp, Homo sapiens
cggggctgggcag

SEQ ID NO: 529453 - DNA, 12 bp, Homo sapiens
cggggcttctgg

SEQ ID NO: 529454 - DNA, 16 bp, Homo sapiens
cggggcttctgggcgc

SEQ ID NO: 529455 - DNA, 17 bp, Homo sapiens
cggggcttctgggcgcc

SEQ ID NO: 529456 - DNA, 21 bp, Homo sapiens
cggtcctttgagtgtcaggct

SEQ ID NO: 529457 - DNA, 21 bp, Homo sapiens
cggtgggagccgtcagcctgt

SEQ ID NO: 529458 - DNA, 21 bp, Homo sapiens
cggtgtagggaacggcctgag

SEQ ID NO: 529459 - DNA, 20 bp, Homo sapiens
tttccagctaagcctgatga

SEQ ID NO: 529460 - DNA, 14 bp, Homo sapiens
tttccatgacagta

SEQ ID NO: 529461 - DNA, 19 bp, Homo sapiens
tttccccaattatcctcct

SEQ ID NO: 529462 - DNA, 15 bp, Homo sapiens
tttctagcaattgct

SEQ ID NO: 529463 - DNA, 16 bp, Homo sapiens
tttctagcaattgctt

SEQ ID NO: 529464 - DNA, 17 bp, Homo sapiens
tttcttctctctgtgct

SEQ ID NO: 529465 - DNA, 17 bp, Homo sapiens
tttcttggtatgatcat

SEQ ID NO: 529466 - DNA, 15 bp, Homo sapiens
tttgagtgtcaggct

SEQ ID NO: 529467 - DNA, 17 bp, Homo sapiens
tttgctgcttttgatgg

SEQ ID NO: 529468 - DNA, 15 bp, Homo sapiens
tttggctgaaattat

SEQ ID NO: 529469 - DNA, 19 bp, Homo sapiens
tttggctgaaattatgtca

SEQ ID NO: 529470 - DNA, 19 bp, Homo sapiens
tttggttcctcatggctgt

SEQ ID NO: 529471 - DNA, 21 bp, Homo sapiens
tttggttcctcatggctgtta

SEQ ID NO: 529472 - DNA, 21 bp, Homo sapiens
tttgtacgttaattaaacaaa

SEQ ID NO: 529473 - DNA, 22 bp, Homo sapiens
tttgtatcctccattgtatctt

SEQ ID NO: 529474 - DNA, 18 bp, Homo sapiens
tttgtgaagtgattgaca

SEQ ID NO: 529475 - DNA, 21 bp, Homo sapiens
tttgtgaagtgattgacattt

SEQ ID NO: 529476 - DNA, 15 bp, Homo sapiens
tttgtgcttgttctt

SEQ ID NO: 529477 - DNA, 17 bp, Homo sapiens
tttgttaataaagtgca

SEQ ID NO: 529478 - DNA, 13 bp, Homo sapiens
ttttatctcttct

SEQ ID NO: 529479 - DNA, 17 bp, Homo sapiens
ttttatctcttcttcct

SEQ ID NO: 529480 - DNA, 16 bp, Homo sapiens
ttttcattttctctcc

SEQ ID NO: 529481 - DNA, 13 bp, Homo sapiens
ttttcctgtcaat

SEQ ID NO: 529482 - DNA, 15 bp, Homo sapiens
ttttcttttaatttt

SEQ ID NO: 529483 - DNA, 14 bp, Homo sapiens
ttttgatggctatg

SEQ ID NO: 529484 - DNA, 21 bp, Homo sapiens
ttttgggaaatgctgatttaa

SEQ ID NO: 529485 - DNA, 13 bp, Homo sapiens
ttttgtatcctcc

SEQ ID NO: 529486 - DNA, 19 bp, Homo sapiens
ttttgttgattaaaacatt

SEQ ID NO: 529487 - DNA, 22 bp, Homo sapiens
tttttcctatgaccataaaatt

SEQ ID NO: 529488 - DNA, 22 bp, Homo sapiens
tttttgttcaccttctgtgcat

SEQ ID NO: 529489 - DNA, 23 bp, Homo sapiens
tttttgttcaccttctgtgcatc

SEQ ID NO: 529490 - DNA, 14 bp, Homo sapiens
cgtcagcctgtgaa

SEQ ID NO: 529491 - DNA, 21 bp, Homo sapiens
cgtccctgagggcccttccca

SEQ ID NO: 529492 - DNA, 19 bp, Homo sapiens
cgtctttggttcctcatgg

SEQ ID NO: 529493 - DNA, 12 bp, Homo sapiens
cgtgcagggcca

SEQ ID NO: 529494 - DNA, 17 bp, Homo sapiens
cgtggcaactgtggaag

SEQ ID NO: 529495 - DNA, 13 bp, Homo sapiens
cgtgggctccagg

SEQ ID NO: 529496 - DNA, 17 bp, Homo sapiens
cgtgtcttgtgttgctg

SEQ ID NO: 529497 - DNA, 14 bp, Homo sapiens
cgtgtgcttagaaa

SEQ ID NO: 529498 - DNA, 18 bp, Homo sapiens
cgtgttctcctccaaatg

SEQ ID NO: 529499 - DNA, 13 bp, Homo sapiens
cgttaattaaaca

SEQ ID NO: 529500 - DNA, 14 bp, Homo sapiens
cgttaattaaacaa

SEQ ID NO: 529501 - DNA, 17 bp, Homo sapiens
cgttgttgtccctgcag

SEQ ID NO: 529502 - DNA, 18 bp, Homo sapiens
ctaaatgcctaataaaca

SEQ ID NO: 529503 - DNA, 19 bp, Homo sapiens
ctaaatgcctaataaacaa

SEQ ID NO: 529504 - DNA, 18 bp, Homo sapiens
ctaaattaacttctattt

SEQ ID NO: 529505 - DNA, 17 bp, Homo sapiens
ctaagataattaaatga

SEQ ID NO: 529506 - DNA, 15 bp, Homo sapiens
ctaattaaaaagtta

SEQ ID NO: 529507 - DNA, 14 bp, Homo sapiens
ctaattaatttcag

SEQ ID NO: 529508 - DNA, 15 bp, Homo sapiens
ctactcctccccctc

SEQ ID NO: 529509 - DNA, 18 bp, Homo sapiens
ctactcctccccctcctc

SEQ ID NO: 529510 - DNA, 20 bp, Homo sapiens
ctactcctccccctcctcca

SEQ ID NO: 529511 - DNA, 22 bp, Homo sapiens
ctactctgcgacgatccccatg

SEQ ID NO: 529512 - DNA, 14 bp, Homo sapiens
ctacttaaacaaaa

SEQ ID NO: 529513 - DNA, 16 bp, Homo sapiens
ctagatatgagaaata

SEQ ID NO: 529514 - DNA, 23 bp, Homo sapiens
ctagtaggtctgcacacataaca

SEQ ID NO: 529515 - DNA, 24 bp, Homo sapiens
ctagtaggtctgcacacataacac

SEQ ID NO: 529516 - DNA, 16 bp, Homo sapiens
ctagttagagactcgc

SEQ ID NO: 529517 - DNA, 23 bp, Homo sapiens
ttactctgtgctaagttgtctta

SEQ ID NO: 529518 - DNA, 13 bp, Homo sapiens
ttagacaatgtgg

SEQ ID NO: 529519 - DNA, 14 bp, Homo sapiens
ttaggaatgctcaa

SEQ ID NO: 529520 - DNA, 18 bp, Homo sapiens
ttaggaatgctcaatgtg

SEQ ID NO: 529521 - DNA, 19 bp, Homo sapiens
ttaggaatgctcaatgtgc

SEQ ID NO: 529522 - DNA, 12 bp, Homo sapiens
ttagtgtgattg

SEQ ID NO: 529523 - DNA, 12 bp, Homo sapiens
ttataaaatctg

SEQ ID NO: 529524 - DNA, 19 bp, Homo sapiens
ttatagcatgtaatattaa

SEQ ID NO: 529525 - DNA, 22 bp, Homo sapiens
ttatatctgtggtcttcaaatt

SEQ ID NO: 529526 - DNA, 20 bp, Homo sapiens
ttatctagtaggtctgcaca

SEQ ID NO: 529527 - DNA, 22 bp, Homo sapiens
ttatctagtaggtctgcacaca

SEQ ID NO: 529528 - DNA, 23 bp, Homo sapiens
ttatctagtaggtctgcacacat

SEQ ID NO: 529529 - DNA, 20 bp, Homo sapiens
ttatctgtctttatgatttc

SEQ ID NO: 529530 - DNA, 15 bp, Homo sapiens
ttatggctttgtgct

SEQ ID NO: 529531 - DNA, 15 bp, Homo sapiens
ttattagcaccagct

SEQ ID NO: 529532 - DNA, 13 bp, Homo sapiens
ttattcaataact

SEQ ID NO: 529533 - DNA, 13 bp, Homo sapiens
ttcaaagaatcac

SEQ ID NO: 529534 - DNA, 15 bp, Homo sapiens
ttcaccttctgtgca

SEQ ID NO: 529535 - DNA, 16 bp, Homo sapiens
ttcacttttattgtat

SEQ ID NO: 529536 - DNA, 23 bp, Homo sapiens
ttcatagataccattttgaaata

SEQ ID NO: 529537 - DNA, 15 bp, Homo sapiens
ttcatgattagacaa

SEQ ID NO: 529538 - DNA, 15 bp, Homo sapiens
ttcatgcttttctca

SEQ ID NO: 529539 - DNA, 17 bp, Homo sapiens
ttccaaaggttgtacat

SEQ ID NO: 529540 - DNA, 12 bp, Homo sapiens
ttccagcaaaat

SEQ ID NO: 529541 - DNA, 13 bp, Homo sapiens
ttccagtgctgct

SEQ ID NO: 529542 - DNA, 13 bp, Homo sapiens
ttccatgacagta

SEQ ID NO: 529543 - DNA, 16 bp, Homo sapiens
ttccatgacagtagca

SEQ ID NO: 529544 - DNA, 15 bp, Homo sapiens
ttcccaacctcccct

SEQ ID NO: 529545 - DNA, 23 bp, Homo sapiens
ttccccatcgccttctggctgct

SEQ ID NO: 529546 - DNA, 16 bp, Homo sapiens
ttccccattgccttct

SEQ ID NO: 529547 - DNA, 18 bp, Homo sapiens
ttccgcgtggttctgcca

SEQ ID NO: 529548 - DNA, 12 bp, Homo sapiens
ttcctcccctgg

SEQ ID NO: 529549 - DNA, 14 bp, Homo sapiens
ttcctcctgtctcc

SEQ ID NO: 529550 - DNA, 17 bp, Homo sapiens
ttcctgaccctcacttt

SEQ ID NO: 529551 - DNA, 18 bp, Homo sapiens
ttctaaatcataatcatc

SEQ ID NO: 529552 - DNA, 16 bp, Homo sapiens
ttctcaaatgctactc

SEQ ID NO: 529553 - DNA, 20 bp, Homo sapiens
ttctcaaatgctactcagta

SEQ ID NO: 529554 - DNA, 16 bp, Homo sapiens
ttctcagaagtgaaaa

SEQ ID NO: 529555 - DNA, 20 bp, Homo sapiens
ttctcatctgtaaaaccagg

SEQ ID NO: 529556 - DNA, 16 bp, Homo sapiens
ttctcccctccaagtg

SEQ ID NO: 529557 - DNA, 12 bp, Homo sapiens
ttctctaaaaca

SEQ ID NO: 529558 - DNA, 14 bp, Homo sapiens
ttctctctgtgctg

SEQ ID NO: 529559 - DNA, 12 bp, Homo sapiens
ttctctcttggt

SEQ ID NO: 529560 - DNA, 18 bp, Homo sapiens
ttctcttctacttcttgt

SEQ ID NO: 529561 - DNA, 15 bp, Homo sapiens
ttctgatcctctctt

SEQ ID NO: 529562 - DNA, 14 bp, Homo sapiens
ttctgtcaatgaaa

SEQ ID NO: 529563 - DNA, 14 bp, Homo sapiens
ttctgtgcatctgg

SEQ ID NO: 529564 - DNA, 14 bp, Homo sapiens
ttcttgtaaaactg

SEQ ID NO: 529565 - DNA, 18 bp, Homo sapiens
ttcttgtaaaactgtgac

SEQ ID NO: 529566 - DNA, 21 bp, Homo sapiens
ttcttgtaaaactgtgacatt

SEQ ID NO: 529567 - DNA, 22 bp, Homo sapiens
ttcttgtaaaactgtgacattc

SEQ ID NO: 529568 - DNA, 23 bp, Homo sapiens
ttcttgtaaaactgtgacattcc

SEQ ID NO: 529569 - DNA, 14 bp, Homo sapiens
ttcttttcccattt

SEQ ID NO: 529570 - DNA, 21 bp, Homo sapiens
ttgacacattgcacacacagt

SEQ ID NO: 529571 - DNA, 16 bp, Homo sapiens
ttgacattttgtagct

SEQ ID NO: 529572 - DNA, 20 bp, Homo sapiens
ttgactgttatttgttgaga

SEQ ID NO: 529573 - DNA, 16 bp, Homo sapiens
ttgagtgtcaggctct

SEQ ID NO: 529574 - DNA, 23 bp, Homo sapiens
ttgcaataaactcagtcaaatgt

SEQ ID NO: 529575 - DNA, 15 bp, Homo sapiens
ttgcactaaaagtga

SEQ ID NO: 529576 - DNA, 19 bp, Homo sapiens
ttgctaagataattaaatg

SEQ ID NO: 529577 - DNA, 15 bp, Homo sapiens
ttgctccattcctga

SEQ ID NO: 529578 - DNA, 16 bp, Homo sapiens
ttgctccattcctgag

SEQ ID NO: 529579 - DNA, 19 bp, Homo sapiens
ttgctgaataacaacaatt

SEQ ID NO: 529580 - DNA, 19 bp, Homo sapiens
ttgctggaatctactagaa

SEQ ID NO: 529581 - DNA, 15 bp, Homo sapiens
ttgctggcatttgct

SEQ ID NO: 529582 - DNA, 21 bp, Homo sapiens
ttggagagagcaatcttgctg

SEQ ID NO: 529583 - DNA, 12 bp, Homo sapiens
ttgggaggctga

SEQ ID NO: 529584 - DNA, 22 bp, Homo sapiens
ttgggattcctcccctggaagt

SEQ ID NO: 529585 - DNA, 16 bp, Homo sapiens
ttgggctggcacccac

SEQ ID NO: 529586 - DNA, 17 bp, Homo sapiens
ttggtaacttgctgtga

SEQ ID NO: 529587 - DNA, 23 bp, Homo sapiens
ttggttccacaatcatctattga

SEQ ID NO: 529588 - DNA, 16 bp, Homo sapiens
ttgtacgttaattaaa

SEQ ID NO: 529589 - DNA, 15 bp, Homo sapiens
ttgtagctagtttaa

SEQ ID NO: 529590 - DNA, 12 bp, Homo sapiens
ttgtccctgcag

SEQ ID NO: 529591 - DNA, 15 bp, Homo sapiens
ttgtgcttgttcttc

SEQ ID NO: 529592 - DNA, 17 bp, Homo sapiens
ttgtgtgggtttactct

SEQ ID NO: 529593 - DNA, 20 bp, Homo sapiens
ttgtgtgggtttactctgtg

SEQ ID NO: 529594 - DNA, 16 bp, Homo sapiens
ttgttatcagtacaat

SEQ ID NO: 529595 - DNA, 14 bp, Homo sapiens
ttgttctctcttgg

SEQ ID NO: 529596 - DNA, 20 bp, Homo sapiens
ttgttcttgtaaaactgtga

SEQ ID NO: 529597 - DNA, 14 bp, Homo sapiens
ttgttgtccctgca

SEQ ID NO: 529598 - DNA, 13 bp, Homo sapiens
tttaatcatttcc

SEQ ID NO: 529599 - DNA, 15 bp, Homo sapiens
tttaatcatttccag

SEQ ID NO: 529600 - DNA, 14 bp, Homo sapiens
tttaggaatgctca

SEQ ID NO: 529601 - DNA, 17 bp, Homo sapiens
tttataaggctgactct

SEQ ID NO: 529602 - DNA, 15 bp, Homo sapiens
tttatcatgtgtttc

SEQ ID NO: 529603 - DNA, 12 bp, Homo sapiens
tttatgatttca

SEQ ID NO: 529604 - DNA, 10 bp, Homo sapiens
tttatgcatt

SEQ ID NO: 529605 - DNA, 15 bp, Homo sapiens
tttatgcatttatgc

SEQ ID NO: 529606 - DNA, 16 bp, Homo sapiens
tttatgcatttatgca

SEQ ID NO: 529607 - DNA, 16 bp, Homo sapiens
tttattcattagctgt

SEQ ID NO: 529608 - DNA, 18 bp, Homo sapiens
tttattcattagctgtga

SEQ ID NO: 529609 - DNA, 18 bp, Homo sapiens
tttcaatccacagtattg

SEQ ID NO: 529610 - DNA, 20 bp, Homo sapiens
tttcatagataccattttga

SEQ ID NO: 529611 - DNA, 21 bp, Homo sapiens
tttcatagataccattttgaa

SEQ ID NO: 529612 - DNA, 14 bp, Homo sapiens
tttcatgattagac

SEQ ID NO: 529613 - DNA, 18 bp, Homo sapiens
actgtgacattccacaga

SEQ ID NO: 529614 - DNA, 16 bp, Homo sapiens
actgtgagataaatat

SEQ ID NO: 529615 - DNA, 21 bp, Homo sapiens
actgtggtcccagctacaggg

SEQ ID NO: 529616 - DNA, 13 bp, Homo sapiens
acttaaacaaaaa

SEQ ID NO: 529617 - DNA, 14 bp, Homo sapiens
acttaaacaaaaac

SEQ ID NO: 529618 - DNA, 18 bp, Homo sapiens
acttaaacaaaaactttc

SEQ ID NO: 529619 - DNA, 18 bp, Homo sapiens
acttcatgctgtctgtgt

SEQ ID NO: 529620 - DNA, 17 bp, Homo sapiens
acttgaaattatatctg

SEQ ID NO: 529621 - DNA, 16 bp, Homo sapiens
acttgctgtgaaatga

SEQ ID NO: 529622 - DNA, 21 bp, Homo sapiens
actttccatgacagtagcata

SEQ ID NO: 529623 - DNA, 20 bp, Homo sapiens
actttgtgtcttttgttctc

SEQ ID NO: 529624 - DNA, 17 bp, Homo sapiens
acttttttcctgtcaat

SEQ ID NO: 529625 - DNA, 21 bp, Homo sapiens
acttttttcctgtcaatatat

SEQ ID NO: 529626 - DNA, 22 bp, Homo sapiens
agaaaccttttaaaaaaataat

SEQ ID NO: 529627 - DNA, 23 bp, Homo sapiens
agaaaccttttaaaaaaataata

SEQ ID NO: 529628 - DNA, 14 bp, Homo sapiens
agaacaacaacaaa

SEQ ID NO: 529629 - DNA, 23 bp, Homo sapiens
agaacaacaacaaagcatgctca

SEQ ID NO: 529630 - DNA, 13 bp, Homo sapiens
agaaccttctaat

SEQ ID NO: 529631 - DNA, 18 bp, Homo sapiens
agaacgcatgcagggccc

SEQ ID NO: 529632 - DNA, 15 bp, Homo sapiens
agaactcatgtgatt

SEQ ID NO: 529633 - DNA, 19 bp, Homo sapiens
agaatcacctaattaattt

SEQ ID NO: 529634 - DNA, 22 bp, Homo sapiens
agaatccccgtgctcacagtag

SEQ ID NO: 529635 - DNA, 21 bp, Homo sapiens
agaattttaaaaaagatggat

SEQ ID NO: 529636 - DNA, 22 bp, Homo sapiens
agaattttaaaaaagatggatt

SEQ ID NO: 529637 - DNA, 16 bp, Homo sapiens
agaccacgcccctgcc

SEQ ID NO: 529638 - DNA, 16 bp, Homo sapiens
agacttctaaatcata

SEQ ID NO: 529639 - DNA, 17 bp, Homo sapiens
agacttctaaatcataa

SEQ ID NO: 529640 - DNA, 14 bp, Homo sapiens
agagaaaggagggc

SEQ ID NO: 529641 - DNA, 15 bp, Homo sapiens
agagactcgcctggg

SEQ ID NO: 529642 - DNA, 22 bp, Homo sapiens
agagagatatatctgaaaactg

SEQ ID NO: 529643 - DNA, 17 bp, Homo sapiens
agagagcggcttcccca

SEQ ID NO: 529644 - DNA, 22 bp, Homo sapiens
agagagtatggtgctgggtcct

SEQ ID NO: 529645 - DNA, 15 bp, Homo sapiens
agagatatatctgaa

SEQ ID NO: 529646 - DNA, 19 bp, Homo sapiens
agagatatatctgaaaact

SEQ ID NO: 529647 - DNA, 20 bp, Homo sapiens
agagcaatcttgctgtgaaa

SEQ ID NO: 529648 - DNA, 10 bp, Homo sapiens
agagccacaa

SEQ ID NO: 529649 - DNA, 17 bp, Homo sapiens
agagctatgcacaccaa

SEQ ID NO: 529650 - DNA, 20 bp, Homo sapiens
agagctatgcacaccaaatt

SEQ ID NO: 529651 - DNA, 23 bp, Homo sapiens
agaggacagcttccccatcgcct

SEQ ID NO: 529652 - DNA, 15 bp, Homo sapiens
agagtatggattgaa

SEQ ID NO: 529653 - DNA, 18 bp, Homo sapiens
agataaatccaactctga

SEQ ID NO: 529654 - DNA, 15 bp, Homo sapiens
agataccattttgaa

SEQ ID NO: 529655 - DNA, 18 bp, Homo sapiens
agatagccgggctccagg

SEQ ID NO: 529656 - DNA, 14 bp, Homo sapiens
agatagctccttca

SEQ ID NO: 529657 - DNA, 18 bp, Homo sapiens
agatatatctgaaaactg

SEQ ID NO: 529658 - DNA, 21 bp, Homo sapiens
agatatgagaaatataaaaat

SEQ ID NO: 529659 - DNA, 18 bp, Homo sapiens
agatggatttgacacact

SEQ ID NO: 529660 - DNA, 18 bp, Homo sapiens
agatggggagggcgcttt

SEQ ID NO: 529661 - DNA, 16 bp, Homo sapiens
agatgtttagtagctg

SEQ ID NO: 529662 - DNA, 20 bp, Homo sapiens
agattaagttataccagcaa

SEQ ID NO: 529663 - DNA, 15 bp, Homo sapiens
agattcctacttaaa

SEQ ID NO: 529664 - DNA, 16 bp, Homo sapiens
agattcctacttaaac

SEQ ID NO: 529665 - DNA, 17 bp, Homo sapiens
agattcctacttaaaca

SEQ ID NO: 529666 - DNA, 20 bp, Homo sapiens
agattcctacttaaacaaaa

SEQ ID NO: 529667 - DNA, 20 bp, Homo sapiens
agattttaaaacttcatctg

SEQ ID NO: 529668 - DNA, 12 bp, Homo sapiens
agcaaaatatat

SEQ ID NO: 529669 - DNA, 19 bp, Homo sapiens
agcaaactgaagcccacag

SEQ ID NO: 529670 - DNA, 13 bp, Homo sapiens
agcaaggggctgc

SEQ ID NO: 529671 - DNA, 14 bp, Homo sapiens
agcaatcttgctgt

SEQ ID NO: 529672 - DNA, 23 bp, Homo sapiens
agcaatcttgctgtgaaacagtg

SEQ ID NO: 529673 - DNA, 23 bp, Homo sapiens
agcacacctcggccgaggcctgc

SEQ ID NO: 529674 - DNA, 22 bp, Homo sapiens
agcacagaggatggcttcccca

SEQ ID NO: 529675 - DNA, 15 bp, Homo sapiens
agcacagctttcctg

SEQ ID NO: 529676 - DNA, 18 bp, Homo sapiens
agcactttgggaggctga

SEQ ID NO: 529677 - DNA, 22 bp, Homo sapiens
agcatactgatgagacaacaca

SEQ ID NO: 529678 - DNA, 16 bp, Homo sapiens
agcatgtaatattaaa

SEQ ID NO: 529679 - DNA, 14 bp, Homo sapiens
agcatgtcctatcc

SEQ ID NO: 529680 - DNA, 17 bp, Homo sapiens
agcatttgactttctgt

SEQ ID NO: 529681 - DNA, 17 bp, Homo sapiens
agccaataaagctcaca

SEQ ID NO: 529682 - DNA, 19 bp, Homo sapiens
agccaataaagctcacact

SEQ ID NO: 529683 - DNA, 18 bp, Homo sapiens
agccagctgcaggaatca

SEQ ID NO: 529684 - DNA, 17 bp, Homo sapiens
agccctccgccagccct

SEQ ID NO: 529685 - DNA, 19 bp, Homo sapiens
agccctccgccagccctgt

SEQ ID NO: 529686 - DNA, 13 bp, Homo sapiens
agccctgcacgcc

SEQ ID NO: 529687 - DNA, 21 bp, Homo sapiens
agccctgttccgcctcactgg

SEQ ID NO: 529688 - DNA, 16 bp, Homo sapiens
agccgtgacctccagg

SEQ ID NO: 529689 - DNA, 17 bp, Homo sapiens
agcctcactgatatatt

SEQ ID NO: 529690 - DNA, 13 bp, Homo sapiens
agcctgtgggtcc

SEQ ID NO: 529691 - DNA, 23 bp, Homo sapiens
agccttgtgatcactttctgaaa

SEQ ID NO: 529692 - DNA, 21 bp, Homo sapiens
agcgtgtcctatccccggacg

SEQ ID NO: 529693 - DNA, 17 bp, Homo sapiens
agctaagcctgatgatg

SEQ ID NO: 529694 - DNA, 18 bp, Homo sapiens
agctacaggggaggctga

SEQ ID NO: 529695 - DNA, 18 bp, Homo sapiens
agctagtttaaaattatt

SEQ ID NO: 529696 - DNA, 14 bp, Homo sapiens
agctatgcacacca

SEQ ID NO: 529697 - DNA, 19 bp, Homo sapiens
actgagttagaatgttgaa

SEQ ID NO: 529698 - DNA, 22 bp, Homo sapiens
actgccctctgccactgacagg

SEQ ID NO: 529699 - DNA, 13 bp, Homo sapiens
actgggtgtggcc

SEQ ID NO: 529700 - DNA, 22 bp, Homo sapiens
actgtagtttttgttcaccttc

SEQ ID NO: 529701 - DNA, 14 bp, Homo sapiens
actgtgacattcca

SEQ ID NO: 529702 - DNA, 20 bp, Homo sapiens
cagacattgacaagcacgca

SEQ ID NO: 529703 - DNA, 20 bp, Homo sapiens
cagaggacagcttccccatc

SEQ ID NO: 529704 - DNA, 20 bp, Homo sapiens
cagaggacggcttccccatc

SEQ ID NO: 529705 - DNA, 22 bp, Homo sapiens
cagaggagaggagcaaacagga

SEQ ID NO: 529706 - DNA, 12 bp, Homo sapiens
cagaggatggct

SEQ ID NO: 529707 - DNA, 13 bp, Homo sapiens
cagcaaggggctg

SEQ ID NO: 529708 - DNA, 21 bp, Homo sapiens
cagcaaggggctgcttctggg

SEQ ID NO: 529709 - DNA, 17 bp, Homo sapiens
cagcacagagagcggct

SEQ ID NO: 529710 - DNA, 21 bp, Homo sapiens
cagcagttttcttttaatttt

SEQ ID NO: 529711 - DNA, 18 bp, Homo sapiens
cagccctccgccagccct

SEQ ID NO: 529712 - DNA, 23 bp, Homo sapiens
cagccctccgccagccctgttcc

SEQ ID NO: 529713 - DNA, 17 bp, Homo sapiens
cagccctgcacgcccag

SEQ ID NO: 529714 - DNA, 19 bp, Homo sapiens
cagccctgttccgcctcac

SEQ ID NO: 529715 - DNA, 15 bp, Homo sapiens
cagctgcaggaatca

SEQ ID NO: 529716 - DNA, 19 bp, Homo sapiens
cagctgcagttagcacaga

SEQ ID NO: 529717 - DNA, 21 bp, Homo sapiens
cagctgcagttagcacagagg

SEQ ID NO: 529718 - DNA, 22 bp, Homo sapiens
cagctgcagttagcacagagga

SEQ ID NO: 529719 - DNA, 14 bp, Homo sapiens
cagctgtctgtggc

SEQ ID NO: 529720 - DNA, 16 bp, Homo sapiens
cagctgtctgtggctt

SEQ ID NO: 529721 - DNA, 21 bp, Homo sapiens
cagcttccccatcgccttctg

SEQ ID NO: 529722 - DNA, 14 bp, Homo sapiens
cagcttgcttctct

SEQ ID NO: 529723 - DNA, 17 bp, Homo sapiens
caggagcatgtcctatc

SEQ ID NO: 529724 - DNA, 17 bp, Homo sapiens
caggatgaaggggccag

SEQ ID NO: 529725 - DNA, 22 bp, Homo sapiens
caggatgaaggggccagaccac

SEQ ID NO: 529726 - DNA, 22 bp, Homo sapiens
caggatgcatgcagggccccca

SEQ ID NO: 529727 - DNA, 14 bp, Homo sapiens
caggcaccatgctg

SEQ ID NO: 529728 - DNA, 16 bp, Homo sapiens
caggcacggaggctcg

SEQ ID NO: 529729 - DNA, 14 bp, Homo sapiens
caggcagcctgcag

SEQ ID NO: 529730 - DNA, 13 bp, Homo sapiens
caggcagcctgtg

SEQ ID NO: 529731 - DNA, 19 bp, Homo sapiens
caggcagcctgtgggtcct

SEQ ID NO: 529732 - DNA, 20 bp, Homo sapiens
caggcagcctgtgggtcctt

SEQ ID NO: 529733 - DNA, 20 bp, Homo sapiens
caggcatccgctgcgctccc

SEQ ID NO: 529734 - DNA, 14 bp, Homo sapiens
caggcattgcacta

SEQ ID NO: 529735 - DNA, 18 bp, Homo sapiens
caggcattgcactaaaag

SEQ ID NO: 529736 - DNA, 20 bp, Homo sapiens
caggcattgcactaaaagtg

SEQ ID NO: 529737 - DNA, 23 bp, Homo sapiens
caggcctcagggaccaaggagat

SEQ ID NO: 529738 - DNA, 20 bp, Homo sapiens
cagggacagcctgcacagtg

SEQ ID NO: 529739 - DNA, 16 bp, Homo sapiens
cagggccagtcatggc

SEQ ID NO: 529740 - DNA, 12 bp, Homo sapiens
caggggaggctg

SEQ ID NO: 529741 - DNA, 16 bp, Homo sapiens
caggggaggctgagac

SEQ ID NO: 529742 - DNA, 19 bp, Homo sapiens
caggggaggctgagacgca

SEQ ID NO: 529743 - DNA, 19 bp, Homo sapiens
caggggccgtgcagggcca

SEQ ID NO: 529744 - DNA, 16 bp, Homo sapiens
cagggggcaaggagaa

SEQ ID NO: 529745 - DNA, 17 bp, Homo sapiens
cagggtccagccctccg

SEQ ID NO: 529746 - DNA, 21 bp, Homo sapiens
cagggtcctgggggctgctgc

SEQ ID NO: 529747 - DNA, 20 bp, Homo sapiens
cagggttttagagagcagtg

SEQ ID NO: 529748 - DNA, 22 bp, Homo sapiens
cagggttttagagagcagtggc

SEQ ID NO: 529749 - DNA, 23 bp, Homo sapiens
caggtaaactgatgctttcagat

SEQ ID NO: 529750 - DNA, 13 bp, Homo sapiens
caggtcacaggca

SEQ ID NO: 529751 - DNA, 16 bp, Homo sapiens
caggtgcgtgccacat

SEQ ID NO: 529752 - DNA, 23 bp, Homo sapiens
cagtacaattctttgttgcttaa

SEQ ID NO: 529753 - DNA, 18 bp, Homo sapiens
cagtagcatactgatgag

SEQ ID NO: 529754 - DNA, 23 bp, Homo sapiens
cagtagtgtcacttttttcctgt

SEQ ID NO: 529755 - DNA, 24 bp, Homo sapiens
cagtatccgcgagcctgcttgctg

SEQ ID NO: 529756 - DNA, 20 bp, Homo sapiens
cagtattgagacactgtcaa

SEQ ID NO: 529757 - DNA, 18 bp, Homo sapiens
cagtattgttcttgtaaa

SEQ ID NO: 529758 - DNA, 23 bp, Homo sapiens
cagtattgttcttgtaaaactgt

SEQ ID NO: 529759 - DNA, 22 bp, Homo sapiens
cagtcatggctgtcccctgcaa

SEQ ID NO: 529760 - DNA, 17 bp, Homo sapiens
cagtctgttcagaggca

SEQ ID NO: 529761 - DNA, 21 bp, Homo sapiens
cagtgcagggacagcctgcac

SEQ ID NO: 529762 - DNA, 17 bp, Homo sapiens
cagtggtccagggtcca

SEQ ID NO: 529763 - DNA, 20 bp, Homo sapiens
cagtggtccagggtccagcc

SEQ ID NO: 529764 - DNA, 23 bp, Homo sapiens
cagtggtccagggtccagccctc

SEQ ID NO: 529765 - DNA, 16 bp, Homo sapiens
cagtgttataaaatct

SEQ ID NO: 529766 - DNA, 13 bp, Homo sapiens
cagtttgtgaagt

SEQ ID NO: 529767 - DNA, 18 bp, Homo sapiens
cagtttgtgaagtgattg

SEQ ID NO: 529768 - DNA, 23 bp, Homo sapiens
cagtttgtgaagtgattgacatt

SEQ ID NO: 529769 - DNA, 17 bp, Homo sapiens
cataaccgcacagacat

SEQ ID NO: 529770 - DNA, 16 bp, Homo sapiens
cataagctttttctct

SEQ ID NO: 529771 - DNA, 20 bp, Homo sapiens
catactgatgagacaacaca

SEQ ID NO: 529772 - DNA, 21 bp, Homo sapiens
catactgatgagacaacacac

SEQ ID NO: 529773 - DNA, 17 bp, Homo sapiens
catagcttaagaagtat

SEQ ID NO: 529774 - DNA, 21 bp, Homo sapiens
ccccatgccctccctgctgcc

SEQ ID NO: 529775 - DNA, 23 bp, Homo sapiens
ccccatggaacagccctgcacgc

SEQ ID NO: 529776 - DNA, 17 bp, Homo sapiens
ccccattgccttctggg

SEQ ID NO: 529777 - DNA, 12 bp, Homo sapiens
cccccatgccct

SEQ ID NO: 529778 - DNA, 19 bp, Homo sapiens
cccccatgccctccctgct

SEQ ID NO: 529779 - DNA, 13 bp, Homo sapiens
ccccccatgccct

SEQ ID NO: 529780 - DNA, 12 bp, Homo sapiens
cccccggacgcc

SEQ ID NO: 529781 - DNA, 13 bp, Homo sapiens
ccccctctcgggc

SEQ ID NO: 529782 - DNA, 13 bp, Homo sapiens
ccccgctgctccc

SEQ ID NO: 529783 - DNA, 13 bp, Homo sapiens
cccctcctccatg

SEQ ID NO: 529784 - DNA, 21 bp, Homo sapiens
cccctctcgggctctctcacc

SEQ ID NO: 529785 - DNA, 13 bp, Homo sapiens
cccctgcctgaga

SEQ ID NO: 529786 - DNA, 15 bp, Homo sapiens
cccctggtcctgcac

SEQ ID NO: 529787 - DNA, 14 bp, Homo sapiens
cccctttgccttcc

SEQ ID NO: 529788 - DNA, 17 bp, Homo sapiens
cccgatgcgtggctccc

SEQ ID NO: 529789 - DNA, 17 bp, Homo sapiens
cccggagctcaggccct

SEQ ID NO: 529790 - DNA, 19 bp, Homo sapiens
cccggcccccctctcgggc

SEQ ID NO: 529791 - DNA, 17 bp, Homo sapiens
cccgtgctcacagtagc

SEQ ID NO: 529792 - DNA, 15 bp, Homo sapiens
cccgtggctttgtgc

SEQ ID NO: 529793 - DNA, 16 bp, Homo sapiens
cccgttgttgtccctg

SEQ ID NO: 529794 - DNA, 18 bp, Homo sapiens
ccctaagcacaataaaag

SEQ ID NO: 529795 - DNA, 22 bp, Homo sapiens
ccctaagcacaataaaagacat

SEQ ID NO: 529796 - DNA, 17 bp, Homo sapiens
ccctcagcaaggggctg

SEQ ID NO: 529797 - DNA, 15 bp, Homo sapiens
ccctccctgctccct

SEQ ID NO: 529798 - DNA, 14 bp, Homo sapiens
ccctcctccatgct

SEQ ID NO: 529799 - DNA, 19 bp, Homo sapiens
ccctctcgggctctctcac

SEQ ID NO: 529800 - DNA, 20 bp, Homo sapiens
ccctgacatgctaacctctc

SEQ ID NO: 529801 - DNA, 14 bp, Homo sapiens
ccctgcaagtggac

SEQ ID NO: 529802 - DNA, 19 bp, Homo sapiens
ccctgctcccggctctgag

SEQ ID NO: 529803 - DNA, 17 bp, Homo sapiens
ccctgctccctgctccc

SEQ ID NO: 529804 - DNA, 13 bp, Homo sapiens
ccctgctgagtgg

SEQ ID NO: 529805 - DNA, 14 bp, Homo sapiens
ccctgctgccaggc

SEQ ID NO: 529806 - DNA, 23 bp, Homo sapiens
ccctgcttagtgtcccttacctg

SEQ ID NO: 529807 - DNA, 19 bp, Homo sapiens
ccctggaccgagtggacca

SEQ ID NO: 529808 - DNA, 20 bp, Homo sapiens
ccctggacgcatgcagggcc

SEQ ID NO: 529809 - DNA, 13 bp, Homo sapiens
ccctggtcctgca

SEQ ID NO: 529810 - DNA, 14 bp, Homo sapiens
ccctggtcctgcac

SEQ ID NO: 529811 - DNA, 15 bp, Homo sapiens
ccctgtgggctcaca

SEQ ID NO: 529812 - DNA, 19 bp, Homo sapiens
ccctgtgggctcacaccgg

SEQ ID NO: 529813 - DNA, 16 bp, Homo sapiens
ccctgttccgcctcac

SEQ ID NO: 529814 - DNA, 17 bp, Homo sapiens
ccctgttccgcctcact

SEQ ID NO: 529815 - DNA, 21 bp, Homo sapiens
ccctgttccgcctcactgggt

SEQ ID NO: 529816 - DNA, 22 bp, Homo sapiens
ccctgttgacctaccctggacc

SEQ ID NO: 529817 - DNA, 23 bp, Homo sapiens
ccgagtggaccacgacctcgtcc

SEQ ID NO: 529818 - DNA, 18 bp, Homo sapiens
ccgcccttccctgacact

SEQ ID NO: 529819 - DNA, 15 bp, Homo sapiens
ccgcgctcggggctg

SEQ ID NO: 529820 - DNA, 20 bp, Homo sapiens
ccgcgctcggggctgggcag

SEQ ID NO: 529821 - DNA, 17 bp, Homo sapiens
ccgcgtggttctgccac

SEQ ID NO: 529822 - DNA, 20 bp, Homo sapiens
ccggacgggggagctttccc

SEQ ID NO: 529823 - DNA, 16 bp, Homo sapiens
ccggcactgtgcactc

SEQ ID NO: 529824 - DNA, 19 bp, Homo sapiens
ccggcccccctctcgggct

SEQ ID NO: 529825 - DNA, 20 bp, Homo sapiens
ccggcccccctctcgggctc

SEQ ID NO: 529826 - DNA, 20 bp, Homo sapiens
ccggcctgatggccaggcct

SEQ ID NO: 529827 - DNA, 14 bp, Homo sapiens
ccgggctccaggga

SEQ ID NO: 529828 - DNA, 18 bp, Homo sapiens
ccgggctccagggagtgg

SEQ ID NO: 529829 - DNA, 13 bp, Homo sapiens
ccggggtggagtc

SEQ ID NO: 529830 - DNA, 22 bp, Homo sapiens
ccgggtgccccccatgccctcc

SEQ ID NO: 529831 - DNA, 17 bp, Homo sapiens
cggctctgaggctgccc

SEQ ID NO: 529832 - DNA, 19 bp, Homo sapiens
cggctctgaggctgcccca

SEQ ID NO: 529833 - DNA, 21 bp, Homo sapiens
cggcttccccatcgccttctg

SEQ ID NO: 529834 - DNA, 21 bp, Homo sapiens
cgggctctctcacccagcctg

SEQ ID NO: 529835 - DNA, 21 bp, Homo sapiens
cgggtgccccccatgccctcc

SEQ ID NO: 529836 - DNA, 18 bp, Homo sapiens
cggtggcatttgctgaat

SEQ ID NO: 529837 - DNA, 12 bp, Homo sapiens
cgtcagcctgtg

SEQ ID NO: 529838 - DNA, 13 bp, Homo sapiens
cgtcagcctgtga

SEQ ID NO: 529839 - DNA, 22 bp, Homo sapiens
cgtccctgagggcccttcccaa

SEQ ID NO: 529840 - DNA, 23 bp, Homo sapiens
cgtccctgagggcccttcccaac

SEQ ID NO: 529841 - DNA, 17 bp, Homo sapiens
cgtctgggaatcctgga

SEQ ID NO: 529842 - DNA, 18 bp, Homo sapiens
cgtctttggttcctcatg

SEQ ID NO: 529843 - DNA, 20 bp, Homo sapiens
cgtctttggttcctcatggc

SEQ ID NO: 529844 - DNA, 21 bp, Homo sapiens
cgtctttggttcctcatggct

SEQ ID NO: 529845 - DNA, 15 bp, Homo sapiens
cgtggctcccagcag

SEQ ID NO: 529846 - DNA, 20 bp, Homo sapiens
cgtggctcccagcagaggcc

SEQ ID NO: 529847 - DNA, 15 bp, Homo sapiens
cgtgtactaccccag

SEQ ID NO: 529848 - DNA, 16 bp, Homo sapiens
ctaaaagtgatgtgat

SEQ ID NO: 529849 - DNA, 20 bp, Homo sapiens
ctaaaagtgatgtgatttat

SEQ ID NO: 529850 - DNA, 14 bp, Homo sapiens
ctaaatgcaaagca

SEQ ID NO: 529851 - DNA, 16 bp, Homo sapiens
ctaagagccacaataa

SEQ ID NO: 529852 - DNA, 20 bp, Homo sapiens
ctaccccagaacgcatgcag

SEQ ID NO: 529853 - DNA, 22 bp, Homo sapiens
ctaccctggaccgagtggacca

SEQ ID NO: 529854 - DNA, 21 bp, Homo sapiens
ctacctttggcttaattccaa

SEQ ID NO: 529855 - DNA, 19 bp, Homo sapiens
ctactcctccccctcctcc

SEQ ID NO: 529856 - DNA, 21 bp, Homo sapiens
ctactcctccccctcctccat

SEQ ID NO: 529857 - DNA, 19 bp, Homo sapiens
ctacttaaacaaaaacttt

SEQ ID NO: 529858 - DNA, 22 bp, Homo sapiens
ctacttaaacaaaaactttcca

SEQ ID NO: 529859 - DNA, 15 bp, Homo sapiens
ctagatatgagaaat

SEQ ID NO: 529860 - DNA, 20 bp, Homo sapiens
ctagcactttgggaggctga

SEQ ID NO: 529861 - DNA, 17 bp, Homo sapiens
ctagccatatattttct

SEQ ID NO: 529862 - DNA, 16 bp, Homo sapiens
ctagtaggtctgcaca

SEQ ID NO: 529863 - DNA, 22 bp, Homo sapiens
ctagtaggtctgcacacataac

SEQ ID NO: 529864 - DNA, 18 bp, Homo sapiens
ctagttctttgcattcgt

SEQ ID NO: 529865 - DNA, 16 bp, Homo sapiens
ctagtttaaaattatt

SEQ ID NO: 529866 - DNA, 23 bp, Homo sapiens
ctatccccggacgcatgcagggc

SEQ ID NO: 529867 - DNA, 23 bp, Homo sapiens
ctatccctggacgcatgcagggc

SEQ ID NO: 529868 - DNA, 12 bp, Homo sapiens
ctatctggaaaa

SEQ ID NO: 529869 - DNA, 22 bp, Homo sapiens
ctatctggaaaaaaaaaaatat

SEQ ID NO: 529870 - DNA, 18 bp, Homo sapiens
ctatgacactcatcaggt

SEQ ID NO: 529871 - DNA, 17 bp, Homo sapiens
ctatgcacaccaaattg

SEQ ID NO: 529872 - DNA, 21 bp, Homo sapiens
ctatgcacaccaaattgctga

SEQ ID NO: 529873 - DNA, 21 bp, Homo sapiens
ctattagcttactgattaact

SEQ ID NO: 529874 - DNA, 22 bp, Homo sapiens
ctattgctgtaaataaaaatag

SEQ ID NO: 529875 - DNA, 12 bp, Homo sapiens
ctcaaaatgtgc

SEQ ID NO: 529876 - DNA, 12 bp, Homo sapiens
ctcaaggctgca

SEQ ID NO: 529877 - DNA, 20 bp, Homo sapiens
gtagcatactgatgagacaa

SEQ ID NO: 529878 - DNA, 17 bp, Homo sapiens
gtagctagtttaaaatt

SEQ ID NO: 529879 - DNA, 20 bp, Homo sapiens
gtagctagtttaaaattatt

SEQ ID NO: 529880 - DNA, 18 bp, Homo sapiens
gtagtagctcgtgtgctt

SEQ ID NO: 529881 - DNA, 21 bp, Homo sapiens
gtagtttttgttcaccttctg

SEQ ID NO: 529882 - DNA, 14 bp, Homo sapiens
gtatatattttgaa

SEQ ID NO: 529883 - DNA, 23 bp, Homo sapiens
gtatctgatatctgtttgcttct

SEQ ID NO: 529884 - DNA, 20 bp, Homo sapiens
gtattgttcttgtaaaactg

SEQ ID NO: 529885 - DNA, 20 bp, Homo sapiens
gtatttggtaacttgctgtg

SEQ ID NO: 529886 - DNA, 20 bp, Homo sapiens
gtcaaatggatgtaatatag

SEQ ID NO: 529887 - DNA, 11 bp, Homo sapiens
gtcaatatata

SEQ ID NO: 529888 - DNA, 16 bp, Homo sapiens
gtcaatatatagagac

SEQ ID NO: 529889 - DNA, 18 bp, Homo sapiens
gtcagggctgtgctttcc

SEQ ID NO: 529890 - DNA, 14 bp, Homo sapiens
gtcagtttgtgaag

SEQ ID NO: 529891 - DNA, 12 bp, Homo sapiens
gtcatctgtcag

SEQ ID NO: 529892 - DNA, 21 bp, Homo sapiens
gtcatttcttctctctgtgct

SEQ ID NO: 529893 - DNA, 17 bp, Homo sapiens
gtccacccccattgtga

SEQ ID NO: 529894 - DNA, 18 bp, Homo sapiens
gtccacccccattgtgaa

SEQ ID NO: 529895 - DNA, 21 bp, Homo sapiens
gtccacccccattgtgaatgt

SEQ ID NO: 529896 - DNA, 22 bp, Homo sapiens
gtccaccccgttgttgtccctg

SEQ ID NO: 529897 - DNA, 12 bp, Homo sapiens
gtccagccctcc

SEQ ID NO: 529898 - DNA, 15 bp, Homo sapiens
gtccagggtccagcc

SEQ ID NO: 529899 - DNA, 17 bp, Homo sapiens
gtccagggtccagccct

SEQ ID NO: 529900 - DNA, 14 bp, Homo sapiens
gtccaggtcacagg

SEQ ID NO: 529901 - DNA, 19 bp, Homo sapiens
gtcccggagctcaggccct

SEQ ID NO: 529902 - DNA, 13 bp, Homo sapiens
gtccctgcagggc

SEQ ID NO: 529903 - DNA, 14 bp, Homo sapiens
gtccctgtgggctc

SEQ ID NO: 529904 - DNA, 15 bp, Homo sapiens
gtcctaaatgcaaag

SEQ ID NO: 529905 - DNA, 22 bp, Homo sapiens
gtcctatccccggaccggacgc

SEQ ID NO: 529906 - DNA, 17 bp, Homo sapiens
gtcctcaccttctgttt

SEQ ID NO: 529907 - DNA, 18 bp, Homo sapiens
gtcctgtgtcatctgtca

SEQ ID NO: 529908 - DNA, 19 bp, Homo sapiens
gtcctgtgtcatctgtcag

SEQ ID NO: 529909 - DNA, 13 bp, Homo sapiens
gtctcctctgtca

SEQ ID NO: 529910 - DNA, 17 bp, Homo sapiens
gtctcctctgtcagttt

SEQ ID NO: 529911 - DNA, 22 bp, Homo sapiens
gtctcctctgtcagtttgtgaa

SEQ ID NO: 529912 - DNA, 23 bp, Homo sapiens
gtctcctctgtcagtttgtgaag

SEQ ID NO: 529913 - DNA, 21 bp, Homo sapiens
gtctgcacacataacacacat

SEQ ID NO: 529914 - DNA, 19 bp, Homo sapiens
gtctgtcccagttaactgt

SEQ ID NO: 529915 - DNA, 20 bp, Homo sapiens
gtcttcaaattgtcttttgt

SEQ ID NO: 529916 - DNA, 17 bp, Homo sapiens
gtcttgagtttcatttt

SEQ ID NO: 529917 - DNA, 15 bp, Homo sapiens
gtctttatgatttca

SEQ ID NO: 529918 - DNA, 17 bp, Homo sapiens
gtctttatgatttcatg

SEQ ID NO: 529919 - DNA, 14 bp, Homo sapiens
gtctttctccaaag

SEQ ID NO: 529920 - DNA, 21 bp, Homo sapiens
gtctttggttcctcatggctg

SEQ ID NO: 529921 - DNA, 23 bp, Homo sapiens
gtctttggttcctcatggctgtt

SEQ ID NO: 529922 - DNA, 13 bp, Homo sapiens
gtcttttgttctc

SEQ ID NO: 529923 - DNA, 20 bp, Homo sapiens
gtcttttgttctctcttggt

SEQ ID NO: 529924 - DNA, 15 bp, Homo sapiens
gtgaagtgattgaca

SEQ ID NO: 529925 - DNA, 23 bp, Homo sapiens
gtgatcactttctgaaattcaca

SEQ ID NO: 529926 - DNA, 14 bp, Homo sapiens
gtgatgtgatttat

SEQ ID NO: 529927 - DNA, 17 bp, Homo sapiens
gtgatttatgcatttat

SEQ ID NO: 529928 - DNA, 16 bp, Homo sapiens
gtgcactctactctgc

SEQ ID NO: 529929 - DNA, 19 bp, Homo sapiens
gtgcactctactctgcgac

SEQ ID NO: 529930 - DNA, 17 bp, Homo sapiens
gtgcagggacagcctgc

SEQ ID NO: 529931 - DNA, 14 bp, Homo sapiens
gtgcagtagtgtca

SEQ ID NO: 529932 - DNA, 14 bp, Homo sapiens
gtgcatctggcctg

SEQ ID NO: 529933 - DNA, 15 bp, Homo sapiens
gtgcatctggcctgg

SEQ ID NO: 529934 - DNA, 19 bp, Homo sapiens
gtgccccccatgccctccc

SEQ ID NO: 529935 - DNA, 16 bp, Homo sapiens
gtgcccctcctgcccc

SEQ ID NO: 529936 - DNA, 22 bp, Homo sapiens
gtgccctgttgacctaccctgg

SEQ ID NO: 529937 - DNA, 17 bp, Homo sapiens
gtgcggcagggcaggag

SEQ ID NO: 529938 - DNA, 20 bp, Homo sapiens
gtgctcacagtagcttccta

SEQ ID NO: 529939 - DNA, 22 bp, Homo sapiens
gtgctcatcagaaacaatttct

SEQ ID NO: 529940 - DNA, 15 bp, Homo sapiens
gtgctcctgctgacc

SEQ ID NO: 529941 - DNA, 14 bp, Homo sapiens
gtgctgggtcctta

SEQ ID NO: 529942 - DNA, 15 bp, Homo sapiens
gtgctgttgattctt

SEQ ID NO: 529943 - DNA, 17 bp, Homo sapiens
gtgctgttgattctttc

SEQ ID NO: 529944 - DNA, 17 bp, Homo sapiens
gtgcttagaaacctcac

SEQ ID NO: 529945 - DNA, 21 bp, Homo sapiens
gtgcttatgtcatttcttctc

SEQ ID NO: 529946 - DNA, 20 bp, Homo sapiens
gtggaattattagcaccagc

SEQ ID NO: 529947 - DNA, 15 bp, Homo sapiens
gtggaccacgacctc

SEQ ID NO: 529948 - DNA, 17 bp, Homo sapiens
gtggacgtgggctccag

SEQ ID NO: 529949 - DNA, 23 bp, Homo sapiens
gtggcctggcttctgggacaggc

SEQ ID NO: 529950 - DNA, 18 bp, Homo sapiens
gtggcttcccatgtcttt

SEQ ID NO: 529951 - DNA, 14 bp, Homo sapiens
gtggctttgtgctt

SEQ ID NO: 529952 - DNA, 13 bp, Homo sapiens
gtgggcctgccta

SEQ ID NO: 529953 - DNA, 16 bp, Homo sapiens
ctgttccgcctcactg

SEQ ID NO: 529954 - DNA, 14 bp, Homo sapiens
ctgtttatgttctt

SEQ ID NO: 529955 - DNA, 13 bp, Homo sapiens
ctgtttgcttcta

SEQ ID NO: 529956 - DNA, 12 bp, Homo sapiens
ctgttttgtgcg

SEQ ID NO: 529957 - DNA, 17 bp, Homo sapiens
cttaaaaaaaaaaatga

SEQ ID NO: 529958 - DNA, 20 bp, Homo sapiens
cttaaaaattatctttaaaa

SEQ ID NO: 529959 - DNA, 12 bp, Homo sapiens
cttaaacaaaaa

SEQ ID NO: 529960 - DNA, 21 bp, Homo sapiens
cttaaacaaaaactttccatg

SEQ ID NO: 529961 - DNA, 16 bp, Homo sapiens
cttactgttttgtgcg

SEQ ID NO: 529962 - DNA, 23 bp, Homo sapiens
cttcatacaaaggacagtacaca

SEQ ID NO: 529963 - DNA, 13 bp, Homo sapiens
cttcatgctgtct

SEQ ID NO: 529964 - DNA, 19 bp, Homo sapiens
cttcatgctgtctgtgtga

SEQ ID NO: 529965 - DNA, 16 bp, Homo sapiens
cttcatgcttttctca

SEQ ID NO: 529966 - DNA, 20 bp, Homo sapiens
cttcatgcttttctcatggt

SEQ ID NO: 529967 - DNA, 21 bp, Homo sapiens
cttcatggaactcagctgtct

SEQ ID NO: 529968 - DNA, 13 bp, Homo sapiens
cttcccaacaata

SEQ ID NO: 529969 - DNA, 19 bp, Homo sapiens
cttcccaacaatactttgt

SEQ ID NO: 529970 - DNA, 20 bp, Homo sapiens
cttcccccagggtcccctgc

SEQ ID NO: 529971 - DNA, 23 bp, Homo sapiens
cttcccccagggtcccctgcatg

SEQ ID NO: 529972 - DNA, 13 bp, Homo sapiens
cttcctcttacct

SEQ ID NO: 529973 - DNA, 19 bp, Homo sapiens
cttctaaatcataatcatc

SEQ ID NO: 529974 - DNA, 20 bp, Homo sapiens
cttctcaaatgctactcagt

SEQ ID NO: 529975 - DNA, 16 bp, Homo sapiens
cttctggccgctgcag

SEQ ID NO: 529976 - DNA, 18 bp, Homo sapiens
cttctggccgctgcagtc

SEQ ID NO: 529977 - DNA, 18 bp, Homo sapiens
cttctggctgctgcagtc

SEQ ID NO: 529978 - DNA, 23 bp, Homo sapiens
cttctggctgctgcagtcagcac

SEQ ID NO: 529979 - DNA, 21 bp, Homo sapiens
cttctgggacaggcaccatgc

SEQ ID NO: 529980 - DNA, 22 bp, Homo sapiens
cttctggggctccctgcctgga

SEQ ID NO: 529981 - DNA, 18 bp, Homo sapiens
cttctgtgcatctggcct

SEQ ID NO: 529982 - DNA, 20 bp, Homo sapiens
cttctgtgcatctggcctgg

SEQ ID NO: 529983 - DNA, 18 bp, Homo sapiens
cttctttactaacactgg

SEQ ID NO: 529984 - DNA, 14 bp, Homo sapiens
cttcttttcccatt

SEQ ID NO: 529985 - DNA, 24 bp, Homo sapiens
cttgaaattatatctgtggtcttc

SEQ ID NO: 529986 - DNA, 17 bp, Homo sapiens
cttgcagtcatcagaag

SEQ ID NO: 529987 - DNA, 20 bp, Homo sapiens
cttgcattttagctaattta

SEQ ID NO: 529988 - DNA, 18 bp, Homo sapiens
cttgctgtgaaacagtgt

SEQ ID NO: 529989 - DNA, 18 bp, Homo sapiens
cttgctgtgaaatgactg

SEQ ID NO: 529990 - DNA, 12 bp, Homo sapiens
cttggaaaatgt

SEQ ID NO: 529991 - DNA, 21 bp, Homo sapiens
cttgggattcctcccctggaa

SEQ ID NO: 529992 - DNA, 12 bp, Homo sapiens
cttggtctcttt

SEQ ID NO: 529993 - DNA, 14 bp, Homo sapiens
cttgtaaaactgtg

SEQ ID NO: 529994 - DNA, 16 bp, Homo sapiens
cttgtaaaactgtgac

SEQ ID NO: 529995 - DNA, 22 bp, Homo sapiens
cttgtaaaactgtgacattcca

SEQ ID NO: 529996 - DNA, 14 bp, Homo sapiens
cttgttcagtcact

SEQ ID NO: 529997 - DNA, 22 bp, Homo sapiens
cttgttcagtcacttgtttgtg

SEQ ID NO: 529998 - DNA, 18 bp, Homo sapiens
ctttatcatgtgtttctg

SEQ ID NO: 529999 - DNA, 17 bp, Homo sapiens
ctttcaatccacagtat

SEQ ID NO: 530000 - DNA, 19 bp, Homo sapiens
ctttcaatccacagtattg

SEQ ID NO: 530001 - DNA, 23 bp, Homo sapiens
ctttcaatccacagtattgttct

SEQ ID NO: 530002 - DNA, 14 bp, Homo sapiens
ctttccatgacagt

SEQ ID NO: 530003 - DNA, 18 bp, Homo sapiens
ctttccatgacagtagca

SEQ ID NO: 530004 - DNA, 15 bp, Homo sapiens
ctttcccagagaccc

SEQ ID NO: 530005 - DNA, 16 bp, Homo sapiens
ctttcccagagacccg

SEQ ID NO: 530006 - DNA, 23 bp, Homo sapiens
ctttcccgatgcgtggctcccag

SEQ ID NO: 530007 - DNA, 20 bp, Homo sapiens
ctttctccaaagttatccag

SEQ ID NO: 530008 - DNA, 12 bp, Homo sapiens
ctttctttccaa

SEQ ID NO: 530009 - DNA, 13 bp, Homo sapiens
ctttctttccaaa

SEQ ID NO: 530010 - DNA, 14 bp, Homo sapiens
ctttctttccaaag

SEQ ID NO: 530011 - DNA, 21 bp, Homo sapiens
ctttggcttaattccaatcat

SEQ ID NO: 530012 - DNA, 20 bp, Homo sapiens
aggaatgctcaatgtgctgt

SEQ ID NO: 530013 - DNA, 15 bp, Homo sapiens
aggacagcttcccca

SEQ ID NO: 530014 - DNA, 16 bp, Homo sapiens
aggacgcatgcagggc

SEQ ID NO: 530015 - DNA, 13 bp, Homo sapiens
aggagcgtgtcct

SEQ ID NO: 530016 - DNA, 14 bp, Homo sapiens
aggagcgtgtccta

SEQ ID NO: 530017 - DNA, 22 bp, Homo sapiens
aggatgtggatggaggtgatga

SEQ ID NO: 530018 - DNA, 17 bp, Homo sapiens
aggcattgcactaaaag

SEQ ID NO: 530019 - DNA, 22 bp, Homo sapiens
aggcattgcactaaaagtgatg

SEQ ID NO: 530020 - DNA, 21 bp, Homo sapiens
aggcctcagggaccaaggaga

SEQ ID NO: 530021 - DNA, 22 bp, Homo sapiens
aggcctcagggaccaaggagat

SEQ ID NO: 530022 - DNA, 17 bp, Homo sapiens
aggctgccccaggggca

SEQ ID NO: 530023 - DNA, 22 bp, Homo sapiens
aggctgccccaggggcactgtg

SEQ ID NO: 530024 - DNA, 18 bp, Homo sapiens
agggacacagaggacagc

SEQ ID NO: 530025 - DNA, 13 bp, Homo sapiens
agggacagcctgc

SEQ ID NO: 530026 - DNA, 15 bp, Homo sapiens
agggagtggggagga

SEQ ID NO: 530027 - DNA, 18 bp, Homo sapiens
agggagtggggaggagag

SEQ ID NO: 530028 - DNA, 20 bp, Homo sapiens
agggctgacttctccaggac

SEQ ID NO: 530029 - DNA, 17 bp, Homo sapiens
aggggcactgtgttctc

SEQ ID NO: 530030 - DNA, 12 bp, Homo sapiens
aggggccagacc

SEQ ID NO: 530031 - DNA, 13 bp, Homo sapiens
aggggctgcttct

SEQ ID NO: 530032 - DNA, 12 bp, Homo sapiens
agggtccagccc

SEQ ID NO: 530033 - DNA, 14 bp, Homo sapiens
agggtccagccctc

SEQ ID NO: 530034 - DNA, 15 bp, Homo sapiens
agggtccagccctcc

SEQ ID NO: 530035 - DNA, 19 bp, Homo sapiens
agggttgtgattttgtctg

SEQ ID NO: 530036 - DNA, 16 bp, Homo sapiens
aggtaaactgatgctt

SEQ ID NO: 530037 - DNA, 19 bp, Homo sapiens
aggtaaactgatgctttca

SEQ ID NO: 530038 - DNA, 20 bp, Homo sapiens
aggtccaccccgttgttgtc

SEQ ID NO: 530039 - DNA, 21 bp, Homo sapiens
aggtccaccccgttgttgtcc

SEQ ID NO: 530040 - DNA, 21 bp, Homo sapiens
aggtcctgtcctggctcccag

SEQ ID NO: 530041 - DNA, 22 bp, Homo sapiens
aggtcctgtcctggctcccagg

SEQ ID NO: 530042 - DNA, 23 bp, Homo sapiens
aggtcctgtcctggctcccaggg

SEQ ID NO: 530043 - DNA, 18 bp, Homo sapiens
aggttgctggcatttgct

SEQ ID NO: 530044 - DNA, 18 bp, Homo sapiens
agtaaatctaaattaact

SEQ ID NO: 530045 - DNA, 16 bp, Homo sapiens
agtaaatgtatattga

SEQ ID NO: 530046 - DNA, 16 bp, Homo sapiens
agtagctcgtgtgctt

SEQ ID NO: 530047 - DNA, 14 bp, Homo sapiens
agtagctgataaag

SEQ ID NO: 530048 - DNA, 23 bp, Homo sapiens
agtaggtctgcacacataacaca

SEQ ID NO: 530049 - DNA, 19 bp, Homo sapiens
agtatatagccttaagtct

SEQ ID NO: 530050 - DNA, 22 bp, Homo sapiens
agtatctcatcaacaaagaaat

SEQ ID NO: 530051 - DNA, 14 bp, Homo sapiens
agtattgagacact

SEQ ID NO: 530052 - DNA, 17 bp, Homo sapiens
agtattgagacactgtc

SEQ ID NO: 530053 - DNA, 18 bp, Homo sapiens
agtattgagacactgtca

SEQ ID NO: 530054 - DNA, 15 bp, Homo sapiens
agtcatggctgtccc

SEQ ID NO: 530055 - DNA, 17 bp, Homo sapiens
agtcatggctgtcccct

SEQ ID NO: 530056 - DNA, 22 bp, Homo sapiens
agtcatggctgtcccctgcaag

SEQ ID NO: 530057 - DNA, 23 bp, Homo sapiens
agtcatggctgtcccctgcaagt

SEQ ID NO: 530058 - DNA, 19 bp, Homo sapiens
agtcttactgttttgtgcg

SEQ ID NO: 530059 - DNA, 20 bp, Homo sapiens
agtgatgtgatttatgcatt

SEQ ID NO: 530060 - DNA, 21 bp, Homo sapiens
agtgatgtgatttatgcattt

SEQ ID NO: 530061 - DNA, 18 bp, Homo sapiens
agtgcagggacagcctgc

SEQ ID NO: 530062 - DNA, 20 bp, Homo sapiens
agtgcagggacagcctgcac

SEQ ID NO: 530063 - DNA, 18 bp, Homo sapiens
agtggacgtgggctccag

SEQ ID NO: 530064 - DNA, 22 bp, Homo sapiens
agtggctcgtgtttcacagtgg

SEQ ID NO: 530065 - DNA, 19 bp, Homo sapiens
agtgggcggcttccctgcg

SEQ ID NO: 530066 - DNA, 20 bp, Homo sapiens
agtggtagagtcctaggaca

SEQ ID NO: 530067 - DNA, 19 bp, Homo sapiens
agtgtcacttttttcctgt

SEQ ID NO: 530068 - DNA, 17 bp, Homo sapiens
agtgtcaggctctgaat

SEQ ID NO: 530069 - DNA, 16 bp, Homo sapiens
agttataccagcaaaa

SEQ ID NO: 530070 - DNA, 18 bp, Homo sapiens
agttgccgtggcaactgt

SEQ ID NO: 530071 - DNA, 15 bp, Homo sapiens
agttgtcctttctga

SEQ ID NO: 530072 - DNA, 12 bp, Homo sapiens
agtttgtgaagt

SEQ ID NO: 530073 - DNA, 21 bp, Homo sapiens
agtttgtgaagtgattgacat

SEQ ID NO: 530074 - DNA, 16 bp, Homo sapiens
agttttcttttaattt

SEQ ID NO: 530075 - DNA, 17 bp, Homo sapiens
agttttcttttaatttt

SEQ ID NO: 530076 - DNA, 21 bp, Homo sapiens
agtttttgttcaccttctgtg

SEQ ID NO: 530077 - DNA, 11 bp, Homo sapiens
ataaactgtga

SEQ ID NO: 530078 - DNA, 14 bp, Homo sapiens
ataaactgtgagat

SEQ ID NO: 530079 - DNA, 17 bp, Homo sapiens
ataaactgtgagataaa

SEQ ID NO: 530080 - DNA, 16 bp, Homo sapiens
ataaagctcacacttg

SEQ ID NO: 530081 - DNA, 11 bp, Homo sapiens
ataacacacat

SEQ ID NO: 530082 - DNA, 15 bp, Homo sapiens
ataacaggcattgca

SEQ ID NO: 530083 - DNA, 19 bp, Homo sapiens
ataatataaatgaatgaaa

SEQ ID NO: 530084 - DNA, 16 bp, Homo sapiens
ataatggcctcttaaa

SEQ ID NO: 530085 - DNA, 14 bp, Homo sapiens
ataattaaatgaaa

SEQ ID NO: 530086 - DNA, 19 bp, Homo sapiens
atacatgatgatttcagaa

SEQ ID NO: 530087 - DNA, 12 bp, Homo sapiens
ataccagcaaaa

SEQ ID NO: 530088 - DNA, 13 bp, Homo sapiens
ataccagcaaaag

SEQ ID NO: 530089 - DNA, 19 bp, Homo sapiens
atactatttattaaaacca

SEQ ID NO: 530090 - DNA, 17 bp, Homo sapiens
atactgatgagacaaca

SEQ ID NO: 530091 - DNA, 20 bp, Homo sapiens
atactgatgagacaacacac

SEQ ID NO: 530092 - DNA, 14 bp, Homo sapiens
atacttggtcctta

SEQ ID NO: 530093 - DNA, 15 bp, Homo sapiens
atactttgtgtcttt

SEQ ID NO: 530094 - DNA, 20 bp, Homo sapiens
atagataccattttgaaata

SEQ ID NO: 530095 - DNA, 22 bp, Homo sapiens
cacccgtctgggaatcctggac

SEQ ID NO: 530096 - DNA, 17 bp, Homo sapiens
cacccgtgttctcctcc

SEQ ID NO: 530097 - DNA, 21 bp, Homo sapiens
caccgacaatctttgattact

SEQ ID NO: 530098 - DNA, 22 bp, Homo sapiens
caccgagaggaaaaaggcttct

SEQ ID NO: 530099 - DNA, 20 bp, Homo sapiens
cacctaaagggaagccctga

SEQ ID NO: 530100 - DNA, 21 bp, Homo sapiens
caccttccctagttctttgca

SEQ ID NO: 530101 - DNA, 21 bp, Homo sapiens
caccttctgtgcatctggcct

SEQ ID NO: 530102 - DNA, 23 bp, Homo sapiens
caccttctgtgcatctggcctgg

SEQ ID NO: 530103 - DNA, 14 bp, Homo sapiens
cacctttccgtgcc

SEQ ID NO: 530104 - DNA, 19 bp, Homo sapiens
cactaaaagtgatgtgatt

SEQ ID NO: 530105 - DNA, 21 bp, Homo sapiens
cactaaaagtgatgtgattta

SEQ ID NO: 530106 - DNA, 12 bp, Homo sapiens
cactcaccattt

SEQ ID NO: 530107 - DNA, 20 bp, Homo sapiens
cactgccatttcctcctggg

SEQ ID NO: 530108 - DNA, 21 bp, Homo sapiens
cactgccctccgcccttccct

SEQ ID NO: 530109 - DNA, 15 bp, Homo sapiens
cactggagcgtgtac

SEQ ID NO: 530110 - DNA, 18 bp, Homo sapiens
cactggagcgtgtactac

SEQ ID NO: 530111 - DNA, 23 bp, Homo sapiens
cacttagggagtgtgccttgggc

SEQ ID NO: 530112 - DNA, 13 bp, Homo sapiens
cacttatttccat

SEQ ID NO: 530113 - DNA, 22 bp, Homo sapiens
cacttgggctggcacccactgg

SEQ ID NO: 530114 - DNA, 16 bp, Homo sapiens
cacttttttcctgtca

SEQ ID NO: 530115 - DNA, 18 bp, Homo sapiens
cacttttttcctgtcaat

SEQ ID NO: 530116 - DNA, 22 bp, Homo sapiens
cacttttttcctgtcaatatat

SEQ ID NO: 530117 - DNA, 14 bp, Homo sapiens
cagaacaacaacaa

SEQ ID NO: 530118 - DNA, 15 bp, Homo sapiens
cagaacaacaacaaa

SEQ ID NO: 530119 - DNA, 18 bp, Homo sapiens
cagaagctcaaggctgca

SEQ ID NO: 530120 - DNA, 17 bp, Homo sapiens
cagaagtgaaaaagact

SEQ ID NO: 530121 - DNA, 17 bp, Homo sapiens
gtgtgggtttactctgt

SEQ ID NO: 530122 - DNA, 19 bp, Homo sapiens
gtgttgtccgtgtctgttg

SEQ ID NO: 530123 - DNA, 17 bp, Homo sapiens
gttaattgatagaataa

SEQ ID NO: 530124 - DNA, 11 bp, Homo sapiens
gttagctcaga

SEQ ID NO: 530125 - DNA, 13 bp, Homo sapiens
gttagctcagagg

SEQ ID NO: 530126 - DNA, 21 bp, Homo sapiens
gttagctcagaggagaggagc

SEQ ID NO: 530127 - DNA, 22 bp, Homo sapiens
gttatcagtacaattctttgtt

SEQ ID NO: 530128 - DNA, 18 bp, Homo sapiens
gttatctgtctttatgat

SEQ ID NO: 530129 - DNA, 18 bp, Homo sapiens
gttcaatgctacaaaatg

SEQ ID NO: 530130 - DNA, 24 bp, Homo sapiens
gttcaatgctacaaaatgtgtgct

SEQ ID NO: 530131 - DNA, 14 bp, Homo sapiens
gttcaccttctgtg

SEQ ID NO: 530132 - DNA, 16 bp, Homo sapiens
gttcaccttctgtgca

SEQ ID NO: 530133 - DNA, 12 bp, Homo sapiens
gttcatgaatac

SEQ ID NO: 530134 - DNA, 16 bp, Homo sapiens
gttccacgtggggtgg

SEQ ID NO: 530135 - DNA, 16 bp, Homo sapiens
gttccatgaagacaaa

SEQ ID NO: 530136 - DNA, 22 bp, Homo sapiens
gttctctcttggtctctttctt

SEQ ID NO: 530137 - DNA, 13 bp, Homo sapiens
gttctgccactta

SEQ ID NO: 530138 - DNA, 16 bp, Homo sapiens
gttcttcctcttacct

SEQ ID NO: 530139 - DNA, 21 bp, Homo sapiens
gttcttgcagtcatcagaagt

SEQ ID NO: 530140 - DNA, 21 bp, Homo sapiens
gttcttttttaagactcaatc

SEQ ID NO: 530141 - DNA, 19 bp, Homo sapiens
gttgacctaccctggaccg

SEQ ID NO: 530142 - DNA, 17 bp, Homo sapiens
gttgtacatagtggtca

SEQ ID NO: 530143 - DNA, 13 bp, Homo sapiens
gttgtccctgcag

SEQ ID NO: 530144 - DNA, 15 bp, Homo sapiens
gttgtcctgtgtcat

SEQ ID NO: 530145 - DNA, 13 bp, Homo sapiens
gttgtcctttctg

SEQ ID NO: 530146 - DNA, 20 bp, Homo sapiens
gtttagtagctgataaagaa

SEQ ID NO: 530147 - DNA, 23 bp, Homo sapiens
gtttttgttcaccttctgtgcat

SEQ ID NO: 530148 - DNA, 18 bp, Homo sapiens
taaaaaaataatataaat

SEQ ID NO: 530149 - DNA, 20 bp, Homo sapiens
taaaaaaataatataaatga

SEQ ID NO: 530150 - DNA, 12 bp, Homo sapiens
taaaaccaggct

SEQ ID NO: 530151 - DNA, 11 bp, Homo sapiens
taaaactgtga

SEQ ID NO: 530152 - DNA, 12 bp, Homo sapiens
taaaactgtgac

SEQ ID NO: 530153 - DNA, 20 bp, Homo sapiens
taaaactgtgacattccaca

SEQ ID NO: 530154 - DNA, 14 bp, Homo sapiens
taaaatgattcact

SEQ ID NO: 530155 - DNA, 13 bp, Homo sapiens
taaaattattaaa

SEQ ID NO: 530156 - DNA, 19 bp, Homo sapiens
taaaattattaaaaattat

SEQ ID NO: 530157 - DNA, 15 bp, Homo sapiens
taaacatttccctgc

SEQ ID NO: 530158 - DNA, 17 bp, Homo sapiens
taaacatttccctgctg

SEQ ID NO: 530159 - DNA, 20 bp, Homo sapiens
taaactgtgagataaatatc

SEQ ID NO: 530160 - DNA, 13 bp, Homo sapiens
taaagctcacact

SEQ ID NO: 530161 - DNA, 19 bp, Homo sapiens
taaagctcacacttgggct

SEQ ID NO: 530162 - DNA, 21 bp, Homo sapiens
taaagctcacacttgggctgg

SEQ ID NO: 530163 - DNA, 14 bp, Homo sapiens
taaagggaagccct

SEQ ID NO: 530164 - DNA, 21 bp, Homo sapiens
taaaggtttcactgttcatga

SEQ ID NO: 530165 - DNA, 15 bp, Homo sapiens
taaataaaaatagct

SEQ ID NO: 530166 - DNA, 17 bp, Homo sapiens
taaataaaaatagctat

SEQ ID NO: 530167 - DNA, 16 bp, Homo sapiens
taaatctaaattaact

SEQ ID NO: 530168 - DNA, 19 bp, Homo sapiens
taaatgtatattgatgtaa

SEQ ID NO: 530169 - DNA, 17 bp, Homo sapiens
taacaacaatttaggaa

SEQ ID NO: 530170 - DNA, 15 bp, Homo sapiens
taacattgtaaatga

SEQ ID NO: 530171 - DNA, 17 bp, Homo sapiens
taactacctttggctta

SEQ ID NO: 530172 - DNA, 13 bp, Homo sapiens
taacttgctgtga

SEQ ID NO: 530173 - DNA, 15 bp, Homo sapiens
taacttgctgtgaaa

SEQ ID NO: 530174 - DNA, 14 bp, Homo sapiens
taagaagcaaataa

SEQ ID NO: 530175 - DNA, 12 bp, Homo sapiens
taagagccacaa

SEQ ID NO: 530176 - DNA, 17 bp, Homo sapiens
taagataattaaatgaa

SEQ ID NO: 530177 - DNA, 17 bp, Homo sapiens
taagccactggtatctg

SEQ ID NO: 530178 - DNA, 13 bp, Homo sapiens
taaggctgactct

SEQ ID NO: 530179 - DNA, 18 bp, Homo sapiens
taaggggaattaacaatt

SEQ ID NO: 530180 - DNA, 22 bp, Homo sapiens
taaggggaattaacaattgcca

SEQ ID NO: 530181 - DNA, 16 bp, Homo sapiens
taagtcttactgtttt

SEQ ID NO: 530182 - DNA, 15 bp, Homo sapiens
taagttataccagca

SEQ ID NO: 530183 - DNA, 19 bp, Homo sapiens
taagttataccagcaaaag

SEQ ID NO: 530184 - DNA, 15 bp, Homo sapiens
taagttgtcttacac

SEQ ID NO: 530185 - DNA, 16 bp, Homo sapiens
taatataaatgaatga

SEQ ID NO: 530186 - DNA, 23 bp, Homo sapiens
taatatagggtttgtttgctgct

SEQ ID NO: 530187 - DNA, 18 bp, Homo sapiens
taatcacactctcttctt

SEQ ID NO: 530188 - DNA, 20 bp, Homo sapiens
taatccatgtgctgctgtgg

SEQ ID NO: 530189 - DNA, 22 bp, Homo sapiens
taatccatgtgctgctgtggca

SEQ ID NO: 530190 - DNA, 19 bp, Homo sapiens
taatctagagctatgcaca

SEQ ID NO: 530191 - DNA, 21 bp, Homo sapiens
tacaattctttgttgcttaat

SEQ ID NO: 530192 - DNA, 15 bp, Homo sapiens
tacataacaggcatt

SEQ ID NO: 530193 - DNA, 15 bp, Homo sapiens
tacatagtggtcatt

SEQ ID NO: 530194 - DNA, 22 bp, Homo sapiens
tacatgcctttccagtgctgct

SEQ ID NO: 530195 - DNA, 20 bp, Homo sapiens
tacctggcttagcgttctgt

SEQ ID NO: 530196 - DNA, 23 bp, Homo sapiens
tacctgtaatagcctcaccttcc

SEQ ID NO: 530197 - DNA, 17 bp, Homo sapiens
tactaaccaccatttcc

SEQ ID NO: 530198 - DNA, 16 bp, Homo sapiens
tactagaaccttctaa

SEQ ID NO: 530199 - DNA, 16 bp, Homo sapiens
tactcctccccctcct

SEQ ID NO: 530200 - DNA, 19 bp, Homo sapiens
tactcctccccctcctcca

SEQ ID NO: 530201 - DNA, 23 bp, Homo sapiens
tactgttttgtgcggtgtgtctc

SEQ ID NO: 530202 - DNA, 20 bp, Homo sapiens
tacttaaacaaaaactttcc

SEQ ID NO: 530203 - DNA, 22 bp, Homo sapiens
tacttaaacaaaaactttccat

SEQ ID NO: 530204 - DNA, 23 bp, Homo sapiens
tacttaaacaaaaactttccatg

SEQ ID NO: 530205 - DNA, 20 bp, Homo sapiens
tacttatttataacattgta

SEQ ID NO: 530206 - DNA, 13 bp, Homo sapiens
tactttgtgtctt

SEQ ID NO: 530207 - DNA, 21 bp, Homo sapiens
tagacaatgtggaattacata

SEQ ID NO: 530208 - DNA, 14 bp, Homo sapiens
tagagagcagtggc

SEQ ID NO: 530209 - DNA, 17 bp, Homo sapiens
tagagctatgcacacca

SEQ ID NO: 530210 - DNA, 20 bp, Homo sapiens
tagataccattttgaaatat

SEQ ID NO: 530211 - DNA, 18 bp, Homo sapiens
tagattcctacttaaaca

SEQ ID NO: 530212 - DNA, 14 bp, Homo sapiens
tagattttcatgtt

SEQ ID NO: 530213 - DNA, 17 bp, Homo sapiens
tagatttttagattcct

SEQ ID NO: 530214 - DNA, 15 bp, Homo sapiens
tagccgggctccagg

SEQ ID NO: 530215 - DNA, 15 bp, Homo sapiens
tagctataaatagtg

SEQ ID NO: 530216 - DNA, 17 bp, Homo sapiens
catgtgctgctgtggca

SEQ ID NO: 530217 - DNA, 17 bp, Homo sapiens
catgttctcaataccca

SEQ ID NO: 530218 - DNA, 22 bp, Homo sapiens
cattatagcatgtaatattaaa

SEQ ID NO: 530219 - DNA, 17 bp, Homo sapiens
cattatggctttgtgct

SEQ ID NO: 530220 - DNA, 19 bp, Homo sapiens
cattgcactaaaagtgatg

SEQ ID NO: 530221 - DNA, 23 bp, Homo sapiens
cattgcactaaaagtgatgtgat

SEQ ID NO: 530222 - DNA, 22 bp, Homo sapiens
cattgccttctggggagggaca

SEQ ID NO: 530223 - DNA, 21 bp, Homo sapiens
cattgtgaatgttgtcctgtg

SEQ ID NO: 530224 - DNA, 15 bp, Homo sapiens
catttaaacccggct

SEQ ID NO: 530225 - DNA, 12 bp, Homo sapiens
catttaatcatt

SEQ ID NO: 530226 - DNA, 23 bp, Homo sapiens
catttagtcctcaccttctgttt

SEQ ID NO: 530227 - DNA, 21 bp, Homo sapiens
catttatgcatgagaactaaa

SEQ ID NO: 530228 - DNA, 13 bp, Homo sapiens
catttatgtgtga

SEQ ID NO: 530229 - DNA, 15 bp, Homo sapiens
catttcacattcctg

SEQ ID NO: 530230 - DNA, 16 bp, Homo sapiens
catttcacattcctga

SEQ ID NO: 530231 - DNA, 19 bp, Homo sapiens
catttccagcaaaatatat

SEQ ID NO: 530232 - DNA, 21 bp, Homo sapiens
catttccagcaaaatatatgt

SEQ ID NO: 530233 - DNA, 20 bp, Homo sapiens
catttcccctgtggtttgtt

SEQ ID NO: 530234 - DNA, 19 bp, Homo sapiens
catttcttctctctgtgct

SEQ ID NO: 530235 - DNA, 22 bp, Homo sapiens
catttcttctctctgtgctggt

SEQ ID NO: 530236 - DNA, 17 bp, Homo sapiens
catttcttggtatgatc

SEQ ID NO: 530237 - DNA, 14 bp, Homo sapiens
catttggtggctct

SEQ ID NO: 530238 - DNA, 16 bp, Homo sapiens
cattttagctaattta

SEQ ID NO: 530239 - DNA, 12 bp, Homo sapiens
cattttctctcc

SEQ ID NO: 530240 - DNA, 20 bp, Homo sapiens
ccaacaatactttgtgtctt

SEQ ID NO: 530241 - DNA, 22 bp, Homo sapiens
ccaacaatactttgtgtctttt

SEQ ID NO: 530242 - DNA, 19 bp, Homo sapiens
ccaacgatcatatctgtat

SEQ ID NO: 530243 - DNA, 12 bp, Homo sapiens
ccaagtgtcctg

SEQ ID NO: 530244 - DNA, 15 bp, Homo sapiens
ccaataaagctcaca

SEQ ID NO: 530245 - DNA, 22 bp, Homo sapiens
ccacagagttactgccacggtc

SEQ ID NO: 530246 - DNA, 18 bp, Homo sapiens
ccacaggagcatgtccta

SEQ ID NO: 530247 - DNA, 23 bp, Homo sapiens
ccacaggagcgtgtcctatcccc

SEQ ID NO: 530248 - DNA, 17 bp, Homo sapiens
ccacccccattgtgaat

SEQ ID NO: 530249 - DNA, 20 bp, Homo sapiens
ccaccccgttgttgtccctg

SEQ ID NO: 530250 - DNA, 21 bp, Homo sapiens
ccaccccgttgttgtccctgc

SEQ ID NO: 530251 - DNA, 22 bp, Homo sapiens
ccaccccgttgttgtccctgca

SEQ ID NO: 530252 - DNA, 15 bp, Homo sapiens
ccacgtggggtggaa

SEQ ID NO: 530253 - DNA, 19 bp, Homo sapiens
ccagaacgcatgcagggcc

SEQ ID NO: 530254 - DNA, 20 bp, Homo sapiens
ccagaagctcaaggctgcag

SEQ ID NO: 530255 - DNA, 18 bp, Homo sapiens
ccagaccacgcccctgcc

SEQ ID NO: 530256 - DNA, 20 bp, Homo sapiens
ccagacgtgctcctgctgac

SEQ ID NO: 530257 - DNA, 22 bp, Homo sapiens
ccagagaaatgaaagtcagttt

SEQ ID NO: 530258 - DNA, 22 bp, Homo sapiens
ccagccctccgccagccctgtt

SEQ ID NO: 530259 - DNA, 21 bp, Homo sapiens
ccagccctgttccgcctcact

SEQ ID NO: 530260 - DNA, 17 bp, Homo sapiens
ccagcggggcttctggg

SEQ ID NO: 530261 - DNA, 20 bp, Homo sapiens
ccagctacaggggaggctga

SEQ ID NO: 530262 - DNA, 17 bp, Homo sapiens
ccagctctgggagccct

SEQ ID NO: 530263 - DNA, 14 bp, Homo sapiens
ccagcttgcttctc

SEQ ID NO: 530264 - DNA, 21 bp, Homo sapiens
ccaggaagtcatcctgcaatg

SEQ ID NO: 530265 - DNA, 17 bp, Homo sapiens
ccaggacgcatgcaggg

SEQ ID NO: 530266 - DNA, 17 bp, Homo sapiens
ccaggatgcatgcaggg

SEQ ID NO: 530267 - DNA, 18 bp, Homo sapiens
ccaggctcccactgcccc

SEQ ID NO: 530268 - DNA, 16 bp, Homo sapiens
ccagggagtggggagg

SEQ ID NO: 530269 - DNA, 17 bp, Homo sapiens
ccagggcgcaggggagg

SEQ ID NO: 530270 - DNA, 18 bp, Homo sapiens
ccagggcgcaggggaggg

SEQ ID NO: 530271 - DNA, 15 bp, Homo sapiens
ccagggtccagccct

SEQ ID NO: 530272 - DNA, 20 bp, Homo sapiens
ccagggtccagccctccgcc

SEQ ID NO: 530273 - DNA, 21 bp, Homo sapiens
ccagggtccagccctccgcca

SEQ ID NO: 530274 - DNA, 20 bp, Homo sapiens
ccagggtcctgggggctgct

SEQ ID NO: 530275 - DNA, 22 bp, Homo sapiens
ccaggtgttgtccgtgtctgtt

SEQ ID NO: 530276 - DNA, 22 bp, Homo sapiens
tagctccttcatgcttttctca

SEQ ID NO: 530277 - DNA, 19 bp, Homo sapiens
taggaaagcctcactgata

SEQ ID NO: 530278 - DNA, 16 bp, Homo sapiens
taggaatgctcaatgt

SEQ ID NO: 530279 - DNA, 16 bp, Homo sapiens
tagggctctaatttcc

SEQ ID NO: 530280 - DNA, 19 bp, Homo sapiens
tcatctgtaaaaccaggct

SEQ ID NO: 530281 - DNA, 14 bp, Homo sapiens
tcatgattagacaa

SEQ ID NO: 530282 - DNA, 13 bp, Homo sapiens
aaaaaaaaatatg

SEQ ID NO: 530283 - DNA, 13 bp, Homo sapiens
aaaaaaaatatga

SEQ ID NO: 530284 - DNA, 12 bp, Homo sapiens
aaaaaaatatga

SEQ ID NO: 530285 - DNA, 14 bp, Homo sapiens
aaaaaaatatgaga

SEQ ID NO: 530286 - DNA, 18 bp, Homo sapiens
aaaaatagctataaatag

SEQ ID NO: 530287 - DNA, 17 bp, Homo sapiens
aaaaccattctgcttgg

SEQ ID NO: 530288 - DNA, 17 bp, Homo sapiens
aaaacgatttaatttat

SEQ ID NO: 530289 - DNA, 10 bp, Homo sapiens
aaaactgtga

SEQ ID NO: 530290 - DNA, 11 bp, Homo sapiens
aaaactgtgac

SEQ ID NO: 530291 - DNA, 12 bp, Homo sapiens
aaaactgtgaca

SEQ ID NO: 530292 - DNA, 19 bp, Homo sapiens
aaaactgtgacattccaca

SEQ ID NO: 530293 - DNA, 18 bp, Homo sapiens
aaaactttccatgacagt

SEQ ID NO: 530294 - DNA, 15 bp, Homo sapiens
aaaagtgatgtgatt

SEQ ID NO: 530295 - DNA, 12 bp, Homo sapiens
aaaatacttctt

SEQ ID NO: 530296 - DNA, 16 bp, Homo sapiens
aaaatagctataaata

SEQ ID NO: 530297 - DNA, 11 bp, Homo sapiens
aaaatatatgt

SEQ ID NO: 530298 - DNA, 16 bp, Homo sapiens
aaaatatatgtttggc

SEQ ID NO: 530299 - DNA, 14 bp, Homo sapiens
aaaatgttctgaca

SEQ ID NO: 530300 - DNA, 14 bp, Homo sapiens
aaaattatctttaa

SEQ ID NO: 530301 - DNA, 16 bp, Homo sapiens
aaaattatctttaaaa

SEQ ID NO: 530302 - DNA, 14 bp, Homo sapiens
aaaattattaaaaa

SEQ ID NO: 530303 - DNA, 14 bp, Homo sapiens
aaacaacagcaaca

SEQ ID NO: 530304 - DNA, 14 bp, Homo sapiens
aaaccttttaaaaa

SEQ ID NO: 530305 - DNA, 17 bp, Homo sapiens
aaacgtctaacttcatg

SEQ ID NO: 530306 - DNA, 10 bp, Homo sapiens
aaactgtgac

SEQ ID NO: 530307 - DNA, 14 bp, Homo sapiens
aaactgtgacattc

SEQ ID NO: 530308 - DNA, 18 bp, Homo sapiens
aaactgtgagataaatat

SEQ ID NO: 530309 - DNA, 19 bp, Homo sapiens
aaactgtgagataaatatc

SEQ ID NO: 530310 - DNA, 21 bp, Homo sapiens
aaactgtgagataaatatcat

SEQ ID NO: 530311 - DNA, 14 bp, Homo sapiens
aaactttccatgac

SEQ ID NO: 530312 - DNA, 15 bp, Homo sapiens
aaactttccatgaca

SEQ ID NO: 530313 - DNA, 16 bp, Homo sapiens
aaactttccatgacag

SEQ ID NO: 530314 - DNA, 18 bp, Homo sapiens
aaagacttcaaatgttat

SEQ ID NO: 530315 - DNA, 20 bp, Homo sapiens
aaagatggatttgacacact

SEQ ID NO: 530316 - DNA, 13 bp, Homo sapiens
aaaggcttctcca

SEQ ID NO: 530317 - DNA, 18 bp, Homo sapiens
aaagtcttgaatgttgaa

SEQ ID NO: 530318 - DNA, 14 bp, Homo sapiens
aaataatataaatg

SEQ ID NO: 530319 - DNA, 13 bp, Homo sapiens
aaatacttgacaa

SEQ ID NO: 530320 - DNA, 17 bp, Homo sapiens
aaatagatttttagatt

SEQ ID NO: 530321 - DNA, 21 bp, Homo sapiens
aaatagctataaatagtgaaa

SEQ ID NO: 530322 - DNA, 12 bp, Homo sapiens
aaatataaaaat

SEQ ID NO: 530323 - DNA, 14 bp, Homo sapiens
aaatataaactgtg

SEQ ID NO: 530324 - DNA, 16 bp, Homo sapiens
aaatataaactgtgag

SEQ ID NO: 530325 - DNA, 23 bp, Homo sapiens
aaatatatgtttggctgaaatta

SEQ ID NO: 530326 - DNA, 23 bp, Homo sapiens
aaatatgctctcccctccctttt

SEQ ID NO: 530327 - DNA, 14 bp, Homo sapiens
aaatattagcaaag

SEQ ID NO: 530328 - DNA, 22 bp, Homo sapiens
aaatctaaattaacttctattt

SEQ ID NO: 530329 - DNA, 14 bp, Homo sapiens
aaatgaatgaaata

SEQ ID NO: 530330 - DNA, 17 bp, Homo sapiens
aaatgaatgaaatataa

SEQ ID NO: 530331 - DNA, 19 bp, Homo sapiens
aaatgatacttggtcctta

SEQ ID NO: 530332 - DNA, 17 bp, Homo sapiens
aaatgatatgtctttaa

SEQ ID NO: 530333 - DNA, 18 bp, Homo sapiens
aaatgatatgtctttaaa

SEQ ID NO: 530334 - DNA, 13 bp, Homo sapiens
aaatgattcactt

SEQ ID NO: 530335 - DNA, 21 bp, Homo sapiens
aaatgattcacttttattgta

SEQ ID NO: 530336 - DNA, 15 bp, Homo sapiens
aaatgcctaataaac

SEQ ID NO: 530337 - DNA, 15 bp, Homo sapiens
aaatgctactcagta

SEQ ID NO: 530338 - DNA, 18 bp, Homo sapiens
aaatggaggaaaccacaa

SEQ ID NO: 530339 - DNA, 19 bp, Homo sapiens
aaatggaggaaaccacaaa

SEQ ID NO: 530340 - DNA, 13 bp, Homo sapiens
aaatggatgtaat

SEQ ID NO: 530341 - DNA, 14 bp, Homo sapiens
aaatggatgtaata

SEQ ID NO: 530342 - DNA, 18 bp, Homo sapiens
aaatggatgtaatatagg

SEQ ID NO: 530343 - DNA, 20 bp, Homo sapiens
aaatggcttgttcagtcact

SEQ ID NO: 530344 - DNA, 20 bp, Homo sapiens
aaattaacttctattttcaa

SEQ ID NO: 530345 - DNA, 21 bp, Homo sapiens
aaattagggctctaatttcct

SEQ ID NO: 530346 - DNA, 23 bp, Homo sapiens
aaattagggctctaatttcctta

SEQ ID NO: 530347 - DNA, 18 bp, Homo sapiens
aaattatgtcaaatggat

SEQ ID NO: 530348 - DNA, 13 bp, Homo sapiens
aaattattaaaaa

SEQ ID NO: 530349 - DNA, 19 bp, Homo sapiens
aaattattaaaaattatag

SEQ ID NO: 530350 - DNA, 15 bp, Homo sapiens
aaattgctgagatgt

SEQ ID NO: 530351 - DNA, 16 bp, Homo sapiens
aaattgctgagatgtt

SEQ ID NO: 530352 - DNA, 21 bp, Homo sapiens
aaattgtcttttgtcatgtgg

SEQ ID NO: 530353 - DNA, 18 bp, Homo sapiens
aacaaaaactttccatga

SEQ ID NO: 530354 - DNA, 24 bp, Homo sapiens
actgggtgtggcctggcttctggg

SEQ ID NO: 530355 - DNA, 17 bp, Homo sapiens
actgtaaaatacttctt

SEQ ID NO: 530356 - DNA, 23 bp, Homo sapiens
actgtagtttttgttcaccttct

SEQ ID NO: 530357 - DNA, 22 bp, Homo sapiens
actgtcccggagctcaggccct

SEQ ID NO: 530358 - DNA, 23 bp, Homo sapiens
actgtcccggagctcaggccctg

SEQ ID NO: 530359 - DNA, 20 bp, Homo sapiens
actgtgacacagctgagctg

SEQ ID NO: 530360 - DNA, 12 bp, Homo sapiens
actgtgacattc

SEQ ID NO: 530361 - DNA, 17 bp, Homo sapiens
actgtgacattccacag

SEQ ID NO: 530362 - DNA, 15 bp, Homo sapiens
acttaaacaaaaact

SEQ ID NO: 530363 - DNA, 21 bp, Homo sapiens
acttaaacaaaaactttccat

SEQ ID NO: 530364 - DNA, 23 bp, Homo sapiens
acttaaacaaaaactttccatga

SEQ ID NO: 530365 - DNA, 15 bp, Homo sapiens
acttagggagtgtgc

SEQ ID NO: 530366 - DNA, 23 bp, Homo sapiens
acttatttataacattgtaaatg

SEQ ID NO: 530367 - DNA, 13 bp, Homo sapiens
acttatttccatg

SEQ ID NO: 530368 - DNA, 16 bp, Homo sapiens
acttctaaatcataat

SEQ ID NO: 530369 - DNA, 12 bp, Homo sapiens
acttgctgtgaa

SEQ ID NO: 530370 - DNA, 18 bp, Homo sapiens
acttgctgtgaaatgact

SEQ ID NO: 530371 - DNA, 16 bp, Homo sapiens
acttgtttgtgtttga

SEQ ID NO: 530372 - DNA, 22 bp, Homo sapiens
actttccatgacagtagcatac

SEQ ID NO: 530373 - DNA, 19 bp, Homo sapiens
actttctgaaattcacaaa

SEQ ID NO: 530374 - DNA, 14 bp, Homo sapiens
actttgggaggctg

SEQ ID NO: 530375 - DNA, 19 bp, Homo sapiens
actttgtgtcttttgttct

SEQ ID NO: 530376 - DNA, 15 bp, Homo sapiens
acttttattgtataa

SEQ ID NO: 530377 - DNA, 22 bp, Homo sapiens
acttttattgtataattatgaa

SEQ ID NO: 530378 - DNA, 15 bp, Homo sapiens
acttttttcctgtca

SEQ ID NO: 530379 - DNA, 16 bp, Homo sapiens
agaaatataaaaataa

SEQ ID NO: 530380 - DNA, 13 bp, Homo sapiens
agaaattagggct

SEQ ID NO: 530381 - DNA, 19 bp, Homo sapiens
agaaattagggctctaatt

SEQ ID NO: 530382 - DNA, 20 bp, Homo sapiens
agaaattagggctctaattt

SEQ ID NO: 530383 - DNA, 22 bp, Homo sapiens
agaaattagggctctaatttcc

SEQ ID NO: 530384 - DNA, 23 bp, Homo sapiens
agaaattagggctctaatttcct

SEQ ID NO: 530385 - DNA, 15 bp, Homo sapiens
agaaattttatctct

SEQ ID NO: 530386 - DNA, 22 bp, Homo sapiens
agaacaacaacaaagcatgctc

SEQ ID NO: 530387 - DNA, 13 bp, Homo sapiens
agaacagggatgc

SEQ ID NO: 530388 - DNA, 16 bp, Homo sapiens
agaacgcatgcagggc

SEQ ID NO: 530389 - DNA, 14 bp, Homo sapiens
agaactaaatagat

SEQ ID NO: 530390 - DNA, 17 bp, Homo sapiens
agaaggtgaaatggagg

SEQ ID NO: 530391 - DNA, 14 bp, Homo sapiens
agaatcaagtctgt

SEQ ID NO: 530392 - DNA, 22 bp, Homo sapiens
agaatcacctaattaatttcag

SEQ ID NO: 530393 - DNA, 18 bp, Homo sapiens
agaatccccgtgctcaca

SEQ ID NO: 530394 - DNA, 17 bp, Homo sapiens
agaattttaaaaaagat

SEQ ID NO: 530395 - DNA, 18 bp, Homo sapiens
agaattttaaaaaagatg

SEQ ID NO: 530396 - DNA, 13 bp, Homo sapiens
agacaacacacac

SEQ ID NO: 530397 - DNA, 21 bp, Homo sapiens
agacaatgtggaattacataa

SEQ ID NO: 530398 - DNA, 13 bp, Homo sapiens
agacactgtcaag

SEQ ID NO: 530399 - DNA, 21 bp, Homo sapiens
agaccatttagtcctcacctt

SEQ ID NO: 530400 - DNA, 21 bp, Homo sapiens
agactcaaggcctccagccac

SEQ ID NO: 530401 - DNA, 12 bp, Homo sapiens
agactcaatcat

SEQ ID NO: 530402 - DNA, 18 bp, Homo sapiens
agactcctctcttctgac

SEQ ID NO: 530403 - DNA, 15 bp, Homo sapiens
agactcgcctgggaa

SEQ ID NO: 530404 - DNA, 14 bp, Homo sapiens
agacttctaaatca

SEQ ID NO: 530405 - DNA, 23 bp, Homo sapiens
agagacaatttaaggcctgcact

SEQ ID NO: 530406 - DNA, 17 bp, Homo sapiens
agagacttctaaatcat

SEQ ID NO: 530407 - DNA, 23 bp, Homo sapiens
agagagcggcttccccatcgcct

SEQ ID NO: 530408 - DNA, 23 bp, Homo sapiens
agagatatatctgaaaactggaa

SEQ ID NO: 530409 - DNA, 14 bp, Homo sapiens
agagccacaataag

SEQ ID NO: 530410 - DNA, 16 bp, Homo sapiens
agagggggagacccct

SEQ ID NO: 530411 - DNA, 21 bp, Homo sapiens
agagggtgtgggtgccctgtt

SEQ ID NO: 530412 - DNA, 18 bp, Homo sapiens
agagtatggtgctgggtc

SEQ ID NO: 530413 - DNA, 14 bp, Homo sapiens
agataaatatcatt

SEQ ID NO: 530414 - DNA, 15 bp, Homo sapiens
agataaatatcatta

SEQ ID NO: 530415 - DNA, 22 bp, Homo sapiens
agataattaaatgaaatacttg

SEQ ID NO: 530416 - DNA, 18 bp, Homo sapiens
agataccattttgaaata

SEQ ID NO: 530417 - DNA, 20 bp, Homo sapiens
agataccattttgaaatatt

SEQ ID NO: 530418 - DNA, 15 bp, Homo sapiens
agatatatctgaaaa

SEQ ID NO: 530419 - DNA, 23 bp, Homo sapiens
agatccatcggtttatactattt

SEQ ID NO: 530420 - DNA, 14 bp, Homo sapiens
agatggggagggcg

SEQ ID NO: 530421 - DNA, 22 bp, Homo sapiens
agattaagttataccagcaaaa

SEQ ID NO: 530422 - DNA, 13 bp, Homo sapiens
agcaaaaggatga

SEQ ID NO: 530423 - DNA, 21 bp, Homo sapiens
agcaaatttctagatatgaga

SEQ ID NO: 530424 - DNA, 22 bp, Homo sapiens
agcaacccaggtgttgtccgtg

SEQ ID NO: 530425 - DNA, 15 bp, Homo sapiens
agcaatcttgctgtg

SEQ ID NO: 530426 - DNA, 16 bp, Homo sapiens
agcacagagagcggct

SEQ ID NO: 530427 - DNA, 11 bp, Homo sapiens
agcaccagctt

SEQ ID NO: 530428 - DNA, 20 bp, Homo sapiens
agcactatcgaggtatttgg

SEQ ID NO: 530429 - DNA, 21 bp, Homo sapiens
agcagttgcaataaactcagt

SEQ ID NO: 530430 - DNA, 17 bp, Homo sapiens
agcatgccaatttctct

SEQ ID NO: 530431 - DNA, 11 bp, Homo sapiens
agcatgctcag

SEQ ID NO: 530432 - DNA, 17 bp, Homo sapiens
agcatgctcagtattga

SEQ ID NO: 530433 - DNA, 16 bp, Homo sapiens
agcatttgactttctg

SEQ ID NO: 530434 - DNA, 21 bp, Homo sapiens
agcatttgactttctgtctgt

SEQ ID NO: 530435 - DNA, 14 bp, Homo sapiens
agccaagtgtcctg

SEQ ID NO: 530436 - DNA, 18 bp, Homo sapiens
agccaataaagctcacac

SEQ ID NO: 530437 - DNA, 20 bp, Homo sapiens
agccatatattttctgagta

SEQ ID NO: 530438 - DNA, 21 bp, Homo sapiens
agcccagaagctcaaggctgc

SEQ ID NO: 530439 - DNA, 18 bp, Homo sapiens
agccctaagtaaatctaa

SEQ ID NO: 530440 - DNA, 12 bp, Homo sapiens
agccctgacaac

SEQ ID NO: 530441 - DNA, 15 bp, Homo sapiens
agccctgttccgcct

SEQ ID NO: 530442 - DNA, 18 bp, Homo sapiens
agccctgttccgcctcac

SEQ ID NO: 530443 - DNA, 20 bp, Homo sapiens
agccctgttccgcctcactg

SEQ ID NO: 530444 - DNA, 22 bp, Homo sapiens
agccctgttccgcctcactggg

SEQ ID NO: 530445 - DNA, 13 bp, Homo sapiens
agcctcactgata

SEQ ID NO: 530446 - DNA, 23 bp, Homo sapiens
agcctccactttggatcaggaaa

SEQ ID NO: 530447 - DNA, 17 bp, Homo sapiens
agcctgatgatggaagg

SEQ ID NO: 530448 - DNA, 17 bp, Homo sapiens
agcctgtgaactgccag

SEQ ID NO: 530449 - DNA, 22 bp, Homo sapiens
agcctgtgaactgccaggcagc

SEQ ID NO: 530450 - DNA, 22 bp, Homo sapiens
agccttaagtcttactgttttg

SEQ ID NO: 530451 - DNA, 22 bp, Homo sapiens
agcggcttccccattgccttct

SEQ ID NO: 530452 - DNA, 12 bp, Homo sapiens
agcggggcttct

SEQ ID NO: 530453 - DNA, 15 bp, Homo sapiens
agcggggcttctggg

SEQ ID NO: 530454 - DNA, 17 bp, Homo sapiens
agcggggcttctgggcg

SEQ ID NO: 530455 - DNA, 22 bp, Homo sapiens
atgtctttctccaaagttatcc

SEQ ID NO: 530456 - DNA, 14 bp, Homo sapiens
atgtgatttatgca

SEQ ID NO: 530457 - DNA, 16 bp, Homo sapiens
atgtgatttatgcatt

SEQ ID NO: 530458 - DNA, 20 bp, Homo sapiens
atgtggaattacataacagg

SEQ ID NO: 530459 - DNA, 19 bp, Homo sapiens
atgttcacgcaacttgaaa

SEQ ID NO: 530460 - DNA, 14 bp, Homo sapiens
atgtttagtagctg

SEQ ID NO: 530461 - DNA, 16 bp, Homo sapiens
atgtttagtagctgat

SEQ ID NO: 530462 - DNA, 19 bp, Homo sapiens
atgtttagtagctgataaa

SEQ ID NO: 530463 - DNA, 13 bp, Homo sapiens
atgtttggctgaa

SEQ ID NO: 530464 - DNA, 16 bp, Homo sapiens
atgtttggctgaaatt

SEQ ID NO: 530465 - DNA, 15 bp, Homo sapiens
attaaaaagttaatc

SEQ ID NO: 530466 - DNA, 16 bp, Homo sapiens
attaaaacaaaatcct

SEQ ID NO: 530467 - DNA, 18 bp, Homo sapiens
attaagttataccagcaa

SEQ ID NO: 530468 - DNA, 14 bp, Homo sapiens
attagacaatgtgg

SEQ ID NO: 530469 - DNA, 19 bp, Homo sapiens
attagacaatgtggaatta

SEQ ID NO: 530470 - DNA, 20 bp, Homo sapiens
attagattttaaaacttcat

SEQ ID NO: 530471 - DNA, 15 bp, Homo sapiens
attagctgtgatttt

SEQ ID NO: 530472 - DNA, 17 bp, Homo sapiens
attagggctctaatttc

SEQ ID NO: 530473 - DNA, 12 bp, Homo sapiens
attatagcatgt

SEQ ID NO: 530474 - DNA, 23 bp, Homo sapiens
attatctagtaggtctgcacaca

SEQ ID NO: 530475 - DNA, 15 bp, Homo sapiens
attatctgatccttg

SEQ ID NO: 530476 - DNA, 23 bp, Homo sapiens
attatgtcaaatggatgtaatat

SEQ ID NO: 530477 - DNA, 21 bp, Homo sapiens
attcaaagaatcacctaatta

SEQ ID NO: 530478 - DNA, 20 bp, Homo sapiens
attcccatggtagactgtga

SEQ ID NO: 530479 - DNA, 17 bp, Homo sapiens
attcctacttaaacaaa

SEQ ID NO: 530480 - DNA, 17 bp, Homo sapiens
attcctcccctggaagt

SEQ ID NO: 530481 - DNA, 15 bp, Homo sapiens
attcctgaccctcac

SEQ ID NO: 530482 - DNA, 12 bp, Homo sapiens
attctatttcaa

SEQ ID NO: 530483 - DNA, 23 bp, Homo sapiens
attctttcaatccacagtattgt

SEQ ID NO: 530484 - DNA, 23 bp, Homo sapiens
attgaagagagatatatctgaaa

SEQ ID NO: 530485 - DNA, 18 bp, Homo sapiens
attgacattttgtagcta

SEQ ID NO: 530486 - DNA, 16 bp, Homo sapiens
attgcactaaaagtga

SEQ ID NO: 530487 - DNA, 21 bp, Homo sapiens
attgctgagatgtttagtagc

SEQ ID NO: 530488 - DNA, 23 bp, Homo sapiens
attgctgagatgtttagtagctg

SEQ ID NO: 530489 - DNA, 18 bp, Homo sapiens
attgctgtaaataaaaat

SEQ ID NO: 530490 - DNA, 14 bp, Homo sapiens
attggcctccaggg

SEQ ID NO: 530491 - DNA, 23 bp, Homo sapiens
attgtgaatgttgtcctgtgtca

SEQ ID NO: 530492 - DNA, 22 bp, Homo sapiens
attgttcttgtaaaactgtgac

SEQ ID NO: 530493 - DNA, 16 bp, Homo sapiens
atttaggaatgctcaa

SEQ ID NO: 530494 - DNA, 14 bp, Homo sapiens
atttatgcatgaga

SEQ ID NO: 530495 - DNA, 16 bp, Homo sapiens
atttatgcatgagaac

SEQ ID NO: 530496 - DNA, 14 bp, Homo sapiens
atttcacattcctg

SEQ ID NO: 530497 - DNA, 18 bp, Homo sapiens
atttcagctgtgagcttt

SEQ ID NO: 530498 - DNA, 18 bp, Homo sapiens
atttccagcaaaatatat

SEQ ID NO: 530499 - DNA, 15 bp, Homo sapiens
atttctcttaagtac

SEQ ID NO: 530500 - DNA, 18 bp, Homo sapiens
atttcttctctctgtgct

SEQ ID NO: 530501 - DNA, 18 bp, Homo sapiens
atttgactttctgtctgt

SEQ ID NO: 530502 - DNA, 21 bp, Homo sapiens
atttgctgaataacaacaatt

SEQ ID NO: 530503 - DNA, 22 bp, Homo sapiens
attttccagggcaatcaatgtt

SEQ ID NO: 530504 - DNA, 17 bp, Homo sapiens
attttctgagtagcata

SEQ ID NO: 530505 - DNA, 18 bp, Homo sapiens
attttggacgtgtgagga

SEQ ID NO: 530506 - DNA, 18 bp, Homo sapiens
atttttctactgctcttt

SEQ ID NO: 530507 - DNA, 17 bp, Homo sapiens
caaaacaaattcaagaa

SEQ ID NO: 530508 - DNA, 15 bp, Homo sapiens
caaaacaacagcaac

SEQ ID NO: 530509 - DNA, 18 bp, Homo sapiens
caaaacaacagcaacaac

SEQ ID NO: 530510 - DNA, 23 bp, Homo sapiens
caaaatatatgtttggctgaaat

SEQ ID NO: 530511 - DNA, 19 bp, Homo sapiens
caaaatgtgtgcttggaaa

SEQ ID NO: 530512 - DNA, 13 bp, Homo sapiens
caaacctaagttg

SEQ ID NO: 530513 - DNA, 22 bp, Homo sapiens
caaagaatcacctaattaattt

SEQ ID NO: 530514 - DNA, 16 bp, Homo sapiens
caaagcatgctcagta

SEQ ID NO: 530515 - DNA, 20 bp, Homo sapiens
caaagcatttgactttctgt

SEQ ID NO: 530516 - DNA, 14 bp, Homo sapiens
caaatggatgtaat

SEQ ID NO: 530517 - DNA, 16 bp, Homo sapiens
caaatggatgtaatat

SEQ ID NO: 530518 - DNA, 13 bp, Homo sapiens
caaattgctgaga

SEQ ID NO: 530519 - DNA, 16 bp, Homo sapiens
caaattgctgagatgt

SEQ ID NO: 530520 - DNA, 22 bp, Homo sapiens
caaattgtcttttgtcatgtgg

SEQ ID NO: 530521 - DNA, 12 bp, Homo sapiens
caacaacaaagc

SEQ ID NO: 530522 - DNA, 13 bp, Homo sapiens
caacaacagaaca

SEQ ID NO: 530523 - DNA, 15 bp, Homo sapiens
caacaacagaacaac

SEQ ID NO: 530524 - DNA, 20 bp, Homo sapiens
caacaatttaggaatgctca

SEQ ID NO: 530525 - DNA, 22 bp, Homo sapiens
caacaatttaggaatgctcaat

SEQ ID NO: 530526 - DNA, 12 bp, Homo sapiens
caacagaacaac

SEQ ID NO: 530527 - DNA, 16 bp, Homo sapiens
caacagaacaacaaca

SEQ ID NO: 530528 - DNA, 19 bp, Homo sapiens
caacagaacaacaacaaag

SEQ ID NO: 530529 - DNA, 20 bp, Homo sapiens
caacagaacaacaacaaagc

SEQ ID NO: 530530 - DNA, 22 bp, Homo sapiens
caacagcaacaacaacagaaca

SEQ ID NO: 530531 - DNA, 17 bp, Homo sapiens
caacccaggtgttgtcc

SEQ ID NO: 530532 - DNA, 17 bp, Homo sapiens
caacctcccctggtcct

SEQ ID NO: 530533 - DNA, 20 bp, Homo sapiens
caacctcccctggtcctgca

SEQ ID NO: 530534 - DNA, 21 bp, Homo sapiens
caacctcccctggtcctgcac

SEQ ID NO: 530535 - DNA, 18 bp, Homo sapiens
caactctgactgtaaaat

SEQ ID NO: 530536 - DNA, 17 bp, Homo sapiens
caacttacatatgtctt

SEQ ID NO: 530537 - DNA, 22 bp, Homo sapiens
caagatagctccttcatgcttt

SEQ ID NO: 530538 - DNA, 23 bp, Homo sapiens
caagattaagttataccagcaaa

SEQ ID NO: 530539 - DNA, 14 bp, Homo sapiens
caagctcacttgct

SEQ ID NO: 530540 - DNA, 21 bp, Homo sapiens
caagtttattgccctcaaaat

SEQ ID NO: 530541 - DNA, 15 bp, Homo sapiens
caatactttgtgtct

SEQ ID NO: 530542 - DNA, 15 bp, Homo sapiens
caatccacagtattg

SEQ ID NO: 530543 - DNA, 11 bp, Homo sapiens
caatcttgctg

SEQ ID NO: 530544 - DNA, 16 bp, Homo sapiens
caatcttgctgtgaaa

SEQ ID NO: 530545 - DNA, 14 bp, Homo sapiens
caatgtccaggtca

SEQ ID NO: 530546 - DNA, 12 bp, Homo sapiens
caatgtgctgtt

SEQ ID NO: 530547 - DNA, 19 bp, Homo sapiens
caatgtggaattacataac

SEQ ID NO: 530548 - DNA, 17 bp, Homo sapiens
caattctttgttgctta

SEQ ID NO: 530549 - DNA, 17 bp, Homo sapiens
cacacaaaacaacagca

SEQ ID NO: 530550 - DNA, 12 bp, Homo sapiens
cacacacaaaac

SEQ ID NO: 530551 - DNA, 15 bp, Homo sapiens
cacacacaaaacaac

SEQ ID NO: 530552 - DNA, 12 bp, Homo sapiens
cacacacacaaa

SEQ ID NO: 530553 - DNA, 15 bp, Homo sapiens
cacaccaaattgctg

SEQ ID NO: 530554 - DNA, 19 bp, Homo sapiens
cacactgccctctgccact

SEQ ID NO: 530555 - DNA, 13 bp, Homo sapiens
cacacttgggctg

SEQ ID NO: 530556 - DNA, 13 bp, Homo sapiens
cctggcttctggg

SEQ ID NO: 530557 - DNA, 22 bp, Homo sapiens
cctggcttctgggacaggcacc

SEQ ID NO: 530558 - DNA, 23 bp, Homo sapiens
cctgggaaattgctccattcctg

SEQ ID NO: 530559 - DNA, 21 bp, Homo sapiens
cctgggcaacagagtgagacc

SEQ ID NO: 530560 - DNA, 22 bp, Homo sapiens
cctgggggctgttagctcagag

SEQ ID NO: 530561 - DNA, 17 bp, Homo sapiens
cctggtcctgcactgtc

SEQ ID NO: 530562 - DNA, 12 bp, Homo sapiens
cctgtctcctct

SEQ ID NO: 530563 - DNA, 18 bp, Homo sapiens
cctgtgggctcacaccgg

SEQ ID NO: 530564 - DNA, 17 bp, Homo sapiens
cctgtggtttgttatca

SEQ ID NO: 530565 - DNA, 18 bp, Homo sapiens
ccttaaaaaaaaaaatga

SEQ ID NO: 530566 - DNA, 18 bp, Homo sapiens
ccttcatgcttttctcat

SEQ ID NO: 530567 - DNA, 18 bp, Homo sapiens
ccttctggccgctgcagt

SEQ ID NO: 530568 - DNA, 17 bp, Homo sapiens
ccttctggctgctgcag

SEQ ID NO: 530569 - DNA, 23 bp, Homo sapiens
ccttctggggagggacacagagg

SEQ ID NO: 530570 - DNA, 21 bp, Homo sapiens
ccttctggggaggggctccgt

SEQ ID NO: 530571 - DNA, 17 bp, Homo sapiens
ccttctgtgcatctggc

SEQ ID NO: 530572 - DNA, 23 bp, Homo sapiens
ccttctgtgcatctggcctgggg

SEQ ID NO: 530573 - DNA, 17 bp, Homo sapiens
ccttcttcccccagggt

SEQ ID NO: 530574 - DNA, 21 bp, Homo sapiens
ccttgagccgtgacctccagg

SEQ ID NO: 530575 - DNA, 21 bp, Homo sapiens
ccttgtagacgcacctgctga

SEQ ID NO: 530576 - DNA, 18 bp, Homo sapiens
cctttatcatgtgtttct

SEQ ID NO: 530577 - DNA, 20 bp, Homo sapiens
cctttatcatgtgtttctgt

SEQ ID NO: 530578 - DNA, 12 bp, Homo sapiens
cgaatggctttt

SEQ ID NO: 530579 - DNA, 16 bp, Homo sapiens
cgacgatccccatgga

SEQ ID NO: 530580 - DNA, 20 bp, Homo sapiens
cgaggcggcaaagatccagc

SEQ ID NO: 530581 - DNA, 20 bp, Homo sapiens
cgcaaatacatgcctttcca

SEQ ID NO: 530582 - DNA, 22 bp, Homo sapiens
cgcatgcagggcccccacagga

SEQ ID NO: 530583 - DNA, 21 bp, Homo sapiens
cgcccaggatgaaggggccag

SEQ ID NO: 530584 - DNA, 12 bp, Homo sapiens
cgcccctgcctg

SEQ ID NO: 530585 - DNA, 15 bp, Homo sapiens
cgcccctgcctgaga

SEQ ID NO: 530586 - DNA, 12 bp, Homo sapiens
cgctcggggctg

SEQ ID NO: 530587 - DNA, 20 bp, Homo sapiens
cgctgcagtcagcacagaga

SEQ ID NO: 530588 - DNA, 15 bp, Homo sapiens
cggcaaagatccagc

SEQ ID NO: 530589 - DNA, 23 bp, Homo sapiens
cggcgtccctgagggcccttccc

SEQ ID NO: 530590 - DNA, 12 bp, Homo sapiens
cggcttccctgc

SEQ ID NO: 530591 - DNA, 13 bp, Homo sapiens
cgggaacgccccc

SEQ ID NO: 530592 - DNA, 20 bp, Homo sapiens
cgggcaagatagctccttca

SEQ ID NO: 530593 - DNA, 12 bp, Homo sapiens
cgggctccaggg

SEQ ID NO: 530594 - DNA, 17 bp, Homo sapiens
cgggctctctcacccag

SEQ ID NO: 530595 - DNA, 19 bp, Homo sapiens
cggggtggagtcagggctg

SEQ ID NO: 530596 - DNA, 21 bp, Homo sapiens
cggggtgtggaatcaccggga

SEQ ID NO: 530597 - DNA, 15 bp, Homo sapiens
cggtccaatccagcc

SEQ ID NO: 530598 - DNA, 16 bp, Homo sapiens
cggtggcatttgctga

SEQ ID NO: 530599 - DNA, 17 bp, Homo sapiens
cggtggcatttgctgaa

SEQ ID NO: 530600 - DNA, 17 bp, Homo sapiens
cgtccctgagggccctt

SEQ ID NO: 530601 - DNA, 18 bp, Homo sapiens
cgtccctgagggcccttc

SEQ ID NO: 530602 - DNA, 20 bp, Homo sapiens
cgtccctgagggcccttccc

SEQ ID NO: 530603 - DNA, 13 bp, Homo sapiens
cgtgcagggccag

SEQ ID NO: 530604 - DNA, 22 bp, Homo sapiens
cgtgccacatcaataacaacag

SEQ ID NO: 530605 - DNA, 22 bp, Homo sapiens
cgtgctgcccgagggcaggggc

SEQ ID NO: 530606 - DNA, 14 bp, Homo sapiens
cgtgtcctatcccc

SEQ ID NO: 530607 - DNA, 17 bp, Homo sapiens
ctaaaagtgatgtgatt

SEQ ID NO: 530608 - DNA, 22 bp, Homo sapiens
ctaaaagtgatgtgatttatgc

SEQ ID NO: 530609 - DNA, 16 bp, Homo sapiens
ctaaagggaagccctg

SEQ ID NO: 530610 - DNA, 17 bp, Homo sapiens
ctaaagggaagccctga

SEQ ID NO: 530611 - DNA, 20 bp, Homo sapiens
ctaaatagatttttagattc

SEQ ID NO: 530612 - DNA, 22 bp, Homo sapiens
ctaaatagatttttagattcct

SEQ ID NO: 530613 - DNA, 17 bp, Homo sapiens
ctaaatgcctaataaac

SEQ ID NO: 530614 - DNA, 13 bp, Homo sapiens
ctaaattaacttc

SEQ ID NO: 530615 - DNA, 11 bp, Homo sapiens
ctaacactggc

SEQ ID NO: 530616 - DNA, 13 bp, Homo sapiens
ctaacctctctga

SEQ ID NO: 530617 - DNA, 22 bp, Homo sapiens
ctaagataattaaatgaaatac

SEQ ID NO: 530618 - DNA, 21 bp, Homo sapiens
ctaaggtcagtgttataaaat

SEQ ID NO: 530619 - DNA, 17 bp, Homo sapiens
ctaagtaaatctaaatt

SEQ ID NO: 530620 - DNA, 18 bp, Homo sapiens
ctaagtaaatctaaatta

SEQ ID NO: 530621 - DNA, 18 bp, Homo sapiens
ctaatccatgtgctgctg

SEQ ID NO: 530622 - DNA, 13 bp, Homo sapiens
ctaattaatttca

SEQ ID NO: 530623 - DNA, 15 bp, Homo sapiens
ctaattaatttcagt

SEQ ID NO: 530624 - DNA, 16 bp, Homo sapiens
ctacaaaatgtgtgct

SEQ ID NO: 530625 - DNA, 20 bp, Homo sapiens
ctaccccaggatgcatgcag

SEQ ID NO: 530626 - DNA, 23 bp, Homo sapiens
ctactcctccccctcctccatgc

SEQ ID NO: 530627 - DNA, 16 bp, Homo sapiens
ctacttaaacaaaaac

SEQ ID NO: 530628 - DNA, 23 bp, Homo sapiens
ctacttaaacaaaaactttccat

SEQ ID NO: 530629 - DNA, 13 bp, Homo sapiens
ctagcaaaaggat

SEQ ID NO: 530630 - DNA, 15 bp, Homo sapiens
ctagttagagactcg

SEQ ID NO: 530631 - DNA, 21 bp, Homo sapiens
ctagttagagactcgcctggg

SEQ ID NO: 530632 - DNA, 17 bp, Homo sapiens
ctataaatagtgaaaat

SEQ ID NO: 530633 - DNA, 19 bp, Homo sapiens
ctatctcgctagccatata

SEQ ID NO: 530634 - DNA, 13 bp, Homo sapiens
ctatgcacaccaa

SEQ ID NO: 530635 - DNA, 15 bp, Homo sapiens
ctatgcacaccaaat

SEQ ID NO: 530636 - DNA, 16 bp, Homo sapiens
ctatgcacaccaaatt

SEQ ID NO: 530637 - DNA, 18 bp, Homo sapiens
ctatgcacaccaaattgc

SEQ ID NO: 530638 - DNA, 15 bp, Homo sapiens
ctatgctgttcattg

SEQ ID NO: 530639 - DNA, 15 bp, Homo sapiens
ctattgctgtaaata

SEQ ID NO: 530640 - DNA, 19 bp, Homo sapiens
ctcaagatcctgtcttgct

SEQ ID NO: 530641 - DNA, 22 bp, Homo sapiens
ctcaatgtgctgttgattcttt

SEQ ID NO: 530642 - DNA, 16 bp, Homo sapiens
ctcacaccggcactgt

SEQ ID NO: 530643 - DNA, 20 bp, Homo sapiens
ctcacaccggcactgtgcac

SEQ ID NO: 530644 - DNA, 14 bp, Homo sapiens
ctcacacttgggct

SEQ ID NO: 530645 - DNA, 17 bp, Homo sapiens
ctcaccatttaatcatt

SEQ ID NO: 530646 - DNA, 14 bp, Homo sapiens
ctcacccagcctgg

SEQ ID NO: 530647 - DNA, 14 bp, Homo sapiens
ctcaccttctgttt

SEQ ID NO: 530648 - DNA, 15 bp, Homo sapiens
ctcactgggtgtggc

SEQ ID NO: 530649 - DNA, 21 bp, Homo sapiens
ctcactgggtgtggcctggct

SEQ ID NO: 530650 - DNA, 15 bp, Homo sapiens
ctcagaagtgaaaaa

SEQ ID NO: 530651 - DNA, 23 bp, Homo sapiens
ctcagcaaggggctgcttctggg

SEQ ID NO: 530652 - DNA, 16 bp, Homo sapiens
ctcaggcggggatcac

SEQ ID NO: 530653 - DNA, 16 bp, Homo sapiens
ctcagggaccaaggag

SEQ ID NO: 530654 - DNA, 23 bp, Homo sapiens
ctcagggaccaaggagatgggga

SEQ ID NO: 530655 - DNA, 22 bp, Homo sapiens
ctcagtattgagacactgtcaa

SEQ ID NO: 530656 - DNA, 23 bp, Homo sapiens
ctcagtattgagacactgtcaag

SEQ ID NO: 530657 - DNA, 17 bp, Homo sapiens
gaatccccgtgctcaca

SEQ ID NO: 530658 - DNA, 19 bp, Homo sapiens
gaatctctcaaaatgtgcc

SEQ ID NO: 530659 - DNA, 24 bp, Homo sapiens
gaatgaaatataaactgtgagata

SEQ ID NO: 530660 - DNA, 15 bp, Homo sapiens
gaattacataacagg

SEQ ID NO: 530661 - DNA, 17 bp, Homo sapiens
gaattacataacaggca

SEQ ID NO: 530662 - DNA, 19 bp, Homo sapiens
gaattattagcaccagctt

SEQ ID NO: 530663 - DNA, 16 bp, Homo sapiens
gaattggcagaagcag

SEQ ID NO: 530664 - DNA, 12 bp, Homo sapiens
gacaacacacac

SEQ ID NO: 530665 - DNA, 20 bp, Homo sapiens
gacaacacacacacacacaa

SEQ ID NO: 530666 - DNA, 13 bp, Homo sapiens
gacaatgtggaat

SEQ ID NO: 530667 - DNA, 18 bp, Homo sapiens
gacaatgtggaattacat

SEQ ID NO: 530668 - DNA, 14 bp, Homo sapiens
gacagcctgcacag

SEQ ID NO: 530669 - DNA, 15 bp, Homo sapiens
gacatattcccatgg

SEQ ID NO: 530670 - DNA, 21 bp, Homo sapiens
gacatgctaacctctctgaac

SEQ ID NO: 530671 - DNA, 15 bp, Homo sapiens
gacattttgtagcta

SEQ ID NO: 530672 - DNA, 17 bp, Homo sapiens
gacattttgtagctagt

SEQ ID NO: 530673 - DNA, 17 bp, Homo sapiens
gaccacgacctcgtcca

SEQ ID NO: 530674 - DNA, 21 bp, Homo sapiens
gaccacggtccaatccagcct

SEQ ID NO: 530675 - DNA, 15 bp, Homo sapiens
gaccggggtggagtc

SEQ ID NO: 530676 - DNA, 20 bp, Homo sapiens
gacctaccctggaccgagtg

SEQ ID NO: 530677 - DNA, 23 bp, Homo sapiens
gacgatccccatggaacagccct

SEQ ID NO: 530678 - DNA, 12 bp, Homo sapiens
gacgcatgcagg

SEQ ID NO: 530679 - DNA, 14 bp, Homo sapiens
gacttctaaatcat

SEQ ID NO: 530680 - DNA, 21 bp, Homo sapiens
gacttctaaatcataatcatc

SEQ ID NO: 530681 - DNA, 18 bp, Homo sapiens
gacttctttactaacact

SEQ ID NO: 530682 - DNA, 22 bp, Homo sapiens
gacttctttactaacactggct

SEQ ID NO: 530683 - DNA, 12 bp, Homo sapiens
gagaaggaggaa

SEQ ID NO: 530684 - DNA, 14 bp, Homo sapiens
gagaaggaggaacc

SEQ ID NO: 530685 - DNA, 14 bp, Homo sapiens
gagacaacacacac

SEQ ID NO: 530686 - DNA, 15 bp, Homo sapiens
gagacaacacacaca

SEQ ID NO: 530687 - DNA, 19 bp, Homo sapiens
gagacccctttgccttccc

SEQ ID NO: 530688 - DNA, 14 bp, Homo sapiens
gagactcgcctggg

SEQ ID NO: 530689 - DNA, 16 bp, Homo sapiens
gagactcgcctgggaa

SEQ ID NO: 530690 - DNA, 19 bp, Homo sapiens
gagagagcaatcttgctgt

SEQ ID NO: 530691 - DNA, 16 bp, Homo sapiens
gagagcggcttcccca

SEQ ID NO: 530692 - DNA, 15 bp, Homo sapiens
gagaggaaaaaggct

SEQ ID NO: 530693 - DNA, 12 bp, Homo sapiens
gagataaatatc

SEQ ID NO: 530694 - DNA, 20 bp, Homo sapiens
gagatagccgggctccaggg

SEQ ID NO: 530695 - DNA, 19 bp, Homo sapiens
gagcagagacgaagacccc

SEQ ID NO: 530696 - DNA, 15 bp, Homo sapiens
gagcatgaagataaa

SEQ ID NO: 530697 - DNA, 19 bp, Homo sapiens
gagccaataaagctcacac

SEQ ID NO: 530698 - DNA, 15 bp, Homo sapiens
gagccgtcagcctgt

SEQ ID NO: 530699 - DNA, 16 bp, Homo sapiens
gagccgtcagcctgtg

SEQ ID NO: 530700 - DNA, 16 bp, Homo sapiens
gagcctgcttgctgat

SEQ ID NO: 530701 - DNA, 21 bp, Homo sapiens
gagcggcttccccatcgcctt

SEQ ID NO: 530702 - DNA, 23 bp, Homo sapiens
gagcggcttccccattgccttct

SEQ ID NO: 530703 - DNA, 14 bp, Homo sapiens
gagctatgcacacc

SEQ ID NO: 530704 - DNA, 15 bp, Homo sapiens
gagctatgcacacca

SEQ ID NO: 530705 - DNA, 20 bp, Homo sapiens
gagctcaggccctggtgagg

SEQ ID NO: 530706 - DNA, 21 bp, Homo sapiens
gagctggcctattttggacgt

SEQ ID NO: 530707 - DNA, 19 bp, Homo sapiens
gagctttcccagagacccg

SEQ ID NO: 530708 - DNA, 18 bp, Homo sapiens
gaggagagagggggagac

SEQ ID NO: 530709 - DNA, 22 bp, Homo sapiens
gaggtcctgtcctggctcccag

SEQ ID NO: 530710 - DNA, 21 bp, Homo sapiens
gagtatggtgctgggtcctta

SEQ ID NO: 530711 - DNA, 22 bp, Homo sapiens
gagtggaccacgacctcgtcca

SEQ ID NO: 530712 - DNA, 14 bp, Homo sapiens
gagtgtcaggctct

SEQ ID NO: 530713 - DNA, 19 bp, Homo sapiens
gataaatatcattatagca

SEQ ID NO: 530714 - DNA, 17 bp, Homo sapiens
gataattaaatgaaata

SEQ ID NO: 530715 - DNA, 18 bp, Homo sapiens
gataattaaatgaaatac

SEQ ID NO: 530716 - DNA, 17 bp, Homo sapiens
gataccattttgaaata

SEQ ID NO: 530717 - DNA, 14 bp, Homo sapiens
gatacttggtcctt

SEQ ID NO: 530718 - DNA, 21 bp, Homo sapiens
gatagccgggctccagggagt

SEQ ID NO: 530719 - DNA, 20 bp, Homo sapiens
gatatctgtttgcttctaaa

SEQ ID NO: 530720 - DNA, 22 bp, Homo sapiens
gatatgagaaatataaaaataa

SEQ ID NO: 530721 - DNA, 15 bp, Homo sapiens
gatatgtctttaaaa

SEQ ID NO: 530722 - DNA, 19 bp, Homo sapiens
gatccccatggaacagccc

SEQ ID NO: 530723 - DNA, 18 bp, Homo sapiens
gatgcgtggctcccagca

SEQ ID NO: 530724 - DNA, 19 bp, Homo sapiens
gatggattggcctccaggg

SEQ ID NO: 530725 - DNA, 18 bp, Homo sapiens
gatggatttgacacactc

SEQ ID NO: 530726 - DNA, 19 bp, Homo sapiens
gatggatttgacacactca

SEQ ID NO: 530727 - DNA, 20 bp, Homo sapiens
gatgtaatatagggtttgtt

SEQ ID NO: 530728 - DNA, 15 bp, Homo sapiens
gatgtttagtagctg

SEQ ID NO: 530729 - DNA, 17 bp, Homo sapiens
gatgtttagtagctgat

SEQ ID NO: 530730 - DNA, 19 bp, Homo sapiens
gattaagttataccagcaa

SEQ ID NO: 530731 - DNA, 16 bp, Homo sapiens
gattagacaatgtgga

SEQ ID NO: 530732 - DNA, 20 bp, Homo sapiens
gattcccgtggctttgtgct

SEQ ID NO: 530733 - DNA, 15 bp, Homo sapiens
gattcctacttaaac

SEQ ID NO: 530734 - DNA, 19 bp, Homo sapiens
gattcctacttaaacaaaa

SEQ ID NO: 530735 - DNA, 21 bp, Homo sapiens
gattcctacttaaacaaaaac

SEQ ID NO: 530736 - DNA, 18 bp, Homo sapiens
gattcctcccctggaagt

SEQ ID NO: 530737 - DNA, 23 bp, Homo sapiens
gattctttcaatccacagtattg

SEQ ID NO: 530738 - DNA, 15 bp, Homo sapiens
gattggcctccaggg

SEQ ID NO: 530739 - DNA, 16 bp, Homo sapiens
gattggcctccagggc

SEQ ID NO: 530740 - DNA, 15 bp, Homo sapiens
gatttcatgattaga

SEQ ID NO: 530741 - DNA, 14 bp, Homo sapiens
gattttcatgttct

SEQ ID NO: 530742 - DNA, 14 bp, Homo sapiens
gatttttgttgatt

SEQ ID NO: 530743 - DNA, 18 bp, Homo sapiens
gcaaactgaagcccacag

SEQ ID NO: 530744 - DNA, 21 bp, Homo sapiens
gcaaagcatgccaatttctct

SEQ ID NO: 530745 - DNA, 17 bp, Homo sapiens
gcaacaacaacagaaca

SEQ ID NO: 530746 - DNA, 11 bp, Homo sapiens
gcaacactgga

SEQ ID NO: 530747 - DNA, 19 bp, Homo sapiens
gcaaggggctgcttctggg

SEQ ID NO: 530748 - DNA, 12 bp, Homo sapiens
gcaatcttgctg

SEQ ID NO: 530749 - DNA, 15 bp, Homo sapiens
gcaatcttgctgtga

SEQ ID NO: 530750 - DNA, 21 bp, Homo sapiens
gcaattgcttctctaaaacag

SEQ ID NO: 530751 - DNA, 13 bp, Homo sapiens
gcacacataacac

SEQ ID NO: 530752 - DNA, 20 bp, Homo sapiens
gcacagagagcggcttcccc

SEQ ID NO: 530753 - DNA, 18 bp, Homo sapiens
gcacagctttcctgggtc

SEQ ID NO: 530754 - DNA, 17 bp, Homo sapiens
gcacctcgccgtgtctt

SEQ ID NO: 530755 - DNA, 15 bp, Homo sapiens
gcactaaaagtgatg

SEQ ID NO: 530756 - DNA, 22 bp, Homo sapiens
gcactaaaagtgatgtgattta

SEQ ID NO: 530757 - DNA, 20 bp, Homo sapiens
gcagcagagagaaataaaac

SEQ ID NO: 530758 - DNA, 20 bp, Homo sapiens
gtttgtttgctgcttttgat

SEQ ID NO: 530759 - DNA, 22 bp, Homo sapiens
gtttttgttcaccttctgtgca

SEQ ID NO: 530760 - DNA, 15 bp, Homo sapiens
taaaaaaaaaaatga

SEQ ID NO: 530761 - DNA, 12 bp, Homo sapiens
taaaaagttaat

SEQ ID NO: 530762 - DNA, 16 bp, Homo sapiens
taaaaatagctataaa

SEQ ID NO: 530763 - DNA, 12 bp, Homo sapiens
taaaacaaaatc

SEQ ID NO: 530764 - DNA, 16 bp, Homo sapiens
taaaactgtgacattc

SEQ ID NO: 530765 - DNA, 22 bp, Homo sapiens
taaaactgtgacattccacaga

SEQ ID NO: 530766 - DNA, 15 bp, Homo sapiens
taaaagtgatgtgat

SEQ ID NO: 530767 - DNA, 20 bp, Homo sapiens
taaaatacatggtatctctt

SEQ ID NO: 530768 - DNA, 23 bp, Homo sapiens
taaaatgattcacttttattgta

SEQ ID NO: 530769 - DNA, 14 bp, Homo sapiens
taaaattattaaaa

SEQ ID NO: 530770 - DNA, 21 bp, Homo sapiens
taaaattattaaaaattatag

SEQ ID NO: 530771 - DNA, 19 bp, Homo sapiens
taaacaaaaactttccatg

SEQ ID NO: 530772 - DNA, 17 bp, Homo sapiens
taaacaaattccttccc

SEQ ID NO: 530773 - DNA, 12 bp, Homo sapiens
taaactagcaaa

SEQ ID NO: 530774 - DNA, 13 bp, Homo sapiens
taaactcagtcaa

SEQ ID NO: 530775 - DNA, 17 bp, Homo sapiens
taaagaaaccttttaaa

SEQ ID NO: 530776 - DNA, 23 bp, Homo sapiens
taaagaccatttagtcctcacct

SEQ ID NO: 530777 - DNA, 19 bp, Homo sapiens
taaagcaagctcacttgct

SEQ ID NO: 530778 - DNA, 21 bp, Homo sapiens
taaatagatttttagattcct

SEQ ID NO: 530779 - DNA, 22 bp, Homo sapiens
taaatagatttttagattccta

SEQ ID NO: 530780 - DNA, 14 bp, Homo sapiens
taaatcataatcat

SEQ ID NO: 530781 - DNA, 21 bp, Homo sapiens
taaatctaaattaacttctat

SEQ ID NO: 530782 - DNA, 13 bp, Homo sapiens
taaatgaaatact

SEQ ID NO: 530783 - DNA, 22 bp, Homo sapiens
taaatgaaatacttgacaacat

SEQ ID NO: 530784 - DNA, 17 bp, Homo sapiens
taaatgaatgaaatata

SEQ ID NO: 530785 - DNA, 14 bp, Homo sapiens
taaatgtatattga

SEQ ID NO: 530786 - DNA, 21 bp, Homo sapiens
taaattcctcctgtctcctct

SEQ ID NO: 530787 - DNA, 11 bp, Homo sapiens
taacaacaatt

SEQ ID NO: 530788 - DNA, 22 bp, Homo sapiens
taacaacaatttaggaatgctc

SEQ ID NO: 530789 - DNA, 23 bp, Homo sapiens
taacaacaatttaggaatgctca

SEQ ID NO: 530790 - DNA, 17 bp, Homo sapiens
taacaggcattgcacta

SEQ ID NO: 530791 - DNA, 19 bp, Homo sapiens
taacattctatttcaactt

SEQ ID NO: 530792 - DNA, 17 bp, Homo sapiens
taaccttatcataaatt

SEQ ID NO: 530793 - DNA, 21 bp, Homo sapiens
taactacctttggcttaattc

SEQ ID NO: 530794 - DNA, 22 bp, Homo sapiens
taactacctttggcttaattcc

SEQ ID NO: 530795 - DNA, 14 bp, Homo sapiens
taacttgctgtgaa

SEQ ID NO: 530796 - DNA, 20 bp, Homo sapiens
taacttgctgtgaaatgact

SEQ ID NO: 530797 - DNA, 20 bp, Homo sapiens
taagataattaaatgaaata

SEQ ID NO: 530798 - DNA, 22 bp, Homo sapiens
taagataattaaatgaaatact

SEQ ID NO: 530799 - DNA, 22 bp, Homo sapiens
taaggtcagtgttataaaatct

SEQ ID NO: 530800 - DNA, 14 bp, Homo sapiens
taatagcctcacct

SEQ ID NO: 530801 - DNA, 13 bp, Homo sapiens
taatataaatgaa

SEQ ID NO: 530802 - DNA, 12 bp, Homo sapiens
taatattaaatt

SEQ ID NO: 530803 - DNA, 15 bp, Homo sapiens
taatcatttccagca

SEQ ID NO: 530804 - DNA, 19 bp, Homo sapiens
taatcatttccagcaaaat

SEQ ID NO: 530805 - DNA, 22 bp, Homo sapiens
taatcatttccagcaaaatata

SEQ ID NO: 530806 - DNA, 15 bp, Homo sapiens
taattaaatgaaata

SEQ ID NO: 530807 - DNA, 22 bp, Homo sapiens
taattaaatgaaatacttgaca

SEQ ID NO: 530808 - DNA, 20 bp, Homo sapiens
taatttaggagttttgagaa

SEQ ID NO: 530809 - DNA, 17 bp, Homo sapiens
taatttccttaaagcaa

SEQ ID NO: 530810 - DNA, 22 bp, Homo sapiens
tacaaaaaaaatcaaaaaatta

SEQ ID NO: 530811 - DNA, 14 bp, Homo sapiens
tacaaaatgtgtgc

SEQ ID NO: 530812 - DNA, 18 bp, Homo sapiens
tacaattctttgttgctt

SEQ ID NO: 530813 - DNA, 20 bp, Homo sapiens
tacacttctcaaatgctact

SEQ ID NO: 530814 - DNA, 20 bp, Homo sapiens
tacagctgaaagacagtaaa

SEQ ID NO: 530815 - DNA, 20 bp, Homo sapiens
tacataacaggcattgcact

SEQ ID NO: 530816 - DNA, 22 bp, Homo sapiens
tacatgatgatttcagaaacaa

SEQ ID NO: 530817 - DNA, 13 bp, Homo sapiens
tacatggtatctc

SEQ ID NO: 530818 - DNA, 15 bp, Homo sapiens
tacatttatgtgtga

SEQ ID NO: 530819 - DNA, 20 bp, Homo sapiens
tacatttatgtgtgaagcaa

SEQ ID NO: 530820 - DNA, 20 bp, Homo sapiens
taccatagcttaagaagtat

SEQ ID NO: 530821 - DNA, 21 bp, Homo sapiens
taccattatggctttgtgctt

SEQ ID NO: 530822 - DNA, 15 bp, Homo sapiens
taccattttgaaata

SEQ ID NO: 530823 - DNA, 19 bp, Homo sapiens
taccccaggacgcatgcag

SEQ ID NO: 530824 - DNA, 18 bp, Homo sapiens
tacctctgcataaatatt

SEQ ID NO: 530825 - DNA, 22 bp, Homo sapiens
tacctggcttagcgttctgttt

SEQ ID NO: 530826 - DNA, 15 bp, Homo sapiens
tacgttaattaaaca

SEQ ID NO: 530827 - DNA, 20 bp, Homo sapiens
tactatggtatatattttga

SEQ ID NO: 530828 - DNA, 18 bp, Homo sapiens
tactcctccccctcctcc

SEQ ID NO: 530829 - DNA, 18 bp, Homo sapiens
tactgaaggtgccagacg

SEQ ID NO: 530830 - DNA, 14 bp, Homo sapiens
tacttaaacaaaaa

SEQ ID NO: 530831 - DNA, 15 bp, Homo sapiens
tactttgtgtctttt

SEQ ID NO: 530832 - DNA, 20 bp, Homo sapiens
tagaatactgtattgttaca

SEQ ID NO: 530833 - DNA, 20 bp, Homo sapiens
tagacaatgtggaattacat

SEQ ID NO: 530834 - DNA, 22 bp, Homo sapiens
tagacaatgtggaattacataa

SEQ ID NO: 530835 - DNA, 16 bp, Homo sapiens
tagatatgagaaatat

SEQ ID NO: 530836 - DNA, 17 bp, Homo sapiens
tagattcctacttaaac

SEQ ID NO: 530837 - DNA, 21 bp, Homo sapiens
tagattcctacttaaacaaaa

SEQ ID NO: 530838 - DNA, 17 bp, Homo sapiens
tagattttcatgttctt

SEQ ID NO: 530839 - DNA, 21 bp, Homo sapiens
tagcaattgcttctctaaaac

SEQ ID NO: 530840 - DNA, 20 bp, Homo sapiens
tagcacagaggatggcttcc

SEQ ID NO: 530841 - DNA, 21 bp, Homo sapiens
tagcacagaggatggcttccc

SEQ ID NO: 530842 - DNA, 22 bp, Homo sapiens
tagcacagaggatggcttcccc

SEQ ID NO: 530843 - DNA, 16 bp, Homo sapiens
tagcatactgatgaga

SEQ ID NO: 530844 - DNA, 19 bp, Homo sapiens
tagcatactgatgagacaa

SEQ ID NO: 530845 - DNA, 22 bp, Homo sapiens
tagcatactgatgagacaacac

SEQ ID NO: 530846 - DNA, 11 bp, Homo sapiens
tagctccttca

SEQ ID NO: 530847 - DNA, 14 bp, Homo sapiens
tagctgataaagaa

SEQ ID NO: 530848 - DNA, 20 bp, Homo sapiens
tagctgataaagaaaccttt

SEQ ID NO: 530849 - DNA, 18 bp, Homo sapiens
taggaatgctcaatgtgc

SEQ ID NO: 530850 - DNA, 17 bp, Homo sapiens
taggacatctctgtaaa

SEQ ID NO: 530851 - DNA, 22 bp, Homo sapiens
taggacatctctgtaaaaagca

SEQ ID NO: 530852 - DNA, 17 bp, Homo sapiens
tagggctctaatttcct

SEQ ID NO: 530853 - DNA, 14 bp, Homo sapiens
taggtctgcacaca

SEQ ID NO: 530854 - DNA, 15 bp, Homo sapiens
tagtagctgataaag

SEQ ID NO: 530855 - DNA, 20 bp, Homo sapiens
tagtcctcaccttctgtttt

SEQ ID NO: 530856 - DNA, 21 bp, Homo sapiens
tagtggtcatttggtggctct

SEQ ID NO: 530857 - DNA, 20 bp, Homo sapiens
tagtttaaaattattaaaaa

SEQ ID NO: 530858 - DNA, 22 bp, Homo sapiens
tgccactgacaggaaagtggat

SEQ ID NO: 530859 - DNA, 21 bp, Homo sapiens
tgccagacgtgctcctgctga

SEQ ID NO: 530860 - DNA, 22 bp, Homo sapiens
tgcccacccgtgttctcctcca

SEQ ID NO: 530861 - DNA, 15 bp, Homo sapiens
tgccccccatgccct

SEQ ID NO: 530862 - DNA, 20 bp, Homo sapiens
tgccccccatgccctccctg

SEQ ID NO: 530863 - DNA, 19 bp, Homo sapiens
tgccctcaaaatctttaga

SEQ ID NO: 530864 - DNA, 14 bp, Homo sapiens
tgccctccctgctg

SEQ ID NO: 530865 - DNA, 16 bp, Homo sapiens
tgccctccctgctgcc

SEQ ID NO: 530866 - DNA, 20 bp, Homo sapiens
tgccctccctgctgccaggc

SEQ ID NO: 530867 - DNA, 20 bp, Homo sapiens
tgccgcttaaacatttccct

SEQ ID NO: 530868 - DNA, 16 bp, Homo sapiens
tgccggtggggccagc

SEQ ID NO: 530869 - DNA, 17 bp, Homo sapiens
tgccggtggggccagcg

SEQ ID NO: 530870 - DNA, 20 bp, Homo sapiens
tgccggtggggccagcgctg

SEQ ID NO: 530871 - DNA, 23 bp, Homo sapiens
tgccgtctttggttcctcatggc

SEQ ID NO: 530872 - DNA, 24 bp, Homo sapiens
tgccttcatggaactcagctgtct

SEQ ID NO: 530873 - DNA, 12 bp, Homo sapiens
tgccttctgggg

SEQ ID NO: 530874 - DNA, 20 bp, Homo sapiens
tgccttctggggagggacac

SEQ ID NO: 530875 - DNA, 17 bp, Homo sapiens
tgcgccctgacatgcta

SEQ ID NO: 530876 - DNA, 12 bp, Homo sapiens
tgcgtggctccc

SEQ ID NO: 530877 - DNA, 17 bp, Homo sapiens
tgctaattaaaaagtta

SEQ ID NO: 530878 - DNA, 16 bp, Homo sapiens
tgctacaaaatgtgtg

SEQ ID NO: 530879 - DNA, 17 bp, Homo sapiens
tgctcaatgtgctgttg

SEQ ID NO: 530880 - DNA, 22 bp, Homo sapiens
tgctcagtattgagacactgtc

SEQ ID NO: 530881 - DNA, 13 bp, Homo sapiens
tgctccattcctg

SEQ ID NO: 530882 - DNA, 14 bp, Homo sapiens
tgctgaccttctgc

SEQ ID NO: 530883 - DNA, 14 bp, Homo sapiens
tgctgcactgccct

SEQ ID NO: 530884 - DNA, 16 bp, Homo sapiens
tgctgcactgccctcc

SEQ ID NO: 530885 - DNA, 24 bp, Homo sapiens
tgctgccccacaacacaccttgcc

SEQ ID NO: 530886 - DNA, 13 bp, Homo sapiens
tgctgcctcagga

SEQ ID NO: 530887 - DNA, 15 bp, Homo sapiens
tgctgcctcaggaat

SEQ ID NO: 530888 - DNA, 24 bp, Homo sapiens
tgctgctccctttatcatgtgttt

SEQ ID NO: 530889 - DNA, 13 bp, Homo sapiens
tgctgctgtggca

SEQ ID NO: 530890 - DNA, 16 bp, Homo sapiens
tgctgggtccttaaaa

SEQ ID NO: 530891 - DNA, 16 bp, Homo sapiens
tgctgtaaataaaaat

SEQ ID NO: 530892 - DNA, 20 bp, Homo sapiens
tgctgtaaataaaaatagct

SEQ ID NO: 530893 - DNA, 20 bp, Homo sapiens
tgctgtccctgtgggctcac

SEQ ID NO: 530894 - DNA, 23 bp, Homo sapiens
tgctgtccctgtgggctcacacc

SEQ ID NO: 530895 - DNA, 17 bp, Homo sapiens
tgctgtgaaacagtgtg

SEQ ID NO: 530896 - DNA, 16 bp, Homo sapiens
tgctgtgaaatgactg

SEQ ID NO: 530897 - DNA, 16 bp, Homo sapiens
tgcttaatctagagct

SEQ ID NO: 530898 - DNA, 21 bp, Homo sapiens
tgcttaatctagagctatgca

SEQ ID NO: 530899 - DNA, 16 bp, Homo sapiens
tgcttatgtcatttct

SEQ ID NO: 530900 - DNA, 20 bp, Homo sapiens
tgcttggtttagctgtgcag

SEQ ID NO: 530901 - DNA, 14 bp, Homo sapiens
tgcttgttcttcct

SEQ ID NO: 530902 - DNA, 20 bp, Homo sapiens
tgcttttgatggctatgttt

SEQ ID NO: 530903 - DNA, 21 bp, Homo sapiens
tggaaaatgttctgacagcat

SEQ ID NO: 530904 - DNA, 12 bp, Homo sapiens
tggaacagccct

SEQ ID NO: 530905 - DNA, 14 bp, Homo sapiens
tggaagttgtcctt

SEQ ID NO: 530906 - DNA, 19 bp, Homo sapiens
tggaattattagcaccagc

SEQ ID NO: 530907 - DNA, 17 bp, Homo sapiens
tggacgtgggctccagg

SEQ ID NO: 530908 - DNA, 14 bp, Homo sapiens
tggaggagaaggag

SEQ ID NO: 530909 - DNA, 15 bp, Homo sapiens
tggaggagaaggagg

SEQ ID NO: 530910 - DNA, 17 bp, Homo sapiens
tggaggagaaggaggaa

SEQ ID NO: 530911 - DNA, 23 bp, Homo sapiens
tggatttgacacactcaccattt

SEQ ID NO: 530912 - DNA, 13 bp, Homo sapiens
tggcacccactgg

SEQ ID NO: 530913 - DNA, 16 bp, Homo sapiens
tggccaggcctcaggg

SEQ ID NO: 530914 - DNA, 13 bp, Homo sapiens
tggcctgggggct

SEQ ID NO: 530915 - DNA, 16 bp, Homo sapiens
tggctcccagcagagg

SEQ ID NO: 530916 - DNA, 18 bp, Homo sapiens
tggctcccagggtcctgg

SEQ ID NO: 530917 - DNA, 12 bp, Homo sapiens
tggctgaaatta

SEQ ID NO: 530918 - DNA, 18 bp, Homo sapiens
tggctgagagggtgtggg

SEQ ID NO: 530919 - DNA, 13 bp, Homo sapiens
tggctgccagggg

SEQ ID NO: 530920 - DNA, 19 bp, Homo sapiens
tggctgttatctgtcttta

SEQ ID NO: 530921 - DNA, 15 bp, Homo sapiens
tggcttcccatgtct

SEQ ID NO: 530922 - DNA, 17 bp, Homo sapiens
tggcttcccatgtcttt

SEQ ID NO: 530923 - DNA, 16 bp, Homo sapiens
tgggaatcctggacag

SEQ ID NO: 530924 - DNA, 17 bp, Homo sapiens
tgggagccgtcagcctg

SEQ ID NO: 530925 - DNA, 20 bp, Homo sapiens
tgggagccgtcagcctgtga

SEQ ID NO: 530926 - DNA, 20 bp, Homo sapiens
tgggattcctcccctggaag

SEQ ID NO: 530927 - DNA, 20 bp, Homo sapiens
tgggcgccggttccacgtgg

SEQ ID NO: 530928 - DNA, 21 bp, Homo sapiens
tgggcgccggttccacgtggg

SEQ ID NO: 530929 - DNA, 13 bp, Homo sapiens
tgggctcacaccg

SEQ ID NO: 530930 - DNA, 15 bp, Homo sapiens
tgggctcacaccggc

SEQ ID NO: 530931 - DNA, 18 bp, Homo sapiens
tgggctggcacccactgg

SEQ ID NO: 530932 - DNA, 16 bp, Homo sapiens
tgggggctgctgcact

SEQ ID NO: 530933 - DNA, 22 bp, Homo sapiens
tgggggctgctgcactgccctc

SEQ ID NO: 530934 - DNA, 21 bp, Homo sapiens
tgggtcccgggtgccccccat

SEQ ID NO: 530935 - DNA, 13 bp, Homo sapiens
tgggtgccctgtt

SEQ ID NO: 530936 - DNA, 16 bp, Homo sapiens
tggtaacttgctgtga

SEQ ID NO: 530937 - DNA, 19 bp, Homo sapiens
tggtcatttggtggctcta

SEQ ID NO: 530938 - DNA, 16 bp, Homo sapiens
tggtccagggtccagc

SEQ ID NO: 530939 - DNA, 21 bp, Homo sapiens
tggtgtctaataaacacagat

SEQ ID NO: 530940 - DNA, 16 bp, Homo sapiens
tggttacctattgctg

SEQ ID NO: 530941 - DNA, 22 bp, Homo sapiens
tggttccacaatcatctattga

SEQ ID NO: 530942 - DNA, 12 bp, Homo sapiens
tgtaaaactgtg

SEQ ID NO: 530943 - DNA, 14 bp, Homo sapiens
tgtaaaactgtgac

SEQ ID NO: 530944 - DNA, 15 bp, Homo sapiens
tgtaaaactgtgaca

SEQ ID NO: 530945 - DNA, 23 bp, Homo sapiens
tgtaaaactgtgacattccacag

SEQ ID NO: 530946 - DNA, 19 bp, Homo sapiens
tgtaaataaaaatagctat

SEQ ID NO: 530947 - DNA, 16 bp, Homo sapiens
tgtaatagcctcacct

SEQ ID NO: 530948 - DNA, 19 bp, Homo sapiens
tgtaatcacactctcttct

SEQ ID NO: 530949 - DNA, 17 bp, Homo sapiens
tgtacatttatgtgtga

SEQ ID NO: 530950 - DNA, 21 bp, Homo sapiens
tgtatttttcctctttcactt

SEQ ID NO: 530951 - DNA, 19 bp, Homo sapiens
tgtcaatatatagagactt

SEQ ID NO: 530952 - DNA, 13 bp, Homo sapiens
tgtcacttttttc

SEQ ID NO: 530953 - DNA, 14 bp, Homo sapiens
tgtcagtttgtgaa

SEQ ID NO: 530954 - DNA, 13 bp, Homo sapiens
tgtcatctgtcag

SEQ ID NO: 530955 - DNA, 15 bp, Homo sapiens
tgtcatctgtcagct

SEQ ID NO: 530956 - DNA, 18 bp, Homo sapiens
tgtcatctgtcagcttcc

SEQ ID NO: 530957 - DNA, 18 bp, Homo sapiens
tgtccaggtcacaggcat

SEQ ID NO: 530958 - DNA, 20 bp, Homo sapiens
tgtcccggagctcaggccct

SEQ ID NO: 530959 - DNA, 17 bp, Homo sapiens
cctctttcggaaatgat

SEQ ID NO: 530960 - DNA, 17 bp, Homo sapiens
cctgaaagcaacagctg

SEQ ID NO: 530961 - DNA, 12 bp, Homo sapiens
cctgaaagccct

SEQ ID NO: 530962 - DNA, 20 bp, Homo sapiens
cctgaaatattttctacttt

SEQ ID NO: 530963 - DNA, 19 bp, Homo sapiens
cctgaaatgtgtgtgatgt

SEQ ID NO: 530964 - DNA, 14 bp, Homo sapiens
cgtggcaaatataa

SEQ ID NO: 530965 - DNA, 15 bp, Homo sapiens
cgtggcctggggctg

SEQ ID NO: 530966 - DNA, 17 bp, Homo sapiens
cgtggctgacccccctc

SEQ ID NO: 530967 - DNA, 18 bp, Homo sapiens
cgtggctgacccccctca

SEQ ID NO: 530968 - DNA, 19 bp, Homo sapiens
cgtggctgcggcacccttg

SEQ ID NO: 530969 - DNA, 17 bp, Homo sapiens
cgtgggcggcagagagg

SEQ ID NO: 530970 - DNA, 18 bp, Homo sapiens
cgtggggcagcacagaga

SEQ ID NO: 530971 - DNA, 22 bp, Homo sapiens
cgtgtatatgaggatgtatgtg

SEQ ID NO: 530972 - DNA, 23 bp, Homo sapiens
cgtgtatatgaggatgtatgtgt

SEQ ID NO: 530973 - DNA, 17 bp, Homo sapiens
cgtgtatttggctgggc

SEQ ID NO: 530974 - DNA, 12 bp, Homo sapiens
cgtgtgctgtgt

SEQ ID NO: 530975 - DNA, 14 bp, Homo sapiens
cgtgtgctgtgttt

SEQ ID NO: 530976 - DNA, 14 bp, Homo sapiens
cgtgtgcttagaaa

SEQ ID NO: 530977 - DNA, 16 bp, Homo sapiens
cgtgtttgtctcttct

SEQ ID NO: 530978 - DNA, 18 bp, Homo sapiens
cgttaggatactgcctcc

SEQ ID NO: 530979 - DNA, 20 bp, Homo sapiens
cgttcacccctccacccttg

SEQ ID NO: 530980 - DNA, 15 bp, Homo sapiens
cgttgttttgtggat

SEQ ID NO: 530981 - DNA, 18 bp, Homo sapiens
cgttgttttgtggataag

SEQ ID NO: 530982 - DNA, 17 bp, Homo sapiens
ctaaaactgtactttga

SEQ ID NO: 530983 - DNA, 18 bp, Homo sapiens
ctaaaactgtactttgat

SEQ ID NO: 530984 - DNA, 17 bp, Homo sapiens
ctaaacgtgtatgtttt

SEQ ID NO: 530985 - DNA, 20 bp, Homo sapiens
ctaaacgtgtatgtttttca

SEQ ID NO: 530986 - DNA, 17 bp, Homo sapiens
ctaaactaggctccttc

SEQ ID NO: 530987 - DNA, 16 bp, Homo sapiens
ctaaactggtacaatt

SEQ ID NO: 530988 - DNA, 18 bp, Homo sapiens
ctaaagatctttttttaa

SEQ ID NO: 530989 - DNA, 21 bp, Homo sapiens
ctaaagatctttttttaagtg

SEQ ID NO: 530990 - DNA, 20 bp, Homo sapiens
ctaaagtactgagcagtgat

SEQ ID NO: 530991 - DNA, 22 bp, Homo sapiens
ctaaagtactgagcagtgatat

SEQ ID NO: 530992 - DNA, 23 bp, Homo sapiens
ctaaagtactgagcagtgatatt

SEQ ID NO: 530993 - DNA, 14 bp, Homo sapiens
ctaaatgttaaaga

SEQ ID NO: 530994 - DNA, 19 bp, Homo sapiens
ctaaatgttaaagatgtag

SEQ ID NO: 530995 - DNA, 13 bp, Homo sapiens
ctaaattaacttc

SEQ ID NO: 530996 - DNA, 18 bp, Homo sapiens
ctaaattaacttctattt

SEQ ID NO: 530997 - DNA, 15 bp, Homo sapiens
ctaaattctttattt

SEQ ID NO: 530998 - DNA, 17 bp, Homo sapiens
ctaaattctttatttct

SEQ ID NO: 530999 - DNA, 17 bp, Homo sapiens
ctaacagtaactgccat

SEQ ID NO: 531000 - DNA, 12 bp, Homo sapiens
ctaacctccttt

SEQ ID NO: 531001 - DNA, 13 bp, Homo sapiens
ctaacctccttta

SEQ ID NO: 531002 - DNA, 14 bp, Homo sapiens
ctaactctgatgta

SEQ ID NO: 531003 - DNA, 16 bp, Homo sapiens
ctccttcccactcttc

SEQ ID NO: 531004 - DNA, 15 bp, Homo sapiens
ctccttcccagctgc

SEQ ID NO: 531005 - DNA, 14 bp, Homo sapiens
ctccttcccttgct

SEQ ID NO: 531006 - DNA, 20 bp, Homo sapiens
ctcctttaccctcatctgtc

SEQ ID NO: 531007 - DNA, 17 bp, Homo sapiens
ctcctttagggacagct

SEQ ID NO: 531008 - DNA, 17 bp, Homo sapiens
ctccttttgtgttccaa

SEQ ID NO: 531009 - DNA, 18 bp, Homo sapiens
ctcgatgttcatggaatt

SEQ ID NO: 531010 - DNA, 22 bp, Homo sapiens
ctcgatgttcatggaattggtt

SEQ ID NO: 531011 - DNA, 18 bp, Homo sapiens
ctcgcctcggatcagctg

SEQ ID NO: 531012 - DNA, 16 bp, Homo sapiens
ctcgctggcccccact

SEQ ID NO: 531013 - DNA, 14 bp, Homo sapiens
ctcggccagagctc

SEQ ID NO: 531014 - DNA, 16 bp, Homo sapiens
ctcggccagagctccc

SEQ ID NO: 531015 - DNA, 24 bp, Homo sapiens
ctcggccagagctcccaggacgca

SEQ ID NO: 531016 - DNA, 17 bp, Homo sapiens
ctcggccttcacaatct

SEQ ID NO: 531017 - DNA, 21 bp, Homo sapiens
ctcgggctaagtccagctctc

SEQ ID NO: 531018 - DNA, 22 bp, Homo sapiens
ctcgggctaagtccagctctcc

SEQ ID NO: 531019 - DNA, 20 bp, Homo sapiens
ctcggtaaaccgaggaccca

SEQ ID NO: 531020 - DNA, 16 bp, Homo sapiens
ctcgtatagaagtctt

SEQ ID NO: 531021 - DNA, 13 bp, Homo sapiens
ctctaaaactatc

SEQ ID NO: 531022 - DNA, 14 bp, Homo sapiens
ctctaacctccttt

SEQ ID NO: 531023 - DNA, 15 bp, Homo sapiens
ctctaagatgttata

SEQ ID NO: 531024 - DNA, 18 bp, Homo sapiens
ctctaagatgttatattt

SEQ ID NO: 531025 - DNA, 24 bp, Homo sapiens
ctctaaggtaaaaccatctaggat

SEQ ID NO: 531026 - DNA, 11 bp, Homo sapiens
ctctaatttcc

SEQ ID NO: 531027 - DNA, 15 bp, Homo sapiens
ctctacaaaaaaaat

SEQ ID NO: 531028 - DNA, 17 bp, Homo sapiens
ctctacccctttcttct

SEQ ID NO: 531029 - DNA, 18 bp, Homo sapiens
ctctactaaaaatacaaa

SEQ ID NO: 531030 - DNA, 14 bp, Homo sapiens
ctctagccctgccc

SEQ ID NO: 531031 - DNA, 17 bp, Homo sapiens
ctctaggtaaactagca

SEQ ID NO: 531032 - DNA, 14 bp, Homo sapiens
ctctatttccccct

SEQ ID NO: 531033 - DNA, 14 bp, Homo sapiens
ctctcactgcctcc

SEQ ID NO: 531034 - DNA, 19 bp, Homo sapiens
ctctcatccttttctccta

SEQ ID NO: 531035 - DNA, 21 bp, Homo sapiens
ctctcatgctgcccctgcctt

SEQ ID NO: 531036 - DNA, 16 bp, Homo sapiens
ctctccagtcttccac

SEQ ID NO: 531037 - DNA, 22 bp, Homo sapiens
ctctccccgcagtgtttgtgtg

SEQ ID NO: 531038 - DNA, 20 bp, Homo sapiens
ctctctaaactggtacaatt

SEQ ID NO: 531039 - DNA, 14 bp, Homo sapiens
ctctctactggtcc

SEQ ID NO: 531040 - DNA, 21 bp, Homo sapiens
ctctctatttccccctttctt

SEQ ID NO: 531041 - DNA, 18 bp, Homo sapiens
ctctctccagtcttccac

SEQ ID NO: 531042 - DNA, 14 bp, Homo sapiens
ctctctccatcaga

SEQ ID NO: 531043 - DNA, 21 bp, Homo sapiens
ctctctgggctgactgggcca

SEQ ID NO: 531044 - DNA, 13 bp, Homo sapiens
ctctctgtataaa

SEQ ID NO: 531045 - DNA, 16 bp, Homo sapiens
ctctgaactgctgctg

SEQ ID NO: 531046 - DNA, 19 bp, Homo sapiens
ctctgaactgctgctggtc

SEQ ID NO: 531047 - DNA, 21 bp, Homo sapiens
ctctgaactgctgctggtcac

SEQ ID NO: 531048 - DNA, 15 bp, Homo sapiens
ctctgatgtaaatga

SEQ ID NO: 531049 - DNA, 13 bp, Homo sapiens
ctctgatgtattt

SEQ ID NO: 531050 - DNA, 14 bp, Homo sapiens
ctctgattctatgt

SEQ ID NO: 531051 - DNA, 18 bp, Homo sapiens
ctctgattctatgtaact

SEQ ID NO: 531052 - DNA, 18 bp, Homo sapiens
ctctgccatcagcccctg

SEQ ID NO: 531053 - DNA, 21 bp, Homo sapiens
ctctgccatcagcccctgctg

SEQ ID NO: 531054 - DNA, 22 bp, Homo sapiens
ctctgccatcagcccctgctgc

SEQ ID NO: 531055 - DNA, 17 bp, Homo sapiens
ctctgctgagaaggcaa

SEQ ID NO: 531056 - DNA, 21 bp, Homo sapiens
ctctgctgatgacccccccag

SEQ ID NO: 531057 - DNA, 11 bp, Homo sapiens
ctctgctgtgg

SEQ ID NO: 531058 - DNA, 18 bp, Homo sapiens
ctctggaagggagggctt

SEQ ID NO: 531059 - DNA, 18 bp, Homo sapiens
ctctgtacatattagcga

SEQ ID NO: 531060 - DNA, 16 bp, Homo sapiens
ctctgtactaaggaga

SEQ ID NO: 531061 - DNA, 16 bp, Homo sapiens
ctctgtcgagcctggg

SEQ ID NO: 531062 - DNA, 15 bp, Homo sapiens
ctctgtggggccaca

SEQ ID NO: 531063 - DNA, 20 bp, Homo sapiens
ctcttacctgtaatagcctc

SEQ ID NO: 531064 - DNA, 13 bp, Homo sapiens
ctcttagaaaata

SEQ ID NO: 531065 - DNA, 21 bp, Homo sapiens
ctcttagaaaataaatacaag

SEQ ID NO: 531066 - DNA, 22 bp, Homo sapiens
ctcttatatctaaatctgtcca

SEQ ID NO: 531067 - DNA, 17 bp, Homo sapiens
ctcttatatgtgcccct

SEQ ID NO: 531068 - DNA, 23 bp, Homo sapiens
ctcttatatgtgccccttcccca

SEQ ID NO: 531069 - DNA, 20 bp, Homo sapiens
ctcttcatgcgcagtcccca

SEQ ID NO: 531070 - DNA, 15 bp, Homo sapiens
ctcttcccccaccac

SEQ ID NO: 531071 - DNA, 11 bp, Homo sapiens
ctcttcctcca

SEQ ID NO: 531072 - DNA, 19 bp, Homo sapiens
ctcttcctccaaggacaga

SEQ ID NO: 531073 - DNA, 15 bp, Homo sapiens
ctcttcctccctggg

SEQ ID NO: 531074 - DNA, 14 bp, Homo sapiens
ctcttctccccttc

SEQ ID NO: 531075 - DNA, 15 bp, Homo sapiens
ctcttctctctgctc

SEQ ID NO: 531076 - DNA, 19 bp, Homo sapiens
ctcttctctctgctctgac

SEQ ID NO: 531077 - DNA, 13 bp, Homo sapiens
ctcttctgtgttt

SEQ ID NO: 531078 - DNA, 20 bp, Homo sapiens
ctcttcttccttttgtatcc

SEQ ID NO: 531079 - DNA, 15 bp, Homo sapiens
ctcttggaactgcac

SEQ ID NO: 531080 - DNA, 11 bp, Homo sapiens
ctctttcagtg

SEQ ID NO: 531081 - DNA, 13 bp, Homo sapiens
ctctttcccttcc

SEQ ID NO: 531082 - DNA, 16 bp, Homo sapiens
ctcttttgctctctca

SEQ ID NO: 531083 - DNA, 14 bp, Homo sapiens
ctcttttttacaaa

SEQ ID NO: 531084 - DNA, 18 bp, Homo sapiens
ccattttggtgtctttct

SEQ ID NO: 531085 - DNA, 22 bp, Homo sapiens
ccattttggtgtctttctcttt

SEQ ID NO: 531086 - DNA, 22 bp, Homo sapiens
ccattttttgtctgtgataaca

SEQ ID NO: 531087 - DNA, 12 bp, Homo sapiens
cccaaacctgga

SEQ ID NO: 531088 - DNA, 15 bp, Homo sapiens
cccaacaacatccat

SEQ ID NO: 531089 - DNA, 20 bp, Homo sapiens
cccaaccctgcccagcctga

SEQ ID NO: 531090 - DNA, 14 bp, Homo sapiens
cccaagcaggaggc

SEQ ID NO: 531091 - DNA, 22 bp, Homo sapiens
cccaaggccccctgcctgccct

SEQ ID NO: 531092 - DNA, 19 bp, Homo sapiens
cccaagttatgcatcccca

SEQ ID NO: 531093 - DNA, 13 bp, Homo sapiens
cccacacacccca

SEQ ID NO: 531094 - DNA, 14 bp, Homo sapiens
cccacacaccccaa

SEQ ID NO: 531095 - DNA, 19 bp, Homo sapiens
cccacaccctacagcagat

SEQ ID NO: 531096 - DNA, 14 bp, Homo sapiens
cccacacctgcctc

SEQ ID NO: 531097 - DNA, 16 bp, Homo sapiens
cccacacctgcctctg

SEQ ID NO: 531098 - DNA, 16 bp, Homo sapiens
cccacacctggccctg

SEQ ID NO: 531099 - DNA, 22 bp, Homo sapiens
cccacatccggggccagctccg

SEQ ID NO: 531100 - DNA, 19 bp, Homo sapiens
cccacctcccccactccca

SEQ ID NO: 531101 - DNA, 14 bp, Homo sapiens
cccactcctgctct

SEQ ID NO: 531102 - DNA, 19 bp, Homo sapiens
cccactgcccctgcacctg

SEQ ID NO: 531103 - DNA, 15 bp, Homo sapiens
cccactggctgtggg

SEQ ID NO: 531104 - DNA, 19 bp, Homo sapiens
cccagaaatgccgctgtgt

SEQ ID NO: 531105 - DNA, 17 bp, Homo sapiens
cccagaactctgcctgc

SEQ ID NO: 531106 - DNA, 20 bp, Homo sapiens
cccagaagctcaaggctgca

SEQ ID NO: 531107 - DNA, 18 bp, Homo sapiens
cccagacaacagcccagg

SEQ ID NO: 531108 - DNA, 19 bp, Homo sapiens
cccagaccagtagtgacca

SEQ ID NO: 531109 - DNA, 14 bp, Homo sapiens
cccagatcagccag

SEQ ID NO: 531110 - DNA, 19 bp, Homo sapiens
cccagatcagccagaagcc

SEQ ID NO: 531111 - DNA, 21 bp, Homo sapiens
cccagatccaggaacacatgc

SEQ ID NO: 531112 - DNA, 12 bp, Homo sapiens
cccagccccagc

SEQ ID NO: 531113 - DNA, 16 bp, Homo sapiens
cccagccccctggccc

SEQ ID NO: 531114 - DNA, 16 bp, Homo sapiens
cccagcctatctctct

SEQ ID NO: 531115 - DNA, 17 bp, Homo sapiens
cccagctgcccctccct

SEQ ID NO: 531116 - DNA, 22 bp, Homo sapiens
cccagcttcacttctgactctt

SEQ ID NO: 531117 - DNA, 16 bp, Homo sapiens
cccagcttctcagctc

SEQ ID NO: 531118 - DNA, 17 bp, Homo sapiens
cccagctttcagggaca

SEQ ID NO: 531119 - DNA, 17 bp, Homo sapiens
cccaggacgcagggaga

SEQ ID NO: 531120 - DNA, 16 bp, Homo sapiens
cccaggagcgcagctg

SEQ ID NO: 531121 - DNA, 10 bp, Homo sapiens
cccaggaggg

SEQ ID NO: 531122 - DNA, 13 bp, Homo sapiens
cccaggcactctc

SEQ ID NO: 531123 - DNA, 23 bp, Homo sapiens
cccaggcatctccttgggctggg

SEQ ID NO: 531124 - DNA, 21 bp, Homo sapiens
cccagggatttgtccttgggg

SEQ ID NO: 531125 - DNA, 12 bp, Homo sapiens
cccagggtcctg

SEQ ID NO: 531126 - DNA, 18 bp, Homo sapiens
cccagtgctcacacaatc

SEQ ID NO: 531127 - DNA, 21 bp, Homo sapiens
cccagtgctcacacaatcaga

SEQ ID NO: 531128 - DNA, 21 bp, Homo sapiens
cccataatgcttctttcctct

SEQ ID NO: 531129 - DNA, 22 bp, Homo sapiens
cccatcgtctcggccttcacaa

SEQ ID NO: 531130 - DNA, 13 bp, Homo sapiens
cccatctgctgag

SEQ ID NO: 531131 - DNA, 15 bp, Homo sapiens
cccatgaaacagcag

SEQ ID NO: 531132 - DNA, 20 bp, Homo sapiens
cccatgaaacagcagctgaa

SEQ ID NO: 531133 - DNA, 12 bp, Homo sapiens
cccatgccctcc

SEQ ID NO: 531134 - DNA, 13 bp, Homo sapiens
cccatgccctccc

SEQ ID NO: 531135 - DNA, 18 bp, Homo sapiens
cccatggctcctcaccac

SEQ ID NO: 531136 - DNA, 22 bp, Homo sapiens
cccatgtctttctccaaagtta

SEQ ID NO: 531137 - DNA, 19 bp, Homo sapiens
cccatgtggagtcagcctc

SEQ ID NO: 531138 - DNA, 19 bp, Homo sapiens
cccattttctttacagtct

SEQ ID NO: 531139 - DNA, 12 bp, Homo sapiens
ccccaaatatag

SEQ ID NO: 531140 - DNA, 12 bp, Homo sapiens
ccccactggctg

SEQ ID NO: 531141 - DNA, 20 bp, Homo sapiens
ccccactggctgtgggctcc

SEQ ID NO: 531142 - DNA, 22 bp, Homo sapiens
ccccagaaatgccgctgtgtcc

SEQ ID NO: 531143 - DNA, 17 bp, Homo sapiens
ccccagaccagtagtga

SEQ ID NO: 531144 - DNA, 19 bp, Homo sapiens
ccccagaccagtagtgacc

SEQ ID NO: 531145 - DNA, 20 bp, Homo sapiens
ccccagcgctgacgtgtcag

SEQ ID NO: 531146 - DNA, 11 bp, Homo sapiens
ccccagctccc

SEQ ID NO: 531147 - DNA, 11 bp, Homo sapiens
ccccagtccca

SEQ ID NO: 531148 - DNA, 17 bp, Homo sapiens
ccccagtccccttcccg

SEQ ID NO: 531149 - DNA, 15 bp, Homo sapiens
ccccagtgctcacac

SEQ ID NO: 531150 - DNA, 16 bp, Homo sapiens
ccccagtgctcacaca

SEQ ID NO: 531151 - DNA, 16 bp, Homo sapiens
ccccagtgtccccagg

SEQ ID NO: 531152 - DNA, 18 bp, Homo sapiens
ccccagtgtccccagggg

SEQ ID NO: 531153 - DNA, 11 bp, Homo sapiens
ccccatctgct

SEQ ID NO: 531154 - DNA, 12 bp, Homo sapiens
ccccatctgctg

SEQ ID NO: 531155 - DNA, 14 bp, Homo sapiens
ccccatgccctccc

SEQ ID NO: 531156 - DNA, 16 bp, Homo sapiens
cccccacacctggccc

SEQ ID NO: 531157 - DNA, 13 bp, Homo sapiens
cccccactggctg

SEQ ID NO: 531158 - DNA, 14 bp, Homo sapiens
cccccactggctgt

SEQ ID NO: 531159 - DNA, 21 bp, Homo sapiens
cccccactggctgtgggctcc

SEQ ID NO: 531160 - DNA, 19 bp, Homo sapiens
cccccagcttcacttctga

SEQ ID NO: 531161 - DNA, 12 bp, Homo sapiens
cccccaggaccc

SEQ ID NO: 531162 - DNA, 22 bp, Homo sapiens
cccccatgccctccctgctgcc

SEQ ID NO: 531163 - DNA, 12 bp, Homo sapiens
ccccccagcttc

SEQ ID NO: 531164 - DNA, 13 bp, Homo sapiens
ccccccatgccct

SEQ ID NO: 531165 - DNA, 18 bp, Homo sapiens
ccccctcaggaccctcgc

SEQ ID NO: 531166 - DNA, 18 bp, Homo sapiens
ccccctccttcccagctg

SEQ ID NO: 531167 - DNA, 19 bp, Homo sapiens
ccccgagccgagctctcct

SEQ ID NO: 531168 - DNA, 20 bp, Homo sapiens
ccccgagccgagctctcctg

SEQ ID NO: 531169 - DNA, 19 bp, Homo sapiens
ccccgtgtattcaggaccc

SEQ ID NO: 531170 - DNA, 18 bp, Homo sapiens
cccctcaggaccctcgct

SEQ ID NO: 531171 - DNA, 20 bp, Homo sapiens
cccctccttcccagctgccc

SEQ ID NO: 531172 - DNA, 16 bp, Homo sapiens
cccctcttcctccctg

SEQ ID NO: 531173 - DNA, 19 bp, Homo sapiens
cccctgcacctgcttctca

SEQ ID NO: 531174 - DNA, 22 bp, Homo sapiens
cccctgcaggcggtatccagag

SEQ ID NO: 531175 - DNA, 12 bp, Homo sapiens
cccctggcccct

SEQ ID NO: 531176 - DNA, 15 bp, Homo sapiens
cccgctctgccatca

SEQ ID NO: 531177 - DNA, 17 bp, Homo sapiens
cccggagctcaggccct

SEQ ID NO: 531178 - DNA, 22 bp, Homo sapiens
cccggcagccccccagtgtccc

SEQ ID NO: 531179 - DNA, 16 bp, Homo sapiens
cccggccctgcctgct

SEQ ID NO: 531180 - DNA, 16 bp, Homo sapiens
ccctacagcagatcca

SEQ ID NO: 531181 - DNA, 17 bp, Homo sapiens
ccctacagcagatccac

SEQ ID NO: 531182 - DNA, 11 bp, Homo sapiens
ccctatctccc

SEQ ID NO: 531183 - DNA, 15 bp, Homo sapiens
ccctcaaagaggcag

SEQ ID NO: 531184 - DNA, 17 bp, Homo sapiens
ccctcaccacctgcccg

SEQ ID NO: 531185 - DNA, 13 bp, Homo sapiens
ccctcagccctca

SEQ ID NO: 531186 - DNA, 22 bp, Homo sapiens
ccctcaggaccctcgctggccc

SEQ ID NO: 531187 - DNA, 11 bp, Homo sapiens
ccctcattttt

SEQ ID NO: 531188 - DNA, 18 bp, Homo sapiens
ccctccacgttcacccct

SEQ ID NO: 531189 - DNA, 13 bp, Homo sapiens
ccctcccagatcc

SEQ ID NO: 531190 - DNA, 14 bp, Homo sapiens
ccctccctcccaga

SEQ ID NO: 531191 - DNA, 15 bp, Homo sapiens
ccctccttcccagct

SEQ ID NO: 531192 - DNA, 16 bp, Homo sapiens
ccctccttcccagctg

SEQ ID NO: 531193 - DNA, 14 bp, Homo sapiens
ccctcgctggcccc

SEQ ID NO: 531194 - DNA, 19 bp, Homo sapiens
ccctcgctggcccccactg

SEQ ID NO: 531195 - DNA, 19 bp, Homo sapiens
ccctcggagttcttcttga

SEQ ID NO: 531196 - DNA, 17 bp, Homo sapiens
ccctcggggcaggaagt

SEQ ID NO: 531197 - DNA, 22 bp, Homo sapiens
ccctcttccctggtaagaaaaa

SEQ ID NO: 531198 - DNA, 11 bp, Homo sapiens
ccctcttcctc

SEQ ID NO: 531199 - DNA, 12 bp, Homo sapiens
ccctcttcctcc

SEQ ID NO: 531200 - DNA, 16 bp, Homo sapiens
ccctcttcctccctgg

SEQ ID NO: 531201 - DNA, 11 bp, Homo sapiens
ccctgaaatgt

SEQ ID NO: 531202 - DNA, 13 bp, Homo sapiens
ccctgaaatgtgt

SEQ ID NO: 531203 - DNA, 17 bp, Homo sapiens
ccctgaatctgaccaca

SEQ ID NO: 531204 - DNA, 20 bp, Homo sapiens
ccctgaatctgaccacagac

SEQ ID NO: 531205 - DNA, 20 bp, Homo sapiens
ccctgagaagcctcatggga

SEQ ID NO: 531206 - DNA, 23 bp, Homo sapiens
ccctgagggcccttcccaacctc

SEQ ID NO: 531207 - DNA, 18 bp, Homo sapiens
ccctgcaccaggccatca

SEQ ID NO: 531208 - DNA, 13 bp, Homo sapiens
ccctgcaggcggt

SEQ ID NO: 531209 - DNA, 13 bp, Homo sapiens
ccctgcctgccct

SEQ ID NO: 531210 - DNA, 13 bp, Homo sapiens
ccctgcgcaggcc

SEQ ID NO: 531211 - DNA, 23 bp, Homo sapiens
ccctgctccctccgggtcttcct

SEQ ID NO: 531212 - DNA, 21 bp, Homo sapiens
ccctgctgccaggctcccact

SEQ ID NO: 531213 - DNA, 21 bp, Homo sapiens
ccctgctgctcctcggccaga

SEQ ID NO: 531214 - DNA, 16 bp, Homo sapiens
ccctgctgtgtgggag

SEQ ID NO: 531215 - DNA, 23 bp, Homo sapiens
ccctgcttagtgtcccttacctg

SEQ ID NO: 531216 - DNA, 21 bp, Homo sapiens
ccctggaattgccacataatt

SEQ ID NO: 531217 - DNA, 14 bp, Homo sapiens
ccctggactctgtg

SEQ ID NO: 531218 - DNA, 14 bp, Homo sapiens
ccctggcaggcagg

SEQ ID NO: 531219 - DNA, 21 bp, Homo sapiens
ccctggcccctcccacatccc

SEQ ID NO: 531220 - DNA, 17 bp, Homo sapiens
gcactttaatgataaaa

SEQ ID NO: 531221 - DNA, 16 bp, Homo sapiens
gcactttgggaggctg

SEQ ID NO: 531222 - DNA, 12 bp, Homo sapiens
gcagacacacac

SEQ ID NO: 531223 - DNA, 13 bp, Homo sapiens
gcagacacacaca

SEQ ID NO: 531224 - DNA, 16 bp, Homo sapiens
gcagacacacacacac

SEQ ID NO: 531225 - DNA, 14 bp, Homo sapiens
gcagacacacacat

SEQ ID NO: 531226 - DNA, 20 bp, Homo sapiens
gcagactggtgttaatgagt

SEQ ID NO: 531227 - DNA, 19 bp, Homo sapiens
gcagagacctcctgatgtc

SEQ ID NO: 531228 - DNA, 14 bp, Homo sapiens
gcagagcctgcagg

SEQ ID NO: 531229 - DNA, 17 bp, Homo sapiens
cctgaaatgtttccagg

SEQ ID NO: 531230 - DNA, 16 bp, Homo sapiens
cctgaatcagaggcag

SEQ ID NO: 531231 - DNA, 14 bp, Homo sapiens
cctgacagccagaa

SEQ ID NO: 531232 - DNA, 17 bp, Homo sapiens
cctgacctccccctcct

SEQ ID NO: 531233 - DNA, 19 bp, Homo sapiens
cctgacctccccctccttc

SEQ ID NO: 531234 - DNA, 13 bp, Homo sapiens
cctgactccccca

SEQ ID NO: 531235 - DNA, 22 bp, Homo sapiens
cctgatcccttccacctgctct

SEQ ID NO: 531236 - DNA, 22 bp, Homo sapiens
cctgcaaccaaactcccatcag

SEQ ID NO: 531237 - DNA, 12 bp, Homo sapiens
cctgcacaaaca

SEQ ID NO: 531238 - DNA, 19 bp, Homo sapiens
cctgcaccaggccatcagc

SEQ ID NO: 531239 - DNA, 20 bp, Homo sapiens
cctgcactgtcccggagctc

SEQ ID NO: 531240 - DNA, 16 bp, Homo sapiens
cctgcaggactcgggc

SEQ ID NO: 531241 - DNA, 14 bp, Homo sapiens
cctgcccagatcag

SEQ ID NO: 531242 - DNA, 14 bp, Homo sapiens
cctgccccagcgct

SEQ ID NO: 531243 - DNA, 19 bp, Homo sapiens
cctgcccccacacctggcc

SEQ ID NO: 531244 - DNA, 18 bp, Homo sapiens
cctgccctgtcaggaggc

SEQ ID NO: 531245 - DNA, 21 bp, Homo sapiens
cctgccctgtcaggaggcaga

SEQ ID NO: 531246 - DNA, 21 bp, Homo sapiens
cctgccctttgtcctcctgct

SEQ ID NO: 531247 - DNA, 23 bp, Homo sapiens
cctgcctctgaactgctgctggt

SEQ ID NO: 531248 - DNA, 14 bp, Homo sapiens
cctgccttcatgga

SEQ ID NO: 531249 - DNA, 13 bp, Homo sapiens
cctgcgcaggccc

SEQ ID NO: 531250 - DNA, 23 bp, Homo sapiens
cctgcgtggctgacccccctcag

SEQ ID NO: 531251 - DNA, 13 bp, Homo sapiens
cctgctcattgtg

SEQ ID NO: 531252 - DNA, 12 bp, Homo sapiens
cctgctctgctc

SEQ ID NO: 531253 - DNA, 13 bp, Homo sapiens
cctgctctgctga

SEQ ID NO: 531254 - DNA, 15 bp, Homo sapiens
cctgctctttggcct

SEQ ID NO: 531255 - DNA, 19 bp, Homo sapiens
cctgctgctcctcggccag

SEQ ID NO: 531256 - DNA, 17 bp, Homo sapiens
cctgcttttgcaaataa

SEQ ID NO: 531257 - DNA, 15 bp, Homo sapiens
cctggaaacctgtct

SEQ ID NO: 531258 - DNA, 20 bp, Homo sapiens
cctggaagccctctctggct

SEQ ID NO: 531259 - DNA, 19 bp, Homo sapiens
cctggagaagaatggcttt

SEQ ID NO: 531260 - DNA, 15 bp, Homo sapiens
cctggagcccggcag

SEQ ID NO: 531261 - DNA, 14 bp, Homo sapiens
cctggcaggcaggg

SEQ ID NO: 531262 - DNA, 21 bp, Homo sapiens
cctggcagggcaggcagagct

SEQ ID NO: 531263 - DNA, 15 bp, Homo sapiens
cctggcccctcccac

SEQ ID NO: 531264 - DNA, 20 bp, Homo sapiens
cctggcccctcccacatccc

SEQ ID NO: 531265 - DNA, 17 bp, Homo sapiens
cctggccctggggcctg

SEQ ID NO: 531266 - DNA, 13 bp, Homo sapiens
cctggcctgtctc

SEQ ID NO: 531267 - DNA, 17 bp, Homo sapiens
cctggcctgtctgtgaa

SEQ ID NO: 531268 - DNA, 23 bp, Homo sapiens
cctggcgagttctctttggaaat

SEQ ID NO: 531269 - DNA, 14 bp, Homo sapiens
cctggctcccaggg

SEQ ID NO: 531270 - DNA, 19 bp, Homo sapiens
cctgggacagggagcagcc

SEQ ID NO: 531271 - DNA, 14 bp, Homo sapiens
cctgggagagtgag

SEQ ID NO: 531272 - DNA, 23 bp, Homo sapiens
cctgggagatgctgggaccctcg

SEQ ID NO: 531273 - DNA, 17 bp, Homo sapiens
cctgggataggggcaga

SEQ ID NO: 531274 - DNA, 23 bp, Homo sapiens
cctgggataggggcagaggaggc

SEQ ID NO: 531275 - DNA, 15 bp, Homo sapiens
cctgggccagggtct

SEQ ID NO: 531276 - DNA, 11 bp, Homo sapiens
cctgggctctg

SEQ ID NO: 531277 - DNA, 12 bp, Homo sapiens
cctgggctctgg

SEQ ID NO: 531278 - DNA, 14 bp, Homo sapiens
cctgggctctgggt

SEQ ID NO: 531279 - DNA, 22 bp, Homo sapiens
cctgggcttttgttttgctttt

SEQ ID NO: 531280 - DNA, 16 bp, Homo sapiens
cctgggggcctgacct

SEQ ID NO: 531281 - DNA, 23 bp, Homo sapiens
cctgggggcctgacctccccctc

SEQ ID NO: 531282 - DNA, 20 bp, Homo sapiens
cctggggtttccacacaggc

SEQ ID NO: 531283 - DNA, 22 bp, Homo sapiens
cctggggtttccacacaggccc

SEQ ID NO: 531284 - DNA, 20 bp, Homo sapiens
cctggtcagggtgagcccat

SEQ ID NO: 531285 - DNA, 17 bp, Homo sapiens
cctggtcctgcactgtc

SEQ ID NO: 531286 - DNA, 15 bp, Homo sapiens
cctggttcccccagg

SEQ ID NO: 531287 - DNA, 17 bp, Homo sapiens
cctggttcccccaggac

SEQ ID NO: 531288 - DNA, 15 bp, Homo sapiens
cctgtacacacacag

SEQ ID NO: 531289 - DNA, 14 bp, Homo sapiens
cctgtactggagag

SEQ ID NO: 531290 - DNA, 20 bp, Homo sapiens
cctgtagctttgggcagatt

SEQ ID NO: 531291 - DNA, 21 bp, Homo sapiens
cctgtaggtctatgatgtcca

SEQ ID NO: 531292 - DNA, 23 bp, Homo sapiens
cctgtattcctgacctccgccat

SEQ ID NO: 531293 - DNA, 16 bp, Homo sapiens
cctgtcaggaggcaga

SEQ ID NO: 531294 - DNA, 14 bp, Homo sapiens
cctgtcctggctcc

SEQ ID NO: 531295 - DNA, 16 bp, Homo sapiens
cctgtcctggctccca

SEQ ID NO: 531296 - DNA, 13 bp, Homo sapiens
cctgtctgctcca

SEQ ID NO: 531297 - DNA, 15 bp, Homo sapiens
cctgtctgctccagc

SEQ ID NO: 531298 - DNA, 20 bp, Homo sapiens
cctgtctgtctgtctctctt

SEQ ID NO: 531299 - DNA, 19 bp, Homo sapiens
cctgtgaccggggtcctga

SEQ ID NO: 531300 - DNA, 14 bp, Homo sapiens
cctgtgagctgcac

SEQ ID NO: 531301 - DNA, 14 bp, Homo sapiens
cctgtgccagccca

SEQ ID NO: 531302 - DNA, 19 bp, Homo sapiens
cctgtgccagcccagaggc

SEQ ID NO: 531303 - DNA, 14 bp, Homo sapiens
cctgtgccaggtga

SEQ ID NO: 531304 - DNA, 20 bp, Homo sapiens
cctgtgctatgctggacatt

SEQ ID NO: 531305 - DNA, 15 bp, Homo sapiens
cctgtggcctgccag

SEQ ID NO: 531306 - DNA, 18 bp, Homo sapiens
cctgtggtgaggtcctgt

SEQ ID NO: 531307 - DNA, 20 bp, Homo sapiens
cctgtggtgaggtcctgtcc

SEQ ID NO: 531308 - DNA, 22 bp, Homo sapiens
cctgtgtcagtttatgttttgg

SEQ ID NO: 531309 - DNA, 18 bp, Homo sapiens
cctgtgtgtgtctaggta

SEQ ID NO: 531310 - DNA, 20 bp, Homo sapiens
cctgttcacgtgactcctca

SEQ ID NO: 531311 - DNA, 23 bp, Homo sapiens
cctgtttcaagttcacacctgca

SEQ ID NO: 531312 - DNA, 22 bp, Homo sapiens
ccttaattaattctcagattcc

SEQ ID NO: 531313 - DNA, 21 bp, Homo sapiens
ccttacaaatgattgctttta

SEQ ID NO: 531314 - DNA, 23 bp, Homo sapiens
ccttcaacaaggcttgctgcaga

SEQ ID NO: 531315 - DNA, 18 bp, Homo sapiens
ccttcactccctgtcata

SEQ ID NO: 531316 - DNA, 17 bp, Homo sapiens
ccttccacagttatctt

SEQ ID NO: 531317 - DNA, 16 bp, Homo sapiens
ccttccacctgctctg

SEQ ID NO: 531318 - DNA, 17 bp, Homo sapiens
ccttccacctgctctgc

SEQ ID NO: 531319 - DNA, 17 bp, Homo sapiens
ccttccatttctgcctt

SEQ ID NO: 531320 - DNA, 15 bp, Homo sapiens
ccttcccaacctccc

SEQ ID NO: 531321 - DNA, 17 bp, Homo sapiens
ccttcccaacctcccct

SEQ ID NO: 531322 - DNA, 13 bp, Homo sapiens
ccttcccagctgc

SEQ ID NO: 531323 - DNA, 13 bp, Homo sapiens
ccttccccttcct

SEQ ID NO: 531324 - DNA, 16 bp, Homo sapiens
ccttccccttccttct

SEQ ID NO: 531325 - DNA, 17 bp, Homo sapiens
ccttccccttccttctt

SEQ ID NO: 531326 - DNA, 12 bp, Homo sapiens
ccttcccttgct

SEQ ID NO: 531327 - DNA, 22 bp, Homo sapiens
ccttctacttacacatcttcca

SEQ ID NO: 531328 - DNA, 12 bp, Homo sapiens
ccttctccacag

SEQ ID NO: 531329 - DNA, 22 bp, Homo sapiens
ccttctgatgaagttgtacaac

SEQ ID NO: 531330 - DNA, 20 bp, Homo sapiens
ccttctgtcgtccccagacc

SEQ ID NO: 531331 - DNA, 22 bp, Homo sapiens
ccttgatataaaaaatctttag

SEQ ID NO: 531332 - DNA, 21 bp, Homo sapiens
ccttgattcaaataaccctga

SEQ ID NO: 531333 - DNA, 12 bp, Homo sapiens
ccttgccagtct

SEQ ID NO: 531334 - DNA, 17 bp, Homo sapiens
ccttgcccactcctgct

SEQ ID NO: 531335 - DNA, 19 bp, Homo sapiens
ccttgcccactcctgctct

SEQ ID NO: 531336 - DNA, 20 bp, Homo sapiens
ccttgcccactcctgctctg

SEQ ID NO: 531337 - DNA, 18 bp, Homo sapiens
ccttgctaccacggcctc

SEQ ID NO: 531338 - DNA, 23 bp, Homo sapiens
ccttgctaccacggcctcctttc

SEQ ID NO: 531339 - DNA, 17 bp, Homo sapiens
ccttgcttacctctcag

SEQ ID NO: 531340 - DNA, 17 bp, Homo sapiens
ccttgggatgggcacag

SEQ ID NO: 531341 - DNA, 19 bp, Homo sapiens
ccttgggatgggcacaggc

SEQ ID NO: 531342 - DNA, 16 bp, Homo sapiens
ccttgggctctgctga

SEQ ID NO: 531343 - DNA, 22 bp, Homo sapiens
ccttggggtcaggttgacagga

SEQ ID NO: 531344 - DNA, 15 bp, Homo sapiens
ccttgtaatgtaact

SEQ ID NO: 531345 - DNA, 16 bp, Homo sapiens
ccttgtaatgtaactg

SEQ ID NO: 531346 - DNA, 15 bp, Homo sapiens
ccttgtctaaagatc

SEQ ID NO: 531347 - DNA, 17 bp, Homo sapiens
cctttacttgtctttct

SEQ ID NO: 531348 - DNA, 16 bp, Homo sapiens
cctttcagcaggcagc

SEQ ID NO: 531349 - DNA, 16 bp, Homo sapiens
cctttccagtgctgct

SEQ ID NO: 531350 - DNA, 16 bp, Homo sapiens
cctttctagcaattgc

SEQ ID NO: 531351 - DNA, 13 bp, Homo sapiens
cctttcttcctca

SEQ ID NO: 531352 - DNA, 19 bp, Homo sapiens
cctttcttcctcattccct

SEQ ID NO: 531353 - DNA, 17 bp, Homo sapiens
cctttgaagtgcctctg

SEQ ID NO: 531354 - DNA, 22 bp, Homo sapiens
cctttgaagtgcctctgattct

SEQ ID NO: 531355 - DNA, 16 bp, Homo sapiens
cctttgtcctcctgct

SEQ ID NO: 531356 - DNA, 20 bp, Homo sapiens
ccttttcacccttctactct

SEQ ID NO: 531357 - DNA, 15 bp, Homo sapiens
ccttttccagagcat

SEQ ID NO: 531358 - DNA, 17 bp, Homo sapiens
ccttttgtatcctccat

SEQ ID NO: 531359 - DNA, 19 bp, Homo sapiens
ccttttgttcatttcatcc

SEQ ID NO: 531360 - DNA, 18 bp, Homo sapiens
cgaaaattcatttcacat

SEQ ID NO: 531361 - DNA, 22 bp, Homo sapiens
cgaaactctaagtgtttgctgc

SEQ ID NO: 531362 - DNA, 17 bp, Homo sapiens
cgaagaactaataaatg

SEQ ID NO: 531363 - DNA, 16 bp, Homo sapiens
cgaaggtctctctggc

SEQ ID NO: 531364 - DNA, 17 bp, Homo sapiens
cgaagtttgcaaccttt

SEQ ID NO: 531365 - DNA, 17 bp, Homo sapiens
cgaatggagtccagacc

SEQ ID NO: 531366 - DNA, 15 bp, Homo sapiens
cgacaaatctgtctg

SEQ ID NO: 531367 - DNA, 11 bp, Homo sapiens
cgacagagcag

SEQ ID NO: 531368 - DNA, 20 bp, Homo sapiens
cgacctcttagaaaataaat

SEQ ID NO: 531369 - DNA, 17 bp, Homo sapiens
cgacctggcctgtctgt

SEQ ID NO: 531370 - DNA, 15 bp, Homo sapiens
cgactagacacacaa

SEQ ID NO: 531371 - DNA, 21 bp, Homo sapiens
ctcaatgtgtgccgagccctt

SEQ ID NO: 531372 - DNA, 22 bp, Homo sapiens
ctcaattccagggaaccagagc

SEQ ID NO: 531373 - DNA, 17 bp, Homo sapiens
ctcacacaatcagacca

SEQ ID NO: 531374 - DNA, 12 bp, Homo sapiens
ctcaccacctgc

SEQ ID NO: 531375 - DNA, 16 bp, Homo sapiens
ctcaccacctgcccgg

SEQ ID NO: 531376 - DNA, 13 bp, Homo sapiens
ctcacccctgcag

SEQ ID NO: 531377 - DNA, 15 bp, Homo sapiens
ctcacccctgcaggc

SEQ ID NO: 531378 - DNA, 15 bp, Homo sapiens
ctcactgatatattt

SEQ ID NO: 531379 - DNA, 15 bp, Homo sapiens
ctcagaagtgaaaaa

SEQ ID NO: 531380 - DNA, 16 bp, Homo sapiens
ctcagagtgaagagtg

SEQ ID NO: 531381 - DNA, 15 bp, Homo sapiens
ctcagcaaacccaaa

SEQ ID NO: 531382 - DNA, 14 bp, Homo sapiens
ctcagcacagcctc

SEQ ID NO: 531383 - DNA, 20 bp, Homo sapiens
ctcagcacagcctcacccct

SEQ ID NO: 531384 - DNA, 21 bp, Homo sapiens
ctcagcacagcctcacccctg

SEQ ID NO: 531385 - DNA, 20 bp, Homo sapiens
ctcagccctcattaaactaa

SEQ ID NO: 531386 - DNA, 16 bp, Homo sapiens
ctcagctgtctgtggc

SEQ ID NO: 531387 - DNA, 13 bp, Homo sapiens
ctcaggaccctcg

SEQ ID NO: 531388 - DNA, 17 bp, Homo sapiens
ctcaggaccctcgctgg

SEQ ID NO: 531389 - DNA, 21 bp, Homo sapiens
ctcaggaccctcgctggcccc

SEQ ID NO: 531390 - DNA, 22 bp, Homo sapiens
ctcaggaccctcgctggccccc

SEQ ID NO: 531391 - DNA, 21 bp, Homo sapiens
ctcaggaggcagtggcttgga

SEQ ID NO: 531392 - DNA, 22 bp, Homo sapiens
ctcaggcccacattgcccacac

SEQ ID NO: 531393 - DNA, 14 bp, Homo sapiens
ctcagtctcacatt

SEQ ID NO: 531394 - DNA, 19 bp, Homo sapiens
ctcataagtaaatgtcttc

SEQ ID NO: 531395 - DNA, 22 bp, Homo sapiens
ctcataatggaaaaaaagactg

SEQ ID NO: 531396 - DNA, 16 bp, Homo sapiens
ctcatcatcagtctta

SEQ ID NO: 531397 - DNA, 15 bp, Homo sapiens
ctcatccttttctcc

SEQ ID NO: 531398 - DNA, 13 bp, Homo sapiens
ctcatctgtctgg

SEQ ID NO: 531399 - DNA, 23 bp, Homo sapiens
ctcatctgtctggaggggagctc

SEQ ID NO: 531400 - DNA, 22 bp, Homo sapiens
ctcatcttgacagagcctgccc

SEQ ID NO: 531401 - DNA, 12 bp, Homo sapiens
ctcatgctgccc

SEQ ID NO: 531402 - DNA, 20 bp, Homo sapiens
ctcatgctgcccctgccttg

SEQ ID NO: 531403 - DNA, 17 bp, Homo sapiens
ctcatgttttatatgat

SEQ ID NO: 531404 - DNA, 17 bp, Homo sapiens
ctcattacggctcctct

SEQ ID NO: 531405 - DNA, 12 bp, Homo sapiens
ctcattcctctg

SEQ ID NO: 531406 - DNA, 22 bp, Homo sapiens
ctcattcctctgtccccgagcc

SEQ ID NO: 531407 - DNA, 15 bp, Homo sapiens
ctcattgttcagaaa

SEQ ID NO: 531408 - DNA, 16 bp, Homo sapiens
ctcatttctaaaagaa

SEQ ID NO: 531409 - DNA, 16 bp, Homo sapiens
ctccaaagttatccag

SEQ ID NO: 531410 - DNA, 14 bp, Homo sapiens
ctccaaatgtctac

SEQ ID NO: 531411 - DNA, 21 bp, Homo sapiens
ctccaactcagagcacagcca

SEQ ID NO: 531412 - DNA, 17 bp, Homo sapiens
ctccaactctctctgtg

SEQ ID NO: 531413 - DNA, 13 bp, Homo sapiens
ctccaagccagca

SEQ ID NO: 531414 - DNA, 15 bp, Homo sapiens
ctccaagccagcaag

SEQ ID NO: 531415 - DNA, 16 bp, Homo sapiens
ctccaagccagcaagc

SEQ ID NO: 531416 - DNA, 14 bp, Homo sapiens
ctccacacacacaa

SEQ ID NO: 531417 - DNA, 21 bp, Homo sapiens
ctccacacacacaaaaaaaga

SEQ ID NO: 531418 - DNA, 12 bp, Homo sapiens
gccagggtctcg

SEQ ID NO: 531419 - DNA, 22 bp, Homo sapiens
gccagtaacacaggccaccctg

SEQ ID NO: 531420 - DNA, 18 bp, Homo sapiens
gccagtgcgggtgcagac

SEQ ID NO: 531421 - DNA, 18 bp, Homo sapiens
gccagtggaaattcaggt

SEQ ID NO: 531422 - DNA, 21 bp, Homo sapiens
gccataagcaacaattttcag

SEQ ID NO: 531423 - DNA, 15 bp, Homo sapiens
gccataggccctttc

SEQ ID NO: 531424 - DNA, 16 bp, Homo sapiens
gccataggccctttca

SEQ ID NO: 531425 - DNA, 15 bp, Homo sapiens
gccatgaactggagg

SEQ ID NO: 531426 - DNA, 16 bp, Homo sapiens
gccatgaactggaggc

SEQ ID NO: 531427 - DNA, 21 bp, Homo sapiens
gccatggaggcacacagctgc

SEQ ID NO: 531428 - DNA, 16 bp, Homo sapiens
gcccaaacctttcccc

SEQ ID NO: 531429 - DNA, 13 bp, Homo sapiens
gcccacacacccc

SEQ ID NO: 531430 - DNA, 15 bp, Homo sapiens
gcccacacctgcctc

SEQ ID NO: 531431 - DNA, 21 bp, Homo sapiens
gcccacatccggggccagctc

SEQ ID NO: 531432 - DNA, 20 bp, Homo sapiens
gcccacccggttcagtgttt

SEQ ID NO: 531433 - DNA, 15 bp, Homo sapiens
gcccactcctgctct

SEQ ID NO: 531434 - DNA, 18 bp, Homo sapiens
gcccactcctgctctgct

SEQ ID NO: 531435 - DNA, 17 bp, Homo sapiens
gcccagaccctggagga

SEQ ID NO: 531436 - DNA, 19 bp, Homo sapiens
gcccagaggggcggggcca

SEQ ID NO: 531437 - DNA, 22 bp, Homo sapiens
gcccagaggggcggggccagga

SEQ ID NO: 531438 - DNA, 16 bp, Homo sapiens
gcccagatcagccaga

SEQ ID NO: 531439 - DNA, 21 bp, Homo sapiens
gcccagcaccaccctccttcc

SEQ ID NO: 531440 - DNA, 17 bp, Homo sapiens
gcccaggagcgcagctg

SEQ ID NO: 531441 - DNA, 21 bp, Homo sapiens
gcccatgccctccgtcctggc

SEQ ID NO: 531442 - DNA, 13 bp, Homo sapiens
gcccatgtgtatg

SEQ ID NO: 531443 - DNA, 22 bp, Homo sapiens
gccccaaattgtcacctgcttc

SEQ ID NO: 531444 - DNA, 21 bp, Homo sapiens
gccccaacccaaacctggaga

SEQ ID NO: 531445 - DNA, 21 bp, Homo sapiens
gccccaagttttgtgaaattt

SEQ ID NO: 531446 - DNA, 13 bp, Homo sapiens
gccccaattttct

SEQ ID NO: 531447 - DNA, 15 bp, Homo sapiens
gccccacccctccat

SEQ ID NO: 531448 - DNA, 23 bp, Homo sapiens
gccccagaaatgccgctgtgtcc

SEQ ID NO: 531449 - DNA, 19 bp, Homo sapiens
gccccagacaacagcccag

SEQ ID NO: 531450 - DNA, 16 bp, Homo sapiens
gcccccaaacccccat

SEQ ID NO: 531451 - DNA, 17 bp, Homo sapiens
gcccccacacctggccc

SEQ ID NO: 531452 - DNA, 19 bp, Homo sapiens
gcccccacacctggccctg

SEQ ID NO: 531453 - DNA, 18 bp, Homo sapiens
gcccccactggctgtggg

SEQ ID NO: 531454 - DNA, 23 bp, Homo sapiens
gtagctttgggcagatttgcaac

SEQ ID NO: 531455 - DNA, 21 bp, Homo sapiens
gtaggaatattatatttggat

SEQ ID NO: 531456 - DNA, 21 bp, Homo sapiens
gtaggacaaggtgcaggcagg

SEQ ID NO: 531457 - DNA, 17 bp, Homo sapiens
gtagggccagggctctg

SEQ ID NO: 531458 - DNA, 12 bp, Homo sapiens
gtaggggagaga

SEQ ID NO: 531459 - DNA, 19 bp, Homo sapiens
gtaggtattacatccctgg

SEQ ID NO: 531460 - DNA, 18 bp, Homo sapiens
gtagtagctcgtgtgctt

SEQ ID NO: 531461 - DNA, 14 bp, Homo sapiens
gtagtcggcacagc

SEQ ID NO: 531462 - DNA, 23 bp, Homo sapiens
gtagtgaccaatcgggagtagca

SEQ ID NO: 531463 - DNA, 14 bp, Homo sapiens
gtataaacattaaa

SEQ ID NO: 531464 - DNA, 18 bp, Homo sapiens
gtataaacattaaatgtc

SEQ ID NO: 531465 - DNA, 19 bp, Homo sapiens
gtataaacattaaatgtct

SEQ ID NO: 531466 - DNA, 11 bp, Homo sapiens
gtataaatgta

SEQ ID NO: 531467 - DNA, 13 bp, Homo sapiens
gtataaatgtata

SEQ ID NO: 531468 - DNA, 14 bp, Homo sapiens
gtataaatgtatat

SEQ ID NO: 531469 - DNA, 17 bp, Homo sapiens
gtataaatgtatataca

SEQ ID NO: 531470 - DNA, 18 bp, Homo sapiens
gtataaatgtatatacac

SEQ ID NO: 531471 - DNA, 22 bp, Homo sapiens
gtataaatgtatatacacatat

SEQ ID NO: 531472 - DNA, 13 bp, Homo sapiens
taaaactgtactt

SEQ ID NO: 531473 - DNA, 19 bp, Homo sapiens
taaaactgtactttgattc

SEQ ID NO: 531474 - DNA, 20 bp, Homo sapiens
taaaactgtactttgattca

SEQ ID NO: 531475 - DNA, 23 bp, Homo sapiens
taaaactgtactttgattcacat

SEQ ID NO: 531476 - DNA, 13 bp, Homo sapiens
taaaactgtccct

SEQ ID NO: 531477 - DNA, 13 bp, Homo sapiens
taaaactttaatc

SEQ ID NO: 531478 - DNA, 17 bp, Homo sapiens
taaaagaaggtaaataa

SEQ ID NO: 531479 - DNA, 17 bp, Homo sapiens
taaaagagtagaaaagg

SEQ ID NO: 531480 - DNA, 16 bp, Homo sapiens
taaaatacacgtgtat

SEQ ID NO: 531481 - DNA, 13 bp, Homo sapiens
taaaatacttctt

SEQ ID NO: 531482 - DNA, 22 bp, Homo sapiens
taaaatacttctttttacaatg

SEQ ID NO: 531483 - DNA, 23 bp, Homo sapiens
taaaatagttgtccatattttca

SEQ ID NO: 531484 - DNA, 19 bp, Homo sapiens
taaaatatgcactaagtct

SEQ ID NO: 531485 - DNA, 23 bp, Homo sapiens
taaaatatgcactaagtctcttt

SEQ ID NO: 531486 - DNA, 18 bp, Homo sapiens
taaaatctgtattgctaa

SEQ ID NO: 531487 - DNA, 18 bp, Homo sapiens
taaaatcttattaaagtt

SEQ ID NO: 531488 - DNA, 19 bp, Homo sapiens
taaaatcttattaaagttt

SEQ ID NO: 531489 - DNA, 16 bp, Homo sapiens
taaaatggcaacaaac

SEQ ID NO: 531490 - DNA, 20 bp, Homo sapiens
taaaatggcaacaaactgca

SEQ ID NO: 531491 - DNA, 22 bp, Homo sapiens
taaaatggcaacaaactgcaca

SEQ ID NO: 531492 - DNA, 18 bp, Homo sapiens
taaaatggcatttagcac

SEQ ID NO: 531493 - DNA, 17 bp, Homo sapiens
taaaatgtgtatttttc

SEQ ID NO: 531494 - DNA, 16 bp, Homo sapiens
taaaattaaaatttaa

SEQ ID NO: 531495 - DNA, 14 bp, Homo sapiens
taaaatttgaaaca

SEQ ID NO: 531496 - DNA, 18 bp, Homo sapiens
taaaattttaagctagga

SEQ ID NO: 531497 - DNA, 11 bp, Homo sapiens
taaacaaatgg

SEQ ID NO: 531498 - DNA, 16 bp, Homo sapiens
taaacaattcaagtga

SEQ ID NO: 531499 - DNA, 17 bp, Homo sapiens
taaacacagattatttg

SEQ ID NO: 531500 - DNA, 16 bp, Homo sapiens
taaacattaaatgtct

SEQ ID NO: 531501 - DNA, 21 bp, Homo sapiens
taaacattaaatgtcttatat

SEQ ID NO: 531502 - DNA, 15 bp, Homo sapiens
taaacatttcctttt

SEQ ID NO: 531503 - DNA, 20 bp, Homo sapiens
taaaccaaaggacattatgt

SEQ ID NO: 531504 - DNA, 21 bp, Homo sapiens
taaaccaaaggacattatgtg

SEQ ID NO: 531505 - DNA, 19 bp, Homo sapiens
taaacccaatcagatgcct

SEQ ID NO: 531506 - DNA, 22 bp, Homo sapiens
taaacgtattttgatcagtgtt

SEQ ID NO: 531507 - DNA, 16 bp, Homo sapiens
taaacgtctttttaag

SEQ ID NO: 531508 - DNA, 18 bp, Homo sapiens
taaacgtctttttaagcc

SEQ ID NO: 531509 - DNA, 22 bp, Homo sapiens
taaacgtgtatgtttttcagtt

SEQ ID NO: 531510 - DNA, 23 bp, Homo sapiens
taaactaatgagtttcttttata

SEQ ID NO: 531511 - DNA, 16 bp, Homo sapiens
taaactttaatatgta

SEQ ID NO: 531512 - DNA, 15 bp, Homo sapiens
taaagaaagcagaat

SEQ ID NO: 531513 - DNA, 21 bp, Homo sapiens
taaagaagagtaacacttgaa

SEQ ID NO: 531514 - DNA, 22 bp, Homo sapiens
taaagaagagtaacacttgaaa

SEQ ID NO: 531515 - DNA, 18 bp, Homo sapiens
taaagaccatttagtcct

SEQ ID NO: 531516 - DNA, 15 bp, Homo sapiens
taaagatattgtatc

SEQ ID NO: 531517 - DNA, 16 bp, Homo sapiens
taaagatattgtatct

SEQ ID NO: 531518 - DNA, 22 bp, Homo sapiens
taaagatattgtatctccttta

SEQ ID NO: 531519 - DNA, 20 bp, Homo sapiens
taaagatctttttttaagtg

SEQ ID NO: 531520 - DNA, 20 bp, Homo sapiens
taaagatgtagcaaaccctg

SEQ ID NO: 531521 - DNA, 16 bp, Homo sapiens
taaagcatctaaactt

SEQ ID NO: 531522 - DNA, 18 bp, Homo sapiens
taaagcatctaaacttta

SEQ ID NO: 531523 - DNA, 14 bp, Homo sapiens
taaagcgaaaaact

SEQ ID NO: 531524 - DNA, 16 bp, Homo sapiens
taaagtatgaatattt

SEQ ID NO: 531525 - DNA, 16 bp, Homo sapiens
taaagtcagatttgta

SEQ ID NO: 531526 - DNA, 15 bp, Homo sapiens
taaagtctgtcatgc

SEQ ID NO: 531527 - DNA, 18 bp, Homo sapiens
taaagtgtaataatatga

SEQ ID NO: 531528 - DNA, 12 bp, Homo sapiens
taaagtttcaaa

SEQ ID NO: 531529 - DNA, 24 bp, Homo sapiens
taaagtttcaaaaatctgaagatt

SEQ ID NO: 531530 - DNA, 22 bp, Homo sapiens
taaataaaaaataataatacaa

SEQ ID NO: 531531 - DNA, 15 bp, Homo sapiens
taaataaaaatagct

SEQ ID NO: 531532 - DNA, 15 bp, Homo sapiens
taaataatcatacac

SEQ ID NO: 531533 - DNA, 12 bp, Homo sapiens
taaatagtgtta

SEQ ID NO: 531534 - DNA, 16 bp, Homo sapiens
taaatagtgttattga

SEQ ID NO: 531535 - DNA, 22 bp, Homo sapiens
taaatattatgccttgagaatg

SEQ ID NO: 531536 - DNA, 15 bp, Homo sapiens
taaatcatgtggcct

SEQ ID NO: 531537 - DNA, 21 bp, Homo sapiens
taaatctgtccaactgagaag

SEQ ID NO: 531538 - DNA, 12 bp, Homo sapiens
taaatgaaatac

SEQ ID NO: 531539 - DNA, 13 bp, Homo sapiens
taaatgaaatact

SEQ ID NO: 531540 - DNA, 14 bp, Homo sapiens
taaatgaaatactt

SEQ ID NO: 531541 - DNA, 15 bp, Homo sapiens
taaatgaaatacttg

SEQ ID NO: 531542 - DNA, 18 bp, Homo sapiens
taaatgtagttcatactt

SEQ ID NO: 531543 - DNA, 13 bp, Homo sapiens
taaatgtatatac

SEQ ID NO: 531544 - DNA, 18 bp, Homo sapiens
taaatgtatatacacata

SEQ ID NO: 531545 - DNA, 22 bp, Homo sapiens
taaatgtgaattactaacttct

SEQ ID NO: 531546 - DNA, 16 bp, Homo sapiens
taaatgttttgtaaac

SEQ ID NO: 531547 - DNA, 21 bp, Homo sapiens
taaatgttttgtaaactttga

SEQ ID NO: 531548 - DNA, 23 bp, Homo sapiens
taaattaggaggctcaacaataa

SEQ ID NO: 531549 - DNA, 21 bp, Homo sapiens
taaattatcattgtttgtcct

SEQ ID NO: 531550 - DNA, 15 bp, Homo sapiens
taaattcaaacctaa

SEQ ID NO: 531551 - DNA, 15 bp, Homo sapiens
taaattccaaagatc

SEQ ID NO: 531552 - DNA, 21 bp, Homo sapiens
taaattccaaagatctgaatg

SEQ ID NO: 531553 - DNA, 13 bp, Homo sapiens
taaattctttatt

SEQ ID NO: 531554 - DNA, 12 bp, Homo sapiens
taaattgtggat

SEQ ID NO: 531555 - DNA, 13 bp, Homo sapiens
taaattgtggatg

SEQ ID NO: 531556 - DNA, 20 bp, Homo sapiens
taaattttgtacatttttga

SEQ ID NO: 531557 - DNA, 13 bp, Homo sapiens
taacaaagtgaga

SEQ ID NO: 531558 - DNA, 17 bp, Homo sapiens
taacaaataacaacttt

SEQ ID NO: 531559 - DNA, 21 bp, Homo sapiens
taacactgagtgaaatattac

SEQ ID NO: 531560 - DNA, 15 bp, Homo sapiens
taacacttgaaaagt

SEQ ID NO: 531561 - DNA, 18 bp, Homo sapiens
taacacttgaaaagtgtg

SEQ ID NO: 531562 - DNA, 16 bp, Homo sapiens
taacaggattagacag

SEQ ID NO: 531563 - DNA, 13 bp, Homo sapiens
taacagtaactgc

SEQ ID NO: 531564 - DNA, 22 bp, Homo sapiens
taacagtaactgccattttttg

SEQ ID NO: 531565 - DNA, 14 bp, Homo sapiens
taacagtattttaa

SEQ ID NO: 531566 - DNA, 15 bp, Homo sapiens
taacagtattttaag

SEQ ID NO: 531567 - DNA, 17 bp, Homo sapiens
taacatctgcagtgttc

SEQ ID NO: 531568 - DNA, 20 bp, Homo sapiens
taacatctgcagtgttctgt

SEQ ID NO: 531569 - DNA, 12 bp, Homo sapiens
taacattgtaaa

SEQ ID NO: 531570 - DNA, 17 bp, Homo sapiens
taaccacagctcctttt

SEQ ID NO: 531571 - DNA, 19 bp, Homo sapiens
taaccacagctccttttcc

SEQ ID NO: 531572 - DNA, 21 bp, Homo sapiens
taaccacagctccttttccag

SEQ ID NO: 531573 - DNA, 22 bp, Homo sapiens
taaccaccctagctttatattt

SEQ ID NO: 531574 - DNA, 18 bp, Homo sapiens
taacctctgttcaggaag

SEQ ID NO: 531575 - DNA, 17 bp, Homo sapiens
taaccttatcataaatt

SEQ ID NO: 531576 - DNA, 23 bp, Homo sapiens
taacgcaccgactagacacacaa

SEQ ID NO: 531577 - DNA, 17 bp, Homo sapiens
taacgtgtgctgtgttt

SEQ ID NO: 531578 - DNA, 22 bp, Homo sapiens
taacgtgtgctgtgtttgctcc

SEQ ID NO: 531579 - DNA, 17 bp, Homo sapiens
taactactttctgttat

SEQ ID NO: 531580 - DNA, 21 bp, Homo sapiens
taactcctagtaggggtacca

SEQ ID NO: 531581 - DNA, 14 bp, Homo sapiens
gtcctttatgtatt

SEQ ID NO: 531582 - DNA, 13 bp, Homo sapiens
gtcgaaagttagt

SEQ ID NO: 531583 - DNA, 13 bp, Homo sapiens
gtcgagctccccc

SEQ ID NO: 531584 - DNA, 20 bp, Homo sapiens
gtcgcctttcagcaggcagc

SEQ ID NO: 531585 - DNA, 15 bp, Homo sapiens
gtcgtccccagacca

SEQ ID NO: 531586 - DNA, 13 bp, Homo sapiens
gtctacagctccc

SEQ ID NO: 531587 - DNA, 15 bp, Homo sapiens
gtctacagctccccc

SEQ ID NO: 531588 - DNA, 23 bp, Homo sapiens
gtctacccctcccggccctgcct

SEQ ID NO: 531589 - DNA, 15 bp, Homo sapiens
gtctcaaaataaaac

SEQ ID NO: 531590 - DNA, 20 bp, Homo sapiens
gtctcaaaataaaaccagaa

SEQ ID NO: 531591 - DNA, 13 bp, Homo sapiens
gtctcaaacaagg

SEQ ID NO: 531592 - DNA, 18 bp, Homo sapiens
gtctcattcctctgtccc

SEQ ID NO: 531593 - DNA, 13 bp, Homo sapiens
gtctccagctgat

SEQ ID NO: 531594 - DNA, 18 bp, Homo sapiens
gtctcccccacccttgtt

SEQ ID NO: 531595 - DNA, 14 bp, Homo sapiens
gtctcctgccccca

SEQ ID NO: 531596 - DNA, 15 bp, Homo sapiens
gtctcctgcccccac

SEQ ID NO: 531597 - DNA, 22 bp, Homo sapiens
gtctcctgcccccacacctggc

SEQ ID NO: 531598 - DNA, 16 bp, Homo sapiens
gtctctatttatgaga

SEQ ID NO: 531599 - DNA, 16 bp, Homo sapiens
gtctctatttcatttt

SEQ ID NO: 531600 - DNA, 11 bp, Homo sapiens
gtctctgccat

SEQ ID NO: 531601 - DNA, 22 bp, Homo sapiens
gtctctgccatgaactggaggc

SEQ ID NO: 531602 - DNA, 13 bp, Homo sapiens
gtctcttctcctt

SEQ ID NO: 531603 - DNA, 14 bp, Homo sapiens
gtctcttctcctta

SEQ ID NO: 531604 - DNA, 14 bp, Homo sapiens
gtctctttcttcct

SEQ ID NO: 531605 - DNA, 15 bp, Homo sapiens
gtctctttcttcctt

SEQ ID NO: 531606 - DNA, 16 bp, Homo sapiens
gtctcttttttacaaa

SEQ ID NO: 531607 - DNA, 18 bp, Homo sapiens
gtctcttttttacaaagg

SEQ ID NO: 531608 - DNA, 20 bp, Homo sapiens
gtctcttttttacaaaggct

SEQ ID NO: 531609 - DNA, 20 bp, Homo sapiens
gtctgaacgaccgtcttttg

SEQ ID NO: 531610 - DNA, 19 bp, Homo sapiens
gtctgccccaagttttgtg

SEQ ID NO: 531611 - DNA, 22 bp, Homo sapiens
gtctgccccaagttttgtgaaa

SEQ ID NO: 531612 - DNA, 17 bp, Homo sapiens
gtctgctctcaaggatg

SEQ ID NO: 531613 - DNA, 12 bp, Homo sapiens
gtctgctgcccc

SEQ ID NO: 531614 - DNA, 14 bp, Homo sapiens
gtctggagaccagg

SEQ ID NO: 531615 - DNA, 11 bp, Homo sapiens
gtctggagggg

SEQ ID NO: 531616 - DNA, 14 bp, Homo sapiens
gtctggctccagcc

SEQ ID NO: 531617 - DNA, 16 bp, Homo sapiens
gtctgtgataacagag

SEQ ID NO: 531618 - DNA, 13 bp, Homo sapiens
gtcttaattaagt

SEQ ID NO: 531619 - DNA, 17 bp, Homo sapiens
gtcttactttgttaatt

SEQ ID NO: 531620 - DNA, 15 bp, Homo sapiens
gtcttaggatgtctg

SEQ ID NO: 531621 - DNA, 17 bp, Homo sapiens
gtcttcaaattgtcttt

SEQ ID NO: 531622 - DNA, 14 bp, Homo sapiens
gtctttaaaatgat

SEQ ID NO: 531623 - DNA, 15 bp, Homo sapiens
gtctttctcctctgg

SEQ ID NO: 531624 - DNA, 20 bp, Homo sapiens
gtctttggaaaattcagata

SEQ ID NO: 531625 - DNA, 15 bp, Homo sapiens
gtcttttaaaaagta

SEQ ID NO: 531626 - DNA, 17 bp, Homo sapiens
gtcttttaaaaagtatt

SEQ ID NO: 531627 - DNA, 23 bp, Homo sapiens
gtcttttaaaaagtattgccaaa

SEQ ID NO: 531628 - DNA, 17 bp, Homo sapiens
gtcttttcctcgcttct

SEQ ID NO: 531629 - DNA, 23 bp, Homo sapiens
gtcttttgcatgtcgcacaatgt

SEQ ID NO: 531630 - DNA, 22 bp, Homo sapiens
gtcttttgtgtctgtcatttct

SEQ ID NO: 531631 - DNA, 21 bp, Homo sapiens
gtcttttttttttaagtgaaa

SEQ ID NO: 531632 - DNA, 17 bp, Homo sapiens
gtgaaaattttattgaa

SEQ ID NO: 531633 - DNA, 12 bp, Homo sapiens
gtgaaatttttc

SEQ ID NO: 531634 - DNA, 13 bp, Homo sapiens
gtgaaatttttca

SEQ ID NO: 531635 - DNA, 15 bp, Homo sapiens
gtgaactgaagcaga

SEQ ID NO: 531636 - DNA, 12 bp, Homo sapiens
gtgaataataat

SEQ ID NO: 531637 - DNA, 16 bp, Homo sapiens
gtgaatagcagtggca

SEQ ID NO: 531638 - DNA, 21 bp, Homo sapiens
gtgacagtgaggtcctggggg

SEQ ID NO: 531639 - DNA, 20 bp, Homo sapiens
gtgacatgcgggctgggcag

SEQ ID NO: 531640 - DNA, 22 bp, Homo sapiens
gtgacatgcgggctgggcagct

SEQ ID NO: 531641 - DNA, 19 bp, Homo sapiens
gtgacctctagccctgccc

SEQ ID NO: 531642 - DNA, 17 bp, Homo sapiens
gtgacgtgagtggggag

SEQ ID NO: 531643 - DNA, 17 bp, Homo sapiens
gtgagctgctgccatga

SEQ ID NO: 531644 - DNA, 11 bp, Homo sapiens
gtgagctggag

SEQ ID NO: 531645 - DNA, 14 bp, Homo sapiens
gtgagggaggcctg

SEQ ID NO: 531646 - DNA, 23 bp, Homo sapiens
gtgaggtcatcccggggccatgg

SEQ ID NO: 531647 - DNA, 24 bp, Homo sapiens
gtgaggtcatcccggggccatgga

SEQ ID NO: 531648 - DNA, 17 bp, Homo sapiens
gtgaggtcctgggggcc

SEQ ID NO: 531649 - DNA, 20 bp, Homo sapiens
gtgaggtcctgggggcctga

SEQ ID NO: 531650 - DNA, 14 bp, Homo sapiens
gtgagtcctccaga

SEQ ID NO: 531651 - DNA, 16 bp, Homo sapiens
gtgagtcctccagaac

SEQ ID NO: 531652 - DNA, 21 bp, Homo sapiens
gtgagtttgctggttgtaaat

SEQ ID NO: 531653 - DNA, 17 bp, Homo sapiens
gtgagtttgtttctttg

SEQ ID NO: 531654 - DNA, 22 bp, Homo sapiens
gtgagtttgtttctttgaattt

SEQ ID NO: 531655 - DNA, 20 bp, Homo sapiens
gtgatattctttgttaattt

SEQ ID NO: 531656 - DNA, 22 bp, Homo sapiens
gtgatattctttgttaatttgg

SEQ ID NO: 531657 - DNA, 14 bp, Homo sapiens
gtgatctgtccttc

SEQ ID NO: 531658 - DNA, 14 bp, Homo sapiens
gtgatggatggcac

SEQ ID NO: 531659 - DNA, 17 bp, Homo sapiens
gtgatggatggcacaat

SEQ ID NO: 531660 - DNA, 16 bp, Homo sapiens
gtgatgtgacatttgt

SEQ ID NO: 531661 - DNA, 18 bp, Homo sapiens
gtgatgtgacatttgtca

SEQ ID NO: 531662 - DNA, 15 bp, Homo sapiens
gtgatgtttttatga

SEQ ID NO: 531663 - DNA, 20 bp, Homo sapiens
gtgattttcaaatatgtaaa

SEQ ID NO: 531664 - DNA, 21 bp, Homo sapiens
gtgattttcaaatatgtaaac

SEQ ID NO: 531665 - DNA, 13 bp, Homo sapiens
gtgcaatatattt

SEQ ID NO: 531666 - DNA, 14 bp, Homo sapiens
gtgcaatatatttt

SEQ ID NO: 531667 - DNA, 16 bp, Homo sapiens
gtgcaatatattttgt

SEQ ID NO: 531668 - DNA, 22 bp, Homo sapiens
gtgcaatttgtctttggaaaat

SEQ ID NO: 531669 - DNA, 20 bp, Homo sapiens
gtgcacagacgtccctccac

SEQ ID NO: 531670 - DNA, 13 bp, Homo sapiens
gtgcacaggcaga

SEQ ID NO: 531671 - DNA, 23 bp, Homo sapiens
gtgcagaagggagctggctccag

SEQ ID NO: 531672 - DNA, 14 bp, Homo sapiens
gtgcagcagggcag

SEQ ID NO: 531673 - DNA, 14 bp, Homo sapiens
gtgcatgtgtgtat

SEQ ID NO: 531674 - DNA, 19 bp, Homo sapiens
gtgccaggagtgggtggga

SEQ ID NO: 531675 - DNA, 22 bp, Homo sapiens
gtgccaggagtgggtgggacac

SEQ ID NO: 531676 - DNA, 14 bp, Homo sapiens
gtgccatcagtgcc

SEQ ID NO: 531677 - DNA, 12 bp, Homo sapiens
gtgcccccagac

SEQ ID NO: 531678 - DNA, 20 bp, Homo sapiens
gtgcgtcagtccaaggggtc

SEQ ID NO: 531679 - DNA, 16 bp, Homo sapiens
gtgctaagagcctctg

SEQ ID NO: 531680 - DNA, 18 bp, Homo sapiens
gtgctaagagcctctgga

SEQ ID NO: 531681 - DNA, 18 bp, Homo sapiens
gtgctaagtctttcccaa

SEQ ID NO: 531682 - DNA, 13 bp, Homo sapiens
gtgctatatatat

SEQ ID NO: 531683 - DNA, 18 bp, Homo sapiens
gtgctccaaatgtctact

SEQ ID NO: 531684 - DNA, 21 bp, Homo sapiens
gtgctctacatctcgtatgga

SEQ ID NO: 531685 - DNA, 21 bp, Homo sapiens
gtgctggatattttactacca

SEQ ID NO: 531686 - DNA, 18 bp, Homo sapiens
gtgcttatgtcatttctt

SEQ ID NO: 531687 - DNA, 18 bp, Homo sapiens
gtgcttgtgaaagaggtc

SEQ ID NO: 531688 - DNA, 18 bp, Homo sapiens
gtggacatgcacccgcat

SEQ ID NO: 531689 - DNA, 21 bp, Homo sapiens
gtggaccagttccctcagccc

SEQ ID NO: 531690 - DNA, 16 bp, Homo sapiens
gtggaccctgaaatgt

SEQ ID NO: 531691 - DNA, 19 bp, Homo sapiens
gtggaccctgaaatgtgtg

SEQ ID NO: 531692 - DNA, 14 bp, Homo sapiens
gtggactgtatttc

SEQ ID NO: 531693 - DNA, 19 bp, Homo sapiens
gtggagcctgacagccaga

SEQ ID NO: 531694 - DNA, 22 bp, Homo sapiens
gtggagcctgacagccagaact

SEQ ID NO: 531695 - DNA, 16 bp, Homo sapiens
gtggagcgttcaccag

SEQ ID NO: 531696 - DNA, 13 bp, Homo sapiens
gtggataagaaaa

SEQ ID NO: 531697 - DNA, 14 bp, Homo sapiens
gtggatgtcccttc

SEQ ID NO: 531698 - DNA, 19 bp, Homo sapiens
gtggatgtcccttccccac

SEQ ID NO: 531699 - DNA, 18 bp, Homo sapiens
gtggattcttgttttgct

SEQ ID NO: 531700 - DNA, 22 bp, Homo sapiens
gtggattcttgttttgcttccc

SEQ ID NO: 531701 - DNA, 14 bp, Homo sapiens
gtggcaaaatatta

SEQ ID NO: 531702 - DNA, 20 bp, Homo sapiens
gtggcaaaatattatgttat

SEQ ID NO: 531703 - DNA, 22 bp, Homo sapiens
gtggcaaagctgttcttcctgg

SEQ ID NO: 531704 - DNA, 16 bp, Homo sapiens
gtggcaaatataaaac

SEQ ID NO: 531705 - DNA, 18 bp, Homo sapiens
gtggcacctgtctgctcc

SEQ ID NO: 531706 - DNA, 20 bp, Homo sapiens
gtggcctaatattgaaaatg

SEQ ID NO: 531707 - DNA, 23 bp, Homo sapiens
gtggcctcgaactcctggcacta

SEQ ID NO: 531708 - DNA, 22 bp, Homo sapiens
gtggctaaatgcctaataaaca

SEQ ID NO: 531709 - DNA, 21 bp, Homo sapiens
gtggctcaagtctggccccac

SEQ ID NO: 531710 - DNA, 15 bp, Homo sapiens
gtggcttcagcccct

SEQ ID NO: 531711 - DNA, 16 bp, Homo sapiens
gtggcttcagcccctg

SEQ ID NO: 531712 - DNA, 17 bp, Homo sapiens
gtgggcattctctctcc

SEQ ID NO: 531713 - DNA, 13 bp, Homo sapiens
gtgggctcccttc

SEQ ID NO: 531714 - DNA, 14 bp, Homo sapiens
gtggggcagcacag

SEQ ID NO: 531715 - DNA, 19 bp, Homo sapiens
gtggggcagcacagagagg

SEQ ID NO: 531716 - DNA, 12 bp, Homo sapiens
gtggggccacac

SEQ ID NO: 531717 - DNA, 14 bp, Homo sapiens
gtgggggggcagag

SEQ ID NO: 531718 - DNA, 21 bp, Homo sapiens
gtgggtcatgatgctctttcc

SEQ ID NO: 531719 - DNA, 13 bp, Homo sapiens
gtgggtcttcagg

SEQ ID NO: 531720 - DNA, 17 bp, Homo sapiens
gtgggtcttcagggggc

SEQ ID NO: 531721 - DNA, 11 bp, Homo sapiens
gtggtacttgg

SEQ ID NO: 531722 - DNA, 23 bp, Homo sapiens
gtggtacttggcaccaataaagg

SEQ ID NO: 531723 - DNA, 20 bp, Homo sapiens
gtggtgaggttgtgctgcct

SEQ ID NO: 531724 - DNA, 23 bp, Homo sapiens
taaggcttcaatttattgcacaa

SEQ ID NO: 531725 - DNA, 22 bp, Homo sapiens
taagggactccagaagcagcag

SEQ ID NO: 531726 - DNA, 13 bp, Homo sapiens
taaggttcttgct

SEQ ID NO: 531727 - DNA, 18 bp, Homo sapiens
taagtaaatctcttctgt

SEQ ID NO: 531728 - DNA, 19 bp, Homo sapiens
taagtaaatgtcttcatgt

SEQ ID NO: 531729 - DNA, 14 bp, Homo sapiens
taagtattcaagaa

SEQ ID NO: 531730 - DNA, 12 bp, Homo sapiens
taagtccagctc

SEQ ID NO: 531731 - DNA, 14 bp, Homo sapiens
taagtctctttttt

SEQ ID NO: 531732 - DNA, 11 bp, Homo sapiens
taagtcttact

SEQ ID NO: 531733 - DNA, 12 bp, Homo sapiens
taagtctttccc

SEQ ID NO: 531734 - DNA, 13 bp, Homo sapiens
taagtgaaattta

SEQ ID NO: 531735 - DNA, 19 bp, Homo sapiens
taagtgcacacagaaatat

SEQ ID NO: 531736 - DNA, 22 bp, Homo sapiens
taagtgcacacagaaatatata

SEQ ID NO: 531737 - DNA, 16 bp, Homo sapiens
taagtggacccagctg

SEQ ID NO: 531738 - DNA, 15 bp, Homo sapiens
taagtgttctgtggc

SEQ ID NO: 531739 - DNA, 16 bp, Homo sapiens
taagtgtttcacagtg

SEQ ID NO: 531740 - DNA, 17 bp, Homo sapiens
taagtgtttcacagtgt

SEQ ID NO: 531741 - DNA, 17 bp, Homo sapiens
taagttcccatttcctt

SEQ ID NO: 531742 - DNA, 18 bp, Homo sapiens
taagttggaaacactaaa

SEQ ID NO: 531743 - DNA, 22 bp, Homo sapiens
taagttggaaacactaaatgtt

SEQ ID NO: 531744 - DNA, 14 bp, Homo sapiens
taagttgtcttaca

SEQ ID NO: 531745 - DNA, 15 bp, Homo sapiens
taagttgtcttacac

SEQ ID NO: 531746 - DNA, 20 bp, Homo sapiens
taataaagcgaaaaactcaa

SEQ ID NO: 531747 - DNA, 22 bp, Homo sapiens
taataaagtatgaatatttcat

SEQ ID NO: 531748 - DNA, 15 bp, Homo sapiens
taataacagctcctt

SEQ ID NO: 531749 - DNA, 17 bp, Homo sapiens
taataacagctccttta

SEQ ID NO: 531750 - DNA, 13 bp, Homo sapiens
taatactaaaata

SEQ ID NO: 531751 - DNA, 17 bp, Homo sapiens
taatactaaaatatgtc

SEQ ID NO: 531752 - DNA, 16 bp, Homo sapiens
taatataactgcctta

SEQ ID NO: 531753 - DNA, 22 bp, Homo sapiens
taatataactgccttaaaactt

SEQ ID NO: 531754 - DNA, 20 bp, Homo sapiens
taatataatggaagagaaat

SEQ ID NO: 531755 - DNA, 16 bp, Homo sapiens
taatatactccttaaa

SEQ ID NO: 531756 - DNA, 21 bp, Homo sapiens
taatatactccttaaaaatgt

SEQ ID NO: 531757 - DNA, 23 bp, Homo sapiens
taatatgattttttaaaagaaat

SEQ ID NO: 531758 - DNA, 21 bp, Homo sapiens
taatatgtattttatgtatgt

SEQ ID NO: 531759 - DNA, 18 bp, Homo sapiens
taatcacactctcttctt

SEQ ID NO: 531760 - DNA, 21 bp, Homo sapiens
taatcaccagggccaaaagct

SEQ ID NO: 531761 - DNA, 22 bp, Homo sapiens
taatcatattagacttctgttt

SEQ ID NO: 531762 - DNA, 20 bp, Homo sapiens
taatccatgtgctgctgtgg

SEQ ID NO: 531763 - DNA, 21 bp, Homo sapiens
taatcctatctggggagctcc

SEQ ID NO: 531764 - DNA, 19 bp, Homo sapiens
taatctttgaaaactcata

SEQ ID NO: 531765 - DNA, 21 bp, Homo sapiens
taatctttgaaaactcataca

SEQ ID NO: 531766 - DNA, 18 bp, Homo sapiens
taatgaagatctttgttt

SEQ ID NO: 531767 - DNA, 16 bp, Homo sapiens
taatgacaagtgactt

SEQ ID NO: 531768 - DNA, 21 bp, Homo sapiens
taatgagctcctgctcattgt

SEQ ID NO: 531769 - DNA, 17 bp, Homo sapiens
taatgagtatatgtaac

SEQ ID NO: 531770 - DNA, 18 bp, Homo sapiens
taatgagtatatgtaaca

SEQ ID NO: 531771 - DNA, 24 bp, Homo sapiens
taatgcaggcaggtgtgaacatgg

SEQ ID NO: 531772 - DNA, 13 bp, Homo sapiens
taatggaagagaa

SEQ ID NO: 531773 - DNA, 17 bp, Homo sapiens
taatggaagagaaatct

SEQ ID NO: 531774 - DNA, 14 bp, Homo sapiens
taatggtaactttt

SEQ ID NO: 531775 - DNA, 16 bp, Homo sapiens
taatggtaacttttgt

SEQ ID NO: 531776 - DNA, 17 bp, Homo sapiens
taatggtctaaaaataa

SEQ ID NO: 531777 - DNA, 18 bp, Homo sapiens
taatgtgtaaaattggat

SEQ ID NO: 531778 - DNA, 12 bp, Homo sapiens
taatgtgtgtat

SEQ ID NO: 531779 - DNA, 16 bp, Homo sapiens
taatgtttaagcagaa

SEQ ID NO: 531780 - DNA, 15 bp, Homo sapiens
taattaaaaagttaa

SEQ ID NO: 531781 - DNA, 15 bp, Homo sapiens
taattaaatgaaata

SEQ ID NO: 531782 - DNA, 16 bp, Homo sapiens
taattaaatgaaatac

SEQ ID NO: 531783 - DNA, 18 bp, Homo sapiens
taattaaatgaaatactt

SEQ ID NO: 531784 - DNA, 17 bp, Homo sapiens
taattaagtaaactaat

SEQ ID NO: 531785 - DNA, 21 bp, Homo sapiens
taattaagtaaactaatgagt

SEQ ID NO: 531786 - DNA, 12 bp, Homo sapiens
taattagagcag

SEQ ID NO: 531787 - DNA, 15 bp, Homo sapiens
taattcattaaaaac

SEQ ID NO: 531788 - DNA, 23 bp, Homo sapiens
taattctcagaagtgaaaaagac

SEQ ID NO: 531789 - DNA, 16 bp, Homo sapiens
taattgctgaggcatg

SEQ ID NO: 531790 - DNA, 12 bp, Homo sapiens
taattgttccag

SEQ ID NO: 531791 - DNA, 20 bp, Homo sapiens
taatttaagtcattttcatg

SEQ ID NO: 531792 - DNA, 23 bp, Homo sapiens
taatttagtggatggaatatcag

SEQ ID NO: 531793 - DNA, 21 bp, Homo sapiens
gtggtgaggttgtgctgcctg

SEQ ID NO: 531794 - DNA, 12 bp, Homo sapiens
gtggtgtaattt

SEQ ID NO: 531795 - DNA, 15 bp, Homo sapiens
gtgtaatttttctgt

SEQ ID NO: 531796 - DNA, 18 bp, Homo sapiens
gtgtatatatgtgtatat

SEQ ID NO: 531797 - DNA, 20 bp, Homo sapiens
gtgtatatgtttatacacac

SEQ ID NO: 531798 - DNA, 20 bp, Homo sapiens
gtgtatggaagacaaataca

SEQ ID NO: 531799 - DNA, 21 bp, Homo sapiens
gtgtatggaagacaaatacac

SEQ ID NO: 531800 - DNA, 23 bp, Homo sapiens
gtgtatggaagacaaatacacat

SEQ ID NO: 531801 - DNA, 13 bp, Homo sapiens
gtgtatgtttttc

SEQ ID NO: 531802 - DNA, 16 bp, Homo sapiens
gtgtatgtttttcagt

SEQ ID NO: 531803 - DNA, 14 bp, Homo sapiens
gtgtattcaggacc

SEQ ID NO: 531804 - DNA, 20 bp, Homo sapiens
gtgtatttattgaagaaaca

SEQ ID NO: 531805 - DNA, 17 bp, Homo sapiens
gtgtcaagtggcaaagc

SEQ ID NO: 531806 - DNA, 19 bp, Homo sapiens
gtgtctcaaaggagctttc

SEQ ID NO: 531807 - DNA, 23 bp, Homo sapiens
gtgtctcaatctgatctgagtga

SEQ ID NO: 531808 - DNA, 11 bp, Homo sapiens
gtgtctgctgt

SEQ ID NO: 531809 - DNA, 15 bp, Homo sapiens
gtgtctttctctttt

SEQ ID NO: 531810 - DNA, 18 bp, Homo sapiens
gtgtgactgcgcactgag

SEQ ID NO: 531811 - DNA, 16 bp, Homo sapiens
gtgtgcatgtgtgtat

SEQ ID NO: 531812 - DNA, 19 bp, Homo sapiens
gtgtggagctgcttccagt

SEQ ID NO: 531813 - DNA, 23 bp, Homo sapiens
gtgtgtatatatgtgtatatata

SEQ ID NO: 531814 - DNA, 14 bp, Homo sapiens
gtgtgtatgtgtat

SEQ ID NO: 531815 - DNA, 17 bp, Homo sapiens
gtgttaatgagtatatg

SEQ ID NO: 531816 - DNA, 23 bp, Homo sapiens
gtgttcagtgttagcagtgggtc

SEQ ID NO: 531817 - DNA, 18 bp, Homo sapiens
gtgttctgttacaaaatg

SEQ ID NO: 531818 - DNA, 17 bp, Homo sapiens
gtgttgccactttccaa

SEQ ID NO: 531819 - DNA, 16 bp, Homo sapiens
gttaaagatgtagcaa

SEQ ID NO: 531820 - DNA, 19 bp, Homo sapiens
gttaaatgttttgtaaact

SEQ ID NO: 531821 - DNA, 23 bp, Homo sapiens
gttaaatgttttgtaaactttga

SEQ ID NO: 531822 - DNA, 17 bp, Homo sapiens
gttaacaaataacaact

SEQ ID NO: 531823 - DNA, 23 bp, Homo sapiens
gttaatctttgaaaactcataca

SEQ ID NO: 531824 - DNA, 17 bp, Homo sapiens
gttaattgatagaataa

SEQ ID NO: 531825 - DNA, 17 bp, Homo sapiens
gttaatttggaccattt

SEQ ID NO: 531826 - DNA, 19 bp, Homo sapiens
gttacaggtaccagttctt

SEQ ID NO: 531827 - DNA, 18 bp, Homo sapiens
gttacagtggcagtattg

SEQ ID NO: 531828 - DNA, 16 bp, Homo sapiens
gttaccattggaaatt

SEQ ID NO: 531829 - DNA, 20 bp, Homo sapiens
gttaccattggaaatttcac

SEQ ID NO: 531830 - DNA, 19 bp, Homo sapiens
gttacctaattagagcaga

SEQ ID NO: 531831 - DNA, 21 bp, Homo sapiens
gttactttccaattctccttt

SEQ ID NO: 531832 - DNA, 13 bp, Homo sapiens
gttacttttcctt

SEQ ID NO: 531833 - DNA, 22 bp, Homo sapiens
gttagagtccaacgtggggcag

SEQ ID NO: 531834 - DNA, 13 bp, Homo sapiens
gttataaaatctg

SEQ ID NO: 531835 - DNA, 15 bp, Homo sapiens
gttataaattttgta

SEQ ID NO: 531836 - DNA, 23 bp, Homo sapiens
gttatgaaaaccctcgatgttca

SEQ ID NO: 531837 - DNA, 21 bp, Homo sapiens
gttatgcatccccatccccat

SEQ ID NO: 531838 - DNA, 13 bp, Homo sapiens
gttatgttgtaat

SEQ ID NO: 531839 - DNA, 22 bp, Homo sapiens
gttatttattctgggaatgtat

SEQ ID NO: 531840 - DNA, 15 bp, Homo sapiens
gttattttgtgtcct

SEQ ID NO: 531841 - DNA, 18 bp, Homo sapiens
gttcaaagtcatgatgtt

SEQ ID NO: 531842 - DNA, 17 bp, Homo sapiens
gttcaagaccagcctgg

SEQ ID NO: 531843 - DNA, 12 bp, Homo sapiens
gttcacccctcc

SEQ ID NO: 531844 - DNA, 16 bp, Homo sapiens
gttcacgcaacttgaa

SEQ ID NO: 531845 - DNA, 18 bp, Homo sapiens
gttcacgtgactcctcaa

SEQ ID NO: 531846 - DNA, 12 bp, Homo sapiens
gttcagaaaaaa

SEQ ID NO: 531847 - DNA, 19 bp, Homo sapiens
gttcagggaagataagttg

SEQ ID NO: 531848 - DNA, 17 bp, Homo sapiens
gttcagtgtttctgggg

SEQ ID NO: 531849 - DNA, 16 bp, Homo sapiens
gttccctcagccctca

SEQ ID NO: 531850 - DNA, 19 bp, Homo sapiens
gttcccttgattcaaataa

SEQ ID NO: 531851 - DNA, 19 bp, Homo sapiens
gttccggaatcctgtcctc

SEQ ID NO: 531852 - DNA, 13 bp, Homo sapiens
gttctaacctcct

SEQ ID NO: 531853 - DNA, 19 bp, Homo sapiens
gttctatcagttatccttt

SEQ ID NO: 531854 - DNA, 15 bp, Homo sapiens
gttctctttggaaat

SEQ ID NO: 531855 - DNA, 12 bp, Homo sapiens
gttctgtgaata

SEQ ID NO: 531856 - DNA, 22 bp, Homo sapiens
gttcttaaaaatgcatttaagt

SEQ ID NO: 531857 - DNA, 15 bp, Homo sapiens
gttcttgagcagctg

SEQ ID NO: 531858 - DNA, 19 bp, Homo sapiens
gttgaagacctaaccaggg

SEQ ID NO: 531859 - DNA, 16 bp, Homo sapiens
gttgaagtcatgctcc

SEQ ID NO: 531860 - DNA, 19 bp, Homo sapiens
gttgaagtcatgctcccct

SEQ ID NO: 531861 - DNA, 20 bp, Homo sapiens
gttgaagtcatgctcccctg

SEQ ID NO: 531862 - DNA, 12 bp, Homo sapiens
gttgcactgaag

SEQ ID NO: 531863 - DNA, 15 bp, Homo sapiens
gttgcactgaagttt

SEQ ID NO: 531864 - DNA, 16 bp, Homo sapiens
gttgcactgaagtttg

SEQ ID NO: 531865 - DNA, 20 bp, Homo sapiens
gttgcccagggatttgtcct

SEQ ID NO: 531866 - DNA, 22 bp, Homo sapiens
gttgctcagagtgaagagtgaa

SEQ ID NO: 531867 - DNA, 16 bp, Homo sapiens
gttggaaacactaaat

SEQ ID NO: 531868 - DNA, 23 bp, Homo sapiens
gttggaaacactaaatgttaaag

SEQ ID NO: 531869 - DNA, 14 bp, Homo sapiens
gttggagttcattc

SEQ ID NO: 531870 - DNA, 17 bp, Homo sapiens
gttggcacatttcatga

SEQ ID NO: 531871 - DNA, 12 bp, Homo sapiens
gttggtatttta

SEQ ID NO: 531872 - DNA, 18 bp, Homo sapiens
gttgtaaacgtcttttta

SEQ ID NO: 531873 - DNA, 22 bp, Homo sapiens
gttgtaagtactctaatataca

SEQ ID NO: 531874 - DNA, 14 bp, Homo sapiens
gttgtaatatcagt

SEQ ID NO: 531875 - DNA, 20 bp, Homo sapiens
gttgtaatatcagttacagt

SEQ ID NO: 531876 - DNA, 13 bp, Homo sapiens
gttgtgatctgtt

SEQ ID NO: 531877 - DNA, 17 bp, Homo sapiens
gttgtgatctgttgtaa

SEQ ID NO: 531878 - DNA, 20 bp, Homo sapiens
gttgtgattccccggagctg

SEQ ID NO: 531879 - DNA, 12 bp, Homo sapiens
gttgtttcttcc

SEQ ID NO: 531880 - DNA, 12 bp, Homo sapiens
gtttaaactttt

SEQ ID NO: 531881 - DNA, 22 bp, Homo sapiens
gtttaataaagcgaaaaactca

SEQ ID NO: 531882 - DNA, 18 bp, Homo sapiens
gtttacactgtcaaacat

SEQ ID NO: 531883 - DNA, 13 bp, Homo sapiens
gtttactctgtgc

SEQ ID NO: 531884 - DNA, 20 bp, Homo sapiens
gtttagcgttgttttgtgga

SEQ ID NO: 531885 - DNA, 16 bp, Homo sapiens
gtttagtcatatctat

SEQ ID NO: 531886 - DNA, 12 bp, Homo sapiens
gtttatgttttg

SEQ ID NO: 531887 - DNA, 23 bp, Homo sapiens
gtttatgttttggtccacttttc

SEQ ID NO: 531888 - DNA, 15 bp, Homo sapiens
gtttcaaaaatctga

SEQ ID NO: 531889 - DNA, 16 bp, Homo sapiens
gtttcaataaagtttg

SEQ ID NO: 531890 - DNA, 18 bp, Homo sapiens
gtttcacagtgtctgtaa

SEQ ID NO: 531891 - DNA, 17 bp, Homo sapiens
gtttcatattctcagat

SEQ ID NO: 531892 - DNA, 14 bp, Homo sapiens
gtttcatccttccc

SEQ ID NO: 531893 - DNA, 18 bp, Homo sapiens
gtttccaggcatgaccct

SEQ ID NO: 531894 - DNA, 15 bp, Homo sapiens
gtttctcccgtgctt

SEQ ID NO: 531895 - DNA, 13 bp, Homo sapiens
gtttctcttctcc

SEQ ID NO: 531896 - DNA, 14 bp, Homo sapiens
gtttctgagaaaag

SEQ ID NO: 531897 - DNA, 17 bp, Homo sapiens
gtttcttctttctagag

SEQ ID NO: 531898 - DNA, 18 bp, Homo sapiens
gtttctttgaattttcat

SEQ ID NO: 531899 - DNA, 19 bp, Homo sapiens
gtttgtcctttatgtattc

SEQ ID NO: 531900 - DNA, 14 bp, Homo sapiens
gttttaaaatactg

SEQ ID NO: 531901 - DNA, 21 bp, Homo sapiens
gttttaaaatactgtagataa

SEQ ID NO: 531902 - DNA, 15 bp, Homo sapiens
gttttatatgattaa

SEQ ID NO: 531903 - DNA, 22 bp, Homo sapiens
gttttcagctaggaacaaatct

SEQ ID NO: 531904 - DNA, 14 bp, Homo sapiens
gttttcttcgtgga

SEQ ID NO: 531905 - DNA, 15 bp, Homo sapiens
gttttgatatgagta

SEQ ID NO: 531906 - DNA, 13 bp, Homo sapiens
gttttgcactctt

SEQ ID NO: 531907 - DNA, 15 bp, Homo sapiens
gttttgcttcccctc

SEQ ID NO: 531908 - DNA, 18 bp, Homo sapiens
gttttgtaaactttgaaa

SEQ ID NO: 531909 - DNA, 13 bp, Homo sapiens
gttttgtgaaatt

SEQ ID NO: 531910 - DNA, 22 bp, Homo sapiens
gttttgtgaaatttttcatatt

SEQ ID NO: 531911 - DNA, 23 bp, Homo sapiens
gttttgtgaaatttttcatattt

SEQ ID NO: 531912 - DNA, 17 bp, Homo sapiens
gttttgtggataagaaa

SEQ ID NO: 531913 - DNA, 13 bp, Homo sapiens
gttttgttttttg

SEQ ID NO: 531914 - DNA, 21 bp, Homo sapiens
gtttttcagttcaaagtcatg

SEQ ID NO: 531915 - DNA, 16 bp, Homo sapiens
gtttttcttaatatat

SEQ ID NO: 531916 - DNA, 11 bp, Homo sapiens
gtttttgttct

SEQ ID NO: 531917 - DNA, 18 bp, Homo sapiens
gtttttgttcttaaaaat

SEQ ID NO: 531918 - DNA, 17 bp, Homo sapiens
gttttttgaagtgttgg

SEQ ID NO: 531919 - DNA, 18 bp, Homo sapiens
gttttttgttttcattaa

SEQ ID NO: 531920 - DNA, 23 bp, Homo sapiens
gtttttttcttttttaattgaaa

SEQ ID NO: 531921 - DNA, 14 bp, Homo sapiens
taaaaacatttttt

SEQ ID NO: 531922 - DNA, 22 bp, Homo sapiens
taaaaacctcttagcttttctg

SEQ ID NO: 531923 - DNA, 15 bp, Homo sapiens
taaaaactactgaat

SEQ ID NO: 531924 - DNA, 17 bp, Homo sapiens
taaaaactactgaataa

SEQ ID NO: 531925 - DNA, 21 bp, Homo sapiens
taaaaagaagatgaatggtct

SEQ ID NO: 531926 - DNA, 12 bp, Homo sapiens
taaaaatacaaa

SEQ ID NO: 531927 - DNA, 15 bp, Homo sapiens
taaaaatacaaacaa

SEQ ID NO: 531928 - DNA, 14 bp, Homo sapiens
taaaaatcagaaag

SEQ ID NO: 531929 - DNA, 21 bp, Homo sapiens
taaaaatgcatttaagttgta

SEQ ID NO: 531930 - DNA, 17 bp, Homo sapiens
taaaaattatctttaaa

SEQ ID NO: 531931 - DNA, 12 bp, Homo sapiens
taaaacagtggt

SEQ ID NO: 531932 - DNA, 12 bp, Homo sapiens
taaaacattatg

SEQ ID NO: 531933 - DNA, 12 bp, Homo sapiens
taaaacatttca

SEQ ID NO: 531934 - DNA, 17 bp, Homo sapiens
taaaactacttagcact

SEQ ID NO: 531935 - DNA, 18 bp, Homo sapiens
taaaactagaaaaggaag

SEQ ID NO: 531936 - DNA, 19 bp, Homo sapiens
cttaaaatttgaaacattg

SEQ ID NO: 531937 - DNA, 16 bp, Homo sapiens
cttaaacattgcctta

SEQ ID NO: 531938 - DNA, 14 bp, Homo sapiens
cttaaatgtgaatt

SEQ ID NO: 531939 - DNA, 19 bp, Homo sapiens
cttaaattagtacagcact

SEQ ID NO: 531940 - DNA, 18 bp, Homo sapiens
cttaacatccctcctgct

SEQ ID NO: 531941 - DNA, 23 bp, Homo sapiens
cttaaccgaagaactaataaatg

SEQ ID NO: 531942 - DNA, 12 bp, Homo sapiens
cttaagaagtat

SEQ ID NO: 531943 - DNA, 12 bp, Homo sapiens
cttaagagaaat

SEQ ID NO: 531944 - DNA, 19 bp, Homo sapiens
cttaagcatccgtgtattt

SEQ ID NO: 531945 - DNA, 13 bp, Homo sapiens
cttaagctgcagg

SEQ ID NO: 531946 - DNA, 22 bp, Homo sapiens
cttaagctgcaggattctcacc

SEQ ID NO: 531947 - DNA, 20 bp, Homo sapiens
cttaaggtactctggacttt

SEQ ID NO: 531948 - DNA, 15 bp, Homo sapiens
cttaagtcttactgt

SEQ ID NO: 531949 - DNA, 19 bp, Homo sapiens
cttaatatatagcatttat

SEQ ID NO: 531950 - DNA, 20 bp, Homo sapiens
cttaatgagcaatatctgct

SEQ ID NO: 531951 - DNA, 18 bp, Homo sapiens
cttaatggccttaattaa

SEQ ID NO: 531952 - DNA, 21 bp, Homo sapiens
cttaattaagtaaactaatga

SEQ ID NO: 531953 - DNA, 12 bp, Homo sapiens
cttaattaattc

SEQ ID NO: 531954 - DNA, 15 bp, Homo sapiens
cttaattaattctca

SEQ ID NO: 531955 - DNA, 20 bp, Homo sapiens
cttacaaatgattgctttta

SEQ ID NO: 531956 - DNA, 22 bp, Homo sapiens
cttacaaatgattgcttttaaa

SEQ ID NO: 531957 - DNA, 20 bp, Homo sapiens
cttacagaaccaattcactt

SEQ ID NO: 531958 - DNA, 12 bp, Homo sapiens
cttacccaaagc

SEQ ID NO: 531959 - DNA, 18 bp, Homo sapiens
cttactacatgtgggagc

SEQ ID NO: 531960 - DNA, 20 bp, Homo sapiens
cttactacatgtgggagctt

SEQ ID NO: 531961 - DNA, 21 bp, Homo sapiens
cttagaaaataaatacaagtt

SEQ ID NO: 531962 - DNA, 16 bp, Homo sapiens
cttagaagaaatatga

SEQ ID NO: 531963 - DNA, 17 bp, Homo sapiens
cttagaatactgtattg

SEQ ID NO: 531964 - DNA, 16 bp, Homo sapiens
cttagaattatttgca

SEQ ID NO: 531965 - DNA, 18 bp, Homo sapiens
cttagaattatttgcact

SEQ ID NO: 531966 - DNA, 14 bp, Homo sapiens
cttagagctttttt

SEQ ID NO: 531967 - DNA, 21 bp, Homo sapiens
cttagaggcatgggcttgctg

SEQ ID NO: 531968 - DNA, 17 bp, Homo sapiens
cttagcctggagcacct

SEQ ID NO: 531969 - DNA, 19 bp, Homo sapiens
cttagcctttaataggctt

SEQ ID NO: 531970 - DNA, 14 bp, Homo sapiens
cttagctggagatg

SEQ ID NO: 531971 - DNA, 18 bp, Homo sapiens
cttagctggatataatgt

SEQ ID NO: 531972 - DNA, 22 bp, Homo sapiens
cttagctggatataatgtattt

SEQ ID NO: 531973 - DNA, 17 bp, Homo sapiens
cttagcttatctttctt

SEQ ID NO: 531974 - DNA, 15 bp, Homo sapiens
cttagcttttctgca

SEQ ID NO: 531975 - DNA, 19 bp, Homo sapiens
cttagtatctcatcaacaa

SEQ ID NO: 531976 - DNA, 17 bp, Homo sapiens
cttagtcaaatgtaatg

SEQ ID NO: 531977 - DNA, 17 bp, Homo sapiens
cttagtgtcccttacct

SEQ ID NO: 531978 - DNA, 19 bp, Homo sapiens
cttatatagcagcaaaaat

SEQ ID NO: 531979 - DNA, 19 bp, Homo sapiens
cttatcaaagtagcaaatg

SEQ ID NO: 531980 - DNA, 20 bp, Homo sapiens
cttatccacgagagcgcagc

SEQ ID NO: 531981 - DNA, 15 bp, Homo sapiens
cttatcctccaccgt

SEQ ID NO: 531982 - DNA, 15 bp, Homo sapiens
cttatgaatagacat

SEQ ID NO: 531983 - DNA, 14 bp, Homo sapiens
cttatgtcatttct

SEQ ID NO: 531984 - DNA, 23 bp, Homo sapiens
cttatgtcatttcttctctctgt

SEQ ID NO: 531985 - DNA, 18 bp, Homo sapiens
cttattaaagtttcaaaa

SEQ ID NO: 531986 - DNA, 19 bp, Homo sapiens
cttattaaagtttcaaaaa

SEQ ID NO: 531987 - DNA, 16 bp, Homo sapiens
cttcaaacgaaatggc

SEQ ID NO: 531988 - DNA, 19 bp, Homo sapiens
cttcaacaaggcttgctgc

SEQ ID NO: 531989 - DNA, 16 bp, Homo sapiens
cttcaacatgtgtgac

SEQ ID NO: 531990 - DNA, 20 bp, Homo sapiens
cttcaatcaataacagccgc

SEQ ID NO: 531991 - DNA, 23 bp, Homo sapiens
cttcaatccccataatgcttctt

SEQ ID NO: 531992 - DNA, 21 bp, Homo sapiens
cttcacaatctgtcagttcta

SEQ ID NO: 531993 - DNA, 22 bp, Homo sapiens
cttcagaaacccggcttcctgt

SEQ ID NO: 531994 - DNA, 11 bp, Homo sapiens
cttcagccagt

SEQ ID NO: 531995 - DNA, 17 bp, Homo sapiens
cttcagggcagatttta

SEQ ID NO: 531996 - DNA, 23 bp, Homo sapiens
cttcatatcctctcgttcagttt

SEQ ID NO: 531997 - DNA, 12 bp, Homo sapiens
cttcatgaaatg

SEQ ID NO: 531998 - DNA, 13 bp, Homo sapiens
cttcatgaaatgc

SEQ ID NO: 531999 - DNA, 17 bp, Homo sapiens
cttcatgaaatgctatg

SEQ ID NO: 532000 - DNA, 17 bp, Homo sapiens
cttcatgcgcagtcccc

SEQ ID NO: 532001 - DNA, 19 bp, Homo sapiens
cttcatggccatagctttt

SEQ ID NO: 532002 - DNA, 13 bp, Homo sapiens
cttcatttttcct

SEQ ID NO: 532003 - DNA, 17 bp, Homo sapiens
cttcatttttcctaaca

SEQ ID NO: 532004 - DNA, 12 bp, Homo sapiens
cttccaaagcag

SEQ ID NO: 532005 - DNA, 19 bp, Homo sapiens
cttccaagactccagccct

SEQ ID NO: 532006 - DNA, 12 bp, Homo sapiens
cttccaggcagc

SEQ ID NO: 532007 - DNA, 18 bp, Homo sapiens
cttccaggcgtagggcca

SEQ ID NO: 532008 - DNA, 21 bp, Homo sapiens
cttccagtctcactgacacag

SEQ ID NO: 532009 - DNA, 21 bp, Homo sapiens
cttccagtttattccagagct

SEQ ID NO: 532010 - DNA, 15 bp, Homo sapiens
cttccatttctgcct

SEQ ID NO: 532011 - DNA, 15 bp, Homo sapiens
cttcccactcttctc

SEQ ID NO: 532012 - DNA, 12 bp, Homo sapiens
cttcccagctgc

SEQ ID NO: 532013 - DNA, 18 bp, Homo sapiens
cttcccagctgcccctcc

SEQ ID NO: 532014 - DNA, 17 bp, Homo sapiens
cttcccatgtctttctc

SEQ ID NO: 532015 - DNA, 22 bp, Homo sapiens
cttccccaaaggccaacagcat

SEQ ID NO: 532016 - DNA, 13 bp, Homo sapiens
cttccccacaata

SEQ ID NO: 532017 - DNA, 16 bp, Homo sapiens
cttccctgacactgtc

SEQ ID NO: 532018 - DNA, 18 bp, Homo sapiens
cttccctggtaagaaaaa

SEQ ID NO: 532019 - DNA, 15 bp, Homo sapiens
cttcctactcttctc

SEQ ID NO: 532020 - DNA, 18 bp, Homo sapiens
cttcctactcttctctct

SEQ ID NO: 532021 - DNA, 14 bp, Homo sapiens
cttcctccaaggac

SEQ ID NO: 532022 - DNA, 20 bp, Homo sapiens
cttcctccccaggacttggt

SEQ ID NO: 532023 - DNA, 22 bp, Homo sapiens
cttcctctcatccttttctcct

SEQ ID NO: 532024 - DNA, 16 bp, Homo sapiens
cttcctctgctaaatt

SEQ ID NO: 532025 - DNA, 15 bp, Homo sapiens
cttcctgtgggagca

SEQ ID NO: 532026 - DNA, 17 bp, Homo sapiens
cttcctgttctgtgtct

SEQ ID NO: 532027 - DNA, 23 bp, Homo sapiens
cttcctgttctgtgtctgctgta

SEQ ID NO: 532028 - DNA, 22 bp, Homo sapiens
cttcctttgtttttttttcctg

SEQ ID NO: 532029 - DNA, 17 bp, Homo sapiens
cttcggcctctcttgga

SEQ ID NO: 532030 - DNA, 18 bp, Homo sapiens
cttctaaaactgtacttt

SEQ ID NO: 532031 - DNA, 15 bp, Homo sapiens
cttctacctgcagga

SEQ ID NO: 532032 - DNA, 18 bp, Homo sapiens
cttctacctgcaggactc

SEQ ID NO: 532033 - DNA, 22 bp, Homo sapiens
cttctacctgcaggactcgggc

SEQ ID NO: 532034 - DNA, 17 bp, Homo sapiens
cttctcatcttttatct

SEQ ID NO: 532035 - DNA, 14 bp, Homo sapiens
cttctctctgtgct

SEQ ID NO: 532036 - DNA, 19 bp, Homo sapiens
cttctctgcccagcttttc

SEQ ID NO: 532037 - DNA, 16 bp, Homo sapiens
cttctcttccaggcag

SEQ ID NO: 532038 - DNA, 17 bp, Homo sapiens
cttctgactcttcccca

SEQ ID NO: 532039 - DNA, 23 bp, Homo sapiens
cttctgcctgaggggcagcctgc

SEQ ID NO: 532040 - DNA, 15 bp, Homo sapiens
cttctgtccaagcag

SEQ ID NO: 532041 - DNA, 23 bp, Homo sapiens
tatttgctcataagtaaatgtct

SEQ ID NO: 532042 - DNA, 16 bp, Homo sapiens
tatttggatgcagagt

SEQ ID NO: 532043 - DNA, 20 bp, Homo sapiens
tatttggatgcagagttcag

SEQ ID NO: 532044 - DNA, 20 bp, Homo sapiens
tatttggctgggctacaatt

SEQ ID NO: 532045 - DNA, 12 bp, Homo sapiens
tatttgtgaaag

SEQ ID NO: 532046 - DNA, 14 bp, Homo sapiens
tatttgtgtaactg

SEQ ID NO: 532047 - DNA, 15 bp, Homo sapiens
tatttgtgtgctaaa

SEQ ID NO: 532048 - DNA, 16 bp, Homo sapiens
tatttgttaatttctt

SEQ ID NO: 532049 - DNA, 13 bp, Homo sapiens
tattttaatttca

SEQ ID NO: 532050 - DNA, 14 bp, Homo sapiens
tattttaatttcaa

SEQ ID NO: 532051 - DNA, 15 bp, Homo sapiens
tattttaatttcaag

SEQ ID NO: 532052 - DNA, 15 bp, Homo sapiens
tattttactgtctta

SEQ ID NO: 532053 - DNA, 16 bp, Homo sapiens
tattttactgtcttaa

SEQ ID NO: 532054 - DNA, 22 bp, Homo sapiens
tattttagtggaccctgaaatg

SEQ ID NO: 532055 - DNA, 23 bp, Homo sapiens
tattttcagctcaattgttaatg

SEQ ID NO: 532056 - DNA, 21 bp, Homo sapiens
tattttcattacaatggaaac

SEQ ID NO: 532057 - DNA, 21 bp, Homo sapiens
tattttctactttaaattgtg

SEQ ID NO: 532058 - DNA, 21 bp, Homo sapiens
tattttgcctgttaaatcgta

SEQ ID NO: 532059 - DNA, 12 bp, Homo sapiens
tattttgtatgc

SEQ ID NO: 532060 - DNA, 22 bp, Homo sapiens
tctggataatttgtataagatg

SEQ ID NO: 532061 - DNA, 14 bp, Homo sapiens
tctggcaaatattt

SEQ ID NO: 532062 - DNA, 20 bp, Homo sapiens
tctggcaaatattttgtcac

SEQ ID NO: 532063 - DNA, 19 bp, Homo sapiens
tctggcaggtggccagggc

SEQ ID NO: 532064 - DNA, 14 bp, Homo sapiens
tctggctgaaaaag

SEQ ID NO: 532065 - DNA, 18 bp, Homo sapiens
tctgtaaaaagcaggtga

SEQ ID NO: 532066 - DNA, 21 bp, Homo sapiens
tctgtaatcacactctcttct

SEQ ID NO: 532067 - DNA, 14 bp, Homo sapiens
tctgtaatttttca

SEQ ID NO: 532068 - DNA, 22 bp, Homo sapiens
tctgtacagagccgtaaaaact

SEQ ID NO: 532069 - DNA, 23 bp, Homo sapiens
tctgtacagagccgtaaaaactg

SEQ ID NO: 532070 - DNA, 15 bp, Homo sapiens
tctgtactaaacatt

SEQ ID NO: 532071 - DNA, 20 bp, Homo sapiens
tctgtatagacaggagaaga

SEQ ID NO: 532072 - DNA, 18 bp, Homo sapiens
tctgtcatttctctttca

SEQ ID NO: 532073 - DNA, 17 bp, Homo sapiens
tctgtcgtccccagacc

SEQ ID NO: 532074 - DNA, 18 bp, Homo sapiens
tctgtcgtccccagacca

SEQ ID NO: 532075 - DNA, 9 bp, Homo sapiens
tctgtctgc

SEQ ID NO: 532076 - DNA, 12 bp, Homo sapiens
tctgtctgctgg

SEQ ID NO: 532077 - DNA, 22 bp, Homo sapiens
tctgtctgctggtcacttcttc

SEQ ID NO: 532078 - DNA, 23 bp, Homo sapiens
tctgtgaaagtctcctgtatcat

SEQ ID NO: 532079 - DNA, 14 bp, Homo sapiens
tctgtgaatagcag

SEQ ID NO: 532080 - DNA, 19 bp, Homo sapiens
tctgtgacttagtggacag

SEQ ID NO: 532081 - DNA, 20 bp, Homo sapiens
tctgtgccttttttatatct

SEQ ID NO: 532082 - DNA, 17 bp, Homo sapiens
tctgtgctaagttgtct

SEQ ID NO: 532083 - DNA, 15 bp, Homo sapiens
tctgtggctcctccc

SEQ ID NO: 532084 - DNA, 13 bp, Homo sapiens
tctgtgtctgctg

SEQ ID NO: 532085 - DNA, 19 bp, Homo sapiens
tctgttacaaaatgtaact

SEQ ID NO: 532086 - DNA, 22 bp, Homo sapiens
tctgttacaaaatgtaactgtt

SEQ ID NO: 532087 - DNA, 12 bp, Homo sapiens
tctgttttcaat

SEQ ID NO: 532088 - DNA, 12 bp, Homo sapiens
tcttaaaaagta

SEQ ID NO: 532089 - DNA, 15 bp, Homo sapiens
tcttaaataaaagaa

SEQ ID NO: 532090 - DNA, 22 bp, Homo sapiens
tcttaaataaaagaaatgcaca

SEQ ID NO: 532091 - DNA, 15 bp, Homo sapiens
tcttaatataactgc

SEQ ID NO: 532092 - DNA, 22 bp, Homo sapiens
tcttaatattcagagaaaactt

SEQ ID NO: 532093 - DNA, 13 bp, Homo sapiens
tcttaattaagta

SEQ ID NO: 532094 - DNA, 19 bp, Homo sapiens
tcttaattaagtaaactaa

SEQ ID NO: 532095 - DNA, 20 bp, Homo sapiens
tcttaattaagtaaactaat

SEQ ID NO: 532096 - DNA, 16 bp, Homo sapiens
tcttacccaaagcaca

SEQ ID NO: 532097 - DNA, 13 bp, Homo sapiens
tcttactttgtta

SEQ ID NO: 532098 - DNA, 20 bp, Homo sapiens
tcttagttaatctttgaaaa

SEQ ID NO: 532099 - DNA, 21 bp, Homo sapiens
tcttataacattgtatgttaa

SEQ ID NO: 532100 - DNA, 15 bp, Homo sapiens
tcttatgaatagaca

SEQ ID NO: 532101 - DNA, 23 bp, Homo sapiens
tcttatgaatagacataaattgt

SEQ ID NO: 532102 - DNA, 17 bp, Homo sapiens
tcttattaaagtttcaa

SEQ ID NO: 532103 - DNA, 22 bp, Homo sapiens
tcttattaaagtttcaaaaatc

SEQ ID NO: 532104 - DNA, 14 bp, Homo sapiens
tcttattccatatt

SEQ ID NO: 532105 - DNA, 14 bp, Homo sapiens
tcttcatacaaagg

SEQ ID NO: 532106 - DNA, 14 bp, Homo sapiens
tcttcatgaaatgc

SEQ ID NO: 532107 - DNA, 14 bp, Homo sapiens
tcttcatgttccca

SEQ ID NO: 532108 - DNA, 16 bp, Homo sapiens
tcttccaacatgtgat

SEQ ID NO: 532109 - DNA, 21 bp, Homo sapiens
tcttccaagactccagccctg

SEQ ID NO: 532110 - DNA, 13 bp, Homo sapiens
tcttccccaggaa

SEQ ID NO: 532111 - DNA, 18 bp, Homo sapiens
tcttccctggtaagaaaa

SEQ ID NO: 532112 - DNA, 19 bp, Homo sapiens
tcttccctggtaagaaaaa

SEQ ID NO: 532113 - DNA, 20 bp, Homo sapiens
tcttcctccaaggacagaag

SEQ ID NO: 532114 - DNA, 16 bp, Homo sapiens
tcttcctccccaggac

SEQ ID NO: 532115 - DNA, 19 bp, Homo sapiens
tcttcctctgctaaattga

SEQ ID NO: 532116 - DNA, 13 bp, Homo sapiens
tcttcctggacag

SEQ ID NO: 532117 - DNA, 14 bp, Homo sapiens
tcttccttccacag

SEQ ID NO: 532118 - DNA, 19 bp, Homo sapiens
tcttccttttgtatcctcc

SEQ ID NO: 532119 - DNA, 22 bp, Homo sapiens
tcttcgtggattgttttttctg

SEQ ID NO: 532120 - DNA, 18 bp, Homo sapiens
tcttctcgggccaccctc

SEQ ID NO: 532121 - DNA, 17 bp, Homo sapiens
tcttctgtcatctacct

SEQ ID NO: 532122 - DNA, 12 bp, Homo sapiens
tcttctgtgttt

SEQ ID NO: 532123 - DNA, 22 bp, Homo sapiens
tcttgaatgttgaagaactcat

SEQ ID NO: 532124 - DNA, 15 bp, Homo sapiens
tcttgagcagctgaa

SEQ ID NO: 532125 - DNA, 15 bp, Homo sapiens
tcttggaactgcacc

SEQ ID NO: 532126 - DNA, 17 bp, Homo sapiens
tcttgggcaatattctc

SEQ ID NO: 532127 - DNA, 22 bp, Homo sapiens
tcttgggcaatattctctgtac

SEQ ID NO: 532128 - DNA, 24 bp, Homo sapiens
tcttgggcaatattctctgtacat

SEQ ID NO: 532129 - DNA, 19 bp, Homo sapiens
tcttggtcacaaagctatt

SEQ ID NO: 532130 - DNA, 16 bp, Homo sapiens
tcttgtattatcataa

SEQ ID NO: 532131 - DNA, 16 bp, Homo sapiens
tcttgttttgcttccc

SEQ ID NO: 532132 - DNA, 14 bp, Homo sapiens
tctttaaagttctt

SEQ ID NO: 532133 - DNA, 16 bp, Homo sapiens
tctttatacagatttt

SEQ ID NO: 532134 - DNA, 15 bp, Homo sapiens
tctttcccttccagt

SEQ ID NO: 532135 - DNA, 15 bp, Homo sapiens
tctttcccttcctcc

SEQ ID NO: 532136 - DNA, 12 bp, Homo sapiens
tctttccttcct

SEQ ID NO: 532137 - DNA, 21 bp, Homo sapiens
tctttctccaaagttatccag

SEQ ID NO: 532138 - DNA, 13 bp, Homo sapiens
tctttctttccat

SEQ ID NO: 532139 - DNA, 16 bp, Homo sapiens
tctttgcattcgtcct

SEQ ID NO: 532140 - DNA, 13 bp, Homo sapiens
tctttgcccttta

SEQ ID NO: 532141 - DNA, 19 bp, Homo sapiens
tctttggaaaattcagata

SEQ ID NO: 532142 - DNA, 14 bp, Homo sapiens
tcttttaaaaagta

SEQ ID NO: 532143 - DNA, 18 bp, Homo sapiens
tcttttatactcagcttt

SEQ ID NO: 532144 - DNA, 20 bp, Homo sapiens
tcttttgcatgtcgcacaat

SEQ ID NO: 532145 - DNA, 21 bp, Homo sapiens
tcttttgcatgtcgcacaatg

SEQ ID NO: 532146 - DNA, 14 bp, Homo sapiens
tctttttcctatga

SEQ ID NO: 532147 - DNA, 13 bp, Homo sapiens
tcttttttacaaa

SEQ ID NO: 532148 - DNA, 18 bp, Homo sapiens
tcttttttacaaaggctg

SEQ ID NO: 532149 - DNA, 16 bp, Homo sapiens
tcttttttctgggtct

SEQ ID NO: 532150 - DNA, 21 bp, Homo sapiens
tctttttttaagtgttctgtg

SEQ ID NO: 532151 - DNA, 20 bp, Homo sapiens
tgaaaaatagtgtgtccatg

SEQ ID NO: 532152 - DNA, 14 bp, Homo sapiens
tgaaaacagaaatt

SEQ ID NO: 532153 - DNA, 15 bp, Homo sapiens
tgaaaacagaaattg

SEQ ID NO: 532154 - DNA, 22 bp, Homo sapiens
tgaaaacagaaattggtacctt

SEQ ID NO: 532155 - DNA, 20 bp, Homo sapiens
tgaaaaccctcgatgttcat

SEQ ID NO: 532156 - DNA, 17 bp, Homo sapiens
tgaaaatgtcactgtta

SEQ ID NO: 532157 - DNA, 13 bp, Homo sapiens
tgaaaatgttcat

SEQ ID NO: 532158 - DNA, 11 bp, Homo sapiens
tgaaacagcag

SEQ ID NO: 532159 - DNA, 12 bp, Homo sapiens
tgaaacagcagc

SEQ ID NO: 532160 - DNA, 13 bp, Homo sapiens
tgaaacagcagct

SEQ ID NO: 532161 - DNA, 13 bp, Homo sapiens
tgaaactgtattt

SEQ ID NO: 532162 - DNA, 21 bp, Homo sapiens
tgaaagcacaggagacactgt

SEQ ID NO: 532163 - DNA, 14 bp, Homo sapiens
tgaaagctgtttca

SEQ ID NO: 532164 - DNA, 16 bp, Homo sapiens
tgaaagctgtttcatt

SEQ ID NO: 532165 - DNA, 22 bp, Homo sapiens
tgaaaggaattttgctaagtaa

SEQ ID NO: 532166 - DNA, 15 bp, Homo sapiens
tgaaagggacaagta

SEQ ID NO: 532167 - DNA, 24 bp, Homo sapiens
tgaaagtgccaaaataaagtctgt

SEQ ID NO: 532168 - DNA, 13 bp, Homo sapiens
tgaaagttgtgat

SEQ ID NO: 532169 - DNA, 22 bp, Homo sapiens
tgaaatatatggtctaatgttt

SEQ ID NO: 532170 - DNA, 13 bp, Homo sapiens
tgaaatgaacaca

SEQ ID NO: 532171 - DNA, 22 bp, Homo sapiens
tgaaatgaacacaaattatgct

SEQ ID NO: 532172 - DNA, 21 bp, Homo sapiens
tgaaatgctatgtcatttcat

SEQ ID NO: 532173 - DNA, 14 bp, Homo sapiens
tgaaatgtgtgtga

SEQ ID NO: 532174 - DNA, 16 bp, Homo sapiens
tgaaatgtgtgtgatg

SEQ ID NO: 532175 - DNA, 19 bp, Homo sapiens
tgaaatgtgtgtgatgtga

SEQ ID NO: 532176 - DNA, 22 bp, Homo sapiens
tgaaatgtgtgtgatgtgacat

SEQ ID NO: 532177 - DNA, 17 bp, Homo sapiens
tgaaatgtttccaggca

SEQ ID NO: 532178 - DNA, 14 bp, Homo sapiens
tgaaattatatctg

SEQ ID NO: 532179 - DNA, 16 bp, Homo sapiens
tgaaatttaagcacaa

SEQ ID NO: 532180 - DNA, 17 bp, Homo sapiens
tgaaatttattgaggaa

SEQ ID NO: 532181 - DNA, 20 bp, Homo sapiens
tgaaatttttcatattttaa

SEQ ID NO: 532182 - DNA, 19 bp, Homo sapiens
tgaacaacgagccttttca

SEQ ID NO: 532183 - DNA, 12 bp, Homo sapiens
tgaacacaaatt

SEQ ID NO: 532184 - DNA, 12 bp, Homo sapiens
tgaacagtgcac

SEQ ID NO: 532185 - DNA, 15 bp, Homo sapiens
tgaactgaagcagag

SEQ ID NO: 532186 - DNA, 17 bp, Homo sapiens
tgaactgaagcagagtc

SEQ ID NO: 532187 - DNA, 15 bp, Homo sapiens
tgaactgctgctggt

SEQ ID NO: 532188 - DNA, 18 bp, Homo sapiens
tgaacttttcaaaataaa

SEQ ID NO: 532189 - DNA, 21 bp, Homo sapiens
tgaacttttcaaaataaagct

SEQ ID NO: 532190 - DNA, 23 bp, Homo sapiens
tgaacttttcaaaataaagcttt

SEQ ID NO: 532191 - DNA, 16 bp, Homo sapiens
tgaagaccctatctcc

SEQ ID NO: 532192 - DNA, 15 bp, Homo sapiens
tgaagacctaaccag

SEQ ID NO: 532193 - DNA, 14 bp, Homo sapiens
tgaagactccagaa

SEQ ID NO: 532194 - DNA, 15 bp, Homo sapiens
tgaagactccagaaa

SEQ ID NO: 532195 - DNA, 23 bp, Homo sapiens
tgaagagaaccgagcaaagatca

SEQ ID NO: 532196 - DNA, 17 bp, Homo sapiens
tgaagagacagttattt

SEQ ID NO: 532197 - DNA, 23 bp, Homo sapiens
tgaagagacagttatttatagtc

SEQ ID NO: 532198 - DNA, 22 bp, Homo sapiens
tgaagagagatatatctgaaaa

SEQ ID NO: 532199 - DNA, 13 bp, Homo sapiens
tgaagagtagttt

SEQ ID NO: 532200 - DNA, 13 bp, Homo sapiens
tgaagatctttgt

SEQ ID NO: 532201 - DNA, 24 bp, Homo sapiens
tgaagattgtttatctagatgtaa

SEQ ID NO: 532202 - DNA, 20 bp, Homo sapiens
tgaagcagagtcaagctgat

SEQ ID NO: 532203 - DNA, 13 bp, Homo sapiens
tgaagccagctcc

SEQ ID NO: 532204 - DNA, 15 bp, Homo sapiens
tgaagccctaagtaa

SEQ ID NO: 532205 - DNA, 13 bp, Homo sapiens
tgaaggaaaggaa

SEQ ID NO: 532206 - DNA, 14 bp, Homo sapiens
tgaaggaaaggaag

SEQ ID NO: 532207 - DNA, 21 bp, Homo sapiens
tgaaggaggctccaggcagca

SEQ ID NO: 532208 - DNA, 13 bp, Homo sapiens
tgaagttatattt

SEQ ID NO: 532209 - DNA, 16 bp, Homo sapiens
tgaagttggcacattt

SEQ ID NO: 532210 - DNA, 20 bp, Homo sapiens
tgaagttggcacatttcatg

SEQ ID NO: 532211 - DNA, 22 bp, Homo sapiens
tgaagttggcacatttcatgag

SEQ ID NO: 532212 - DNA, 14 bp, Homo sapiens
tgaagtttgataaa

SEQ ID NO: 532213 - DNA, 15 bp, Homo sapiens
tgaagtttgataaat

SEQ ID NO: 532214 - DNA, 21 bp, Homo sapiens
tgaatagacataaattgtaat

SEQ ID NO: 532215 - DNA, 23 bp, Homo sapiens
tgaatagacataaattgtaattt

SEQ ID NO: 532216 - DNA, 18 bp, Homo sapiens
tgaatagcagtggcaaaa

SEQ ID NO: 532217 - DNA, 20 bp, Homo sapiens
tgaatagcagtggcaaaata

SEQ ID NO: 532218 - DNA, 22 bp, Homo sapiens
tgaatagtcttttgcatgtcgc

SEQ ID NO: 532219 - DNA, 20 bp, Homo sapiens
tgaatatttcattttgagaa

SEQ ID NO: 532220 - DNA, 23 bp, Homo sapiens
tgaatatttcattttgagaacat

SEQ ID NO: 532221 - DNA, 17 bp, Homo sapiens
tgaatccaaaagaaaaa

SEQ ID NO: 532222 - DNA, 18 bp, Homo sapiens
tgaatccaaaagaaaaac

SEQ ID NO: 532223 - DNA, 13 bp, Homo sapiens
tgaatctgtacag

SEQ ID NO: 532224 - DNA, 14 bp, Homo sapiens
tgaatctgtacaga

SEQ ID NO: 532225 - DNA, 20 bp, Homo sapiens
tgaatgctatttgtgtaact

SEQ ID NO: 532226 - DNA, 21 bp, Homo sapiens
tgaattactaacttctaaaac

SEQ ID NO: 532227 - DNA, 16 bp, Homo sapiens
tgaattggctgccaag

SEQ ID NO: 532228 - DNA, 20 bp, Homo sapiens
tgaatttagtgagatttacc

SEQ ID NO: 532229 - DNA, 12 bp, Homo sapiens
tgaattttcatt

SEQ ID NO: 532230 - DNA, 14 bp, Homo sapiens
tgaattttcatttt

SEQ ID NO: 532231 - DNA, 15 bp, Homo sapiens
tgaattttcatttta

SEQ ID NO: 532232 - DNA, 16 bp, Homo sapiens
tgaattttcattttac

SEQ ID NO: 532233 - DNA, 22 bp, Homo sapiens
tgacacagcagcttcaccagag

SEQ ID NO: 532234 - DNA, 16 bp, Homo sapiens
tgacagagcctgcccc

SEQ ID NO: 532235 - DNA, 22 bp, Homo sapiens
tgacagagcctgccccagcgct

SEQ ID NO: 532236 - DNA, 18 bp, Homo sapiens
tgacagcaaacacagtca

SEQ ID NO: 532237 - DNA, 12 bp, Homo sapiens
tgacagtgaggt

SEQ ID NO: 532238 - DNA, 13 bp, Homo sapiens
tgacatccaagct

SEQ ID NO: 532239 - DNA, 17 bp, Homo sapiens
tgacatgcgggctgggc

SEQ ID NO: 532240 - DNA, 19 bp, Homo sapiens
tgacatgcgggctgggcag

SEQ ID NO: 532241 - DNA, 15 bp, Homo sapiens
tgacatttgtcattt

SEQ ID NO: 532242 - DNA, 22 bp, Homo sapiens
tgacatttgtttggttatagtg

SEQ ID NO: 532243 - DNA, 22 bp, Homo sapiens
tgaccaggcacctcccctcccg

SEQ ID NO: 532244 - DNA, 15 bp, Homo sapiens
tgacccccctcagga

SEQ ID NO: 532245 - DNA, 20 bp, Homo sapiens
tgacccctgcccagatcagc

SEQ ID NO: 532246 - DNA, 17 bp, Homo sapiens
tgaccctgaaatatttt

SEQ ID NO: 532247 - DNA, 20 bp, Homo sapiens
tgaccggggtcctgaggctg

SEQ ID NO: 532248 - DNA, 17 bp, Homo sapiens
tgacctccccctccttc

SEQ ID NO: 532249 - DNA, 17 bp, Homo sapiens
tgacctccgccatccac

SEQ ID NO: 532250 - DNA, 20 bp, Homo sapiens
tgacctctagccctgcccgg

SEQ ID NO: 532251 - DNA, 21 bp, Homo sapiens
tgacctgcccccgctctgcca

SEQ ID NO: 532252 - DNA, 13 bp, Homo sapiens
tgacctggtcagg

SEQ ID NO: 532253 - DNA, 19 bp, Homo sapiens
tgaccttctgtcgtcccca

SEQ ID NO: 532254 - DNA, 20 bp, Homo sapiens
tgaccttctgtcgtccccag

SEQ ID NO: 532255 - DNA, 17 bp, Homo sapiens
tgacgtgtcaggaaaac

SEQ ID NO: 532256 - DNA, 12 bp, Homo sapiens
tgactcaaagat

SEQ ID NO: 532257 - DNA, 22 bp, Homo sapiens
tgactcccccagtccccttccc

SEQ ID NO: 532258 - DNA, 15 bp, Homo sapiens
tgactcctcaattcc

SEQ ID NO: 532259 - DNA, 18 bp, Homo sapiens
tgactcttccccaggaag

SEQ ID NO: 532260 - DNA, 16 bp, Homo sapiens
tgctatgtcatttcat

SEQ ID NO: 532261 - DNA, 19 bp, Homo sapiens
tgctatgtcatttcatgtc

SEQ ID NO: 532262 - DNA, 14 bp, Homo sapiens
tgctatttgtgtaa

SEQ ID NO: 532263 - DNA, 19 bp, Homo sapiens
tgctatttgtgtaactgaa

SEQ ID NO: 532264 - DNA, 17 bp, Homo sapiens
tgctattttactgtctt

SEQ ID NO: 532265 - DNA, 18 bp, Homo sapiens
tgctattttactgtctta

SEQ ID NO: 532266 - DNA, 19 bp, Homo sapiens
tgctattttactgtcttaa

SEQ ID NO: 532267 - DNA, 21 bp, Homo sapiens
tgctcacacaatcagaccaag

SEQ ID NO: 532268 - DNA, 19 bp, Homo sapiens
tgctcagagtgaagagtga

SEQ ID NO: 532269 - DNA, 17 bp, Homo sapiens
tgctcagcagtgagagc

SEQ ID NO: 532270 - DNA, 21 bp, Homo sapiens
tgctcataagtaaatgtcttc

SEQ ID NO: 532271 - DNA, 16 bp, Homo sapiens
tgctcattgtggccag

SEQ ID NO: 532272 - DNA, 13 bp, Homo sapiens
tgctccccctttt

SEQ ID NO: 532273 - DNA, 16 bp, Homo sapiens
tgctccccttcccctt

SEQ ID NO: 532274 - DNA, 20 bp, Homo sapiens
tgctcctccagtacaataaa

SEQ ID NO: 532275 - DNA, 15 bp, Homo sapiens
tgctcctcggccaga

SEQ ID NO: 532276 - DNA, 22 bp, Homo sapiens
tgctcgcctcggatcagctgag

SEQ ID NO: 532277 - DNA, 22 bp, Homo sapiens
tgctctcaccagctgctgctct

SEQ ID NO: 532278 - DNA, 23 bp, Homo sapiens
tgctctcccctccctttttaaac

SEQ ID NO: 532279 - DNA, 15 bp, Homo sapiens
tgctctctcattccc

SEQ ID NO: 532280 - DNA, 23 bp, Homo sapiens
tgctctgagagcaaactggcttg

SEQ ID NO: 532281 - DNA, 15 bp, Homo sapiens
tgctctgctgatgac

SEQ ID NO: 532282 - DNA, 15 bp, Homo sapiens
tgctcttgggcaata

SEQ ID NO: 532283 - DNA, 18 bp, Homo sapiens
tgctcttgggcaatattc

SEQ ID NO: 532284 - DNA, 19 bp, Homo sapiens
tgctcttgggcaatattct

SEQ ID NO: 532285 - DNA, 16 bp, Homo sapiens
tgctctttcccaccca

SEQ ID NO: 532286 - DNA, 21 bp, Homo sapiens
tgctctttcccacccagcctg

SEQ ID NO: 532287 - DNA, 20 bp, Homo sapiens
tgctctttggcctgatgacc

SEQ ID NO: 532288 - DNA, 21 bp, Homo sapiens
tgctgcacagctggccaccat

SEQ ID NO: 532289 - DNA, 14 bp, Homo sapiens
tgctgcactgccct

SEQ ID NO: 532290 - DNA, 16 bp, Homo sapiens
tgctgcactgccctcc

SEQ ID NO: 532291 - DNA, 18 bp, Homo sapiens
tgctgccaggctcccact

SEQ ID NO: 532292 - DNA, 19 bp, Homo sapiens
tgctgccagtaccagcccc

SEQ ID NO: 532293 - DNA, 19 bp, Homo sapiens
tgctgccccactacaggcc

SEQ ID NO: 532294 - DNA, 21 bp, Homo sapiens
tgctgcccccagaccccatcc

SEQ ID NO: 532295 - DNA, 13 bp, Homo sapiens
tgctgcctcagga

SEQ ID NO: 532296 - DNA, 16 bp, Homo sapiens
tgctgctattttactg

SEQ ID NO: 532297 - DNA, 21 bp, Homo sapiens
tgctgctattttactgtctta

SEQ ID NO: 532298 - DNA, 22 bp, Homo sapiens
tgctgctattttactgtcttaa

SEQ ID NO: 532299 - DNA, 13 bp, Homo sapiens
tgctgctcctcgg

SEQ ID NO: 532300 - DNA, 19 bp, Homo sapiens
tgctgctcctcggccagag

SEQ ID NO: 532301 - DNA, 22 bp, Homo sapiens
tgctgctgagcacatctcttca

SEQ ID NO: 532302 - DNA, 13 bp, Homo sapiens
tgctgctgtggca

SEQ ID NO: 532303 - DNA, 16 bp, Homo sapiens
tgctgggtccttaaaa

SEQ ID NO: 532304 - DNA, 18 bp, Homo sapiens
tgctggtcacccccaccc

SEQ ID NO: 532305 - DNA, 15 bp, Homo sapiens
tgctgtaaaagcaag

SEQ ID NO: 532306 - DNA, 15 bp, Homo sapiens
tgctgtaagacggcc

SEQ ID NO: 532307 - DNA, 13 bp, Homo sapiens
tgctgtcattgct

SEQ ID NO: 532308 - DNA, 12 bp, Homo sapiens
tgcttaaatgtg

SEQ ID NO: 532309 - DNA, 17 bp, Homo sapiens
tgcttaaatgtgaatta

SEQ ID NO: 532310 - DNA, 23 bp, Homo sapiens
tgcttaaatgtgaattactaact

SEQ ID NO: 532311 - DNA, 22 bp, Homo sapiens
tgcttacctctcagccttagct

SEQ ID NO: 532312 - DNA, 21 bp, Homo sapiens
tgcttagtatctcatcaacaa

SEQ ID NO: 532313 - DNA, 12 bp, Homo sapiens
tgcttccagaaa

SEQ ID NO: 532314 - DNA, 20 bp, Homo sapiens
tgcttccccaaaggccaaca

SEQ ID NO: 532315 - DNA, 16 bp, Homo sapiens
tgcttctctaaaacag

SEQ ID NO: 532316 - DNA, 18 bp, Homo sapiens
tgcttctctgcccagctt

SEQ ID NO: 532317 - DNA, 17 bp, Homo sapiens
tgcttctttcctcttaa

SEQ ID NO: 532318 - DNA, 18 bp, Homo sapiens
tgcttgaccctgaaatat

SEQ ID NO: 532319 - DNA, 18 bp, Homo sapiens
tgcttgaggccaaatgag

SEQ ID NO: 532320 - DNA, 23 bp, Homo sapiens
tgctttaaagtgtaataatatga

SEQ ID NO: 532321 - DNA, 15 bp, Homo sapiens
tgctttatttttcat

SEQ ID NO: 532322 - DNA, 15 bp, Homo sapiens
tgctttccatatttt

SEQ ID NO: 532323 - DNA, 21 bp, Homo sapiens
tgctttccatatttttttcct

SEQ ID NO: 532324 - DNA, 22 bp, Homo sapiens
tgctttccatatttttttcctt

SEQ ID NO: 532325 - DNA, 18 bp, Homo sapiens
tgctttgcattactgtcc

SEQ ID NO: 532326 - DNA, 12 bp, Homo sapiens
tgctttgtctcc

SEQ ID NO: 532327 - DNA, 15 bp, Homo sapiens
tgctttgtctcctct

SEQ ID NO: 532328 - DNA, 17 bp, Homo sapiens
tgctttgtctcctctat

SEQ ID NO: 532329 - DNA, 19 bp, Homo sapiens
tgcttttaaaattttaagc

SEQ ID NO: 532330 - DNA, 19 bp, Homo sapiens
tgcttttaaggaaaggcaa

SEQ ID NO: 532331 - DNA, 13 bp, Homo sapiens
tgcttttgcaaat

SEQ ID NO: 532332 - DNA, 17 bp, Homo sapiens
tgcttttgcaaataact

SEQ ID NO: 532333 - DNA, 15 bp, Homo sapiens
tggaaaactcacaga

SEQ ID NO: 532334 - DNA, 21 bp, Homo sapiens
tggaaaatgttctgacagcat

SEQ ID NO: 532335 - DNA, 13 bp, Homo sapiens
tggaaacactaaa

SEQ ID NO: 532336 - DNA, 13 bp, Homo sapiens
tggaaatttcacg

SEQ ID NO: 532337 - DNA, 13 bp, Homo sapiens
tggaactgcacca

SEQ ID NO: 532338 - DNA, 17 bp, Homo sapiens
tggaagcaggttaaatg

SEQ ID NO: 532339 - DNA, 19 bp, Homo sapiens
tggaagcaggttaaatgtt

SEQ ID NO: 532340 - DNA, 20 bp, Homo sapiens
tggaagcaggttaaatgttt

SEQ ID NO: 532341 - DNA, 21 bp, Homo sapiens
tggaagcaggttaaatgtttt

SEQ ID NO: 532342 - DNA, 14 bp, Homo sapiens
tggaagctggcagg

SEQ ID NO: 532343 - DNA, 13 bp, Homo sapiens
tggaaggaaaaca

SEQ ID NO: 532344 - DNA, 13 bp, Homo sapiens
tggaaggcccagc

SEQ ID NO: 532345 - DNA, 18 bp, Homo sapiens
tggaatctactagaacct

SEQ ID NO: 532346 - DNA, 16 bp, Homo sapiens
tggacaatttaccaca

SEQ ID NO: 532347 - DNA, 12 bp, Homo sapiens
tggacaccccct

SEQ ID NO: 532348 - DNA, 16 bp, Homo sapiens
tggacagtgcctaact

SEQ ID NO: 532349 - DNA, 12 bp, Homo sapiens
tggacatgcacc

SEQ ID NO: 532350 - DNA, 22 bp, Homo sapiens
tggacatgcacccgcatgtaca

SEQ ID NO: 532351 - DNA, 15 bp, Homo sapiens
tggaccattttcctg

SEQ ID NO: 532352 - DNA, 17 bp, Homo sapiens
tggaccctgaaatgtgt

SEQ ID NO: 532353 - DNA, 18 bp, Homo sapiens
tggacggggacacggcct

SEQ ID NO: 532354 - DNA, 21 bp, Homo sapiens
tggacggggacacggcctctg

SEQ ID NO: 532355 - DNA, 14 bp, Homo sapiens
tggacgtgtgagga

SEQ ID NO: 532356 - DNA, 17 bp, Homo sapiens
tggactctgtggggcca

SEQ ID NO: 532357 - DNA, 19 bp, Homo sapiens
tggactctgtggggccaca

SEQ ID NO: 532358 - DNA, 13 bp, Homo sapiens
tggactgtggcct

SEQ ID NO: 532359 - DNA, 14 bp, Homo sapiens
tggagaccaggact

SEQ ID NO: 532360 - DNA, 18 bp, Homo sapiens
tggagcccggcagtgcac

SEQ ID NO: 532361 - DNA, 17 bp, Homo sapiens
tggagcctgacagccag

SEQ ID NO: 532362 - DNA, 16 bp, Homo sapiens
tggaggagagcctggt

SEQ ID NO: 532363 - DNA, 19 bp, Homo sapiens
tggaggcacacagctgcag

SEQ ID NO: 532364 - DNA, 12 bp, Homo sapiens
tggagggaaagc

SEQ ID NO: 532365 - DNA, 19 bp, Homo sapiens
tggagggctgcagagcctg

SEQ ID NO: 532366 - DNA, 12 bp, Homo sapiens
tggaggtgatga

SEQ ID NO: 532367 - DNA, 13 bp, Homo sapiens
tggagtagagtca

SEQ ID NO: 532368 - DNA, 22 bp, Homo sapiens
tggagtgatatgatccagagca

SEQ ID NO: 532369 - DNA, 13 bp, Homo sapiens
tggagttatgagg

SEQ ID NO: 532370 - DNA, 11 bp, Homo sapiens
tggagttggag

SEQ ID NO: 532371 - DNA, 20 bp, Homo sapiens
tggataagaaaaatgcttga

SEQ ID NO: 532372 - DNA, 14 bp, Homo sapiens
tggatataatgtat

SEQ ID NO: 532373 - DNA, 15 bp, Homo sapiens
tggatataatgtatt

SEQ ID NO: 532374 - DNA, 15 bp, Homo sapiens
tggatcactcaccat

SEQ ID NO: 532375 - DNA, 18 bp, Homo sapiens
tggatccttgtcagttgt

SEQ ID NO: 532376 - DNA, 15 bp, Homo sapiens
tggatggcacaatga

SEQ ID NO: 532377 - DNA, 14 bp, Homo sapiens
tggatgtcccttcc

SEQ ID NO: 532378 - DNA, 14 bp, Homo sapiens
tggattcctgtttc

SEQ ID NO: 532379 - DNA, 17 bp, Homo sapiens
tggattcttgttttgct

SEQ ID NO: 532380 - DNA, 11 bp, Homo sapiens
tggattgtttt

SEQ ID NO: 532381 - DNA, 19 bp, Homo sapiens
tggcaaatattttgtcact

SEQ ID NO: 532382 - DNA, 14 bp, Homo sapiens
tggcaactgtggaa

SEQ ID NO: 532383 - DNA, 18 bp, Homo sapiens
tggcaatgttttgctttt

SEQ ID NO: 532384 - DNA, 10 bp, Homo sapiens
tggcacaatg

SEQ ID NO: 532385 - DNA, 20 bp, Homo sapiens
tggcacagggcatgaaatga

SEQ ID NO: 532386 - DNA, 14 bp, Homo sapiens
tggcaccaataaag

SEQ ID NO: 532387 - DNA, 19 bp, Homo sapiens
tggcaccaataaaggagga

SEQ ID NO: 532388 - DNA, 23 bp, Homo sapiens
tggcaccaataaaggaggaatca

SEQ ID NO: 532389 - DNA, 16 bp, Homo sapiens
tggcaccctgcaccag

SEQ ID NO: 532390 - DNA, 14 bp, Homo sapiens
tggcacctgtctgc

SEQ ID NO: 532391 - DNA, 21 bp, Homo sapiens
tgattgagagcagcctcttga

SEQ ID NO: 532392 - DNA, 14 bp, Homo sapiens
tgattgcttttaaa

SEQ ID NO: 532393 - DNA, 18 bp, Homo sapiens
tgattgtctttttcctat

SEQ ID NO: 532394 - DNA, 15 bp, Homo sapiens
tgatttacctttgga

SEQ ID NO: 532395 - DNA, 17 bp, Homo sapiens
tgatttacctttggaat

SEQ ID NO: 532396 - DNA, 16 bp, Homo sapiens
tgatttactaacagta

SEQ ID NO: 532397 - DNA, 17 bp, Homo sapiens
tgatttactaacagtaa

SEQ ID NO: 532398 - DNA, 12 bp, Homo sapiens
tgatttattctg

SEQ ID NO: 532399 - DNA, 16 bp, Homo sapiens
tgatttccaagtaata

SEQ ID NO: 532400 - DNA, 14 bp, Homo sapiens
tgatttctaagtgt

SEQ ID NO: 532401 - DNA, 15 bp, Homo sapiens
tgatttgtcactgct

SEQ ID NO: 532402 - DNA, 15 bp, Homo sapiens
tgatttgttcttaca

SEQ ID NO: 532403 - DNA, 22 bp, Homo sapiens
tgattttcaaatatgtaaactt

SEQ ID NO: 532404 - DNA, 18 bp, Homo sapiens
tgatttttcttttttaat

SEQ ID NO: 532405 - DNA, 14 bp, Homo sapiens
tgatttttgttgat

SEQ ID NO: 532406 - DNA, 23 bp, Homo sapiens
tgcaaaatacatgatgatttcag

SEQ ID NO: 532407 - DNA, 22 bp, Homo sapiens
tgcaaagcagagtgaaattcaa

SEQ ID NO: 532408 - DNA, 13 bp, Homo sapiens
tgcaaataactta

SEQ ID NO: 532409 - DNA, 18 bp, Homo sapiens
tgcaaataacttacaaga

SEQ ID NO: 532410 - DNA, 22 bp, Homo sapiens
tgcaaatggtggttgtttcttc

SEQ ID NO: 532411 - DNA, 20 bp, Homo sapiens
tgcaaccaaactcccatcag

SEQ ID NO: 532412 - DNA, 22 bp, Homo sapiens
tgcaagaacactggacctttgg

SEQ ID NO: 532413 - DNA, 14 bp, Homo sapiens
tgcaatatattttg

SEQ ID NO: 532414 - DNA, 15 bp, Homo sapiens
tgcaatccttacaaa

SEQ ID NO: 532415 - DNA, 12 bp, Homo sapiens
tgcaattcaact

SEQ ID NO: 532416 - DNA, 18 bp, Homo sapiens
tgcaatttgtctttggaa

SEQ ID NO: 532417 - DNA, 20 bp, Homo sapiens
tgcaatttgtctttggaaaa

SEQ ID NO: 532418 - DNA, 14 bp, Homo sapiens
tgcacaaacataga

SEQ ID NO: 532419 - DNA, 18 bp, Homo sapiens
tgcacaacatcctcagaa

SEQ ID NO: 532420 - DNA, 14 bp, Homo sapiens
tgcacaatgtcttg

SEQ ID NO: 532421 - DNA, 16 bp, Homo sapiens
tgcacacagaaatata

SEQ ID NO: 532422 - DNA, 18 bp, Homo sapiens
tgcacacagaaatatata

SEQ ID NO: 532423 - DNA, 20 bp, Homo sapiens
tgcacacagaaatatatata

SEQ ID NO: 532424 - DNA, 22 bp, Homo sapiens
tgcacacagaaatatatataca

SEQ ID NO: 532425 - DNA, 19 bp, Homo sapiens
tgcacagacgtccctccac

SEQ ID NO: 532426 - DNA, 23 bp, Homo sapiens
tgcacaggcagagcccagaccct

SEQ ID NO: 532427 - DNA, 21 bp, Homo sapiens
tgcacatgatttcacaaatat

SEQ ID NO: 532428 - DNA, 21 bp, Homo sapiens
tgcaccaggtagaacgccagg

SEQ ID NO: 532429 - DNA, 16 bp, Homo sapiens
tgcacccgcatgtaca

SEQ ID NO: 532430 - DNA, 22 bp, Homo sapiens
tgcacgtagtagggtcaggcca

SEQ ID NO: 532431 - DNA, 19 bp, Homo sapiens
tcctgctgagtggtccaca

SEQ ID NO: 532432 - DNA, 21 bp, Homo sapiens
tcctgctgccagtaccagccc

SEQ ID NO: 532433 - DNA, 13 bp, Homo sapiens
tcctgcttttagg

SEQ ID NO: 532434 - DNA, 23 bp, Homo sapiens
tcctggagtgatatgatccagag

SEQ ID NO: 532435 - DNA, 14 bp, Homo sapiens
tcctggctcccagg

SEQ ID NO: 532436 - DNA, 21 bp, Homo sapiens
tcctgggcaacagagtgagac

SEQ ID NO: 532437 - DNA, 12 bp, Homo sapiens
tcctgggccagg

SEQ ID NO: 532438 - DNA, 19 bp, Homo sapiens
tcctgggggctgctgcact

SEQ ID NO: 532439 - DNA, 22 bp, Homo sapiens
tcctgggggctgctgcactgcc

SEQ ID NO: 532440 - DNA, 16 bp, Homo sapiens
tcctgtcctggctccc

SEQ ID NO: 532441 - DNA, 22 bp, Homo sapiens
tcctgtccttctctcacctcct

SEQ ID NO: 532442 - DNA, 21 bp, Homo sapiens
tcctgtcttatcctccaccgt

SEQ ID NO: 532443 - DNA, 17 bp, Homo sapiens
tcctgtggcctgccagt

SEQ ID NO: 532444 - DNA, 17 bp, Homo sapiens
tcctgttctgtgtctgc

SEQ ID NO: 532445 - DNA, 19 bp, Homo sapiens
tccttaaaaaaaaaaatga

SEQ ID NO: 532446 - DNA, 19 bp, Homo sapiens
tccttaaaaatgtatgttg

SEQ ID NO: 532447 - DNA, 23 bp, Homo sapiens
tccttaatggccttaattaattc

SEQ ID NO: 532448 - DNA, 16 bp, Homo sapiens
tccttacaaatgattg

SEQ ID NO: 532449 - DNA, 14 bp, Homo sapiens
tccttatctagctg

SEQ ID NO: 532450 - DNA, 14 bp, Homo sapiens
tccttcccagctgc

SEQ ID NO: 532451 - DNA, 16 bp, Homo sapiens
tccttcccagctgccc

SEQ ID NO: 532452 - DNA, 21 bp, Homo sapiens
tccttcccagctgcccctccc

SEQ ID NO: 532453 - DNA, 20 bp, Homo sapiens
tccttcctgttctgtgtctg

SEQ ID NO: 532454 - DNA, 21 bp, Homo sapiens
tccttgaggacctccacctgg

SEQ ID NO: 532455 - DNA, 19 bp, Homo sapiens
tccttgaggggagccagga

SEQ ID NO: 532456 - DNA, 17 bp, Homo sapiens
tccttgcttcctgtctt

SEQ ID NO: 532457 - DNA, 16 bp, Homo sapiens
tccttgtcttggcagc

SEQ ID NO: 532458 - DNA, 20 bp, Homo sapiens
tcctttaatatactccttaa

SEQ ID NO: 532459 - DNA, 15 bp, Homo sapiens
tcctttaccctcatc

SEQ ID NO: 532460 - DNA, 19 bp, Homo sapiens
tcctttatgtgatgtaact

SEQ ID NO: 532461 - DNA, 13 bp, Homo sapiens
tcctttcacttct

SEQ ID NO: 532462 - DNA, 16 bp, Homo sapiens
tcctttcacttctttc

SEQ ID NO: 532463 - DNA, 19 bp, Homo sapiens
tcctttctaatcctatctg

SEQ ID NO: 532464 - DNA, 20 bp, Homo sapiens
tcctttggccactgtatttg

SEQ ID NO: 532465 - DNA, 23 bp, Homo sapiens
tcctttgtttttttttcctgtcc

SEQ ID NO: 532466 - DNA, 15 bp, Homo sapiens
tccttttccagagca

SEQ ID NO: 532467 - DNA, 16 bp, Homo sapiens
tccttttctcctatct

SEQ ID NO: 532468 - DNA, 19 bp, Homo sapiens
tccttttctcctatcttca

SEQ ID NO: 532469 - DNA, 14 bp, Homo sapiens
tccttttctgtgtt

SEQ ID NO: 532470 - DNA, 15 bp, Homo sapiens
tccttttctgtgttt

SEQ ID NO: 532471 - DNA, 21 bp, Homo sapiens
tcgaagaattggcagaagcag

SEQ ID NO: 532472 - DNA, 14 bp, Homo sapiens
tcgaagtttgcaac

SEQ ID NO: 532473 - DNA, 18 bp, Homo sapiens
tcgaagtttgcaaccttt

SEQ ID NO: 532474 - DNA, 19 bp, Homo sapiens
tcgagctatatttaagtat

SEQ ID NO: 532475 - DNA, 22 bp, Homo sapiens
tcgcactacatctgatatcagg

SEQ ID NO: 532476 - DNA, 15 bp, Homo sapiens
tcgcaggcctccctg

SEQ ID NO: 532477 - DNA, 20 bp, Homo sapiens
tcgcaggcctccctgccagt

SEQ ID NO: 532478 - DNA, 17 bp, Homo sapiens
tcgccctggcaggcagg

SEQ ID NO: 532479 - DNA, 16 bp, Homo sapiens
tcgcctttcagcaggc

SEQ ID NO: 532480 - DNA, 20 bp, Homo sapiens
tcgcctttcagcaggcagcc

SEQ ID NO: 532481 - DNA, 22 bp, Homo sapiens
tcgcctttcagcaggcagcctt

SEQ ID NO: 532482 - DNA, 11 bp, Homo sapiens
tcgctggcccc

SEQ ID NO: 532483 - DNA, 14 bp, Homo sapiens
tcggcacagcctgg

SEQ ID NO: 532484 - DNA, 17 bp, Homo sapiens
tcggccagagctcccag

SEQ ID NO: 532485 - DNA, 18 bp, Homo sapiens
tcggccagagctcccagg

SEQ ID NO: 532486 - DNA, 17 bp, Homo sapiens
tcggctatgtctcatgt

SEQ ID NO: 532487 - DNA, 21 bp, Homo sapiens
gatggcgcacccggcagcccc

SEQ ID NO: 532488 - DNA, 20 bp, Homo sapiens
tgtcttaaataaaagaaatg

SEQ ID NO: 532489 - DNA, 16 bp, Homo sapiens
tgtcttaattaagtaa

SEQ ID NO: 532490 - DNA, 20 bp, Homo sapiens
tgtcttaattaagtaaacta

SEQ ID NO: 532491 - DNA, 17 bp, Homo sapiens
tgtcttcatgttgatgt

SEQ ID NO: 532492 - DNA, 17 bp, Homo sapiens
tgtcttggtacttgctg

SEQ ID NO: 532493 - DNA, 17 bp, Homo sapiens
tgtctttggaaaattca

SEQ ID NO: 532494 - DNA, 22 bp, Homo sapiens
tgtgaaagtgccaaaataaagt

SEQ ID NO: 532495 - DNA, 23 bp, Homo sapiens
tgtgaaagtgccaaaataaagtc

SEQ ID NO: 532496 - DNA, 19 bp, Homo sapiens
tgtgaaatttttcatattt

SEQ ID NO: 532497 - DNA, 21 bp, Homo sapiens
tgtgaactttctcagcatata

SEQ ID NO: 532498 - DNA, 19 bp, Homo sapiens
tgtgaattactaacttcta

SEQ ID NO: 532499 - DNA, 13 bp, Homo sapiens
tgtgacagtgttg

SEQ ID NO: 532500 - DNA, 21 bp, Homo sapiens
tgtgacatctctattccccac

SEQ ID NO: 532501 - DNA, 19 bp, Homo sapiens
tgtgacatgcgggctgggc

SEQ ID NO: 532502 - DNA, 21 bp, Homo sapiens
tgtgacatgcgggctgggcag

SEQ ID NO: 532503 - DNA, 15 bp, Homo sapiens
tgtgacatttgtcat

SEQ ID NO: 532504 - DNA, 13 bp, Homo sapiens
tgtgaccttctct

SEQ ID NO: 532505 - DNA, 20 bp, Homo sapiens
tgtgagaaaaccccttccca

SEQ ID NO: 532506 - DNA, 14 bp, Homo sapiens
tgtgagcctatgat

SEQ ID NO: 532507 - DNA, 21 bp, Homo sapiens
tgtgagcctatgatattcccc

SEQ ID NO: 532508 - DNA, 12 bp, Homo sapiens
tgtgagctgcac

SEQ ID NO: 532509 - DNA, 19 bp, Homo sapiens
tgtgaggatgtggatggag

SEQ ID NO: 532510 - DNA, 19 bp, Homo sapiens
tgtgagtttgtttctttga

SEQ ID NO: 532511 - DNA, 18 bp, Homo sapiens
tgtgataacagagtgatt

SEQ ID NO: 532512 - DNA, 16 bp, Homo sapiens
tgtgatggatggcaca

SEQ ID NO: 532513 - DNA, 17 bp, Homo sapiens
tgtgatggatggcacaa

SEQ ID NO: 532514 - DNA, 15 bp, Homo sapiens
tgtgatgtgttgctc

SEQ ID NO: 532515 - DNA, 19 bp, Homo sapiens
tgtgattccccggagctgg

SEQ ID NO: 532516 - DNA, 14 bp, Homo sapiens
tgtgattttcaaat

SEQ ID NO: 532517 - DNA, 17 bp, Homo sapiens
tgtgattttcaaatatg

SEQ ID NO: 532518 - DNA, 14 bp, Homo sapiens
tgtgcacaggcaga

SEQ ID NO: 532519 - DNA, 16 bp, Homo sapiens
tgtgcacaggcagagc

SEQ ID NO: 532520 - DNA, 15 bp, Homo sapiens
tgtgcagagctgaag

SEQ ID NO: 532521 - DNA, 16 bp, Homo sapiens
ttcacttttattgtat

SEQ ID NO: 532522 - DNA, 22 bp, Homo sapiens
ttcagaaacaaagcatttgact

SEQ ID NO: 532523 - DNA, 13 bp, Homo sapiens
ttcagagaatatc

SEQ ID NO: 532524 - DNA, 13 bp, Homo sapiens
ttcagataatggt

SEQ ID NO: 532525 - DNA, 15 bp, Homo sapiens
ttcagataatggtaa

SEQ ID NO: 532526 - DNA, 18 bp, Homo sapiens
ttcagataatggtaattt

SEQ ID NO: 532527 - DNA, 11 bp, Homo sapiens
ttcagcccctg

SEQ ID NO: 532528 - DNA, 20 bp, Homo sapiens
ttcagctaggaacaaatctt

SEQ ID NO: 532529 - DNA, 18 bp, Homo sapiens
ttcagctctctgtataaa

SEQ ID NO: 532530 - DNA, 21 bp, Homo sapiens
ttcagctctctgtataaacat

SEQ ID NO: 532531 - DNA, 22 bp, Homo sapiens
ttcaggaccccatctgctgagc

SEQ ID NO: 532532 - DNA, 22 bp, Homo sapiens
ttcagtcacttgtttgtgtttg

SEQ ID NO: 532533 - DNA, 13 bp, Homo sapiens
ttcagttcaaagt

SEQ ID NO: 532534 - DNA, 16 bp, Homo sapiens
ttcagttcaaagtcat

SEQ ID NO: 532535 - DNA, 21 bp, Homo sapiens
ttcatagaataacaactgctg

SEQ ID NO: 532536 - DNA, 18 bp, Homo sapiens
ttcatattttaatttcaa

SEQ ID NO: 532537 - DNA, 22 bp, Homo sapiens
ttcatattttaatttcaagctt

SEQ ID NO: 532538 - DNA, 16 bp, Homo sapiens
ttcatcccttctcttc

SEQ ID NO: 532539 - DNA, 12 bp, Homo sapiens
ttcatcctttca

SEQ ID NO: 532540 - DNA, 20 bp, Homo sapiens
ttcatctgagagaggctaaa

SEQ ID NO: 532541 - DNA, 22 bp, Homo sapiens
ttcatgaaatgctatgtcattt

SEQ ID NO: 532542 - DNA, 19 bp, Homo sapiens
ttcatgcgcagtccccagg

SEQ ID NO: 532543 - DNA, 12 bp, Homo sapiens
ttcatgtatttc

SEQ ID NO: 532544 - DNA, 18 bp, Homo sapiens
ttcatgtatttctttaga

SEQ ID NO: 532545 - DNA, 19 bp, Homo sapiens
ttcatgtatttctttagaa

SEQ ID NO: 532546 - DNA, 23 bp, Homo sapiens
ttcatgtatttctttagaacaac

SEQ ID NO: 532547 - DNA, 23 bp, Homo sapiens
ttcatgtcctgtgtcagtttatg

SEQ ID NO: 532548 - DNA, 22 bp, Homo sapiens
ttcatgtgggatcccatctttt

SEQ ID NO: 532549 - DNA, 18 bp, Homo sapiens
ttcattacctgtagcttt

SEQ ID NO: 532550 - DNA, 14 bp, Homo sapiens
ttcattagctgtga

SEQ ID NO: 532551 - DNA, 13 bp, Homo sapiens
ttcattcatatta

SEQ ID NO: 532552 - DNA, 23 bp, Homo sapiens
ttcattcatattacaatatttgt

SEQ ID NO: 532553 - DNA, 23 bp, Homo sapiens
ttcatttctaacataagtaagac

SEQ ID NO: 532554 - DNA, 15 bp, Homo sapiens
ttcatttttcctaac

SEQ ID NO: 532555 - DNA, 12 bp, Homo sapiens
ttccaacaccac

SEQ ID NO: 532556 - DNA, 20 bp, Homo sapiens
ttccaacaccacagacacac

SEQ ID NO: 532557 - DNA, 23 bp, Homo sapiens
ttccaacaccacagacacacaca

SEQ ID NO: 532558 - DNA, 16 bp, Homo sapiens
ttccaacatacaattt

SEQ ID NO: 532559 - DNA, 22 bp, Homo sapiens
ttccaacatacaatttactttt

SEQ ID NO: 532560 - DNA, 17 bp, Homo sapiens
ttccaacctgttcacgt

SEQ ID NO: 532561 - DNA, 19 bp, Homo sapiens
ttccaacctgttcacgtga

SEQ ID NO: 532562 - DNA, 12 bp, Homo sapiens
ttccaagggccc

SEQ ID NO: 532563 - DNA, 13 bp, Homo sapiens
ttccacacaggcc

SEQ ID NO: 532564 - DNA, 16 bp, Homo sapiens
ttccacacaggcccat

SEQ ID NO: 532565 - DNA, 13 bp, Homo sapiens
ttccacagttatc

SEQ ID NO: 532566 - DNA, 20 bp, Homo sapiens
ttccacagttatcttagctg

SEQ ID NO: 532567 - DNA, 13 bp, Homo sapiens
ttccacctgctct

SEQ ID NO: 532568 - DNA, 15 bp, Homo sapiens
ttccacctgctctgc

SEQ ID NO: 532569 - DNA, 13 bp, Homo sapiens
ttccacctggaag

SEQ ID NO: 532570 - DNA, 19 bp, Homo sapiens
ttccactttgtataaattt

SEQ ID NO: 532571 - DNA, 21 bp, Homo sapiens
ttccagagcattccagtcagg

SEQ ID NO: 532572 - DNA, 19 bp, Homo sapiens
ttccaggcgtagggccagg

SEQ ID NO: 532573 - DNA, 16 bp, Homo sapiens
ttccagggaaccagag

SEQ ID NO: 532574 - DNA, 14 bp, Homo sapiens
ttccagtattttag

SEQ ID NO: 532575 - DNA, 22 bp, Homo sapiens
ttccagtcaggctctctgggct

SEQ ID NO: 532576 - DNA, 17 bp, Homo sapiens
ttccagttactttccaa

SEQ ID NO: 532577 - DNA, 18 bp, Homo sapiens
ttccagttggactgtggc

SEQ ID NO: 532578 - DNA, 20 bp, Homo sapiens
ttccagtttattccagagct

SEQ ID NO: 532579 - DNA, 21 bp, Homo sapiens
ttccatattagaaaactttgt

SEQ ID NO: 532580 - DNA, 15 bp, Homo sapiens
ttccatttacagtct

SEQ ID NO: 532581 - DNA, 20 bp, Homo sapiens
ttccatttacagtctctttc

SEQ ID NO: 532582 - DNA, 23 bp, Homo sapiens
ttcccaatctctacccctttctt

SEQ ID NO: 532583 - DNA, 14 bp, Homo sapiens
ttcccacccagcct

SEQ ID NO: 532584 - DNA, 17 bp, Homo sapiens
ttcccaccgccctccct

SEQ ID NO: 532585 - DNA, 22 bp, Homo sapiens
ttcccaccgccctccctcccca

SEQ ID NO: 532586 - DNA, 19 bp, Homo sapiens
ttcccagctgcccctccct

SEQ ID NO: 532587 - DNA, 19 bp, Homo sapiens
ttcccatggtagactgtga

SEQ ID NO: 532588 - DNA, 20 bp, Homo sapiens
ttcccatggtagactgtgac

SEQ ID NO: 532589 - DNA, 23 bp, Homo sapiens
ttcccccaccaccaaaactgctc

SEQ ID NO: 532590 - DNA, 17 bp, Homo sapiens
ttccctagttctttgca

SEQ ID NO: 532591 - DNA, 19 bp, Homo sapiens
ttccctcggagttcttctt

SEQ ID NO: 532592 - DNA, 17 bp, Homo sapiens
ttccctggtaagaaaaa

SEQ ID NO: 532593 - DNA, 20 bp, Homo sapiens
ttcccttccagtttattcca

SEQ ID NO: 532594 - DNA, 21 bp, Homo sapiens
ttcccttctacaaggactcca

SEQ ID NO: 532595 - DNA, 18 bp, Homo sapiens
ttcccttgattcaaataa

SEQ ID NO: 532596 - DNA, 11 bp, Homo sapiens
ttctctgtaca

SEQ ID NO: 532597 - DNA, 21 bp, Homo sapiens
ttctcttctccccttccattt

SEQ ID NO: 532598 - DNA, 14 bp, Homo sapiens
ttctgagctggcct

SEQ ID NO: 532599 - DNA, 21 bp, Homo sapiens
ttctgaggcctgaatccaaaa

SEQ ID NO: 532600 - DNA, 18 bp, Homo sapiens
ttctgataaccatagcat

SEQ ID NO: 532601 - DNA, 22 bp, Homo sapiens
ttctgcctctgatgtattttgt

SEQ ID NO: 532602 - DNA, 21 bp, Homo sapiens
ttctgcctgaggggcagcctg

SEQ ID NO: 532603 - DNA, 15 bp, Homo sapiens
ttctgctgcccccag

SEQ ID NO: 532604 - DNA, 22 bp, Homo sapiens
ttctggaatcattgtccagagc

SEQ ID NO: 532605 - DNA, 23 bp, Homo sapiens
ttctggcaaatattttgtcactg

SEQ ID NO: 532606 - DNA, 18 bp, Homo sapiens
ttctggctgaaaaaggcc

SEQ ID NO: 532607 - DNA, 19 bp, Homo sapiens
ttctggggggatatttcct

SEQ ID NO: 532608 - DNA, 15 bp, Homo sapiens
ttctgtactaaacat

SEQ ID NO: 532609 - DNA, 18 bp, Homo sapiens
ttctgtatagacaggaga

SEQ ID NO: 532610 - DNA, 14 bp, Homo sapiens
ttctgtcgtcccca

SEQ ID NO: 532611 - DNA, 20 bp, Homo sapiens
ttctgtcgtccccagaccag

SEQ ID NO: 532612 - DNA, 15 bp, Homo sapiens
ttctgtgaatagcag

SEQ ID NO: 532613 - DNA, 23 bp, Homo sapiens
ttctgtggctgatttactaacag

SEQ ID NO: 532614 - DNA, 14 bp, Homo sapiens
ttctgtgtctgctg

SEQ ID NO: 532615 - DNA, 14 bp, Homo sapiens
ttctgtgtttacag

SEQ ID NO: 532616 - DNA, 13 bp, Homo sapiens
ttctgttacaaaa

SEQ ID NO: 532617 - DNA, 16 bp, Homo sapiens
ttctgttacaaaatgt

SEQ ID NO: 532618 - DNA, 13 bp, Homo sapiens
ttctgttttcaat

SEQ ID NO: 532619 - DNA, 14 bp, Homo sapiens
ttctgttttcaatc

SEQ ID NO: 532620 - DNA, 14 bp, Homo sapiens
ttcttaaaaagtaa

SEQ ID NO: 532621 - DNA, 19 bp, Homo sapiens
ttcttaaaaatgcatttaa

SEQ ID NO: 532622 - DNA, 22 bp, Homo sapiens
ttcttaaaaatgcatttaagtt

SEQ ID NO: 532623 - DNA, 13 bp, Homo sapiens
ttcttaaaacact

SEQ ID NO: 532624 - DNA, 21 bp, Homo sapiens
ttcttacagttaagaagccct

SEQ ID NO: 532625 - DNA, 14 bp, Homo sapiens
ttcttacccaaagc

SEQ ID NO: 532626 - DNA, 22 bp, Homo sapiens
ttcttagttaatctttgaaaac

SEQ ID NO: 532627 - DNA, 13 bp, Homo sapiens
ttcttcctttcta

SEQ ID NO: 532628 - DNA, 20 bp, Homo sapiens
ttcttccttttgtatcctcc

SEQ ID NO: 532629 - DNA, 12 bp, Homo sapiens
ttcttctttcta

SEQ ID NO: 532630 - DNA, 14 bp, Homo sapiens
ttcttgaataaaag

SEQ ID NO: 532631 - DNA, 16 bp, Homo sapiens
ttcttgcaatttgaag

SEQ ID NO: 532632 - DNA, 14 bp, Homo sapiens
ttcttggtatgatc

SEQ ID NO: 532633 - DNA, 17 bp, Homo sapiens
ttctttgaattttcatt

SEQ ID NO: 532634 - DNA, 23 bp, Homo sapiens
ttcttttcgccgtggctgcggca

SEQ ID NO: 532635 - DNA, 15 bp, Homo sapiens
ttgaaaacagaaatt

SEQ ID NO: 532636 - DNA, 19 bp, Homo sapiens
ttgaaaagaccaagacttt

SEQ ID NO: 532637 - DNA, 19 bp, Homo sapiens
ttgaaaattaaggaaatgt

SEQ ID NO: 532638 - DNA, 11 bp, Homo sapiens
ttgaaacattg

SEQ ID NO: 532639 - DNA, 14 bp, Homo sapiens
ttgaaactgtattt

SEQ ID NO: 532640 - DNA, 20 bp, Homo sapiens
ttgaaactgtatttacttgt

SEQ ID NO: 532641 - DNA, 23 bp, Homo sapiens
ttgaaaggagaaaaaaaaagcca

SEQ ID NO: 532642 - DNA, 14 bp, Homo sapiens
ttgaaattatatct

SEQ ID NO: 532643 - DNA, 14 bp, Homo sapiens
ttgaagaaacagat

SEQ ID NO: 532644 - DNA, 18 bp, Homo sapiens
ttgaagagagatatatct

SEQ ID NO: 532645 - DNA, 21 bp, Homo sapiens
ttgaagagagatatatctgaa

SEQ ID NO: 532646 - DNA, 15 bp, Homo sapiens
ttgaagcctgctcct

SEQ ID NO: 532647 - DNA, 23 bp, Homo sapiens
ttgaagttgactctgctcttgca

SEQ ID NO: 532648 - DNA, 11 bp, Homo sapiens
ttgaattttca

SEQ ID NO: 532649 - DNA, 13 bp, Homo sapiens
ttgaattttcatt

SEQ ID NO: 532650 - DNA, 15 bp, Homo sapiens
ttgacaataagaaac

SEQ ID NO: 532651 - DNA, 18 bp, Homo sapiens
ttgacaataagaaacagt

SEQ ID NO: 532652 - DNA, 12 bp, Homo sapiens
ttgacagctcag

SEQ ID NO: 532653 - DNA, 17 bp, Homo sapiens
ttgaccaggcacctccc

SEQ ID NO: 532654 - DNA, 21 bp, Homo sapiens
ttgaccttctgtcgtccccag

SEQ ID NO: 532655 - DNA, 20 bp, Homo sapiens
ttgactgttatttgttgaga

SEQ ID NO: 532656 - DNA, 23 bp, Homo sapiens
ttgagaatgagggcgtgaaacac

SEQ ID NO: 532657 - DNA, 21 bp, Homo sapiens
ttgaggacctccacctgggag

SEQ ID NO: 532658 - DNA, 20 bp, Homo sapiens
ttgaggcttatatttgtgta

SEQ ID NO: 532659 - DNA, 11 bp, Homo sapiens
ttgagtctttt

SEQ ID NO: 532660 - DNA, 22 bp, Homo sapiens
ttgataaatagtgttattgaga

SEQ ID NO: 532661 - DNA, 18 bp, Homo sapiens
ttgatatgagtatacaat

SEQ ID NO: 532662 - DNA, 17 bp, Homo sapiens
ttgatcttcctctgcta

SEQ ID NO: 532663 - DNA, 20 bp, Homo sapiens
ttgatgcaatccttacaaat

SEQ ID NO: 532664 - DNA, 22 bp, Homo sapiens
ttgatgcaatccttacaaatga

SEQ ID NO: 532665 - DNA, 19 bp, Homo sapiens
ttgatgctgtttctacatt

SEQ ID NO: 532666 - DNA, 16 bp, Homo sapiens
ttgatgttgatgcaat

SEQ ID NO: 532667 - DNA, 20 bp, Homo sapiens
ttgatttacctttggaattg

SEQ ID NO: 532668 - DNA, 18 bp, Homo sapiens
ttgatttcccttcttctg

SEQ ID NO: 532669 - DNA, 12 bp, Homo sapiens
ttgatttctaag

SEQ ID NO: 532670 - DNA, 22 bp, Homo sapiens
ttgatttctagttatttattct

SEQ ID NO: 532671 - DNA, 19 bp, Homo sapiens
ttgatttgtcactgcttca

SEQ ID NO: 532672 - DNA, 12 bp, Homo sapiens
ttgcaaagcaaa

SEQ ID NO: 532673 - DNA, 14 bp, Homo sapiens
ttgcaacctttata

SEQ ID NO: 532674 - DNA, 22 bp, Homo sapiens
ttgcacaaaaagataccttaaa

SEQ ID NO: 532675 - DNA, 23 bp, Homo sapiens
ttgcacaaaaagataccttaaaa

SEQ ID NO: 532676 - DNA, 15 bp, Homo sapiens
ttgcacaattataaa

SEQ ID NO: 532677 - DNA, 21 bp, Homo sapiens
ttgcacagtcactgctcttca

SEQ ID NO: 532678 - DNA, 11 bp, Homo sapiens
ttgcactgaag

SEQ ID NO: 532679 - DNA, 12 bp, Homo sapiens
ttgcactgaagt

SEQ ID NO: 532680 - DNA, 19 bp, Homo sapiens
ttgcagactggtgttaatg

SEQ ID NO: 532681 - DNA, 13 bp, Homo sapiens
ttgcatacaaaca

SEQ ID NO: 532682 - DNA, 14 bp, Homo sapiens
ttgcatacaaacaa

SEQ ID NO: 532683 - DNA, 13 bp, Homo sapiens
ttgcatagaataa

SEQ ID NO: 532684 - DNA, 16 bp, Homo sapiens
ttggctgccaagagtc

SEQ ID NO: 532685 - DNA, 19 bp, Homo sapiens
ttgggcaatattctctgta

SEQ ID NO: 532686 - DNA, 21 bp, Homo sapiens
ttgggcaatattctctgtaca

SEQ ID NO: 532687 - DNA, 21 bp, Homo sapiens
ttggggtggggggcaggatgg

SEQ ID NO: 532688 - DNA, 19 bp, Homo sapiens
ttggtaacttgctgtgaaa

SEQ ID NO: 532689 - DNA, 17 bp, Homo sapiens
ttggtaccttgcacaca

SEQ ID NO: 532690 - DNA, 23 bp, Homo sapiens
ttggttatagtgcaatatatttt

SEQ ID NO: 532691 - DNA, 19 bp, Homo sapiens
ttggtttaaaagtcacata

SEQ ID NO: 532692 - DNA, 16 bp, Homo sapiens
ttggtttaaactttta

SEQ ID NO: 532693 - DNA, 19 bp, Homo sapiens
ttggttttgcatgtctgca

SEQ ID NO: 532694 - DNA, 17 bp, Homo sapiens
ttgtaaacgtattttga

SEQ ID NO: 532695 - DNA, 22 bp, Homo sapiens
ttgtaaagatattgtatctcct

SEQ ID NO: 532696 - DNA, 22 bp, Homo sapiens
ttgtaactatgtttaaagtaat

SEQ ID NO: 532697 - DNA, 14 bp, Homo sapiens
ttgtaatatcagtt

SEQ ID NO: 532698 - DNA, 19 bp, Homo sapiens
ttgtaatatcagttacagt

SEQ ID NO: 532699 - DNA, 15 bp, Homo sapiens
ttgtaatattttgct

SEQ ID NO: 532700 - DNA, 13 bp, Homo sapiens
ttgtaatgtaact

SEQ ID NO: 532701 - DNA, 14 bp, Homo sapiens
ttgtaatgtaactg

SEQ ID NO: 532702 - DNA, 13 bp, Homo sapiens
ttgtataaatgta

SEQ ID NO: 532703 - DNA, 17 bp, Homo sapiens
ttgtataaatgtatata

SEQ ID NO: 532704 - DNA, 19 bp, Homo sapiens
ttgtataaatgtatataca

SEQ ID NO: 532705 - DNA, 17 bp, Homo sapiens
ttgtataaatttttaag

SEQ ID NO: 532706 - DNA, 19 bp, Homo sapiens
ttgtatatatatgtgaact

SEQ ID NO: 532707 - DNA, 23 bp, Homo sapiens
ttgtatttaaaacatttcatgta

SEQ ID NO: 532708 - DNA, 17 bp, Homo sapiens
ttgtcactgagaagatg

SEQ ID NO: 532709 - DNA, 13 bp, Homo sapiens
ttgtccagagctg

SEQ ID NO: 532710 - DNA, 16 bp, Homo sapiens
ttgtccatattttcac

SEQ ID NO: 532711 - DNA, 18 bp, Homo sapiens
ttgtccctggcttcctta

SEQ ID NO: 532712 - DNA, 15 bp, Homo sapiens
ttgtcctaagagatt

SEQ ID NO: 532713 - DNA, 15 bp, Homo sapiens
ttgtcctcctgctgc

SEQ ID NO: 532714 - DNA, 17 bp, Homo sapiens
ttgtcctcctgctgcca

SEQ ID NO: 532715 - DNA, 20 bp, Homo sapiens
ttgtcggctccagtccccag

SEQ ID NO: 532716 - DNA, 14 bp, Homo sapiens
ttgtctaaagatct

SEQ ID NO: 532717 - DNA, 17 bp, Homo sapiens
ttgtctaagaaacattg

SEQ ID NO: 532718 - DNA, 18 bp, Homo sapiens
ttgtctaagaaacattgg

SEQ ID NO: 532719 - DNA, 20 bp, Homo sapiens
ttgtctaagaaacattggaa

SEQ ID NO: 532720 - DNA, 13 bp, Homo sapiens
ttgtctgaaacat

SEQ ID NO: 532721 - DNA, 18 bp, Homo sapiens
ttgtctgccccaagtttt

SEQ ID NO: 532722 - DNA, 16 bp, Homo sapiens
ttgtctgtgataacag

SEQ ID NO: 532723 - DNA, 17 bp, Homo sapiens
ttgtcttaaataaaaga

SEQ ID NO: 532724 - DNA, 12 bp, Homo sapiens
ttgtctttctgg

SEQ ID NO: 532725 - DNA, 18 bp, Homo sapiens
ttgtctttggaaaattca

SEQ ID NO: 532726 - DNA, 21 bp, Homo sapiens
ttgtgaaagtgccaaaataaa

SEQ ID NO: 532727 - DNA, 14 bp, Homo sapiens
ttgtgaaatttttc

SEQ ID NO: 532728 - DNA, 16 bp, Homo sapiens
ttgtgagtttgtttct

SEQ ID NO: 532729 - DNA, 19 bp, Homo sapiens
ttgtgagtttgtttctttg

SEQ ID NO: 532730 - DNA, 21 bp, Homo sapiens
ttgtgagtttgtttctttgaa

SEQ ID NO: 532731 - DNA, 15 bp, Homo sapiens
ttgtgcacaggcaga

SEQ ID NO: 532732 - DNA, 21 bp, Homo sapiens
ttgtgcggtgtgtctccagct

SEQ ID NO: 532733 - DNA, 19 bp, Homo sapiens
ttgtgcttatgtcatttct

SEQ ID NO: 532734 - DNA, 18 bp, Homo sapiens
ttgtgtatgagactgtgt

SEQ ID NO: 532735 - DNA, 19 bp, Homo sapiens
ttgtgtgggtttactctgt

SEQ ID NO: 532736 - DNA, 21 bp, Homo sapiens
ttgtgtgggtttactctgtgc

SEQ ID NO: 532737 - DNA, 15 bp, Homo sapiens
ttgtgttattcgtga

SEQ ID NO: 532738 - DNA, 17 bp, Homo sapiens
ttgtgttttcttcgtgg

SEQ ID NO: 532739 - DNA, 12 bp, Homo sapiens
ttgttctgtgca

SEQ ID NO: 532740 - DNA, 17 bp, Homo sapiens
ttgttcttaaaaatgca

SEQ ID NO: 532741 - DNA, 15 bp, Homo sapiens
ttgttgattctctcc

SEQ ID NO: 532742 - DNA, 14 bp, Homo sapiens
ttgttgcaaaggtc

SEQ ID NO: 532743 - DNA, 20 bp, Homo sapiens
ttgttgcactgaagtttgat

SEQ ID NO: 532744 - DNA, 14 bp, Homo sapiens
ttgtttctttgaat

SEQ ID NO: 532745 - DNA, 18 bp, Homo sapiens
ttgtttggttatagtgca

SEQ ID NO: 532746 - DNA, 13 bp, Homo sapiens
ttgttttgcttcc

SEQ ID NO: 532747 - DNA, 14 bp, Homo sapiens
ttgttttgcttttt

SEQ ID NO: 532748 - DNA, 13 bp, Homo sapiens
ttgttttgtggat

SEQ ID NO: 532749 - DNA, 21 bp, Homo sapiens
ttgttttgttgcactgaagtt

SEQ ID NO: 532750 - DNA, 17 bp, Homo sapiens
ttgttttttgaagtgtt

SEQ ID NO: 532751 - DNA, 18 bp, Homo sapiens
tttaaaaacaaaaggcaa

SEQ ID NO: 532752 - DNA, 17 bp, Homo sapiens
tttaaaaagtattgcca

SEQ ID NO: 532753 - DNA, 20 bp, Homo sapiens
tttaaaaagtattgccaaac

SEQ ID NO: 532754 - DNA, 13 bp, Homo sapiens
tttaaaactactt

SEQ ID NO: 532755 - DNA, 20 bp, Homo sapiens
tttaaaagccctttccaaag

SEQ ID NO: 532756 - DNA, 21 bp, Homo sapiens
tttaaaatcttattaaagttt

SEQ ID NO: 532757 - DNA, 22 bp, Homo sapiens
tttaaaatcttattaaagtttc

SEQ ID NO: 532758 - DNA, 21 bp, Homo sapiens
tttaaaatggcatttagcaca

SEQ ID NO: 532759 - DNA, 11 bp, Homo sapiens
tttaaagaaga

SEQ ID NO: 532760 - DNA, 14 bp, Homo sapiens
tttaaatccttaat

SEQ ID NO: 532761 - DNA, 22 bp, Homo sapiens
tttaacttttgaaaagaccaag

SEQ ID NO: 532762 - DNA, 17 bp, Homo sapiens
tttaagacacttccgtc

SEQ ID NO: 532763 - DNA, 21 bp, Homo sapiens
tttaagagagaaatctgaaaa

SEQ ID NO: 532764 - DNA, 15 bp, Homo sapiens
tttaagcagaattgg

SEQ ID NO: 532765 - DNA, 19 bp, Homo sapiens
tttaagcagaattggaaaa

SEQ ID NO: 532766 - DNA, 15 bp, Homo sapiens
tttaaggaaaggcaa

SEQ ID NO: 532767 - DNA, 19 bp, Homo sapiens
tttaagtcattttcatgtg

SEQ ID NO: 532768 - DNA, 17 bp, Homo sapiens
tttaagtggactgtatt

SEQ ID NO: 532769 - DNA, 18 bp, Homo sapiens
tttaagtggactgtattt

SEQ ID NO: 532770 - DNA, 19 bp, Homo sapiens
tttaagtgttctgtggctg

SEQ ID NO: 532771 - DNA, 15 bp, Homo sapiens
tttaagttgtaaacg

SEQ ID NO: 532772 - DNA, 19 bp, Homo sapiens
tttaataaagcgaaaaact

SEQ ID NO: 532773 - DNA, 13 bp, Homo sapiens
tttaataaagtat

SEQ ID NO: 532774 - DNA, 14 bp, Homo sapiens
tttaatgataaaat

SEQ ID NO: 532775 - DNA, 20 bp, Homo sapiens
tttaatttcaagcttatttt

SEQ ID NO: 532776 - DNA, 23 bp, Homo sapiens
tttacaaaggctgtattcagcaa

SEQ ID NO: 532777 - DNA, 12 bp, Homo sapiens
tttacacaatta

SEQ ID NO: 532778 - DNA, 16 bp, Homo sapiens
tttacagctttacaca

SEQ ID NO: 532779 - DNA, 21 bp, Homo sapiens
tttacagtctctttcttcctt

SEQ ID NO: 532780 - DNA, 15 bp, Homo sapiens
tttacagttactttt

SEQ ID NO: 532781 - DNA, 13 bp, Homo sapiens
tttactaacagta

SEQ ID NO: 532782 - DNA, 16 bp, Homo sapiens
tttactaacagtaact

SEQ ID NO: 532783 - DNA, 17 bp, Homo sapiens
tttggaccattttcctg

SEQ ID NO: 532784 - DNA, 13 bp, Homo sapiens
tttgggaacataa

SEQ ID NO: 532785 - DNA, 18 bp, Homo sapiens
tttgggaacataaaaact

SEQ ID NO: 532786 - DNA, 15 bp, Homo sapiens
tttgggcagatttgc

SEQ ID NO: 532787 - DNA, 23 bp, Homo sapiens
tttgggcagatttgcaacagcaa

SEQ ID NO: 532788 - DNA, 13 bp, Homo sapiens
tttggttatagtg

SEQ ID NO: 532789 - DNA, 23 bp, Homo sapiens
tttggttttaaaatactgtagat

SEQ ID NO: 532790 - DNA, 12 bp, Homo sapiens
tttggttttgtt

SEQ ID NO: 532791 - DNA, 16 bp, Homo sapiens
tttgtataaattttta

SEQ ID NO: 532792 - DNA, 12 bp, Homo sapiens
tttgtatgcaag

SEQ ID NO: 532793 - DNA, 23 bp, Homo sapiens
tttgtatgcaagcagtttcaata

SEQ ID NO: 532794 - DNA, 23 bp, Homo sapiens
tttgtcagtgtagatcaactcat

SEQ ID NO: 532795 - DNA, 14 bp, Homo sapiens
tttgtcattttcat

SEQ ID NO: 532796 - DNA, 21 bp, Homo sapiens
tttgtcattttcattagcaaa

SEQ ID NO: 532797 - DNA, 18 bp, Homo sapiens
tttgtcctaagagattta

SEQ ID NO: 532798 - DNA, 18 bp, Homo sapiens
tttgtcctcctgctgcca

SEQ ID NO: 532799 - DNA, 17 bp, Homo sapiens
tttgtcctttatgtatt

SEQ ID NO: 532800 - DNA, 12 bp, Homo sapiens
tttgtctcctct

SEQ ID NO: 532801 - DNA, 14 bp, Homo sapiens
tttgtctcttctgg

SEQ ID NO: 532802 - DNA, 22 bp, Homo sapiens
tttgtgaaagtgccaaaataaa

SEQ ID NO: 532803 - DNA, 18 bp, Homo sapiens
tttgtgaaatttttcata

SEQ ID NO: 532804 - DNA, 20 bp, Homo sapiens
tttgtgatctgtccttccaa

SEQ ID NO: 532805 - DNA, 15 bp, Homo sapiens
tttgtgtcctttaaa

SEQ ID NO: 532806 - DNA, 18 bp, Homo sapiens
tttgtgtctgtcatttct

SEQ ID NO: 532807 - DNA, 10 bp, Homo sapiens
tttgttctgt

SEQ ID NO: 532808 - DNA, 18 bp, Homo sapiens
tttgttcttaaaaatgca

SEQ ID NO: 532809 - DNA, 16 bp, Homo sapiens
tgtttaaggttcttgc

SEQ ID NO: 532810 - DNA, 16 bp, Homo sapiens
tgtttacactgtcaaa

SEQ ID NO: 532811 - DNA, 13 bp, Homo sapiens
tgtttactttaaa

SEQ ID NO: 532812 - DNA, 19 bp, Homo sapiens
tgtttagtcagtgtactct

SEQ ID NO: 532813 - DNA, 15 bp, Homo sapiens
tgtttatacacacag

SEQ ID NO: 532814 - DNA, 18 bp, Homo sapiens
tgtttatctagatgtaaa

SEQ ID NO: 532815 - DNA, 18 bp, Homo sapiens
tgtttcatccttcccact

SEQ ID NO: 532816 - DNA, 21 bp, Homo sapiens
tgtttccaggcatgaccctgg

SEQ ID NO: 532817 - DNA, 12 bp, Homo sapiens
tgtttctttgaa

SEQ ID NO: 532818 - DNA, 16 bp, Homo sapiens
tgtttctttgaatttt

SEQ ID NO: 532819 - DNA, 23 bp, Homo sapiens
tgtttctttgaattttcatttta

SEQ ID NO: 532820 - DNA, 16 bp, Homo sapiens
tgtttgaattgatttt

SEQ ID NO: 532821 - DNA, 21 bp, Homo sapiens
tgtttgaattgatttttaaac

SEQ ID NO: 532822 - DNA, 16 bp, Homo sapiens
tgtttggttttaaaat

SEQ ID NO: 532823 - DNA, 15 bp, Homo sapiens
tgttttaaactgtga

SEQ ID NO: 532824 - DNA, 16 bp, Homo sapiens
tgttttatatgattaa

SEQ ID NO: 532825 - DNA, 13 bp, Homo sapiens
tgttttcaaatgg

SEQ ID NO: 532826 - DNA, 16 bp, Homo sapiens
tgttttgtaaactttg

SEQ ID NO: 532827 - DNA, 20 bp, Homo sapiens
tgttttgtaaactttgaaat

SEQ ID NO: 532828 - DNA, 12 bp, Homo sapiens
tgttttgtggat

SEQ ID NO: 532829 - DNA, 13 bp, Homo sapiens
tgttttgtggata

SEQ ID NO: 532830 - DNA, 18 bp, Homo sapiens
tgttttgtggataagaaa

SEQ ID NO: 532831 - DNA, 14 bp, Homo sapiens
tgttttgttgattt

SEQ ID NO: 532832 - DNA, 14 bp, Homo sapiens
tgttttgttgcact

SEQ ID NO: 532833 - DNA, 21 bp, Homo sapiens
tgtttttaaaatcttattaaa

SEQ ID NO: 532834 - DNA, 12 bp, Homo sapiens
tgtttttcagtt

SEQ ID NO: 532835 - DNA, 13 bp, Homo sapiens
tgtttttcagttc

SEQ ID NO: 532836 - DNA, 16 bp, Homo sapiens
tgttttttgaagtgtt

SEQ ID NO: 532837 - DNA, 20 bp, Homo sapiens
ttaaaaaaaaagttggtatt

SEQ ID NO: 532838 - DNA, 16 bp, Homo sapiens
ttaaaaaatgaaaata

SEQ ID NO: 532839 - DNA, 17 bp, Homo sapiens
ttaaaaacaaaaggcaa

SEQ ID NO: 532840 - DNA, 20 bp, Homo sapiens
ttaaaaagtattgccaaaca

SEQ ID NO: 532841 - DNA, 21 bp, Homo sapiens
ttaaaaagtattgccaaacat

SEQ ID NO: 532842 - DNA, 23 bp, Homo sapiens
ttaaaaagtcttttaaaaagtat

SEQ ID NO: 532843 - DNA, 20 bp, Homo sapiens
ttaaaaagttaatcttcatg

SEQ ID NO: 532844 - DNA, 12 bp, Homo sapiens
ttaaaaatgcat

SEQ ID NO: 532845 - DNA, 18 bp, Homo sapiens
ttaaaaatgcatttaagt

SEQ ID NO: 532846 - DNA, 15 bp, Homo sapiens
ttaaaaatgtatgtt

SEQ ID NO: 532847 - DNA, 13 bp, Homo sapiens
ttaaaacatttca

SEQ ID NO: 532848 - DNA, 16 bp, Homo sapiens
ttaaaactacttagca

SEQ ID NO: 532849 - DNA, 12 bp, Homo sapiens
ttaaaagaaatt

SEQ ID NO: 532850 - DNA, 16 bp, Homo sapiens
ttaaaagaaatttatt

SEQ ID NO: 532851 - DNA, 13 bp, Homo sapiens
aaaaaaaatgata

SEQ ID NO: 532852 - DNA, 12 bp, Homo sapiens
aaaaaaatatga

SEQ ID NO: 532853 - DNA, 11 bp, Homo sapiens
aaaaaaatcaa

SEQ ID NO: 532854 - DNA, 19 bp, Homo sapiens
aaaaaatgaaatgttttaa

SEQ ID NO: 532855 - DNA, 11 bp, Homo sapiens
aaaaaattaag

SEQ ID NO: 532856 - DNA, 11 bp, Homo sapiens
aaaaacaaaag

SEQ ID NO: 532857 - DNA, 12 bp, Homo sapiens
aaaaacaaagag

SEQ ID NO: 532858 - DNA, 18 bp, Homo sapiens
aaaaacatttttttaagc

SEQ ID NO: 532859 - DNA, 17 bp, Homo sapiens
aaaaactactgaataaa

SEQ ID NO: 532860 - DNA, 18 bp, Homo sapiens
aaaaactagacattattt

SEQ ID NO: 532861 - DNA, 22 bp, Homo sapiens
aaaaactcaaccaaatggtaca

SEQ ID NO: 532862 - DNA, 11 bp, Homo sapiens
aaaaagaaaaa

SEQ ID NO: 532863 - DNA, 15 bp, Homo sapiens
aaaaagcaacttttc

SEQ ID NO: 532864 - DNA, 12 bp, Homo sapiens
aaaaagccctct

SEQ ID NO: 532865 - DNA, 15 bp, Homo sapiens
aaaaagtattgccaa

SEQ ID NO: 532866 - DNA, 15 bp, Homo sapiens
aaaaagtgacacagc

SEQ ID NO: 532867 - DNA, 23 bp, Homo sapiens
aaaaagtgacacagcagcttcac

SEQ ID NO: 532868 - DNA, 14 bp, Homo sapiens
aaaaagtgtctcaa

SEQ ID NO: 532869 - DNA, 12 bp, Homo sapiens
aaaaataaatgg

SEQ ID NO: 532870 - DNA, 16 bp, Homo sapiens
aaaaatatgtgaagga

SEQ ID NO: 532871 - DNA, 18 bp, Homo sapiens
aaaaatatttttttttct

SEQ ID NO: 532872 - DNA, 14 bp, Homo sapiens
aaaaatctgaagat

SEQ ID NO: 532873 - DNA, 17 bp, Homo sapiens
aaaaatctgaagattgt

SEQ ID NO: 532874 - DNA, 13 bp, Homo sapiens
aaaaatgatactt

SEQ ID NO: 532875 - DNA, 19 bp, Homo sapiens
aaaaatgcatttaagttgt

SEQ ID NO: 532876 - DNA, 15 bp, Homo sapiens
aaaaattatctttaa

SEQ ID NO: 532877 - DNA, 13 bp, Homo sapiens
aaaaattgaagag

SEQ ID NO: 532878 - DNA, 18 bp, Homo sapiens
aaaaatttctggcaaata

SEQ ID NO: 532879 - DNA, 21 bp, Homo sapiens
aaaaatttctggcaaatattt

SEQ ID NO: 532880 - DNA, 13 bp, Homo sapiens
aaaacaaaaggca

SEQ ID NO: 532881 - DNA, 16 bp, Homo sapiens
aaaacagaaattggta

SEQ ID NO: 532882 - DNA, 11 bp, Homo sapiens
aaaacagtggt

SEQ ID NO: 532883 - DNA, 12 bp, Homo sapiens
aaaacatttcat

SEQ ID NO: 532884 - DNA, 14 bp, Homo sapiens
aaaacatttcatgt

SEQ ID NO: 532885 - DNA, 22 bp, Homo sapiens
aaaaccctcgatgttcatggaa

SEQ ID NO: 532886 - DNA, 23 bp, Homo sapiens
aaaaccctcgatgttcatggaat

SEQ ID NO: 532887 - DNA, 19 bp, Homo sapiens
aaaaccgtgtttgtctctt

SEQ ID NO: 532888 - DNA, 16 bp, Homo sapiens
aaaacgatttaattta

SEQ ID NO: 532889 - DNA, 13 bp, Homo sapiens
aaaactaagttct

SEQ ID NO: 532890 - DNA, 19 bp, Homo sapiens
aaaactactgaataaatca

SEQ ID NO: 532891 - DNA, 11 bp, Homo sapiens
aaaactgctcc

SEQ ID NO: 532892 - DNA, 20 bp, Homo sapiens
aaaactgtactttgattcac

SEQ ID NO: 532893 - DNA, 21 bp, Homo sapiens
aaaactgtactttgattcaca

SEQ ID NO: 532894 - DNA, 13 bp, Homo sapiens
aaaacttcagaga

SEQ ID NO: 532895 - DNA, 19 bp, Homo sapiens
aaaactttgttaggccaaa

SEQ ID NO: 532896 - DNA, 15 bp, Homo sapiens
aaaagaaaaatttct

SEQ ID NO: 532897 - DNA, 22 bp, Homo sapiens
aaaagaaatctatagaaagtgt

SEQ ID NO: 532898 - DNA, 15 bp, Homo sapiens
aaaagaaatgcacaa

SEQ ID NO: 532899 - DNA, 13 bp, Homo sapiens
aaaagacttcaaa

SEQ ID NO: 532900 - DNA, 21 bp, Homo sapiens
aaaagataccttaaaatttga

SEQ ID NO: 532901 - DNA, 14 bp, Homo sapiens
aaaagcaacttttc

SEQ ID NO: 532902 - DNA, 14 bp, Homo sapiens
aaaagcacctcttg

SEQ ID NO: 532903 - DNA, 14 bp, Homo sapiens
aaaagccctcttca

SEQ ID NO: 532904 - DNA, 18 bp, Homo sapiens
aaaaggccagtggaaatt

SEQ ID NO: 532905 - DNA, 22 bp, Homo sapiens
aaaagggagaataaaattccta

SEQ ID NO: 532906 - DNA, 21 bp, Homo sapiens
aaaagtatcgggggctggggc

SEQ ID NO: 532907 - DNA, 14 bp, Homo sapiens
aaaagtcttttaaa

SEQ ID NO: 532908 - DNA, 19 bp, Homo sapiens
aaaagttaataacagctcc

SEQ ID NO: 532909 - DNA, 22 bp, Homo sapiens
aaaagttaataacagctccttt

SEQ ID NO: 532910 - DNA, 22 bp, Homo sapiens
aaaagttggtattttataagca

SEQ ID NO: 532911 - DNA, 15 bp, Homo sapiens
aaaagttgtatgatc

SEQ ID NO: 532912 - DNA, 16 bp, Homo sapiens
aaaagttgtatgatct

SEQ ID NO: 532913 - DNA, 18 bp, Homo sapiens
aaaagttgtatgatctgt

SEQ ID NO: 532914 - DNA, 14 bp, Homo sapiens
aaaagtttaaagaa

SEQ ID NO: 532915 - DNA, 18 bp, Homo sapiens
aaaagtttaaagaagagt

SEQ ID NO: 532916 - DNA, 17 bp, Homo sapiens
aaaataaaaagtgacac

SEQ ID NO: 532917 - DNA, 14 bp, Homo sapiens
aaaataaaaccaga

SEQ ID NO: 532918 - DNA, 15 bp, Homo sapiens
aaaataaaaggtcta

SEQ ID NO: 532919 - DNA, 23 bp, Homo sapiens
aaaataaagcttttgcatagaat

SEQ ID NO: 532920 - DNA, 14 bp, Homo sapiens
aaaataaataaata

SEQ ID NO: 532921 - DNA, 21 bp, Homo sapiens
aaaataagtgaataataatta

SEQ ID NO: 532922 - DNA, 13 bp, Homo sapiens
aaaatacaaacaa

SEQ ID NO: 532923 - DNA, 15 bp, Homo sapiens
aaaatactgtagata

SEQ ID NO: 532924 - DNA, 15 bp, Homo sapiens
aaaatagctataaat

SEQ ID NO: 532925 - DNA, 19 bp, Homo sapiens
aaaatagttccctttgcca

SEQ ID NO: 532926 - DNA, 16 bp, Homo sapiens
aaaatagttgtccata

SEQ ID NO: 532927 - DNA, 18 bp, Homo sapiens
aaaatataaagcatctaa

SEQ ID NO: 532928 - DNA, 12 bp, Homo sapiens
aaaatatgcact

SEQ ID NO: 532929 - DNA, 12 bp, Homo sapiens
aaaatatgtgaa

SEQ ID NO: 532930 - DNA, 13 bp, Homo sapiens
aaaatatgtgaag

SEQ ID NO: 532931 - DNA, 15 bp, Homo sapiens
aaaatcagtttttgt

SEQ ID NO: 532932 - DNA, 18 bp, Homo sapiens
aaaatcccattgtattta

SEQ ID NO: 532933 - DNA, 19 bp, Homo sapiens
aaaatcccattgtatttaa

SEQ ID NO: 532934 - DNA, 19 bp, Homo sapiens
aaaatcccatttatgcaat

SEQ ID NO: 532935 - DNA, 18 bp, Homo sapiens
aaaatccttgccttcaaa

SEQ ID NO: 532936 - DNA, 18 bp, Homo sapiens
aaaatctgaagattgttt

SEQ ID NO: 532937 - DNA, 22 bp, Homo sapiens
aaaatcttattaaagtttcaaa

SEQ ID NO: 532938 - DNA, 19 bp, Homo sapiens
aaaatgcatttaagttgta

SEQ ID NO: 532939 - DNA, 23 bp, Homo sapiens
aaaatgcatttaagttgtaaacg

SEQ ID NO: 532940 - DNA, 20 bp, Homo sapiens
aaaatgtgtatttttcaagg

SEQ ID NO: 532941 - DNA, 12 bp, Homo sapiens
aaaatgttcatc

SEQ ID NO: 532942 - DNA, 14 bp, Homo sapiens
aaaatgttctgaca

SEQ ID NO: 532943 - DNA, 17 bp, Homo sapiens
aaaattaaaatttaaca

SEQ ID NO: 532944 - DNA, 16 bp, Homo sapiens
aaaattaattgaaata

SEQ ID NO: 532945 - DNA, 23 bp, Homo sapiens
aaaatttaacatctgcagtgttc

SEQ ID NO: 532946 - DNA, 16 bp, Homo sapiens
aaaatttctggcaaat

SEQ ID NO: 532947 - DNA, 19 bp, Homo sapiens
aaaatttgaaacattgctt

SEQ ID NO: 532948 - DNA, 20 bp, Homo sapiens
aaaatttgaaacattgcttt

SEQ ID NO: 532949 - DNA, 21 bp, Homo sapiens
aaaatttgaaacattgctttt

SEQ ID NO: 532950 - DNA, 12 bp, Homo sapiens
aaaattttaagc

SEQ ID NO: 532951 - DNA, 23 bp, Homo sapiens
aaaattttataagcaaatttcaa

SEQ ID NO: 532952 - DNA, 12 bp, Homo sapiens
aaacaaaaggca

SEQ ID NO: 532953 - DNA, 22 bp, Homo sapiens
aaacaaaatccttgccttcaaa

SEQ ID NO: 532954 - DNA, 15 bp, Homo sapiens
aaacaaacaagctag

SEQ ID NO: 532955 - DNA, 18 bp, Homo sapiens
aaacaagcatataaaatg

SEQ ID NO: 532956 - DNA, 18 bp, Homo sapiens
aaacacctgacagcccct

SEQ ID NO: 532957 - DNA, 15 bp, Homo sapiens
aaacagatttaagca

SEQ ID NO: 532958 - DNA, 12 bp, Homo sapiens
aaacagcagctg

SEQ ID NO: 532959 - DNA, 14 bp, Homo sapiens
aaacagtttaacag

SEQ ID NO: 532960 - DNA, 21 bp, Homo sapiens
aaacatctggaaaataaaagg

SEQ ID NO: 532961 - DNA, 23 bp, Homo sapiens
aaacatgaggttctctctactgg

SEQ ID NO: 532962 - DNA, 20 bp, Homo sapiens
aaacattaaatgtcttatat

SEQ ID NO: 532963 - DNA, 22 bp, Homo sapiens
aaacattaatgttgatttctag

SEQ ID NO: 532964 - DNA, 24 bp, Homo sapiens
aaacattagtactttatagaagaa

SEQ ID NO: 532965 - DNA, 16 bp, Homo sapiens
aaacattgcttttaaa

SEQ ID NO: 532966 - DNA, 19 bp, Homo sapiens
aaacattggaagcaggtta

SEQ ID NO: 532967 - DNA, 22 bp, Homo sapiens
aaacatttcctttttctatttt

SEQ ID NO: 532968 - DNA, 17 bp, Homo sapiens
aaaccaaaggacattat

SEQ ID NO: 532969 - DNA, 13 bp, Homo sapiens
aaaccaatttctt

SEQ ID NO: 532970 - DNA, 17 bp, Homo sapiens
aaaccaatttgttctgt

SEQ ID NO: 532971 - DNA, 12 bp, Homo sapiens
aaaccagaaaga

SEQ ID NO: 532972 - DNA, 17 bp, Homo sapiens
aaaccagaaagaggaat

SEQ ID NO: 532973 - DNA, 20 bp, Homo sapiens
aaaccagtttagatttcaag

SEQ ID NO: 532974 - DNA, 23 bp, Homo sapiens
aaaccccatttgctttcttttct

SEQ ID NO: 532975 - DNA, 19 bp, Homo sapiens
aaaccctatgccttttgta

SEQ ID NO: 532976 - DNA, 22 bp, Homo sapiens
aaaccctatgccttttgtagct

SEQ ID NO: 532977 - DNA, 15 bp, Homo sapiens
aaaccctgtcaaaca

SEQ ID NO: 532978 - DNA, 16 bp, Homo sapiens
aaaccctgtcaaacat

SEQ ID NO: 532979 - DNA, 18 bp, Homo sapiens
aaaccctgtcaaacatta

SEQ ID NO: 532980 - DNA, 20 bp, Homo sapiens
aaaccgtgtttgtctcttct

SEQ ID NO: 532981 - DNA, 20 bp, Homo sapiens
aaacctctttcggaaatgat

SEQ ID NO: 532982 - DNA, 14 bp, Homo sapiens
aaacgaaagctggg

SEQ ID NO: 532983 - DNA, 15 bp, Homo sapiens
aaacggttaaaactg

SEQ ID NO: 532984 - DNA, 16 bp, Homo sapiens
aaacgtctttttaagc

SEQ ID NO: 532985 - DNA, 12 bp, Homo sapiens
aaactaatgagt

SEQ ID NO: 532986 - DNA, 13 bp, Homo sapiens
aaactaatgagtt

SEQ ID NO: 532987 - DNA, 13 bp, Homo sapiens
aaactaattaaac

SEQ ID NO: 532988 - DNA, 20 bp, Homo sapiens
aaactcaaccaaatggtaca

SEQ ID NO: 532989 - DNA, 18 bp, Homo sapiens
aaactgcacatgatttca

SEQ ID NO: 532990 - DNA, 18 bp, Homo sapiens
aaactgcgtaggagagaa

SEQ ID NO: 532991 - DNA, 14 bp, Homo sapiens
aaactggaataaga

SEQ ID NO: 532992 - DNA, 21 bp, Homo sapiens
aaactgtactttgattcacat

SEQ ID NO: 532993 - DNA, 12 bp, Homo sapiens
aaactgtattta

SEQ ID NO: 532994 - DNA, 12 bp, Homo sapiens
aaactgtccctt

SEQ ID NO: 532995 - DNA, 13 bp, Homo sapiens
aaactttaacttc

SEQ ID NO: 532996 - DNA, 22 bp, Homo sapiens
aaactttaacttccactttgta

SEQ ID NO: 532997 - DNA, 18 bp, Homo sapiens
aaactttaatatgtattt

SEQ ID NO: 532998 - DNA, 13 bp, Homo sapiens
aaactttgaaata

SEQ ID NO: 532999 - DNA, 12 bp, Homo sapiens
aaagaaaaattt

SEQ ID NO: 533000 - DNA, 13 bp, Homo sapiens
aaagaaaaatttc

SEQ ID NO: 533001 - DNA, 14 bp, Homo sapiens
aaagaaaaatttct

SEQ ID NO: 533002 - DNA, 13 bp, Homo sapiens
aaagaaagtcata

SEQ ID NO: 533003 - DNA, 18 bp, Homo sapiens
aaagaaatctatagaaag

SEQ ID NO: 533004 - DNA, 21 bp, Homo sapiens
aaagaaatctatagaaagtgt

SEQ ID NO: 533005 - DNA, 22 bp, Homo sapiens
aaagaaatctatagaaagtgtt

SEQ ID NO: 533006 - DNA, 14 bp, Homo sapiens
aaagaataggactt

SEQ ID NO: 533007 - DNA, 15 bp, Homo sapiens
aaagaccaagacttt

SEQ ID NO: 533008 - DNA, 18 bp, Homo sapiens
aaagacttcaaatgttat

SEQ ID NO: 533009 - DNA, 14 bp, Homo sapiens
aaagacttcattta

SEQ ID NO: 533010 - DNA, 15 bp, Homo sapiens
aaagacttcatttaa

SEQ ID NO: 533011 - DNA, 21 bp, Homo sapiens
aaagacttcatttaacactga

SEQ ID NO: 533012 - DNA, 22 bp, Homo sapiens
aaagacttcatttaacactgag

SEQ ID NO: 533013 - DNA, 24 bp, Homo sapiens
aaagagatccaggaagcatgagtg

SEQ ID NO: 533014 - DNA, 20 bp, Homo sapiens
aaagaggcagttgcccagcc

SEQ ID NO: 533015 - DNA, 22 bp, Homo sapiens
aaagagtagaactttaaaagaa

SEQ ID NO: 533016 - DNA, 23 bp, Homo sapiens
aaagagtagaactttaaaagaag

SEQ ID NO: 533017 - DNA, 18 bp, Homo sapiens
aaagataccttaaaattt

SEQ ID NO: 533018 - DNA, 19 bp, Homo sapiens
aaagataccttaaaatttg

SEQ ID NO: 533019 - DNA, 20 bp, Homo sapiens
aaagataccttaaaatttga

SEQ ID NO: 533020 - DNA, 14 bp, Homo sapiens
aaagatcaaaataa

SEQ ID NO: 533021 - DNA, 18 bp, Homo sapiens
aaagatctttttttaagt

SEQ ID NO: 533022 - DNA, 20 bp, Homo sapiens
aaagatggcgcacccggcag

SEQ ID NO: 533023 - DNA, 15 bp, Homo sapiens
aaagatgtagcaaac

SEQ ID NO: 533024 - DNA, 20 bp, Homo sapiens
aaagatgttaacagtatttt

SEQ ID NO: 533025 - DNA, 11 bp, Homo sapiens
aaagcaaaata

SEQ ID NO: 533026 - DNA, 12 bp, Homo sapiens
aaagcaaaatat

SEQ ID NO: 533027 - DNA, 16 bp, Homo sapiens
aaagcaaaatatttgt

SEQ ID NO: 533028 - DNA, 15 bp, Homo sapiens
aaagcaacagctgga

SEQ ID NO: 533029 - DNA, 15 bp, Homo sapiens
aaagcacatgcttag

SEQ ID NO: 533030 - DNA, 21 bp, Homo sapiens
aaagcactcctccctgatgta

SEQ ID NO: 533031 - DNA, 15 bp, Homo sapiens
aaagccctccctgtc

SEQ ID NO: 533032 - DNA, 17 bp, Homo sapiens
aaagccctccctgtctg

SEQ ID NO: 533033 - DNA, 16 bp, Homo sapiens
aaagcccttctcaaga

SEQ ID NO: 533034 - DNA, 15 bp, Homo sapiens
aaagcctcagaaagg

SEQ ID NO: 533035 - DNA, 15 bp, Homo sapiens
aaagctatttaagtg

SEQ ID NO: 533036 - DNA, 17 bp, Homo sapiens
aaagctgttcttcctgg

SEQ ID NO: 533037 - DNA, 16 bp, Homo sapiens
aaagctgtttcatttg

SEQ ID NO: 533038 - DNA, 17 bp, Homo sapiens
aaagctgtttcatttgt

SEQ ID NO: 533039 - DNA, 20 bp, Homo sapiens
aaagctgtttcatttgtgtc

SEQ ID NO: 533040 - DNA, 13 bp, Homo sapiens
aaagcttccctcc

SEQ ID NO: 533041 - DNA, 16 bp, Homo sapiens
aaagcttccctccctg

SEQ ID NO: 533042 - DNA, 18 bp, Homo sapiens
aaagcttttgcatagaat

SEQ ID NO: 533043 - DNA, 22 bp, Homo sapiens
aaaggagctttctcaatgtctt

SEQ ID NO: 533044 - DNA, 19 bp, Homo sapiens
aaaggcaaaccaatttgtt

SEQ ID NO: 533045 - DNA, 14 bp, Homo sapiens
aaaggccaacagca

SEQ ID NO: 533046 - DNA, 15 bp, Homo sapiens
aaaggccaacagcat

SEQ ID NO: 533047 - DNA, 14 bp, Homo sapiens
aaaggcttctccac

SEQ ID NO: 533048 - DNA, 18 bp, Homo sapiens
aaaggcttgagtctggat

SEQ ID NO: 533049 - DNA, 17 bp, Homo sapiens
aaaggcttgcagaactt

SEQ ID NO: 533050 - DNA, 16 bp, Homo sapiens
aaaggttctttgtgta

SEQ ID NO: 533051 - DNA, 20 bp, Homo sapiens
aaagtacaggtactttgtct

SEQ ID NO: 533052 - DNA, 22 bp, Homo sapiens
aaagtacaggtactttgtctaa

SEQ ID NO: 533053 - DNA, 18 bp, Homo sapiens
aaagtaccacactgagtt

SEQ ID NO: 533054 - DNA, 15 bp, Homo sapiens
aaagtatcgggggct

SEQ ID NO: 533055 - DNA, 18 bp, Homo sapiens
aaagtatgaatatttcat

SEQ ID NO: 533056 - DNA, 22 bp, Homo sapiens
aaagtatgaatatttcattttg

SEQ ID NO: 533057 - DNA, 15 bp, Homo sapiens
aaagtattgccaaac

SEQ ID NO: 533058 - DNA, 14 bp, Homo sapiens
aaagtctcctgtat

SEQ ID NO: 533059 - DNA, 14 bp, Homo sapiens
aaagtctgtcatgc

SEQ ID NO: 533060 - DNA, 20 bp, Homo sapiens
aaagtgccaaaataaagtct

SEQ ID NO: 533061 - DNA, 14 bp, Homo sapiens
aaagtgtctcaaag

SEQ ID NO: 533062 - DNA, 18 bp, Homo sapiens
aaagtgttctgttacaaa

SEQ ID NO: 533063 - DNA, 16 bp, Homo sapiens
aaagttaatcttcatg

SEQ ID NO: 533064 - DNA, 15 bp, Homo sapiens
aaagttcttaaaaca

SEQ ID NO: 533065 - DNA, 20 bp, Homo sapiens
aaagttggtattttataagc

SEQ ID NO: 533066 - DNA, 21 bp, Homo sapiens
aaagttgtgatctgttgtaat

SEQ ID NO: 533067 - DNA, 18 bp, Homo sapiens
aaagtttcaaaaatctga

SEQ ID NO: 533068 - DNA, 19 bp, Homo sapiens
aaagtttcaaaaatctgaa

SEQ ID NO: 533069 - DNA, 13 bp, Homo sapiens
aaagtttgatctt

SEQ ID NO: 533070 - DNA, 22 bp, Homo sapiens
aaagtttgatcttcctctgcta

SEQ ID NO: 533071 - DNA, 14 bp, Homo sapiens
aaataaaaagtgac

SEQ ID NO: 533072 - DNA, 19 bp, Homo sapiens
aaataaaaagtgacacagc

SEQ ID NO: 533073 - DNA, 16 bp, Homo sapiens
aaataaagtctgtcat

SEQ ID NO: 533074 - DNA, 15 bp, Homo sapiens
aaataaatatactca

SEQ ID NO: 533075 - DNA, 13 bp, Homo sapiens
aaataaccctgaa

SEQ ID NO: 533076 - DNA, 14 bp, Homo sapiens
aaatacaaaatgat

SEQ ID NO: 533077 - DNA, 12 bp, Homo sapiens
aaatacaaacaa

SEQ ID NO: 533078 - DNA, 14 bp, Homo sapiens
aaatacaagtttga

SEQ ID NO: 533079 - DNA, 20 bp, Homo sapiens
aaatacacatacatatatac

SEQ ID NO: 533080 - DNA, 21 bp, Homo sapiens
aaatacatgcctttccagtgc

SEQ ID NO: 533081 - DNA, 17 bp, Homo sapiens
aaatacatgttgtaaat

SEQ ID NO: 533082 - DNA, 16 bp, Homo sapiens
aaatacctattcaaga

SEQ ID NO: 533083 - DNA, 22 bp, Homo sapiens
aagactgtaaattccaaagatc

SEQ ID NO: 533084 - DNA, 18 bp, Homo sapiens
aagagaaaaagccctctt

SEQ ID NO: 533085 - DNA, 22 bp, Homo sapiens
aagagaaccgagcaaagatcaa

SEQ ID NO: 533086 - DNA, 17 bp, Homo sapiens
aagagacagttatttat

SEQ ID NO: 533087 - DNA, 21 bp, Homo sapiens
aagagatgggccttttcttga

SEQ ID NO: 533088 - DNA, 15 bp, Homo sapiens
aagagatttatcttt

SEQ ID NO: 533089 - DNA, 18 bp, Homo sapiens
aagagatttatctttata

SEQ ID NO: 533090 - DNA, 22 bp, Homo sapiens
aagagatttatctttatacaga

SEQ ID NO: 533091 - DNA, 13 bp, Homo sapiens
aagagcatttggt

SEQ ID NO: 533092 - DNA, 23 bp, Homo sapiens
aagagcatttggtacacacttga

SEQ ID NO: 533093 - DNA, 23 bp, Homo sapiens
aagagccattctggcactttaat

SEQ ID NO: 533094 - DNA, 20 bp, Homo sapiens
aagagcctctggaagggagg

SEQ ID NO: 533095 - DNA, 21 bp, Homo sapiens
aagagcctgtcgatgagactg

SEQ ID NO: 533096 - DNA, 19 bp, Homo sapiens
aagaggcagttgcccagcc

SEQ ID NO: 533097 - DNA, 18 bp, Homo sapiens
aagaggtaccaaaaaaga

SEQ ID NO: 533098 - DNA, 20 bp, Homo sapiens
aagaggtaccaaaaaagaaa

SEQ ID NO: 533099 - DNA, 15 bp, Homo sapiens
aagagtaacacttga

SEQ ID NO: 533100 - DNA, 18 bp, Homo sapiens
aagagtgcaaaacattga

SEQ ID NO: 533101 - DNA, 20 bp, Homo sapiens
aagataaatccaactctgac

SEQ ID NO: 533102 - DNA, 13 bp, Homo sapiens
aagataagttgga

SEQ ID NO: 533103 - DNA, 16 bp, Homo sapiens
aagataagttggaaac

SEQ ID NO: 533104 - DNA, 17 bp, Homo sapiens
aagataagttggaaaca

SEQ ID NO: 533105 - DNA, 20 bp, Homo sapiens
aagataagttggaaacacta

SEQ ID NO: 533106 - DNA, 22 bp, Homo sapiens
aagataattaaatgaaatactt

SEQ ID NO: 533107 - DNA, 15 bp, Homo sapiens
aagataccttaaaat

SEQ ID NO: 533108 - DNA, 19 bp, Homo sapiens
aagataccttaaaatttga

SEQ ID NO: 533109 - DNA, 13 bp, Homo sapiens
aagatagttgtaa

SEQ ID NO: 533110 - DNA, 16 bp, Homo sapiens
aagatagttgtaaaga

SEQ ID NO: 533111 - DNA, 15 bp, Homo sapiens
aagatcaaaataaaa

SEQ ID NO: 533112 - DNA, 22 bp, Homo sapiens
aagatcaaaataaaaagtgaca

SEQ ID NO: 533113 - DNA, 20 bp, Homo sapiens
aagatcggttaacaaataac

SEQ ID NO: 533114 - DNA, 21 bp, Homo sapiens
aagatcggttaacaaataaca

SEQ ID NO: 533115 - DNA, 13 bp, Homo sapiens
aagatgtagcaaa

SEQ ID NO: 533116 - DNA, 15 bp, Homo sapiens
aagatgttaacagta

SEQ ID NO: 533117 - DNA, 17 bp, Homo sapiens
aagatgttaacagtatt

SEQ ID NO: 533118 - DNA, 23 bp, Homo sapiens
aagatgttaacagtattttaaga

SEQ ID NO: 533119 - DNA, 16 bp, Homo sapiens
aagatgttatattttt

SEQ ID NO: 533120 - DNA, 22 bp, Homo sapiens
aagatgttatatttttcttaaa

SEQ ID NO: 533121 - DNA, 14 bp, Homo sapiens
aagcaaaatatttg

SEQ ID NO: 533122 - DNA, 23 bp, Homo sapiens
aagcaacacttggaacagtgttt

SEQ ID NO: 533123 - DNA, 20 bp, Homo sapiens
aagcacaaaaaatttaagag

SEQ ID NO: 533124 - DNA, 14 bp, Homo sapiens
aagcacaggagaca

SEQ ID NO: 533125 - DNA, 22 bp, Homo sapiens
aagcacatgcttagcttatctt

SEQ ID NO: 533126 - DNA, 21 bp, Homo sapiens
aagcactcctccctgatgtac

SEQ ID NO: 533127 - DNA, 15 bp, Homo sapiens
aagcagaattggaaa

SEQ ID NO: 533128 - DNA, 19 bp, Homo sapiens
aagcagaattggaaaagac

SEQ ID NO: 533129 - DNA, 18 bp, Homo sapiens
aagcagacacacacatat

SEQ ID NO: 533130 - DNA, 17 bp, Homo sapiens
aagcagagtgaaattca

SEQ ID NO: 533131 - DNA, 11 bp, Homo sapiens
aagcaggaggc

SEQ ID NO: 533132 - DNA, 20 bp, Homo sapiens
aagcaggttaaatgttttgt

SEQ ID NO: 533133 - DNA, 18 bp, Homo sapiens
aagcagtggagcccagga

SEQ ID NO: 533134 - DNA, 12 bp, Homo sapiens
aagcagtttcaa

SEQ ID NO: 533135 - DNA, 16 bp, Homo sapiens
aagcatataaaatggc

SEQ ID NO: 533136 - DNA, 22 bp, Homo sapiens
aagcatataaaatggcaacaaa

SEQ ID NO: 533137 - DNA, 13 bp, Homo sapiens
aagcatctaaact

SEQ ID NO: 533138 - DNA, 16 bp, Homo sapiens
aagccacccaaagcag

SEQ ID NO: 533139 - DNA, 14 bp, Homo sapiens
aagccaccgggaga

SEQ ID NO: 533140 - DNA, 16 bp, Homo sapiens
aagccacgctgtgtcc

SEQ ID NO: 533141 - DNA, 12 bp, Homo sapiens
aagccagtctta

SEQ ID NO: 533142 - DNA, 14 bp, Homo sapiens
aagccagtcttaac

SEQ ID NO: 533143 - DNA, 20 bp, Homo sapiens
aagcccagcctatctctctt

SEQ ID NO: 533144 - DNA, 21 bp, Homo sapiens
aagccctccctgtctgtctgt

SEQ ID NO: 533145 - DNA, 23 bp, Homo sapiens
aagcctcagcaaacccaaagatg

SEQ ID NO: 533146 - DNA, 14 bp, Homo sapiens
aagcctcctgctga

SEQ ID NO: 533147 - DNA, 12 bp, Homo sapiens
aagcctgctcct

SEQ ID NO: 533148 - DNA, 17 bp, Homo sapiens
aagcctgctccttccct

SEQ ID NO: 533149 - DNA, 21 bp, Homo sapiens
aagctaggaaaagaaatctat

SEQ ID NO: 533150 - DNA, 16 bp, Homo sapiens
aagctcacttgcttta

SEQ ID NO: 533151 - DNA, 16 bp, Homo sapiens
aagctccatcttattt

SEQ ID NO: 533152 - DNA, 18 bp, Homo sapiens
aagctcgtagaaacaaga

SEQ ID NO: 533153 - DNA, 20 bp, Homo sapiens
aagctctctgtactaaggag

SEQ ID NO: 533154 - DNA, 23 bp, Homo sapiens
aagctgagttaggtgtctgtcct

SEQ ID NO: 533155 - DNA, 18 bp, Homo sapiens
aagctgatgaagttaagc

SEQ ID NO: 533156 - DNA, 18 bp, Homo sapiens
aagctgttgaccaggcac

SEQ ID NO: 533157 - DNA, 17 bp, Homo sapiens
aagctgtttggttttaa

SEQ ID NO: 533158 - DNA, 16 bp, Homo sapiens
aagcttattttggaga

SEQ ID NO: 533159 - DNA, 21 bp, Homo sapiens
aaggaagacctcaagaaaaat

SEQ ID NO: 533160 - DNA, 13 bp, Homo sapiens
aaggacaggcagg

SEQ ID NO: 533161 - DNA, 18 bp, Homo sapiens
aaggaggctccaggcagc

SEQ ID NO: 533162 - DNA, 13 bp, Homo sapiens
aaggagggagaaa

SEQ ID NO: 533163 - DNA, 14 bp, Homo sapiens
aaggccaacagcat

SEQ ID NO: 533164 - DNA, 18 bp, Homo sapiens
aaggccagtggaaattca

SEQ ID NO: 533165 - DNA, 19 bp, Homo sapiens
aaggccccctgcctgccct

SEQ ID NO: 533166 - DNA, 22 bp, Homo sapiens
aaggcgctaacttgcttaaatg

SEQ ID NO: 533167 - DNA, 23 bp, Homo sapiens
aaggcgctaacttgcttaaatgt

SEQ ID NO: 533168 - DNA, 12 bp, Homo sapiens
aaggcggtgttt

SEQ ID NO: 533169 - DNA, 16 bp, Homo sapiens
aaggctgtattcagca

SEQ ID NO: 533170 - DNA, 17 bp, Homo sapiens
aagggactccagaagca

SEQ ID NO: 533171 - DNA, 16 bp, Homo sapiens
aagggagtgaaaacct

SEQ ID NO: 533172 - DNA, 16 bp, Homo sapiens
aaggggaatctggagg

SEQ ID NO: 533173 - DNA, 17 bp, Homo sapiens
aagggtatcctgtgcta

SEQ ID NO: 533174 - DNA, 13 bp, Homo sapiens
aaggtagaatgac

SEQ ID NO: 533175 - DNA, 14 bp, Homo sapiens
aaggtgcaggcagg

SEQ ID NO: 533176 - DNA, 16 bp, Homo sapiens
aaggtttcactgttca

SEQ ID NO: 533177 - DNA, 21 bp, Homo sapiens
aagtaaatgtcttcatgttga

SEQ ID NO: 533178 - DNA, 18 bp, Homo sapiens
aagtaacttgtcttaaat

SEQ ID NO: 533179 - DNA, 17 bp, Homo sapiens
aatcatattagacttct

SEQ ID NO: 533180 - DNA, 19 bp, Homo sapiens
aatcatcgaaaattcattt

SEQ ID NO: 533181 - DNA, 21 bp, Homo sapiens
aatcatcgaaaattcatttca

SEQ ID NO: 533182 - DNA, 22 bp, Homo sapiens
aatcatgtggcctaatattgaa

SEQ ID NO: 533183 - DNA, 15 bp, Homo sapiens
aatcattgtccagag

SEQ ID NO: 533184 - DNA, 15 bp, Homo sapiens
aatccaaaagaaaaa

SEQ ID NO: 533185 - DNA, 20 bp, Homo sapiens
aatccagaaacttgttcttc

SEQ ID NO: 533186 - DNA, 15 bp, Homo sapiens
aatccatgtgctgct

SEQ ID NO: 533187 - DNA, 19 bp, Homo sapiens
aatccccataatgcttctt

SEQ ID NO: 533188 - DNA, 20 bp, Homo sapiens
aatcctatctggggagctcc

SEQ ID NO: 533189 - DNA, 18 bp, Homo sapiens
aatcctgggcatccccag

SEQ ID NO: 533190 - DNA, 18 bp, Homo sapiens
aatcctgtcctcagcttc

SEQ ID NO: 533191 - DNA, 19 bp, Homo sapiens
aatccttacaaatgattgc

SEQ ID NO: 533192 - DNA, 15 bp, Homo sapiens
aatctatagaaagtg

SEQ ID NO: 533193 - DNA, 17 bp, Homo sapiens
aatctatagaaagtgtt

SEQ ID NO: 533194 - DNA, 23 bp, Homo sapiens
aatctatagaaagtgttctgtta

SEQ ID NO: 533195 - DNA, 11 bp, Homo sapiens
aatctcagcac

SEQ ID NO: 533196 - DNA, 19 bp, Homo sapiens
aatctcagcactttgtttc

SEQ ID NO: 533197 - DNA, 20 bp, Homo sapiens
aatctcgcactacatctgat

SEQ ID NO: 533198 - DNA, 22 bp, Homo sapiens
aatctctacccctttcttctcg

SEQ ID NO: 533199 - DNA, 23 bp, Homo sapiens
aatctctatgccctgttaaatgg

SEQ ID NO: 533200 - DNA, 11 bp, Homo sapiens
aatctcttctg

SEQ ID NO: 533201 - DNA, 12 bp, Homo sapiens
aatctcttctgt

SEQ ID NO: 533202 - DNA, 18 bp, Homo sapiens
aatctgatgtaacaaggt

SEQ ID NO: 533203 - DNA, 14 bp, Homo sapiens
aatctgtctgctgg

SEQ ID NO: 533204 - DNA, 21 bp, Homo sapiens
aatcttattaaagtttcaaaa

SEQ ID NO: 533205 - DNA, 21 bp, Homo sapiens
aatcttctcatcttttatcta

SEQ ID NO: 533206 - DNA, 11 bp, Homo sapiens
aatgaaaataa

SEQ ID NO: 533207 - DNA, 12 bp, Homo sapiens
aatgaaatactt

SEQ ID NO: 533208 - DNA, 12 bp, Homo sapiens
aatgaaatgttt

SEQ ID NO: 533209 - DNA, 17 bp, Homo sapiens
aatgaacacaaattatg

SEQ ID NO: 533210 - DNA, 14 bp, Homo sapiens
aatgaccttgtaat

SEQ ID NO: 533211 - DNA, 18 bp, Homo sapiens
aatgagagttccttctca

SEQ ID NO: 533212 - DNA, 19 bp, Homo sapiens
aatgagagttccttctcac

SEQ ID NO: 533213 - DNA, 14 bp, Homo sapiens
aatgagttcccttg

SEQ ID NO: 533214 - DNA, 17 bp, Homo sapiens
aatgatatgtctttaaa

SEQ ID NO: 533215 - DNA, 18 bp, Homo sapiens
aatgatatgtctttaaaa

SEQ ID NO: 533216 - DNA, 15 bp, Homo sapiens
aatgattattttcat

SEQ ID NO: 533217 - DNA, 16 bp, Homo sapiens
aatgattgcttttaaa

SEQ ID NO: 533218 - DNA, 19 bp, Homo sapiens
aatgattgcttttaaaatt

SEQ ID NO: 533219 - DNA, 22 bp, Homo sapiens
aatgattgcttttaaaatttta

SEQ ID NO: 533220 - DNA, 13 bp, Homo sapiens
aatgattgtcttt

SEQ ID NO: 533221 - DNA, 14 bp, Homo sapiens
aatgcacaatgtct

SEQ ID NO: 533222 - DNA, 19 bp, Homo sapiens
aatgcacaatgtcttggta

SEQ ID NO: 533223 - DNA, 12 bp, Homo sapiens
aatgcagaactc

SEQ ID NO: 533224 - DNA, 23 bp, Homo sapiens
aatgcaggcaggtgtgaacatgg

SEQ ID NO: 533225 - DNA, 13 bp, Homo sapiens
aatgcatgctttc

SEQ ID NO: 533226 - DNA, 13 bp, Homo sapiens
aatgcccttcact

SEQ ID NO: 533227 - DNA, 17 bp, Homo sapiens
aatgcccttcactgtca

SEQ ID NO: 533228 - DNA, 15 bp, Homo sapiens
aatgcctaataaaca

SEQ ID NO: 533229 - DNA, 16 bp, Homo sapiens
aatgcctaataaacaa

SEQ ID NO: 533230 - DNA, 15 bp, Homo sapiens
aatgctatgtcattt

SEQ ID NO: 533231 - DNA, 17 bp, Homo sapiens
aatgctatgtcatttca

SEQ ID NO: 533232 - DNA, 11 bp, Homo sapiens
aatgctatttg

SEQ ID NO: 533233 - DNA, 17 bp, Homo sapiens
acaggtaccagttcttt

SEQ ID NO: 533234 - DNA, 14 bp, Homo sapiens
acaggtactttgtc

SEQ ID NO: 533235 - DNA, 15 bp, Homo sapiens
acaggtactttgtct

SEQ ID NO: 533236 - DNA, 18 bp, Homo sapiens
acaggtgtggtgtaattt

SEQ ID NO: 533237 - DNA, 17 bp, Homo sapiens
acagtaaagaccattta

SEQ ID NO: 533238 - DNA, 13 bp, Homo sapiens
acagtagctgtgg

SEQ ID NO: 533239 - DNA, 21 bp, Homo sapiens
acagtagctgtggggagctgg

SEQ ID NO: 533240 - DNA, 22 bp, Homo sapiens
acagtagctgtggggagctggt

SEQ ID NO: 533241 - DNA, 23 bp, Homo sapiens
acagtatggtaactttgcaaatg

SEQ ID NO: 533242 - DNA, 13 bp, Homo sapiens
acagtatttaaca

SEQ ID NO: 533243 - DNA, 15 bp, Homo sapiens
acagtatttaacatt

SEQ ID NO: 533244 - DNA, 12 bp, Homo sapiens
acagtattttaa

SEQ ID NO: 533245 - DNA, 15 bp, Homo sapiens
acagtcaggttgaag

SEQ ID NO: 533246 - DNA, 15 bp, Homo sapiens
acagtctctttcttc

SEQ ID NO: 533247 - DNA, 20 bp, Homo sapiens
acagtctctttcttcctttc

SEQ ID NO: 533248 - DNA, 16 bp, Homo sapiens
acagtgaggtcctggg

SEQ ID NO: 533249 - DNA, 19 bp, Homo sapiens
acagtggagtgcaaaaggc

SEQ ID NO: 533250 - DNA, 20 bp, Homo sapiens
acagtggttgttttttcatt

SEQ ID NO: 533251 - DNA, 23 bp, Homo sapiens
acagtggttgttttttcattgtg

SEQ ID NO: 533252 - DNA, 20 bp, Homo sapiens
acagtgtaccattaaaatat

SEQ ID NO: 533253 - DNA, 15 bp, Homo sapiens
acagtgtctgtaaat

SEQ ID NO: 533254 - DNA, 16 bp, Homo sapiens
acagtgttgagaacta

SEQ ID NO: 533255 - DNA, 21 bp, Homo sapiens
acagttaagaagccctgcaga

SEQ ID NO: 533256 - DNA, 18 bp, Homo sapiens
acagttatttatagtcat

SEQ ID NO: 533257 - DNA, 23 bp, Homo sapiens
acagttatttatagtcatttatt

SEQ ID NO: 533258 - DNA, 19 bp, Homo sapiens
acagttcattcagggccga

SEQ ID NO: 533259 - DNA, 20 bp, Homo sapiens
acagttgggaaaatatgtcc

SEQ ID NO: 533260 - DNA, 12 bp, Homo sapiens
acagtttaacag

SEQ ID NO: 533261 - DNA, 20 bp, Homo sapiens
acagtttaacagaaaaatga

SEQ ID NO: 533262 - DNA, 21 bp, Homo sapiens
acagtttaacagaaaaatgaa

SEQ ID NO: 533263 - DNA, 13 bp, Homo sapiens
acataaaattaaa

SEQ ID NO: 533264 - DNA, 12 bp, Homo sapiens
acataaacatca

SEQ ID NO: 533265 - DNA, 12 bp, Homo sapiens
acataacaagaa

SEQ ID NO: 533266 - DNA, 14 bp, Homo sapiens
acataacaagaaaa

SEQ ID NO: 533267 - DNA, 19 bp, Homo sapiens
acataagtaagacttgatt

SEQ ID NO: 533268 - DNA, 23 bp, Homo sapiens
acataattcattaaaaacatttt

SEQ ID NO: 533269 - DNA, 19 bp, Homo sapiens
acatacacttgtataaatg

SEQ ID NO: 533270 - DNA, 20 bp, Homo sapiens
acatacacttgtataaatgt

SEQ ID NO: 533271 - DNA, 13 bp, Homo sapiens
acatagacagatg

SEQ ID NO: 533272 - DNA, 16 bp, Homo sapiens
acatagacagatgtgg

SEQ ID NO: 533273 - DNA, 21 bp, Homo sapiens
acatagctacccaaaagagaa

SEQ ID NO: 533274 - DNA, 22 bp, Homo sapiens
acatagctacccaaaagagaaa

SEQ ID NO: 533275 - DNA, 16 bp, Homo sapiens
acatagggttcccacg

SEQ ID NO: 533276 - DNA, 17 bp, Homo sapiens
acatagttctccagttg

SEQ ID NO: 533277 - DNA, 19 bp, Homo sapiens
acatatacctataatgtgt

SEQ ID NO: 533278 - DNA, 22 bp, Homo sapiens
acatatacctataatgtgtgta

SEQ ID NO: 533279 - DNA, 14 bp, Homo sapiens
acatatatacatac

SEQ ID NO: 533280 - DNA, 20 bp, Homo sapiens
acatatatgtatacgcacgc

SEQ ID NO: 533281 - DNA, 16 bp, Homo sapiens
acatatgtagactata

SEQ ID NO: 533282 - DNA, 23 bp, Homo sapiens
acatatgtagactatatacatgt

SEQ ID NO: 533283 - DNA, 15 bp, Homo sapiens
acatatttcataagc

SEQ ID NO: 533284 - DNA, 19 bp, Homo sapiens
acatatttcataagcacat

SEQ ID NO: 533285 - DNA, 22 bp, Homo sapiens
acatcactattgggcccccagg

SEQ ID NO: 533286 - DNA, 16 bp, Homo sapiens
acatccaagcttcctt

SEQ ID NO: 533287 - DNA, 21 bp, Homo sapiens
acatccatgtcctatgtgtga

SEQ ID NO: 533288 - DNA, 20 bp, Homo sapiens
acatcccaccccatcctcca

SEQ ID NO: 533289 - DNA, 18 bp, Homo sapiens
acatccggggccagctcc

SEQ ID NO: 533290 - DNA, 14 bp, Homo sapiens
acatcggttcagga

SEQ ID NO: 533291 - DNA, 17 bp, Homo sapiens
acatcggttcaggagga

SEQ ID NO: 533292 - DNA, 17 bp, Homo sapiens
acatctcccctttgcta

SEQ ID NO: 533293 - DNA, 15 bp, Homo sapiens
acatctctattcccc

SEQ ID NO: 533294 - DNA, 21 bp, Homo sapiens
acatctgcagtgttctgtgaa

SEQ ID NO: 533295 - DNA, 22 bp, Homo sapiens
acatctgcagtgttctgtgaat

SEQ ID NO: 533296 - DNA, 15 bp, Homo sapiens
acatcttccacaggt

SEQ ID NO: 533297 - DNA, 13 bp, Homo sapiens
acatcttggcagg

SEQ ID NO: 533298 - DNA, 14 bp, Homo sapiens
acatcttggcaggg

SEQ ID NO: 533299 - DNA, 17 bp, Homo sapiens
acatgacccgtacacac

SEQ ID NO: 533300 - DNA, 20 bp, Homo sapiens
acatgacccgtacacaccac

SEQ ID NO: 533301 - DNA, 17 bp, Homo sapiens
acatgatttcacaaata

SEQ ID NO: 533302 - DNA, 19 bp, Homo sapiens
acatgatttcacaaatatt

SEQ ID NO: 533303 - DNA, 20 bp, Homo sapiens
acatgatttcacaaatatta

SEQ ID NO: 533304 - DNA, 15 bp, Homo sapiens
acatgcaacccgaag

SEQ ID NO: 533305 - DNA, 15 bp, Homo sapiens
acatgcccctcttag

SEQ ID NO: 533306 - DNA, 16 bp, Homo sapiens
acatgcgggctgggca

SEQ ID NO: 533307 - DNA, 21 bp, Homo sapiens
acatgcgggctgggcagctgt

SEQ ID NO: 533308 - DNA, 20 bp, Homo sapiens
acatggttacctctgcataa

SEQ ID NO: 533309 - DNA, 20 bp, Homo sapiens
acatgtggaaaactcacaga

SEQ ID NO: 533310 - DNA, 13 bp, Homo sapiens
acatgtgtgtata

SEQ ID NO: 533311 - DNA, 14 bp, Homo sapiens
acatgtgtgtatat

SEQ ID NO: 533312 - DNA, 22 bp, Homo sapiens
acatgtgtgtatatatgtgtat

SEQ ID NO: 533313 - DNA, 13 bp, Homo sapiens
acatgttttcaaa

SEQ ID NO: 533314 - DNA, 12 bp, Homo sapiens
acattaaatgtc

SEQ ID NO: 533315 - DNA, 13 bp, Homo sapiens
acattaaatgtct

SEQ ID NO: 533316 - DNA, 15 bp, Homo sapiens
acattaacaagatca

SEQ ID NO: 533317 - DNA, 16 bp, Homo sapiens
acattagtactttata

SEQ ID NO: 533318 - DNA, 18 bp, Homo sapiens
acattagtactttataga

SEQ ID NO: 533319 - DNA, 15 bp, Homo sapiens
acattatagattttc

SEQ ID NO: 533320 - DNA, 13 bp, Homo sapiens
acattatgtgtgc

SEQ ID NO: 533321 - DNA, 15 bp, Homo sapiens
acattatgtgtgcat

SEQ ID NO: 533322 - DNA, 19 bp, Homo sapiens
acattatgtgtgcatgtgt

SEQ ID NO: 533323 - DNA, 21 bp, Homo sapiens
acattatgtgtgcatgtgtgt

SEQ ID NO: 533324 - DNA, 22 bp, Homo sapiens
acattatgtgtgcatgtgtgta

SEQ ID NO: 533325 - DNA, 16 bp, Homo sapiens
acattccaaacagagt

SEQ ID NO: 533326 - DNA, 14 bp, Homo sapiens
acattctcagtttt

SEQ ID NO: 533327 - DNA, 17 bp, Homo sapiens
acattctcagtttttct

SEQ ID NO: 533328 - DNA, 19 bp, Homo sapiens
acattctcagtttttctta

SEQ ID NO: 533329 - DNA, 12 bp, Homo sapiens
acattctgctgc

SEQ ID NO: 533330 - DNA, 15 bp, Homo sapiens
acattgaaactgtat

SEQ ID NO: 533331 - DNA, 18 bp, Homo sapiens
acattgaaactgtattta

SEQ ID NO: 533332 - DNA, 20 bp, Homo sapiens
acattggaagcaggttaaat

SEQ ID NO: 533333 - DNA, 15 bp, Homo sapiens
acatttcactgtctg

SEQ ID NO: 533334 - DNA, 22 bp, Homo sapiens
acatttcactgtctgtctggtc

SEQ ID NO: 533335 - DNA, 22 bp, Homo sapiens
acatttctaactctgatgtaaa

SEQ ID NO: 533336 - DNA, 19 bp, Homo sapiens
acatttgctttttgcttgt

SEQ ID NO: 533337 - DNA, 14 bp, Homo sapiens
acatttgtcatttt

SEQ ID NO: 533338 - DNA, 16 bp, Homo sapiens
acatttgtcattttca

SEQ ID NO: 533339 - DNA, 17 bp, Homo sapiens
acatttgtcattttcat

SEQ ID NO: 533340 - DNA, 22 bp, Homo sapiens
acatttgtcattttcattagca

SEQ ID NO: 533341 - DNA, 18 bp, Homo sapiens
acatttttagcctgtgtc

SEQ ID NO: 533342 - DNA, 18 bp, Homo sapiens
acatttttgatcaaatgt

SEQ ID NO: 533343 - DNA, 20 bp, Homo sapiens
acatttttgatcaaatgtac

SEQ ID NO: 533344 - DNA, 22 bp, Homo sapiens
acatttttgatcaaatgtacat

SEQ ID NO: 533345 - DNA, 22 bp, Homo sapiens
accaacaagaataaaggcagct

SEQ ID NO: 533346 - DNA, 19 bp, Homo sapiens
accaagctataaaagccca

SEQ ID NO: 533347 - DNA, 15 bp, Homo sapiens
accaagtacaaggac

SEQ ID NO: 533348 - DNA, 21 bp, Homo sapiens
accaagttggtcttactttgt

SEQ ID NO: 533349 - DNA, 11 bp, Homo sapiens
accaataaagg

SEQ ID NO: 533350 - DNA, 20 bp, Homo sapiens
accaataaaggaggaatcag

SEQ ID NO: 533351 - DNA, 17 bp, Homo sapiens
accaatttcttccttcc

SEQ ID NO: 533352 - DNA, 15 bp, Homo sapiens
accacactgagttct

SEQ ID NO: 533353 - DNA, 20 bp, Homo sapiens
accacacttgtcggctccag

SEQ ID NO: 533354 - DNA, 11 bp, Homo sapiens
accacagacac

SEQ ID NO: 533355 - DNA, 14 bp, Homo sapiens
accacagacacaca

SEQ ID NO: 533356 - DNA, 13 bp, Homo sapiens
accacagacactc

SEQ ID NO: 533357 - DNA, 17 bp, Homo sapiens
accacagacactcctgg

SEQ ID NO: 533358 - DNA, 17 bp, Homo sapiens
accacagctccttttcc

SEQ ID NO: 533359 - DNA, 16 bp, Homo sapiens
accacaggatgcatat

SEQ ID NO: 533360 - DNA, 15 bp, Homo sapiens
accacgcgtcaccca

SEQ ID NO: 533361 - DNA, 23 bp, Homo sapiens
accactgtctccacccaccttga

SEQ ID NO: 533362 - DNA, 15 bp, Homo sapiens
accagaaagaggaat

SEQ ID NO: 533363 - DNA, 11 bp, Homo sapiens
accagcctggc

SEQ ID NO: 533364 - DNA, 18 bp, Homo sapiens
accagctgtgtccggccc

SEQ ID NO: 533365 - DNA, 19 bp, Homo sapiens
accaggcacctcccctccc

SEQ ID NO: 533366 - DNA, 19 bp, Homo sapiens
accaggttttgttccgccc

SEQ ID NO: 533367 - DNA, 20 bp, Homo sapiens
accagttccctcagccctca

SEQ ID NO: 533368 - DNA, 21 bp, Homo sapiens
accagtttagatttcaagaaa

SEQ ID NO: 533369 - DNA, 17 bp, Homo sapiens
accatactcatttctaa

SEQ ID NO: 533370 - DNA, 14 bp, Homo sapiens
accatagttgacag

SEQ ID NO: 533371 - DNA, 14 bp, Homo sapiens
accatccaccttcc

SEQ ID NO: 533372 - DNA, 18 bp, Homo sapiens
accatctaggatgatttt

SEQ ID NO: 533373 - DNA, 14 bp, Homo sapiens
accattaaaatatg

SEQ ID NO: 533374 - DNA, 14 bp, Homo sapiens
accatttaacatgc

SEQ ID NO: 533375 - DNA, 16 bp, Homo sapiens
acaacccccagctccc

SEQ ID NO: 533376 - DNA, 19 bp, Homo sapiens
acaacgcataggaaaagaa

SEQ ID NO: 533377 - DNA, 21 bp, Homo sapiens
acaactttcactttgcaaaga

SEQ ID NO: 533378 - DNA, 15 bp, Homo sapiens
acaacttttttttct

SEQ ID NO: 533379 - DNA, 19 bp, Homo sapiens
acaagacccccaggaagga

SEQ ID NO: 533380 - DNA, 15 bp, Homo sapiens
acaagactgtaaatt

SEQ ID NO: 533381 - DNA, 23 bp, Homo sapiens
acaagactgtaaattccaaagat

SEQ ID NO: 533382 - DNA, 15 bp, Homo sapiens
acaagcagacacaca

SEQ ID NO: 533383 - DNA, 18 bp, Homo sapiens
acaagcagacacacacat

SEQ ID NO: 533384 - DNA, 20 bp, Homo sapiens
acaagcagacacacacatat

SEQ ID NO: 533385 - DNA, 17 bp, Homo sapiens
acaagcatataaaatgg

SEQ ID NO: 533386 - DNA, 18 bp, Homo sapiens
acaagcctggcaacacac

SEQ ID NO: 533387 - DNA, 22 bp, Homo sapiens
acaagctgttgaccaggcacct

SEQ ID NO: 533388 - DNA, 17 bp, Homo sapiens
acaaggcaaaaacaaag

SEQ ID NO: 533389 - DNA, 21 bp, Homo sapiens
acaaggggctgttacataaca

SEQ ID NO: 533390 - DNA, 16 bp, Homo sapiens
acaaggtgcaggcagg

SEQ ID NO: 533391 - DNA, 18 bp, Homo sapiens
acaagtgacttatttgct

SEQ ID NO: 533392 - DNA, 16 bp, Homo sapiens
acaatatataaaaata

SEQ ID NO: 533393 - DNA, 17 bp, Homo sapiens
acaatatataaaaatat

SEQ ID NO: 533394 - DNA, 19 bp, Homo sapiens
acaatatttgtgtgctaaa

SEQ ID NO: 533395 - DNA, 12 bp, Homo sapiens
acaatcagacca

SEQ ID NO: 533396 - DNA, 19 bp, Homo sapiens
acaatcagaccaaggaaca

SEQ ID NO: 533397 - DNA, 15 bp, Homo sapiens
acaatcatctattga

SEQ ID NO: 533398 - DNA, 12 bp, Homo sapiens
acaatgaatgta

SEQ ID NO: 533399 - DNA, 16 bp, Homo sapiens
acaattactttagaaa

SEQ ID NO: 533400 - DNA, 18 bp, Homo sapiens
acaattctaatggtaact

SEQ ID NO: 533401 - DNA, 22 bp, Homo sapiens
acaattctaatggtaacttttg

SEQ ID NO: 533402 - DNA, 23 bp, Homo sapiens
acaatttaccacaggatgcatat

SEQ ID NO: 533403 - DNA, 16 bp, Homo sapiens
acaatttacttttaat

SEQ ID NO: 533404 - DNA, 17 bp, Homo sapiens
acaatttacttttaata

SEQ ID NO: 533405 - DNA, 13 bp, Homo sapiens
acaatttgttaat

SEQ ID NO: 533406 - DNA, 22 bp, Homo sapiens
acaatttgttaattcctatgaa

SEQ ID NO: 533407 - DNA, 13 bp, Homo sapiens
acaattttatagg

SEQ ID NO: 533408 - DNA, 17 bp, Homo sapiens
acaattttcagatttgc

SEQ ID NO: 533409 - DNA, 22 bp, Homo sapiens
acaattttcagatttgcacaaa

SEQ ID NO: 533410 - DNA, 20 bp, Homo sapiens
acacaattaattcatccctt

SEQ ID NO: 533411 - DNA, 15 bp, Homo sapiens
acacacaagcagaca

SEQ ID NO: 533412 - DNA, 20 bp, Homo sapiens
acacacaagcagacacacac

SEQ ID NO: 533413 - DNA, 13 bp, Homo sapiens
acacacacacaca

SEQ ID NO: 533414 - DNA, 14 bp, Homo sapiens
acacacacacacac

SEQ ID NO: 533415 - DNA, 16 bp, Homo sapiens
acacacacacacacat

SEQ ID NO: 533416 - DNA, 14 bp, Homo sapiens
acacacacacacat

SEQ ID NO: 533417 - DNA, 13 bp, Homo sapiens
acacacacacata

SEQ ID NO: 533418 - DNA, 14 bp, Homo sapiens
acacacacacgcag

SEQ ID NO: 533419 - DNA, 17 bp, Homo sapiens
acacacacgcagacaca

SEQ ID NO: 533420 - DNA, 18 bp, Homo sapiens
acacacacgcagacacac

SEQ ID NO: 533421 - DNA, 19 bp, Homo sapiens
acacacacgcagacacaca

SEQ ID NO: 533422 - DNA, 12 bp, Homo sapiens
acacacatatat

SEQ ID NO: 533423 - DNA, 18 bp, Homo sapiens
acacacatatatacatac

SEQ ID NO: 533424 - DNA, 13 bp, Homo sapiens
acacacgcacgca

SEQ ID NO: 533425 - DNA, 17 bp, Homo sapiens
acacacgcacgcacaca

SEQ ID NO: 533426 - DNA, 18 bp, Homo sapiens
acacacgcacgcacacac

SEQ ID NO: 533427 - DNA, 13 bp, Homo sapiens
acacacgcagaca

SEQ ID NO: 533428 - DNA, 21 bp, Homo sapiens
acacagaaatatatatacata

SEQ ID NO: 533429 - DNA, 17 bp, Homo sapiens
acacagacacacaagca

SEQ ID NO: 533430 - DNA, 21 bp, Homo sapiens
acacagctgagctggcctatt

SEQ ID NO: 533431 - DNA, 12 bp, Homo sapiens
acacaggcccat

SEQ ID NO: 533432 - DNA, 14 bp, Homo sapiens
acacagtctggtgc

SEQ ID NO: 533433 - DNA, 16 bp, Homo sapiens
acacagtgacacgttt

SEQ ID NO: 533434 - DNA, 17 bp, Homo sapiens
acacatacatatataca

SEQ ID NO: 533435 - DNA, 21 bp, Homo sapiens
acacatacatatatacatttt

SEQ ID NO: 533436 - DNA, 12 bp, Homo sapiens
acacatatatac

SEQ ID NO: 533437 - DNA, 13 bp, Homo sapiens
acacatatataca

SEQ ID NO: 533438 - DNA, 16 bp, Homo sapiens
acacatatatgtatac

SEQ ID NO: 533439 - DNA, 16 bp, Homo sapiens
acacatcatctgtaag

SEQ ID NO: 533440 - DNA, 13 bp, Homo sapiens
acacatcttccac

SEQ ID NO: 533441 - DNA, 11 bp, Homo sapiens
acacatgcaca

SEQ ID NO: 533442 - DNA, 12 bp, Homo sapiens
acacatgcacac

SEQ ID NO: 533443 - DNA, 16 bp, Homo sapiens
acacattgaaactgta

SEQ ID NO: 533444 - DNA, 18 bp, Homo sapiens
acacattgaaactgtatt

SEQ ID NO: 533445 - DNA, 18 bp, Homo sapiens
acacatttcactgtctgt

SEQ ID NO: 533446 - DNA, 13 bp, Homo sapiens
acacccccttggt

SEQ ID NO: 533447 - DNA, 14 bp, Homo sapiens
acaccctacagcag

SEQ ID NO: 533448 - DNA, 15 bp, Homo sapiens
acaccctacagcaga

SEQ ID NO: 533449 - DNA, 17 bp, Homo sapiens
acaccctacagcagatc

SEQ ID NO: 533450 - DNA, 16 bp, Homo sapiens
acacctgacagcccct

SEQ ID NO: 533451 - DNA, 17 bp, Homo sapiens
acacctgagctgctgca

SEQ ID NO: 533452 - DNA, 12 bp, Homo sapiens
acacctggccct

SEQ ID NO: 533453 - DNA, 17 bp, Homo sapiens
acacctggccctggggc

SEQ ID NO: 533454 - DNA, 20 bp, Homo sapiens
acacctggccctggggcctg

SEQ ID NO: 533455 - DNA, 22 bp, Homo sapiens
acaccttgtgaccttctctata

SEQ ID NO: 533456 - DNA, 16 bp, Homo sapiens
acacgcagacacacac

SEQ ID NO: 533457 - DNA, 12 bp, Homo sapiens
acacggcctctg

SEQ ID NO: 533458 - DNA, 12 bp, Homo sapiens
acactaaatgtt

SEQ ID NO: 533459 - DNA, 18 bp, Homo sapiens
acactaaatgttaaagat

SEQ ID NO: 533460 - DNA, 21 bp, Homo sapiens
acactaaatgttaaagatgta

SEQ ID NO: 533461 - DNA, 17 bp, Homo sapiens
acactcaccgagaggaa

SEQ ID NO: 533462 - DNA, 16 bp, Homo sapiens
acactcatcaggtaaa

SEQ ID NO: 533463 - DNA, 18 bp, Homo sapiens
acactgagtgaaatatta

SEQ ID NO: 533464 - DNA, 19 bp, Homo sapiens
acactgagttctatcagtt

SEQ ID NO: 533465 - DNA, 16 bp, Homo sapiens
acactggacctttggg

SEQ ID NO: 533466 - DNA, 15 bp, Homo sapiens
acacttgaaaagtgt

SEQ ID NO: 533467 - DNA, 22 bp, Homo sapiens
acacttgaccttctgtcgtccc

SEQ ID NO: 533468 - DNA, 16 bp, Homo sapiens
acacttgtataaatgt

SEQ ID NO: 533469 - DNA, 21 bp, Homo sapiens
acactttttctttacaaacaa

SEQ ID NO: 533470 - DNA, 17 bp, Homo sapiens
acagaaacatgccagaa

SEQ ID NO: 533471 - DNA, 17 bp, Homo sapiens
acagaaatatatataca

SEQ ID NO: 533472 - DNA, 20 bp, Homo sapiens
acagaaatatatatacatat

SEQ ID NO: 533473 - DNA, 22 bp, Homo sapiens
acagaaatatatatacatatgt

SEQ ID NO: 533474 - DNA, 15 bp, Homo sapiens
acagaactcccttca

SEQ ID NO: 533475 - DNA, 18 bp, Homo sapiens
acagaatactagccagag

SEQ ID NO: 533476 - DNA, 19 bp, Homo sapiens
acagacaattctaatggta

SEQ ID NO: 533477 - DNA, 11 bp, Homo sapiens
acagacacaca

SEQ ID NO: 533478 - DNA, 16 bp, Homo sapiens
acagacacacacacgc

SEQ ID NO: 533479 - DNA, 12 bp, Homo sapiens
acagacactcct

SEQ ID NO: 533480 - DNA, 21 bp, Homo sapiens
acagacgcctgcttttgcaaa

SEQ ID NO: 533481 - DNA, 15 bp, Homo sapiens
acagagaggacgtgg

SEQ ID NO: 533482 - DNA, 22 bp, Homo sapiens
acagagcactaggttcaattcc

SEQ ID NO: 533483 - DNA, 16 bp, Homo sapiens
acagagcagttgagag

SEQ ID NO: 533484 - DNA, 17 bp, Homo sapiens
acagagccgtaaaaact

SEQ ID NO: 533485 - DNA, 22 bp, Homo sapiens
acagagcgtggctgtgctctca

SEQ ID NO: 533486 - DNA, 17 bp, Homo sapiens
acagagtgatttgtaaa

SEQ ID NO: 533487 - DNA, 17 bp, Homo sapiens
acagatgtggacatgca

SEQ ID NO: 533488 - DNA, 20 bp, Homo sapiens
acagatgtggacatgcaccc

SEQ ID NO: 533489 - DNA, 17 bp, Homo sapiens
acagattggattttatg

SEQ ID NO: 533490 - DNA, 15 bp, Homo sapiens
acagattttctagaa

SEQ ID NO: 533491 - DNA, 22 bp, Homo sapiens
acagcaaaaaaagcaacttttc

SEQ ID NO: 533492 - DNA, 14 bp, Homo sapiens
acagcaaacacagt

SEQ ID NO: 533493 - DNA, 13 bp, Homo sapiens
acagcaaattaat

SEQ ID NO: 533494 - DNA, 22 bp, Homo sapiens
acagcaaattaatgtgtaaaat

SEQ ID NO: 533495 - DNA, 22 bp, Homo sapiens
acagcagatccacctgcacaaa

SEQ ID NO: 533496 - DNA, 22 bp, Homo sapiens
acagcagctgaagccagctccc

SEQ ID NO: 533497 - DNA, 22 bp, Homo sapiens
acagcagcttcaccagagcatt

SEQ ID NO: 533498 - DNA, 20 bp, Homo sapiens
acagcagtcttatgcttcca

SEQ ID NO: 533499 - DNA, 20 bp, Homo sapiens
acagcattggcctggccaga

SEQ ID NO: 533500 - DNA, 18 bp, Homo sapiens
acagcatttcagctgtga

SEQ ID NO: 533501 - DNA, 16 bp, Homo sapiens
acagccaatctccagg

SEQ ID NO: 533502 - DNA, 19 bp, Homo sapiens
acagcccaggcatctcctt

SEQ ID NO: 533503 - DNA, 20 bp, Homo sapiens
acagcctggtcgccttccac

SEQ ID NO: 533504 - DNA, 21 bp, Homo sapiens
acagcctggtcgccttccacc

SEQ ID NO: 533505 - DNA, 20 bp, Homo sapiens
acagctccttttccagagca

SEQ ID NO: 533506 - DNA, 17 bp, Homo sapiens
acagctgcagagacaga

SEQ ID NO: 533507 - DNA, 21 bp, Homo sapiens
acagctgcagagacagagagg

SEQ ID NO: 533508 - DNA, 16 bp, Homo sapiens
acagctggacaccccc

SEQ ID NO: 533509 - DNA, 15 bp, Homo sapiens
acagctttacacaca

SEQ ID NO: 533510 - DNA, 20 bp, Homo sapiens
acagctttcccctcattttt

SEQ ID NO: 533511 - DNA, 14 bp, Homo sapiens
acaggaacacccag

SEQ ID NO: 533512 - DNA, 16 bp, Homo sapiens
acaggaacacccagcc

SEQ ID NO: 533513 - DNA, 20 bp, Homo sapiens
acaggaacacccagccccag

SEQ ID NO: 533514 - DNA, 17 bp, Homo sapiens
acaggagaagaaagaac

SEQ ID NO: 533515 - DNA, 17 bp, Homo sapiens
acaggaggttggaggga

SEQ ID NO: 533516 - DNA, 20 bp, Homo sapiens
acagggacacagtctggtgc

SEQ ID NO: 533517 - DNA, 21 bp, Homo sapiens
actacttgatggtcagacaca

SEQ ID NO: 533518 - DNA, 15 bp, Homo sapiens
actaggaaggcactt

SEQ ID NO: 533519 - DNA, 16 bp, Homo sapiens
actagggacctgggga

SEQ ID NO: 533520 - DNA, 21 bp, Homo sapiens
actaggttcaattccctgaag

SEQ ID NO: 533521 - DNA, 18 bp, Homo sapiens
actatatacatgtgtgta

SEQ ID NO: 533522 - DNA, 18 bp, Homo sapiens
actatatgtacagctctc

SEQ ID NO: 533523 - DNA, 13 bp, Homo sapiens
actatcagcagcg

SEQ ID NO: 533524 - DNA, 10 bp, Homo sapiens
actatggtgt

SEQ ID NO: 533525 - DNA, 19 bp, Homo sapiens
actatggtgtgttgtatct

SEQ ID NO: 533526 - DNA, 20 bp, Homo sapiens
actattcagaagacacagag

SEQ ID NO: 533527 - DNA, 14 bp, Homo sapiens
actattgagtcttc

SEQ ID NO: 533528 - DNA, 16 bp, Homo sapiens
actcaaccaaatggta

SEQ ID NO: 533529 - DNA, 23 bp, Homo sapiens
actcagccggcgtggcaaatata

SEQ ID NO: 533530 - DNA, 15 bp, Homo sapiens
actcatttctaaaag

SEQ ID NO: 533531 - DNA, 21 bp, Homo sapiens
actcatttctaaaagaatatt

SEQ ID NO: 533532 - DNA, 23 bp, Homo sapiens
actccagaaatgtccctttcttc

SEQ ID NO: 533533 - DNA, 12 bp, Homo sapiens
actccattccca

SEQ ID NO: 533534 - DNA, 21 bp, Homo sapiens
actcccaagacccgagctggg

SEQ ID NO: 533535 - DNA, 20 bp, Homo sapiens
actcctccctgatgtacagt

SEQ ID NO: 533536 - DNA, 14 bp, Homo sapiens
actccttaaaaatg

SEQ ID NO: 533537 - DNA, 17 bp, Homo sapiens
actccttaaaaatgtat

SEQ ID NO: 533538 - DNA, 22 bp, Homo sapiens
actcggcagcccttccaaactc

SEQ ID NO: 533539 - DNA, 21 bp, Homo sapiens
actcgggctaagtccagctct

SEQ ID NO: 533540 - DNA, 22 bp, Homo sapiens
actctaaattctttatttctgt

SEQ ID NO: 533541 - DNA, 17 bp, Homo sapiens
actctaatatacagtgt

SEQ ID NO: 533542 - DNA, 17 bp, Homo sapiens
actctatgccccaaata

SEQ ID NO: 533543 - DNA, 20 bp, Homo sapiens
actctatgccccaaatatag

SEQ ID NO: 533544 - DNA, 14 bp, Homo sapiens
actctgagtcctca

SEQ ID NO: 533545 - DNA, 18 bp, Homo sapiens
actctgatgtaaatgaag

SEQ ID NO: 533546 - DNA, 14 bp, Homo sapiens
actctgcctgccct

SEQ ID NO: 533547 - DNA, 15 bp, Homo sapiens
actctgccttccagg

SEQ ID NO: 533548 - DNA, 18 bp, Homo sapiens
actctgccttccaggcgt

SEQ ID NO: 533549 - DNA, 19 bp, Homo sapiens
actctgccttccaggcgta

SEQ ID NO: 533550 - DNA, 16 bp, Homo sapiens
actctgtggggccaca

SEQ ID NO: 533551 - DNA, 17 bp, Homo sapiens
actctgtggggccacac

SEQ ID NO: 533552 - DNA, 23 bp, Homo sapiens
actcttctcatcttgacagagcc

SEQ ID NO: 533553 - DNA, 15 bp, Homo sapiens
actcttctctctgct

SEQ ID NO: 533554 - DNA, 16 bp, Homo sapiens
actcttctctctgctc

SEQ ID NO: 533555 - DNA, 22 bp, Homo sapiens
actcttgcacagtcactgctct

SEQ ID NO: 533556 - DNA, 18 bp, Homo sapiens
actctttatgatctggcc

SEQ ID NO: 533557 - DNA, 17 bp, Homo sapiens
actgaacttttcaaaat

SEQ ID NO: 533558 - DNA, 12 bp, Homo sapiens
actgaagagaca

SEQ ID NO: 533559 - DNA, 15 bp, Homo sapiens
actgaagtcagttct

SEQ ID NO: 533560 - DNA, 21 bp, Homo sapiens
actgaagtttgataaatagtg

SEQ ID NO: 533561 - DNA, 12 bp, Homo sapiens
actgaataaatc

SEQ ID NO: 533562 - DNA, 15 bp, Homo sapiens
actgaatctgtacag

SEQ ID NO: 533563 - DNA, 13 bp, Homo sapiens
actgagggcagga

SEQ ID NO: 533564 - DNA, 14 bp, Homo sapiens
actgagtacaaatg

SEQ ID NO: 533565 - DNA, 14 bp, Homo sapiens
actgatatattttc

SEQ ID NO: 533566 - DNA, 18 bp, Homo sapiens
actgcacatgatttcaca

SEQ ID NO: 533567 - DNA, 21 bp, Homo sapiens
actgcacatgatttcacaaat

SEQ ID NO: 533568 - DNA, 23 bp, Homo sapiens
actgcacatgatttcacaaatat

SEQ ID NO: 533569 - DNA, 23 bp, Homo sapiens
accatttcagtaaacctgtctga

SEQ ID NO: 533570 - DNA, 22 bp, Homo sapiens
accattttgaaatattcacaag

SEQ ID NO: 533571 - DNA, 14 bp, Homo sapiens
acccaaaagagaaa

SEQ ID NO: 533572 - DNA, 16 bp, Homo sapiens
acccaaaagagaaaaa

SEQ ID NO: 533573 - DNA, 15 bp, Homo sapiens
acccaaacctggaga

SEQ ID NO: 533574 - DNA, 22 bp, Homo sapiens
acccaaagcacatgcttagctt

SEQ ID NO: 533575 - DNA, 11 bp, Homo sapiens
acccaaagcag

SEQ ID NO: 533576 - DNA, 19 bp, Homo sapiens
acccaagttatgcatcccc

SEQ ID NO: 533577 - DNA, 18 bp, Homo sapiens
acccacaccctacagcag

SEQ ID NO: 533578 - DNA, 18 bp, Homo sapiens
acccaccagttgctgctg

SEQ ID NO: 533579 - DNA, 15 bp, Homo sapiens
acccaccttgacgtt

SEQ ID NO: 533580 - DNA, 16 bp, Homo sapiens
acccatgaaacagcag

SEQ ID NO: 533581 - DNA, 17 bp, Homo sapiens
acccatgaaacagcagc

SEQ ID NO: 533582 - DNA, 20 bp, Homo sapiens
acccatgaaacagcagctga

SEQ ID NO: 533583 - DNA, 18 bp, Homo sapiens
accccatcctccagggct

SEQ ID NO: 533584 - DNA, 12 bp, Homo sapiens
acccccagctcc

SEQ ID NO: 533585 - DNA, 19 bp, Homo sapiens
acccccagtgctcacacaa

SEQ ID NO: 533586 - DNA, 15 bp, Homo sapiens
acccccattctgtcc

SEQ ID NO: 533587 - DNA, 16 bp, Homo sapiens
acccccattctgtcct

SEQ ID NO: 533588 - DNA, 15 bp, Homo sapiens
acccccgggtgcctg

SEQ ID NO: 533589 - DNA, 23 bp, Homo sapiens
acccccgtgccaaatcctgggca

SEQ ID NO: 533590 - DNA, 11 bp, Homo sapiens
acccccttggt

SEQ ID NO: 533591 - DNA, 18 bp, Homo sapiens
acccctcccctaatgcct

SEQ ID NO: 533592 - DNA, 13 bp, Homo sapiens
acccctttcttct

SEQ ID NO: 533593 - DNA, 21 bp, Homo sapiens
acccctttcttctcgggccac

SEQ ID NO: 533594 - DNA, 15 bp, Homo sapiens
acccgagctgggacc

SEQ ID NO: 533595 - DNA, 14 bp, Homo sapiens
acccgcatgtacaa

SEQ ID NO: 533596 - DNA, 14 bp, Homo sapiens
acccggcttcctgt

SEQ ID NO: 533597 - DNA, 16 bp, Homo sapiens
accctacagcagatcc

SEQ ID NO: 533598 - DNA, 17 bp, Homo sapiens
accctacagcagatcca

SEQ ID NO: 533599 - DNA, 16 bp, Homo sapiens
accctatgccttttgt

SEQ ID NO: 533600 - DNA, 17 bp, Homo sapiens
accctatgccttttgta

SEQ ID NO: 533601 - DNA, 21 bp, Homo sapiens
accctatgccttttgtagctg

SEQ ID NO: 533602 - DNA, 22 bp, Homo sapiens
accctattctatccatctcctg

SEQ ID NO: 533603 - DNA, 16 bp, Homo sapiens
accctcatctgtctgg

SEQ ID NO: 533604 - DNA, 21 bp, Homo sapiens
accctccccttcccagggcaa

SEQ ID NO: 533605 - DNA, 21 bp, Homo sapiens
accctccttcccactcttctc

SEQ ID NO: 533606 - DNA, 15 bp, Homo sapiens
accctcgatgttcat

SEQ ID NO: 533607 - DNA, 11 bp, Homo sapiens
accctgaaatg

SEQ ID NO: 533608 - DNA, 15 bp, Homo sapiens
accctgaaatgtgtg

SEQ ID NO: 533609 - DNA, 15 bp, Homo sapiens
accctgaatcagagg

SEQ ID NO: 533610 - DNA, 13 bp, Homo sapiens
accctgcccagcc

SEQ ID NO: 533611 - DNA, 22 bp, Homo sapiens
accctggagcccggcagtgcac

SEQ ID NO: 533612 - DNA, 13 bp, Homo sapiens
acccttgttccag

SEQ ID NO: 533613 - DNA, 23 bp, Homo sapiens
acccttttaagtttaaaatgtgt

SEQ ID NO: 533614 - DNA, 15 bp, Homo sapiens
accgactagacacac

SEQ ID NO: 533615 - DNA, 18 bp, Homo sapiens
accgagtgtggagctgct

SEQ ID NO: 533616 - DNA, 23 bp, Homo sapiens
accgagtgtggagctgcttccag

SEQ ID NO: 533617 - DNA, 22 bp, Homo sapiens
accgggagcctgcgtggcctgg

SEQ ID NO: 533618 - DNA, 14 bp, Homo sapiens
acctaattaatttc

SEQ ID NO: 533619 - DNA, 15 bp, Homo sapiens
acctaattagagcag

SEQ ID NO: 533620 - DNA, 16 bp, Homo sapiens
acctaattagagcaga

SEQ ID NO: 533621 - DNA, 14 bp, Homo sapiens
acctagcaattcca

SEQ ID NO: 533622 - DNA, 18 bp, Homo sapiens
acctagcaattccatcac

SEQ ID NO: 533623 - DNA, 17 bp, Homo sapiens
acctataatgtgtgtat

SEQ ID NO: 533624 - DNA, 21 bp, Homo sapiens
acctcactcagaagtccagag

SEQ ID NO: 533625 - DNA, 20 bp, Homo sapiens
acctccaactggatgttgac

SEQ ID NO: 533626 - DNA, 19 bp, Homo sapiens
aggtcctgggggcctgacc

SEQ ID NO: 533627 - DNA, 22 bp, Homo sapiens
aggtcctgggggcctgacctcc

SEQ ID NO: 533628 - DNA, 21 bp, Homo sapiens
aggtcctgtcctggctcccag

SEQ ID NO: 533629 - DNA, 22 bp, Homo sapiens
aggtcctgtcctggctcccagg

SEQ ID NO: 533630 - DNA, 22 bp, Homo sapiens
aggtctacctgaaaattcaaca

SEQ ID NO: 533631 - DNA, 13 bp, Homo sapiens
aggtctctctggc

SEQ ID NO: 533632 - DNA, 20 bp, Homo sapiens
aggtctgtggctcctcccga

SEQ ID NO: 533633 - DNA, 21 bp, Homo sapiens
aggtgacagtgaggtcctggg

SEQ ID NO: 533634 - DNA, 16 bp, Homo sapiens
aggtgagggaggcctg

SEQ ID NO: 533635 - DNA, 20 bp, Homo sapiens
aggtgcaccggtttcataga

SEQ ID NO: 533636 - DNA, 21 bp, Homo sapiens
aggtggccactttaagagaga

SEQ ID NO: 533637 - DNA, 14 bp, Homo sapiens
aggtggccagggct

SEQ ID NO: 533638 - DNA, 19 bp, Homo sapiens
aggtggccagggctccacg

SEQ ID NO: 533639 - DNA, 18 bp, Homo sapiens
aggtgggggtcggcgcct

SEQ ID NO: 533640 - DNA, 19 bp, Homo sapiens
aggtggtgggcattctctc

SEQ ID NO: 533641 - DNA, 15 bp, Homo sapiens
aggtgtgaggcagga

SEQ ID NO: 533642 - DNA, 11 bp, Homo sapiens
aggttaaatgt

SEQ ID NO: 533643 - DNA, 18 bp, Homo sapiens
aggttaaatgttttgtaa

SEQ ID NO: 533644 - DNA, 12 bp, Homo sapiens
aggttctctcta

SEQ ID NO: 533645 - DNA, 18 bp, Homo sapiens
aggttctgggtgcaggag

SEQ ID NO: 533646 - DNA, 14 bp, Homo sapiens
agtgtctctattta

SEQ ID NO: 533647 - DNA, 18 bp, Homo sapiens
agtgtctctatttatgag

SEQ ID NO: 533648 - DNA, 15 bp, Homo sapiens
agtgtctgtaaatca

SEQ ID NO: 533649 - DNA, 15 bp, Homo sapiens
agtgttataaaatct

SEQ ID NO: 533650 - DNA, 19 bp, Homo sapiens
agtgttataaaatctgtat

SEQ ID NO: 533651 - DNA, 14 bp, Homo sapiens
agtgttctgtgaat

SEQ ID NO: 533652 - DNA, 16 bp, Homo sapiens
agtgttctgtgaatag

SEQ ID NO: 533653 - DNA, 19 bp, Homo sapiens
agtgttctgtgaatagcag

SEQ ID NO: 533654 - DNA, 20 bp, Homo sapiens
agtgttctgtgaatagcagt

SEQ ID NO: 533655 - DNA, 16 bp, Homo sapiens
agtgttctgttacaaa

SEQ ID NO: 533656 - DNA, 21 bp, Homo sapiens
agtgttctgttacaaaatgta

SEQ ID NO: 533657 - DNA, 22 bp, Homo sapiens
agttaagcacaaccatgttctt

SEQ ID NO: 533658 - DNA, 17 bp, Homo sapiens
agttaataacagctcct

SEQ ID NO: 533659 - DNA, 18 bp, Homo sapiens
agttaataacagctcctt

SEQ ID NO: 533660 - DNA, 17 bp, Homo sapiens
agttaatctttgaaaac

SEQ ID NO: 533661 - DNA, 21 bp, Homo sapiens
agttaatctttgaaaactcat

SEQ ID NO: 533662 - DNA, 14 bp, Homo sapiens
agttacagtggcag

SEQ ID NO: 533663 - DNA, 15 bp, Homo sapiens
agttacagtggcagt

SEQ ID NO: 533664 - DNA, 21 bp, Homo sapiens
agttactttccaattctcctt

SEQ ID NO: 533665 - DNA, 17 bp, Homo sapiens
agttacttttccttgca

SEQ ID NO: 533666 - DNA, 20 bp, Homo sapiens
agttacttttccttgcatac

SEQ ID NO: 533667 - DNA, 21 bp, Homo sapiens
agttacttttccttgcataca

SEQ ID NO: 533668 - DNA, 14 bp, Homo sapiens
agttatgcatcccc

SEQ ID NO: 533669 - DNA, 22 bp, Homo sapiens
agttattgtccctggcttcctt

SEQ ID NO: 533670 - DNA, 15 bp, Homo sapiens
agttcaaagtcatga

SEQ ID NO: 533671 - DNA, 22 bp, Homo sapiens
agttcaaagtcatgatgttttt

SEQ ID NO: 533672 - DNA, 16 bp, Homo sapiens
agttcaagaccagcct

SEQ ID NO: 533673 - DNA, 22 bp, Homo sapiens
agttcagggaagataagttgga

SEQ ID NO: 533674 - DNA, 13 bp, Homo sapiens
agttcatcccttc

SEQ ID NO: 533675 - DNA, 19 bp, Homo sapiens
agttcatcccttctcttcc

SEQ ID NO: 533676 - DNA, 22 bp, Homo sapiens
agttcatcccttctcttccagg

SEQ ID NO: 533677 - DNA, 14 bp, Homo sapiens
agttcattcatatt

SEQ ID NO: 533678 - DNA, 15 bp, Homo sapiens
agttcattcatatta

SEQ ID NO: 533679 - DNA, 17 bp, Homo sapiens
agttccaatcagtagct

SEQ ID NO: 533680 - DNA, 19 bp, Homo sapiens
agttctatcagttatcctt

SEQ ID NO: 533681 - DNA, 15 bp, Homo sapiens
agttctctttggaaa

SEQ ID NO: 533682 - DNA, 16 bp, Homo sapiens
agttctctttggaaat

SEQ ID NO: 533683 - DNA, 22 bp, Homo sapiens
agttctctttggaaatagcatg

SEQ ID NO: 533684 - DNA, 12 bp, Homo sapiens
agttctgatgag

SEQ ID NO: 533685 - DNA, 15 bp, Homo sapiens
agttcttaaaacact

SEQ ID NO: 533686 - DNA, 16 bp, Homo sapiens
agttcttaaaacacta

SEQ ID NO: 533687 - DNA, 21 bp, Homo sapiens
agttgcaataaactcagtcaa

SEQ ID NO: 533688 - DNA, 15 bp, Homo sapiens
agttgcattttcata

SEQ ID NO: 533689 - DNA, 21 bp, Homo sapiens
agttggaaacactaaatgtta

SEQ ID NO: 533690 - DNA, 18 bp, Homo sapiens
agttggactgtggcctca

SEQ ID NO: 533691 - DNA, 20 bp, Homo sapiens
agttggagttcattcatatt

SEQ ID NO: 533692 - DNA, 21 bp, Homo sapiens
agttggagttcattcatatta

SEQ ID NO: 533693 - DNA, 15 bp, Homo sapiens
agttggccaagcaga

SEQ ID NO: 533694 - DNA, 20 bp, Homo sapiens
agttggtcttactttgttaa

SEQ ID NO: 533695 - DNA, 21 bp, Homo sapiens
agttggtcttactttgttaat

SEQ ID NO: 533696 - DNA, 22 bp, Homo sapiens
agttggtcttactttgttaatt

SEQ ID NO: 533697 - DNA, 13 bp, Homo sapiens
agttgtaaacgtc

SEQ ID NO: 533698 - DNA, 13 bp, Homo sapiens
agttgtaaagata

SEQ ID NO: 533699 - DNA, 13 bp, Homo sapiens
agttgtgatctgt

SEQ ID NO: 533700 - DNA, 23 bp, Homo sapiens
agtttaaaaatcagaaagacatt

SEQ ID NO: 533701 - DNA, 14 bp, Homo sapiens
agtttagagaaata

SEQ ID NO: 533702 - DNA, 23 bp, Homo sapiens
agtttattttttttcttccaaca

SEQ ID NO: 533703 - DNA, 15 bp, Homo sapiens
agtttcaaaaatctg

SEQ ID NO: 533704 - DNA, 16 bp, Homo sapiens
agtttcaaaaatctga

SEQ ID NO: 533705 - DNA, 15 bp, Homo sapiens
agtttcaataaagtt

SEQ ID NO: 533706 - DNA, 19 bp, Homo sapiens
agtttccagctaagcctga

SEQ ID NO: 533707 - DNA, 16 bp, Homo sapiens
agtttcttttattttc

SEQ ID NO: 533708 - DNA, 16 bp, Homo sapiens
agtttgataaatagtg

SEQ ID NO: 533709 - DNA, 19 bp, Homo sapiens
agtttgataaatagtgtta

SEQ ID NO: 533710 - DNA, 16 bp, Homo sapiens
agtttgatcttcctct

SEQ ID NO: 533711 - DNA, 20 bp, Homo sapiens
agtttgatgtcattaatgtg

SEQ ID NO: 533712 - DNA, 23 bp, Homo sapiens
agtttgtttctttgaattttcat

SEQ ID NO: 533713 - DNA, 13 bp, Homo sapiens
agttttattttct

SEQ ID NO: 533714 - DNA, 16 bp, Homo sapiens
agttttcttttaattt

SEQ ID NO: 533715 - DNA, 21 bp, Homo sapiens
agttttgcttttagtttttct

SEQ ID NO: 533716 - DNA, 13 bp, Homo sapiens
agttttgtgaaat

SEQ ID NO: 533717 - DNA, 14 bp, Homo sapiens
agttttgtgaaatt

SEQ ID NO: 533718 - DNA, 15 bp, Homo sapiens
agttttgtgaaattt

SEQ ID NO: 533719 - DNA, 12 bp, Homo sapiens
agtttttcttaa

SEQ ID NO: 533720 - DNA, 12 bp, Homo sapiens
agtttttgttct

SEQ ID NO: 533721 - DNA, 20 bp, Homo sapiens
ataaaaaataataatacaag

SEQ ID NO: 533722 - DNA, 20 bp, Homo sapiens
ataaaaagtgacacagcagc

SEQ ID NO: 533723 - DNA, 12 bp, Homo sapiens
ataaaaccagaa

SEQ ID NO: 533724 - DNA, 18 bp, Homo sapiens
ataaaaccagaaagagga

SEQ ID NO: 533725 - DNA, 16 bp, Homo sapiens
ataaaaggtctatgct

SEQ ID NO: 533726 - DNA, 13 bp, Homo sapiens
ataaaatacacgt

SEQ ID NO: 533727 - DNA, 15 bp, Homo sapiens
ataaaatacacgtgt

SEQ ID NO: 533728 - DNA, 16 bp, Homo sapiens
ataaacattaaatgtc

SEQ ID NO: 533729 - DNA, 20 bp, Homo sapiens
ataaaccaaaggacattatg

SEQ ID NO: 533730 - DNA, 15 bp, Homo sapiens
ataaagaataggact

SEQ ID NO: 533731 - DNA, 19 bp, Homo sapiens
ataaagaataggacttgtt

SEQ ID NO: 533732 - DNA, 17 bp, Homo sapiens
ataaagcatctaaactt

SEQ ID NO: 533733 - DNA, 22 bp, Homo sapiens
ataaagcgaaaaactcaaccaa

SEQ ID NO: 533734 - DNA, 21 bp, Homo sapiens
ataaagcttttgcatagaata

SEQ ID NO: 533735 - DNA, 14 bp, Homo sapiens
ataaaggaggaatc

SEQ ID NO: 533736 - DNA, 14 bp, Homo sapiens
ataaagtatgaata

SEQ ID NO: 533737 - DNA, 16 bp, Homo sapiens
ataaagtctgtcatgc

SEQ ID NO: 533738 - DNA, 15 bp, Homo sapiens
ataaagtttgatctt

SEQ ID NO: 533739 - DNA, 22 bp, Homo sapiens
ataaagtttgatcttcctctgc

SEQ ID NO: 533740 - DNA, 15 bp, Homo sapiens
ataaatcaattcatt

SEQ ID NO: 533741 - DNA, 20 bp, Homo sapiens
ataaatcatgtggcctaata

SEQ ID NO: 533742 - DNA, 13 bp, Homo sapiens
ataaatgtatata

SEQ ID NO: 533743 - DNA, 21 bp, Homo sapiens
ataaatgtatatacacatata

SEQ ID NO: 533744 - DNA, 13 bp, Homo sapiens
ataaattgtaatt

SEQ ID NO: 533745 - DNA, 21 bp, Homo sapiens
ataaattgtaatttgggaaca

SEQ ID NO: 533746 - DNA, 11 bp, Homo sapiens
ataaattttgt

SEQ ID NO: 533747 - DNA, 17 bp, Homo sapiens
ataaatttttaagtgtc

SEQ ID NO: 533748 - DNA, 18 bp, Homo sapiens
ataaatttttaagtgtca

SEQ ID NO: 533749 - DNA, 13 bp, Homo sapiens
ataacaacttttt

SEQ ID NO: 533750 - DNA, 14 bp, Homo sapiens
ataacaactttttt

SEQ ID NO: 533751 - DNA, 16 bp, Homo sapiens
ataacagctcctttat

SEQ ID NO: 533752 - DNA, 12 bp, Homo sapiens
ataacattgtaa

SEQ ID NO: 533753 - DNA, 16 bp, Homo sapiens
ataacattgtatgtta

SEQ ID NO: 533754 - DNA, 14 bp, Homo sapiens
ataaccagacacaa

SEQ ID NO: 533755 - DNA, 21 bp, Homo sapiens
ataacttacaagactgtaaat

SEQ ID NO: 533756 - DNA, 21 bp, Homo sapiens
ataagcaaatttcaaaagaca

SEQ ID NO: 533757 - DNA, 12 bp, Homo sapiens
ataagcaacaat

SEQ ID NO: 533758 - DNA, 13 bp, Homo sapiens
ataagcaacaatt

SEQ ID NO: 533759 - DNA, 17 bp, Homo sapiens
ataagcaacaattttca

SEQ ID NO: 533760 - DNA, 15 bp, Homo sapiens
ataagtgaataataa

SEQ ID NO: 533761 - DNA, 13 bp, Homo sapiens
ataataatacaag

SEQ ID NO: 533762 - DNA, 13 bp, Homo sapiens
ataatatgcatat

SEQ ID NO: 533763 - DNA, 15 bp, Homo sapiens
ataatcaccagggcc

SEQ ID NO: 533764 - DNA, 14 bp, Homo sapiens
ataatcctgcaaag

SEQ ID NO: 533765 - DNA, 21 bp, Homo sapiens
ataatgcttctttcctcttaa

SEQ ID NO: 533766 - DNA, 17 bp, Homo sapiens
ataatggccctgtagct

SEQ ID NO: 533767 - DNA, 16 bp, Homo sapiens
ataatggcctcttaaa

SEQ ID NO: 533768 - DNA, 16 bp, Homo sapiens
ataatgtattttcagc

SEQ ID NO: 533769 - DNA, 12 bp, Homo sapiens
ataatgtgtgta

SEQ ID NO: 533770 - DNA, 12 bp, Homo sapiens
ataattaaaaca

SEQ ID NO: 533771 - DNA, 14 bp, Homo sapiens
ataattaaatgaaa

SEQ ID NO: 533772 - DNA, 15 bp, Homo sapiens
ataattaaatgaaat

SEQ ID NO: 533773 - DNA, 18 bp, Homo sapiens
ataattaaatgaaatact

SEQ ID NO: 533774 - DNA, 21 bp, Homo sapiens
aaaaagtattgccaaacatta

SEQ ID NO: 533775 - DNA, 14 bp, Homo sapiens
aaaaagtcttttaa

SEQ ID NO: 533776 - DNA, 14 bp, Homo sapiens
aaaaagtgacacag

SEQ ID NO: 533777 - DNA, 22 bp, Homo sapiens
aatgttttgtaaactttgaaat

SEQ ID NO: 533778 - DNA, 14 bp, Homo sapiens
aattaaaatttaac

SEQ ID NO: 533779 - DNA, 15 bp, Homo sapiens
aattaaaatttaaca

SEQ ID NO: 533780 - DNA, 14 bp, Homo sapiens
aattaaatgaaata

SEQ ID NO: 533781 - DNA, 15 bp, Homo sapiens
aattaatgtgtaaaa

SEQ ID NO: 533782 - DNA, 14 bp, Homo sapiens
aattactaacttct

SEQ ID NO: 533783 - DNA, 16 bp, Homo sapiens
aattactaacttctaa

SEQ ID NO: 533784 - DNA, 18 bp, Homo sapiens
aattactaacttctaaaa

SEQ ID NO: 533785 - DNA, 12 bp, Homo sapiens
aattagagcaga

SEQ ID NO: 533786 - DNA, 21 bp, Homo sapiens
aattagattttaaaacttcat

SEQ ID NO: 533787 - DNA, 19 bp, Homo sapiens
aattaggaggctcaacaat

SEQ ID NO: 533788 - DNA, 18 bp, Homo sapiens
aattatgctaagaatttt

SEQ ID NO: 533789 - DNA, 22 bp, Homo sapiens
aattatgctaagaattttttat

SEQ ID NO: 533790 - DNA, 15 bp, Homo sapiens
aattcacaaagttaa

SEQ ID NO: 533791 - DNA, 12 bp, Homo sapiens
aattcactttag

SEQ ID NO: 533792 - DNA, 17 bp, Homo sapiens
aattcagataatggtaa

SEQ ID NO: 533793 - DNA, 22 bp, Homo sapiens
aattcagataatggtaatttag

SEQ ID NO: 533794 - DNA, 23 bp, Homo sapiens
aattcagataatggtaatttagt

SEQ ID NO: 533795 - DNA, 21 bp, Homo sapiens
aattcaggtgaaaatgttcat

SEQ ID NO: 533796 - DNA, 13 bp, Homo sapiens
aattcatagaata

SEQ ID NO: 533797 - DNA, 16 bp, Homo sapiens
aattcattgtgtatga

SEQ ID NO: 533798 - DNA, 12 bp, Homo sapiens
aattccaaagat

SEQ ID NO: 533799 - DNA, 18 bp, Homo sapiens
aattccaaagatctgaat

SEQ ID NO: 533800 - DNA, 14 bp, Homo sapiens
aattctaatggtaa

SEQ ID NO: 533801 - DNA, 11 bp, Homo sapiens
aattctccttt

SEQ ID NO: 533802 - DNA, 14 bp, Homo sapiens
aattctgaagttat

SEQ ID NO: 533803 - DNA, 18 bp, Homo sapiens
aattcttattccatatta

SEQ ID NO: 533804 - DNA, 19 bp, Homo sapiens
aattcttattccatattag

SEQ ID NO: 533805 - DNA, 22 bp, Homo sapiens
aattcttattccatattagaaa

SEQ ID NO: 533806 - DNA, 21 bp, Homo sapiens
aattgaaagggacaagtatca

SEQ ID NO: 533807 - DNA, 22 bp, Homo sapiens
aattgaaagggacaagtatcat

SEQ ID NO: 533808 - DNA, 23 bp, Homo sapiens
aattgaagagagatatatctgaa

SEQ ID NO: 533809 - DNA, 15 bp, Homo sapiens
aattgatgttgatgc

SEQ ID NO: 533810 - DNA, 20 bp, Homo sapiens
aattgcttctctaaaacagc

SEQ ID NO: 533811 - DNA, 15 bp, Homo sapiens
aattggaaaagacta

SEQ ID NO: 533812 - DNA, 14 bp, Homo sapiens
aattggattattac

SEQ ID NO: 533813 - DNA, 20 bp, Homo sapiens
aattggccagaggaaatctg

SEQ ID NO: 533814 - DNA, 13 bp, Homo sapiens
aattggcttgttt

SEQ ID NO: 533815 - DNA, 16 bp, Homo sapiens
aattggtttaaacttt

SEQ ID NO: 533816 - DNA, 22 bp, Homo sapiens
aattggtttaaacttttatgcg

SEQ ID NO: 533817 - DNA, 16 bp, Homo sapiens
aattgtgctccaaatg

SEQ ID NO: 533818 - DNA, 19 bp, Homo sapiens
aatttaacatctgcagtgt

SEQ ID NO: 533819 - DNA, 20 bp, Homo sapiens
aatttaagcacaaaaaattt

SEQ ID NO: 533820 - DNA, 12 bp, Homo sapiens
aatttactttta

SEQ ID NO: 533821 - DNA, 18 bp, Homo sapiens
aatttagtggatggaata

SEQ ID NO: 533822 - DNA, 13 bp, Homo sapiens
aatttagtgtata

SEQ ID NO: 533823 - DNA, 20 bp, Homo sapiens
aatttagtgtatatgtgatt

SEQ ID NO: 533824 - DNA, 15 bp, Homo sapiens
aatttataaaattag

SEQ ID NO: 533825 - DNA, 16 bp, Homo sapiens
aatttataaaattaga

SEQ ID NO: 533826 - DNA, 21 bp, Homo sapiens
aatttataaaattagaaagca

SEQ ID NO: 533827 - DNA, 15 bp, Homo sapiens
aatttatgaagcaga

SEQ ID NO: 533828 - DNA, 20 bp, Homo sapiens
aatttatgaagcagatttat

SEQ ID NO: 533829 - DNA, 20 bp, Homo sapiens
aatttcaaaagacatgttgt

SEQ ID NO: 533830 - DNA, 15 bp, Homo sapiens
aatttcaagcttatt

SEQ ID NO: 533831 - DNA, 22 bp, Homo sapiens
aatttcacgtcataggaagtta

SEQ ID NO: 533832 - DNA, 21 bp, Homo sapiens
aatttcagaaactaagaatca

SEQ ID NO: 533833 - DNA, 22 bp, Homo sapiens
aatttctggcaaatattttgtc

SEQ ID NO: 533834 - DNA, 12 bp, Homo sapiens
aatttcttcctt

SEQ ID NO: 533835 - DNA, 13 bp, Homo sapiens
aatttcttccttc

SEQ ID NO: 533836 - DNA, 14 bp, Homo sapiens
aatttcttccttcc

SEQ ID NO: 533837 - DNA, 15 bp, Homo sapiens
aatttcttgcaattt

SEQ ID NO: 533838 - DNA, 14 bp, Homo sapiens
acaattttcagatt

SEQ ID NO: 533839 - DNA, 16 bp, Homo sapiens
acaattttcagatttg

SEQ ID NO: 533840 - DNA, 19 bp, Homo sapiens
acaattttcagatttgcac

SEQ ID NO: 533841 - DNA, 14 bp, Homo sapiens
acacaaacaaacaa

SEQ ID NO: 533842 - DNA, 22 bp, Homo sapiens
acacaaacaaacaagctaggtg

SEQ ID NO: 533843 - DNA, 20 bp, Homo sapiens
acacaaatacggaagtaaac

SEQ ID NO: 533844 - DNA, 15 bp, Homo sapiens
acacaatcagaccaa

SEQ ID NO: 533845 - DNA, 20 bp, Homo sapiens
acacaatcagaccaaggaac

SEQ ID NO: 533846 - DNA, 15 bp, Homo sapiens
acacacacacacgca

SEQ ID NO: 533847 - DNA, 15 bp, Homo sapiens
acacacacacatata

SEQ ID NO: 533848 - DNA, 16 bp, Homo sapiens
acacacacacgcacgc

SEQ ID NO: 533849 - DNA, 12 bp, Homo sapiens
acacacacagac

SEQ ID NO: 533850 - DNA, 11 bp, Homo sapiens
acacacacata

SEQ ID NO: 533851 - DNA, 15 bp, Homo sapiens
acacacacatatata

SEQ ID NO: 533852 - DNA, 12 bp, Homo sapiens
acacacacgcac

SEQ ID NO: 533853 - DNA, 14 bp, Homo sapiens
acacacacgcacgc

SEQ ID NO: 533854 - DNA, 15 bp, Homo sapiens
acacacacgcagaca

SEQ ID NO: 533855 - DNA, 18 bp, Homo sapiens
acacacagacacacaagc

SEQ ID NO: 533856 - DNA, 15 bp, Homo sapiens
acacacatatataca

SEQ ID NO: 533857 - DNA, 9 bp, Homo sapiens
acacacgca

SEQ ID NO: 533858 - DNA, 14 bp, Homo sapiens
acacacgcacgcac

SEQ ID NO: 533859 - DNA, 15 bp, Homo sapiens
acacacgcacgcaca

SEQ ID NO: 533860 - DNA, 16 bp, Homo sapiens
acacacgcacgcacac

SEQ ID NO: 533861 - DNA, 18 bp, Homo sapiens
acacacgcagacacacac

SEQ ID NO: 533862 - DNA, 13 bp, Homo sapiens
acacacttgacct

SEQ ID NO: 533863 - DNA, 14 bp, Homo sapiens
acacagcatttcaa

SEQ ID NO: 533864 - DNA, 19 bp, Homo sapiens
acacaggccaccctgtgca

SEQ ID NO: 533865 - DNA, 23 bp, Homo sapiens
acacatatacctataatgtgtgt

SEQ ID NO: 533866 - DNA, 15 bp, Homo sapiens
acacatatatacata

SEQ ID NO: 533867 - DNA, 18 bp, Homo sapiens
acacatatatacatacgc

SEQ ID NO: 533868 - DNA, 19 bp, Homo sapiens
acacatatatacatacgca

SEQ ID NO: 533869 - DNA, 20 bp, Homo sapiens
acacatatatgtatacgcac

SEQ ID NO: 533870 - DNA, 22 bp, Homo sapiens
acacatatatgtatacgcacgc

SEQ ID NO: 533871 - DNA, 15 bp, Homo sapiens
acacatcatctgtaa

SEQ ID NO: 533872 - DNA, 15 bp, Homo sapiens
acacatgcacacaca

SEQ ID NO: 533873 - DNA, 15 bp, Homo sapiens
acaccacagacacac

SEQ ID NO: 533874 - DNA, 16 bp, Homo sapiens
acaccacagacacaca

SEQ ID NO: 533875 - DNA, 18 bp, Homo sapiens
acaccacagacacacaca

SEQ ID NO: 533876 - DNA, 22 bp, Homo sapiens
acaccacagacacacacacgca

SEQ ID NO: 533877 - DNA, 18 bp, Homo sapiens
acaccactttcccacact

SEQ ID NO: 533878 - DNA, 16 bp, Homo sapiens
acaccagcaacattat

SEQ ID NO: 533879 - DNA, 14 bp, Homo sapiens
acacccagccccag

SEQ ID NO: 533880 - DNA, 12 bp, Homo sapiens
acacccagggaa

SEQ ID NO: 533881 - DNA, 20 bp, Homo sapiens
acaccctacagcagatccac

SEQ ID NO: 533882 - DNA, 19 bp, Homo sapiens
acacctgcctctgaactgc

SEQ ID NO: 533883 - DNA, 11 bp, Homo sapiens
acacctggccc

SEQ ID NO: 533884 - DNA, 18 bp, Homo sapiens
acacctggccctggggcc

SEQ ID NO: 533885 - DNA, 21 bp, Homo sapiens
acaccttgtgaccttctctat

SEQ ID NO: 533886 - DNA, 23 bp, Homo sapiens
acaccttgtgaccttctctatat

SEQ ID NO: 533887 - DNA, 14 bp, Homo sapiens
acacgcacgcacac

SEQ ID NO: 533888 - DNA, 15 bp, Homo sapiens
acacgcacgcacaca

SEQ ID NO: 533889 - DNA, 16 bp, Homo sapiens
acacgcacgcacacac

SEQ ID NO: 533890 - DNA, 17 bp, Homo sapiens
acacgcacgcacacaca

SEQ ID NO: 533891 - DNA, 20 bp, Homo sapiens
acacgcacgcacacacacaa

SEQ ID NO: 533892 - DNA, 12 bp, Homo sapiens
acacgcagacac

SEQ ID NO: 533893 - DNA, 13 bp, Homo sapiens
acacgcagacaca

SEQ ID NO: 533894 - DNA, 14 bp, Homo sapiens
acacggcctctggg

SEQ ID NO: 533895 - DNA, 15 bp, Homo sapiens
acactaaatgttaaa

SEQ ID NO: 533896 - DNA, 20 bp, Homo sapiens
acactaaatgttaaagatgt

SEQ ID NO: 533897 - DNA, 23 bp, Homo sapiens
acactgagttctatcagttatcc

SEQ ID NO: 533898 - DNA, 20 bp, Homo sapiens
acactgtcaaacatctggaa

SEQ ID NO: 533899 - DNA, 18 bp, Homo sapiens
acactgtctgctgcccca

SEQ ID NO: 533900 - DNA, 22 bp, Homo sapiens
acactgtgaactaatgacaagt

SEQ ID NO: 533901 - DNA, 16 bp, Homo sapiens
acactgtgacatctct

SEQ ID NO: 533902 - DNA, 13 bp, Homo sapiens
acactgtgctata

SEQ ID NO: 533903 - DNA, 15 bp, Homo sapiens
acacttagctggaga

SEQ ID NO: 533904 - DNA, 18 bp, Homo sapiens
acacttgctttatttttc

SEQ ID NO: 533905 - DNA, 19 bp, Homo sapiens
acacttgctttatttttca

SEQ ID NO: 533906 - DNA, 19 bp, Homo sapiens
acacttggaacagtgttta

SEQ ID NO: 533907 - DNA, 23 bp, Homo sapiens
acacttgggtaattaaaaataaa

SEQ ID NO: 533908 - DNA, 21 bp, Homo sapiens
acagaaaaatgaaatttaagc

SEQ ID NO: 533909 - DNA, 20 bp, Homo sapiens
acagaaaacggttaaaactg

SEQ ID NO: 533910 - DNA, 19 bp, Homo sapiens
acagaaatatatatacata

SEQ ID NO: 533911 - DNA, 20 bp, Homo sapiens
acagaaattggtaccttgca

SEQ ID NO: 533912 - DNA, 21 bp, Homo sapiens
acagaaattggtaccttgcac

SEQ ID NO: 533913 - DNA, 23 bp, Homo sapiens
acagaagggagtgaaaacctctt

SEQ ID NO: 533914 - DNA, 23 bp, Homo sapiens
acagacaattctaatggtaactt

SEQ ID NO: 533915 - DNA, 13 bp, Homo sapiens
acagacacacaca

SEQ ID NO: 533916 - DNA, 18 bp, Homo sapiens
acagacacacacacgcac

SEQ ID NO: 533917 - DNA, 16 bp, Homo sapiens
acagacactcctgggg

SEQ ID NO: 533918 - DNA, 16 bp, Homo sapiens
acagacgtccctccac

SEQ ID NO: 533919 - DNA, 21 bp, Homo sapiens
acagagacccccgtgccaaat

SEQ ID NO: 533920 - DNA, 21 bp, Homo sapiens
acagagagggggccacctccc

SEQ ID NO: 533921 - DNA, 19 bp, Homo sapiens
acagagcctgccccagcgc

SEQ ID NO: 533922 - DNA, 16 bp, Homo sapiens
acagagcgacagagca

SEQ ID NO: 533923 - DNA, 12 bp, Homo sapiens
acagataccata

SEQ ID NO: 533924 - DNA, 21 bp, Homo sapiens
acagatcacatgcccctctta

SEQ ID NO: 533925 - DNA, 18 bp, Homo sapiens
acagatgtggacatgcac

SEQ ID NO: 533926 - DNA, 19 bp, Homo sapiens
acagatgtggacatgcacc

SEQ ID NO: 533927 - DNA, 23 bp, Homo sapiens
acagatgtggacatgcacccgca

SEQ ID NO: 533928 - DNA, 13 bp, Homo sapiens
acagattggattt

SEQ ID NO: 533929 - DNA, 15 bp, Homo sapiens
acagattggatttta

SEQ ID NO: 533930 - DNA, 23 bp, Homo sapiens
acagattggattttatgttgaca

SEQ ID NO: 533931 - DNA, 20 bp, Homo sapiens
acagatttaagcaagaccat

SEQ ID NO: 533932 - DNA, 21 bp, Homo sapiens
acagcaaaaaaagcaactttt

SEQ ID NO: 533933 - DNA, 23 bp, Homo sapiens
acagcaaaaaaagcaacttttcc

SEQ ID NO: 533934 - DNA, 13 bp, Homo sapiens
acagcaaacacag

SEQ ID NO: 533935 - DNA, 15 bp, Homo sapiens
acagcaaacacagtc

SEQ ID NO: 533936 - DNA, 12 bp, Homo sapiens
acagcagatcca

SEQ ID NO: 533937 - DNA, 19 bp, Homo sapiens
acagcagatccacctgcac

SEQ ID NO: 533938 - DNA, 18 bp, Homo sapiens
acagcagctgaagccagc

SEQ ID NO: 533939 - DNA, 19 bp, Homo sapiens
acagcagctgaagccagct

SEQ ID NO: 533940 - DNA, 13 bp, Homo sapiens
acagcagcttcac

SEQ ID NO: 533941 - DNA, 22 bp, Homo sapiens
acagcattggcctggccagacc

SEQ ID NO: 533942 - DNA, 20 bp, Homo sapiens
acagccagaactctgtgtcc

SEQ ID NO: 533943 - DNA, 20 bp, Homo sapiens
acagccagtttagagaaata

SEQ ID NO: 533944 - DNA, 20 bp, Homo sapiens
acagccataggccctttcag

SEQ ID NO: 533945 - DNA, 21 bp, Homo sapiens
acagcccaggcatctccttgg

SEQ ID NO: 533946 - DNA, 16 bp, Homo sapiens
acagcccctccctcct

SEQ ID NO: 533947 - DNA, 19 bp, Homo sapiens
acagcccctccctcctctg

SEQ ID NO: 533948 - DNA, 12 bp, Homo sapiens
acagcctcaccc

SEQ ID NO: 533949 - DNA, 15 bp, Homo sapiens
acagcctcacccctg

SEQ ID NO: 533950 - DNA, 15 bp, Homo sapiens
acagctccttttcca

SEQ ID NO: 533951 - DNA, 13 bp, Homo sapiens
acagctctcccct

SEQ ID NO: 533952 - DNA, 16 bp, Homo sapiens
acagctctgagatcct

SEQ ID NO: 533953 - DNA, 19 bp, Homo sapiens
acagctctgagatcctgga

SEQ ID NO: 533954 - DNA, 15 bp, Homo sapiens
acagctgcagagaca

SEQ ID NO: 533955 - DNA, 16 bp, Homo sapiens
acagctttacacacac

SEQ ID NO: 533956 - DNA, 21 bp, Homo sapiens
acaggaacacccagccccagc

SEQ ID NO: 533957 - DNA, 19 bp, Homo sapiens
acaggctgccccacccctc

SEQ ID NO: 533958 - DNA, 22 bp, Homo sapiens
acaggctgccccacccctccat

SEQ ID NO: 533959 - DNA, 23 bp, Homo sapiens
acaggctgccccacccctccatg

SEQ ID NO: 533960 - DNA, 17 bp, Homo sapiens
acagggacacagtctgg

SEQ ID NO: 533961 - DNA, 16 bp, Homo sapiens
acaggtctcagaatct

SEQ ID NO: 533962 - DNA, 16 bp, Homo sapiens
acagtaactgccattt

SEQ ID NO: 533963 - DNA, 22 bp, Homo sapiens
acagtatggtaactttgcaaat

SEQ ID NO: 533964 - DNA, 18 bp, Homo sapiens
acagtatttaacattctt

SEQ ID NO: 533965 - DNA, 16 bp, Homo sapiens
acagtattttaagaag

SEQ ID NO: 533966 - DNA, 18 bp, Homo sapiens
acagtcaaggagtggctt

SEQ ID NO: 533967 - DNA, 22 bp, Homo sapiens
acagtcaaggagtggcttacta

SEQ ID NO: 533968 - DNA, 13 bp, Homo sapiens
acagtcaggaagc

SEQ ID NO: 533969 - DNA, 14 bp, Homo sapiens
acagtctctttctt

SEQ ID NO: 533970 - DNA, 22 bp, Homo sapiens
acagtgaggtcctgggggcctg

SEQ ID NO: 533971 - DNA, 21 bp, Homo sapiens
acagtgcacctgggacaggga

SEQ ID NO: 533972 - DNA, 17 bp, Homo sapiens
acagtggagtgcaaaag

SEQ ID NO: 533973 - DNA, 14 bp, Homo sapiens
acagtggcagtatt

SEQ ID NO: 533974 - DNA, 15 bp, Homo sapiens
acagtggcagtattg

SEQ ID NO: 533975 - DNA, 18 bp, Homo sapiens
acagtgtaccattaaaat

SEQ ID NO: 533976 - DNA, 19 bp, Homo sapiens
acagtgtaccattaaaata

SEQ ID NO: 533977 - DNA, 13 bp, Homo sapiens
acagtgtgtagtt

SEQ ID NO: 533978 - DNA, 12 bp, Homo sapiens
acagttactttt

SEQ ID NO: 533979 - DNA, 20 bp, Homo sapiens
acagttacttttccttgcat

SEQ ID NO: 533980 - DNA, 16 bp, Homo sapiens
acagttatcttagctg

SEQ ID NO: 533981 - DNA, 14 bp, Homo sapiens
acagttatttatag

SEQ ID NO: 533982 - DNA, 19 bp, Homo sapiens
acagttccaatcagtagct

SEQ ID NO: 533983 - DNA, 20 bp, Homo sapiens
acagtttgatgtcattaatg

SEQ ID NO: 533984 - DNA, 20 bp, Homo sapiens
acataaaaactactgaataa

SEQ ID NO: 533985 - DNA, 12 bp, Homo sapiens
acataaattgta

SEQ ID NO: 533986 - DNA, 15 bp, Homo sapiens
acataacaagaaaat

SEQ ID NO: 533987 - DNA, 17 bp, Homo sapiens
acataattcattaaaaa

SEQ ID NO: 533988 - DNA, 16 bp, Homo sapiens
acatacacttgtataa

SEQ ID NO: 533989 - DNA, 15 bp, Homo sapiens
acatacatatataca

SEQ ID NO: 533990 - DNA, 16 bp, Homo sapiens
acatatacctataatg

SEQ ID NO: 533991 - DNA, 20 bp, Homo sapiens
acatatacctataatgtgtg

SEQ ID NO: 533992 - DNA, 19 bp, Homo sapiens
acatatatacatacgcaat

SEQ ID NO: 533993 - DNA, 23 bp, Homo sapiens
acatatatgtatacgcacgcacc

SEQ ID NO: 533994 - DNA, 20 bp, Homo sapiens
acatatttcataagcacatc

SEQ ID NO: 533995 - DNA, 21 bp, Homo sapiens
acatcactattgggcccccag

SEQ ID NO: 533996 - DNA, 20 bp, Homo sapiens
acatcatctgtaagctgttt

SEQ ID NO: 533997 - DNA, 13 bp, Homo sapiens
acatccaagcttc

SEQ ID NO: 533998 - DNA, 15 bp, Homo sapiens
acatccacagtctcc

SEQ ID NO: 533999 - DNA, 19 bp, Homo sapiens
acatccacagtctccccca

SEQ ID NO: 534000 - DNA, 17 bp, Homo sapiens
acatccattcccaagaa

SEQ ID NO: 534001 - DNA, 20 bp, Homo sapiens
acatccattcccaagaaatg

SEQ ID NO: 534002 - DNA, 21 bp, Homo sapiens
acatccattcccaagaaatgc

SEQ ID NO: 534003 - DNA, 18 bp, Homo sapiens
acatccctcctgctttta

SEQ ID NO: 534004 - DNA, 19 bp, Homo sapiens
acatccggggccagctccg

SEQ ID NO: 534005 - DNA, 21 bp, Homo sapiens
acatcggttcaggaggagaca

SEQ ID NO: 534006 - DNA, 16 bp, Homo sapiens
acatctcatccatcaa

SEQ ID NO: 534007 - DNA, 18 bp, Homo sapiens
acatctctgtaaaaagca

SEQ ID NO: 534008 - DNA, 12 bp, Homo sapiens
acatctgatatc

SEQ ID NO: 534009 - DNA, 18 bp, Homo sapiens
acatctgcagtgttctgt

SEQ ID NO: 534010 - DNA, 18 bp, Homo sapiens
acatgatttcacaaatat

SEQ ID NO: 534011 - DNA, 21 bp, Homo sapiens
acatgatttcacaaatattaa

SEQ ID NO: 534012 - DNA, 15 bp, Homo sapiens
acatgcacacacaca

SEQ ID NO: 534013 - DNA, 19 bp, Homo sapiens
acatgcacccgcatgtaca

SEQ ID NO: 534014 - DNA, 20 bp, Homo sapiens
acatgcacccgcatgtacaa

SEQ ID NO: 534015 - DNA, 21 bp, Homo sapiens
acatgcacccgcatgtacaaa

SEQ ID NO: 534016 - DNA, 22 bp, Homo sapiens
acatgcacccgcatgtacaaaa

SEQ ID NO: 534017 - DNA, 22 bp, Homo sapiens
acatgcttagcttatctttctt

SEQ ID NO: 534018 - DNA, 16 bp, Homo sapiens
acatggatacttcctg

SEQ ID NO: 534019 - DNA, 19 bp, Homo sapiens
acatggatacttcctgggt

SEQ ID NO: 534020 - DNA, 12 bp, Homo sapiens
acatgtgtgtat

SEQ ID NO: 534021 - DNA, 15 bp, Homo sapiens
acatgtgtgtatata

SEQ ID NO: 534022 - DNA, 17 bp, Homo sapiens
acatgtgtgtatatatg

SEQ ID NO: 534023 - DNA, 11 bp, Homo sapiens
acatgttttca

SEQ ID NO: 534024 - DNA, 12 bp, Homo sapiens
acatgttttcaa

SEQ ID NO: 534025 - DNA, 14 bp, Homo sapiens
acatgttttcaaat

SEQ ID NO: 534026 - DNA, 16 bp, Homo sapiens
acatgttttcaaatgg

SEQ ID NO: 534027 - DNA, 17 bp, Homo sapiens
acatgttttcaaatgga

SEQ ID NO: 534028 - DNA, 14 bp, Homo sapiens
acattaaatgtctt

SEQ ID NO: 534029 - DNA, 17 bp, Homo sapiens
acattaaatgtcttata

SEQ ID NO: 534030 - DNA, 17 bp, Homo sapiens
acattaatggtctaaaa

SEQ ID NO: 534031 - DNA, 18 bp, Homo sapiens
acattaatgttgatttct

SEQ ID NO: 534032 - DNA, 21 bp, Homo sapiens
acattaatgttgatttctagt

SEQ ID NO: 534033 - DNA, 17 bp, Homo sapiens
acattatgctccagaaa

SEQ ID NO: 534034 - DNA, 23 bp, Homo sapiens
acattatgtgtgcatgtgtgtat

SEQ ID NO: 534035 - DNA, 17 bp, Homo sapiens
acattattttgtatgga

SEQ ID NO: 534036 - DNA, 18 bp, Homo sapiens
acattctatttcaacttc

SEQ ID NO: 534037 - DNA, 13 bp, Homo sapiens
acattctcagttt

SEQ ID NO: 534038 - DNA, 15 bp, Homo sapiens
acattctcagttttt

SEQ ID NO: 534039 - DNA, 21 bp, Homo sapiens
acattctgctgcccccagacc

SEQ ID NO: 534040 - DNA, 18 bp, Homo sapiens
acattcttggtcacaaag

SEQ ID NO: 534041 - DNA, 20 bp, Homo sapiens
acattgaaactgtatttact

SEQ ID NO: 534042 - DNA, 16 bp, Homo sapiens
acattgcccacacctg

SEQ ID NO: 534043 - DNA, 19 bp, Homo sapiens
acattgcccacacctgcct

SEQ ID NO: 534044 - DNA, 14 bp, Homo sapiens
acattgccttatat

SEQ ID NO: 534045 - DNA, 14 bp, Homo sapiens
acattgcttttaaa

SEQ ID NO: 534046 - DNA, 12 bp, Homo sapiens
acattggaagca

SEQ ID NO: 534047 - DNA, 12 bp, Homo sapiens
acattgtatgtt

SEQ ID NO: 534048 - DNA, 21 bp, Homo sapiens
agcacagagagggggccacct

SEQ ID NO: 534049 - DNA, 23 bp, Homo sapiens
agcacagccaatctccaggctcc

SEQ ID NO: 534050 - DNA, 12 bp, Homo sapiens
agcacagctccc

SEQ ID NO: 534051 - DNA, 15 bp, Homo sapiens
agcacagctcccttc

SEQ ID NO: 534052 - DNA, 12 bp, Homo sapiens
agcacagtattt

SEQ ID NO: 534053 - DNA, 14 bp, Homo sapiens
agcacagtatttaa

SEQ ID NO: 534054 - DNA, 19 bp, Homo sapiens
agcacagtatttaacattc

SEQ ID NO: 534055 - DNA, 18 bp, Homo sapiens
agcacagtcaggttgaag

SEQ ID NO: 534056 - DNA, 15 bp, Homo sapiens
agcacatctcttcat

SEQ ID NO: 534057 - DNA, 16 bp, Homo sapiens
agcaccaccctccttc

SEQ ID NO: 534058 - DNA, 20 bp, Homo sapiens
agcacccccacgccctcatt

SEQ ID NO: 534059 - DNA, 22 bp, Homo sapiens
agcacctcttgaagaactgact

SEQ ID NO: 534060 - DNA, 19 bp, Homo sapiens
agcactcctccctgatgta

SEQ ID NO: 534061 - DNA, 18 bp, Homo sapiens
agcactttgggaggctga

SEQ ID NO: 534062 - DNA, 23 bp, Homo sapiens
agcagaaaaaaaagtgtctcaaa

SEQ ID NO: 534063 - DNA, 19 bp, Homo sapiens
agcagaatcaaaatgacct

SEQ ID NO: 534064 - DNA, 18 bp, Homo sapiens
agcagaattgaccgacag

SEQ ID NO: 534065 - DNA, 20 bp, Homo sapiens
agcagagtgaaattcaattc

SEQ ID NO: 534066 - DNA, 16 bp, Homo sapiens
agcagatccacctgca

SEQ ID NO: 534067 - DNA, 19 bp, Homo sapiens
agcagatccacctgcacaa

SEQ ID NO: 534068 - DNA, 20 bp, Homo sapiens
agcagatccacctgcacaaa

SEQ ID NO: 534069 - DNA, 17 bp, Homo sapiens
agcagcaaaaatataaa

SEQ ID NO: 534070 - DNA, 14 bp, Homo sapiens
agcagcaaggtctt

SEQ ID NO: 534071 - DNA, 12 bp, Homo sapiens
agcagcccaaat

SEQ ID NO: 534072 - DNA, 18 bp, Homo sapiens
agcagctagaaagagaaa

SEQ ID NO: 534073 - DNA, 18 bp, Homo sapiens
agcagcttcaccagagca

SEQ ID NO: 534074 - DNA, 14 bp, Homo sapiens
agcaggttaaatgt

SEQ ID NO: 534075 - DNA, 15 bp, Homo sapiens
agcaggttaaatgtt

SEQ ID NO: 534076 - DNA, 18 bp, Homo sapiens
agcaggttaaatgttttg

SEQ ID NO: 534077 - DNA, 20 bp, Homo sapiens
agcaggttaaatgttttgta

SEQ ID NO: 534078 - DNA, 22 bp, Homo sapiens
agcaggttaaatgttttgtaaa

SEQ ID NO: 534079 - DNA, 16 bp, Homo sapiens
agcagtaaatgtatat

SEQ ID NO: 534080 - DNA, 16 bp, Homo sapiens
agcagtgagagcagat

SEQ ID NO: 534081 - DNA, 15 bp, Homo sapiens
agcagtgatattctt

SEQ ID NO: 534082 - DNA, 19 bp, Homo sapiens
agcagtgatattctttgtt

SEQ ID NO: 534083 - DNA, 14 bp, Homo sapiens
agcagtggcaaaat

SEQ ID NO: 534084 - DNA, 22 bp, Homo sapiens
agcagtgggtcatgatgctctt

SEQ ID NO: 534085 - DNA, 14 bp, Homo sapiens
agcagtttcaataa

SEQ ID NO: 534086 - DNA, 21 bp, Homo sapiens
agcagtttcaataaagtttga

SEQ ID NO: 534087 - DNA, 14 bp, Homo sapiens
agcatataaaatgg

SEQ ID NO: 534088 - DNA, 15 bp, Homo sapiens
agcatataaaatggc

SEQ ID NO: 534089 - DNA, 14 bp, Homo sapiens
agcatatatataaa

SEQ ID NO: 534090 - DNA, 18 bp, Homo sapiens
agcatatatataaaatac

SEQ ID NO: 534091 - DNA, 23 bp, Homo sapiens
agcatccatgcggccggcctggg

SEQ ID NO: 534092 - DNA, 13 bp, Homo sapiens
agcatctaaactt

SEQ ID NO: 534093 - DNA, 16 bp, Homo sapiens
agcatctaaactttaa

SEQ ID NO: 534094 - DNA, 17 bp, Homo sapiens
agcatctaaactttaat

SEQ ID NO: 534095 - DNA, 17 bp, Homo sapiens
agcatctggaagagcta

SEQ ID NO: 534096 - DNA, 17 bp, Homo sapiens
agcatgccaatttctct

SEQ ID NO: 534097 - DNA, 21 bp, Homo sapiens
agcattataatcaccagggcc

SEQ ID NO: 534098 - DNA, 14 bp, Homo sapiens
agcattccagtcag

SEQ ID NO: 534099 - DNA, 22 bp, Homo sapiens
agcattggcctggccagaccag

SEQ ID NO: 534100 - DNA, 22 bp, Homo sapiens
agcatttccaacaccacagaca

SEQ ID NO: 534101 - DNA, 21 bp, Homo sapiens
agcatttgactttctgtctgt

SEQ ID NO: 534102 - DNA, 13 bp, Homo sapiens
agccaaattttat

SEQ ID NO: 534103 - DNA, 22 bp, Homo sapiens
agccaccagatgtgacagtgtt

SEQ ID NO: 534104 - DNA, 18 bp, Homo sapiens
agccacccaaagcagtgg

SEQ ID NO: 534105 - DNA, 16 bp, Homo sapiens
agccagaactctgtgt

SEQ ID NO: 534106 - DNA, 14 bp, Homo sapiens
agccagctccctga

SEQ ID NO: 534107 - DNA, 21 bp, Homo sapiens
agccagctccctgaatctgac

SEQ ID NO: 534108 - DNA, 18 bp, Homo sapiens
agccagctgcaggaatca

SEQ ID NO: 534109 - DNA, 17 bp, Homo sapiens
agccagtttagagaaat

SEQ ID NO: 534110 - DNA, 14 bp, Homo sapiens
agccataggccctt

SEQ ID NO: 534111 - DNA, 20 bp, Homo sapiens
agccatatattttctgagta

SEQ ID NO: 534112 - DNA, 22 bp, Homo sapiens
agccatgagtgtgggccatcgc

SEQ ID NO: 534113 - DNA, 14 bp, Homo sapiens
agccattctggcac

SEQ ID NO: 534114 - DNA, 17 bp, Homo sapiens
agccattctggcacttt

SEQ ID NO: 534115 - DNA, 19 bp, Homo sapiens
agcccaggagggagcagag

SEQ ID NO: 534116 - DNA, 18 bp, Homo sapiens
agcccaggcatctccttg

SEQ ID NO: 534117 - DNA, 21 bp, Homo sapiens
agcccaggcatctccttgggc

SEQ ID NO: 534118 - DNA, 19 bp, Homo sapiens
agccccagacaacagccca

SEQ ID NO: 534119 - DNA, 19 bp, Homo sapiens
agccccccagtgtccccag

SEQ ID NO: 534120 - DNA, 21 bp, Homo sapiens
agccccctggcccctcccaca

SEQ ID NO: 534121 - DNA, 19 bp, Homo sapiens
agcccggcagtgcaccccc

SEQ ID NO: 534122 - DNA, 24 bp, Homo sapiens
agcccgggagatccgccctgggct

SEQ ID NO: 534123 - DNA, 18 bp, Homo sapiens
agccctaagtaaatctaa

SEQ ID NO: 534124 - DNA, 22 bp, Homo sapiens
agccctaagtaaatctaaatta

SEQ ID NO: 534125 - DNA, 12 bp, Homo sapiens
agcccttcctct

SEQ ID NO: 534126 - DNA, 17 bp, Homo sapiens
agcccttcctctgctcc

SEQ ID NO: 534127 - DNA, 22 bp, Homo sapiens
agcccttcggaggaccagggct

SEQ ID NO: 534128 - DNA, 16 bp, Homo sapiens
agccgaatagctgatg

SEQ ID NO: 534129 - DNA, 19 bp, Homo sapiens
agccgacctgaggacatgg

SEQ ID NO: 534130 - DNA, 13 bp, Homo sapiens
agccgagctctcc

SEQ ID NO: 534131 - DNA, 19 bp, Homo sapiens
agccggagtgacagagtaa

SEQ ID NO: 534132 - DNA, 22 bp, Homo sapiens
agcctactagggacctggggaa

SEQ ID NO: 534133 - DNA, 18 bp, Homo sapiens
agcctatctctcttctgc

SEQ ID NO: 534134 - DNA, 17 bp, Homo sapiens
agcctcaccctgcatag

SEQ ID NO: 534135 - DNA, 11 bp, Homo sapiens
agcctcacctt

SEQ ID NO: 534136 - DNA, 18 bp, Homo sapiens
agcctcagaaagggattg

SEQ ID NO: 534137 - DNA, 23 bp, Homo sapiens
agcctccactttggatcaggaaa

SEQ ID NO: 534138 - DNA, 21 bp, Homo sapiens
agcctcctgctgagtggtcca

SEQ ID NO: 534139 - DNA, 20 bp, Homo sapiens
agcctcgcaggcctccctgc

SEQ ID NO: 534140 - DNA, 22 bp, Homo sapiens
agcctcgcaggcctccctgcca

SEQ ID NO: 534141 - DNA, 23 bp, Homo sapiens
agcctctccaggcaccatctccc

SEQ ID NO: 534142 - DNA, 12 bp, Homo sapiens
agcctctggaag

SEQ ID NO: 534143 - DNA, 13 bp, Homo sapiens
agcctctgggccc

SEQ ID NO: 534144 - DNA, 12 bp, Homo sapiens
agcctctttccc

SEQ ID NO: 534145 - DNA, 15 bp, Homo sapiens
agcctgacagccaga

SEQ ID NO: 534146 - DNA, 16 bp, Homo sapiens
agcctgccccagcgct

SEQ ID NO: 534147 - DNA, 18 bp, Homo sapiens
agcctgccccagcgctga

SEQ ID NO: 534148 - DNA, 23 bp, Homo sapiens
agcctgccttgcccactcctgct

SEQ ID NO: 534149 - DNA, 16 bp, Homo sapiens
agcctgcgtggcctgg

SEQ ID NO: 534150 - DNA, 17 bp, Homo sapiens
agcctgcgtggctgacc

SEQ ID NO: 534151 - DNA, 18 bp, Homo sapiens
agcctgcgtggctgaccc

SEQ ID NO: 534152 - DNA, 19 bp, Homo sapiens
agcctgcgtggctgacccc

SEQ ID NO: 534153 - DNA, 23 bp, Homo sapiens
agcctgcgtggctgacccccctc

SEQ ID NO: 534154 - DNA, 18 bp, Homo sapiens
agcctggaaacctgtctg

SEQ ID NO: 534155 - DNA, 19 bp, Homo sapiens
agcctggaaacctgtctga

SEQ ID NO: 534156 - DNA, 16 bp, Homo sapiens
agccttaagctgcagg

SEQ ID NO: 534157 - DNA, 21 bp, Homo sapiens
agccttaagtcttactgtttt

SEQ ID NO: 534158 - DNA, 13 bp, Homo sapiens
agccttctgagct

SEQ ID NO: 534159 - DNA, 15 bp, Homo sapiens
agcctttaataggct

SEQ ID NO: 534160 - DNA, 14 bp, Homo sapiens
agcgatgtgttctt

SEQ ID NO: 534161 - DNA, 17 bp, Homo sapiens
agcgctatcttcacata

SEQ ID NO: 534162 - DNA, 18 bp, Homo sapiens
agcgctatcttcacatag

SEQ ID NO: 534163 - DNA, 17 bp, Homo sapiens
agcggctcaagcccagg

SEQ ID NO: 534164 - DNA, 18 bp, Homo sapiens
agcggctcaagcccagga

SEQ ID NO: 534165 - DNA, 20 bp, Homo sapiens
agcgtagtgcagcagggcag

SEQ ID NO: 534166 - DNA, 17 bp, Homo sapiens
agcgtggctgtgctctc

SEQ ID NO: 534167 - DNA, 17 bp, Homo sapiens
agcgttgttttgtggat

SEQ ID NO: 534168 - DNA, 18 bp, Homo sapiens
agcgttgttttgtggata

SEQ ID NO: 534169 - DNA, 23 bp, Homo sapiens
agctaaaatcaggaaagaaaagg

SEQ ID NO: 534170 - DNA, 22 bp, Homo sapiens
agctaccacccttaggggtaat

SEQ ID NO: 534171 - DNA, 18 bp, Homo sapiens
acttgatttttcaaagac

SEQ ID NO: 534172 - DNA, 19 bp, Homo sapiens
acttgatttttcaaagact

SEQ ID NO: 534173 - DNA, 14 bp, Homo sapiens
acttgctgctattt

SEQ ID NO: 534174 - DNA, 17 bp, Homo sapiens
acttgctgctattttac

SEQ ID NO: 534175 - DNA, 14 bp, Homo sapiens
acttgctgtgactt

SEQ ID NO: 534176 - DNA, 15 bp, Homo sapiens
acttgcttaaatgtg

SEQ ID NO: 534177 - DNA, 17 bp, Homo sapiens
acttgcttaaatgtgaa

SEQ ID NO: 534178 - DNA, 17 bp, Homo sapiens
acttggaacagtgttta

SEQ ID NO: 534179 - DNA, 15 bp, Homo sapiens
acttggaatttgctt

SEQ ID NO: 534180 - DNA, 16 bp, Homo sapiens
acttggcaccaataaa

SEQ ID NO: 534181 - DNA, 20 bp, Homo sapiens
acttggcaccaataaaggag

SEQ ID NO: 534182 - DNA, 22 bp, Homo sapiens
acttggcaccaataaaggagga

SEQ ID NO: 534183 - DNA, 17 bp, Homo sapiens
acttggggcacagggag

SEQ ID NO: 534184 - DNA, 18 bp, Homo sapiens
acttggtcacagccaggc

SEQ ID NO: 534185 - DNA, 20 bp, Homo sapiens
acttggtgattacctgaaag

SEQ ID NO: 534186 - DNA, 15 bp, Homo sapiens
acttgtcggctccag

SEQ ID NO: 534187 - DNA, 13 bp, Homo sapiens
acttgtctttctg

SEQ ID NO: 534188 - DNA, 18 bp, Homo sapiens
acttgttatgttgtaata

SEQ ID NO: 534189 - DNA, 12 bp, Homo sapiens
acttgttcttcc

SEQ ID NO: 534190 - DNA, 21 bp, Homo sapiens
acttgttcttccaaagcagag

SEQ ID NO: 534191 - DNA, 13 bp, Homo sapiens
acttgtttaataa

SEQ ID NO: 534192 - DNA, 16 bp, Homo sapiens
acttgtttgtgtttga

SEQ ID NO: 534193 - DNA, 23 bp, Homo sapiens
acttgtttttgtttttgttttgt

SEQ ID NO: 534194 - DNA, 15 bp, Homo sapiens
actttaaattgtgga

SEQ ID NO: 534195 - DNA, 11 bp, Homo sapiens
actttaacttc

SEQ ID NO: 534196 - DNA, 17 bp, Homo sapiens
actttaacttccacttt

SEQ ID NO: 534197 - DNA, 21 bp, Homo sapiens
actttaacttccactttgtat

SEQ ID NO: 534198 - DNA, 14 bp, Homo sapiens
actttaatgataaa

SEQ ID NO: 534199 - DNA, 15 bp, Homo sapiens
actttagagtgacta

SEQ ID NO: 534200 - DNA, 17 bp, Homo sapiens
actttagagtgactaaa

SEQ ID NO: 534201 - DNA, 20 bp, Homo sapiens
actttagcagaatcaaaatg

SEQ ID NO: 534202 - DNA, 18 bp, Homo sapiens
actttccaattctccttt

SEQ ID NO: 534203 - DNA, 12 bp, Homo sapiens
actttcccacac

SEQ ID NO: 534204 - DNA, 18 bp, Homo sapiens
actttcccacactgtgaa

SEQ ID NO: 534205 - DNA, 19 bp, Homo sapiens
actttctcagcatatatat

SEQ ID NO: 534206 - DNA, 21 bp, Homo sapiens
actttctgtactaaacatttc

SEQ ID NO: 534207 - DNA, 16 bp, Homo sapiens
actttcttcttcccat

SEQ ID NO: 534208 - DNA, 16 bp, Homo sapiens
actttgaggtgtctca

SEQ ID NO: 534209 - DNA, 13 bp, Homo sapiens
actttgattcaca

SEQ ID NO: 534210 - DNA, 16 bp, Homo sapiens
actttggatcaggaaa

SEQ ID NO: 534211 - DNA, 14 bp, Homo sapiens
actttgtataaatt

SEQ ID NO: 534212 - DNA, 19 bp, Homo sapiens
aggctgagacgcaaggatc

SEQ ID NO: 534213 - DNA, 14 bp, Homo sapiens
aggctgaggcagga

SEQ ID NO: 534214 - DNA, 15 bp, Homo sapiens
ataaacattaaatgt

SEQ ID NO: 534215 - DNA, 21 bp, Homo sapiens
ataaacattaaatgtcttata

SEQ ID NO: 534216 - DNA, 15 bp, Homo sapiens
ataaaccaaaggaca

SEQ ID NO: 534217 - DNA, 14 bp, Homo sapiens
ataaactcagtcaa

SEQ ID NO: 534218 - DNA, 19 bp, Homo sapiens
ataaactcagtcaaatgta

SEQ ID NO: 534219 - DNA, 23 bp, Homo sapiens
ataaagaataggacttgtttttg

SEQ ID NO: 534220 - DNA, 16 bp, Homo sapiens
ataaagcttttgcata

SEQ ID NO: 534221 - DNA, 20 bp, Homo sapiens
ataaagcttttgcatagaat

SEQ ID NO: 534222 - DNA, 17 bp, Homo sapiens
ataaaggaggaatcaga

SEQ ID NO: 534223 - DNA, 19 bp, Homo sapiens
ataaagtatgaatatttca

SEQ ID NO: 534224 - DNA, 18 bp, Homo sapiens
atatacctataatgtgtg

SEQ ID NO: 534225 - DNA, 21 bp, Homo sapiens
atatacctataatgtgtgtat

SEQ ID NO: 534226 - DNA, 14 bp, Homo sapiens
atatactccttaaa

SEQ ID NO: 534227 - DNA, 19 bp, Homo sapiens
atatagcagcaaaaatata

SEQ ID NO: 534228 - DNA, 21 bp, Homo sapiens
atatagcgttcccaacaacat

SEQ ID NO: 534229 - DNA, 15 bp, Homo sapiens
atatataaaaatata

SEQ ID NO: 534230 - DNA, 14 bp, Homo sapiens
atatatacatacgc

SEQ ID NO: 534231 - DNA, 22 bp, Homo sapiens
atatatacatacgcaattgtat

SEQ ID NO: 534232 - DNA, 13 bp, Homo sapiens
atatatacatatg

SEQ ID NO: 534233 - DNA, 16 bp, Homo sapiens
atatatagcatttatg

SEQ ID NO: 534234 - DNA, 15 bp, Homo sapiens
atatatagtgctata

SEQ ID NO: 534235 - DNA, 16 bp, Homo sapiens
atatatagtgctatat

SEQ ID NO: 534236 - DNA, 16 bp, Homo sapiens
atatatataaaataca

SEQ ID NO: 534237 - DNA, 16 bp, Homo sapiens
atatatatacatatgt

SEQ ID NO: 534238 - DNA, 13 bp, Homo sapiens
atatatatgtata

SEQ ID NO: 534239 - DNA, 12 bp, Homo sapiens
atatatatgtga

SEQ ID NO: 534240 - DNA, 12 bp, Homo sapiens
atatatctgaaa

SEQ ID NO: 534241 - DNA, 19 bp, Homo sapiens
atatatgaaaactaagttc

SEQ ID NO: 534242 - DNA, 19 bp, Homo sapiens
acgagtagaggtttaaaga

SEQ ID NO: 534243 - DNA, 14 bp, Homo sapiens
acgatttaatttat

SEQ ID NO: 534244 - DNA, 22 bp, Homo sapiens
acgcaattgtatatatatgtga

SEQ ID NO: 534245 - DNA, 14 bp, Homo sapiens
acgcacgcacacac

SEQ ID NO: 534246 - DNA, 15 bp, Homo sapiens
acgcacgcacacaca

SEQ ID NO: 534247 - DNA, 16 bp, Homo sapiens
acgcacgcacacacac

SEQ ID NO: 534248 - DNA, 20 bp, Homo sapiens
acgcacgtgggtcttcaggg

SEQ ID NO: 534249 - DNA, 12 bp, Homo sapiens
acgcagacacac

SEQ ID NO: 534250 - DNA, 15 bp, Homo sapiens
acgccacatccccca

SEQ ID NO: 534251 - DNA, 18 bp, Homo sapiens
acgccagggaccccagaa

SEQ ID NO: 534252 - DNA, 22 bp, Homo sapiens
acgcctgcttttgcaaataact

SEQ ID NO: 534253 - DNA, 20 bp, Homo sapiens
acggaagccccctcttcctc

SEQ ID NO: 534254 - DNA, 10 bp, Homo sapiens
acggaggctc

SEQ ID NO: 534255 - DNA, 13 bp, Homo sapiens
acggccccagctt

SEQ ID NO: 534256 - DNA, 18 bp, Homo sapiens
acgtactatggaagccac

SEQ ID NO: 534257 - DNA, 22 bp, Homo sapiens
acgtactatggaagccacatca

SEQ ID NO: 534258 - DNA, 20 bp, Homo sapiens
acgtagtcggcacagcctgg

SEQ ID NO: 534259 - DNA, 13 bp, Homo sapiens
acgtctttttaag

SEQ ID NO: 534260 - DNA, 22 bp, Homo sapiens
acgtctttttaagcctttgaag

SEQ ID NO: 534261 - DNA, 15 bp, Homo sapiens
acgtgggcggcagag

SEQ ID NO: 534262 - DNA, 23 bp, Homo sapiens
acgtgtatatgaggatgtatgtg

SEQ ID NO: 534263 - DNA, 19 bp, Homo sapiens
acgtgtatgtttttcagtt

SEQ ID NO: 534264 - DNA, 16 bp, Homo sapiens
acgttcacccctccac

SEQ ID NO: 534265 - DNA, 16 bp, Homo sapiens
acgttgatgtctgaac

SEQ ID NO: 534266 - DNA, 18 bp, Homo sapiens
acgtttcttctttctaga

SEQ ID NO: 534267 - DNA, 11 bp, Homo sapiens
actaaatgtta

SEQ ID NO: 534268 - DNA, 15 bp, Homo sapiens
actaaatgttaaaga

SEQ ID NO: 534269 - DNA, 18 bp, Homo sapiens
actaaatgttaaagatgt

SEQ ID NO: 534270 - DNA, 15 bp, Homo sapiens
actaacagtaactgc

SEQ ID NO: 534271 - DNA, 16 bp, Homo sapiens
actaacttctaaaact

SEQ ID NO: 534272 - DNA, 18 bp, Homo sapiens
actaacttctaaaactgt

SEQ ID NO: 534273 - DNA, 19 bp, Homo sapiens
actaacttctaaaactgta

SEQ ID NO: 534274 - DNA, 17 bp, Homo sapiens
actaagatcggttaaca

SEQ ID NO: 534275 - DNA, 19 bp, Homo sapiens
actaagatcggttaacaaa

SEQ ID NO: 534276 - DNA, 16 bp, Homo sapiens
actaataaatggacta

SEQ ID NO: 534277 - DNA, 15 bp, Homo sapiens
actaattaaactgat

SEQ ID NO: 534278 - DNA, 16 bp, Homo sapiens
actacatctgatatca

SEQ ID NO: 534279 - DNA, 16 bp, Homo sapiens
actactcctagactga

SEQ ID NO: 534280 - DNA, 19 bp, Homo sapiens
actactgaataaatcatgt

SEQ ID NO: 534281 - DNA, 19 bp, Homo sapiens
actactgaccagacaagct

SEQ ID NO: 534282 - DNA, 14 bp, Homo sapiens
actagggacctggg

SEQ ID NO: 534283 - DNA, 14 bp, Homo sapiens
actatatacatgtg

SEQ ID NO: 534284 - DNA, 15 bp, Homo sapiens
actatatacatgtgt

SEQ ID NO: 534285 - DNA, 16 bp, Homo sapiens
actatatacatgtgtg

SEQ ID NO: 534286 - DNA, 19 bp, Homo sapiens
actatatgtttacacaatt

SEQ ID NO: 534287 - DNA, 23 bp, Homo sapiens
actatcagcagcggcagcagcag

SEQ ID NO: 534288 - DNA, 15 bp, Homo sapiens
actatccattttaca

SEQ ID NO: 534289 - DNA, 13 bp, Homo sapiens
actatcttcatct

SEQ ID NO: 534290 - DNA, 21 bp, Homo sapiens
acattgttgctccctgtgaca

SEQ ID NO: 534291 - DNA, 14 bp, Homo sapiens
acatttatgtgtga

SEQ ID NO: 534292 - DNA, 16 bp, Homo sapiens
acatttcaatcactga

SEQ ID NO: 534293 - DNA, 16 bp, Homo sapiens
acatttcactgtctgt

SEQ ID NO: 534294 - DNA, 14 bp, Homo sapiens
acatttcatgtatt

SEQ ID NO: 534295 - DNA, 20 bp, Homo sapiens
acatttcatgtatttcttta

SEQ ID NO: 534296 - DNA, 22 bp, Homo sapiens
acatttcatgtatttctttaga

SEQ ID NO: 534297 - DNA, 23 bp, Homo sapiens
acatttcatgtatttctttagaa

SEQ ID NO: 534298 - DNA, 17 bp, Homo sapiens
acatttcctttttctat

SEQ ID NO: 534299 - DNA, 19 bp, Homo sapiens
acatttcctttttctattt

SEQ ID NO: 534300 - DNA, 22 bp, Homo sapiens
acatttcctttttctattttac

SEQ ID NO: 534301 - DNA, 20 bp, Homo sapiens
acatttctaactctgatgta

SEQ ID NO: 534302 - DNA, 18 bp, Homo sapiens
acatttgtcattttcatt

SEQ ID NO: 534303 - DNA, 23 bp, Homo sapiens
acatttgtcattttcattagcaa

SEQ ID NO: 534304 - DNA, 21 bp, Homo sapiens
acattttgcagctatggacaa

SEQ ID NO: 534305 - DNA, 13 bp, Homo sapiens
acatttttttaag

SEQ ID NO: 534306 - DNA, 20 bp, Homo sapiens
accaaaggacattatgtgtg

SEQ ID NO: 534307 - DNA, 13 bp, Homo sapiens
accaaatggtaca

SEQ ID NO: 534308 - DNA, 15 bp, Homo sapiens
accaaatggtacaaa

SEQ ID NO: 534309 - DNA, 12 bp, Homo sapiens
accaactttcaa

SEQ ID NO: 534310 - DNA, 23 bp, Homo sapiens
accaagacttttgtctgatcaag

SEQ ID NO: 534311 - DNA, 21 bp, Homo sapiens
accaaggaacaagacccccag

SEQ ID NO: 534312 - DNA, 23 bp, Homo sapiens
accaatcgggagtagcaaggaag

SEQ ID NO: 534313 - DNA, 16 bp, Homo sapiens
accaatttcttccttc

SEQ ID NO: 534314 - DNA, 15 bp, Homo sapiens
accaatttgttctgt

SEQ ID NO: 534315 - DNA, 17 bp, Homo sapiens
accaatttgttctgtgc

SEQ ID NO: 534316 - DNA, 14 bp, Homo sapiens
accacacatttcac

SEQ ID NO: 534317 - DNA, 13 bp, Homo sapiens
accacactgagtt

SEQ ID NO: 534318 - DNA, 12 bp, Homo sapiens
accacagacaca

SEQ ID NO: 534319 - DNA, 13 bp, Homo sapiens
accacagacacac

SEQ ID NO: 534320 - DNA, 15 bp, Homo sapiens
accacagacacacac

SEQ ID NO: 534321 - DNA, 12 bp, Homo sapiens
accacagacact

SEQ ID NO: 534322 - DNA, 17 bp, Homo sapiens
accacaggatgcatatt

SEQ ID NO: 534323 - DNA, 22 bp, Homo sapiens
accacagtgtaccattaaaata

SEQ ID NO: 534324 - DNA, 23 bp, Homo sapiens
accaccctatcatcagttaggat

SEQ ID NO: 534325 - DNA, 12 bp, Homo sapiens
accaccctcctt

SEQ ID NO: 534326 - DNA, 14 bp, Homo sapiens
accaccctccttcc

SEQ ID NO: 534327 - DNA, 14 bp, Homo sapiens
accaccctgctcat

SEQ ID NO: 534328 - DNA, 17 bp, Homo sapiens
accaccgaccaactcca

SEQ ID NO: 534329 - DNA, 20 bp, Homo sapiens
accacctgcccggcccagga

SEQ ID NO: 534330 - DNA, 23 bp, Homo sapiens
accacctgcccggcccaggagcg

SEQ ID NO: 534331 - DNA, 20 bp, Homo sapiens
accacgttgggacagggagg

SEQ ID NO: 534332 - DNA, 12 bp, Homo sapiens
accactccattc

SEQ ID NO: 534333 - DNA, 13 bp, Homo sapiens
accagacacaaac

SEQ ID NO: 534334 - DNA, 14 bp, Homo sapiens
accagatgtgacag

SEQ ID NO: 534335 - DNA, 19 bp, Homo sapiens
accagccccaatccaaaac

SEQ ID NO: 534336 - DNA, 16 bp, Homo sapiens
accagccccaccctgt

SEQ ID NO: 534337 - DNA, 21 bp, Homo sapiens
accaggactctgccttccagg

SEQ ID NO: 534338 - DNA, 22 bp, Homo sapiens
accaggactctgccttccaggc

SEQ ID NO: 534339 - DNA, 23 bp, Homo sapiens
accaggcacctcccctcccgccc

SEQ ID NO: 534340 - DNA, 22 bp, Homo sapiens
accagggccagaagtagctttg

SEQ ID NO: 534341 - DNA, 14 bp, Homo sapiens
accagtagtgacca

SEQ ID NO: 534342 - DNA, 15 bp, Homo sapiens
accatagcttaagaa

SEQ ID NO: 534343 - DNA, 19 bp, Homo sapiens
accatagcttaagaagtat

SEQ ID NO: 534344 - DNA, 18 bp, Homo sapiens
accatccaccttcccttc

SEQ ID NO: 534345 - DNA, 16 bp, Homo sapiens
accatcggtcagcagg

SEQ ID NO: 534346 - DNA, 23 bp, Homo sapiens
accatgttcttgagcagctgaat

SEQ ID NO: 534347 - DNA, 19 bp, Homo sapiens
accattaaaatatgcacta

SEQ ID NO: 534348 - DNA, 15 bp, Homo sapiens
accattatggctttg

SEQ ID NO: 534349 - DNA, 19 bp, Homo sapiens
accattatggctttgtgct

SEQ ID NO: 534350 - DNA, 20 bp, Homo sapiens
accattggaaatttcacgtc

SEQ ID NO: 534351 - DNA, 19 bp, Homo sapiens
accatttagtcctcacctt

SEQ ID NO: 534352 - DNA, 14 bp, Homo sapiens
accattttcctgca

SEQ ID NO: 534353 - DNA, 13 bp, Homo sapiens
acccaaagcagtg

SEQ ID NO: 534354 - DNA, 15 bp, Homo sapiens
acccaagcaggaggc

SEQ ID NO: 534355 - DNA, 19 bp, Homo sapiens
acccacaccctacagcaga

SEQ ID NO: 534356 - DNA, 16 bp, Homo sapiens
accccatccagccagg

SEQ ID NO: 534357 - DNA, 14 bp, Homo sapiens
accccatctgctga

SEQ ID NO: 534358 - DNA, 20 bp, Homo sapiens
acccccaggaaggaaacaga

SEQ ID NO: 534359 - DNA, 21 bp, Homo sapiens
acccccagtgctcacacaatc

SEQ ID NO: 534360 - DNA, 22 bp, Homo sapiens
acccccccagcttcacttctga

SEQ ID NO: 534361 - DNA, 14 bp, Homo sapiens
acccccgggtgcct

SEQ ID NO: 534362 - DNA, 20 bp, Homo sapiens
acccctcccggccctgcctg

SEQ ID NO: 534363 - DNA, 15 bp, Homo sapiens
acccggcagcccccc

SEQ ID NO: 534364 - DNA, 20 bp, Homo sapiens
acccggcatgccgagtgccc

SEQ ID NO: 534365 - DNA, 16 bp, Homo sapiens
acccggcttcctgtgc

SEQ ID NO: 534366 - DNA, 14 bp, Homo sapiens
accctacagcagat

SEQ ID NO: 534367 - DNA, 14 bp, Homo sapiens
accctatcatcagt

SEQ ID NO: 534368 - DNA, 15 bp, Homo sapiens
accctatgccttttg

SEQ ID NO: 534369 - DNA, 19 bp, Homo sapiens
accctattctatccatctc

SEQ ID NO: 534370 - DNA, 19 bp, Homo sapiens
accctccccttcccagggc

SEQ ID NO: 534371 - DNA, 20 bp, Homo sapiens
accctccccttcccagggca

SEQ ID NO: 534372 - DNA, 13 bp, Homo sapiens
accctccttccca

SEQ ID NO: 534373 - DNA, 15 bp, Homo sapiens
accctccttcccact

SEQ ID NO: 534374 - DNA, 22 bp, Homo sapiens
accctcgctggcccccactggc

SEQ ID NO: 534375 - DNA, 12 bp, Homo sapiens
accctgaaatgt

SEQ ID NO: 534376 - DNA, 14 bp, Homo sapiens
accctgaaatgtgt

SEQ ID NO: 534377 - DNA, 13 bp, Homo sapiens
accctgaatcaga

SEQ ID NO: 534378 - DNA, 20 bp, Homo sapiens
accctgaatcagaggcagag

SEQ ID NO: 534379 - DNA, 18 bp, Homo sapiens
accctgctcatccactct

SEQ ID NO: 534380 - DNA, 17 bp, Homo sapiens
accctggacagtgccta

SEQ ID NO: 534381 - DNA, 20 bp, Homo sapiens
accctgtgcagaagggagct

SEQ ID NO: 534382 - DNA, 13 bp, Homo sapiens
acccttctttcca

SEQ ID NO: 534383 - DNA, 23 bp, Homo sapiens
accctttaaatggggacgcagat

SEQ ID NO: 534384 - DNA, 15 bp, Homo sapiens
accgaccaactccag

SEQ ID NO: 534385 - DNA, 19 bp, Homo sapiens
accgagcaaagatcaaaat

SEQ ID NO: 534386 - DNA, 18 bp, Homo sapiens
accgaggacccatgaaac

SEQ ID NO: 534387 - DNA, 19 bp, Homo sapiens
accgagtgtggagctgctt

SEQ ID NO: 534388 - DNA, 21 bp, Homo sapiens
accgagtgtggagctgcttcc

SEQ ID NO: 534389 - DNA, 22 bp, Homo sapiens
accgagtgtggagctgcttcca

SEQ ID NO: 534390 - DNA, 17 bp, Homo sapiens
accggcaatttccggcc

SEQ ID NO: 534391 - DNA, 22 bp, Homo sapiens
accgtttagtcatatctatcta

SEQ ID NO: 534392 - DNA, 19 bp, Homo sapiens
acctaagagccacaataag

SEQ ID NO: 534393 - DNA, 19 bp, Homo sapiens
acctaattagagcagatga

SEQ ID NO: 534394 - DNA, 14 bp, Homo sapiens
acctactgttcctt

SEQ ID NO: 534395 - DNA, 13 bp, Homo sapiens
acctagcaattcc

SEQ ID NO: 534396 - DNA, 16 bp, Homo sapiens
acctataatgtgtgta

SEQ ID NO: 534397 - DNA, 12 bp, Homo sapiens
acctccccctcc

SEQ ID NO: 534398 - DNA, 17 bp, Homo sapiens
acctcccctggtcctgc

SEQ ID NO: 534399 - DNA, 13 bp, Homo sapiens
acctctaactgtg

SEQ ID NO: 534400 - DNA, 13 bp, Homo sapiens
acctctgtaattt

SEQ ID NO: 534401 - DNA, 23 bp, Homo sapiens
acctctgtaatttttcagctctc

SEQ ID NO: 534402 - DNA, 12 bp, Homo sapiens
acctcttagaaa

SEQ ID NO: 534403 - DNA, 12 bp, Homo sapiens
acctcttgtttt

SEQ ID NO: 534404 - DNA, 17 bp, Homo sapiens
acctctttcggaaatga

SEQ ID NO: 534405 - DNA, 13 bp, Homo sapiens
acctgaaagccct

SEQ ID NO: 534406 - DNA, 14 bp, Homo sapiens
acctgaaagccctt

SEQ ID NO: 534407 - DNA, 16 bp, Homo sapiens
acctgaaagcccttct

SEQ ID NO: 534408 - DNA, 21 bp, Homo sapiens
acctgaggacatggcttctga

SEQ ID NO: 534409 - DNA, 19 bp, Homo sapiens
acctgcacaaacatagaca

SEQ ID NO: 534410 - DNA, 13 bp, Homo sapiens
acctgcagctccc

SEQ ID NO: 534411 - DNA, 13 bp, Homo sapiens
acctgcaggactc

SEQ ID NO: 534412 - DNA, 14 bp, Homo sapiens
acctgcttctctgc

SEQ ID NO: 534413 - DNA, 21 bp, Homo sapiens
acctgcttctctgcccagctt

SEQ ID NO: 534414 - DNA, 15 bp, Homo sapiens
acctggccctggggc

SEQ ID NO: 534415 - DNA, 15 bp, Homo sapiens
acctgggagatgctg

SEQ ID NO: 534416 - DNA, 23 bp, Homo sapiens
acctgggtccccagcccttcctc

SEQ ID NO: 534417 - DNA, 17 bp, Homo sapiens
acctgtcttttgggagt

SEQ ID NO: 534418 - DNA, 17 bp, Homo sapiens
acctgttaaaattatac

SEQ ID NO: 534419 - DNA, 12 bp, Homo sapiens
accttaaaattt

SEQ ID NO: 534420 - DNA, 13 bp, Homo sapiens
accttaaaatttg

SEQ ID NO: 534421 - DNA, 20 bp, Homo sapiens
accttaaaatttgaaacatt

SEQ ID NO: 534422 - DNA, 18 bp, Homo sapiens
accttcactctaagatgt

SEQ ID NO: 534423 - DNA, 21 bp, Homo sapiens
accttcactctaagatgttat

SEQ ID NO: 534424 - DNA, 17 bp, Homo sapiens
accttcccttctacaag

SEQ ID NO: 534425 - DNA, 17 bp, Homo sapiens
accttctgtcgtcccca

SEQ ID NO: 534426 - DNA, 19 bp, Homo sapiens
accttctgtcgtccccaga

SEQ ID NO: 534427 - DNA, 22 bp, Homo sapiens
accttgcacacatcatctgtaa

SEQ ID NO: 534428 - DNA, 14 bp, Homo sapiens
accttgtaatgtaa

SEQ ID NO: 534429 - DNA, 17 bp, Homo sapiens
accttgtaatgtaactg

SEQ ID NO: 534430 - DNA, 17 bp, Homo sapiens
acctttgggttctttct

SEQ ID NO: 534431 - DNA, 18 bp, Homo sapiens
acgaggccaagctgagga

SEQ ID NO: 534432 - DNA, 17 bp, Homo sapiens
tttactaccaatgccaa

SEQ ID NO: 534433 - DNA, 22 bp, Homo sapiens
tttagcctgtgtcattgcccca

SEQ ID NO: 534434 - DNA, 16 bp, Homo sapiens
tttaggattgaagtgg

SEQ ID NO: 534435 - DNA, 22 bp, Homo sapiens
tttagtggaccctgaaatgtgt

SEQ ID NO: 534436 - DNA, 17 bp, Homo sapiens
tttagtggatggaatat

SEQ ID NO: 534437 - DNA, 19 bp, Homo sapiens
tttagttttattttctaaa

SEQ ID NO: 534438 - DNA, 19 bp, Homo sapiens
tttataaaaaaaatgaaat

SEQ ID NO: 534439 - DNA, 20 bp, Homo sapiens
tttataaaaaaaatgaaatg

SEQ ID NO: 534440 - DNA, 22 bp, Homo sapiens
tttataaaattagaaagcaact

SEQ ID NO: 534441 - DNA, 19 bp, Homo sapiens
tttatacctgtacacacac

SEQ ID NO: 534442 - DNA, 20 bp, Homo sapiens
tttatacctgtacacacaca

SEQ ID NO: 534443 - DNA, 14 bp, Homo sapiens
tttatatcttggca

SEQ ID NO: 534444 - DNA, 19 bp, Homo sapiens
tttatatgattaaattatc

SEQ ID NO: 534445 - DNA, 21 bp, Homo sapiens
tttatcgccctggcaggcagg

SEQ ID NO: 534446 - DNA, 15 bp, Homo sapiens
tttatctagatgtaa

SEQ ID NO: 534447 - DNA, 20 bp, Homo sapiens
tttatctagatgtaaatttt

SEQ ID NO: 534448 - DNA, 14 bp, Homo sapiens
tttatctttataca

SEQ ID NO: 534449 - DNA, 14 bp, Homo sapiens
tttatgaagcagat

SEQ ID NO: 534450 - DNA, 22 bp, Homo sapiens
tttatgcgcaaatacaaaatga

SEQ ID NO: 534451 - DNA, 15 bp, Homo sapiens
tttatgtgatgtaac

SEQ ID NO: 534452 - DNA, 13 bp, Homo sapiens
tttatgttgacat

SEQ ID NO: 534453 - DNA, 19 bp, Homo sapiens
tttatgtttaaaatggcat

SEQ ID NO: 534454 - DNA, 18 bp, Homo sapiens
tttattaccagattcact

SEQ ID NO: 534455 - DNA, 18 bp, Homo sapiens
tttattcattagctgtga

SEQ ID NO: 534456 - DNA, 21 bp, Homo sapiens
tttattctgtcaatgaaaagc

SEQ ID NO: 534457 - DNA, 17 bp, Homo sapiens
tttattgcacaaaatat

SEQ ID NO: 534458 - DNA, 21 bp, Homo sapiens
tttattgcacaaaatataaag

SEQ ID NO: 534459 - DNA, 14 bp, Homo sapiens
tttattgctacttc

SEQ ID NO: 534460 - DNA, 12 bp, Homo sapiens
tttatttctatc

SEQ ID NO: 534461 - DNA, 13 bp, Homo sapiens
tttatttctcctt

SEQ ID NO: 534462 - DNA, 13 bp, Homo sapiens
tttattttttggt

SEQ ID NO: 534463 - DNA, 12 bp, Homo sapiens
tttcaaaagaca

SEQ ID NO: 534464 - DNA, 13 bp, Homo sapiens
tttcaaaagacat

SEQ ID NO: 534465 - DNA, 20 bp, Homo sapiens
tttcaaagacttcatttaac

SEQ ID NO: 534466 - DNA, 21 bp, Homo sapiens
tttcaagaaaaaataaatgga

SEQ ID NO: 534467 - DNA, 22 bp, Homo sapiens
tttcaagaaaaaataaatggaa

SEQ ID NO: 534468 - DNA, 14 bp, Homo sapiens
tttcaagcttattt

SEQ ID NO: 534469 - DNA, 14 bp, Homo sapiens
tttcaataaagttt

SEQ ID NO: 534470 - DNA, 13 bp, Homo sapiens
tttcaatctcgta

SEQ ID NO: 534471 - DNA, 19 bp, Homo sapiens
tttcaatctcgtatagaag

SEQ ID NO: 534472 - DNA, 17 bp, Homo sapiens
tttcacaaatattaaaa

SEQ ID NO: 534473 - DNA, 13 bp, Homo sapiens
tttcactgtctgt

SEQ ID NO: 534474 - DNA, 16 bp, Homo sapiens
tttcacttctttccct

SEQ ID NO: 534475 - DNA, 16 bp, Homo sapiens
tttcagctctctgtat

SEQ ID NO: 534476 - DNA, 16 bp, Homo sapiens
tttcagtaagatcaag

SEQ ID NO: 534477 - DNA, 20 bp, Homo sapiens
tttcagttattgtccctggc

SEQ ID NO: 534478 - DNA, 17 bp, Homo sapiens
tttcagttcaaagtcat

SEQ ID NO: 534479 - DNA, 20 bp, Homo sapiens
tttcatagataccattttga

SEQ ID NO: 534480 - DNA, 14 bp, Homo sapiens
tttcatccttccca

SEQ ID NO: 534481 - DNA, 20 bp, Homo sapiens
tttcatgaggggaaagggag

SEQ ID NO: 534482 - DNA, 19 bp, Homo sapiens
tttcatgtgtgtgagtttg

SEQ ID NO: 534483 - DNA, 16 bp, Homo sapiens
tttcattacaatggaa

SEQ ID NO: 534484 - DNA, 14 bp, Homo sapiens
tttcattagcaaaa

SEQ ID NO: 534485 - DNA, 12 bp, Homo sapiens
tttcattgtgtt

SEQ ID NO: 534486 - DNA, 19 bp, Homo sapiens
tttcatttctaacataagt

SEQ ID NO: 534487 - DNA, 16 bp, Homo sapiens
tttcattttgagaaca

SEQ ID NO: 534488 - DNA, 18 bp, Homo sapiens
tttccaacaccacagaca

SEQ ID NO: 534489 - DNA, 15 bp, Homo sapiens
tttccaattctcctt

SEQ ID NO: 534490 - DNA, 13 bp, Homo sapiens
tttccacacaggc

SEQ ID NO: 534491 - DNA, 12 bp, Homo sapiens
tttccagagcat

SEQ ID NO: 534492 - DNA, 17 bp, Homo sapiens
tttccagagcattccag

SEQ ID NO: 534493 - DNA, 19 bp, Homo sapiens
tttccagagcattccagtc

SEQ ID NO: 534494 - DNA, 15 bp, Homo sapiens
tttccagtattttag

SEQ ID NO: 534495 - DNA, 16 bp, Homo sapiens
tttccagtattttagt

SEQ ID NO: 534496 - DNA, 16 bp, Homo sapiens
tttcccacactgtgaa

SEQ ID NO: 534497 - DNA, 18 bp, Homo sapiens
tttccccctttcttcctc

SEQ ID NO: 534498 - DNA, 13 bp, Homo sapiens
tttcccttccagt

SEQ ID NO: 534499 - DNA, 23 bp, Homo sapiens
tttccgtttgatttgtcactgct

SEQ ID NO: 534500 - DNA, 18 bp, Homo sapiens
tttcctaacaggattaga

SEQ ID NO: 534501 - DNA, 14 bp, Homo sapiens
tttcctaaggcatg

SEQ ID NO: 534502 - DNA, 14 bp, Homo sapiens
tttcctcctgggca

SEQ ID NO: 534503 - DNA, 19 bp, Homo sapiens
tttccttgcatacaaacaa

SEQ ID NO: 534504 - DNA, 20 bp, Homo sapiens
tttctaaaagaatattcaga

SEQ ID NO: 534505 - DNA, 14 bp, Homo sapiens
tttctaaagtactg

SEQ ID NO: 534506 - DNA, 16 bp, Homo sapiens
tttctaactctgatgt

SEQ ID NO: 534507 - DNA, 21 bp, Homo sapiens
tttctagaaatgtttaggtta

SEQ ID NO: 534508 - DNA, 13 bp, Homo sapiens
tttctcaatgtct

SEQ ID NO: 534509 - DNA, 19 bp, Homo sapiens
tttctctctatttccccct

SEQ ID NO: 534510 - DNA, 13 bp, Homo sapiens
tttctcttctccc

SEQ ID NO: 534511 - DNA, 16 bp, Homo sapiens
tttctcttctcccctt

SEQ ID NO: 534512 - DNA, 12 bp, Homo sapiens
tttctctttcaa

SEQ ID NO: 534513 - DNA, 13 bp, Homo sapiens
tttctctttcaaa

SEQ ID NO: 534514 - DNA, 19 bp, Homo sapiens
tttctgaaactaatgaaag

SEQ ID NO: 534515 - DNA, 14 bp, Homo sapiens
tttctgaacaaaga

SEQ ID NO: 534516 - DNA, 15 bp, Homo sapiens
tttctgagaaaagaa

SEQ ID NO: 534517 - DNA, 16 bp, Homo sapiens
tttctgccttttgttc

SEQ ID NO: 534518 - DNA, 14 bp, Homo sapiens
tttctggcaaatat

SEQ ID NO: 534519 - DNA, 21 bp, Homo sapiens
tttctggggggatatttccta

SEQ ID NO: 534520 - DNA, 16 bp, Homo sapiens
tttctggggtttttct

SEQ ID NO: 534521 - DNA, 11 bp, Homo sapiens
tttctgggtct

SEQ ID NO: 534522 - DNA, 14 bp, Homo sapiens
tttctgtatagaca

SEQ ID NO: 534523 - DNA, 20 bp, Homo sapiens
tttcttaatatatagcattt

SEQ ID NO: 534524 - DNA, 14 bp, Homo sapiens
tttcttcctttcta

SEQ ID NO: 534525 - DNA, 17 bp, Homo sapiens
tttcttctctctgtgct

SEQ ID NO: 534526 - DNA, 11 bp, Homo sapiens
tttctttacag

SEQ ID NO: 534527 - DNA, 24 bp, Homo sapiens
tttctttagaacaacataaaatta

SEQ ID NO: 534528 - DNA, 17 bp, Homo sapiens
tttcttttttaattgaa

SEQ ID NO: 534529 - DNA, 18 bp, Homo sapiens
tttgaaaagaccaagact

SEQ ID NO: 534530 - DNA, 13 bp, Homo sapiens
tttgaaatatatg

SEQ ID NO: 534531 - DNA, 23 bp, Homo sapiens
tttgaattttcattttacagtta

SEQ ID NO: 534532 - DNA, 12 bp, Homo sapiens
tttgattcacat

SEQ ID NO: 534533 - DNA, 18 bp, Homo sapiens
tttgattcacatgttttc

SEQ ID NO: 534534 - DNA, 20 bp, Homo sapiens
tttgattcacatgttttcaa

SEQ ID NO: 534535 - DNA, 22 bp, Homo sapiens
tttgattcacatgttttcaaat

SEQ ID NO: 534536 - DNA, 18 bp, Homo sapiens
tttgatttccaagtaata

SEQ ID NO: 534537 - DNA, 13 bp, Homo sapiens
tttgatttctaag

SEQ ID NO: 534538 - DNA, 14 bp, Homo sapiens
tttgatttgtcact

SEQ ID NO: 534539 - DNA, 21 bp, Homo sapiens
tttgcagctatggacaattta

SEQ ID NO: 534540 - DNA, 16 bp, Homo sapiens
tttgcatgtcgcacaa

SEQ ID NO: 534541 - DNA, 18 bp, Homo sapiens
tttgcatgtcgcacaatg

SEQ ID NO: 534542 - DNA, 13 bp, Homo sapiens
tttgccctttact

SEQ ID NO: 534543 - DNA, 20 bp, Homo sapiens
tttgctggttgtaaatactt

SEQ ID NO: 534544 - DNA, 17 bp, Homo sapiens
tttggaacaaatgcttt

SEQ ID NO: 534545 - DNA, 16 bp, Homo sapiens
tttggacgtgtgagga

SEQ ID NO: 534546 - DNA, 21 bp, Homo sapiens
tttggccactgtatttgttaa

SEQ ID NO: 534547 - DNA, 22 bp, Homo sapiens
tttggcctgatgaccaatttta

SEQ ID NO: 534548 - DNA, 15 bp, Homo sapiens
tttggctcctgccca

SEQ ID NO: 534549 - DNA, 20 bp, Homo sapiens
tttggtcagttgggttttta

SEQ ID NO: 534550 - DNA, 19 bp, Homo sapiens
tttggtccacttttccagt

SEQ ID NO: 534551 - DNA, 18 bp, Homo sapiens
tttggttatagtgcaata

SEQ ID NO: 534552 - DNA, 16 bp, Homo sapiens
tttggtttggttttta

SEQ ID NO: 534553 - DNA, 16 bp, Homo sapiens
tttgtaaaacagtggt

SEQ ID NO: 534554 - DNA, 14 bp, Homo sapiens
tttgtaccatttca

SEQ ID NO: 534555 - DNA, 20 bp, Homo sapiens
tttgtataaatttttaagtg

SEQ ID NO: 534556 - DNA, 14 bp, Homo sapiens
tttgtcactgctgt

SEQ ID NO: 534557 - DNA, 22 bp, Homo sapiens
tttgtccttggggacatctcat

SEQ ID NO: 534558 - DNA, 16 bp, Homo sapiens
tttgtcctttatgtat

SEQ ID NO: 534559 - DNA, 16 bp, Homo sapiens
tttgtctaagaaacat

SEQ ID NO: 534560 - DNA, 19 bp, Homo sapiens
tttgtctgccccaagtttt

SEQ ID NO: 534561 - DNA, 20 bp, Homo sapiens
tttgtgaaatttttcatatt

SEQ ID NO: 534562 - DNA, 15 bp, Homo sapiens
tttgtgagtttgttt

SEQ ID NO: 534563 - DNA, 20 bp, Homo sapiens
tttgtgcatcagaaaatgca

SEQ ID NO: 534564 - DNA, 16 bp, Homo sapiens
tttgtgcttgttcttc

SEQ ID NO: 534565 - DNA, 18 bp, Homo sapiens
tttgtgcttgttcttcct

SEQ ID NO: 534566 - DNA, 13 bp, Homo sapiens
tttgtgtaactga

SEQ ID NO: 534567 - DNA, 18 bp, Homo sapiens
tttgtgtgctaaacgtgt

SEQ ID NO: 534568 - DNA, 16 bp, Homo sapiens
tttgtgttattcgtga

SEQ ID NO: 534569 - DNA, 21 bp, Homo sapiens
tttgttaatttatctgttgtc

SEQ ID NO: 534570 - DNA, 13 bp, Homo sapiens
tttgttaatttct

SEQ ID NO: 534571 - DNA, 20 bp, Homo sapiens
tttgttaatttggaccattt

SEQ ID NO: 534572 - DNA, 14 bp, Homo sapiens
tttgttcttaaaaa

SEQ ID NO: 534573 - DNA, 16 bp, Homo sapiens
tttgttgattctctcc

SEQ ID NO: 534574 - DNA, 17 bp, Homo sapiens
tttgttgcactgaagtt

SEQ ID NO: 534575 - DNA, 21 bp, Homo sapiens
tttgtttctgttgttcacttg

SEQ ID NO: 534576 - DNA, 17 bp, Homo sapiens
tttgtttcttacgcttg

SEQ ID NO: 534577 - DNA, 22 bp, Homo sapiens
tttgtttggttatagtgcaata

SEQ ID NO: 534578 - DNA, 11 bp, Homo sapiens
tttgttttgtt

SEQ ID NO: 534579 - DNA, 14 bp, Homo sapiens
tttgttttgttgca

SEQ ID NO: 534580 - DNA, 16 bp, Homo sapiens
tttgttttttgaagtg

SEQ ID NO: 534581 - DNA, 16 bp, Homo sapiens
tttgttttttgagtct

SEQ ID NO: 534582 - DNA, 18 bp, Homo sapiens
tttgttttttgagtcttt

SEQ ID NO: 534583 - DNA, 19 bp, Homo sapiens
tttgttttttgagtctttt

SEQ ID NO: 534584 - DNA, 11 bp, Homo sapiens
ttttaaaaaca

SEQ ID NO: 534585 - DNA, 11 bp, Homo sapiens
ttttaaaaagt

SEQ ID NO: 534586 - DNA, 14 bp, Homo sapiens
ttttaaaaagtatt

SEQ ID NO: 534587 - DNA, 18 bp, Homo sapiens
ttttaaaactacttagca

SEQ ID NO: 534588 - DNA, 13 bp, Homo sapiens
ttttaaaatctta

SEQ ID NO: 534589 - DNA, 14 bp, Homo sapiens
ttttaaaatcttat

SEQ ID NO: 534590 - DNA, 15 bp, Homo sapiens
ttttaaaatcttatt

SEQ ID NO: 534591 - DNA, 10 bp, Homo sapiens
ttttaaagaa

SEQ ID NO: 534592 - DNA, 22 bp, Homo sapiens
ttttaagaagttgctgcagatt

SEQ ID NO: 534593 - DNA, 14 bp, Homo sapiens
ttttaagtgaaatt

SEQ ID NO: 534594 - DNA, 20 bp, Homo sapiens
ttttagtggaccctgaaatg

SEQ ID NO: 534595 - DNA, 19 bp, Homo sapiens
ttttataaaaaaaatgaaa

SEQ ID NO: 534596 - DNA, 21 bp, Homo sapiens
ttttataaaaaaaatgaaatg

SEQ ID NO: 534597 - DNA, 14 bp, Homo sapiens
ttttataagcaaat

SEQ ID NO: 534598 - DNA, 22 bp, Homo sapiens
ttttataagcacagacaattct

SEQ ID NO: 534599 - DNA, 17 bp, Homo sapiens
ttttatacctgtacaca

SEQ ID NO: 534600 - DNA, 15 bp, Homo sapiens
ttttatgatatccct

SEQ ID NO: 534601 - DNA, 22 bp, Homo sapiens
ttttatgcgcaaatacaaaatg

SEQ ID NO: 534602 - DNA, 16 bp, Homo sapiens
ttttatttctcctttt

SEQ ID NO: 534603 - DNA, 12 bp, Homo sapiens
ttttcaaaataa

SEQ ID NO: 534604 - DNA, 21 bp, Homo sapiens
ttttcaaaataaagcttttgc

SEQ ID NO: 534605 - DNA, 12 bp, Homo sapiens
ttttcaaatatg

SEQ ID NO: 534606 - DNA, 16 bp, Homo sapiens
ttttcaaatatgtaaa

SEQ ID NO: 534607 - DNA, 24 bp, Homo sapiens
ttttcaatctcgtatagaagtctt

SEQ ID NO: 534608 - DNA, 17 bp, Homo sapiens
ttttcagatttgcacaa

SEQ ID NO: 534609 - DNA, 18 bp, Homo sapiens
ttttcagatttgcacaaa

SEQ ID NO: 534610 - DNA, 15 bp, Homo sapiens
ttttcagttcaaagt

SEQ ID NO: 534611 - DNA, 22 bp, Homo sapiens
ttttcatattttaatttcaagc

SEQ ID NO: 534612 - DNA, 17 bp, Homo sapiens
ttttcatccattaaaat

SEQ ID NO: 534613 - DNA, 16 bp, Homo sapiens
ttttcattacaatgga

SEQ ID NO: 534614 - DNA, 12 bp, Homo sapiens
ttttcattacct

SEQ ID NO: 534615 - DNA, 20 bp, Homo sapiens
ttttcattagcaaaaaaagt

SEQ ID NO: 534616 - DNA, 21 bp, Homo sapiens
ttttcattagcaaaaaaagtt

SEQ ID NO: 534617 - DNA, 14 bp, Homo sapiens
ttttcattgctgtg

SEQ ID NO: 534618 - DNA, 18 bp, Homo sapiens
ttttccaacatacaattt

SEQ ID NO: 534619 - DNA, 14 bp, Homo sapiens
ttttccagtatttt

SEQ ID NO: 534620 - DNA, 17 bp, Homo sapiens
ttttcccacctctttgg

SEQ ID NO: 534621 - DNA, 19 bp, Homo sapiens
ttttccccaattatcctcc

SEQ ID NO: 534622 - DNA, 21 bp, Homo sapiens
ttttcctcgcttctttcaagg

SEQ ID NO: 534623 - DNA, 14 bp, Homo sapiens
ttttccttacataa

SEQ ID NO: 534624 - DNA, 13 bp, Homo sapiens
ttttcttaaaaag

SEQ ID NO: 534625 - DNA, 19 bp, Homo sapiens
ttttcttccaacatgtgat

SEQ ID NO: 534626 - DNA, 14 bp, Homo sapiens
ttttgaatttagtg

SEQ ID NO: 534627 - DNA, 15 bp, Homo sapiens
ttttgatcaaatgta

SEQ ID NO: 534628 - DNA, 22 bp, Homo sapiens
ttttgctaagtaaatctcttct

SEQ ID NO: 534629 - DNA, 13 bp, Homo sapiens
ttttgcttcccct

SEQ ID NO: 534630 - DNA, 18 bp, Homo sapiens
ttttggggtgtgacctca

SEQ ID NO: 534631 - DNA, 21 bp, Homo sapiens
ttttggtccacttttccagta

SEQ ID NO: 534632 - DNA, 14 bp, Homo sapiens
ttttgtaaactttg

SEQ ID NO: 534633 - DNA, 17 bp, Homo sapiens
ttttgtaaactttgaaa

SEQ ID NO: 534634 - DNA, 19 bp, Homo sapiens
ttttgtagtcttatgaata

SEQ ID NO: 534635 - DNA, 13 bp, Homo sapiens
ttttgtatcctcc

SEQ ID NO: 534636 - DNA, 23 bp, Homo sapiens
ttttgtatgcaagcagtttcaat

SEQ ID NO: 534637 - DNA, 19 bp, Homo sapiens
ttttgtctgtgataacaga

SEQ ID NO: 534638 - DNA, 13 bp, Homo sapiens
ttttgtgaaattt

SEQ ID NO: 534639 - DNA, 17 bp, Homo sapiens
ttttgtgaaatttttca

SEQ ID NO: 534640 - DNA, 17 bp, Homo sapiens
ttttgttcttaaaaatg

SEQ ID NO: 534641 - DNA, 22 bp, Homo sapiens
ttttgttttcattaaagagcca

SEQ ID NO: 534642 - DNA, 13 bp, Homo sapiens
ttttgttttgctt

SEQ ID NO: 534643 - DNA, 22 bp, Homo sapiens
tttttaaagaaaagttcttaaa

SEQ ID NO: 534644 - DNA, 18 bp, Homo sapiens
tttttaagcctttgaagt

SEQ ID NO: 534645 - DNA, 17 bp, Homo sapiens
tttttaagtgtcagact

SEQ ID NO: 534646 - DNA, 15 bp, Homo sapiens
tttttatacctgtac

SEQ ID NO: 534647 - DNA, 14 bp, Homo sapiens
tttttatatcttgg

SEQ ID NO: 534648 - DNA, 14 bp, Homo sapiens
tttttatttctcct

SEQ ID NO: 534649 - DNA, 15 bp, Homo sapiens
tttttcttaaaaagt

SEQ ID NO: 534650 - DNA, 21 bp, Homo sapiens
tgggacttcttacccaaagca

SEQ ID NO: 534651 - DNA, 23 bp, Homo sapiens
tgggacttcttacccaaagcaca

SEQ ID NO: 534652 - DNA, 14 bp, Homo sapiens
tgggagagtgaggt

SEQ ID NO: 534653 - DNA, 17 bp, Homo sapiens
tgggaggatttgatgta

SEQ ID NO: 534654 - DNA, 20 bp, Homo sapiens
tgggagtagttggagcattg

SEQ ID NO: 534655 - DNA, 19 bp, Homo sapiens
tgggagtcagggagccctg

SEQ ID NO: 534656 - DNA, 15 bp, Homo sapiens
tgggatgggcacagg

SEQ ID NO: 534657 - DNA, 18 bp, Homo sapiens
tgggcaaggcctttggct

SEQ ID NO: 534658 - DNA, 17 bp, Homo sapiens
tgggcaatattctctgt

SEQ ID NO: 534659 - DNA, 18 bp, Homo sapiens
tgggcaatattctctgta

SEQ ID NO: 534660 - DNA, 13 bp, Homo sapiens
tgggcacaggctg

SEQ ID NO: 534661 - DNA, 13 bp, Homo sapiens
tgggcacaggtca

SEQ ID NO: 534662 - DNA, 16 bp, Homo sapiens
tgggcagatttgcaac

SEQ ID NO: 534663 - DNA, 16 bp, Homo sapiens
tgggcatccccagccc

SEQ ID NO: 534664 - DNA, 21 bp, Homo sapiens
tgggcatccccagccccctgg

SEQ ID NO: 534665 - DNA, 23 bp, Homo sapiens
tgggcattactgtttaagacact

SEQ ID NO: 534666 - DNA, 14 bp, Homo sapiens
tgggccagggtctc

SEQ ID NO: 534667 - DNA, 19 bp, Homo sapiens
tgggcccacccaagcagga

SEQ ID NO: 534668 - DNA, 21 bp, Homo sapiens
tgggccctggttcccccagga

SEQ ID NO: 534669 - DNA, 19 bp, Homo sapiens
tgggcggcagagaggactg

SEQ ID NO: 534670 - DNA, 14 bp, Homo sapiens
tgggctcagcacat

SEQ ID NO: 534671 - DNA, 19 bp, Homo sapiens
tgggctcccttcctcccaa

SEQ ID NO: 534672 - DNA, 11 bp, Homo sapiens
tgggctctgcg

SEQ ID NO: 534673 - DNA, 14 bp, Homo sapiens
tgggctctgggttc

SEQ ID NO: 534674 - DNA, 16 bp, Homo sapiens
tgggctgggacttctt

SEQ ID NO: 534675 - DNA, 20 bp, Homo sapiens
tggggacgtgtgtcctttgg

SEQ ID NO: 534676 - DNA, 13 bp, Homo sapiens
tggggagctcctg

SEQ ID NO: 534677 - DNA, 16 bp, Homo sapiens
tggggagctcctggcc

SEQ ID NO: 534678 - DNA, 14 bp, Homo sapiens
tggggcagcacaga

SEQ ID NO: 534679 - DNA, 22 bp, Homo sapiens
tggggcagcacagagagggggc

SEQ ID NO: 534680 - DNA, 20 bp, Homo sapiens
tggggcttttgtgccaggag

SEQ ID NO: 534681 - DNA, 19 bp, Homo sapiens
tgggggcagcctgcgtggc

SEQ ID NO: 534682 - DNA, 16 bp, Homo sapiens
tgggggctgctgcact

SEQ ID NO: 534683 - DNA, 19 bp, Homo sapiens
tggggtcaggccgggcaga

SEQ ID NO: 534684 - DNA, 22 bp, Homo sapiens
tggggtcaggccgggcagagca

SEQ ID NO: 534685 - DNA, 18 bp, Homo sapiens
tggggtttccacacaggc

SEQ ID NO: 534686 - DNA, 17 bp, Homo sapiens
tgggtagggctctgaca

SEQ ID NO: 534687 - DNA, 22 bp, Homo sapiens
tgggtcatgatgctctttccca

SEQ ID NO: 534688 - DNA, 15 bp, Homo sapiens
tgggtccccagccct

SEQ ID NO: 534689 - DNA, 21 bp, Homo sapiens
tgggtctggaggacctgcccg

SEQ ID NO: 534690 - DNA, 20 bp, Homo sapiens
tgggtgcaggagcgctccct

SEQ ID NO: 534691 - DNA, 13 bp, Homo sapiens
tgggtgggacaca

SEQ ID NO: 534692 - DNA, 17 bp, Homo sapiens
tgggtgggacacagaga

SEQ ID NO: 534693 - DNA, 16 bp, Homo sapiens
tgggttttgcctctgc

SEQ ID NO: 534694 - DNA, 13 bp, Homo sapiens
tggtaagaaaaag

SEQ ID NO: 534695 - DNA, 22 bp, Homo sapiens
tggtaagaaaaagcaaaaggca

SEQ ID NO: 534696 - DNA, 23 bp, Homo sapiens
tggtaagaaaaagcaaaaggcat

SEQ ID NO: 534697 - DNA, 17 bp, Homo sapiens
tggtacacacttgacct

SEQ ID NO: 534698 - DNA, 19 bp, Homo sapiens
tggtacacacttgaccttc

SEQ ID NO: 534699 - DNA, 13 bp, Homo sapiens
tggtaccttgcac

SEQ ID NO: 534700 - DNA, 21 bp, Homo sapiens
tggtacttggcaccaataaag

SEQ ID NO: 534701 - DNA, 15 bp, Homo sapiens
tggtactttctgtac

SEQ ID NO: 534702 - DNA, 22 bp, Homo sapiens
tggtatatccttttctgtgttt

SEQ ID NO: 534703 - DNA, 14 bp, Homo sapiens
tggtcacagccagg

SEQ ID NO: 534704 - DNA, 17 bp, Homo sapiens
tggtcacagccaggcgc

SEQ ID NO: 534705 - DNA, 22 bp, Homo sapiens
tggtcagacacaaacaaacaag

SEQ ID NO: 534706 - DNA, 15 bp, Homo sapiens
tggtccacttttcca

SEQ ID NO: 534707 - DNA, 16 bp, Homo sapiens
tggtccacttttccag

SEQ ID NO: 534708 - DNA, 19 bp, Homo sapiens
tatacatatgtagactata

SEQ ID NO: 534709 - DNA, 16 bp, Homo sapiens
tatacatgtgtgtata

SEQ ID NO: 534710 - DNA, 13 bp, Homo sapiens
tataccatttccg

SEQ ID NO: 534711 - DNA, 17 bp, Homo sapiens
tatacctataatgtgtg

SEQ ID NO: 534712 - DNA, 19 bp, Homo sapiens
tatacctctaactgtgcaa

SEQ ID NO: 534713 - DNA, 14 bp, Homo sapiens
tatacctgtacaca

SEQ ID NO: 534714 - DNA, 16 bp, Homo sapiens
tatacctgtacacaca

SEQ ID NO: 534715 - DNA, 22 bp, Homo sapiens
tatacgcacgcacccacaccct

SEQ ID NO: 534716 - DNA, 13 bp, Homo sapiens
tatacgtttcaaa

SEQ ID NO: 534717 - DNA, 18 bp, Homo sapiens
tatactccttaaaaatgt

SEQ ID NO: 534718 - DNA, 22 bp, Homo sapiens
tatagaaagtgttctgttacaa

SEQ ID NO: 534719 - DNA, 23 bp, Homo sapiens
tatagaaagtgttctgttacaaa

SEQ ID NO: 534720 - DNA, 13 bp, Homo sapiens
tatagaagtcttc

SEQ ID NO: 534721 - DNA, 16 bp, Homo sapiens
tatagaagtcttcatg

SEQ ID NO: 534722 - DNA, 19 bp, Homo sapiens
tatagaagtcttcatgaaa

SEQ ID NO: 534723 - DNA, 20 bp, Homo sapiens
tatagacaggagaagaaaga

SEQ ID NO: 534724 - DNA, 18 bp, Homo sapiens
tatagcagcaaaaatata

SEQ ID NO: 534725 - DNA, 13 bp, Homo sapiens
tatagtatttgaa

SEQ ID NO: 534726 - DNA, 17 bp, Homo sapiens
tatagtatttgaaaaca

SEQ ID NO: 534727 - DNA, 13 bp, Homo sapiens
tatagtcatttat

SEQ ID NO: 534728 - DNA, 15 bp, Homo sapiens
tatagtgcaatatat

SEQ ID NO: 534729 - DNA, 19 bp, Homo sapiens
tatagtgcaatatattttg

SEQ ID NO: 534730 - DNA, 14 bp, Homo sapiens
tatataaaaatata

SEQ ID NO: 534731 - DNA, 15 bp, Homo sapiens
tatataaaatacacg

SEQ ID NO: 534732 - DNA, 16 bp, Homo sapiens
tatataaataaatgtt

SEQ ID NO: 534733 - DNA, 18 bp, Homo sapiens
tatataattttattgctg

SEQ ID NO: 534734 - DNA, 14 bp, Homo sapiens
tatatacacatata

SEQ ID NO: 534735 - DNA, 13 bp, Homo sapiens
tatatacatatgt

SEQ ID NO: 534736 - DNA, 13 bp, Homo sapiens
tatatacatgtgt

SEQ ID NO: 534737 - DNA, 15 bp, Homo sapiens
tatatacatgtgtgt

SEQ ID NO: 534738 - DNA, 17 bp, Homo sapiens
tatatacatgtgtgtat

SEQ ID NO: 534739 - DNA, 18 bp, Homo sapiens
tatatacatgtgtgtata

SEQ ID NO: 534740 - DNA, 18 bp, Homo sapiens
tatatagcatttatggta

SEQ ID NO: 534741 - DNA, 14 bp, Homo sapiens
tatatagtgctata

SEQ ID NO: 534742 - DNA, 17 bp, Homo sapiens
tatatagtgctatatat

SEQ ID NO: 534743 - DNA, 12 bp, Homo sapiens
tatatatacata

SEQ ID NO: 534744 - DNA, 19 bp, Homo sapiens
tatatatagtgctatatat

SEQ ID NO: 534745 - DNA, 12 bp, Homo sapiens
tatatatatgtg

SEQ ID NO: 534746 - DNA, 20 bp, Homo sapiens
tatatatgtgaactttctca

SEQ ID NO: 534747 - DNA, 19 bp, Homo sapiens
tatatatgtgtatatatac

SEQ ID NO: 534748 - DNA, 23 bp, Homo sapiens
tatatatgtgtatatatacatac

SEQ ID NO: 534749 - DNA, 20 bp, Homo sapiens
tatatcatgctttaaagtgt

SEQ ID NO: 534750 - DNA, 13 bp, Homo sapiens
tatatccttttct

SEQ ID NO: 534751 - DNA, 12 bp, Homo sapiens
tatatctgaaaa

SEQ ID NO: 534752 - DNA, 17 bp, Homo sapiens
tatatctgaaaactgga

SEQ ID NO: 534753 - DNA, 14 bp, Homo sapiens
tatatctgtggtct

SEQ ID NO: 534754 - DNA, 18 bp, Homo sapiens
tatatctgtggtcttcaa

SEQ ID NO: 534755 - DNA, 18 bp, Homo sapiens
tatatgaggatgtatgtg

SEQ ID NO: 534756 - DNA, 22 bp, Homo sapiens
tatatgtatatttaccaagatt

SEQ ID NO: 534757 - DNA, 17 bp, Homo sapiens
tatatgtgtatatatac

SEQ ID NO: 534758 - DNA, 13 bp, Homo sapiens
tatatgtgtccat

SEQ ID NO: 534759 - DNA, 14 bp, Homo sapiens
tatatgtttataca

SEQ ID NO: 534760 - DNA, 20 bp, Homo sapiens
tatatgtttatacacacagg

SEQ ID NO: 534761 - DNA, 17 bp, Homo sapiens
tatattctgcagaaaat

SEQ ID NO: 534762 - DNA, 12 bp, Homo sapiens
tatattgaaaag

SEQ ID NO: 534763 - DNA, 13 bp, Homo sapiens
tatattgaaaaga

SEQ ID NO: 534764 - DNA, 16 bp, Homo sapiens
tatattgaaaagaaaa

SEQ ID NO: 534765 - DNA, 22 bp, Homo sapiens
tatattgaaaagaaaaagaaga

SEQ ID NO: 534766 - DNA, 17 bp, Homo sapiens
tatatttttcttaaaaa

SEQ ID NO: 534767 - DNA, 21 bp, Homo sapiens
tatcagctacttaagagaaat

SEQ ID NO: 534768 - DNA, 21 bp, Homo sapiens
tatcagttacagtggcagtat

SEQ ID NO: 534769 - DNA, 22 bp, Homo sapiens
tatcagttacagtggcagtatt

SEQ ID NO: 534770 - DNA, 15 bp, Homo sapiens
tatcagttatccttt

SEQ ID NO: 534771 - DNA, 23 bp, Homo sapiens
tatcagttatcctttgtgagcct

SEQ ID NO: 534772 - DNA, 20 bp, Homo sapiens
tatcatccccaaatgtgtct

SEQ ID NO: 534773 - DNA, 17 bp, Homo sapiens
tatcatctaaatattat

SEQ ID NO: 534774 - DNA, 16 bp, Homo sapiens
tatcattgtttgtcct

SEQ ID NO: 534775 - DNA, 17 bp, Homo sapiens
tatccacgagagcgcag

SEQ ID NO: 534776 - DNA, 16 bp, Homo sapiens
tatccttttctgtgtt

SEQ ID NO: 534777 - DNA, 12 bp, Homo sapiens
tatctaaccagt

SEQ ID NO: 534778 - DNA, 17 bp, Homo sapiens
tatctaccaactttcaa

SEQ ID NO: 534779 - DNA, 18 bp, Homo sapiens
tatctaccaactttcaag

SEQ ID NO: 534780 - DNA, 13 bp, Homo sapiens
tatctagctgcat

SEQ ID NO: 534781 - DNA, 23 bp, Homo sapiens
tatctcatcaacaaagaaatatt

SEQ ID NO: 534782 - DNA, 16 bp, Homo sapiens
tatctcctttaatata

SEQ ID NO: 534783 - DNA, 20 bp, Homo sapiens
tatctcgctagccatatatt

SEQ ID NO: 534784 - DNA, 13 bp, Homo sapiens
tatctgaaaactg

SEQ ID NO: 534785 - DNA, 15 bp, Homo sapiens
tatctgaaaactgga

SEQ ID NO: 534786 - DNA, 16 bp, Homo sapiens
tatctgaaaactggaa

SEQ ID NO: 534787 - DNA, 18 bp, Homo sapiens
tatctgatgatgttctga

SEQ ID NO: 534788 - DNA, 17 bp, Homo sapiens
tatctggggagctcctg

SEQ ID NO: 534789 - DNA, 21 bp, Homo sapiens
tatctggggagctcctggcca

SEQ ID NO: 534790 - DNA, 21 bp, Homo sapiens
tatctgggggactagaacaca

SEQ ID NO: 534791 - DNA, 13 bp, Homo sapiens
tatctgtggtctt

SEQ ID NO: 534792 - DNA, 13 bp, Homo sapiens
tatcttcatgttt

SEQ ID NO: 534793 - DNA, 16 bp, Homo sapiens
tatcttggcaggtagg

SEQ ID NO: 534794 - DNA, 16 bp, Homo sapiens
tatctttatacagatt

SEQ ID NO: 534795 - DNA, 20 bp, Homo sapiens
tatgaagttggcacatttca

SEQ ID NO: 534796 - DNA, 17 bp, Homo sapiens
tatgaatagacataaat

SEQ ID NO: 534797 - DNA, 18 bp, Homo sapiens
tatgaatagacataaatt

SEQ ID NO: 534798 - DNA, 18 bp, Homo sapiens
tatgaatatttcattttg

SEQ ID NO: 534799 - DNA, 18 bp, Homo sapiens
tatgagaaatataaaaat

SEQ ID NO: 534800 - DNA, 15 bp, Homo sapiens
tatgagactgtgttt

SEQ ID NO: 534801 - DNA, 16 bp, Homo sapiens
tatgagactgtgtttc

SEQ ID NO: 534802 - DNA, 14 bp, Homo sapiens
tatgagatcactga

SEQ ID NO: 534803 - DNA, 22 bp, Homo sapiens
tatgagatcactgaacttttca

SEQ ID NO: 534804 - DNA, 20 bp, Homo sapiens
tatgagcatgctccctcatg

SEQ ID NO: 534805 - DNA, 16 bp, Homo sapiens
tatgaggatgtatgtg

SEQ ID NO: 534806 - DNA, 20 bp, Homo sapiens
tatgagggtactgtggctgg

SEQ ID NO: 534807 - DNA, 15 bp, Homo sapiens
tatgagtatacaata

SEQ ID NO: 534808 - DNA, 23 bp, Homo sapiens
tatgagtatacaatatataaaaa

SEQ ID NO: 534809 - DNA, 13 bp, Homo sapiens
tatgataaatttg

SEQ ID NO: 534810 - DNA, 14 bp, Homo sapiens
tatgatccagagca

SEQ ID NO: 534811 - DNA, 18 bp, Homo sapiens
tatgatgtccaaacttaa

SEQ ID NO: 534812 - DNA, 16 bp, Homo sapiens
tatgattaaattatca

SEQ ID NO: 534813 - DNA, 18 bp, Homo sapiens
tatgattttttaaaagaa

SEQ ID NO: 534814 - DNA, 13 bp, Homo sapiens
tatgcaagcagtt

SEQ ID NO: 534815 - DNA, 18 bp, Homo sapiens
tatgcaagcagtttcaat

SEQ ID NO: 534816 - DNA, 23 bp, Homo sapiens
tatgcaagcagtttcaataaagt

SEQ ID NO: 534817 - DNA, 15 bp, Homo sapiens
tatgcatcccacagc

SEQ ID NO: 534818 - DNA, 17 bp, Homo sapiens
tatgcatcccacagcca

SEQ ID NO: 534819 - DNA, 15 bp, Homo sapiens
tatgccccaaatata

SEQ ID NO: 534820 - DNA, 16 bp, Homo sapiens
tatgccttttgtagct

SEQ ID NO: 534821 - DNA, 16 bp, Homo sapiens
tatgctaagaattttt

SEQ ID NO: 534822 - DNA, 15 bp, Homo sapiens
tatgctgttcattga

SEQ ID NO: 534823 - DNA, 17 bp, Homo sapiens
tatgcttccagaaacac

SEQ ID NO: 534824 - DNA, 20 bp, Homo sapiens
tatggaagacaaatacacat

SEQ ID NO: 534825 - DNA, 22 bp, Homo sapiens
tatggaagacaaatacacatac

SEQ ID NO: 534826 - DNA, 12 bp, Homo sapiens
tatggaagccac

SEQ ID NO: 534827 - DNA, 18 bp, Homo sapiens
tatggacagcattgccag

SEQ ID NO: 534828 - DNA, 23 bp, Homo sapiens
tatggaggagagtgtttaactga

SEQ ID NO: 534829 - DNA, 13 bp, Homo sapiens
tatggatttctag

SEQ ID NO: 534830 - DNA, 14 bp, Homo sapiens
tatggctttgtgct

SEQ ID NO: 534831 - DNA, 14 bp, Homo sapiens
tatggtatatattt

SEQ ID NO: 534832 - DNA, 23 bp, Homo sapiens
tatggtctaatgtttaagcagaa

SEQ ID NO: 534833 - DNA, 23 bp, Homo sapiens
tatgtaacagtttaaaaaaaaag

SEQ ID NO: 534834 - DNA, 11 bp, Homo sapiens
tatgtaacttg

SEQ ID NO: 534835 - DNA, 19 bp, Homo sapiens
tatgtagactatatacatg

SEQ ID NO: 534836 - DNA, 22 bp, Homo sapiens
tatgtagactatatacatgtgt

SEQ ID NO: 534837 - DNA, 17 bp, Homo sapiens
tgcatggggaaagagat

SEQ ID NO: 534838 - DNA, 16 bp, Homo sapiens
tgcatgtcgcacaatg

SEQ ID NO: 534839 - DNA, 18 bp, Homo sapiens
tgcatgtcgcacaatgtt

SEQ ID NO: 534840 - DNA, 19 bp, Homo sapiens
tgcatgtgtgtataagtgc

SEQ ID NO: 534841 - DNA, 22 bp, Homo sapiens
tgcattcattcatcctcttata

SEQ ID NO: 534842 - DNA, 14 bp, Homo sapiens
tgcatttgcttttg

SEQ ID NO: 534843 - DNA, 16 bp, Homo sapiens
tgcattttctgaaact

SEQ ID NO: 534844 - DNA, 21 bp, Homo sapiens
tgccaaaataaagtctgtcat

SEQ ID NO: 534845 - DNA, 17 bp, Homo sapiens
tgccaaatcctgggcat

SEQ ID NO: 534846 - DNA, 16 bp, Homo sapiens
tgccaagagtccaagc

SEQ ID NO: 534847 - DNA, 16 bp, Homo sapiens
tgccagcacccccacg

SEQ ID NO: 534848 - DNA, 20 bp, Homo sapiens
tgccagcatacattttctgg

SEQ ID NO: 534849 - DNA, 13 bp, Homo sapiens
tgccaggagtggg

SEQ ID NO: 534850 - DNA, 22 bp, Homo sapiens
tgccaggtgaaggaggctccag

SEQ ID NO: 534851 - DNA, 22 bp, Homo sapiens
tgccagtaccagccccaccctg

SEQ ID NO: 534852 - DNA, 20 bp, Homo sapiens
tgccatagtcttaactggtc

SEQ ID NO: 534853 - DNA, 21 bp, Homo sapiens
tgccatattaaaatctgatgt

SEQ ID NO: 534854 - DNA, 16 bp, Homo sapiens
tgccatcagcccctgc

SEQ ID NO: 534855 - DNA, 20 bp, Homo sapiens
tgccatcagcccctgctgct

SEQ ID NO: 534856 - DNA, 16 bp, Homo sapiens
tgccatgaactggagg

SEQ ID NO: 534857 - DNA, 16 bp, Homo sapiens
tgccatggaggcacac

SEQ ID NO: 534858 - DNA, 23 bp, Homo sapiens
tgccatttcctcctgggcaacag

SEQ ID NO: 534859 - DNA, 18 bp, Homo sapiens
tgccattttttgtctgtg

SEQ ID NO: 534860 - DNA, 19 bp, Homo sapiens
tgccattttttgtctgtga

SEQ ID NO: 534861 - DNA, 17 bp, Homo sapiens
tgcccacacctgcctct

SEQ ID NO: 534862 - DNA, 18 bp, Homo sapiens
tgcccacacctgcctctg

SEQ ID NO: 534863 - DNA, 17 bp, Homo sapiens
tgcccagatcagccaga

SEQ ID NO: 534864 - DNA, 20 bp, Homo sapiens
tgcccagatcagccagaagc

SEQ ID NO: 534865 - DNA, 17 bp, Homo sapiens
tgcccagcctctttccc

SEQ ID NO: 534866 - DNA, 18 bp, Homo sapiens
tgcccagcctctttccct

SEQ ID NO: 534867 - DNA, 20 bp, Homo sapiens
tgcccagcttttcattgctg

SEQ ID NO: 534868 - DNA, 23 bp, Homo sapiens
tgcccagcttttcattgctgtga

SEQ ID NO: 534869 - DNA, 14 bp, Homo sapiens
tgcccatgtgtatg

SEQ ID NO: 534870 - DNA, 22 bp, Homo sapiens
tgccccaagttttgtgaaattt

SEQ ID NO: 534871 - DNA, 13 bp, Homo sapiens
tgccccacccctc

SEQ ID NO: 534872 - DNA, 23 bp, Homo sapiens
tgccccacccctccatgattcca

SEQ ID NO: 534873 - DNA, 17 bp, Homo sapiens
tgcccccacacctggcc

SEQ ID NO: 534874 - DNA, 19 bp, Homo sapiens
tgcccccacacctggccct

SEQ ID NO: 534875 - DNA, 15 bp, Homo sapiens
tgcccccagacccca

SEQ ID NO: 534876 - DNA, 19 bp, Homo sapiens
tgcccccagaccccatcca

SEQ ID NO: 534877 - DNA, 14 bp, Homo sapiens
tgccccccatgccc

SEQ ID NO: 534878 - DNA, 18 bp, Homo sapiens
tgccccccatgccctccc

SEQ ID NO: 534879 - DNA, 20 bp, Homo sapiens
tgccccccatgccctccctg

SEQ ID NO: 534880 - DNA, 13 bp, Homo sapiens
tgcccctctctcc

SEQ ID NO: 534881 - DNA, 15 bp, Homo sapiens
tgcccctctctccat

SEQ ID NO: 534882 - DNA, 16 bp, Homo sapiens
tgcccggcccaggagc

SEQ ID NO: 534883 - DNA, 18 bp, Homo sapiens
tgcccggcccaggagcgc

SEQ ID NO: 534884 - DNA, 21 bp, Homo sapiens
tgcccggcccaggagcgcagc

SEQ ID NO: 534885 - DNA, 23 bp, Homo sapiens
tgccctcatcccgacctcttaga

SEQ ID NO: 534886 - DNA, 17 bp, Homo sapiens
tgccctcccttcttgtg

SEQ ID NO: 534887 - DNA, 17 bp, Homo sapiens
tgccctccgtcctggca

SEQ ID NO: 534888 - DNA, 22 bp, Homo sapiens
tgccctccgtcctggcagggca

SEQ ID NO: 534889 - DNA, 16 bp, Homo sapiens
tgccctgtcaggaggc

SEQ ID NO: 534890 - DNA, 19 bp, Homo sapiens
tgccctgtcaggaggcaga

SEQ ID NO: 534891 - DNA, 21 bp, Homo sapiens
tgccctttacttgtctttctg

SEQ ID NO: 534892 - DNA, 15 bp, Homo sapiens
tgccctttgtcctcc

SEQ ID NO: 534893 - DNA, 16 bp, Homo sapiens
tgccgagtgccccaga

SEQ ID NO: 534894 - DNA, 22 bp, Homo sapiens
tgccgctgatgtttggccgtga

SEQ ID NO: 534895 - DNA, 21 bp, Homo sapiens
tgccgtgcacggggccagcat

SEQ ID NO: 534896 - DNA, 17 bp, Homo sapiens
tgcctctgaactgctgc

SEQ ID NO: 534897 - DNA, 17 bp, Homo sapiens
tgcctctgatgtatttt

SEQ ID NO: 534898 - DNA, 15 bp, Homo sapiens
tgcctctgcccttgg

SEQ ID NO: 534899 - DNA, 15 bp, Homo sapiens
tgcctgaggggcagc

SEQ ID NO: 534900 - DNA, 11 bp, Homo sapiens
tgcctgctctt

SEQ ID NO: 534901 - DNA, 14 bp, Homo sapiens
tgcctgtcaagttt

SEQ ID NO: 534902 - DNA, 15 bp, Homo sapiens
tgccttaaaacttta

SEQ ID NO: 534903 - DNA, 23 bp, Homo sapiens
tgccttgcccactcctgctctgc

SEQ ID NO: 534904 - DNA, 16 bp, Homo sapiens
tgcgaacacagtgaca

SEQ ID NO: 534905 - DNA, 19 bp, Homo sapiens
tgcgaggttgttttaaagt

SEQ ID NO: 534906 - DNA, 22 bp, Homo sapiens
tgcgaggttgttttaaagtcag

SEQ ID NO: 534907 - DNA, 13 bp, Homo sapiens
tgcgcaaatacaa

SEQ ID NO: 534908 - DNA, 18 bp, Homo sapiens
tgcgcaaatacaaaatga

SEQ ID NO: 534909 - DNA, 20 bp, Homo sapiens
tgcgcataggcctgctttgt

SEQ ID NO: 534910 - DNA, 14 bp, Homo sapiens
tgcgtggctgaccc

SEQ ID NO: 534911 - DNA, 17 bp, Homo sapiens
tgctaaacgtgtatgtt

SEQ ID NO: 534912 - DNA, 18 bp, Homo sapiens
tgctaaacgtgtatgttt

SEQ ID NO: 534913 - DNA, 15 bp, Homo sapiens
tgctaaattgatgtt

SEQ ID NO: 534914 - DNA, 17 bp, Homo sapiens
tgctaaattgatgttga

SEQ ID NO: 534915 - DNA, 16 bp, Homo sapiens
tgctaagagcctctgg

SEQ ID NO: 534916 - DNA, 19 bp, Homo sapiens
tgctaagagcctctggaag

SEQ ID NO: 534917 - DNA, 21 bp, Homo sapiens
tgctaagtaaatctcttctgt

SEQ ID NO: 534918 - DNA, 16 bp, Homo sapiens
tgctaagtctttccca

SEQ ID NO: 534919 - DNA, 13 bp, Homo sapiens
tgctactcagtat

SEQ ID NO: 534920 - DNA, 15 bp, Homo sapiens
tgctacttcctgcct

SEQ ID NO: 534921 - DNA, 22 bp, Homo sapiens
tgctacttcctgcctggtctcc

SEQ ID NO: 534922 - DNA, 15 bp, Homo sapiens
tgctatatatataaa

SEQ ID NO: 534923 - DNA, 18 bp, Homo sapiens
tgctatgctgttcattga

SEQ ID NO: 534924 - DNA, 18 bp, Homo sapiens
tgctatgtcatttcatgt

SEQ ID NO: 534925 - DNA, 20 bp, Homo sapiens
tgctatttgtgtaactgaaa

SEQ ID NO: 534926 - DNA, 15 bp, Homo sapiens
tgctattttactgtc

SEQ ID NO: 534927 - DNA, 16 bp, Homo sapiens
tgctcacacaatcaga

SEQ ID NO: 534928 - DNA, 15 bp, Homo sapiens
tgctcagcagtgaga

SEQ ID NO: 534929 - DNA, 19 bp, Homo sapiens
tgctcataagtaaatgtct

SEQ ID NO: 534930 - DNA, 17 bp, Homo sapiens
tgctcatccactctact

SEQ ID NO: 534931 - DNA, 12 bp, Homo sapiens
tgctccagctct

SEQ ID NO: 534932 - DNA, 17 bp, Homo sapiens
tgctccagctctggcat

SEQ ID NO: 534933 - DNA, 18 bp, Homo sapiens
tgctcccctgtgccagcc

SEQ ID NO: 534934 - DNA, 13 bp, Homo sapiens
tgctccctcatgc

SEQ ID NO: 534935 - DNA, 21 bp, Homo sapiens
tgctcctccagtacaataaat

SEQ ID NO: 534936 - DNA, 13 bp, Homo sapiens
tgctcctcggcca

SEQ ID NO: 534937 - DNA, 24 bp, Homo sapiens
tgctcttgggcaatattctctgta

SEQ ID NO: 534938 - DNA, 19 bp, Homo sapiens
tgctctttcccacccagcc

SEQ ID NO: 534939 - DNA, 23 bp, Homo sapiens
tgctctttggcctgatgaccaat

SEQ ID NO: 534940 - DNA, 17 bp, Homo sapiens
tgctgagtggtccacat

SEQ ID NO: 534941 - DNA, 22 bp, Homo sapiens
tgctgatgacccccccagcttc

SEQ ID NO: 534942 - DNA, 17 bp, Homo sapiens
tgctgcactgccctccg

SEQ ID NO: 534943 - DNA, 13 bp, Homo sapiens
tgctgcagatact

SEQ ID NO: 534944 - DNA, 17 bp, Homo sapiens
tgctgccagtaccagcc

SEQ ID NO: 534945 - DNA, 24 bp, Homo sapiens
tgctgccccacaacacaccttgcc

SEQ ID NO: 534946 - DNA, 15 bp, Homo sapiens
tgctgcctcaggaat

SEQ ID NO: 534947 - DNA, 18 bp, Homo sapiens
tgctgctattttactgtc

SEQ ID NO: 534948 - DNA, 24 bp, Homo sapiens
tgctgctccctttatcatgtgttt

SEQ ID NO: 534949 - DNA, 21 bp, Homo sapiens
tgctgctcctcggccagagct

SEQ ID NO: 534950 - DNA, 16 bp, Homo sapiens
tgctggtcactgccat

SEQ ID NO: 534951 - DNA, 21 bp, Homo sapiens
tgctgtaaagcaaaatatttg

SEQ ID NO: 534952 - DNA, 20 bp, Homo sapiens
tgctgtaaataaaaatagct

SEQ ID NO: 534953 - DNA, 20 bp, Homo sapiens
tgctgtcattgcttcttctg

SEQ ID NO: 534954 - DNA, 13 bp, Homo sapiens
tgctgttcattga

SEQ ID NO: 534955 - DNA, 17 bp, Homo sapiens
tgcttaaataaaaatta

SEQ ID NO: 534956 - DNA, 18 bp, Homo sapiens
tgcttaaatgatcaagga

SEQ ID NO: 534957 - DNA, 15 bp, Homo sapiens
tgcttaaatgtgaat

SEQ ID NO: 534958 - DNA, 20 bp, Homo sapiens
tgcttaaatgtgaattacta

SEQ ID NO: 534959 - DNA, 14 bp, Homo sapiens
tgcttacctctcag

SEQ ID NO: 534960 - DNA, 14 bp, Homo sapiens
tgcttagcttatct

SEQ ID NO: 534961 - DNA, 21 bp, Homo sapiens
tgcttagcttatctttctttc

SEQ ID NO: 534962 - DNA, 23 bp, Homo sapiens
tgcttagcttatctttctttcca

SEQ ID NO: 534963 - DNA, 15 bp, Homo sapiens
tgcttagtgtccctt

SEQ ID NO: 534964 - DNA, 14 bp, Homo sapiens
tgcttccagaaaca

SEQ ID NO: 534965 - DNA, 15 bp, Homo sapiens
tgctttaaagtgtaa

SEQ ID NO: 534966 - DNA, 15 bp, Homo sapiens
tgctttaggattgaa

SEQ ID NO: 534967 - DNA, 17 bp, Homo sapiens
tgctttaggattgaagt

SEQ ID NO: 534968 - DNA, 19 bp, Homo sapiens
tgctttaggattgaagtgg

SEQ ID NO: 534969 - DNA, 14 bp, Homo sapiens
tgctttgtctcctc

SEQ ID NO: 534970 - DNA, 13 bp, Homo sapiens
tgcttttaaaact

SEQ ID NO: 534971 - DNA, 14 bp, Homo sapiens
tgcttttaaaacta

SEQ ID NO: 534972 - DNA, 23 bp, Homo sapiens
tgcttttaggagaattcacagaa

SEQ ID NO: 534973 - DNA, 12 bp, Homo sapiens
tgcttttgcaaa

SEQ ID NO: 534974 - DNA, 16 bp, Homo sapiens
tggaaacactaaatgt

SEQ ID NO: 534975 - DNA, 17 bp, Homo sapiens
tggaaacactaaatgtt

SEQ ID NO: 534976 - DNA, 19 bp, Homo sapiens
tggaaacactaaatgttaa

SEQ ID NO: 534977 - DNA, 18 bp, Homo sapiens
tggaaatcatcgaaaatt

SEQ ID NO: 534978 - DNA, 22 bp, Homo sapiens
tgaggatgtatgtgtatatgtt

SEQ ID NO: 534979 - DNA, 13 bp, Homo sapiens
tgaggcaggagaa

SEQ ID NO: 534980 - DNA, 22 bp, Homo sapiens
tgaggccaaatgagttcccttg

SEQ ID NO: 534981 - DNA, 23 bp, Homo sapiens
tgaggctccttagggttttctct

SEQ ID NO: 534982 - DNA, 13 bp, Homo sapiens
tgaggctggggct

SEQ ID NO: 534983 - DNA, 15 bp, Homo sapiens
tgagggcagtgcaag

SEQ ID NO: 534984 - DNA, 16 bp, Homo sapiens
tgagggcgtgaaacac

SEQ ID NO: 534985 - DNA, 18 bp, Homo sapiens
tgagggcgtgaaacacaa

SEQ ID NO: 534986 - DNA, 23 bp, Homo sapiens
tgaggtcatcccggggccatgga

SEQ ID NO: 534987 - DNA, 16 bp, Homo sapiens
tgaggtcctgggggcc

SEQ ID NO: 534988 - DNA, 18 bp, Homo sapiens
tgaggtcctgggggcctg

SEQ ID NO: 534989 - DNA, 15 bp, Homo sapiens
tgagtacaaatgtgt

SEQ ID NO: 534990 - DNA, 16 bp, Homo sapiens
tgagtacaaatgtgtg

SEQ ID NO: 534991 - DNA, 12 bp, Homo sapiens
tgagtagcatat

SEQ ID NO: 534992 - DNA, 15 bp, Homo sapiens
tgagtatatgtaaca

SEQ ID NO: 534993 - DNA, 14 bp, Homo sapiens
tgagtcctccagaa

SEQ ID NO: 534994 - DNA, 18 bp, Homo sapiens
tgagtcttcatgttccca

SEQ ID NO: 534995 - DNA, 20 bp, Homo sapiens
tgagtcttttttttttaagt

SEQ ID NO: 534996 - DNA, 15 bp, Homo sapiens
tgagtgcatcccagc

SEQ ID NO: 534997 - DNA, 22 bp, Homo sapiens
tgagtgctaagagcctctggaa

SEQ ID NO: 534998 - DNA, 19 bp, Homo sapiens
tgagtggacgtcagaagaa

SEQ ID NO: 534999 - DNA, 18 bp, Homo sapiens
tgagtggtccacattctg

SEQ ID NO: 535000 - DNA, 19 bp, Homo sapiens
tgagttggttacctattgc

SEQ ID NO: 535001 - DNA, 19 bp, Homo sapiens
tgagtttgtttctttgaat

SEQ ID NO: 535002 - DNA, 17 bp, Homo sapiens
tgataaatagtgttatt

SEQ ID NO: 535003 - DNA, 17 bp, Homo sapiens
tgataaatttgactgtt

SEQ ID NO: 535004 - DNA, 21 bp, Homo sapiens
tgatagcccctctccccgcag

SEQ ID NO: 535005 - DNA, 22 bp, Homo sapiens
tgatatcaggaaatatctgtga

SEQ ID NO: 535006 - DNA, 21 bp, Homo sapiens
tgatatccaacagaaagcata

SEQ ID NO: 535007 - DNA, 18 bp, Homo sapiens
tgatatccctgatcctaa

SEQ ID NO: 535008 - DNA, 15 bp, Homo sapiens
tgatatctgtttgct

SEQ ID NO: 535009 - DNA, 19 bp, Homo sapiens
tgatatctgtttgcttcta

SEQ ID NO: 535010 - DNA, 19 bp, Homo sapiens
tgatatgagtatacaatat

SEQ ID NO: 535011 - DNA, 15 bp, Homo sapiens
tgatattctttgtta

SEQ ID NO: 535012 - DNA, 12 bp, Homo sapiens
tgatcaaatgta

SEQ ID NO: 535013 - DNA, 23 bp, Homo sapiens
tgatcaaggagggagaaaggcaa

SEQ ID NO: 535014 - DNA, 15 bp, Homo sapiens
tgatccagagcagag

SEQ ID NO: 535015 - DNA, 20 bp, Homo sapiens
tgatcccttccacctgctct

SEQ ID NO: 535016 - DNA, 23 bp, Homo sapiens
tgatcccttccacctgctctgct

SEQ ID NO: 535017 - DNA, 15 bp, Homo sapiens
tgatctgtccttcca

SEQ ID NO: 535018 - DNA, 20 bp, Homo sapiens
tgatctgttgtaatatcagt

SEQ ID NO: 535019 - DNA, 21 bp, Homo sapiens
tgatctgttgtaatatcagtt

SEQ ID NO: 535020 - DNA, 20 bp, Homo sapiens
tgatcttcctctgctaaatt

SEQ ID NO: 535021 - DNA, 16 bp, Homo sapiens
tgatgaccaattttaa

SEQ ID NO: 535022 - DNA, 15 bp, Homo sapiens
tgatgatttcagaaa

SEQ ID NO: 535023 - DNA, 23 bp, Homo sapiens
tgatgcaatccttacaaatgatt

SEQ ID NO: 535024 - DNA, 15 bp, Homo sapiens
tgatgctctttccca

SEQ ID NO: 535025 - DNA, 15 bp, Homo sapiens
tgatggaagggcctt

SEQ ID NO: 535026 - DNA, 19 bp, Homo sapiens
tgatgtaaatgaagtaact

SEQ ID NO: 535027 - DNA, 21 bp, Homo sapiens
tgatgtaaatgaagtaacttg

SEQ ID NO: 535028 - DNA, 15 bp, Homo sapiens
tgatgtccaaactta

SEQ ID NO: 535029 - DNA, 16 bp, Homo sapiens
tgatgtccaaacttaa

SEQ ID NO: 535030 - DNA, 16 bp, Homo sapiens
tgatgtccccaaagta

SEQ ID NO: 535031 - DNA, 13 bp, Homo sapiens
tgatgtgacattt

SEQ ID NO: 535032 - DNA, 19 bp, Homo sapiens
tgatgtgctcatcagaaac

SEQ ID NO: 535033 - DNA, 13 bp, Homo sapiens
tgatgttctgaaa

SEQ ID NO: 535034 - DNA, 16 bp, Homo sapiens
tgatgttctgaaatgg

SEQ ID NO: 535035 - DNA, 18 bp, Homo sapiens
tgatgtttttaaaatctt

SEQ ID NO: 535036 - DNA, 19 bp, Homo sapiens
tgattaaattatcattgtt

SEQ ID NO: 535037 - DNA, 21 bp, Homo sapiens
tgattaaattatcattgtttg

SEQ ID NO: 535038 - DNA, 17 bp, Homo sapiens
tgattaactcagtcctg

SEQ ID NO: 535039 - DNA, 21 bp, Homo sapiens
tgattattttcattacaatgg

SEQ ID NO: 535040 - DNA, 17 bp, Homo sapiens
tgattcacatgttttca

SEQ ID NO: 535041 - DNA, 18 bp, Homo sapiens
tgattcacatgttttcaa

SEQ ID NO: 535042 - DNA, 14 bp, Homo sapiens
tgattcacttttat

SEQ ID NO: 535043 - DNA, 15 bp, Homo sapiens
tgattccaagggccc

SEQ ID NO: 535044 - DNA, 20 bp, Homo sapiens
tgattccaagggcccagagg

SEQ ID NO: 535045 - DNA, 14 bp, Homo sapiens
tgattctatgtaac

SEQ ID NO: 535046 - DNA, 18 bp, Homo sapiens
tgattctatgtaacttgt

SEQ ID NO: 535047 - DNA, 17 bp, Homo sapiens
tgattgcttttaaaatt

SEQ ID NO: 535048 - DNA, 14 bp, Homo sapiens
tgattgtctttttc

SEQ ID NO: 535049 - DNA, 12 bp, Homo sapiens
tgatttaacatt

SEQ ID NO: 535050 - DNA, 19 bp, Homo sapiens
tgatttactaacagtaact

SEQ ID NO: 535051 - DNA, 18 bp, Homo sapiens
tgatttattctggtgtct

SEQ ID NO: 535052 - DNA, 16 bp, Homo sapiens
tgatttcacaaatatt

SEQ ID NO: 535053 - DNA, 18 bp, Homo sapiens
tgatttctaagtgtttca

SEQ ID NO: 535054 - DNA, 15 bp, Homo sapiens
tgatttgtaaaacag

SEQ ID NO: 535055 - DNA, 24 bp, Homo sapiens
tgcaaatggtggttgtttcttcca

SEQ ID NO: 535056 - DNA, 16 bp, Homo sapiens
tgcaacaaactcaaaa

SEQ ID NO: 535057 - DNA, 22 bp, Homo sapiens
tgcaacagcaaattaatgtgta

SEQ ID NO: 535058 - DNA, 23 bp, Homo sapiens
tgcaacagcaaattaatgtgtaa

SEQ ID NO: 535059 - DNA, 16 bp, Homo sapiens
tgcaataaactcagtc

SEQ ID NO: 535060 - DNA, 22 bp, Homo sapiens
tgcaataaactcagtcaaatgt

SEQ ID NO: 535061 - DNA, 15 bp, Homo sapiens
tgcaatatattttgt

SEQ ID NO: 535062 - DNA, 16 bp, Homo sapiens
tgcaatatattttgta

SEQ ID NO: 535063 - DNA, 20 bp, Homo sapiens
tgcaatatattttgtatgca

SEQ ID NO: 535064 - DNA, 21 bp, Homo sapiens
tgcaatatattttgtatgcaa

SEQ ID NO: 535065 - DNA, 16 bp, Homo sapiens
tgcaatccttacaaat

SEQ ID NO: 535066 - DNA, 20 bp, Homo sapiens
tgcaatccttacaaatgatt

SEQ ID NO: 535067 - DNA, 17 bp, Homo sapiens
tgcaatttacttggaat

SEQ ID NO: 535068 - DNA, 13 bp, Homo sapiens
tgcaatttgaagg

SEQ ID NO: 535069 - DNA, 14 bp, Homo sapiens
tgcaatttgtcttt

SEQ ID NO: 535070 - DNA, 17 bp, Homo sapiens
tgcaatttgtctttgga

SEQ ID NO: 535071 - DNA, 21 bp, Homo sapiens
tgcacaaacatagacagatgt

SEQ ID NO: 535072 - DNA, 10 bp, Homo sapiens
tgcacacaca

SEQ ID NO: 535073 - DNA, 19 bp, Homo sapiens
tgcacacagaaatatatat

SEQ ID NO: 535074 - DNA, 21 bp, Homo sapiens
tgcacacatcatctgtaagct

SEQ ID NO: 535075 - DNA, 17 bp, Homo sapiens
tgcacagtcactgctct

SEQ ID NO: 535076 - DNA, 13 bp, Homo sapiens
tgcacatccattc

SEQ ID NO: 535077 - DNA, 12 bp, Homo sapiens
tgcacatgattt

SEQ ID NO: 535078 - DNA, 18 bp, Homo sapiens
tgcacatgatttcacaaa

SEQ ID NO: 535079 - DNA, 23 bp, Homo sapiens
tgcacatgatttcacaaatatta

SEQ ID NO: 535080 - DNA, 22 bp, Homo sapiens
tgcacccgcatgtacaaaaaca

SEQ ID NO: 535081 - DNA, 19 bp, Homo sapiens
tgcaccggtttcatagacg

SEQ ID NO: 535082 - DNA, 17 bp, Homo sapiens
tgcacctcattccagtc

SEQ ID NO: 535083 - DNA, 14 bp, Homo sapiens
tgcacctgcttctc

SEQ ID NO: 535084 - DNA, 15 bp, Homo sapiens
tgcacggggccagca

SEQ ID NO: 535085 - DNA, 19 bp, Homo sapiens
tgcacgtagtagggtcagg

SEQ ID NO: 535086 - DNA, 15 bp, Homo sapiens
tgcactctagccgga

SEQ ID NO: 535087 - DNA, 18 bp, Homo sapiens
tgcactcttttgagcagt

SEQ ID NO: 535088 - DNA, 13 bp, Homo sapiens
tgcactgaagttt

SEQ ID NO: 535089 - DNA, 24 bp, Homo sapiens
tgcactgaagtttgataaatagtg

SEQ ID NO: 535090 - DNA, 17 bp, Homo sapiens
tgcactgccctccgccc

SEQ ID NO: 535091 - DNA, 17 bp, Homo sapiens
tgcacttggggcacagg

SEQ ID NO: 535092 - DNA, 14 bp, Homo sapiens
tgcagaactcccaa

SEQ ID NO: 535093 - DNA, 22 bp, Homo sapiens
tgcagaagggagctggctccag

SEQ ID NO: 535094 - DNA, 17 bp, Homo sapiens
tgcagacaatcttctgt

SEQ ID NO: 535095 - DNA, 22 bp, Homo sapiens
tgcagacagggggccagaacac

SEQ ID NO: 535096 - DNA, 22 bp, Homo sapiens
tgcagactggtgttaatgagta

SEQ ID NO: 535097 - DNA, 13 bp, Homo sapiens
tgcagagctgaag

SEQ ID NO: 535098 - DNA, 19 bp, Homo sapiens
tgcagagttcagggaagat

SEQ ID NO: 535099 - DNA, 16 bp, Homo sapiens
tgcagataattctgga

SEQ ID NO: 535100 - DNA, 22 bp, Homo sapiens
tgcagataattctggaccagag

SEQ ID NO: 535101 - DNA, 21 bp, Homo sapiens
tgcagccttaaacagtgtcca

SEQ ID NO: 535102 - DNA, 17 bp, Homo sapiens
tgcagctatggacaatt

SEQ ID NO: 535103 - DNA, 15 bp, Homo sapiens
tgcagctcttcctgg

SEQ ID NO: 535104 - DNA, 15 bp, Homo sapiens
tgcaggaatcaaaaa

SEQ ID NO: 535105 - DNA, 21 bp, Homo sapiens
tgcaggattctcaccagctgt

SEQ ID NO: 535106 - DNA, 20 bp, Homo sapiens
tgcaggcggtatccagaggt

SEQ ID NO: 535107 - DNA, 21 bp, Homo sapiens
tgcaggcggtatccagaggtg

SEQ ID NO: 535108 - DNA, 20 bp, Homo sapiens
tgcataatatgcatatatat

SEQ ID NO: 535109 - DNA, 22 bp, Homo sapiens
tgcataatatgcatatatatgt

SEQ ID NO: 535110 - DNA, 19 bp, Homo sapiens
tgcataattctgaagttat

SEQ ID NO: 535111 - DNA, 12 bp, Homo sapiens
tgcatacaaaca

SEQ ID NO: 535112 - DNA, 13 bp, Homo sapiens
tgcatagaataat

SEQ ID NO: 535113 - DNA, 14 bp, Homo sapiens
tgcatatcttcatc

SEQ ID NO: 535114 - DNA, 14 bp, Homo sapiens
tgcatcagtattaa

SEQ ID NO: 535115 - DNA, 14 bp, Homo sapiens
tgcatcccacagcc

SEQ ID NO: 535116 - DNA, 23 bp, Homo sapiens
tgcatccccatccccatgccctc

SEQ ID NO: 535117 - DNA, 18 bp, Homo sapiens
tgcatgctttccatattt

SEQ ID NO: 535118 - DNA, 16 bp, Homo sapiens
tgcatggcacatacca

SEQ ID NO: 535119 - DNA, 13 bp, Homo sapiens
taagtgttctgtg

SEQ ID NO: 535120 - DNA, 19 bp, Homo sapiens
taagtgtttcacagtgtct

SEQ ID NO: 535121 - DNA, 23 bp, Homo sapiens
taagttcccatttccttgtctaa

SEQ ID NO: 535122 - DNA, 17 bp, Homo sapiens
taagttggaaacactaa

SEQ ID NO: 535123 - DNA, 21 bp, Homo sapiens
taagttggaaacactaaatgt

SEQ ID NO: 535124 - DNA, 21 bp, Homo sapiens
taataaagtatgaatatttca

SEQ ID NO: 535125 - DNA, 13 bp, Homo sapiens
taataaccagaca

SEQ ID NO: 535126 - DNA, 14 bp, Homo sapiens
taataaccagacac

SEQ ID NO: 535127 - DNA, 11 bp, Homo sapiens
taataatacaa

SEQ ID NO: 535128 - DNA, 12 bp, Homo sapiens
taataatacaag

SEQ ID NO: 535129 - DNA, 15 bp, Homo sapiens
taatagcctcacctt

SEQ ID NO: 535130 - DNA, 23 bp, Homo sapiens
taatataactgccttaaaacttt

SEQ ID NO: 535131 - DNA, 19 bp, Homo sapiens
taatataatggaagagaaa

SEQ ID NO: 535132 - DNA, 16 bp, Homo sapiens
taatatacagtgtgta

SEQ ID NO: 535133 - DNA, 19 bp, Homo sapiens
taatatgtattttatgtat

SEQ ID NO: 535134 - DNA, 19 bp, Homo sapiens
taatattgaaaatgtcact

SEQ ID NO: 535135 - DNA, 20 bp, Homo sapiens
taatcaaagctcataatgga

SEQ ID NO: 535136 - DNA, 12 bp, Homo sapiens
taatcatattag

SEQ ID NO: 535137 - DNA, 16 bp, Homo sapiens
taatccatgtgctgct

SEQ ID NO: 535138 - DNA, 14 bp, Homo sapiens
taatgaagatcttt

SEQ ID NO: 535139 - DNA, 22 bp, Homo sapiens
taatgagctcctgctcattgtg

SEQ ID NO: 535140 - DNA, 15 bp, Homo sapiens
taatgagtatatgta

SEQ ID NO: 535141 - DNA, 22 bp, Homo sapiens
taatgataaaatcccattgtat

SEQ ID NO: 535142 - DNA, 14 bp, Homo sapiens
taatggaagagaaa

SEQ ID NO: 535143 - DNA, 17 bp, Homo sapiens
taatggtaacttttgta

SEQ ID NO: 535144 - DNA, 21 bp, Homo sapiens
taatggtaacttttgtagtct

SEQ ID NO: 535145 - DNA, 21 bp, Homo sapiens
taatgtaactgctcttgggca

SEQ ID NO: 535146 - DNA, 13 bp, Homo sapiens
taatgtattttca

SEQ ID NO: 535147 - DNA, 20 bp, Homo sapiens
taatgtgatggatggcacaa

SEQ ID NO: 535148 - DNA, 13 bp, Homo sapiens
taatgtggcttct

SEQ ID NO: 535149 - DNA, 20 bp, Homo sapiens
taatgtgtaaaattggatta

SEQ ID NO: 535150 - DNA, 13 bp, Homo sapiens
taatgtgtgtatg

SEQ ID NO: 535151 - DNA, 22 bp, Homo sapiens
tactcatttctaaaagaatatt

SEQ ID NO: 535152 - DNA, 17 bp, Homo sapiens
tactctgagtcctcatt

SEQ ID NO: 535153 - DNA, 11 bp, Homo sapiens
tactgaataaa

SEQ ID NO: 535154 - DNA, 17 bp, Homo sapiens
tactgttcctttcagat

SEQ ID NO: 535155 - DNA, 14 bp, Homo sapiens
tactgttttgtgcg

SEQ ID NO: 535156 - DNA, 23 bp, Homo sapiens
tactgttttgtgcggtgtgtctc

SEQ ID NO: 535157 - DNA, 19 bp, Homo sapiens
tacttaagagaaatggcaa

SEQ ID NO: 535158 - DNA, 15 bp, Homo sapiens
tacttatattctgca

SEQ ID NO: 535159 - DNA, 12 bp, Homo sapiens
tacttcctgcct

SEQ ID NO: 535160 - DNA, 14 bp, Homo sapiens
tacttcctgggtca

SEQ ID NO: 535161 - DNA, 14 bp, Homo sapiens
tacttgatttttca

SEQ ID NO: 535162 - DNA, 10 bp, Homo sapiens
tacttggcac

SEQ ID NO: 535163 - DNA, 16 bp, Homo sapiens
tacttggcaccaataa

SEQ ID NO: 535164 - DNA, 23 bp, Homo sapiens
tacttggcaccaataaaggagga

SEQ ID NO: 535165 - DNA, 14 bp, Homo sapiens
tacttgtctttctg

SEQ ID NO: 535166 - DNA, 19 bp, Homo sapiens
tacttgttatgttgtaata

SEQ ID NO: 535167 - DNA, 15 bp, Homo sapiens
tactttaaattgtgg

SEQ ID NO: 535168 - DNA, 22 bp, Homo sapiens
tactttaggtagtagaatctca

SEQ ID NO: 535169 - DNA, 19 bp, Homo sapiens
tactttatagaagaatgca

SEQ ID NO: 535170 - DNA, 19 bp, Homo sapiens
tactttccaattctccttt

SEQ ID NO: 535171 - DNA, 17 bp, Homo sapiens
tactttctgtactaaac

SEQ ID NO: 535172 - DNA, 21 bp, Homo sapiens
tactttctgtactaaacattt

SEQ ID NO: 535173 - DNA, 19 bp, Homo sapiens
tactttctgttatctagaa

SEQ ID NO: 535174 - DNA, 15 bp, Homo sapiens
tactttgattcacat

SEQ ID NO: 535175 - DNA, 23 bp, Homo sapiens
tactttgattcacatgttttcaa

SEQ ID NO: 535176 - DNA, 13 bp, Homo sapiens
tactttgttaatt

SEQ ID NO: 535177 - DNA, 12 bp, Homo sapiens
tagaaaaggaag

SEQ ID NO: 535178 - DNA, 17 bp, Homo sapiens
tagaaacaccaaaaaaa

SEQ ID NO: 535179 - DNA, 20 bp, Homo sapiens
tagaaagtgttctgttacaa

SEQ ID NO: 535180 - DNA, 23 bp, Homo sapiens
tagaaattttatctcttcttcct

SEQ ID NO: 535181 - DNA, 16 bp, Homo sapiens
tagaactttaaaagaa

SEQ ID NO: 535182 - DNA, 18 bp, Homo sapiens
tagaagtcttcatgaaat

SEQ ID NO: 535183 - DNA, 20 bp, Homo sapiens
tagaagtcttcatgaaatgc

SEQ ID NO: 535184 - DNA, 21 bp, Homo sapiens
tagaataatgaagatctttgt

SEQ ID NO: 535185 - DNA, 16 bp, Homo sapiens
tagaatccgaagggaa

SEQ ID NO: 535186 - DNA, 14 bp, Homo sapiens
tagaatctcagcac

SEQ ID NO: 535187 - DNA, 16 bp, Homo sapiens
tagaatgaccttgtaa

SEQ ID NO: 535188 - DNA, 19 bp, Homo sapiens
tagaatgaccttgtaatgt

SEQ ID NO: 535189 - DNA, 15 bp, Homo sapiens
tagacaggagaagaa

SEQ ID NO: 535190 - DNA, 13 bp, Homo sapiens
tagacataaattg

SEQ ID NO: 535191 - DNA, 15 bp, Homo sapiens
tagacataaattgta

SEQ ID NO: 535192 - DNA, 19 bp, Homo sapiens
tagactatatacatgtgtg

SEQ ID NO: 535193 - DNA, 20 bp, Homo sapiens
tagactatatacatgtgtgt

SEQ ID NO: 535194 - DNA, 18 bp, Homo sapiens
tagactctaaaactatca

SEQ ID NO: 535195 - DNA, 23 bp, Homo sapiens
tagacttcagggagtcagctgtt

SEQ ID NO: 535196 - DNA, 24 bp, Homo sapiens
tagagaaatacatgttgtaaatgg

SEQ ID NO: 535197 - DNA, 22 bp, Homo sapiens
tagagacagagcgacagagcag

SEQ ID NO: 535198 - DNA, 13 bp, Homo sapiens
tagagatattgga

SEQ ID NO: 535199 - DNA, 19 bp, Homo sapiens
tagagcagatgacccctcc

SEQ ID NO: 535200 - DNA, 14 bp, Homo sapiens
tagagcagcccaaa

SEQ ID NO: 535201 - DNA, 17 bp, Homo sapiens
tagagtatattgaaaag

SEQ ID NO: 535202 - DNA, 19 bp, Homo sapiens
tagataccattttgaaata

SEQ ID NO: 535203 - DNA, 17 bp, Homo sapiens
tagattttcatgttctt

SEQ ID NO: 535204 - DNA, 14 bp, Homo sapiens
tagcaaaaaaagtt

SEQ ID NO: 535205 - DNA, 23 bp, Homo sapiens
tagcaaaaggatgatttaacatt

SEQ ID NO: 535206 - DNA, 22 bp, Homo sapiens
tagcaaatgagacagcagtctt

SEQ ID NO: 535207 - DNA, 14 bp, Homo sapiens
tagcaaggaaggac

SEQ ID NO: 535208 - DNA, 15 bp, Homo sapiens
tagcaaggaaggaca

SEQ ID NO: 535209 - DNA, 16 bp, Homo sapiens
tagcaaggaaggacac

SEQ ID NO: 535210 - DNA, 14 bp, Homo sapiens
tagcacagctccct

SEQ ID NO: 535211 - DNA, 19 bp, Homo sapiens
tagcactttgggaggctga

SEQ ID NO: 535212 - DNA, 17 bp, Homo sapiens
tagcagcaaaaatataa

SEQ ID NO: 535213 - DNA, 18 bp, Homo sapiens
tagcagcaaaaatataaa

SEQ ID NO: 535214 - DNA, 15 bp, Homo sapiens
tagcatttatggtaa

SEQ ID NO: 535215 - DNA, 19 bp, Homo sapiens
tagccaacggccccagctt

SEQ ID NO: 535216 - DNA, 15 bp, Homo sapiens
tagccccctcttccc

SEQ ID NO: 535217 - DNA, 19 bp, Homo sapiens
tagcctagctttctaaagc

SEQ ID NO: 535218 - DNA, 19 bp, Homo sapiens
tagcgttgttttgtggata

SEQ ID NO: 535219 - DNA, 21 bp, Homo sapiens
tagctacccaaaagagaaaaa

SEQ ID NO: 535220 - DNA, 20 bp, Homo sapiens
tagctgtcatggtgcaattt

SEQ ID NO: 535221 - DNA, 13 bp, Homo sapiens
tagcttatctttc

SEQ ID NO: 535222 - DNA, 15 bp, Homo sapiens
tagcttatctttctt

SEQ ID NO: 535223 - DNA, 20 bp, Homo sapiens
tagcttatctttctttccat

SEQ ID NO: 535224 - DNA, 13 bp, Homo sapiens
tagcttttcaaac

SEQ ID NO: 535225 - DNA, 12 bp, Homo sapiens
taggaacccggc

SEQ ID NO: 535226 - DNA, 21 bp, Homo sapiens
taggaaggcacttctgcctga

SEQ ID NO: 535227 - DNA, 23 bp, Homo sapiens
taggaaggtcatttccatgtatg

SEQ ID NO: 535228 - DNA, 21 bp, Homo sapiens
taggaagttagcctttatcta

SEQ ID NO: 535229 - DNA, 16 bp, Homo sapiens
taggaatattatattt

SEQ ID NO: 535230 - DNA, 23 bp, Homo sapiens
taggaatattatatttggatgca

SEQ ID NO: 535231 - DNA, 15 bp, Homo sapiens
taggacaaggtgcag

SEQ ID NO: 535232 - DNA, 17 bp, Homo sapiens
taggacatctctgtaaa

SEQ ID NO: 535233 - DNA, 22 bp, Homo sapiens
taggacatctctgtaaaaagca

SEQ ID NO: 535234 - DNA, 17 bp, Homo sapiens
taggatatgcctgctct

SEQ ID NO: 535235 - DNA, 18 bp, Homo sapiens
taggatatgcctgctctt

SEQ ID NO: 535236 - DNA, 19 bp, Homo sapiens
taggcaagatggcacaggg

SEQ ID NO: 535237 - DNA, 18 bp, Homo sapiens
taggccaaagacaaatag

SEQ ID NO: 535238 - DNA, 14 bp, Homo sapiens
taggccctttcagt

SEQ ID NO: 535239 - DNA, 15 bp, Homo sapiens
taggccctttcagtg

SEQ ID NO: 535240 - DNA, 20 bp, Homo sapiens
taggctccttcaacaaggct

SEQ ID NO: 535241 - DNA, 16 bp, Homo sapiens
tagggctctaatttcc

SEQ ID NO: 535242 - DNA, 21 bp, Homo sapiens
taggtttagaatcaagtctgt

SEQ ID NO: 535243 - DNA, 23 bp, Homo sapiens
taggtttagaatcaagtctgtga

SEQ ID NO: 535244 - DNA, 23 bp, Homo sapiens
tagtaagcggctcaagcccagga

SEQ ID NO: 535245 - DNA, 14 bp, Homo sapiens
tagtactttataga

SEQ ID NO: 535246 - DNA, 16 bp, Homo sapiens
tagtactttatagaag

SEQ ID NO: 535247 - DNA, 16 bp, Homo sapiens
tagtaggggtaccact

SEQ ID NO: 535248 - DNA, 14 bp, Homo sapiens
tagtatttgaaaac

SEQ ID NO: 535249 - DNA, 19 bp, Homo sapiens
tagtcatttattttaaaaa

SEQ ID NO: 535250 - DNA, 13 bp, Homo sapiens
tagtcctcacctt

SEQ ID NO: 535251 - DNA, 17 bp, Homo sapiens
tagtgcaatatattttg

SEQ ID NO: 535252 - DNA, 15 bp, Homo sapiens
tagtgcagcagggca

SEQ ID NO: 535253 - DNA, 22 bp, Homo sapiens
tagtgctatatatataaatatt

SEQ ID NO: 535254 - DNA, 15 bp, Homo sapiens
tagtggaccctgaaa

SEQ ID NO: 535255 - DNA, 20 bp, Homo sapiens
tagtggaccctgaaatgtgt

SEQ ID NO: 535256 - DNA, 18 bp, Homo sapiens
tagtggcttcagcccctg

SEQ ID NO: 535257 - DNA, 16 bp, Homo sapiens
tagtgtctctatttat

SEQ ID NO: 535258 - DNA, 20 bp, Homo sapiens
tagtgtctctatttatgaga

SEQ ID NO: 535259 - DNA, 13 bp, Homo sapiens
tagtttgtttctg

SEQ ID NO: 535260 - DNA, 19 bp, Homo sapiens
tagttttattttctaaagt

SEQ ID NO: 535261 - DNA, 23 bp, Homo sapiens
tagttttattttctaaagtactg

SEQ ID NO: 535262 - DNA, 23 bp, Homo sapiens
tataaaaaaaatgaaatgtttta

SEQ ID NO: 535263 - DNA, 12 bp, Homo sapiens
tataaaagccca

SEQ ID NO: 535264 - DNA, 19 bp, Homo sapiens
tataaaagtttaaagaaga

SEQ ID NO: 535265 - DNA, 13 bp, Homo sapiens
tataaaatacacg

SEQ ID NO: 535266 - DNA, 15 bp, Homo sapiens
tataaaattagaaag

SEQ ID NO: 535267 - DNA, 18 bp, Homo sapiens
tataaaattagaaagcaa

SEQ ID NO: 535268 - DNA, 12 bp, Homo sapiens
tataaagaatag

SEQ ID NO: 535269 - DNA, 19 bp, Homo sapiens
tataaagcatctaaacttt

SEQ ID NO: 535270 - DNA, 14 bp, Homo sapiens
tataaataaatgtt

SEQ ID NO: 535271 - DNA, 13 bp, Homo sapiens
gttaaatgttttg

SEQ ID NO: 535272 - DNA, 18 bp, Homo sapiens
gttaaatgttttgtaaac

SEQ ID NO: 535273 - DNA, 17 bp, Homo sapiens
gttaacagtattttaag

SEQ ID NO: 535274 - DNA, 22 bp, Homo sapiens
gttaacattgttgctccctgtg

SEQ ID NO: 535275 - DNA, 15 bp, Homo sapiens
gttaataacagctcc

SEQ ID NO: 535276 - DNA, 16 bp, Homo sapiens
gttaataacagctcct

SEQ ID NO: 535277 - DNA, 17 bp, Homo sapiens
gttaataacagctcctt

SEQ ID NO: 535278 - DNA, 14 bp, Homo sapiens
gttaatcttcatgg

SEQ ID NO: 535279 - DNA, 22 bp, Homo sapiens
gttaatttcttgcaatttgaag

SEQ ID NO: 535280 - DNA, 14 bp, Homo sapiens
gttacaaaatgtaa

SEQ ID NO: 535281 - DNA, 21 bp, Homo sapiens
gttacaaaatgtaactgttac

SEQ ID NO: 535282 - DNA, 21 bp, Homo sapiens
gttaccattggaaatttcacg

SEQ ID NO: 535283 - DNA, 12 bp, Homo sapiens
gttaccttaaat

SEQ ID NO: 535284 - DNA, 15 bp, Homo sapiens
gttactacctcctct

SEQ ID NO: 535285 - DNA, 17 bp, Homo sapiens
gttacttttccttgcat

SEQ ID NO: 535286 - DNA, 19 bp, Homo sapiens
gttaggattaggtttagaa

SEQ ID NO: 535287 - DNA, 22 bp, Homo sapiens
gttaggattaggtttagaatca

SEQ ID NO: 535288 - DNA, 22 bp, Homo sapiens
gttaggccaaagacaaatagta

SEQ ID NO: 535289 - DNA, 19 bp, Homo sapiens
gttataaattttgtacatt

SEQ ID NO: 535290 - DNA, 19 bp, Homo sapiens
gttatcattcttataacat

SEQ ID NO: 535291 - DNA, 16 bp, Homo sapiens
gttatcctttgtgagc

SEQ ID NO: 535292 - DNA, 14 bp, Homo sapiens
gttatctagaaatt

SEQ ID NO: 535293 - DNA, 15 bp, Homo sapiens
gttatctagaaatta

SEQ ID NO: 535294 - DNA, 13 bp, Homo sapiens
gttatcttagctg

SEQ ID NO: 535295 - DNA, 18 bp, Homo sapiens
gttattcgttactctaag

SEQ ID NO: 535296 - DNA, 19 bp, Homo sapiens
gttatttatagtcatttat

SEQ ID NO: 535297 - DNA, 19 bp, Homo sapiens
gttcaaagtcatgatgttt

SEQ ID NO: 535298 - DNA, 16 bp, Homo sapiens
gttcacccctccaccc

SEQ ID NO: 535299 - DNA, 17 bp, Homo sapiens
gttcagaaaagcacctc

SEQ ID NO: 535300 - DNA, 15 bp, Homo sapiens
gttcagtgtttctgg

SEQ ID NO: 535301 - DNA, 16 bp, Homo sapiens
gttcatcccttctctt

SEQ ID NO: 535302 - DNA, 14 bp, Homo sapiens
gttcattcatatta

SEQ ID NO: 535303 - DNA, 17 bp, Homo sapiens
gttccaaacatgaggtt

SEQ ID NO: 535304 - DNA, 23 bp, Homo sapiens
gttccaaacatgaggttctctct

SEQ ID NO: 535305 - DNA, 17 bp, Homo sapiens
gttccagattcccagct

SEQ ID NO: 535306 - DNA, 16 bp, Homo sapiens
gttccatgaagacaaa

SEQ ID NO: 535307 - DNA, 18 bp, Homo sapiens
gttcccccaggaccctga

SEQ ID NO: 535308 - DNA, 15 bp, Homo sapiens
gttccctcagccctc

SEQ ID NO: 535309 - DNA, 19 bp, Homo sapiens
gttccctcagccctcatta

SEQ ID NO: 535310 - DNA, 15 bp, Homo sapiens
gttcctttcagatga

SEQ ID NO: 535311 - DNA, 16 bp, Homo sapiens
gttctgtgtctgctgt

SEQ ID NO: 535312 - DNA, 20 bp, Homo sapiens
gttctgttacaaaatgtaac

SEQ ID NO: 535313 - DNA, 21 bp, Homo sapiens
gttcttaaaaatgcatttaag

SEQ ID NO: 535314 - DNA, 14 bp, Homo sapiens
gttcttccaaagca

SEQ ID NO: 535315 - DNA, 19 bp, Homo sapiens
gttcttccagttactttcc

SEQ ID NO: 535316 - DNA, 16 bp, Homo sapiens
gttcttgagcagctga

SEQ ID NO: 535317 - DNA, 11 bp, Homo sapiens
gttcttggaac

SEQ ID NO: 535318 - DNA, 19 bp, Homo sapiens
gttctttccatctttagaa

SEQ ID NO: 535319 - DNA, 18 bp, Homo sapiens
gtctaagaaacattggaa

SEQ ID NO: 535320 - DNA, 17 bp, Homo sapiens
gtctaatgtttaagcag

SEQ ID NO: 535321 - DNA, 21 bp, Homo sapiens
gtctacagctcccccagctcc

SEQ ID NO: 535322 - DNA, 21 bp, Homo sapiens
gtctatgatgtccaaacttaa

SEQ ID NO: 535323 - DNA, 16 bp, Homo sapiens
gtctcagaatctttcc

SEQ ID NO: 535324 - DNA, 22 bp, Homo sapiens
gtctcatagttggactttctag

SEQ ID NO: 535325 - DNA, 20 bp, Homo sapiens
gtctcccccacccttgttcc

SEQ ID NO: 535326 - DNA, 20 bp, Homo sapiens
gtctcctctatcctgggctt

SEQ ID NO: 535327 - DNA, 19 bp, Homo sapiens
gtctcctgcccccacacct

SEQ ID NO: 535328 - DNA, 23 bp, Homo sapiens
gtctcctgcccccacacctggcc

SEQ ID NO: 535329 - DNA, 15 bp, Homo sapiens
gtctcctgtatcatt

SEQ ID NO: 535330 - DNA, 18 bp, Homo sapiens
gtctcctgtatcatttct

SEQ ID NO: 535331 - DNA, 19 bp, Homo sapiens
gtctcggaacctgtgagct

SEQ ID NO: 535332 - DNA, 15 bp, Homo sapiens
gtctcggccttcaca

SEQ ID NO: 535333 - DNA, 17 bp, Homo sapiens
gtctctcttttgctctc

SEQ ID NO: 535334 - DNA, 21 bp, Homo sapiens
gtctctgccatgaactggagg

SEQ ID NO: 535335 - DNA, 11 bp, Homo sapiens
gtctcttctcc

SEQ ID NO: 535336 - DNA, 19 bp, Homo sapiens
gtctctttcttcctttcta

SEQ ID NO: 535337 - DNA, 17 bp, Homo sapiens
gtctgaggttgggagag

SEQ ID NO: 535338 - DNA, 20 bp, Homo sapiens
gtctgcattttctgaaacta

SEQ ID NO: 535339 - DNA, 21 bp, Homo sapiens
gtctgcattttctgaaactaa

SEQ ID NO: 535340 - DNA, 14 bp, Homo sapiens
gtctgctccagctc

SEQ ID NO: 535341 - DNA, 20 bp, Homo sapiens
gtctgctggtcacttcttct

SEQ ID NO: 535342 - DNA, 23 bp, Homo sapiens
gtctgctgtaagacggccttgga

SEQ ID NO: 535343 - DNA, 17 bp, Homo sapiens
gtctggagaccaggact

SEQ ID NO: 535344 - DNA, 18 bp, Homo sapiens
gtctggaggacctgcccg

SEQ ID NO: 535345 - DNA, 19 bp, Homo sapiens
gtctgtcccagttaactgt

SEQ ID NO: 535346 - DNA, 22 bp, Homo sapiens
gtctgtctctcttttgctctct

SEQ ID NO: 535347 - DNA, 14 bp, Homo sapiens
gtcttactttgtta

SEQ ID NO: 535348 - DNA, 20 bp, Homo sapiens
gtcttactttgttaatttat

SEQ ID NO: 535349 - DNA, 21 bp, Homo sapiens
gtcttatgcttccagaaacac

SEQ ID NO: 535350 - DNA, 13 bp, Homo sapiens
gtcttcatgaaat

SEQ ID NO: 535351 - DNA, 14 bp, Homo sapiens
gtcttcctactctt

SEQ ID NO: 535352 - DNA, 16 bp, Homo sapiens
gtcttcctactcttct

SEQ ID NO: 535353 - DNA, 23 bp, Homo sapiens
gtcttggtttccatcaaagccct

SEQ ID NO: 535354 - DNA, 13 bp, Homo sapiens
gtcttgtattatc

SEQ ID NO: 535355 - DNA, 14 bp, Homo sapiens
gtctttctccaaag

SEQ ID NO: 535356 - DNA, 16 bp, Homo sapiens
gtctttctccaaagtt

SEQ ID NO: 535357 - DNA, 10 bp, Homo sapiens
gtcttttaaa

SEQ ID NO: 535358 - DNA, 14 bp, Homo sapiens
gtgaaacacaatat

SEQ ID NO: 535359 - DNA, 23 bp, Homo sapiens
gtgaaccaagctataaaagccca

SEQ ID NO: 535360 - DNA, 21 bp, Homo sapiens
gtgaactaatgacaagtgact

SEQ ID NO: 535361 - DNA, 23 bp, Homo sapiens
gtgaactttctcagcatatatat

SEQ ID NO: 535362 - DNA, 16 bp, Homo sapiens
gtgaagagtgaagagc

SEQ ID NO: 535363 - DNA, 21 bp, Homo sapiens
gtgaaggaccttcactctaag

SEQ ID NO: 535364 - DNA, 12 bp, Homo sapiens
gtgaatagcagt

SEQ ID NO: 535365 - DNA, 16 bp, Homo sapiens
gtgacatgcgggctgg

SEQ ID NO: 535366 - DNA, 17 bp, Homo sapiens
gtgaccaatcgggagta

SEQ ID NO: 535367 - DNA, 20 bp, Homo sapiens
gtgacctctagccctgcccg

SEQ ID NO: 535368 - DNA, 18 bp, Homo sapiens
gtgaggaaagcacacagt

SEQ ID NO: 535369 - DNA, 19 bp, Homo sapiens
gtgaggtcctgggggcctg

SEQ ID NO: 535370 - DNA, 17 bp, Homo sapiens
gtgaggttgtgctgcct

SEQ ID NO: 535371 - DNA, 17 bp, Homo sapiens
gtgagtttgctggttgt

SEQ ID NO: 535372 - DNA, 13 bp, Homo sapiens
gtgagtttgtttc

SEQ ID NO: 535373 - DNA, 16 bp, Homo sapiens
gtgatatcctgaaaaa

SEQ ID NO: 535374 - DNA, 14 bp, Homo sapiens
gtgatcactttctg

SEQ ID NO: 535375 - DNA, 18 bp, Homo sapiens
gtgatctgtccttccaac

SEQ ID NO: 535376 - DNA, 14 bp, Homo sapiens
gtgatctgttgtaa

SEQ ID NO: 535377 - DNA, 16 bp, Homo sapiens
gtgatgtttttatgat

SEQ ID NO: 535378 - DNA, 18 bp, Homo sapiens
gtgattccccggagctgg

SEQ ID NO: 535379 - DNA, 18 bp, Homo sapiens
gtgattcgagctatattt

SEQ ID NO: 535380 - DNA, 12 bp, Homo sapiens
gtgattttcaaa

SEQ ID NO: 535381 - DNA, 15 bp, Homo sapiens
gtgcaatatattttg

SEQ ID NO: 535382 - DNA, 15 bp, Homo sapiens
gtgcaatttgtcttt

SEQ ID NO: 535383 - DNA, 21 bp, Homo sapiens
gtgcacacagaaatatatata

SEQ ID NO: 535384 - DNA, 22 bp, Homo sapiens
gtgcacacagaaatatatatac

SEQ ID NO: 535385 - DNA, 22 bp, Homo sapiens
gtgcacctgggacagggagcag

SEQ ID NO: 535386 - DNA, 23 bp, Homo sapiens
gtgcacctgggacagggagcagc

SEQ ID NO: 535387 - DNA, 14 bp, Homo sapiens
gtgcacggggccag

SEQ ID NO: 535388 - DNA, 19 bp, Homo sapiens
gtgcacggggccagcatcc

SEQ ID NO: 535389 - DNA, 15 bp, Homo sapiens
gtgcaggagcgctcc

SEQ ID NO: 535390 - DNA, 24 bp, Homo sapiens
gtgccaaatcctgggcatccccag

SEQ ID NO: 535391 - DNA, 15 bp, Homo sapiens
gtgccccccatgccc

SEQ ID NO: 535392 - DNA, 18 bp, Homo sapiens
gtgcctctgattctatgt

SEQ ID NO: 535393 - DNA, 19 bp, Homo sapiens
gtgcctgagagcagaatga

SEQ ID NO: 535394 - DNA, 20 bp, Homo sapiens
gtgcctgtgaccggggtcct

SEQ ID NO: 535395 - DNA, 14 bp, Homo sapiens
gtgctaaacgtgta

SEQ ID NO: 535396 - DNA, 20 bp, Homo sapiens
gtgctaaacgtgtatgtttt

SEQ ID NO: 535397 - DNA, 20 bp, Homo sapiens
gtgctatatatataaatatt

SEQ ID NO: 535398 - DNA, 22 bp, Homo sapiens
gtgctcatcagaaacaatttct

SEQ ID NO: 535399 - DNA, 15 bp, Homo sapiens
gtgctctcaccagct

SEQ ID NO: 535400 - DNA, 13 bp, Homo sapiens
gtggaaggagaaa

SEQ ID NO: 535401 - DNA, 13 bp, Homo sapiens
gtggacatgcacc

SEQ ID NO: 535402 - DNA, 17 bp, Homo sapiens
gtggacatgcacccgca

SEQ ID NO: 535403 - DNA, 23 bp, Homo sapiens
gtggaccctgaaatgtgtgtgat

SEQ ID NO: 535404 - DNA, 13 bp, Homo sapiens
gtggactgtattt

SEQ ID NO: 535405 - DNA, 14 bp, Homo sapiens
gtggagcccaggag

SEQ ID NO: 535406 - DNA, 17 bp, Homo sapiens
gtggaggagagcctggt

SEQ ID NO: 535407 - DNA, 22 bp, Homo sapiens
gtggagtcagcctcgcaggcct

SEQ ID NO: 535408 - DNA, 15 bp, Homo sapiens
gtggattgttttttc

SEQ ID NO: 535409 - DNA, 14 bp, Homo sapiens
gtggcacctgtctg

SEQ ID NO: 535410 - DNA, 12 bp, Homo sapiens
gtggcagtattg

SEQ ID NO: 535411 - DNA, 16 bp, Homo sapiens
gtggccactttaagag

SEQ ID NO: 535412 - DNA, 15 bp, Homo sapiens
gtggcctcaggaggc

SEQ ID NO: 535413 - DNA, 18 bp, Homo sapiens
gtggcctgactcccccag

SEQ ID NO: 535414 - DNA, 16 bp, Homo sapiens
gtggctgacccccctc

SEQ ID NO: 535415 - DNA, 20 bp, Homo sapiens
gtggcttactacatgtggga

SEQ ID NO: 535416 - DNA, 13 bp, Homo sapiens
gtggcttcagccc

SEQ ID NO: 535417 - DNA, 18 bp, Homo sapiens
gtggcttcccatgtcttt

SEQ ID NO: 535418 - DNA, 19 bp, Homo sapiens
gtggcttggagcagaggtg

SEQ ID NO: 535419 - DNA, 14 bp, Homo sapiens
gtggctttgtgctt

SEQ ID NO: 535420 - DNA, 13 bp, Homo sapiens
gtgggcggcagag

SEQ ID NO: 535421 - DNA, 16 bp, Homo sapiens
gtgggcggcagagagg

SEQ ID NO: 535422 - DNA, 12 bp, Homo sapiens
gtggggcagcac

SEQ ID NO: 535423 - DNA, 23 bp, Homo sapiens
gtggggcagcacagagagggggc

SEQ ID NO: 535424 - DNA, 13 bp, Homo sapiens
gtggggggcagga

SEQ ID NO: 535425 - DNA, 18 bp, Homo sapiens
gtggggggcaggatgggg

SEQ ID NO: 535426 - DNA, 18 bp, Homo sapiens
gtggtccacattctgctg

SEQ ID NO: 535427 - DNA, 16 bp, Homo sapiens
gtgtaaaattggatta

SEQ ID NO: 535428 - DNA, 18 bp, Homo sapiens
gtgtacatttatgtgtga

SEQ ID NO: 535429 - DNA, 15 bp, Homo sapiens
gtgtactctgagtcc

SEQ ID NO: 535430 - DNA, 17 bp, Homo sapiens
gtgtataagtgcacaca

SEQ ID NO: 535431 - DNA, 15 bp, Homo sapiens
gtgtatatatacata

SEQ ID NO: 535432 - DNA, 13 bp, Homo sapiens
gtgtatatatgtg

SEQ ID NO: 535433 - DNA, 22 bp, Homo sapiens
gtgtatatatgtgtatatatac

SEQ ID NO: 535434 - DNA, 12 bp, Homo sapiens
gtgtatgtgtat

SEQ ID NO: 535435 - DNA, 14 bp, Homo sapiens
gtgtcaagtggcaa

SEQ ID NO: 535436 - DNA, 19 bp, Homo sapiens
gtgtcaggattgaggatga

SEQ ID NO: 535437 - DNA, 19 bp, Homo sapiens
gtgtcagtttatgttttgg

SEQ ID NO: 535438 - DNA, 14 bp, Homo sapiens
gtgtcccgttgtgt

SEQ ID NO: 535439 - DNA, 15 bp, Homo sapiens
gtgtctctatttatg

SEQ ID NO: 535440 - DNA, 13 bp, Homo sapiens
gtgtctgtaaatc

SEQ ID NO: 535441 - DNA, 23 bp, Homo sapiens
gtgtctgtcatttctctttcaaa

SEQ ID NO: 535442 - DNA, 13 bp, Homo sapiens
gtgtgaggcagga

SEQ ID NO: 535443 - DNA, 17 bp, Homo sapiens
gtgtgcatgtgtgtata

SEQ ID NO: 535444 - DNA, 18 bp, Homo sapiens
gtgtgcttacctgttgtc

SEQ ID NO: 535445 - DNA, 22 bp, Homo sapiens
gtgtgtataagtgcacacagaa

SEQ ID NO: 535446 - DNA, 15 bp, Homo sapiens
gtgtgtatgtgtatt

SEQ ID NO: 535447 - DNA, 15 bp, Homo sapiens
gtgtgtgatgtgaca

SEQ ID NO: 535448 - DNA, 18 bp, Homo sapiens
gtgtgtttcatccttccc

SEQ ID NO: 535449 - DNA, 22 bp, Homo sapiens
gtgttattgagagagatgtgta

SEQ ID NO: 535450 - DNA, 14 bp, Homo sapiens
gtgttctgttacaa

SEQ ID NO: 535451 - DNA, 17 bp, Homo sapiens
gtgttctgttacaaaat

SEQ ID NO: 535452 - DNA, 19 bp, Homo sapiens
gtgttctgttacaaaatgt

SEQ ID NO: 535453 - DNA, 23 bp, Homo sapiens
gtgttgctcagagtgaagagtga

SEQ ID NO: 535454 - DNA, 12 bp, Homo sapiens
gtgtttaactga

SEQ ID NO: 535455 - DNA, 12 bp, Homo sapiens
gtgtttctgggg

SEQ ID NO: 535456 - DNA, 12 bp, Homo sapiens
gtgtttgtctct

SEQ ID NO: 535457 - DNA, 15 bp, Homo sapiens
gtgtttgtctcttct

SEQ ID NO: 535458 - DNA, 17 bp, Homo sapiens
gtgtttgtctcttctgg

SEQ ID NO: 535459 - DNA, 14 bp, Homo sapiens
gtgttttcttcgtg

SEQ ID NO: 535460 - DNA, 13 bp, Homo sapiens
gttaaaattatac

SEQ ID NO: 535461 - DNA, 11 bp, Homo sapiens
gttaaatgttt

SEQ ID NO: 535462 - DNA, 19 bp, Homo sapiens
ggtgcagacaatcttctgt

SEQ ID NO: 535463 - DNA, 12 bp, Homo sapiens
ggtgcctgtgac

SEQ ID NO: 535464 - DNA, 13 bp, Homo sapiens
ggtgcctgtgacc

SEQ ID NO: 535465 - DNA, 18 bp, Homo sapiens
ggtgctgggtccttaaaa

SEQ ID NO: 535466 - DNA, 13 bp, Homo sapiens
ggtggaaggagaa

SEQ ID NO: 535467 - DNA, 14 bp, Homo sapiens
ggtggagaaaggag

SEQ ID NO: 535468 - DNA, 13 bp, Homo sapiens
ggtggaggagagc

SEQ ID NO: 535469 - DNA, 18 bp, Homo sapiens
ggtggaggagagcctggt

SEQ ID NO: 535470 - DNA, 15 bp, Homo sapiens
ggtgggtgaaaggaa

SEQ ID NO: 535471 - DNA, 17 bp, Homo sapiens
ggtggtacttggcacca

SEQ ID NO: 535472 - DNA, 13 bp, Homo sapiens
ggttaacaaataa

SEQ ID NO: 535473 - DNA, 15 bp, Homo sapiens
ggttatagtgcaata

SEQ ID NO: 535474 - DNA, 17 bp, Homo sapiens
ggttcccccaggaccct

SEQ ID NO: 535475 - DNA, 17 bp, Homo sapiens
ggttgcagtgagctgag

SEQ ID NO: 535476 - DNA, 14 bp, Homo sapiens
ggttgggctctgcg

SEQ ID NO: 535477 - DNA, 23 bp, Homo sapiens
ggtttatcgccctggcaggcagg

SEQ ID NO: 535478 - DNA, 19 bp, Homo sapiens
ggtttccacacaggcccat

SEQ ID NO: 535479 - DNA, 20 bp, Homo sapiens
ggtttccacacaggcccatg

SEQ ID NO: 535480 - DNA, 18 bp, Homo sapiens
ggtttccatcaaagccct

SEQ ID NO: 535481 - DNA, 20 bp, Homo sapiens
ggtttccatcaaagccctcc

SEQ ID NO: 535482 - DNA, 22 bp, Homo sapiens
ggtttctcttctccccttccat

SEQ ID NO: 535483 - DNA, 17 bp, Homo sapiens
ggtttggctcctgccca

SEQ ID NO: 535484 - DNA, 20 bp, Homo sapiens
ggttttaaaatactgtagat

SEQ ID NO: 535485 - DNA, 17 bp, Homo sapiens
ggtttttatttctcctt

SEQ ID NO: 535486 - DNA, 19 bp, Homo sapiens
ggtttttatttctcctttt

SEQ ID NO: 535487 - DNA, 13 bp, Homo sapiens
gtaaaacagtggt

SEQ ID NO: 535488 - DNA, 19 bp, Homo sapiens
gtaaaattggattattact

SEQ ID NO: 535489 - DNA, 20 bp, Homo sapiens
gtaaaccgaggacccatgaa

SEQ ID NO: 535490 - DNA, 17 bp, Homo sapiens
gtaaacctgaacaaacc

SEQ ID NO: 535491 - DNA, 12 bp, Homo sapiens
gtaaactttaac

SEQ ID NO: 535492 - DNA, 15 bp, Homo sapiens
gtaaataaaaatagc

SEQ ID NO: 535493 - DNA, 18 bp, Homo sapiens
gtaaatctcttctgtgtt

SEQ ID NO: 535494 - DNA, 22 bp, Homo sapiens
gtaaatgaagtaacttgtctta

SEQ ID NO: 535495 - DNA, 12 bp, Homo sapiens
gtaaatgtcttc

SEQ ID NO: 535496 - DNA, 20 bp, Homo sapiens
gtaaatgtcttcatgttgat

SEQ ID NO: 535497 - DNA, 15 bp, Homo sapiens
gtaaattccaaagat

SEQ ID NO: 535498 - DNA, 14 bp, Homo sapiens
gtaacacaggccac

SEQ ID NO: 535499 - DNA, 18 bp, Homo sapiens
gtaacacttgaaaagtgt

SEQ ID NO: 535500 - DNA, 17 bp, Homo sapiens
gtaacattctatttcaa

SEQ ID NO: 535501 - DNA, 19 bp, Homo sapiens
gtaactattgggtgaatat

SEQ ID NO: 535502 - DNA, 12 bp, Homo sapiens
gtaactgaaagg

SEQ ID NO: 535503 - DNA, 13 bp, Homo sapiens
gtaactgttacca

SEQ ID NO: 535504 - DNA, 19 bp, Homo sapiens
gtaacttgctgtgaaatga

SEQ ID NO: 535505 - DNA, 21 bp, Homo sapiens
gtaacttgctgtgaaatgact

SEQ ID NO: 535506 - DNA, 15 bp, Homo sapiens
gtaagacggccttgg

SEQ ID NO: 535507 - DNA, 16 bp, Homo sapiens
gtaagcggctcaagcc

SEQ ID NO: 535508 - DNA, 22 bp, Homo sapiens
gtaagcggctcaagcccaggag

SEQ ID NO: 535509 - DNA, 20 bp, Homo sapiens
gtaagggactccagaagcag

SEQ ID NO: 535510 - DNA, 19 bp, Homo sapiens
gtaatataatggaagagaa

SEQ ID NO: 535511 - DNA, 17 bp, Homo sapiens
gtaatatcagttacagt

SEQ ID NO: 535512 - DNA, 20 bp, Homo sapiens
gtaatcacactctcttctta

SEQ ID NO: 535513 - DNA, 12 bp, Homo sapiens
gtaatcatatta

SEQ ID NO: 535514 - DNA, 12 bp, Homo sapiens
gtaatgtaactg

SEQ ID NO: 535515 - DNA, 16 bp, Homo sapiens
gtaattcttattccat

SEQ ID NO: 535516 - DNA, 12 bp, Homo sapiens
gtaattgttcca

SEQ ID NO: 535517 - DNA, 22 bp, Homo sapiens
gtaatttagtgtatatgtgatt

SEQ ID NO: 535518 - DNA, 18 bp, Homo sapiens
gtaatttataaaattaga

SEQ ID NO: 535519 - DNA, 16 bp, Homo sapiens
gtaatttttctgtata

SEQ ID NO: 535520 - DNA, 16 bp, Homo sapiens
gtacaaaaacacaaat

SEQ ID NO: 535521 - DNA, 18 bp, Homo sapiens
gtacaataaataaaagaa

SEQ ID NO: 535522 - DNA, 14 bp, Homo sapiens
gtacaatcatgaac

SEQ ID NO: 535523 - DNA, 20 bp, Homo sapiens
gtacacacacagacacacaa

SEQ ID NO: 535524 - DNA, 19 bp, Homo sapiens
gtacaggtcatctgctggg

SEQ ID NO: 535525 - DNA, 22 bp, Homo sapiens
gtacatattagcgacaacagat

SEQ ID NO: 535526 - DNA, 20 bp, Homo sapiens
gtacatctcccctttgctaa

SEQ ID NO: 535527 - DNA, 21 bp, Homo sapiens
gtacatttatgtgtgaagcaa

SEQ ID NO: 535528 - DNA, 12 bp, Homo sapiens
gtaccacactga

SEQ ID NO: 535529 - DNA, 13 bp, Homo sapiens
gtaccagccccac

SEQ ID NO: 535530 - DNA, 17 bp, Homo sapiens
gtaccattaaaatatgc

SEQ ID NO: 535531 - DNA, 17 bp, Homo sapiens
gtaccttgcacacatca

SEQ ID NO: 535532 - DNA, 21 bp, Homo sapiens
gtacgagtagaggtttaaaga

SEQ ID NO: 535533 - DNA, 18 bp, Homo sapiens
gtactatggaagccacat

SEQ ID NO: 535534 - DNA, 14 bp, Homo sapiens
gtactctaatatac

SEQ ID NO: 535535 - DNA, 17 bp, Homo sapiens
gtactgagcagtgatat

SEQ ID NO: 535536 - DNA, 13 bp, Homo sapiens
gtacttggcacca

SEQ ID NO: 535537 - DNA, 13 bp, Homo sapiens
gtactttgattca

SEQ ID NO: 535538 - DNA, 22 bp, Homo sapiens
gtagaatgaccttgtaatgtaa

SEQ ID NO: 535539 - DNA, 21 bp, Homo sapiens
gcaatattctgtaactattgg

SEQ ID NO: 535540 - DNA, 14 bp, Homo sapiens
gcaatgttttgctt

SEQ ID NO: 535541 - DNA, 17 bp, Homo sapiens
gcaatgttttgcttttg

SEQ ID NO: 535542 - DNA, 16 bp, Homo sapiens
gcaattgtatatatat

SEQ ID NO: 535543 - DNA, 13 bp, Homo sapiens
gcaatttgaaggt

SEQ ID NO: 535544 - DNA, 18 bp, Homo sapiens
gcaatttgtctttggaaa

SEQ ID NO: 535545 - DNA, 18 bp, Homo sapiens
gcacaaaaaatttaagag

SEQ ID NO: 535546 - DNA, 15 bp, Homo sapiens
gcacaaacatagaca

SEQ ID NO: 535547 - DNA, 14 bp, Homo sapiens
gcacaaacttcaga

SEQ ID NO: 535548 - DNA, 17 bp, Homo sapiens
gcacaaccatgttcttg

SEQ ID NO: 535549 - DNA, 18 bp, Homo sapiens
gcacaacccccagctccc

SEQ ID NO: 535550 - DNA, 10 bp, Homo sapiens
gcacaatgaa

SEQ ID NO: 535551 - DNA, 12 bp, Homo sapiens
gcacacacacaa

SEQ ID NO: 535552 - DNA, 14 bp, Homo sapiens
gcacacagaaatat

SEQ ID NO: 535553 - DNA, 15 bp, Homo sapiens
gcacacagaaatata

SEQ ID NO: 535554 - DNA, 20 bp, Homo sapiens
gcacacagaaatatatatac

SEQ ID NO: 535555 - DNA, 12 bp, Homo sapiens
gcacacttcccc

SEQ ID NO: 535556 - DNA, 15 bp, Homo sapiens
gcacagagagggggc

SEQ ID NO: 535557 - DNA, 21 bp, Homo sapiens
gcacagcctcacccctgcagg

SEQ ID NO: 535558 - DNA, 16 bp, Homo sapiens
gcacagggagaggccg

SEQ ID NO: 535559 - DNA, 18 bp, Homo sapiens
gcacagggcatgaaatga

SEQ ID NO: 535560 - DNA, 23 bp, Homo sapiens
gcacagggcatgaaatgaacaca

SEQ ID NO: 535561 - DNA, 16 bp, Homo sapiens
gcacagtatttaacat

SEQ ID NO: 535562 - DNA, 14 bp, Homo sapiens
gcacatccaactac

SEQ ID NO: 535563 - DNA, 21 bp, Homo sapiens
gcacatccattcccaagaaat

SEQ ID NO: 535564 - DNA, 13 bp, Homo sapiens
gcacatgatttca

SEQ ID NO: 535565 - DNA, 15 bp, Homo sapiens
gcacatgatttcaca

SEQ ID NO: 535566 - DNA, 17 bp, Homo sapiens
gcacatgatttcacaaa

SEQ ID NO: 535567 - DNA, 19 bp, Homo sapiens
gcacatgatttcacaaata

SEQ ID NO: 535568 - DNA, 14 bp, Homo sapiens
gcaccaataaagga

SEQ ID NO: 535569 - DNA, 16 bp, Homo sapiens
gcaccaccctccttcc

SEQ ID NO: 535570 - DNA, 18 bp, Homo sapiens
gcaccaccgaccaactcc

SEQ ID NO: 535571 - DNA, 22 bp, Homo sapiens
gcaccaccgaccaactccagac

SEQ ID NO: 535572 - DNA, 21 bp, Homo sapiens
gcacccacaccctacagcaga

SEQ ID NO: 535573 - DNA, 20 bp, Homo sapiens
gcacccgcatgtacaaaaac

SEQ ID NO: 535574 - DNA, 23 bp, Homo sapiens
gcacccgcatgtacaaaaacaca

SEQ ID NO: 535575 - DNA, 15 bp, Homo sapiens
gcacccggcagcccc

SEQ ID NO: 535576 - DNA, 16 bp, Homo sapiens
gcacccggcagccccc

SEQ ID NO: 535577 - DNA, 12 bp, Homo sapiens
gcacctcttgaa

SEQ ID NO: 535578 - DNA, 13 bp, Homo sapiens
gcacctcttgaag

SEQ ID NO: 535579 - DNA, 14 bp, Homo sapiens
gcacctgcttctca

SEQ ID NO: 535580 - DNA, 14 bp, Homo sapiens
gcacctgtctgctc

SEQ ID NO: 535581 - DNA, 15 bp, Homo sapiens
gcacctgtctgctcc

SEQ ID NO: 535582 - DNA, 16 bp, Homo sapiens
gcacctgtctgctcca

SEQ ID NO: 535583 - DNA, 13 bp, Homo sapiens
gcacgcacccaca

SEQ ID NO: 535584 - DNA, 19 bp, Homo sapiens
gcacgcacccacaccctac

SEQ ID NO: 535585 - DNA, 13 bp, Homo sapiens
gcacggggccagc

SEQ ID NO: 535586 - DNA, 19 bp, Homo sapiens
gcactaggttcaattccct

SEQ ID NO: 535587 - DNA, 15 bp, Homo sapiens
gcactattgagtctt

SEQ ID NO: 535588 - DNA, 15 bp, Homo sapiens
gcactgccctccgcc

SEQ ID NO: 535589 - DNA, 21 bp, Homo sapiens
gcacttctgcctgaggggcag

SEQ ID NO: 535590 - DNA, 20 bp, Homo sapiens
gcactttgggaggccgaggc

SEQ ID NO: 535591 - DNA, 21 bp, Homo sapiens
gcagaaaaacaggcacaggct

SEQ ID NO: 535592 - DNA, 19 bp, Homo sapiens
gcagaacttgaagcctgct

SEQ ID NO: 535593 - DNA, 18 bp, Homo sapiens
gcagaagggagctggctc

SEQ ID NO: 535594 - DNA, 14 bp, Homo sapiens
gcagaattggaaaa

SEQ ID NO: 535595 - DNA, 20 bp, Homo sapiens
gcagaattggaaaagactaa

SEQ ID NO: 535596 - DNA, 16 bp, Homo sapiens
gcagacacacacatat

SEQ ID NO: 535597 - DNA, 17 bp, Homo sapiens
gcagactggtgttaatg

SEQ ID NO: 535598 - DNA, 17 bp, Homo sapiens
gcagagctcagcacagc

SEQ ID NO: 535599 - DNA, 19 bp, Homo sapiens
gcagagtgaaattcaattc

SEQ ID NO: 535600 - DNA, 22 bp, Homo sapiens
gcagatactactgaccagacaa

SEQ ID NO: 535601 - DNA, 24 bp, Homo sapiens
gcagatactactgaccagacaagc

SEQ ID NO: 535602 - DNA, 16 bp, Homo sapiens
gcagatccacctgcac

SEQ ID NO: 535603 - DNA, 17 bp, Homo sapiens
gcagatccacctgcaca

SEQ ID NO: 535604 - DNA, 21 bp, Homo sapiens
gcagatccacctgcacaaaca

SEQ ID NO: 535605 - DNA, 23 bp, Homo sapiens
gcagatccacctgcacaaacata

SEQ ID NO: 535606 - DNA, 16 bp, Homo sapiens
gcagatgacccctccc

SEQ ID NO: 535607 - DNA, 23 bp, Homo sapiens
gcagatgaggtgaaaaggccaag

SEQ ID NO: 535608 - DNA, 14 bp, Homo sapiens
gcagatgcagctct

SEQ ID NO: 535609 - DNA, 19 bp, Homo sapiens
gcagatgcagctcttcctg

SEQ ID NO: 535610 - DNA, 21 bp, Homo sapiens
gcagattctaggacctgtgtc

SEQ ID NO: 535611 - DNA, 17 bp, Homo sapiens
gcagattttagttttat

SEQ ID NO: 535612 - DNA, 17 bp, Homo sapiens
gcagcaaggtcttgctc

SEQ ID NO: 535613 - DNA, 21 bp, Homo sapiens
gcagcaaggtcttgctctcct

SEQ ID NO: 535614 - DNA, 14 bp, Homo sapiens
gcagcacagagagg

SEQ ID NO: 535615 - DNA, 14 bp, Homo sapiens
gcagcccttccaaa

SEQ ID NO: 535616 - DNA, 13 bp, Homo sapiens
gcagcctctgggc

SEQ ID NO: 535617 - DNA, 13 bp, Homo sapiens
gcagcctcttgaa

SEQ ID NO: 535618 - DNA, 24 bp, Homo sapiens
gcagcctgccttgcccactcctgc

SEQ ID NO: 535619 - DNA, 13 bp, Homo sapiens
gcagcctgcgtgg

SEQ ID NO: 535620 - DNA, 15 bp, Homo sapiens
gcagcctgcgtggct

SEQ ID NO: 535621 - DNA, 22 bp, Homo sapiens
gcagctgaagccagctccctga

SEQ ID NO: 535622 - DNA, 10 bp, Homo sapiens
gcagctgttg

SEQ ID NO: 535623 - DNA, 16 bp, Homo sapiens
gcagctgttgtctctt

SEQ ID NO: 535624 - DNA, 20 bp, Homo sapiens
gcagctgttgtctcttctcc

SEQ ID NO: 535625 - DNA, 13 bp, Homo sapiens
gcaggaagtccct

SEQ ID NO: 535626 - DNA, 16 bp, Homo sapiens
gcaggaagtccctgag

SEQ ID NO: 535627 - DNA, 23 bp, Homo sapiens
gcaggaagtccctgagaagcctc

SEQ ID NO: 535628 - DNA, 19 bp, Homo sapiens
gcaggaatcaaaaattgaa

SEQ ID NO: 535629 - DNA, 13 bp, Homo sapiens
gcaggaggggagt

SEQ ID NO: 535630 - DNA, 19 bp, Homo sapiens
gcaggatagctcttcctcc

SEQ ID NO: 535631 - DNA, 21 bp, Homo sapiens
gcaggcagagctcagcacagc

SEQ ID NO: 535632 - DNA, 13 bp, Homo sapiens
gcaggcctccctg

SEQ ID NO: 535633 - DNA, 15 bp, Homo sapiens
gcaggcggtatccag

SEQ ID NO: 535634 - DNA, 15 bp, Homo sapiens
gcagggagaccctgg

SEQ ID NO: 535635 - DNA, 15 bp, Homo sapiens
gcaggtggccagggc

SEQ ID NO: 535636 - DNA, 13 bp, Homo sapiens
gcaggttaaatgt

SEQ ID NO: 535637 - DNA, 14 bp, Homo sapiens
gcaggttaaatgtt

SEQ ID NO: 535638 - DNA, 23 bp, Homo sapiens
gcaggttaaatgttttgtaaact

SEQ ID NO: 535639 - DNA, 23 bp, Homo sapiens
gcagtccctgagaccatttaaca

SEQ ID NO: 535640 - DNA, 17 bp, Homo sapiens
gcagtcttatgcttcca

SEQ ID NO: 535641 - DNA, 21 bp, Homo sapiens
gcagtcttatgcttccagaaa

SEQ ID NO: 535642 - DNA, 16 bp, Homo sapiens
gcagtgacgtgagtgg

SEQ ID NO: 535643 - DNA, 18 bp, Homo sapiens
gcagtgacgtgagtgggg

SEQ ID NO: 535644 - DNA, 17 bp, Homo sapiens
gcagtggagcccaggag

SEQ ID NO: 535645 - DNA, 22 bp, Homo sapiens
gcagtggcttggagcagaggtg

SEQ ID NO: 535646 - DNA, 16 bp, Homo sapiens
gcagtgttctgtgaat

SEQ ID NO: 535647 - DNA, 18 bp, Homo sapiens
gcagttgaatttttatat

SEQ ID NO: 535648 - DNA, 16 bp, Homo sapiens
gcagttgcaataaact

SEQ ID NO: 535649 - DNA, 14 bp, Homo sapiens
gcagttgcccagcc

SEQ ID NO: 535650 - DNA, 16 bp, Homo sapiens
gcagttgcccagcctc

SEQ ID NO: 535651 - DNA, 19 bp, Homo sapiens
gcagttggccaagcagaaa

SEQ ID NO: 535652 - DNA, 19 bp, Homo sapiens
gcataagtggacccagctg

SEQ ID NO: 535653 - DNA, 17 bp, Homo sapiens
gcataataatcctgcaa

SEQ ID NO: 535654 - DNA, 12 bp, Homo sapiens
gcatacaaacaa

SEQ ID NO: 535655 - DNA, 18 bp, Homo sapiens
gcatacaaacaagcatat

SEQ ID NO: 535656 - DNA, 14 bp, Homo sapiens
gcatagaataatga

SEQ ID NO: 535657 - DNA, 17 bp, Homo sapiens
gcatagcttgcacaaca

SEQ ID NO: 535658 - DNA, 16 bp, Homo sapiens
gcataggcctgctttg

SEQ ID NO: 535659 - DNA, 22 bp, Homo sapiens
gcataggcctgctttgtctcct

SEQ ID NO: 535660 - DNA, 15 bp, Homo sapiens
gcatataaaatggca

SEQ ID NO: 535661 - DNA, 22 bp, Homo sapiens
gcatataaaatggcaacaaact

SEQ ID NO: 535662 - DNA, 19 bp, Homo sapiens
gcatcactattcagaagac

SEQ ID NO: 535663 - DNA, 17 bp, Homo sapiens
gcatcattccaggcccg

SEQ ID NO: 535664 - DNA, 21 bp, Homo sapiens
gcatccatgcggccggcctgg

SEQ ID NO: 535665 - DNA, 12 bp, Homo sapiens
gcatccccagcc

SEQ ID NO: 535666 - DNA, 15 bp, Homo sapiens
gcatccccagccccc

SEQ ID NO: 535667 - DNA, 19 bp, Homo sapiens
gcatccccagccccctggc

SEQ ID NO: 535668 - DNA, 14 bp, Homo sapiens
gcatccgaccaggt

SEQ ID NO: 535669 - DNA, 16 bp, Homo sapiens
gcatccgaccaggttg

SEQ ID NO: 535670 - DNA, 15 bp, Homo sapiens
gcatccttgaggacc

SEQ ID NO: 535671 - DNA, 12 bp, Homo sapiens
gcatctaaactt

SEQ ID NO: 535672 - DNA, 19 bp, Homo sapiens
gcatctaaactttaatatg

SEQ ID NO: 535673 - DNA, 15 bp, Homo sapiens
gcatctccttgggct

SEQ ID NO: 535674 - DNA, 23 bp, Homo sapiens
gcatctggaagagctaggcaggg

SEQ ID NO: 535675 - DNA, 19 bp, Homo sapiens
gcatgaaatgaacacaaat

SEQ ID NO: 535676 - DNA, 11 bp, Homo sapiens
gcatgaccctg

SEQ ID NO: 535677 - DNA, 15 bp, Homo sapiens
gcatgaccctggagc

SEQ ID NO: 535678 - DNA, 16 bp, Homo sapiens
gcatgaccctggagcc

SEQ ID NO: 535679 - DNA, 18 bp, Homo sapiens
gcatgccgagtgccccag

SEQ ID NO: 535680 - DNA, 14 bp, Homo sapiens
gcatgctttccata

SEQ ID NO: 535681 - DNA, 14 bp, Homo sapiens
gcatggatttctgt

SEQ ID NO: 535682 - DNA, 22 bp, Homo sapiens
gagtcctccagaactcttcctc

SEQ ID NO: 535683 - DNA, 12 bp, Homo sapiens
gagtctggagac

SEQ ID NO: 535684 - DNA, 22 bp, Homo sapiens
gagtctggagaccaggactctg

SEQ ID NO: 535685 - DNA, 11 bp, Homo sapiens
gagtcttcatg

SEQ ID NO: 535686 - DNA, 17 bp, Homo sapiens
gagtgaagagtgaagag

SEQ ID NO: 535687 - DNA, 17 bp, Homo sapiens
gagtgactccaagaaca

SEQ ID NO: 535688 - DNA, 23 bp, Homo sapiens
gagtgcaaaaggcttgcagaact

SEQ ID NO: 535689 - DNA, 17 bp, Homo sapiens
gagtgccccagaaatgc

SEQ ID NO: 535690 - DNA, 22 bp, Homo sapiens
gagtgccccagaaatgccgctg

SEQ ID NO: 535691 - DNA, 15 bp, Homo sapiens
gagtgctaagagcct

SEQ ID NO: 535692 - DNA, 20 bp, Homo sapiens
gagtgctaagagcctctgga

SEQ ID NO: 535693 - DNA, 17 bp, Homo sapiens
gagtggtccacattctg

SEQ ID NO: 535694 - DNA, 23 bp, Homo sapiens
gagtggtccacattctgctgccc

SEQ ID NO: 535695 - DNA, 19 bp, Homo sapiens
gagtgtggagctgcttcca

SEQ ID NO: 535696 - DNA, 19 bp, Homo sapiens
gagttcaagaccagcctgg

SEQ ID NO: 535697 - DNA, 20 bp, Homo sapiens
gagttcaagaccagcctggc

SEQ ID NO: 535698 - DNA, 15 bp, Homo sapiens
gagttcattcatatt

SEQ ID NO: 535699 - DNA, 21 bp, Homo sapiens
gagttcccttgattcaaataa

SEQ ID NO: 535700 - DNA, 17 bp, Homo sapiens
gagttcctaccatggag

SEQ ID NO: 535701 - DNA, 14 bp, Homo sapiens
gagtttgtttcttt

SEQ ID NO: 535702 - DNA, 18 bp, Homo sapiens
gataaatccaactctgac

SEQ ID NO: 535703 - DNA, 20 bp, Homo sapiens
gataacagagtgatttgtaa

SEQ ID NO: 535704 - DNA, 13 bp, Homo sapiens
gataagttggaaa

SEQ ID NO: 535705 - DNA, 17 bp, Homo sapiens
gataagttggaaacact

SEQ ID NO: 535706 - DNA, 17 bp, Homo sapiens
gataatatatttgcaga

SEQ ID NO: 535707 - DNA, 14 bp, Homo sapiens
gataattaaccaag

SEQ ID NO: 535708 - DNA, 23 bp, Homo sapiens
gataattaaccaaggtagaatga

SEQ ID NO: 535709 - DNA, 16 bp, Homo sapiens
gataccattttgaaat

SEQ ID NO: 535710 - DNA, 17 bp, Homo sapiens
gataccattttgaaata

SEQ ID NO: 535711 - DNA, 14 bp, Homo sapiens
gataccttaaaatt

SEQ ID NO: 535712 - DNA, 19 bp, Homo sapiens
gataccttaaaatttgaaa

SEQ ID NO: 535713 - DNA, 16 bp, Homo sapiens
gatactactgaccaga

SEQ ID NO: 535714 - DNA, 14 bp, Homo sapiens
gatacttcctgggt

SEQ ID NO: 535715 - DNA, 21 bp, Homo sapiens
gataggaaggtcatttccatg

SEQ ID NO: 535716 - DNA, 22 bp, Homo sapiens
gataggaaggtcatttccatgt

SEQ ID NO: 535717 - DNA, 15 bp, Homo sapiens
gatataatgtatttt

SEQ ID NO: 535718 - DNA, 12 bp, Homo sapiens
gatatatctgaa

SEQ ID NO: 535719 - DNA, 16 bp, Homo sapiens
gatatatctgaaaact

SEQ ID NO: 535720 - DNA, 23 bp, Homo sapiens
gatatatttaaaaacaaaaggca

SEQ ID NO: 535721 - DNA, 21 bp, Homo sapiens
gatatccctgatcctaactga

SEQ ID NO: 535722 - DNA, 15 bp, Homo sapiens
gatcacatgcccctc

SEQ ID NO: 535723 - DNA, 14 bp, Homo sapiens
gatcactgaacttt

SEQ ID NO: 535724 - DNA, 22 bp, Homo sapiens
gatcactgaacttttcaaaata

SEQ ID NO: 535725 - DNA, 14 bp, Homo sapiens
gatcactttctgaa

SEQ ID NO: 535726 - DNA, 14 bp, Homo sapiens
gatcagccagaagc

SEQ ID NO: 535727 - DNA, 15 bp, Homo sapiens
gatcagccagaagcc

SEQ ID NO: 535728 - DNA, 17 bp, Homo sapiens
gatcattatcttcatgt

SEQ ID NO: 535729 - DNA, 14 bp, Homo sapiens
gatccacctgcaca

SEQ ID NO: 535730 - DNA, 15 bp, Homo sapiens
gatccaggaacacat

SEQ ID NO: 535731 - DNA, 16 bp, Homo sapiens
gatccaggaacacatg

SEQ ID NO: 535732 - DNA, 18 bp, Homo sapiens
gatccaggaacacatgca

SEQ ID NO: 535733 - DNA, 14 bp, Homo sapiens
gatccgccctgggc

SEQ ID NO: 535734 - DNA, 20 bp, Homo sapiens
gatcctaactgaagagacag

SEQ ID NO: 535735 - DNA, 20 bp, Homo sapiens
gatctgggttttgcctctgc

SEQ ID NO: 535736 - DNA, 21 bp, Homo sapiens
gatctgggttttgcctctgcc

SEQ ID NO: 535737 - DNA, 12 bp, Homo sapiens
gatctgtccttc

SEQ ID NO: 535738 - DNA, 21 bp, Homo sapiens
gatctttgttttttgttttca

SEQ ID NO: 535739 - DNA, 16 bp, Homo sapiens
gatgaaggaaaggaag

SEQ ID NO: 535740 - DNA, 16 bp, Homo sapiens
gatgacccctccccta

SEQ ID NO: 535741 - DNA, 17 bp, Homo sapiens
gatgacccctcccctaa

SEQ ID NO: 535742 - DNA, 15 bp, Homo sapiens
gatgagactgtttat

SEQ ID NO: 535743 - DNA, 11 bp, Homo sapiens
gatgatccttg

SEQ ID NO: 535744 - DNA, 15 bp, Homo sapiens
gatgctgggaccctc

SEQ ID NO: 535745 - DNA, 16 bp, Homo sapiens
gatggatggcacaatg

SEQ ID NO: 535746 - DNA, 22 bp, Homo sapiens
gatggcacagggcatgaaatga

SEQ ID NO: 535747 - DNA, 15 bp, Homo sapiens
gatggcgtgtcccct

SEQ ID NO: 535748 - DNA, 15 bp, Homo sapiens
gatgggcacaggctg

SEQ ID NO: 535749 - DNA, 18 bp, Homo sapiens
gatgggcacaggctgccc

SEQ ID NO: 535750 - DNA, 13 bp, Homo sapiens
gatgtaaatgaag

SEQ ID NO: 535751 - DNA, 14 bp, Homo sapiens
gatgtatgtgtata

SEQ ID NO: 535752 - DNA, 14 bp, Homo sapiens
gatgtccccaaagt

SEQ ID NO: 535753 - DNA, 22 bp, Homo sapiens
gatgtgagaaaaccccttccca

SEQ ID NO: 535754 - DNA, 18 bp, Homo sapiens
gatgtggacatgcacccg

SEQ ID NO: 535755 - DNA, 21 bp, Homo sapiens
gatgtggacatgcacccgcat

SEQ ID NO: 535756 - DNA, 20 bp, Homo sapiens
gatgtgtaatttttctgtat

SEQ ID NO: 535757 - DNA, 12 bp, Homo sapiens
gatgtgttcttt

SEQ ID NO: 535758 - DNA, 13 bp, Homo sapiens
gatgttaacagta

SEQ ID NO: 535759 - DNA, 21 bp, Homo sapiens
gatgttaacagtattttaaga

SEQ ID NO: 535760 - DNA, 22 bp, Homo sapiens
gatgttaacagtattttaagaa

SEQ ID NO: 535761 - DNA, 21 bp, Homo sapiens
gatgttatatttttcttaaaa

SEQ ID NO: 535762 - DNA, 13 bp, Homo sapiens
gatgtttttaaaa

SEQ ID NO: 535763 - DNA, 16 bp, Homo sapiens
gatgtttttaaaatct

SEQ ID NO: 535764 - DNA, 17 bp, Homo sapiens
gattcacatgttttcaa

SEQ ID NO: 535765 - DNA, 17 bp, Homo sapiens
gattccaagggcccaga

SEQ ID NO: 535766 - DNA, 15 bp, Homo sapiens
gattccccggagctg

SEQ ID NO: 535767 - DNA, 17 bp, Homo sapiens
gattccccggagctggg

SEQ ID NO: 535768 - DNA, 18 bp, Homo sapiens
gattccccggagctggga

SEQ ID NO: 535769 - DNA, 20 bp, Homo sapiens
gattcccgtggctttgtgct

SEQ ID NO: 535770 - DNA, 16 bp, Homo sapiens
gattcctgtttcaagt

SEQ ID NO: 535771 - DNA, 20 bp, Homo sapiens
gattcctttggccactgtat

SEQ ID NO: 535772 - DNA, 21 bp, Homo sapiens
gattcgagctatatttaagta

SEQ ID NO: 535773 - DNA, 14 bp, Homo sapiens
gattctatgtaact

SEQ ID NO: 535774 - DNA, 15 bp, Homo sapiens
gattctatgtaactt

SEQ ID NO: 535775 - DNA, 16 bp, Homo sapiens
gattctatgtaacttg

SEQ ID NO: 535776 - DNA, 11 bp, Homo sapiens
gattctctcca

SEQ ID NO: 535777 - DNA, 22 bp, Homo sapiens
gattctctccattttggtgtct

SEQ ID NO: 535778 - DNA, 15 bp, Homo sapiens
gattcttgttttgct

SEQ ID NO: 535779 - DNA, 22 bp, Homo sapiens
gattgatttacctttggaattg

SEQ ID NO: 535780 - DNA, 14 bp, Homo sapiens
gattgcttttaaaa

SEQ ID NO: 535781 - DNA, 19 bp, Homo sapiens
gattggattttatgttgac

SEQ ID NO: 535782 - DNA, 12 bp, Homo sapiens
gatttcaagaaa

SEQ ID NO: 535783 - DNA, 19 bp, Homo sapiens
gatttcaagaaaaaataaa

SEQ ID NO: 535784 - DNA, 18 bp, Homo sapiens
gatttcgaagtttgcaac

SEQ ID NO: 535785 - DNA, 15 bp, Homo sapiens
gatttgatgtaagtt

SEQ ID NO: 535786 - DNA, 14 bp, Homo sapiens
gatttgcaacagca

SEQ ID NO: 535787 - DNA, 21 bp, Homo sapiens
gatttgtccttggggacatct

SEQ ID NO: 535788 - DNA, 15 bp, Homo sapiens
gattttagttttatt

SEQ ID NO: 535789 - DNA, 14 bp, Homo sapiens
gattttatgttgac

SEQ ID NO: 535790 - DNA, 14 bp, Homo sapiens
gattttcatgttct

SEQ ID NO: 535791 - DNA, 15 bp, Homo sapiens
gattttcatgttctt

SEQ ID NO: 535792 - DNA, 15 bp, Homo sapiens
gattttttaaaagaa

SEQ ID NO: 535793 - DNA, 12 bp, Homo sapiens
gcaaaaaaagtt

SEQ ID NO: 535794 - DNA, 19 bp, Homo sapiens
gcaaaaaaagttgtatgat

SEQ ID NO: 535795 - DNA, 11 bp, Homo sapiens
gcaaaaatata

SEQ ID NO: 535796 - DNA, 18 bp, Homo sapiens
gcaaaagcctcagaaagg

SEQ ID NO: 535797 - DNA, 15 bp, Homo sapiens
gcaaaatattatgtt

SEQ ID NO: 535798 - DNA, 15 bp, Homo sapiens
gcaaaccaatttgtt

SEQ ID NO: 535799 - DNA, 18 bp, Homo sapiens
gcaaaccaatttgttctg

SEQ ID NO: 535800 - DNA, 19 bp, Homo sapiens
gcaaaccaatttgttctgt

SEQ ID NO: 535801 - DNA, 20 bp, Homo sapiens
gcaaacccaaagatgttaac

SEQ ID NO: 535802 - DNA, 18 bp, Homo sapiens
gcaaactgaagcccacag

SEQ ID NO: 535803 - DNA, 14 bp, Homo sapiens
gcaaagatcaaaat

SEQ ID NO: 535804 - DNA, 18 bp, Homo sapiens
gcaaagatcaaaataaaa

SEQ ID NO: 535805 - DNA, 21 bp, Homo sapiens
gcaaagcatgccaatttctct

SEQ ID NO: 535806 - DNA, 22 bp, Homo sapiens
gcaaaggagggcaacctgacag

SEQ ID NO: 535807 - DNA, 15 bp, Homo sapiens
gcaaatattttgtca

SEQ ID NO: 535808 - DNA, 21 bp, Homo sapiens
gcaaatattttgtcactgctg

SEQ ID NO: 535809 - DNA, 22 bp, Homo sapiens
gcaaatttctagatatgagaaa

SEQ ID NO: 535810 - DNA, 14 bp, Homo sapiens
gcaacaaactgcac

SEQ ID NO: 535811 - DNA, 15 bp, Homo sapiens
gcaacaaactgcaca

SEQ ID NO: 535812 - DNA, 16 bp, Homo sapiens
gcaacaattttcagat

SEQ ID NO: 535813 - DNA, 14 bp, Homo sapiens
gcaacacttggaac

SEQ ID NO: 535814 - DNA, 21 bp, Homo sapiens
gcaacagcaaattaatgtgta

SEQ ID NO: 535815 - DNA, 20 bp, Homo sapiens
gcaacagctggacaccccct

SEQ ID NO: 535816 - DNA, 15 bp, Homo sapiens
gcaaccaaactccca

SEQ ID NO: 535817 - DNA, 10 bp, Homo sapiens
gcaacttttc

SEQ ID NO: 535818 - DNA, 17 bp, Homo sapiens
gcaagatggcacagggc

SEQ ID NO: 535819 - DNA, 11 bp, Homo sapiens
gcaaggatcac

SEQ ID NO: 535820 - DNA, 17 bp, Homo sapiens
gcaataaactcagtcaa

SEQ ID NO: 535821 - DNA, 21 bp, Homo sapiens
gcaataaactcagtcaaatgt

SEQ ID NO: 535822 - DNA, 14 bp, Homo sapiens
gcaatatattttgt

SEQ ID NO: 535823 - DNA, 15 bp, Homo sapiens
gcaatatattttgta

SEQ ID NO: 535824 - DNA, 22 bp, Homo sapiens
gcaatattctctgtacatatta

SEQ ID NO: 535825 - DNA, 17 bp, Homo sapiens
gaacacccagccccagc

SEQ ID NO: 535826 - DNA, 16 bp, Homo sapiens
gaacactttgctagga

SEQ ID NO: 535827 - DNA, 19 bp, Homo sapiens
gaacactttgctaggagat

SEQ ID NO: 535828 - DNA, 14 bp, Homo sapiens
gaacagctctgaga

SEQ ID NO: 535829 - DNA, 20 bp, Homo sapiens
gaacagctctgagatcctgg

SEQ ID NO: 535830 - DNA, 19 bp, Homo sapiens
gaacagtgtttactttaaa

SEQ ID NO: 535831 - DNA, 22 bp, Homo sapiens
gaacatgacccgtacacaccac

SEQ ID NO: 535832 - DNA, 17 bp, Homo sapiens
gaacattccctggaatt

SEQ ID NO: 535833 - DNA, 17 bp, Homo sapiens
gaaccgagcaaagatca

SEQ ID NO: 535834 - DNA, 19 bp, Homo sapiens
gaaccgagcaaagatcaaa

SEQ ID NO: 535835 - DNA, 21 bp, Homo sapiens
gaaccgagcaaagatcaaaat

SEQ ID NO: 535836 - DNA, 20 bp, Homo sapiens
gaacctactgttcctttcag

SEQ ID NO: 535837 - DNA, 16 bp, Homo sapiens
gaactcagctgtctgt

SEQ ID NO: 535838 - DNA, 21 bp, Homo sapiens
gaactcagctgtctgtggctt

SEQ ID NO: 535839 - DNA, 22 bp, Homo sapiens
gaactcttcctccaaggacaga

SEQ ID NO: 535840 - DNA, 15 bp, Homo sapiens
gaactgaagcagagt

SEQ ID NO: 535841 - DNA, 20 bp, Homo sapiens
gaactgctgctggtcacccc

SEQ ID NO: 535842 - DNA, 21 bp, Homo sapiens
gaactgctgctggtcaccccc

SEQ ID NO: 535843 - DNA, 15 bp, Homo sapiens
gaactggaggccagg

SEQ ID NO: 535844 - DNA, 18 bp, Homo sapiens
gaacttgaagcctgctcc

SEQ ID NO: 535845 - DNA, 22 bp, Homo sapiens
gaacttgaagcctgctccttcc

SEQ ID NO: 535846 - DNA, 14 bp, Homo sapiens
gaacttgtttaata

SEQ ID NO: 535847 - DNA, 14 bp, Homo sapiens
gaactttaaaagaa

SEQ ID NO: 535848 - DNA, 21 bp, Homo sapiens
gaagaaaatgttcttccagtt

SEQ ID NO: 535849 - DNA, 19 bp, Homo sapiens
gaagaatctctatgccctg

SEQ ID NO: 535850 - DNA, 18 bp, Homo sapiens
gaagaatggctttcaata

SEQ ID NO: 535851 - DNA, 16 bp, Homo sapiens
gaagacaaatacacat

SEQ ID NO: 535852 - DNA, 15 bp, Homo sapiens
gaagaccctatctcc

SEQ ID NO: 535853 - DNA, 20 bp, Homo sapiens
gaagaccctatctcccacaa

SEQ ID NO: 535854 - DNA, 18 bp, Homo sapiens
gaagacctaaccagggcc

SEQ ID NO: 535855 - DNA, 14 bp, Homo sapiens
gaagactccagaaa

SEQ ID NO: 535856 - DNA, 18 bp, Homo sapiens
gaagagagatatatctga

SEQ ID NO: 535857 - DNA, 19 bp, Homo sapiens
gaagagtaacacttgaaaa

SEQ ID NO: 535858 - DNA, 20 bp, Homo sapiens
gaagagtaacacttgaaaag

SEQ ID NO: 535859 - DNA, 14 bp, Homo sapiens
gaagataagttgga

SEQ ID NO: 535860 - DNA, 18 bp, Homo sapiens
gaagataagttggaaaca

SEQ ID NO: 535861 - DNA, 15 bp, Homo sapiens
gaagatctttgtttt

SEQ ID NO: 535862 - DNA, 15 bp, Homo sapiens
gaagatgaatggtct

SEQ ID NO: 535863 - DNA, 13 bp, Homo sapiens
gaagattgtttat

SEQ ID NO: 535864 - DNA, 16 bp, Homo sapiens
gaagattgtttatcta

SEQ ID NO: 535865 - DNA, 23 bp, Homo sapiens
gaagattgtttatctagatgtaa

SEQ ID NO: 535866 - DNA, 20 bp, Homo sapiens
gaagcaaaaacgaaagctgg

SEQ ID NO: 535867 - DNA, 15 bp, Homo sapiens
gaagcaaataaatat

SEQ ID NO: 535868 - DNA, 19 bp, Homo sapiens
gaagcaggtgtgagggcag

SEQ ID NO: 535869 - DNA, 14 bp, Homo sapiens
gaagcctcctgctg

SEQ ID NO: 535870 - DNA, 15 bp, Homo sapiens
gaagcctcctgctga

SEQ ID NO: 535871 - DNA, 18 bp, Homo sapiens
gaagctcaaggctgcagt

SEQ ID NO: 535872 - DNA, 16 bp, Homo sapiens
gaaggaccttcactct

SEQ ID NO: 535873 - DNA, 20 bp, Homo sapiens
gaaggcaaactgaggcagca

SEQ ID NO: 535874 - DNA, 22 bp, Homo sapiens
gaaggcccagcaccaccctcct

SEQ ID NO: 535875 - DNA, 16 bp, Homo sapiens
gaaggtctctctggct

SEQ ID NO: 535876 - DNA, 11 bp, Homo sapiens
gaaggtgacac

SEQ ID NO: 535877 - DNA, 18 bp, Homo sapiens
gaagtaaacctgaacaaa

SEQ ID NO: 535878 - DNA, 19 bp, Homo sapiens
gaagtatccctgatttatt

SEQ ID NO: 535879 - DNA, 17 bp, Homo sapiens
gaagtcttcatgaaatg

SEQ ID NO: 535880 - DNA, 21 bp, Homo sapiens
gaagttgactctgctcttgca

SEQ ID NO: 535881 - DNA, 19 bp, Homo sapiens
gaataaaattcctatctca

SEQ ID NO: 535882 - DNA, 16 bp, Homo sapiens
gaataatgaagatctt

SEQ ID NO: 535883 - DNA, 22 bp, Homo sapiens
gaatagcagtggcaaaatatta

SEQ ID NO: 535884 - DNA, 14 bp, Homo sapiens
gaatagctgatgtg

SEQ ID NO: 535885 - DNA, 17 bp, Homo sapiens
gaatatggtggaaaata

SEQ ID NO: 535886 - DNA, 16 bp, Homo sapiens
gaatattatatttgga

SEQ ID NO: 535887 - DNA, 19 bp, Homo sapiens
gaatcacctaattaatttc

SEQ ID NO: 535888 - DNA, 20 bp, Homo sapiens
gaatcacctaattaatttca

SEQ ID NO: 535889 - DNA, 21 bp, Homo sapiens
gaatcattgtccagagctgct

SEQ ID NO: 535890 - DNA, 14 bp, Homo sapiens
gaatctgaccacag

SEQ ID NO: 535891 - DNA, 18 bp, Homo sapiens
gaatctgaccacagacac

SEQ ID NO: 535892 - DNA, 21 bp, Homo sapiens
gaatcttctcatcttttatct

SEQ ID NO: 535893 - DNA, 21 bp, Homo sapiens
gaatgaccttgtaatgtaact

SEQ ID NO: 535894 - DNA, 19 bp, Homo sapiens
gaatgagggcgtgaaacac

SEQ ID NO: 535895 - DNA, 23 bp, Homo sapiens
gaatgagggcgtgaaacacaata

SEQ ID NO: 535896 - DNA, 15 bp, Homo sapiens
gaatgcttaaatgat

SEQ ID NO: 535897 - DNA, 18 bp, Homo sapiens
gaatggcaatgttttgct

SEQ ID NO: 535898 - DNA, 22 bp, Homo sapiens
gaatggtctggcaatattctgt

SEQ ID NO: 535899 - DNA, 19 bp, Homo sapiens
gaatgtatagtatttgaaa

SEQ ID NO: 535900 - DNA, 15 bp, Homo sapiens
gaatgttttccttct

SEQ ID NO: 535901 - DNA, 12 bp, Homo sapiens
gaattgattttt

SEQ ID NO: 535902 - DNA, 20 bp, Homo sapiens
gaattgtgctccaaatgtct

SEQ ID NO: 535903 - DNA, 12 bp, Homo sapiens
gaattttcattt

SEQ ID NO: 535904 - DNA, 22 bp, Homo sapiens
gaattttcattttacagttact

SEQ ID NO: 535905 - DNA, 14 bp, Homo sapiens
gacaaatacacata

SEQ ID NO: 535906 - DNA, 15 bp, Homo sapiens
gacaaatacacatac

SEQ ID NO: 535907 - DNA, 17 bp, Homo sapiens
gacaaatacacatacat

SEQ ID NO: 535908 - DNA, 22 bp, Homo sapiens
gacaagctgttgaccaggcacc

SEQ ID NO: 535909 - DNA, 13 bp, Homo sapiens
gacaataagaaac

SEQ ID NO: 535910 - DNA, 17 bp, Homo sapiens
gacaataagaaacagtt

SEQ ID NO: 535911 - DNA, 19 bp, Homo sapiens
gacaattctaatggtaact

SEQ ID NO: 535912 - DNA, 15 bp, Homo sapiens
gacacaaactgccaa

SEQ ID NO: 535913 - DNA, 13 bp, Homo sapiens
gacacacaaagca

SEQ ID NO: 535914 - DNA, 14 bp, Homo sapiens
gacacacaaagcag

SEQ ID NO: 535915 - DNA, 22 bp, Homo sapiens
gacacacacacacacacacata

SEQ ID NO: 535916 - DNA, 12 bp, Homo sapiens
gacacacacacg

SEQ ID NO: 535917 - DNA, 11 bp, Homo sapiens
gacacagcagc

SEQ ID NO: 535918 - DNA, 15 bp, Homo sapiens
gacacagcagcttca

SEQ ID NO: 535919 - DNA, 18 bp, Homo sapiens
gacacagcagcttcacca

SEQ ID NO: 535920 - DNA, 22 bp, Homo sapiens
gacacagcagcttcaccagagc

SEQ ID NO: 535921 - DNA, 20 bp, Homo sapiens
gacacctgtactggagagca

SEQ ID NO: 535922 - DNA, 18 bp, Homo sapiens
gacactgtctgctgcccc

SEQ ID NO: 535923 - DNA, 23 bp, Homo sapiens
gacacttatccacgagagcgcag

SEQ ID NO: 535924 - DNA, 16 bp, Homo sapiens
gacagagcctgcccca

SEQ ID NO: 535925 - DNA, 14 bp, Homo sapiens
gacagatgtggaca

SEQ ID NO: 535926 - DNA, 18 bp, Homo sapiens
gacagatgtggacatgca

SEQ ID NO: 535927 - DNA, 15 bp, Homo sapiens
gacagcaaacacagt

SEQ ID NO: 535928 - DNA, 22 bp, Homo sapiens
gacagcagtcttatgcttccag

SEQ ID NO: 535929 - DNA, 23 bp, Homo sapiens
gacagcagtcttatgcttccaga

SEQ ID NO: 535930 - DNA, 17 bp, Homo sapiens
gacagcttagaattatt

SEQ ID NO: 535931 - DNA, 17 bp, Homo sapiens
gacagggggccagaaca

SEQ ID NO: 535932 - DNA, 17 bp, Homo sapiens
gacagtgaggtcctggg

SEQ ID NO: 535933 - DNA, 15 bp, Homo sapiens
gacatccaagcttcc

SEQ ID NO: 535934 - DNA, 14 bp, Homo sapiens
gacatgcgggctgg

SEQ ID NO: 535935 - DNA, 15 bp, Homo sapiens
gacatgcgggctggg

SEQ ID NO: 535936 - DNA, 21 bp, Homo sapiens
gacatgcgggctgggcagctg

SEQ ID NO: 535937 - DNA, 15 bp, Homo sapiens
gacatgttgtaaatt

SEQ ID NO: 535938 - DNA, 12 bp, Homo sapiens
gacatttgtcat

SEQ ID NO: 535939 - DNA, 20 bp, Homo sapiens
gaccaaagagcctgtcgatg

SEQ ID NO: 535940 - DNA, 14 bp, Homo sapiens
gaccaaggaacaag

SEQ ID NO: 535941 - DNA, 18 bp, Homo sapiens
gaccaaggaacaagaccc

SEQ ID NO: 535942 - DNA, 19 bp, Homo sapiens
gaccaatcgggagtagcaa

SEQ ID NO: 535943 - DNA, 21 bp, Homo sapiens
gaccaatcgggagtagcaagg

SEQ ID NO: 535944 - DNA, 20 bp, Homo sapiens
gaccacagacactcctgggg

SEQ ID NO: 535945 - DNA, 22 bp, Homo sapiens
gaccagggctggggcagcctct

SEQ ID NO: 535946 - DNA, 15 bp, Homo sapiens
gaccaggtgacctta

SEQ ID NO: 535947 - DNA, 20 bp, Homo sapiens
gaccagttccctcagccctc

SEQ ID NO: 535948 - DNA, 14 bp, Homo sapiens
gaccattttcctgc

SEQ ID NO: 535949 - DNA, 20 bp, Homo sapiens
gaccccatccagccaggggt

SEQ ID NO: 535950 - DNA, 21 bp, Homo sapiens
gaccccatccagccaggggtg

SEQ ID NO: 535951 - DNA, 19 bp, Homo sapiens
gaccccatctgctgagctc

SEQ ID NO: 535952 - DNA, 15 bp, Homo sapiens
gacccccaggaagga

SEQ ID NO: 535953 - DNA, 22 bp, Homo sapiens
gaacaacgtactatggaagcca

SEQ ID NO: 535954 - DNA, 16 bp, Homo sapiens
gaacaagacccccagg

SEQ ID NO: 535955 - DNA, 20 bp, Homo sapiens
gaacaagacccccaggaagg

SEQ ID NO: 535956 - DNA, 17 bp, Homo sapiens
gaacacatgcacacaca

SEQ ID NO: 535957 - DNA, 16 bp, Homo sapiens
gaacacccagccccag

SEQ ID NO: 535958 - DNA, 17 bp, Homo sapiens
cttccaacatgtgatgt

SEQ ID NO: 535959 - DNA, 15 bp, Homo sapiens
cttccacctgctctg

SEQ ID NO: 535960 - DNA, 16 bp, Homo sapiens
cttccacctgctctgc

SEQ ID NO: 535961 - DNA, 18 bp, Homo sapiens
cttccacctgctctgctg

SEQ ID NO: 535962 - DNA, 13 bp, Homo sapiens
cttccacctggaa

SEQ ID NO: 535963 - DNA, 13 bp, Homo sapiens
cttccactttgta

SEQ ID NO: 535964 - DNA, 19 bp, Homo sapiens
cttccactttgtataaatt

SEQ ID NO: 535965 - DNA, 21 bp, Homo sapiens
cttccactttgtataaatttt

SEQ ID NO: 535966 - DNA, 16 bp, Homo sapiens
ataattcattaaaaac

SEQ ID NO: 535967 - DNA, 17 bp, Homo sapiens
ataattctgaagttata

SEQ ID NO: 535968 - DNA, 17 bp, Homo sapiens
ataattttattgctgga

SEQ ID NO: 535969 - DNA, 18 bp, Homo sapiens
atacaagtttgaacaggc

SEQ ID NO: 535970 - DNA, 19 bp, Homo sapiens
atacaatatataaaaatat

SEQ ID NO: 535971 - DNA, 11 bp, Homo sapiens
atacacacagg

SEQ ID NO: 535972 - DNA, 19 bp, Homo sapiens
atacacatacatatataca

SEQ ID NO: 535973 - DNA, 15 bp, Homo sapiens
atacacttgtataaa

SEQ ID NO: 535974 - DNA, 17 bp, Homo sapiens
atacacttgtataaatg

SEQ ID NO: 535975 - DNA, 22 bp, Homo sapiens
atacacttgtataaatgtatat

SEQ ID NO: 535976 - DNA, 21 bp, Homo sapiens
ctgtcatctaccttttctctt

SEQ ID NO: 535977 - DNA, 13 bp, Homo sapiens
ctgtcatgccaaa

SEQ ID NO: 535978 - DNA, 18 bp, Homo sapiens
ctgtcatggtgcaatttg

SEQ ID NO: 535979 - DNA, 14 bp, Homo sapiens
ctgtcattcaaatg

SEQ ID NO: 535980 - DNA, 17 bp, Homo sapiens
ctgtcattcaaatgggt

SEQ ID NO: 535981 - DNA, 19 bp, Homo sapiens
ctgtcattcaaatgggtga

SEQ ID NO: 535982 - DNA, 16 bp, Homo sapiens
ctgtcattgcttcttc

SEQ ID NO: 535983 - DNA, 19 bp, Homo sapiens
ctgtcattgcttcttctga

SEQ ID NO: 535984 - DNA, 12 bp, Homo sapiens
ctgtcatttctc

SEQ ID NO: 535985 - DNA, 19 bp, Homo sapiens
ctgtcatttctctttcaaa

SEQ ID NO: 535986 - DNA, 20 bp, Homo sapiens
ctgtcatttctctttcaaaa

SEQ ID NO: 535987 - DNA, 15 bp, Homo sapiens
ctgtcctcagcttct

SEQ ID NO: 535988 - DNA, 16 bp, Homo sapiens
ctgtcctggctcccag

SEQ ID NO: 535989 - DNA, 17 bp, Homo sapiens
ctgtcctggctcccagg

SEQ ID NO: 535990 - DNA, 23 bp, Homo sapiens
ctgtccttctctcacctcctaaa

SEQ ID NO: 535991 - DNA, 12 bp, Homo sapiens
ctgtcgtcccca

SEQ ID NO: 535992 - DNA, 15 bp, Homo sapiens
ctgtcgtccccagac

SEQ ID NO: 535993 - DNA, 18 bp, Homo sapiens
ctgtcgtccccagaccag

SEQ ID NO: 535994 - DNA, 20 bp, Homo sapiens
ctgtctagcacttccttgcc

SEQ ID NO: 535995 - DNA, 22 bp, Homo sapiens
ctgtctctacaaaaaaaatcaa

SEQ ID NO: 535996 - DNA, 11 bp, Homo sapiens
ctgtctctctt

SEQ ID NO: 535997 - DNA, 20 bp, Homo sapiens
ctgtctggaggggagctctg

SEQ ID NO: 535998 - DNA, 19 bp, Homo sapiens
ctgtctgtcccagttaact

SEQ ID NO: 535999 - DNA, 13 bp, Homo sapiens
ctgtctgtctctc

SEQ ID NO: 536000 - DNA, 15 bp, Homo sapiens
ctgtcttaattaagt

SEQ ID NO: 536001 - DNA, 23 bp, Homo sapiens
ctgtcttaattaagtaaactaat

SEQ ID NO: 536002 - DNA, 19 bp, Homo sapiens
ctgtcttcgaggacagcaa

SEQ ID NO: 536003 - DNA, 21 bp, Homo sapiens
ctgtgaaagtctcctgtatca

SEQ ID NO: 536004 - DNA, 21 bp, Homo sapiens
ctgtgaatagcagtggcaaaa

SEQ ID NO: 536005 - DNA, 17 bp, Homo sapiens
ctgtgacacagctgagc

SEQ ID NO: 536006 - DNA, 14 bp, Homo sapiens
ctgtgataacagag

SEQ ID NO: 536007 - DNA, 17 bp, Homo sapiens
ctgtgataacagagtga

SEQ ID NO: 536008 - DNA, 20 bp, Homo sapiens
ctgtgccttttttatatctt

SEQ ID NO: 536009 - DNA, 20 bp, Homo sapiens
ctgtgcgcataggcctgctt

SEQ ID NO: 536010 - DNA, 15 bp, Homo sapiens
ctgtgctaagttgtc

SEQ ID NO: 536011 - DNA, 17 bp, Homo sapiens
ctgtgctaagttgtctt

SEQ ID NO: 536012 - DNA, 19 bp, Homo sapiens
ctgtgctatgctggacatt

SEQ ID NO: 536013 - DNA, 16 bp, Homo sapiens
ctgtgctctcaccagc

SEQ ID NO: 536014 - DNA, 12 bp, Homo sapiens
ctgtggcctcag

SEQ ID NO: 536015 - DNA, 15 bp, Homo sapiens
ctgtggcctcaggag

SEQ ID NO: 536016 - DNA, 16 bp, Homo sapiens
ctgtggcctcaggagg

SEQ ID NO: 536017 - DNA, 21 bp, Homo sapiens
ctgtggctgatttactaacag

SEQ ID NO: 536018 - DNA, 21 bp, Homo sapiens
ctgtggctggtactttctgta

SEQ ID NO: 536019 - DNA, 13 bp, Homo sapiens
ctgtgggctccct

SEQ ID NO: 536020 - DNA, 15 bp, Homo sapiens
ctgtgggctcccttc

SEQ ID NO: 536021 - DNA, 16 bp, Homo sapiens
ctgtggggagctggtg

SEQ ID NO: 536022 - DNA, 22 bp, Homo sapiens
ctgtggtcttcaaattgtcttt

SEQ ID NO: 536023 - DNA, 23 bp, Homo sapiens
ctgtggtgaggtcctgtcctggc

SEQ ID NO: 536024 - DNA, 21 bp, Homo sapiens
ctgtgtccccgcgggcagtga

SEQ ID NO: 536025 - DNA, 22 bp, Homo sapiens
ctgtgtccccgcgggcagtgac

SEQ ID NO: 536026 - DNA, 17 bp, Homo sapiens
ctgtgtgttaaaatgag

SEQ ID NO: 536027 - DNA, 22 bp, Homo sapiens
ctgttaaatggggagacaaagg

SEQ ID NO: 536028 - DNA, 17 bp, Homo sapiens
ctgttacaaaatgtaac

SEQ ID NO: 536029 - DNA, 19 bp, Homo sapiens
ctgttaccattggaaattt

SEQ ID NO: 536030 - DNA, 19 bp, Homo sapiens
ctgttataaattttgtaca

SEQ ID NO: 536031 - DNA, 22 bp, Homo sapiens
ctgttataaattttgtacattt

SEQ ID NO: 536032 - DNA, 17 bp, Homo sapiens
ctgttcctttcagatga

SEQ ID NO: 536033 - DNA, 12 bp, Homo sapiens
ctgttctgtgtc

SEQ ID NO: 536034 - DNA, 17 bp, Homo sapiens
ctgttctgtgtctgctg

SEQ ID NO: 536035 - DNA, 19 bp, Homo sapiens
ctgttctgtgtctgctgta

SEQ ID NO: 536036 - DNA, 20 bp, Homo sapiens
ctgttgacatccaagcttcc

SEQ ID NO: 536037 - DNA, 14 bp, Homo sapiens
ctgttgaccaggca

SEQ ID NO: 536038 - DNA, 17 bp, Homo sapiens
ctgttgaccaggcacct

SEQ ID NO: 536039 - DNA, 15 bp, Homo sapiens
ctgttgtctgaaaca

SEQ ID NO: 536040 - DNA, 16 bp, Homo sapiens
ctgttgtctgaaacat

SEQ ID NO: 536041 - DNA, 17 bp, Homo sapiens
ctgtttcatttgtgtca

SEQ ID NO: 536042 - DNA, 17 bp, Homo sapiens
ctgtttctcagtctcac

SEQ ID NO: 536043 - DNA, 13 bp, Homo sapiens
ctgtttgcttcta

SEQ ID NO: 536044 - DNA, 17 bp, Homo sapiens
ctgtttggttttaaaat

SEQ ID NO: 536045 - DNA, 18 bp, Homo sapiens
cttaaaaatgcatttaag

SEQ ID NO: 536046 - DNA, 19 bp, Homo sapiens
cttaaaaatgcatttaagt

SEQ ID NO: 536047 - DNA, 11 bp, Homo sapiens
cttaaaacact

SEQ ID NO: 536048 - DNA, 14 bp, Homo sapiens
cttaaaatttgaaa

SEQ ID NO: 536049 - DNA, 15 bp, Homo sapiens
cttaaataaaaatta

SEQ ID NO: 536050 - DNA, 22 bp, Homo sapiens
cttaaataaaagaaatgcacaa

SEQ ID NO: 536051 - DNA, 16 bp, Homo sapiens
cttaaatgtgaattac

SEQ ID NO: 536052 - DNA, 15 bp, Homo sapiens
cttaacatccctcct

SEQ ID NO: 536053 - DNA, 20 bp, Homo sapiens
cttaacatttctaactctga

SEQ ID NO: 536054 - DNA, 24 bp, Homo sapiens
cttaacatttctaactctgatgta

SEQ ID NO: 536055 - DNA, 16 bp, Homo sapiens
cttaagagaaatggca

SEQ ID NO: 536056 - DNA, 12 bp, Homo sapiens
cttaagctgcag

SEQ ID NO: 536057 - DNA, 20 bp, Homo sapiens
cttaatatatagcatttatg

SEQ ID NO: 536058 - DNA, 17 bp, Homo sapiens
cttaatggccttaatta

SEQ ID NO: 536059 - DNA, 15 bp, Homo sapiens
cttaattaagtaaac

SEQ ID NO: 536060 - DNA, 16 bp, Homo sapiens
cttacaaatgattgct

SEQ ID NO: 536061 - DNA, 18 bp, Homo sapiens
cttacacatcttccacag

SEQ ID NO: 536062 - DNA, 18 bp, Homo sapiens
cttacagaagggagtgaa

SEQ ID NO: 536063 - DNA, 17 bp, Homo sapiens
cttacataaacatcagg

SEQ ID NO: 536064 - DNA, 23 bp, Homo sapiens
cttaccaagttggtcttactttg

SEQ ID NO: 536065 - DNA, 17 bp, Homo sapiens
cttactttgttaattta

SEQ ID NO: 536066 - DNA, 19 bp, Homo sapiens
cttagaaaataaatacaag

SEQ ID NO: 536067 - DNA, 19 bp, Homo sapiens
cttagatttggtgaacaac

SEQ ID NO: 536068 - DNA, 15 bp, Homo sapiens
cttagcctggagcac

SEQ ID NO: 536069 - DNA, 22 bp, Homo sapiens
cttagcctggagcacctttcct

SEQ ID NO: 536070 - DNA, 15 bp, Homo sapiens
cttagcgttctgttt

SEQ ID NO: 536071 - DNA, 16 bp, Homo sapiens
cttagcttatctttct

SEQ ID NO: 536072 - DNA, 13 bp, Homo sapiens
cttagcttttctg

SEQ ID NO: 536073 - DNA, 23 bp, Homo sapiens
cttaggcaatggtgaactgtcat

SEQ ID NO: 536074 - DNA, 12 bp, Homo sapiens
cttagtggacag

SEQ ID NO: 536075 - DNA, 13 bp, Homo sapiens
cttagtgtctcta

SEQ ID NO: 536076 - DNA, 17 bp, Homo sapiens
cttagtgtctctattta

SEQ ID NO: 536077 - DNA, 15 bp, Homo sapiens
cttataacattgtat

SEQ ID NO: 536078 - DNA, 16 bp, Homo sapiens
cttatatgtgcccctt

SEQ ID NO: 536079 - DNA, 13 bp, Homo sapiens
cttatattctgca

SEQ ID NO: 536080 - DNA, 14 bp, Homo sapiens
cttatatttgtgta

SEQ ID NO: 536081 - DNA, 21 bp, Homo sapiens
cttatccacgagagcgcagca

SEQ ID NO: 536082 - DNA, 20 bp, Homo sapiens
cttatctagctgcatatctt

SEQ ID NO: 536083 - DNA, 19 bp, Homo sapiens
cttatctttctttccattt

SEQ ID NO: 536084 - DNA, 14 bp, Homo sapiens
cttatgaatagaca

SEQ ID NO: 536085 - DNA, 23 bp, Homo sapiens
cttatgaatagacataaattgta

SEQ ID NO: 536086 - DNA, 16 bp, Homo sapiens
cttatgcttccagaaa

SEQ ID NO: 536087 - DNA, 17 bp, Homo sapiens
cttattaaagtttcaaa

SEQ ID NO: 536088 - DNA, 22 bp, Homo sapiens
cttattaaagtttcaaaaatct

SEQ ID NO: 536089 - DNA, 18 bp, Homo sapiens
cttatttgctcataagta

SEQ ID NO: 536090 - DNA, 23 bp, Homo sapiens
cttatttgctcataagtaaatgt

SEQ ID NO: 536091 - DNA, 18 bp, Homo sapiens
cttatttgtatttttcct

SEQ ID NO: 536092 - DNA, 12 bp, Homo sapiens
cttcaacaaggc

SEQ ID NO: 536093 - DNA, 22 bp, Homo sapiens
cttcaacaaggcttgctgcaga

SEQ ID NO: 536094 - DNA, 14 bp, Homo sapiens
cttcaacatgtgtg

SEQ ID NO: 536095 - DNA, 18 bp, Homo sapiens
cttcaatttattgcacaa

SEQ ID NO: 536096 - DNA, 22 bp, Homo sapiens
cttcactgtcatgtgcgaacac

SEQ ID NO: 536097 - DNA, 20 bp, Homo sapiens
cttcacttctgactcttccc

SEQ ID NO: 536098 - DNA, 20 bp, Homo sapiens
cttcagggagtcagctgttt

SEQ ID NO: 536099 - DNA, 22 bp, Homo sapiens
cttcagtaaatgtgattcacct

SEQ ID NO: 536100 - DNA, 24 bp, Homo sapiens
cttcatccagattgggtgccagca

SEQ ID NO: 536101 - DNA, 14 bp, Homo sapiens
cttcatgaaatgct

SEQ ID NO: 536102 - DNA, 14 bp, Homo sapiens
cttcatgttgatgt

SEQ ID NO: 536103 - DNA, 16 bp, Homo sapiens
cttcatttaacactga

SEQ ID NO: 536104 - DNA, 21 bp, Homo sapiens
cttcatttaacactgagtgaa

SEQ ID NO: 536105 - DNA, 20 bp, Homo sapiens
actttcttttcgccgtggct

SEQ ID NO: 536106 - DNA, 23 bp, Homo sapiens
actttgattcacatgttttcaaa

SEQ ID NO: 536107 - DNA, 20 bp, Homo sapiens
actttgtcctaagagattta

SEQ ID NO: 536108 - DNA, 12 bp, Homo sapiens
actttgttaatt

SEQ ID NO: 536109 - DNA, 18 bp, Homo sapiens
actttgttaggccaaaga

SEQ ID NO: 536110 - DNA, 22 bp, Homo sapiens
actttgttaggccaaagacaaa

SEQ ID NO: 536111 - DNA, 16 bp, Homo sapiens
acttttccagtatttt

SEQ ID NO: 536112 - DNA, 18 bp, Homo sapiens
acttttccagtattttag

SEQ ID NO: 536113 - DNA, 18 bp, Homo sapiens
acttttccttgcatacaa

SEQ ID NO: 536114 - DNA, 20 bp, Homo sapiens
acttttgtagtcttatgaat

SEQ ID NO: 536115 - DNA, 16 bp, Homo sapiens
agaaaaagcaaaaggc

SEQ ID NO: 536116 - DNA, 18 bp, Homo sapiens
agaaaaatgaaatttaag

SEQ ID NO: 536117 - DNA, 19 bp, Homo sapiens
agaaaaatttctggcaaat

SEQ ID NO: 536118 - DNA, 11 bp, Homo sapiens
agaaaaggaag

SEQ ID NO: 536119 - DNA, 20 bp, Homo sapiens
agaaaataaatacaagtttg

SEQ ID NO: 536120 - DNA, 16 bp, Homo sapiens
agaaaatgttcttcca

SEQ ID NO: 536121 - DNA, 12 bp, Homo sapiens
agaaacaagaca

SEQ ID NO: 536122 - DNA, 15 bp, Homo sapiens
agaaacaatttctgt

SEQ ID NO: 536123 - DNA, 21 bp, Homo sapiens
agaaacagataccatactcat

SEQ ID NO: 536124 - DNA, 20 bp, Homo sapiens
agaaacctacagaatactag

SEQ ID NO: 536125 - DNA, 14 bp, Homo sapiens
agaaagaactatct

SEQ ID NO: 536126 - DNA, 18 bp, Homo sapiens
agaaaggggctagcactg

SEQ ID NO: 536127 - DNA, 13 bp, Homo sapiens
agaaagtcatagt

SEQ ID NO: 536128 - DNA, 17 bp, Homo sapiens
agaaatatatatacata

SEQ ID NO: 536129 - DNA, 20 bp, Homo sapiens
agaaatctatagaaagtgtt

SEQ ID NO: 536130 - DNA, 13 bp, Homo sapiens
agaaatgcacaat

SEQ ID NO: 536131 - DNA, 14 bp, Homo sapiens
agaaatgccgctgt

SEQ ID NO: 536132 - DNA, 17 bp, Homo sapiens
agaaatgccgctgtgtc

SEQ ID NO: 536133 - DNA, 22 bp, Homo sapiens
agaaattagggctctaatttcc

SEQ ID NO: 536134 - DNA, 21 bp, Homo sapiens
agaaattcgccccattttctt

SEQ ID NO: 536135 - DNA, 21 bp, Homo sapiens
agaaccattcactggcaaatg

SEQ ID NO: 536136 - DNA, 23 bp, Homo sapiens
agaaccattcactggcaaatgga

SEQ ID NO: 536137 - DNA, 22 bp, Homo sapiens
agaaccgagcaaagatcaaaat

SEQ ID NO: 536138 - DNA, 22 bp, Homo sapiens
agaacctactgttcctttcaga

SEQ ID NO: 536139 - DNA, 13 bp, Homo sapiens
agaaccttctaat

SEQ ID NO: 536140 - DNA, 22 bp, Homo sapiens
agaacgccagggaccccagaat

SEQ ID NO: 536141 - DNA, 13 bp, Homo sapiens
agaactatcttca

SEQ ID NO: 536142 - DNA, 14 bp, Homo sapiens
agaactatcttcat

SEQ ID NO: 536143 - DNA, 17 bp, Homo sapiens
agaactatcttcatctg

SEQ ID NO: 536144 - DNA, 18 bp, Homo sapiens
agaactatcttcatctga

SEQ ID NO: 536145 - DNA, 18 bp, Homo sapiens
agaactcatgtgatttac

SEQ ID NO: 536146 - DNA, 23 bp, Homo sapiens
agaactctgcctgccctttgtcc

SEQ ID NO: 536147 - DNA, 15 bp, Homo sapiens
agaagaaagaactat

SEQ ID NO: 536148 - DNA, 15 bp, Homo sapiens
agaagaatgcatgct

SEQ ID NO: 536149 - DNA, 14 bp, Homo sapiens
agaagacagcaaaa

SEQ ID NO: 536150 - DNA, 18 bp, Homo sapiens
agaagatagttgtaaaga

SEQ ID NO: 536151 - DNA, 15 bp, Homo sapiens
agaagatctttgggc

SEQ ID NO: 536152 - DNA, 15 bp, Homo sapiens
agataatggtaattt

SEQ ID NO: 536153 - DNA, 16 bp, Homo sapiens
agataatggtaattta

SEQ ID NO: 536154 - DNA, 13 bp, Homo sapiens
agataattctgga

SEQ ID NO: 536155 - DNA, 16 bp, Homo sapiens
agataccatactcatt

SEQ ID NO: 536156 - DNA, 19 bp, Homo sapiens
agataccatactcatttct

SEQ ID NO: 536157 - DNA, 18 bp, Homo sapiens
agataccattttgaaata

SEQ ID NO: 536158 - DNA, 18 bp, Homo sapiens
agataccttaaaatttga

SEQ ID NO: 536159 - DNA, 20 bp, Homo sapiens
agataggaaggtcatttcca

SEQ ID NO: 536160 - DNA, 21 bp, Homo sapiens
agataggaaggtcatttccat

SEQ ID NO: 536161 - DNA, 18 bp, Homo sapiens
agatatatctgaaaactg

SEQ ID NO: 536162 - DNA, 23 bp, Homo sapiens
agatatgagaaatataaaaataa

SEQ ID NO: 536163 - DNA, 20 bp, Homo sapiens
agatattgtatctcctttaa

SEQ ID NO: 536164 - DNA, 14 bp, Homo sapiens
agatcaaaataaaa

SEQ ID NO: 536165 - DNA, 14 bp, Homo sapiens
agatcactgaactt

SEQ ID NO: 536166 - DNA, 17 bp, Homo sapiens
agatcactgaacttttc

SEQ ID NO: 536167 - DNA, 14 bp, Homo sapiens
agatccacctgcac

SEQ ID NO: 536168 - DNA, 15 bp, Homo sapiens
agatccacctgcaca

SEQ ID NO: 536169 - DNA, 18 bp, Homo sapiens
agatccaggaacacatgc

SEQ ID NO: 536170 - DNA, 21 bp, Homo sapiens
agatccaggaacacatgcaca

SEQ ID NO: 536171 - DNA, 22 bp, Homo sapiens
agatccaggaacacatgcacac

SEQ ID NO: 536172 - DNA, 23 bp, Homo sapiens
agatccaggaacacatgcacaca

SEQ ID NO: 536173 - DNA, 14 bp, Homo sapiens
agatccgccctggg

SEQ ID NO: 536174 - DNA, 18 bp, Homo sapiens
agatctttttttaagtgt

SEQ ID NO: 536175 - DNA, 19 bp, Homo sapiens
agatctttttttaagtgtt

SEQ ID NO: 536176 - DNA, 13 bp, Homo sapiens
agatgatccttgc

SEQ ID NO: 536177 - DNA, 23 bp, Homo sapiens
agatgcactatatgtttacacaa

SEQ ID NO: 536178 - DNA, 18 bp, Homo sapiens
agatgccattcatagaga

SEQ ID NO: 536179 - DNA, 19 bp, Homo sapiens
agatgctgctgagcacatc

SEQ ID NO: 536180 - DNA, 14 bp, Homo sapiens
agatggcgcacccg

SEQ ID NO: 536181 - DNA, 16 bp, Homo sapiens
agatggcgcacccggc

SEQ ID NO: 536182 - DNA, 18 bp, Homo sapiens
agatgggccttttcttga

SEQ ID NO: 536183 - DNA, 15 bp, Homo sapiens
agatgggggcctctt

SEQ ID NO: 536184 - DNA, 23 bp, Homo sapiens
agatgtaagaagcccgatccaca

SEQ ID NO: 536185 - DNA, 14 bp, Homo sapiens
agatgtctctaaaa

SEQ ID NO: 536186 - DNA, 21 bp, Homo sapiens
agatgtgtaatttttctgtat

SEQ ID NO: 536187 - DNA, 17 bp, Homo sapiens
agatgttatatttttct

SEQ ID NO: 536188 - DNA, 21 bp, Homo sapiens
agatgttatatttttcttaaa

SEQ ID NO: 536189 - DNA, 20 bp, Homo sapiens
agattcctttggccactgta

SEQ ID NO: 536190 - DNA, 18 bp, Homo sapiens
agattgaagctaaaacac

SEQ ID NO: 536191 - DNA, 18 bp, Homo sapiens
agattggaaaaaattaga

SEQ ID NO: 536192 - DNA, 22 bp, Homo sapiens
agattggattttatgttgacat

SEQ ID NO: 536193 - DNA, 16 bp, Homo sapiens
agattgtttatctaga

SEQ ID NO: 536194 - DNA, 18 bp, Homo sapiens
agattgtttatctagatg

SEQ ID NO: 536195 - DNA, 13 bp, Homo sapiens
agatttatcttta

SEQ ID NO: 536196 - DNA, 19 bp, Homo sapiens
agatttatctttatacaga

SEQ ID NO: 536197 - DNA, 17 bp, Homo sapiens
agatttcaagaaaaaat

SEQ ID NO: 536198 - DNA, 12 bp, Homo sapiens
agatttgcacaa

SEQ ID NO: 536199 - DNA, 17 bp, Homo sapiens
agatttgcacaaaaaga

SEQ ID NO: 536200 - DNA, 16 bp, Homo sapiens
agatttggtgaacaac

SEQ ID NO: 536201 - DNA, 13 bp, Homo sapiens
agattttagtttt

SEQ ID NO: 536202 - DNA, 15 bp, Homo sapiens
agattttatgtttaa

SEQ ID NO: 536203 - DNA, 22 bp, Homo sapiens
agcaaacccaaagatgttaaca

SEQ ID NO: 536204 - DNA, 17 bp, Homo sapiens
agcaaagatcaaaataa

SEQ ID NO: 536205 - DNA, 14 bp, Homo sapiens
agcaaattaatgtg

SEQ ID NO: 536206 - DNA, 16 bp, Homo sapiens
agcaaattaatgtgta

SEQ ID NO: 536207 - DNA, 17 bp, Homo sapiens
agcaaattaatgtgtaa

SEQ ID NO: 536208 - DNA, 19 bp, Homo sapiens
agcaaattaatgtgtaaaa

SEQ ID NO: 536209 - DNA, 15 bp, Homo sapiens
agcaacaattttcag

SEQ ID NO: 536210 - DNA, 16 bp, Homo sapiens
agcaacaattttcaga

SEQ ID NO: 536211 - DNA, 13 bp, Homo sapiens
agcaacagctgga

SEQ ID NO: 536212 - DNA, 21 bp, Homo sapiens
agcaacagctggacaccccct

SEQ ID NO: 536213 - DNA, 22 bp, Homo sapiens
agcaagcttttacaacagtgct

SEQ ID NO: 536214 - DNA, 13 bp, Homo sapiens
agcaatatctgct

SEQ ID NO: 536215 - DNA, 18 bp, Homo sapiens
agcacaacccccagctcc

SEQ ID NO: 536216 - DNA, 22 bp, Homo sapiens
agcacaacccccagctcccgct

SEQ ID NO: 536217 - DNA, 18 bp, Homo sapiens
agcacagacaattctaat

SEQ ID NO: 536218 - DNA, 23 bp, Homo sapiens
agcacagacaattctaatggtaa

SEQ ID NO: 536219 - DNA, 12 bp, Homo sapiens
agcacagagagg

SEQ ID NO: 536220 - DNA, 18 bp, Homo sapiens
agcacagaggcctcctgt

SEQ ID NO: 536221 - DNA, 18 bp, Homo sapiens
agcacagcctcacccctg

SEQ ID NO: 536222 - DNA, 14 bp, Homo sapiens
agcacagctccctt

SEQ ID NO: 536223 - DNA, 16 bp, Homo sapiens
agcacagtatttaaca

SEQ ID NO: 536224 - DNA, 20 bp, Homo sapiens
agcacagtatttaacattct

SEQ ID NO: 536225 - DNA, 18 bp, Homo sapiens
agcaccaagtacaaggac

SEQ ID NO: 536226 - DNA, 20 bp, Homo sapiens
agcactatcgaggtatttgg

SEQ ID NO: 536227 - DNA, 19 bp, Homo sapiens
agcacttccttgccagtct

SEQ ID NO: 536228 - DNA, 19 bp, Homo sapiens
agcagaaaaaaaagtgtct

SEQ ID NO: 536229 - DNA, 22 bp, Homo sapiens
agcagaaaaacaggcacaggct

SEQ ID NO: 536230 - DNA, 17 bp, Homo sapiens
agcagaattggaaaaga

SEQ ID NO: 536231 - DNA, 19 bp, Homo sapiens
agcagaattggaaaagact

SEQ ID NO: 536232 - DNA, 12 bp, Homo sapiens
agcagacacaca

SEQ ID NO: 536233 - DNA, 13 bp, Homo sapiens
agcagacacacac

SEQ ID NO: 536234 - DNA, 14 bp, Homo sapiens
agcagacacacaca

SEQ ID NO: 536235 - DNA, 19 bp, Homo sapiens
agcagacacacacatatat

SEQ ID NO: 536236 - DNA, 19 bp, Homo sapiens
agcagagaagtacaggtca

SEQ ID NO: 536237 - DNA, 22 bp, Homo sapiens
agcagagtcaagctgatgaagt

SEQ ID NO: 536238 - DNA, 19 bp, Homo sapiens
agcagagtgaaattcaatt

SEQ ID NO: 536239 - DNA, 18 bp, Homo sapiens
agcagatccacctgcaca

SEQ ID NO: 536240 - DNA, 22 bp, Homo sapiens
agcagatccacctgcacaaaca

SEQ ID NO: 536241 - DNA, 23 bp, Homo sapiens
agcagatccacctgcacaaacat

SEQ ID NO: 536242 - DNA, 20 bp, Homo sapiens
agcagcaaaaatataaaata

SEQ ID NO: 536243 - DNA, 23 bp, Homo sapiens
agcagcaaggtcttgctctccta

SEQ ID NO: 536244 - DNA, 15 bp, Homo sapiens
agcagcagcagcagc

SEQ ID NO: 536245 - DNA, 15 bp, Homo sapiens
agcagcagtttgtga

SEQ ID NO: 536246 - DNA, 13 bp, Homo sapiens
agcagcccaaatt

SEQ ID NO: 536247 - DNA, 17 bp, Homo sapiens
agcagctagaaagagaa

SEQ ID NO: 536248 - DNA, 17 bp, Homo sapiens
agcagctgaagccagct

SEQ ID NO: 536249 - DNA, 19 bp, Homo sapiens
agcagctgaagccagctcc

SEQ ID NO: 536250 - DNA, 20 bp, Homo sapiens
agcagctgaagccagctccc

SEQ ID NO: 536251 - DNA, 15 bp, Homo sapiens
agcaggaggctggga

SEQ ID NO: 536252 - DNA, 20 bp, Homo sapiens
agcaggatagctcttcctcc

SEQ ID NO: 536253 - DNA, 23 bp, Homo sapiens
agcagtgatattctttgttaatt

SEQ ID NO: 536254 - DNA, 16 bp, Homo sapiens
agcagtggagcccagg

SEQ ID NO: 536255 - DNA, 18 bp, Homo sapiens
agcagtggagcccaggag

SEQ ID NO: 536256 - DNA, 13 bp, Homo sapiens
agcagtggcaaaa

SEQ ID NO: 536257 - DNA, 16 bp, Homo sapiens
agcagtggcaaaatat

SEQ ID NO: 536258 - DNA, 21 bp, Homo sapiens
agcagttgcaataaactcagt

SEQ ID NO: 536259 - DNA, 17 bp, Homo sapiens
agcagtttcaataaagt

SEQ ID NO: 536260 - DNA, 18 bp, Homo sapiens
agcatacattttctggtg

SEQ ID NO: 536261 - DNA, 22 bp, Homo sapiens
agcatccatgcggccggcctgg

SEQ ID NO: 536262 - DNA, 14 bp, Homo sapiens
agcatctaaacttt

SEQ ID NO: 536263 - DNA, 15 bp, Homo sapiens
agcatgctccctcat

SEQ ID NO: 536264 - DNA, 14 bp, Homo sapiens
agcattcggaggga

SEQ ID NO: 536265 - DNA, 17 bp, Homo sapiens
agcatttccaacaccac

SEQ ID NO: 536266 - DNA, 17 bp, Homo sapiens
agcatttgactttctgt

SEQ ID NO: 536267 - DNA, 12 bp, Homo sapiens
agccacatcact

SEQ ID NO: 536268 - DNA, 11 bp, Homo sapiens
agccagctccc

SEQ ID NO: 536269 - DNA, 20 bp, Homo sapiens
agccagtttagagaaataca

SEQ ID NO: 536270 - DNA, 10 bp, Homo sapiens
agccatagtg

SEQ ID NO: 536271 - DNA, 22 bp, Homo sapiens
agcccaggagtcccactccaag

SEQ ID NO: 536272 - DNA, 17 bp, Homo sapiens
agcccaggcatctcctt

SEQ ID NO: 536273 - DNA, 20 bp, Homo sapiens
agccccaacccaaacctgga

SEQ ID NO: 536274 - DNA, 21 bp, Homo sapiens
agccccaacccaaacctggag

SEQ ID NO: 536275 - DNA, 23 bp, Homo sapiens
agccccaacccaaacctggagat

SEQ ID NO: 536276 - DNA, 18 bp, Homo sapiens
agccccagcgagtctgga

SEQ ID NO: 536277 - DNA, 16 bp, Homo sapiens
agcccctccctcctct

SEQ ID NO: 536278 - DNA, 17 bp, Homo sapiens
agcccgatccacattgc

SEQ ID NO: 536279 - DNA, 23 bp, Homo sapiens
agccctctctggctaaggacagg

SEQ ID NO: 536280 - DNA, 17 bp, Homo sapiens
agccctgaggaggcctt

SEQ ID NO: 536281 - DNA, 18 bp, Homo sapiens
agccctgaggaggccttg

SEQ ID NO: 536282 - DNA, 11 bp, Homo sapiens
agccctgctcc

SEQ ID NO: 536283 - DNA, 13 bp, Homo sapiens
agccctgctccct

SEQ ID NO: 536284 - DNA, 15 bp, Homo sapiens
agcccttcctctgct

SEQ ID NO: 536285 - DNA, 19 bp, Homo sapiens
agcccttcctctgctcccc

SEQ ID NO: 536286 - DNA, 22 bp, Homo sapiens
agcccttgcccatgctgggctc

SEQ ID NO: 536287 - DNA, 20 bp, Homo sapiens
agccgagctctcctgggcca

SEQ ID NO: 536288 - DNA, 16 bp, Homo sapiens
tgacctcactcagaag

SEQ ID NO: 536289 - DNA, 16 bp, Homo sapiens
tgacctccccctcctt

SEQ ID NO: 536290 - DNA, 18 bp, Homo sapiens
tgacctccccctccttcc

SEQ ID NO: 536291 - DNA, 22 bp, Homo sapiens
tgaccttctgtcgtccccagac

SEQ ID NO: 536292 - DNA, 14 bp, Homo sapiens
tgaccttgtaatgt

SEQ ID NO: 536293 - DNA, 21 bp, Homo sapiens
tgaccttgtaatgtaactgct

SEQ ID NO: 536294 - DNA, 18 bp, Homo sapiens
tgacgtttcttctttcta

SEQ ID NO: 536295 - DNA, 19 bp, Homo sapiens
tgacgtttcttctttctag

SEQ ID NO: 536296 - DNA, 13 bp, Homo sapiens
tgactcaaagatg

SEQ ID NO: 536297 - DNA, 19 bp, Homo sapiens
tgactccaagaacaattgt

SEQ ID NO: 536298 - DNA, 12 bp, Homo sapiens
tgactctgctct

SEQ ID NO: 536299 - DNA, 16 bp, Homo sapiens
tgactctgctcttgca

SEQ ID NO: 536300 - DNA, 21 bp, Homo sapiens
tgactgtacttgatttttcaa

SEQ ID NO: 536301 - DNA, 15 bp, Homo sapiens
tgacttcctgaactc

SEQ ID NO: 536302 - DNA, 15 bp, Homo sapiens
tgagaaatataaaaa

SEQ ID NO: 536303 - DNA, 19 bp, Homo sapiens
tgagaagcctcatgggagt

SEQ ID NO: 536304 - DNA, 18 bp, Homo sapiens
tgagagaggctaaaatgt

SEQ ID NO: 536305 - DNA, 19 bp, Homo sapiens
tgagagaggctaaaatgtt

SEQ ID NO: 536306 - DNA, 16 bp, Homo sapiens
tgagaggaaatgttga

SEQ ID NO: 536307 - DNA, 13 bp, Homo sapiens
tgagaggggagag

SEQ ID NO: 536308 - DNA, 14 bp, Homo sapiens
tgagaggggagagc

SEQ ID NO: 536309 - DNA, 15 bp, Homo sapiens
tgagagttccttctc

SEQ ID NO: 536310 - DNA, 19 bp, Homo sapiens
tgagagttccttctcactt

SEQ ID NO: 536311 - DNA, 17 bp, Homo sapiens
tgagatcactgaacttt

SEQ ID NO: 536312 - DNA, 21 bp, Homo sapiens
tgagatcactgaacttttcaa

SEQ ID NO: 536313 - DNA, 22 bp, Homo sapiens
tgagatcactgaacttttcaaa

SEQ ID NO: 536314 - DNA, 14 bp, Homo sapiens
tgagatctttctaa

SEQ ID NO: 536315 - DNA, 20 bp, Homo sapiens
tgagcacatctcttcatgcg

SEQ ID NO: 536316 - DNA, 12 bp, Homo sapiens
tgagcagctgaa

SEQ ID NO: 536317 - DNA, 22 bp, Homo sapiens
tgagcagtgatattctttgtta

SEQ ID NO: 536318 - DNA, 14 bp, Homo sapiens
tgagcatgctccct

SEQ ID NO: 536319 - DNA, 14 bp, Homo sapiens
tgagccttctgagc

SEQ ID NO: 536320 - DNA, 15 bp, Homo sapiens
tgagctagaaatcac

SEQ ID NO: 536321 - DNA, 15 bp, Homo sapiens
tgagctgcaccaggt

SEQ ID NO: 536322 - DNA, 15 bp, Homo sapiens
tgaggaaaaatatgt

SEQ ID NO: 536323 - DNA, 17 bp, Homo sapiens
tgaggaaagcacacagt

SEQ ID NO: 536324 - DNA, 19 bp, Homo sapiens
tgaggacatggcttctgaa

SEQ ID NO: 536325 - DNA, 16 bp, Homo sapiens
atccaggaacacatgc

SEQ ID NO: 536326 - DNA, 17 bp, Homo sapiens
atccaggaacacatgca

SEQ ID NO: 536327 - DNA, 19 bp, Homo sapiens
atccaggaacacatgcaca

SEQ ID NO: 536328 - DNA, 21 bp, Homo sapiens
atccaggaacacatgcacaca

SEQ ID NO: 536329 - DNA, 14 bp, Homo sapiens
atccatcagtgcca

SEQ ID NO: 536330 - DNA, 19 bp, Homo sapiens
atccatcggtttatactat

SEQ ID NO: 536331 - DNA, 20 bp, Homo sapiens
atccatctcctggtgttctg

SEQ ID NO: 536332 - DNA, 19 bp, Homo sapiens
atccatgcggccggcctgg

SEQ ID NO: 536333 - DNA, 21 bp, Homo sapiens
atccatgcggccggcctgggg

SEQ ID NO: 536334 - DNA, 17 bp, Homo sapiens
atccatgtgctgctgtg

SEQ ID NO: 536335 - DNA, 19 bp, Homo sapiens
atccattcccaagaaatgc

SEQ ID NO: 536336 - DNA, 11 bp, Homo sapiens
atcccacagcc

SEQ ID NO: 536337 - DNA, 16 bp, Homo sapiens
atcccacttgcccctg

SEQ ID NO: 536338 - DNA, 19 bp, Homo sapiens
atcccagccccaattttct

SEQ ID NO: 536339 - DNA, 21 bp, Homo sapiens
atcccatcgtctcggccttca

SEQ ID NO: 536340 - DNA, 16 bp, Homo sapiens
atcccattgtatttaa

SEQ ID NO: 536341 - DNA, 18 bp, Homo sapiens
atccccataatgcttctt

SEQ ID NO: 536342 - DNA, 15 bp, Homo sapiens
atcccgacctcttag

SEQ ID NO: 536343 - DNA, 14 bp, Homo sapiens
atcccggggccatg

SEQ ID NO: 536344 - DNA, 19 bp, Homo sapiens
atcccttccacctgctctg

SEQ ID NO: 536345 - DNA, 13 bp, Homo sapiens
atcccttctcttc

SEQ ID NO: 536346 - DNA, 13 bp, Homo sapiens
atccgtgtatttg

SEQ ID NO: 536347 - DNA, 21 bp, Homo sapiens
atcctacgagtaattgcattt

SEQ ID NO: 536348 - DNA, 13 bp, Homo sapiens
atcctccagggct

SEQ ID NO: 536349 - DNA, 13 bp, Homo sapiens
atcctcctccttc

SEQ ID NO: 536350 - DNA, 15 bp, Homo sapiens
tcagatgggaacagt

SEQ ID NO: 536351 - DNA, 14 bp, Homo sapiens
tcagatttgcacaa

SEQ ID NO: 536352 - DNA, 14 bp, Homo sapiens
tcagatttgtataa

SEQ ID NO: 536353 - DNA, 22 bp, Homo sapiens
tcagcaaacccaaagatgttaa

SEQ ID NO: 536354 - DNA, 24 bp, Homo sapiens
tcagcaaacccaaagatgttaaca

SEQ ID NO: 536355 - DNA, 19 bp, Homo sapiens
tcagcaaggcgctaacttg

SEQ ID NO: 536356 - DNA, 18 bp, Homo sapiens
tcagcacagcctcacccc

SEQ ID NO: 536357 - DNA, 24 bp, Homo sapiens
tcagcacatagggttcccacgaag

SEQ ID NO: 536358 - DNA, 15 bp, Homo sapiens
tcagcaccacgtgcc

SEQ ID NO: 536359 - DNA, 18 bp, Homo sapiens
tcagcaccacgtgccaag

SEQ ID NO: 536360 - DNA, 19 bp, Homo sapiens
tcagcagcggcagcagcag

SEQ ID NO: 536361 - DNA, 16 bp, Homo sapiens
tcagcaggcagccttg

SEQ ID NO: 536362 - DNA, 13 bp, Homo sapiens
tcagcatatatat

SEQ ID NO: 536363 - DNA, 20 bp, Homo sapiens
tcagcatatatataaaatac

SEQ ID NO: 536364 - DNA, 21 bp, Homo sapiens
tcagccggcgtggcaaatata

SEQ ID NO: 536365 - DNA, 13 bp, Homo sapiens
tcagcctcgcagg

SEQ ID NO: 536366 - DNA, 16 bp, Homo sapiens
tcagctaggaacaaat

SEQ ID NO: 536367 - DNA, 20 bp, Homo sapiens
tcagctaggaacaaatcttc

SEQ ID NO: 536368 - DNA, 23 bp, Homo sapiens
tcagctaggaacaaatcttcctg

SEQ ID NO: 536369 - DNA, 20 bp, Homo sapiens
tcagctctctgtataaacat

SEQ ID NO: 536370 - DNA, 21 bp, Homo sapiens
tcagctgagccttctgagctg

SEQ ID NO: 536371 - DNA, 13 bp, Homo sapiens
tcagcttcttaat

SEQ ID NO: 536372 - DNA, 21 bp, Homo sapiens
tcagctttctttaaagttctt

SEQ ID NO: 536373 - DNA, 18 bp, Homo sapiens
tcaggaagaagagatgca

SEQ ID NO: 536374 - DNA, 14 bp, Homo sapiens
tcaggaccccatct

SEQ ID NO: 536375 - DNA, 17 bp, Homo sapiens
tcaggaccctcgctggc

SEQ ID NO: 536376 - DNA, 20 bp, Homo sapiens
tcaggaccctcgctggcccc

SEQ ID NO: 536377 - DNA, 21 bp, Homo sapiens
tcaggaggtgcctgagagcag

SEQ ID NO: 536378 - DNA, 23 bp, Homo sapiens
tcaggattgaggatgaactcagg

SEQ ID NO: 536379 - DNA, 13 bp, Homo sapiens
tcaggcccacatt

SEQ ID NO: 536380 - DNA, 20 bp, Homo sapiens
tcaggcccacattgcccaca

SEQ ID NO: 536381 - DNA, 13 bp, Homo sapiens
tcagggagccctg

SEQ ID NO: 536382 - DNA, 15 bp, Homo sapiens
tcaggtaaactgatg

SEQ ID NO: 536383 - DNA, 18 bp, Homo sapiens
tcaggtcctgctcagcag

SEQ ID NO: 536384 - DNA, 17 bp, Homo sapiens
tcaggtgaaaatgttca

SEQ ID NO: 536385 - DNA, 17 bp, Homo sapiens
tcaggttgacaggaggt

SEQ ID NO: 536386 - DNA, 17 bp, Homo sapiens
tcagtaaacctgtctga

SEQ ID NO: 536387 - DNA, 19 bp, Homo sapiens
tcagtagcttaagaaaaaa

SEQ ID NO: 536388 - DNA, 16 bp, Homo sapiens
tcagtattaatactaa

SEQ ID NO: 536389 - DNA, 23 bp, Homo sapiens
tcagtattaatactaaaatatgt

SEQ ID NO: 536390 - DNA, 23 bp, Homo sapiens
tcagtccaaggggtcccctccag

SEQ ID NO: 536391 - DNA, 23 bp, Homo sapiens
tcagtgccccgtctacagctccc

SEQ ID NO: 536392 - DNA, 13 bp, Homo sapiens
tcagtgttataaa

SEQ ID NO: 536393 - DNA, 20 bp, Homo sapiens
tcagttacagtggcagtatt

SEQ ID NO: 536394 - DNA, 16 bp, Homo sapiens
tcagttcaaagtcatg

SEQ ID NO: 536395 - DNA, 16 bp, Homo sapiens
tcagtttatgttttgg

SEQ ID NO: 536396 - DNA, 14 bp, Homo sapiens
tcagtttgtataga

SEQ ID NO: 536397 - DNA, 13 bp, Homo sapiens
tcataaattcaaa

SEQ ID NO: 536398 - DNA, 21 bp, Homo sapiens
tcatacaaaggacagtacaca

SEQ ID NO: 536399 - DNA, 20 bp, Homo sapiens
tcatacacagaaatcctaac

SEQ ID NO: 536400 - DNA, 21 bp, Homo sapiens
tcatagaataacaactgctgg

SEQ ID NO: 536401 - DNA, 20 bp, Homo sapiens
tcatagataccattttgaaa

SEQ ID NO: 536402 - DNA, 15 bp, Homo sapiens
tcataggaagttagc

SEQ ID NO: 536403 - DNA, 17 bp, Homo sapiens
taggcaagatggcacag

SEQ ID NO: 536404 - DNA, 15 bp, Homo sapiens
taggcagtataaaga

SEQ ID NO: 536405 - DNA, 16 bp, Homo sapiens
taggcagtataaagaa

SEQ ID NO: 536406 - DNA, 15 bp, Homo sapiens
taggccaaagacaaa

SEQ ID NO: 536407 - DNA, 19 bp, Homo sapiens
taggccaaagacaaatagt

SEQ ID NO: 536408 - DNA, 15 bp, Homo sapiens
tagggacctggggaa

SEQ ID NO: 536409 - DNA, 18 bp, Homo sapiens
tagggacctggggaagca

SEQ ID NO: 536410 - DNA, 16 bp, Homo sapiens
taggggtaccactgaa

SEQ ID NO: 536411 - DNA, 19 bp, Homo sapiens
taggtgctaattaataaag

SEQ ID NO: 536412 - DNA, 16 bp, Homo sapiens
tagtaaatgtagttca

SEQ ID NO: 536413 - DNA, 18 bp, Homo sapiens
tagtactttatagaagaa

SEQ ID NO: 536414 - DNA, 13 bp, Homo sapiens
tagtaggcaagat

SEQ ID NO: 536415 - DNA, 17 bp, Homo sapiens
tagtaggggtaccactg

SEQ ID NO: 536416 - DNA, 20 bp, Homo sapiens
tagtaggggtaccactgaat

SEQ ID NO: 536417 - DNA, 22 bp, Homo sapiens
tagtatttgaaaacagaaattg

SEQ ID NO: 536418 - DNA, 15 bp, Homo sapiens
tagtcttttgcatgt

SEQ ID NO: 536419 - DNA, 17 bp, Homo sapiens
tagtgaagactccagaa

SEQ ID NO: 536420 - DNA, 18 bp, Homo sapiens
tagtgaagactccagaaa

SEQ ID NO: 536421 - DNA, 10 bp, Homo sapiens
tagtgaccaa

SEQ ID NO: 536422 - DNA, 18 bp, Homo sapiens
tagtgcaatatattttgt

SEQ ID NO: 536423 - DNA, 19 bp, Homo sapiens
tagtgcaatatattttgta

SEQ ID NO: 536424 - DNA, 22 bp, Homo sapiens
tagtgcaatatattttgtatgc

SEQ ID NO: 536425 - DNA, 23 bp, Homo sapiens
tagtgcaatatattttgtatgca

SEQ ID NO: 536426 - DNA, 15 bp, Homo sapiens
tagtgctatatatat

SEQ ID NO: 536427 - DNA, 19 bp, Homo sapiens
tagtggaccctgaaatgtg

SEQ ID NO: 536428 - DNA, 16 bp, Homo sapiens
tagtggcttcagcccc

SEQ ID NO: 536429 - DNA, 19 bp, Homo sapiens
tagtggcttcagcccctgg

SEQ ID NO: 536430 - DNA, 13 bp, Homo sapiens
tagtgtgtccatg

SEQ ID NO: 536431 - DNA, 22 bp, Homo sapiens
tagtgttattgagagagatgtg

SEQ ID NO: 536432 - DNA, 15 bp, Homo sapiens
tagttaaattggctt

SEQ ID NO: 536433 - DNA, 20 bp, Homo sapiens
tagttcatcccttctcttcc

SEQ ID NO: 536434 - DNA, 20 bp, Homo sapiens
tagttccctttgccaacaga

SEQ ID NO: 536435 - DNA, 14 bp, Homo sapiens
tagttgtaaagata

SEQ ID NO: 536436 - DNA, 21 bp, Homo sapiens
tagttgtccatattttcacag

SEQ ID NO: 536437 - DNA, 15 bp, Homo sapiens
tagttttattttcta

SEQ ID NO: 536438 - DNA, 17 bp, Homo sapiens
tagttttattttctaaa

SEQ ID NO: 536439 - DNA, 13 bp, Homo sapiens
tagttttgctttt

SEQ ID NO: 536440 - DNA, 17 bp, Homo sapiens
tataaaaaaaatgaaat

SEQ ID NO: 536441 - DNA, 19 bp, Homo sapiens
tataaaaaaaatgaaatgt

SEQ ID NO: 536442 - DNA, 14 bp, Homo sapiens
tataaaaaatcttt

SEQ ID NO: 536443 - DNA, 20 bp, Homo sapiens
tataaaaataattaaaacaa

SEQ ID NO: 536444 - DNA, 16 bp, Homo sapiens
tataaaaatatatata

SEQ ID NO: 536445 - DNA, 19 bp, Homo sapiens
tataaaagcccatgcttaa

SEQ ID NO: 536446 - DNA, 14 bp, Homo sapiens
tataaaatacacgt

SEQ ID NO: 536447 - DNA, 18 bp, Homo sapiens
tataaaatacacgtgtat

SEQ ID NO: 536448 - DNA, 20 bp, Homo sapiens
tataaaatacacgtgtatat

SEQ ID NO: 536449 - DNA, 19 bp, Homo sapiens
tataaacattaaatgtctt

SEQ ID NO: 536450 - DNA, 23 bp, Homo sapiens
tataaatgtatatacacatatac

SEQ ID NO: 536451 - DNA, 16 bp, Homo sapiens
tataaattttgtacat

SEQ ID NO: 536452 - DNA, 15 bp, Homo sapiens
tataaatttttaagt

SEQ ID NO: 536453 - DNA, 17 bp, Homo sapiens
tataaatttttaagtgt

SEQ ID NO: 536454 - DNA, 19 bp, Homo sapiens
tataaatttttaagtgtca

SEQ ID NO: 536455 - DNA, 19 bp, Homo sapiens
tataacattgtatgttaat

SEQ ID NO: 536456 - DNA, 19 bp, Homo sapiens
tataactgccttaaaactt

SEQ ID NO: 536457 - DNA, 23 bp, Homo sapiens
tataagcaaatttcaaaagacat

SEQ ID NO: 536458 - DNA, 17 bp, Homo sapiens
tataatcaaagctcata

SEQ ID NO: 536459 - DNA, 21 bp, Homo sapiens
tataatgtattttcagctcaa

SEQ ID NO: 536460 - DNA, 15 bp, Homo sapiens
tataatgtgtgtatg

SEQ ID NO: 536461 - DNA, 17 bp, Homo sapiens
tataatgtgtgtatgtg

SEQ ID NO: 536462 - DNA, 22 bp, Homo sapiens
tataatgtgtgtatgtgtattt

SEQ ID NO: 536463 - DNA, 17 bp, Homo sapiens
tatacacatatacctat

SEQ ID NO: 536464 - DNA, 16 bp, Homo sapiens
tatacacatcataaac

SEQ ID NO: 536465 - DNA, 17 bp, Homo sapiens
tatacagattttctaga

SEQ ID NO: 536466 - DNA, 16 bp, Homo sapiens
tatacagtgtgtagtt

SEQ ID NO: 536467 - DNA, 19 bp, Homo sapiens
tatacatacgcaattgtat

SEQ ID NO: 536468 - DNA, 21 bp, Homo sapiens
tatacatacgcaattgtatat

SEQ ID NO: 536469 - DNA, 16 bp, Homo sapiens
tatacatatgtagact

SEQ ID NO: 536470 - DNA, 17 bp, Homo sapiens
tatacatgtgtgtatat

SEQ ID NO: 536471 - DNA, 19 bp, Homo sapiens
tatacatgtgtgtatatat

SEQ ID NO: 536472 - DNA, 16 bp, Homo sapiens
tatacctctaactgtg

SEQ ID NO: 536473 - DNA, 18 bp, Homo sapiens
tatacctgtacacacaca

SEQ ID NO: 536474 - DNA, 18 bp, Homo sapiens
tatacgcacgcacccaca

SEQ ID NO: 536475 - DNA, 20 bp, Homo sapiens
tatactccttaaaaatgtat

SEQ ID NO: 536476 - DNA, 11 bp, Homo sapiens
tatagaaagtg

SEQ ID NO: 536477 - DNA, 20 bp, Homo sapiens
tatagaaagtgttctgttac

SEQ ID NO: 536478 - DNA, 23 bp, Homo sapiens
tatagaagtcttcatgaaatgct

SEQ ID NO: 536479 - DNA, 17 bp, Homo sapiens
tatagagttcatcccag

SEQ ID NO: 536480 - DNA, 22 bp, Homo sapiens
tatagcagcaaaaatataaaat

SEQ ID NO: 536481 - DNA, 18 bp, Homo sapiens
tatagtatttgaaaacag

SEQ ID NO: 536482 - DNA, 20 bp, Homo sapiens
tatagtatttgaaaacagaa

SEQ ID NO: 536483 - DNA, 21 bp, Homo sapiens
tatagtcatttattttaaaaa

SEQ ID NO: 536484 - DNA, 13 bp, Homo sapiens
tatataaaataca

SEQ ID NO: 536485 - DNA, 14 bp, Homo sapiens
tatataaaatacac

SEQ ID NO: 536486 - DNA, 16 bp, Homo sapiens
tatataaaatacacgt

SEQ ID NO: 536487 - DNA, 21 bp, Homo sapiens
tatataaaatacacgtgtata

SEQ ID NO: 536488 - DNA, 23 bp, Homo sapiens
tatataaaatacacgtgtatatg

SEQ ID NO: 536489 - DNA, 22 bp, Homo sapiens
tatataaacagaactcccttca

SEQ ID NO: 536490 - DNA, 14 bp, Homo sapiens
tatatacatgtgtg

SEQ ID NO: 536491 - DNA, 19 bp, Homo sapiens
tatatacctgcgcttgttt

SEQ ID NO: 536492 - DNA, 21 bp, Homo sapiens
tatatagcagcaaaaatataa

SEQ ID NO: 536493 - DNA, 11 bp, Homo sapiens
tatatatacat

SEQ ID NO: 536494 - DNA, 22 bp, Homo sapiens
tatatatacatacacttgtata

SEQ ID NO: 536495 - DNA, 14 bp, Homo sapiens
tatatatacatatg

SEQ ID NO: 536496 - DNA, 16 bp, Homo sapiens
tatatatacatatgta

SEQ ID NO: 536497 - DNA, 13 bp, Homo sapiens
tatatatatctgt

SEQ ID NO: 536498 - DNA, 16 bp, Homo sapiens
tatatatgtgtatata

SEQ ID NO: 536499 - DNA, 14 bp, Homo sapiens
tatatattttgaaa

SEQ ID NO: 536500 - DNA, 19 bp, Homo sapiens
tatatccttttctgtgttt

SEQ ID NO: 536501 - DNA, 16 bp, Homo sapiens
tatatctgaaaactgg

SEQ ID NO: 536502 - DNA, 14 bp, Homo sapiens
tatatgaaaactaa

SEQ ID NO: 536503 - DNA, 22 bp, Homo sapiens
tatatgaggatgtatgtgtata

SEQ ID NO: 536504 - DNA, 14 bp, Homo sapiens
tatatgattaaatt

SEQ ID NO: 536505 - DNA, 21 bp, Homo sapiens
tatttaagtattcaagaaagc

SEQ ID NO: 536506 - DNA, 18 bp, Homo sapiens
tatttaagtggactgtat

SEQ ID NO: 536507 - DNA, 19 bp, Homo sapiens
tatttaagtggactgtatt

SEQ ID NO: 536508 - DNA, 21 bp, Homo sapiens
tatttaagtggactgtatttc

SEQ ID NO: 536509 - DNA, 15 bp, Homo sapiens
tatttataacattgt

SEQ ID NO: 536510 - DNA, 17 bp, Homo sapiens
tatttataacattgtaa

SEQ ID NO: 536511 - DNA, 23 bp, Homo sapiens
tatttcagttattgtccctggct

SEQ ID NO: 536512 - DNA, 12 bp, Homo sapiens
tatttcattttg

SEQ ID NO: 536513 - DNA, 11 bp, Homo sapiens
tatttccatgg

SEQ ID NO: 536514 - DNA, 16 bp, Homo sapiens
tatttcggctatgtct

SEQ ID NO: 536515 - DNA, 20 bp, Homo sapiens
tatttcggctatgtctcatg

SEQ ID NO: 536516 - DNA, 20 bp, Homo sapiens
tatttctagacactttttct

SEQ ID NO: 536517 - DNA, 11 bp, Homo sapiens
tatttctcctt

SEQ ID NO: 536518 - DNA, 17 bp, Homo sapiens
tatttctttagaacaac

SEQ ID NO: 536519 - DNA, 18 bp, Homo sapiens
tatttgaaaacagaaatt

SEQ ID NO: 536520 - DNA, 21 bp, Homo sapiens
tatttgctcataagtaaatgt

SEQ ID NO: 536521 - DNA, 15 bp, Homo sapiens
tatttggctgggcta

SEQ ID NO: 536522 - DNA, 22 bp, Homo sapiens
tatttggtaacttgctgtgaaa

SEQ ID NO: 536523 - DNA, 20 bp, Homo sapiens
tatttgtcagtgtagatcaa

SEQ ID NO: 536524 - DNA, 18 bp, Homo sapiens
tatttgtgtgctaaacgt

SEQ ID NO: 536525 - DNA, 14 bp, Homo sapiens
tatttgttaatttc

SEQ ID NO: 536526 - DNA, 12 bp, Homo sapiens
tattttaaaagc

SEQ ID NO: 536527 - DNA, 23 bp, Homo sapiens
tattttaaaagccacatagagtg

SEQ ID NO: 536528 - DNA, 20 bp, Homo sapiens
tattttaagaagttgctgca

SEQ ID NO: 536529 - DNA, 16 bp, Homo sapiens
tattttaatttcaagc

SEQ ID NO: 536530 - DNA, 19 bp, Homo sapiens
tattttaccactaattttg

SEQ ID NO: 536531 - DNA, 23 bp, Homo sapiens
tattttagtggaccctgaaatgt

SEQ ID NO: 536532 - DNA, 13 bp, Homo sapiens
tattttcattaca

SEQ ID NO: 536533 - DNA, 14 bp, Homo sapiens
tattttcatttcta

SEQ ID NO: 536534 - DNA, 14 bp, Homo sapiens
tattttctaaagta

SEQ ID NO: 536535 - DNA, 19 bp, Homo sapiens
tattttggacgtgtgagga

SEQ ID NO: 536536 - DNA, 16 bp, Homo sapiens
tattttgtatgcaagc

SEQ ID NO: 536537 - DNA, 22 bp, Homo sapiens
tattttgtatgcaagcagtttc

SEQ ID NO: 536538 - DNA, 12 bp, Homo sapiens
tattttgtcact

SEQ ID NO: 536539 - DNA, 23 bp, Homo sapiens
tattttgtgagtttgtttctttg

SEQ ID NO: 536540 - DNA, 15 bp, Homo sapiens
tattttgtgtccttt

SEQ ID NO: 536541 - DNA, 13 bp, Homo sapiens
tatttttcttaaa

SEQ ID NO: 536542 - DNA, 12 bp, Homo sapiens
tatttttttcct

SEQ ID NO: 536543 - DNA, 14 bp, Homo sapiens
tcaaaaatctgaag

SEQ ID NO: 536544 - DNA, 18 bp, Homo sapiens
tcaaaaattgaagagaga

SEQ ID NO: 536545 - DNA, 21 bp, Homo sapiens
tcaaaataaaaagtgacacag

SEQ ID NO: 536546 - DNA, 17 bp, Homo sapiens
tcaaaataaaaccagaa

SEQ ID NO: 536547 - DNA, 13 bp, Homo sapiens
tcaaacaagaatg

SEQ ID NO: 536548 - DNA, 16 bp, Homo sapiens
tcaaacatctggaaaa

SEQ ID NO: 536549 - DNA, 19 bp, Homo sapiens
tcaaaccaatttcttcctt

SEQ ID NO: 536550 - DNA, 15 bp, Homo sapiens
tcaaagatgaaagct

SEQ ID NO: 536551 - DNA, 20 bp, Homo sapiens
tcaaagccctccctgtctgt

SEQ ID NO: 536552 - DNA, 13 bp, Homo sapiens
tacagatcaagaa

SEQ ID NO: 536553 - DNA, 23 bp, Homo sapiens
tacagcagatccacctgcacaaa

SEQ ID NO: 536554 - DNA, 13 bp, Homo sapiens
tacaggcaattcc

SEQ ID NO: 536555 - DNA, 23 bp, Homo sapiens
tacagtagctgtggggagctggt

SEQ ID NO: 536556 - DNA, 13 bp, Homo sapiens
tacagtctctttc

SEQ ID NO: 536557 - DNA, 16 bp, Homo sapiens
tacagtctctttcttc

SEQ ID NO: 536558 - DNA, 19 bp, Homo sapiens
tacagtctctttcttcctt

SEQ ID NO: 536559 - DNA, 14 bp, Homo sapiens
tacagttacttttc

SEQ ID NO: 536560 - DNA, 21 bp, Homo sapiens
tacatacacttgtataaatgt

SEQ ID NO: 536561 - DNA, 17 bp, Homo sapiens
tacatacgcaattgtat

SEQ ID NO: 536562 - DNA, 19 bp, Homo sapiens
tacatacgcaattgtatat

SEQ ID NO: 536563 - DNA, 19 bp, Homo sapiens
tacatatatacattttgca

SEQ ID NO: 536564 - DNA, 15 bp, Homo sapiens
tacatatgtagacta

SEQ ID NO: 536565 - DNA, 20 bp, Homo sapiens
tacatatgtagactatatac

SEQ ID NO: 536566 - DNA, 21 bp, Homo sapiens
tacatatgtagactatataca

SEQ ID NO: 536567 - DNA, 19 bp, Homo sapiens
tacatctcccctttgctaa

SEQ ID NO: 536568 - DNA, 22 bp, Homo sapiens
tacatgatgatttcagaaacaa

SEQ ID NO: 536569 - DNA, 13 bp, Homo sapiens
tacatggtatctc

SEQ ID NO: 536570 - DNA, 13 bp, Homo sapiens
tacatgtgtgtat

SEQ ID NO: 536571 - DNA, 16 bp, Homo sapiens
tacatgtgtgtatata

SEQ ID NO: 536572 - DNA, 20 bp, Homo sapiens
tacattctcagtttttctta

SEQ ID NO: 536573 - DNA, 20 bp, Homo sapiens
tacatttttgatcaaatgta

SEQ ID NO: 536574 - DNA, 14 bp, Homo sapiens
taccaaaaaagaaa

SEQ ID NO: 536575 - DNA, 15 bp, Homo sapiens
taccaactttcaaga

SEQ ID NO: 536576 - DNA, 21 bp, Homo sapiens
taccaactttcaagaacttgt

SEQ ID NO: 536577 - DNA, 14 bp, Homo sapiens
taccacactgagtt

SEQ ID NO: 536578 - DNA, 22 bp, Homo sapiens
taccacactgagttctatcagt

SEQ ID NO: 536579 - DNA, 20 bp, Homo sapiens
taccacaggatgcatattaa

SEQ ID NO: 536580 - DNA, 21 bp, Homo sapiens
taccacaggatgcatattaaa

SEQ ID NO: 536581 - DNA, 21 bp, Homo sapiens
taccaccatcccgtgctttta

SEQ ID NO: 536582 - DNA, 16 bp, Homo sapiens
taccactaattttgtt

SEQ ID NO: 536583 - DNA, 18 bp, Homo sapiens
taccactgaatctgtaca

SEQ ID NO: 536584 - DNA, 22 bp, Homo sapiens
taccagctactccggaggctga

SEQ ID NO: 536585 - DNA, 16 bp, Homo sapiens
taccatactcatttct

SEQ ID NO: 536586 - DNA, 17 bp, Homo sapiens
taccattaaaatatgca

SEQ ID NO: 536587 - DNA, 13 bp, Homo sapiens
taccattggaaat

SEQ ID NO: 536588 - DNA, 22 bp, Homo sapiens
taccatttccgtaattcttatt

SEQ ID NO: 536589 - DNA, 16 bp, Homo sapiens
taccattttgaaatat

SEQ ID NO: 536590 - DNA, 21 bp, Homo sapiens
tacccctcccggccctgcctg

SEQ ID NO: 536591 - DNA, 14 bp, Homo sapiens
tacccctttcttct

SEQ ID NO: 536592 - DNA, 23 bp, Homo sapiens
taccctattctatccatctcctg

SEQ ID NO: 536593 - DNA, 20 bp, Homo sapiens
taccctggacagtgcctaac

SEQ ID NO: 536594 - DNA, 17 bp, Homo sapiens
tacctaattagagcaga

SEQ ID NO: 536595 - DNA, 19 bp, Homo sapiens
tacctataatgtgtgtatg

SEQ ID NO: 536596 - DNA, 23 bp, Homo sapiens
tacctataatgtgtgtatgtgta

SEQ ID NO: 536597 - DNA, 15 bp, Homo sapiens
tacctctaactgtgc

SEQ ID NO: 536598 - DNA, 14 bp, Homo sapiens
tacctgaaagccct

SEQ ID NO: 536599 - DNA, 15 bp, Homo sapiens
tacctggagaagaat

SEQ ID NO: 536600 - DNA, 19 bp, Homo sapiens
tacctgggtccccagccct

SEQ ID NO: 536601 - DNA, 20 bp, Homo sapiens
tacctgggtccccagccctt

SEQ ID NO: 536602 - DNA, 15 bp, Homo sapiens
tacctgtacacacac

SEQ ID NO: 536603 - DNA, 18 bp, Homo sapiens
tacctgtacacacacaga

SEQ ID NO: 536604 - DNA, 20 bp, Homo sapiens
tacctgtatacgtttcaaaa

SEQ ID NO: 536605 - DNA, 21 bp, Homo sapiens
taccttaaaatttgaaacatt

SEQ ID NO: 536606 - DNA, 20 bp, Homo sapiens
tacctttgaattcaagaaca

SEQ ID NO: 536607 - DNA, 15 bp, Homo sapiens
taccttttctcttca

SEQ ID NO: 536608 - DNA, 16 bp, Homo sapiens
tacgcacgcacccaca

SEQ ID NO: 536609 - DNA, 20 bp, Homo sapiens
tactaacttctaaaactgta

SEQ ID NO: 536610 - DNA, 22 bp, Homo sapiens
tactacaaaaccgtttagtcat

SEQ ID NO: 536611 - DNA, 22 bp, Homo sapiens
tactagaaccttctaatccatg

SEQ ID NO: 536612 - DNA, 15 bp, Homo sapiens
tactagataaaatgt

SEQ ID NO: 536613 - DNA, 20 bp, Homo sapiens
tactagcttttcaaacaaga

SEQ ID NO: 536614 - DNA, 15 bp, Homo sapiens
tactagggacctggg

SEQ ID NO: 536615 - DNA, 21 bp, Homo sapiens
tactatggaagccacatcact

SEQ ID NO: 536616 - DNA, 15 bp, Homo sapiens
tactcatttctaaaa

SEQ ID NO: 536617 - DNA, 18 bp, Homo sapiens
tactccttaaaaatgtat

SEQ ID NO: 536618 - DNA, 21 bp, Homo sapiens
tactccttaaaaatgtatgtt

SEQ ID NO: 536619 - DNA, 14 bp, Homo sapiens
tactctaatataca

SEQ ID NO: 536620 - DNA, 16 bp, Homo sapiens
tactctaatatacagt

SEQ ID NO: 536621 - DNA, 14 bp, Homo sapiens
tactctagagaagt

SEQ ID NO: 536622 - DNA, 18 bp, Homo sapiens
tactcttctctctgctct

SEQ ID NO: 536623 - DNA, 19 bp, Homo sapiens
tactcttctctctgctctg

SEQ ID NO: 536624 - DNA, 20 bp, Homo sapiens
tactcttctgcctcctagac

SEQ ID NO: 536625 - DNA, 12 bp, Homo sapiens
tactgaataaat

SEQ ID NO: 536626 - DNA, 15 bp, Homo sapiens
tactgagcagtgata

SEQ ID NO: 536627 - DNA, 14 bp, Homo sapiens
tactgtcttaatta

SEQ ID NO: 536628 - DNA, 15 bp, Homo sapiens
tactgtcttaattaa

SEQ ID NO: 536629 - DNA, 23 bp, Homo sapiens
tactgtggctggtactttctgta

SEQ ID NO: 536630 - DNA, 21 bp, Homo sapiens
tactgttttgtgcggtgtgtc

SEQ ID NO: 536631 - DNA, 12 bp, Homo sapiens
tacttaagagaa

SEQ ID NO: 536632 - DNA, 13 bp, Homo sapiens
tacttaagagaaa

SEQ ID NO: 536633 - DNA, 14 bp, Homo sapiens
tacttaagagaaat

SEQ ID NO: 536634 - DNA, 17 bp, Homo sapiens
tacttagcacttggcct

SEQ ID NO: 536635 - DNA, 22 bp, Homo sapiens
tacttcctgcctggtctcctgc

SEQ ID NO: 536636 - DNA, 13 bp, Homo sapiens
tacttctctcaga

SEQ ID NO: 536637 - DNA, 15 bp, Homo sapiens
tacttgatttttcaa

SEQ ID NO: 536638 - DNA, 15 bp, Homo sapiens
tacttgctgctattt

SEQ ID NO: 536639 - DNA, 17 bp, Homo sapiens
tacttggtcacagccag

SEQ ID NO: 536640 - DNA, 18 bp, Homo sapiens
tacttggtcacagccagg

SEQ ID NO: 536641 - DNA, 18 bp, Homo sapiens
tacttgttatgttgtaat

SEQ ID NO: 536642 - DNA, 17 bp, Homo sapiens
tactttaaattgtggat

SEQ ID NO: 536643 - DNA, 14 bp, Homo sapiens
tactttatagaaga

SEQ ID NO: 536644 - DNA, 16 bp, Homo sapiens
tactttatagaagaat

SEQ ID NO: 536645 - DNA, 19 bp, Homo sapiens
tactttctgtactaaacat

SEQ ID NO: 536646 - DNA, 14 bp, Homo sapiens
tactttgattcaca

SEQ ID NO: 536647 - DNA, 20 bp, Homo sapiens
tactttgattcacatgtttt

SEQ ID NO: 536648 - DNA, 21 bp, Homo sapiens
tactttgattcacatgttttc

SEQ ID NO: 536649 - DNA, 15 bp, Homo sapiens
tacttttaataaagt

SEQ ID NO: 536650 - DNA, 15 bp, Homo sapiens
tacttttccttgcat

SEQ ID NO: 536651 - DNA, 21 bp, Homo sapiens
tacttttccttgcatacaaac

SEQ ID NO: 536652 - DNA, 11 bp, Homo sapiens
tagaaaaggca

SEQ ID NO: 536653 - DNA, 17 bp, Homo sapiens
tagaaacaagacaaggt

SEQ ID NO: 536654 - DNA, 22 bp, Homo sapiens
tagaaagtgttctgttacaaaa

SEQ ID NO: 536655 - DNA, 12 bp, Homo sapiens
tagaaatgttta

SEQ ID NO: 536656 - DNA, 22 bp, Homo sapiens
tagaagaatgcatgctttccat

SEQ ID NO: 536657 - DNA, 21 bp, Homo sapiens
tagaagtcttcatgaaatgct

SEQ ID NO: 536658 - DNA, 18 bp, Homo sapiens
tagaataacaactgctgg

SEQ ID NO: 536659 - DNA, 15 bp, Homo sapiens
tagaatcaagtctgt

SEQ ID NO: 536660 - DNA, 20 bp, Homo sapiens
tagaatgaccttgtaatgta

SEQ ID NO: 536661 - DNA, 16 bp, Homo sapiens
tagacacacaaagcag

SEQ ID NO: 536662 - DNA, 12 bp, Homo sapiens
tagacagatgtg

SEQ ID NO: 536663 - DNA, 18 bp, Homo sapiens
tagacaggagaagaaaga

SEQ ID NO: 536664 - DNA, 16 bp, Homo sapiens
tagacataaattgtaa

SEQ ID NO: 536665 - DNA, 13 bp, Homo sapiens
tagactatataca

SEQ ID NO: 536666 - DNA, 14 bp, Homo sapiens
tagactatatacat

SEQ ID NO: 536667 - DNA, 22 bp, Homo sapiens
tagactatatacatgtgtgtat

SEQ ID NO: 536668 - DNA, 24 bp, Homo sapiens
tagacttcagggagtcagctgttt

SEQ ID NO: 536669 - DNA, 17 bp, Homo sapiens
tagacttctgttttcaa

SEQ ID NO: 536670 - DNA, 18 bp, Homo sapiens
tagacttctgttttcaat

SEQ ID NO: 536671 - DNA, 12 bp, Homo sapiens
tagagcagccca

SEQ ID NO: 536672 - DNA, 21 bp, Homo sapiens
tagaggtttaaagaaaaatca

SEQ ID NO: 536673 - DNA, 18 bp, Homo sapiens
tagagtatattgaaaaga

SEQ ID NO: 536674 - DNA, 19 bp, Homo sapiens
tagagtatattgaaaagaa

SEQ ID NO: 536675 - DNA, 15 bp, Homo sapiens
tagataattaaccaa

SEQ ID NO: 536676 - DNA, 22 bp, Homo sapiens
tagatcaactcatgttaattga

SEQ ID NO: 536677 - DNA, 13 bp, Homo sapiens
tagatgtaaattt

SEQ ID NO: 536678 - DNA, 15 bp, Homo sapiens
tagatgtgagaaaac

SEQ ID NO: 536679 - DNA, 13 bp, Homo sapiens
tagcaaaaaaagt

SEQ ID NO: 536680 - DNA, 18 bp, Homo sapiens
tagcaaaaaaagttgtat

SEQ ID NO: 536681 - DNA, 20 bp, Homo sapiens
tagcaaaaaaagttgtatga

SEQ ID NO: 536682 - DNA, 17 bp, Homo sapiens
tagcaaaccctgtcaaa

SEQ ID NO: 536683 - DNA, 19 bp, Homo sapiens
tagcaaaccctgtcaaaca

SEQ ID NO: 536684 - DNA, 22 bp, Homo sapiens
tagcaaaccctgtcaaacatta

SEQ ID NO: 536685 - DNA, 21 bp, Homo sapiens
tagcaattgcttctctaaaac

SEQ ID NO: 536686 - DNA, 12 bp, Homo sapiens
tagcacagctcc

SEQ ID NO: 536687 - DNA, 12 bp, Homo sapiens
tagcacagtatt

SEQ ID NO: 536688 - DNA, 20 bp, Homo sapiens
tagcagcaaaaatataaaat

SEQ ID NO: 536689 - DNA, 18 bp, Homo sapiens
tccgtcctggcagggcag

SEQ ID NO: 536690 - DNA, 13 bp, Homo sapiens
tccgtgaaagttg

SEQ ID NO: 536691 - DNA, 15 bp, Homo sapiens
tccgtgaaagttgtg

SEQ ID NO: 536692 - DNA, 19 bp, Homo sapiens
tccgtgaaagttgtgatct

SEQ ID NO: 536693 - DNA, 18 bp, Homo sapiens
tccgtgtggagggctgca

SEQ ID NO: 536694 - DNA, 15 bp, Homo sapiens
tcctaatcactcaga

SEQ ID NO: 536695 - DNA, 16 bp, Homo sapiens
tcctaatcactcagag

SEQ ID NO: 536696 - DNA, 20 bp, Homo sapiens
tcctactcttctctctgctc

SEQ ID NO: 536697 - DNA, 20 bp, Homo sapiens
tcctagttcatcccttctct

SEQ ID NO: 536698 - DNA, 13 bp, Homo sapiens
tcctataccattt

SEQ ID NO: 536699 - DNA, 20 bp, Homo sapiens
tcctataccatttccgtaat

SEQ ID NO: 536700 - DNA, 22 bp, Homo sapiens
tcctatcttcatatctatcaga

SEQ ID NO: 536701 - DNA, 16 bp, Homo sapiens
tcctatgagagaagag

SEQ ID NO: 536702 - DNA, 21 bp, Homo sapiens
tcctatgagagaagagagtat

SEQ ID NO: 536703 - DNA, 22 bp, Homo sapiens
tcctcagaaccattcactggca

SEQ ID NO: 536704 - DNA, 22 bp, Homo sapiens
tcctcattccctcgtctttccc

SEQ ID NO: 536705 - DNA, 13 bp, Homo sapiens
tcctccagaactc

SEQ ID NO: 536706 - DNA, 19 bp, Homo sapiens
tcctccagggctcaacact

SEQ ID NO: 536707 - DNA, 15 bp, Homo sapiens
tcctccatcctcctc

SEQ ID NO: 536708 - DNA, 15 bp, Homo sapiens
tcctccctgatgtac

SEQ ID NO: 536709 - DNA, 14 bp, Homo sapiens
tcctccctgggggc

SEQ ID NO: 536710 - DNA, 14 bp, Homo sapiens
tcctcctgctgcca

SEQ ID NO: 536711 - DNA, 15 bp, Homo sapiens
tcctcctgctgccag

SEQ ID NO: 536712 - DNA, 15 bp, Homo sapiens
tcctcgcttctttca

SEQ ID NO: 536713 - DNA, 14 bp, Homo sapiens
tcctcggccagagc

SEQ ID NO: 536714 - DNA, 14 bp, Homo sapiens
tcctctatcctggg

SEQ ID NO: 536715 - DNA, 19 bp, Homo sapiens
tcctctcatccttttctcc

SEQ ID NO: 536716 - DNA, 20 bp, Homo sapiens
tcctctcatccttttctcct

SEQ ID NO: 536717 - DNA, 21 bp, Homo sapiens
tcctctctaacctcctttacc

SEQ ID NO: 536718 - DNA, 21 bp, Homo sapiens
tcctcttaatgtctcaaaata

SEQ ID NO: 536719 - DNA, 12 bp, Homo sapiens
tcctcttacctg

SEQ ID NO: 536720 - DNA, 13 bp, Homo sapiens
tcctcttacctgt

SEQ ID NO: 536721 - DNA, 23 bp, Homo sapiens
tcctcttacctgtaatagcctca

SEQ ID NO: 536722 - DNA, 19 bp, Homo sapiens
tcctcttatatgtgcccct

SEQ ID NO: 536723 - DNA, 15 bp, Homo sapiens
tcctgacctccgcca

SEQ ID NO: 536724 - DNA, 15 bp, Homo sapiens
tcctgaggctggggc

SEQ ID NO: 536725 - DNA, 13 bp, Homo sapiens
tcctgatgtcttg

SEQ ID NO: 536726 - DNA, 20 bp, Homo sapiens
tcctgatgttggtatctaag

SEQ ID NO: 536727 - DNA, 21 bp, Homo sapiens
tcctgattggtttctcttctc

SEQ ID NO: 536728 - DNA, 23 bp, Homo sapiens
tcctgcaaccaaactcccatcag

SEQ ID NO: 536729 - DNA, 15 bp, Homo sapiens
tcctgcccactgata

SEQ ID NO: 536730 - DNA, 23 bp, Homo sapiens
tcctgcctggtctcctgccccca

SEQ ID NO: 536731 - DNA, 21 bp, Homo sapiens
tcctgctacagtagctgtggg

SEQ ID NO: 536732 - DNA, 13 bp, Homo sapiens
tcctgctctgctc

SEQ ID NO: 536733 - DNA, 15 bp, Homo sapiens
tcctggacaggccag

SEQ ID NO: 536734 - DNA, 20 bp, Homo sapiens
tcctggcagggcaggcagag

SEQ ID NO: 536735 - DNA, 16 bp, Homo sapiens
tcctgggcatccccag

SEQ ID NO: 536736 - DNA, 20 bp, Homo sapiens
tcctgggcatccccagcccc

SEQ ID NO: 536737 - DNA, 23 bp, Homo sapiens
tcctgggcttttgttttgctttt

SEQ ID NO: 536738 - DNA, 13 bp, Homo sapiens
tcctgggggcctg

SEQ ID NO: 536739 - DNA, 20 bp, Homo sapiens
tcctgggggctgctgcactg

SEQ ID NO: 536740 - DNA, 14 bp, Homo sapiens
tcctggtcgaaagt

SEQ ID NO: 536741 - DNA, 16 bp, Homo sapiens
tcctgtcctcagcttc

SEQ ID NO: 536742 - DNA, 13 bp, Homo sapiens
tcctgtcctggct

SEQ ID NO: 536743 - DNA, 19 bp, Homo sapiens
tcctgtcctggctcccagg

SEQ ID NO: 536744 - DNA, 13 bp, Homo sapiens
tcctgtgccaggt

SEQ ID NO: 536745 - DNA, 14 bp, Homo sapiens
tcctgtgtcagttt

SEQ ID NO: 536746 - DNA, 16 bp, Homo sapiens
tcctgtgtcagtttat

SEQ ID NO: 536747 - DNA, 20 bp, Homo sapiens
tcctgtttctcagtctcaca

SEQ ID NO: 536748 - DNA, 20 bp, Homo sapiens
tccttaatggccttaattaa

SEQ ID NO: 536749 - DNA, 20 bp, Homo sapiens
tccttacagaagggagtgaa

SEQ ID NO: 536750 - DNA, 23 bp, Homo sapiens
tccttccacagttatcttagctg

SEQ ID NO: 536751 - DNA, 19 bp, Homo sapiens
tccttcccactcttctcat

SEQ ID NO: 536752 - DNA, 22 bp, Homo sapiens
tccttcctagttcatcccttct

SEQ ID NO: 536753 - DNA, 13 bp, Homo sapiens
tccttctttgccc

SEQ ID NO: 536754 - DNA, 19 bp, Homo sapiens
tccttctttgccctttact

SEQ ID NO: 536755 - DNA, 17 bp, Homo sapiens
ttgtaaacgtcttttta

SEQ ID NO: 536756 - DNA, 23 bp, Homo sapiens
ttgtaaacgtctttttaagcctt

SEQ ID NO: 536757 - DNA, 12 bp, Homo sapiens
ttgtaaactttg

SEQ ID NO: 536758 - DNA, 15 bp, Homo sapiens
ttgtaaactttgaaa

SEQ ID NO: 536759 - DNA, 21 bp, Homo sapiens
ttgtaaactttgaaatatatg

SEQ ID NO: 536760 - DNA, 21 bp, Homo sapiens
ttgtaacattctatttcaact

SEQ ID NO: 536761 - DNA, 13 bp, Homo sapiens
ttgtaatatcagt

SEQ ID NO: 536762 - DNA, 18 bp, Homo sapiens
ttgtaatattttgctgct

SEQ ID NO: 536763 - DNA, 21 bp, Homo sapiens
ttgtacatttttgatcaaatg

SEQ ID NO: 536764 - DNA, 14 bp, Homo sapiens
ttgtataaattttt

SEQ ID NO: 536765 - DNA, 15 bp, Homo sapiens
ttgtataaattttta

SEQ ID NO: 536766 - DNA, 20 bp, Homo sapiens
ttgtataaatttttaagtgt

SEQ ID NO: 536767 - DNA, 18 bp, Homo sapiens
ttgtatatatatgtgaac

SEQ ID NO: 536768 - DNA, 15 bp, Homo sapiens
ttgtatctcctttaa

SEQ ID NO: 536769 - DNA, 13 bp, Homo sapiens
ttgtatgatctgt

SEQ ID NO: 536770 - DNA, 19 bp, Homo sapiens
ttgtatgcaagcagtttca

SEQ ID NO: 536771 - DNA, 20 bp, Homo sapiens
ttgtatgcaagcagtttcaa

SEQ ID NO: 536772 - DNA, 20 bp, Homo sapiens
ttgtatgttaatagaaaata

SEQ ID NO: 536773 - DNA, 22 bp, Homo sapiens
ttgtatgttaatagaaaatata

SEQ ID NO: 536774 - DNA, 13 bp, Homo sapiens
ttgtcattttcat

SEQ ID NO: 536775 - DNA, 16 bp, Homo sapiens
ttgtccagagctgctt

SEQ ID NO: 536776 - DNA, 19 bp, Homo sapiens
ttgtccagagctgcttccc

SEQ ID NO: 536777 - DNA, 19 bp, Homo sapiens
ttgtccctggcttccttac

SEQ ID NO: 536778 - DNA, 16 bp, Homo sapiens
ttgtcctcctgctgcc

SEQ ID NO: 536779 - DNA, 15 bp, Homo sapiens
ttgtcctttatgtat

SEQ ID NO: 536780 - DNA, 18 bp, Homo sapiens
ttgtcctttatgtattct

SEQ ID NO: 536781 - DNA, 14 bp, Homo sapiens
ttgtcggctccagt

SEQ ID NO: 536782 - DNA, 16 bp, Homo sapiens
ttgtctaaagatcttt

SEQ ID NO: 536783 - DNA, 16 bp, Homo sapiens
ttgtctaagaaacatt

SEQ ID NO: 536784 - DNA, 23 bp, Homo sapiens
ttgtctaagaaacattggaagca

SEQ ID NO: 536785 - DNA, 15 bp, Homo sapiens
ttgtctcttctcctt

SEQ ID NO: 536786 - DNA, 18 bp, Homo sapiens
ttgtcttgtgtatttcag

SEQ ID NO: 536787 - DNA, 19 bp, Homo sapiens
ttgtgaaagaggtcccaag

SEQ ID NO: 536788 - DNA, 21 bp, Homo sapiens
ttgtgaaatttttcatatttt

SEQ ID NO: 536789 - DNA, 14 bp, Homo sapiens
ttgtgagtttgttt

SEQ ID NO: 536790 - DNA, 14 bp, Homo sapiens
ttgtgatctgttgt

SEQ ID NO: 536791 - DNA, 18 bp, Homo sapiens
ttgtgatctgttgtaata

SEQ ID NO: 536792 - DNA, 15 bp, Homo sapiens
ttgtgcccttaaaac

SEQ ID NO: 536793 - DNA, 15 bp, Homo sapiens
ttgtgcggtgtgtct

SEQ ID NO: 536794 - DNA, 15 bp, Homo sapiens
ttgtgcttgttcttc

SEQ ID NO: 536795 - DNA, 18 bp, Homo sapiens
ttgtggctccacacacac

SEQ ID NO: 536796 - DNA, 20 bp, Homo sapiens
ttgtgtgggtttactctgtg

SEQ ID NO: 536797 - DNA, 13 bp, Homo sapiens
ttgttaatttctt

SEQ ID NO: 536798 - DNA, 14 bp, Homo sapiens
ttgttactttaggt

SEQ ID NO: 536799 - DNA, 20 bp, Homo sapiens
ttgttaggccaaagacaaat

SEQ ID NO: 536800 - DNA, 22 bp, Homo sapiens
ttgttaggccaaagacaaatag

SEQ ID NO: 536801 - DNA, 22 bp, Homo sapiens
ttgttagtttcttttattttca

SEQ ID NO: 536802 - DNA, 18 bp, Homo sapiens
ttgttcagtcacttgttt

SEQ ID NO: 536803 - DNA, 15 bp, Homo sapiens
ttgttgcactgaagt

SEQ ID NO: 536804 - DNA, 12 bp, Homo sapiens
ttgtttcttcca

SEQ ID NO: 536805 - DNA, 19 bp, Homo sapiens
ttgtttgttaataaagtgc

SEQ ID NO: 536806 - DNA, 12 bp, Homo sapiens
ttgttttttgaa

SEQ ID NO: 536807 - DNA, 16 bp, Homo sapiens
ttgttttttgaagtgt

SEQ ID NO: 536808 - DNA, 19 bp, Homo sapiens
tttaaaaaatgaaaataag

SEQ ID NO: 536809 - DNA, 21 bp, Homo sapiens
tttaaaacatttcatgtattt

SEQ ID NO: 536810 - DNA, 20 bp, Homo sapiens
tttaaaagaaggtaaataat

SEQ ID NO: 536811 - DNA, 19 bp, Homo sapiens
tttaaaagccctttccaaa

SEQ ID NO: 536812 - DNA, 15 bp, Homo sapiens
tttaaaagtcacata

SEQ ID NO: 536813 - DNA, 19 bp, Homo sapiens
tttaaaagtcacataaaat

SEQ ID NO: 536814 - DNA, 14 bp, Homo sapiens
tttaaaatggcatt

SEQ ID NO: 536815 - DNA, 19 bp, Homo sapiens
tttaaaatggcatttagca

SEQ ID NO: 536816 - DNA, 14 bp, Homo sapiens
tttaaaattttaag

SEQ ID NO: 536817 - DNA, 15 bp, Homo sapiens
tttaaacttttatgc

SEQ ID NO: 536818 - DNA, 20 bp, Homo sapiens
tttaaacttttatgcgcaaa

SEQ ID NO: 536819 - DNA, 20 bp, Homo sapiens
tttaaagaaaaatcagtttt

SEQ ID NO: 536820 - DNA, 18 bp, Homo sapiens
tttaaagtgtaataatat

SEQ ID NO: 536821 - DNA, 17 bp, Homo sapiens
tttaacactgagtgaaa

SEQ ID NO: 536822 - DNA, 22 bp, Homo sapiens
tttaacagaaaaatgaaattta

SEQ ID NO: 536823 - DNA, 17 bp, Homo sapiens
tttaacatctgcagtgt

SEQ ID NO: 536824 - DNA, 15 bp, Homo sapiens
tttaagagattttat

SEQ ID NO: 536825 - DNA, 18 bp, Homo sapiens
tttaagcaacacttggaa

SEQ ID NO: 536826 - DNA, 16 bp, Homo sapiens
tttaagcctttgaagt

SEQ ID NO: 536827 - DNA, 14 bp, Homo sapiens
tttaagtgaaattt

SEQ ID NO: 536828 - DNA, 16 bp, Homo sapiens
tttaagtggactgtat

SEQ ID NO: 536829 - DNA, 22 bp, Homo sapiens
tttaagtggactgtatttcggc

SEQ ID NO: 536830 - DNA, 14 bp, Homo sapiens
tttaagtgttctgt

SEQ ID NO: 536831 - DNA, 13 bp, Homo sapiens
tttaagttgtaaa

SEQ ID NO: 536832 - DNA, 14 bp, Homo sapiens
tttaagttgtaaac

SEQ ID NO: 536833 - DNA, 19 bp, Homo sapiens
tttaagttgtaaacgtctt

SEQ ID NO: 536834 - DNA, 21 bp, Homo sapiens
tttaataaagcgaaaaactca

SEQ ID NO: 536835 - DNA, 20 bp, Homo sapiens
tttaataaagtatgaatatt

SEQ ID NO: 536836 - DNA, 15 bp, Homo sapiens
tttaataattagaaa

SEQ ID NO: 536837 - DNA, 13 bp, Homo sapiens
tttaatatgtatt

SEQ ID NO: 536838 - DNA, 21 bp, Homo sapiens
tttaattgaaagggacaagta

SEQ ID NO: 536839 - DNA, 17 bp, Homo sapiens
tttacaaacaaaagcat

SEQ ID NO: 536840 - DNA, 21 bp, Homo sapiens
tttacacaattaattcatccc

SEQ ID NO: 536841 - DNA, 22 bp, Homo sapiens
tttacacggagcggattgcaaa

SEQ ID NO: 536842 - DNA, 16 bp, Homo sapiens
tttaccactaattttg

SEQ ID NO: 536843 - DNA, 18 bp, Homo sapiens
tttactaacagtaactgc

SEQ ID NO: 536844 - DNA, 22 bp, Homo sapiens
tttactctatgccccaaatata

SEQ ID NO: 536845 - DNA, 15 bp, Homo sapiens
tttactttaaatcct

SEQ ID NO: 536846 - DNA, 17 bp, Homo sapiens
tttactttaaatcctta

SEQ ID NO: 536847 - DNA, 20 bp, Homo sapiens
tttagaacaacataaaatta

SEQ ID NO: 536848 - DNA, 13 bp, Homo sapiens
tttagagaaatac

SEQ ID NO: 536849 - DNA, 16 bp, Homo sapiens
tttagatttcaagaaa

SEQ ID NO: 536850 - DNA, 20 bp, Homo sapiens
tttagatttcaagaaaaaat

SEQ ID NO: 536851 - DNA, 13 bp, Homo sapiens
tttagcacagtat

SEQ ID NO: 536852 - DNA, 19 bp, Homo sapiens
tttagcacagtatttaaca

SEQ ID NO: 536853 - DNA, 16 bp, Homo sapiens
tttataaaattagaaa

SEQ ID NO: 536854 - DNA, 15 bp, Homo sapiens
tttataacattgtaa

SEQ ID NO: 536855 - DNA, 21 bp, Homo sapiens
tttataagcacagacaattct

SEQ ID NO: 536856 - DNA, 13 bp, Homo sapiens
tttatacacacag

SEQ ID NO: 536857 - DNA, 16 bp, Homo sapiens
tttatacacacaggag

SEQ ID NO: 536858 - DNA, 15 bp, Homo sapiens
tttataggtgaaaga

SEQ ID NO: 536859 - DNA, 21 bp, Homo sapiens
tttatatcttggcaggtagga

SEQ ID NO: 536860 - DNA, 14 bp, Homo sapiens
tttatatgattaaa

SEQ ID NO: 536861 - DNA, 15 bp, Homo sapiens
tttatcatgtgtttc

SEQ ID NO: 536862 - DNA, 21 bp, Homo sapiens
tttatctaccaactttcaaga

SEQ ID NO: 536863 - DNA, 17 bp, Homo sapiens
tttatctagatgtaaat

SEQ ID NO: 536864 - DNA, 16 bp, Homo sapiens
tttatctcttcttcct

SEQ ID NO: 536865 - DNA, 22 bp, Homo sapiens
tttatgagatcactgaactttt

SEQ ID NO: 536866 - DNA, 16 bp, Homo sapiens
tttatgatatccctga

SEQ ID NO: 536867 - DNA, 21 bp, Homo sapiens
tttatgcgcaaatacaaaatg

SEQ ID NO: 536868 - DNA, 21 bp, Homo sapiens
tttatgtatgtttacactgtc

SEQ ID NO: 536869 - DNA, 22 bp, Homo sapiens
tttatgtatgtttacactgtca

SEQ ID NO: 536870 - DNA, 14 bp, Homo sapiens
tttatgttttggtc

SEQ ID NO: 536871 - DNA, 17 bp, Homo sapiens
tttattaaaaccattct

SEQ ID NO: 536872 - DNA, 20 bp, Homo sapiens
tttattgaggaaaaatatgt

SEQ ID NO: 536873 - DNA, 13 bp, Homo sapiens
tttattgcacaaa

SEQ ID NO: 536874 - DNA, 15 bp, Homo sapiens
tttatttctcctttt

SEQ ID NO: 536875 - DNA, 16 bp, Homo sapiens
tttatttctccttttg

SEQ ID NO: 536876 - DNA, 17 bp, Homo sapiens
tttatttctccttttgt

SEQ ID NO: 536877 - DNA, 14 bp, Homo sapiens
tttatttttcatta

SEQ ID NO: 536878 - DNA, 16 bp, Homo sapiens
tttcaaatatgtaaac

SEQ ID NO: 536879 - DNA, 17 bp, Homo sapiens
tttcaaatatgtaaact

SEQ ID NO: 536880 - DNA, 13 bp, Homo sapiens
tttcaagaacttg

SEQ ID NO: 536881 - DNA, 20 bp, Homo sapiens
tttcaagcgtcactttattt

SEQ ID NO: 536882 - DNA, 18 bp, Homo sapiens
tttcaataaagtttgatc

SEQ ID NO: 536883 - DNA, 17 bp, Homo sapiens
tttcaatacccttttaa

SEQ ID NO: 536884 - DNA, 17 bp, Homo sapiens
tttcaatcactgaaaat

SEQ ID NO: 536885 - DNA, 20 bp, Homo sapiens
tttcacaggtgtggtgtaat

SEQ ID NO: 536886 - DNA, 20 bp, Homo sapiens
tttcacagtgtctgtaaatc

SEQ ID NO: 536887 - DNA, 20 bp, Homo sapiens
tttcacattaatggtctaaa

SEQ ID NO: 536888 - DNA, 14 bp, Homo sapiens
tttcacttctttcc

SEQ ID NO: 536889 - DNA, 15 bp, Homo sapiens
tttcagatttgcaca

SEQ ID NO: 536890 - DNA, 16 bp, Homo sapiens
tttcagatttgcacaa

SEQ ID NO: 536891 - DNA, 17 bp, Homo sapiens
tttcagatttgcacaaa

SEQ ID NO: 536892 - DNA, 15 bp, Homo sapiens
tttgttttaaactgt

SEQ ID NO: 536893 - DNA, 17 bp, Homo sapiens
tttgttttttgaagtgt

SEQ ID NO: 536894 - DNA, 13 bp, Homo sapiens
ttttaaaaaatga

SEQ ID NO: 536895 - DNA, 21 bp, Homo sapiens
ttttaaaaagtattgccaaac

SEQ ID NO: 536896 - DNA, 14 bp, Homo sapiens
ttttaaaactactt

SEQ ID NO: 536897 - DNA, 20 bp, Homo sapiens
ttttaaaactacttagcact

SEQ ID NO: 536898 - DNA, 12 bp, Homo sapiens
ttttaaaatact

SEQ ID NO: 536899 - DNA, 19 bp, Homo sapiens
ttttaaaatactgtagata

SEQ ID NO: 536900 - DNA, 22 bp, Homo sapiens
ttttaaagctcgtagaaacaag

SEQ ID NO: 536901 - DNA, 17 bp, Homo sapiens
ttttaacttagagcttt

SEQ ID NO: 536902 - DNA, 18 bp, Homo sapiens
ttttaacttagagctttt

SEQ ID NO: 536903 - DNA, 15 bp, Homo sapiens
ttttaagcctttgaa

SEQ ID NO: 536904 - DNA, 21 bp, Homo sapiens
ttttaagctaggaaaagaaat

SEQ ID NO: 536905 - DNA, 14 bp, Homo sapiens
ttttaaggcttcaa

SEQ ID NO: 536906 - DNA, 15 bp, Homo sapiens
ttttaagtgtcagac

SEQ ID NO: 536907 - DNA, 21 bp, Homo sapiens
ttttaagtttaaaatgtgtat

SEQ ID NO: 536908 - DNA, 21 bp, Homo sapiens
ttttaataaagtatgaatatt

SEQ ID NO: 536909 - DNA, 12 bp, Homo sapiens
ttttaattgaaa

SEQ ID NO: 536910 - DNA, 22 bp, Homo sapiens
ttttaattttggaacaaatgct

SEQ ID NO: 536911 - DNA, 13 bp, Homo sapiens
ttttaattttgtc

SEQ ID NO: 536912 - DNA, 11 bp, Homo sapiens
ttttacacttg

SEQ ID NO: 536913 - DNA, 19 bp, Homo sapiens
ttttacagctttacacaca

SEQ ID NO: 536914 - DNA, 22 bp, Homo sapiens
ttttactctatgccccaaatat

SEQ ID NO: 536915 - DNA, 19 bp, Homo sapiens
ttttataaggacttcctga

SEQ ID NO: 536916 - DNA, 20 bp, Homo sapiens
ttttataaggacttcctgat

SEQ ID NO: 536917 - DNA, 17 bp, Homo sapiens
ttttatctcttcttcct

SEQ ID NO: 536918 - DNA, 13 bp, Homo sapiens
ttttatgttgaca

SEQ ID NO: 536919 - DNA, 15 bp, Homo sapiens
ttttatgttgacatt

SEQ ID NO: 536920 - DNA, 21 bp, Homo sapiens
ttttatgtttaaaatggcatt

SEQ ID NO: 536921 - DNA, 14 bp, Homo sapiens
ttttatttctcctt

SEQ ID NO: 536922 - DNA, 18 bp, Homo sapiens
ttttcaaaataaagcttt

SEQ ID NO: 536923 - DNA, 22 bp, Homo sapiens
ttttcaaaataaagcttttgca

SEQ ID NO: 536924 - DNA, 15 bp, Homo sapiens
ttttcaaagacttca

SEQ ID NO: 536925 - DNA, 21 bp, Homo sapiens
ttttcaaatatgtaaacttta

SEQ ID NO: 536926 - DNA, 18 bp, Homo sapiens
ttttcaaatggagttgga

SEQ ID NO: 536927 - DNA, 20 bp, Homo sapiens
tgtaactgttaccattggaa

SEQ ID NO: 536928 - DNA, 14 bp, Homo sapiens
tgtaagaagcccga

SEQ ID NO: 536929 - DNA, 21 bp, Homo sapiens
tgtaatatcagttacagtggc

SEQ ID NO: 536930 - DNA, 15 bp, Homo sapiens
tgtaatcccagcact

SEQ ID NO: 536931 - DNA, 16 bp, Homo sapiens
tgtaatcccagcactt

SEQ ID NO: 536932 - DNA, 20 bp, Homo sapiens
tgtaatttttctgtatagac

SEQ ID NO: 536933 - DNA, 14 bp, Homo sapiens
tgtacaaaaacaca

SEQ ID NO: 536934 - DNA, 19 bp, Homo sapiens
tgtacaaaatatccaagcc

SEQ ID NO: 536935 - DNA, 12 bp, Homo sapiens
tgtacacacaca

SEQ ID NO: 536936 - DNA, 13 bp, Homo sapiens
tgtacacacacag

SEQ ID NO: 536937 - DNA, 11 bp, Homo sapiens
tgtacagctct

SEQ ID NO: 536938 - DNA, 15 bp, Homo sapiens
tgtacagctctcccc

SEQ ID NO: 536939 - DNA, 20 bp, Homo sapiens
tgtacagctctcccctccct

SEQ ID NO: 536940 - DNA, 22 bp, Homo sapiens
tgtacatctcccctttgctaac

SEQ ID NO: 536941 - DNA, 16 bp, Homo sapiens
tgtacatttatgtgtg

SEQ ID NO: 536942 - DNA, 17 bp, Homo sapiens
tgtacatttatgtgtga

SEQ ID NO: 536943 - DNA, 21 bp, Homo sapiens
tgtacatttttgatcaaatgt

SEQ ID NO: 536944 - DNA, 13 bp, Homo sapiens
tgtaccattaaaa

SEQ ID NO: 536945 - DNA, 17 bp, Homo sapiens
tgtaccattaaaatatg

SEQ ID NO: 536946 - DNA, 14 bp, Homo sapiens
tgtactaaacattt

SEQ ID NO: 536947 - DNA, 17 bp, Homo sapiens
tgtactaaacatttcct

SEQ ID NO: 536948 - DNA, 18 bp, Homo sapiens
tgtactaaacatttcctt

SEQ ID NO: 536949 - DNA, 18 bp, Homo sapiens
tgtactttgattcacatg

SEQ ID NO: 536950 - DNA, 19 bp, Homo sapiens
tgtactttgattcacatgt

SEQ ID NO: 536951 - DNA, 16 bp, Homo sapiens
tgtagactatatacat

SEQ ID NO: 536952 - DNA, 19 bp, Homo sapiens
tgtagactatatacatgtg

SEQ ID NO: 536953 - DNA, 15 bp, Homo sapiens
tgtagcaaaccctgt

SEQ ID NO: 536954 - DNA, 22 bp, Homo sapiens
tgtagcaaaccctgtcaaacat

SEQ ID NO: 536955 - DNA, 23 bp, Homo sapiens
tgtagctctgaatgctatttgtg

SEQ ID NO: 536956 - DNA, 14 bp, Homo sapiens
tgtagctgtcatgg

SEQ ID NO: 536957 - DNA, 22 bp, Homo sapiens
tgtagctgtcatggtgcaattt

SEQ ID NO: 536958 - DNA, 16 bp, Homo sapiens
tgtagtgttcagaaaa

SEQ ID NO: 536959 - DNA, 18 bp, Homo sapiens
tgtagtgttcagaaaaaa

SEQ ID NO: 536960 - DNA, 11 bp, Homo sapiens
tgtataaatgt

SEQ ID NO: 536961 - DNA, 12 bp, Homo sapiens
tgtataaatgta

SEQ ID NO: 536962 - DNA, 18 bp, Homo sapiens
tgtataaatgtatataca

SEQ ID NO: 536963 - DNA, 14 bp, Homo sapiens
tgtataaattttta

SEQ ID NO: 536964 - DNA, 21 bp, Homo sapiens
tgtataaatttttaagtgtca

SEQ ID NO: 536965 - DNA, 21 bp, Homo sapiens
tgtataagtgcacacagaaat

SEQ ID NO: 536966 - DNA, 19 bp, Homo sapiens
tgtatacgtttcaaaaaca

SEQ ID NO: 536967 - DNA, 15 bp, Homo sapiens
tgtatagtatttgaa

SEQ ID NO: 536968 - DNA, 17 bp, Homo sapiens
tgtatagtatttgaaaa

SEQ ID NO: 536969 - DNA, 18 bp, Homo sapiens
tgtatatacacatatacc

SEQ ID NO: 536970 - DNA, 11 bp, Homo sapiens
tgtatatatac

SEQ ID NO: 536971 - DNA, 20 bp, Homo sapiens
tgtatatatgtgtatatata

SEQ ID NO: 536972 - DNA, 19 bp, Homo sapiens
tgtatatgaggatgtatgt

SEQ ID NO: 536973 - DNA, 22 bp, Homo sapiens
tgtatatgaggatgtatgtgta

SEQ ID NO: 536974 - DNA, 18 bp, Homo sapiens
tgtatatgtttatacaca

SEQ ID NO: 536975 - DNA, 17 bp, Homo sapiens
tgtatctgacatatttc

SEQ ID NO: 536976 - DNA, 17 bp, Homo sapiens
tgtatgatctgtgcctt

SEQ ID NO: 536977 - DNA, 16 bp, Homo sapiens
tgtatgcaagcagttt

SEQ ID NO: 536978 - DNA, 12 bp, Homo sapiens
tgtatgcataat

SEQ ID NO: 536979 - DNA, 17 bp, Homo sapiens
tgtatggaagacaaata

SEQ ID NO: 536980 - DNA, 18 bp, Homo sapiens
tgtatggaagacaaatac

SEQ ID NO: 536981 - DNA, 20 bp, Homo sapiens
tgtatggaagacaaatacac

SEQ ID NO: 536982 - DNA, 12 bp, Homo sapiens
tgtatgtgtatt

SEQ ID NO: 536983 - DNA, 16 bp, Homo sapiens
tgtatgtttttcagtt

SEQ ID NO: 536984 - DNA, 20 bp, Homo sapiens
tgtatgtttttcagttcaaa

SEQ ID NO: 536985 - DNA, 22 bp, Homo sapiens
tgtatgtttttcagttcaaagt

SEQ ID NO: 536986 - DNA, 14 bp, Homo sapiens
tgtatttaaaacat

SEQ ID NO: 536987 - DNA, 23 bp, Homo sapiens
tgtatttacttgttatgttgtaa

SEQ ID NO: 536988 - DNA, 17 bp, Homo sapiens
tgtatttgttaatttct

SEQ ID NO: 536989 - DNA, 18 bp, Homo sapiens
tgtatttgttaatttctt

SEQ ID NO: 536990 - DNA, 13 bp, Homo sapiens
tgtattttatgta

SEQ ID NO: 536991 - DNA, 20 bp, Homo sapiens
tgtcaaacattagtacttta

SEQ ID NO: 536992 - DNA, 20 bp, Homo sapiens
tgtcaagtttttatacctgt

SEQ ID NO: 536993 - DNA, 17 bp, Homo sapiens
tgtcaatgattattttc

SEQ ID NO: 536994 - DNA, 22 bp, Homo sapiens
tgtcaccaccctgctcatccac

SEQ ID NO: 536995 - DNA, 20 bp, Homo sapiens
tgtcacctgcttctctgccc

SEQ ID NO: 536996 - DNA, 18 bp, Homo sapiens
tgtcactgctgtaaagca

SEQ ID NO: 536997 - DNA, 19 bp, Homo sapiens
tgtcactgctgtaaagcaa

SEQ ID NO: 536998 - DNA, 19 bp, Homo sapiens
tgtcagactatccatttta

SEQ ID NO: 536999 - DNA, 21 bp, Homo sapiens
tgtcagactatccattttaca

SEQ ID NO: 537000 - DNA, 19 bp, Homo sapiens
tgtcaggaaaacacccagg

SEQ ID NO: 537001 - DNA, 22 bp, Homo sapiens
tgtcagtttatgttttggtcca

SEQ ID NO: 537002 - DNA, 16 bp, Homo sapiens
tgtcattcaaatgggt

SEQ ID NO: 537003 - DNA, 18 bp, Homo sapiens
tgtcatttcatgtcctgt

SEQ ID NO: 537004 - DNA, 20 bp, Homo sapiens
tgtcatttctctttcaaaaa

SEQ ID NO: 537005 - DNA, 12 bp, Homo sapiens
tgtcattttcat

SEQ ID NO: 537006 - DNA, 20 bp, Homo sapiens
tgtcattttcattagcaaaa

SEQ ID NO: 537007 - DNA, 19 bp, Homo sapiens
tgtcccatgtgagctgctg

SEQ ID NO: 537008 - DNA, 20 bp, Homo sapiens
tgtcccatgtgagctgctgc

SEQ ID NO: 537009 - DNA, 15 bp, Homo sapiens
tgtccccaggggcac

SEQ ID NO: 537010 - DNA, 16 bp, Homo sapiens
tgtccccaggggcaca

SEQ ID NO: 537011 - DNA, 22 bp, Homo sapiens
tgtccccaggggcacacttccc

SEQ ID NO: 537012 - DNA, 15 bp, Homo sapiens
tgtccctcaattaca

SEQ ID NO: 537013 - DNA, 18 bp, Homo sapiens
tgtttaaaatggcattta

SEQ ID NO: 537014 - DNA, 21 bp, Homo sapiens
tgtttaaaatggcatttagca

SEQ ID NO: 537015 - DNA, 15 bp, Homo sapiens
tgtttacacaattaa

SEQ ID NO: 537016 - DNA, 15 bp, Homo sapiens
tgtttacactgtcaa

SEQ ID NO: 537017 - DNA, 22 bp, Homo sapiens
tgtttagtcagtgtactctgag

SEQ ID NO: 537018 - DNA, 17 bp, Homo sapiens
tgtttatctagatgtaa

SEQ ID NO: 537019 - DNA, 20 bp, Homo sapiens
tgtttatctagatgtaaatt

SEQ ID NO: 537020 - DNA, 22 bp, Homo sapiens
tgtttcaagttcacacctgcag

SEQ ID NO: 537021 - DNA, 21 bp, Homo sapiens
tgtttcacagtgtctgtaaat

SEQ ID NO: 537022 - DNA, 15 bp, Homo sapiens
tgtttcaccagtttc

SEQ ID NO: 537023 - DNA, 12 bp, Homo sapiens
tgtttcatcctt

SEQ ID NO: 537024 - DNA, 14 bp, Homo sapiens
tgtttcatttgtgt

SEQ ID NO: 537025 - DNA, 12 bp, Homo sapiens
tgtttccaggca

SEQ ID NO: 537026 - DNA, 23 bp, Homo sapiens
tgtttccttgaggggagccagga

SEQ ID NO: 537027 - DNA, 16 bp, Homo sapiens
tgtttctagagttcct

SEQ ID NO: 537028 - DNA, 22 bp, Homo sapiens
tgtttcttacgcttgctatcat

SEQ ID NO: 537029 - DNA, 19 bp, Homo sapiens
tgtttctttgaattttcat

SEQ ID NO: 537030 - DNA, 14 bp, Homo sapiens
tgtttgatgtcccc

SEQ ID NO: 537031 - DNA, 12 bp, Homo sapiens
tgtttgctcccc

SEQ ID NO: 537032 - DNA, 21 bp, Homo sapiens
tgtttgtcctttatgtattct

SEQ ID NO: 537033 - DNA, 23 bp, Homo sapiens
tgtttgtcctttatgtattctct

SEQ ID NO: 537034 - DNA, 14 bp, Homo sapiens
tgttttcaaatgga

SEQ ID NO: 537035 - DNA, 17 bp, Homo sapiens
tgttttgcttcccctcc

SEQ ID NO: 537036 - DNA, 13 bp, Homo sapiens
tgttttgtaaact

SEQ ID NO: 537037 - DNA, 21 bp, Homo sapiens
tgttttgtaaactttgaaata

SEQ ID NO: 537038 - DNA, 22 bp, Homo sapiens
tgttttgtaaactttgaaatat

SEQ ID NO: 537039 - DNA, 17 bp, Homo sapiens
tgtttttaaaatcttat

SEQ ID NO: 537040 - DNA, 19 bp, Homo sapiens
tgtttttcagttcaaagtc

SEQ ID NO: 537041 - DNA, 21 bp, Homo sapiens
tgttttttcattgtgttttct

SEQ ID NO: 537042 - DNA, 18 bp, Homo sapiens
tgttttttgttttcatta

SEQ ID NO: 537043 - DNA, 22 bp, Homo sapiens
ttaaaaaaaaagttggtatttt

SEQ ID NO: 537044 - DNA, 23 bp, Homo sapiens
ttaaaaaaatcccatttatgcaa

SEQ ID NO: 537045 - DNA, 12 bp, Homo sapiens
ttaaaaaatgaa

SEQ ID NO: 537046 - DNA, 16 bp, Homo sapiens
ttaaaaacaaaaggca

SEQ ID NO: 537047 - DNA, 13 bp, Homo sapiens
ttaaaaacatttt

SEQ ID NO: 537048 - DNA, 14 bp, Homo sapiens
ttaaaaatgcattt

SEQ ID NO: 537049 - DNA, 13 bp, Homo sapiens
ttaaaacaaaatc

SEQ ID NO: 537050 - DNA, 14 bp, Homo sapiens
ttaaaacttcatct

SEQ ID NO: 537051 - DNA, 17 bp, Homo sapiens
ttaaaagccacatagag

SEQ ID NO: 537052 - DNA, 11 bp, Homo sapiens
ttaaaatactg

SEQ ID NO: 537053 - DNA, 13 bp, Homo sapiens
ttaaaatactgta

SEQ ID NO: 537054 - DNA, 16 bp, Homo sapiens
ttaaaatactgtagat

SEQ ID NO: 537055 - DNA, 13 bp, Homo sapiens
ttaaaatcttatt

SEQ ID NO: 537056 - DNA, 16 bp, Homo sapiens
ttaaaatcttattaaa

SEQ ID NO: 537057 - DNA, 12 bp, Homo sapiens
ttaaaatttaac

SEQ ID NO: 537058 - DNA, 15 bp, Homo sapiens
ttaaaatttaacatc

SEQ ID NO: 537059 - DNA, 17 bp, Homo sapiens
ttaaaatttaacatctg

SEQ ID NO: 537060 - DNA, 17 bp, Homo sapiens
ttaaaatttgaaacatt

SEQ ID NO: 537061 - DNA, 18 bp, Homo sapiens
ttaaaatttgaaacattg

SEQ ID NO: 537062 - DNA, 12 bp, Homo sapiens
ttaaaattttaa

SEQ ID NO: 537063 - DNA, 21 bp, Homo sapiens
ttaaaccagtttagatttcaa

SEQ ID NO: 537064 - DNA, 21 bp, Homo sapiens
ttaaagagccattctggcact

SEQ ID NO: 537065 - DNA, 21 bp, Homo sapiens
ttaaagatgtagcaaaccctg

SEQ ID NO: 537066 - DNA, 16 bp, Homo sapiens
ttaaagtttcaaaaat

SEQ ID NO: 537067 - DNA, 21 bp, Homo sapiens
ttaaataaaagaaatgcacaa

SEQ ID NO: 537068 - DNA, 22 bp, Homo sapiens
ttaaataaaagaaatgcacaat

SEQ ID NO: 537069 - DNA, 19 bp, Homo sapiens
ttaaatgtcttatatagca

SEQ ID NO: 537070 - DNA, 18 bp, Homo sapiens
ttaaatgtgaattactaa

SEQ ID NO: 537071 - DNA, 21 bp, Homo sapiens
ttaaatgtgaattactaactt

SEQ ID NO: 537072 - DNA, 19 bp, Homo sapiens
ttaaatgttttgtaaactt

SEQ ID NO: 537073 - DNA, 20 bp, Homo sapiens
ttaaatgttttgtaaacttt

SEQ ID NO: 537074 - DNA, 23 bp, Homo sapiens
ttaaattatcattgtttgtcctt

SEQ ID NO: 537075 - DNA, 12 bp, Homo sapiens
ttcatgaaatgc

SEQ ID NO: 537076 - DNA, 15 bp, Homo sapiens
ttcatgaaatgctat

SEQ ID NO: 537077 - DNA, 20 bp, Homo sapiens
ttcatgaaatgctatgtcat

SEQ ID NO: 537078 - DNA, 21 bp, Homo sapiens
ttcatgaaatgctatgtcatt

SEQ ID NO: 537079 - DNA, 23 bp, Homo sapiens
ttcatgaaatgctatgtcatttc

SEQ ID NO: 537080 - DNA, 23 bp, Homo sapiens
ttcatggaattggtttaaacttt

SEQ ID NO: 537081 - DNA, 21 bp, Homo sapiens
ttcatgtcctgtgtcagttta

SEQ ID NO: 537082 - DNA, 17 bp, Homo sapiens
ttcatgttcccacttca

SEQ ID NO: 537083 - DNA, 13 bp, Homo sapiens
ttcattaaaaaca

SEQ ID NO: 537084 - DNA, 16 bp, Homo sapiens
ttcattaaaaacattt

SEQ ID NO: 537085 - DNA, 17 bp, Homo sapiens
ttcattaaaaacatttt

SEQ ID NO: 537086 - DNA, 13 bp, Homo sapiens
ttcattgctgtga

SEQ ID NO: 537087 - DNA, 14 bp, Homo sapiens
ttcattgtgtatga

SEQ ID NO: 537088 - DNA, 13 bp, Homo sapiens
ttcatttaacact

SEQ ID NO: 537089 - DNA, 16 bp, Homo sapiens
ttcatttaacactgag

SEQ ID NO: 537090 - DNA, 14 bp, Homo sapiens
ttcatttcatcctt

SEQ ID NO: 537091 - DNA, 13 bp, Homo sapiens
ttcatttttccta

SEQ ID NO: 537092 - DNA, 11 bp, Homo sapiens
ttccaaagatc

SEQ ID NO: 537093 - DNA, 20 bp, Homo sapiens
ttccaaagcagagagcatta

SEQ ID NO: 537094 - DNA, 19 bp, Homo sapiens
ttccaacaccacagacaca

SEQ ID NO: 537095 - DNA, 20 bp, Homo sapiens
ttccaacatacaatttactt

SEQ ID NO: 537096 - DNA, 13 bp, Homo sapiens
ttccaagggccca

SEQ ID NO: 537097 - DNA, 19 bp, Homo sapiens
ttccaagtaatataatgga

SEQ ID NO: 537098 - DNA, 17 bp, Homo sapiens
ttccacacaggcccatg

SEQ ID NO: 537099 - DNA, 16 bp, Homo sapiens
ttccacctgctctgct

SEQ ID NO: 537100 - DNA, 17 bp, Homo sapiens
ttccacctgctctgctg

SEQ ID NO: 537101 - DNA, 23 bp, Homo sapiens
ttccaccttggcgcgcagcccgg

SEQ ID NO: 537102 - DNA, 20 bp, Homo sapiens
ttccagagacaaatatttct

SEQ ID NO: 537103 - DNA, 10 bp, Homo sapiens
ttccagagca

SEQ ID NO: 537104 - DNA, 15 bp, Homo sapiens
ttccagagctgccag

SEQ ID NO: 537105 - DNA, 21 bp, Homo sapiens
ttccagctaagcctgatgatg

SEQ ID NO: 537106 - DNA, 11 bp, Homo sapiens
ttccaggcagc

SEQ ID NO: 537107 - DNA, 21 bp, Homo sapiens
ttccaggcatgaccctggagc

SEQ ID NO: 537108 - DNA, 17 bp, Homo sapiens
ttccaggcccgaagcat

SEQ ID NO: 537109 - DNA, 15 bp, Homo sapiens
ttccagggaaccaga

SEQ ID NO: 537110 - DNA, 14 bp, Homo sapiens
ttccagggcaatca

SEQ ID NO: 537111 - DNA, 12 bp, Homo sapiens
ttccagtatttt

SEQ ID NO: 537112 - DNA, 14 bp, Homo sapiens
ttccagtgctgctc

SEQ ID NO: 537113 - DNA, 23 bp, Homo sapiens
ttccagttggactgtggcctcag

SEQ ID NO: 537114 - DNA, 24 bp, Homo sapiens
ttccagttggactgtggcctcagg

SEQ ID NO: 537115 - DNA, 14 bp, Homo sapiens
ttccatacttctct

SEQ ID NO: 537116 - DNA, 17 bp, Homo sapiens
ttccatacttctctcag

SEQ ID NO: 537117 - DNA, 23 bp, Homo sapiens
ttccatatttttttccttacata

SEQ ID NO: 537118 - DNA, 17 bp, Homo sapiens
ttccatttacagtctct

SEQ ID NO: 537119 - DNA, 23 bp, Homo sapiens
ttccatttacagtctctttcttc

SEQ ID NO: 537120 - DNA, 21 bp, Homo sapiens
ttccatttctctctccagtct

SEQ ID NO: 537121 - DNA, 15 bp, Homo sapiens
ttcccaacctcccct

SEQ ID NO: 537122 - DNA, 14 bp, Homo sapiens
ttcccaagaaatgc

SEQ ID NO: 537123 - DNA, 16 bp, Homo sapiens
ttcccacccagcctgg

SEQ ID NO: 537124 - DNA, 23 bp, Homo sapiens
ttcccattgcatcacctctgtaa

SEQ ID NO: 537125 - DNA, 21 bp, Homo sapiens
ttccccaaaggccaacagcat

SEQ ID NO: 537126 - DNA, 12 bp, Homo sapiens
ttcccccaccac

SEQ ID NO: 537127 - DNA, 14 bp, Homo sapiens
ttccccctttcttc

SEQ ID NO: 537128 - DNA, 16 bp, Homo sapiens
ttccccctttcttcct

SEQ ID NO: 537129 - DNA, 13 bp, Homo sapiens
ttccccttccttc

SEQ ID NO: 537130 - DNA, 19 bp, Homo sapiens
ttcccgtggctttgtgctt

SEQ ID NO: 537131 - DNA, 14 bp, Homo sapiens
ttccctagttcttt

SEQ ID NO: 537132 - DNA, 15 bp, Homo sapiens
ttccctccctgctgt

SEQ ID NO: 537133 - DNA, 16 bp, Homo sapiens
ttccctccctgctgtc

SEQ ID NO: 537134 - DNA, 18 bp, Homo sapiens
ttccctcggagttcttct

SEQ ID NO: 537135 - DNA, 13 bp, Homo sapiens
ttcccttcctcca

SEQ ID NO: 537136 - DNA, 17 bp, Homo sapiens
ttcccttcctccatcct

SEQ ID NO: 537137 - DNA, 16 bp, Homo sapiens
ttcccttgattcaaat

SEQ ID NO: 537138 - DNA, 12 bp, Homo sapiens
ttccctttgcca

SEQ ID NO: 537139 - DNA, 23 bp, Homo sapiens
ttcctaccattatggctttgtgc

SEQ ID NO: 537140 - DNA, 18 bp, Homo sapiens
ttcctactcttctctctg

SEQ ID NO: 537141 - DNA, 21 bp, Homo sapiens
ttcctagttcatcccttctct

SEQ ID NO: 537142 - DNA, 18 bp, Homo sapiens
ttcctccatcctcctcct

SEQ ID NO: 537143 - DNA, 22 bp, Homo sapiens
ttcctccatcctcctccttcct

SEQ ID NO: 537144 - DNA, 13 bp, Homo sapiens
ttcctcgcttctt

SEQ ID NO: 537145 - DNA, 21 bp, Homo sapiens
ttcctctcatccttttctcct

SEQ ID NO: 537146 - DNA, 23 bp, Homo sapiens
ttcctctcatccttttctcctat

SEQ ID NO: 537147 - DNA, 19 bp, Homo sapiens
ttcctctgctaaattgatg

SEQ ID NO: 537148 - DNA, 13 bp, Homo sapiens
ttcctctgctccc

SEQ ID NO: 537149 - DNA, 20 bp, Homo sapiens
ttcctcttaatgtctcaaaa

SEQ ID NO: 537150 - DNA, 22 bp, Homo sapiens
ttcctgctacagtagctgtggg

SEQ ID NO: 537151 - DNA, 19 bp, Homo sapiens
ttcctgtcttatcctccac

SEQ ID NO: 537152 - DNA, 13 bp, Homo sapiens
ttccttacataaa

SEQ ID NO: 537153 - DNA, 13 bp, Homo sapiens
tgaaatttttcat

SEQ ID NO: 537154 - DNA, 18 bp, Homo sapiens
tgaaatttttcatatttt

SEQ ID NO: 537155 - DNA, 21 bp, Homo sapiens
tgaacagatgacccctgccca

SEQ ID NO: 537156 - DNA, 15 bp, Homo sapiens
tgaacagctctgaga

SEQ ID NO: 537157 - DNA, 13 bp, Homo sapiens
tgaacccaggagg

SEQ ID NO: 537158 - DNA, 14 bp, Homo sapiens
tgaactgaagcaga

SEQ ID NO: 537159 - DNA, 20 bp, Homo sapiens
tatgtcgtcgagctcccccc

SEQ ID NO: 537160 - DNA, 14 bp, Homo sapiens
tatgtctcatgttt

SEQ ID NO: 537161 - DNA, 17 bp, Homo sapiens
tatgtctcatgttttat

SEQ ID NO: 537162 - DNA, 16 bp, Homo sapiens
tatgtctttaaaatga

SEQ ID NO: 537163 - DNA, 17 bp, Homo sapiens
tatgtgtatatatacat

SEQ ID NO: 537164 - DNA, 14 bp, Homo sapiens
tatgtgtatatgtt

SEQ ID NO: 537165 - DNA, 14 bp, Homo sapiens
tatgttatgaaaac

SEQ ID NO: 537166 - DNA, 23 bp, Homo sapiens
tatgtttaaagtaattgttccag

SEQ ID NO: 537167 - DNA, 15 bp, Homo sapiens
tatgtttacacaatt

SEQ ID NO: 537168 - DNA, 13 bp, Homo sapiens
tatgtttacactg

SEQ ID NO: 537169 - DNA, 18 bp, Homo sapiens
tatgtttacactgtcaaa

SEQ ID NO: 537170 - DNA, 11 bp, Homo sapiens
tatgtttttca

SEQ ID NO: 537171 - DNA, 13 bp, Homo sapiens
tatgtttttcagt

SEQ ID NO: 537172 - DNA, 14 bp, Homo sapiens
tatgtttttcagtt

SEQ ID NO: 537173 - DNA, 16 bp, Homo sapiens
tatgtttttcagttca

SEQ ID NO: 537174 - DNA, 20 bp, Homo sapiens
tatgtttttcagttcaaagt

SEQ ID NO: 537175 - DNA, 12 bp, Homo sapiens
tattaaaaagtc

SEQ ID NO: 537176 - DNA, 13 bp, Homo sapiens
tattacaatattt

SEQ ID NO: 537177 - DNA, 22 bp, Homo sapiens
tattaccagattcacttctgaa

SEQ ID NO: 537178 - DNA, 14 bp, Homo sapiens
tattacttgttgca

SEQ ID NO: 537179 - DNA, 21 bp, Homo sapiens
tattacttgttgcaaaggtct

SEQ ID NO: 537180 - DNA, 18 bp, Homo sapiens
tattagaaaactttgtta

SEQ ID NO: 537181 - DNA, 21 bp, Homo sapiens
tattagacttctgttttcaat

SEQ ID NO: 537182 - DNA, 18 bp, Homo sapiens
tattagcgacaacagatt

SEQ ID NO: 537183 - DNA, 20 bp, Homo sapiens
tattagcgacaacagattgg

SEQ ID NO: 537184 - DNA, 21 bp, Homo sapiens
tattagcgacaacagattgga

SEQ ID NO: 537185 - DNA, 13 bp, Homo sapiens
tattatcctgtgt

SEQ ID NO: 537186 - DNA, 17 bp, Homo sapiens
tattatgccttgagaat

SEQ ID NO: 537187 - DNA, 15 bp, Homo sapiens
tattatgttatgaaa

SEQ ID NO: 537188 - DNA, 18 bp, Homo sapiens
tattattcaaaccaattt

SEQ ID NO: 537189 - DNA, 22 bp, Homo sapiens
tattattcaaaccaatttcttc

SEQ ID NO: 537190 - DNA, 23 bp, Homo sapiens
tattattcaaaccaatttcttcc

SEQ ID NO: 537191 - DNA, 19 bp, Homo sapiens
tattcaaaccaatttcttc

SEQ ID NO: 537192 - DNA, 22 bp, Homo sapiens
tattcaaaccaatttcttcctt

SEQ ID NO: 537193 - DNA, 17 bp, Homo sapiens
tattcaagaaagccagt

SEQ ID NO: 537194 - DNA, 20 bp, Homo sapiens
tattcaagaaagccagtctt

SEQ ID NO: 537195 - DNA, 23 bp, Homo sapiens
tattcaagaaagccagtcttaac

SEQ ID NO: 537196 - DNA, 17 bp, Homo sapiens
tattcaagaagatagtt

SEQ ID NO: 537197 - DNA, 17 bp, Homo sapiens
tattcagaagacacaga

SEQ ID NO: 537198 - DNA, 23 bp, Homo sapiens
tattcagcaaggcgctaacttgc

SEQ ID NO: 537199 - DNA, 19 bp, Homo sapiens
tattcaggaccccatctgc

SEQ ID NO: 537200 - DNA, 23 bp, Homo sapiens
tattcataccttctgatgaagtt

SEQ ID NO: 537201 - DNA, 12 bp, Homo sapiens
tattccagagct

SEQ ID NO: 537202 - DNA, 20 bp, Homo sapiens
tattccatattagaaaactt

SEQ ID NO: 537203 - DNA, 22 bp, Homo sapiens
tattcctgacctccgccatcca

SEQ ID NO: 537204 - DNA, 22 bp, Homo sapiens
tattctatccatctcctggtgt

SEQ ID NO: 537205 - DNA, 14 bp, Homo sapiens
tattctcttctaca

SEQ ID NO: 537206 - DNA, 16 bp, Homo sapiens
tattctgcagaaaatt

SEQ ID NO: 537207 - DNA, 13 bp, Homo sapiens
tattctttgttaa

SEQ ID NO: 537208 - DNA, 22 bp, Homo sapiens
tattgaaaagaaaaagaagagc

SEQ ID NO: 537209 - DNA, 21 bp, Homo sapiens
tattgaaaatgtcactgttat

SEQ ID NO: 537210 - DNA, 14 bp, Homo sapiens
tattgaagaaacag

SEQ ID NO: 537211 - DNA, 22 bp, Homo sapiens
tattgacaataagaaacagttt

SEQ ID NO: 537212 - DNA, 22 bp, Homo sapiens
tattgagagagatgtgtaattt

SEQ ID NO: 537213 - DNA, 14 bp, Homo sapiens
tattgattgctttt

SEQ ID NO: 537214 - DNA, 14 bp, Homo sapiens
tattgccaaacatt

SEQ ID NO: 537215 - DNA, 15 bp, Homo sapiens
tattgccaaacatta

SEQ ID NO: 537216 - DNA, 18 bp, Homo sapiens
tattgccaaacattaatg

SEQ ID NO: 537217 - DNA, 21 bp, Homo sapiens
tattgccaaacattaatgttg

SEQ ID NO: 537218 - DNA, 20 bp, Homo sapiens
tattgctgtaaataaaaata

SEQ ID NO: 537219 - DNA, 21 bp, Homo sapiens
tattgctgtaaataaaaatag

SEQ ID NO: 537220 - DNA, 18 bp, Homo sapiens
tattggtcaagaaaagca

SEQ ID NO: 537221 - DNA, 16 bp, Homo sapiens
tattgtaactatgttt

SEQ ID NO: 537222 - DNA, 18 bp, Homo sapiens
tatttaaaacatttcatg

SEQ ID NO: 537223 - DNA, 14 bp, Homo sapiens
tatttaacattctt

SEQ ID NO: 537224 - DNA, 15 bp, Homo sapiens
tatttaagtggactg

SEQ ID NO: 537225 - DNA, 20 bp, Homo sapiens
tatttaagtggactgtattt

SEQ ID NO: 537226 - DNA, 14 bp, Homo sapiens
tatttacttgttat

SEQ ID NO: 537227 - DNA, 21 bp, Homo sapiens
tatttataacattgtaaatga

SEQ ID NO: 537228 - DNA, 21 bp, Homo sapiens
tatttattgaagaaacagata

SEQ ID NO: 537229 - DNA, 21 bp, Homo sapiens
tatttattgctacttcctgcc

SEQ ID NO: 537230 - DNA, 15 bp, Homo sapiens
tatttcctaaggcat

SEQ ID NO: 537231 - DNA, 22 bp, Homo sapiens
tatttgaaaacagaaattggta

SEQ ID NO: 537232 - DNA, 20 bp, Homo sapiens
tatttgctcataagtaaatg

SEQ ID NO: 537233 - DNA, 15 bp, Homo sapiens
tatttggatgcagag

SEQ ID NO: 537234 - DNA, 19 bp, Homo sapiens
tatttggatgcagagttca

SEQ ID NO: 537235 - DNA, 22 bp, Homo sapiens
tatttgtgaaagtgccaaaata

SEQ ID NO: 537236 - DNA, 17 bp, Homo sapiens
tatttgtgtaactgaaa

SEQ ID NO: 537237 - DNA, 17 bp, Homo sapiens
tatttgttaatttcttg

SEQ ID NO: 537238 - DNA, 19 bp, Homo sapiens
tattttaaaaaatgaaaat

SEQ ID NO: 537239 - DNA, 14 bp, Homo sapiens
tattttaaaagcca

SEQ ID NO: 537240 - DNA, 18 bp, Homo sapiens
tattttaagaagttgctg

SEQ ID NO: 537241 - DNA, 17 bp, Homo sapiens
tattttactgtcttaat

SEQ ID NO: 537242 - DNA, 21 bp, Homo sapiens
tattttagtggaccctgaaat

SEQ ID NO: 537243 - DNA, 17 bp, Homo sapiens
tattttcattacaatgg

SEQ ID NO: 537244 - DNA, 12 bp, Homo sapiens
tattttctactt

SEQ ID NO: 537245 - DNA, 22 bp, Homo sapiens
tattttctgagtagcatatata

SEQ ID NO: 537246 - DNA, 16 bp, Homo sapiens
tattttgatcagtgtt

SEQ ID NO: 537247 - DNA, 14 bp, Homo sapiens
tattttgtatgcaa

SEQ ID NO: 537248 - DNA, 16 bp, Homo sapiens
tattttgtcactgctg

SEQ ID NO: 537249 - DNA, 18 bp, Homo sapiens
tattttgtcactgctgta

SEQ ID NO: 537250 - DNA, 15 bp, Homo sapiens
tatttttcaaggcat

SEQ ID NO: 537251 - DNA, 16 bp, Homo sapiens
tatttttcaaggcatt

SEQ ID NO: 537252 - DNA, 18 bp, Homo sapiens
tatttttcattacctgta

SEQ ID NO: 537253 - DNA, 18 bp, Homo sapiens
tatttttttccttacata

SEQ ID NO: 537254 - DNA, 19 bp, Homo sapiens
tatttttttccttacataa

SEQ ID NO: 537255 - DNA, 16 bp, Homo sapiens
tcaaaaatctgaagat

SEQ ID NO: 537256 - DNA, 18 bp, Homo sapiens
tcaaaaatctgaagattg

SEQ ID NO: 537257 - DNA, 22 bp, Homo sapiens
tcaaaacaaacagatgctctga

SEQ ID NO: 537258 - DNA, 13 bp, Homo sapiens
tcaaaagacatgt

SEQ ID NO: 537259 - DNA, 20 bp, Homo sapiens
tcaaaataaaaagtgacaca

SEQ ID NO: 537260 - DNA, 17 bp, Homo sapiens
tcaaaatgtggaccagt

SEQ ID NO: 537261 - DNA, 15 bp, Homo sapiens
tcaaacattagtact

SEQ ID NO: 537262 - DNA, 16 bp, Homo sapiens
tcaaacattagtactt

SEQ ID NO: 537263 - DNA, 17 bp, Homo sapiens
tcaaacattagtacttt

SEQ ID NO: 537264 - DNA, 20 bp, Homo sapiens
tcaaacattagtactttata

SEQ ID NO: 537265 - DNA, 14 bp, Homo sapiens
tcaaaccaatttct

SEQ ID NO: 537266 - DNA, 15 bp, Homo sapiens
tcaaacgaaatggct

SEQ ID NO: 537267 - DNA, 15 bp, Homo sapiens
tcaaataaccctgaa

SEQ ID NO: 537268 - DNA, 21 bp, Homo sapiens
tcaaataaccctgaatcagag

SEQ ID NO: 537269 - DNA, 18 bp, Homo sapiens
tcaaatatgtaaacttta

SEQ ID NO: 537270 - DNA, 16 bp, Homo sapiens
tcaaatgtacatctcc

SEQ ID NO: 537271 - DNA, 18 bp, Homo sapiens
tcaaatgttattcaataa

SEQ ID NO: 537272 - DNA, 14 bp, Homo sapiens
tcaacaaagaaata

SEQ ID NO: 537273 - DNA, 15 bp, Homo sapiens
tcaacaaagaaatat

SEQ ID NO: 537274 - DNA, 14 bp, Homo sapiens
tcaacaactactac

SEQ ID NO: 537275 - DNA, 17 bp, Homo sapiens
tcaacatttgctttttg

SEQ ID NO: 537276 - DNA, 18 bp, Homo sapiens
tcaaccaaatggtacaaa

SEQ ID NO: 537277 - DNA, 14 bp, Homo sapiens
tcaacttcaggaaa

SEQ ID NO: 537278 - DNA, 16 bp, Homo sapiens
tcaagaaaaaaaggga

SEQ ID NO: 537279 - DNA, 13 bp, Homo sapiens
tcaagaccagcct

SEQ ID NO: 537280 - DNA, 15 bp, Homo sapiens
tcaagaccagcctgg

SEQ ID NO: 537281 - DNA, 13 bp, Homo sapiens
tcaagcccaggag

SEQ ID NO: 537282 - DNA, 14 bp, Homo sapiens
tcaagcccaggagg

SEQ ID NO: 537283 - DNA, 15 bp, Homo sapiens
tcaagcccaggaggg

SEQ ID NO: 537284 - DNA, 13 bp, Homo sapiens
tcaaggctgcagt

SEQ ID NO: 537285 - DNA, 15 bp, Homo sapiens
tcaaggctgcagtga

SEQ ID NO: 537286 - DNA, 14 bp, Homo sapiens
tcaagggctttcct

SEQ ID NO: 537287 - DNA, 19 bp, Homo sapiens
tcaagggctttcctgtgcc

SEQ ID NO: 537288 - DNA, 16 bp, Homo sapiens
tcaagtggaaaccttg

SEQ ID NO: 537289 - DNA, 14 bp, Homo sapiens
tcaagtggcaaagc

SEQ ID NO: 537290 - DNA, 14 bp, Homo sapiens
tcaataaagtttga

SEQ ID NO: 537291 - DNA, 15 bp, Homo sapiens
tcaataaagtttgat

SEQ ID NO: 537292 - DNA, 18 bp, Homo sapiens
tcaataaagtttgatctt

SEQ ID NO: 537293 - DNA, 20 bp, Homo sapiens
tcaataacagccgctccaga

SEQ ID NO: 537294 - DNA, 13 bp, Homo sapiens
tcaatcccaaaag

SEQ ID NO: 537295 - DNA, 11 bp, Homo sapiens
tccgccctggg

SEQ ID NO: 537296 - DNA, 21 bp, Homo sapiens
tccggaacgtagtcggcacag

SEQ ID NO: 537297 - DNA, 15 bp, Homo sapiens
tccggaatcctgtcc

SEQ ID NO: 537298 - DNA, 15 bp, Homo sapiens
tccggggccagctcc

SEQ ID NO: 537299 - DNA, 20 bp, Homo sapiens
tccgtaccatcggtcagcag

SEQ ID NO: 537300 - DNA, 14 bp, Homo sapiens
tccgtcctggcagg

SEQ ID NO: 537301 - DNA, 20 bp, Homo sapiens
tccgtttgatttgtcactgc

SEQ ID NO: 537302 - DNA, 19 bp, Homo sapiens
tcctaacattatattccca

SEQ ID NO: 537303 - DNA, 21 bp, Homo sapiens
tcctaagcaactaggccttca

SEQ ID NO: 537304 - DNA, 13 bp, Homo sapiens
tcctactcttctc

SEQ ID NO: 537305 - DNA, 17 bp, Homo sapiens
tcctactcttctctctg

SEQ ID NO: 537306 - DNA, 19 bp, Homo sapiens
tcctagttcatcccttctc

SEQ ID NO: 537307 - DNA, 19 bp, Homo sapiens
tcctatgaagttggcacat

SEQ ID NO: 537308 - DNA, 19 bp, Homo sapiens
tcctatgactcaaagatga

SEQ ID NO: 537309 - DNA, 19 bp, Homo sapiens
cattcatattacaatattt

SEQ ID NO: 537310 - DNA, 18 bp, Homo sapiens
cattccctcgtctttccc

SEQ ID NO: 537311 - DNA, 19 bp, Homo sapiens
cattccctcgtctttccca

SEQ ID NO: 537312 - DNA, 15 bp, Homo sapiens
cattccctggaattg

SEQ ID NO: 537313 - DNA, 22 bp, Homo sapiens
cattcgggccccacctgcagct

SEQ ID NO: 537314 - DNA, 14 bp, Homo sapiens
cattctcaagggac

SEQ ID NO: 537315 - DNA, 21 bp, Homo sapiens
cattctcaagggacgtcctcc

SEQ ID NO: 537316 - DNA, 20 bp, Homo sapiens
cattctcagtttttcttaat

SEQ ID NO: 537317 - DNA, 17 bp, Homo sapiens
cattctgctgcccccag

SEQ ID NO: 537318 - DNA, 16 bp, Homo sapiens
cattctggcactttaa

SEQ ID NO: 537319 - DNA, 23 bp, Homo sapiens
cattgcataagtggacccagctg

SEQ ID NO: 537320 - DNA, 22 bp, Homo sapiens
cattgcatcacctctgtaattt

SEQ ID NO: 537321 - DNA, 21 bp, Homo sapiens
cattgcatgccgggtgcagca

SEQ ID NO: 537322 - DNA, 22 bp, Homo sapiens
cattgccccaaatggattcctg

SEQ ID NO: 537323 - DNA, 15 bp, Homo sapiens
cattgcttcttctga

SEQ ID NO: 537324 - DNA, 16 bp, Homo sapiens
cattgcttcttctgag

SEQ ID NO: 537325 - DNA, 21 bp, Homo sapiens
cattgcttttaaaactactta

SEQ ID NO: 537326 - DNA, 14 bp, Homo sapiens
cattggaaatttca

SEQ ID NO: 537327 - DNA, 19 bp, Homo sapiens
cattggcctggccagacca

SEQ ID NO: 537328 - DNA, 13 bp, Homo sapiens
cattgtatgttaa

SEQ ID NO: 537329 - DNA, 12 bp, Homo sapiens
cattgtgtatga

SEQ ID NO: 537330 - DNA, 20 bp, Homo sapiens
cattgtgttttcttcgtgga

SEQ ID NO: 537331 - DNA, 21 bp, Homo sapiens
cattgttcagaaaagcacctc

SEQ ID NO: 537332 - DNA, 14 bp, Homo sapiens
cattgtttgtcctt

SEQ ID NO: 537333 - DNA, 23 bp, Homo sapiens
catttaaacccaatcagatgcct

SEQ ID NO: 537334 - DNA, 17 bp, Homo sapiens
catttaacactgagtga

SEQ ID NO: 537335 - DNA, 20 bp, Homo sapiens
catttaacactgagtgaaat

SEQ ID NO: 537336 - DNA, 15 bp, Homo sapiens
catttaagttgtaaa

SEQ ID NO: 537337 - DNA, 16 bp, Homo sapiens
catttacagtctcttt

SEQ ID NO: 537338 - DNA, 17 bp, Homo sapiens
catttagcacagtattt

SEQ ID NO: 537339 - DNA, 18 bp, Homo sapiens
catttagcacagtattta

SEQ ID NO: 537340 - DNA, 16 bp, Homo sapiens
catttagtcctcacct

SEQ ID NO: 537341 - DNA, 16 bp, Homo sapiens
catttatggtaatcat

SEQ ID NO: 537342 - DNA, 22 bp, Homo sapiens
catttatgtgtgaagcaaattt

SEQ ID NO: 537343 - DNA, 21 bp, Homo sapiens
catttcagtaaacctgtctga

SEQ ID NO: 537344 - DNA, 14 bp, Homo sapiens
catttcatcctttc

SEQ ID NO: 537345 - DNA, 17 bp, Homo sapiens
catttcatcctttcact

SEQ ID NO: 537346 - DNA, 16 bp, Homo sapiens
catttccatgtatgca

SEQ ID NO: 537347 - DNA, 16 bp, Homo sapiens
catttccgtaattctt

SEQ ID NO: 537348 - DNA, 22 bp, Homo sapiens
catttcctgtacaatcatgaac

SEQ ID NO: 537349 - DNA, 19 bp, Homo sapiens
catttcctttttctatttt

SEQ ID NO: 537350 - DNA, 15 bp, Homo sapiens
catttctaacataag

SEQ ID NO: 537351 - DNA, 19 bp, Homo sapiens
catttctaactctgatgta

SEQ ID NO: 537352 - DNA, 11 bp, Homo sapiens
catttctctct

SEQ ID NO: 537353 - DNA, 19 bp, Homo sapiens
catttcttctctctgtgct

SEQ ID NO: 537354 - DNA, 20 bp, Homo sapiens
catttcttctctctgtgctg

SEQ ID NO: 537355 - DNA, 17 bp, Homo sapiens
catttcttggtatgatc

SEQ ID NO: 537356 - DNA, 15 bp, Homo sapiens
catttgtcattttca

SEQ ID NO: 537357 - DNA, 17 bp, Homo sapiens
catttgtcattttcatt

SEQ ID NO: 537358 - DNA, 18 bp, Homo sapiens
catttgtcattttcatta

SEQ ID NO: 537359 - DNA, 18 bp, Homo sapiens
cattttacacttgcttta

SEQ ID NO: 537360 - DNA, 19 bp, Homo sapiens
cattttacagttacttttc

SEQ ID NO: 537361 - DNA, 22 bp, Homo sapiens
cattttacagttacttttcctt

SEQ ID NO: 537362 - DNA, 17 bp, Homo sapiens
cattttcattagcaaaa

SEQ ID NO: 537363 - DNA, 15 bp, Homo sapiens
cattttctgaaacta

SEQ ID NO: 537364 - DNA, 20 bp, Homo sapiens
cattttctgaaactaatgaa

SEQ ID NO: 537365 - DNA, 14 bp, Homo sapiens
cattttctttacag

SEQ ID NO: 537366 - DNA, 22 bp, Homo sapiens
catttttattacccttctttcc

SEQ ID NO: 537367 - DNA, 17 bp, Homo sapiens
ccaaaaaaatccagaaa

SEQ ID NO: 537368 - DNA, 14 bp, Homo sapiens
ccaaaaaagaaagt

SEQ ID NO: 537369 - DNA, 12 bp, Homo sapiens
ccaaaagaaaaa

SEQ ID NO: 537370 - DNA, 16 bp, Homo sapiens
ccaaacccccattctg

SEQ ID NO: 537371 - DNA, 19 bp, Homo sapiens
ccaaacccccattctgtcc

SEQ ID NO: 537372 - DNA, 20 bp, Homo sapiens
ccaaaggacattatgtgtgc

SEQ ID NO: 537373 - DNA, 17 bp, Homo sapiens
ccaaagtaccacactga

SEQ ID NO: 537374 - DNA, 18 bp, Homo sapiens
ccaaagtaccacactgag

SEQ ID NO: 537375 - DNA, 17 bp, Homo sapiens
ccaaatcctgggcatcc

SEQ ID NO: 537376 - DNA, 21 bp, Homo sapiens
ccaaatgtgtcttgtattatc

SEQ ID NO: 537377 - DNA, 14 bp, Homo sapiens
ccaaattgtcacct

SEQ ID NO: 537378 - DNA, 21 bp, Homo sapiens
ccaaattgtcacctgcttctc

SEQ ID NO: 537379 - DNA, 22 bp, Homo sapiens
ccaaattgtcacctgcttctct

SEQ ID NO: 537380 - DNA, 21 bp, Homo sapiens
ccaaattttccttcctgttct

SEQ ID NO: 537381 - DNA, 17 bp, Homo sapiens
ccaacaacatccatgtc

SEQ ID NO: 537382 - DNA, 19 bp, Homo sapiens
ccaacaagaataaaggcag

SEQ ID NO: 537383 - DNA, 23 bp, Homo sapiens
ccaacaccacagacacacacacg

SEQ ID NO: 537384 - DNA, 20 bp, Homo sapiens
ccaacagaaacatgccagaa

SEQ ID NO: 537385 - DNA, 22 bp, Homo sapiens
ccaacagcattggcctggccag

SEQ ID NO: 537386 - DNA, 19 bp, Homo sapiens
ccaaccctgcccagcctga

SEQ ID NO: 537387 - DNA, 13 bp, Homo sapiens
ccaacctcccctg

SEQ ID NO: 537388 - DNA, 24 bp, Homo sapiens
ccaacctcccctggtcctgcactg

SEQ ID NO: 537389 - DNA, 15 bp, Homo sapiens
ccaacgtggggcagc

SEQ ID NO: 537390 - DNA, 14 bp, Homo sapiens
ccaactctctctgt

SEQ ID NO: 537391 - DNA, 16 bp, Homo sapiens
ccaactttcaagaact

SEQ ID NO: 537392 - DNA, 19 bp, Homo sapiens
ccaagctgaggaggtgctg

SEQ ID NO: 537393 - DNA, 17 bp, Homo sapiens
ccaagcttcctttgttt

SEQ ID NO: 537394 - DNA, 19 bp, Homo sapiens
ccaaggccccctgcctgcc

SEQ ID NO: 537395 - DNA, 20 bp, Homo sapiens
ccaaggtagaatgaccttgt

SEQ ID NO: 537396 - DNA, 14 bp, Homo sapiens
ccaaggttctgggt

SEQ ID NO: 537397 - DNA, 16 bp, Homo sapiens
ccaagtaatataatgg

SEQ ID NO: 537398 - DNA, 16 bp, Homo sapiens
ccaataaaggaggaat

SEQ ID NO: 537399 - DNA, 18 bp, Homo sapiens
ccaataaaggaggaatca

SEQ ID NO: 537400 - DNA, 19 bp, Homo sapiens
ccaatgcacatccattccc

SEQ ID NO: 537401 - DNA, 10 bp, Homo sapiens
ccaatttctc

SEQ ID NO: 537402 - DNA, 16 bp, Homo sapiens
ccaatttcttccttcc

SEQ ID NO: 537403 - DNA, 12 bp, Homo sapiens
ccacacacacaa

SEQ ID NO: 537404 - DNA, 13 bp, Homo sapiens
ccacacacacaaa

SEQ ID NO: 537405 - DNA, 13 bp, Homo sapiens
ccacacaggccca

SEQ ID NO: 537406 - DNA, 18 bp, Homo sapiens
ccacacctggccctgggg

SEQ ID NO: 537407 - DNA, 14 bp, Homo sapiens
ccacagacactcct

SEQ ID NO: 537408 - DNA, 17 bp, Homo sapiens
ccacagacactcctggg

SEQ ID NO: 537409 - DNA, 18 bp, Homo sapiens
ccacagacactcctgggg

SEQ ID NO: 537410 - DNA, 11 bp, Homo sapiens
ccacagccagt

SEQ ID NO: 537411 - DNA, 15 bp, Homo sapiens
ccacagctccttttc

SEQ ID NO: 537412 - DNA, 16 bp, Homo sapiens
ccacaggcatgtccca

SEQ ID NO: 537413 - DNA, 16 bp, Homo sapiens
ccacatccacagtctc

SEQ ID NO: 537414 - DNA, 21 bp, Homo sapiens
ccacatccggggccagctccg

SEQ ID NO: 537415 - DNA, 16 bp, Homo sapiens
ccacattccaaacaga

SEQ ID NO: 537416 - DNA, 14 bp, Homo sapiens
ccacattctgctgc

SEQ ID NO: 537417 - DNA, 23 bp, Homo sapiens
ccacattctgctgcccccagacc

SEQ ID NO: 537418 - DNA, 15 bp, Homo sapiens
ccaccaaaactgctc

SEQ ID NO: 537419 - DNA, 13 bp, Homo sapiens
tattttgtcactg

SEQ ID NO: 537420 - DNA, 20 bp, Homo sapiens
tattttgtcactgctgtaaa

SEQ ID NO: 537421 - DNA, 21 bp, Homo sapiens
tattttgtcactgctgtaaag

SEQ ID NO: 537422 - DNA, 14 bp, Homo sapiens
tattttgtgagttt

SEQ ID NO: 537423 - DNA, 17 bp, Homo sapiens
tattttgtgagtttgtt

SEQ ID NO: 537424 - DNA, 17 bp, Homo sapiens
tattttttaaaattcta

SEQ ID NO: 537425 - DNA, 11 bp, Homo sapiens
tcaaaaatctg

SEQ ID NO: 537426 - DNA, 13 bp, Homo sapiens
tcaaaaatctgaa

SEQ ID NO: 537427 - DNA, 20 bp, Homo sapiens
tcaaaaatctgaagattgtt

SEQ ID NO: 537428 - DNA, 21 bp, Homo sapiens
tcaaaaattgaagagagatat

SEQ ID NO: 537429 - DNA, 21 bp, Homo sapiens
tcaaaagacatgttgtaaatt

SEQ ID NO: 537430 - DNA, 23 bp, Homo sapiens
tcaaaataaaaagtgacacagca

SEQ ID NO: 537431 - DNA, 15 bp, Homo sapiens
tcaaaataaaaccag

SEQ ID NO: 537432 - DNA, 13 bp, Homo sapiens
tcaaaataaagct

SEQ ID NO: 537433 - DNA, 14 bp, Homo sapiens
tcaaaataaagctt

SEQ ID NO: 537434 - DNA, 14 bp, Homo sapiens
tcaaacaagaatgt

SEQ ID NO: 537435 - DNA, 19 bp, Homo sapiens
tcaaacattagtactttat

SEQ ID NO: 537436 - DNA, 16 bp, Homo sapiens
tcaaaccaatttcttc

SEQ ID NO: 537437 - DNA, 23 bp, Homo sapiens
tcaaagaatcacctaattaattt

SEQ ID NO: 537438 - DNA, 21 bp, Homo sapiens
tcaaagagatgggccttttct

SEQ ID NO: 537439 - DNA, 17 bp, Homo sapiens
tcaaaggagctttctca

SEQ ID NO: 537440 - DNA, 16 bp, Homo sapiens
tcaaagtcatgatgtt

SEQ ID NO: 537441 - DNA, 15 bp, Homo sapiens
tcaaatgggtgatat

SEQ ID NO: 537442 - DNA, 21 bp, Homo sapiens
tcaacaaagaaatattatttg

SEQ ID NO: 537443 - DNA, 21 bp, Homo sapiens
tcaacaaggcaaaaacaaaga

SEQ ID NO: 537444 - DNA, 16 bp, Homo sapiens
tcaacaaggcttgctg

SEQ ID NO: 537445 - DNA, 14 bp, Homo sapiens
tcaacaataaaaca

SEQ ID NO: 537446 - DNA, 15 bp, Homo sapiens
tcaacatgtgtgact

SEQ ID NO: 537447 - DNA, 13 bp, Homo sapiens
tcaaccaaatggt

SEQ ID NO: 537448 - DNA, 14 bp, Homo sapiens
tcaaccaaatggta

SEQ ID NO: 537449 - DNA, 16 bp, Homo sapiens
tcaaccaaatggtaca

SEQ ID NO: 537450 - DNA, 17 bp, Homo sapiens
tcaaccaaatggtacaa

SEQ ID NO: 537451 - DNA, 22 bp, Homo sapiens
tcaacggaagccccctcttcct

SEQ ID NO: 537452 - DNA, 22 bp, Homo sapiens
tcaactgcccctgacttaactt

SEQ ID NO: 537453 - DNA, 18 bp, Homo sapiens
tcaagaaaaaataaatgg

SEQ ID NO: 537454 - DNA, 22 bp, Homo sapiens
tcaagaaaagcatgaaaactga

SEQ ID NO: 537455 - DNA, 18 bp, Homo sapiens
tcaagaaagccagtctta

SEQ ID NO: 537456 - DNA, 20 bp, Homo sapiens
tcaagaaagccagtcttaac

SEQ ID NO: 537457 - DNA, 17 bp, Homo sapiens
tcaagaagatagttgta

SEQ ID NO: 537458 - DNA, 23 bp, Homo sapiens
tcaagaagatagttgtaaagata

SEQ ID NO: 537459 - DNA, 14 bp, Homo sapiens
tcaagaccaaagag

SEQ ID NO: 537460 - DNA, 19 bp, Homo sapiens
tcaagccagcaacacagag

SEQ ID NO: 537461 - DNA, 15 bp, Homo sapiens
tcaagggctttcctg

SEQ ID NO: 537462 - DNA, 14 bp, Homo sapiens
tcaagtctgtgaaa

SEQ ID NO: 537463 - DNA, 19 bp, Homo sapiens
tcaagtggcaaagctgttc

SEQ ID NO: 537464 - DNA, 12 bp, Homo sapiens
tcaataaagttt

SEQ ID NO: 537465 - DNA, 18 bp, Homo sapiens
tcaataacagccgctcca

SEQ ID NO: 537466 - DNA, 24 bp, Homo sapiens
tcaataacagccgctccagagtca

SEQ ID NO: 537467 - DNA, 16 bp, Homo sapiens
tcaataactattgctg

SEQ ID NO: 537468 - DNA, 15 bp, Homo sapiens
tcaatcactgaaaat

SEQ ID NO: 537469 - DNA, 24 bp, Homo sapiens
tcaatctcgtatagaagtcttcat

SEQ ID NO: 537470 - DNA, 12 bp, Homo sapiens
tcaatgtcttcc

SEQ ID NO: 537471 - DNA, 20 bp, Homo sapiens
tcaatgttcacgcaacttga

SEQ ID NO: 537472 - DNA, 22 bp, Homo sapiens
tcaatgttcacgcaacttgaaa

SEQ ID NO: 537473 - DNA, 15 bp, Homo sapiens
tcaattcatagaata

SEQ ID NO: 537474 - DNA, 12 bp, Homo sapiens
tcaattcattgt

SEQ ID NO: 537475 - DNA, 16 bp, Homo sapiens
tcaattcccattgcat

SEQ ID NO: 537476 - DNA, 21 bp, Homo sapiens
tcaatttcagaaactaagaat

SEQ ID NO: 537477 - DNA, 23 bp, Homo sapiens
tcaatttcagaaactaagaatca

SEQ ID NO: 537478 - DNA, 19 bp, Homo sapiens
tcacaaagctatttaagtg

SEQ ID NO: 537479 - DNA, 17 bp, Homo sapiens
tcacaaatattaaaaag

SEQ ID NO: 537480 - DNA, 18 bp, Homo sapiens
tcacactctcttcttact

SEQ ID NO: 537481 - DNA, 22 bp, Homo sapiens
tcacagaacctactgttccttt

SEQ ID NO: 537482 - DNA, 11 bp, Homo sapiens
tcacagccagg

SEQ ID NO: 537483 - DNA, 16 bp, Homo sapiens
tcacagtgtctgtaaa

SEQ ID NO: 537484 - DNA, 13 bp, Homo sapiens
tcacataaaatgc

SEQ ID NO: 537485 - DNA, 15 bp, Homo sapiens
tcaccactccattcc

SEQ ID NO: 537486 - DNA, 16 bp, Homo sapiens
tcaccactccattccc

SEQ ID NO: 537487 - DNA, 17 bp, Homo sapiens
tcaccagtacattctca

SEQ ID NO: 537488 - DNA, 19 bp, Homo sapiens
tcaccagtacattctcagt

SEQ ID NO: 537489 - DNA, 13 bp, Homo sapiens
tcacctgcttctc

SEQ ID NO: 537490 - DNA, 15 bp, Homo sapiens
tcaccttctgtttta

SEQ ID NO: 537491 - DNA, 20 bp, Homo sapiens
tcaccttctgttttagagtt

SEQ ID NO: 537492 - DNA, 14 bp, Homo sapiens
tcacgtcataggaa

SEQ ID NO: 537493 - DNA, 19 bp, Homo sapiens
tcactcagaagtccagagt

SEQ ID NO: 537494 - DNA, 14 bp, Homo sapiens
tcactctaagatgt

SEQ ID NO: 537495 - DNA, 22 bp, Homo sapiens
tcactctaagatgttatatttt

SEQ ID NO: 537496 - DNA, 14 bp, Homo sapiens
tcactgacacagga

SEQ ID NO: 537497 - DNA, 13 bp, Homo sapiens
tcactgcctcccc

SEQ ID NO: 537498 - DNA, 20 bp, Homo sapiens
tcactgcctctttgcagtag

SEQ ID NO: 537499 - DNA, 11 bp, Homo sapiens
tcactgcttca

SEQ ID NO: 537500 - DNA, 17 bp, Homo sapiens
tcactgttataaatttt

SEQ ID NO: 537501 - DNA, 18 bp, Homo sapiens
tcactgttataaattttg

SEQ ID NO: 537502 - DNA, 20 bp, Homo sapiens
tcactgttataaattttgta

SEQ ID NO: 537503 - DNA, 22 bp, Homo sapiens
tcactgttataaattttgtaca

SEQ ID NO: 537504 - DNA, 21 bp, Homo sapiens
tcacttcttctgtccaagcag

SEQ ID NO: 537505 - DNA, 16 bp, Homo sapiens
tcacttgtttgtgttt

SEQ ID NO: 537506 - DNA, 23 bp, Homo sapiens
tcagaaaaaaggttctttgtgta

SEQ ID NO: 537507 - DNA, 20 bp, Homo sapiens
tcagaaacccggcttcctgt

SEQ ID NO: 537508 - DNA, 23 bp, Homo sapiens
tcagaaccattcactggcaaatg

SEQ ID NO: 537509 - DNA, 23 bp, Homo sapiens
tcagaagaagacagcaaaaaaag

SEQ ID NO: 537510 - DNA, 16 bp, Homo sapiens
tcagaagtatatctgt

SEQ ID NO: 537511 - DNA, 17 bp, Homo sapiens
tcagaagtatatctgta

SEQ ID NO: 537512 - DNA, 17 bp, Homo sapiens
tcagaagtgaaaaagac

SEQ ID NO: 537513 - DNA, 20 bp, Homo sapiens
tcagacacctagactctaaa

SEQ ID NO: 537514 - DNA, 22 bp, Homo sapiens
tcagactatccattttacactt

SEQ ID NO: 537515 - DNA, 14 bp, Homo sapiens
tcagagcacagcca

SEQ ID NO: 537516 - DNA, 23 bp, Homo sapiens
tcagaggacacctgtactggaga

SEQ ID NO: 537517 - DNA, 14 bp, Homo sapiens
tcagagtgaagagt

SEQ ID NO: 537518 - DNA, 20 bp, Homo sapiens
tcagagtgaagagtgaagag

SEQ ID NO: 537519 - DNA, 15 bp, Homo sapiens
tcagataatggtaat

SEQ ID NO: 537520 - DNA, 15 bp, Homo sapiens
tcagatttgcacaaa

SEQ ID NO: 537521 - DNA, 18 bp, Homo sapiens
tcagcaaacccaaagatg

SEQ ID NO: 537522 - DNA, 22 bp, Homo sapiens
tcagcaaggcgctaacttgctt

SEQ ID NO: 537523 - DNA, 24 bp, Homo sapiens
tcagcaaggcgctaacttgcttaa

SEQ ID NO: 537524 - DNA, 22 bp, Homo sapiens
tcagcacagcctcacccctgca

SEQ ID NO: 537525 - DNA, 21 bp, Homo sapiens
tcagcacatagggttcccacg

SEQ ID NO: 537526 - DNA, 16 bp, Homo sapiens
tcagcaccacgtgcca

SEQ ID NO: 537527 - DNA, 16 bp, Homo sapiens
aaacatttttttaagc

SEQ ID NO: 537528 - DNA, 23 bp, Homo sapiens
aaaccaaaggacattatgtgtgc

SEQ ID NO: 537529 - DNA, 16 bp, Homo sapiens
aaaccaatttgttctg

SEQ ID NO: 537530 - DNA, 20 bp, Homo sapiens
aaaccagaaagaggaataaa

SEQ ID NO: 537531 - DNA, 23 bp, Homo sapiens
aaaccagtttagatttcaagaaa

SEQ ID NO: 537532 - DNA, 22 bp, Homo sapiens
aaacccaagttatgcatcccca

SEQ ID NO: 537533 - DNA, 21 bp, Homo sapiens
aaaccctatgccttttgtagc

SEQ ID NO: 537534 - DNA, 14 bp, Homo sapiens
aaaccctgtcaaac

SEQ ID NO: 537535 - DNA, 13 bp, Homo sapiens
aaacctgaacaaa

SEQ ID NO: 537536 - DNA, 12 bp, Homo sapiens
aaacctgtctga

SEQ ID NO: 537537 - DNA, 13 bp, Homo sapiens
aaacgaaagctgg

SEQ ID NO: 537538 - DNA, 18 bp, Homo sapiens
aaacgacaaatctgtctg

SEQ ID NO: 537539 - DNA, 17 bp, Homo sapiens
aaacggttaaaactgtc

SEQ ID NO: 537540 - DNA, 21 bp, Homo sapiens
aaacgtattttgatcagtgtt

SEQ ID NO: 537541 - DNA, 13 bp, Homo sapiens
aaacgtcttttta

SEQ ID NO: 537542 - DNA, 15 bp, Homo sapiens
aaacgtctttttaag

SEQ ID NO: 537543 - DNA, 18 bp, Homo sapiens
aaacgtgtatgtttttca

SEQ ID NO: 537544 - DNA, 15 bp, Homo sapiens
aaactaggctccttc

SEQ ID NO: 537545 - DNA, 18 bp, Homo sapiens
aaactcaaccaaatggta

SEQ ID NO: 537546 - DNA, 15 bp, Homo sapiens
aaactcattttgctt

SEQ ID NO: 537547 - DNA, 13 bp, Homo sapiens
aaactgatgcttt

SEQ ID NO: 537548 - DNA, 17 bp, Homo sapiens
aaactgatgctttcaga

SEQ ID NO: 537549 - DNA, 14 bp, Homo sapiens
aaactgcacatgat

SEQ ID NO: 537550 - DNA, 21 bp, Homo sapiens
aaactgcacatgatttcacaa

SEQ ID NO: 537551 - DNA, 15 bp, Homo sapiens
aaactggaataagaa

SEQ ID NO: 537552 - DNA, 12 bp, Homo sapiens
aaactgtacttt

SEQ ID NO: 537553 - DNA, 15 bp, Homo sapiens
aaacttaacagatca

SEQ ID NO: 537554 - DNA, 22 bp, Homo sapiens
aaacttactatggtatatattt

SEQ ID NO: 537555 - DNA, 15 bp, Homo sapiens
aaacttcagagaaat

SEQ ID NO: 537556 - DNA, 15 bp, Homo sapiens
aaactttaacttcca

SEQ ID NO: 537557 - DNA, 21 bp, Homo sapiens
aaactttaacttccactttgt

SEQ ID NO: 537558 - DNA, 12 bp, Homo sapiens
aaactttgaaat

SEQ ID NO: 537559 - DNA, 15 bp, Homo sapiens
aaactttgaaatata

SEQ ID NO: 537560 - DNA, 12 bp, Homo sapiens
aaacttttatgc

SEQ ID NO: 537561 - DNA, 22 bp, Homo sapiens
aaagaaaagttcttaaaacact

SEQ ID NO: 537562 - DNA, 13 bp, Homo sapiens
aaagaaagcagaa

SEQ ID NO: 537563 - DNA, 23 bp, Homo sapiens
aaagaaatctatagaaagtgttc

SEQ ID NO: 537564 - DNA, 20 bp, Homo sapiens
aaagaactatcttcatctga

SEQ ID NO: 537565 - DNA, 22 bp, Homo sapiens
aaagaatattcagagaatatca

SEQ ID NO: 537566 - DNA, 22 bp, Homo sapiens
aaagaatcacctaattaatttc

SEQ ID NO: 537567 - DNA, 11 bp, Homo sapiens
aaagacaaata

SEQ ID NO: 537568 - DNA, 12 bp, Homo sapiens
aaagacaaatag

SEQ ID NO: 537569 - DNA, 14 bp, Homo sapiens
aaagacaaatagta

SEQ ID NO: 537570 - DNA, 14 bp, Homo sapiens
aaagacatgttgta

SEQ ID NO: 537571 - DNA, 16 bp, Homo sapiens
aaagacattcttagtt

SEQ ID NO: 537572 - DNA, 22 bp, Homo sapiens
aaagagcaggatagctcttcct

SEQ ID NO: 537573 - DNA, 21 bp, Homo sapiens
aaagataccttaaaatttgaa

SEQ ID NO: 537574 - DNA, 17 bp, Homo sapiens
aaagatcaaaataaaaa

SEQ ID NO: 537575 - DNA, 14 bp, Homo sapiens
aaagatctcctgtg

SEQ ID NO: 537576 - DNA, 21 bp, Homo sapiens
aaagatgttaacagtatttta

SEQ ID NO: 537577 - DNA, 13 bp, Homo sapiens
aaagcaaaatatt

SEQ ID NO: 537578 - DNA, 17 bp, Homo sapiens
aaagcaaaatatttgtg

SEQ ID NO: 537579 - DNA, 13 bp, Homo sapiens
aaagcaacagctg

SEQ ID NO: 537580 - DNA, 19 bp, Homo sapiens
aaagcacaggagacactgt

SEQ ID NO: 537581 - DNA, 15 bp, Homo sapiens
aaagcacctcttgaa

SEQ ID NO: 537582 - DNA, 13 bp, Homo sapiens
aaagccagtctta

SEQ ID NO: 537583 - DNA, 16 bp, Homo sapiens
aaagcctcagaaaggg

SEQ ID NO: 537584 - DNA, 14 bp, Homo sapiens
aaagctatttaagt

SEQ ID NO: 537585 - DNA, 16 bp, Homo sapiens
aaagctgttcttcctg

SEQ ID NO: 537586 - DNA, 15 bp, Homo sapiens
aaagctgtttcattt

SEQ ID NO: 537587 - DNA, 13 bp, Homo sapiens
aaagcttttgcat

SEQ ID NO: 537588 - DNA, 14 bp, Homo sapiens
aaaggacattatgt

SEQ ID NO: 537589 - DNA, 15 bp, Homo sapiens
aaaggacattatgtg

SEQ ID NO: 537590 - DNA, 15 bp, Homo sapiens
aaaggagctttctca

SEQ ID NO: 537591 - DNA, 17 bp, Homo sapiens
aaaggaggaatcagacc

SEQ ID NO: 537592 - DNA, 17 bp, Homo sapiens
aaaggcagctgttgtct

SEQ ID NO: 537593 - DNA, 14 bp, Homo sapiens
aaaggctgtattca

SEQ ID NO: 537594 - DNA, 18 bp, Homo sapiens
aaaggctgtattcagcaa

SEQ ID NO: 537595 - DNA, 20 bp, Homo sapiens
aaaggctgtattcagcaagg

SEQ ID NO: 537596 - DNA, 13 bp, Homo sapiens
aaaggcttctcca

SEQ ID NO: 537597 - DNA, 12 bp, Homo sapiens
aaagggacatga

SEQ ID NO: 537598 - DNA, 18 bp, Homo sapiens
aaagtacaggtactttgt

SEQ ID NO: 537599 - DNA, 14 bp, Homo sapiens
aaagtaccacactg

SEQ ID NO: 537600 - DNA, 15 bp, Homo sapiens
aaagtaccacactga

SEQ ID NO: 537601 - DNA, 19 bp, Homo sapiens
aaagtaccacactgagttc

SEQ ID NO: 537602 - DNA, 19 bp, Homo sapiens
aaagtatcgggggctgggg

SEQ ID NO: 537603 - DNA, 13 bp, Homo sapiens
aaagtattgccaa

SEQ ID NO: 537604 - DNA, 14 bp, Homo sapiens
aaagtattgccaaa

SEQ ID NO: 537605 - DNA, 15 bp, Homo sapiens
aaagtcatgatgttt

SEQ ID NO: 537606 - DNA, 22 bp, Homo sapiens
aaagtcatgatgtttttaaaat

SEQ ID NO: 537607 - DNA, 17 bp, Homo sapiens
aaagtctcctgtatcat

SEQ ID NO: 537608 - DNA, 14 bp, Homo sapiens
aaagtcttttaaaa

SEQ ID NO: 537609 - DNA, 15 bp, Homo sapiens
aaagtcttttaaaaa

SEQ ID NO: 537610 - DNA, 14 bp, Homo sapiens
aaagtgacacagca

SEQ ID NO: 537611 - DNA, 19 bp, Homo sapiens
aaagtgccaaaataaagtc

SEQ ID NO: 537612 - DNA, 20 bp, Homo sapiens
aaagtggcacctgtctgctc

SEQ ID NO: 537613 - DNA, 17 bp, Homo sapiens
aaagtgttctgttacaa

SEQ ID NO: 537614 - DNA, 20 bp, Homo sapiens
aaagtgttctgttacaaaat

SEQ ID NO: 537615 - DNA, 22 bp, Homo sapiens
aaagtttaaagaagagtaacac

SEQ ID NO: 537616 - DNA, 21 bp, Homo sapiens
aaagtttcaaaaatctgaaga

SEQ ID NO: 537617 - DNA, 14 bp, Homo sapiens
aaagtttgatcttc

SEQ ID NO: 537618 - DNA, 15 bp, Homo sapiens
aaataaagtctgtca

SEQ ID NO: 537619 - DNA, 18 bp, Homo sapiens
aaataatcatacacagaa

SEQ ID NO: 537620 - DNA, 15 bp, Homo sapiens
aaataattaaaacaa

SEQ ID NO: 537621 - DNA, 17 bp, Homo sapiens
aaatacaaaatgattgt

SEQ ID NO: 537622 - DNA, 15 bp, Homo sapiens
aaatacacatacata

SEQ ID NO: 537623 - DNA, 18 bp, Homo sapiens
aaatacacatacatatat

SEQ ID NO: 537624 - DNA, 14 bp, Homo sapiens
aaatacacgtgtat

SEQ ID NO: 537625 - DNA, 16 bp, Homo sapiens
aaatacacgtgtatat

SEQ ID NO: 537626 - DNA, 20 bp, Homo sapiens
aaatagctataaatagtgaa

SEQ ID NO: 537627 - DNA, 23 bp, Homo sapiens
aaatagttgtccatattttcaca

SEQ ID NO: 537628 - DNA, 13 bp, Homo sapiens
aaatatatatagt

SEQ ID NO: 537629 - DNA, 22 bp, Homo sapiens
aaatatatggtctaatgtttaa

SEQ ID NO: 537630 - DNA, 17 bp, Homo sapiens
aaatatgagattggaaa

SEQ ID NO: 537631 - DNA, 14 bp, Homo sapiens
aaatatgtaaactt

SEQ ID NO: 537632 - DNA, 21 bp, Homo sapiens
aaatatgtccatatctaacca

SEQ ID NO: 537633 - DNA, 15 bp, Homo sapiens
aaatatgtgaaggac

SEQ ID NO: 537634 - DNA, 20 bp, Homo sapiens
aaatatgtgaaggaccttca

SEQ ID NO: 537635 - DNA, 12 bp, Homo sapiens
aaatattaaaaa

SEQ ID NO: 537636 - DNA, 17 bp, Homo sapiens
aaatattaaaaagtctt

SEQ ID NO: 537637 - DNA, 12 bp, Homo sapiens
aaatattatgcc

SEQ ID NO: 537638 - DNA, 15 bp, Homo sapiens
aaatattttcaaaga

SEQ ID NO: 537639 - DNA, 13 bp, Homo sapiens
aaatattttgtca

SEQ ID NO: 537640 - DNA, 15 bp, Homo sapiens
aaatattttgtcact

SEQ ID NO: 537641 - DNA, 22 bp, Homo sapiens
aaatattttgtcactgctgtaa

SEQ ID NO: 537642 - DNA, 19 bp, Homo sapiens
aaatcagtttttgttctta

SEQ ID NO: 537643 - DNA, 19 bp, Homo sapiens
aaatcatgtggcctaatat

SEQ ID NO: 537644 - DNA, 21 bp, Homo sapiens
aaatcatgtggcctaatattg

SEQ ID NO: 537645 - DNA, 23 bp, Homo sapiens
aaatcatgtggcctaatattgaa

SEQ ID NO: 537646 - DNA, 11 bp, Homo sapiens
aaatccagaaa

SEQ ID NO: 537647 - DNA, 23 bp, Homo sapiens
aaatccagaaacttgttcttcca

SEQ ID NO: 537648 - DNA, 15 bp, Homo sapiens
aaatcccattgtatt

SEQ ID NO: 537649 - DNA, 22 bp, Homo sapiens
aaatctaaattaacttctattt

SEQ ID NO: 537650 - DNA, 14 bp, Homo sapiens
aaatctatagaaag

SEQ ID NO: 537651 - DNA, 21 bp, Homo sapiens
aaatctcaaaagatctcctgt

SEQ ID NO: 537652 - DNA, 13 bp, Homo sapiens
aaatctcttctgt

SEQ ID NO: 537653 - DNA, 15 bp, Homo sapiens
aaatctgaagattgt

SEQ ID NO: 537654 - DNA, 19 bp, Homo sapiens
aaatctgaagattgtttat

SEQ ID NO: 537655 - DNA, 12 bp, Homo sapiens
aaatctgtctgc

SEQ ID NO: 537656 - DNA, 19 bp, Homo sapiens
aaatcttattaaagtttca

SEQ ID NO: 537657 - DNA, 20 bp, Homo sapiens
aaatcttattaaagtttcaa

SEQ ID NO: 537658 - DNA, 23 bp, Homo sapiens
aaatcttcctggtcgaaagttag

SEQ ID NO: 537659 - DNA, 12 bp, Homo sapiens
aaatgaaatact

SEQ ID NO: 537660 - DNA, 13 bp, Homo sapiens
aaatgaaatactt

SEQ ID NO: 537661 - DNA, 15 bp, Homo sapiens
aaatgaaatttaagc

SEQ ID NO: 537662 - DNA, 18 bp, Homo sapiens
aaatgaaatttaagcaca

SEQ ID NO: 537663 - DNA, 21 bp, Homo sapiens
aaatgagtcacttacttcata

SEQ ID NO: 537664 - DNA, 20 bp, Homo sapiens
aaatgatatgtctttaaaat

SEQ ID NO: 537665 - DNA, 13 bp, Homo sapiens
aagcctttgaagt

SEQ ID NO: 537666 - DNA, 22 bp, Homo sapiens
aagcggctcaagcccaggaggg

SEQ ID NO: 537667 - DNA, 20 bp, Homo sapiens
aagctaggaaaagaaatcta

SEQ ID NO: 537668 - DNA, 16 bp, Homo sapiens
aagctataaaagccca

SEQ ID NO: 537669 - DNA, 20 bp, Homo sapiens
aagctatttaagtggactgt

SEQ ID NO: 537670 - DNA, 22 bp, Homo sapiens
aagctatttaagtggactgtat

SEQ ID NO: 537671 - DNA, 22 bp, Homo sapiens
aagctcgtagaaacaagacaag

SEQ ID NO: 537672 - DNA, 15 bp, Homo sapiens
aagctgctgcacagc

SEQ ID NO: 537673 - DNA, 16 bp, Homo sapiens
aagctggcaggagaca

SEQ ID NO: 537674 - DNA, 13 bp, Homo sapiens
aagcttttgcata

SEQ ID NO: 537675 - DNA, 14 bp, Homo sapiens
aaggaaacagattt

SEQ ID NO: 537676 - DNA, 18 bp, Homo sapiens
aaggaaagccaaatttta

SEQ ID NO: 537677 - DNA, 17 bp, Homo sapiens
aaggacattatgtgtgc

SEQ ID NO: 537678 - DNA, 22 bp, Homo sapiens
aaggaccttcactctaagatgt

SEQ ID NO: 537679 - DNA, 23 bp, Homo sapiens
aaggaccttcactctaagatgtt

SEQ ID NO: 537680 - DNA, 24 bp, Homo sapiens
aaggaccttcactctaagatgtta

SEQ ID NO: 537681 - DNA, 13 bp, Homo sapiens
aaggacttcctga

SEQ ID NO: 537682 - DNA, 16 bp, Homo sapiens
aaggacttcctgctac

SEQ ID NO: 537683 - DNA, 12 bp, Homo sapiens
aaggagaaaaaa

SEQ ID NO: 537684 - DNA, 13 bp, Homo sapiens
aaggagctttctc

SEQ ID NO: 537685 - DNA, 16 bp, Homo sapiens
aaggagctttctcaat

SEQ ID NO: 537686 - DNA, 19 bp, Homo sapiens
aaggaggctccaggcagca

SEQ ID NO: 537687 - DNA, 15 bp, Homo sapiens
aaggcaatgatatgg

SEQ ID NO: 537688 - DNA, 21 bp, Homo sapiens
aaggcagctgttgtctcttct

SEQ ID NO: 537689 - DNA, 21 bp, Homo sapiens
aaggcatgtggcctttatctc

SEQ ID NO: 537690 - DNA, 22 bp, Homo sapiens
aaggcatgtggcctttatctca

SEQ ID NO: 537691 - DNA, 17 bp, Homo sapiens
aaggcatttattgccat

SEQ ID NO: 537692 - DNA, 15 bp, Homo sapiens
aaggcatttcccacc

SEQ ID NO: 537693 - DNA, 21 bp, Homo sapiens
aaggccagtggaaattcaggt

SEQ ID NO: 537694 - DNA, 14 bp, Homo sapiens
aaggccccctgcct

SEQ ID NO: 537695 - DNA, 17 bp, Homo sapiens
aaggctgtattcagcaa

SEQ ID NO: 537696 - DNA, 15 bp, Homo sapiens
aaggggaattaacaa

SEQ ID NO: 537697 - DNA, 17 bp, Homo sapiens
aaggtagaatgaccttg

SEQ ID NO: 537698 - DNA, 20 bp, Homo sapiens
aaggtagaatgaccttgtaa

SEQ ID NO: 537699 - DNA, 22 bp, Homo sapiens
aaggtagaatgaccttgtaatg

SEQ ID NO: 537700 - DNA, 18 bp, Homo sapiens
aaggtcagtgttataaaa

SEQ ID NO: 537701 - DNA, 22 bp, Homo sapiens
aaggtcagtgttataaaatctg

SEQ ID NO: 537702 - DNA, 17 bp, Homo sapiens
aaggtctctctggctct

SEQ ID NO: 537703 - DNA, 21 bp, Homo sapiens
aaggtctctctggctctagga

SEQ ID NO: 537704 - DNA, 19 bp, Homo sapiens
aaggtgagaggaaatgttg

SEQ ID NO: 537705 - DNA, 17 bp, Homo sapiens
aaggtttcactgttcat

SEQ ID NO: 537706 - DNA, 17 bp, Homo sapiens
aagtaaacctgaacaaa

SEQ ID NO: 537707 - DNA, 16 bp, Homo sapiens
aagtaaatctcttctg

SEQ ID NO: 537708 - DNA, 17 bp, Homo sapiens
aagtaaatctcttctgt

SEQ ID NO: 537709 - DNA, 22 bp, Homo sapiens
aagtaacttgtcttaaataaaa

SEQ ID NO: 537710 - DNA, 18 bp, Homo sapiens
aagtacaggtactttgtc

SEQ ID NO: 537711 - DNA, 16 bp, Homo sapiens
aagtaccacactgagt

SEQ ID NO: 537712 - DNA, 23 bp, Homo sapiens
aagtactgagcagtgatattctt

SEQ ID NO: 537713 - DNA, 19 bp, Homo sapiens
aagtagacttcatttttcc

SEQ ID NO: 537714 - DNA, 12 bp, Homo sapiens
aagtagagtata

SEQ ID NO: 537715 - DNA, 20 bp, Homo sapiens
aagtagagtatattgaaaag

SEQ ID NO: 537716 - DNA, 22 bp, Homo sapiens
aagtagagtatattgaaaagaa

SEQ ID NO: 537717 - DNA, 19 bp, Homo sapiens
aagtatcatctaaatatta

SEQ ID NO: 537718 - DNA, 14 bp, Homo sapiens
aagtatgaatattt

SEQ ID NO: 537719 - DNA, 13 bp, Homo sapiens
aagtattattcaa

SEQ ID NO: 537720 - DNA, 17 bp, Homo sapiens
aagtattgccaaacatt

SEQ ID NO: 537721 - DNA, 19 bp, Homo sapiens
aagtcactgcaaaaccagg

SEQ ID NO: 537722 - DNA, 13 bp, Homo sapiens
aagtcatgatgtt

SEQ ID NO: 537723 - DNA, 19 bp, Homo sapiens
aagtcatgatgtttttaaa

SEQ ID NO: 537724 - DNA, 22 bp, Homo sapiens
aagtcatgatgtttttaaaatc

SEQ ID NO: 537725 - DNA, 23 bp, Homo sapiens
aagtcatgatgtttttaaaatct

SEQ ID NO: 537726 - DNA, 19 bp, Homo sapiens
aagtcatgctcccctgtgc

SEQ ID NO: 537727 - DNA, 21 bp, Homo sapiens
aagtcatgctcccctgtgcca

SEQ ID NO: 537728 - DNA, 11 bp, Homo sapiens
aagtccctgag

SEQ ID NO: 537729 - DNA, 15 bp, Homo sapiens
aagtctcctgtatca

SEQ ID NO: 537730 - DNA, 15 bp, Homo sapiens
aagtcttactgtttt

SEQ ID NO: 537731 - DNA, 16 bp, Homo sapiens
aagtcttcatgaaatg

SEQ ID NO: 537732 - DNA, 12 bp, Homo sapiens
aagtcttttaaa

SEQ ID NO: 537733 - DNA, 22 bp, Homo sapiens
aagtgcacacagaaatatatat

SEQ ID NO: 537734 - DNA, 14 bp, Homo sapiens
aagtgccaaaataa

SEQ ID NO: 537735 - DNA, 15 bp, Homo sapiens
aagtgccaaaataaa

SEQ ID NO: 537736 - DNA, 17 bp, Homo sapiens
aagtgccaaaataaagt

SEQ ID NO: 537737 - DNA, 15 bp, Homo sapiens
aagtggactgtattt

SEQ ID NO: 537738 - DNA, 15 bp, Homo sapiens
aagtgtactggattt

SEQ ID NO: 537739 - DNA, 19 bp, Homo sapiens
aagtgtctcaaaggagctt

SEQ ID NO: 537740 - DNA, 17 bp, Homo sapiens
aagtgttctgtggctga

SEQ ID NO: 537741 - DNA, 16 bp, Homo sapiens
aagttctgcctctgat

SEQ ID NO: 537742 - DNA, 20 bp, Homo sapiens
aagttgactctgctcttgca

SEQ ID NO: 537743 - DNA, 18 bp, Homo sapiens
aagttgctgcagattcct

SEQ ID NO: 537744 - DNA, 23 bp, Homo sapiens
aagttggaaacactaaatgttaa

SEQ ID NO: 537745 - DNA, 15 bp, Homo sapiens
aagttggtattttat

SEQ ID NO: 537746 - DNA, 20 bp, Homo sapiens
aagttggtattttataagca

SEQ ID NO: 537747 - DNA, 23 bp, Homo sapiens
aagttggtattttataagcacag

SEQ ID NO: 537748 - DNA, 15 bp, Homo sapiens
aagttgtgatctgtt

SEQ ID NO: 537749 - DNA, 12 bp, Homo sapiens
aagtttgataaa

SEQ ID NO: 537750 - DNA, 20 bp, Homo sapiens
aagtttgataaatagtgtta

SEQ ID NO: 537751 - DNA, 21 bp, Homo sapiens
aagtttgataaatagtgttat

SEQ ID NO: 537752 - DNA, 11 bp, Homo sapiens
aagtttgcaac

SEQ ID NO: 537753 - DNA, 21 bp, Homo sapiens
aagttttgtgaaatttttcat

SEQ ID NO: 537754 - DNA, 23 bp, Homo sapiens
aagtttttatacctgtacacaca

SEQ ID NO: 537755 - DNA, 17 bp, Homo sapiens
aataaaaaaagaaaaaa

SEQ ID NO: 537756 - DNA, 19 bp, Homo sapiens
aataaaaccagaaagagga

SEQ ID NO: 537757 - DNA, 23 bp, Homo sapiens
aataaaagttaataacagctcct

SEQ ID NO: 537758 - DNA, 12 bp, Homo sapiens
aataaacacaga

SEQ ID NO: 537759 - DNA, 17 bp, Homo sapiens
aataaaccaaaggacat

SEQ ID NO: 537760 - DNA, 12 bp, Homo sapiens
aataaaccagac

SEQ ID NO: 537761 - DNA, 17 bp, Homo sapiens
aataaagcgaaaaactc

SEQ ID NO: 537762 - DNA, 16 bp, Homo sapiens
aataaaggaggaatca

SEQ ID NO: 537763 - DNA, 23 bp, Homo sapiens
aataaaggcagctgttgtctctt

SEQ ID NO: 537764 - DNA, 18 bp, Homo sapiens
aataaagtatgaatattt

SEQ ID NO: 537765 - DNA, 15 bp, Homo sapiens
aataaagtctgtcat

SEQ ID NO: 537766 - DNA, 19 bp, Homo sapiens
aataaagtttgatcttcct

SEQ ID NO: 537767 - DNA, 10 bp, Homo sapiens
aataaatgtt

SEQ ID NO: 537768 - DNA, 20 bp, Homo sapiens
aataacagccgctccagagt

SEQ ID NO: 537769 - DNA, 15 bp, Homo sapiens
aataaccctgaatca

SEQ ID NO: 537770 - DNA, 18 bp, Homo sapiens
aataaccctgaatcagag

SEQ ID NO: 537771 - DNA, 13 bp, Homo sapiens
aataactattgct

SEQ ID NO: 537772 - DNA, 20 bp, Homo sapiens
aataacttacaagactgtaa

SEQ ID NO: 537773 - DNA, 17 bp, Homo sapiens
aataagaaacagtttaa

SEQ ID NO: 537774 - DNA, 21 bp, Homo sapiens
aataataattaggttaacatt

SEQ ID NO: 537775 - DNA, 19 bp, Homo sapiens
aataatcctgcaaagtaca

SEQ ID NO: 537776 - DNA, 11 bp, Homo sapiens
aataatgaaga

SEQ ID NO: 537777 - DNA, 18 bp, Homo sapiens
aataatgaagatctttgt

SEQ ID NO: 537778 - DNA, 13 bp, Homo sapiens
aatacaaaatgat

SEQ ID NO: 537779 - DNA, 18 bp, Homo sapiens
aatacaagtttgaacagg

SEQ ID NO: 537780 - DNA, 13 bp, Homo sapiens
aatagacataaat

SEQ ID NO: 537781 - DNA, 18 bp, Homo sapiens
aatagcagtggcaaaata

SEQ ID NO: 537782 - DNA, 20 bp, Homo sapiens
aatagcagtggcaaaatatt

SEQ ID NO: 537783 - DNA, 21 bp, Homo sapiens
aatagcagtggcaaaatatta

SEQ ID NO: 537784 - DNA, 14 bp, Homo sapiens
aatagcctcacctt

SEQ ID NO: 537785 - DNA, 22 bp, Homo sapiens
aatagctataaatagtgaaaat

SEQ ID NO: 537786 - DNA, 15 bp, Homo sapiens
aataggacttgtttt

SEQ ID NO: 537787 - DNA, 18 bp, Homo sapiens
aatagtcttttgcatgtc

SEQ ID NO: 537788 - DNA, 22 bp, Homo sapiens
aatataactgccttaaaacttt

SEQ ID NO: 537789 - DNA, 19 bp, Homo sapiens
aatataatggaagagaaat

SEQ ID NO: 537790 - DNA, 22 bp, Homo sapiens
aatatactccttaaaaatgtat

SEQ ID NO: 537791 - DNA, 20 bp, Homo sapiens
aatatataaaaatatatata

SEQ ID NO: 537792 - DNA, 13 bp, Homo sapiens
aatatatagcatt

SEQ ID NO: 537793 - DNA, 24 bp, Homo sapiens
aatatatttgcataatatgcatat

SEQ ID NO: 537794 - DNA, 14 bp, Homo sapiens
aatatattttgtat

SEQ ID NO: 537795 - DNA, 16 bp, Homo sapiens
aatatattttgtatgc

SEQ ID NO: 537796 - DNA, 18 bp, Homo sapiens
aatatattttgtatgcaa

SEQ ID NO: 537797 - DNA, 18 bp, Homo sapiens
aatatcagttacagtggc

SEQ ID NO: 537798 - DNA, 16 bp, Homo sapiens
aatatccaagcccagc

SEQ ID NO: 537799 - DNA, 19 bp, Homo sapiens
aatatccgtgccaggaaaa

SEQ ID NO: 537800 - DNA, 18 bp, Homo sapiens
aatatgcactaagtctct

SEQ ID NO: 537801 - DNA, 14 bp, Homo sapiens
acatcatctgtaag

SEQ ID NO: 537802 - DNA, 11 bp, Homo sapiens
acatccatgtc

SEQ ID NO: 537803 - DNA, 13 bp, Homo sapiens
acatccatgtcct

SEQ ID NO: 537804 - DNA, 13 bp, Homo sapiens
acatccattccca

SEQ ID NO: 537805 - DNA, 18 bp, Homo sapiens
acatccattcccaagaaa

SEQ ID NO: 537806 - DNA, 18 bp, Homo sapiens
acatctcccctttgctaa

SEQ ID NO: 537807 - DNA, 11 bp, Homo sapiens
acatctcctta

SEQ ID NO: 537808 - DNA, 15 bp, Homo sapiens
acatctctgaaagca

SEQ ID NO: 537809 - DNA, 18 bp, Homo sapiens
acatctctgaaagcacag

SEQ ID NO: 537810 - DNA, 13 bp, Homo sapiens
acatctctgtaaa

SEQ ID NO: 537811 - DNA, 15 bp, Homo sapiens
acatctgatatcagg

SEQ ID NO: 537812 - DNA, 20 bp, Homo sapiens
acatctgcagtgttctgtga

SEQ ID NO: 537813 - DNA, 23 bp, Homo sapiens
acatcttccacaggtctcagaat

SEQ ID NO: 537814 - DNA, 18 bp, Homo sapiens
acatgacccgtacacacc

SEQ ID NO: 537815 - DNA, 16 bp, Homo sapiens
acatgatgatttcaga

SEQ ID NO: 537816 - DNA, 12 bp, Homo sapiens
acatgatttcac

SEQ ID NO: 537817 - DNA, 13 bp, Homo sapiens
acatgcacacaca

SEQ ID NO: 537818 - DNA, 14 bp, Homo sapiens
acatgccagaagga

SEQ ID NO: 537819 - DNA, 21 bp, Homo sapiens
acatgccagaaggaatcttct

SEQ ID NO: 537820 - DNA, 23 bp, Homo sapiens
acatgccagaaggaatcttctca

SEQ ID NO: 537821 - DNA, 14 bp, Homo sapiens
acatgcctttccag

SEQ ID NO: 537822 - DNA, 17 bp, Homo sapiens
acatgcctttccagtgc

SEQ ID NO: 537823 - DNA, 21 bp, Homo sapiens
acatgcctttccagtgctgct

SEQ ID NO: 537824 - DNA, 17 bp, Homo sapiens
acatgcgggctgggcag

SEQ ID NO: 537825 - DNA, 19 bp, Homo sapiens
acatgcgggctgggcagct

SEQ ID NO: 537826 - DNA, 18 bp, Homo sapiens
acatgcttagcttatctt

SEQ ID NO: 537827 - DNA, 19 bp, Homo sapiens
acatgcttagcttatcttt

SEQ ID NO: 537828 - DNA, 15 bp, Homo sapiens
acatggatacttcct

SEQ ID NO: 537829 - DNA, 11 bp, Homo sapiens
acatgtgtgac

SEQ ID NO: 537830 - DNA, 18 bp, Homo sapiens
acatgtgtgtatatatgt

SEQ ID NO: 537831 - DNA, 14 bp, Homo sapiens
acatgttgtaaatt

SEQ ID NO: 537832 - DNA, 15 bp, Homo sapiens
acatgttttcaaatg

SEQ ID NO: 537833 - DNA, 20 bp, Homo sapiens
acattaatggtctaaaaata

SEQ ID NO: 537834 - DNA, 14 bp, Homo sapiens
acattaatgttgat

SEQ ID NO: 537835 - DNA, 15 bp, Homo sapiens
acattaatgttgatt

SEQ ID NO: 537836 - DNA, 23 bp, Homo sapiens
acattaatgttgatttctagtta

SEQ ID NO: 537837 - DNA, 23 bp, Homo sapiens
acattagtactttatagaagaat

SEQ ID NO: 537838 - DNA, 14 bp, Homo sapiens
acattatgtgtgca

SEQ ID NO: 537839 - DNA, 16 bp, Homo sapiens
acattccctggaattg

SEQ ID NO: 537840 - DNA, 17 bp, Homo sapiens
acattctgctgccccca

SEQ ID NO: 537841 - DNA, 22 bp, Homo sapiens
acattgcccacacctgcctctg

SEQ ID NO: 537842 - DNA, 21 bp, Homo sapiens
acattggaagcaggttaaatg

SEQ ID NO: 537843 - DNA, 22 bp, Homo sapiens
acattggaagcaggttaaatgt

SEQ ID NO: 537844 - DNA, 23 bp, Homo sapiens
acattggaagcaggttaaatgtt

SEQ ID NO: 537845 - DNA, 21 bp, Homo sapiens
acattgtaaacgtattttgat

SEQ ID NO: 537846 - DNA, 20 bp, Homo sapiens
acatttcctttttctatttt

SEQ ID NO: 537847 - DNA, 12 bp, Homo sapiens
acatttctaact

SEQ ID NO: 537848 - DNA, 14 bp, Homo sapiens
acatttctaactct

SEQ ID NO: 537849 - DNA, 11 bp, Homo sapiens
acatttgtcat

SEQ ID NO: 537850 - DNA, 19 bp, Homo sapiens
acatttgtcattttcatta

SEQ ID NO: 537851 - DNA, 12 bp, Homo sapiens
acattttctggt

SEQ ID NO: 537852 - DNA, 19 bp, Homo sapiens
acatttttgatcaaatgta

SEQ ID NO: 537853 - DNA, 23 bp, Homo sapiens
acatttttgatcaaatgtacatc

SEQ ID NO: 537854 - DNA, 21 bp, Homo sapiens
acatttttttaagcaacactt

SEQ ID NO: 537855 - DNA, 20 bp, Homo sapiens
accaaaaactagacattatt

SEQ ID NO: 537856 - DNA, 13 bp, Homo sapiens
accaaaactgctc

SEQ ID NO: 537857 - DNA, 14 bp, Homo sapiens
accaaaactgctcc

SEQ ID NO: 537858 - DNA, 15 bp, Homo sapiens
accaaactcccatca

SEQ ID NO: 537859 - DNA, 19 bp, Homo sapiens
accaaaggacattatgtgt

SEQ ID NO: 537860 - DNA, 14 bp, Homo sapiens
accaactccagact

SEQ ID NO: 537861 - DNA, 13 bp, Homo sapiens
accaactttcaag

SEQ ID NO: 537862 - DNA, 14 bp, Homo sapiens
accaactttcaaga

SEQ ID NO: 537863 - DNA, 15 bp, Homo sapiens
accaactttcaagaa

SEQ ID NO: 537864 - DNA, 18 bp, Homo sapiens
accaagttggtcttactt

SEQ ID NO: 537865 - DNA, 13 bp, Homo sapiens
accaataaaggag

SEQ ID NO: 537866 - DNA, 19 bp, Homo sapiens
accaataaaggaggaatca

SEQ ID NO: 537867 - DNA, 21 bp, Homo sapiens
accaataaaggaggaatcaga

SEQ ID NO: 537868 - DNA, 17 bp, Homo sapiens
accaatcgggagtagca

SEQ ID NO: 537869 - DNA, 18 bp, Homo sapiens
accaatcgggagtagcaa

SEQ ID NO: 537870 - DNA, 22 bp, Homo sapiens
accaatgccaagataattcact

SEQ ID NO: 537871 - DNA, 12 bp, Homo sapiens
accaatttcttc

SEQ ID NO: 537872 - DNA, 14 bp, Homo sapiens
accaatttcttcct

SEQ ID NO: 537873 - DNA, 15 bp, Homo sapiens
accaattttaactta

SEQ ID NO: 537874 - DNA, 16 bp, Homo sapiens
accacagacacacaca

SEQ ID NO: 537875 - DNA, 18 bp, Homo sapiens
accacagacacacacacg

SEQ ID NO: 537876 - DNA, 20 bp, Homo sapiens
accacagacacacacacgca

SEQ ID NO: 537877 - DNA, 12 bp, Homo sapiens
accacagctcct

SEQ ID NO: 537878 - DNA, 21 bp, Homo sapiens
accacagctccttttccagag

SEQ ID NO: 537879 - DNA, 21 bp, Homo sapiens
accacagtgtaccattaaaat

SEQ ID NO: 537880 - DNA, 20 bp, Homo sapiens
accactaattttgttttaaa

SEQ ID NO: 537881 - DNA, 19 bp, Homo sapiens
accactggtgtatgaaatg

SEQ ID NO: 537882 - DNA, 16 bp, Homo sapiens
accagacaagctgttg

SEQ ID NO: 537883 - DNA, 18 bp, Homo sapiens
accagagcgatgtgttct

SEQ ID NO: 537884 - DNA, 19 bp, Homo sapiens
accagattcacttctgaat

SEQ ID NO: 537885 - DNA, 14 bp, Homo sapiens
accagcaacattat

SEQ ID NO: 537886 - DNA, 17 bp, Homo sapiens
accagctgctgctctga

SEQ ID NO: 537887 - DNA, 13 bp, Homo sapiens
accagctgtgtcc

SEQ ID NO: 537888 - DNA, 15 bp, Homo sapiens
accaggactctgcct

SEQ ID NO: 537889 - DNA, 16 bp, Homo sapiens
accaggactctgcctt

SEQ ID NO: 537890 - DNA, 15 bp, Homo sapiens
accaggcccccctgt

SEQ ID NO: 537891 - DNA, 15 bp, Homo sapiens
accagggccagaagt

SEQ ID NO: 537892 - DNA, 18 bp, Homo sapiens
accagtacattctcagtt

SEQ ID NO: 537893 - DNA, 13 bp, Homo sapiens
accagtagtgacc

SEQ ID NO: 537894 - DNA, 14 bp, Homo sapiens
accagttgctgctg

SEQ ID NO: 537895 - DNA, 13 bp, Homo sapiens
accattggaaatt

SEQ ID NO: 537896 - DNA, 18 bp, Homo sapiens
accattggaaatttcacg

SEQ ID NO: 537897 - DNA, 19 bp, Homo sapiens
accattggaaatttcacgt

SEQ ID NO: 537898 - DNA, 15 bp, Homo sapiens
accattttgaaatat

SEQ ID NO: 537899 - DNA, 14 bp, Homo sapiens
acccaaacctggag

SEQ ID NO: 537900 - DNA, 16 bp, Homo sapiens
acccaaacctggagat

SEQ ID NO: 537901 - DNA, 22 bp, Homo sapiens
acccacaccctacagcagatcc

SEQ ID NO: 537902 - DNA, 20 bp, Homo sapiens
acccagaaacgccacatccc

SEQ ID NO: 537903 - DNA, 21 bp, Homo sapiens
acccagaaacgccacatcccc

SEQ ID NO: 537904 - DNA, 22 bp, Homo sapiens
acccagccccagcgagtctgga

SEQ ID NO: 537905 - DNA, 11 bp, Homo sapiens
acccagcctgg

SEQ ID NO: 537906 - DNA, 23 bp, Homo sapiens
acccaggaggcagaggttgcagt

SEQ ID NO: 537907 - DNA, 20 bp, Homo sapiens
acccaggttttgcactcttg

SEQ ID NO: 537908 - DNA, 18 bp, Homo sapiens
acccatgaaacagcagct

SEQ ID NO: 537909 - DNA, 13 bp, Homo sapiens
accccatctgctg

SEQ ID NO: 537910 - DNA, 19 bp, Homo sapiens
acccccaggaaggaaacag

SEQ ID NO: 537911 - DNA, 18 bp, Homo sapiens
acccccagtgctcacaca

SEQ ID NO: 537912 - DNA, 13 bp, Homo sapiens
accccccccccac

SEQ ID NO: 537913 - DNA, 19 bp, Homo sapiens
acccctcccggccctgcct

SEQ ID NO: 537914 - DNA, 21 bp, Homo sapiens
acccctcccggccctgcctgc

SEQ ID NO: 537915 - DNA, 12 bp, Homo sapiens
acccctgcaggc

SEQ ID NO: 537916 - DNA, 11 bp, Homo sapiens
acccctttctt

SEQ ID NO: 537917 - DNA, 20 bp, Homo sapiens
acccctttcttctcgggcca

SEQ ID NO: 537918 - DNA, 21 bp, Homo sapiens
acccgcatgtacaaaaacaca

SEQ ID NO: 537919 - DNA, 17 bp, Homo sapiens
acccggcagccccccag

SEQ ID NO: 537920 - DNA, 22 bp, Homo sapiens
acccggcatgccgagtgcccca

SEQ ID NO: 537921 - DNA, 22 bp, Homo sapiens
acccggttcagtgtttctgggg

SEQ ID NO: 537922 - DNA, 18 bp, Homo sapiens
accctacagcagatccac

SEQ ID NO: 537923 - DNA, 20 bp, Homo sapiens
accctagctttatattttgt

SEQ ID NO: 537924 - DNA, 23 bp, Homo sapiens
accctattctatccatctcctgg

SEQ ID NO: 537925 - DNA, 15 bp, Homo sapiens
accctcatctgtctg

SEQ ID NO: 537926 - DNA, 15 bp, Homo sapiens
accctccccttccca

SEQ ID NO: 537927 - DNA, 17 bp, Homo sapiens
accctccccttcccagg

SEQ ID NO: 537928 - DNA, 16 bp, Homo sapiens
accctcgatgttcatg

SEQ ID NO: 537929 - DNA, 14 bp, Homo sapiens
accctcgctggccc

SEQ ID NO: 537930 - DNA, 17 bp, Homo sapiens
accctcgctggccccca

SEQ ID NO: 537931 - DNA, 20 bp, Homo sapiens
accctcgctggcccccactg

SEQ ID NO: 537932 - DNA, 23 bp, Homo sapiens
accctgaaatattttctacttta

SEQ ID NO: 537933 - DNA, 13 bp, Homo sapiens
accctgaaatgtg

SEQ ID NO: 537934 - DNA, 23 bp, Homo sapiens
accctgaacaacgagccttttca

SEQ ID NO: 537935 - DNA, 14 bp, Homo sapiens
accctgaatcagag

SEQ ID NO: 537936 - DNA, 18 bp, Homo sapiens
accctgaatcagaggcag

SEQ ID NO: 537937 - DNA, 22 bp, Homo sapiens
accctgagggtttccaccttgg

SEQ ID NO: 537938 - DNA, 22 bp, Homo sapiens
accctgattatatccagtaaca

SEQ ID NO: 537939 - DNA, 14 bp, Homo sapiens
actttgttaggcca

SEQ ID NO: 537940 - DNA, 20 bp, Homo sapiens
acttttaataaagtatgaat

SEQ ID NO: 537941 - DNA, 21 bp, Homo sapiens
acttttaataaagtatgaata

SEQ ID NO: 537942 - DNA, 21 bp, Homo sapiens
acttttatgcgcaaatacaaa

SEQ ID NO: 537943 - DNA, 11 bp, Homo sapiens
acttttccagt

SEQ ID NO: 537944 - DNA, 19 bp, Homo sapiens
acttttccagtattttagt

SEQ ID NO: 537945 - DNA, 14 bp, Homo sapiens
acttttccttgcat

SEQ ID NO: 537946 - DNA, 21 bp, Homo sapiens
acttttccttgcatacaaaca

SEQ ID NO: 537947 - DNA, 13 bp, Homo sapiens
acttttgaaaaga

SEQ ID NO: 537948 - DNA, 18 bp, Homo sapiens
acttttgtagtcttatga

SEQ ID NO: 537949 - DNA, 23 bp, Homo sapiens
agaaaaaaaagtgtctcaaagga

SEQ ID NO: 537950 - DNA, 16 bp, Homo sapiens
agaaaaaaagggagaa

SEQ ID NO: 537951 - DNA, 14 bp, Homo sapiens
agaaaaaataaatg

SEQ ID NO: 537952 - DNA, 22 bp, Homo sapiens
agaaaaaattccctcatttaaa

SEQ ID NO: 537953 - DNA, 12 bp, Homo sapiens
agaaaaagcaaa

SEQ ID NO: 537954 - DNA, 17 bp, Homo sapiens
agaaaaagcaaaaggca

SEQ ID NO: 537955 - DNA, 15 bp, Homo sapiens
agaaaaagccctctt

SEQ ID NO: 537956 - DNA, 14 bp, Homo sapiens
agaaaaatcagttt

SEQ ID NO: 537957 - DNA, 22 bp, Homo sapiens
agaaaaatcagtttttgttctt

SEQ ID NO: 537958 - DNA, 12 bp, Homo sapiens
agaaaactttgt

SEQ ID NO: 537959 - DNA, 22 bp, Homo sapiens
agaaaataaatacaagtttgaa

SEQ ID NO: 537960 - DNA, 17 bp, Homo sapiens
agaaaatgcacctcatt

SEQ ID NO: 537961 - DNA, 13 bp, Homo sapiens
agaaacaatttct

SEQ ID NO: 537962 - DNA, 14 bp, Homo sapiens
agaaacaatttctg

SEQ ID NO: 537963 - DNA, 13 bp, Homo sapiens
agaaacattggaa

SEQ ID NO: 537964 - DNA, 21 bp, Homo sapiens
agaaacccggcttcctgtgct

SEQ ID NO: 537965 - DNA, 14 bp, Homo sapiens
agaaactaagaatc

SEQ ID NO: 537966 - DNA, 22 bp, Homo sapiens
agaaactgtctagcacttcctt

SEQ ID NO: 537967 - DNA, 15 bp, Homo sapiens
agaaagacattctta

SEQ ID NO: 537968 - DNA, 15 bp, Homo sapiens
agaaagggattgctt

SEQ ID NO: 537969 - DNA, 18 bp, Homo sapiens
agaaagtgttctgttaca

SEQ ID NO: 537970 - DNA, 23 bp, Homo sapiens
agaaagtgttctgttacaaaatg

SEQ ID NO: 537971 - DNA, 19 bp, Homo sapiens
agaaatctatagaaagtgt

SEQ ID NO: 537972 - DNA, 21 bp, Homo sapiens
agaaatctatagaaagtgttc

SEQ ID NO: 537973 - DNA, 19 bp, Homo sapiens
agaaatgtccctttcttct

SEQ ID NO: 537974 - DNA, 13 bp, Homo sapiens
agaaattagggct

SEQ ID NO: 537975 - DNA, 23 bp, Homo sapiens
agaaattccatacttctctcaga

SEQ ID NO: 537976 - DNA, 14 bp, Homo sapiens
agaaattggtacct

SEQ ID NO: 537977 - DNA, 16 bp, Homo sapiens
agaaattggtaccttg

SEQ ID NO: 537978 - DNA, 18 bp, Homo sapiens
agaaattggtaccttgca

SEQ ID NO: 537979 - DNA, 20 bp, Homo sapiens
agaaattggtaccttgcaca

SEQ ID NO: 537980 - DNA, 22 bp, Homo sapiens
agaaattggtaccttgcacaca

SEQ ID NO: 537981 - DNA, 14 bp, Homo sapiens
agaacaaatacact

SEQ ID NO: 537982 - DNA, 22 bp, Homo sapiens
agaacattccctggaattgcca

SEQ ID NO: 537983 - DNA, 14 bp, Homo sapiens
agaaccgagcaaag

SEQ ID NO: 537984 - DNA, 19 bp, Homo sapiens
agaacctactgttcctttc

SEQ ID NO: 537985 - DNA, 23 bp, Homo sapiens
agaacgtattttaaaagccacat

SEQ ID NO: 537986 - DNA, 20 bp, Homo sapiens
agaactacctggatttgtat

SEQ ID NO: 537987 - DNA, 19 bp, Homo sapiens
agaactatcttcatctgag

SEQ ID NO: 537988 - DNA, 12 bp, Homo sapiens
agaactctgcct

SEQ ID NO: 537989 - DNA, 17 bp, Homo sapiens
agaactctgcctgccct

SEQ ID NO: 537990 - DNA, 13 bp, Homo sapiens
agaactcttcctc

SEQ ID NO: 537991 - DNA, 23 bp, Homo sapiens
agaagaatggctttcaataccct

SEQ ID NO: 537992 - DNA, 23 bp, Homo sapiens
agaagagagggtgagtcctccag

SEQ ID NO: 537993 - DNA, 17 bp, Homo sapiens
agaagagtaacacttga

SEQ ID NO: 537994 - DNA, 18 bp, Homo sapiens
agaagagtaacacttgaa

SEQ ID NO: 537995 - DNA, 15 bp, Homo sapiens
agaagatagttgtaa

SEQ ID NO: 537996 - DNA, 13 bp, Homo sapiens
agaagatctttgg

SEQ ID NO: 537997 - DNA, 18 bp, Homo sapiens
agaagccctgcagagcac

SEQ ID NO: 537998 - DNA, 19 bp, Homo sapiens
agaagcctcatgggagtca

SEQ ID NO: 537999 - DNA, 14 bp, Homo sapiens
agaaggaagcaggt

SEQ ID NO: 538000 - DNA, 14 bp, Homo sapiens
agaaggaatcttct

SEQ ID NO: 538001 - DNA, 21 bp, Homo sapiens
agaaggacttcctgctacagt

SEQ ID NO: 538002 - DNA, 14 bp, Homo sapiens
agaagtacaggtca

SEQ ID NO: 538003 - DNA, 18 bp, Homo sapiens
agaagtcttcatgaaatg

SEQ ID NO: 538004 - DNA, 14 bp, Homo sapiens
agaagtgaaaaaga

SEQ ID NO: 538005 - DNA, 23 bp, Homo sapiens
agaataaagccttgtgatcactt

SEQ ID NO: 538006 - DNA, 13 bp, Homo sapiens
agaataatgaaga

SEQ ID NO: 538007 - DNA, 14 bp, Homo sapiens
agaatactgtattg

SEQ ID NO: 538008 - DNA, 17 bp, Homo sapiens
agaataggacttgtttt

SEQ ID NO: 538009 - DNA, 20 bp, Homo sapiens
agaatatcaagatgattctg

SEQ ID NO: 538010 - DNA, 14 bp, Homo sapiens
agaatcaagtctgt

SEQ ID NO: 538011 - DNA, 16 bp, Homo sapiens
agaatcaagtctgtga

SEQ ID NO: 538012 - DNA, 19 bp, Homo sapiens
agaatcacctaattaattt

SEQ ID NO: 538013 - DNA, 13 bp, Homo sapiens
agaatctcagcac

SEQ ID NO: 538014 - DNA, 12 bp, Homo sapiens
agaatgaccttg

SEQ ID NO: 538015 - DNA, 22 bp, Homo sapiens
agaatggctttcaatacccttt

SEQ ID NO: 538016 - DNA, 23 bp, Homo sapiens
agaatgttgaaactgacttgctg

SEQ ID NO: 538017 - DNA, 14 bp, Homo sapiens
agaattttttattt

SEQ ID NO: 538018 - DNA, 17 bp, Homo sapiens
agacaaatacacataca

SEQ ID NO: 538019 - DNA, 22 bp, Homo sapiens
agacaacctaccttctttccag

SEQ ID NO: 538020 - DNA, 18 bp, Homo sapiens
agacaagctgttgaccag

SEQ ID NO: 538021 - DNA, 22 bp, Homo sapiens
agacaagctgttgaccaggcac

SEQ ID NO: 538022 - DNA, 18 bp, Homo sapiens
agacaagtctagtggaac

SEQ ID NO: 538023 - DNA, 14 bp, Homo sapiens
agacaatcttctgt

SEQ ID NO: 538024 - DNA, 20 bp, Homo sapiens
agacaattctaatggtaact

SEQ ID NO: 538025 - DNA, 22 bp, Homo sapiens
agacaattctaatggtaacttt

SEQ ID NO: 538026 - DNA, 15 bp, Homo sapiens
agacacacaaagcag

SEQ ID NO: 538027 - DNA, 17 bp, Homo sapiens
agacacacaagcagaca

SEQ ID NO: 538028 - DNA, 13 bp, Homo sapiens
agacacacacaca

SEQ ID NO: 538029 - DNA, 23 bp, Homo sapiens
agacacacacacacacacacata

SEQ ID NO: 538030 - DNA, 18 bp, Homo sapiens
agacacacacacgcacgc

SEQ ID NO: 538031 - DNA, 12 bp, Homo sapiens
agacacacacat

SEQ ID NO: 538032 - DNA, 13 bp, Homo sapiens
agacacacacata

SEQ ID NO: 538033 - DNA, 20 bp, Homo sapiens
agacactcctggggggcctg

SEQ ID NO: 538034 - DNA, 13 bp, Homo sapiens
agacactggtctc

SEQ ID NO: 538035 - DNA, 17 bp, Homo sapiens
agacagatgtggacatg

SEQ ID NO: 538036 - DNA, 23 bp, Homo sapiens
agacagatgtggacatgcacccg

SEQ ID NO: 538037 - DNA, 18 bp, Homo sapiens
agacagcaaaaaaagcaa

SEQ ID NO: 538038 - DNA, 21 bp, Homo sapiens
agacaggagaagaaagaacta

SEQ ID NO: 538039 - DNA, 18 bp, Homo sapiens
agacataaattgtaattt

SEQ ID NO: 538040 - DNA, 22 bp, Homo sapiens
agaccaaagagcctgtcgatga

SEQ ID NO: 538041 - DNA, 16 bp, Homo sapiens
agaccaaggaacaaga

SEQ ID NO: 538042 - DNA, 12 bp, Homo sapiens
agaccactgtct

SEQ ID NO: 538043 - DNA, 23 bp, Homo sapiens
agaccactgtctccacccacctt

SEQ ID NO: 538044 - DNA, 17 bp, Homo sapiens
agaccaggactctgcct

SEQ ID NO: 538045 - DNA, 22 bp, Homo sapiens
agaccaggactctgccttccag

SEQ ID NO: 538046 - DNA, 23 bp, Homo sapiens
agaccaggactctgccttccagg

SEQ ID NO: 538047 - DNA, 23 bp, Homo sapiens
agaccagtagtgaccaatcggga

SEQ ID NO: 538048 - DNA, 22 bp, Homo sapiens
agaccatggggtggaaggagaa

SEQ ID NO: 538049 - DNA, 15 bp, Homo sapiens
agaccatttaacatg

SEQ ID NO: 538050 - DNA, 16 bp, Homo sapiens
agaccatttaacatgc

SEQ ID NO: 538051 - DNA, 18 bp, Homo sapiens
agaccatttaacatgcaa

SEQ ID NO: 538052 - DNA, 19 bp, Homo sapiens
agaccccatccagccaggg

SEQ ID NO: 538053 - DNA, 23 bp, Homo sapiens
agacctctgtgaggaaagcacac

SEQ ID NO: 538054 - DNA, 13 bp, Homo sapiens
agacctgggccct

SEQ ID NO: 538055 - DNA, 16 bp, Homo sapiens
agacctgggccctggt

SEQ ID NO: 538056 - DNA, 14 bp, Homo sapiens
agacgtccctccac

SEQ ID NO: 538057 - DNA, 21 bp, Homo sapiens
agactaagatcggttaacaaa

SEQ ID NO: 538058 - DNA, 12 bp, Homo sapiens
agactatataca

SEQ ID NO: 538059 - DNA, 18 bp, Homo sapiens
agactatatacatgtgtg

SEQ ID NO: 538060 - DNA, 21 bp, Homo sapiens
agactatatacatgtgtgtat

SEQ ID NO: 538061 - DNA, 16 bp, Homo sapiens
agactatccattttac

SEQ ID NO: 538062 - DNA, 17 bp, Homo sapiens
agactatccattttaca

SEQ ID NO: 538063 - DNA, 19 bp, Homo sapiens
agactatccattttacact

SEQ ID NO: 538064 - DNA, 20 bp, Homo sapiens
agactcaggcccacattgcc

SEQ ID NO: 538065 - DNA, 22 bp, Homo sapiens
agactctaaaactatcagcagc

SEQ ID NO: 538066 - DNA, 23 bp, Homo sapiens
agactctaaaactatcagcagcg

SEQ ID NO: 538067 - DNA, 15 bp, Homo sapiens
agactgatgaagaaa

SEQ ID NO: 538068 - DNA, 13 bp, Homo sapiens
agactggtgttaa

SEQ ID NO: 538069 - DNA, 16 bp, Homo sapiens
agactggtgttaatga

SEQ ID NO: 538070 - DNA, 14 bp, Homo sapiens
agactgtttattac

SEQ ID NO: 538071 - DNA, 14 bp, Homo sapiens
agacttcagggagt

SEQ ID NO: 538072 - DNA, 20 bp, Homo sapiens
agacttgggagctttaaaga

SEQ ID NO: 538073 - DNA, 16 bp, Homo sapiens
agagaaaaagccctct

SEQ ID NO: 538074 - DNA, 22 bp, Homo sapiens
agagaaattatgttttcatcca

SEQ ID NO: 538075 - DNA, 12 bp, Homo sapiens
agggacctgggg

SEQ ID NO: 538076 - DNA, 22 bp, Homo sapiens
agggacttcaggatcaagtcct

SEQ ID NO: 538077 - DNA, 14 bp, Homo sapiens
agggagaaaggcaa

SEQ ID NO: 538078 - DNA, 19 bp, Homo sapiens
agggagaataaaattccta

SEQ ID NO: 538079 - DNA, 14 bp, Homo sapiens
agggagaccctggg

SEQ ID NO: 538080 - DNA, 23 bp, Homo sapiens
agggagatgtatttctaaatgtt

SEQ ID NO: 538081 - DNA, 22 bp, Homo sapiens
agggagcacaacccccagctcc

SEQ ID NO: 538082 - DNA, 22 bp, Homo sapiens
agggattcctaatcactcagag

SEQ ID NO: 538083 - DNA, 23 bp, Homo sapiens
agggcaacctgacagcaaacaca

SEQ ID NO: 538084 - DNA, 19 bp, Homo sapiens
agggcagtgcaaggaggga

SEQ ID NO: 538085 - DNA, 12 bp, Homo sapiens
agggcatgaaat

SEQ ID NO: 538086 - DNA, 16 bp, Homo sapiens
agggccagggctctgg

SEQ ID NO: 538087 - DNA, 21 bp, Homo sapiens
agggcccagaggggcggggcc

SEQ ID NO: 538088 - DNA, 22 bp, Homo sapiens
agggcccagaggggcggggcca

SEQ ID NO: 538089 - DNA, 23 bp, Homo sapiens
agggcccttcccaacctcccctg

SEQ ID NO: 538090 - DNA, 15 bp, Homo sapiens
agggcgtgaaacaca

SEQ ID NO: 538091 - DNA, 20 bp, Homo sapiens
agggctccacgggggcctag

SEQ ID NO: 538092 - DNA, 17 bp, Homo sapiens
agggctctgacaaagct

SEQ ID NO: 538093 - DNA, 16 bp, Homo sapiens
agggctgcagagcctg

SEQ ID NO: 538094 - DNA, 18 bp, Homo sapiens
agggctttcctgtgccag

SEQ ID NO: 538095 - DNA, 20 bp, Homo sapiens
aggggaatctggaggtagcc

SEQ ID NO: 538096 - DNA, 21 bp, Homo sapiens
aggggagagatctccaactct

SEQ ID NO: 538097 - DNA, 12 bp, Homo sapiens
aggggagccagg

SEQ ID NO: 538098 - DNA, 13 bp, Homo sapiens
aggggagccagga

SEQ ID NO: 538099 - DNA, 15 bp, Homo sapiens
aggggagccaggagg

SEQ ID NO: 538100 - DNA, 11 bp, Homo sapiens
aggggaggctg

SEQ ID NO: 538101 - DNA, 17 bp, Homo sapiens
aggggatgtgtgtgtgc

SEQ ID NO: 538102 - DNA, 18 bp, Homo sapiens
aggggcagcctgccttgc

SEQ ID NO: 538103 - DNA, 10 bp, Homo sapiens
agggggccac

SEQ ID NO: 538104 - DNA, 18 bp, Homo sapiens
agggtcctgggggctgct

SEQ ID NO: 538105 - DNA, 18 bp, Homo sapiens
agggtgagtcctccagaa

SEQ ID NO: 538106 - DNA, 17 bp, Homo sapiens
agggtggtaaatatttt

SEQ ID NO: 538107 - DNA, 20 bp, Homo sapiens
aggtaggaatattatatttg

SEQ ID NO: 538108 - DNA, 19 bp, Homo sapiens
aggtagtagaatctcagca

SEQ ID NO: 538109 - DNA, 17 bp, Homo sapiens
aggtatctgatgatgtt

SEQ ID NO: 538110 - DNA, 21 bp, Homo sapiens
aggtcagtgttataaaatctg

SEQ ID NO: 538111 - DNA, 18 bp, Homo sapiens
aggtcatttccatgtatg

SEQ ID NO: 538112 - DNA, 16 bp, Homo sapiens
aggtcctgggggcctg

SEQ ID NO: 538113 - DNA, 18 bp, Homo sapiens
aggtcctgggggcctgac

SEQ ID NO: 538114 - DNA, 23 bp, Homo sapiens
aggtcctgtcctggctcccaggg

SEQ ID NO: 538115 - DNA, 19 bp, Homo sapiens
aggtctcagaatctttcct

SEQ ID NO: 538116 - DNA, 16 bp, Homo sapiens
aggtctgatctgggtt

SEQ ID NO: 538117 - DNA, 18 bp, Homo sapiens
aggtgaaggaggctccag

SEQ ID NO: 538118 - DNA, 21 bp, Homo sapiens
aggtgaaggaggctccaggca

SEQ ID NO: 538119 - DNA, 23 bp, Homo sapiens
aggtgaaggaggctccaggcagc

SEQ ID NO: 538120 - DNA, 13 bp, Homo sapiens
aggtgcaggcagg

SEQ ID NO: 538121 - DNA, 17 bp, Homo sapiens
aggtgcccctctctcca

SEQ ID NO: 538122 - DNA, 21 bp, Homo sapiens
aggtgcctgagagcagaatga

SEQ ID NO: 538123 - DNA, 18 bp, Homo sapiens
aggtggccagggctccac

SEQ ID NO: 538124 - DNA, 18 bp, Homo sapiens
aggtggtgggcattctct

SEQ ID NO: 538125 - DNA, 17 bp, Homo sapiens
aggtgtgaggcaggaga

SEQ ID NO: 538126 - DNA, 14 bp, Homo sapiens
aggttaaatgtttt

SEQ ID NO: 538127 - DNA, 17 bp, Homo sapiens
aggttactaaaacaggg

SEQ ID NO: 538128 - DNA, 19 bp, Homo sapiens
aggttaggcagtataaaga

SEQ ID NO: 538129 - DNA, 23 bp, Homo sapiens
aggttaggcagtataaagaatag

SEQ ID NO: 538130 - DNA, 17 bp, Homo sapiens
aggttgtcactgagaag

SEQ ID NO: 538131 - DNA, 16 bp, Homo sapiens
aggtttcactgttcat

SEQ ID NO: 538132 - DNA, 19 bp, Homo sapiens
aggtttcactgttcatgaa

SEQ ID NO: 538133 - DNA, 21 bp, Homo sapiens
aggttttgcactcttgtttct

SEQ ID NO: 538134 - DNA, 15 bp, Homo sapiens
agtaaacctgaacaa

SEQ ID NO: 538135 - DNA, 16 bp, Homo sapiens
agtaaacctgaacaaa

SEQ ID NO: 538136 - DNA, 16 bp, Homo sapiens
agtaaactaatgagtt

SEQ ID NO: 538137 - DNA, 18 bp, Homo sapiens
agtaaatctaaattaact

SEQ ID NO: 538138 - DNA, 14 bp, Homo sapiens
agtaaatgtagttc

SEQ ID NO: 538139 - DNA, 16 bp, Homo sapiens
agtaacacttgaaaag

SEQ ID NO: 538140 - DNA, 23 bp, Homo sapiens
agtaacttgtcttaaataaaaga

SEQ ID NO: 538141 - DNA, 22 bp, Homo sapiens
agtaagcggctcaagcccagga

SEQ ID NO: 538142 - DNA, 20 bp, Homo sapiens
agtaatataatggaagagaa

SEQ ID NO: 538143 - DNA, 18 bp, Homo sapiens
agtaattgttccagagac

SEQ ID NO: 538144 - DNA, 20 bp, Homo sapiens
agtacaggtactttgtctaa

SEQ ID NO: 538145 - DNA, 20 bp, Homo sapiens
agtacattctcagtttttct

SEQ ID NO: 538146 - DNA, 16 bp, Homo sapiens
agtaccagccccaccc

SEQ ID NO: 538147 - DNA, 22 bp, Homo sapiens
agtacctgggtccccagccctt

SEQ ID NO: 538148 - DNA, 20 bp, Homo sapiens
agtaccttatcaaagtagca

SEQ ID NO: 538149 - DNA, 19 bp, Homo sapiens
agtactgagcagtgatatt

SEQ ID NO: 538150 - DNA, 18 bp, Homo sapiens
agtactttatagaagaat

SEQ ID NO: 538151 - DNA, 23 bp, Homo sapiens
agtagccccaacccaaacctgga

SEQ ID NO: 538152 - DNA, 16 bp, Homo sapiens
agtagcttaagaaaaa

SEQ ID NO: 538153 - DNA, 22 bp, Homo sapiens
agtaggacaaggtgcaggcagg

SEQ ID NO: 538154 - DNA, 23 bp, Homo sapiens
agtaggacaaggtgcaggcaggc

SEQ ID NO: 538155 - DNA, 22 bp, Homo sapiens
agtaggatatgcctgctctttg

SEQ ID NO: 538156 - DNA, 11 bp, Homo sapiens
agtagtgacca

SEQ ID NO: 538157 - DNA, 21 bp, Homo sapiens
agtatacaatatataaaaata

SEQ ID NO: 538158 - DNA, 21 bp, Homo sapiens
agtatatgtaacagtttaaaa

SEQ ID NO: 538159 - DNA, 14 bp, Homo sapiens
agtatattgaaaag

SEQ ID NO: 538160 - DNA, 21 bp, Homo sapiens
agtatcatctaaatattatgc

SEQ ID NO: 538161 - DNA, 22 bp, Homo sapiens
agtatccctgatttattctggt

SEQ ID NO: 538162 - DNA, 18 bp, Homo sapiens
agtatcgggggctggggc

SEQ ID NO: 538163 - DNA, 21 bp, Homo sapiens
agtatctcatcaacaaagaaa

SEQ ID NO: 538164 - DNA, 18 bp, Homo sapiens
agtattaatactaaaata

SEQ ID NO: 538165 - DNA, 21 bp, Homo sapiens
agtattgacaataagaaacag

SEQ ID NO: 538166 - DNA, 16 bp, Homo sapiens
agtattgccaaacatt

SEQ ID NO: 538167 - DNA, 22 bp, Homo sapiens
agtattgccaaacattaatgtt

SEQ ID NO: 538168 - DNA, 17 bp, Homo sapiens
agtatttaacattcttg

SEQ ID NO: 538169 - DNA, 20 bp, Homo sapiens
agtatttgaaaacagaaatt

SEQ ID NO: 538170 - DNA, 23 bp, Homo sapiens
agtcaaatgtaatgtggcttctg

SEQ ID NO: 538171 - DNA, 14 bp, Homo sapiens
agtcacagaaaatg

SEQ ID NO: 538172 - DNA, 12 bp, Homo sapiens
agtcactgctct

SEQ ID NO: 538173 - DNA, 17 bp, Homo sapiens
agtcagggagccctggg

SEQ ID NO: 538174 - DNA, 22 bp, Homo sapiens
agtcagtgcccatgtgtatgga

SEQ ID NO: 538175 - DNA, 17 bp, Homo sapiens
agtcatcgagtggccca

SEQ ID NO: 538176 - DNA, 14 bp, Homo sapiens
agtcatgatgtttt

SEQ ID NO: 538177 - DNA, 19 bp, Homo sapiens
agtcatgatgtttttaaaa

SEQ ID NO: 538178 - DNA, 18 bp, Homo sapiens
agtcatgctcccctgtgc

SEQ ID NO: 538179 - DNA, 21 bp, Homo sapiens
agtcatgctcccctgtgccag

SEQ ID NO: 538180 - DNA, 20 bp, Homo sapiens
agtcatttattttaaaaaat

SEQ ID NO: 538181 - DNA, 22 bp, Homo sapiens
agtccaacgtggggcagcacag

SEQ ID NO: 538182 - DNA, 21 bp, Homo sapiens
agtccaaggggtcccctccag

SEQ ID NO: 538183 - DNA, 23 bp, Homo sapiens
agtccaaggggtcccctccagga

SEQ ID NO: 538184 - DNA, 20 bp, Homo sapiens
agtccagacctgggccctgg

SEQ ID NO: 538185 - DNA, 14 bp, Homo sapiens
agtcccactccaag

SEQ ID NO: 538186 - DNA, 13 bp, Homo sapiens
agtccccagaact

SEQ ID NO: 538187 - DNA, 15 bp, Homo sapiens
agtccctgagaagcc

SEQ ID NO: 538188 - DNA, 16 bp, Homo sapiens
agtcggcacagcctgg

SEQ ID NO: 538189 - DNA, 18 bp, Homo sapiens
agtctcattcctctgtcc

SEQ ID NO: 538190 - DNA, 23 bp, Homo sapiens
agtctcccccacccttgttccag

SEQ ID NO: 538191 - DNA, 14 bp, Homo sapiens
agtctcctgtatca

SEQ ID NO: 538192 - DNA, 17 bp, Homo sapiens
agtctctttcttccttt

SEQ ID NO: 538193 - DNA, 19 bp, Homo sapiens
agtctctttcttcctttct

SEQ ID NO: 538194 - DNA, 20 bp, Homo sapiens
agtctcttttttacaaaggc

SEQ ID NO: 538195 - DNA, 22 bp, Homo sapiens
agtctcttttttacaaaggctg

SEQ ID NO: 538196 - DNA, 15 bp, Homo sapiens
agtctggagaccagg

SEQ ID NO: 538197 - DNA, 18 bp, Homo sapiens
agtctggataatttgtat

SEQ ID NO: 538198 - DNA, 14 bp, Homo sapiens
agtcttatgaatag

SEQ ID NO: 538199 - DNA, 15 bp, Homo sapiens
agtcttatgaataga

SEQ ID NO: 538200 - DNA, 23 bp, Homo sapiens
agtcttatgaatagacataaatt

SEQ ID NO: 538201 - DNA, 23 bp, Homo sapiens
agtcttcatgaaatgctatgtca

SEQ ID NO: 538202 - DNA, 17 bp, Homo sapiens
agtctttcccaatctct

SEQ ID NO: 538203 - DNA, 13 bp, Homo sapiens
agtcttttaaaaa

SEQ ID NO: 538204 - DNA, 21 bp, Homo sapiens
agtgaaaacctctttcggaaa

SEQ ID NO: 538205 - DNA, 20 bp, Homo sapiens
agtgaaattcaattcataga

SEQ ID NO: 538206 - DNA, 16 bp, Homo sapiens
agtgaagagcatttgg

SEQ ID NO: 538207 - DNA, 14 bp, Homo sapiens
agtgaagagtgaag

SEQ ID NO: 538208 - DNA, 16 bp, Homo sapiens
agtgaagagtgaagag

SEQ ID NO: 538209 - DNA, 23 bp, Homo sapiens
agtgagacctccctgtctctaca

SEQ ID NO: 538210 - DNA, 18 bp, Homo sapiens
atatagtgctatatatat

SEQ ID NO: 538211 - DNA, 22 bp, Homo sapiens
atatataaaatacacgtgtata

SEQ ID NO: 538212 - DNA, 22 bp, Homo sapiens
atatataaacagaactcccttc

SEQ ID NO: 538213 - DNA, 10 bp, Homo sapiens
atatatacat

SEQ ID NO: 538214 - DNA, 11 bp, Homo sapiens
atatatacata

SEQ ID NO: 538215 - DNA, 16 bp, Homo sapiens
atatatacatacactt

SEQ ID NO: 538216 - DNA, 14 bp, Homo sapiens
atatatagcattta

SEQ ID NO: 538217 - DNA, 14 bp, Homo sapiens
atatatagtgctat

SEQ ID NO: 538218 - DNA, 14 bp, Homo sapiens
atatatataaatat

SEQ ID NO: 538219 - DNA, 14 bp, Homo sapiens
atatatatacatat

SEQ ID NO: 538220 - DNA, 15 bp, Homo sapiens
atatatatgtgaact

SEQ ID NO: 538221 - DNA, 20 bp, Homo sapiens
atatatggtctaatgtttaa

SEQ ID NO: 538222 - DNA, 16 bp, Homo sapiens
atatatgtatacgcac

SEQ ID NO: 538223 - DNA, 18 bp, Homo sapiens
atatatgtgtatatatac

SEQ ID NO: 538224 - DNA, 13 bp, Homo sapiens
atatatttgcaga

SEQ ID NO: 538225 - DNA, 13 bp, Homo sapiens
atatattttgaaa

SEQ ID NO: 538226 - DNA, 21 bp, Homo sapiens
atatcagttacagtggcagta

SEQ ID NO: 538227 - DNA, 22 bp, Homo sapiens
atatcagttacagtggcagtat

SEQ ID NO: 538228 - DNA, 15 bp, Homo sapiens
atatctatctaatca

SEQ ID NO: 538229 - DNA, 17 bp, Homo sapiens
atatctgtttgcttcta

SEQ ID NO: 538230 - DNA, 23 bp, Homo sapiens
atatgaccaaatatcaccaggac

SEQ ID NO: 538231 - DNA, 22 bp, Homo sapiens
atatgagaaatataaaaataat

SEQ ID NO: 538232 - DNA, 17 bp, Homo sapiens
atatgagcatgctccct

SEQ ID NO: 538233 - DNA, 15 bp, Homo sapiens
atatgaggatgtatg

SEQ ID NO: 538234 - DNA, 13 bp, Homo sapiens
atatgagtataca

SEQ ID NO: 538235 - DNA, 16 bp, Homo sapiens
atatgagtatacaata

SEQ ID NO: 538236 - DNA, 17 bp, Homo sapiens
atatgagtatacaatat

SEQ ID NO: 538237 - DNA, 21 bp, Homo sapiens
atatgagtatacaatatataa

SEQ ID NO: 538238 - DNA, 15 bp, Homo sapiens
atatgatccagagca

SEQ ID NO: 538239 - DNA, 16 bp, Homo sapiens
atatgatccagagcag

SEQ ID NO: 538240 - DNA, 21 bp, Homo sapiens
atatgattaaattatcattgt

SEQ ID NO: 538241 - DNA, 19 bp, Homo sapiens
atatgattttttaaaagaa

SEQ ID NO: 538242 - DNA, 23 bp, Homo sapiens
atatgcactaagtctctttttta

SEQ ID NO: 538243 - DNA, 18 bp, Homo sapiens
atatgcatatatatgtat

SEQ ID NO: 538244 - DNA, 14 bp, Homo sapiens
atatgcctgctctt

SEQ ID NO: 538245 - DNA, 13 bp, Homo sapiens
atatggtctaatg

SEQ ID NO: 538246 - DNA, 16 bp, Homo sapiens
atatggtctaatgttt

SEQ ID NO: 538247 - DNA, 11 bp, Homo sapiens
atatgtaaact

SEQ ID NO: 538248 - DNA, 16 bp, Homo sapiens
atatgtaaactttaac

SEQ ID NO: 538249 - DNA, 17 bp, Homo sapiens
atatgtaacagtttaaa

SEQ ID NO: 538250 - DNA, 13 bp, Homo sapiens
atatgtagactat

SEQ ID NO: 538251 - DNA, 19 bp, Homo sapiens
atatgtagactatatacat

SEQ ID NO: 538252 - DNA, 21 bp, Homo sapiens
atatgtagactatatacatgt

SEQ ID NO: 538253 - DNA, 14 bp, Homo sapiens
atatgtatacgcac

SEQ ID NO: 538254 - DNA, 19 bp, Homo sapiens
atatgtatacgcacgcacc

SEQ ID NO: 538255 - DNA, 23 bp, Homo sapiens
atatgtatacgcacgcacccaca

SEQ ID NO: 538256 - DNA, 18 bp, Homo sapiens
atatgtattttatgtatg

SEQ ID NO: 538257 - DNA, 17 bp, Homo sapiens
atatgtgaactttctca

SEQ ID NO: 538258 - DNA, 23 bp, Homo sapiens
atatgtgaactttctcagcatat

SEQ ID NO: 538259 - DNA, 14 bp, Homo sapiens
atatgtgattttca

SEQ ID NO: 538260 - DNA, 12 bp, Homo sapiens
atatgtgcccct

SEQ ID NO: 538261 - DNA, 13 bp, Homo sapiens
atatgtgtatata

SEQ ID NO: 538262 - DNA, 22 bp, Homo sapiens
atatgtgtatatatacatacac

SEQ ID NO: 538263 - DNA, 16 bp, Homo sapiens
atattaaaaagtcttt

SEQ ID NO: 538264 - DNA, 18 bp, Homo sapiens
atattaaaatctgatgta

SEQ ID NO: 538265 - DNA, 15 bp, Homo sapiens
atattaaagaaagtc

SEQ ID NO: 538266 - DNA, 16 bp, Homo sapiens
atattaaagaaagtca

SEQ ID NO: 538267 - DNA, 17 bp, Homo sapiens
atattactctgcctgtc

SEQ ID NO: 538268 - DNA, 18 bp, Homo sapiens
atattagaaaactttgtt

SEQ ID NO: 538269 - DNA, 21 bp, Homo sapiens
atattagacttctgttttcaa

SEQ ID NO: 538270 - DNA, 16 bp, Homo sapiens
atattatgttatgaaa

SEQ ID NO: 538271 - DNA, 17 bp, Homo sapiens
atattatgttatgaaaa

SEQ ID NO: 538272 - DNA, 23 bp, Homo sapiens
atattatttgctaattaaaaagt

SEQ ID NO: 538273 - DNA, 15 bp, Homo sapiens
atattcagagaaaac

SEQ ID NO: 538274 - DNA, 12 bp, Homo sapiens
atattctctgta

SEQ ID NO: 538275 - DNA, 15 bp, Homo sapiens
atattctctgtacat

SEQ ID NO: 538276 - DNA, 14 bp, Homo sapiens
atattctttgttaa

SEQ ID NO: 538277 - DNA, 15 bp, Homo sapiens
atattgaaaagaaaa

SEQ ID NO: 538278 - DNA, 14 bp, Homo sapiens
atattgaaaatgtc

SEQ ID NO: 538279 - DNA, 18 bp, Homo sapiens
atattgaaaatgtcactg

SEQ ID NO: 538280 - DNA, 20 bp, Homo sapiens
atatttaagtattcaagaaa

SEQ ID NO: 538281 - DNA, 16 bp, Homo sapiens
atatttcctaaggcat

SEQ ID NO: 538282 - DNA, 21 bp, Homo sapiens
atatttcctataccatttccg

SEQ ID NO: 538283 - DNA, 17 bp, Homo sapiens
atatttggatgcagagt

SEQ ID NO: 538284 - DNA, 16 bp, Homo sapiens
atatttgtgtgctaaa

SEQ ID NO: 538285 - DNA, 14 bp, Homo sapiens
atattttaatttca

SEQ ID NO: 538286 - DNA, 14 bp, Homo sapiens
atattttgtcactg

SEQ ID NO: 538287 - DNA, 15 bp, Homo sapiens
atatttttcttaaaa

SEQ ID NO: 538288 - DNA, 18 bp, Homo sapiens
atatttttcttaaaaagt

SEQ ID NO: 538289 - DNA, 15 bp, Homo sapiens
atatttttttcctta

SEQ ID NO: 538290 - DNA, 18 bp, Homo sapiens
atatttttttccttacat

SEQ ID NO: 538291 - DNA, 14 bp, Homo sapiens
atcaaaataaaaag

SEQ ID NO: 538292 - DNA, 15 bp, Homo sapiens
atcaaaataaaaagt

SEQ ID NO: 538293 - DNA, 18 bp, Homo sapiens
atcaaaataaaaagtgac

SEQ ID NO: 538294 - DNA, 23 bp, Homo sapiens
atcaaaatgacctcaccattttt

SEQ ID NO: 538295 - DNA, 11 bp, Homo sapiens
atcaaagccct

SEQ ID NO: 538296 - DNA, 22 bp, Homo sapiens
atcaaagccctccctgtctgtc

SEQ ID NO: 538297 - DNA, 13 bp, Homo sapiens
atcaaatgtacat

SEQ ID NO: 538298 - DNA, 16 bp, Homo sapiens
atcaagaaaaaaaggg

SEQ ID NO: 538299 - DNA, 15 bp, Homo sapiens
atcaagaccaaagag

SEQ ID NO: 538300 - DNA, 15 bp, Homo sapiens
atcaattcattgtgt

SEQ ID NO: 538301 - DNA, 13 bp, Homo sapiens
atcaccagggcca

SEQ ID NO: 538302 - DNA, 20 bp, Homo sapiens
atcacgaggtcaggagttca

SEQ ID NO: 538303 - DNA, 16 bp, Homo sapiens
atcactattcagaaga

SEQ ID NO: 538304 - DNA, 20 bp, Homo sapiens
atcactattgggcccccagg

SEQ ID NO: 538305 - DNA, 17 bp, Homo sapiens
atcactgaacttttcaa

SEQ ID NO: 538306 - DNA, 18 bp, Homo sapiens
atcactgaacttttcaaa

SEQ ID NO: 538307 - DNA, 22 bp, Homo sapiens
atcactgaacttttcaaaataa

SEQ ID NO: 538308 - DNA, 19 bp, Homo sapiens
atcagaccaaggaacaaga

SEQ ID NO: 538309 - DNA, 13 bp, Homo sapiens
atcagaggcagag

SEQ ID NO: 538310 - DNA, 20 bp, Homo sapiens
atcagcccaatccctgatcc

SEQ ID NO: 538311 - DNA, 11 bp, Homo sapiens
atcagcccctg

SEQ ID NO: 538312 - DNA, 15 bp, Homo sapiens
atcagcccctgctgc

SEQ ID NO: 538313 - DNA, 18 bp, Homo sapiens
atcagctgagccttctga

SEQ ID NO: 538314 - DNA, 21 bp, Homo sapiens
atcaggtcctgctcagcagtg

SEQ ID NO: 538315 - DNA, 22 bp, Homo sapiens
atcaggttaggcagtataaaga

SEQ ID NO: 538316 - DNA, 17 bp, Homo sapiens
atcagtagcttaagaaa

SEQ ID NO: 538317 - DNA, 15 bp, Homo sapiens
atcagttacagtggc

SEQ ID NO: 538318 - DNA, 21 bp, Homo sapiens
atcagttacagtggcagtatt

SEQ ID NO: 538319 - DNA, 16 bp, Homo sapiens
atcagtttttgttctt

SEQ ID NO: 538320 - DNA, 17 bp, Homo sapiens
atcataagttagatgtt

SEQ ID NO: 538321 - DNA, 13 bp, Homo sapiens
atcatatctgtat

SEQ ID NO: 538322 - DNA, 17 bp, Homo sapiens
atcatccccaaatgtgt

SEQ ID NO: 538323 - DNA, 15 bp, Homo sapiens
atcatcgaaaattca

SEQ ID NO: 538324 - DNA, 19 bp, Homo sapiens
atcatctattgagtgtaca

SEQ ID NO: 538325 - DNA, 12 bp, Homo sapiens
atcatgcttcta

SEQ ID NO: 538326 - DNA, 14 bp, Homo sapiens
atcatgctttaaag

SEQ ID NO: 538327 - DNA, 17 bp, Homo sapiens
atcatgctttaaagtgt

SEQ ID NO: 538328 - DNA, 20 bp, Homo sapiens
atcatgctttaaagtgtaat

SEQ ID NO: 538329 - DNA, 15 bp, Homo sapiens
atcatgtgtttctgt

SEQ ID NO: 538330 - DNA, 18 bp, Homo sapiens
atcatgtgtttctgtgta

SEQ ID NO: 538331 - DNA, 22 bp, Homo sapiens
atcattcttataacattgtatg

SEQ ID NO: 538332 - DNA, 23 bp, Homo sapiens
atcattgtccagagctgcttccc

SEQ ID NO: 538333 - DNA, 14 bp, Homo sapiens
atccacctgcacaa

SEQ ID NO: 538334 - DNA, 15 bp, Homo sapiens
atccacctgcacaaa

SEQ ID NO: 538335 - DNA, 18 bp, Homo sapiens
atccacctgcacaaacat

SEQ ID NO: 538336 - DNA, 10 bp, Homo sapiens
atccagaaac

SEQ ID NO: 538337 - DNA, 19 bp, Homo sapiens
atccagaaacttgttcttc

SEQ ID NO: 538338 - DNA, 11 bp, Homo sapiens
atccagagcag

SEQ ID NO: 538339 - DNA, 20 bp, Homo sapiens
atccagagggttgtgatttt

SEQ ID NO: 538340 - DNA, 23 bp, Homo sapiens
atccagaggtgagggaggcctga

SEQ ID NO: 538341 - DNA, 14 bp, Homo sapiens
atccaggaacacat

SEQ ID NO: 538342 - DNA, 18 bp, Homo sapiens
atccaggaacacatgcac

SEQ ID NO: 538343 - DNA, 23 bp, Homo sapiens
atccaggaacacatgcacacaca

SEQ ID NO: 538344 - DNA, 23 bp, Homo sapiens
atccatgcggccggcctggggcc

SEQ ID NO: 538345 - DNA, 19 bp, Homo sapiens
atccatgtcctatgtgtga

SEQ ID NO: 538346 - DNA, 17 bp, Homo sapiens
atccattcccaagaaat

SEQ ID NO: 538347 - DNA, 20 bp, Homo sapiens
atcccaccccatcctccagg

SEQ ID NO: 538348 - DNA, 18 bp, Homo sapiens
attctcaccagctgtgtc

SEQ ID NO: 538349 - DNA, 13 bp, Homo sapiens
attctcagttttt

SEQ ID NO: 538350 - DNA, 14 bp, Homo sapiens
attctgaagttata

SEQ ID NO: 538351 - DNA, 13 bp, Homo sapiens
attctgctgcccc

SEQ ID NO: 538352 - DNA, 16 bp, Homo sapiens
attctggcactttaat

SEQ ID NO: 538353 - DNA, 21 bp, Homo sapiens
attctggcactttaatgataa

SEQ ID NO: 538354 - DNA, 14 bp, Homo sapiens
attctggctgaaaa

SEQ ID NO: 538355 - DNA, 16 bp, Homo sapiens
attctgggaatgtata

SEQ ID NO: 538356 - DNA, 17 bp, Homo sapiens
attctgggaatgtatag

SEQ ID NO: 538357 - DNA, 17 bp, Homo sapiens
attctgtcaatgaaaag

SEQ ID NO: 538358 - DNA, 15 bp, Homo sapiens
attcttagttaatct

SEQ ID NO: 538359 - DNA, 18 bp, Homo sapiens
attcttataacattgtat

SEQ ID NO: 538360 - DNA, 13 bp, Homo sapiens
attcttattccat

SEQ ID NO: 538361 - DNA, 21 bp, Homo sapiens
attcttattccatattagaaa

SEQ ID NO: 538362 - DNA, 16 bp, Homo sapiens
attcttgttttgcttc

SEQ ID NO: 538363 - DNA, 15 bp, Homo sapiens
attctttagagaaga

SEQ ID NO: 538364 - DNA, 13 bp, Homo sapiens
attgaaaagaaaa

SEQ ID NO: 538365 - DNA, 14 bp, Homo sapiens
attgaaaatgtcac

SEQ ID NO: 538366 - DNA, 19 bp, Homo sapiens
attgaaaatgtcactgtta

SEQ ID NO: 538367 - DNA, 18 bp, Homo sapiens
attgaaactgtatttact

SEQ ID NO: 538368 - DNA, 23 bp, Homo sapiens
attgaagagagatatatctgaaa

SEQ ID NO: 538369 - DNA, 17 bp, Homo sapiens
attgagagagatgtgta

SEQ ID NO: 538370 - DNA, 19 bp, Homo sapiens
attgagagagatgtgtaat

SEQ ID NO: 538371 - DNA, 20 bp, Homo sapiens
attgaggaaaaatatgtgaa

SEQ ID NO: 538372 - DNA, 16 bp, Homo sapiens
attgatgttgatgcaa

SEQ ID NO: 538373 - DNA, 14 bp, Homo sapiens
attgatgtttcctt

SEQ ID NO: 538374 - DNA, 18 bp, Homo sapiens
attgcacaaaatataaag

SEQ ID NO: 538375 - DNA, 19 bp, Homo sapiens
attgcataagtggacccag

SEQ ID NO: 538376 - DNA, 18 bp, Homo sapiens
attgcatcacctctgtaa

SEQ ID NO: 538377 - DNA, 13 bp, Homo sapiens
attgccaaacatt

SEQ ID NO: 538378 - DNA, 14 bp, Homo sapiens
attgccaaacatta

SEQ ID NO: 538379 - DNA, 15 bp, Homo sapiens
attgctacttcctgc

SEQ ID NO: 538380 - DNA, 21 bp, Homo sapiens
attgctgtaaataaaaatagc

SEQ ID NO: 538381 - DNA, 14 bp, Homo sapiens
attgcttcttctga

SEQ ID NO: 538382 - DNA, 12 bp, Homo sapiens
attgcttttaaa

SEQ ID NO: 538383 - DNA, 15 bp, Homo sapiens
attgcttttaaaact

SEQ ID NO: 538384 - DNA, 12 bp, Homo sapiens
attggaagcagg

SEQ ID NO: 538385 - DNA, 20 bp, Homo sapiens
attggaagcaggttaaatgt

SEQ ID NO: 538386 - DNA, 21 bp, Homo sapiens
attggaagcaggttaaatgtt

SEQ ID NO: 538387 - DNA, 12 bp, Homo sapiens
attggcctggcc

SEQ ID NO: 538388 - DNA, 17 bp, Homo sapiens
attggcctggccagacc

SEQ ID NO: 538389 - DNA, 13 bp, Homo sapiens
attgggcccccag

SEQ ID NO: 538390 - DNA, 22 bp, Homo sapiens
attgggtgaatatggtggaaaa

SEQ ID NO: 538391 - DNA, 16 bp, Homo sapiens
attggtttaaactttt

SEQ ID NO: 538392 - DNA, 15 bp, Homo sapiens
attggtttctcttct

SEQ ID NO: 538393 - DNA, 18 bp, Homo sapiens
attggtttctcttctccc

SEQ ID NO: 538394 - DNA, 18 bp, Homo sapiens
attgtatatatatgtgaa

SEQ ID NO: 538395 - DNA, 13 bp, Homo sapiens
attgtatctcctt

SEQ ID NO: 538396 - DNA, 13 bp, Homo sapiens
attgtatgttaat

SEQ ID NO: 538397 - DNA, 18 bp, Homo sapiens
attgtatttaaaacattt

SEQ ID NO: 538398 - DNA, 21 bp, Homo sapiens
attgtatttaaaacatttcat

SEQ ID NO: 538399 - DNA, 19 bp, Homo sapiens
attgtcacctgcttctctg

SEQ ID NO: 538400 - DNA, 18 bp, Homo sapiens
attgtccctggcttcctt

SEQ ID NO: 538401 - DNA, 15 bp, Homo sapiens
attgtgctccaaatg

SEQ ID NO: 538402 - DNA, 22 bp, Homo sapiens
attgtgctccaaatgtctactg

SEQ ID NO: 538403 - DNA, 23 bp, Homo sapiens
attgtgctccaaatgtctactga

SEQ ID NO: 538404 - DNA, 16 bp, Homo sapiens
attgttaattgctgag

SEQ ID NO: 538405 - DNA, 14 bp, Homo sapiens
attgttgctccctg

SEQ ID NO: 538406 - DNA, 19 bp, Homo sapiens
attgtttatctagatgtaa

SEQ ID NO: 538407 - DNA, 20 bp, Homo sapiens
attgtttatctagatgtaaa

SEQ ID NO: 538408 - DNA, 20 bp, Homo sapiens
atttaacactgagtgaaata

SEQ ID NO: 538409 - DNA, 12 bp, Homo sapiens
atttaacatctg

SEQ ID NO: 538410 - DNA, 16 bp, Homo sapiens
atttaacattcttggt

SEQ ID NO: 538411 - DNA, 19 bp, Homo sapiens
atttaagagattttatgtt

SEQ ID NO: 538412 - DNA, 14 bp, Homo sapiens
atttaagcacaaaa

SEQ ID NO: 538413 - DNA, 18 bp, Homo sapiens
atttaagtattcaagaaa

SEQ ID NO: 538414 - DNA, 23 bp, Homo sapiens
atttaagtggactgtatttcggc

SEQ ID NO: 538415 - DNA, 17 bp, Homo sapiens
atttaagttgtaaacgt

SEQ ID NO: 538416 - DNA, 18 bp, Homo sapiens
atttacagtctctttctt

SEQ ID NO: 538417 - DNA, 22 bp, Homo sapiens
atttacagtctctttcttcctt

SEQ ID NO: 538418 - DNA, 17 bp, Homo sapiens
atttaccacaggatgca

SEQ ID NO: 538419 - DNA, 15 bp, Homo sapiens
atttacctttggaat

SEQ ID NO: 538420 - DNA, 14 bp, Homo sapiens
atttactaacagta

SEQ ID NO: 538421 - DNA, 12 bp, Homo sapiens
atttacttttaa

SEQ ID NO: 538422 - DNA, 21 bp, Homo sapiens
atttagcacagtatttaacat

SEQ ID NO: 538423 - DNA, 18 bp, Homo sapiens
atttagtggatggaatat

SEQ ID NO: 538424 - DNA, 20 bp, Homo sapiens
atttagtgtatatgtgattt

SEQ ID NO: 538425 - DNA, 19 bp, Homo sapiens
atttataaaattagaaagc

SEQ ID NO: 538426 - DNA, 21 bp, Homo sapiens
atttataaaattagaaagcaa

SEQ ID NO: 538427 - DNA, 18 bp, Homo sapiens
atttatgaagcagattta

SEQ ID NO: 538428 - DNA, 18 bp, Homo sapiens
atttatgagatcactgaa

SEQ ID NO: 538429 - DNA, 18 bp, Homo sapiens
atttattctgggaatgta

SEQ ID NO: 538430 - DNA, 19 bp, Homo sapiens
atttattctgggaatgtat

SEQ ID NO: 538431 - DNA, 20 bp, Homo sapiens
atttattctgggaatgtata

SEQ ID NO: 538432 - DNA, 21 bp, Homo sapiens
atttattctgggaatgtatag

SEQ ID NO: 538433 - DNA, 18 bp, Homo sapiens
atttattgaagaaacaga

SEQ ID NO: 538434 - DNA, 14 bp, Homo sapiens
atttattgaggaaa

SEQ ID NO: 538435 - DNA, 14 bp, Homo sapiens
atttcaaaagacat

SEQ ID NO: 538436 - DNA, 17 bp, Homo sapiens
atttcaaaagacatgtt

SEQ ID NO: 538437 - DNA, 20 bp, Homo sapiens
atttcaagaaaaaataaatg

SEQ ID NO: 538438 - DNA, 12 bp, Homo sapiens
atttcaagctta

SEQ ID NO: 538439 - DNA, 14 bp, Homo sapiens
atttcaagcttatt

SEQ ID NO: 538440 - DNA, 22 bp, Homo sapiens
atttcaagcttattttggagag

SEQ ID NO: 538441 - DNA, 16 bp, Homo sapiens
atttcacattaatggt

SEQ ID NO: 538442 - DNA, 20 bp, Homo sapiens
atttcagaaactaagaatca

SEQ ID NO: 538443 - DNA, 19 bp, Homo sapiens
atttcatcctttcacttct

SEQ ID NO: 538444 - DNA, 22 bp, Homo sapiens
atttcatcctttcacttctttc

SEQ ID NO: 538445 - DNA, 20 bp, Homo sapiens
atttcatgtatttctttaga

SEQ ID NO: 538446 - DNA, 18 bp, Homo sapiens
atttcatgtcctgtgtca

SEQ ID NO: 538447 - DNA, 21 bp, Homo sapiens
atttcattcgggccccacctg

SEQ ID NO: 538448 - DNA, 22 bp, Homo sapiens
atttcattttttgcatcagtat

SEQ ID NO: 538449 - DNA, 23 bp, Homo sapiens
atttccaacaccacagacacaca

SEQ ID NO: 538450 - DNA, 14 bp, Homo sapiens
atttccccctttct

SEQ ID NO: 538451 - DNA, 19 bp, Homo sapiens
atttccccctttcttcctc

SEQ ID NO: 538452 - DNA, 20 bp, Homo sapiens
atttccccctttcttcctca

SEQ ID NO: 538453 - DNA, 15 bp, Homo sapiens
atttcccttcttctg

SEQ ID NO: 538454 - DNA, 14 bp, Homo sapiens
atttccgtaattct

SEQ ID NO: 538455 - DNA, 18 bp, Homo sapiens
atttccgtaattcttatt

SEQ ID NO: 538456 - DNA, 15 bp, Homo sapiens
atttcctaaggcatg

SEQ ID NO: 538457 - DNA, 19 bp, Homo sapiens
atttccttgtctaaagatc

SEQ ID NO: 538458 - DNA, 13 bp, Homo sapiens
atttctaagtgtt

SEQ ID NO: 538459 - DNA, 18 bp, Homo sapiens
atttctaagtgtttcaca

SEQ ID NO: 538460 - DNA, 17 bp, Homo sapiens
atttctagttatttatt

SEQ ID NO: 538461 - DNA, 11 bp, Homo sapiens
atttctccttt

SEQ ID NO: 538462 - DNA, 13 bp, Homo sapiens
atttctctctcca

SEQ ID NO: 538463 - DNA, 22 bp, Homo sapiens
atttctctctccagtcttccac

SEQ ID NO: 538464 - DNA, 15 bp, Homo sapiens
atttctggcaaatat

SEQ ID NO: 538465 - DNA, 21 bp, Homo sapiens
atttctgtcattcaaatgggt

SEQ ID NO: 538466 - DNA, 12 bp, Homo sapiens
atttcttgcaat

SEQ ID NO: 538467 - DNA, 19 bp, Homo sapiens
atttgatgtaagttactga

SEQ ID NO: 538468 - DNA, 18 bp, Homo sapiens
atttgcacaaaaagatac

SEQ ID NO: 538469 - DNA, 14 bp, Homo sapiens
atttgcacagaaga

SEQ ID NO: 538470 - DNA, 16 bp, Homo sapiens
atttgctcataagtaa

SEQ ID NO: 538471 - DNA, 14 bp, Homo sapiens
atttggatgcagag

SEQ ID NO: 538472 - DNA, 20 bp, Homo sapiens
atttggctgggctacaattt

SEQ ID NO: 538473 - DNA, 15 bp, Homo sapiens
atttgggaacataaa

SEQ ID NO: 538474 - DNA, 16 bp, Homo sapiens
atttgggaacataaaa

SEQ ID NO: 538475 - DNA, 11 bp, Homo sapiens
atttgtaaaac

SEQ ID NO: 538476 - DNA, 22 bp, Homo sapiens
atttgtcagtgtagatcaactc

SEQ ID NO: 538477 - DNA, 15 bp, Homo sapiens
atttgtcattttcat

SEQ ID NO: 538478 - DNA, 15 bp, Homo sapiens
atttgtgtgctaaac

SEQ ID NO: 538479 - DNA, 19 bp, Homo sapiens
atttgttaattcctatgaa

SEQ ID NO: 538480 - DNA, 14 bp, Homo sapiens
atttgttaatttct

SEQ ID NO: 538481 - DNA, 19 bp, Homo sapiens
attttaaaaaatgaaaata

SEQ ID NO: 538482 - DNA, 19 bp, Homo sapiens
attttaaaagccacataga

SEQ ID NO: 538483 - DNA, 23 bp, Homo sapiens
attttaagaagttgctgcagatt

SEQ ID NO: 538484 - DNA, 18 bp, Homo sapiens
attttaatttcaagctta

SEQ ID NO: 538485 - DNA, 19 bp, Homo sapiens
attttaatttcaagcttat

SEQ ID NO: 538486 - DNA, 13 bp, Homo sapiens
cacagacacacac

SEQ ID NO: 538487 - DNA, 17 bp, Homo sapiens
cacagacacacacacgc

SEQ ID NO: 538488 - DNA, 10 bp, Homo sapiens
cacagagacc

SEQ ID NO: 538489 - DNA, 21 bp, Homo sapiens
cacagagcactaggttcaatt

SEQ ID NO: 538490 - DNA, 14 bp, Homo sapiens
cacagattatttgt

SEQ ID NO: 538491 - DNA, 13 bp, Homo sapiens
cacagcagcttca

SEQ ID NO: 538492 - DNA, 17 bp, Homo sapiens
cacagccaatctccagg

SEQ ID NO: 538493 - DNA, 17 bp, Homo sapiens
cacagctcccttctgtt

SEQ ID NO: 538494 - DNA, 13 bp, Homo sapiens
cacagctcctttt

SEQ ID NO: 538495 - DNA, 18 bp, Homo sapiens
cacagctgcagagacaga

SEQ ID NO: 538496 - DNA, 23 bp, Homo sapiens
cacaggacaggaaagtggcacct

SEQ ID NO: 538497 - DNA, 14 bp, Homo sapiens
cacaggatgcatat

SEQ ID NO: 538498 - DNA, 17 bp, Homo sapiens
cacaggatgcatattaa

SEQ ID NO: 538499 - DNA, 23 bp, Homo sapiens
cacaggccaccctgtgcagaagg

SEQ ID NO: 538500 - DNA, 20 bp, Homo sapiens
cacaggctgccccacccctc

SEQ ID NO: 538501 - DNA, 17 bp, Homo sapiens
cacagggcatgaaatga

SEQ ID NO: 538502 - DNA, 15 bp, Homo sapiens
cacagtatttaacat

SEQ ID NO: 538503 - DNA, 15 bp, Homo sapiens
cacagtcactgctct

SEQ ID NO: 538504 - DNA, 15 bp, Homo sapiens
cacagtgtaccatta

SEQ ID NO: 538505 - DNA, 18 bp, Homo sapiens
cacagtgtaccattaaaa

SEQ ID NO: 538506 - DNA, 14 bp, Homo sapiens
cacatacatatata

SEQ ID NO: 538507 - DNA, 22 bp, Homo sapiens
cacatatacctataatgtgtgt

SEQ ID NO: 538508 - DNA, 14 bp, Homo sapiens
cacatatatacata

SEQ ID NO: 538509 - DNA, 17 bp, Homo sapiens
cacatatatacatacgc

SEQ ID NO: 538510 - DNA, 22 bp, Homo sapiens
cacatatatgtatacgcacgca

SEQ ID NO: 538511 - DNA, 14 bp, Homo sapiens
cacatccattccca

SEQ ID NO: 538512 - DNA, 22 bp, Homo sapiens
cacatcccccgtgtattcagga

SEQ ID NO: 538513 - DNA, 19 bp, Homo sapiens
cacatccggggccagctcc

SEQ ID NO: 538514 - DNA, 14 bp, Homo sapiens
cacatctcttcatg

SEQ ID NO: 538515 - DNA, 18 bp, Homo sapiens
cacatgatttcacaaata

SEQ ID NO: 538516 - DNA, 20 bp, Homo sapiens
cacatgatttcacaaatatt

SEQ ID NO: 538517 - DNA, 22 bp, Homo sapiens
cacatgcccctcttagaagaaa

SEQ ID NO: 538518 - DNA, 23 bp, Homo sapiens
cacatgcttagcttatctttctt

SEQ ID NO: 538519 - DNA, 12 bp, Homo sapiens
cacatgttttca

SEQ ID NO: 538520 - DNA, 16 bp, Homo sapiens
cacatgttttcaaatg

SEQ ID NO: 538521 - DNA, 14 bp, Homo sapiens
cacattctgctgcc

SEQ ID NO: 538522 - DNA, 18 bp, Homo sapiens
cacattctgctgccccca

SEQ ID NO: 538523 - DNA, 22 bp, Homo sapiens
cacattctgctgcccccagacc

SEQ ID NO: 538524 - DNA, 15 bp, Homo sapiens
cacattgaaactgta

SEQ ID NO: 538525 - DNA, 18 bp, Homo sapiens
cacattgaaactgtattt

SEQ ID NO: 538526 - DNA, 22 bp, Homo sapiens
cacattgcccacacctgcctct

SEQ ID NO: 538527 - DNA, 17 bp, Homo sapiens
cacatttcactgtctgt

SEQ ID NO: 538528 - DNA, 12 bp, Homo sapiens
cacatttcatga

SEQ ID NO: 538529 - DNA, 19 bp, Homo sapiens
caccaaaaaaatccagaaa

SEQ ID NO: 538530 - DNA, 20 bp, Homo sapiens
caccaaaaaaatccagaaac

SEQ ID NO: 538531 - DNA, 15 bp, Homo sapiens
caccaagtacaagga

SEQ ID NO: 538532 - DNA, 11 bp, Homo sapiens
caccaataaag

SEQ ID NO: 538533 - DNA, 17 bp, Homo sapiens
caccaataaaggaggaa

SEQ ID NO: 538534 - DNA, 21 bp, Homo sapiens
caccaataaaggaggaatcag

SEQ ID NO: 538535 - DNA, 15 bp, Homo sapiens
caccagatgtgacag

SEQ ID NO: 538536 - DNA, 16 bp, Homo sapiens
caccaggcccccctgt

SEQ ID NO: 538537 - DNA, 21 bp, Homo sapiens
caccagtacattctcagtttt

SEQ ID NO: 538538 - DNA, 15 bp, Homo sapiens
caccagtgacctgga

SEQ ID NO: 538539 - DNA, 20 bp, Homo sapiens
caccatccaccttcccttct

SEQ ID NO: 538540 - DNA, 20 bp, Homo sapiens
cacccacaccctacagcaga

SEQ ID NO: 538541 - DNA, 11 bp, Homo sapiens
cacccagaaac

SEQ ID NO: 538542 - DNA, 22 bp, Homo sapiens
cacccgcatgtacaaaaacaca

SEQ ID NO: 538543 - DNA, 13 bp, Homo sapiens
cacccggcagccc

SEQ ID NO: 538544 - DNA, 22 bp, Homo sapiens
cacccggtgacctctagccctg

SEQ ID NO: 538545 - DNA, 14 bp, Homo sapiens
caccctacagcaga

SEQ ID NO: 538546 - DNA, 15 bp, Homo sapiens
caccctacagcagat

SEQ ID NO: 538547 - DNA, 17 bp, Homo sapiens
caccctacagcagatcc

SEQ ID NO: 538548 - DNA, 16 bp, Homo sapiens
caccctccccttccca

SEQ ID NO: 538549 - DNA, 20 bp, Homo sapiens
caccctccccttcccagggc

SEQ ID NO: 538550 - DNA, 15 bp, Homo sapiens
cacctaattaatttc

SEQ ID NO: 538551 - DNA, 14 bp, Homo sapiens
cacctataatacca

SEQ ID NO: 538552 - DNA, 20 bp, Homo sapiens
cacctataataccagctact

SEQ ID NO: 538553 - DNA, 15 bp, Homo sapiens
cacctccccaggccg

SEQ ID NO: 538554 - DNA, 17 bp, Homo sapiens
cacctcccccactccca

SEQ ID NO: 538555 - DNA, 21 bp, Homo sapiens
cacctcccccactcccaacca

SEQ ID NO: 538556 - DNA, 14 bp, Homo sapiens
cacctctgtaattt

SEQ ID NO: 538557 - DNA, 18 bp, Homo sapiens
cacctgacagcccctccc

SEQ ID NO: 538558 - DNA, 23 bp, Homo sapiens
cacctgcagattctaggacctgt

SEQ ID NO: 538559 - DNA, 11 bp, Homo sapiens
cacctgcagct

SEQ ID NO: 538560 - DNA, 16 bp, Homo sapiens
cacctgcagctccctc

SEQ ID NO: 538561 - DNA, 18 bp, Homo sapiens
cacctgcccggcccagga

SEQ ID NO: 538562 - DNA, 12 bp, Homo sapiens
cacctgctctgc

SEQ ID NO: 538563 - DNA, 13 bp, Homo sapiens
cacctgcttctca

SEQ ID NO: 538564 - DNA, 21 bp, Homo sapiens
cacctgggacagggagcagcc

SEQ ID NO: 538565 - DNA, 11 bp, Homo sapiens
cacctgtctgc

SEQ ID NO: 538566 - DNA, 20 bp, Homo sapiens
cacctgtctgctccagctct

SEQ ID NO: 538567 - DNA, 13 bp, Homo sapiens
caccttctgtttt

SEQ ID NO: 538568 - DNA, 18 bp, Homo sapiens
caccttgacgtttcttct

SEQ ID NO: 538569 - DNA, 19 bp, Homo sapiens
caccttgacgtttcttctt

SEQ ID NO: 538570 - DNA, 20 bp, Homo sapiens
caccttggcgcgcagcccgg

SEQ ID NO: 538571 - DNA, 15 bp, Homo sapiens
cacgagagcgcagca

SEQ ID NO: 538572 - DNA, 13 bp, Homo sapiens
cacgcaacttgaa

SEQ ID NO: 538573 - DNA, 12 bp, Homo sapiens
cacgcacgcaca

SEQ ID NO: 538574 - DNA, 12 bp, Homo sapiens
cacgcagacaca

SEQ ID NO: 538575 - DNA, 15 bp, Homo sapiens
cacgcagacacacac

SEQ ID NO: 538576 - DNA, 20 bp, Homo sapiens
cacgccctcattacggctcc

SEQ ID NO: 538577 - DNA, 14 bp, Homo sapiens
cacggcctcctttc

SEQ ID NO: 538578 - DNA, 16 bp, Homo sapiens
cacggcctctggggag

SEQ ID NO: 538579 - DNA, 21 bp, Homo sapiens
cacggcgtccctgagggccct

SEQ ID NO: 538580 - DNA, 11 bp, Homo sapiens
cactaaatgtt

SEQ ID NO: 538581 - DNA, 16 bp, Homo sapiens
cactaagtctcttttt

SEQ ID NO: 538582 - DNA, 22 bp, Homo sapiens
cactaagtctcttttttacaaa

SEQ ID NO: 538583 - DNA, 16 bp, Homo sapiens
cactaattttgtttta

SEQ ID NO: 538584 - DNA, 17 bp, Homo sapiens
cactaccaaaggacact

SEQ ID NO: 538585 - DNA, 12 bp, Homo sapiens
cactcagagcag

SEQ ID NO: 538586 - DNA, 16 bp, Homo sapiens
cactcccgttttcggt

SEQ ID NO: 538587 - DNA, 16 bp, Homo sapiens
cactcctgctctgctc

SEQ ID NO: 538588 - DNA, 13 bp, Homo sapiens
cactctaagatgt

SEQ ID NO: 538589 - DNA, 16 bp, Homo sapiens
cactctaagatgttat

SEQ ID NO: 538590 - DNA, 21 bp, Homo sapiens
cactctaagatgttatatttt

SEQ ID NO: 538591 - DNA, 21 bp, Homo sapiens
cactcttgtttctcccgtgct

SEQ ID NO: 538592 - DNA, 14 bp, Homo sapiens
cactgaacttttca

SEQ ID NO: 538593 - DNA, 21 bp, Homo sapiens
cactgaacttttcaaaataaa

SEQ ID NO: 538594 - DNA, 17 bp, Homo sapiens
cactgaagtcagttctc

SEQ ID NO: 538595 - DNA, 15 bp, Homo sapiens
cactgaagtttgata

SEQ ID NO: 538596 - DNA, 21 bp, Homo sapiens
cactgaagtttgataaatagt

SEQ ID NO: 538597 - DNA, 15 bp, Homo sapiens
cactgaatctgtaca

SEQ ID NO: 538598 - DNA, 17 bp, Homo sapiens
cactgagtacaaatgtg

SEQ ID NO: 538599 - DNA, 21 bp, Homo sapiens
cactgagtctcattcctctgt

SEQ ID NO: 538600 - DNA, 16 bp, Homo sapiens
cactgagtgaaatatt

SEQ ID NO: 538601 - DNA, 12 bp, Homo sapiens
cactgagttcta

SEQ ID NO: 538602 - DNA, 15 bp, Homo sapiens
cactgagttctatca

SEQ ID NO: 538603 - DNA, 22 bp, Homo sapiens
cactgcaaaaccaggttttgtt

SEQ ID NO: 538604 - DNA, 13 bp, Homo sapiens
cactgcactctag

SEQ ID NO: 538605 - DNA, 18 bp, Homo sapiens
cactgcactctagccgga

SEQ ID NO: 538606 - DNA, 22 bp, Homo sapiens
cactgccatggaggcacacagc

SEQ ID NO: 538607 - DNA, 14 bp, Homo sapiens
cactgctccctgaa

SEQ ID NO: 538608 - DNA, 17 bp, Homo sapiens
cactgctgtaaagcaaa

SEQ ID NO: 538609 - DNA, 23 bp, Homo sapiens
cactgctgtaaagcaaaatattt

SEQ ID NO: 538610 - DNA, 21 bp, Homo sapiens
cactggctgtgggctcccttc

SEQ ID NO: 538611 - DNA, 16 bp, Homo sapiens
cactgtatttgttaat

SEQ ID NO: 538612 - DNA, 21 bp, Homo sapiens
cactgtcaccaccctgctcat

SEQ ID NO: 538613 - DNA, 19 bp, Homo sapiens
cactgtcccggagctcagg

SEQ ID NO: 538614 - DNA, 14 bp, Homo sapiens
cactgttataaatt

SEQ ID NO: 538615 - DNA, 22 bp, Homo sapiens
cactgttataaattttgtacat

SEQ ID NO: 538616 - DNA, 24 bp, Homo sapiens
cactgttataaattttgtacattt

SEQ ID NO: 538617 - DNA, 23 bp, Homo sapiens
cacttacagaaccaattcacttt

SEQ ID NO: 538618 - DNA, 14 bp, Homo sapiens
cacttatttccatg

SEQ ID NO: 538619 - DNA, 17 bp, Homo sapiens
cacttcagggcagattt

SEQ ID NO: 538620 - DNA, 22 bp, Homo sapiens
cacttcagggcagattttagtt

SEQ ID NO: 538621 - DNA, 15 bp, Homo sapiens
cacttcatccagatg

SEQ ID NO: 538622 - DNA, 23 bp, Homo sapiens
cacttccccttgggatgggcaca

SEQ ID NO: 538623 - DNA, 19 bp, Homo sapiens
cacttctttcccttcctcc

SEQ ID NO: 538624 - DNA, 12 bp, Homo sapiens
catccattccca

SEQ ID NO: 538625 - DNA, 12 bp, Homo sapiens
catcccacagcc

SEQ ID NO: 538626 - DNA, 16 bp, Homo sapiens
catcccaccccatcct

SEQ ID NO: 538627 - DNA, 19 bp, Homo sapiens
catcccaccccatcctcca

SEQ ID NO: 538628 - DNA, 20 bp, Homo sapiens
catcccagccccaattttct

SEQ ID NO: 538629 - DNA, 15 bp, Homo sapiens
catccccagccccct

SEQ ID NO: 538630 - DNA, 17 bp, Homo sapiens
catcccggggccatgga

SEQ ID NO: 538631 - DNA, 18 bp, Homo sapiens
catcccttctcttccagg

SEQ ID NO: 538632 - DNA, 23 bp, Homo sapiens
catccgtgtatttggctgggcta

SEQ ID NO: 538633 - DNA, 14 bp, Homo sapiens
catcctcagaacca

SEQ ID NO: 538634 - DNA, 15 bp, Homo sapiens
catcctcctccttcc

SEQ ID NO: 538635 - DNA, 17 bp, Homo sapiens
catcctcctccttccta

SEQ ID NO: 538636 - DNA, 11 bp, Homo sapiens
catcctcttat

SEQ ID NO: 538637 - DNA, 16 bp, Homo sapiens
catcctgccttcatgg

SEQ ID NO: 538638 - DNA, 22 bp, Homo sapiens
catcctgccttcatggaactca

SEQ ID NO: 538639 - DNA, 14 bp, Homo sapiens
catccttctcccca

SEQ ID NO: 538640 - DNA, 17 bp, Homo sapiens
catcctttcacttcttt

SEQ ID NO: 538641 - DNA, 21 bp, Homo sapiens
catcctttcacttctttccct

SEQ ID NO: 538642 - DNA, 15 bp, Homo sapiens
catcggttcaggagg

SEQ ID NO: 538643 - DNA, 16 bp, Homo sapiens
catcggttcaggagga

SEQ ID NO: 538644 - DNA, 14 bp, Homo sapiens
catctaaactttaa

SEQ ID NO: 538645 - DNA, 15 bp, Homo sapiens
catctaaactttaat

SEQ ID NO: 538646 - DNA, 17 bp, Homo sapiens
catctaaactttaatat

SEQ ID NO: 538647 - DNA, 15 bp, Homo sapiens
catctcatccatcaa

SEQ ID NO: 538648 - DNA, 17 bp, Homo sapiens
catctcccctttgctaa

SEQ ID NO: 538649 - DNA, 16 bp, Homo sapiens
catctccttagaaaag

SEQ ID NO: 538650 - DNA, 16 bp, Homo sapiens
catctcgtatggattt

SEQ ID NO: 538651 - DNA, 17 bp, Homo sapiens
catctctgtaaaaagca

SEQ ID NO: 538652 - DNA, 23 bp, Homo sapiens
catctgagagaggctaaaatgtt

SEQ ID NO: 538653 - DNA, 17 bp, Homo sapiens
catctgcagtgttctgt

SEQ ID NO: 538654 - DNA, 18 bp, Homo sapiens
catctgctgagctctgac

SEQ ID NO: 538655 - DNA, 22 bp, Homo sapiens
catcttgacagagcctgcccca

SEQ ID NO: 538656 - DNA, 13 bp, Homo sapiens
catcttttatcta

SEQ ID NO: 538657 - DNA, 19 bp, Homo sapiens
catgaaatgaacacaaatt

SEQ ID NO: 538658 - DNA, 19 bp, Homo sapiens
catgaaatgctatgtcatt

SEQ ID NO: 538659 - DNA, 16 bp, Homo sapiens
catgacccgtacacac

SEQ ID NO: 538660 - DNA, 15 bp, Homo sapiens
catgaccctggagcc

SEQ ID NO: 538661 - DNA, 16 bp, Homo sapiens
catgatgctctttccc

SEQ ID NO: 538662 - DNA, 20 bp, Homo sapiens
catgattccaagggcccaga

SEQ ID NO: 538663 - DNA, 21 bp, Homo sapiens
catgattccaagggcccagag

SEQ ID NO: 538664 - DNA, 23 bp, Homo sapiens
catgattccaagggcccagaggg

SEQ ID NO: 538665 - DNA, 15 bp, Homo sapiens
catgatttcacaaat

SEQ ID NO: 538666 - DNA, 19 bp, Homo sapiens
catgcccctcttagaagaa

SEQ ID NO: 538667 - DNA, 15 bp, Homo sapiens
catgccgggtgcagc

SEQ ID NO: 538668 - DNA, 16 bp, Homo sapiens
catgcctgctttagaa

SEQ ID NO: 538669 - DNA, 15 bp, Homo sapiens
catgctcagctcagc

SEQ ID NO: 538670 - DNA, 12 bp, Homo sapiens
catgcttagctt

SEQ ID NO: 538671 - DNA, 19 bp, Homo sapiens
catgctttaaagtgtaata

SEQ ID NO: 538672 - DNA, 16 bp, Homo sapiens
catggaagctggcagg

SEQ ID NO: 538673 - DNA, 18 bp, Homo sapiens
catggaattggtttaaac

SEQ ID NO: 538674 - DNA, 21 bp, Homo sapiens
catggaattggtttaaacttt

SEQ ID NO: 538675 - DNA, 22 bp, Homo sapiens
catggaattggtttaaactttt

SEQ ID NO: 538676 - DNA, 21 bp, Homo sapiens
catggagtagagtcaggagaa

SEQ ID NO: 538677 - DNA, 15 bp, Homo sapiens
catggatacttcctg

SEQ ID NO: 538678 - DNA, 16 bp, Homo sapiens
catggatacttcctgg

SEQ ID NO: 538679 - DNA, 21 bp, Homo sapiens
catgggaggtgaaaggggcac

SEQ ID NO: 538680 - DNA, 22 bp, Homo sapiens
catgggagtcagggagccctgg

SEQ ID NO: 538681 - DNA, 17 bp, Homo sapiens
catggtgaactgaagca

SEQ ID NO: 538682 - DNA, 13 bp, Homo sapiens
catggtgcaattt

SEQ ID NO: 538683 - DNA, 17 bp, Homo sapiens
catggtgcaatttgtct

SEQ ID NO: 538684 - DNA, 18 bp, Homo sapiens
catgtcctatgtgtgact

SEQ ID NO: 538685 - DNA, 18 bp, Homo sapiens
catgtcctgtgtcagttt

SEQ ID NO: 538686 - DNA, 20 bp, Homo sapiens
catgtcctgtgtcagtttat

SEQ ID NO: 538687 - DNA, 16 bp, Homo sapiens
catgtcgcacaatgtt

SEQ ID NO: 538688 - DNA, 13 bp, Homo sapiens
catgtctcagatt

SEQ ID NO: 538689 - DNA, 20 bp, Homo sapiens
catgtctttctccaaagtta

SEQ ID NO: 538690 - DNA, 20 bp, Homo sapiens
catgtgagcatgtcacttcc

SEQ ID NO: 538691 - DNA, 23 bp, Homo sapiens
catgtgatgtgttgctctccatt

SEQ ID NO: 538692 - DNA, 14 bp, Homo sapiens
catgtgcgaacaca

SEQ ID NO: 538693 - DNA, 15 bp, Homo sapiens
catgtgctgctgtgg

SEQ ID NO: 538694 - DNA, 18 bp, Homo sapiens
catgtggaaaactcacag

SEQ ID NO: 538695 - DNA, 17 bp, Homo sapiens
catgtggcctaatattg

SEQ ID NO: 538696 - DNA, 21 bp, Homo sapiens
catgtggcctaatattgaaaa

SEQ ID NO: 538697 - DNA, 12 bp, Homo sapiens
catgtgggagct

SEQ ID NO: 538698 - DNA, 12 bp, Homo sapiens
catgtgtgtata

SEQ ID NO: 538699 - DNA, 13 bp, Homo sapiens
catgtgtgtataa

SEQ ID NO: 538700 - DNA, 14 bp, Homo sapiens
catgtgtgtatata

SEQ ID NO: 538701 - DNA, 19 bp, Homo sapiens
catgtgtgtatatatgtgt

SEQ ID NO: 538702 - DNA, 15 bp, Homo sapiens
catgtgtttctgtgt

SEQ ID NO: 538703 - DNA, 18 bp, Homo sapiens
catgttaattgatagaat

SEQ ID NO: 538704 - DNA, 16 bp, Homo sapiens
catgttttcaaatgga

SEQ ID NO: 538705 - DNA, 16 bp, Homo sapiens
cattaaaatatgcact

SEQ ID NO: 538706 - DNA, 14 bp, Homo sapiens
cattaatgtgttgg

SEQ ID NO: 538707 - DNA, 20 bp, Homo sapiens
cattaatgttgatttctagt

SEQ ID NO: 538708 - DNA, 16 bp, Homo sapiens
cattacggctcctctc

SEQ ID NO: 538709 - DNA, 18 bp, Homo sapiens
cattactagataaaatgt

SEQ ID NO: 538710 - DNA, 20 bp, Homo sapiens
cattactgtttaagacactt

SEQ ID NO: 538711 - DNA, 17 bp, Homo sapiens
cattagcaaaaaaagtt

SEQ ID NO: 538712 - DNA, 22 bp, Homo sapiens
cattagcaaaaaaagttgtatg

SEQ ID NO: 538713 - DNA, 20 bp, Homo sapiens
cattagtactttatagaaga

SEQ ID NO: 538714 - DNA, 18 bp, Homo sapiens
cattataatcaccagggc

SEQ ID NO: 538715 - DNA, 15 bp, Homo sapiens
cattatcttcatgtt

SEQ ID NO: 538716 - DNA, 17 bp, Homo sapiens
cattatgtgtgcatgtg

SEQ ID NO: 538717 - DNA, 22 bp, Homo sapiens
cattatgtgtgcatgtgtgtat

SEQ ID NO: 538718 - DNA, 23 bp, Homo sapiens
cattcaaatgggtgatatcctga

SEQ ID NO: 538719 - DNA, 21 bp, Homo sapiens
cattcatgcaacttgattctt

SEQ ID NO: 538720 - DNA, 13 bp, Homo sapiens
cattctcagtttt

SEQ ID NO: 538721 - DNA, 18 bp, Homo sapiens
cattctcagtttttctta

SEQ ID NO: 538722 - DNA, 20 bp, Homo sapiens
cattctggcactttaatgat

SEQ ID NO: 538723 - DNA, 11 bp, Homo sapiens
cattctgtcct

SEQ ID NO: 538724 - DNA, 22 bp, Homo sapiens
cattcttataacattgtatgtt

SEQ ID NO: 538725 - DNA, 13 bp, Homo sapiens
cattcttttaaat

SEQ ID NO: 538726 - DNA, 13 bp, Homo sapiens
cattgcttcttct

SEQ ID NO: 538727 - DNA, 19 bp, Homo sapiens
cattggaaatttcacgtca

SEQ ID NO: 538728 - DNA, 21 bp, Homo sapiens
cattggaagcaggttaaatgt

SEQ ID NO: 538729 - DNA, 23 bp, Homo sapiens
cattggaagcaggttaaatgttt

SEQ ID NO: 538730 - DNA, 14 bp, Homo sapiens
cattggatctgcaa

SEQ ID NO: 538731 - DNA, 21 bp, Homo sapiens
cattgtatgttaatagaaaat

SEQ ID NO: 538732 - DNA, 17 bp, Homo sapiens
cattgtatttaaaacat

SEQ ID NO: 538733 - DNA, 20 bp, Homo sapiens
cattgtatttaaaacatttc

SEQ ID NO: 538734 - DNA, 22 bp, Homo sapiens
cattgtatttaaaacatttcat

SEQ ID NO: 538735 - DNA, 16 bp, Homo sapiens
cattgtccagagctgc

SEQ ID NO: 538736 - DNA, 22 bp, Homo sapiens
cattgtccagagctgcttcccc

SEQ ID NO: 538737 - DNA, 23 bp, Homo sapiens
cattgtgtatgagactgtgtttc

SEQ ID NO: 538738 - DNA, 16 bp, Homo sapiens
cattgttgctccctgt

SEQ ID NO: 538739 - DNA, 17 bp, Homo sapiens
cattgttgctccctgtg

SEQ ID NO: 538740 - DNA, 14 bp, Homo sapiens
catttaaacccaat

SEQ ID NO: 538741 - DNA, 13 bp, Homo sapiens
catttaacactga

SEQ ID NO: 538742 - DNA, 18 bp, Homo sapiens
catttaagttgtaaacgt

SEQ ID NO: 538743 - DNA, 17 bp, Homo sapiens
catttacagtctctttc

SEQ ID NO: 538744 - DNA, 16 bp, Homo sapiens
catttagcacagtatt

SEQ ID NO: 538745 - DNA, 14 bp, Homo sapiens
catttagtcctcac

SEQ ID NO: 538746 - DNA, 15 bp, Homo sapiens
catttagtcctcacc

SEQ ID NO: 538747 - DNA, 18 bp, Homo sapiens
catttagtcctcaccttc

SEQ ID NO: 538748 - DNA, 23 bp, Homo sapiens
catttagtcctcaccttctgttt

SEQ ID NO: 538749 - DNA, 20 bp, Homo sapiens
catttatggtaatcatatta

SEQ ID NO: 538750 - DNA, 13 bp, Homo sapiens
catttcacattaa

SEQ ID NO: 538751 - DNA, 15 bp, Homo sapiens
catttcacattaatg

SEQ ID NO: 538752 - DNA, 15 bp, Homo sapiens
catttcactgtctgt

SEQ ID NO: 538753 - DNA, 21 bp, Homo sapiens
catttcatgtatttctttaga

SEQ ID NO: 538754 - DNA, 19 bp, Homo sapiens
catttccaacaccacagac

SEQ ID NO: 538755 - DNA, 22 bp, Homo sapiens
catttccaacaccacagacaca

SEQ ID NO: 538756 - DNA, 14 bp, Homo sapiens
catttccatgtatg

SEQ ID NO: 538757 - DNA, 15 bp, Homo sapiens
catttccatgtatgc

SEQ ID NO: 538758 - DNA, 17 bp, Homo sapiens
catttccatgtatgcat

SEQ ID NO: 538759 - DNA, 22 bp, Homo sapiens
catttccgtaattcttattcca

SEQ ID NO: 538760 - DNA, 15 bp, Homo sapiens
catttccttgtctaa

SEQ ID NO: 538761 - DNA, 17 bp, Homo sapiens
cccatgaaacagcagct

SEQ ID NO: 538762 - DNA, 13 bp, Homo sapiens
cccatgaccgttc

SEQ ID NO: 538763 - DNA, 21 bp, Homo sapiens
cccatgccctccgtcctggca

SEQ ID NO: 538764 - DNA, 16 bp, Homo sapiens
cccatgtgagctgctg

SEQ ID NO: 538765 - DNA, 18 bp, Homo sapiens
cccatgtgagctgctgcc

SEQ ID NO: 538766 - DNA, 22 bp, Homo sapiens
cccatgtgagctgctgccatga

SEQ ID NO: 538767 - DNA, 21 bp, Homo sapiens
cccattgcatcacctctgtaa

SEQ ID NO: 538768 - DNA, 13 bp, Homo sapiens
cccattgtattta

SEQ ID NO: 538769 - DNA, 14 bp, Homo sapiens
cccattgtatttaa

SEQ ID NO: 538770 - DNA, 13 bp, Homo sapiens
cccatttcctgta

SEQ ID NO: 538771 - DNA, 15 bp, Homo sapiens
cccattttctttaca

SEQ ID NO: 538772 - DNA, 18 bp, Homo sapiens
ccccaacccaaacctgga

SEQ ID NO: 538773 - DNA, 16 bp, Homo sapiens
ccccacacctggccct

SEQ ID NO: 538774 - DNA, 12 bp, Homo sapiens
ccccacccctcc

SEQ ID NO: 538775 - DNA, 21 bp, Homo sapiens
ccccactggctgtgggctccc

SEQ ID NO: 538776 - DNA, 23 bp, Homo sapiens
ccccagaccccatccagccaggg

SEQ ID NO: 538777 - DNA, 17 bp, Homo sapiens
ccccagccccctggccc

SEQ ID NO: 538778 - DNA, 18 bp, Homo sapiens
ccccagcttcacttctga

SEQ ID NO: 538779 - DNA, 14 bp, Homo sapiens
ccccaggaccctga

SEQ ID NO: 538780 - DNA, 14 bp, Homo sapiens
ccccagtgctcaca

SEQ ID NO: 538781 - DNA, 20 bp, Homo sapiens
ccccagtgctcacacaatca

SEQ ID NO: 538782 - DNA, 20 bp, Homo sapiens
ccccagtgtccccaggggca

SEQ ID NO: 538783 - DNA, 23 bp, Homo sapiens
ccccataatgcttctttcctctt

SEQ ID NO: 538784 - DNA, 15 bp, Homo sapiens
ccccatccagccagg

SEQ ID NO: 538785 - DNA, 16 bp, Homo sapiens
ccccatgccctccctg

SEQ ID NO: 538786 - DNA, 21 bp, Homo sapiens
ccccatgccctccctgctgcc

SEQ ID NO: 538787 - DNA, 21 bp, Homo sapiens
ccccatttcctgtacaatcat

SEQ ID NO: 538788 - DNA, 14 bp, Homo sapiens
ccccattttcttta

SEQ ID NO: 538789 - DNA, 16 bp, Homo sapiens
ccccattttctttaca

SEQ ID NO: 538790 - DNA, 19 bp, Homo sapiens
cccccactgaatccctgta

SEQ ID NO: 538791 - DNA, 15 bp, Homo sapiens
cccccactggctgtg

SEQ ID NO: 538792 - DNA, 11 bp, Homo sapiens
cccccaggtct

SEQ ID NO: 538793 - DNA, 12 bp, Homo sapiens
cccccatgccct

SEQ ID NO: 538794 - DNA, 19 bp, Homo sapiens
cccccatgccctccctgct

SEQ ID NO: 538795 - DNA, 12 bp, Homo sapiens
cccccctgtcac

SEQ ID NO: 538796 - DNA, 13 bp, Homo sapiens
cccccgctctgcc

SEQ ID NO: 538797 - DNA, 19 bp, Homo sapiens
cccccgctctgccatcagc

SEQ ID NO: 538798 - DNA, 22 bp, Homo sapiens
cccccgtctaaccacagctcct

SEQ ID NO: 538799 - DNA, 19 bp, Homo sapiens
ccccctcaggaccctcgct

SEQ ID NO: 538800 - DNA, 19 bp, Homo sapiens
ccccctccttcccagctgc

SEQ ID NO: 538801 - DNA, 21 bp, Homo sapiens
ccccctccttcccagctgccc

SEQ ID NO: 538802 - DNA, 18 bp, Homo sapiens
ccccctggcccctcccac

SEQ ID NO: 538803 - DNA, 12 bp, Homo sapiens
ccccgctctgcc

SEQ ID NO: 538804 - DNA, 23 bp, Homo sapiens
ccccgctctgccatcagcccctg

SEQ ID NO: 538805 - DNA, 16 bp, Homo sapiens
ccccggagctgggaag

SEQ ID NO: 538806 - DNA, 22 bp, Homo sapiens
cccctaaagatggcgcacccgg

SEQ ID NO: 538807 - DNA, 19 bp, Homo sapiens
cccctcaggaccctcgctg

SEQ ID NO: 538808 - DNA, 19 bp, Homo sapiens
cccctcccctaatgcctgc

SEQ ID NO: 538809 - DNA, 16 bp, Homo sapiens
cccctcttagaagaaa

SEQ ID NO: 538810 - DNA, 13 bp, Homo sapiens
cccctgcctgccc

SEQ ID NO: 538811 - DNA, 19 bp, Homo sapiens
cccctgcctgccctgtcag

SEQ ID NO: 538812 - DNA, 15 bp, Homo sapiens
cccctgctgctcctc

SEQ ID NO: 538813 - DNA, 23 bp, Homo sapiens
cccctgctgctcctcggccagag

SEQ ID NO: 538814 - DNA, 13 bp, Homo sapiens
cccctggtcctgc

SEQ ID NO: 538815 - DNA, 21 bp, Homo sapiens
cccctggtcctgcactgtccc

SEQ ID NO: 538816 - DNA, 18 bp, Homo sapiens
ccccttcccgtgacctgg

SEQ ID NO: 538817 - DNA, 14 bp, Homo sapiens
cccctttcttcctc

SEQ ID NO: 538818 - DNA, 22 bp, Homo sapiens
cccgaaggtctctctggctcta

SEQ ID NO: 538819 - DNA, 23 bp, Homo sapiens
cccgaaggttatggtcaatccca

SEQ ID NO: 538820 - DNA, 22 bp, Homo sapiens
cccgaatggagtccagacctgg

SEQ ID NO: 538821 - DNA, 18 bp, Homo sapiens
cccgagccgagctctcct

SEQ ID NO: 538822 - DNA, 20 bp, Homo sapiens
cccgcatgtacaaaaacaca

SEQ ID NO: 538823 - DNA, 17 bp, Homo sapiens
cccggcagccccccagt

SEQ ID NO: 538824 - DNA, 13 bp, Homo sapiens
cccggcagtgcac

SEQ ID NO: 538825 - DNA, 21 bp, Homo sapiens
cccggcatgccgagtgcccca

SEQ ID NO: 538826 - DNA, 12 bp, Homo sapiens
cccggcccagga

SEQ ID NO: 538827 - DNA, 21 bp, Homo sapiens
cccgggagatccgccctgggc

SEQ ID NO: 538828 - DNA, 19 bp, Homo sapiens
cccgtgccaaatcctgggc

SEQ ID NO: 538829 - DNA, 15 bp, Homo sapiens
cccgtggctttgtgc

SEQ ID NO: 538830 - DNA, 23 bp, Homo sapiens
cccgttgtgtgggtttactctgt

SEQ ID NO: 538831 - DNA, 21 bp, Homo sapiens
ccctaaagatggcgcacccgg

SEQ ID NO: 538832 - DNA, 12 bp, Homo sapiens
ccctaatgcctg

SEQ ID NO: 538833 - DNA, 12 bp, Homo sapiens
ccctacagcaga

SEQ ID NO: 538834 - DNA, 13 bp, Homo sapiens
ccctagttctttg

SEQ ID NO: 538835 - DNA, 21 bp, Homo sapiens
ccctattctatccatctcctg

SEQ ID NO: 538836 - DNA, 15 bp, Homo sapiens
ccctcaggaccctcg

SEQ ID NO: 538837 - DNA, 23 bp, Homo sapiens
ccctcaggaccctcgctggcccc

SEQ ID NO: 538838 - DNA, 13 bp, Homo sapiens
ccctcatctgtct

SEQ ID NO: 538839 - DNA, 14 bp, Homo sapiens
ccctcatctgtctg

SEQ ID NO: 538840 - DNA, 20 bp, Homo sapiens
ccctcattaaactaattaaa

SEQ ID NO: 538841 - DNA, 22 bp, Homo sapiens
ccctcccagatccaggaacaca

SEQ ID NO: 538842 - DNA, 18 bp, Homo sapiens
ccctcccttgtccttgaa

SEQ ID NO: 538843 - DNA, 16 bp, Homo sapiens
ccctccgcgggggaca

SEQ ID NO: 538844 - DNA, 16 bp, Homo sapiens
ccctccgtcctggcag

SEQ ID NO: 538845 - DNA, 15 bp, Homo sapiens
ccctcgctggccccc

SEQ ID NO: 538846 - DNA, 23 bp, Homo sapiens
ccctcggggcaggaagtccctga

SEQ ID NO: 538847 - DNA, 13 bp, Homo sapiens
ccctcgtctttcc

SEQ ID NO: 538848 - DNA, 21 bp, Homo sapiens
ccctcgtctttcccaaaggca

SEQ ID NO: 538849 - DNA, 15 bp, Homo sapiens
ccctcttagaagaaa

SEQ ID NO: 538850 - DNA, 14 bp, Homo sapiens
ccctcttccctggt

SEQ ID NO: 538851 - DNA, 18 bp, Homo sapiens
ccctgaatctgaccacag

SEQ ID NO: 538852 - DNA, 22 bp, Homo sapiens
ccctgaatctgaccacagacac

SEQ ID NO: 538853 - DNA, 13 bp, Homo sapiens
ccctgacactgtc

SEQ ID NO: 538854 - DNA, 13 bp, Homo sapiens
ccctgagggccct

SEQ ID NO: 538855 - DNA, 14 bp, Homo sapiens
ccctgagggccctt

SEQ ID NO: 538856 - DNA, 19 bp, Homo sapiens
ccctgagggtttccacctt

SEQ ID NO: 538857 - DNA, 16 bp, Homo sapiens
ccctgatcccttccac

SEQ ID NO: 538858 - DNA, 23 bp, Homo sapiens
ccctgatcccttccacctgctct

SEQ ID NO: 538859 - DNA, 16 bp, Homo sapiens
ccctgatttattctgg

SEQ ID NO: 538860 - DNA, 20 bp, Homo sapiens
ccctgcaccaggccatcagc

SEQ ID NO: 538861 - DNA, 21 bp, Homo sapiens
ccctgcagctctcatgctgcc

SEQ ID NO: 538862 - DNA, 23 bp, Homo sapiens
ccctgccagcacccccacgccct

SEQ ID NO: 538863 - DNA, 15 bp, Homo sapiens
ccctgcgcaggccct

SEQ ID NO: 538864 - DNA, 11 bp, Homo sapiens
ccctgctccct

SEQ ID NO: 538865 - DNA, 23 bp, Homo sapiens
ccctgctgccaggctcccactgc

SEQ ID NO: 538866 - DNA, 13 bp, Homo sapiens
ccctgctgctcct

SEQ ID NO: 538867 - DNA, 14 bp, Homo sapiens
ccctggagcccggc

SEQ ID NO: 538868 - DNA, 14 bp, Homo sapiens
ccctggcttcctta

SEQ ID NO: 538869 - DNA, 23 bp, Homo sapiens
ccctggggtttccacacaggccc

SEQ ID NO: 538870 - DNA, 12 bp, Homo sapiens
ccctggtcctgc

SEQ ID NO: 538871 - DNA, 13 bp, Homo sapiens
cccttacctggct

SEQ ID NO: 538872 - DNA, 16 bp, Homo sapiens
cccttccctgacactg

SEQ ID NO: 538873 - DNA, 12 bp, Homo sapiens
cccttccttctt

SEQ ID NO: 538874 - DNA, 15 bp, Homo sapiens
cccttctacaaggac

SEQ ID NO: 538875 - DNA, 13 bp, Homo sapiens
cccttctcttcca

SEQ ID NO: 538876 - DNA, 14 bp, Homo sapiens
cccttctcttccag

SEQ ID NO: 538877 - DNA, 15 bp, Homo sapiens
cccttgacctgctga

SEQ ID NO: 538878 - DNA, 19 bp, Homo sapiens
cccttgcagttatgttatc

SEQ ID NO: 538879 - DNA, 20 bp, Homo sapiens
cccttgggatgggcacaggc

SEQ ID NO: 538880 - DNA, 12 bp, Homo sapiens
cccttggtgctc

SEQ ID NO: 538881 - DNA, 21 bp, Homo sapiens
ccctttcttctcccccatcct

SEQ ID NO: 538882 - DNA, 22 bp, Homo sapiens
ccctttgtcctcctgctgccag

SEQ ID NO: 538883 - DNA, 23 bp, Homo sapiens
ccgaagggaattaaaaagaagat

SEQ ID NO: 538884 - DNA, 17 bp, Homo sapiens
ccgaccaactccagact

SEQ ID NO: 538885 - DNA, 22 bp, Homo sapiens
ccgacctgaggacatggcttct

SEQ ID NO: 538886 - DNA, 21 bp, Homo sapiens
ccgagcaaagatcaaaataaa

SEQ ID NO: 538887 - DNA, 19 bp, Homo sapiens
ccgagccgagctctcctgg

SEQ ID NO: 538888 - DNA, 16 bp, Homo sapiens
ccgagtgtggagctgc

SEQ ID NO: 538889 - DNA, 14 bp, Homo sapiens
ccgcatgtacaaaa

SEQ ID NO: 538890 - DNA, 17 bp, Homo sapiens
ccgcatgtacaaaaaca

SEQ ID NO: 538891 - DNA, 18 bp, Homo sapiens
ccgcccttccctgacact

SEQ ID NO: 538892 - DNA, 11 bp, Homo sapiens
ccgctccagag

SEQ ID NO: 538893 - DNA, 12 bp, Homo sapiens
ccgctccagagt

SEQ ID NO: 538894 - DNA, 10 bp, Homo sapiens
ccggagctgg

SEQ ID NO: 538895 - DNA, 11 bp, Homo sapiens
ccggagctggg

SEQ ID NO: 538896 - DNA, 15 bp, Homo sapiens
ccggagctgggaagg

SEQ ID NO: 538897 - DNA, 13 bp, Homo sapiens
ccggcccaggagc

SEQ ID NO: 538898 - DNA, 14 bp, Homo sapiens
ccggcccaggagcg

SEQ ID NO: 538899 - DNA, 19 bp, Homo sapiens
cggaacctgtgagctgcac

SEQ ID NO: 538900 - DNA, 17 bp, Homo sapiens
cggaatcctgtcctcag

SEQ ID NO: 538901 - DNA, 17 bp, Homo sapiens
cggaccgaaggtgacag

SEQ ID NO: 538902 - DNA, 15 bp, Homo sapiens
cggagtgacagagta

SEQ ID NO: 538903 - DNA, 22 bp, Homo sapiens
cggcaactaagcagtccctgag

SEQ ID NO: 538904 - DNA, 13 bp, Homo sapiens
cggcacagcctgg

SEQ ID NO: 538905 - DNA, 18 bp, Homo sapiens
cggcagccccccagtgtc

SEQ ID NO: 538906 - DNA, 21 bp, Homo sapiens
cggcatgccgagtgccccaga

SEQ ID NO: 538907 - DNA, 16 bp, Homo sapiens
cggccagagctcccag

SEQ ID NO: 538908 - DNA, 17 bp, Homo sapiens
cggccagagctcccagg

SEQ ID NO: 538909 - DNA, 12 bp, Homo sapiens
cggcccaggagc

SEQ ID NO: 538910 - DNA, 19 bp, Homo sapiens
cggccccagcttctcagct

SEQ ID NO: 538911 - DNA, 22 bp, Homo sapiens
cggccgtctgctctcaaggatg

SEQ ID NO: 538912 - DNA, 20 bp, Homo sapiens
cggcctggggccgggctggc

SEQ ID NO: 538913 - DNA, 23 bp, Homo sapiens
cggcctggggccgggctggcttc

SEQ ID NO: 538914 - DNA, 19 bp, Homo sapiens
cggcgtccctgagggccct

SEQ ID NO: 538915 - DNA, 18 bp, Homo sapiens
cggctatgtctcatgttt

SEQ ID NO: 538916 - DNA, 16 bp, Homo sapiens
cggctcaagcccagga

SEQ ID NO: 538917 - DNA, 23 bp, Homo sapiens
cggctccagccccagacaacagc

SEQ ID NO: 538918 - DNA, 15 bp, Homo sapiens
cgggagcctgcgtgg

SEQ ID NO: 538919 - DNA, 21 bp, Homo sapiens
cgggagcctgcgtggcctggg

SEQ ID NO: 538920 - DNA, 20 bp, Homo sapiens
cgggcagtgacgtgagtggg

SEQ ID NO: 538921 - DNA, 21 bp, Homo sapiens
cgggccaccctctgtttaaaa

SEQ ID NO: 538922 - DNA, 19 bp, Homo sapiens
cgggccccacctgcagctc

SEQ ID NO: 538923 - DNA, 16 bp, Homo sapiens
cgggctgggcagctgt

SEQ ID NO: 538924 - DNA, 11 bp, Homo sapiens
cggggccatgg

SEQ ID NO: 538925 - DNA, 22 bp, Homo sapiens
cgggtgcagacaatcttctgtt

SEQ ID NO: 538926 - DNA, 22 bp, Homo sapiens
cgggtgcctgtgaccggggtcc

SEQ ID NO: 538927 - DNA, 20 bp, Homo sapiens
cggtaaaccgaggacccatg

SEQ ID NO: 538928 - DNA, 20 bp, Homo sapiens
cggtggctcacgcctgtaat

SEQ ID NO: 538929 - DNA, 18 bp, Homo sapiens
cgtagtcggcacagcctg

SEQ ID NO: 538930 - DNA, 21 bp, Homo sapiens
cgtagtcggcacagcctggtc

SEQ ID NO: 538931 - DNA, 15 bp, Homo sapiens
cgtagtgcagcaggg

SEQ ID NO: 538932 - DNA, 21 bp, Homo sapiens
cgtatcaggaaagcatggctc

SEQ ID NO: 538933 - DNA, 12 bp, Homo sapiens
cgtattttaaaa

SEQ ID NO: 538934 - DNA, 19 bp, Homo sapiens
cgtcaccatccaccttccc

SEQ ID NO: 538935 - DNA, 16 bp, Homo sapiens
cgtcaggaggtgcctg

SEQ ID NO: 538936 - DNA, 12 bp, Homo sapiens
cgtccccagacc

SEQ ID NO: 538937 - DNA, 21 bp, Homo sapiens
cgtctaaccacagctcctttt

SEQ ID NO: 538938 - DNA, 13 bp, Homo sapiens
cgtctacagctcc

SEQ ID NO: 538939 - DNA, 17 bp, Homo sapiens
cgtctacagctccccca

SEQ ID NO: 538940 - DNA, 11 bp, Homo sapiens
cgtctttccca

SEQ ID NO: 538941 - DNA, 12 bp, Homo sapiens
cgtgaaacacaa

SEQ ID NO: 538942 - DNA, 14 bp, Homo sapiens
cgtgaaacacaata

SEQ ID NO: 538943 - DNA, 22 bp, Homo sapiens
cgtgaatagtcttttgcatgtc

SEQ ID NO: 538944 - DNA, 15 bp, Homo sapiens
cgtggcaaatataaa

SEQ ID NO: 538945 - DNA, 18 bp, Homo sapiens
cgtggcaaatataaaact

SEQ ID NO: 538946 - DNA, 12 bp, Homo sapiens
cgtggggcagca

SEQ ID NO: 538947 - DNA, 23 bp, Homo sapiens
cgtggtgaggttgtgctgcctgt

SEQ ID NO: 538948 - DNA, 14 bp, Homo sapiens
cgtgtggagggctg

SEQ ID NO: 538949 - DNA, 18 bp, Homo sapiens
cgtgtttgtctcttctgg

SEQ ID NO: 538950 - DNA, 15 bp, Homo sapiens
cgttcacccctccac

SEQ ID NO: 538951 - DNA, 19 bp, Homo sapiens
cgttgaagttgactctgct

SEQ ID NO: 538952 - DNA, 20 bp, Homo sapiens
ctaaaactgtactttgattc

SEQ ID NO: 538953 - DNA, 22 bp, Homo sapiens
ctaaaactgtactttgattcac

SEQ ID NO: 538954 - DNA, 13 bp, Homo sapiens
ctaaaatgttttc

SEQ ID NO: 538955 - DNA, 14 bp, Homo sapiens
ctaaacgtgtatgt

SEQ ID NO: 538956 - DNA, 22 bp, Homo sapiens
ctaaagatggcgcacccggcag

SEQ ID NO: 538957 - DNA, 17 bp, Homo sapiens
ctaaagtagacttcatt

SEQ ID NO: 538958 - DNA, 13 bp, Homo sapiens
ctaaatattatgc

SEQ ID NO: 538959 - DNA, 18 bp, Homo sapiens
ctaaatgcctaataaaca

SEQ ID NO: 538960 - DNA, 16 bp, Homo sapiens
ctaaatgttaaagatg

SEQ ID NO: 538961 - DNA, 23 bp, Homo sapiens
ctaaatgttaaagatgtagcaaa

SEQ ID NO: 538962 - DNA, 21 bp, Homo sapiens
ctaaattctttatttctgtca

SEQ ID NO: 538963 - DNA, 15 bp, Homo sapiens
ctaaccacagctcct

SEQ ID NO: 538964 - DNA, 17 bp, Homo sapiens
ctaactctgatgtaaat

SEQ ID NO: 538965 - DNA, 15 bp, Homo sapiens
ctaactgaagagaca

SEQ ID NO: 538966 - DNA, 13 bp, Homo sapiens
ctaactgtgcaaa

SEQ ID NO: 538967 - DNA, 16 bp, Homo sapiens
ctaacttgcttaaatg

SEQ ID NO: 538968 - DNA, 17 bp, Homo sapiens
ctaagaattttttattt

SEQ ID NO: 538969 - DNA, 16 bp, Homo sapiens
ctaagagcctctggaa

SEQ ID NO: 538970 - DNA, 18 bp, Homo sapiens
ctaagagcctctggaagg

SEQ ID NO: 538971 - DNA, 18 bp, Homo sapiens
ctaagatcggttaacaaa

SEQ ID NO: 538972 - DNA, 14 bp, Homo sapiens
ctaagatgttatat

SEQ ID NO: 538973 - DNA, 19 bp, Homo sapiens
ctaagatgttatatttttc

SEQ ID NO: 538974 - DNA, 17 bp, Homo sapiens
ctaagtaaatctaaatt

SEQ ID NO: 538975 - DNA, 18 bp, Homo sapiens
ctaagtaaatctcttctg

SEQ ID NO: 538976 - DNA, 19 bp, Homo sapiens
ctaagtaaatctcttctgt

SEQ ID NO: 538977 - DNA, 20 bp, Homo sapiens
ctaagtctcttttttacaaa

SEQ ID NO: 538978 - DNA, 14 bp, Homo sapiens
ctaataaatggact

SEQ ID NO: 538979 - DNA, 19 bp, Homo sapiens
ctaatattgaaaatgtcac

SEQ ID NO: 538980 - DNA, 23 bp, Homo sapiens
ctaatattgaaaatgtcactgtt

SEQ ID NO: 538981 - DNA, 22 bp, Homo sapiens
ctaatcctatctggggagctcc

SEQ ID NO: 538982 - DNA, 14 bp, Homo sapiens
ctaatgacaagtga

SEQ ID NO: 538983 - DNA, 15 bp, Homo sapiens
ctaatggtaactttt

SEQ ID NO: 538984 - DNA, 20 bp, Homo sapiens
ctaatggtaacttttgtagt

SEQ ID NO: 538985 - DNA, 22 bp, Homo sapiens
ctaatgttggcagatgcagctc

SEQ ID NO: 538986 - DNA, 16 bp, Homo sapiens
ctaatgtttaagcaga

SEQ ID NO: 538987 - DNA, 17 bp, Homo sapiens
ctaatgtttaagcagaa

SEQ ID NO: 538988 - DNA, 18 bp, Homo sapiens
ctaatgtttaagcagaat

SEQ ID NO: 538989 - DNA, 13 bp, Homo sapiens
ctaattaataaag

SEQ ID NO: 538990 - DNA, 14 bp, Homo sapiens
ctaattttgtttta

SEQ ID NO: 538991 - DNA, 18 bp, Homo sapiens
ctaattttgttttaaact

SEQ ID NO: 538992 - DNA, 19 bp, Homo sapiens
ctacaatacaacacattga

SEQ ID NO: 538993 - DNA, 21 bp, Homo sapiens
ctacaatttgttaattcctat

SEQ ID NO: 538994 - DNA, 22 bp, Homo sapiens
ctacagcagatccacctgcaca

SEQ ID NO: 538995 - DNA, 23 bp, Homo sapiens
ctacagcagatccacctgcacaa

SEQ ID NO: 538996 - DNA, 16 bp, Homo sapiens
ctacaggggaggctga

SEQ ID NO: 538997 - DNA, 16 bp, Homo sapiens
ctacagtagctgtggg

SEQ ID NO: 538998 - DNA, 18 bp, Homo sapiens
ctacagtagctgtgggga

SEQ ID NO: 538999 - DNA, 20 bp, Homo sapiens
ctacagtagctgtggggagc

SEQ ID NO: 539000 - DNA, 21 bp, Homo sapiens
ctacagtagctgtggggagct

SEQ ID NO: 539001 - DNA, 16 bp, Homo sapiens
ctacatgtgggagctt

SEQ ID NO: 539002 - DNA, 15 bp, Homo sapiens
ctaccaaaggacact

SEQ ID NO: 539003 - DNA, 21 bp, Homo sapiens
ctaccacggcctcctttccgt

SEQ ID NO: 539004 - DNA, 21 bp, Homo sapiens
ctacccctcccggccctgcct

SEQ ID NO: 539005 - DNA, 24 bp, Homo sapiens
ctacccctcccggccctgcctgct

SEQ ID NO: 539006 - DNA, 20 bp, Homo sapiens
ctactagggacctggggaag

SEQ ID NO: 539007 - DNA, 21 bp, Homo sapiens
ctactagggacctggggaagc

SEQ ID NO: 539008 - DNA, 11 bp, Homo sapiens
ctactcttctc

SEQ ID NO: 539009 - DNA, 18 bp, Homo sapiens
ctactcttctctctgctc

SEQ ID NO: 539010 - DNA, 19 bp, Homo sapiens
ctactcttctctctgctct

SEQ ID NO: 539011 - DNA, 12 bp, Homo sapiens
ctactgaagctt

SEQ ID NO: 539012 - DNA, 15 bp, Homo sapiens
ctactgaataaatca

SEQ ID NO: 539013 - DNA, 18 bp, Homo sapiens
ctactgaataaatcatgt

SEQ ID NO: 539014 - DNA, 23 bp, Homo sapiens
ctactgaataaatcatgtggcct

SEQ ID NO: 539015 - DNA, 19 bp, Homo sapiens
ctactggtcctcttaactg

SEQ ID NO: 539016 - DNA, 15 bp, Homo sapiens
ctacttcctgcctgg

SEQ ID NO: 539017 - DNA, 14 bp, Homo sapiens
ctactttaaattgt

SEQ ID NO: 539018 - DNA, 18 bp, Homo sapiens
ctagaaatcacaagaaca

SEQ ID NO: 539019 - DNA, 14 bp, Homo sapiens
ctagacacacaaag

SEQ ID NO: 539020 - DNA, 17 bp, Homo sapiens
ctagacacacaaagcag

SEQ ID NO: 539021 - DNA, 22 bp, Homo sapiens
ctagagaagtggactggaggag

SEQ ID NO: 539022 - DNA, 21 bp, Homo sapiens
ctagagcagcccaaatttttc

SEQ ID NO: 539023 - DNA, 16 bp, Homo sapiens
ctagcacagctccctt

SEQ ID NO: 539024 - DNA, 18 bp, Homo sapiens
ctagctttatattttgtt

SEQ ID NO: 539025 - DNA, 15 bp, Homo sapiens
ctagctttctaaagc

SEQ ID NO: 539026 - DNA, 17 bp, Homo sapiens
ctagctttctaaagcca

SEQ ID NO: 539027 - DNA, 14 bp, Homo sapiens
ctaggaacaaatct

SEQ ID NO: 539028 - DNA, 23 bp, Homo sapiens
ctaggacccccagtgctcacaca

SEQ ID NO: 539029 - DNA, 12 bp, Homo sapiens
ctaggctccttc

SEQ ID NO: 539030 - DNA, 13 bp, Homo sapiens
ctagggacctggg

SEQ ID NO: 539031 - DNA, 14 bp, Homo sapiens
ctagggacctgggg

SEQ ID NO: 539032 - DNA, 19 bp, Homo sapiens
ctagtggcttcagcccctg

SEQ ID NO: 539033 - DNA, 20 bp, Homo sapiens
ctagttcatcccttctcttc

SEQ ID NO: 539034 - DNA, 21 bp, Homo sapiens
ctataaaagcccatgcttaaa

SEQ ID NO: 539035 - DNA, 19 bp, Homo sapiens
ctggcttgaattggtgaca

SEQ ID NO: 539036 - DNA, 23 bp, Homo sapiens
ctgggaatgtatagtatttgaaa

SEQ ID NO: 539037 - DNA, 17 bp, Homo sapiens
ctgggacagggagcagc

SEQ ID NO: 539038 - DNA, 14 bp, Homo sapiens
ctgggacgctctgc

SEQ ID NO: 539039 - DNA, 17 bp, Homo sapiens
ctgggacgctctgctgt

SEQ ID NO: 539040 - DNA, 13 bp, Homo sapiens
ctgggagagtgag

SEQ ID NO: 539041 - DNA, 15 bp, Homo sapiens
ctgggagatgctggg

SEQ ID NO: 539042 - DNA, 17 bp, Homo sapiens
ctgggcatccccagccc

SEQ ID NO: 539043 - DNA, 21 bp, Homo sapiens
ctgggcatccccagccccctg

SEQ ID NO: 539044 - DNA, 20 bp, Homo sapiens
ctgggccaggggaggttaca

SEQ ID NO: 539045 - DNA, 13 bp, Homo sapiens
ctgggccagggtc

SEQ ID NO: 539046 - DNA, 16 bp, Homo sapiens
ctgggccagggtctcg

SEQ ID NO: 539047 - DNA, 21 bp, Homo sapiens
ctgggccagggtctcgtcagg

SEQ ID NO: 539048 - DNA, 17 bp, Homo sapiens
ctgggcccgatttggta

SEQ ID NO: 539049 - DNA, 14 bp, Homo sapiens
ctgggccctggttc

SEQ ID NO: 539050 - DNA, 21 bp, Homo sapiens
ctgggccctggttcccccagg

SEQ ID NO: 539051 - DNA, 16 bp, Homo sapiens
ctgggctacaatttgt

SEQ ID NO: 539052 - DNA, 19 bp, Homo sapiens
ctgggctcccgtgtatctg

SEQ ID NO: 539053 - DNA, 19 bp, Homo sapiens
ctgggcttttctcccagct

SEQ ID NO: 539054 - DNA, 13 bp, Homo sapiens
ctggggaaggaga

SEQ ID NO: 539055 - DNA, 15 bp, Homo sapiens
ctggggagaccgagt

SEQ ID NO: 539056 - DNA, 15 bp, Homo sapiens
ctggggagctcctgg

SEQ ID NO: 539057 - DNA, 19 bp, Homo sapiens
ctggggcagcctctgggcc

SEQ ID NO: 539058 - DNA, 13 bp, Homo sapiens
ctggggccgggct

SEQ ID NO: 539059 - DNA, 13 bp, Homo sapiens
ctggggctgccgt

SEQ ID NO: 539060 - DNA, 14 bp, Homo sapiens
ctggggctgccgtg

SEQ ID NO: 539061 - DNA, 20 bp, Homo sapiens
ctgggggcagcctgcgtggc

SEQ ID NO: 539062 - DNA, 14 bp, Homo sapiens
ctgggggccccagg

SEQ ID NO: 539063 - DNA, 16 bp, Homo sapiens
ctgggggcctgacctc

SEQ ID NO: 539064 - DNA, 18 bp, Homo sapiens
ctggggtacttctgtgtt

SEQ ID NO: 539065 - DNA, 24 bp, Homo sapiens
ctggggtcaggccgggcagagcac

SEQ ID NO: 539066 - DNA, 20 bp, Homo sapiens
ctggggtttccacacaggcc

SEQ ID NO: 539067 - DNA, 21 bp, Homo sapiens
ctggggtttccacacaggccc

SEQ ID NO: 539068 - DNA, 22 bp, Homo sapiens
ctggggtttccacacaggccca

SEQ ID NO: 539069 - DNA, 13 bp, Homo sapiens
ctgggtgcaggag

SEQ ID NO: 539070 - DNA, 14 bp, Homo sapiens
ctgggtgcaggagc

SEQ ID NO: 539071 - DNA, 14 bp, Homo sapiens
ctggtaagaaaaag

SEQ ID NO: 539072 - DNA, 16 bp, Homo sapiens
ctggtcacccccaccc

SEQ ID NO: 539073 - DNA, 15 bp, Homo sapiens
ctggtcacttcttct

SEQ ID NO: 539074 - DNA, 17 bp, Homo sapiens
ctggtctcctgccccca

SEQ ID NO: 539075 - DNA, 22 bp, Homo sapiens
ctggtctcctgcccccacacct

SEQ ID NO: 539076 - DNA, 13 bp, Homo sapiens
ctggtgagcatta

SEQ ID NO: 539077 - DNA, 17 bp, Homo sapiens
ctggtgttaatgagtat

SEQ ID NO: 539078 - DNA, 17 bp, Homo sapiens
ctggttcccccaggacc

SEQ ID NO: 539079 - DNA, 22 bp, Homo sapiens
ctggttctgtacatgtggaaaa

SEQ ID NO: 539080 - DNA, 20 bp, Homo sapiens
ctgtaaaagcaagtcctgca

SEQ ID NO: 539081 - DNA, 23 bp, Homo sapiens
ctgtaaaatacatggtatctctt

SEQ ID NO: 539082 - DNA, 19 bp, Homo sapiens
ctgtaaagcaaaatatttg

SEQ ID NO: 539083 - DNA, 16 bp, Homo sapiens
ctgtaactattgggtg

SEQ ID NO: 539084 - DNA, 12 bp, Homo sapiens
ctgtaactgtcc

SEQ ID NO: 539085 - DNA, 18 bp, Homo sapiens
ctgtaagacggccttgga

SEQ ID NO: 539086 - DNA, 19 bp, Homo sapiens
ctgtaatagcctcaccttc

SEQ ID NO: 539087 - DNA, 20 bp, Homo sapiens
ctgtacaaaagggacatgaa

SEQ ID NO: 539088 - DNA, 19 bp, Homo sapiens
ctgtacagatcaagaaaaa

SEQ ID NO: 539089 - DNA, 13 bp, Homo sapiens
ctgtactaaacat

SEQ ID NO: 539090 - DNA, 23 bp, Homo sapiens
ctgtacttgatttttcaaagact

SEQ ID NO: 539091 - DNA, 12 bp, Homo sapiens
ctgtactttgat

SEQ ID NO: 539092 - DNA, 17 bp, Homo sapiens
ctgtagataattaacca

SEQ ID NO: 539093 - DNA, 14 bp, Homo sapiens
ctgtatttgttaat

SEQ ID NO: 539094 - DNA, 21 bp, Homo sapiens
ctgtatttgttaatttcttgc

SEQ ID NO: 539095 - DNA, 20 bp, Homo sapiens
ctgtcaaacattagtacttt

SEQ ID NO: 539096 - DNA, 20 bp, Homo sapiens
ctgtcaatgattattttcat

SEQ ID NO: 539097 - DNA, 18 bp, Homo sapiens
ctgtcatctaccttttct

SEQ ID NO: 539098 - DNA, 13 bp, Homo sapiens
ctgtcatggtgca

SEQ ID NO: 539099 - DNA, 14 bp, Homo sapiens
ctgtcattgcttct

SEQ ID NO: 539100 - DNA, 18 bp, Homo sapiens
ctgtcattgcttcttctg

SEQ ID NO: 539101 - DNA, 18 bp, Homo sapiens
ctgtccccgagccgagct

SEQ ID NO: 539102 - DNA, 23 bp, Homo sapiens
ctgtccccgagccgagctctcct

SEQ ID NO: 539103 - DNA, 12 bp, Homo sapiens
ctgtcctacctt

SEQ ID NO: 539104 - DNA, 17 bp, Homo sapiens
ctgtcctcagcttctta

SEQ ID NO: 539105 - DNA, 15 bp, Homo sapiens
ctgtccttccaacct

SEQ ID NO: 539106 - DNA, 16 bp, Homo sapiens
ctgtccttccaacctg

SEQ ID NO: 539107 - DNA, 15 bp, Homo sapiens
ctgtccttctctcac

SEQ ID NO: 539108 - DNA, 14 bp, Homo sapiens
ctgtcgagcctggg

SEQ ID NO: 539109 - DNA, 17 bp, Homo sapiens
ctgtcgtccccagacca

SEQ ID NO: 539110 - DNA, 23 bp, Homo sapiens
ctgtctagcacttccttgccagt

SEQ ID NO: 539111 - DNA, 20 bp, Homo sapiens
ctgtctctacaaaaaaaatc

SEQ ID NO: 539112 - DNA, 12 bp, Homo sapiens
ctgtctgctcca

SEQ ID NO: 539113 - DNA, 14 bp, Homo sapiens
ctgtctgctccagc

SEQ ID NO: 539114 - DNA, 19 bp, Homo sapiens
ctgtctgctccagctctgg

SEQ ID NO: 539115 - DNA, 19 bp, Homo sapiens
ctgtctggaggggagctct

SEQ ID NO: 539116 - DNA, 16 bp, Homo sapiens
ctgtcttatcctccac

SEQ ID NO: 539117 - DNA, 18 bp, Homo sapiens
ctgtgaaagtctcctgta

SEQ ID NO: 539118 - DNA, 22 bp, Homo sapiens
ctgtgaaagtctcctgtatcat

SEQ ID NO: 539119 - DNA, 16 bp, Homo sapiens
ctgtgacacagctgag

SEQ ID NO: 539120 - DNA, 21 bp, Homo sapiens
ctgtgacatctctattcccca

SEQ ID NO: 539121 - DNA, 21 bp, Homo sapiens
ctgtgaccggggtcctgaggc

SEQ ID NO: 539122 - DNA, 22 bp, Homo sapiens
ctgtgaccggggtcctgaggct

SEQ ID NO: 539123 - DNA, 17 bp, Homo sapiens
ctgtgaggaaagcacac

SEQ ID NO: 539124 - DNA, 16 bp, Homo sapiens
ctgtgccagcccagag

SEQ ID NO: 539125 - DNA, 18 bp, Homo sapiens
ctgtgctaagtctttccc

SEQ ID NO: 539126 - DNA, 12 bp, Homo sapiens
ctgtggctgatt

SEQ ID NO: 539127 - DNA, 23 bp, Homo sapiens
ctgtggctgatttactaacagta

SEQ ID NO: 539128 - DNA, 20 bp, Homo sapiens
ctgtggcttcccatgtcttt

SEQ ID NO: 539129 - DNA, 17 bp, Homo sapiens
ctgtgggcacaggtcag

SEQ ID NO: 539130 - DNA, 18 bp, Homo sapiens
ctgtgggctcccttcctc

SEQ ID NO: 539131 - DNA, 14 bp, Homo sapiens
ctgtggggagctgg

SEQ ID NO: 539132 - DNA, 15 bp, Homo sapiens
ctgtggggagctggt

SEQ ID NO: 539133 - DNA, 17 bp, Homo sapiens
ctgtggggagctggtgg

SEQ ID NO: 539134 - DNA, 14 bp, Homo sapiens
ctgtggggccacac

SEQ ID NO: 539135 - DNA, 17 bp, Homo sapiens
ctgtggtgaggtcctgt

SEQ ID NO: 539136 - DNA, 20 bp, Homo sapiens
ctgtggtgaggtcctgtcct

SEQ ID NO: 539137 - DNA, 13 bp, Homo sapiens
ctgtgtctgctgt

SEQ ID NO: 539138 - DNA, 12 bp, Homo sapiens
ctgtgtgttaaa

SEQ ID NO: 539139 - DNA, 14 bp, Homo sapiens
ctgtgtgttaaaat

SEQ ID NO: 539140 - DNA, 17 bp, Homo sapiens
ctgtgtttacagagatg

SEQ ID NO: 539141 - DNA, 13 bp, Homo sapiens
ctgttacaaaatg

SEQ ID NO: 539142 - DNA, 13 bp, Homo sapiens
ctgttataaattt

SEQ ID NO: 539143 - DNA, 17 bp, Homo sapiens
ctgttataaattttgta

SEQ ID NO: 539144 - DNA, 18 bp, Homo sapiens
ctgttataaattttgtac

SEQ ID NO: 539145 - DNA, 21 bp, Homo sapiens
ctgttataaattttgtacatt

SEQ ID NO: 539146 - DNA, 15 bp, Homo sapiens
ctgttcacgtgactc

SEQ ID NO: 539147 - DNA, 18 bp, Homo sapiens
ctgttcacgtgactcctc

SEQ ID NO: 539148 - DNA, 20 bp, Homo sapiens
ctgttcacgtgactcctcaa

SEQ ID NO: 539149 - DNA, 13 bp, Homo sapiens
ctgttcttcctgg

SEQ ID NO: 539150 - DNA, 14 bp, Homo sapiens
ctgttgtctcttct

SEQ ID NO: 539151 - DNA, 17 bp, Homo sapiens
ctgttgtctcttctcct

SEQ ID NO: 539152 - DNA, 13 bp, Homo sapiens
ctgtttcatttgt

SEQ ID NO: 539153 - DNA, 21 bp, Homo sapiens
ctgtttggttttaaaatactg

SEQ ID NO: 539154 - DNA, 17 bp, Homo sapiens
cttaaaaaaaaaaatga

SEQ ID NO: 539155 - DNA, 11 bp, Homo sapiens
cttaaaaagta

SEQ ID NO: 539156 - DNA, 23 bp, Homo sapiens
cttaaaaatgcatttaagttgta

SEQ ID NO: 539157 - DNA, 12 bp, Homo sapiens
cttaaaaatgta

SEQ ID NO: 539158 - DNA, 23 bp, Homo sapiens
cttaaaatttgaaacattgcttt

SEQ ID NO: 539159 - DNA, 23 bp, Homo sapiens
cttaaataaaagaaatgcacaat

SEQ ID NO: 539160 - DNA, 13 bp, Homo sapiens
cttaaatgtgaat

SEQ ID NO: 539161 - DNA, 17 bp, Homo sapiens
cttaaatgtgaattact

SEQ ID NO: 539162 - DNA, 19 bp, Homo sapiens
cttaaatgtgaattactaa

SEQ ID NO: 539163 - DNA, 13 bp, Homo sapiens
cttaactttaact

SEQ ID NO: 539164 - DNA, 11 bp, Homo sapiens
cttaagaaaaa

SEQ ID NO: 539165 - DNA, 15 bp, Homo sapiens
cttaagctgcaggat

SEQ ID NO: 539166 - DNA, 21 bp, Homo sapiens
cttaaggtactctggactttc

SEQ ID NO: 539167 - DNA, 19 bp, Homo sapiens
cttaattaagtaaactaat

SEQ ID NO: 539168 - DNA, 21 bp, Homo sapiens
cttaattaattctcagattcc

SEQ ID NO: 539169 - DNA, 18 bp, Homo sapiens
cttacaaatgattgcttt

SEQ ID NO: 539170 - DNA, 21 bp, Homo sapiens
cttacaaatgattgcttttaa

SEQ ID NO: 539171 - DNA, 17 bp, Homo sapiens
cttacaagactgtaaat

SEQ ID NO: 539172 - DNA, 22 bp, Homo sapiens
cttacagaaccaattcacttta

SEQ ID NO: 539173 - DNA, 15 bp, Homo sapiens
gaaaacctagaaaac

SEQ ID NO: 539174 - DNA, 18 bp, Homo sapiens
gaaaactttgttaggcca

SEQ ID NO: 539175 - DNA, 15 bp, Homo sapiens
gaaaagaaaaatttc

SEQ ID NO: 539176 - DNA, 23 bp, Homo sapiens
gaaaagaaatctatagaaagtgt

SEQ ID NO: 539177 - DNA, 24 bp, Homo sapiens
gaaaagaaatctatagaaagtgtt

SEQ ID NO: 539178 - DNA, 19 bp, Homo sapiens
gaaaaggcttgagtctgga

SEQ ID NO: 539179 - DNA, 20 bp, Homo sapiens
gaaaaggcttgagtctggat

SEQ ID NO: 539180 - DNA, 19 bp, Homo sapiens
gaaaatgcagccttaaaca

SEQ ID NO: 539181 - DNA, 17 bp, Homo sapiens
gaaaatgtcactgttat

SEQ ID NO: 539182 - DNA, 21 bp, Homo sapiens
gaaaatgtcactgttataaat

SEQ ID NO: 539183 - DNA, 19 bp, Homo sapiens
gaaaattcagataatggta

SEQ ID NO: 539184 - DNA, 23 bp, Homo sapiens
gaaaattcagataatggtaattt

SEQ ID NO: 539185 - DNA, 18 bp, Homo sapiens
gaaacactaaatgttaaa

SEQ ID NO: 539186 - DNA, 23 bp, Homo sapiens
gaaacactaaatgttaaagatgt

SEQ ID NO: 539187 - DNA, 14 bp, Homo sapiens
gaaacagataccat

SEQ ID NO: 539188 - DNA, 22 bp, Homo sapiens
gaaacagatttaagcaagacca

SEQ ID NO: 539189 - DNA, 11 bp, Homo sapiens
gaaacagcagc

SEQ ID NO: 539190 - DNA, 16 bp, Homo sapiens
gaaacagtttaacaga

SEQ ID NO: 539191 - DNA, 16 bp, Homo sapiens
gaaacattgcttttaa

SEQ ID NO: 539192 - DNA, 18 bp, Homo sapiens
gaaacattggaagcaggt

SEQ ID NO: 539193 - DNA, 16 bp, Homo sapiens
gaaacccggcttcctg

SEQ ID NO: 539194 - DNA, 16 bp, Homo sapiens
gaaacttgttcttcca

SEQ ID NO: 539195 - DNA, 19 bp, Homo sapiens
gaaagaggaataaaatgat

SEQ ID NO: 539196 - DNA, 15 bp, Homo sapiens
gaaagcagaatcaac

SEQ ID NO: 539197 - DNA, 18 bp, Homo sapiens
gaaagcctcactgatata

SEQ ID NO: 539198 - DNA, 22 bp, Homo sapiens
gaaaggagtttctttagctgac

SEQ ID NO: 539199 - DNA, 11 bp, Homo sapiens
gaaagggacaa

SEQ ID NO: 539200 - DNA, 21 bp, Homo sapiens
gaaatagcatgacaggctgtt

SEQ ID NO: 539201 - DNA, 19 bp, Homo sapiens
gaaatataaaaataattaa

SEQ ID NO: 539202 - DNA, 14 bp, Homo sapiens
gaaatatatataca

SEQ ID NO: 539203 - DNA, 15 bp, Homo sapiens
gaaatatatatacat

SEQ ID NO: 539204 - DNA, 21 bp, Homo sapiens
gaaatatatatacatatgtag

SEQ ID NO: 539205 - DNA, 20 bp, Homo sapiens
gaaatatatggtctaatgtt

SEQ ID NO: 539206 - DNA, 24 bp, Homo sapiens
gaaatatatggtctaatgtttaag

SEQ ID NO: 539207 - DNA, 20 bp, Homo sapiens
gaaatatctgtgaaggactt

SEQ ID NO: 539208 - DNA, 23 bp, Homo sapiens
gaaatattttctactttaaattg

SEQ ID NO: 539209 - DNA, 15 bp, Homo sapiens
gaaatgaacacaaat

SEQ ID NO: 539210 - DNA, 12 bp, Homo sapiens
gaaatgcacaat

SEQ ID NO: 539211 - DNA, 13 bp, Homo sapiens
gaaatgcacaatg

SEQ ID NO: 539212 - DNA, 20 bp, Homo sapiens
gaaatgctatgtcatttcat

SEQ ID NO: 539213 - DNA, 21 bp, Homo sapiens
gaaatgctatgtcatttcatg

SEQ ID NO: 539214 - DNA, 18 bp, Homo sapiens
gaaatggatagattgttt

SEQ ID NO: 539215 - DNA, 20 bp, Homo sapiens
gaaatggccttttttaatat

SEQ ID NO: 539216 - DNA, 15 bp, Homo sapiens
gaaatgtccctttct

SEQ ID NO: 539217 - DNA, 18 bp, Homo sapiens
gaaatgtccctttcttct

SEQ ID NO: 539218 - DNA, 13 bp, Homo sapiens
gaaatgtgtgtga

SEQ ID NO: 539219 - DNA, 18 bp, Homo sapiens
gaaatgtgtgtgatgtga

SEQ ID NO: 539220 - DNA, 13 bp, Homo sapiens
gaaatgtttccag

SEQ ID NO: 539221 - DNA, 15 bp, Homo sapiens
gaaatgttttaaggc

SEQ ID NO: 539222 - DNA, 18 bp, Homo sapiens
gaaattcaattcatagaa

SEQ ID NO: 539223 - DNA, 21 bp, Homo sapiens
gaaattccatacttctctcag

SEQ ID NO: 539224 - DNA, 20 bp, Homo sapiens
gaaatttcacgtcataggaa

SEQ ID NO: 539225 - DNA, 16 bp, Homo sapiens
gaaattttatctcttc

SEQ ID NO: 539226 - DNA, 13 bp, Homo sapiens
gaacaacataaaa

SEQ ID NO: 539227 - DNA, 15 bp, Homo sapiens
gaacaacataaaatt

SEQ ID NO: 539228 - DNA, 13 bp, Homo sapiens
gaacactggacct

SEQ ID NO: 539229 - DNA, 20 bp, Homo sapiens
gaacagatgacccctgccca

SEQ ID NO: 539230 - DNA, 22 bp, Homo sapiens
gaacagatgacccctgcccaga

SEQ ID NO: 539231 - DNA, 19 bp, Homo sapiens
gaacagctctgagatcctg

SEQ ID NO: 539232 - DNA, 15 bp, Homo sapiens
gaacatgacccgtac

SEQ ID NO: 539233 - DNA, 20 bp, Homo sapiens
gaacatgacccgtacacacc

SEQ ID NO: 539234 - DNA, 21 bp, Homo sapiens
gaacatgacccgtacacacca

SEQ ID NO: 539235 - DNA, 21 bp, Homo sapiens
gaaccaagctataaaagccca

SEQ ID NO: 539236 - DNA, 15 bp, Homo sapiens
gaaccaattcacttt

SEQ ID NO: 539237 - DNA, 23 bp, Homo sapiens
gaaccgagcaaagatcaaaataa

SEQ ID NO: 539238 - DNA, 19 bp, Homo sapiens
gaacctactgttcctttca

SEQ ID NO: 539239 - DNA, 21 bp, Homo sapiens
gaacctactgttcctttcaga

SEQ ID NO: 539240 - DNA, 17 bp, Homo sapiens
gaacctgtgagctgcac

SEQ ID NO: 539241 - DNA, 19 bp, Homo sapiens
gaacctgtgagctgcacca

SEQ ID NO: 539242 - DNA, 12 bp, Homo sapiens
gaactaataaat

SEQ ID NO: 539243 - DNA, 13 bp, Homo sapiens
gaactaataaatg

SEQ ID NO: 539244 - DNA, 19 bp, Homo sapiens
gaactaatgacaagtgact

SEQ ID NO: 539245 - DNA, 20 bp, Homo sapiens
gaactaggaaggcacttctg

SEQ ID NO: 539246 - DNA, 16 bp, Homo sapiens
gaactatcttcatctg

SEQ ID NO: 539247 - DNA, 16 bp, Homo sapiens
gaactgaagcagagtc

SEQ ID NO: 539248 - DNA, 14 bp, Homo sapiens
gaactgctgctggt

SEQ ID NO: 539249 - DNA, 17 bp, Homo sapiens
gaactgctgctggtcac

SEQ ID NO: 539250 - DNA, 22 bp, Homo sapiens
gaactgctgctggtcaccccca

SEQ ID NO: 539251 - DNA, 16 bp, Homo sapiens
gaacttgaagcctgct

SEQ ID NO: 539252 - DNA, 19 bp, Homo sapiens
gaacttggtgcctaatgtt

SEQ ID NO: 539253 - DNA, 16 bp, Homo sapiens
gaacttttcaaaataa

SEQ ID NO: 539254 - DNA, 14 bp, Homo sapiens
gaagaaatatgagc

SEQ ID NO: 539255 - DNA, 15 bp, Homo sapiens
gaagaaggacttcct

SEQ ID NO: 539256 - DNA, 14 bp, Homo sapiens
gaagaatgcatgct

SEQ ID NO: 539257 - DNA, 17 bp, Homo sapiens
gaagaatggctttcaat

SEQ ID NO: 539258 - DNA, 13 bp, Homo sapiens
gaagacctaacca

SEQ ID NO: 539259 - DNA, 23 bp, Homo sapiens
gaagacctaaccagggccagaag

SEQ ID NO: 539260 - DNA, 15 bp, Homo sapiens
gaagagtgaagagca

SEQ ID NO: 539261 - DNA, 16 bp, Homo sapiens
gaagatagttgtaaag

SEQ ID NO: 539262 - DNA, 14 bp, Homo sapiens
gaagcaaataaata

SEQ ID NO: 539263 - DNA, 18 bp, Homo sapiens
gaagcaggttaaatgttt

SEQ ID NO: 539264 - DNA, 13 bp, Homo sapiens
gaagccacatcac

SEQ ID NO: 539265 - DNA, 18 bp, Homo sapiens
gaagccccctcttcctcc

SEQ ID NO: 539266 - DNA, 20 bp, Homo sapiens
gaagccctgcagagcacaaa

SEQ ID NO: 539267 - DNA, 22 bp, Homo sapiens
gaagcctcatgggagtcaggga

SEQ ID NO: 539268 - DNA, 15 bp, Homo sapiens
gaagcctgctccttc

SEQ ID NO: 539269 - DNA, 14 bp, Homo sapiens
gaagctaaaacact

SEQ ID NO: 539270 - DNA, 24 bp, Homo sapiens
gaaggaccttcactctaagatgtt

SEQ ID NO: 539271 - DNA, 16 bp, Homo sapiens
gaaggcacactgagca

SEQ ID NO: 539272 - DNA, 24 bp, Homo sapiens
gaagggaccgggagcctgcgtggc

SEQ ID NO: 539273 - DNA, 15 bp, Homo sapiens
gaaggtcatttccat

SEQ ID NO: 539274 - DNA, 21 bp, Homo sapiens
gaaggtgacactgctccctga

SEQ ID NO: 539275 - DNA, 20 bp, Homo sapiens
gaagtaacttgtcttaaata

SEQ ID NO: 539276 - DNA, 16 bp, Homo sapiens
gaagtaccttatcaaa

SEQ ID NO: 539277 - DNA, 14 bp, Homo sapiens
gaagtagctttgca

SEQ ID NO: 539278 - DNA, 21 bp, Homo sapiens
gaagtcatgctcccctgtgcc

SEQ ID NO: 539279 - DNA, 15 bp, Homo sapiens
gaagtcttcatgaaa

SEQ ID NO: 539280 - DNA, 18 bp, Homo sapiens
gaagtcttcatgaaatgc

SEQ ID NO: 539281 - DNA, 20 bp, Homo sapiens
gaagtgcctctgattctatg

SEQ ID NO: 539282 - DNA, 18 bp, Homo sapiens
gaagttagcctttatcta

SEQ ID NO: 539283 - DNA, 21 bp, Homo sapiens
gaagttagcctttatctacca

SEQ ID NO: 539284 - DNA, 13 bp, Homo sapiens
gaagttatatttc

SEQ ID NO: 539285 - DNA, 17 bp, Homo sapiens
gaagttggcacatttca

SEQ ID NO: 539286 - DNA, 12 bp, Homo sapiens
gaagtttgcaac

SEQ ID NO: 539287 - DNA, 16 bp, Homo sapiens
gaatagacataaattg

SEQ ID NO: 539288 - DNA, 22 bp, Homo sapiens
gaatagacataaattgtaattt

SEQ ID NO: 539289 - DNA, 19 bp, Homo sapiens
gaatataatggcctcttaa

SEQ ID NO: 539290 - DNA, 20 bp, Homo sapiens
gaatatgcatcccacagcca

SEQ ID NO: 539291 - DNA, 17 bp, Homo sapiens
gaatattaatggaaaca

SEQ ID NO: 539292 - DNA, 24 bp, Homo sapiens
gaatattatatttggatgcagagt

SEQ ID NO: 539293 - DNA, 16 bp, Homo sapiens
gaatcagaggcagaga

SEQ ID NO: 539294 - DNA, 21 bp, Homo sapiens
gaatcatgtgcgtcagtccaa

SEQ ID NO: 539295 - DNA, 16 bp, Homo sapiens
gaatccaaaagaaaaa

SEQ ID NO: 539296 - DNA, 14 bp, Homo sapiens
gaatccgaagggaa

SEQ ID NO: 539297 - DNA, 15 bp, Homo sapiens
gaatctgaccacaga

SEQ ID NO: 539298 - DNA, 22 bp, Homo sapiens
gaatcttctcatcttttatcta

SEQ ID NO: 539299 - DNA, 16 bp, Homo sapiens
gaatgaccttgtaatg

SEQ ID NO: 539300 - DNA, 19 bp, Homo sapiens
gaatgaccttgtaatgtaa

SEQ ID NO: 539301 - DNA, 19 bp, Homo sapiens
gaatgagagttccttctca

SEQ ID NO: 539302 - DNA, 18 bp, Homo sapiens
gaatgagggcgtgaaaca

SEQ ID NO: 539303 - DNA, 18 bp, Homo sapiens
gaatggagtccagacctg

SEQ ID NO: 539304 - DNA, 15 bp, Homo sapiens
gaatgtatagtattt

SEQ ID NO: 539305 - DNA, 17 bp, Homo sapiens
gaatgtcccttttccta

SEQ ID NO: 539306 - DNA, 16 bp, Homo sapiens
gaattaaaaagaagat

SEQ ID NO: 539307 - DNA, 23 bp, Homo sapiens
gaattactaacttctaaaactgt

SEQ ID NO: 539308 - DNA, 21 bp, Homo sapiens
gaattgaccgacagctttcca

SEQ ID NO: 539309 - DNA, 14 bp, Homo sapiens
gcacatgatttcac

SEQ ID NO: 539310 - DNA, 21 bp, Homo sapiens
gcacatgcttagcttatcttt

SEQ ID NO: 539311 - DNA, 18 bp, Homo sapiens
gcaccaataaaggaggaa

SEQ ID NO: 539312 - DNA, 15 bp, Homo sapiens
gcaccaccctccttc

SEQ ID NO: 539313 - DNA, 17 bp, Homo sapiens
gcaccaccctccttccc

SEQ ID NO: 539314 - DNA, 19 bp, Homo sapiens
gcaccaccgaccaactcca

SEQ ID NO: 539315 - DNA, 16 bp, Homo sapiens
gcacccacaccctaca

SEQ ID NO: 539316 - DNA, 22 bp, Homo sapiens
gcacccacaccctacagcagat

SEQ ID NO: 539317 - DNA, 23 bp, Homo sapiens
gcacccggcagccccccagtgtc

SEQ ID NO: 539318 - DNA, 12 bp, Homo sapiens
gcacctgtctgc

SEQ ID NO: 539319 - DNA, 21 bp, Homo sapiens
gcacctgtctgctccagctct

SEQ ID NO: 539320 - DNA, 10 bp, Homo sapiens
gcacgcacac

SEQ ID NO: 539321 - DNA, 12 bp, Homo sapiens
gcacgcacacac

SEQ ID NO: 539322 - DNA, 13 bp, Homo sapiens
gcacgcacacaca

SEQ ID NO: 539323 - DNA, 17 bp, Homo sapiens
gcacgcacccacaccct

SEQ ID NO: 539324 - DNA, 21 bp, Homo sapiens
gcacgcacccacaccctacag

SEQ ID NO: 539325 - DNA, 15 bp, Homo sapiens
gcacgcctgccttct

SEQ ID NO: 539326 - DNA, 21 bp, Homo sapiens
gcacgtagtagggtcaggcca

SEQ ID NO: 539327 - DNA, 23 bp, Homo sapiens
gcacgtgggtcttcagggggcca

SEQ ID NO: 539328 - DNA, 15 bp, Homo sapiens
gcactaagtctcttt

SEQ ID NO: 539329 - DNA, 18 bp, Homo sapiens
gcactatatgtttacaca

SEQ ID NO: 539330 - DNA, 19 bp, Homo sapiens
gcactcctccctgatgtac

SEQ ID NO: 539331 - DNA, 18 bp, Homo sapiens
gcactctagccggagtga

SEQ ID NO: 539332 - DNA, 22 bp, Homo sapiens
gcactctagggtgaaccaagct

SEQ ID NO: 539333 - DNA, 19 bp, Homo sapiens
gcactcttttgagcagtaa

SEQ ID NO: 539334 - DNA, 14 bp, Homo sapiens
gcactgaagtttga

SEQ ID NO: 539335 - DNA, 11 bp, Homo sapiens
gcactgccctc

SEQ ID NO: 539336 - DNA, 14 bp, Homo sapiens
gcacttctgcctga

SEQ ID NO: 539337 - DNA, 18 bp, Homo sapiens
gcactttcttcttcccat

SEQ ID NO: 539338 - DNA, 23 bp, Homo sapiens
gcacttttctaaactaggctcct

SEQ ID NO: 539339 - DNA, 20 bp, Homo sapiens
gcagaagggagctggctcca

SEQ ID NO: 539340 - DNA, 22 bp, Homo sapiens
gcagaagggagctggctccagc

SEQ ID NO: 539341 - DNA, 15 bp, Homo sapiens
gcagagacagagagg

SEQ ID NO: 539342 - DNA, 20 bp, Homo sapiens
gcagagcacaaacttcagaa

SEQ ID NO: 539343 - DNA, 11 bp, Homo sapiens
gcagagccctg

SEQ ID NO: 539344 - DNA, 13 bp, Homo sapiens
gcagagccctgct

SEQ ID NO: 539345 - DNA, 16 bp, Homo sapiens
gcagagccctgctccc

SEQ ID NO: 539346 - DNA, 16 bp, Homo sapiens
gcagagtcaagctgat

SEQ ID NO: 539347 - DNA, 16 bp, Homo sapiens
gcagataattctggac

SEQ ID NO: 539348 - DNA, 17 bp, Homo sapiens
gcagatactactgacca

SEQ ID NO: 539349 - DNA, 15 bp, Homo sapiens
gcagatccacctgca

SEQ ID NO: 539350 - DNA, 18 bp, Homo sapiens
gcagatccacctgcacaa

SEQ ID NO: 539351 - DNA, 22 bp, Homo sapiens
gcagatccacctgcacaaacat

SEQ ID NO: 539352 - DNA, 17 bp, Homo sapiens
gcagatgagtcctcggt

SEQ ID NO: 539353 - DNA, 12 bp, Homo sapiens
gcagattccttt

SEQ ID NO: 539354 - DNA, 23 bp, Homo sapiens
gcagatttcagatgtaagaagcc

SEQ ID NO: 539355 - DNA, 19 bp, Homo sapiens
gcagcaaaaatataaaata

SEQ ID NO: 539356 - DNA, 20 bp, Homo sapiens
gcagcagctagaaagagaaa

SEQ ID NO: 539357 - DNA, 12 bp, Homo sapiens
gcagcagggcag

SEQ ID NO: 539358 - DNA, 19 bp, Homo sapiens
gcagcatgcgatgtcatat

SEQ ID NO: 539359 - DNA, 19 bp, Homo sapiens
gcagcctgcgtggctgacc

SEQ ID NO: 539360 - DNA, 17 bp, Homo sapiens
gcagcggcagcagcagc

SEQ ID NO: 539361 - DNA, 15 bp, Homo sapiens
gcagctagaaagaga

SEQ ID NO: 539362 - DNA, 13 bp, Homo sapiens
gcagctatggaca

SEQ ID NO: 539363 - DNA, 14 bp, Homo sapiens
gcagctatggacaa

SEQ ID NO: 539364 - DNA, 13 bp, Homo sapiens
gcagctcttcctg

SEQ ID NO: 539365 - DNA, 14 bp, Homo sapiens
gcagctcttcctgg

SEQ ID NO: 539366 - DNA, 23 bp, Homo sapiens
gcagctcttcctggacaggccag

SEQ ID NO: 539367 - DNA, 17 bp, Homo sapiens
gcagctgttagagtcca

SEQ ID NO: 539368 - DNA, 14 bp, Homo sapiens
gcaggaagtccctg

SEQ ID NO: 539369 - DNA, 18 bp, Homo sapiens
gcaggagacactggtctc

SEQ ID NO: 539370 - DNA, 22 bp, Homo sapiens
gcaggatagctcttcctcccca

SEQ ID NO: 539371 - DNA, 19 bp, Homo sapiens
gcaggatgggggagagggg

SEQ ID NO: 539372 - DNA, 13 bp, Homo sapiens
gcaggcagagctc

SEQ ID NO: 539373 - DNA, 22 bp, Homo sapiens
gcaggcagagctcagcacagcc

SEQ ID NO: 539374 - DNA, 24 bp, Homo sapiens
gcaggcagagctcagcacagcctc

SEQ ID NO: 539375 - DNA, 13 bp, Homo sapiens
gcaggcagccttg

SEQ ID NO: 539376 - DNA, 11 bp, Homo sapiens
gcaggcagggg

SEQ ID NO: 539377 - DNA, 17 bp, Homo sapiens
gcaggcctccctgccag

SEQ ID NO: 539378 - DNA, 17 bp, Homo sapiens
gcaggcggtatccagag

SEQ ID NO: 539379 - DNA, 18 bp, Homo sapiens
gcaggcggtatccagagg

SEQ ID NO: 539380 - DNA, 14 bp, Homo sapiens
gcagggagaccctg

SEQ ID NO: 539381 - DNA, 20 bp, Homo sapiens
gcaggggccctgcagctctc

SEQ ID NO: 539382 - DNA, 19 bp, Homo sapiens
gcagggtgtctgccccctc

SEQ ID NO: 539383 - DNA, 23 bp, Homo sapiens
gcagggtgtctgccccctcctga

SEQ ID NO: 539384 - DNA, 16 bp, Homo sapiens
gcaggtaggaatatta

SEQ ID NO: 539385 - DNA, 20 bp, Homo sapiens
gcaggtaggaatattatatt

SEQ ID NO: 539386 - DNA, 13 bp, Homo sapiens
gcaggtggccagg

SEQ ID NO: 539387 - DNA, 19 bp, Homo sapiens
gcaggttaaatgttttgta

SEQ ID NO: 539388 - DNA, 14 bp, Homo sapiens
gcagtgagagcaga

SEQ ID NO: 539389 - DNA, 22 bp, Homo sapiens
gcagtggcaaaatattatgtta

SEQ ID NO: 539390 - DNA, 18 bp, Homo sapiens
gcagtgtgcttacctgtt

SEQ ID NO: 539391 - DNA, 15 bp, Homo sapiens
gcagttgcccagcct

SEQ ID NO: 539392 - DNA, 18 bp, Homo sapiens
gcagttggccaagcagaa

SEQ ID NO: 539393 - DNA, 16 bp, Homo sapiens
gcataagtggacccag

SEQ ID NO: 539394 - DNA, 16 bp, Homo sapiens
gcatagaataatgaag

SEQ ID NO: 539395 - DNA, 14 bp, Homo sapiens
gcataggaaaagaa

SEQ ID NO: 539396 - DNA, 15 bp, Homo sapiens
gcataggaaaagaat

SEQ ID NO: 539397 - DNA, 17 bp, Homo sapiens
gcatagtaaatgtagtt

SEQ ID NO: 539398 - DNA, 22 bp, Homo sapiens
gcatagtctacttgttataaat

SEQ ID NO: 539399 - DNA, 13 bp, Homo sapiens
gcatatatataaa

SEQ ID NO: 539400 - DNA, 15 bp, Homo sapiens
gcatcattccaggcc

SEQ ID NO: 539401 - DNA, 22 bp, Homo sapiens
gcatccatgcggccggcctggg

SEQ ID NO: 539402 - DNA, 14 bp, Homo sapiens
gcatccccagcccc

SEQ ID NO: 539403 - DNA, 23 bp, Homo sapiens
gcatccgtgtatttggctgggct

SEQ ID NO: 539404 - DNA, 15 bp, Homo sapiens
gcatctaaactttaa

SEQ ID NO: 539405 - DNA, 21 bp, Homo sapiens
gcatctaaactttaatatgta

SEQ ID NO: 539406 - DNA, 16 bp, Homo sapiens
gcatgcgatgtcatat

SEQ ID NO: 539407 - DNA, 22 bp, Homo sapiens
gcatggtccattctcaagggac

SEQ ID NO: 539408 - DNA, 20 bp, Homo sapiens
gcatgtacaaaaacacaaat

SEQ ID NO: 539409 - DNA, 20 bp, Homo sapiens
gcatgtctcagattgacctt

SEQ ID NO: 539410 - DNA, 16 bp, Homo sapiens
gcatgtggcctttatc

SEQ ID NO: 539411 - DNA, 15 bp, Homo sapiens
gcatgtgtgtataag

SEQ ID NO: 539412 - DNA, 21 bp, Homo sapiens
gcattactgtccccttgatat

SEQ ID NO: 539413 - DNA, 20 bp, Homo sapiens
gcattataatcaccagggcc

SEQ ID NO: 539414 - DNA, 14 bp, Homo sapiens
gcattcggagggag

SEQ ID NO: 539415 - DNA, 16 bp, Homo sapiens
gcattgggtgatcatt

SEQ ID NO: 539416 - DNA, 16 bp, Homo sapiens
gcatttagcacagtat

SEQ ID NO: 539417 - DNA, 14 bp, Homo sapiens
gcatttcagctgtg

SEQ ID NO: 539418 - DNA, 22 bp, Homo sapiens
gcatttccaacaccacagacac

SEQ ID NO: 539419 - DNA, 14 bp, Homo sapiens
gcatttgcttttgt

SEQ ID NO: 539420 - DNA, 14 bp, Homo sapiens
gccaaaagcttccc

SEQ ID NO: 539421 - DNA, 15 bp, Homo sapiens
gccaaaagcttccct

SEQ ID NO: 539422 - DNA, 22 bp, Homo sapiens
gccaaaagcttccctccctgct

SEQ ID NO: 539423 - DNA, 21 bp, Homo sapiens
gccaaaataaagtctgtcatg

SEQ ID NO: 539424 - DNA, 22 bp, Homo sapiens
gccaaacattaatgttgatttc

SEQ ID NO: 539425 - DNA, 24 bp, Homo sapiens
gccaaacattaatgttgatttcta

SEQ ID NO: 539426 - DNA, 12 bp, Homo sapiens
gccaaagacaaa

SEQ ID NO: 539427 - DNA, 14 bp, Homo sapiens
gccaaagacaaata

SEQ ID NO: 539428 - DNA, 20 bp, Homo sapiens
gccaagcagaaaaaaaagtg

SEQ ID NO: 539429 - DNA, 20 bp, Homo sapiens
gccaagctgaggaggtgctg

SEQ ID NO: 539430 - DNA, 17 bp, Homo sapiens
gccaatctccaggctcc

SEQ ID NO: 539431 - DNA, 20 bp, Homo sapiens
gccaatttctcttaagtact

SEQ ID NO: 539432 - DNA, 23 bp, Homo sapiens
gccacatccacagtctcccccac

SEQ ID NO: 539433 - DNA, 14 bp, Homo sapiens
gccacccaaagcag

SEQ ID NO: 539434 - DNA, 17 bp, Homo sapiens
gccacctccccaggccg

SEQ ID NO: 539435 - DNA, 13 bp, Homo sapiens
gccactgtatttg

SEQ ID NO: 539436 - DNA, 20 bp, Homo sapiens
gccactttaagagagaaatc

SEQ ID NO: 539437 - DNA, 18 bp, Homo sapiens
gccagaagtagctttgca

SEQ ID NO: 539438 - DNA, 14 bp, Homo sapiens
gccagagctcccag

SEQ ID NO: 539439 - DNA, 15 bp, Homo sapiens
gccagagctcccagg

SEQ ID NO: 539440 - DNA, 16 bp, Homo sapiens
gccagagctcccagga

SEQ ID NO: 539441 - DNA, 20 bp, Homo sapiens
gccagagctcccaggacgca

SEQ ID NO: 539442 - DNA, 16 bp, Homo sapiens
gccagcccagaggccg

SEQ ID NO: 539443 - DNA, 19 bp, Homo sapiens
gccaggagtgggtgggaca

SEQ ID NO: 539444 - DNA, 22 bp, Homo sapiens
gccaggcgctagcacagctccc

SEQ ID NO: 539445 - DNA, 23 bp, Homo sapiens
gccagggctccacgggggcctag

SEQ ID NO: 539446 - DNA, 17 bp, Homo sapiens
gcttcagcccctggggt

SEQ ID NO: 539447 - DNA, 14 bp, Homo sapiens
gcttccctccctgc

SEQ ID NO: 539448 - DNA, 20 bp, Homo sapiens
gcttctccctggactctgtg

SEQ ID NO: 539449 - DNA, 21 bp, Homo sapiens
gcttcttaatataactgcctt

SEQ ID NO: 539450 - DNA, 22 bp, Homo sapiens
gcttcttaatataactgcctta

SEQ ID NO: 539451 - DNA, 22 bp, Homo sapiens
gcttctttcaagggctttcctg

SEQ ID NO: 539452 - DNA, 14 bp, Homo sapiens
gcttgcactctctt

SEQ ID NO: 539453 - DNA, 17 bp, Homo sapiens
gcttgtcatagccagtg

SEQ ID NO: 539454 - DNA, 19 bp, Homo sapiens
gcttgtgtaatttcctgct

SEQ ID NO: 539455 - DNA, 11 bp, Homo sapiens
gcttgttcttc

SEQ ID NO: 539456 - DNA, 20 bp, Homo sapiens
gctttaaagagcaggatagc

SEQ ID NO: 539457 - DNA, 16 bp, Homo sapiens
gctttacacacacaga

SEQ ID NO: 539458 - DNA, 18 bp, Homo sapiens
gctttagaatgttttcct

SEQ ID NO: 539459 - DNA, 13 bp, Homo sapiens
gctttatttttca

SEQ ID NO: 539460 - DNA, 14 bp, Homo sapiens
gctttcctgggtct

SEQ ID NO: 539461 - DNA, 18 bp, Homo sapiens
gctttcctgtgccaggtg

SEQ ID NO: 539462 - DNA, 19 bp, Homo sapiens
gctttgggcagatttgcaa

SEQ ID NO: 539463 - DNA, 13 bp, Homo sapiens
gctttgtgcttat

SEQ ID NO: 539464 - DNA, 14 bp, Homo sapiens
gcttttaaaactac

SEQ ID NO: 539465 - DNA, 12 bp, Homo sapiens
gcttttaaaatt

SEQ ID NO: 539466 - DNA, 14 bp, Homo sapiens
gcttttaaaatttt

SEQ ID NO: 539467 - DNA, 18 bp, Homo sapiens
gcttttaaggaaaggcaa

SEQ ID NO: 539468 - DNA, 18 bp, Homo sapiens
gcttttcaaacaagaatg

SEQ ID NO: 539469 - DNA, 17 bp, Homo sapiens
gcttttctgcaattcaa

SEQ ID NO: 539470 - DNA, 17 bp, Homo sapiens
gcttttgcatagaataa

SEQ ID NO: 539471 - DNA, 19 bp, Homo sapiens
gcttttgctggtcactgcc

SEQ ID NO: 539472 - DNA, 15 bp, Homo sapiens
ggaaaacgatttaat

SEQ ID NO: 539473 - DNA, 17 bp, Homo sapiens
ggaaaagaaaaatttct

SEQ ID NO: 539474 - DNA, 18 bp, Homo sapiens
ggaaaagaaaaatttctg

SEQ ID NO: 539475 - DNA, 21 bp, Homo sapiens
ggaaacactaaatgttaaaga

SEQ ID NO: 539476 - DNA, 21 bp, Homo sapiens
ggaaagcacagaggcctcctg

SEQ ID NO: 539477 - DNA, 23 bp, Homo sapiens
ggaaattcaggtgaaaatgttca

SEQ ID NO: 539478 - DNA, 13 bp, Homo sapiens
ggaacaaatcttc

SEQ ID NO: 539479 - DNA, 16 bp, Homo sapiens
ggaacacccagcccca

SEQ ID NO: 539480 - DNA, 23 bp, Homo sapiens
ggaaccagagcgatgtgttcttt

SEQ ID NO: 539481 - DNA, 23 bp, Homo sapiens
ggaaccccctcaccacctgcccg

SEQ ID NO: 539482 - DNA, 16 bp, Homo sapiens
ggaagacctcaagaaa

SEQ ID NO: 539483 - DNA, 18 bp, Homo sapiens
ggaagataagttggaaac

SEQ ID NO: 539484 - DNA, 18 bp, Homo sapiens
ggaagccccctcttcctc

SEQ ID NO: 539485 - DNA, 15 bp, Homo sapiens
ggaagcctcctgctg

SEQ ID NO: 539486 - DNA, 16 bp, Homo sapiens
ggaagctggcaggaga

SEQ ID NO: 539487 - DNA, 19 bp, Homo sapiens
ggaagctggcaggagacac

SEQ ID NO: 539488 - DNA, 22 bp, Homo sapiens
ggaagctggcaggagacactgg

SEQ ID NO: 539489 - DNA, 14 bp, Homo sapiens
ggaagggagggctt

SEQ ID NO: 539490 - DNA, 19 bp, Homo sapiens
ggaagtccttatctagctg

SEQ ID NO: 539491 - DNA, 19 bp, Homo sapiens
ggaatattatatttggatg

SEQ ID NO: 539492 - DNA, 14 bp, Homo sapiens
ggaatcaaaaattg

SEQ ID NO: 539493 - DNA, 13 bp, Homo sapiens
ggaatgaccttgg

SEQ ID NO: 539494 - DNA, 21 bp, Homo sapiens
ggaatgtatagtatttgaaaa

SEQ ID NO: 539495 - DNA, 15 bp, Homo sapiens
ggacacccccttggt

SEQ ID NO: 539496 - DNA, 19 bp, Homo sapiens
ggacacctgtactggagag

SEQ ID NO: 539497 - DNA, 21 bp, Homo sapiens
ggacacctgtactggagagca

SEQ ID NO: 539498 - DNA, 13 bp, Homo sapiens
ggacacggcctct

SEQ ID NO: 539499 - DNA, 21 bp, Homo sapiens
ggacactgtaacgtgtgctgt

SEQ ID NO: 539500 - DNA, 18 bp, Homo sapiens
ggacagctttgtcctgag

SEQ ID NO: 539501 - DNA, 21 bp, Homo sapiens
ggacaggaacacccagcccca

SEQ ID NO: 539502 - DNA, 20 bp, Homo sapiens
ggacattccaatttgcactt

SEQ ID NO: 539503 - DNA, 17 bp, Homo sapiens
ggacccatgaaacagca

SEQ ID NO: 539504 - DNA, 19 bp, Homo sapiens
ggacccatgaaacagcagc

SEQ ID NO: 539505 - DNA, 20 bp, Homo sapiens
ggacccatgaaacagcagct

SEQ ID NO: 539506 - DNA, 15 bp, Homo sapiens
ggaccctcgctggcc

SEQ ID NO: 539507 - DNA, 13 bp, Homo sapiens
ggacctccacctg

SEQ ID NO: 539508 - DNA, 17 bp, Homo sapiens
ggacctccacctgggag

SEQ ID NO: 539509 - DNA, 18 bp, Homo sapiens
ggacctccacctgggaga

SEQ ID NO: 539510 - DNA, 22 bp, Homo sapiens
ggacctccacctgggagatgct

SEQ ID NO: 539511 - DNA, 21 bp, Homo sapiens
ggacgcagatgagtcctcggt

SEQ ID NO: 539512 - DNA, 17 bp, Homo sapiens
ggacgcagggagaccct

SEQ ID NO: 539513 - DNA, 17 bp, Homo sapiens
ggactctgccttccagg

SEQ ID NO: 539514 - DNA, 16 bp, Homo sapiens
ggactctgtggggcca

SEQ ID NO: 539515 - DNA, 11 bp, Homo sapiens
ggactgtgaag

SEQ ID NO: 539516 - DNA, 15 bp, Homo sapiens
ggactgtggcctcag

SEQ ID NO: 539517 - DNA, 22 bp, Homo sapiens
ggacttcctgctacagtagctg

SEQ ID NO: 539518 - DNA, 21 bp, Homo sapiens
ggacttggtgattacctgaaa

SEQ ID NO: 539519 - DNA, 18 bp, Homo sapiens
ggagaaaggcaaaccaat

SEQ ID NO: 539520 - DNA, 19 bp, Homo sapiens
ggagaagaaagaactatct

SEQ ID NO: 539521 - DNA, 15 bp, Homo sapiens
ggagaagaatggctt

SEQ ID NO: 539522 - DNA, 15 bp, Homo sapiens
ggagaccaggactct

SEQ ID NO: 539523 - DNA, 23 bp, Homo sapiens
ggagaccaggactctgccttcca

SEQ ID NO: 539524 - DNA, 14 bp, Homo sapiens
ggagaccctgggag

SEQ ID NO: 539525 - DNA, 22 bp, Homo sapiens
ggagaccgagtgtggagctgct

SEQ ID NO: 539526 - DNA, 12 bp, Homo sapiens
ggagagagcaga

SEQ ID NO: 539527 - DNA, 23 bp, Homo sapiens
ggagatacttggtcacagccagg

SEQ ID NO: 539528 - DNA, 14 bp, Homo sapiens
ggagatgaggctgg

SEQ ID NO: 539529 - DNA, 15 bp, Homo sapiens
ggagatgaggctgga

SEQ ID NO: 539530 - DNA, 17 bp, Homo sapiens
ggagatggggagaaacc

SEQ ID NO: 539531 - DNA, 21 bp, Homo sapiens
ggagatgtatttctaaatgtt

SEQ ID NO: 539532 - DNA, 19 bp, Homo sapiens
ggagccctggggtttccac

SEQ ID NO: 539533 - DNA, 19 bp, Homo sapiens
ggagcctgcgtggcctggg

SEQ ID NO: 539534 - DNA, 21 bp, Homo sapiens
ggagcctgcgtggcctggggc

SEQ ID NO: 539535 - DNA, 22 bp, Homo sapiens
ggagctcaggaagaagagatgc

SEQ ID NO: 539536 - DNA, 11 bp, Homo sapiens
ggagctcctgg

SEQ ID NO: 539537 - DNA, 17 bp, Homo sapiens
ggagctggagtccactg

SEQ ID NO: 539538 - DNA, 12 bp, Homo sapiens
ggagctttaaag

SEQ ID NO: 539539 - DNA, 14 bp, Homo sapiens
ggaggacctgcccg

SEQ ID NO: 539540 - DNA, 23 bp, Homo sapiens
ggaggagacagtcaggaagcctc

SEQ ID NO: 539541 - DNA, 22 bp, Homo sapiens
ggaggagactcaggcccacatt

SEQ ID NO: 539542 - DNA, 11 bp, Homo sapiens
ggaggagagcc

SEQ ID NO: 539543 - DNA, 15 bp, Homo sapiens
ggaggctccaggcag

SEQ ID NO: 539544 - DNA, 22 bp, Homo sapiens
ggaggctctgtgtgttaaaatg

SEQ ID NO: 539545 - DNA, 12 bp, Homo sapiens
ggaggctgagat

SEQ ID NO: 539546 - DNA, 18 bp, Homo sapiens
ggagggatagagacgcag

SEQ ID NO: 539547 - DNA, 17 bp, Homo sapiens
ggagggctgcagagcct

SEQ ID NO: 539548 - DNA, 14 bp, Homo sapiens
ggaggggagctctg

SEQ ID NO: 539549 - DNA, 13 bp, Homo sapiens
ggagggggcaaag

SEQ ID NO: 539550 - DNA, 14 bp, Homo sapiens
ggaggtgctgcagg

SEQ ID NO: 539551 - DNA, 17 bp, Homo sapiens
ggagtagcaaggaagga

SEQ ID NO: 539552 - DNA, 17 bp, Homo sapiens
ggagtcagggagccctg

SEQ ID NO: 539553 - DNA, 18 bp, Homo sapiens
ggagtcagggagccctgg

SEQ ID NO: 539554 - DNA, 14 bp, Homo sapiens
ggagtccagacctg

SEQ ID NO: 539555 - DNA, 20 bp, Homo sapiens
ggagtcccactccaagccag

SEQ ID NO: 539556 - DNA, 21 bp, Homo sapiens
ggagtgatatgatccagagca

SEQ ID NO: 539557 - DNA, 22 bp, Homo sapiens
ggagtgatatgatccagagcag

SEQ ID NO: 539558 - DNA, 18 bp, Homo sapiens
ggagtgggtgggacacag

SEQ ID NO: 539559 - DNA, 12 bp, Homo sapiens
ggagttcttctt

SEQ ID NO: 539560 - DNA, 17 bp, Homo sapiens
ggatcacttgagcccag

SEQ ID NO: 539561 - DNA, 15 bp, Homo sapiens
ggatgaagaccctat

SEQ ID NO: 539562 - DNA, 14 bp, Homo sapiens
ggatgatttaacat

SEQ ID NO: 539563 - DNA, 15 bp, Homo sapiens
ggatggcacaatgaa

SEQ ID NO: 539564 - DNA, 15 bp, Homo sapiens
ggatggcccagggtg

SEQ ID NO: 539565 - DNA, 23 bp, Homo sapiens
ggatggcgtgtcccctgcctgtg

SEQ ID NO: 539566 - DNA, 16 bp, Homo sapiens
ggatgggcacaggctg

SEQ ID NO: 539567 - DNA, 17 bp, Homo sapiens
ggatgggcacaggctgc

SEQ ID NO: 539568 - DNA, 16 bp, Homo sapiens
ggatggtggtgcatcc

SEQ ID NO: 539569 - DNA, 16 bp, Homo sapiens
ggattcccctggacat

SEQ ID NO: 539570 - DNA, 16 bp, Homo sapiens
ggattctcaccagctg

SEQ ID NO: 539571 - DNA, 18 bp, Homo sapiens
ggattcttgttttgcttc

SEQ ID NO: 539572 - DNA, 21 bp, Homo sapiens
ggattgaagtggctggaaaga

SEQ ID NO: 539573 - DNA, 15 bp, Homo sapiens
ggattttatgttgac

SEQ ID NO: 539574 - DNA, 21 bp, Homo sapiens
ggattttatgttgacatttgt

SEQ ID NO: 539575 - DNA, 11 bp, Homo sapiens
ggcaaaaacaa

SEQ ID NO: 539576 - DNA, 17 bp, Homo sapiens
ggcaaatattttgtcac

SEQ ID NO: 539577 - DNA, 22 bp, Homo sapiens
ggcaaatattttgtcactgctg

SEQ ID NO: 539578 - DNA, 16 bp, Homo sapiens
ggcaacaaactgcaca

SEQ ID NO: 539579 - DNA, 23 bp, Homo sapiens
ggcaaggacgcttcacaggacag

SEQ ID NO: 539580 - DNA, 24 bp, Homo sapiens
ggcaaggacgcttcacaggacagg

SEQ ID NO: 539581 - DNA, 16 bp, Homo sapiens
ggcaaggggaatctgg

SEQ ID NO: 539582 - DNA, 16 bp, Homo sapiens
ggcaatattctctgta

SEQ ID NO: 539583 - DNA, 16 bp, Homo sapiens
gtagcttaagaaaaaa

SEQ ID NO: 539584 - DNA, 17 bp, Homo sapiens
gtaggaatattatattt

SEQ ID NO: 539585 - DNA, 18 bp, Homo sapiens
gtaggaatattatatttg

SEQ ID NO: 539586 - DNA, 14 bp, Homo sapiens
gtaggatatgcctg

SEQ ID NO: 539587 - DNA, 21 bp, Homo sapiens
gtaggggagagagcagagaag

SEQ ID NO: 539588 - DNA, 18 bp, Homo sapiens
gtaggggcttagaggcat

SEQ ID NO: 539589 - DNA, 21 bp, Homo sapiens
gtagggtcaggccacggcagc

SEQ ID NO: 539590 - DNA, 16 bp, Homo sapiens
gtaggtctatgatgtc

SEQ ID NO: 539591 - DNA, 18 bp, Homo sapiens
gtagtagaatctcagcac

SEQ ID NO: 539592 - DNA, 18 bp, Homo sapiens
gtagtagggtcaggccac

SEQ ID NO: 539593 - DNA, 14 bp, Homo sapiens
gtagtcttatgaat

SEQ ID NO: 539594 - DNA, 16 bp, Homo sapiens
gtagtcttatgaatag

SEQ ID NO: 539595 - DNA, 12 bp, Homo sapiens
gtagtgaccaat

SEQ ID NO: 539596 - DNA, 19 bp, Homo sapiens
gtagttgaggaaagcacag

SEQ ID NO: 539597 - DNA, 21 bp, Homo sapiens
gtataaagaataggacttgtt

SEQ ID NO: 539598 - DNA, 12 bp, Homo sapiens
gtataaatgtat

SEQ ID NO: 539599 - DNA, 16 bp, Homo sapiens
gtataaatgtatatac

SEQ ID NO: 539600 - DNA, 19 bp, Homo sapiens
gtataaatgtatatacaca

SEQ ID NO: 539601 - DNA, 17 bp, Homo sapiens
gtataagatgctgctga

SEQ ID NO: 539602 - DNA, 21 bp, Homo sapiens
gtatacaatatataaaaatat

SEQ ID NO: 539603 - DNA, 22 bp, Homo sapiens
gtatacaatatataaaaatata

SEQ ID NO: 539604 - DNA, 23 bp, Homo sapiens
gtatagaagtcttcatgaaatgc

SEQ ID NO: 539605 - DNA, 17 bp, Homo sapiens
gtatagtatttgaaaac

SEQ ID NO: 539606 - DNA, 21 bp, Homo sapiens
gtatagtatttgaaaacagaa

SEQ ID NO: 539607 - DNA, 15 bp, Homo sapiens
gtatatacacatata

SEQ ID NO: 539608 - DNA, 17 bp, Homo sapiens
gtatatatacatacact

SEQ ID NO: 539609 - DNA, 14 bp, Homo sapiens
gtatatatatgtga

SEQ ID NO: 539610 - DNA, 14 bp, Homo sapiens
gtatatatgtgtat

SEQ ID NO: 539611 - DNA, 16 bp, Homo sapiens
gtatatatgtgtatat

SEQ ID NO: 539612 - DNA, 20 bp, Homo sapiens
gtatatatgtgtatatatac

SEQ ID NO: 539613 - DNA, 14 bp, Homo sapiens
gtatatccttttct

SEQ ID NO: 539614 - DNA, 13 bp, Homo sapiens
gtatatgtaacag

SEQ ID NO: 539615 - DNA, 14 bp, Homo sapiens
gtatatgtttatac

SEQ ID NO: 539616 - DNA, 18 bp, Homo sapiens
gtatatgtttatacacac

SEQ ID NO: 539617 - DNA, 15 bp, Homo sapiens
gtatattgaaaagaa

SEQ ID NO: 539618 - DNA, 17 bp, Homo sapiens
gtatattgaaaagaaaa

SEQ ID NO: 539619 - DNA, 21 bp, Homo sapiens
gtatattgatgtaactgtgtc

SEQ ID NO: 539620 - DNA, 19 bp, Homo sapiens
gtatcaatctttagaaaag

SEQ ID NO: 539621 - DNA, 17 bp, Homo sapiens
gtatcatctaaatatta

SEQ ID NO: 539622 - DNA, 17 bp, Homo sapiens
gtatcgggggctggggc

SEQ ID NO: 539623 - DNA, 16 bp, Homo sapiens
gtatctcctttaatat

SEQ ID NO: 539624 - DNA, 15 bp, Homo sapiens
gtatgcaagcagttt

SEQ ID NO: 539625 - DNA, 23 bp, Homo sapiens
gtatgcaagcagtttcaataaag

SEQ ID NO: 539626 - DNA, 20 bp, Homo sapiens
gtatggaagacaaatacaca

SEQ ID NO: 539627 - DNA, 21 bp, Homo sapiens
gtatggaagacaaatacacat

SEQ ID NO: 539628 - DNA, 13 bp, Homo sapiens
gtatgtgtatatg

SEQ ID NO: 539629 - DNA, 23 bp, Homo sapiens
gtatgtgtatatgtttatacaca

SEQ ID NO: 539630 - DNA, 18 bp, Homo sapiens
gtatgtttttcagttcaa

SEQ ID NO: 539631 - DNA, 21 bp, Homo sapiens
gtattaatactaaaatatgtc

SEQ ID NO: 539632 - DNA, 14 bp, Homo sapiens
gtattcaagaaagc

SEQ ID NO: 539633 - DNA, 18 bp, Homo sapiens
gtattcaagaaagccagt

SEQ ID NO: 539634 - DNA, 21 bp, Homo sapiens
gtattgacaataagaaacagt

SEQ ID NO: 539635 - DNA, 23 bp, Homo sapiens
gtattgacaataagaaacagttt

SEQ ID NO: 539636 - DNA, 16 bp, Homo sapiens
gtattgccaaacatta

SEQ ID NO: 539637 - DNA, 21 bp, Homo sapiens
gtattgccaaacattaatgtt

SEQ ID NO: 539638 - DNA, 21 bp, Homo sapiens
gtatttaaaacatttcatgta

SEQ ID NO: 539639 - DNA, 15 bp, Homo sapiens
gtatttctaaatgtt

SEQ ID NO: 539640 - DNA, 15 bp, Homo sapiens
gtatttgaaaacaga

SEQ ID NO: 539641 - DNA, 16 bp, Homo sapiens
gtatttgaaaacagaa

SEQ ID NO: 539642 - DNA, 20 bp, Homo sapiens
gtatttgaaaacagaaattg

SEQ ID NO: 539643 - DNA, 20 bp, Homo sapiens
gtattttataagcacagaca

SEQ ID NO: 539644 - DNA, 23 bp, Homo sapiens
gtattttatgtatgtttacactg

SEQ ID NO: 539645 - DNA, 17 bp, Homo sapiens
gtattttgatcagtgtt

SEQ ID NO: 539646 - DNA, 16 bp, Homo sapiens
gtatttttcaaggcat

SEQ ID NO: 539647 - DNA, 17 bp, Homo sapiens
gtcaaacattagtactt

SEQ ID NO: 539648 - DNA, 19 bp, Homo sapiens
gtcacaaagctatttaagt

SEQ ID NO: 539649 - DNA, 22 bp, Homo sapiens
gtcacatcccaccccatcctcc

SEQ ID NO: 539650 - DNA, 22 bp, Homo sapiens
gtcacccccacccccgggtgcc

SEQ ID NO: 539651 - DNA, 23 bp, Homo sapiens
gtcactgctgtaaagcaaaatat

SEQ ID NO: 539652 - DNA, 14 bp, Homo sapiens
gtcactgttataaa

SEQ ID NO: 539653 - DNA, 18 bp, Homo sapiens
gtcactgttataaatttt

SEQ ID NO: 539654 - DNA, 17 bp, Homo sapiens
gtcacttcttctgtcca

SEQ ID NO: 539655 - DNA, 15 bp, Homo sapiens
gtcagacacaaacaa

SEQ ID NO: 539656 - DNA, 20 bp, Homo sapiens
gtcaggaggtgcctgagagc

SEQ ID NO: 539657 - DNA, 15 bp, Homo sapiens
gtcaggccacggcag

SEQ ID NO: 539658 - DNA, 17 bp, Homo sapiens
gtcaggccgggcagagc

SEQ ID NO: 539659 - DNA, 20 bp, Homo sapiens
gtcaggctctctgggctgac

SEQ ID NO: 539660 - DNA, 15 bp, Homo sapiens
gtcagggagccctgg

SEQ ID NO: 539661 - DNA, 15 bp, Homo sapiens
gtcagggtgagccca

SEQ ID NO: 539662 - DNA, 23 bp, Homo sapiens
gtcagtcgcctttcagcaggcag

SEQ ID NO: 539663 - DNA, 22 bp, Homo sapiens
gtcagtgtactctgagtcctca

SEQ ID NO: 539664 - DNA, 16 bp, Homo sapiens
gtcataccaactttag

SEQ ID NO: 539665 - DNA, 15 bp, Homo sapiens
gtcataggaagttag

SEQ ID NO: 539666 - DNA, 16 bp, Homo sapiens
gtcatcccggggccat

SEQ ID NO: 539667 - DNA, 19 bp, Homo sapiens
gtcatcccggggccatgga

SEQ ID NO: 539668 - DNA, 22 bp, Homo sapiens
gtcatcccggggccatggaagc

SEQ ID NO: 539669 - DNA, 16 bp, Homo sapiens
gtcatctcccctcctg

SEQ ID NO: 539670 - DNA, 16 bp, Homo sapiens
gtcatgatgctctttc

SEQ ID NO: 539671 - DNA, 15 bp, Homo sapiens
gtcatggtgcaattt

SEQ ID NO: 539672 - DNA, 17 bp, Homo sapiens
gtcatgtgcgaacacag

SEQ ID NO: 539673 - DNA, 12 bp, Homo sapiens
gtcatgtggcta

SEQ ID NO: 539674 - DNA, 22 bp, Homo sapiens
gtcattgcttcttctgaggcct

SEQ ID NO: 539675 - DNA, 16 bp, Homo sapiens
gtcatttattttaaaa

SEQ ID NO: 539676 - DNA, 11 bp, Homo sapiens
gtcatttccat

SEQ ID NO: 539677 - DNA, 21 bp, Homo sapiens
gtcatttccatgtatgcataa

SEQ ID NO: 539678 - DNA, 22 bp, Homo sapiens
gtcatttccatgtatgcataat

SEQ ID NO: 539679 - DNA, 11 bp, Homo sapiens
gtcatttctct

SEQ ID NO: 539680 - DNA, 21 bp, Homo sapiens
gtcatttcttctctctgtgct

SEQ ID NO: 539681 - DNA, 22 bp, Homo sapiens
gtcatttcttctctctgtgctg

SEQ ID NO: 539682 - DNA, 18 bp, Homo sapiens
gtccaacgtggggcagca

SEQ ID NO: 539683 - DNA, 20 bp, Homo sapiens
gtccacttttccagtatttt

SEQ ID NO: 539684 - DNA, 21 bp, Homo sapiens
gtccacttttccagtatttta

SEQ ID NO: 539685 - DNA, 17 bp, Homo sapiens
gtccagacctgggccct

SEQ ID NO: 539686 - DNA, 19 bp, Homo sapiens
gtccagacctgggccctgg

SEQ ID NO: 539687 - DNA, 13 bp, Homo sapiens
gtccagctctccc

SEQ ID NO: 539688 - DNA, 16 bp, Homo sapiens
gtccagctctcccctg

SEQ ID NO: 539689 - DNA, 20 bp, Homo sapiens
gtccagctctcccctgcgca

SEQ ID NO: 539690 - DNA, 13 bp, Homo sapiens
gtccaggagctca

SEQ ID NO: 539691 - DNA, 23 bp, Homo sapiens
gtccaggagctcaggaagaagag

SEQ ID NO: 539692 - DNA, 13 bp, Homo sapiens
gtccatagctgtg

SEQ ID NO: 539693 - DNA, 19 bp, Homo sapiens
gtcccactccaagccagca

SEQ ID NO: 539694 - DNA, 23 bp, Homo sapiens
gtcccagctacaggggaggctga

SEQ ID NO: 539695 - DNA, 23 bp, Homo sapiens
gtccccagaactctgcctgccct

SEQ ID NO: 539696 - DNA, 20 bp, Homo sapiens
gtccccagaccagtagtgac

SEQ ID NO: 539697 - DNA, 16 bp, Homo sapiens
gtccccaggggcacac

SEQ ID NO: 539698 - DNA, 19 bp, Homo sapiens
gtccctccacgttcacccc

SEQ ID NO: 539699 - DNA, 23 bp, Homo sapiens
gtccctgagaagcctcatgggag

SEQ ID NO: 539700 - DNA, 15 bp, Homo sapiens
gtccctggcttcctt

SEQ ID NO: 539701 - DNA, 20 bp, Homo sapiens
gtcccttgaactactgggtg

SEQ ID NO: 539702 - DNA, 15 bp, Homo sapiens
gtccgtgaaagttgt

SEQ ID NO: 539703 - DNA, 16 bp, Homo sapiens
gtcctcattgttcaga

SEQ ID NO: 539704 - DNA, 18 bp, Homo sapiens
gtcctcttaactgtggtg

SEQ ID NO: 539705 - DNA, 15 bp, Homo sapiens
gtcctgaggctgggg

SEQ ID NO: 539706 - DNA, 17 bp, Homo sapiens
gtcctgaggctggggct

SEQ ID NO: 539707 - DNA, 15 bp, Homo sapiens
gtcctggcagggcag

SEQ ID NO: 539708 - DNA, 19 bp, Homo sapiens
gtcctggcagggcaggcag

SEQ ID NO: 539709 - DNA, 20 bp, Homo sapiens
gtcctggcagggcaggcaga

SEQ ID NO: 539710 - DNA, 20 bp, Homo sapiens
gtcctggctcccagggtcct

SEQ ID NO: 539711 - DNA, 17 bp, Homo sapiens
gtcctgggggcctgacc

SEQ ID NO: 539712 - DNA, 19 bp, Homo sapiens
gtcctggtttcctcagcct

SEQ ID NO: 539713 - DNA, 22 bp, Homo sapiens
gtcctgtgtcagtttatgtttt

SEQ ID NO: 539714 - DNA, 18 bp, Homo sapiens
gtccttatctagctgcat

SEQ ID NO: 539715 - DNA, 17 bp, Homo sapiens
gtcctttatgtattctc

SEQ ID NO: 539716 - DNA, 21 bp, Homo sapiens
gtcgcctttcagcaggcagcc

SEQ ID NO: 539717 - DNA, 18 bp, Homo sapiens
gtcggcgccttctacctg

SEQ ID NO: 539718 - DNA, 12 bp, Homo sapiens
gtcggctccagt

SEQ ID NO: 539719 - DNA, 18 bp, Homo sapiens
taaaagaaagatgctgat

SEQ ID NO: 539720 - DNA, 17 bp, Homo sapiens
taaaagaaatgcacaat

SEQ ID NO: 539721 - DNA, 16 bp, Homo sapiens
taaaagcccatgctta

SEQ ID NO: 539722 - DNA, 22 bp, Homo sapiens
taaaagttaataacagctcctt

SEQ ID NO: 539723 - DNA, 19 bp, Homo sapiens
taaaagtttaaagaagagt

SEQ ID NO: 539724 - DNA, 15 bp, Homo sapiens
taaaatacacgtgta

SEQ ID NO: 539725 - DNA, 18 bp, Homo sapiens
taaaatacacgtgtatat

SEQ ID NO: 539726 - DNA, 23 bp, Homo sapiens
taaaatacacgtgtatatgagga

SEQ ID NO: 539727 - DNA, 14 bp, Homo sapiens
taaaatactgtaga

SEQ ID NO: 539728 - DNA, 20 bp, Homo sapiens
taaaatactgtagataatta

SEQ ID NO: 539729 - DNA, 21 bp, Homo sapiens
taaaatactgtagataattaa

SEQ ID NO: 539730 - DNA, 14 bp, Homo sapiens
taaaatcttattaa

SEQ ID NO: 539731 - DNA, 15 bp, Homo sapiens
taaaatcttattaaa

SEQ ID NO: 539732 - DNA, 22 bp, Homo sapiens
taaaatcttattaaagtttcaa

SEQ ID NO: 539733 - DNA, 23 bp, Homo sapiens
taaaatcttattaaagtttcaaa

SEQ ID NO: 539734 - DNA, 14 bp, Homo sapiens
taaaatgattcact

SEQ ID NO: 539735 - DNA, 20 bp, Homo sapiens
taaaatgtgtatttttcaag

SEQ ID NO: 539736 - DNA, 12 bp, Homo sapiens
taaaatgttttc

SEQ ID NO: 539737 - DNA, 13 bp, Homo sapiens
taaaatgttttca

SEQ ID NO: 539738 - DNA, 14 bp, Homo sapiens
taaaatgttttcag

SEQ ID NO: 539739 - DNA, 16 bp, Homo sapiens
taaaatgttttcagct

SEQ ID NO: 539740 - DNA, 17 bp, Homo sapiens
taaaattaaaatttaac

SEQ ID NO: 539741 - DNA, 22 bp, Homo sapiens
taaaatttaacatctgcagtgt

SEQ ID NO: 539742 - DNA, 15 bp, Homo sapiens
taaaatttgaaacat

SEQ ID NO: 539743 - DNA, 21 bp, Homo sapiens
taaaatttgaaacattgcttt

SEQ ID NO: 539744 - DNA, 18 bp, Homo sapiens
taaacacagattatttgt

SEQ ID NO: 539745 - DNA, 24 bp, Homo sapiens
taaacagaactcccttcaaaagcc

SEQ ID NO: 539746 - DNA, 17 bp, Homo sapiens
taaacattaaatgtctt

SEQ ID NO: 539747 - DNA, 19 bp, Homo sapiens
taaacatttcctttttcta

SEQ ID NO: 539748 - DNA, 22 bp, Homo sapiens
taaacatttcctttttctattt

SEQ ID NO: 539749 - DNA, 19 bp, Homo sapiens
taaaccaaaggacattatg

SEQ ID NO: 539750 - DNA, 19 bp, Homo sapiens
taaaccagtttagatttca

SEQ ID NO: 539751 - DNA, 18 bp, Homo sapiens
taaacgtgtatgtttttc

SEQ ID NO: 539752 - DNA, 20 bp, Homo sapiens
taaactttaacttccacttt

SEQ ID NO: 539753 - DNA, 23 bp, Homo sapiens
taaactttaacttccactttgta

SEQ ID NO: 539754 - DNA, 12 bp, Homo sapiens
taaactttaata

SEQ ID NO: 539755 - DNA, 15 bp, Homo sapiens
taaactttgaaatat

SEQ ID NO: 539756 - DNA, 13 bp, Homo sapiens
taaagaaaaatca

SEQ ID NO: 539757 - DNA, 14 bp, Homo sapiens
taaagaaagcagaa

SEQ ID NO: 539758 - DNA, 15 bp, Homo sapiens
taaagaaagtcatag

SEQ ID NO: 539759 - DNA, 14 bp, Homo sapiens
taaagaataggact

SEQ ID NO: 539760 - DNA, 17 bp, Homo sapiens
taaagatattgtatctc

SEQ ID NO: 539761 - DNA, 18 bp, Homo sapiens
taaagatattgtatctcc

SEQ ID NO: 539762 - DNA, 24 bp, Homo sapiens
taaagatattgtatctcctttaat

SEQ ID NO: 539763 - DNA, 16 bp, Homo sapiens
taaagatgtagcaaac

SEQ ID NO: 539764 - DNA, 12 bp, Homo sapiens
taaagcaaaata

SEQ ID NO: 539765 - DNA, 16 bp, Homo sapiens
taaagcaaaatatttg

SEQ ID NO: 539766 - DNA, 21 bp, Homo sapiens
taaagcaaaatatttgtgaaa

SEQ ID NO: 539767 - DNA, 21 bp, Homo sapiens
taaagcaagctcacttgcttt

SEQ ID NO: 539768 - DNA, 14 bp, Homo sapiens
taaagcatctaaac

SEQ ID NO: 539769 - DNA, 21 bp, Homo sapiens
taaagcctaccctattctatc

SEQ ID NO: 539770 - DNA, 16 bp, Homo sapiens
taaaggaaaaatcata

SEQ ID NO: 539771 - DNA, 15 bp, Homo sapiens
taaaggcagctgttg

SEQ ID NO: 539772 - DNA, 20 bp, Homo sapiens
taaaggcagctgttgtctct

SEQ ID NO: 539773 - DNA, 21 bp, Homo sapiens
taaaggtttcactgttcatga

SEQ ID NO: 539774 - DNA, 17 bp, Homo sapiens
taaagtaattgttccag

SEQ ID NO: 539775 - DNA, 19 bp, Homo sapiens
taaagtactgagcagtgat

SEQ ID NO: 539776 - DNA, 14 bp, Homo sapiens
taaagtctgtcatg

SEQ ID NO: 539777 - DNA, 16 bp, Homo sapiens
taaagtgtaataatat

SEQ ID NO: 539778 - DNA, 13 bp, Homo sapiens
taaagtttcaaaa

SEQ ID NO: 539779 - DNA, 20 bp, Homo sapiens
taaagtttcaaaaatctgaa

SEQ ID NO: 539780 - DNA, 12 bp, Homo sapiens
taaagtttgatc

SEQ ID NO: 539781 - DNA, 20 bp, Homo sapiens
taaataaaaaataataatac

SEQ ID NO: 539782 - DNA, 19 bp, Homo sapiens
taaatatactcaagtttca

SEQ ID NO: 539783 - DNA, 20 bp, Homo sapiens
taaatattatgccttgagaa

SEQ ID NO: 539784 - DNA, 19 bp, Homo sapiens
taaatatttggtctctatt

SEQ ID NO: 539785 - DNA, 18 bp, Homo sapiens
taaatattttcaaagaga

SEQ ID NO: 539786 - DNA, 18 bp, Homo sapiens
taaatcaagaccaaagag

SEQ ID NO: 539787 - DNA, 17 bp, Homo sapiens
taaatctaaattaactt

SEQ ID NO: 539788 - DNA, 22 bp, Homo sapiens
taaatctcgcactacatctgat

SEQ ID NO: 539789 - DNA, 22 bp, Homo sapiens
taaatgaaatacttgacaacat

SEQ ID NO: 539790 - DNA, 21 bp, Homo sapiens
taaatgaagtaacttgtctta

SEQ ID NO: 539791 - DNA, 12 bp, Homo sapiens
taaatggggacg

SEQ ID NO: 539792 - DNA, 16 bp, Homo sapiens
taaatggggacgcaga

SEQ ID NO: 539793 - DNA, 15 bp, Homo sapiens
taaatgtatatacac

SEQ ID NO: 539794 - DNA, 15 bp, Homo sapiens
taaatgtcttcatgt

SEQ ID NO: 539795 - DNA, 17 bp, Homo sapiens
taaatgtcttcatgttg

SEQ ID NO: 539796 - DNA, 23 bp, Homo sapiens
taaatgtcttcatgttgatgtgt

SEQ ID NO: 539797 - DNA, 11 bp, Homo sapiens
taaatgtgaat

SEQ ID NO: 539798 - DNA, 16 bp, Homo sapiens
taaatgttaaagatgt

SEQ ID NO: 539799 - DNA, 12 bp, Homo sapiens
taaatgttttgt

SEQ ID NO: 539800 - DNA, 15 bp, Homo sapiens
taaatgttttgtaaa

SEQ ID NO: 539801 - DNA, 18 bp, Homo sapiens
taaatgttttgtaaactt

SEQ ID NO: 539802 - DNA, 23 bp, Homo sapiens
taaatgttttgtaaactttgaaa

SEQ ID NO: 539803 - DNA, 14 bp, Homo sapiens
taaattgatgttga

SEQ ID NO: 539804 - DNA, 20 bp, Homo sapiens
taaattgatgttgatgcaat

SEQ ID NO: 539805 - DNA, 12 bp, Homo sapiens
taaattgtaatt

SEQ ID NO: 539806 - DNA, 21 bp, Homo sapiens
taaattgtaatttgggaacat

SEQ ID NO: 539807 - DNA, 21 bp, Homo sapiens
taaattttgtacatttttgat

SEQ ID NO: 539808 - DNA, 15 bp, Homo sapiens
taaatttttaagtgt

SEQ ID NO: 539809 - DNA, 16 bp, Homo sapiens
taacaactgctgggaa

SEQ ID NO: 539810 - DNA, 20 bp, Homo sapiens
taacaacttttttttctttt

SEQ ID NO: 539811 - DNA, 14 bp, Homo sapiens
taacactgagtgaa

SEQ ID NO: 539812 - DNA, 15 bp, Homo sapiens
taacactgagtgaaa

SEQ ID NO: 539813 - DNA, 17 bp, Homo sapiens
taacactgagtgaaata

SEQ ID NO: 539814 - DNA, 18 bp, Homo sapiens
taacactgagtgaaatat

SEQ ID NO: 539815 - DNA, 17 bp, Homo sapiens
taacacttgaaaagtgt

SEQ ID NO: 539816 - DNA, 21 bp, Homo sapiens
taacagaaaaatgaaatttaa

SEQ ID NO: 539817 - DNA, 22 bp, Homo sapiens
taacagtttaaaaaaaaagttg

SEQ ID NO: 539818 - DNA, 24 bp, Homo sapiens
taacatctgcagtgttctgtgaat

SEQ ID NO: 539819 - DNA, 15 bp, Homo sapiens
taacattcttggtca

SEQ ID NO: 539820 - DNA, 22 bp, Homo sapiens
taacatttctaactctgatgta

SEQ ID NO: 539821 - DNA, 21 bp, Homo sapiens
taaccaaggtagaatgacctt

SEQ ID NO: 539822 - DNA, 13 bp, Homo sapiens
taaccacagctcc

SEQ ID NO: 539823 - DNA, 11 bp, Homo sapiens
taacctccttt

SEQ ID NO: 539824 - DNA, 15 bp, Homo sapiens
taacgtgtgctgtgt

SEQ ID NO: 539825 - DNA, 17 bp, Homo sapiens
taactacctttggctta

SEQ ID NO: 539826 - DNA, 19 bp, Homo sapiens
taactatatgtacagctct

SEQ ID NO: 539827 - DNA, 17 bp, Homo sapiens
taactattgggtgaata

SEQ ID NO: 539828 - DNA, 18 bp, Homo sapiens
taactattgggtgaatat

SEQ ID NO: 539829 - DNA, 14 bp, Homo sapiens
taactctgatgtaa

SEQ ID NO: 539830 - DNA, 14 bp, Homo sapiens
taactgaaaggttg

SEQ ID NO: 539831 - DNA, 14 bp, Homo sapiens
taactgaagagaca

SEQ ID NO: 539832 - DNA, 18 bp, Homo sapiens
taactgccttaaaacttt

SEQ ID NO: 539833 - DNA, 15 bp, Homo sapiens
taactgctcttgggc

SEQ ID NO: 539834 - DNA, 17 bp, Homo sapiens
taacttagagctttttt

SEQ ID NO: 539835 - DNA, 19 bp, Homo sapiens
taacttccactttgtataa

SEQ ID NO: 539836 - DNA, 16 bp, Homo sapiens
taacttctaaaactgt

SEQ ID NO: 539837 - DNA, 17 bp, Homo sapiens
taacttctaaaactgta

SEQ ID NO: 539838 - DNA, 18 bp, Homo sapiens
taacttctaaaactgtac

SEQ ID NO: 539839 - DNA, 13 bp, Homo sapiens
taacttgctgtga

SEQ ID NO: 539840 - DNA, 18 bp, Homo sapiens
taacttgctgtgaaatga

SEQ ID NO: 539841 - DNA, 14 bp, Homo sapiens
taacttgcttaaat

SEQ ID NO: 539842 - DNA, 15 bp, Homo sapiens
taacttgcttaaatg

SEQ ID NO: 539843 - DNA, 17 bp, Homo sapiens
taacttgcttaaatgtg

SEQ ID NO: 539844 - DNA, 18 bp, Homo sapiens
taacttgcttaaatgtga

SEQ ID NO: 539845 - DNA, 13 bp, Homo sapiens
taacttgtcttaa

SEQ ID NO: 539846 - DNA, 24 bp, Homo sapiens
taacttttgtagtcttatgaatag

SEQ ID NO: 539847 - DNA, 19 bp, Homo sapiens
taagaaaaagcaaaaggca

SEQ ID NO: 539848 - DNA, 12 bp, Homo sapiens
taagaaacagtt

SEQ ID NO: 539849 - DNA, 17 bp, Homo sapiens
taagaaacagtttaaca

SEQ ID NO: 539850 - DNA, 18 bp, Homo sapiens
taagaaacagtttaacag

SEQ ID NO: 539851 - DNA, 13 bp, Homo sapiens
taagaaacattgg

SEQ ID NO: 539852 - DNA, 19 bp, Homo sapiens
taagaagccctgcagagca

SEQ ID NO: 539853 - DNA, 12 bp, Homo sapiens
taagagaaatgg

SEQ ID NO: 539854 - DNA, 14 bp, Homo sapiens
taagagagaaatct

SEQ ID NO: 539855 - DNA, 16 bp, Homo sapiens
taagagatttatcttt

SEQ ID NO: 539856 - DNA, 15 bp, Homo sapiens
tatcctccaccgtct

SEQ ID NO: 539857 - DNA, 18 bp, Homo sapiens
tatcctgggcttttgttt

SEQ ID NO: 539858 - DNA, 21 bp, Homo sapiens
tatcctttgtgagcctatgat

SEQ ID NO: 539859 - DNA, 16 bp, Homo sapiens
tatcgggggctggggc

SEQ ID NO: 539860 - DNA, 18 bp, Homo sapiens
tatcgtattcaccttcag

SEQ ID NO: 539861 - DNA, 18 bp, Homo sapiens
tatctagctgcatatctt

SEQ ID NO: 539862 - DNA, 14 bp, Homo sapiens
tatctgaaaactgg

SEQ ID NO: 539863 - DNA, 15 bp, Homo sapiens
tatctgatatctgtt

SEQ ID NO: 539864 - DNA, 22 bp, Homo sapiens
tatctggaaaaaaaaaaatatg

SEQ ID NO: 539865 - DNA, 17 bp, Homo sapiens
tatctgtttgcttctaa

SEQ ID NO: 539866 - DNA, 12 bp, Homo sapiens
tatcttcacata

SEQ ID NO: 539867 - DNA, 15 bp, Homo sapiens
tatcttcacatagtt

SEQ ID NO: 539868 - DNA, 15 bp, Homo sapiens
tatctttaaaactta

SEQ ID NO: 539869 - DNA, 14 bp, Homo sapiens
tatctttatacaga

SEQ ID NO: 539870 - DNA, 17 bp, Homo sapiens
tatctttatacagattt

SEQ ID NO: 539871 - DNA, 23 bp, Homo sapiens
tatctttatacagattttctaga

SEQ ID NO: 539872 - DNA, 13 bp, Homo sapiens
tatctttctttcc

SEQ ID NO: 539873 - DNA, 17 bp, Homo sapiens
tatgaagttggcacatt

SEQ ID NO: 539874 - DNA, 21 bp, Homo sapiens
tatgaatagacataaattgta

SEQ ID NO: 539875 - DNA, 21 bp, Homo sapiens
tatgaatatttcattttgaga

SEQ ID NO: 539876 - DNA, 15 bp, Homo sapiens
tatgactcaaagatg

SEQ ID NO: 539877 - DNA, 18 bp, Homo sapiens
tatgagcatgctccctca

SEQ ID NO: 539878 - DNA, 20 bp, Homo sapiens
tatgaggatgtatgtgtata

SEQ ID NO: 539879 - DNA, 14 bp, Homo sapiens
tatgagtatacaat

SEQ ID NO: 539880 - DNA, 16 bp, Homo sapiens
tatgagtatacaatat

SEQ ID NO: 539881 - DNA, 13 bp, Homo sapiens
tatgatatccctg

SEQ ID NO: 539882 - DNA, 19 bp, Homo sapiens
tatgattaaattatcattg

SEQ ID NO: 539883 - DNA, 16 bp, Homo sapiens
tatgattttttaaaag

SEQ ID NO: 539884 - DNA, 13 bp, Homo sapiens
tatgcatatatat

SEQ ID NO: 539885 - DNA, 17 bp, Homo sapiens
tatgcatatatatgtat

SEQ ID NO: 539886 - DNA, 20 bp, Homo sapiens
tatgcatatatatgtatatt

SEQ ID NO: 539887 - DNA, 14 bp, Homo sapiens
tatgcctgctcttt

SEQ ID NO: 539888 - DNA, 16 bp, Homo sapiens
tatgcctgctctttgg

SEQ ID NO: 539889 - DNA, 13 bp, Homo sapiens
tatgccttttgta

SEQ ID NO: 539890 - DNA, 22 bp, Homo sapiens
tatgccttttgtagctgtcatg

SEQ ID NO: 539891 - DNA, 13 bp, Homo sapiens
tatgcgcaaatac

SEQ ID NO: 539892 - DNA, 15 bp, Homo sapiens
tatgcgcaaatacaa

SEQ ID NO: 539893 - DNA, 14 bp, Homo sapiens
tatgctaagaattt

SEQ ID NO: 539894 - DNA, 19 bp, Homo sapiens
tatggaagacaaatacaca

SEQ ID NO: 539895 - DNA, 19 bp, Homo sapiens
tatggaagccaccgggaga

SEQ ID NO: 539896 - DNA, 16 bp, Homo sapiens
tatggaaggtggagcg

SEQ ID NO: 539897 - DNA, 17 bp, Homo sapiens
tatggctttgtgcttgt

SEQ ID NO: 539898 - DNA, 22 bp, Homo sapiens
tatggctttgtgcttgttcttc

SEQ ID NO: 539899 - DNA, 14 bp, Homo sapiens
tatggtaatcatat

SEQ ID NO: 539900 - DNA, 16 bp, Homo sapiens
tatggtaatcatatta

SEQ ID NO: 539901 - DNA, 18 bp, Homo sapiens
tatggtaatcatattaga

SEQ ID NO: 539902 - DNA, 13 bp, Homo sapiens
tatggtctaatgt

SEQ ID NO: 539903 - DNA, 16 bp, Homo sapiens
tatggtctaatgttta

SEQ ID NO: 539904 - DNA, 20 bp, Homo sapiens
tatggtgctgggtccttaaa

SEQ ID NO: 539905 - DNA, 23 bp, Homo sapiens
tatggtgtgttgtatctttgtaa

SEQ ID NO: 539906 - DNA, 14 bp, Homo sapiens
tatgtaacttgttg

SEQ ID NO: 539907 - DNA, 18 bp, Homo sapiens
tatgtagactatatacat

SEQ ID NO: 539908 - DNA, 14 bp, Homo sapiens
tatgtattttatgt

SEQ ID NO: 539909 - DNA, 16 bp, Homo sapiens
tatgtattttatgtat

SEQ ID NO: 539910 - DNA, 19 bp, Homo sapiens
tatgtattttatgtatgtt

SEQ ID NO: 539911 - DNA, 10 bp, Homo sapiens
tatgtgtata

SEQ ID NO: 539912 - DNA, 14 bp, Homo sapiens
tatgtgtatatata

SEQ ID NO: 539913 - DNA, 18 bp, Homo sapiens
tatgtgtgcatgtgtgta

SEQ ID NO: 539914 - DNA, 14 bp, Homo sapiens
tatgttgacatttg

SEQ ID NO: 539915 - DNA, 22 bp, Homo sapiens
tatgtttaaagtaattgttcca

SEQ ID NO: 539916 - DNA, 14 bp, Homo sapiens
tattaaagtttcaa

SEQ ID NO: 539917 - DNA, 18 bp, Homo sapiens
tattaaagtttcaaaaat

SEQ ID NO: 539918 - DNA, 21 bp, Homo sapiens
tattaaagtttcaaaaatctg

SEQ ID NO: 539919 - DNA, 22 bp, Homo sapiens
tattaaagtttcaaaaatctga

SEQ ID NO: 539920 - DNA, 15 bp, Homo sapiens
tattacaatatttgt

SEQ ID NO: 539921 - DNA, 19 bp, Homo sapiens
tattacaatatttgtgtgc

SEQ ID NO: 539922 - DNA, 20 bp, Homo sapiens
tattaccaccatcccgtgct

SEQ ID NO: 539923 - DNA, 23 bp, Homo sapiens
tattactacaaaaccgtttagtc

SEQ ID NO: 539924 - DNA, 14 bp, Homo sapiens
tattagaaaacttt

SEQ ID NO: 539925 - DNA, 16 bp, Homo sapiens
tattagaaaactttgt

SEQ ID NO: 539926 - DNA, 17 bp, Homo sapiens
tattagacttctgtttt

SEQ ID NO: 539927 - DNA, 15 bp, Homo sapiens
tattatatttggatg

SEQ ID NO: 539928 - DNA, 17 bp, Homo sapiens
tattatatttggatgca

SEQ ID NO: 539929 - DNA, 14 bp, Homo sapiens
tattatgttatgaa

SEQ ID NO: 539930 - DNA, 13 bp, Homo sapiens
tattattcaaacc

SEQ ID NO: 539931 - DNA, 20 bp, Homo sapiens
tattcaaaccaatttcttcc

SEQ ID NO: 539932 - DNA, 19 bp, Homo sapiens
tattcaagaaagccagtct

SEQ ID NO: 539933 - DNA, 22 bp, Homo sapiens
tattcaagaaagccagtcttaa

SEQ ID NO: 539934 - DNA, 17 bp, Homo sapiens
tattcaccttcagtttt

SEQ ID NO: 539935 - DNA, 17 bp, Homo sapiens
tattcagagaatatcaa

SEQ ID NO: 539936 - DNA, 21 bp, Homo sapiens
tattcaggaccccatctgctg

SEQ ID NO: 539937 - DNA, 23 bp, Homo sapiens
tattcattactagataaaatgta

SEQ ID NO: 539938 - DNA, 19 bp, Homo sapiens
tattccatattagaaaact

SEQ ID NO: 539939 - DNA, 21 bp, Homo sapiens
tattcccatggtagactgtga

SEQ ID NO: 539940 - DNA, 18 bp, Homo sapiens
tattccccatttcctgta

SEQ ID NO: 539941 - DNA, 21 bp, Homo sapiens
tattccccatttcctgtacaa

SEQ ID NO: 539942 - DNA, 15 bp, Homo sapiens
tattctctgtacata

SEQ ID NO: 539943 - DNA, 16 bp, Homo sapiens
tattctctgtacatat

SEQ ID NO: 539944 - DNA, 18 bp, Homo sapiens
tattctctgtacatatta

SEQ ID NO: 539945 - DNA, 19 bp, Homo sapiens
tattctgcagaaaattaat

SEQ ID NO: 539946 - DNA, 16 bp, Homo sapiens
tattctgggaatgtat

SEQ ID NO: 539947 - DNA, 17 bp, Homo sapiens
tattctgggaatgtata

SEQ ID NO: 539948 - DNA, 19 bp, Homo sapiens
tattctgggaatgtatagt

SEQ ID NO: 539949 - DNA, 21 bp, Homo sapiens
tattctgggaatgtatagtat

SEQ ID NO: 539950 - DNA, 23 bp, Homo sapiens
tattctgggaatgtatagtattt

SEQ ID NO: 539951 - DNA, 19 bp, Homo sapiens
tattctttgttaatttgga

SEQ ID NO: 539952 - DNA, 16 bp, Homo sapiens
tattgaaaatgtcact

SEQ ID NO: 539953 - DNA, 17 bp, Homo sapiens
tattgaaaatgtcactg

SEQ ID NO: 539954 - DNA, 17 bp, Homo sapiens
tattgccaaacattaat

SEQ ID NO: 539955 - DNA, 13 bp, Homo sapiens
tattgctacttcc

SEQ ID NO: 539956 - DNA, 22 bp, Homo sapiens
tattggccataagcaacaattt

SEQ ID NO: 539957 - DNA, 22 bp, Homo sapiens
tattgtatcaatctttagaaaa

SEQ ID NO: 539958 - DNA, 15 bp, Homo sapiens
tattgtatctccttt

SEQ ID NO: 539959 - DNA, 16 bp, Homo sapiens
tattgttacagctgaa

SEQ ID NO: 539960 - DNA, 13 bp, Homo sapiens
tatttaaaaacaa

SEQ ID NO: 539961 - DNA, 19 bp, Homo sapiens
tatttaaaaacaaaaggca

SEQ ID NO: 539962 - DNA, 15 bp, Homo sapiens
tatttaagtattcaa

SEQ ID NO: 539963 - DNA, 18 bp, Homo sapiens
tatttaagtattcaagaa

SEQ ID NO: 539964 - DNA, 21 bp, Homo sapiens
tatttattctgggaatgtata

SEQ ID NO: 539965 - DNA, 17 bp, Homo sapiens
tatttattgctacttcc

SEQ ID NO: 539966 - DNA, 22 bp, Homo sapiens
tatttcagttattgtccctggc

SEQ ID NO: 539967 - DNA, 17 bp, Homo sapiens
tatttcataagcacatc

SEQ ID NO: 539968 - DNA, 14 bp, Homo sapiens
tatttcggctatgt

SEQ ID NO: 539969 - DNA, 14 bp, Homo sapiens
tatttctttagaac

SEQ ID NO: 539970 - DNA, 14 bp, Homo sapiens
tatttgaaaacaga

SEQ ID NO: 539971 - DNA, 16 bp, Homo sapiens
tatttgcacagaagag

SEQ ID NO: 539972 - DNA, 23 bp, Homo sapiens
tatttgcagataattctggacca

SEQ ID NO: 539973 - DNA, 13 bp, Homo sapiens
tatttggctgggc

SEQ ID NO: 539974 - DNA, 18 bp, Homo sapiens
tatttggtctctatttca

SEQ ID NO: 539975 - DNA, 12 bp, Homo sapiens
tatttgtgtgct

SEQ ID NO: 539976 - DNA, 12 bp, Homo sapiens
tatttgttaatt

SEQ ID NO: 539977 - DNA, 13 bp, Homo sapiens
tatttgttaattt

SEQ ID NO: 539978 - DNA, 14 bp, Homo sapiens
tattttatgtatgt

SEQ ID NO: 539979 - DNA, 15 bp, Homo sapiens
tattttcaaagagat

SEQ ID NO: 539980 - DNA, 16 bp, Homo sapiens
tattttcagctcaatt

SEQ ID NO: 539981 - DNA, 19 bp, Homo sapiens
tattttcatttctaacata

SEQ ID NO: 539982 - DNA, 18 bp, Homo sapiens
tattttctactttaaatt

SEQ ID NO: 539983 - DNA, 13 bp, Homo sapiens
tattttgtatgca

SEQ ID NO: 539984 - DNA, 20 bp, Homo sapiens
tattttgtatgcaagcagtt

SEQ ID NO: 539985 - DNA, 23 bp, Homo sapiens
tattttgtcactgctgtaaagca

SEQ ID NO: 539986 - DNA, 12 bp, Homo sapiens
tatttttcatta

SEQ ID NO: 539987 - DNA, 15 bp, Homo sapiens
tcaaaaatctgaaga

SEQ ID NO: 539988 - DNA, 17 bp, Homo sapiens
tcaaaaatctgaagatt

SEQ ID NO: 539989 - DNA, 16 bp, Homo sapiens
tcaaaaattgaagaga

SEQ ID NO: 539990 - DNA, 17 bp, Homo sapiens
tcaaaagacatgttgta

SEQ ID NO: 539991 - DNA, 12 bp, Homo sapiens
tcaaaataaaaa

SEQ ID NO: 539992 - DNA, 14 bp, Homo sapiens
tcaaaataaaacca

SEQ ID NO: 539993 - DNA, 15 bp, Homo sapiens
tcaaaataaagcttt

SEQ ID NO: 539994 - DNA, 18 bp, Homo sapiens
tccatcctcctccttcct

SEQ ID NO: 539995 - DNA, 16 bp, Homo sapiens
tccatccttctcccca

SEQ ID NO: 539996 - DNA, 18 bp, Homo sapiens
tccatgcggccggcctgg

SEQ ID NO: 539997 - DNA, 22 bp, Homo sapiens
tccatgcggccggcctggggcc

SEQ ID NO: 539998 - DNA, 17 bp, Homo sapiens
tccatggtgaactgaag

SEQ ID NO: 539999 - DNA, 21 bp, Homo sapiens
tccatggtgaactgaagcaga

SEQ ID NO: 540000 - DNA, 23 bp, Homo sapiens
tccatggtgaactgaagcagagt

SEQ ID NO: 540001 - DNA, 15 bp, Homo sapiens
tccatgtatgcataa

SEQ ID NO: 540002 - DNA, 17 bp, Homo sapiens
tccatgtcctatgtgtg

SEQ ID NO: 540003 - DNA, 16 bp, Homo sapiens
tccattggatctgcaa

SEQ ID NO: 540004 - DNA, 23 bp, Homo sapiens
tccattggatctgcaagaacact

SEQ ID NO: 540005 - DNA, 13 bp, Homo sapiens
tccattgtatctt

SEQ ID NO: 540006 - DNA, 15 bp, Homo sapiens
tccattttacacttg

SEQ ID NO: 540007 - DNA, 23 bp, Homo sapiens
tcccaaaagtatcgggggctggg

SEQ ID NO: 540008 - DNA, 14 bp, Homo sapiens
tcccaaatctcaaa

SEQ ID NO: 540009 - DNA, 15 bp, Homo sapiens
tcccaaatctcaaaa

SEQ ID NO: 540010 - DNA, 14 bp, Homo sapiens
tcccaacctcccct

SEQ ID NO: 540011 - DNA, 16 bp, Homo sapiens
tcccacactgtgaact

SEQ ID NO: 540012 - DNA, 13 bp, Homo sapiens
tcccacatccccc

SEQ ID NO: 540013 - DNA, 16 bp, Homo sapiens
tcccactccaagccag

SEQ ID NO: 540014 - DNA, 18 bp, Homo sapiens
tcccactccaagccagca

SEQ ID NO: 540015 - DNA, 19 bp, Homo sapiens
tcccactccaagccagcaa

SEQ ID NO: 540016 - DNA, 15 bp, Homo sapiens
tcccacttgcccctg

SEQ ID NO: 540017 - DNA, 11 bp, Homo sapiens
tcccagatcca

SEQ ID NO: 540018 - DNA, 20 bp, Homo sapiens
tcccagatccaggaacacat

SEQ ID NO: 540019 - DNA, 22 bp, Homo sapiens
tcccagctacaggggaggctga

SEQ ID NO: 540020 - DNA, 19 bp, Homo sapiens
tcccagctgcccctccctg

SEQ ID NO: 540021 - DNA, 22 bp, Homo sapiens
tcccagctgcccctccctgcca

SEQ ID NO: 540022 - DNA, 12 bp, Homo sapiens
tcccagggtcct

SEQ ID NO: 540023 - DNA, 22 bp, Homo sapiens
tcccatcgtctcggccttcaca

SEQ ID NO: 540024 - DNA, 17 bp, Homo sapiens
tcccatggtagactgtg

SEQ ID NO: 540025 - DNA, 23 bp, Homo sapiens
tcccatggtagactgtgacacag

SEQ ID NO: 540026 - DNA, 11 bp, Homo sapiens
tcccatggtgc

SEQ ID NO: 540027 - DNA, 22 bp, Homo sapiens
tcccattgcatcacctctgtaa

SEQ ID NO: 540028 - DNA, 17 bp, Homo sapiens
tcccattgtatttaaaa

SEQ ID NO: 540029 - DNA, 22 bp, Homo sapiens
tcccattgtatttaaaacattt

SEQ ID NO: 540030 - DNA, 16 bp, Homo sapiens
tcccatttccttgtct

SEQ ID NO: 540031 - DNA, 18 bp, Homo sapiens
tcccatttccttgtctaa

SEQ ID NO: 540032 - DNA, 10 bp, Homo sapiens
tccccaaagt

SEQ ID NO: 540033 - DNA, 19 bp, Homo sapiens
tccccaaggccccctgcct

SEQ ID NO: 540034 - DNA, 21 bp, Homo sapiens
tccccaaggccccctgcctgc

SEQ ID NO: 540035 - DNA, 17 bp, Homo sapiens
tccccaccctccccttc

SEQ ID NO: 540036 - DNA, 14 bp, Homo sapiens
tccccagaccagta

SEQ ID NO: 540037 - DNA, 17 bp, Homo sapiens
tccccagaccagtagtg

SEQ ID NO: 540038 - DNA, 11 bp, Homo sapiens
tccccctcctt

SEQ ID NO: 540039 - DNA, 21 bp, Homo sapiens
tccccgagccgagctctcctg

SEQ ID NO: 540040 - DNA, 16 bp, Homo sapiens
tcccctgcgcaggccc

SEQ ID NO: 540041 - DNA, 19 bp, Homo sapiens
tcccctgcgcaggccctcc

SEQ ID NO: 540042 - DNA, 16 bp, Homo sapiens
tcccctggtcctgcac

SEQ ID NO: 540043 - DNA, 17 bp, Homo sapiens
tcccctgtgccagccca

SEQ ID NO: 540044 - DNA, 20 bp, Homo sapiens
tcccctgtgccagcccagag

SEQ ID NO: 540045 - DNA, 15 bp, Homo sapiens
tccccttccatttct

SEQ ID NO: 540046 - DNA, 22 bp, Homo sapiens
tccccttgggatgggcacaggc

SEQ ID NO: 540047 - DNA, 20 bp, Homo sapiens
tcccgcccaaacctttcccc

SEQ ID NO: 540048 - DNA, 14 bp, Homo sapiens
tccctcagccctca

SEQ ID NO: 540049 - DNA, 15 bp, Homo sapiens
tccctcccagatcca

SEQ ID NO: 540050 - DNA, 15 bp, Homo sapiens
tccctccccagctcc

SEQ ID NO: 540051 - DNA, 15 bp, Homo sapiens
tccctccctcccaga

SEQ ID NO: 540052 - DNA, 16 bp, Homo sapiens
tccctccctgctgtca

SEQ ID NO: 540053 - DNA, 16 bp, Homo sapiens
tccctcgtctttccca

SEQ ID NO: 540054 - DNA, 15 bp, Homo sapiens
tccctctctcactcc

SEQ ID NO: 540055 - DNA, 19 bp, Homo sapiens
tccctgaatctgaccacag

SEQ ID NO: 540056 - DNA, 22 bp, Homo sapiens
tccctgacactgtctgctgccc

SEQ ID NO: 540057 - DNA, 14 bp, Homo sapiens
tccctgagggccct

SEQ ID NO: 540058 - DNA, 16 bp, Homo sapiens
tccctgctgccaggct

SEQ ID NO: 540059 - DNA, 22 bp, Homo sapiens
tccctgctgtcattgcttcttc

SEQ ID NO: 540060 - DNA, 23 bp, Homo sapiens
tccctgctgtcattgcttcttct

SEQ ID NO: 540061 - DNA, 16 bp, Homo sapiens
tccctggcttccttac

SEQ ID NO: 540062 - DNA, 19 bp, Homo sapiens
tccctgggggccccaggat

SEQ ID NO: 540063 - DNA, 20 bp, Homo sapiens
tccctgtctgtctgtctctc

SEQ ID NO: 540064 - DNA, 14 bp, Homo sapiens
tcccttccacctgc

SEQ ID NO: 540065 - DNA, 17 bp, Homo sapiens
tcccttccacctgctct

SEQ ID NO: 540066 - DNA, 12 bp, Homo sapiens
tcccttctcttc

SEQ ID NO: 540067 - DNA, 14 bp, Homo sapiens
tcccttctcttcca

SEQ ID NO: 540068 - DNA, 15 bp, Homo sapiens
tcccttctcttccag

SEQ ID NO: 540069 - DNA, 16 bp, Homo sapiens
tcccttctcttccagg

SEQ ID NO: 540070 - DNA, 18 bp, Homo sapiens
tcccttctggctgtcagt

SEQ ID NO: 540071 - DNA, 16 bp, Homo sapiens
tccctttcttctcccc

SEQ ID NO: 540072 - DNA, 19 bp, Homo sapiens
tccctttttaaacaaatgg

SEQ ID NO: 540073 - DNA, 22 bp, Homo sapiens
tccgaagggaattaaaaagaag

SEQ ID NO: 540074 - DNA, 21 bp, Homo sapiens
tccgacttgtgcacaggcaga

SEQ ID NO: 540075 - DNA, 14 bp, Homo sapiens
tccgccctgggctc

SEQ ID NO: 540076 - DNA, 15 bp, Homo sapiens
tccgccctgggctct

SEQ ID NO: 540077 - DNA, 13 bp, Homo sapiens
tccgcccttccct

SEQ ID NO: 540078 - DNA, 15 bp, Homo sapiens
tccgtcctggcaggg

SEQ ID NO: 540079 - DNA, 16 bp, Homo sapiens
tccgtgtggagggctg

SEQ ID NO: 540080 - DNA, 21 bp, Homo sapiens
tccgtttgatttgtcactgct

SEQ ID NO: 540081 - DNA, 17 bp, Homo sapiens
tcctaactgaagagaca

SEQ ID NO: 540082 - DNA, 18 bp, Homo sapiens
tcctaactgaagagacag

SEQ ID NO: 540083 - DNA, 15 bp, Homo sapiens
tcctaccattatggc

SEQ ID NO: 540084 - DNA, 23 bp, Homo sapiens
tcctacgagtaattgcatttgct

SEQ ID NO: 540085 - DNA, 16 bp, Homo sapiens
tcctactcttctctct

SEQ ID NO: 540086 - DNA, 23 bp, Homo sapiens
tcctactcttctctctgctctga

SEQ ID NO: 540087 - DNA, 22 bp, Homo sapiens
tcctagcactttgggaggctga

SEQ ID NO: 540088 - DNA, 15 bp, Homo sapiens
tcctatctggggagc

SEQ ID NO: 540089 - DNA, 18 bp, Homo sapiens
tcctatctggggagctcc

SEQ ID NO: 540090 - DNA, 20 bp, Homo sapiens
tcctatctggggagctcctg

SEQ ID NO: 540091 - DNA, 20 bp, Homo sapiens
tcctatgactcaaagatgaa

SEQ ID NO: 540092 - DNA, 17 bp, Homo sapiens
tcctcaattccagggaa

SEQ ID NO: 540093 - DNA, 17 bp, Homo sapiens
tcctcattgttcagaaa

SEQ ID NO: 540094 - DNA, 14 bp, Homo sapiens
tcctccaaggacag

SEQ ID NO: 540095 - DNA, 11 bp, Homo sapiens
tcctccagaac

SEQ ID NO: 540096 - DNA, 16 bp, Homo sapiens
tcctccattgtatctt

SEQ ID NO: 540097 - DNA, 20 bp, Homo sapiens
tcctccccaggacttggtct

SEQ ID NO: 540098 - DNA, 16 bp, Homo sapiens
tcctcctccttcctag

SEQ ID NO: 540099 - DNA, 19 bp, Homo sapiens
tcctccttcactccctgtc

SEQ ID NO: 540100 - DNA, 19 bp, Homo sapiens
tcctccttgtcttggcagc

SEQ ID NO: 540101 - DNA, 15 bp, Homo sapiens
tcctcggccagagct

SEQ ID NO: 540102 - DNA, 22 bp, Homo sapiens
tcctcggccagagctcccagga

SEQ ID NO: 540103 - DNA, 17 bp, Homo sapiens
tcctctctaacctcctt

SEQ ID NO: 540104 - DNA, 19 bp, Homo sapiens
tcctctctaacctccttta

SEQ ID NO: 540105 - DNA, 22 bp, Homo sapiens
tcctctgccctcccttcttgtg

SEQ ID NO: 540106 - DNA, 15 bp, Homo sapiens
tcctctgctaaattg

SEQ ID NO: 540107 - DNA, 12 bp, Homo sapiens
tcctctgctccc

SEQ ID NO: 540108 - DNA, 18 bp, Homo sapiens
tcctcttaatgtctcaaa

SEQ ID NO: 540109 - DNA, 14 bp, Homo sapiens
tcctcttacctgta

SEQ ID NO: 540110 - DNA, 20 bp, Homo sapiens
tcctgacctccgccatccac

SEQ ID NO: 540111 - DNA, 15 bp, Homo sapiens
tcctgcactgtcccg

SEQ ID NO: 540112 - DNA, 17 bp, Homo sapiens
tcctgcactgtcccgga

SEQ ID NO: 540113 - DNA, 15 bp, Homo sapiens
tcctgcccccacacc

SEQ ID NO: 540114 - DNA, 18 bp, Homo sapiens
tcctgcctggtctcctgc

SEQ ID NO: 540115 - DNA, 20 bp, Homo sapiens
tcctgctacagtagctgtgg

SEQ ID NO: 540116 - DNA, 20 bp, Homo sapiens
tcctgctgagtggtccacat

SEQ ID NO: 540117 - DNA, 13 bp, Homo sapiens
tcctgctgccagt

SEQ ID NO: 540118 - DNA, 17 bp, Homo sapiens
tcctggacaggccaggt

SEQ ID NO: 540119 - DNA, 22 bp, Homo sapiens
tcctggcactaccaaaggacac

SEQ ID NO: 540120 - DNA, 22 bp, Homo sapiens
tcctggcagggcaggcagagct

SEQ ID NO: 540121 - DNA, 16 bp, Homo sapiens
tcctggctcccagggt

SEQ ID NO: 540122 - DNA, 15 bp, Homo sapiens
tcctgggcatcccca

SEQ ID NO: 540123 - DNA, 17 bp, Homo sapiens
tcctgggcatccccagc

SEQ ID NO: 540124 - DNA, 14 bp, Homo sapiens
tcctgggccagggt

SEQ ID NO: 540125 - DNA, 18 bp, Homo sapiens
tcctgggggcctgacctc

SEQ ID NO: 540126 - DNA, 19 bp, Homo sapiens
tcctgggggcctgacctcc

SEQ ID NO: 540127 - DNA, 14 bp, Homo sapiens
tcctgggggctgct

SEQ ID NO: 540128 - DNA, 17 bp, Homo sapiens
tcctgggggctgctgca

SEQ ID NO: 540129 - DNA, 14 bp, Homo sapiens
tcctgtacaatcat

SEQ ID NO: 540130 - DNA, 17 bp, Homo sapiens
tcctgtcctggctccca

SEQ ID NO: 540131 - DNA, 21 bp, Homo sapiens
tcttttgttttttgaagtgtt

SEQ ID NO: 540132 - DNA, 23 bp, Homo sapiens
tctttttttaagtgttctgtggc

SEQ ID NO: 540133 - DNA, 23 bp, Homo sapiens
tcttttttttttaagtgaaattt

SEQ ID NO: 540134 - DNA, 18 bp, Homo sapiens
tgaaaacagaaaacggtt

SEQ ID NO: 540135 - DNA, 17 bp, Homo sapiens
tgaaaacagaaattggt

SEQ ID NO: 540136 - DNA, 18 bp, Homo sapiens
tgaaaacagaaattggta

SEQ ID NO: 540137 - DNA, 15 bp, Homo sapiens
tgaaaactcatacag

SEQ ID NO: 540138 - DNA, 14 bp, Homo sapiens
tgaaaactggaata

SEQ ID NO: 540139 - DNA, 21 bp, Homo sapiens
tgaaaactggaataagaagca

SEQ ID NO: 540140 - DNA, 14 bp, Homo sapiens
tgaaaaggccaaga

SEQ ID NO: 540141 - DNA, 15 bp, Homo sapiens
tgaaaatgtcactgt

SEQ ID NO: 540142 - DNA, 21 bp, Homo sapiens
tgaaaatgtcactgttataaa

SEQ ID NO: 540143 - DNA, 12 bp, Homo sapiens
tgaaacacaata

SEQ ID NO: 540144 - DNA, 17 bp, Homo sapiens
tgaaacacaatatcatc

SEQ ID NO: 540145 - DNA, 16 bp, Homo sapiens
tgaaacattgctttta

SEQ ID NO: 540146 - DNA, 17 bp, Homo sapiens
tgaaacattgcttttaa

SEQ ID NO: 540147 - DNA, 18 bp, Homo sapiens
tgaaacattgcttttaaa

SEQ ID NO: 540148 - DNA, 21 bp, Homo sapiens
tgaaacattgcttttaaaact

SEQ ID NO: 540149 - DNA, 14 bp, Homo sapiens
tgaaactaatgaaa

SEQ ID NO: 540150 - DNA, 11 bp, Homo sapiens
tgaaactgtat

SEQ ID NO: 540151 - DNA, 12 bp, Homo sapiens
tgaaactgtatt

SEQ ID NO: 540152 - DNA, 15 bp, Homo sapiens
tgaaactgtatttac

SEQ ID NO: 540153 - DNA, 17 bp, Homo sapiens
tgaaactgtatttactt

SEQ ID NO: 540154 - DNA, 15 bp, Homo sapiens
tgaaagcaacagctg

SEQ ID NO: 540155 - DNA, 19 bp, Homo sapiens
tgaaagctgtttcatttgt

SEQ ID NO: 540156 - DNA, 21 bp, Homo sapiens
tgaaagtcagtttaagaggct

SEQ ID NO: 540157 - DNA, 22 bp, Homo sapiens
tgaaagttgtgatctgttgtaa

SEQ ID NO: 540158 - DNA, 12 bp, Homo sapiens
tgaaatacctat

SEQ ID NO: 540159 - DNA, 13 bp, Homo sapiens
tgaaatattactc

SEQ ID NO: 540160 - DNA, 21 bp, Homo sapiens
tgaaatattttctactttaaa

SEQ ID NO: 540161 - DNA, 14 bp, Homo sapiens
tgaaatgaacacaa

SEQ ID NO: 540162 - DNA, 17 bp, Homo sapiens
tgaaatgaacacaaatt

SEQ ID NO: 540163 - DNA, 18 bp, Homo sapiens
tgaaatgaacacaaatta

SEQ ID NO: 540164 - DNA, 22 bp, Homo sapiens
tgaaatgctatgtcatttcatg

SEQ ID NO: 540165 - DNA, 24 bp, Homo sapiens
tgaaatgtgtgtgatgtgacattt

SEQ ID NO: 540166 - DNA, 12 bp, Homo sapiens
tgaaattcaatt

SEQ ID NO: 540167 - DNA, 20 bp, Homo sapiens
tgaaattcaattcatagaat

SEQ ID NO: 540168 - DNA, 18 bp, Homo sapiens
tgaaattcacaaagttaa

SEQ ID NO: 540169 - DNA, 11 bp, Homo sapiens
tgaaatttaag

SEQ ID NO: 540170 - DNA, 14 bp, Homo sapiens
tgaaatttaagcac

SEQ ID NO: 540171 - DNA, 17 bp, Homo sapiens
tgaaatttaagcacaaa

SEQ ID NO: 540172 - DNA, 22 bp, Homo sapiens
tgaaatttattgaggaaaaata

SEQ ID NO: 540173 - DNA, 17 bp, Homo sapiens
tgaaatttttcatattt

SEQ ID NO: 540174 - DNA, 17 bp, Homo sapiens
tgaacaaaccctttaaa

SEQ ID NO: 540175 - DNA, 18 bp, Homo sapiens
tgaacaaaccctttaaat

SEQ ID NO: 540176 - DNA, 14 bp, Homo sapiens
tgaacacaaattat

SEQ ID NO: 540177 - DNA, 19 bp, Homo sapiens
tgaacagctctgagatcct

SEQ ID NO: 540178 - DNA, 19 bp, Homo sapiens
tgaacaggtgggtgtctgc

SEQ ID NO: 540179 - DNA, 14 bp, Homo sapiens
tgaactcctgccat

SEQ ID NO: 540180 - DNA, 14 bp, Homo sapiens
tgaacttttcaaaa

SEQ ID NO: 540181 - DNA, 17 bp, Homo sapiens
tgaacttttcaaaataa

SEQ ID NO: 540182 - DNA, 17 bp, Homo sapiens
tgaagaaatttatgaag

SEQ ID NO: 540183 - DNA, 22 bp, Homo sapiens
tgaagaaatttatgaagcagat

SEQ ID NO: 540184 - DNA, 17 bp, Homo sapiens
tgaagaccctatctccc

SEQ ID NO: 540185 - DNA, 23 bp, Homo sapiens
tgaagacctaaccagggccagaa

SEQ ID NO: 540186 - DNA, 24 bp, Homo sapiens
tgaagagaaccgagcaaagatcaa

SEQ ID NO: 540187 - DNA, 15 bp, Homo sapiens
tgaagagagatatat

SEQ ID NO: 540188 - DNA, 21 bp, Homo sapiens
tgaagagagatatatctgaaa

SEQ ID NO: 540189 - DNA, 13 bp, Homo sapiens
tgaagagtgaaga

SEQ ID NO: 540190 - DNA, 16 bp, Homo sapiens
tgaagagtgaagagca

SEQ ID NO: 540191 - DNA, 20 bp, Homo sapiens
tgaagagtgaagagcatttg

SEQ ID NO: 540192 - DNA, 23 bp, Homo sapiens
tgaagataaatccaactctgact

SEQ ID NO: 540193 - DNA, 22 bp, Homo sapiens
tgaagatgggggcctctttcag

SEQ ID NO: 540194 - DNA, 16 bp, Homo sapiens
tgaagattgtttatct

SEQ ID NO: 540195 - DNA, 16 bp, Homo sapiens
tgaagcagatttattt

SEQ ID NO: 540196 - DNA, 14 bp, Homo sapiens
tgaagccagctccc

SEQ ID NO: 540197 - DNA, 18 bp, Homo sapiens
tgaagccagctccctgaa

SEQ ID NO: 540198 - DNA, 22 bp, Homo sapiens
tgaagcttcactcactgtcaat

SEQ ID NO: 540199 - DNA, 21 bp, Homo sapiens
tgaaggaccttcactctaaga

SEQ ID NO: 540200 - DNA, 22 bp, Homo sapiens
tgaaggaggctccaggcagcac

SEQ ID NO: 540201 - DNA, 17 bp, Homo sapiens
tgaagtaacttgtctta

SEQ ID NO: 540202 - DNA, 20 bp, Homo sapiens
tgaagtgcctctgattctat

SEQ ID NO: 540203 - DNA, 22 bp, Homo sapiens
tgaagtgcctctgattctatgt

SEQ ID NO: 540204 - DNA, 15 bp, Homo sapiens
tgaagttaagcacaa

SEQ ID NO: 540205 - DNA, 22 bp, Homo sapiens
tgaagttaagcacaaccatgtt

SEQ ID NO: 540206 - DNA, 16 bp, Homo sapiens
tgaagttatatttcct

SEQ ID NO: 540207 - DNA, 21 bp, Homo sapiens
tgaagttctgcctctgatgta

SEQ ID NO: 540208 - DNA, 18 bp, Homo sapiens
tgaagttggcacatttca

SEQ ID NO: 540209 - DNA, 17 bp, Homo sapiens
tgaagttgtacaacacc

SEQ ID NO: 540210 - DNA, 20 bp, Homo sapiens
tgaagtttgataaatagtgt

SEQ ID NO: 540211 - DNA, 23 bp, Homo sapiens
tgaatagcagtggcaaaatatta

SEQ ID NO: 540212 - DNA, 12 bp, Homo sapiens
tgaatatttcat

SEQ ID NO: 540213 - DNA, 16 bp, Homo sapiens
tgaatcagaggcagag

SEQ ID NO: 540214 - DNA, 19 bp, Homo sapiens
tgaatcagaggcagagacc

SEQ ID NO: 540215 - DNA, 22 bp, Homo sapiens
tgaatgagtttccagctaagcc

SEQ ID NO: 540216 - DNA, 17 bp, Homo sapiens
tgaatgcttaaatgatc

SEQ ID NO: 540217 - DNA, 13 bp, Homo sapiens
tgaattactaact

SEQ ID NO: 540218 - DNA, 20 bp, Homo sapiens
tgaattactaacttctaaaa

SEQ ID NO: 540219 - DNA, 20 bp, Homo sapiens
tgaatttggggctacttata

SEQ ID NO: 540220 - DNA, 22 bp, Homo sapiens
tgaatttggggctacttatatt

SEQ ID NO: 540221 - DNA, 13 bp, Homo sapiens
tgaattttcattt

SEQ ID NO: 540222 - DNA, 17 bp, Homo sapiens
tgaattttcattttaca

SEQ ID NO: 540223 - DNA, 21 bp, Homo sapiens
tgaattttcattttacagtta

SEQ ID NO: 540224 - DNA, 23 bp, Homo sapiens
tgaatttttatatatatatctgt

SEQ ID NO: 540225 - DNA, 14 bp, Homo sapiens
tgacagagcctgcc

SEQ ID NO: 540226 - DNA, 14 bp, Homo sapiens
tgacagcaaacaca

SEQ ID NO: 540227 - DNA, 14 bp, Homo sapiens
tgacagccagaact

SEQ ID NO: 540228 - DNA, 11 bp, Homo sapiens
tgacagcccct

SEQ ID NO: 540229 - DNA, 20 bp, Homo sapiens
tgacagtgaggtcctggggg

SEQ ID NO: 540230 - DNA, 22 bp, Homo sapiens
tgacatgcgggctgggcagctg

SEQ ID NO: 540231 - DNA, 16 bp, Homo sapiens
tgacatttcaatcact

SEQ ID NO: 540232 - DNA, 16 bp, Homo sapiens
tgacatttgtcatttt

SEQ ID NO: 540233 - DNA, 15 bp, Homo sapiens
tgacatttgtttggt

SEQ ID NO: 540234 - DNA, 21 bp, Homo sapiens
tgaccaaatatcaccaggact

SEQ ID NO: 540235 - DNA, 19 bp, Homo sapiens
tgaccaatcgggagtagca

SEQ ID NO: 540236 - DNA, 20 bp, Homo sapiens
tgaccaatcgggagtagcaa

SEQ ID NO: 540237 - DNA, 21 bp, Homo sapiens
tgaccaatcgggagtagcaag

SEQ ID NO: 540238 - DNA, 13 bp, Homo sapiens
tgaccaattttaa

SEQ ID NO: 540239 - DNA, 14 bp, Homo sapiens
tgaccacagacact

SEQ ID NO: 540240 - DNA, 17 bp, Homo sapiens
tgaccacagacactcct

SEQ ID NO: 540241 - DNA, 15 bp, Homo sapiens
tgacccccccagctt

SEQ ID NO: 540242 - DNA, 14 bp, Homo sapiens
tgacccccctcagg

SEQ ID NO: 540243 - DNA, 21 bp, Homo sapiens
tgaccctgaaatattttctac

SEQ ID NO: 540244 - DNA, 18 bp, Homo sapiens
tgaccgacagctttccag

SEQ ID NO: 540245 - DNA, 23 bp, Homo sapiens
tgacctcaatttcaattttgtct

SEQ ID NO: 540246 - DNA, 14 bp, Homo sapiens
tgaccttctctata

SEQ ID NO: 540247 - DNA, 21 bp, Homo sapiens
tgaccttctgtcgtccccaga

SEQ ID NO: 540248 - DNA, 23 bp, Homo sapiens
tgaccttctgtcgtccccagacc

SEQ ID NO: 540249 - DNA, 12 bp, Homo sapiens
tgaccttgtaat

SEQ ID NO: 540250 - DNA, 18 bp, Homo sapiens
tgaccttgtaatgtaact

SEQ ID NO: 540251 - DNA, 19 bp, Homo sapiens
tgactcccccagtcccctt

SEQ ID NO: 540252 - DNA, 12 bp, Homo sapiens
tgactctaaatt

SEQ ID NO: 540253 - DNA, 17 bp, Homo sapiens
tgacttaactttaactt

SEQ ID NO: 540254 - DNA, 21 bp, Homo sapiens
tgacttaactttaacttttga

SEQ ID NO: 540255 - DNA, 18 bp, Homo sapiens
tgagaaaaccccttccca

SEQ ID NO: 540256 - DNA, 20 bp, Homo sapiens
tgagaagcctcatgggagtc

SEQ ID NO: 540257 - DNA, 15 bp, Homo sapiens
tgagactgtttatta

SEQ ID NO: 540258 - DNA, 20 bp, Homo sapiens
tgagagaggctaaaatgttt

SEQ ID NO: 540259 - DNA, 21 bp, Homo sapiens
tgagagaggctaaaatgtttt

SEQ ID NO: 540260 - DNA, 21 bp, Homo sapiens
tgagaggggagagctgaacag

SEQ ID NO: 540261 - DNA, 17 bp, Homo sapiens
tgagagttccttctcac

SEQ ID NO: 540262 - DNA, 12 bp, Homo sapiens
tgagatcactga

SEQ ID NO: 540263 - DNA, 21 bp, Homo sapiens
tgagcaaactgaagcccacag

SEQ ID NO: 540264 - DNA, 21 bp, Homo sapiens
tgagcagtaaatgtatattga

SEQ ID NO: 540265 - DNA, 14 bp, Homo sapiens
tgagcagtgatatt

SEQ ID NO: 540266 - DNA, 23 bp, Homo sapiens
tgagcagtgatattctttgttaa

SEQ ID NO: 540267 - DNA, 17 bp, Homo sapiens
tggaaaaaaaaaaatat

SEQ ID NO: 540268 - DNA, 14 bp, Homo sapiens
tggaaaactcacag

SEQ ID NO: 540269 - DNA, 21 bp, Homo sapiens
tggaaaataatttagtggatg

SEQ ID NO: 540270 - DNA, 22 bp, Homo sapiens
tggaaaattcagataatggtaa

SEQ ID NO: 540271 - DNA, 22 bp, Homo sapiens
tggaaacactaaatgttaaaga

SEQ ID NO: 540272 - DNA, 16 bp, Homo sapiens
tggaaatagcatgaca

SEQ ID NO: 540273 - DNA, 21 bp, Homo sapiens
tggaaattcaggtgaaaatgt

SEQ ID NO: 540274 - DNA, 14 bp, Homo sapiens
tggaaatttcacgt

SEQ ID NO: 540275 - DNA, 17 bp, Homo sapiens
tggaagacaaatacaca

SEQ ID NO: 540276 - DNA, 14 bp, Homo sapiens
tggaagagaaatct

SEQ ID NO: 540277 - DNA, 18 bp, Homo sapiens
tggaattgtgctccaaat

SEQ ID NO: 540278 - DNA, 14 bp, Homo sapiens
tggaccagagactt

SEQ ID NO: 540279 - DNA, 22 bp, Homo sapiens
tggaccagttccctcagccctc

SEQ ID NO: 540280 - DNA, 14 bp, Homo sapiens
tggaccctgaaatg

SEQ ID NO: 540281 - DNA, 20 bp, Homo sapiens
tggacctttgggttctttct

SEQ ID NO: 540282 - DNA, 19 bp, Homo sapiens
tggacggggacacggcctc

SEQ ID NO: 540283 - DNA, 18 bp, Homo sapiens
tggactgtggcctcagga

SEQ ID NO: 540284 - DNA, 11 bp, Homo sapiens
tggagaagaat

SEQ ID NO: 540285 - DNA, 19 bp, Homo sapiens
tggagaagaatggctttca

SEQ ID NO: 540286 - DNA, 15 bp, Homo sapiens
tggagaccaggactc

SEQ ID NO: 540287 - DNA, 14 bp, Homo sapiens
tggagagcaacaca

SEQ ID NO: 540288 - DNA, 17 bp, Homo sapiens
tggagagtagatgcttg

SEQ ID NO: 540289 - DNA, 17 bp, Homo sapiens
tggagatggggagaaac

SEQ ID NO: 540290 - DNA, 18 bp, Homo sapiens
tggagcggggcccacccg

SEQ ID NO: 540291 - DNA, 13 bp, Homo sapiens
tggagctgcttcc

SEQ ID NO: 540292 - DNA, 15 bp, Homo sapiens
tggaggacctgcccg

SEQ ID NO: 540293 - DNA, 17 bp, Homo sapiens
tggaggcacacagctgc

SEQ ID NO: 540294 - DNA, 18 bp, Homo sapiens
tggagtagagtcaggaga

SEQ ID NO: 540295 - DNA, 14 bp, Homo sapiens
tggagtcagcctcg

SEQ ID NO: 540296 - DNA, 19 bp, Homo sapiens
tggagtccagacctgggcc

SEQ ID NO: 540297 - DNA, 17 bp, Homo sapiens
tggagttcattcatatt

SEQ ID NO: 540298 - DNA, 18 bp, Homo sapiens
tggagttcattcatatta

SEQ ID NO: 540299 - DNA, 20 bp, Homo sapiens
tggagttcattcatattaca

SEQ ID NO: 540300 - DNA, 16 bp, Homo sapiens
tggagttggagttcat

SEQ ID NO: 540301 - DNA, 14 bp, Homo sapiens
tggatacttcctgg

SEQ ID NO: 540302 - DNA, 14 bp, Homo sapiens
tggataggagagga

SEQ ID NO: 540303 - DNA, 17 bp, Homo sapiens
tggatataatgtatttt

SEQ ID NO: 540304 - DNA, 12 bp, Homo sapiens
tggatcaggaaa

SEQ ID NO: 540305 - DNA, 17 bp, Homo sapiens
tggatggaatatcagaa

SEQ ID NO: 540306 - DNA, 17 bp, Homo sapiens
tggatggaggtgatgaa

SEQ ID NO: 540307 - DNA, 13 bp, Homo sapiens
tggatggcacaat

SEQ ID NO: 540308 - DNA, 20 bp, Homo sapiens
tggatggcacaatgaatgta

SEQ ID NO: 540309 - DNA, 14 bp, Homo sapiens
tggattcccctgga

SEQ ID NO: 540310 - DNA, 13 bp, Homo sapiens
tggattttatgtt

SEQ ID NO: 540311 - DNA, 15 bp, Homo sapiens
tggattttatgttga

SEQ ID NO: 540312 - DNA, 22 bp, Homo sapiens
tggattttatgttgacatttgt

SEQ ID NO: 540313 - DNA, 20 bp, Homo sapiens
tggcaaagctgttcttcctg

SEQ ID NO: 540314 - DNA, 12 bp, Homo sapiens
tggcaaatataa

SEQ ID NO: 540315 - DNA, 18 bp, Homo sapiens
tggcaaatattttgtcac

SEQ ID NO: 540316 - DNA, 20 bp, Homo sapiens
tggcaaatattttgtcactg

SEQ ID NO: 540317 - DNA, 15 bp, Homo sapiens
tggcaacaaactgca

SEQ ID NO: 540318 - DNA, 19 bp, Homo sapiens
tggcaacaaactgcacatg

SEQ ID NO: 540319 - DNA, 23 bp, Homo sapiens
tggcaaggacgcttcacaggaca

SEQ ID NO: 540320 - DNA, 20 bp, Homo sapiens
tggcaatattctgtaactat

SEQ ID NO: 540321 - DNA, 16 bp, Homo sapiens
tggcacagggcatgaa

SEQ ID NO: 540322 - DNA, 13 bp, Homo sapiens
tggcaccaataaa

SEQ ID NO: 540323 - DNA, 18 bp, Homo sapiens
tggcacctgtctgctcca

SEQ ID NO: 540324 - DNA, 16 bp, Homo sapiens
tggcagatgcagctct

SEQ ID NO: 540325 - DNA, 22 bp, Homo sapiens
tggcagcctactagggacctgg

SEQ ID NO: 540326 - DNA, 12 bp, Homo sapiens
tggcaggcaggg

SEQ ID NO: 540327 - DNA, 21 bp, Homo sapiens
tggcaggcaggggccctgcag

SEQ ID NO: 540328 - DNA, 15 bp, Homo sapiens
tggcagggcaggcag

SEQ ID NO: 540329 - DNA, 21 bp, Homo sapiens
tggcaggggtggaggagagcc

SEQ ID NO: 540330 - DNA, 17 bp, Homo sapiens
tggcaggtaggaatatt

SEQ ID NO: 540331 - DNA, 19 bp, Homo sapiens
tggcaggtggccagggctc

SEQ ID NO: 540332 - DNA, 13 bp, Homo sapiens
tggccaagcagaa

SEQ ID NO: 540333 - DNA, 23 bp, Homo sapiens
tggccactgtatttgttaatttc

SEQ ID NO: 540334 - DNA, 16 bp, Homo sapiens
tggccagggctccacg

SEQ ID NO: 540335 - DNA, 18 bp, Homo sapiens
tggccagtgacatttcaa

SEQ ID NO: 540336 - DNA, 20 bp, Homo sapiens
tggcccaacaggggctccat

SEQ ID NO: 540337 - DNA, 13 bp, Homo sapiens
tggcccccactgg

SEQ ID NO: 540338 - DNA, 20 bp, Homo sapiens
tggcccccactggctgtggg

SEQ ID NO: 540339 - DNA, 19 bp, Homo sapiens
tggcccctcccacatcccc

SEQ ID NO: 540340 - DNA, 20 bp, Homo sapiens
tggcccctcccacatccccc

SEQ ID NO: 540341 - DNA, 16 bp, Homo sapiens
tggccctggggcctgt

SEQ ID NO: 540342 - DNA, 14 bp, Homo sapiens
tggcctcaggaggc

SEQ ID NO: 540343 - DNA, 19 bp, Homo sapiens
tggcctgaaccacaggaga

SEQ ID NO: 540344 - DNA, 20 bp, Homo sapiens
tggctaaatgcctaataaac

SEQ ID NO: 540345 - DNA, 17 bp, Homo sapiens
tggctcaagtctggccc

SEQ ID NO: 540346 - DNA, 17 bp, Homo sapiens
tggctccacacacacaa

SEQ ID NO: 540347 - DNA, 23 bp, Homo sapiens
tggctccacacacacaaaaaaag

SEQ ID NO: 540348 - DNA, 17 bp, Homo sapiens
tggctctaggaccccca

SEQ ID NO: 540349 - DNA, 18 bp, Homo sapiens
tggctctaggacccccag

SEQ ID NO: 540350 - DNA, 15 bp, Homo sapiens
tggctgaaaaaggcc

SEQ ID NO: 540351 - DNA, 16 bp, Homo sapiens
tggctgacccccctca

SEQ ID NO: 540352 - DNA, 13 bp, Homo sapiens
tggctgcccacac

SEQ ID NO: 540353 - DNA, 16 bp, Homo sapiens
tggctgcggcaccctt

SEQ ID NO: 540354 - DNA, 17 bp, Homo sapiens
tggctgcggcacccttg

SEQ ID NO: 540355 - DNA, 14 bp, Homo sapiens
tggctggtactttc

SEQ ID NO: 540356 - DNA, 14 bp, Homo sapiens
tggctgtgggctcc

SEQ ID NO: 540357 - DNA, 16 bp, Homo sapiens
tggcttcagcccctgg

SEQ ID NO: 540358 - DNA, 17 bp, Homo sapiens
tggcttcccatgtcttt

SEQ ID NO: 540359 - DNA, 17 bp, Homo sapiens
tggcttggagcagaggt

SEQ ID NO: 540360 - DNA, 13 bp, Homo sapiens
tggctttgtgctt

SEQ ID NO: 540361 - DNA, 20 bp, Homo sapiens
tgggaaacggaatgaccttg

SEQ ID NO: 540362 - DNA, 23 bp, Homo sapiens
tgggaaatgctgatttaaacttc

SEQ ID NO: 540363 - DNA, 22 bp, Homo sapiens
tgggaacagtaaagaaagcaga

SEQ ID NO: 540364 - DNA, 23 bp, Homo sapiens
tgggaacagtaaagaaagcagaa

SEQ ID NO: 540365 - DNA, 14 bp, Homo sapiens
tgggaatgtatagt

SEQ ID NO: 540366 - DNA, 21 bp, Homo sapiens
tgggaatgtatagtatttgaa

SEQ ID NO: 540367 - DNA, 23 bp, Homo sapiens
tgggaatgtatagtatttgaaaa

SEQ ID NO: 540368 - DNA, 15 bp, Homo sapiens
tgggacacagagacc

SEQ ID NO: 540369 - DNA, 18 bp, Homo sapiens
tgggacacagagaccccc

SEQ ID NO: 540370 - DNA, 19 bp, Homo sapiens
tgggacagggagcagcccc

SEQ ID NO: 540371 - DNA, 15 bp, Homo sapiens
tgggacttcttaccc

SEQ ID NO: 540372 - DNA, 13 bp, Homo sapiens
tgggagagtgagg

SEQ ID NO: 540373 - DNA, 13 bp, Homo sapiens
tgggagctttaaa

SEQ ID NO: 540374 - DNA, 14 bp, Homo sapiens
tgggagctttaaag

SEQ ID NO: 540375 - DNA, 14 bp, Homo sapiens
tgggaggatttgat

SEQ ID NO: 540376 - DNA, 15 bp, Homo sapiens
tgggagtcagggagc

SEQ ID NO: 540377 - DNA, 14 bp, Homo sapiens
tgggatgggcacag

SEQ ID NO: 540378 - DNA, 18 bp, Homo sapiens
tgggatgggcacaggctg

SEQ ID NO: 540379 - DNA, 19 bp, Homo sapiens
tgggcacctataataccag

SEQ ID NO: 540380 - DNA, 17 bp, Homo sapiens
tgggcatccccagcccc

SEQ ID NO: 540381 - DNA, 20 bp, Homo sapiens
tgggcatccccagccccctg

SEQ ID NO: 540382 - DNA, 14 bp, Homo sapiens
tgggcattctctct

SEQ ID NO: 540383 - DNA, 13 bp, Homo sapiens
tgggccagggtct

SEQ ID NO: 540384 - DNA, 21 bp, Homo sapiens
tgggccagggtctcgtcagga

SEQ ID NO: 540385 - DNA, 15 bp, Homo sapiens
tgggcccccaggtct

SEQ ID NO: 540386 - DNA, 14 bp, Homo sapiens
tgggccctggttcc

SEQ ID NO: 540387 - DNA, 19 bp, Homo sapiens
tgggccctggttcccccag

SEQ ID NO: 540388 - DNA, 20 bp, Homo sapiens
tgggccctggttcccccagg

SEQ ID NO: 540389 - DNA, 10 bp, Homo sapiens
tgggctcagc

SEQ ID NO: 540390 - DNA, 14 bp, Homo sapiens
tgggctcccttcct

SEQ ID NO: 540391 - DNA, 12 bp, Homo sapiens
tgggctctgctg

SEQ ID NO: 540392 - DNA, 14 bp, Homo sapiens
tgggcttgctgtgg

SEQ ID NO: 540393 - DNA, 16 bp, Homo sapiens
tggggacgcagatgag

SEQ ID NO: 540394 - DNA, 22 bp, Homo sapiens
tggggagaccgagtgtggagct

SEQ ID NO: 540395 - DNA, 20 bp, Homo sapiens
tggggagtattatggaaatc

SEQ ID NO: 540396 - DNA, 20 bp, Homo sapiens
tggggatggggttgggctct

SEQ ID NO: 540397 - DNA, 14 bp, Homo sapiens
tggggccgggctgg

SEQ ID NO: 540398 - DNA, 16 bp, Homo sapiens
tggggctgccgtgcac

SEQ ID NO: 540399 - DNA, 16 bp, Homo sapiens
tgggggagagggggag

SEQ ID NO: 540400 - DNA, 19 bp, Homo sapiens
tgggggcctgacctccccc

SEQ ID NO: 540401 - DNA, 22 bp, Homo sapiens
tgggggctgctgcactgccctc

SEQ ID NO: 540402 - DNA, 20 bp, Homo sapiens
tggggtttccacacaggccc

SEQ ID NO: 540403 - DNA, 20 bp, Homo sapiens
tgggtaagggactccagaag

SEQ ID NO: 540404 - DNA, 19 bp, Homo sapiens
tgggtccccagcccttcct

SEQ ID NO: 540405 - DNA, 21 bp, Homo sapiens
ttatatttttcttaaaaagta

SEQ ID NO: 540406 - DNA, 16 bp, Homo sapiens
ttatcctccaccgtct

SEQ ID NO: 540407 - DNA, 22 bp, Homo sapiens
ttatcctttgtgagcctatgat

SEQ ID NO: 540408 - DNA, 19 bp, Homo sapiens
ttatcgccctggcaggcag

SEQ ID NO: 540409 - DNA, 20 bp, Homo sapiens
ttatcgccctggcaggcagg

SEQ ID NO: 540410 - DNA, 21 bp, Homo sapiens
ttatctagaaattaagattga

SEQ ID NO: 540411 - DNA, 23 bp, Homo sapiens
ttatctagaaattaagattgaag

SEQ ID NO: 540412 - DNA, 15 bp, Homo sapiens
ttatctagatgtaaa

SEQ ID NO: 540413 - DNA, 16 bp, Homo sapiens
ttatctgttgtcccct

SEQ ID NO: 540414 - DNA, 23 bp, Homo sapiens
ttatctttctttccatttacagt

SEQ ID NO: 540415 - DNA, 14 bp, Homo sapiens
ttatgaatagacat

SEQ ID NO: 540416 - DNA, 15 bp, Homo sapiens
ttatgaatagacata

SEQ ID NO: 540417 - DNA, 18 bp, Homo sapiens
ttatgaatagacataaat

SEQ ID NO: 540418 - DNA, 23 bp, Homo sapiens
ttatgaatagacataaattgtaa

SEQ ID NO: 540419 - DNA, 13 bp, Homo sapiens
ttatgatctggcc

SEQ ID NO: 540420 - DNA, 19 bp, Homo sapiens
ttatgcgcaaatacaaaat

SEQ ID NO: 540421 - DNA, 16 bp, Homo sapiens
ttatgctaagaatttt

SEQ ID NO: 540422 - DNA, 20 bp, Homo sapiens
ttatgctaagaattttttat

SEQ ID NO: 540423 - DNA, 16 bp, Homo sapiens
ttatggtaatcatatt

SEQ ID NO: 540424 - DNA, 18 bp, Homo sapiens
ttatggtaatcatattag

SEQ ID NO: 540425 - DNA, 14 bp, Homo sapiens
ttatgtattctctt

SEQ ID NO: 540426 - DNA, 17 bp, Homo sapiens
ttatgtgtgcatgtgtg

SEQ ID NO: 540427 - DNA, 20 bp, Homo sapiens
ttatgtgtgcatgtgtgtat

SEQ ID NO: 540428 - DNA, 13 bp, Homo sapiens
ttatgttatgaaa

SEQ ID NO: 540429 - DNA, 15 bp, Homo sapiens
ttatgttatgaaaac

SEQ ID NO: 540430 - DNA, 13 bp, Homo sapiens
ttatgttgacatt

SEQ ID NO: 540431 - DNA, 15 bp, Homo sapiens
ttatgttgacatttg

SEQ ID NO: 540432 - DNA, 16 bp, Homo sapiens
ttatgttgacatttgt

SEQ ID NO: 540433 - DNA, 15 bp, Homo sapiens
ttattaaagtttcaa

SEQ ID NO: 540434 - DNA, 18 bp, Homo sapiens
ttattacccttctttcca

SEQ ID NO: 540435 - DNA, 13 bp, Homo sapiens
ttattcaataact

SEQ ID NO: 540436 - DNA, 17 bp, Homo sapiens
ttattcattagctgtga

SEQ ID NO: 540437 - DNA, 12 bp, Homo sapiens
ttattccatatt

SEQ ID NO: 540438 - DNA, 12 bp, Homo sapiens
ttattctaatta

SEQ ID NO: 540439 - DNA, 20 bp, Homo sapiens
ttattctgggaatgtatagt

SEQ ID NO: 540440 - DNA, 18 bp, Homo sapiens
ttattgagagagatgtgt

SEQ ID NO: 540441 - DNA, 15 bp, Homo sapiens
ttatttataacattg

SEQ ID NO: 540442 - DNA, 17 bp, Homo sapiens
ttattttaaaaaatgaa

SEQ ID NO: 540443 - DNA, 12 bp, Homo sapiens
ttattttcatta

SEQ ID NO: 540444 - DNA, 14 bp, Homo sapiens
ttattttctaaagt

SEQ ID NO: 540445 - DNA, 18 bp, Homo sapiens
ttcaaaaatctgaagatt

SEQ ID NO: 540446 - DNA, 21 bp, Homo sapiens
ttcaaaatggtaactttacaa

SEQ ID NO: 540447 - DNA, 13 bp, Homo sapiens
ttcaaacaagaat

SEQ ID NO: 540448 - DNA, 12 bp, Homo sapiens
ttcaaagagatg

SEQ ID NO: 540449 - DNA, 22 bp, Homo sapiens
ttcaaagagatgggccttttct

SEQ ID NO: 540450 - DNA, 17 bp, Homo sapiens
ttcaaagtcatgatgtt

SEQ ID NO: 540451 - DNA, 19 bp, Homo sapiens
ttcaaagtcatgatgtttt

SEQ ID NO: 540452 - DNA, 21 bp, Homo sapiens
ttcaaagtcatgatgttttta

SEQ ID NO: 540453 - DNA, 22 bp, Homo sapiens
ttcaaataaccctgaatcagag

SEQ ID NO: 540454 - DNA, 14 bp, Homo sapiens
ttcaaatatgtaaa

SEQ ID NO: 540455 - DNA, 19 bp, Homo sapiens
ttcaaatatgtaaacttta

SEQ ID NO: 540456 - DNA, 20 bp, Homo sapiens
ttcaacaaggcttgctgcag

SEQ ID NO: 540457 - DNA, 16 bp, Homo sapiens
ttcaacttcaggaaag

SEQ ID NO: 540458 - DNA, 21 bp, Homo sapiens
ttcaagaaaaaataaatggaa

SEQ ID NO: 540459 - DNA, 22 bp, Homo sapiens
ttcaagaaagccagtcttaaca

SEQ ID NO: 540460 - DNA, 11 bp, Homo sapiens
ttcaaggcatt

SEQ ID NO: 540461 - DNA, 18 bp, Homo sapiens
ttcaattcatagaataac

SEQ ID NO: 540462 - DNA, 11 bp, Homo sapiens
ttcacaaatat

SEQ ID NO: 540463 - DNA, 18 bp, Homo sapiens
ttcacagtgtctgtaaat

SEQ ID NO: 540464 - DNA, 17 bp, Homo sapiens
ttcacatgttttcaaat

SEQ ID NO: 540465 - DNA, 22 bp, Homo sapiens
ttcaccagtacattctcagttt

SEQ ID NO: 540466 - DNA, 17 bp, Homo sapiens
ttcactctaagatgtta

SEQ ID NO: 540467 - DNA, 18 bp, Homo sapiens
ttcactctaagatgttat

SEQ ID NO: 540468 - DNA, 23 bp, Homo sapiens
ttcactgtcaccaccctgctcat

SEQ ID NO: 540469 - DNA, 11 bp, Homo sapiens
ttcagaaaaaa

SEQ ID NO: 540470 - DNA, 15 bp, Homo sapiens
ttcagaagacacaga

SEQ ID NO: 540471 - DNA, 23 bp, Homo sapiens
ttcagataatggtaatttagtgt

SEQ ID NO: 540472 - DNA, 21 bp, Homo sapiens
ttcagcaaggcgctaacttgc

SEQ ID NO: 540473 - DNA, 22 bp, Homo sapiens
ttcagctaggaacaaatcttcc

SEQ ID NO: 540474 - DNA, 17 bp, Homo sapiens
ttcaggaccccatctgc

SEQ ID NO: 540475 - DNA, 19 bp, Homo sapiens
ttcaggaggagacagtcag

SEQ ID NO: 540476 - DNA, 19 bp, Homo sapiens
ttcaggcatttttgtaatg

SEQ ID NO: 540477 - DNA, 18 bp, Homo sapiens
ttcagggaagataagttg

SEQ ID NO: 540478 - DNA, 23 bp, Homo sapiens
ttcagggaagataagttggaaac

SEQ ID NO: 540479 - DNA, 23 bp, Homo sapiens
ttcagggcagattttagttttat

SEQ ID NO: 540480 - DNA, 13 bp, Homo sapiens
ttcagggggccag

SEQ ID NO: 540481 - DNA, 22 bp, Homo sapiens
ttcagggggccaggtgcacaga

SEQ ID NO: 540482 - DNA, 20 bp, Homo sapiens
ttcagtcacttgtttgtgtt

SEQ ID NO: 540483 - DNA, 21 bp, Homo sapiens
ttcagtgtttctggggagctg

SEQ ID NO: 540484 - DNA, 13 bp, Homo sapiens
ttcatattacaat

SEQ ID NO: 540485 - DNA, 15 bp, Homo sapiens
ttcatattacaatat

SEQ ID NO: 540486 - DNA, 17 bp, Homo sapiens
ttcatattttaatttca

SEQ ID NO: 540487 - DNA, 20 bp, Homo sapiens
ttcatattttaatttcaagc

SEQ ID NO: 540488 - DNA, 14 bp, Homo sapiens
ttcatcccagcccc

SEQ ID NO: 540489 - DNA, 12 bp, Homo sapiens
ttcatcctctta

SEQ ID NO: 540490 - DNA, 12 bp, Homo sapiens
ttcatccttccc

SEQ ID NO: 540491 - DNA, 13 bp, Homo sapiens
ttcatgaaatgct

SEQ ID NO: 540492 - DNA, 22 bp, Homo sapiens
ttcatggaattggtttaaactt

SEQ ID NO: 540493 - DNA, 15 bp, Homo sapiens
ttcatgtatttcttt

SEQ ID NO: 540494 - DNA, 17 bp, Homo sapiens
ttcatgtcctgtgtcag

SEQ ID NO: 540495 - DNA, 20 bp, Homo sapiens
ttcatgtcctgtgtcagttt

SEQ ID NO: 540496 - DNA, 20 bp, Homo sapiens
ttcatgtgggatcccatctt

SEQ ID NO: 540497 - DNA, 16 bp, Homo sapiens
ttcattacctgtagct

SEQ ID NO: 540498 - DNA, 20 bp, Homo sapiens
ttcattactagataaaatgt

SEQ ID NO: 540499 - DNA, 20 bp, Homo sapiens
ttcattagcaaaaaaagttg

SEQ ID NO: 540500 - DNA, 21 bp, Homo sapiens
ttcattagcaaaaaaagttgt

SEQ ID NO: 540501 - DNA, 12 bp, Homo sapiens
ttcattcatatt

SEQ ID NO: 540502 - DNA, 14 bp, Homo sapiens
ttcattcatattac

SEQ ID NO: 540503 - DNA, 16 bp, Homo sapiens
ttcattgtgtatgaga

SEQ ID NO: 540504 - DNA, 19 bp, Homo sapiens
ttcatttaacactgagtga

SEQ ID NO: 540505 - DNA, 21 bp, Homo sapiens
ttcatttaacactgagtgaaa

SEQ ID NO: 540506 - DNA, 23 bp, Homo sapiens
ttcatttaacactgagtgaaata

SEQ ID NO: 540507 - DNA, 15 bp, Homo sapiens
ttcatttctaacata

SEQ ID NO: 540508 - DNA, 19 bp, Homo sapiens
ttcattttacagttacttt

SEQ ID NO: 540509 - DNA, 22 bp, Homo sapiens
ttccaaacatgaggttctctct

SEQ ID NO: 540510 - DNA, 15 bp, Homo sapiens
ttccaacatacaatt

SEQ ID NO: 540511 - DNA, 18 bp, Homo sapiens
ttccaagactccagccct

SEQ ID NO: 540512 - DNA, 18 bp, Homo sapiens
ttccaagggcccagaggg

SEQ ID NO: 540513 - DNA, 13 bp, Homo sapiens
ttccaagtaatat

SEQ ID NO: 540514 - DNA, 22 bp, Homo sapiens
ttccaagtagaattgatttccc

SEQ ID NO: 540515 - DNA, 12 bp, Homo sapiens
ttccacacaggc

SEQ ID NO: 540516 - DNA, 17 bp, Homo sapiens
ttccacaggtctcagaa

SEQ ID NO: 540517 - DNA, 12 bp, Homo sapiens
ttccaccttggc

SEQ ID NO: 540518 - DNA, 18 bp, Homo sapiens
ttccactttgtataaatt

SEQ ID NO: 540519 - DNA, 19 bp, Homo sapiens
ttccagctaagcctgatga

SEQ ID NO: 540520 - DNA, 18 bp, Homo sapiens
ttccaggcatgaccctgg

SEQ ID NO: 540521 - DNA, 21 bp, Homo sapiens
ttccaggcgtagggccagggc

SEQ ID NO: 540522 - DNA, 11 bp, Homo sapiens
ttccagtattt

SEQ ID NO: 540523 - DNA, 13 bp, Homo sapiens
ttccagtgctgct

SEQ ID NO: 540524 - DNA, 16 bp, Homo sapiens
ttccatattagaaaac

SEQ ID NO: 540525 - DNA, 18 bp, Homo sapiens
ttccatattagaaaactt

SEQ ID NO: 540526 - DNA, 15 bp, Homo sapiens
ttccatttctctctc

SEQ ID NO: 540527 - DNA, 16 bp, Homo sapiens
ttcccaacctcccctg

SEQ ID NO: 540528 - DNA, 15 bp, Homo sapiens
ttcccacccagcctg

SEQ ID NO: 540529 - DNA, 20 bp, Homo sapiens
ttcccactctgtcgagcctg

SEQ ID NO: 540530 - DNA, 22 bp, Homo sapiens
ttcccagaaatacaacagaagt

SEQ ID NO: 540531 - DNA, 15 bp, Homo sapiens
ttcccagctgcccct

SEQ ID NO: 540532 - DNA, 20 bp, Homo sapiens
ttcccagctgcccctccctg

SEQ ID NO: 540533 - DNA, 11 bp, Homo sapiens
ttcccattcca

SEQ ID NO: 540534 - DNA, 19 bp, Homo sapiens
ttcccatttccttgtctaa

SEQ ID NO: 540535 - DNA, 21 bp, Homo sapiens
ttccccaccctccccttccca

SEQ ID NO: 540536 - DNA, 22 bp, Homo sapiens
ttccccaccctccccttcccag

SEQ ID NO: 540537 - DNA, 15 bp, Homo sapiens
ttccccctttcttcc

SEQ ID NO: 540538 - DNA, 20 bp, Homo sapiens
ttccccggagctgggaaggt

SEQ ID NO: 540539 - DNA, 14 bp, Homo sapiens
ttccccttccttct

SEQ ID NO: 540540 - DNA, 15 bp, Homo sapiens
ttccccttccttctt

SEQ ID NO: 540541 - DNA, 13 bp, Homo sapiens
ttccctccctgct

SEQ ID NO: 540542 - DNA, 14 bp, Homo sapiens
ttgttttttgaagt

SEQ ID NO: 540543 - DNA, 12 bp, Homo sapiens
ttgttttttgag

SEQ ID NO: 540544 - DNA, 13 bp, Homo sapiens
ttgttttttgagt

SEQ ID NO: 540545 - DNA, 13 bp, Homo sapiens
tttaaaaagtatt

SEQ ID NO: 540546 - DNA, 16 bp, Homo sapiens
tttaaaaagtattgcc

SEQ ID NO: 540547 - DNA, 20 bp, Homo sapiens
tttaaaaatcagaaagacat

SEQ ID NO: 540548 - DNA, 17 bp, Homo sapiens
tttaaaacatttcatgt

SEQ ID NO: 540549 - DNA, 12 bp, Homo sapiens
tttaaaagaaat

SEQ ID NO: 540550 - DNA, 16 bp, Homo sapiens
tttaaaatactgtaga

SEQ ID NO: 540551 - DNA, 18 bp, Homo sapiens
tttaaaatactgtagata

SEQ ID NO: 540552 - DNA, 20 bp, Homo sapiens
tttaaaatcttattaaagtt

SEQ ID NO: 540553 - DNA, 19 bp, Homo sapiens
tttaaacccaatcagatgc

SEQ ID NO: 540554 - DNA, 18 bp, Homo sapiens
tttaaacttcttaactgg

SEQ ID NO: 540555 - DNA, 12 bp, Homo sapiens
tttaacactgag

SEQ ID NO: 540556 - DNA, 18 bp, Homo sapiens
tttaacttccactttgta

SEQ ID NO: 540557 - DNA, 14 bp, Homo sapiens
tttaagagagaaat

SEQ ID NO: 540558 - DNA, 14 bp, Homo sapiens
tttaagcaacactt

SEQ ID NO: 540559 - DNA, 15 bp, Homo sapiens
tttaagcaagaccat

SEQ ID NO: 540560 - DNA, 17 bp, Homo sapiens
tttaagcacaaaaaatt

SEQ ID NO: 540561 - DNA, 21 bp, Homo sapiens
tttaagcacaaaaaatttaag

SEQ ID NO: 540562 - DNA, 17 bp, Homo sapiens
tttaagcagaattggaa

SEQ ID NO: 540563 - DNA, 13 bp, Homo sapiens
tttaagcctttga

SEQ ID NO: 540564 - DNA, 14 bp, Homo sapiens
tttaagcctttgaa

SEQ ID NO: 540565 - DNA, 15 bp, Homo sapiens
tttaagcctttgaag

SEQ ID NO: 540566 - DNA, 22 bp, Homo sapiens
tttaagctaggaaaagaaatct

SEQ ID NO: 540567 - DNA, 16 bp, Homo sapiens
tttaaggcttcaattt

SEQ ID NO: 540568 - DNA, 22 bp, Homo sapiens
tttaaggcttcaatttattgca

SEQ ID NO: 540569 - DNA, 16 bp, Homo sapiens
tttaagtattcaagaa

SEQ ID NO: 540570 - DNA, 13 bp, Homo sapiens
tttaagtgaaatt

SEQ ID NO: 540571 - DNA, 13 bp, Homo sapiens
tttaagtgttctg

SEQ ID NO: 540572 - DNA, 19 bp, Homo sapiens
tttaataaagtatgaatat

SEQ ID NO: 540573 - DNA, 22 bp, Homo sapiens
tttaatatactccttaaaaatg

SEQ ID NO: 540574 - DNA, 13 bp, Homo sapiens
tttaatttcaagc

SEQ ID NO: 540575 - DNA, 13 bp, Homo sapiens
tttacaaaggctg

SEQ ID NO: 540576 - DNA, 13 bp, Homo sapiens
tttacacttgctt

SEQ ID NO: 540577 - DNA, 19 bp, Homo sapiens
tttacagctttacacacac

SEQ ID NO: 540578 - DNA, 19 bp, Homo sapiens
tttacagtctctttcttcc

SEQ ID NO: 540579 - DNA, 19 bp, Homo sapiens
tttacagttacttttcctt

SEQ ID NO: 540580 - DNA, 21 bp, Homo sapiens
tttacagttacttttccttgc

SEQ ID NO: 540581 - DNA, 18 bp, Homo sapiens
tttaccagggatgtagat

SEQ ID NO: 540582 - DNA, 21 bp, Homo sapiens
tttactaacagtaactgccat

SEQ ID NO: 540583 - DNA, 17 bp, Homo sapiens
tttagaacaacataaaa

SEQ ID NO: 540584 - DNA, 18 bp, Homo sapiens
tttagaacaacataaaat

SEQ ID NO: 540585 - DNA, 20 bp, Homo sapiens
tttagcacagtatttaacat

SEQ ID NO: 540586 - DNA, 18 bp, Homo sapiens
tttagcagaatcaaaatg

SEQ ID NO: 540587 - DNA, 13 bp, Homo sapiens
tttagcctgtgtc

SEQ ID NO: 540588 - DNA, 13 bp, Homo sapiens
tttaggattgaag

SEQ ID NO: 540589 - DNA, 20 bp, Homo sapiens
tttagtggaccctgaaatgt

SEQ ID NO: 540590 - DNA, 14 bp, Homo sapiens
tttagtgtatatgt

SEQ ID NO: 540591 - DNA, 23 bp, Homo sapiens
tttagtgtatatgtgattttcaa

SEQ ID NO: 540592 - DNA, 17 bp, Homo sapiens
tttataaaaaaaatgaa

SEQ ID NO: 540593 - DNA, 18 bp, Homo sapiens
tttataaaaaaaatgaaa

SEQ ID NO: 540594 - DNA, 21 bp, Homo sapiens
tttataaaaaaaatgaaatgt

SEQ ID NO: 540595 - DNA, 14 bp, Homo sapiens
tttataaaattaga

SEQ ID NO: 540596 - DNA, 16 bp, Homo sapiens
tttataagcaaatttc

SEQ ID NO: 540597 - DNA, 17 bp, Homo sapiens
tttataaggacttcctg

SEQ ID NO: 540598 - DNA, 14 bp, Homo sapiens
tttataggataact

SEQ ID NO: 540599 - DNA, 15 bp, Homo sapiens
tttatatgattaaat

SEQ ID NO: 540600 - DNA, 16 bp, Homo sapiens
tttatctagatgtaaa

SEQ ID NO: 540601 - DNA, 16 bp, Homo sapiens
tttatgagatcactga

SEQ ID NO: 540602 - DNA, 23 bp, Homo sapiens
tttatgagatcactgaacttttc

SEQ ID NO: 540603 - DNA, 16 bp, Homo sapiens
tttatgcgcaaataca

SEQ ID NO: 540604 - DNA, 23 bp, Homo sapiens
tttatgcgcaaatacaaaatgat

SEQ ID NO: 540605 - DNA, 20 bp, Homo sapiens
tttatgtatgtttacactgt

SEQ ID NO: 540606 - DNA, 16 bp, Homo sapiens
tttatgtgatgtaact

SEQ ID NO: 540607 - DNA, 11 bp, Homo sapiens
tttatgttgac

SEQ ID NO: 540608 - DNA, 14 bp, Homo sapiens
tttatgttgacatt

SEQ ID NO: 540609 - DNA, 15 bp, Homo sapiens
tttatgttgacattt

SEQ ID NO: 540610 - DNA, 22 bp, Homo sapiens
tttatgttgacatttgtttggt

SEQ ID NO: 540611 - DNA, 18 bp, Homo sapiens
tttatgtttaaaatggca

SEQ ID NO: 540612 - DNA, 20 bp, Homo sapiens
tttatgttttggtccacttt

SEQ ID NO: 540613 - DNA, 15 bp, Homo sapiens
tttattacccttctt

SEQ ID NO: 540614 - DNA, 16 bp, Homo sapiens
tttattcattagctgt

SEQ ID NO: 540615 - DNA, 13 bp, Homo sapiens
tttattccagagc

SEQ ID NO: 540616 - DNA, 23 bp, Homo sapiens
tttattgccatattaaaatctga

SEQ ID NO: 540617 - DNA, 21 bp, Homo sapiens
tttatttctccttttgtgttc

SEQ ID NO: 540618 - DNA, 23 bp, Homo sapiens
tttcaaaaacaccccccccccac

SEQ ID NO: 540619 - DNA, 19 bp, Homo sapiens
tttcaaaaatctgaagatt

SEQ ID NO: 540620 - DNA, 21 bp, Homo sapiens
tttcaaaaatctgaagattgt

SEQ ID NO: 540621 - DNA, 23 bp, Homo sapiens
tttcaaaaatctgaagattgttt

SEQ ID NO: 540622 - DNA, 18 bp, Homo sapiens
tttcaaatatgtaaactt

SEQ ID NO: 540623 - DNA, 20 bp, Homo sapiens
tttcaaatatgtaaacttta

SEQ ID NO: 540624 - DNA, 18 bp, Homo sapiens
tttcaagaaaaaataaat

SEQ ID NO: 540625 - DNA, 16 bp, Homo sapiens
tttcaagaacttgttt

SEQ ID NO: 540626 - DNA, 21 bp, Homo sapiens
tttcaaggcatttattgccat

SEQ ID NO: 540627 - DNA, 19 bp, Homo sapiens
tttcaagggctttcctgtg

SEQ ID NO: 540628 - DNA, 15 bp, Homo sapiens
tttcaataaagtttg

SEQ ID NO: 540629 - DNA, 21 bp, Homo sapiens
tttcaataaagtttgatcttc

SEQ ID NO: 540630 - DNA, 23 bp, Homo sapiens
tttcaatctcgtatagaagtctt

SEQ ID NO: 540631 - DNA, 13 bp, Homo sapiens
tttcacaaatatt

SEQ ID NO: 540632 - DNA, 16 bp, Homo sapiens
tttcacaaatattaaa

SEQ ID NO: 540633 - DNA, 18 bp, Homo sapiens
tttcacaaatattaaaaa

SEQ ID NO: 540634 - DNA, 15 bp, Homo sapiens
tttcacagtgtctgt

SEQ ID NO: 540635 - DNA, 15 bp, Homo sapiens
tttcacccttctact

SEQ ID NO: 540636 - DNA, 21 bp, Homo sapiens
tttcacgtcataggaagttag

SEQ ID NO: 540637 - DNA, 15 bp, Homo sapiens
tttcactgtctgtct

SEQ ID NO: 540638 - DNA, 11 bp, Homo sapiens
tttcagctctc

SEQ ID NO: 540639 - DNA, 12 bp, Homo sapiens
tttcagctctct

SEQ ID NO: 540640 - DNA, 15 bp, Homo sapiens
tttcatccattaaaa

SEQ ID NO: 540641 - DNA, 16 bp, Homo sapiens
tttcatccttcccact

SEQ ID NO: 540642 - DNA, 17 bp, Homo sapiens
tttcatgtcctgtgtca

SEQ ID NO: 540643 - DNA, 21 bp, Homo sapiens
tttcatgtcctgtgtcagttt

SEQ ID NO: 540644 - DNA, 14 bp, Homo sapiens
tttcattacaatgg

SEQ ID NO: 540645 - DNA, 17 bp, Homo sapiens
tttcattacctgtagct

SEQ ID NO: 540646 - DNA, 23 bp, Homo sapiens
tttcattagcaaaaaaagttgta

SEQ ID NO: 540647 - DNA, 15 bp, Homo sapiens
tttcattgctgtgac

SEQ ID NO: 540648 - DNA, 20 bp, Homo sapiens
tttcattttttgcatcagta

SEQ ID NO: 540649 - DNA, 18 bp, Homo sapiens
tttccaacatacaattta

SEQ ID NO: 540650 - DNA, 14 bp, Homo sapiens
tttccaattctcct

SEQ ID NO: 540651 - DNA, 13 bp, Homo sapiens
tttccagagcatt

SEQ ID NO: 540652 - DNA, 20 bp, Homo sapiens
tttccagctaagcctgatga

SEQ ID NO: 540653 - DNA, 12 bp, Homo sapiens
tttccagtattt

SEQ ID NO: 540654 - DNA, 17 bp, Homo sapiens
tttccagtattttagtg

SEQ ID NO: 540655 - DNA, 19 bp, Homo sapiens
tttccatatttttttcctt

SEQ ID NO: 540656 - DNA, 21 bp, Homo sapiens
tttccatatttttttccttac

SEQ ID NO: 540657 - DNA, 22 bp, Homo sapiens
tttccatatttttttccttaca

SEQ ID NO: 540658 - DNA, 20 bp, Homo sapiens
tttccatgtatgcataataa

SEQ ID NO: 540659 - DNA, 20 bp, Homo sapiens
tttcccacactgtgaactaa

SEQ ID NO: 540660 - DNA, 11 bp, Homo sapiens
tttcccaccct

SEQ ID NO: 540661 - DNA, 21 bp, Homo sapiens
tttccccctttcttcctcatt

SEQ ID NO: 540662 - DNA, 24 bp, Homo sapiens
tttcctcttaatgtctcaaaataa

SEQ ID NO: 540663 - DNA, 12 bp, Homo sapiens
tttcctgtacaa

SEQ ID NO: 540664 - DNA, 13 bp, Homo sapiens
tttcctgtacaat

SEQ ID NO: 540665 - DNA, 20 bp, Homo sapiens
tttcctgtacaatcatgaac

SEQ ID NO: 540666 - DNA, 17 bp, Homo sapiens
tttccttacataaacat

SEQ ID NO: 540667 - DNA, 18 bp, Homo sapiens
tttccttacataaacatc

SEQ ID NO: 540668 - DNA, 20 bp, Homo sapiens
tttccttgaggggagccagg

SEQ ID NO: 540669 - DNA, 14 bp, Homo sapiens
tttcgaagtttgca

SEQ ID NO: 540670 - DNA, 13 bp, Homo sapiens
tttcgtggcttca

SEQ ID NO: 540671 - DNA, 12 bp, Homo sapiens
tttctaaaagaa

SEQ ID NO: 540672 - DNA, 15 bp, Homo sapiens
tttctaaaagaatat

SEQ ID NO: 540673 - DNA, 16 bp, Homo sapiens
tttctaacataagtaa

SEQ ID NO: 540674 - DNA, 21 bp, Homo sapiens
tttctaactctgatgtaaatg

SEQ ID NO: 540675 - DNA, 21 bp, Homo sapiens
tttctactttaaattgtggat

SEQ ID NO: 540676 - DNA, 15 bp, Homo sapiens
tttctagttatttat

SEQ ID NO: 540677 - DNA, 17 bp, Homo sapiens
tttctcagcatatatat

SEQ ID NO: 540678 - DNA, 14 bp, Homo sapiens
tttctccgttgtgg

SEQ ID NO: 540679 - DNA, 14 bp, Homo sapiens
tttctctctccagt

SEQ ID NO: 540680 - DNA, 13 bp, Homo sapiens
aagctatttaagt

SEQ ID NO: 540681 - DNA, 14 bp, Homo sapiens
aagctatttaagtg

SEQ ID NO: 540682 - DNA, 15 bp, Homo sapiens
aagctcaaggctgca

SEQ ID NO: 540683 - DNA, 19 bp, Homo sapiens
aagctcaaggctgcagtga

SEQ ID NO: 540684 - DNA, 23 bp, Homo sapiens
aagctgatgaagttaagcacaac

SEQ ID NO: 540685 - DNA, 14 bp, Homo sapiens
aagctgttcttcct

SEQ ID NO: 540686 - DNA, 19 bp, Homo sapiens
aagctgtttggttttaaaa

SEQ ID NO: 540687 - DNA, 20 bp, Homo sapiens
aagctgtttggttttaaaat

SEQ ID NO: 540688 - DNA, 17 bp, Homo sapiens
aagcttccctccctgct

SEQ ID NO: 540689 - DNA, 12 bp, Homo sapiens
aaggaaggacac

SEQ ID NO: 540690 - DNA, 19 bp, Homo sapiens
aaggaagggcaggaaatga

SEQ ID NO: 540691 - DNA, 13 bp, Homo sapiens
aaggaatcttctc

SEQ ID NO: 540692 - DNA, 16 bp, Homo sapiens
aaggacattatgtgtg

SEQ ID NO: 540693 - DNA, 20 bp, Homo sapiens
aaggaccttcactctaagat

SEQ ID NO: 540694 - DNA, 21 bp, Homo sapiens
aaggaccttcactctaagatg

SEQ ID NO: 540695 - DNA, 20 bp, Homo sapiens
aaggagctttctcaatgtct

SEQ ID NO: 540696 - DNA, 14 bp, Homo sapiens
aaggaggctccagg

SEQ ID NO: 540697 - DNA, 17 bp, Homo sapiens
aaggaggctccaggcag

SEQ ID NO: 540698 - DNA, 15 bp, Homo sapiens
aaggccccctgcctg

SEQ ID NO: 540699 - DNA, 13 bp, Homo sapiens
aaggcctctgtcc

SEQ ID NO: 540700 - DNA, 20 bp, Homo sapiens
aaggcgagtccaggagctca

SEQ ID NO: 540701 - DNA, 15 bp, Homo sapiens
aaggctcctgccccc

SEQ ID NO: 540702 - DNA, 12 bp, Homo sapiens
aaggctgtattc

SEQ ID NO: 540703 - DNA, 19 bp, Homo sapiens
aaggcttcaatttattgca

SEQ ID NO: 540704 - DNA, 13 bp, Homo sapiens
aaggcttctccac

SEQ ID NO: 540705 - DNA, 12 bp, Homo sapiens
aagggacatgaa

SEQ ID NO: 540706 - DNA, 22 bp, Homo sapiens
aagggactccagaagcagcagc

SEQ ID NO: 540707 - DNA, 14 bp, Homo sapiens
aagggccttctcca

SEQ ID NO: 540708 - DNA, 14 bp, Homo sapiens
aagggctttcctgt

SEQ ID NO: 540709 - DNA, 14 bp, Homo sapiens
aaggtcatttccat

SEQ ID NO: 540710 - DNA, 20 bp, Homo sapiens
aaggtcatttccatgtatgc

SEQ ID NO: 540711 - DNA, 14 bp, Homo sapiens
aaggtctctctggc

SEQ ID NO: 540712 - DNA, 15 bp, Homo sapiens
aagtaaatctcttct

SEQ ID NO: 540713 - DNA, 15 bp, Homo sapiens
aagtaacttgtctta

SEQ ID NO: 540714 - DNA, 13 bp, Homo sapiens
aagtaatataatg

SEQ ID NO: 540715 - DNA, 21 bp, Homo sapiens
aagtaatataatggaagagaa

SEQ ID NO: 540716 - DNA, 15 bp, Homo sapiens
aagtaattgttccag

SEQ ID NO: 540717 - DNA, 15 bp, Homo sapiens
aagtacaggtacttt

SEQ ID NO: 540718 - DNA, 18 bp, Homo sapiens
aagtaccacactgagttc

SEQ ID NO: 540719 - DNA, 17 bp, Homo sapiens
aagtactctaatataca

SEQ ID NO: 540720 - DNA, 22 bp, Homo sapiens
aagtatcatctaaatattatgc

SEQ ID NO: 540721 - DNA, 12 bp, Homo sapiens
aagtatgaatat

SEQ ID NO: 540722 - DNA, 13 bp, Homo sapiens
aagtatgaatatt

SEQ ID NO: 540723 - DNA, 22 bp, Homo sapiens
aagtatgaatatttcattttga

SEQ ID NO: 540724 - DNA, 12 bp, Homo sapiens
aagtattcaaga

SEQ ID NO: 540725 - DNA, 13 bp, Homo sapiens
aagtattgccaaa

SEQ ID NO: 540726 - DNA, 14 bp, Homo sapiens
aaagccagtcttaa

SEQ ID NO: 540727 - DNA, 18 bp, Homo sapiens
aaagccctccctgtctgt

SEQ ID NO: 540728 - DNA, 17 bp, Homo sapiens
aaagcctaccctattct

SEQ ID NO: 540729 - DNA, 20 bp, Homo sapiens
aaagctcgtagaaacaagac

SEQ ID NO: 540730 - DNA, 18 bp, Homo sapiens
aaagctgtttcatttgtg

SEQ ID NO: 540731 - DNA, 19 bp, Homo sapiens
aaaggaagggcaggaaatg

SEQ ID NO: 540732 - DNA, 18 bp, Homo sapiens
aaaggacattatgtgtgc

SEQ ID NO: 540733 - DNA, 24 bp, Homo sapiens
aaaggagtttctttagctgacaga

SEQ ID NO: 540734 - DNA, 12 bp, Homo sapiens
aaaggcagctgt

SEQ ID NO: 540735 - DNA, 14 bp, Homo sapiens
aaaggcagctgttg

SEQ ID NO: 540736 - DNA, 22 bp, Homo sapiens
aaaggcagctgttgtctcttct

SEQ ID NO: 540737 - DNA, 19 bp, Homo sapiens
aaaggcggtgttttttgtt

SEQ ID NO: 540738 - DNA, 13 bp, Homo sapiens
aaaggctgtattc

SEQ ID NO: 540739 - DNA, 18 bp, Homo sapiens
aaaggtctttttaaacca

SEQ ID NO: 540740 - DNA, 14 bp, Homo sapiens
aaagtacaggtact

SEQ ID NO: 540741 - DNA, 17 bp, Homo sapiens
aaagtaccacactgagt

SEQ ID NO: 540742 - DNA, 18 bp, Homo sapiens
aaagtactgagcagtgat

SEQ ID NO: 540743 - DNA, 18 bp, Homo sapiens
aaagtattgccaaacatt

SEQ ID NO: 540744 - DNA, 19 bp, Homo sapiens
aaagtattgccaaacatta

SEQ ID NO: 540745 - DNA, 12 bp, Homo sapiens
aaagtcagattt

SEQ ID NO: 540746 - DNA, 16 bp, Homo sapiens
aaagtcatgatgtttt

SEQ ID NO: 540747 - DNA, 13 bp, Homo sapiens
aaagtcttttaaa

SEQ ID NO: 540748 - DNA, 20 bp, Homo sapiens
aaagtcttttaaaaagtatt

SEQ ID NO: 540749 - DNA, 13 bp, Homo sapiens
aaagtgacacagc

SEQ ID NO: 540750 - DNA, 18 bp, Homo sapiens
aaagtgccaaaataaagt

SEQ ID NO: 540751 - DNA, 22 bp, Homo sapiens
aaagtggcacctgtctgctcca

SEQ ID NO: 540752 - DNA, 21 bp, Homo sapiens
aaagtgtctcaaaggagcttt

SEQ ID NO: 540753 - DNA, 19 bp, Homo sapiens
aaagtgttctgttacaaaa

SEQ ID NO: 540754 - DNA, 20 bp, Homo sapiens
aaagttaataacagctcctt

SEQ ID NO: 540755 - DNA, 17 bp, Homo sapiens
aaagttcttaaaacact

SEQ ID NO: 540756 - DNA, 17 bp, Homo sapiens
aaagttgtatgatctgt

SEQ ID NO: 540757 - DNA, 18 bp, Homo sapiens
aaagttgtatgatctgtg

SEQ ID NO: 540758 - DNA, 19 bp, Homo sapiens
aaagttgtatgatctgtgc

SEQ ID NO: 540759 - DNA, 14 bp, Homo sapiens
aaagtttaaagaag

SEQ ID NO: 540760 - DNA, 12 bp, Homo sapiens
aaagtttcaaaa

SEQ ID NO: 540761 - DNA, 13 bp, Homo sapiens
aaagttttgccta

SEQ ID NO: 540762 - DNA, 15 bp, Homo sapiens
aaataaaaagtgaca

SEQ ID NO: 540763 - DNA, 21 bp, Homo sapiens
aaataaaaagtgacacagcag

SEQ ID NO: 540764 - DNA, 17 bp, Homo sapiens
aaataaaaccagaaaga

SEQ ID NO: 540765 - DNA, 22 bp, Homo sapiens
aaataaaaccagaaagaggaat

SEQ ID NO: 540766 - DNA, 11 bp, Homo sapiens
aaataaaagaa

SEQ ID NO: 540767 - DNA, 14 bp, Homo sapiens
aaataaatggaaat

SEQ ID NO: 540768 - DNA, 18 bp, Homo sapiens
aaataaccctgaatcaga

SEQ ID NO: 540769 - DNA, 16 bp, Homo sapiens
aaatacaacagaagtt

SEQ ID NO: 540770 - DNA, 17 bp, Homo sapiens
aaatacaagtttgaaca

SEQ ID NO: 540771 - DNA, 19 bp, Homo sapiens
aaatacaagtttgaacagg

SEQ ID NO: 540772 - DNA, 19 bp, Homo sapiens
aaatacacgtgtatatgag

SEQ ID NO: 540773 - DNA, 20 bp, Homo sapiens
aaatacatgatgatttcaga

SEQ ID NO: 540774 - DNA, 19 bp, Homo sapiens
aaatacatgttgtaaatgg

SEQ ID NO: 540775 - DNA, 11 bp, Homo sapiens
aaatactgtag

SEQ ID NO: 540776 - DNA, 15 bp, Homo sapiens
aaatactgtagataa

SEQ ID NO: 540777 - DNA, 23 bp, Homo sapiens
aaatactgtagataattaaccaa

SEQ ID NO: 540778 - DNA, 18 bp, Homo sapiens
aaatagctataaatagtg

SEQ ID NO: 540779 - DNA, 22 bp, Homo sapiens
aaatagtaggcaagatggcaca

SEQ ID NO: 540780 - DNA, 23 bp, Homo sapiens
aaatagtaggcaagatggcacag

SEQ ID NO: 540781 - DNA, 19 bp, Homo sapiens
aaatagtgttattgagaga

SEQ ID NO: 540782 - DNA, 18 bp, Homo sapiens
aaatataaagcatctaaa

SEQ ID NO: 540783 - DNA, 18 bp, Homo sapiens
aaatatatatacatatgt

SEQ ID NO: 540784 - DNA, 19 bp, Homo sapiens
aaatatatatacatatgta

SEQ ID NO: 540785 - DNA, 12 bp, Homo sapiens
aaatatctgtga

SEQ ID NO: 540786 - DNA, 16 bp, Homo sapiens
aaatatgcactaagtc

SEQ ID NO: 540787 - DNA, 19 bp, Homo sapiens
aaatatgcactaagtctct

SEQ ID NO: 540788 - DNA, 23 bp, Homo sapiens
aaatatgctctcccctccctttt

SEQ ID NO: 540789 - DNA, 18 bp, Homo sapiens
aaatatgtctcgctagtg

SEQ ID NO: 540790 - DNA, 12 bp, Homo sapiens
aaatatgtgaag

SEQ ID NO: 540791 - DNA, 16 bp, Homo sapiens
aaatattatgttatga

SEQ ID NO: 540792 - DNA, 14 bp, Homo sapiens
aaatatttgtgaaa

SEQ ID NO: 540793 - DNA, 13 bp, Homo sapiens
aaatattttctac

SEQ ID NO: 540794 - DNA, 22 bp, Homo sapiens
aaatattttctactttaaattg

SEQ ID NO: 540795 - DNA, 14 bp, Homo sapiens
aaatattttgtcac

SEQ ID NO: 540796 - DNA, 17 bp, Homo sapiens
aaatattttgtcactgc

SEQ ID NO: 540797 - DNA, 21 bp, Homo sapiens
aaatattttgtcactgctgta

SEQ ID NO: 540798 - DNA, 15 bp, Homo sapiens
aaatcagaaagacat

SEQ ID NO: 540799 - DNA, 16 bp, Homo sapiens
aaatcagtttttgttc

SEQ ID NO: 540800 - DNA, 21 bp, Homo sapiens
aaatcagtttttgttcttaaa

SEQ ID NO: 540801 - DNA, 17 bp, Homo sapiens
aaatcatcgaaaattca

SEQ ID NO: 540802 - DNA, 22 bp, Homo sapiens
aaatccagaaacttgttcttcc

SEQ ID NO: 540803 - DNA, 18 bp, Homo sapiens
aaatcccattgtatttaa

SEQ ID NO: 540804 - DNA, 17 bp, Homo sapiens
aaatccttgccttcaaa

SEQ ID NO: 540805 - DNA, 15 bp, Homo sapiens
aaatctaaattaact

SEQ ID NO: 540806 - DNA, 13 bp, Homo sapiens
aaatctatagaaa

SEQ ID NO: 540807 - DNA, 19 bp, Homo sapiens
aaatctatagaaagtgttc

SEQ ID NO: 540808 - DNA, 23 bp, Homo sapiens
aaatctcatactcccccacagtt

SEQ ID NO: 540809 - DNA, 17 bp, Homo sapiens
aaatctgaagattgttt

SEQ ID NO: 540810 - DNA, 21 bp, Homo sapiens
aaatcttattaaagtttcaaa

SEQ ID NO: 540811 - DNA, 17 bp, Homo sapiens
aaatgaaatacttgaca

SEQ ID NO: 540812 - DNA, 16 bp, Homo sapiens
aaatgaaatttaagca

SEQ ID NO: 540813 - DNA, 16 bp, Homo sapiens
aaatgaacacaaatta

SEQ ID NO: 540814 - DNA, 18 bp, Homo sapiens
aaatgaacacaaattatg

SEQ ID NO: 540815 - DNA, 21 bp, Homo sapiens
aaatgaagtaacttgtcttaa

SEQ ID NO: 540816 - DNA, 17 bp, Homo sapiens
aaatgatatgtctttaa

SEQ ID NO: 540817 - DNA, 22 bp, Homo sapiens
aaatgattcacttttattgtat

SEQ ID NO: 540818 - DNA, 23 bp, Homo sapiens
aaatgattgcttttaaaatttta

SEQ ID NO: 540819 - DNA, 12 bp, Homo sapiens
aaatgcacaatg

SEQ ID NO: 540820 - DNA, 15 bp, Homo sapiens
aaatgcacaatgtct

SEQ ID NO: 540821 - DNA, 16 bp, Homo sapiens
aaatgcacaatgtctt

SEQ ID NO: 540822 - DNA, 18 bp, Homo sapiens
aaatgcatttaagttgta

SEQ ID NO: 540823 - DNA, 21 bp, Homo sapiens
aaatgcatttaagttgtaaac

SEQ ID NO: 540824 - DNA, 16 bp, Homo sapiens
aaatgctatgtcattt

SEQ ID NO: 540825 - DNA, 14 bp, Homo sapiens
aaatgctgatttaa

SEQ ID NO: 540826 - DNA, 22 bp, Homo sapiens
aaatggagttggagttcattca

SEQ ID NO: 540827 - DNA, 18 bp, Homo sapiens
aaatggcaacaaactgca

SEQ ID NO: 540828 - DNA, 22 bp, Homo sapiens
aaatggcattgacagctgctct

SEQ ID NO: 540829 - DNA, 17 bp, Homo sapiens
aaatggcatttagcaca

SEQ ID NO: 540830 - DNA, 14 bp, Homo sapiens
aaatggggagacaa

SEQ ID NO: 540831 - DNA, 22 bp, Homo sapiens
aaatggtcccaattaagaaatt

SEQ ID NO: 540832 - DNA, 22 bp, Homo sapiens
aaatggtggttgtttcttccaa

SEQ ID NO: 540833 - DNA, 16 bp, Homo sapiens
aaatgtatatacacat

SEQ ID NO: 540834 - DNA, 17 bp, Homo sapiens
aaatgtatatacacata

SEQ ID NO: 540835 - DNA, 20 bp, Homo sapiens
aaatgtcactgttataaatt

SEQ ID NO: 540836 - DNA, 23 bp, Homo sapiens
aaatgtcactgttataaattttg

SEQ ID NO: 540837 - DNA, 23 bp, Homo sapiens
aaatgtgaattactaacttctaa

SEQ ID NO: 540838 - DNA, 15 bp, Homo sapiens
aaatgtgtgtgatgt

SEQ ID NO: 540839 - DNA, 16 bp, Homo sapiens
aaatgttaaagatgta

SEQ ID NO: 540840 - DNA, 18 bp, Homo sapiens
aaatgttattcaataact

SEQ ID NO: 540841 - DNA, 14 bp, Homo sapiens
aaatgttttcagct

SEQ ID NO: 540842 - DNA, 18 bp, Homo sapiens
aaatgttttcagctagga

SEQ ID NO: 540843 - DNA, 22 bp, Homo sapiens
aaatgttttgtaaactttgaaa

SEQ ID NO: 540844 - DNA, 19 bp, Homo sapiens
aacgtgtgctgtgtttgct

SEQ ID NO: 540845 - DNA, 14 bp, Homo sapiens
aactactgaataaa

SEQ ID NO: 540846 - DNA, 17 bp, Homo sapiens
aactactgaataaatca

SEQ ID NO: 540847 - DNA, 18 bp, Homo sapiens
aactactgaataaatcat

SEQ ID NO: 540848 - DNA, 22 bp, Homo sapiens
aactactgaataaatcatgtgg

SEQ ID NO: 540849 - DNA, 18 bp, Homo sapiens
aactagacattattttgt

SEQ ID NO: 540850 - DNA, 23 bp, Homo sapiens
aactaggaaggcacttctgcctg

SEQ ID NO: 540851 - DNA, 15 bp, Homo sapiens
aactaggctccttca

SEQ ID NO: 540852 - DNA, 13 bp, Homo sapiens
aactatcttcatc

SEQ ID NO: 540853 - DNA, 18 bp, Homo sapiens
aactatgtttaaagtaat

SEQ ID NO: 540854 - DNA, 22 bp, Homo sapiens
aactattgggtgaatatggtgg

SEQ ID NO: 540855 - DNA, 23 bp, Homo sapiens
aactcaaccaaatggtacaaaac

SEQ ID NO: 540856 - DNA, 16 bp, Homo sapiens
aactcagagcacagcc

SEQ ID NO: 540857 - DNA, 21 bp, Homo sapiens
aactccagtgttcccttctgg

SEQ ID NO: 540858 - DNA, 17 bp, Homo sapiens
aactctaagtgtttgct

SEQ ID NO: 540859 - DNA, 20 bp, Homo sapiens
aactctgatgtaaatgaagt

SEQ ID NO: 540860 - DNA, 12 bp, Homo sapiens
aactcttcctcc

SEQ ID NO: 540861 - DNA, 13 bp, Homo sapiens
aactgacttgctg

SEQ ID NO: 540862 - DNA, 23 bp, Homo sapiens
aactgatgggtatcatgcttcta

SEQ ID NO: 540863 - DNA, 22 bp, Homo sapiens
aactgctcttgggcaatattct

SEQ ID NO: 540864 - DNA, 21 bp, Homo sapiens
aactggaataagaagcaaata

SEQ ID NO: 540865 - DNA, 17 bp, Homo sapiens
aactgtactttgattca

SEQ ID NO: 540866 - DNA, 19 bp, Homo sapiens
aactgtactttgattcaca

SEQ ID NO: 540867 - DNA, 22 bp, Homo sapiens
aactgtatttacttgttatgtt

SEQ ID NO: 540868 - DNA, 20 bp, Homo sapiens
aacttacaagactgtaaatt

SEQ ID NO: 540869 - DNA, 11 bp, Homo sapiens
aacttcagaga

SEQ ID NO: 540870 - DNA, 14 bp, Homo sapiens
aacttccactttgt

SEQ ID NO: 540871 - DNA, 15 bp, Homo sapiens
aacttccactttgta

SEQ ID NO: 540872 - DNA, 13 bp, Homo sapiens
aacttctaaaact

SEQ ID NO: 540873 - DNA, 23 bp, Homo sapiens
aacttctaaaactgtactttgat

SEQ ID NO: 540874 - DNA, 23 bp, Homo sapiens
aacttgattcttgtgattgactt

SEQ ID NO: 540875 - DNA, 14 bp, Homo sapiens
aacttgctgtgaaa

SEQ ID NO: 540876 - DNA, 12 bp, Homo sapiens
aacttgcttaaa

SEQ ID NO: 540877 - DNA, 18 bp, Homo sapiens
aacttgcttaaatgtgaa

SEQ ID NO: 540878 - DNA, 13 bp, Homo sapiens
aacttgtcttaaa

SEQ ID NO: 540879 - DNA, 15 bp, Homo sapiens
aacttgttgcagact

SEQ ID NO: 540880 - DNA, 18 bp, Homo sapiens
aactttaacttccacttt

SEQ ID NO: 540881 - DNA, 13 bp, Homo sapiens
aaagatattgtat

SEQ ID NO: 540882 - DNA, 16 bp, Homo sapiens
aaagatcaaaataaaa

SEQ ID NO: 540883 - DNA, 18 bp, Homo sapiens
aaagatctcctgtgcacc

SEQ ID NO: 540884 - DNA, 16 bp, Homo sapiens
aaagatctttttttaa

SEQ ID NO: 540885 - DNA, 13 bp, Homo sapiens
aaagcaaaaggca

SEQ ID NO: 540886 - DNA, 14 bp, Homo sapiens
aaagcaaaatattt

SEQ ID NO: 540887 - DNA, 15 bp, Homo sapiens
aaagcaaaatatttg

SEQ ID NO: 540888 - DNA, 14 bp, Homo sapiens
aaagcaacagctgg

SEQ ID NO: 540889 - DNA, 16 bp, Homo sapiens
aaagcaacagctggac

SEQ ID NO: 540890 - DNA, 15 bp, Homo sapiens
aaagcacaggagaca

SEQ ID NO: 540891 - DNA, 18 bp, Homo sapiens
aaagcacatgcttagctt

SEQ ID NO: 540892 - DNA, 10 bp, Homo sapiens
agacacacac

SEQ ID NO: 540893 - DNA, 22 bp, Homo sapiens
agacacacacacacacacacat

SEQ ID NO: 540894 - DNA, 23 bp, Homo sapiens
agacacacacacgcacgcacaca

SEQ ID NO: 540895 - DNA, 13 bp, Homo sapiens
agacactcctggg

SEQ ID NO: 540896 - DNA, 14 bp, Homo sapiens
agacactcctgggg

SEQ ID NO: 540897 - DNA, 23 bp, Homo sapiens
agacagacgcctgcttttgcaaa

SEQ ID NO: 540898 - DNA, 21 bp, Homo sapiens
agacagatgtggacatgcacc

SEQ ID NO: 540899 - DNA, 22 bp, Homo sapiens
agacagatgtggacatgcaccc

SEQ ID NO: 540900 - DNA, 18 bp, Homo sapiens
agacaggagaagaaagaa

SEQ ID NO: 540901 - DNA, 17 bp, Homo sapiens
agacagtcaaggagtgg

SEQ ID NO: 540902 - DNA, 13 bp, Homo sapiens
agacataaattgt

SEQ ID NO: 540903 - DNA, 14 bp, Homo sapiens
agacataaattgta

SEQ ID NO: 540904 - DNA, 13 bp, Homo sapiens
agaccagcctggc

SEQ ID NO: 540905 - DNA, 13 bp, Homo sapiens
agaccagtagtga

SEQ ID NO: 540906 - DNA, 19 bp, Homo sapiens
agaccatggggtggaagga

SEQ ID NO: 540907 - DNA, 21 bp, Homo sapiens
agaccatttagtcctcacctt

SEQ ID NO: 540908 - DNA, 13 bp, Homo sapiens
agaccctggagga

SEQ ID NO: 540909 - DNA, 12 bp, Homo sapiens
agaccctgggag

SEQ ID NO: 540910 - DNA, 13 bp, Homo sapiens
agaccctgggaga

SEQ ID NO: 540911 - DNA, 18 bp, Homo sapiens
agaccgagtgtggagctg

SEQ ID NO: 540912 - DNA, 23 bp, Homo sapiens
agaccgagtgtggagctgcttcc

SEQ ID NO: 540913 - DNA, 14 bp, Homo sapiens
agacctcctgatgt

SEQ ID NO: 540914 - DNA, 19 bp, Homo sapiens
agactatatacatgtgtgt

SEQ ID NO: 540915 - DNA, 16 bp, Homo sapiens
agactgctttgagaaa

SEQ ID NO: 540916 - DNA, 14 bp, Homo sapiens
agactgtgtttcta

SEQ ID NO: 540917 - DNA, 22 bp, Homo sapiens
agacttcagggagtcagctgtt

SEQ ID NO: 540918 - DNA, 15 bp, Homo sapiens
agacttcatttaaca

SEQ ID NO: 540919 - DNA, 18 bp, Homo sapiens
agacttctgttttcaatc

SEQ ID NO: 540920 - DNA, 17 bp, Homo sapiens
agacttgattggtttaa

SEQ ID NO: 540921 - DNA, 15 bp, Homo sapiens
agacttgggagcttt

SEQ ID NO: 540922 - DNA, 14 bp, Homo sapiens
agagaaaaagccct

SEQ ID NO: 540923 - DNA, 17 bp, Homo sapiens
agagaaccgagcaaaga

SEQ ID NO: 540924 - DNA, 23 bp, Homo sapiens
agagaagtacaggtcatctgctg

SEQ ID NO: 540925 - DNA, 13 bp, Homo sapiens
agagacagagagg

SEQ ID NO: 540926 - DNA, 22 bp, Homo sapiens
agagagatatatctgaaaactg

SEQ ID NO: 540927 - DNA, 14 bp, Homo sapiens
agagagatgtgtaa

SEQ ID NO: 540928 - DNA, 22 bp, Homo sapiens
agagagcagagaagtacaggtc

SEQ ID NO: 540929 - DNA, 16 bp, Homo sapiens
agagagggggccacct

SEQ ID NO: 540930 - DNA, 22 bp, Homo sapiens
agagagtatggtgctgggtcct

SEQ ID NO: 540931 - DNA, 23 bp, Homo sapiens
agagataggaaggtcatttccat

SEQ ID NO: 540932 - DNA, 15 bp, Homo sapiens
agagatatatctgaa

SEQ ID NO: 540933 - DNA, 16 bp, Homo sapiens
agagatatatctgaaa

SEQ ID NO: 540934 - DNA, 16 bp, Homo sapiens
agagatgtctcttata

SEQ ID NO: 540935 - DNA, 18 bp, Homo sapiens
agagatgtgtaatttttc

SEQ ID NO: 540936 - DNA, 19 bp, Homo sapiens
agagatgtgtaatttttct

SEQ ID NO: 540937 - DNA, 15 bp, Homo sapiens
agagattgcttctca

SEQ ID NO: 540938 - DNA, 18 bp, Homo sapiens
agagattttatgtttaaa

SEQ ID NO: 540939 - DNA, 20 bp, Homo sapiens
agagcaaaagcctcagaaag

SEQ ID NO: 540940 - DNA, 12 bp, Homo sapiens
agagcacagcca

SEQ ID NO: 540941 - DNA, 12 bp, Homo sapiens
agagcagagaag

SEQ ID NO: 540942 - DNA, 13 bp, Homo sapiens
agagcagagttta

SEQ ID NO: 540943 - DNA, 13 bp, Homo sapiens
agagcagcctctt

SEQ ID NO: 540944 - DNA, 21 bp, Homo sapiens
agagcattccagtcaggctct

SEQ ID NO: 540945 - DNA, 23 bp, Homo sapiens
agagcatttggtacacacttgac

SEQ ID NO: 540946 - DNA, 10 bp, Homo sapiens
agagccacaa

SEQ ID NO: 540947 - DNA, 14 bp, Homo sapiens
agagccctgctccc

SEQ ID NO: 540948 - DNA, 19 bp, Homo sapiens
agagccgtaaaaactgaag

SEQ ID NO: 540949 - DNA, 12 bp, Homo sapiens
agagcctctgga

SEQ ID NO: 540950 - DNA, 20 bp, Homo sapiens
agagcctgcagggtgacctg

SEQ ID NO: 540951 - DNA, 19 bp, Homo sapiens
agagcctgccccagcgctg

SEQ ID NO: 540952 - DNA, 16 bp, Homo sapiens
agagcgacagagcagt

SEQ ID NO: 540953 - DNA, 18 bp, Homo sapiens
agagctcagcacagcctc

SEQ ID NO: 540954 - DNA, 22 bp, Homo sapiens
agagctcagcacagcctcaccc

SEQ ID NO: 540955 - DNA, 17 bp, Homo sapiens
agaggagggatagagac

SEQ ID NO: 540956 - DNA, 22 bp, Homo sapiens
agaggagtgcgtggcccaccag

SEQ ID NO: 540957 - DNA, 19 bp, Homo sapiens
agaggatggcccagggtga

SEQ ID NO: 540958 - DNA, 18 bp, Homo sapiens
agaggccgagagctatgg

SEQ ID NO: 540959 - DNA, 23 bp, Homo sapiens
agaggcctcctgtggcctgccag

SEQ ID NO: 540960 - DNA, 18 bp, Homo sapiens
agaggggaaaagctgaac

SEQ ID NO: 540961 - DNA, 21 bp, Homo sapiens
agagggtaataaccagacaca

SEQ ID NO: 540962 - DNA, 19 bp, Homo sapiens
agagggtgagtcctccaga

SEQ ID NO: 540963 - DNA, 20 bp, Homo sapiens
agaggtaccaaaaaagaaag

SEQ ID NO: 540964 - DNA, 19 bp, Homo sapiens
agaggtgagggaggcctga

SEQ ID NO: 540965 - DNA, 22 bp, Homo sapiens
agaggtgcacttggggcacagg

SEQ ID NO: 540966 - DNA, 14 bp, Homo sapiens
agaggtttaaagaa

SEQ ID NO: 540967 - DNA, 18 bp, Homo sapiens
agaggtttggctcctgcc

SEQ ID NO: 540968 - DNA, 13 bp, Homo sapiens
agagtagaaaagg

SEQ ID NO: 540969 - DNA, 16 bp, Homo sapiens
agagtatattgaaaag

SEQ ID NO: 540970 - DNA, 14 bp, Homo sapiens
agagtgaagagcat

SEQ ID NO: 540971 - DNA, 15 bp, Homo sapiens
agagtgaagagtgaa

SEQ ID NO: 540972 - DNA, 20 bp, Homo sapiens
agagtgaagagtgaagagca

SEQ ID NO: 540973 - DNA, 18 bp, Homo sapiens
agagtgactccaagaaca

SEQ ID NO: 540974 - DNA, 23 bp, Homo sapiens
agagtgaggtcatcccggggcca

SEQ ID NO: 540975 - DNA, 20 bp, Homo sapiens
agagttccagattcccagct

SEQ ID NO: 540976 - DNA, 18 bp, Homo sapiens
agataaatccaactctga

SEQ ID NO: 540977 - DNA, 21 bp, Homo sapiens
agataagttggaaacactaaa

SEQ ID NO: 540978 - DNA, 22 bp, Homo sapiens
agataagttggaaacactaaat

SEQ ID NO: 540979 - DNA, 15 bp, Homo sapiens
agataattaaatgaa

SEQ ID NO: 540980 - DNA, 20 bp, Homo sapiens
agataattaaatgaaatact

SEQ ID NO: 540981 - DNA, 22 bp, Homo sapiens
agataattaaatgaaatacttg

SEQ ID NO: 540982 - DNA, 20 bp, Homo sapiens
agataccattttgaaatatt

SEQ ID NO: 540983 - DNA, 21 bp, Homo sapiens
agatactactgaccagacaag

SEQ ID NO: 540984 - DNA, 23 bp, Homo sapiens
agatactactgaccagacaagct

SEQ ID NO: 540985 - DNA, 13 bp, Homo sapiens
agatagttgtaaa

SEQ ID NO: 540986 - DNA, 17 bp, Homo sapiens
agatatatctgaaaact

SEQ ID NO: 540987 - DNA, 21 bp, Homo sapiens
agatatatctgaaaactggaa

SEQ ID NO: 540988 - DNA, 12 bp, Homo sapiens
agatcaaaataa

SEQ ID NO: 540989 - DNA, 15 bp, Homo sapiens
agatcaactcatgtt

SEQ ID NO: 540990 - DNA, 18 bp, Homo sapiens
agatcaagaaaaaaaggg

SEQ ID NO: 540991 - DNA, 18 bp, Homo sapiens
agatcacgttccttcccc

SEQ ID NO: 540992 - DNA, 15 bp, Homo sapiens
agatcactgaacttt

SEQ ID NO: 540993 - DNA, 20 bp, Homo sapiens
agatcactgaacttttcaaa

SEQ ID NO: 540994 - DNA, 12 bp, Homo sapiens
agatcagccaga

SEQ ID NO: 540995 - DNA, 14 bp, Homo sapiens
agatcagccagaag

SEQ ID NO: 540996 - DNA, 13 bp, Homo sapiens
agatccacctgca

SEQ ID NO: 540997 - DNA, 19 bp, Homo sapiens
agatccacctgcacaaaca

SEQ ID NO: 540998 - DNA, 16 bp, Homo sapiens
agatccaggaacacat

SEQ ID NO: 540999 - DNA, 17 bp, Homo sapiens
agatccaggaacacatg

SEQ ID NO: 541000 - DNA, 20 bp, Homo sapiens
agatccaggaacacatgcac

SEQ ID NO: 541001 - DNA, 20 bp, Homo sapiens
agatccgccctgggctctgg

SEQ ID NO: 541002 - DNA, 14 bp, Homo sapiens
agatcggttaacaa

SEQ ID NO: 541003 - DNA, 17 bp, Homo sapiens
agatcggttaacaaata

SEQ ID NO: 541004 - DNA, 17 bp, Homo sapiens
agatctttttttaagtg

SEQ ID NO: 541005 - DNA, 15 bp, Homo sapiens
agatgaaggaaagga

SEQ ID NO: 541006 - DNA, 18 bp, Homo sapiens
agatgaatggtctggcaa

SEQ ID NO: 541007 - DNA, 20 bp, Homo sapiens
agatgacccctgcccagatc

SEQ ID NO: 541008 - DNA, 18 bp, Homo sapiens
agatgcagctcttcctgg

SEQ ID NO: 541009 - DNA, 15 bp, Homo sapiens
agatgccattcatag

SEQ ID NO: 541010 - DNA, 22 bp, Homo sapiens
agatgcgagcgctatcttcaca

SEQ ID NO: 541011 - DNA, 23 bp, Homo sapiens
agatgctgaaggtgagaggaaat

SEQ ID NO: 541012 - DNA, 15 bp, Homo sapiens
agatggcgcacccgg

SEQ ID NO: 541013 - DNA, 22 bp, Homo sapiens
agatgtagcaaaccctgtcaaa

SEQ ID NO: 541014 - DNA, 23 bp, Homo sapiens
agatgtagcaaaccctgtcaaac

SEQ ID NO: 541015 - DNA, 16 bp, Homo sapiens
agatgtgtaatttttc

SEQ ID NO: 541016 - DNA, 17 bp, Homo sapiens
agatgtgtaatttttct

SEQ ID NO: 541017 - DNA, 17 bp, Homo sapiens
agatgttaacagtattt

SEQ ID NO: 541018 - DNA, 19 bp, Homo sapiens
agatgttatatttttctta

SEQ ID NO: 541019 - DNA, 16 bp, Homo sapiens
agattcacttctgaat

SEQ ID NO: 541020 - DNA, 12 bp, Homo sapiens
agattcccagct

SEQ ID NO: 541021 - DNA, 22 bp, Homo sapiens
agattcctttggccactgtatt

SEQ ID NO: 541022 - DNA, 12 bp, Homo sapiens
agattgcttctc

SEQ ID NO: 541023 - DNA, 14 bp, Homo sapiens
agattgggtgccag

SEQ ID NO: 541024 - DNA, 14 bp, Homo sapiens
agattgtttatcta

SEQ ID NO: 541025 - DNA, 22 bp, Homo sapiens
agattgtttatctagatgtaaa

SEQ ID NO: 541026 - DNA, 20 bp, Homo sapiens
agatttaccagggatgtaga

SEQ ID NO: 541027 - DNA, 19 bp, Homo sapiens
agatttcaagaaaaaataa

SEQ ID NO: 541028 - DNA, 19 bp, Homo sapiens
agatttgcaacagcaaatt

SEQ ID NO: 541029 - DNA, 22 bp, Homo sapiens
agattttagttttattttctaa

SEQ ID NO: 541030 - DNA, 14 bp, Homo sapiens
agattttatgttta

SEQ ID NO: 541031 - DNA, 16 bp, Homo sapiens
agattttatgtttaaa

SEQ ID NO: 541032 - DNA, 20 bp, Homo sapiens
agcaaaaaaagcaacttttc

SEQ ID NO: 541033 - DNA, 18 bp, Homo sapiens
aatatgcatatatatgta

SEQ ID NO: 541034 - DNA, 14 bp, Homo sapiens
aatatgtaaacttt

SEQ ID NO: 541035 - DNA, 13 bp, Homo sapiens
aatatgtatttta

SEQ ID NO: 541036 - DNA, 18 bp, Homo sapiens
aatatgtattttatgtat

SEQ ID NO: 541037 - DNA, 17 bp, Homo sapiens
aatatgtccatatctaa

SEQ ID NO: 541038 - DNA, 19 bp, Homo sapiens
aatattaaaaagtctttta

SEQ ID NO: 541039 - DNA, 22 bp, Homo sapiens
aatattactctgcctgtcaagt

SEQ ID NO: 541040 - DNA, 17 bp, Homo sapiens
aatattatatttggatg

SEQ ID NO: 541041 - DNA, 23 bp, Homo sapiens
aatattctgtaactattgggtga

SEQ ID NO: 541042 - DNA, 19 bp, Homo sapiens
aatattgaaaatgtcactg

SEQ ID NO: 541043 - DNA, 12 bp, Homo sapiens
aatatttcattt

SEQ ID NO: 541044 - DNA, 17 bp, Homo sapiens
aatatttcattttgaga

SEQ ID NO: 541045 - DNA, 22 bp, Homo sapiens
aatatttcattttgagaacatt

SEQ ID NO: 541046 - DNA, 13 bp, Homo sapiens
aatatttgtgaaa

SEQ ID NO: 541047 - DNA, 16 bp, Homo sapiens
aatattttctacttta

SEQ ID NO: 541048 - DNA, 21 bp, Homo sapiens
aatattttctactttaaattg

SEQ ID NO: 541049 - DNA, 15 bp, Homo sapiens
aatattttgtcactg

SEQ ID NO: 541050 - DNA, 14 bp, Homo sapiens
aatcaaaaaattat

SEQ ID NO: 541051 - DNA, 14 bp, Homo sapiens
aatcaaaaattgaa

SEQ ID NO: 541052 - DNA, 23 bp, Homo sapiens
aatcaatgttcacgcaacttgaa

SEQ ID NO: 541053 - DNA, 20 bp, Homo sapiens
aatcaccagggccaaaagct

SEQ ID NO: 541054 - DNA, 12 bp, Homo sapiens
aatcactcagag

SEQ ID NO: 541055 - DNA, 13 bp, Homo sapiens
aatcactgaaaat

SEQ ID NO: 541056 - DNA, 14 bp, Homo sapiens
aatcagaaagacat

SEQ ID NO: 541057 - DNA, 22 bp, Homo sapiens
aatcagtttttgttcttaaaaa

SEQ ID NO: 541058 - DNA, 24 bp, Homo sapiens
aatcataaccaccctagctttata

SEQ ID NO: 541059 - DNA, 14 bp, Homo sapiens
aatcatacacagaa

SEQ ID NO: 541060 - DNA, 18 bp, Homo sapiens
aatcatcctcatgccttt

SEQ ID NO: 541061 - DNA, 14 bp, Homo sapiens
aatcatcgaaaatt

SEQ ID NO: 541062 - DNA, 16 bp, Homo sapiens
aatcatcgaaaattca

SEQ ID NO: 541063 - DNA, 23 bp, Homo sapiens
aatcatcgaaaattcatttcaca

SEQ ID NO: 541064 - DNA, 15 bp, Homo sapiens
aatcatctattgagt

SEQ ID NO: 541065 - DNA, 20 bp, Homo sapiens
aatcatgaacagctctgaga

SEQ ID NO: 541066 - DNA, 17 bp, Homo sapiens
aatcattgtccagagct

SEQ ID NO: 541067 - DNA, 16 bp, Homo sapiens
aatccaaaagaaaaac

SEQ ID NO: 541068 - DNA, 14 bp, Homo sapiens
aatcccaaaagtca

SEQ ID NO: 541069 - DNA, 16 bp, Homo sapiens
aatcctatctggggag

SEQ ID NO: 541070 - DNA, 22 bp, Homo sapiens
aatccttaatggccttaattaa

SEQ ID NO: 541071 - DNA, 15 bp, Homo sapiens
aatcgggagtagcaa

SEQ ID NO: 541072 - DNA, 15 bp, Homo sapiens
aatctactagaacct

SEQ ID NO: 541073 - DNA, 23 bp, Homo sapiens
aatctcaaaagatctcctgtgca

SEQ ID NO: 541074 - DNA, 22 bp, Homo sapiens
aatctcctttggaaggtgacac

SEQ ID NO: 541075 - DNA, 19 bp, Homo sapiens
aatctcgtatagaagtctt

SEQ ID NO: 541076 - DNA, 20 bp, Homo sapiens
aatctcgtatagaagtcttc

SEQ ID NO: 541077 - DNA, 18 bp, Homo sapiens
aatctctacccctttctt

SEQ ID NO: 541078 - DNA, 16 bp, Homo sapiens
aatctcttctgtgttt

SEQ ID NO: 541079 - DNA, 15 bp, Homo sapiens
aatctgaagattgtt

SEQ ID NO: 541080 - DNA, 18 bp, Homo sapiens
aatctgaagcttcactca

SEQ ID NO: 541081 - DNA, 14 bp, Homo sapiens
aatctgaatgtatt

SEQ ID NO: 541082 - DNA, 13 bp, Homo sapiens
aatctgaccacag

SEQ ID NO: 541083 - DNA, 11 bp, Homo sapiens
aatctgtctgc

SEQ ID NO: 541084 - DNA, 17 bp, Homo sapiens
aatcttattaaagtttc

SEQ ID NO: 541085 - DNA, 18 bp, Homo sapiens
aatcttattaaagtttca

SEQ ID NO: 541086 - DNA, 17 bp, Homo sapiens
agctacccaaaagagaa

SEQ ID NO: 541087 - DNA, 20 bp, Homo sapiens
agctacccaaaagagaaaaa

SEQ ID NO: 541088 - DNA, 21 bp, Homo sapiens
agctaggtgctaattaataaa

SEQ ID NO: 541089 - DNA, 18 bp, Homo sapiens
agctcaattgttaatgtg

SEQ ID NO: 541090 - DNA, 17 bp, Homo sapiens
agctcaggaagaagaga

SEQ ID NO: 541091 - DNA, 17 bp, Homo sapiens
agctcatcatcagtctt

SEQ ID NO: 541092 - DNA, 19 bp, Homo sapiens
agctcccaggacgcaggga

SEQ ID NO: 541093 - DNA, 16 bp, Homo sapiens
agctcccccagctccc

SEQ ID NO: 541094 - DNA, 20 bp, Homo sapiens
agctccccccacctccccca

SEQ ID NO: 541095 - DNA, 20 bp, Homo sapiens
agctccctcaaagaggcagt

SEQ ID NO: 541096 - DNA, 21 bp, Homo sapiens
agtcctccagaactcttcctc

SEQ ID NO: 541097 - DNA, 17 bp, Homo sapiens
agtcctgcaaccaaact

SEQ ID NO: 541098 - DNA, 21 bp, Homo sapiens
agtctagcgtagtgcagcagg

SEQ ID NO: 541099 - DNA, 17 bp, Homo sapiens
agtctcactgacacagg

SEQ ID NO: 541100 - DNA, 21 bp, Homo sapiens
agtctcagtgctagcttattt

SEQ ID NO: 541101 - DNA, 16 bp, Homo sapiens
agtctctttcttcctt

SEQ ID NO: 541102 - DNA, 17 bp, Homo sapiens
agtctcttttttacaaa

SEQ ID NO: 541103 - DNA, 21 bp, Homo sapiens
agtctggagaccaggactctg

SEQ ID NO: 541104 - DNA, 19 bp, Homo sapiens
agtcttactgttttgtgcg

SEQ ID NO: 541105 - DNA, 19 bp, Homo sapiens
agtcttatgaatagacata

SEQ ID NO: 541106 - DNA, 15 bp, Homo sapiens
agtcttcatgaaatg

SEQ ID NO: 541107 - DNA, 16 bp, Homo sapiens
agtcttcatgaaatgc

SEQ ID NO: 541108 - DNA, 18 bp, Homo sapiens
agtcttcatgaaatgcta

SEQ ID NO: 541109 - DNA, 17 bp, Homo sapiens
agtcttccacctggaag

SEQ ID NO: 541110 - DNA, 20 bp, Homo sapiens
agtcttttaaaaagtattgc

SEQ ID NO: 541111 - DNA, 22 bp, Homo sapiens
agtcttttgcatgtcgcacaat

SEQ ID NO: 541112 - DNA, 19 bp, Homo sapiens
agtgaaaacctctttcgga

SEQ ID NO: 541113 - DNA, 18 bp, Homo sapiens
agtgaaacatcatagaaa

SEQ ID NO: 541114 - DNA, 13 bp, Homo sapiens
agtgaaatattac

SEQ ID NO: 541115 - DNA, 13 bp, Homo sapiens
agtgaaattcaat

SEQ ID NO: 541116 - DNA, 22 bp, Homo sapiens
agtgaaattcaattcatagaat

SEQ ID NO: 541117 - DNA, 17 bp, Homo sapiens
agtgaagactccagaaa

SEQ ID NO: 541118 - DNA, 18 bp, Homo sapiens
agtgaagagtgaagagca

SEQ ID NO: 541119 - DNA, 20 bp, Homo sapiens
agtgaagagtgaagagcatt

SEQ ID NO: 541120 - DNA, 13 bp, Homo sapiens
agtgacacagcag

SEQ ID NO: 541121 - DNA, 17 bp, Homo sapiens
agtgacacagcagcttc

SEQ ID NO: 541122 - DNA, 18 bp, Homo sapiens
agtgacacagcagcttca

SEQ ID NO: 541123 - DNA, 23 bp, Homo sapiens
agtgacacagcagcttcaccaga

SEQ ID NO: 541124 - DNA, 21 bp, Homo sapiens
agtgaccaatcgggagtagca

SEQ ID NO: 541125 - DNA, 22 bp, Homo sapiens
agtgaccaatcgggagtagcaa

SEQ ID NO: 541126 - DNA, 16 bp, Homo sapiens
agtgacgtgagtgggg

SEQ ID NO: 541127 - DNA, 16 bp, Homo sapiens
agtgactccaagaaca

SEQ ID NO: 541128 - DNA, 17 bp, Homo sapiens
agtgaggtcatcccggg

SEQ ID NO: 541129 - DNA, 16 bp, Homo sapiens
agtgaggtcctggggg

SEQ ID NO: 541130 - DNA, 17 bp, Homo sapiens
agtgatatgatccagag

SEQ ID NO: 541131 - DNA, 20 bp, Homo sapiens
agtgatatgatccagagcag

SEQ ID NO: 541132 - DNA, 23 bp, Homo sapiens
agtgatgtttttatgatatccct

SEQ ID NO: 541133 - DNA, 12 bp, Homo sapiens
agtgcaaaaggc

SEQ ID NO: 541134 - DNA, 14 bp, Homo sapiens
agtgcaatatattt

SEQ ID NO: 541135 - DNA, 20 bp, Homo sapiens
agtgcacacagaaatatata

SEQ ID NO: 541136 - DNA, 15 bp, Homo sapiens
agtgcagcagggcag

SEQ ID NO: 541137 - DNA, 20 bp, Homo sapiens
agtgcattcattcatcctct

SEQ ID NO: 541138 - DNA, 16 bp, Homo sapiens
agtgccccagaaatgc

SEQ ID NO: 541139 - DNA, 16 bp, Homo sapiens
agtgcctctgattcta

SEQ ID NO: 541140 - DNA, 14 bp, Homo sapiens
agtggaaattcagg

SEQ ID NO: 541141 - DNA, 18 bp, Homo sapiens
agtggaccctgaaatgtg

SEQ ID NO: 541142 - DNA, 20 bp, Homo sapiens
agtggagcctgacagccaga

SEQ ID NO: 541143 - DNA, 13 bp, Homo sapiens
agtggcaaaatat

SEQ ID NO: 541144 - DNA, 22 bp, Homo sapiens
agtggcaaaatattatgttatg

SEQ ID NO: 541145 - DNA, 22 bp, Homo sapiens
agtggcacctgtctgctccagc

SEQ ID NO: 541146 - DNA, 21 bp, Homo sapiens
agtggcctcgaactcctggca

SEQ ID NO: 541147 - DNA, 20 bp, Homo sapiens
agtggcttggagcagaggtg

SEQ ID NO: 541148 - DNA, 23 bp, Homo sapiens
agtggggaggagactcaggccca

SEQ ID NO: 541149 - DNA, 15 bp, Homo sapiens
agtggttgttttttc

SEQ ID NO: 541150 - DNA, 15 bp, Homo sapiens
agtgtaataatatga

SEQ ID NO: 541151 - DNA, 18 bp, Homo sapiens
agtgtaccattaaaatat

SEQ ID NO: 541152 - DNA, 21 bp, Homo sapiens
agtgtaccattaaaatatgca

SEQ ID NO: 541153 - DNA, 19 bp, Homo sapiens
agtgtcagactatccattt

SEQ ID NO: 541154 - DNA, 14 bp, Homo sapiens
agtgtctcaaagga

SEQ ID NO: 541155 - DNA, 20 bp, Homo sapiens
agtgttattgagagagatgt

SEQ ID NO: 541156 - DNA, 13 bp, Homo sapiens
agtgttctgtgaa

SEQ ID NO: 541157 - DNA, 13 bp, Homo sapiens
agtgttctgtggc

SEQ ID NO: 541158 - DNA, 23 bp, Homo sapiens
agtgttctgttacaaaatgtaac

SEQ ID NO: 541159 - DNA, 24 bp, Homo sapiens
agttaagcacaaccatgttcttga

SEQ ID NO: 541160 - DNA, 23 bp, Homo sapiens
agttacttttccttgcatacaaa

SEQ ID NO: 541161 - DNA, 22 bp, Homo sapiens
agttatcctttgtgagcctatg

SEQ ID NO: 541162 - DNA, 14 bp, Homo sapiens
agttatcttagctg

SEQ ID NO: 541163 - DNA, 15 bp, Homo sapiens
agttatgcatcccca

SEQ ID NO: 541164 - DNA, 16 bp, Homo sapiens
agttattttgtgtcct

SEQ ID NO: 541165 - DNA, 19 bp, Homo sapiens
agttcagggaagataagtt

SEQ ID NO: 541166 - DNA, 19 bp, Homo sapiens
agttcatcccagccccaat

SEQ ID NO: 541167 - DNA, 20 bp, Homo sapiens
agttcatcccagccccaatt

SEQ ID NO: 541168 - DNA, 20 bp, Homo sapiens
agttcatcccttctcttcca

SEQ ID NO: 541169 - DNA, 16 bp, Homo sapiens
agttcccatttccttg

SEQ ID NO: 541170 - DNA, 20 bp, Homo sapiens
agttcccttgattcaaataa

SEQ ID NO: 541171 - DNA, 18 bp, Homo sapiens
agttccttctcacttaga

SEQ ID NO: 541172 - DNA, 17 bp, Homo sapiens
agttctctttggaaata

SEQ ID NO: 541173 - DNA, 15 bp, Homo sapiens
agttgaagtcatgct

SEQ ID NO: 541174 - DNA, 13 bp, Homo sapiens
agttgcagtaaag

SEQ ID NO: 541175 - DNA, 19 bp, Homo sapiens
agttgcccagcctctttcc

SEQ ID NO: 541176 - DNA, 22 bp, Homo sapiens
agttgccgcatattatatcaga

SEQ ID NO: 541177 - DNA, 22 bp, Homo sapiens
agttggaaacactaaatgttaa

SEQ ID NO: 541178 - DNA, 23 bp, Homo sapiens
agttggaaacactaaatgttaaa

SEQ ID NO: 541179 - DNA, 15 bp, Homo sapiens
agttggactgtggcc

SEQ ID NO: 541180 - DNA, 19 bp, Homo sapiens
agttggagttcattcatat

SEQ ID NO: 541181 - DNA, 14 bp, Homo sapiens
agttggtattttat

SEQ ID NO: 541182 - DNA, 19 bp, Homo sapiens
agttggtcttactttgtta

SEQ ID NO: 541183 - DNA, 15 bp, Homo sapiens
agttgtaaacgtctt

SEQ ID NO: 541184 - DNA, 21 bp, Homo sapiens
agttgtaacattctatttcaa

SEQ ID NO: 541185 - DNA, 17 bp, Homo sapiens
agttgtatgatctgtgc

SEQ ID NO: 541186 - DNA, 20 bp, Homo sapiens
agttgtccatattttcacag

SEQ ID NO: 541187 - DNA, 13 bp, Homo sapiens
agttgtcttacac

SEQ ID NO: 541188 - DNA, 20 bp, Homo sapiens
agttgtgatctgttgtaata

SEQ ID NO: 541189 - DNA, 20 bp, Homo sapiens
agtttaaaaaaaaagttggt

SEQ ID NO: 541190 - DNA, 23 bp, Homo sapiens
agtttaaaatgtgtatttttcaa

SEQ ID NO: 541191 - DNA, 12 bp, Homo sapiens
agtttaacagaa

SEQ ID NO: 541192 - DNA, 20 bp, Homo sapiens
agtttactagcttttcaaac

SEQ ID NO: 541193 - DNA, 14 bp, Homo sapiens
agtttagatttcaa

SEQ ID NO: 541194 - DNA, 14 bp, Homo sapiens
agtttatgttttgg

SEQ ID NO: 541195 - DNA, 16 bp, Homo sapiens
agtttattccagagct

SEQ ID NO: 541196 - DNA, 22 bp, Homo sapiens
agtttattccagagctgccagt

SEQ ID NO: 541197 - DNA, 22 bp, Homo sapiens
agtttattgccctcaaaatctt

SEQ ID NO: 541198 - DNA, 22 bp, Homo sapiens
agtttcaaaaatctgaagattg

SEQ ID NO: 541199 - DNA, 17 bp, Homo sapiens
agtttcaataaagtttg

SEQ ID NO: 541200 - DNA, 18 bp, Homo sapiens
agtttgataaatagtgtt

SEQ ID NO: 541201 - DNA, 21 bp, Homo sapiens
agtttgatcttcctctgctaa

SEQ ID NO: 541202 - DNA, 23 bp, Homo sapiens
agtttgatcttcctctgctaaat

SEQ ID NO: 541203 - DNA, 21 bp, Homo sapiens
agtttgtatagagttcatccc

SEQ ID NO: 541204 - DNA, 16 bp, Homo sapiens
agtttgtttctttgaa

SEQ ID NO: 541205 - DNA, 17 bp, Homo sapiens
agtttgtttctttgaat

SEQ ID NO: 541206 - DNA, 20 bp, Homo sapiens
agtttgtttctttgaatttt

SEQ ID NO: 541207 - DNA, 18 bp, Homo sapiens
agttttgatatgagtata

SEQ ID NO: 541208 - DNA, 12 bp, Homo sapiens
agttttgtgaaa

SEQ ID NO: 541209 - DNA, 19 bp, Homo sapiens
agttttgtgaaatttttca

SEQ ID NO: 541210 - DNA, 17 bp, Homo sapiens
agtttttgttcttaaaa

SEQ ID NO: 541211 - DNA, 20 bp, Homo sapiens
ataaaaaaaatgaaatgttt

SEQ ID NO: 541212 - DNA, 12 bp, Homo sapiens
ataaaaaaagaa

SEQ ID NO: 541213 - DNA, 20 bp, Homo sapiens
ataaaaaatctttagggaat

SEQ ID NO: 541214 - DNA, 16 bp, Homo sapiens
ataaaaactactgaat

SEQ ID NO: 541215 - DNA, 18 bp, Homo sapiens
ataaaaactactgaataa

SEQ ID NO: 541216 - DNA, 17 bp, Homo sapiens
ataaaaagtgacacagc

SEQ ID NO: 541217 - DNA, 19 bp, Homo sapiens
ataaaaagtgacacagcag

SEQ ID NO: 541218 - DNA, 12 bp, Homo sapiens
ataaaagaaaga

SEQ ID NO: 541219 - DNA, 17 bp, Homo sapiens
ataaaagaaatgcacaa

SEQ ID NO: 541220 - DNA, 11 bp, Homo sapiens
ataaaagccca

SEQ ID NO: 541221 - DNA, 17 bp, Homo sapiens
ataaaatacacgtgtat

SEQ ID NO: 541222 - DNA, 21 bp, Homo sapiens
ataaaatacacgtgtatatga

SEQ ID NO: 541223 - DNA, 19 bp, Homo sapiens
ataaaatagttgtccatat

SEQ ID NO: 541224 - DNA, 22 bp, Homo sapiens
ataaaatcccattgtatttaaa

SEQ ID NO: 541225 - DNA, 15 bp, Homo sapiens
ataaaatctgtattg

SEQ ID NO: 541226 - DNA, 14 bp, Homo sapiens
ataaaatggcaaca

SEQ ID NO: 541227 - DNA, 16 bp, Homo sapiens
ataaaatggcaacaaa

SEQ ID NO: 541228 - DNA, 22 bp, Homo sapiens
ataaaatggcaacaaactgcac

SEQ ID NO: 541229 - DNA, 20 bp, Homo sapiens
ataaagtatgaatatttcat

SEQ ID NO: 541230 - DNA, 13 bp, Homo sapiens
ataaagtttgatc

SEQ ID NO: 541231 - DNA, 13 bp, Homo sapiens
ataaataaatgtt

SEQ ID NO: 541232 - DNA, 15 bp, Homo sapiens
ataaatagtgttatt

SEQ ID NO: 541233 - DNA, 19 bp, Homo sapiens
ataaatcaattcattgtgt

SEQ ID NO: 541234 - DNA, 22 bp, Homo sapiens
ataaatcatgtggcctaatatt

SEQ ID NO: 541235 - DNA, 14 bp, Homo sapiens
ataaatgtatatac

SEQ ID NO: 541236 - DNA, 15 bp, Homo sapiens
ataaatgtatataca

SEQ ID NO: 541237 - DNA, 18 bp, Homo sapiens
ataaatgtatatacacat

SEQ ID NO: 541238 - DNA, 19 bp, Homo sapiens
ataaatgtatatacacata

SEQ ID NO: 541239 - DNA, 15 bp, Homo sapiens
ataaattttgtacat

SEQ ID NO: 541240 - DNA, 13 bp, Homo sapiens
ataaatttttaag

SEQ ID NO: 541241 - DNA, 18 bp, Homo sapiens
ataacaactgctgggaat

SEQ ID NO: 541242 - DNA, 19 bp, Homo sapiens
ataacagagtgatttgtaa

SEQ ID NO: 541243 - DNA, 20 bp, Homo sapiens
ataacagagtgatttgtaaa

SEQ ID NO: 541244 - DNA, 14 bp, Homo sapiens
ataacagctccttt

SEQ ID NO: 541245 - DNA, 20 bp, Homo sapiens
ataaccaccctagctttata

SEQ ID NO: 541246 - DNA, 16 bp, Homo sapiens
ataaccagacacaaac

SEQ ID NO: 541247 - DNA, 20 bp, Homo sapiens
ataaccctgaatcagaggca

SEQ ID NO: 541248 - DNA, 15 bp, Homo sapiens
ataactgatggcaat

SEQ ID NO: 541249 - DNA, 18 bp, Homo sapiens
ataactgccttaaaactt

SEQ ID NO: 541250 - DNA, 22 bp, Homo sapiens
ataacttacaagactgtaaatt

SEQ ID NO: 541251 - DNA, 15 bp, Homo sapiens
ataagaaaaatgctt

SEQ ID NO: 541252 - DNA, 14 bp, Homo sapiens
ataagaaacagttt

SEQ ID NO: 541253 - DNA, 22 bp, Homo sapiens
ataagaaacagtttaacagaaa

SEQ ID NO: 541254 - DNA, 22 bp, Homo sapiens
ataagcaacaattttcagattt

SEQ ID NO: 541255 - DNA, 15 bp, Homo sapiens
ataagcacagacaat

SEQ ID NO: 541256 - DNA, 18 bp, Homo sapiens
ataagcacagacaattct

SEQ ID NO: 541257 - DNA, 22 bp, Homo sapiens
ataagcacagacaattctaatg

SEQ ID NO: 541258 - DNA, 15 bp, Homo sapiens
ataagtaaatgtctt

SEQ ID NO: 541259 - DNA, 20 bp, Homo sapiens
ataagtaaatgtcttcatgt

SEQ ID NO: 541260 - DNA, 18 bp, Homo sapiens
ataagtaagacttgattg

SEQ ID NO: 541261 - DNA, 18 bp, Homo sapiens
ataagttcccatttcctt

SEQ ID NO: 541262 - DNA, 13 bp, Homo sapiens
ataagttggaaac

SEQ ID NO: 541263 - DNA, 21 bp, Homo sapiens
ataagttggaaacactaaatg

SEQ ID NO: 541264 - DNA, 15 bp, Homo sapiens
ataatcaaagctcat

SEQ ID NO: 541265 - DNA, 18 bp, Homo sapiens
ataatcctgcaaagtaca

SEQ ID NO: 541266 - DNA, 14 bp, Homo sapiens
ataatgaagatctt

SEQ ID NO: 541267 - DNA, 17 bp, Homo sapiens
ataatgaagatctttgt

SEQ ID NO: 541268 - DNA, 21 bp, Homo sapiens
ataatggaagagaaatctcat

SEQ ID NO: 541269 - DNA, 12 bp, Homo sapiens
ataatggtaatt

SEQ ID NO: 541270 - DNA, 23 bp, Homo sapiens
ataatggtaatttagtgtatatg

SEQ ID NO: 541271 - DNA, 18 bp, Homo sapiens
ataatgtgtgtatgtgta

SEQ ID NO: 541272 - DNA, 20 bp, Homo sapiens
ataattaaccaaggtagaat

SEQ ID NO: 541273 - DNA, 21 bp, Homo sapiens
ataattaaccaaggtagaatg

SEQ ID NO: 541274 - DNA, 12 bp, Homo sapiens
ataattcattaa

SEQ ID NO: 541275 - DNA, 21 bp, Homo sapiens
ataatttagtggatggaatat

SEQ ID NO: 541276 - DNA, 16 bp, Homo sapiens
atacaaacaagcatat

SEQ ID NO: 541277 - DNA, 20 bp, Homo sapiens
atacaatatataaaaatata

SEQ ID NO: 541278 - DNA, 14 bp, Homo sapiens
atacaatttacttt

SEQ ID NO: 541279 - DNA, 17 bp, Homo sapiens
atacaatttacttttaa

SEQ ID NO: 541280 - DNA, 12 bp, Homo sapiens
atacacacagga

SEQ ID NO: 541281 - DNA, 19 bp, Homo sapiens
atacacagaaatcctaaca

SEQ ID NO: 541282 - DNA, 22 bp, Homo sapiens
atacacatacatatatacattt

SEQ ID NO: 541283 - DNA, 15 bp, Homo sapiens
atacagtgtgtagtt

SEQ ID NO: 541284 - DNA, 21 bp, Homo sapiens
atacatacgcaattgtatata

SEQ ID NO: 541285 - DNA, 16 bp, Homo sapiens
atacatgatgatttca

SEQ ID NO: 541286 - DNA, 19 bp, Homo sapiens
atacatgatgatttcagaa

SEQ ID NO: 541287 - DNA, 20 bp, Homo sapiens
atacatgtgtgtatatatgt

SEQ ID NO: 541288 - DNA, 23 bp, Homo sapiens
atacatgtgtgtatatatgtgta

SEQ ID NO: 541289 - DNA, 16 bp, Homo sapiens
atacattttctggtgg

SEQ ID NO: 541290 - DNA, 13 bp, Homo sapiens
ataccatttccgt

SEQ ID NO: 541291 - DNA, 14 bp, Homo sapiens
ataccattttgaaa

SEQ ID NO: 541292 - DNA, 15 bp, Homo sapiens
ataccattttgaaat

SEQ ID NO: 541293 - DNA, 14 bp, Homo sapiens
atacctataatgtg

SEQ ID NO: 541294 - DNA, 15 bp, Homo sapiens
atacctgtacacaca

SEQ ID NO: 541295 - DNA, 17 bp, Homo sapiens
atacctgtacacacaca

SEQ ID NO: 541296 - DNA, 23 bp, Homo sapiens
atacctgtacacacacagacaca

SEQ ID NO: 541297 - DNA, 16 bp, Homo sapiens
ataccttaaaatttga

SEQ ID NO: 541298 - DNA, 23 bp, Homo sapiens
ataccttaaaatttgaaacattg

SEQ ID NO: 541299 - DNA, 18 bp, Homo sapiens
atacgcaattgtatatat

SEQ ID NO: 541300 - DNA, 13 bp, Homo sapiens
atacgcacgcacc

SEQ ID NO: 541301 - DNA, 16 bp, Homo sapiens
atacgcacgcacccac

SEQ ID NO: 541302 - DNA, 21 bp, Homo sapiens
atacgtttcaaaaacaccccc

SEQ ID NO: 541303 - DNA, 22 bp, Homo sapiens
atactagccagagctcctcctt

SEQ ID NO: 541304 - DNA, 16 bp, Homo sapiens
atactatttattaaaa

SEQ ID NO: 541305 - DNA, 18 bp, Homo sapiens
atactcaagtttcaggta

SEQ ID NO: 541306 - DNA, 14 bp, Homo sapiens
atactcatttctaa

SEQ ID NO: 541307 - DNA, 17 bp, Homo sapiens
atactccttaaaaatgt

SEQ ID NO: 541308 - DNA, 13 bp, Homo sapiens
atactgcctcccc

SEQ ID NO: 541309 - DNA, 17 bp, Homo sapiens
atagaaagtgttctgtt

SEQ ID NO: 541310 - DNA, 18 bp, Homo sapiens
atagaaagtgttctgtta

SEQ ID NO: 541311 - DNA, 16 bp, Homo sapiens
atagaagaatgcatgc

SEQ ID NO: 541312 - DNA, 14 bp, Homo sapiens
atagaagtcttcat

SEQ ID NO: 541313 - DNA, 20 bp, Homo sapiens
atagaagtcttcatgaaatg

SEQ ID NO: 541314 - DNA, 18 bp, Homo sapiens
atagaataatgaagatct

SEQ ID NO: 541315 - DNA, 20 bp, Homo sapiens
atagatcccacgttgatgtc

SEQ ID NO: 541316 - DNA, 13 bp, Homo sapiens
atagattgattta

SEQ ID NO: 541317 - DNA, 15 bp, Homo sapiens
atagcagcaaaaata

SEQ ID NO: 541318 - DNA, 19 bp, Homo sapiens
atagcagcaaaaatataaa

SEQ ID NO: 541319 - DNA, 20 bp, Homo sapiens
atagcagcaaaaatataaaa

SEQ ID NO: 541320 - DNA, 15 bp, Homo sapiens
atagcagtggcaaaa

SEQ ID NO: 541321 - DNA, 17 bp, Homo sapiens
atagcctagctttctaa

SEQ ID NO: 541322 - DNA, 14 bp, Homo sapiens
atagctacccaaaa

SEQ ID NO: 541323 - DNA, 19 bp, Homo sapiens
atagctacccaaaagagaa

SEQ ID NO: 541324 - DNA, 19 bp, Homo sapiens
atagctcttcctccccagg

SEQ ID NO: 541325 - DNA, 15 bp, Homo sapiens
ataggaaggtcattt

SEQ ID NO: 541326 - DNA, 19 bp, Homo sapiens
ataggaaggtcatttccat

SEQ ID NO: 541327 - DNA, 22 bp, Homo sapiens
ataggaagttagcctttatcta

SEQ ID NO: 541328 - DNA, 23 bp, Homo sapiens
ataggaagttagcctttatctac

SEQ ID NO: 541329 - DNA, 14 bp, Homo sapiens
ataggagaggaaaa

SEQ ID NO: 541330 - DNA, 17 bp, Homo sapiens
ataggcttgtgtaattt

SEQ ID NO: 541331 - DNA, 13 bp, Homo sapiens
atagtatttgaaa

SEQ ID NO: 541332 - DNA, 22 bp, Homo sapiens
atagtatttgaaaacagaaatt

SEQ ID NO: 541333 - DNA, 18 bp, Homo sapiens
atagtcatttattttaaa

SEQ ID NO: 541334 - DNA, 18 bp, Homo sapiens
atagtgcaatatattttg

SEQ ID NO: 541335 - DNA, 20 bp, Homo sapiens
atagtgctatatatataaat

SEQ ID NO: 541336 - DNA, 22 bp, Homo sapiens
atagtgctatatatataaatat

SEQ ID NO: 541337 - DNA, 17 bp, Homo sapiens
atagtgttattgagaga

SEQ ID NO: 541338 - DNA, 12 bp, Homo sapiens
atagttgtaaag

SEQ ID NO: 541339 - DNA, 21 bp, Homo sapiens
atagttgtaaagatattgtat

SEQ ID NO: 541340 - DNA, 20 bp, Homo sapiens
atataaacagaactcccttc

SEQ ID NO: 541341 - DNA, 20 bp, Homo sapiens
atataaagcatctaaacttt

SEQ ID NO: 541342 - DNA, 13 bp, Homo sapiens
atataaatatttg

SEQ ID NO: 541343 - DNA, 20 bp, Homo sapiens
atataactgccttaaaactt

SEQ ID NO: 541344 - DNA, 19 bp, Homo sapiens
atataatggaagagaaatc

SEQ ID NO: 541345 - DNA, 18 bp, Homo sapiens
atataatggcctcttaaa

SEQ ID NO: 541346 - DNA, 21 bp, Homo sapiens
atataatggcctcttaaaaat

SEQ ID NO: 541347 - DNA, 12 bp, Homo sapiens
atataatgtatt

SEQ ID NO: 541348 - DNA, 14 bp, Homo sapiens
atatacatgtgtgt

SEQ ID NO: 541349 - DNA, 15 bp, Homo sapiens
atatacatgtgtgta

SEQ ID NO: 541350 - DNA, 16 bp, Homo sapiens
atatacatgtgtgtat

SEQ ID NO: 541351 - DNA, 23 bp, Homo sapiens
atatacatttttagcctgtgtca

SEQ ID NO: 541352 - DNA, 14 bp, Homo sapiens
atatacctataatg

SEQ ID NO: 541353 - DNA, 22 bp, Homo sapiens
atgcctttctagcaattgcttc

SEQ ID NO: 541354 - DNA, 14 bp, Homo sapiens
atgcgatgtcatat

SEQ ID NO: 541355 - DNA, 18 bp, Homo sapiens
atgcgcaaatacaaaatg

SEQ ID NO: 541356 - DNA, 15 bp, Homo sapiens
atgcggccggcctgg

SEQ ID NO: 541357 - DNA, 16 bp, Homo sapiens
atgcggccggcctggg

SEQ ID NO: 541358 - DNA, 17 bp, Homo sapiens
atgcgggctgggcagct

SEQ ID NO: 541359 - DNA, 18 bp, Homo sapiens
atgcgggctgggcagctg

SEQ ID NO: 541360 - DNA, 22 bp, Homo sapiens
atgctatcagaaattcgcccca

SEQ ID NO: 541361 - DNA, 14 bp, Homo sapiens
atgctccctcatgc

SEQ ID NO: 541362 - DNA, 15 bp, Homo sapiens
atgctgcccctgcct

SEQ ID NO: 541363 - DNA, 22 bp, Homo sapiens
atgctggacattaacaagatca

SEQ ID NO: 541364 - DNA, 11 bp, Homo sapiens
atgcttagctt

SEQ ID NO: 541365 - DNA, 16 bp, Homo sapiens
atgcttagcttatctt

SEQ ID NO: 541366 - DNA, 17 bp, Homo sapiens
atgcttagcttatcttt

SEQ ID NO: 541367 - DNA, 22 bp, Homo sapiens
atgctttccatatttttttcct

SEQ ID NO: 541368 - DNA, 23 bp, Homo sapiens
atgctttccatatttttttcctt

SEQ ID NO: 541369 - DNA, 22 bp, Homo sapiens
atggaactcagctgtctgtggc

SEQ ID NO: 541370 - DNA, 14 bp, Homo sapiens
atggaagacaaata

SEQ ID NO: 541371 - DNA, 17 bp, Homo sapiens
atggaagacaaatacac

SEQ ID NO: 541372 - DNA, 19 bp, Homo sapiens
atggaagacaaatacacat

SEQ ID NO: 541373 - DNA, 12 bp, Homo sapiens
atggaagagaaa

SEQ ID NO: 541374 - DNA, 14 bp, Homo sapiens
atggaagagaaatc

SEQ ID NO: 541375 - DNA, 17 bp, Homo sapiens
atggaagagaaatctca

SEQ ID NO: 541376 - DNA, 14 bp, Homo sapiens
atggaatatcagaa

SEQ ID NO: 541377 - DNA, 15 bp, Homo sapiens
atggaatatcagaag

SEQ ID NO: 541378 - DNA, 18 bp, Homo sapiens
atggacaatttaccacag

SEQ ID NO: 541379 - DNA, 21 bp, Homo sapiens
atggagtccagacctgggccc

SEQ ID NO: 541380 - DNA, 22 bp, Homo sapiens
atggagtccagacctgggccct

SEQ ID NO: 541381 - DNA, 16 bp, Homo sapiens
atggatacttcctggg

SEQ ID NO: 541382 - DNA, 15 bp, Homo sapiens
atggatggcacaatg

SEQ ID NO: 541383 - DNA, 21 bp, Homo sapiens
atggatggcacaatgaatgta

SEQ ID NO: 541384 - DNA, 23 bp, Homo sapiens
atggattgggtatcaaaatgaat

SEQ ID NO: 541385 - DNA, 12 bp, Homo sapiens
atggcacaatga

SEQ ID NO: 541386 - DNA, 19 bp, Homo sapiens
atggcacagggcatgaaat

SEQ ID NO: 541387 - DNA, 20 bp, Homo sapiens
atggcatttagcacagtatt

SEQ ID NO: 541388 - DNA, 21 bp, Homo sapiens
atggcatttagcacagtattt

SEQ ID NO: 541389 - DNA, 20 bp, Homo sapiens
atggcgcacccggcagcccc

SEQ ID NO: 541390 - DNA, 22 bp, Homo sapiens
atggcgcacccggcagcccccc

SEQ ID NO: 541391 - DNA, 18 bp, Homo sapiens
atggcgtgtcccctgcct

SEQ ID NO: 541392 - DNA, 19 bp, Homo sapiens
atggcgtgtcccctgcctg

SEQ ID NO: 541393 - DNA, 22 bp, Homo sapiens
atggctttcaatacccttttaa

SEQ ID NO: 541394 - DNA, 21 bp, Homo sapiens
atgggagtcagggagccctgg

SEQ ID NO: 541395 - DNA, 14 bp, Homo sapiens
atgggccttttctt

SEQ ID NO: 541396 - DNA, 20 bp, Homo sapiens
atgggccttttcttgaataa

SEQ ID NO: 541397 - DNA, 21 bp, Homo sapiens
atgggccttttcttgaataaa

SEQ ID NO: 541398 - DNA, 17 bp, Homo sapiens
atggggttgggctctgc

SEQ ID NO: 541399 - DNA, 22 bp, Homo sapiens
atgggtagggctctgacaaagc

SEQ ID NO: 541400 - DNA, 23 bp, Homo sapiens
atgggtagggctctgacaaagct

SEQ ID NO: 541401 - DNA, 13 bp, Homo sapiens
atggtaacttttg

SEQ ID NO: 541402 - DNA, 15 bp, Homo sapiens
atggtaacttttgta

SEQ ID NO: 541403 - DNA, 19 bp, Homo sapiens
atggtaacttttgtagtct

SEQ ID NO: 541404 - DNA, 13 bp, Homo sapiens
atggtatctcttt

SEQ ID NO: 541405 - DNA, 20 bp, Homo sapiens
atggtgaaaccccatctcta

SEQ ID NO: 541406 - DNA, 21 bp, Homo sapiens
atggtgaaaccccatctctac

SEQ ID NO: 541407 - DNA, 14 bp, Homo sapiens
atggtgcaatttgt

SEQ ID NO: 541408 - DNA, 22 bp, Homo sapiens
atggtgcaatttgtctttggaa

SEQ ID NO: 541409 - DNA, 13 bp, Homo sapiens
atgtaaactttaa

SEQ ID NO: 541410 - DNA, 18 bp, Homo sapiens
atgtaactgttaccattg

SEQ ID NO: 541411 - DNA, 20 bp, Homo sapiens
atgtacaaaaaaaaaaccct

SEQ ID NO: 541412 - DNA, 17 bp, Homo sapiens
atgtacaaaaacacaaa

SEQ ID NO: 541413 - DNA, 20 bp, Homo sapiens
atgtagactatatacatgtg

SEQ ID NO: 541414 - DNA, 23 bp, Homo sapiens
atgtagactatatacatgtgtgt

SEQ ID NO: 541415 - DNA, 18 bp, Homo sapiens
atgtatacgcacgcaccc

SEQ ID NO: 541416 - DNA, 18 bp, Homo sapiens
atgtatagtatttgaaaa

SEQ ID NO: 541417 - DNA, 22 bp, Homo sapiens
atgtatattttgtgttattcgt

SEQ ID NO: 541418 - DNA, 15 bp, Homo sapiens
atgtatgtgtatatg

SEQ ID NO: 541419 - DNA, 16 bp, Homo sapiens
atgtatgtgtatatgt

SEQ ID NO: 541420 - DNA, 17 bp, Homo sapiens
atgtatgtgtatatgtt

SEQ ID NO: 541421 - DNA, 18 bp, Homo sapiens
atgtatgtgtatatgttt

SEQ ID NO: 541422 - DNA, 19 bp, Homo sapiens
atgtatgtgtatatgttta

SEQ ID NO: 541423 - DNA, 20 bp, Homo sapiens
atgtatgtgtatatgtttat

SEQ ID NO: 541424 - DNA, 17 bp, Homo sapiens
atgtatgtttacactgt

SEQ ID NO: 541425 - DNA, 20 bp, Homo sapiens
atgtatgtttacactgtcaa

SEQ ID NO: 541426 - DNA, 21 bp, Homo sapiens
atgtatgtttacactgtcaaa

SEQ ID NO: 541427 - DNA, 13 bp, Homo sapiens
atgtattttgtga

SEQ ID NO: 541428 - DNA, 14 bp, Homo sapiens
atgtattttgtgag

SEQ ID NO: 541429 - DNA, 17 bp, Homo sapiens
atgtattttgtgagttt

SEQ ID NO: 541430 - DNA, 14 bp, Homo sapiens
atgtcactgttata

SEQ ID NO: 541431 - DNA, 16 bp, Homo sapiens
atgtcactgttataaa

SEQ ID NO: 541432 - DNA, 20 bp, Homo sapiens
atgtcactgttataaatttt

SEQ ID NO: 541433 - DNA, 15 bp, Homo sapiens
atgtcattaatgtgt

SEQ ID NO: 541434 - DNA, 13 bp, Homo sapiens
atgtcatttcatg

SEQ ID NO: 541435 - DNA, 14 bp, Homo sapiens
atgtcatttcatgt

SEQ ID NO: 541436 - DNA, 19 bp, Homo sapiens
atgtccaaacttaacagat

SEQ ID NO: 541437 - DNA, 19 bp, Homo sapiens
atgtccatatctaaccagt

SEQ ID NO: 541438 - DNA, 17 bp, Homo sapiens
atgtccctttcttctcc

SEQ ID NO: 541439 - DNA, 18 bp, Homo sapiens
atgtccctttcttctccc

SEQ ID NO: 541440 - DNA, 20 bp, Homo sapiens
atgtcccttttcctaagtca

SEQ ID NO: 541441 - DNA, 11 bp, Homo sapiens
atgtcctgtgt

SEQ ID NO: 541442 - DNA, 13 bp, Homo sapiens
atgtcctgtgtca

SEQ ID NO: 541443 - DNA, 18 bp, Homo sapiens
atgtcctgtgtcagttta

SEQ ID NO: 541444 - DNA, 14 bp, Homo sapiens
atgtctcaaaataa

SEQ ID NO: 541445 - DNA, 22 bp, Homo sapiens
atgtctcaaaataaaaccagaa

SEQ ID NO: 541446 - DNA, 16 bp, Homo sapiens
atgtctcgctagtgat

SEQ ID NO: 541447 - DNA, 14 bp, Homo sapiens
atgtcttcatgttg

SEQ ID NO: 541448 - DNA, 13 bp, Homo sapiens
atgtcttggtact

SEQ ID NO: 541449 - DNA, 18 bp, Homo sapiens
atgtcttggtacttgctg

SEQ ID NO: 541450 - DNA, 23 bp, Homo sapiens
atgtcttggtacttgctgctatt

SEQ ID NO: 541451 - DNA, 20 bp, Homo sapiens
atgtgaactttctcagcata

SEQ ID NO: 541452 - DNA, 23 bp, Homo sapiens
atgtgaactttctcagcatatat

SEQ ID NO: 541453 - DNA, 16 bp, Homo sapiens
atgtttaagcagaatt

SEQ ID NO: 541454 - DNA, 22 bp, Homo sapiens
atgtttaagcagaattggaaaa

SEQ ID NO: 541455 - DNA, 18 bp, Homo sapiens
atgtttgatgtccccaaa

SEQ ID NO: 541456 - DNA, 16 bp, Homo sapiens
atgttttatatgatta

SEQ ID NO: 541457 - DNA, 21 bp, Homo sapiens
atgttttccccaattatcctc

SEQ ID NO: 541458 - DNA, 18 bp, Homo sapiens
atgttttgtaaactttga

SEQ ID NO: 541459 - DNA, 12 bp, Homo sapiens
atgtttttaaaa

SEQ ID NO: 541460 - DNA, 16 bp, Homo sapiens
atgtttttaaaatctt

SEQ ID NO: 541461 - DNA, 20 bp, Homo sapiens
atgtttttatgatatccctg

SEQ ID NO: 541462 - DNA, 16 bp, Homo sapiens
atgtttttcagttcaa

SEQ ID NO: 541463 - DNA, 13 bp, Homo sapiens
attaaaaagtctt

SEQ ID NO: 541464 - DNA, 18 bp, Homo sapiens
attaaaaagtcttttaaa

SEQ ID NO: 541465 - DNA, 23 bp, Homo sapiens
attaaaaagtcttttaaaaagta

SEQ ID NO: 541466 - DNA, 12 bp, Homo sapiens
attaaaatatgc

SEQ ID NO: 541467 - DNA, 14 bp, Homo sapiens
attaaaatctgatg

SEQ ID NO: 541468 - DNA, 15 bp, Homo sapiens
attaaactgatgggt

SEQ ID NO: 541469 - DNA, 12 bp, Homo sapiens
attaaagtttca

SEQ ID NO: 541470 - DNA, 14 bp, Homo sapiens
attaaagtttcaaa

SEQ ID NO: 541471 - DNA, 18 bp, Homo sapiens
attaaagtttcaaaaatc

SEQ ID NO: 541472 - DNA, 18 bp, Homo sapiens
attaaattatcattgttt

SEQ ID NO: 541473 - DNA, 15 bp, Homo sapiens
attaaccaaggtaga

SEQ ID NO: 541474 - DNA, 18 bp, Homo sapiens
attaacttctattttcaa

SEQ ID NO: 541475 - DNA, 20 bp, Homo sapiens
attaacttctattttcaagt

SEQ ID NO: 541476 - DNA, 12 bp, Homo sapiens
attaagaaaccc

SEQ ID NO: 541477 - DNA, 14 bp, Homo sapiens
attaaggaaatgtt

SEQ ID NO: 541478 - DNA, 15 bp, Homo sapiens
attaaggtgatgtga

SEQ ID NO: 541479 - DNA, 19 bp, Homo sapiens
attaatacctgacctcaca

SEQ ID NO: 541480 - DNA, 16 bp, Homo sapiens
attaatgtgtaaaatt

SEQ ID NO: 541481 - DNA, 15 bp, Homo sapiens
attaatgttgatttc

SEQ ID NO: 541482 - DNA, 14 bp, Homo sapiens
attacaatatttct

SEQ ID NO: 541483 - DNA, 15 bp, Homo sapiens
attaccaccatcccg

SEQ ID NO: 541484 - DNA, 15 bp, Homo sapiens
attacccttctttcc

SEQ ID NO: 541485 - DNA, 12 bp, Homo sapiens
attacctgaaag

SEQ ID NO: 541486 - DNA, 21 bp, Homo sapiens
attacctggagaagaatggct

SEQ ID NO: 541487 - DNA, 22 bp, Homo sapiens
attactctgcctgtcaagtttt

SEQ ID NO: 541488 - DNA, 14 bp, Homo sapiens
attactgtcccctt

SEQ ID NO: 541489 - DNA, 17 bp, Homo sapiens
attagaaaactttgtta

SEQ ID NO: 541490 - DNA, 16 bp, Homo sapiens
attagcaaaaaaagtt

SEQ ID NO: 541491 - DNA, 20 bp, Homo sapiens
attagcaaaaaaagttgtat

SEQ ID NO: 541492 - DNA, 15 bp, Homo sapiens
attagctgtgatttt

SEQ ID NO: 541493 - DNA, 13 bp, Homo sapiens
attagtactttat

SEQ ID NO: 541494 - DNA, 18 bp, Homo sapiens
attataatcaccagggcc

SEQ ID NO: 541495 - DNA, 12 bp, Homo sapiens
attatatttgga

SEQ ID NO: 541496 - DNA, 17 bp, Homo sapiens
attatatttggatgcag

SEQ ID NO: 541497 - DNA, 17 bp, Homo sapiens
attatcattgtttgtcc

SEQ ID NO: 541498 - DNA, 11 bp, Homo sapiens
attatgctaag

SEQ ID NO: 541499 - DNA, 19 bp, Homo sapiens
attatgtgtgcatgtgtgt

SEQ ID NO: 541500 - DNA, 15 bp, Homo sapiens
attatgttatgaaaa

SEQ ID NO: 541501 - DNA, 16 bp, Homo sapiens
attatgttatgaaaac

SEQ ID NO: 541502 - DNA, 21 bp, Homo sapiens
attattactacaaaaccgttt

SEQ ID NO: 541503 - DNA, 15 bp, Homo sapiens
attcaaacctaagtt

SEQ ID NO: 541504 - DNA, 22 bp, Homo sapiens
attcaaataaccctgaatcaga

SEQ ID NO: 541505 - DNA, 16 bp, Homo sapiens
attcaagaaagccagt

SEQ ID NO: 541506 - DNA, 18 bp, Homo sapiens
attcacatgttttcaaat

SEQ ID NO: 541507 - DNA, 21 bp, Homo sapiens
attcacatgttttcaaatgga

SEQ ID NO: 541508 - DNA, 12 bp, Homo sapiens
attcactttaga

SEQ ID NO: 541509 - DNA, 18 bp, Homo sapiens
attcactttagagtgact

SEQ ID NO: 541510 - DNA, 22 bp, Homo sapiens
attcactttagagtgactaaaa

SEQ ID NO: 541511 - DNA, 15 bp, Homo sapiens
attcacttttattgt

SEQ ID NO: 541512 - DNA, 18 bp, Homo sapiens
attcacttttattgtata

SEQ ID NO: 541513 - DNA, 20 bp, Homo sapiens
attcagataatggtaattta

SEQ ID NO: 541514 - DNA, 15 bp, Homo sapiens
attcaggaccccatc

SEQ ID NO: 541515 - DNA, 20 bp, Homo sapiens
attcaggaccccatctgctg

SEQ ID NO: 541516 - DNA, 15 bp, Homo sapiens
attcatattacaata

SEQ ID NO: 541517 - DNA, 20 bp, Homo sapiens
attcatattacaatatttgt

SEQ ID NO: 541518 - DNA, 17 bp, Homo sapiens
attcatcccttaattta

SEQ ID NO: 541519 - DNA, 18 bp, Homo sapiens
attcatgcaacttgattc

SEQ ID NO: 541520 - DNA, 18 bp, Homo sapiens
attcattaaaaacatttt

SEQ ID NO: 541521 - DNA, 13 bp, Homo sapiens
attcatttcacat

SEQ ID NO: 541522 - DNA, 22 bp, Homo sapiens
attcatttcacattaatggtct

SEQ ID NO: 541523 - DNA, 11 bp, Homo sapiens
attccaaagat

SEQ ID NO: 541524 - DNA, 15 bp, Homo sapiens
attccaagggcccag

SEQ ID NO: 541525 - DNA, 20 bp, Homo sapiens
attccagtcaggctctctgg

SEQ ID NO: 541526 - DNA, 16 bp, Homo sapiens
attccatacttctctc

SEQ ID NO: 541527 - DNA, 17 bp, Homo sapiens
attccatacttctctca

SEQ ID NO: 541528 - DNA, 17 bp, Homo sapiens
attcccaaatctcaaaa

SEQ ID NO: 541529 - DNA, 17 bp, Homo sapiens
attccctcgtctttccc

SEQ ID NO: 541530 - DNA, 15 bp, Homo sapiens
attcgagctatattt

SEQ ID NO: 541531 - DNA, 15 bp, Homo sapiens
attcgggccccacct

SEQ ID NO: 541532 - DNA, 18 bp, Homo sapiens
attctaatggtaactttt

SEQ ID NO: 541533 - DNA, 19 bp, Homo sapiens
attctaatggtaacttttg

SEQ ID NO: 541534 - DNA, 21 bp, Homo sapiens
attctaatggtaacttttgta

SEQ ID NO: 541535 - DNA, 14 bp, Homo sapiens
attctatgtaactt

SEQ ID NO: 541536 - DNA, 16 bp, Homo sapiens
attctatgtaacttgt

SEQ ID NO: 541537 - DNA, 21 bp, Homo sapiens
attctcaagggacgtcctcca

SEQ ID NO: 541538 - DNA, 14 bp, Homo sapiens
attctcagtttttc

SEQ ID NO: 541539 - DNA, 18 bp, Homo sapiens
attctcagtttttcttaa

SEQ ID NO: 541540 - DNA, 14 bp, Homo sapiens
attctctgtacata

SEQ ID NO: 541541 - DNA, 12 bp, Homo sapiens
attctgaagtta

SEQ ID NO: 541542 - DNA, 22 bp, Homo sapiens
attctgaagttatatttcctat

SEQ ID NO: 541543 - DNA, 23 bp, Homo sapiens
attctgcagaaaattaattgaaa

SEQ ID NO: 541544 - DNA, 15 bp, Homo sapiens
attctggcactttaa

SEQ ID NO: 541545 - DNA, 17 bp, Homo sapiens
attcttagttaatcttt

SEQ ID NO: 541546 - DNA, 22 bp, Homo sapiens
attcttataacattgtatgtta

SEQ ID NO: 541547 - DNA, 19 bp, Homo sapiens
attcttgtgattgactttt

SEQ ID NO: 541548 - DNA, 19 bp, Homo sapiens
attgtccagagctgcttcc

SEQ ID NO: 541549 - DNA, 23 bp, Homo sapiens
attgtccagagctgcttccccgt

SEQ ID NO: 541550 - DNA, 21 bp, Homo sapiens
attgtgttttcttcgtggatt

SEQ ID NO: 541551 - DNA, 15 bp, Homo sapiens
attgttaattgctga

SEQ ID NO: 541552 - DNA, 16 bp, Homo sapiens
attgttgctccctgtg

SEQ ID NO: 541553 - DNA, 15 bp, Homo sapiens
atttaaaacatttca

SEQ ID NO: 541554 - DNA, 19 bp, Homo sapiens
atttaaaacatttcatgta

SEQ ID NO: 541555 - DNA, 22 bp, Homo sapiens
atttaaaacatttcatgtattt

SEQ ID NO: 541556 - DNA, 16 bp, Homo sapiens
atttaaacccaatcag

SEQ ID NO: 541557 - DNA, 22 bp, Homo sapiens
atttaacatctgcagtgttctg

SEQ ID NO: 541558 - DNA, 23 bp, Homo sapiens
atttaacatctgcagtgttctgt

SEQ ID NO: 541559 - DNA, 13 bp, Homo sapiens
atttaacatgcaa

SEQ ID NO: 541560 - DNA, 13 bp, Homo sapiens
atttaagcacaaa

SEQ ID NO: 541561 - DNA, 15 bp, Homo sapiens
atttaagtattcaag

SEQ ID NO: 541562 - DNA, 17 bp, Homo sapiens
atttaagtggactgtat

SEQ ID NO: 541563 - DNA, 19 bp, Homo sapiens
atttaagtggactgtattt

SEQ ID NO: 541564 - DNA, 16 bp, Homo sapiens
atttacagtctctttc

SEQ ID NO: 541565 - DNA, 17 bp, Homo sapiens
atttacagtctctttct

SEQ ID NO: 541566 - DNA, 19 bp, Homo sapiens
atttacagtctctttcttc

SEQ ID NO: 541567 - DNA, 20 bp, Homo sapiens
atttaccacaggatgcatat

SEQ ID NO: 541568 - DNA, 18 bp, Homo sapiens
atttaccagggatgtaga

SEQ ID NO: 541569 - DNA, 14 bp, Homo sapiens
atttacctttggaa

SEQ ID NO: 541570 - DNA, 17 bp, Homo sapiens
atttacctttggaattg

SEQ ID NO: 541571 - DNA, 13 bp, Homo sapiens
atttactaacagt

SEQ ID NO: 541572 - DNA, 19 bp, Homo sapiens
atttactaacagtaactgc

SEQ ID NO: 541573 - DNA, 22 bp, Homo sapiens
atttactaacagtaactgccat

SEQ ID NO: 541574 - DNA, 23 bp, Homo sapiens
atttactaacagtaactgccatt

SEQ ID NO: 541575 - DNA, 14 bp, Homo sapiens
atttagcacagtat

SEQ ID NO: 541576 - DNA, 17 bp, Homo sapiens
atttagcacagtattta

SEQ ID NO: 541577 - DNA, 18 bp, Homo sapiens
atttagcacagtatttaa

SEQ ID NO: 541578 - DNA, 15 bp, Homo sapiens
atttagtcctcacct

SEQ ID NO: 541579 - DNA, 15 bp, Homo sapiens
atttataacattgta

SEQ ID NO: 541580 - DNA, 19 bp, Homo sapiens
atttatctgttgtcccctt

SEQ ID NO: 541581 - DNA, 20 bp, Homo sapiens
atttatctttatacagattt

SEQ ID NO: 541582 - DNA, 14 bp, Homo sapiens
atttatgaagcaga

SEQ ID NO: 541583 - DNA, 19 bp, Homo sapiens
atttatgaagcagatttat

SEQ ID NO: 541584 - DNA, 16 bp, Homo sapiens
atttattctgggaatg

SEQ ID NO: 541585 - DNA, 15 bp, Homo sapiens
atttattgaggaaaa

SEQ ID NO: 541586 - DNA, 21 bp, Homo sapiens
atttattgaggaaaaatatgt

SEQ ID NO: 541587 - DNA, 18 bp, Homo sapiens
atttcaaaagacatgttg

SEQ ID NO: 541588 - DNA, 21 bp, Homo sapiens
atttcaaaagacatgttgtaa

SEQ ID NO: 541589 - DNA, 23 bp, Homo sapiens
atttcaaaatggtaactttacaa

SEQ ID NO: 541590 - DNA, 15 bp, Homo sapiens
atttcacaaatatta

SEQ ID NO: 541591 - DNA, 23 bp, Homo sapiens
atttcacaaatattaaaaagtct

SEQ ID NO: 541592 - DNA, 18 bp, Homo sapiens
atttcacattaatggtct

SEQ ID NO: 541593 - DNA, 22 bp, Homo sapiens
atttcacattaatggtctaaaa

SEQ ID NO: 541594 - DNA, 18 bp, Homo sapiens
atttcacgtcataggaag

SEQ ID NO: 541595 - DNA, 21 bp, Homo sapiens
atttcagtaagatcaagctcc

SEQ ID NO: 541596 - DNA, 22 bp, Homo sapiens
atttcagttattgtccctggct

SEQ ID NO: 541597 - DNA, 15 bp, Homo sapiens
atttcataagcacat

SEQ ID NO: 541598 - DNA, 20 bp, Homo sapiens
atttcatcctttcacttctt

SEQ ID NO: 541599 - DNA, 18 bp, Homo sapiens
atttcatgtatttcttta

SEQ ID NO: 541600 - DNA, 21 bp, Homo sapiens
atttcatgtatttctttagaa

SEQ ID NO: 541601 - DNA, 21 bp, Homo sapiens
atttcatgtcctgtgtcagtt

SEQ ID NO: 541602 - DNA, 22 bp, Homo sapiens
atttcatgtcctgtgtcagttt

SEQ ID NO: 541603 - DNA, 19 bp, Homo sapiens
atttccaagtaatataatg

SEQ ID NO: 541604 - DNA, 15 bp, Homo sapiens
atttccatgtatgca

SEQ ID NO: 541605 - DNA, 17 bp, Homo sapiens
atttccatgtatgcata

SEQ ID NO: 541606 - DNA, 18 bp, Homo sapiens
atttcctgtacaatcatg

SEQ ID NO: 541607 - DNA, 21 bp, Homo sapiens
atttcctttttctattttacc

SEQ ID NO: 541608 - DNA, 20 bp, Homo sapiens
atttcggaccgaaggtgaca

SEQ ID NO: 541609 - DNA, 14 bp, Homo sapiens
atttcggctatgtc

SEQ ID NO: 541610 - DNA, 15 bp, Homo sapiens
atttcggctatgtct

SEQ ID NO: 541611 - DNA, 15 bp, Homo sapiens
atttctaactctgat

SEQ ID NO: 541612 - DNA, 16 bp, Homo sapiens
atttctaactctgatg

SEQ ID NO: 541613 - DNA, 23 bp, Homo sapiens
atttctaactctgatgtaaatga

SEQ ID NO: 541614 - DNA, 16 bp, Homo sapiens
atttctagttatttat

SEQ ID NO: 541615 - DNA, 18 bp, Homo sapiens
atttctagttatttattc

SEQ ID NO: 541616 - DNA, 10 bp, Homo sapiens
atttctcctt

SEQ ID NO: 541617 - DNA, 17 bp, Homo sapiens
atttctccttttgtgtt

SEQ ID NO: 541618 - DNA, 19 bp, Homo sapiens
atttctctggggtctgtga

SEQ ID NO: 541619 - DNA, 22 bp, Homo sapiens
atttctgaacaaagagagctca

SEQ ID NO: 541620 - DNA, 18 bp, Homo sapiens
atttctgtatctgacata

SEQ ID NO: 541621 - DNA, 11 bp, Homo sapiens
atttcttcctt

SEQ ID NO: 541622 - DNA, 12 bp, Homo sapiens
atttcttccttc

SEQ ID NO: 541623 - DNA, 15 bp, Homo sapiens
atttcttgcaatttg

SEQ ID NO: 541624 - DNA, 19 bp, Homo sapiens
atttcttgcaatttgaagg

SEQ ID NO: 541625 - DNA, 19 bp, Homo sapiens
atttcttggtatgatcatt

SEQ ID NO: 541626 - DNA, 20 bp, Homo sapiens
atttgaaaacagaaattggt

SEQ ID NO: 541627 - DNA, 15 bp, Homo sapiens
atttgactgttattt

SEQ ID NO: 541628 - DNA, 13 bp, Homo sapiens
atttgatgtaagt

SEQ ID NO: 541629 - DNA, 14 bp, Homo sapiens
atttgatgtaagtt

SEQ ID NO: 541630 - DNA, 17 bp, Homo sapiens
atttgatgtaagttact

SEQ ID NO: 541631 - DNA, 18 bp, Homo sapiens
atttgcaacagcaaatta

SEQ ID NO: 541632 - DNA, 23 bp, Homo sapiens
atttgcagataattctggaccag

SEQ ID NO: 541633 - DNA, 18 bp, Homo sapiens
atttgcataatatgcata

SEQ ID NO: 541634 - DNA, 17 bp, Homo sapiens
atttggaccattttcct

SEQ ID NO: 541635 - DNA, 14 bp, Homo sapiens
atttggtctctatt

SEQ ID NO: 541636 - DNA, 17 bp, Homo sapiens
atttgtaaaacagtggt

SEQ ID NO: 541637 - DNA, 17 bp, Homo sapiens
atttgtcattttcatta

SEQ ID NO: 541638 - DNA, 21 bp, Homo sapiens
atttgtcattttcattagcaa

SEQ ID NO: 541639 - DNA, 20 bp, Homo sapiens
atttgtctttggaaaattca

SEQ ID NO: 541640 - DNA, 16 bp, Homo sapiens
atttgtgaaagtgcca

SEQ ID NO: 541641 - DNA, 14 bp, Homo sapiens
atttgtgtaactga

SEQ ID NO: 541642 - DNA, 14 bp, Homo sapiens
atttgtgtgctaaa

SEQ ID NO: 541643 - DNA, 15 bp, Homo sapiens
atttgttaatttctt

SEQ ID NO: 541644 - DNA, 16 bp, Homo sapiens
atttgttgattctctc

SEQ ID NO: 541645 - DNA, 21 bp, Homo sapiens
atttgtttggttatagtgcaa

SEQ ID NO: 541646 - DNA, 20 bp, Homo sapiens
atttgttttcttcaacatgt

SEQ ID NO: 541647 - DNA, 16 bp, Homo sapiens
attttaaaaaatgaaa

SEQ ID NO: 541648 - DNA, 23 bp, Homo sapiens
attttaaaaaatgaaaataagtg

SEQ ID NO: 541649 - DNA, 16 bp, Homo sapiens
attttaagaagttgct

SEQ ID NO: 541650 - DNA, 19 bp, Homo sapiens
attttaagaagttgctgca

SEQ ID NO: 541651 - DNA, 17 bp, Homo sapiens
attttaagctaggaaaa

SEQ ID NO: 541652 - DNA, 20 bp, Homo sapiens
attttaagctaggaaaagaa

SEQ ID NO: 541653 - DNA, 22 bp, Homo sapiens
attttaagctaggaaaagaaat

SEQ ID NO: 541654 - DNA, 17 bp, Homo sapiens
attttaccactaatttt

SEQ ID NO: 541655 - DNA, 19 bp, Homo sapiens
attttaccactaattttgt

SEQ ID NO: 541656 - DNA, 20 bp, Homo sapiens
attttaccactaattttgtt

SEQ ID NO: 541657 - DNA, 15 bp, Homo sapiens
attttactgtcttaa

SEQ ID NO: 541658 - DNA, 20 bp, Homo sapiens
attttagtggaccctgaaat

SEQ ID NO: 541659 - DNA, 21 bp, Homo sapiens
attttagtggaccctgaaatg

SEQ ID NO: 541660 - DNA, 23 bp, Homo sapiens
attttagtggaccctgaaatgtg

SEQ ID NO: 541661 - DNA, 14 bp, Homo sapiens
attttagttttatt

SEQ ID NO: 541662 - DNA, 19 bp, Homo sapiens
attttataagcacagacaa

SEQ ID NO: 541663 - DNA, 20 bp, Homo sapiens
attttataagcacagacaat

SEQ ID NO: 541664 - DNA, 23 bp, Homo sapiens
attttataagcacagacaattct

SEQ ID NO: 541665 - DNA, 18 bp, Homo sapiens
attttataaggacttcct

SEQ ID NO: 541666 - DNA, 20 bp, Homo sapiens
attttataaggacttcctga

SEQ ID NO: 541667 - DNA, 16 bp, Homo sapiens
attttatgtatgttta

SEQ ID NO: 541668 - DNA, 22 bp, Homo sapiens
attttatgtatgtttacactgt

SEQ ID NO: 541669 - DNA, 13 bp, Homo sapiens
attttatgttgac

SEQ ID NO: 541670 - DNA, 17 bp, Homo sapiens
attttatgttgacattt

SEQ ID NO: 541671 - DNA, 12 bp, Homo sapiens
attttatgttta

SEQ ID NO: 541672 - DNA, 14 bp, Homo sapiens
attttatgtttaaa

SEQ ID NO: 541673 - DNA, 17 bp, Homo sapiens
attttatgtttaaaatg

SEQ ID NO: 541674 - DNA, 16 bp, Homo sapiens
attttattgaatataa

SEQ ID NO: 541675 - DNA, 23 bp, Homo sapiens
attttattgaatataatggcctc

SEQ ID NO: 541676 - DNA, 19 bp, Homo sapiens
attttcaaatatgtaaact

SEQ ID NO: 541677 - DNA, 19 bp, Homo sapiens
attttcagatttgcacaaa

SEQ ID NO: 541678 - DNA, 20 bp, Homo sapiens
attttcagatttgcacaaaa

SEQ ID NO: 541679 - DNA, 11 bp, Homo sapiens
attttcatgtg

SEQ ID NO: 541680 - DNA, 13 bp, Homo sapiens
attttcatgtgtg

SEQ ID NO: 541681 - DNA, 18 bp, Homo sapiens
attttcatttctaacata

SEQ ID NO: 541682 - DNA, 17 bp, Homo sapiens
attttccagggcaatca

SEQ ID NO: 541683 - DNA, 21 bp, Homo sapiens
attttcccccttgcagttatg

SEQ ID NO: 541684 - DNA, 15 bp, Homo sapiens
attttcctttatgtg

SEQ ID NO: 541685 - DNA, 20 bp, Homo sapiens
attttctgaaactaatgaaa

SEQ ID NO: 541686 - DNA, 21 bp, Homo sapiens
attttctgaaactaatgaaag

SEQ ID NO: 541687 - DNA, 12 bp, Homo sapiens
attttgaaatat

SEQ ID NO: 541688 - DNA, 18 bp, Homo sapiens
attttgcagctatggaca

SEQ ID NO: 541689 - DNA, 18 bp, Homo sapiens
attttggacgtgtgagga

SEQ ID NO: 541690 - DNA, 12 bp, Homo sapiens
attttgtatgca

SEQ ID NO: 541691 - DNA, 16 bp, Homo sapiens
attttgtcactgctgt

SEQ ID NO: 541692 - DNA, 22 bp, Homo sapiens
attttgtcactgctgtaaagca

SEQ ID NO: 541693 - DNA, 20 bp, Homo sapiens
attttgtctgcttagtatct

SEQ ID NO: 541694 - DNA, 15 bp, Homo sapiens
attttgttttaaact

SEQ ID NO: 541695 - DNA, 18 bp, Homo sapiens
atttttcagctctctgta

SEQ ID NO: 541696 - DNA, 12 bp, Homo sapiens
atttttcatatt

SEQ ID NO: 541697 - DNA, 20 bp, Homo sapiens
atttttcttaaaaagtaact

SEQ ID NO: 541698 - DNA, 18 bp, Homo sapiens
atttttgatcaaatgtac

SEQ ID NO: 541699 - DNA, 19 bp, Homo sapiens
atttttgatcaaatgtaca

SEQ ID NO: 541700 - DNA, 22 bp, Homo sapiens
atttttggtgggtgaaaggaat

SEQ ID NO: 541701 - DNA, 17 bp, Homo sapiens
attttttaaaagaaatt

SEQ ID NO: 541702 - DNA, 16 bp, Homo sapiens
attttttaaaattcta

SEQ ID NO: 541703 - DNA, 14 bp, Homo sapiens
attttttcctacca

SEQ ID NO: 541704 - DNA, 14 bp, Homo sapiens
atttttttaagcaa

SEQ ID NO: 541705 - DNA, 12 bp, Homo sapiens
atttttttcctt

SEQ ID NO: 541706 - DNA, 15 bp, Homo sapiens
atttttttccttaca

SEQ ID NO: 541707 - DNA, 23 bp, Homo sapiens
atttttttttttgtttctgagaa

SEQ ID NO: 541708 - DNA, 13 bp, Homo sapiens
caaaaaaagcaac

SEQ ID NO: 541709 - DNA, 18 bp, Homo sapiens
caaaaaaagcaacttttc

SEQ ID NO: 541710 - DNA, 20 bp, Homo sapiens
caaaaaaagcaacttttcca

SEQ ID NO: 541711 - DNA, 13 bp, Homo sapiens
caaaaaaagttgt

SEQ ID NO: 541712 - DNA, 17 bp, Homo sapiens
caaaaatctgaagattg

SEQ ID NO: 541713 - DNA, 18 bp, Homo sapiens
caaaaatctgaagattgt

SEQ ID NO: 541714 - DNA, 15 bp, Homo sapiens
caaaagacatgttgt

SEQ ID NO: 541715 - DNA, 21 bp, Homo sapiens
caaaagacatgttgtaaatta

SEQ ID NO: 541716 - DNA, 19 bp, Homo sapiens
caaaagagaaaaaaaatta

SEQ ID NO: 541717 - DNA, 15 bp, Homo sapiens
caaaagatctcctgt

SEQ ID NO: 541718 - DNA, 17 bp, Homo sapiens
caaaaggcatttcccac

SEQ ID NO: 541719 - DNA, 15 bp, Homo sapiens
caaaagggacatgaa

SEQ ID NO: 541720 - DNA, 22 bp, Homo sapiens
caaaagtatcgggggctggggc

SEQ ID NO: 541721 - DNA, 22 bp, Homo sapiens
caaaataaaaagtgacacagca

SEQ ID NO: 541722 - DNA, 15 bp, Homo sapiens
caaaataaaaccaga

SEQ ID NO: 541723 - DNA, 14 bp, Homo sapiens
caaaataaagcttt

SEQ ID NO: 541724 - DNA, 20 bp, Homo sapiens
caaaataaagcttttgcata

SEQ ID NO: 541725 - DNA, 19 bp, Homo sapiens
caaaatacatgatgatttc

SEQ ID NO: 541726 - DNA, 13 bp, Homo sapiens
caaaatataaagc

SEQ ID NO: 541727 - DNA, 15 bp, Homo sapiens
caaaatattatgtta

SEQ ID NO: 541728 - DNA, 16 bp, Homo sapiens
caaaatatttgtgaaa

SEQ ID NO: 541729 - DNA, 17 bp, Homo sapiens
caaaatgattgtctttt

SEQ ID NO: 541730 - DNA, 11 bp, Homo sapiens
caaaatgtaac

SEQ ID NO: 541731 - DNA, 13 bp, Homo sapiens
caaaatgtaactg

SEQ ID NO: 541732 - DNA, 19 bp, Homo sapiens
caaaatgtgtgcttggaaa

SEQ ID NO: 541733 - DNA, 15 bp, Homo sapiens
caaacaaacaagcta

SEQ ID NO: 541734 - DNA, 17 bp, Homo sapiens
caaacaagaatgtccct

SEQ ID NO: 541735 - DNA, 16 bp, Homo sapiens
caaacaagcatataaa

SEQ ID NO: 541736 - DNA, 16 bp, Homo sapiens
caaacagatgctctga

SEQ ID NO: 541737 - DNA, 19 bp, Homo sapiens
caaacatagacagatgtgg

SEQ ID NO: 541738 - DNA, 19 bp, Homo sapiens
caaacatggatacttcctg

SEQ ID NO: 541739 - DNA, 21 bp, Homo sapiens
caaacatggatacttcctggg

SEQ ID NO: 541740 - DNA, 19 bp, Homo sapiens
caaacattaatgttgattt

SEQ ID NO: 541741 - DNA, 22 bp, Homo sapiens
caaacattaatgttgatttcta

SEQ ID NO: 541742 - DNA, 16 bp, Homo sapiens
caaacattagtacttt

SEQ ID NO: 541743 - DNA, 18 bp, Homo sapiens
caaaccaatttcttcctt

SEQ ID NO: 541744 - DNA, 15 bp, Homo sapiens
caaaccaatttgttc

SEQ ID NO: 541745 - DNA, 14 bp, Homo sapiens
caaacccccattct

SEQ ID NO: 541746 - DNA, 16 bp, Homo sapiens
caaaccctatgccttt

SEQ ID NO: 541747 - DNA, 17 bp, Homo sapiens
caaaccctgtcaaacat

SEQ ID NO: 541748 - DNA, 18 bp, Homo sapiens
caaaccctgtcaaacatt

SEQ ID NO: 541749 - DNA, 21 bp, Homo sapiens
caaaccctgtcaaacattagt

SEQ ID NO: 541750 - DNA, 15 bp, Homo sapiens
caaactgcacatgat

SEQ ID NO: 541751 - DNA, 19 bp, Homo sapiens
caaactgcacatgatttca

SEQ ID NO: 541752 - DNA, 21 bp, Homo sapiens
caaactgcacatgatttcaca

SEQ ID NO: 541753 - DNA, 13 bp, Homo sapiens
caaagacaaatag

SEQ ID NO: 541754 - DNA, 15 bp, Homo sapiens
caaagacggtagaga

SEQ ID NO: 541755 - DNA, 13 bp, Homo sapiens
caaagatcaaaat

SEQ ID NO: 541756 - DNA, 17 bp, Homo sapiens
caaagatgaaagctgtt

SEQ ID NO: 541757 - DNA, 22 bp, Homo sapiens
caaagatgaaagctgtttcatt

SEQ ID NO: 541758 - DNA, 18 bp, Homo sapiens
caaagatgttaacagtat

SEQ ID NO: 541759 - DNA, 15 bp, Homo sapiens
caaagcagagagcat

SEQ ID NO: 541760 - DNA, 22 bp, Homo sapiens
caaagcagagtgaaattcaatt

SEQ ID NO: 541761 - DNA, 20 bp, Homo sapiens
caaagcatttgactttctgt

SEQ ID NO: 541762 - DNA, 22 bp, Homo sapiens
caaagctatttaagtggactgt

SEQ ID NO: 541763 - DNA, 16 bp, Homo sapiens
caaagctgttcttcct

SEQ ID NO: 541764 - DNA, 17 bp, Homo sapiens
caaaggagctttctcaa

SEQ ID NO: 541765 - DNA, 18 bp, Homo sapiens
caaaggctgtattcagca

SEQ ID NO: 541766 - DNA, 18 bp, Homo sapiens
caaagtaccacactgagt

SEQ ID NO: 541767 - DNA, 20 bp, Homo sapiens
caaagtaccacactgagttc

SEQ ID NO: 541768 - DNA, 18 bp, Homo sapiens
caaagtcatgatgttttt

SEQ ID NO: 541769 - DNA, 15 bp, Homo sapiens
caagagagcagcaag

SEQ ID NO: 541770 - DNA, 24 bp, Homo sapiens
caagagagggccatgcaattcatc

SEQ ID NO: 541771 - DNA, 22 bp, Homo sapiens
caagaggtttggctcctgccca

SEQ ID NO: 541772 - DNA, 23 bp, Homo sapiens
caagaggtttggctcctgcccac

SEQ ID NO: 541773 - DNA, 19 bp, Homo sapiens
caagagtccaagccatctg

SEQ ID NO: 541774 - DNA, 20 bp, Homo sapiens
caagatcattatcttcatgt

SEQ ID NO: 541775 - DNA, 13 bp, Homo sapiens
caagatggcacag

SEQ ID NO: 541776 - DNA, 23 bp, Homo sapiens
caagattttgtttcttacgcttg

SEQ ID NO: 541777 - DNA, 13 bp, Homo sapiens
caagcacagtcag

SEQ ID NO: 541778 - DNA, 17 bp, Homo sapiens
caagcagacacacacat

SEQ ID NO: 541779 - DNA, 23 bp, Homo sapiens
caagcagacacacacatatatac

SEQ ID NO: 541780 - DNA, 13 bp, Homo sapiens
caagcaggaggct

SEQ ID NO: 541781 - DNA, 16 bp, Homo sapiens
caagcagtttcaataa

SEQ ID NO: 541782 - DNA, 12 bp, Homo sapiens
caagccagcaag

SEQ ID NO: 541783 - DNA, 20 bp, Homo sapiens
caagcctcagcaaacccaaa

SEQ ID NO: 541784 - DNA, 17 bp, Homo sapiens
caagctataaaagccca

SEQ ID NO: 541785 - DNA, 14 bp, Homo sapiens
caagcttattttgg

SEQ ID NO: 541786 - DNA, 18 bp, Homo sapiens
caaggaaattcctcagca

SEQ ID NO: 541787 - DNA, 21 bp, Homo sapiens
caaggaacaagacccccagga

SEQ ID NO: 541788 - DNA, 18 bp, Homo sapiens
caaggacagaaggctcct

SEQ ID NO: 541789 - DNA, 20 bp, Homo sapiens
caaggacgcttcacaggaca

SEQ ID NO: 541790 - DNA, 15 bp, Homo sapiens
caaggagggagaaag

SEQ ID NO: 541791 - DNA, 20 bp, Homo sapiens
caaggcttgctgcagatact

SEQ ID NO: 541792 - DNA, 21 bp, Homo sapiens
caagggaaaataaaaaaagaa

SEQ ID NO: 541793 - DNA, 13 bp, Homo sapiens
caaggtagaatga

SEQ ID NO: 541794 - DNA, 22 bp, Homo sapiens
caaggtctgtggctcctcccga

SEQ ID NO: 541795 - DNA, 13 bp, Homo sapiens
caaggtcttgctc

SEQ ID NO: 541796 - DNA, 14 bp, Homo sapiens
caaggtgcaggcag

SEQ ID NO: 541797 - DNA, 21 bp, Homo sapiens
caaggttctgggtgcaggagc

SEQ ID NO: 541798 - DNA, 13 bp, Homo sapiens
caagtacaaggac

SEQ ID NO: 541799 - DNA, 19 bp, Homo sapiens
caagtatcatctaaatatt

SEQ ID NO: 541800 - DNA, 20 bp, Homo sapiens
caagtatcatctaaatatta

SEQ ID NO: 541801 - DNA, 23 bp, Homo sapiens
caagtggcaaagctgttcttcct

SEQ ID NO: 541802 - DNA, 19 bp, Homo sapiens
caagttggtcttactttgt

SEQ ID NO: 541803 - DNA, 21 bp, Homo sapiens
caagtttattgccctcaaaat

SEQ ID NO: 541804 - DNA, 20 bp, Homo sapiens
caagttttcataagcacact

SEQ ID NO: 541805 - DNA, 11 bp, Homo sapiens
caagttttgtg

SEQ ID NO: 541806 - DNA, 18 bp, Homo sapiens
caataaaggaggaatcag

SEQ ID NO: 541807 - DNA, 14 bp, Homo sapiens
caataaagtttgat

SEQ ID NO: 541808 - DNA, 20 bp, Homo sapiens
caataaagtttgatcttcct

SEQ ID NO: 541809 - DNA, 14 bp, Homo sapiens
caataagaaacagt

SEQ ID NO: 541810 - DNA, 22 bp, Homo sapiens
caatacccttttaagtttaaaa

SEQ ID NO: 541811 - DNA, 14 bp, Homo sapiens
caataggcttagtg

SEQ ID NO: 541812 - DNA, 13 bp, Homo sapiens
caatatattttgt

SEQ ID NO: 541813 - DNA, 14 bp, Homo sapiens
caatatattttgta

SEQ ID NO: 541814 - DNA, 16 bp, Homo sapiens
caatatattttgtatg

SEQ ID NO: 541815 - DNA, 23 bp, Homo sapiens
caatatcatccccaaatgtgtct

SEQ ID NO: 541816 - DNA, 16 bp, Homo sapiens
caatattctctgtaca

SEQ ID NO: 541817 - DNA, 19 bp, Homo sapiens
caatattctctgtacatat

SEQ ID NO: 541818 - DNA, 15 bp, Homo sapiens
caatattctgtaact

SEQ ID NO: 541819 - DNA, 22 bp, Homo sapiens
caatatttgtgtgctaaacgtg

SEQ ID NO: 541820 - DNA, 22 bp, Homo sapiens
caatcagtagcttaagaaaaaa

SEQ ID NO: 541821 - DNA, 18 bp, Homo sapiens
caatcccaaaagtcacca

SEQ ID NO: 541822 - DNA, 16 bp, Homo sapiens
caatccctgatccctg

SEQ ID NO: 541823 - DNA, 11 bp, Homo sapiens
caatccttaca

SEQ ID NO: 541824 - DNA, 13 bp, Homo sapiens
caatccttacaaa

SEQ ID NO: 541825 - DNA, 23 bp, Homo sapiens
caatctctacccctttcttctcg

SEQ ID NO: 541826 - DNA, 16 bp, Homo sapiens
caatcttttttactct

SEQ ID NO: 541827 - DNA, 20 bp, Homo sapiens
caatgaatgtatattttgtg

SEQ ID NO: 541828 - DNA, 21 bp, Homo sapiens
caatgaatgtatattttgtgt

SEQ ID NO: 541829 - DNA, 13 bp, Homo sapiens
caatgattatttt

SEQ ID NO: 541830 - DNA, 13 bp, Homo sapiens
caatggaaacaat

SEQ ID NO: 541831 - DNA, 19 bp, Homo sapiens
caatgtcttggtacttgct

SEQ ID NO: 541832 - DNA, 13 bp, Homo sapiens
caatgtgccccca

SEQ ID NO: 541833 - DNA, 16 bp, Homo sapiens
caattaagaaattcca

SEQ ID NO: 541834 - DNA, 17 bp, Homo sapiens
caattaattcatccctt

SEQ ID NO: 541835 - DNA, 19 bp, Homo sapiens
caattcaactttttatttt

SEQ ID NO: 541836 - DNA, 23 bp, Homo sapiens
caattcatagaataacaactgct

SEQ ID NO: 541837 - DNA, 11 bp, Homo sapiens
caattcattgt

SEQ ID NO: 541838 - DNA, 13 bp, Homo sapiens
caattcattgtgt

SEQ ID NO: 541839 - DNA, 13 bp, Homo sapiens
caattctccttta

SEQ ID NO: 541840 - DNA, 18 bp, Homo sapiens
caattgtatatatatgtg

SEQ ID NO: 541841 - DNA, 23 bp, Homo sapiens
cacatatatgtatacgcacgcac

SEQ ID NO: 541842 - DNA, 15 bp, Homo sapiens
cacatcatctgtaag

SEQ ID NO: 541843 - DNA, 19 bp, Homo sapiens
cacatcatctgtaagctgt

SEQ ID NO: 541844 - DNA, 14 bp, Homo sapiens
cacatccaactact

SEQ ID NO: 541845 - DNA, 18 bp, Homo sapiens
cacatccacagtctcccc

SEQ ID NO: 541846 - DNA, 21 bp, Homo sapiens
cacatccattcccaagaaatg

SEQ ID NO: 541847 - DNA, 13 bp, Homo sapiens
cacatctctgaaa

SEQ ID NO: 541848 - DNA, 12 bp, Homo sapiens
cacatgcacaca

SEQ ID NO: 541849 - DNA, 13 bp, Homo sapiens
cacatgcacacac

SEQ ID NO: 541850 - DNA, 16 bp, Homo sapiens
cacatgcacacacaca

SEQ ID NO: 541851 - DNA, 18 bp, Homo sapiens
cacatgttttcaaatgga

SEQ ID NO: 541852 - DNA, 22 bp, Homo sapiens
cacattaatggtctaaaaataa

SEQ ID NO: 541853 - DNA, 16 bp, Homo sapiens
cacattctgctgcccc

SEQ ID NO: 541854 - DNA, 21 bp, Homo sapiens
cacattctgctgcccccagac

SEQ ID NO: 541855 - DNA, 13 bp, Homo sapiens
cacattgaaactg

SEQ ID NO: 541856 - DNA, 23 bp, Homo sapiens
cacattgaaactgtatttacttg

SEQ ID NO: 541857 - DNA, 12 bp, Homo sapiens
caccaataaagg

SEQ ID NO: 541858 - DNA, 13 bp, Homo sapiens
caccaataaagga

SEQ ID NO: 541859 - DNA, 15 bp, Homo sapiens
caccaataaaggagg

SEQ ID NO: 541860 - DNA, 13 bp, Homo sapiens
caccacagacaca

SEQ ID NO: 541861 - DNA, 16 bp, Homo sapiens
caccacagacacacac

SEQ ID NO: 541862 - DNA, 19 bp, Homo sapiens
caccacagacacacacacg

SEQ ID NO: 541863 - DNA, 20 bp, Homo sapiens
caccacagacacacacacgc

SEQ ID NO: 541864 - DNA, 17 bp, Homo sapiens
caccaccgaccaactcc

SEQ ID NO: 541865 - DNA, 21 bp, Homo sapiens
caccacctgcccggcccagga

SEQ ID NO: 541866 - DNA, 22 bp, Homo sapiens
caccacctgcccggcccaggag

SEQ ID NO: 541867 - DNA, 16 bp, Homo sapiens
caccagccccaatcca

SEQ ID NO: 541868 - DNA, 17 bp, Homo sapiens
caccaggcccccctgtc

SEQ ID NO: 541869 - DNA, 15 bp, Homo sapiens
caccagttgctgctg

SEQ ID NO: 541870 - DNA, 12 bp, Homo sapiens
cacccacaccct

SEQ ID NO: 541871 - DNA, 13 bp, Homo sapiens
cacccacacccta

SEQ ID NO: 541872 - DNA, 17 bp, Homo sapiens
cacccacaccctacagc

SEQ ID NO: 541873 - DNA, 19 bp, Homo sapiens
cacccaccttgacgtttct

SEQ ID NO: 541874 - DNA, 11 bp, Homo sapiens
cacccagggaa

SEQ ID NO: 541875 - DNA, 12 bp, Homo sapiens
caccccatcctc

SEQ ID NO: 541876 - DNA, 15 bp, Homo sapiens
cacccccttggtgct

SEQ ID NO: 541877 - DNA, 21 bp, Homo sapiens
cacccccttggtgctcgcctt

SEQ ID NO: 541878 - DNA, 18 bp, Homo sapiens
cacccgcatgtacaaaaa

SEQ ID NO: 541879 - DNA, 20 bp, Homo sapiens
caccctccttcccactcttc

SEQ ID NO: 541880 - DNA, 14 bp, Homo sapiens
caccgaccaactcc

SEQ ID NO: 541881 - DNA, 15 bp, Homo sapiens
caccgaccaactcca

SEQ ID NO: 541882 - DNA, 14 bp, Homo sapiens
cacctccccaggcc

SEQ ID NO: 541883 - DNA, 11 bp, Homo sapiens
cacctccccca

SEQ ID NO: 541884 - DNA, 19 bp, Homo sapiens
cacctgacagcccctccct

SEQ ID NO: 541885 - DNA, 23 bp, Homo sapiens
cacctgcacaaacatagacagat

SEQ ID NO: 541886 - DNA, 12 bp, Homo sapiens
cacctgcagctc

SEQ ID NO: 541887 - DNA, 16 bp, Homo sapiens
cacctgcctctgaact

SEQ ID NO: 541888 - DNA, 14 bp, Homo sapiens
cacctgcttctcag

SEQ ID NO: 541889 - DNA, 15 bp, Homo sapiens
cacctgcttctcagc

SEQ ID NO: 541890 - DNA, 18 bp, Homo sapiens
cacctgcttctctgccca

SEQ ID NO: 541891 - DNA, 22 bp, Homo sapiens
cacctggaagccctctctggct

SEQ ID NO: 541892 - DNA, 13 bp, Homo sapiens
cacctggccctgg

SEQ ID NO: 541893 - DNA, 17 bp, Homo sapiens
cacctggccctggggcc

SEQ ID NO: 541894 - DNA, 17 bp, Homo sapiens
cacctgtactggagagc

SEQ ID NO: 541895 - DNA, 15 bp, Homo sapiens
cacctgtctgctcca

SEQ ID NO: 541896 - DNA, 19 bp, Homo sapiens
caccttcagtttttgtgtt

SEQ ID NO: 541897 - DNA, 15 bp, Homo sapiens
caccttcatccagat

SEQ ID NO: 541898 - DNA, 13 bp, Homo sapiens
caccttcccttct

SEQ ID NO: 541899 - DNA, 20 bp, Homo sapiens
caccttcccttctacaagga

SEQ ID NO: 541900 - DNA, 23 bp, Homo sapiens
caccttgacgtttcttctttcta

SEQ ID NO: 541901 - DNA, 18 bp, Homo sapiens
cacgagagcgcagcatcc

SEQ ID NO: 541902 - DNA, 12 bp, Homo sapiens
cacgcacacaca

SEQ ID NO: 541903 - DNA, 15 bp, Homo sapiens
cacgcacccacaccc

SEQ ID NO: 541904 - DNA, 16 bp, Homo sapiens
cacgcacccacaccct

SEQ ID NO: 541905 - DNA, 20 bp, Homo sapiens
cacgcacccacaccctacag

SEQ ID NO: 541906 - DNA, 16 bp, Homo sapiens
cacgcacgcacacaca

SEQ ID NO: 541907 - DNA, 13 bp, Homo sapiens
cacgcagacacac

SEQ ID NO: 541908 - DNA, 21 bp, Homo sapiens
cacggaggctcgtgcatgtaa

SEQ ID NO: 541909 - DNA, 12 bp, Homo sapiens
cacggcctcctt

SEQ ID NO: 541910 - DNA, 12 bp, Homo sapiens
cacggcctctgg

SEQ ID NO: 541911 - DNA, 18 bp, Homo sapiens
cacggcctctggggagac

SEQ ID NO: 541912 - DNA, 17 bp, Homo sapiens
cacgtagtagggtcagg

SEQ ID NO: 541913 - DNA, 19 bp, Homo sapiens
cacgtgactcctcaattcc

SEQ ID NO: 541914 - DNA, 12 bp, Homo sapiens
cacgtgtatatg

SEQ ID NO: 541915 - DNA, 23 bp, Homo sapiens
cacgtgtatatgaggatgtatgt

SEQ ID NO: 541916 - DNA, 13 bp, Homo sapiens
cacgttcacccct

SEQ ID NO: 541917 - DNA, 20 bp, Homo sapiens
cacgttccttcccccgcaat

SEQ ID NO: 541918 - DNA, 13 bp, Homo sapiens
cactaattttgtt

SEQ ID NO: 541919 - DNA, 18 bp, Homo sapiens
cactaattttgttttaaa

SEQ ID NO: 541920 - DNA, 20 bp, Homo sapiens
cactaattttgttttaaact

SEQ ID NO: 541921 - DNA, 23 bp, Homo sapiens
cactaattttgttttaaactgtg

SEQ ID NO: 541922 - DNA, 17 bp, Homo sapiens
cactaggttcaattccc

SEQ ID NO: 541923 - DNA, 15 bp, Homo sapiens
cactcactggcatct

SEQ ID NO: 541924 - DNA, 17 bp, Homo sapiens
cactcagagcagtctgt

SEQ ID NO: 541925 - DNA, 15 bp, Homo sapiens
cactccaagccagca

SEQ ID NO: 541926 - DNA, 12 bp, Homo sapiens
cactccattccc

SEQ ID NO: 541927 - DNA, 13 bp, Homo sapiens
cactccattccca

SEQ ID NO: 541928 - DNA, 17 bp, Homo sapiens
cactcctccctgatgta

SEQ ID NO: 541929 - DNA, 12 bp, Homo sapiens
cactcctgctct

SEQ ID NO: 541930 - DNA, 18 bp, Homo sapiens
cactctaagatgttatat

SEQ ID NO: 541931 - DNA, 19 bp, Homo sapiens
cactctaagatgttatatt

SEQ ID NO: 541932 - DNA, 18 bp, Homo sapiens
cactgaacttttcaaaat

SEQ ID NO: 541933 - DNA, 22 bp, Homo sapiens
cactgaagtttgataaatagtg

SEQ ID NO: 541934 - DNA, 13 bp, Homo sapiens
cactgaatctgta

SEQ ID NO: 541935 - DNA, 14 bp, Homo sapiens
cactgaatctgtac

SEQ ID NO: 541936 - DNA, 16 bp, Homo sapiens
cactgaatctgtacag

SEQ ID NO: 541937 - DNA, 20 bp, Homo sapiens
cactgaatctgtacagagcc

SEQ ID NO: 541938 - DNA, 16 bp, Homo sapiens
cactgagtacaaatgt

SEQ ID NO: 541939 - DNA, 13 bp, Homo sapiens
cactgagtgaaat

SEQ ID NO: 541940 - DNA, 15 bp, Homo sapiens
cactgagtgaaatat

SEQ ID NO: 541941 - DNA, 17 bp, Homo sapiens
cactgccatggaggcac

SEQ ID NO: 541942 - DNA, 17 bp, Homo sapiens
cactggatggagctgga

SEQ ID NO: 541943 - DNA, 15 bp, Homo sapiens
cactggcaaatggag

SEQ ID NO: 541944 - DNA, 17 bp, Homo sapiens
cactggctgtgggctcc

SEQ ID NO: 541945 - DNA, 18 bp, Homo sapiens
cactggtctcagaggagg

SEQ ID NO: 541946 - DNA, 17 bp, Homo sapiens
cactgtatttgttaatt

SEQ ID NO: 541947 - DNA, 13 bp, Homo sapiens
cactgtctgtctg

SEQ ID NO: 541948 - DNA, 23 bp, Homo sapiens
cactgttataaattttgtacatt

SEQ ID NO: 541949 - DNA, 21 bp, Homo sapiens
cacttagctggagatgtctct

SEQ ID NO: 541950 - DNA, 13 bp, Homo sapiens
cacttcaaaacaa

SEQ ID NO: 541951 - DNA, 19 bp, Homo sapiens
cacttcagggcagatttta

SEQ ID NO: 541952 - DNA, 22 bp, Homo sapiens
cacttgaccttctgtcgtcccc

SEQ ID NO: 541953 - DNA, 22 bp, Homo sapiens
cacttgctttatttttcattac

SEQ ID NO: 541954 - DNA, 12 bp, Homo sapiens
cacttgtataaa

SEQ ID NO: 541955 - DNA, 18 bp, Homo sapiens
cactttaagagagaaatc

SEQ ID NO: 541956 - DNA, 16 bp, Homo sapiens
cactttaatgataaaa

SEQ ID NO: 541957 - DNA, 18 bp, Homo sapiens
cactttagagtgactaaa

SEQ ID NO: 541958 - DNA, 14 bp, Homo sapiens
cactttcaggaaca

SEQ ID NO: 541959 - DNA, 17 bp, Homo sapiens
cactttcaggaacactc

SEQ ID NO: 541960 - DNA, 18 bp, Homo sapiens
cactttcccacactgtga

SEQ ID NO: 541961 - DNA, 14 bp, Homo sapiens
cactttgtataaat

SEQ ID NO: 541962 - DNA, 11 bp, Homo sapiens
cacttttccag

SEQ ID NO: 541963 - DNA, 22 bp, Homo sapiens
cagaaaaaaaagtgtctcaaag

SEQ ID NO: 541964 - DNA, 11 bp, Homo sapiens
cagaaaaaagg

SEQ ID NO: 541965 - DNA, 14 bp, Homo sapiens
cagaaaaacaggca

SEQ ID NO: 541966 - DNA, 20 bp, Homo sapiens
cagaaaaatgaaatttaagc

SEQ ID NO: 541967 - DNA, 17 bp, Homo sapiens
cagaaacacccacaggc

SEQ ID NO: 541968 - DNA, 13 bp, Homo sapiens
cagaaagaggaat

SEQ ID NO: 541969 - DNA, 16 bp, Homo sapiens
cagaaatatatataca

SEQ ID NO: 541970 - DNA, 18 bp, Homo sapiens
cagaaatatatatacata

SEQ ID NO: 541971 - DNA, 20 bp, Homo sapiens
cagaacctactgttcctttc

SEQ ID NO: 541972 - DNA, 21 bp, Homo sapiens
cagaacctactgttcctttca

SEQ ID NO: 541973 - DNA, 13 bp, Homo sapiens
cagaactcttcct

SEQ ID NO: 541974 - DNA, 14 bp, Homo sapiens
cagaactcttcctc

SEQ ID NO: 541975 - DNA, 16 bp, Homo sapiens
cagaactcttcctcca

SEQ ID NO: 541976 - DNA, 22 bp, Homo sapiens
cagaacttgaagcctgctcctt

SEQ ID NO: 541977 - DNA, 18 bp, Homo sapiens
cagaagccacccaaagca

SEQ ID NO: 541978 - DNA, 18 bp, Homo sapiens
cagaagctcaaggctgca

SEQ ID NO: 541979 - DNA, 14 bp, Homo sapiens
cagaaggctcctgc

SEQ ID NO: 541980 - DNA, 20 bp, Homo sapiens
cagaagggagctggctccag

SEQ ID NO: 541981 - DNA, 20 bp, Homo sapiens
cagaatactagccagagctc

SEQ ID NO: 541982 - DNA, 16 bp, Homo sapiens
cagaatctctgaattt

SEQ ID NO: 541983 - DNA, 21 bp, Homo sapiens
cagaatctttccttcctctca

SEQ ID NO: 541984 - DNA, 16 bp, Homo sapiens
cagacaacagcccagg

SEQ ID NO: 541985 - DNA, 21 bp, Homo sapiens
ccagaaacacccacaggcatg

SEQ ID NO: 541986 - DNA, 11 bp, Homo sapiens
ccagaaagagg

SEQ ID NO: 541987 - DNA, 13 bp, Homo sapiens
ccagaaagaggaa

SEQ ID NO: 541988 - DNA, 22 bp, Homo sapiens
ccagaaagaggaataaaatgat

SEQ ID NO: 541989 - DNA, 16 bp, Homo sapiens
ccagaaatgccgctgt

SEQ ID NO: 541990 - DNA, 20 bp, Homo sapiens
ccagaaatgccgctgtgtcc

SEQ ID NO: 541991 - DNA, 22 bp, Homo sapiens
ccagaaatgtccctttcttctc

SEQ ID NO: 541992 - DNA, 15 bp, Homo sapiens
ccagaactctgtgtc

SEQ ID NO: 541993 - DNA, 15 bp, Homo sapiens
ccagaagcagcagct

SEQ ID NO: 541994 - DNA, 21 bp, Homo sapiens
ccagaaggaatcttctcatct

SEQ ID NO: 541995 - DNA, 15 bp, Homo sapiens
ccagaagtagctttg

SEQ ID NO: 541996 - DNA, 23 bp, Homo sapiens
ccagacaagctgttgaccaggca

SEQ ID NO: 541997 - DNA, 16 bp, Homo sapiens
ccagaccagtagtgac

SEQ ID NO: 541998 - DNA, 18 bp, Homo sapiens
ccagaccagtagtgacca

SEQ ID NO: 541999 - DNA, 15 bp, Homo sapiens
ccagaccccatccag

SEQ ID NO: 542000 - DNA, 20 bp, Homo sapiens
ccagaccccatccagccagg

SEQ ID NO: 542001 - DNA, 21 bp, Homo sapiens
ccagaccccatccagccaggg

SEQ ID NO: 542002 - DNA, 14 bp, Homo sapiens
ccagacctgggccc

SEQ ID NO: 542003 - DNA, 15 bp, Homo sapiens
ccagacctgggccct

SEQ ID NO: 542004 - DNA, 23 bp, Homo sapiens
ccagacgcacgtgggtcttcagg

SEQ ID NO: 542005 - DNA, 12 bp, Homo sapiens
ccagagcagagt

SEQ ID NO: 542006 - DNA, 22 bp, Homo sapiens
ccagagcagagtttacgggtct

SEQ ID NO: 542007 - DNA, 14 bp, Homo sapiens
ccagagctcccagg

SEQ ID NO: 542008 - DNA, 18 bp, Homo sapiens
ccagagctcccaggacgc

SEQ ID NO: 542009 - DNA, 15 bp, Homo sapiens
ccagagctcctcctt

SEQ ID NO: 542010 - DNA, 23 bp, Homo sapiens
ccagagctgcttccccgtcacct

SEQ ID NO: 542011 - DNA, 20 bp, Homo sapiens
ccagaggggcggggccagga

SEQ ID NO: 542012 - DNA, 20 bp, Homo sapiens
ccagaggtgagggaggcctg

SEQ ID NO: 542013 - DNA, 22 bp, Homo sapiens
ccagagtctagcgtagtgcagc

SEQ ID NO: 542014 - DNA, 15 bp, Homo sapiens
ccagatcagccagaa

SEQ ID NO: 542015 - DNA, 22 bp, Homo sapiens
ccagatccaggaacacatgcac

SEQ ID NO: 542016 - DNA, 13 bp, Homo sapiens
ccagcacccccac

SEQ ID NO: 542017 - DNA, 16 bp, Homo sapiens
ccagcactttgggagg

SEQ ID NO: 542018 - DNA, 17 bp, Homo sapiens
ccagcactttgggaggc

SEQ ID NO: 542019 - DNA, 17 bp, Homo sapiens
ccagcatacattttctg

SEQ ID NO: 542020 - DNA, 17 bp, Homo sapiens
ccagccccctggcccct

SEQ ID NO: 542021 - DNA, 20 bp, Homo sapiens
ccagcctatctctcttctgc

SEQ ID NO: 542022 - DNA, 15 bp, Homo sapiens
ccagcctctttccct

SEQ ID NO: 542023 - DNA, 21 bp, Homo sapiens
ccagcctgggataggggcaga

SEQ ID NO: 542024 - DNA, 20 bp, Homo sapiens
ccagctacaggggaggctga

SEQ ID NO: 542025 - DNA, 19 bp, Homo sapiens
ccagctccccccacctccc

SEQ ID NO: 542026 - DNA, 13 bp, Homo sapiens
ccagctctcccct

SEQ ID NO: 542027 - DNA, 17 bp, Homo sapiens
ccagctctcccctgcgc

SEQ ID NO: 542028 - DNA, 23 bp, Homo sapiens
ccagctgcaggaatcaaaaattg

SEQ ID NO: 542029 - DNA, 16 bp, Homo sapiens
ccagctgctgctctga

SEQ ID NO: 542030 - DNA, 14 bp, Homo sapiens
ccagcttcacttct

SEQ ID NO: 542031 - DNA, 16 bp, Homo sapiens
ccagcttcacttctga

SEQ ID NO: 542032 - DNA, 15 bp, Homo sapiens
ccaggaacacatgca

SEQ ID NO: 542033 - DNA, 18 bp, Homo sapiens
ccaggaacacatgcacac

SEQ ID NO: 542034 - DNA, 13 bp, Homo sapiens
ccaggaaggaaac

SEQ ID NO: 542035 - DNA, 15 bp, Homo sapiens
ccaggactctgcctt

SEQ ID NO: 542036 - DNA, 17 bp, Homo sapiens
ccaggagggagcagagg

SEQ ID NO: 542037 - DNA, 23 bp, Homo sapiens
ccaggagtcccactccaagccag

SEQ ID NO: 542038 - DNA, 23 bp, Homo sapiens
ccaggagtgggtgggacacagag

SEQ ID NO: 542039 - DNA, 17 bp, Homo sapiens
ccaggcatgaccctgga

SEQ ID NO: 542040 - DNA, 16 bp, Homo sapiens
ccaggccgtggctgcc

SEQ ID NO: 542041 - DNA, 18 bp, Homo sapiens
ccaggccgtggctgccca

SEQ ID NO: 542042 - DNA, 23 bp, Homo sapiens
ccaggcgctagcacagctccctt

SEQ ID NO: 542043 - DNA, 15 bp, Homo sapiens
ccaggcgtagggcca

SEQ ID NO: 542044 - DNA, 16 bp, Homo sapiens
ccaggcgtagggccag

SEQ ID NO: 542045 - DNA, 21 bp, Homo sapiens
ccaggcgtagggccagggctc

SEQ ID NO: 542046 - DNA, 20 bp, Homo sapiens
ccaggctccctccctcccag

SEQ ID NO: 542047 - DNA, 14 bp, Homo sapiens
ccagggaaccagag

SEQ ID NO: 542048 - DNA, 23 bp, Homo sapiens
ccagggctccacgggggcctagt

SEQ ID NO: 542049 - DNA, 15 bp, Homo sapiens
ccagggctctggcag

SEQ ID NO: 542050 - DNA, 17 bp, Homo sapiens
ccagggctctggcaggt

SEQ ID NO: 542051 - DNA, 22 bp, Homo sapiens
ccagggctggggcagcctctgg

SEQ ID NO: 542052 - DNA, 12 bp, Homo sapiens
ccaggggatttc

SEQ ID NO: 542053 - DNA, 17 bp, Homo sapiens
ccaggggcacacttccc

SEQ ID NO: 542054 - DNA, 13 bp, Homo sapiens
ccaggggtgggga

SEQ ID NO: 542055 - DNA, 17 bp, Homo sapiens
ccaggtagaacgccagg

SEQ ID NO: 542056 - DNA, 23 bp, Homo sapiens
ccaggtctacccctcccggccct

SEQ ID NO: 542057 - DNA, 19 bp, Homo sapiens
ccaggtgcacagacgtccc

SEQ ID NO: 542058 - DNA, 17 bp, Homo sapiens
ccaggttgtcactgaga

SEQ ID NO: 542059 - DNA, 12 bp, Homo sapiens
ccagtaacacag

SEQ ID NO: 542060 - DNA, 15 bp, Homo sapiens
ccagtacattctcag

SEQ ID NO: 542061 - DNA, 15 bp, Homo sapiens
ccagtagtgaccaat

SEQ ID NO: 542062 - DNA, 15 bp, Homo sapiens
ccagtccccagaact

SEQ ID NO: 542063 - DNA, 14 bp, Homo sapiens
ccagtccccttccc

SEQ ID NO: 542064 - DNA, 19 bp, Homo sapiens
ccagtctcactgacacagg

SEQ ID NO: 542065 - DNA, 19 bp, Homo sapiens
ccagtgattcgagctatat

SEQ ID NO: 542066 - DNA, 19 bp, Homo sapiens
ccagtgctcacacaatcag

SEQ ID NO: 542067 - DNA, 18 bp, Homo sapiens
ccagtggctatggcctgt

SEQ ID NO: 542068 - DNA, 20 bp, Homo sapiens
ccagtgtccccaggggcaca

SEQ ID NO: 542069 - DNA, 23 bp, Homo sapiens
ccagttccctcagccctcattaa

SEQ ID NO: 542070 - DNA, 23 bp, Homo sapiens
ccagttggactgtggcctcagga

SEQ ID NO: 542071 - DNA, 19 bp, Homo sapiens
ccataagcaacaattttca

SEQ ID NO: 542072 - DNA, 20 bp, Homo sapiens
ccataagcaacaattttcag

SEQ ID NO: 542073 - DNA, 13 bp, Homo sapiens
ccataatgcttct

SEQ ID NO: 542074 - DNA, 13 bp, Homo sapiens
ccatacttctctc

SEQ ID NO: 542075 - DNA, 22 bp, Homo sapiens
ccatattggcatggatttctgt

SEQ ID NO: 542076 - DNA, 15 bp, Homo sapiens
ccatatttttttcct

SEQ ID NO: 542077 - DNA, 16 bp, Homo sapiens
ccatatttttttcctt

SEQ ID NO: 542078 - DNA, 13 bp, Homo sapiens
ccatcagcccctg

SEQ ID NO: 542079 - DNA, 17 bp, Homo sapiens
ccatccttctccccaag

SEQ ID NO: 542080 - DNA, 11 bp, Homo sapiens
ccatctgctga

SEQ ID NO: 542081 - DNA, 23 bp, Homo sapiens
ccatctttttaacctctgttcag

SEQ ID NO: 542082 - DNA, 13 bp, Homo sapiens
ccatgaactggag

SEQ ID NO: 542083 - DNA, 22 bp, Homo sapiens
ccatgaactgtcaagtgtgtgt

SEQ ID NO: 542084 - DNA, 14 bp, Homo sapiens
ccatgagtgtgggc

SEQ ID NO: 542085 - DNA, 14 bp, Homo sapiens
ccatgattccaagg

SEQ ID NO: 542086 - DNA, 12 bp, Homo sapiens
ccatgccagccg

SEQ ID NO: 542087 - DNA, 18 bp, Homo sapiens
ccatgccctccgtcctgg

SEQ ID NO: 542088 - DNA, 22 bp, Homo sapiens
ccatgccctccgtcctggcagg

SEQ ID NO: 542089 - DNA, 18 bp, Homo sapiens
ccatgcggccggcctggg

SEQ ID NO: 542090 - DNA, 16 bp, Homo sapiens
ccatggaagctggcag

SEQ ID NO: 542091 - DNA, 21 bp, Homo sapiens
ccatggaggcacacagctgca

SEQ ID NO: 542092 - DNA, 23 bp, Homo sapiens
ccatggcaccctgcaccaggcca

SEQ ID NO: 542093 - DNA, 19 bp, Homo sapiens
ccatggggtggaaggagaa

SEQ ID NO: 542094 - DNA, 17 bp, Homo sapiens
ccatggtagactgtgac

SEQ ID NO: 542095 - DNA, 14 bp, Homo sapiens
ccatggtgaactga

SEQ ID NO: 542096 - DNA, 21 bp, Homo sapiens
ccatggtgaactgaagcagag

SEQ ID NO: 542097 - DNA, 22 bp, Homo sapiens
ccatggtgaactgaagcagagt

SEQ ID NO: 542098 - DNA, 16 bp, Homo sapiens
ccatgtcctatgtgtg

SEQ ID NO: 542099 - DNA, 19 bp, Homo sapiens
ccatgtcctatgtgtgact

SEQ ID NO: 542100 - DNA, 15 bp, Homo sapiens
ccatgtctttctcca

SEQ ID NO: 542101 - DNA, 19 bp, Homo sapiens
cctgaaagcaacagctgga

SEQ ID NO: 542102 - DNA, 16 bp, Homo sapiens
cctgaaatgtttccag

SEQ ID NO: 542103 - DNA, 19 bp, Homo sapiens
cctgaaatgtttccaggca

SEQ ID NO: 542104 - DNA, 12 bp, Homo sapiens
cctgaatcagag

SEQ ID NO: 542105 - DNA, 15 bp, Homo sapiens
cctgaatcagaggca

SEQ ID NO: 542106 - DNA, 13 bp, Homo sapiens
cctgaatctgacc

SEQ ID NO: 542107 - DNA, 20 bp, Homo sapiens
cctgaatctgaccacagaca

SEQ ID NO: 542108 - DNA, 13 bp, Homo sapiens
cctgacagccaga

SEQ ID NO: 542109 - DNA, 14 bp, Homo sapiens
cctgacctccccct

SEQ ID NO: 542110 - DNA, 15 bp, Homo sapiens
cctgagagcagaatg

SEQ ID NO: 542111 - DNA, 14 bp, Homo sapiens
cctgaggctggggc

SEQ ID NO: 542112 - DNA, 15 bp, Homo sapiens
cctgagggcccttcc

SEQ ID NO: 542113 - DNA, 17 bp, Homo sapiens
cctgagggcccttccca

SEQ ID NO: 542114 - DNA, 20 bp, Homo sapiens
cctgagggtttccaccttgg

SEQ ID NO: 542115 - DNA, 17 bp, Homo sapiens
cctgcacaaacatagac

SEQ ID NO: 542116 - DNA, 17 bp, Homo sapiens
cctgcacctgcttctca

SEQ ID NO: 542117 - DNA, 10 bp, Homo sapiens
cctgcagctc

SEQ ID NO: 542118 - DNA, 22 bp, Homo sapiens
cctgcaggcggtatccagaggt

SEQ ID NO: 542119 - DNA, 13 bp, Homo sapiens
cctgccagcaccc

SEQ ID NO: 542120 - DNA, 12 bp, Homo sapiens
cctgccccagcg

SEQ ID NO: 542121 - DNA, 13 bp, Homo sapiens
cctgccccagcgc

SEQ ID NO: 542122 - DNA, 18 bp, Homo sapiens
cctgcccccacacctggc

SEQ ID NO: 542123 - DNA, 22 bp, Homo sapiens
cctgcccccacacctggccctg

SEQ ID NO: 542124 - DNA, 20 bp, Homo sapiens
cctgcccggatggagcgggg

SEQ ID NO: 542125 - DNA, 19 bp, Homo sapiens
cctgccctttgtcctcctg

SEQ ID NO: 542126 - DNA, 20 bp, Homo sapiens
cctgcctctgaactgctgct

SEQ ID NO: 542127 - DNA, 21 bp, Homo sapiens
cctgccttgcccactcctgct

SEQ ID NO: 542128 - DNA, 14 bp, Homo sapiens
cctgcgcaggccct

SEQ ID NO: 542129 - DNA, 15 bp, Homo sapiens
cctgcgcaggccctc

SEQ ID NO: 542130 - DNA, 21 bp, Homo sapiens
cctgcgcgggaccatctggaa

SEQ ID NO: 542131 - DNA, 15 bp, Homo sapiens
cctgcgtggcctggg

SEQ ID NO: 542132 - DNA, 16 bp, Homo sapiens
cctgcgtggcctgggg

SEQ ID NO: 542133 - DNA, 23 bp, Homo sapiens
cctgcgtggcctggggctgccgt

SEQ ID NO: 542134 - DNA, 13 bp, Homo sapiens
cctgcgtggctga

SEQ ID NO: 542135 - DNA, 16 bp, Homo sapiens
cctgcgtggctgaccc

SEQ ID NO: 542136 - DNA, 22 bp, Homo sapiens
cctgctcagcagtgagagcaga

SEQ ID NO: 542137 - DNA, 13 bp, Homo sapiens
cctgctcctccag

SEQ ID NO: 542138 - DNA, 21 bp, Homo sapiens
cctgctgagtggtccacattc

SEQ ID NO: 542139 - DNA, 22 bp, Homo sapiens
cctgctgctcctcggccagagc

SEQ ID NO: 542140 - DNA, 15 bp, Homo sapiens
cctgctgtcattgct

SEQ ID NO: 542141 - DNA, 22 bp, Homo sapiens
cctgctgtcattgcttcttctg

SEQ ID NO: 542142 - DNA, 18 bp, Homo sapiens
cctgcttccccaaaggcc

SEQ ID NO: 542143 - DNA, 14 bp, Homo sapiens
cctgcttctctgcc

SEQ ID NO: 542144 - DNA, 21 bp, Homo sapiens
cctgctttagaatgttttcct

SEQ ID NO: 542145 - DNA, 17 bp, Homo sapiens
cctggaaggcccagcac

SEQ ID NO: 542146 - DNA, 18 bp, Homo sapiens
cctggaaggcccagcacc

SEQ ID NO: 542147 - DNA, 18 bp, Homo sapiens
cctggacagtgcctaact

SEQ ID NO: 542148 - DNA, 16 bp, Homo sapiens
cctggacatattccca

SEQ ID NO: 542149 - DNA, 22 bp, Homo sapiens
cctggactctgtggggccacac

SEQ ID NO: 542150 - DNA, 13 bp, Homo sapiens
cctggcagggcag

SEQ ID NO: 542151 - DNA, 18 bp, Homo sapiens
cctggcagggcaggcaga

SEQ ID NO: 542152 - DNA, 14 bp, Homo sapiens
cctggccctggggc

SEQ ID NO: 542153 - DNA, 16 bp, Homo sapiens
cctggccctggggcct

SEQ ID NO: 542154 - DNA, 16 bp, Homo sapiens
cctggctcccagggtc

SEQ ID NO: 542155 - DNA, 22 bp, Homo sapiens
cctgggagagtgaggtcatccc

SEQ ID NO: 542156 - DNA, 15 bp, Homo sapiens
cctgggagatgctgg

SEQ ID NO: 542157 - DNA, 22 bp, Homo sapiens
cctgggagatgctgggaccctc

SEQ ID NO: 542158 - DNA, 20 bp, Homo sapiens
cctgggcatccccagccccc

SEQ ID NO: 542159 - DNA, 18 bp, Homo sapiens
cctgggcatgcccagccc

SEQ ID NO: 542160 - DNA, 13 bp, Homo sapiens
cctgggccctggt

SEQ ID NO: 542161 - DNA, 14 bp, Homo sapiens
cctgggccctggtt

SEQ ID NO: 542162 - DNA, 20 bp, Homo sapiens
cctgggcttttctcccagct

SEQ ID NO: 542163 - DNA, 11 bp, Homo sapiens
cctgggggcct

SEQ ID NO: 542164 - DNA, 17 bp, Homo sapiens
cctggggtttccacaca

SEQ ID NO: 542165 - DNA, 23 bp, Homo sapiens
cctggggtttccacacaggccca

SEQ ID NO: 542166 - DNA, 14 bp, Homo sapiens
cctggtaagaaaaa

SEQ ID NO: 542167 - DNA, 15 bp, Homo sapiens
cctggtaagaaaaag

SEQ ID NO: 542168 - DNA, 20 bp, Homo sapiens
cctggtcctgcactgtcccg

SEQ ID NO: 542169 - DNA, 16 bp, Homo sapiens
cctggtcgccttccac

SEQ ID NO: 542170 - DNA, 13 bp, Homo sapiens
cctggtctcctgc

SEQ ID NO: 542171 - DNA, 16 bp, Homo sapiens
cctggtctcctgcccc

SEQ ID NO: 542172 - DNA, 22 bp, Homo sapiens
cctggtctcctgcccccacacc

SEQ ID NO: 542173 - DNA, 23 bp, Homo sapiens
cctgtacaatcatgaacagctct

SEQ ID NO: 542174 - DNA, 21 bp, Homo sapiens
cctgtacacacacagacacac

SEQ ID NO: 542175 - DNA, 16 bp, Homo sapiens
cctgtcaaacattagt

SEQ ID NO: 542176 - DNA, 15 bp, Homo sapiens
cctgtcctcagcttc

SEQ ID NO: 542177 - DNA, 12 bp, Homo sapiens
cctgtcctggct

SEQ ID NO: 542178 - DNA, 21 bp, Homo sapiens
cctgtccttctctcacctcct

SEQ ID NO: 542179 - DNA, 18 bp, Homo sapiens
cctgtctgctccagctct

SEQ ID NO: 542180 - DNA, 23 bp, Homo sapiens
cctgtgaccggggtcctgaggct

SEQ ID NO: 542181 - DNA, 13 bp, Homo sapiens
cctgtgagctgca

SEQ ID NO: 542182 - DNA, 16 bp, Homo sapiens
cctgtgagctgcacca

SEQ ID NO: 542183 - DNA, 15 bp, Homo sapiens
cctgtgcacctgact

SEQ ID NO: 542184 - DNA, 17 bp, Homo sapiens
cctgtgccagcccagag

SEQ ID NO: 542185 - DNA, 21 bp, Homo sapiens
cctgtgccaggtgaaggaggc

SEQ ID NO: 542186 - DNA, 20 bp, Homo sapiens
cctgtgctaagtctttccca

SEQ ID NO: 542187 - DNA, 22 bp, Homo sapiens
cctgttacctaattagagcaga

SEQ ID NO: 542188 - DNA, 23 bp, Homo sapiens
cctgttacctaattagagcagat

SEQ ID NO: 542189 - DNA, 19 bp, Homo sapiens
cctgttctgtgtctgctgt

SEQ ID NO: 542190 - DNA, 20 bp, Homo sapiens
cctgttctgtgtctgctgta

SEQ ID NO: 542191 - DNA, 20 bp, Homo sapiens
ccttaaaaaatatgctctcc

SEQ ID NO: 542192 - DNA, 23 bp, Homo sapiens
ccttaaaactttaatcccacttg

SEQ ID NO: 542193 - DNA, 23 bp, Homo sapiens
ccttaacatccctcctgctttta

SEQ ID NO: 542194 - DNA, 23 bp, Homo sapiens
ccttaagtcttactgttttgtgc

SEQ ID NO: 542195 - DNA, 14 bp, Homo sapiens
ccttatcataaatt

SEQ ID NO: 542196 - DNA, 19 bp, Homo sapiens
ccttcaacaaggcttgctg

SEQ ID NO: 542197 - DNA, 23 bp, Homo sapiens
ccttcaagccagcaacacagagc

SEQ ID NO: 542198 - DNA, 19 bp, Homo sapiens
ccttcactgtcaccaccct

SEQ ID NO: 542199 - DNA, 16 bp, Homo sapiens
ccttccacctctggga

SEQ ID NO: 542200 - DNA, 19 bp, Homo sapiens
ccttccacctgctctgctg

SEQ ID NO: 542201 - DNA, 20 bp, Homo sapiens
ccttccaggcgtagggccag

SEQ ID NO: 542202 - DNA, 14 bp, Homo sapiens
ccttccccttcctt

SEQ ID NO: 542203 - DNA, 17 bp, Homo sapiens
ccttccctgacactgtc

SEQ ID NO: 542204 - DNA, 22 bp, Homo sapiens
ccttcctctcatccttttctcc

SEQ ID NO: 542205 - DNA, 13 bp, Homo sapiens
ccttcctctgctc

SEQ ID NO: 542206 - DNA, 21 bp, Homo sapiens
ccttcctgttctgtgtctgct

SEQ ID NO: 542207 - DNA, 22 bp, Homo sapiens
ccttcctgttctgtgtctgctg

SEQ ID NO: 542208 - DNA, 18 bp, Homo sapiens
ccttcggcctctcttgga

SEQ ID NO: 542209 - DNA, 14 bp, Homo sapiens
ccttctacaaggac

SEQ ID NO: 542210 - DNA, 15 bp, Homo sapiens
ccttctacaaggact

SEQ ID NO: 542211 - DNA, 18 bp, Homo sapiens
ccttctacaaggactcca

SEQ ID NO: 542212 - DNA, 19 bp, Homo sapiens
ccttctacctgcaggactc

SEQ ID NO: 542213 - DNA, 12 bp, Homo sapiens
ccttctcccctc

SEQ ID NO: 542214 - DNA, 16 bp, Homo sapiens
ccttctctcacctcct

SEQ ID NO: 542215 - DNA, 19 bp, Homo sapiens
ccttctctcacctcctaaa

SEQ ID NO: 542216 - DNA, 20 bp, Homo sapiens
ccttctgagctggcctctca

SEQ ID NO: 542217 - DNA, 15 bp, Homo sapiens
ccttctgatccacag

SEQ ID NO: 542218 - DNA, 19 bp, Homo sapiens
ccttctgtcgtccccagac

SEQ ID NO: 542219 - DNA, 19 bp, Homo sapiens
ccttctttccatttctctc

SEQ ID NO: 542220 - DNA, 16 bp, Homo sapiens
ccttctttgcccttta

SEQ ID NO: 542221 - DNA, 22 bp, Homo sapiens
ccttgaggacctccacctggga

SEQ ID NO: 542222 - DNA, 16 bp, Homo sapiens
ccttgaggggagccag

SEQ ID NO: 542223 - DNA, 18 bp, Homo sapiens
ccttgaggggagccagga

SEQ ID NO: 542224 - DNA, 22 bp, Homo sapiens
ccttgaggggagccaggagggg

SEQ ID NO: 542225 - DNA, 18 bp, Homo sapiens
ccttgatttgttcttaca

SEQ ID NO: 542226 - DNA, 24 bp, Homo sapiens
ccttgcacacatcatctgtaagct

SEQ ID NO: 542227 - DNA, 18 bp, Homo sapiens
ccttgcccactcctgctc

SEQ ID NO: 542228 - DNA, 20 bp, Homo sapiens
ccttggacggggacacggcc

SEQ ID NO: 542229 - DNA, 21 bp, Homo sapiens
ccttggacggggacacggcct

SEQ ID NO: 542230 - DNA, 20 bp, Homo sapiens
ccttgggatgggcacaggct

SEQ ID NO: 542231 - DNA, 18 bp, Homo sapiens
ccttgtaatgtaactgct

SEQ ID NO: 542232 - DNA, 21 bp, Homo sapiens
ccttgtaatgtaactgctctt

SEQ ID NO: 542233 - DNA, 17 bp, Homo sapiens
ccttgtgaccttctcta

SEQ ID NO: 542234 - DNA, 18 bp, Homo sapiens
ccttgtgatcactttctg

SEQ ID NO: 542235 - DNA, 20 bp, Homo sapiens
cctttaaatggggacgcaga

SEQ ID NO: 542236 - DNA, 18 bp, Homo sapiens
cctttacttgtctttctg

SEQ ID NO: 542237 - DNA, 20 bp, Homo sapiens
cctttatctaccaactttca

SEQ ID NO: 542238 - DNA, 15 bp, Homo sapiens
cctttcacttctttc

SEQ ID NO: 542239 - DNA, 11 bp, Homo sapiens
cctttcttcct

SEQ ID NO: 542240 - DNA, 12 bp, Homo sapiens
cctttcttcctc

SEQ ID NO: 542241 - DNA, 12 bp, Homo sapiens
cctttcttctcc

SEQ ID NO: 542242 - DNA, 11 bp, Homo sapiens
ttaacaaataa

SEQ ID NO: 542243 - DNA, 16 bp, Homo sapiens
ttaacactgagtgaaa

SEQ ID NO: 542244 - DNA, 19 bp, Homo sapiens
ttaacactgagtgaaatat

SEQ ID NO: 542245 - DNA, 15 bp, Homo sapiens
ttaacagtattttaa

SEQ ID NO: 542246 - DNA, 15 bp, Homo sapiens
ttaacatttctaact

SEQ ID NO: 542247 - DNA, 18 bp, Homo sapiens
ttaacttccactttgtat

SEQ ID NO: 542248 - DNA, 12 bp, Homo sapiens
ttaagagaaatg

SEQ ID NO: 542249 - DNA, 15 bp, Homo sapiens
ttaagagaaatggca

SEQ ID NO: 542250 - DNA, 12 bp, Homo sapiens
ttaagattgaag

SEQ ID NO: 542251 - DNA, 22 bp, Homo sapiens
ttaagattgaagctaaaacact

SEQ ID NO: 542252 - DNA, 21 bp, Homo sapiens
ttaagcacaaaaaatttaaga

SEQ ID NO: 542253 - DNA, 15 bp, Homo sapiens
ttaagcagaattgga

SEQ ID NO: 542254 - DNA, 18 bp, Homo sapiens
ttaagcagaattggaaaa

SEQ ID NO: 542255 - DNA, 17 bp, Homo sapiens
ttaagcctttgaagtgc

SEQ ID NO: 542256 - DNA, 23 bp, Homo sapiens
ttaaggaaatttgtaccatttca

SEQ ID NO: 542257 - DNA, 13 bp, Homo sapiens
ttaagtaaactaa

SEQ ID NO: 542258 - DNA, 18 bp, Homo sapiens
ttaagtcttactgttttg

SEQ ID NO: 542259 - DNA, 12 bp, Homo sapiens
ttaagtgaaatt

SEQ ID NO: 542260 - DNA, 19 bp, Homo sapiens
ttaagtggactgtatttcg

SEQ ID NO: 542261 - DNA, 15 bp, Homo sapiens
ttaagtgttctgtgg

SEQ ID NO: 542262 - DNA, 14 bp, Homo sapiens
ttaagttgtaaacg

SEQ ID NO: 542263 - DNA, 20 bp, Homo sapiens
ttaataaagcgaaaaactca

SEQ ID NO: 542264 - DNA, 14 bp, Homo sapiens
ttaataacagctcc

SEQ ID NO: 542265 - DNA, 15 bp, Homo sapiens
ttaatactaaaatat

SEQ ID NO: 542266 - DNA, 14 bp, Homo sapiens
ttaatatactcctt

SEQ ID NO: 542267 - DNA, 17 bp, Homo sapiens
ttaatatgtattttatg

SEQ ID NO: 542268 - DNA, 22 bp, Homo sapiens
ttaatatgtattttatgtatgt

SEQ ID NO: 542269 - DNA, 19 bp, Homo sapiens
ttaatgagcaatatctgct

SEQ ID NO: 542270 - DNA, 18 bp, Homo sapiens
ttaatgagtatatgtaac

SEQ ID NO: 542271 - DNA, 11 bp, Homo sapiens
ttaatgataaa

SEQ ID NO: 542272 - DNA, 22 bp, Homo sapiens
ttaatgtgtaaaattggattat

SEQ ID NO: 542273 - DNA, 15 bp, Homo sapiens
ttaatgttgatttct

SEQ ID NO: 542274 - DNA, 21 bp, Homo sapiens
ttaatgtttagtcagtgtact

SEQ ID NO: 542275 - DNA, 14 bp, Homo sapiens
ttaattaagtaaac

SEQ ID NO: 542276 - DNA, 13 bp, Homo sapiens
ttaattaattctc

SEQ ID NO: 542277 - DNA, 11 bp, Homo sapiens
ttaattgaaag

SEQ ID NO: 542278 - DNA, 12 bp, Homo sapiens
ttaattgaaagg

SEQ ID NO: 542279 - DNA, 20 bp, Homo sapiens
ttaattgaaagggacaagta

SEQ ID NO: 542280 - DNA, 21 bp, Homo sapiens
ttaattgaaagggacaagtat

SEQ ID NO: 542281 - DNA, 13 bp, Homo sapiens
ttaattgaaatac

SEQ ID NO: 542282 - DNA, 18 bp, Homo sapiens
ttaattgaaatacctatt

SEQ ID NO: 542283 - DNA, 16 bp, Homo sapiens
ttaattgatcagtttt

SEQ ID NO: 542284 - DNA, 12 bp, Homo sapiens
ttaattgctgag

SEQ ID NO: 542285 - DNA, 13 bp, Homo sapiens
ttaatttatctgt

SEQ ID NO: 542286 - DNA, 15 bp, Homo sapiens
ttaatttatctgttg

SEQ ID NO: 542287 - DNA, 20 bp, Homo sapiens
ttaatttcttgcaatttgaa

SEQ ID NO: 542288 - DNA, 12 bp, Homo sapiens
ttaattttgtct

SEQ ID NO: 542289 - DNA, 23 bp, Homo sapiens
ttaattttgtctgccccaagttt

SEQ ID NO: 542290 - DNA, 16 bp, Homo sapiens
ttacaaaatgtaactg

SEQ ID NO: 542291 - DNA, 18 bp, Homo sapiens
ttacaaaatgtaactgtt

SEQ ID NO: 542292 - DNA, 21 bp, Homo sapiens
ttacaagactgtaaattccaa

SEQ ID NO: 542293 - DNA, 16 bp, Homo sapiens
ttacaatatttgtgtg

SEQ ID NO: 542294 - DNA, 22 bp, Homo sapiens
ttacaatatttgtgtgctaaac

SEQ ID NO: 542295 - DNA, 16 bp, Homo sapiens
ttacacacacagatgt

SEQ ID NO: 542296 - DNA, 20 bp, Homo sapiens
ttacagaaccaattcacttt

SEQ ID NO: 542297 - DNA, 16 bp, Homo sapiens
ttacagtggcagtatt

SEQ ID NO: 542298 - DNA, 14 bp, Homo sapiens
ttacagttactttt

SEQ ID NO: 542299 - DNA, 15 bp, Homo sapiens
ttacatttcgatgtt

SEQ ID NO: 542300 - DNA, 19 bp, Homo sapiens
ttaccaagttggtcttact

SEQ ID NO: 542301 - DNA, 17 bp, Homo sapiens
ttaccacaggatgcata

SEQ ID NO: 542302 - DNA, 18 bp, Homo sapiens
ttaccacaggatgcatat

SEQ ID NO: 542303 - DNA, 13 bp, Homo sapiens
ttaccattggaaa

SEQ ID NO: 542304 - DNA, 16 bp, Homo sapiens
ttaccattggaaattt

SEQ ID NO: 542305 - DNA, 15 bp, Homo sapiens
ttacccaaagcacat

SEQ ID NO: 542306 - DNA, 19 bp, Homo sapiens
ttacctgtaatagcctcac

SEQ ID NO: 542307 - DNA, 20 bp, Homo sapiens
ttacctgtaatagcctcacc

SEQ ID NO: 542308 - DNA, 22 bp, Homo sapiens
ttacctgtaatagcctcacctt

SEQ ID NO: 542309 - DNA, 17 bp, Homo sapiens
ttacctgttgtctgaaa

SEQ ID NO: 542310 - DNA, 17 bp, Homo sapiens
ttactaacagtaactgc

SEQ ID NO: 542311 - DNA, 15 bp, Homo sapiens
ttactaacttctaaa

SEQ ID NO: 542312 - DNA, 21 bp, Homo sapiens
ttactctatgccccaaatata

SEQ ID NO: 542313 - DNA, 21 bp, Homo sapiens
ttactgcatggggaaagagat

SEQ ID NO: 542314 - DNA, 11 bp, Homo sapiens
ttactgtctta

SEQ ID NO: 542315 - DNA, 19 bp, Homo sapiens
tgagtcttcatgttcccac

SEQ ID NO: 542316 - DNA, 15 bp, Homo sapiens
tgagtgaaatattac

SEQ ID NO: 542317 - DNA, 21 bp, Homo sapiens
tgagtggacgtcagaagaatc

SEQ ID NO: 542318 - DNA, 22 bp, Homo sapiens
tgagtggtccacattctgctgc

SEQ ID NO: 542319 - DNA, 22 bp, Homo sapiens
tgagtgtacatttatgtgtgaa

SEQ ID NO: 542320 - DNA, 20 bp, Homo sapiens
tgagttctatcagttatcct

SEQ ID NO: 542321 - DNA, 18 bp, Homo sapiens
tgagtttccagctaagcc

SEQ ID NO: 542322 - DNA, 14 bp, Homo sapiens
tgagtttcttttat

SEQ ID NO: 542323 - DNA, 19 bp, Homo sapiens
tgagtttgctggttgtaaa

SEQ ID NO: 542324 - DNA, 22 bp, Homo sapiens
tgataacaacccaaggcaatga

SEQ ID NO: 542325 - DNA, 23 bp, Homo sapiens
tgataacaacccaaggcaatgat

SEQ ID NO: 542326 - DNA, 21 bp, Homo sapiens
tgatacttatttataacattg

SEQ ID NO: 542327 - DNA, 12 bp, Homo sapiens
tgatatgagtat

SEQ ID NO: 542328 - DNA, 16 bp, Homo sapiens
tgatatgagtatacaa

SEQ ID NO: 542329 - DNA, 17 bp, Homo sapiens
tgatatgagtatacaat

SEQ ID NO: 542330 - DNA, 15 bp, Homo sapiens
tgatatgtctttaaa

SEQ ID NO: 542331 - DNA, 18 bp, Homo sapiens
tgatattccccatttcct

SEQ ID NO: 542332 - DNA, 18 bp, Homo sapiens
tgatattctttgttaatt

SEQ ID NO: 542333 - DNA, 14 bp, Homo sapiens
tgatcaaatgtaca

SEQ ID NO: 542334 - DNA, 16 bp, Homo sapiens
tgatcaaatgtacatc

SEQ ID NO: 542335 - DNA, 18 bp, Homo sapiens
tgatctgttgtaatatca

SEQ ID NO: 542336 - DNA, 17 bp, Homo sapiens
tgatcttcctctgctaa

SEQ ID NO: 542337 - DNA, 18 bp, Homo sapiens
tgatgcctggggaaggag

SEQ ID NO: 542338 - DNA, 19 bp, Homo sapiens
tgatgctctttcccaccca

SEQ ID NO: 542339 - DNA, 15 bp, Homo sapiens
tgatggatggcacaa

SEQ ID NO: 542340 - DNA, 16 bp, Homo sapiens
tgatggatggcacaat

SEQ ID NO: 542341 - DNA, 23 bp, Homo sapiens
tgatggggaagggtggatgtccc

SEQ ID NO: 542342 - DNA, 23 bp, Homo sapiens
tgatggtagaaattttatctctt

SEQ ID NO: 542343 - DNA, 15 bp, Homo sapiens
tgatggtcagacaca

SEQ ID NO: 542344 - DNA, 15 bp, Homo sapiens
tgatgtacagttggg

SEQ ID NO: 542345 - DNA, 20 bp, Homo sapiens
tgatgtgttgccactttcca

SEQ ID NO: 542346 - DNA, 16 bp, Homo sapiens
tgatgtttttaaaatc

SEQ ID NO: 542347 - DNA, 17 bp, Homo sapiens
tgatgtttttaaaatct

SEQ ID NO: 542348 - DNA, 21 bp, Homo sapiens
tgatgtttttaaaatcttatt

SEQ ID NO: 542349 - DNA, 15 bp, Homo sapiens
tgatgtttttatgat

SEQ ID NO: 542350 - DNA, 14 bp, Homo sapiens
tgattacctgaaag

SEQ ID NO: 542351 - DNA, 16 bp, Homo sapiens
tgattcacatgttttc

SEQ ID NO: 542352 - DNA, 21 bp, Homo sapiens
tgattcacatgttttcaaatg

SEQ ID NO: 542353 - DNA, 16 bp, Homo sapiens
tgattcacctcttctt

SEQ ID NO: 542354 - DNA, 17 bp, Homo sapiens
tgattccccggagctgg

SEQ ID NO: 542355 - DNA, 16 bp, Homo sapiens
tgattcgagctatatt

SEQ ID NO: 542356 - DNA, 23 bp, Homo sapiens
tgattcgagctatatttaagtat

SEQ ID NO: 542357 - DNA, 23 bp, Homo sapiens
tgattcttgtgattgactttttg

SEQ ID NO: 542358 - DNA, 23 bp, Homo sapiens
tgattgagagcagcctcttgaat

SEQ ID NO: 542359 - DNA, 16 bp, Homo sapiens
tgattgcttttaaaat

SEQ ID NO: 542360 - DNA, 19 bp, Homo sapiens
tgattgcttttaaaatttt

SEQ ID NO: 542361 - DNA, 22 bp, Homo sapiens
tgattgcttttaaaattttaag

SEQ ID NO: 542362 - DNA, 18 bp, Homo sapiens
tgattggtttaaaagtca

SEQ ID NO: 542363 - DNA, 12 bp, Homo sapiens
tgattgtctttt

SEQ ID NO: 542364 - DNA, 22 bp, Homo sapiens
tgatttacctttggaattgtgc

SEQ ID NO: 542365 - DNA, 20 bp, Homo sapiens
tgatttactaacagtaactg

SEQ ID NO: 542366 - DNA, 21 bp, Homo sapiens
tgatttactaacagtaactgc

SEQ ID NO: 542367 - DNA, 15 bp, Homo sapiens
tgatttcacaaatat

SEQ ID NO: 542368 - DNA, 20 bp, Homo sapiens
tgatttcacaaatattaaaa

SEQ ID NO: 542369 - DNA, 23 bp, Homo sapiens
tgatttcacaaatattaaaaagt

SEQ ID NO: 542370 - DNA, 13 bp, Homo sapiens
tgatttcagaaac

SEQ ID NO: 542371 - DNA, 23 bp, Homo sapiens
tgatttcggaccgaaggtgacag

SEQ ID NO: 542372 - DNA, 23 bp, Homo sapiens
tgatttctagttatttattctgg

SEQ ID NO: 542373 - DNA, 19 bp, Homo sapiens
tgatttgtaaaacagtggt

SEQ ID NO: 542374 - DNA, 11 bp, Homo sapiens
tgattttcaaa

SEQ ID NO: 542375 - DNA, 18 bp, Homo sapiens
tgattttcaaatatgtaa

SEQ ID NO: 542376 - DNA, 19 bp, Homo sapiens
tgatttttgttgattaaaa

SEQ ID NO: 542377 - DNA, 17 bp, Homo sapiens
tgcaaagcagagtgaaa

SEQ ID NO: 542378 - DNA, 21 bp, Homo sapiens
tgcaaagtacaggtactttgt

SEQ ID NO: 542379 - DNA, 20 bp, Homo sapiens
tgcaacagcaaattaatgtg

SEQ ID NO: 542380 - DNA, 24 bp, Homo sapiens
tgcaacagcaaattaatgtgtaaa

SEQ ID NO: 542381 - DNA, 15 bp, Homo sapiens
tgcaagcagtttcaa

SEQ ID NO: 542382 - DNA, 17 bp, Homo sapiens
tgcaagcagtttcaata

SEQ ID NO: 542383 - DNA, 21 bp, Homo sapiens
tgcaagcagtttcaataaagt

SEQ ID NO: 542384 - DNA, 12 bp, Homo sapiens
tgcaatccttac

SEQ ID NO: 542385 - DNA, 19 bp, Homo sapiens
tgcaatttgtctttggaaa

SEQ ID NO: 542386 - DNA, 16 bp, Homo sapiens
tgcacaaacatagaca

SEQ ID NO: 542387 - DNA, 19 bp, Homo sapiens
tgcacaaacatagacagat

SEQ ID NO: 542388 - DNA, 11 bp, Homo sapiens
tgcacacacac

SEQ ID NO: 542389 - DNA, 14 bp, Homo sapiens
tgcacacacacaca

SEQ ID NO: 542390 - DNA, 17 bp, Homo sapiens
tgcacacatcatctgta

SEQ ID NO: 542391 - DNA, 18 bp, Homo sapiens
tgcacatccattcccaag

SEQ ID NO: 542392 - DNA, 19 bp, Homo sapiens
tgcacatgatttcacaaat

SEQ ID NO: 542393 - DNA, 22 bp, Homo sapiens
tgcacatgatttcacaaatatt

SEQ ID NO: 542394 - DNA, 17 bp, Homo sapiens
tgcacccgcatgtacaa

SEQ ID NO: 542395 - DNA, 13 bp, Homo sapiens
tgcacctgcttct

SEQ ID NO: 542396 - DNA, 13 bp, Homo sapiens
tgcacctgggaca

SEQ ID NO: 542397 - DNA, 16 bp, Homo sapiens
tgcactctcttggctg

SEQ ID NO: 542398 - DNA, 16 bp, Homo sapiens
tgcactgaagtttgat

SEQ ID NO: 542399 - DNA, 22 bp, Homo sapiens
tgcactgtcccggagctcaggc

SEQ ID NO: 542400 - DNA, 15 bp, Homo sapiens
tgcagaactcccaag

SEQ ID NO: 542401 - DNA, 22 bp, Homo sapiens
tgcagaacttgaagcctgctcc

SEQ ID NO: 542402 - DNA, 14 bp, Homo sapiens
tgcagaccctcaga

SEQ ID NO: 542403 - DNA, 19 bp, Homo sapiens
tgcagactggtgttaatga

SEQ ID NO: 542404 - DNA, 12 bp, Homo sapiens
tgcagagcacaa

SEQ ID NO: 542405 - DNA, 13 bp, Homo sapiens
tgcagagcctgca

SEQ ID NO: 542406 - DNA, 24 bp, Homo sapiens
tgcagagttcagggaagataagtt

SEQ ID NO: 542407 - DNA, 19 bp, Homo sapiens
tgcagatactactgaccag

SEQ ID NO: 542408 - DNA, 13 bp, Homo sapiens
tgcagattccttt

SEQ ID NO: 542409 - DNA, 14 bp, Homo sapiens
tgcagcagggcagt

SEQ ID NO: 542410 - DNA, 16 bp, Homo sapiens
tgcagctcttcctgga

SEQ ID NO: 542411 - DNA, 18 bp, Homo sapiens
tgcagctcttcctggaca

SEQ ID NO: 542412 - DNA, 15 bp, Homo sapiens
tgcaggaacatgacc

SEQ ID NO: 542413 - DNA, 12 bp, Homo sapiens
tgcaggaatcaa

SEQ ID NO: 542414 - DNA, 14 bp, Homo sapiens
tgcaggaatcaaaa

SEQ ID NO: 542415 - DNA, 14 bp, Homo sapiens
tgcaggactcgggc

SEQ ID NO: 542416 - DNA, 13 bp, Homo sapiens
tgcaggcaggctg

SEQ ID NO: 542417 - DNA, 22 bp, Homo sapiens
tgcaggcggtatccagaggtga

SEQ ID NO: 542418 - DNA, 14 bp, Homo sapiens
tgcagggtgacctg

SEQ ID NO: 542419 - DNA, 15 bp, Homo sapiens
tgcagtcatcagaag

SEQ ID NO: 542420 - DNA, 15 bp, Homo sapiens
tgcataatatgcata

SEQ ID NO: 542421 - DNA, 22 bp, Homo sapiens
tgcatacaaacaagcatataaa

SEQ ID NO: 542422 - DNA, 23 bp, Homo sapiens
tgcatacaaacaagcatataaaa

SEQ ID NO: 542423 - DNA, 16 bp, Homo sapiens
tgcatagaataatgaa

SEQ ID NO: 542424 - DNA, 16 bp, Homo sapiens
tgcatatatatgtata

SEQ ID NO: 542425 - DNA, 13 bp, Homo sapiens
tgcatcccacagc

SEQ ID NO: 542426 - DNA, 16 bp, Homo sapiens
tgcatcccacagccag

SEQ ID NO: 542427 - DNA, 21 bp, Homo sapiens
tgcatggcacataccaaagct

SEQ ID NO: 542428 - DNA, 17 bp, Homo sapiens
tgcatgtcgcacaatgt

SEQ ID NO: 542429 - DNA, 12 bp, Homo sapiens
tgcatgtctgca

SEQ ID NO: 542430 - DNA, 18 bp, Homo sapiens
tgcatttaagttgtaaac

SEQ ID NO: 542431 - DNA, 23 bp, Homo sapiens
tgcatttaagttgtaaacgtctt

SEQ ID NO: 542432 - DNA, 20 bp, Homo sapiens
tgcattttctgaaactaatg

SEQ ID NO: 542433 - DNA, 23 bp, Homo sapiens
tgcattttctgaaactaatgaaa

SEQ ID NO: 542434 - DNA, 11 bp, Homo sapiens
tgccaaaataa

SEQ ID NO: 542435 - DNA, 14 bp, Homo sapiens
tgccaaaataaagt

SEQ ID NO: 542436 - DNA, 16 bp, Homo sapiens
tgccaaaataaagtct

SEQ ID NO: 542437 - DNA, 12 bp, Homo sapiens
tgccaaacatta

SEQ ID NO: 542438 - DNA, 12 bp, Homo sapiens
tgccaagagagg

SEQ ID NO: 542439 - DNA, 17 bp, Homo sapiens
tgccacataattcatta

SEQ ID NO: 542440 - DNA, 23 bp, Homo sapiens
tgccacataattcattaaaaaca

SEQ ID NO: 542441 - DNA, 13 bp, Homo sapiens
tgccactttccaa

SEQ ID NO: 542442 - DNA, 17 bp, Homo sapiens
tgccagcacccccacgc

SEQ ID NO: 542443 - DNA, 12 bp, Homo sapiens
tgccaggagtgg

SEQ ID NO: 542444 - DNA, 21 bp, Homo sapiens
tgccaggagtgggtgggacac

SEQ ID NO: 542445 - DNA, 21 bp, Homo sapiens
tgccaggctcccactgcccct

SEQ ID NO: 542446 - DNA, 23 bp, Homo sapiens
tgccagtaccagccccaccctgt

SEQ ID NO: 542447 - DNA, 18 bp, Homo sapiens
tgccatattaaaatctga

SEQ ID NO: 542448 - DNA, 13 bp, Homo sapiens
tgccatcagcccc

SEQ ID NO: 542449 - DNA, 23 bp, Homo sapiens
tgccatggaggcacacagctgca

SEQ ID NO: 542450 - DNA, 21 bp, Homo sapiens
tggacctttgggttctttctg

SEQ ID NO: 542451 - DNA, 15 bp, Homo sapiens
tggactgtggcctca

SEQ ID NO: 542452 - DNA, 17 bp, Homo sapiens
tggactgtggcctcagg

SEQ ID NO: 542453 - DNA, 16 bp, Homo sapiens
tggagaagaatggctt

SEQ ID NO: 542454 - DNA, 17 bp, Homo sapiens
tggagaagaatggcttt

SEQ ID NO: 542455 - DNA, 17 bp, Homo sapiens
tggagaccaggactctg

SEQ ID NO: 542456 - DNA, 15 bp, Homo sapiens
tggagcagaggtggg

SEQ ID NO: 542457 - DNA, 14 bp, Homo sapiens
tggagcccaggagt

SEQ ID NO: 542458 - DNA, 21 bp, Homo sapiens
tggagctgaggactctcacga

SEQ ID NO: 542459 - DNA, 14 bp, Homo sapiens
tggagctgcttcca

SEQ ID NO: 542460 - DNA, 15 bp, Homo sapiens
tggagctgcttccag

SEQ ID NO: 542461 - DNA, 11 bp, Homo sapiens
tggaggagagc

SEQ ID NO: 542462 - DNA, 18 bp, Homo sapiens
tggaggcacacagctgca

SEQ ID NO: 542463 - DNA, 22 bp, Homo sapiens
tggaggcacacagctgcagaga

SEQ ID NO: 542464 - DNA, 14 bp, Homo sapiens
tggaggccaggaat

SEQ ID NO: 542465 - DNA, 17 bp, Homo sapiens
tggagggctgcagagcc

SEQ ID NO: 542466 - DNA, 15 bp, Homo sapiens
tggaggggagctctg

SEQ ID NO: 542467 - DNA, 16 bp, Homo sapiens
tggagtccagacctgg

SEQ ID NO: 542468 - DNA, 22 bp, Homo sapiens
tggagtccagacctgggccctg

SEQ ID NO: 542469 - DNA, 17 bp, Homo sapiens
tggatcactcaccattc

SEQ ID NO: 542470 - DNA, 22 bp, Homo sapiens
tggatcaggaacccttacagta

SEQ ID NO: 542471 - DNA, 14 bp, Homo sapiens
tggatggcacaatg

SEQ ID NO: 542472 - DNA, 17 bp, Homo sapiens
tggcaaagctgttcttc

SEQ ID NO: 542473 - DNA, 15 bp, Homo sapiens
tggcaaatattttgt

SEQ ID NO: 542474 - DNA, 14 bp, Homo sapiens
tggcaacaaactgc

SEQ ID NO: 542475 - DNA, 22 bp, Homo sapiens
tggcaagttttgatatgagtat

SEQ ID NO: 542476 - DNA, 19 bp, Homo sapiens
tggcaatattctgtaacta

SEQ ID NO: 542477 - DNA, 19 bp, Homo sapiens
tggcacagggcatgaaatg

SEQ ID NO: 542478 - DNA, 17 bp, Homo sapiens
tggcaccaataaaggag

SEQ ID NO: 542479 - DNA, 20 bp, Homo sapiens
tggcaccaataaaggaggaa

SEQ ID NO: 542480 - DNA, 21 bp, Homo sapiens
tggcacctgtctgctccagct

SEQ ID NO: 542481 - DNA, 19 bp, Homo sapiens
tggcagaagcagttgcaat

SEQ ID NO: 542482 - DNA, 15 bp, Homo sapiens
tggcagatgcagctc

SEQ ID NO: 542483 - DNA, 17 bp, Homo sapiens
tggcagatgcagctctt

SEQ ID NO: 542484 - DNA, 11 bp, Homo sapiens
tggcaggcagg

SEQ ID NO: 542485 - DNA, 16 bp, Homo sapiens
tggcagggcaggcaga

SEQ ID NO: 542486 - DNA, 21 bp, Homo sapiens
tggcagggcaggcagagctca

SEQ ID NO: 542487 - DNA, 24 bp, Homo sapiens
tggcaggggtggaggagagcctgg

SEQ ID NO: 542488 - DNA, 18 bp, Homo sapiens
tggcaggtggccagggct

SEQ ID NO: 542489 - DNA, 11 bp, Homo sapiens
tggcagtattg

SEQ ID NO: 542490 - DNA, 14 bp, Homo sapiens
tggcagtattgaca

SEQ ID NO: 542491 - DNA, 15 bp, Homo sapiens
tggcatttagcacag

SEQ ID NO: 542492 - DNA, 20 bp, Homo sapiens
tggcatttagcacagtattt

SEQ ID NO: 542493 - DNA, 22 bp, Homo sapiens
tggccactttaagagagaaatc

SEQ ID NO: 542494 - DNA, 23 bp, Homo sapiens
tggccaggataatatatttgcag

SEQ ID NO: 542495 - DNA, 22 bp, Homo sapiens
tggccataagcaacaattttca

SEQ ID NO: 542496 - DNA, 14 bp, Homo sapiens
tggcccaccaggcc

SEQ ID NO: 542497 - DNA, 19 bp, Homo sapiens
tggcccaccaggcccccct

SEQ ID NO: 542498 - DNA, 23 bp, Homo sapiens
tggcccagggtgaggtggcatgg

SEQ ID NO: 542499 - DNA, 18 bp, Homo sapiens
tggcccccactggctgtg

SEQ ID NO: 542500 - DNA, 13 bp, Homo sapiens
tggccctggggcc

SEQ ID NO: 542501 - DNA, 16 bp, Homo sapiens
tggccctgtagctctg

SEQ ID NO: 542502 - DNA, 18 bp, Homo sapiens
tggcctaatattgaaaat

SEQ ID NO: 542503 - DNA, 22 bp, Homo sapiens
tggcctaatattgaaaatgtca

SEQ ID NO: 542504 - DNA, 21 bp, Homo sapiens
tggcctgatgaccaattttaa

SEQ ID NO: 542505 - DNA, 13 bp, Homo sapiens
tggcctggccaga

SEQ ID NO: 542506 - DNA, 15 bp, Homo sapiens
tggcctggccagacc

SEQ ID NO: 542507 - DNA, 21 bp, Homo sapiens
tggcctgtgcgatcccacccg

SEQ ID NO: 542508 - DNA, 22 bp, Homo sapiens
tggcgagttctctttggaaata

SEQ ID NO: 542509 - DNA, 15 bp, Homo sapiens
tggcgcgcagcccgg

SEQ ID NO: 542510 - DNA, 17 bp, Homo sapiens
tggcgtatcaggaaagc

SEQ ID NO: 542511 - DNA, 14 bp, Homo sapiens
tggctcctcaccac

SEQ ID NO: 542512 - DNA, 15 bp, Homo sapiens
tggctcctgcccact

SEQ ID NO: 542513 - DNA, 15 bp, Homo sapiens
tggctgggctacaat

SEQ ID NO: 542514 - DNA, 19 bp, Homo sapiens
tggctgtgctctcaccagc

SEQ ID NO: 542515 - DNA, 15 bp, Homo sapiens
tggcttcccatgtct

SEQ ID NO: 542516 - DNA, 12 bp, Homo sapiens
tggcttggagca

SEQ ID NO: 542517 - DNA, 22 bp, Homo sapiens
tgggaatgtatagtatttgaaa

SEQ ID NO: 542518 - DNA, 21 bp, Homo sapiens
tgggaccctcggggcaggaag

SEQ ID NO: 542519 - DNA, 16 bp, Homo sapiens
tgggagatgctgggac

SEQ ID NO: 542520 - DNA, 18 bp, Homo sapiens
tgggagctggagtccact

SEQ ID NO: 542521 - DNA, 14 bp, Homo sapiens
tgggagtcagggag

SEQ ID NO: 542522 - DNA, 20 bp, Homo sapiens
tgggagtcagggagccctgg

SEQ ID NO: 542523 - DNA, 21 bp, Homo sapiens
tgggagtcagggagccctggg

SEQ ID NO: 542524 - DNA, 16 bp, Homo sapiens
tgggataggggcagag

SEQ ID NO: 542525 - DNA, 16 bp, Homo sapiens
tgggatgggcacaggc

SEQ ID NO: 542526 - DNA, 13 bp, Homo sapiens
tgggcaatattct

SEQ ID NO: 542527 - DNA, 19 bp, Homo sapiens
tgggcaatattctctgtac

SEQ ID NO: 542528 - DNA, 20 bp, Homo sapiens
tgggcaatattctctgtaca

SEQ ID NO: 542529 - DNA, 12 bp, Homo sapiens
tgggcacaggct

SEQ ID NO: 542530 - DNA, 22 bp, Homo sapiens
tgggcatccccagccccctggc

SEQ ID NO: 542531 - DNA, 14 bp, Homo sapiens
tgggcccacatccg

SEQ ID NO: 542532 - DNA, 22 bp, Homo sapiens
tgggcccacccaagcaggaggc

SEQ ID NO: 542533 - DNA, 21 bp, Homo sapiens
tgggcccagaccactgtctcc

SEQ ID NO: 542534 - DNA, 22 bp, Homo sapiens
tgggcccagaccactgtctcca

SEQ ID NO: 542535 - DNA, 23 bp, Homo sapiens
tgggccctggttcccccaggacc

SEQ ID NO: 542536 - DNA, 13 bp, Homo sapiens
tgggcggcagaga

SEQ ID NO: 542537 - DNA, 14 bp, Homo sapiens
tgggctctgcgtcc

SEQ ID NO: 542538 - DNA, 19 bp, Homo sapiens
tgggctgggacttcttacc

SEQ ID NO: 542539 - DNA, 17 bp, Homo sapiens
tggggacgtgtgtcctt

SEQ ID NO: 542540 - DNA, 19 bp, Homo sapiens
tggggaggagactcaggcc

SEQ ID NO: 542541 - DNA, 21 bp, Homo sapiens
tggggaggagactcaggccca

SEQ ID NO: 542542 - DNA, 21 bp, Homo sapiens
tggggagtattatggaaatcc

SEQ ID NO: 542543 - DNA, 22 bp, Homo sapiens
tggggagtattatggaaatcca

SEQ ID NO: 542544 - DNA, 18 bp, Homo sapiens
tggggcacagggagaggc

SEQ ID NO: 542545 - DNA, 18 bp, Homo sapiens
tggggcagcacagagagg

SEQ ID NO: 542546 - DNA, 22 bp, Homo sapiens
tggggcaggaggggagtgaggc

SEQ ID NO: 542547 - DNA, 23 bp, Homo sapiens
tgggggcttctctgctgagaagg

SEQ ID NO: 542548 - DNA, 13 bp, Homo sapiens
tgggggggcagag

SEQ ID NO: 542549 - DNA, 22 bp, Homo sapiens
tggggtcaggttgacaggaggt

SEQ ID NO: 542550 - DNA, 16 bp, Homo sapiens
tggggtttccacacag

SEQ ID NO: 542551 - DNA, 19 bp, Homo sapiens
tggggtttccacacaggcc

SEQ ID NO: 542552 - DNA, 14 bp, Homo sapiens
tgggtccaggagat

SEQ ID NO: 542553 - DNA, 13 bp, Homo sapiens
tgggtctggagga

SEQ ID NO: 542554 - DNA, 12 bp, Homo sapiens
tgggttctttct

SEQ ID NO: 542555 - DNA, 18 bp, Homo sapiens
tgggttctttctgggggg

SEQ ID NO: 542556 - DNA, 12 bp, Homo sapiens
tggtaacttttg

SEQ ID NO: 542557 - DNA, 14 bp, Homo sapiens
tggtaacttttgta

SEQ ID NO: 542558 - DNA, 16 bp, Homo sapiens
tggtaatcatattaga

SEQ ID NO: 542559 - DNA, 19 bp, Homo sapiens
tggtaatttagtgtatatg

SEQ ID NO: 542560 - DNA, 14 bp, Homo sapiens
tggtaccttgcaca

SEQ ID NO: 542561 - DNA, 19 bp, Homo sapiens
tggtacttgctgctatttt

SEQ ID NO: 542562 - DNA, 16 bp, Homo sapiens
tggtacttggcaccaa

SEQ ID NO: 542563 - DNA, 14 bp, Homo sapiens
tggtactttctgta

SEQ ID NO: 542564 - DNA, 18 bp, Homo sapiens
tggtcacaaagctattta

SEQ ID NO: 542565 - DNA, 15 bp, Homo sapiens
tggtcacagccaggc

SEQ ID NO: 542566 - DNA, 15 bp, Homo sapiens
tggtccacattctgc

SEQ ID NO: 542567 - DNA, 18 bp, Homo sapiens
tggtccacattctgctgc

SEQ ID NO: 542568 - DNA, 14 bp, Homo sapiens
tggtccacttttcc

SEQ ID NO: 542569 - DNA, 18 bp, Homo sapiens
tggtcgccttccacctct

SEQ ID NO: 542570 - DNA, 14 bp, Homo sapiens
tggtctaatgttta

SEQ ID NO: 542571 - DNA, 15 bp, Homo sapiens
tggtctaatgtttaa

SEQ ID NO: 542572 - DNA, 18 bp, Homo sapiens
tggtctcctgcccccaca

SEQ ID NO: 542573 - DNA, 18 bp, Homo sapiens
tggtcttactttgttaat

SEQ ID NO: 542574 - DNA, 21 bp, Homo sapiens
tggtgaactgaagcagagtca

SEQ ID NO: 542575 - DNA, 22 bp, Homo sapiens
tggtgcccagactcaaggcctc

SEQ ID NO: 542576 - DNA, 22 bp, Homo sapiens
tggtgctcgccttcggcctctc

SEQ ID NO: 542577 - DNA, 15 bp, Homo sapiens
tggttacctattgct

SEQ ID NO: 542578 - DNA, 21 bp, Homo sapiens
tggttatagtgcaatatattt

SEQ ID NO: 542579 - DNA, 22 bp, Homo sapiens
tggttatagtgcaatatatttt

SEQ ID NO: 542580 - DNA, 20 bp, Homo sapiens
tggttccggaatcctgtcct

SEQ ID NO: 542581 - DNA, 23 bp, Homo sapiens
tggttccttctgatccacagcct

SEQ ID NO: 542582 - DNA, 20 bp, Homo sapiens
tggttgtttcttccaagact

SEQ ID NO: 542583 - DNA, 20 bp, Homo sapiens
tggttgttttttcattgtgt

SEQ ID NO: 542584 - DNA, 14 bp, Homo sapiens
tggtttctcttctc

SEQ ID NO: 542585 - DNA, 16 bp, Homo sapiens
tggttttaaaatactg

SEQ ID NO: 542586 - DNA, 19 bp, Homo sapiens
tggtttttatttctccttt

SEQ ID NO: 542587 - DNA, 20 bp, Homo sapiens
tgtaaaattggattattact

SEQ ID NO: 542588 - DNA, 15 bp, Homo sapiens
tgtaaactttgaaat

SEQ ID NO: 542589 - DNA, 17 bp, Homo sapiens
tgtaaactttgaaatat

SEQ ID NO: 542590 - DNA, 18 bp, Homo sapiens
tgtaaagatattgtatct

SEQ ID NO: 542591 - DNA, 23 bp, Homo sapiens
tgtaaagcaaaatatttgtgaaa

SEQ ID NO: 542592 - DNA, 15 bp, Homo sapiens
tgtaaataaaaatag

SEQ ID NO: 542593 - DNA, 19 bp, Homo sapiens
tgtaaataaaaatagctat

SEQ ID NO: 542594 - DNA, 23 bp, Homo sapiens
tgtaaatactttgtcctaagaga

SEQ ID NO: 542595 - DNA, 19 bp, Homo sapiens
tgtaaatcaagaccaaaga

SEQ ID NO: 542596 - DNA, 20 bp, Homo sapiens
tgtaaatcaagaccaaagag

SEQ ID NO: 542597 - DNA, 21 bp, Homo sapiens
tgtaaatgatatgtctttaaa

SEQ ID NO: 542598 - DNA, 23 bp, Homo sapiens
tgtaaattaggaggctcaacaat

SEQ ID NO: 542599 - DNA, 17 bp, Homo sapiens
tgtaacattctatttca

SEQ ID NO: 542600 - DNA, 18 bp, Homo sapiens
tgtaacgtgtgctgtgtt

SEQ ID NO: 542601 - DNA, 22 bp, Homo sapiens
tgtaactgctcttgggcaatat

SEQ ID NO: 542602 - DNA, 16 bp, Homo sapiens
tcataggaagttagcc

SEQ ID NO: 542603 - DNA, 12 bp, Homo sapiens
tcatatctgtat

SEQ ID NO: 542604 - DNA, 13 bp, Homo sapiens
tcatattagactt

SEQ ID NO: 542605 - DNA, 22 bp, Homo sapiens
tcatattggtatatccttttct

SEQ ID NO: 542606 - DNA, 17 bp, Homo sapiens
tcatattttaatttcaa

SEQ ID NO: 542607 - DNA, 21 bp, Homo sapiens
tcatattttcctttatgtgat

SEQ ID NO: 542608 - DNA, 22 bp, Homo sapiens
tcatattttcctttatgtgatg

SEQ ID NO: 542609 - DNA, 23 bp, Homo sapiens
tcatcagtcttaatattcagaga

SEQ ID NO: 542610 - DNA, 14 bp, Homo sapiens
tcatcatcagtctt

SEQ ID NO: 542611 - DNA, 15 bp, Homo sapiens
tcatccccagtccca

SEQ ID NO: 542612 - DNA, 16 bp, Homo sapiens
tcatcccggggccatg

SEQ ID NO: 542613 - DNA, 15 bp, Homo sapiens
tcatcctgccttcat

SEQ ID NO: 542614 - DNA, 22 bp, Homo sapiens
tcatcgaaaattcatttcacat

SEQ ID NO: 542615 - DNA, 16 bp, Homo sapiens
tcatctaccttttctc

SEQ ID NO: 542616 - DNA, 18 bp, Homo sapiens
tcatctaccttttctctt

SEQ ID NO: 542617 - DNA, 19 bp, Homo sapiens
tcatcttgacagagcctgc

SEQ ID NO: 542618 - DNA, 14 bp, Homo sapiens
tcatgaacagctct

SEQ ID NO: 542619 - DNA, 21 bp, Homo sapiens
tcatgaacagctctgagatcc

SEQ ID NO: 542620 - DNA, 19 bp, Homo sapiens
tcatgaggggaaagggaga

SEQ ID NO: 542621 - DNA, 17 bp, Homo sapiens
tcatgatgctctttccc

SEQ ID NO: 542622 - DNA, 21 bp, Homo sapiens
tcatgcctttatttctgtatc

SEQ ID NO: 542623 - DNA, 23 bp, Homo sapiens
tcatgcctttatttctgtatctg

SEQ ID NO: 542624 - DNA, 23 bp, Homo sapiens
tcatgctcccctgtgccagccca

SEQ ID NO: 542625 - DNA, 17 bp, Homo sapiens
tcatgctgcccctgcct

SEQ ID NO: 542626 - DNA, 17 bp, Homo sapiens
tcatgcttctactccat

SEQ ID NO: 542627 - DNA, 23 bp, Homo sapiens
tcatgctttaaagtgtaataata

SEQ ID NO: 542628 - DNA, 16 bp, Homo sapiens
tcatggaattggttta

SEQ ID NO: 542629 - DNA, 20 bp, Homo sapiens
tcatgtcctgtgtcagttta

SEQ ID NO: 542630 - DNA, 16 bp, Homo sapiens
tcatgtgcgaacacag

SEQ ID NO: 542631 - DNA, 17 bp, Homo sapiens
tcatgtgcgaacacagt

SEQ ID NO: 542632 - DNA, 17 bp, Homo sapiens
tcatgtggcctaatatt

SEQ ID NO: 542633 - DNA, 23 bp, Homo sapiens
tcatgtggcctaatattgaaaat

SEQ ID NO: 542634 - DNA, 18 bp, Homo sapiens
tcatgttaattgatagaa

SEQ ID NO: 542635 - DNA, 22 bp, Homo sapiens
tcatgttcccacttcaaaacaa

SEQ ID NO: 542636 - DNA, 23 bp, Homo sapiens
tcatgttcccacttcaaaacaaa

SEQ ID NO: 542637 - DNA, 17 bp, Homo sapiens
tcatgttgatgtgtccg

SEQ ID NO: 542638 - DNA, 18 bp, Homo sapiens
tcatgttggtaccctgga

SEQ ID NO: 542639 - DNA, 16 bp, Homo sapiens
tcattacctgtagctt

SEQ ID NO: 542640 - DNA, 18 bp, Homo sapiens
tcattacctgtagctttg

SEQ ID NO: 542641 - DNA, 16 bp, Homo sapiens
tcattagcaaaaaaag

SEQ ID NO: 542642 - DNA, 22 bp, Homo sapiens
tcattagcaaaaaaagttgtat

SEQ ID NO: 542643 - DNA, 16 bp, Homo sapiens
tcattatcttcatgtt

SEQ ID NO: 542644 - DNA, 24 bp, Homo sapiens
tcattcaccagtacattctcagtt

SEQ ID NO: 542645 - DNA, 19 bp, Homo sapiens
tcattcatattacaatatt

SEQ ID NO: 542646 - DNA, 12 bp, Homo sapiens
tcattcctctgt

SEQ ID NO: 542647 - DNA, 23 bp, Homo sapiens
tcattcttataacattgtatgtt

SEQ ID NO: 542648 - DNA, 12 bp, Homo sapiens
tcattgcttctt

SEQ ID NO: 542649 - DNA, 17 bp, Homo sapiens
tcattgcttcttctgag

SEQ ID NO: 542650 - DNA, 22 bp, Homo sapiens
tcatttaaacccaatcagatgc

SEQ ID NO: 542651 - DNA, 16 bp, Homo sapiens
tcatttccatgtatgc

SEQ ID NO: 542652 - DNA, 22 bp, Homo sapiens
tcattttatatatgaaaactaa

SEQ ID NO: 542653 - DNA, 21 bp, Homo sapiens
tcattttattctgtcaatgaa

SEQ ID NO: 542654 - DNA, 13 bp, Homo sapiens
tcattttcatgtg

SEQ ID NO: 542655 - DNA, 19 bp, Homo sapiens
tccaaactcttccctctct

SEQ ID NO: 542656 - DNA, 16 bp, Homo sapiens
tccaaacttaacagat

SEQ ID NO: 542657 - DNA, 15 bp, Homo sapiens
tccaaagatctgaat

SEQ ID NO: 542658 - DNA, 12 bp, Homo sapiens
tccaaagcagag

SEQ ID NO: 542659 - DNA, 11 bp, Homo sapiens
tccaaatgtct

SEQ ID NO: 542660 - DNA, 17 bp, Homo sapiens
tccaaatgtctactgaa

SEQ ID NO: 542661 - DNA, 17 bp, Homo sapiens
tccaacaccacagacac

SEQ ID NO: 542662 - DNA, 18 bp, Homo sapiens
tccaacaccacagacaca

SEQ ID NO: 542663 - DNA, 17 bp, Homo sapiens
tccaacatgtgatgtgt

SEQ ID NO: 542664 - DNA, 17 bp, Homo sapiens
tccaactcagagcacag

SEQ ID NO: 542665 - DNA, 16 bp, Homo sapiens
tccaactggatgttga

SEQ ID NO: 542666 - DNA, 16 bp, Homo sapiens
tccaagggcccagagg

SEQ ID NO: 542667 - DNA, 20 bp, Homo sapiens
tccaaggggtcccctccagg

SEQ ID NO: 542668 - DNA, 23 bp, Homo sapiens
tccaagtcactgcaaaaccaggt

SEQ ID NO: 542669 - DNA, 17 bp, Homo sapiens
tccacaacctcctcctc

SEQ ID NO: 542670 - DNA, 12 bp, Homo sapiens
tccacacaggcc

SEQ ID NO: 542671 - DNA, 23 bp, Homo sapiens
tccacacaggcccatgccctccg

SEQ ID NO: 542672 - DNA, 15 bp, Homo sapiens
tccacaggtctcaga

SEQ ID NO: 542673 - DNA, 15 bp, Homo sapiens
tccacattctgctgc

SEQ ID NO: 542674 - DNA, 14 bp, Homo sapiens
tccacctgcacaaa

SEQ ID NO: 542675 - DNA, 16 bp, Homo sapiens
tccacctgcacaaaca

SEQ ID NO: 542676 - DNA, 13 bp, Homo sapiens
tccacctggaagc

SEQ ID NO: 542677 - DNA, 14 bp, Homo sapiens
tccacctgggagat

SEQ ID NO: 542678 - DNA, 13 bp, Homo sapiens
tccaccttccctt

SEQ ID NO: 542679 - DNA, 22 bp, Homo sapiens
tccaccttcccttctacaagga

SEQ ID NO: 542680 - DNA, 15 bp, Homo sapiens
tccactgtttattca

SEQ ID NO: 542681 - DNA, 17 bp, Homo sapiens
tccagaaacacccacag

SEQ ID NO: 542682 - DNA, 17 bp, Homo sapiens
tctatccatctcctggt

SEQ ID NO: 542683 - DNA, 18 bp, Homo sapiens
tctatgccccaaatatag

SEQ ID NO: 542684 - DNA, 18 bp, Homo sapiens
tctatgctcataactgtg

SEQ ID NO: 542685 - DNA, 11 bp, Homo sapiens
tctatgtaact

SEQ ID NO: 542686 - DNA, 14 bp, Homo sapiens
tctatgtaacttgt

SEQ ID NO: 542687 - DNA, 15 bp, Homo sapiens
tctatgtaacttgtt

SEQ ID NO: 542688 - DNA, 18 bp, Homo sapiens
tctattagcttactgatt

SEQ ID NO: 542689 - DNA, 18 bp, Homo sapiens
tctatttccccctttctt

SEQ ID NO: 542690 - DNA, 23 bp, Homo sapiens
tctattttaccactaattttgtt

SEQ ID NO: 542691 - DNA, 22 bp, Homo sapiens
tctcaacaaggcaaaaacaaag

SEQ ID NO: 542692 - DNA, 20 bp, Homo sapiens
tctcaacggaagccccctct

SEQ ID NO: 542693 - DNA, 19 bp, Homo sapiens
tctcactgctttaggattg

SEQ ID NO: 542694 - DNA, 16 bp, Homo sapiens
tctcagcatatatata

SEQ ID NO: 542695 - DNA, 12 bp, Homo sapiens
tctcagtctcac

SEQ ID NO: 542696 - DNA, 16 bp, Homo sapiens
tctcagtttgtataga

SEQ ID NO: 542697 - DNA, 23 bp, Homo sapiens
tctcatccccagtcccaatgcac

SEQ ID NO: 542698 - DNA, 21 bp, Homo sapiens
tctcatccttttctcctatct

SEQ ID NO: 542699 - DNA, 13 bp, Homo sapiens
tctcattcctctg

SEQ ID NO: 542700 - DNA, 12 bp, Homo sapiens
tctccagctgat

SEQ ID NO: 542701 - DNA, 15 bp, Homo sapiens
tctccagctgatttt

SEQ ID NO: 542702 - DNA, 19 bp, Homo sapiens
tctccaggcaccatctccc

SEQ ID NO: 542703 - DNA, 17 bp, Homo sapiens
tctccagtcttccacct

SEQ ID NO: 542704 - DNA, 22 bp, Homo sapiens
tctccattttggtgtctttctc

SEQ ID NO: 542705 - DNA, 19 bp, Homo sapiens
tctcccaactcttgcacag

SEQ ID NO: 542706 - DNA, 20 bp, Homo sapiens
tctcccccacccttgttcca

SEQ ID NO: 542707 - DNA, 16 bp, Homo sapiens
tctccccgcagtgttt

SEQ ID NO: 542708 - DNA, 15 bp, Homo sapiens
tctcccctcccttgt

SEQ ID NO: 542709 - DNA, 17 bp, Homo sapiens
tctcccctgcgcaggcc

SEQ ID NO: 542710 - DNA, 13 bp, Homo sapiens
tctcctgggccag

SEQ ID NO: 542711 - DNA, 20 bp, Homo sapiens
tctcctgggccagggtctcg

SEQ ID NO: 542712 - DNA, 12 bp, Homo sapiens
tctcctgtgcac

SEQ ID NO: 542713 - DNA, 20 bp, Homo sapiens
tctctatgccctgttaaatg

SEQ ID NO: 542714 - DNA, 13 bp, Homo sapiens
tctctatttatga

SEQ ID NO: 542715 - DNA, 15 bp, Homo sapiens
tctctatttatgaga

SEQ ID NO: 542716 - DNA, 23 bp, Homo sapiens
tctctatttccccctttcttcct

SEQ ID NO: 542717 - DNA, 18 bp, Homo sapiens
tctctccaaggtgtgccc

SEQ ID NO: 542718 - DNA, 19 bp, Homo sapiens
tctctccatcagaggacac

SEQ ID NO: 542719 - DNA, 15 bp, Homo sapiens
tctctgcccagcttt

SEQ ID NO: 542720 - DNA, 12 bp, Homo sapiens
tctctggctcta

SEQ ID NO: 542721 - DNA, 22 bp, Homo sapiens
tctctgtactaaggagaaatga

SEQ ID NO: 542722 - DNA, 15 bp, Homo sapiens
tctcttccaggcagc

SEQ ID NO: 542723 - DNA, 17 bp, Homo sapiens
tctcttcttactgtatt

SEQ ID NO: 542724 - DNA, 13 bp, Homo sapiens
tctctttcttcct

SEQ ID NO: 542725 - DNA, 11 bp, Homo sapiens
tctctttgccc

SEQ ID NO: 542726 - DNA, 19 bp, Homo sapiens
tctctttggaaatagcatg

SEQ ID NO: 542727 - DNA, 15 bp, Homo sapiens
tctcttttttacaaa

SEQ ID NO: 542728 - DNA, 16 bp, Homo sapiens
tctcttttttacaaag

SEQ ID NO: 542729 - DNA, 12 bp, Homo sapiens
tctgaaaactgg

SEQ ID NO: 542730 - DNA, 14 bp, Homo sapiens
tctgaaacatagat

SEQ ID NO: 542731 - DNA, 17 bp, Homo sapiens
tctgaaactaatgaaag

SEQ ID NO: 542732 - DNA, 18 bp, Homo sapiens
tctgaagattgtttatct

SEQ ID NO: 542733 - DNA, 17 bp, Homo sapiens
tctgaagttatatttcc

SEQ ID NO: 542734 - DNA, 20 bp, Homo sapiens
tctgaatggggctttcctga

SEQ ID NO: 542735 - DNA, 22 bp, Homo sapiens
tctgacagcatttcagctgtga

SEQ ID NO: 542736 - DNA, 16 bp, Homo sapiens
tctgacctgcccccgc

SEQ ID NO: 542737 - DNA, 23 bp, Homo sapiens
tctgagagaggctaaaatgtttt

SEQ ID NO: 542738 - DNA, 20 bp, Homo sapiens
tctgatatcaggaaatatct

SEQ ID NO: 542739 - DNA, 13 bp, Homo sapiens
tctgatctgggtt

SEQ ID NO: 542740 - DNA, 14 bp, Homo sapiens
tctgatctgggttt

SEQ ID NO: 542741 - DNA, 16 bp, Homo sapiens
tctgatgtaaatgaag

SEQ ID NO: 542742 - DNA, 18 bp, Homo sapiens
tctgattcccagaaatac

SEQ ID NO: 542743 - DNA, 13 bp, Homo sapiens
tctgattctatgt

SEQ ID NO: 542744 - DNA, 14 bp, Homo sapiens
tctgattctatgta

SEQ ID NO: 542745 - DNA, 16 bp, Homo sapiens
tctgattctatgtaac

SEQ ID NO: 542746 - DNA, 17 bp, Homo sapiens
tctgattctatgtaact

SEQ ID NO: 542747 - DNA, 13 bp, Homo sapiens
tctgcaagaacac

SEQ ID NO: 542748 - DNA, 20 bp, Homo sapiens
tctgcagtgttctgtgaata

SEQ ID NO: 542749 - DNA, 20 bp, Homo sapiens
tctgcattttctgaaactaa

SEQ ID NO: 542750 - DNA, 23 bp, Homo sapiens
tctgccatcagcccctgctgctc

SEQ ID NO: 542751 - DNA, 18 bp, Homo sapiens
tctgcccagcttttcatt

SEQ ID NO: 542752 - DNA, 16 bp, Homo sapiens
tctgccccaagttttg

SEQ ID NO: 542753 - DNA, 22 bp, Homo sapiens
tctgcctgaggggcagcctgcc

SEQ ID NO: 542754 - DNA, 23 bp, Homo sapiens
tctgcctgaggggcagcctgcct

SEQ ID NO: 542755 - DNA, 14 bp, Homo sapiens
tctgccttccaggc

SEQ ID NO: 542756 - DNA, 15 bp, Homo sapiens
tctgctaaattgatg

SEQ ID NO: 542757 - DNA, 19 bp, Homo sapiens
tctgctaaattgatgttga

SEQ ID NO: 542758 - DNA, 20 bp, Homo sapiens
tctgctccagctctggcatg

SEQ ID NO: 542759 - DNA, 20 bp, Homo sapiens
tctgctggtcacttcttctg

SEQ ID NO: 542760 - DNA, 21 bp, Homo sapiens
tctgctggtcacttcttctgt

SEQ ID NO: 542761 - DNA, 23 bp, Homo sapiens
tctggaatcattgtccagagctg

SEQ ID NO: 542762 - DNA, 21 bp, Homo sapiens
tctggcaaatattttgtcact

SEQ ID NO: 542763 - DNA, 18 bp, Homo sapiens
taaaatggcaacaaactg

SEQ ID NO: 542764 - DNA, 19 bp, Homo sapiens
taaaatggcatttagcaca

SEQ ID NO: 542765 - DNA, 21 bp, Homo sapiens
taaaatgtgtatttttcaagg

SEQ ID NO: 542766 - DNA, 23 bp, Homo sapiens
taaaatgttttcagctaggaaca

SEQ ID NO: 542767 - DNA, 19 bp, Homo sapiens
taaaattaaaatttaacat

SEQ ID NO: 542768 - DNA, 17 bp, Homo sapiens
taaaattaatttgtgca

SEQ ID NO: 542769 - DNA, 19 bp, Homo sapiens
taaaatttaacatctgcag

SEQ ID NO: 542770 - DNA, 17 bp, Homo sapiens
taaaatttgaaacattg

SEQ ID NO: 542771 - DNA, 22 bp, Homo sapiens
taaacaaagagtagaactttaa

SEQ ID NO: 542772 - DNA, 16 bp, Homo sapiens
taaacatcaggttagg

SEQ ID NO: 542773 - DNA, 17 bp, Homo sapiens
taaacatcaggttaggc

SEQ ID NO: 542774 - DNA, 19 bp, Homo sapiens
taaacatcaggttaggcag

SEQ ID NO: 542775 - DNA, 21 bp, Homo sapiens
taaacatcaggttaggcagta

SEQ ID NO: 542776 - DNA, 15 bp, Homo sapiens
taaacattaaatgtc

SEQ ID NO: 542777 - DNA, 18 bp, Homo sapiens
taaacattaaatgtctta

SEQ ID NO: 542778 - DNA, 11 bp, Homo sapiens
taaacatttcc

SEQ ID NO: 542779 - DNA, 14 bp, Homo sapiens
taaacatttccttt

SEQ ID NO: 542780 - DNA, 15 bp, Homo sapiens
taaaccaaaggacat

SEQ ID NO: 542781 - DNA, 18 bp, Homo sapiens
taaaccagtttagatttc

SEQ ID NO: 542782 - DNA, 15 bp, Homo sapiens
taaacgtctttttaa

SEQ ID NO: 542783 - DNA, 20 bp, Homo sapiens
taaacgtgtatgtttttcag

SEQ ID NO: 542784 - DNA, 23 bp, Homo sapiens
taaacgtgtatgtttttcagttc

SEQ ID NO: 542785 - DNA, 13 bp, Homo sapiens
taaactcagtcaa

SEQ ID NO: 542786 - DNA, 12 bp, Homo sapiens
taaactttgaaa

SEQ ID NO: 542787 - DNA, 13 bp, Homo sapiens
taaactttgaaat

SEQ ID NO: 542788 - DNA, 22 bp, Homo sapiens
taaacttttatgcgcaaataca

SEQ ID NO: 542789 - DNA, 23 bp, Homo sapiens
taaacttttatgcgcaaatacaa

SEQ ID NO: 542790 - DNA, 23 bp, Homo sapiens
taaagaaaagttcttaaaacact

SEQ ID NO: 542791 - DNA, 15 bp, Homo sapiens
taaagaataggactt

SEQ ID NO: 542792 - DNA, 23 bp, Homo sapiens
taaagaccatttagtcctcacct

SEQ ID NO: 542793 - DNA, 22 bp, Homo sapiens
taaagagcaggatagctcttcc

SEQ ID NO: 542794 - DNA, 23 bp, Homo sapiens
taaagagcaggatagctcttcct

SEQ ID NO: 542795 - DNA, 19 bp, Homo sapiens
taaagatattgtatctcct

SEQ ID NO: 542796 - DNA, 13 bp, Homo sapiens
taaagatcttttt

SEQ ID NO: 542797 - DNA, 19 bp, Homo sapiens
taaagatctttttttaagt

SEQ ID NO: 542798 - DNA, 13 bp, Homo sapiens
taaagcaaaatat

SEQ ID NO: 542799 - DNA, 19 bp, Homo sapiens
taaagcaagctcacttgct

SEQ ID NO: 542800 - DNA, 15 bp, Homo sapiens
taaagcatctaaact

SEQ ID NO: 542801 - DNA, 17 bp, Homo sapiens
taaagcgaaaaactcaa

SEQ ID NO: 542802 - DNA, 22 bp, Homo sapiens
taaagctcgtagaaacaagaca

SEQ ID NO: 542803 - DNA, 17 bp, Homo sapiens
taaaggaggaatcagac

SEQ ID NO: 542804 - DNA, 21 bp, Homo sapiens
taaaggcagctgttgtctctt

SEQ ID NO: 542805 - DNA, 20 bp, Homo sapiens
taaagtaattgttccagaga

SEQ ID NO: 542806 - DNA, 22 bp, Homo sapiens
taaagtactgagcagtgatatt

SEQ ID NO: 542807 - DNA, 23 bp, Homo sapiens
taaagtactgagcagtgatattc

SEQ ID NO: 542808 - DNA, 20 bp, Homo sapiens
taaagtatgaatatttcatt

SEQ ID NO: 542809 - DNA, 20 bp, Homo sapiens
taaagttccatgaagacaaa

SEQ ID NO: 542810 - DNA, 17 bp, Homo sapiens
taaagtttcaaaaatct

SEQ ID NO: 542811 - DNA, 18 bp, Homo sapiens
taaagtttcaaaaatctg

SEQ ID NO: 542812 - DNA, 19 bp, Homo sapiens
taaagtttcaaaaatctga

SEQ ID NO: 542813 - DNA, 15 bp, Homo sapiens
taaagtttgatcttc

SEQ ID NO: 542814 - DNA, 13 bp, Homo sapiens
taaataaaaatag

SEQ ID NO: 542815 - DNA, 13 bp, Homo sapiens
taaataaaaatta

SEQ ID NO: 542816 - DNA, 20 bp, Homo sapiens
taaataaaagaaatgcacaa

SEQ ID NO: 542817 - DNA, 21 bp, Homo sapiens
taaataaaagaaatgcacaat

SEQ ID NO: 542818 - DNA, 11 bp, Homo sapiens
taaatactttg

SEQ ID NO: 542819 - DNA, 14 bp, Homo sapiens
taaatagtgaaaat

SEQ ID NO: 542820 - DNA, 19 bp, Homo sapiens
taaatagtgttattgagag

SEQ ID NO: 542821 - DNA, 14 bp, Homo sapiens
taaatattatgcct

SEQ ID NO: 542822 - DNA, 17 bp, Homo sapiens
taaatcaagaccaaaga

SEQ ID NO: 542823 - DNA, 21 bp, Homo sapiens
taaatctaaattaacttctat

SEQ ID NO: 542824 - DNA, 14 bp, Homo sapiens
taaatctcttctgt

SEQ ID NO: 542825 - DNA, 18 bp, Homo sapiens
taaatctcttctgtgttt

SEQ ID NO: 542826 - DNA, 14 bp, Homo sapiens
taaatgcctaataa

SEQ ID NO: 542827 - DNA, 11 bp, Homo sapiens
taaatggaaat

SEQ ID NO: 542828 - DNA, 15 bp, Homo sapiens
taaatggcattgaca

SEQ ID NO: 542829 - DNA, 12 bp, Homo sapiens
taaatgtatata

SEQ ID NO: 542830 - DNA, 17 bp, Homo sapiens
taaatgtatatacacat

SEQ ID NO: 542831 - DNA, 13 bp, Homo sapiens
taaatgtcttata

SEQ ID NO: 542832 - DNA, 14 bp, Homo sapiens
taaatgtcttatat

SEQ ID NO: 542833 - DNA, 22 bp, Homo sapiens
taaatgtcttcatgttgatgtg

SEQ ID NO: 542834 - DNA, 15 bp, Homo sapiens
taaatgtgaattact

SEQ ID NO: 542835 - DNA, 19 bp, Homo sapiens
taaatgtgattcacctctt

SEQ ID NO: 542836 - DNA, 13 bp, Homo sapiens
taaatgttaaaga

SEQ ID NO: 542837 - DNA, 17 bp, Homo sapiens
taaatgttaaagatgta

SEQ ID NO: 542838 - DNA, 18 bp, Homo sapiens
taaatgttaaagatgtag

SEQ ID NO: 542839 - DNA, 11 bp, Homo sapiens
taaatgttttg

SEQ ID NO: 542840 - DNA, 14 bp, Homo sapiens
taaatgttttgtaa

SEQ ID NO: 542841 - DNA, 18 bp, Homo sapiens
taaattagtacagcactt

SEQ ID NO: 542842 - DNA, 15 bp, Homo sapiens
taaattatcattgtt

SEQ ID NO: 542843 - DNA, 16 bp, Homo sapiens
taaattccaaagatct

SEQ ID NO: 542844 - DNA, 21 bp, Homo sapiens
taaattctttatttctgtcat

SEQ ID NO: 542845 - DNA, 15 bp, Homo sapiens
taaattgatgttgat

SEQ ID NO: 542846 - DNA, 18 bp, Homo sapiens
taaattgatgttgatgca

SEQ ID NO: 542847 - DNA, 19 bp, Homo sapiens
taaattgatgttgatgcaa

SEQ ID NO: 542848 - DNA, 14 bp, Homo sapiens
taaattgtaatttg

SEQ ID NO: 542849 - DNA, 15 bp, Homo sapiens
taaattgtaatttgg

SEQ ID NO: 542850 - DNA, 15 bp, Homo sapiens
taaattttgtacatt

SEQ ID NO: 542851 - DNA, 16 bp, Homo sapiens
taaattttgtacattt

SEQ ID NO: 542852 - DNA, 13 bp, Homo sapiens
taaatttttaagt

SEQ ID NO: 542853 - DNA, 14 bp, Homo sapiens
taaatttttaagtg

SEQ ID NO: 542854 - DNA, 17 bp, Homo sapiens
taaatttttaagtgtca

SEQ ID NO: 542855 - DNA, 15 bp, Homo sapiens
taacaactgctggga

SEQ ID NO: 542856 - DNA, 14 bp, Homo sapiens
taacacttgaaaag

SEQ ID NO: 542857 - DNA, 23 bp, Homo sapiens
taacagaaaaatgaaatttaagc

SEQ ID NO: 542858 - DNA, 23 bp, Homo sapiens
taacagagtgatttgtaaaacag

SEQ ID NO: 542859 - DNA, 12 bp, Homo sapiens
taacagctcctt

SEQ ID NO: 542860 - DNA, 13 bp, Homo sapiens
taacagtttaaaa

SEQ ID NO: 542861 - DNA, 22 bp, Homo sapiens
taacatctgcagtgttctgtga

SEQ ID NO: 542862 - DNA, 23 bp, Homo sapiens
taacatctgcagtgttctgtgaa

SEQ ID NO: 542863 - DNA, 23 bp, Homo sapiens
taacattatattcccaaatctca

SEQ ID NO: 542864 - DNA, 15 bp, Homo sapiens
taacattctatttca

SEQ ID NO: 542865 - DNA, 19 bp, Homo sapiens
taacattctatttcaactt

SEQ ID NO: 542866 - DNA, 16 bp, Homo sapiens
taacattcttggtcac

SEQ ID NO: 542867 - DNA, 20 bp, Homo sapiens
taacattcttggtcacaaag

SEQ ID NO: 542868 - DNA, 15 bp, Homo sapiens
taacattgtaaatga

SEQ ID NO: 542869 - DNA, 18 bp, Homo sapiens
taacatttctaactctga

SEQ ID NO: 542870 - DNA, 23 bp, Homo sapiens
taacatttctaactctgatgtaa

SEQ ID NO: 542871 - DNA, 14 bp, Homo sapiens
taaccacagctcct

SEQ ID NO: 542872 - DNA, 18 bp, Homo sapiens
taaccacagctccttttc

SEQ ID NO: 542873 - DNA, 23 bp, Homo sapiens
taaccacagctccttttccagag

SEQ ID NO: 542874 - DNA, 20 bp, Homo sapiens
taaccctgaatcagaggcag

SEQ ID NO: 542875 - DNA, 14 bp, Homo sapiens
taacctctgttcag

SEQ ID NO: 542876 - DNA, 21 bp, Homo sapiens
taactacctttggcttaattc

SEQ ID NO: 542877 - DNA, 22 bp, Homo sapiens
taactacctttggcttaattcc

SEQ ID NO: 542878 - DNA, 18 bp, Homo sapiens
taactactttctgttatc

SEQ ID NO: 542879 - DNA, 22 bp, Homo sapiens
taactactttctgttatctaga

SEQ ID NO: 542880 - DNA, 15 bp, Homo sapiens
taactatgtttaaag

SEQ ID NO: 542881 - DNA, 15 bp, Homo sapiens
taactccttacagaa

SEQ ID NO: 542882 - DNA, 15 bp, Homo sapiens
taactctgatgtaaa

SEQ ID NO: 542883 - DNA, 16 bp, Homo sapiens
taactgaaataaaaaa

SEQ ID NO: 542884 - DNA, 20 bp, Homo sapiens
taactgatggcaatattaag

SEQ ID NO: 542885 - DNA, 18 bp, Homo sapiens
tcaaaggagctttctcaa

SEQ ID NO: 542886 - DNA, 22 bp, Homo sapiens
tcaaagtcatgatgtttttaaa

SEQ ID NO: 542887 - DNA, 13 bp, Homo sapiens
tcaaatatgtaaa

SEQ ID NO: 542888 - DNA, 15 bp, Homo sapiens
tcaaatatgtaaact

SEQ ID NO: 542889 - DNA, 17 bp, Homo sapiens
tcaaatatgtaaacttt

SEQ ID NO: 542890 - DNA, 21 bp, Homo sapiens
tcaaatatgtaaactttaact

SEQ ID NO: 542891 - DNA, 20 bp, Homo sapiens
tcaaatgctactcagtatat

SEQ ID NO: 542892 - DNA, 22 bp, Homo sapiens
tcaaatgtaatgtggcttctgg

SEQ ID NO: 542893 - DNA, 12 bp, Homo sapiens
tcaaatgtacat

SEQ ID NO: 542894 - DNA, 16 bp, Homo sapiens
tcaacaaagaaatatt

SEQ ID NO: 542895 - DNA, 18 bp, Homo sapiens
tcaacaaagaaatattat

SEQ ID NO: 542896 - DNA, 15 bp, Homo sapiens
tcaacaataaaacat

SEQ ID NO: 542897 - DNA, 20 bp, Homo sapiens
tcaaccaaatggtacaaaac

SEQ ID NO: 542898 - DNA, 23 bp, Homo sapiens
tcaagaaaaaataaatggaaatc

SEQ ID NO: 542899 - DNA, 15 bp, Homo sapiens
tcaagaacttgttta

SEQ ID NO: 542900 - DNA, 16 bp, Homo sapiens
tcaagaacttgtttaa

SEQ ID NO: 542901 - DNA, 16 bp, Homo sapiens
tcaagaccagcctggc

SEQ ID NO: 542902 - DNA, 21 bp, Homo sapiens
tcaagccagcaacacagagca

SEQ ID NO: 542903 - DNA, 12 bp, Homo sapiens
tcaaggatgacg

SEQ ID NO: 542904 - DNA, 11 bp, Homo sapiens
tcaagtctgtg

SEQ ID NO: 542905 - DNA, 13 bp, Homo sapiens
tcaagttcacacc

SEQ ID NO: 542906 - DNA, 16 bp, Homo sapiens
tcaagttcacacctgc

SEQ ID NO: 542907 - DNA, 20 bp, Homo sapiens
tcaagttgcacactcactgg

SEQ ID NO: 542908 - DNA, 17 bp, Homo sapiens
tcaataaagtttgatct

SEQ ID NO: 542909 - DNA, 19 bp, Homo sapiens
tcaataaagtttgatcttc

SEQ ID NO: 542910 - DNA, 14 bp, Homo sapiens
tcaataacagccgc

SEQ ID NO: 542911 - DNA, 15 bp, Homo sapiens
tcaataactattgct

SEQ ID NO: 542912 - DNA, 16 bp, Homo sapiens
tcaatcccaaaagtca

SEQ ID NO: 542913 - DNA, 12 bp, Homo sapiens
tcaatccccata

SEQ ID NO: 542914 - DNA, 20 bp, Homo sapiens
tcaatctcgtatagaagtct

SEQ ID NO: 542915 - DNA, 22 bp, Homo sapiens
tcaatctcgtatagaagtcttc

SEQ ID NO: 542916 - DNA, 16 bp, Homo sapiens
tcaatgattattttca

SEQ ID NO: 542917 - DNA, 15 bp, Homo sapiens
tcaatgctacaaaat

SEQ ID NO: 542918 - DNA, 14 bp, Homo sapiens
tcaatttcagaaac

SEQ ID NO: 542919 - DNA, 15 bp, Homo sapiens
tcacaaagctattta

SEQ ID NO: 542920 - DNA, 16 bp, Homo sapiens
tcacaaagctatttaa

SEQ ID NO: 542921 - DNA, 17 bp, Homo sapiens
tcacaaagctatttaag

SEQ ID NO: 542922 - DNA, 18 bp, Homo sapiens
tcacaaatattaaaaagt

SEQ ID NO: 542923 - DNA, 20 bp, Homo sapiens
tcacaaatattaaaaagtct

SEQ ID NO: 542924 - DNA, 21 bp, Homo sapiens
tcacaggtgtggtgtaattta

SEQ ID NO: 542925 - DNA, 21 bp, Homo sapiens
tcacatagctacccaaaagag

SEQ ID NO: 542926 - DNA, 14 bp, Homo sapiens
tcacatattattgg

SEQ ID NO: 542927 - DNA, 15 bp, Homo sapiens
tcacatgttttcaaa

SEQ ID NO: 542928 - DNA, 20 bp, Homo sapiens
tcacatgttttcaaatggag

SEQ ID NO: 542929 - DNA, 19 bp, Homo sapiens
tcacattaatggtctaaaa

SEQ ID NO: 542930 - DNA, 22 bp, Homo sapiens
tcacattaatggtctaaaaata

SEQ ID NO: 542931 - DNA, 21 bp, Homo sapiens
tcaccacctgcccggcccagg

SEQ ID NO: 542932 - DNA, 14 bp, Homo sapiens
tcaccatccacctt

SEQ ID NO: 542933 - DNA, 13 bp, Homo sapiens
tcaccattcccag

SEQ ID NO: 542934 - DNA, 12 bp, Homo sapiens
tcacccctccac

SEQ ID NO: 542935 - DNA, 16 bp, Homo sapiens
tcacccggtgacctct

SEQ ID NO: 542936 - DNA, 17 bp, Homo sapiens
tcacctaattaatttca

SEQ ID NO: 542937 - DNA, 16 bp, Homo sapiens
tcacctatctggaaaa

SEQ ID NO: 542938 - DNA, 19 bp, Homo sapiens
tcaccttccctagttcttt

SEQ ID NO: 542939 - DNA, 14 bp, Homo sapiens
tcaccttctgtttt

SEQ ID NO: 542940 - DNA, 15 bp, Homo sapiens
tcacgcaacttgaaa

SEQ ID NO: 542941 - DNA, 16 bp, Homo sapiens
tcacgcaacttgaaat

SEQ ID NO: 542942 - DNA, 16 bp, Homo sapiens
tcacgtcataggaagt

SEQ ID NO: 542943 - DNA, 18 bp, Homo sapiens
tcactcagaagtccagag

SEQ ID NO: 542944 - DNA, 13 bp, Homo sapiens
tcactcagagcag

SEQ ID NO: 542945 - DNA, 15 bp, Homo sapiens
tcactccctgtcata

SEQ ID NO: 542946 - DNA, 20 bp, Homo sapiens
tcactgaacttttcaaaata

SEQ ID NO: 542947 - DNA, 16 bp, Homo sapiens
tcactgcctctttgca

SEQ ID NO: 542948 - DNA, 16 bp, Homo sapiens
tcactgctgtaaagca

SEQ ID NO: 542949 - DNA, 15 bp, Homo sapiens
tcactggcatctttg

SEQ ID NO: 542950 - DNA, 23 bp, Homo sapiens
tcactgtcaatgattattttcat

SEQ ID NO: 542951 - DNA, 23 bp, Homo sapiens
tcactgtcatgtgcgaacacagt

SEQ ID NO: 542952 - DNA, 13 bp, Homo sapiens
tcactgttataaa

SEQ ID NO: 542953 - DNA, 14 bp, Homo sapiens
tcactgttataaat

SEQ ID NO: 542954 - DNA, 23 bp, Homo sapiens
tcactgttataaattttgtacat

SEQ ID NO: 542955 - DNA, 13 bp, Homo sapiens
tcacttcttctgt

SEQ ID NO: 542956 - DNA, 15 bp, Homo sapiens
tcacttcttctgtcc

SEQ ID NO: 542957 - DNA, 14 bp, Homo sapiens
tcactttatttcat

SEQ ID NO: 542958 - DNA, 10 bp, Homo sapiens
tcagaaaaaa

SEQ ID NO: 542959 - DNA, 12 bp, Homo sapiens
tcagaaaagcac

SEQ ID NO: 542960 - DNA, 14 bp, Homo sapiens
tcagaaaagcacct

SEQ ID NO: 542961 - DNA, 16 bp, Homo sapiens
tcagaaaagcacctct

SEQ ID NO: 542962 - DNA, 22 bp, Homo sapiens
tcagaaacaaagcatttgactt

SEQ ID NO: 542963 - DNA, 24 bp, Homo sapiens
tcagaaacaaagcatttgactttc

SEQ ID NO: 542964 - DNA, 16 bp, Homo sapiens
tcagaaacaatttctg

SEQ ID NO: 542965 - DNA, 22 bp, Homo sapiens
tcagaaattcgccccattttct

SEQ ID NO: 542966 - DNA, 23 bp, Homo sapiens
tcagaaattcgccccattttctt

SEQ ID NO: 542967 - DNA, 22 bp, Homo sapiens
tcagaagaatctctatgccctg

SEQ ID NO: 542968 - DNA, 20 bp, Homo sapiens
tcagaccaaggaacaagacc

SEQ ID NO: 542969 - DNA, 17 bp, Homo sapiens
tcagactatccatttta

SEQ ID NO: 542970 - DNA, 13 bp, Homo sapiens
tcagagcacagcc

SEQ ID NO: 542971 - DNA, 19 bp, Homo sapiens
tcagagtgaagagtgaaga

SEQ ID NO: 542972 - DNA, 23 bp, Homo sapiens
tcagagtgaagagtgaagagcat

SEQ ID NO: 542973 - DNA, 20 bp, Homo sapiens
tcagataatggtaatttagt

SEQ ID NO: 542974 - DNA, 23 bp, Homo sapiens
ggcccccaggtctgatctgggtt

SEQ ID NO: 542975 - DNA, 16 bp, Homo sapiens
ggcccctcccacatcc

SEQ ID NO: 542976 - DNA, 16 bp, Homo sapiens
ggccctccgcggggga

SEQ ID NO: 542977 - DNA, 11 bp, Homo sapiens
ggccctgcctg

SEQ ID NO: 542978 - DNA, 13 bp, Homo sapiens
ggccctgcctgct

SEQ ID NO: 542979 - DNA, 15 bp, Homo sapiens
ggccctggttccccc

SEQ ID NO: 542980 - DNA, 15 bp, Homo sapiens
ggccgggctggcttc

SEQ ID NO: 542981 - DNA, 13 bp, Homo sapiens
ggccgtggctgcc

SEQ ID NO: 542982 - DNA, 18 bp, Homo sapiens
ggcctaatattgaaaatg

SEQ ID NO: 542983 - DNA, 20 bp, Homo sapiens
ggcctagtggcttcagcccc

SEQ ID NO: 542984 - DNA, 13 bp, Homo sapiens
ggcctccctgcca

SEQ ID NO: 542985 - DNA, 19 bp, Homo sapiens
ggcctccctgccagtaggg

SEQ ID NO: 542986 - DNA, 13 bp, Homo sapiens
ggcctctcttgga

SEQ ID NO: 542987 - DNA, 17 bp, Homo sapiens
ggcctgaaagcaacagc

SEQ ID NO: 542988 - DNA, 18 bp, Homo sapiens
ggcctgaaagcaacagct

SEQ ID NO: 542989 - DNA, 17 bp, Homo sapiens
ggcctgaaatgtttcca

SEQ ID NO: 542990 - DNA, 24 bp, Homo sapiens
ggcctgaaatgtttccaggcatga

SEQ ID NO: 542991 - DNA, 19 bp, Homo sapiens
ggcctgatatccaacagaa

SEQ ID NO: 542992 - DNA, 22 bp, Homo sapiens
ggcctggggccgggctggcttc

SEQ ID NO: 542993 - DNA, 20 bp, Homo sapiens
ggccttggacggggacacgg

SEQ ID NO: 542994 - DNA, 22 bp, Homo sapiens
gttattgagagagatgtgtaat

SEQ ID NO: 542995 - DNA, 13 bp, Homo sapiens
gttcaaagtcatg

SEQ ID NO: 542996 - DNA, 20 bp, Homo sapiens
gttcaaagtcatgatgtttt

SEQ ID NO: 542997 - DNA, 18 bp, Homo sapiens
gttcaagaccagcctggc

SEQ ID NO: 542998 - DNA, 21 bp, Homo sapiens
gttcaatgctacaaaatgtgt

SEQ ID NO: 542999 - DNA, 24 bp, Homo sapiens
gttcaatgctacaaaatgtgtgct

SEQ ID NO: 543000 - DNA, 22 bp, Homo sapiens
taaaagaaatgcacaatgtctt

SEQ ID NO: 543001 - DNA, 17 bp, Homo sapiens
taaaagaatattcagag

SEQ ID NO: 543002 - DNA, 13 bp, Homo sapiens
taaaagccacata

SEQ ID NO: 543003 - DNA, 15 bp, Homo sapiens
taaaagccacataga

SEQ ID NO: 543004 - DNA, 14 bp, Homo sapiens
taaaagtcacataa

SEQ ID NO: 543005 - DNA, 20 bp, Homo sapiens
taaaagtcacataaaatgcg

SEQ ID NO: 543006 - DNA, 15 bp, Homo sapiens
taaaagtttaaagaa

SEQ ID NO: 543007 - DNA, 16 bp, Homo sapiens
taaaatactgtagata

SEQ ID NO: 543008 - DNA, 17 bp, Homo sapiens
taaaatagttgtccata

SEQ ID NO: 543009 - DNA, 13 bp, Homo sapiens
taaaatatgcact

SEQ ID NO: 543010 - DNA, 15 bp, Homo sapiens
taaaatcccattgta

SEQ ID NO: 543011 - DNA, 21 bp, Homo sapiens
taaaatcccattgtatttaaa

SEQ ID NO: 543012 - DNA, 21 bp, Homo sapiens
taaaatcttattaaagtttca

SEQ ID NO: 543013 - DNA, 23 bp, Homo sapiens
taagagattttatgtttaaaatg

SEQ ID NO: 543014 - DNA, 12 bp, Homo sapiens
taagagccacaa

SEQ ID NO: 543015 - DNA, 19 bp, Homo sapiens
taagatcggttaacaaata

SEQ ID NO: 543016 - DNA, 16 bp, Homo sapiens
taagcaaatttcaaaa

SEQ ID NO: 543017 - DNA, 16 bp, Homo sapiens
taagcaacaattttca

SEQ ID NO: 543018 - DNA, 13 bp, Homo sapiens
taagcaagaccat

SEQ ID NO: 543019 - DNA, 14 bp, Homo sapiens
taagcaagaccatg

SEQ ID NO: 543020 - DNA, 16 bp, Homo sapiens
taagcacaaaaaattt

SEQ ID NO: 543021 - DNA, 13 bp, Homo sapiens
taagcacagacaa

SEQ ID NO: 543022 - DNA, 22 bp, Homo sapiens
taagcacagacaattctaatgg

SEQ ID NO: 543023 - DNA, 17 bp, Homo sapiens
taagcagaattggaaaa

SEQ ID NO: 543024 - DNA, 13 bp, Homo sapiens
taagcctgatgat

SEQ ID NO: 543025 - DNA, 14 bp, Homo sapiens
taaggacaggcagg

SEQ ID NO: 543026 - DNA, 18 bp, Homo sapiens
taaggggaattaacaatt

SEQ ID NO: 543027 - DNA, 22 bp, Homo sapiens
taaggtcagtgttataaaatct

SEQ ID NO: 543028 - DNA, 15 bp, Homo sapiens
taagtaaatgtcttc

SEQ ID NO: 543029 - DNA, 16 bp, Homo sapiens
taagtattcaagaaag

SEQ ID NO: 543030 - DNA, 17 bp, Homo sapiens
taagtctcttttttaca

SEQ ID NO: 543031 - DNA, 18 bp, Homo sapiens
taagtctcttttttacaa

SEQ ID NO: 543032 - DNA, 16 bp, Homo sapiens
taagtcttactgtttt

SEQ ID NO: 543033 - DNA, 17 bp, Homo sapiens
taagtgcttgaggccaa

SEQ ID NO: 543034 - DNA, 14 bp, Homo sapiens
taagtggactgtat

SEQ ID NO: 543035 - DNA, 15 bp, Homo sapiens
taagtggactgtatt

SEQ ID NO: 543036 - DNA, 16 bp, Homo sapiens
taagtggactgtattt

SEQ ID NO: 543037 - DNA, 21 bp, Homo sapiens
taagtgttctgtggctgattt

SEQ ID NO: 543038 - DNA, 13 bp, Homo sapiens
taagttggaaaca

SEQ ID NO: 543039 - DNA, 17 bp, Homo sapiens
taataaagcgaaaaact

SEQ ID NO: 543040 - DNA, 23 bp, Homo sapiens
taataaagtatgaatatttcatt

SEQ ID NO: 543041 - DNA, 12 bp, Homo sapiens
taataaatggac

SEQ ID NO: 543042 - DNA, 21 bp, Homo sapiens
taatataactgccttaaaact

SEQ ID NO: 543043 - DNA, 20 bp, Homo sapiens
taatatacagtgtgtagttt

SEQ ID NO: 543044 - DNA, 15 bp, Homo sapiens
taatatactccttaa

SEQ ID NO: 543045 - DNA, 20 bp, Homo sapiens
taatatactccttaaaaatg

SEQ ID NO: 543046 - DNA, 23 bp, Homo sapiens
taatatactccttaaaaatgtat

SEQ ID NO: 543047 - DNA, 17 bp, Homo sapiens
taatatcagttacagtg

SEQ ID NO: 543048 - DNA, 22 bp, Homo sapiens
taatatcagttacagtggcagt

SEQ ID NO: 543049 - DNA, 19 bp, Homo sapiens
taatatgcatatatatgta

SEQ ID NO: 543050 - DNA, 20 bp, Homo sapiens
taatatgcatatatatgtat

SEQ ID NO: 543051 - DNA, 13 bp, Homo sapiens
taatattgaaaat

SEQ ID NO: 543052 - DNA, 14 bp, Homo sapiens
taatcaaagctcat

SEQ ID NO: 543053 - DNA, 23 bp, Homo sapiens
taatcctatctggggagctcctg

SEQ ID NO: 543054 - DNA, 13 bp, Homo sapiens
taatgaagatctt

SEQ ID NO: 543055 - DNA, 15 bp, Homo sapiens
taatgaagatctttg

SEQ ID NO: 543056 - DNA, 16 bp, Homo sapiens
taatgaagatctttgt

SEQ ID NO: 543057 - DNA, 17 bp, Homo sapiens
taatgaagatctttgtt

SEQ ID NO: 543058 - DNA, 18 bp, Homo sapiens
taatgagcaatatctgct

SEQ ID NO: 543059 - DNA, 23 bp, Homo sapiens
taatgagtatatgtaacagttta

SEQ ID NO: 543060 - DNA, 18 bp, Homo sapiens
taatgcctcttcattctt

SEQ ID NO: 543061 - DNA, 14 bp, Homo sapiens
taatggaaacatgc

SEQ ID NO: 543062 - DNA, 18 bp, Homo sapiens
taatggccttaattaatt

SEQ ID NO: 543063 - DNA, 20 bp, Homo sapiens
taatggccttaattaattct

SEQ ID NO: 543064 - DNA, 13 bp, Homo sapiens
taatggtaacttt

SEQ ID NO: 543065 - DNA, 22 bp, Homo sapiens
taatggtaacttttgtagtctt

SEQ ID NO: 543066 - DNA, 14 bp, Homo sapiens
taatggtaatttag

SEQ ID NO: 543067 - DNA, 16 bp, Homo sapiens
taatgtattttcagct

SEQ ID NO: 543068 - DNA, 21 bp, Homo sapiens
taatgtattttcagctcaatt

SEQ ID NO: 543069 - DNA, 17 bp, Homo sapiens
taatgtctcaaaataaa

SEQ ID NO: 543070 - DNA, 21 bp, Homo sapiens
taatgtgatggatggcacaat

SEQ ID NO: 543071 - DNA, 22 bp, Homo sapiens
taatgtgatggatggcacaatg

SEQ ID NO: 543072 - DNA, 19 bp, Homo sapiens
taatgtgtaaaattggatt

SEQ ID NO: 543073 - DNA, 14 bp, Homo sapiens
taatgtgtgtatgt

SEQ ID NO: 543074 - DNA, 17 bp, Homo sapiens
taatgtgtgtatgtgta

SEQ ID NO: 543075 - DNA, 13 bp, Homo sapiens
taatgttgatttc

SEQ ID NO: 543076 - DNA, 16 bp, Homo sapiens
taatgtttagtcagtg

SEQ ID NO: 543077 - DNA, 13 bp, Homo sapiens
taattaaactgat

SEQ ID NO: 543078 - DNA, 13 bp, Homo sapiens
taattaatttcag

SEQ ID NO: 543079 - DNA, 14 bp, Homo sapiens
taattaatttcagt

SEQ ID NO: 543080 - DNA, 18 bp, Homo sapiens
taattacaatatttctga

SEQ ID NO: 543081 - DNA, 16 bp, Homo sapiens
taattcattaaaaaca

SEQ ID NO: 543082 - DNA, 13 bp, Homo sapiens
taattcctatgaa

SEQ ID NO: 543083 - DNA, 14 bp, Homo sapiens
taattctgaagtta

SEQ ID NO: 543084 - DNA, 20 bp, Homo sapiens
taattctgaagttatatttc

SEQ ID NO: 543085 - DNA, 15 bp, Homo sapiens
taattcttattccat

SEQ ID NO: 543086 - DNA, 17 bp, Homo sapiens
taattcttattccatat

SEQ ID NO: 543087 - DNA, 22 bp, Homo sapiens
taattgaaagggacaagtatca

SEQ ID NO: 543088 - DNA, 17 bp, Homo sapiens
taattgatcagttttca

SEQ ID NO: 543089 - DNA, 17 bp, Homo sapiens
taattgcatttgctttt

SEQ ID NO: 543090 - DNA, 19 bp, Homo sapiens
taatttaagtcattttcat

SEQ ID NO: 543091 - DNA, 21 bp, Homo sapiens
taatttagtggatggaatatc

SEQ ID NO: 543092 - DNA, 14 bp, Homo sapiens
taatttagtgtata

SEQ ID NO: 543093 - DNA, 19 bp, Homo sapiens
taatttagtgtatatgtga

SEQ ID NO: 543094 - DNA, 11 bp, Homo sapiens
taatttcaagc

SEQ ID NO: 543095 - DNA, 19 bp, Homo sapiens
taatttcaagcttattttg

SEQ ID NO: 543096 - DNA, 19 bp, Homo sapiens
taatttggaccattttcct

SEQ ID NO: 543097 - DNA, 20 bp, Homo sapiens
taatttggaccattttcctg

SEQ ID NO: 543098 - DNA, 23 bp, Homo sapiens
taatttgtgcatcagaaaatgca

SEQ ID NO: 543099 - DNA, 11 bp, Homo sapiens
taattttgtct

SEQ ID NO: 543100 - DNA, 14 bp, Homo sapiens
taattttgttttaa

SEQ ID NO: 543101 - DNA, 22 bp, Homo sapiens
taatttttcagctctctgtata

SEQ ID NO: 543102 - DNA, 12 bp, Homo sapiens
taatttttctgt

SEQ ID NO: 543103 - DNA, 15 bp, Homo sapiens
tacaaaaacacaaat

SEQ ID NO: 543104 - DNA, 18 bp, Homo sapiens
tacaaaagggacatgaaa

SEQ ID NO: 543105 - DNA, 23 bp, Homo sapiens
tacaaaatgtaactgttaccatt

SEQ ID NO: 543106 - DNA, 20 bp, Homo sapiens
tacaaacaagcatataaaat

SEQ ID NO: 543107 - DNA, 16 bp, Homo sapiens
tacaaaggctgtattc

SEQ ID NO: 543108 - DNA, 13 bp, Homo sapiens
tacaaatgattgc

SEQ ID NO: 543109 - DNA, 18 bp, Homo sapiens
tacaacacattgaaactg

SEQ ID NO: 543110 - DNA, 21 bp, Homo sapiens
tacaacacattgaaactgtat

SEQ ID NO: 543111 - DNA, 19 bp, Homo sapiens
tacaacagaagttatattt

SEQ ID NO: 543112 - DNA, 18 bp, Homo sapiens
tacaagactgtaaattcc

SEQ ID NO: 543113 - DNA, 14 bp, Homo sapiens
tacaatacaacaca

SEQ ID NO: 543114 - DNA, 14 bp, Homo sapiens
tacaatatataaaa

SEQ ID NO: 543115 - DNA, 14 bp, Homo sapiens
tacaatggaaacaa

SEQ ID NO: 543116 - DNA, 16 bp, Homo sapiens
tacaatttgttaattc

SEQ ID NO: 543117 - DNA, 12 bp, Homo sapiens
tacacacacaga

SEQ ID NO: 543118 - DNA, 19 bp, Homo sapiens
tacacacacagacacacaa

SEQ ID NO: 543119 - DNA, 14 bp, Homo sapiens
tacacacacagatg

SEQ ID NO: 543120 - DNA, 17 bp, Homo sapiens
tacacagaaatcctaac

SEQ ID NO: 543121 - DNA, 17 bp, Homo sapiens
tacacatacatatatac

SEQ ID NO: 543122 - DNA, 22 bp, Homo sapiens
tacaccactttcccacactgtg

SEQ ID NO: 543123 - DNA, 13 bp, Homo sapiens
tacacgtgtatat

SEQ ID NO: 543124 - DNA, 15 bp, Homo sapiens
tacactgtcaaacat

SEQ ID NO: 543125 - DNA, 20 bp, Homo sapiens
tacacttgctttatttttca

SEQ ID NO: 543126 - DNA, 11 bp, Homo sapiens
tacactttatt

SEQ ID NO: 543127 - DNA, 16 bp, Homo sapiens
tacagagatgtctctt

SEQ ID NO: 543128 - DNA, 14 bp, Homo sapiens
tatatgtaacagtt

SEQ ID NO: 543129 - DNA, 17 bp, Homo sapiens
tatatgtgattttcaaa

SEQ ID NO: 543130 - DNA, 18 bp, Homo sapiens
tatatgtgattttcaaat

SEQ ID NO: 543131 - DNA, 21 bp, Homo sapiens
tatatgtgattttcaaatatg

SEQ ID NO: 543132 - DNA, 23 bp, Homo sapiens
tatatgtgattttcaaatatgta

SEQ ID NO: 543133 - DNA, 20 bp, Homo sapiens
tatatgtgtatatatacata

SEQ ID NO: 543134 - DNA, 14 bp, Homo sapiens
tatatgtttacaca

SEQ ID NO: 543135 - DNA, 18 bp, Homo sapiens
tatatgtttacacaatta

SEQ ID NO: 543136 - DNA, 15 bp, Homo sapiens
tatatgtttatacac

SEQ ID NO: 543137 - DNA, 19 bp, Homo sapiens
tatattgcacaattataaa

SEQ ID NO: 543138 - DNA, 14 bp, Homo sapiens
tatatttaaaaaca

SEQ ID NO: 543139 - DNA, 18 bp, Homo sapiens
tatatttaagtattcaag

SEQ ID NO: 543140 - DNA, 23 bp, Homo sapiens
tatatttggatgcagagttcagg

SEQ ID NO: 543141 - DNA, 16 bp, Homo sapiens
tatattttgtatgcaa

SEQ ID NO: 543142 - DNA, 17 bp, Homo sapiens
tatattttgtatgcaag

SEQ ID NO: 543143 - DNA, 19 bp, Homo sapiens
tatcagctacttaagagaa

SEQ ID NO: 543144 - DNA, 16 bp, Homo sapiens
tatcagttacagtggc

SEQ ID NO: 543145 - DNA, 21 bp, Homo sapiens
tatcatgctttaaagtgtaat

SEQ ID NO: 543146 - DNA, 22 bp, Homo sapiens
tatcatgctttaaagtgtaata

SEQ ID NO: 543147 - DNA, 21 bp, Homo sapiens
tatcatggcagcatgcgatgt

SEQ ID NO: 543148 - DNA, 21 bp, Homo sapiens
tatcattcttataacattgta

SEQ ID NO: 543149 - DNA, 20 bp, Homo sapiens
tatcattgtttgtcctttat

SEQ ID NO: 543150 - DNA, 21 bp, Homo sapiens
tatccactgtttattcaacaa

SEQ ID NO: 543151 - DNA, 13 bp, Homo sapiens
tatccatctcctg

SEQ ID NO: 543152 - DNA, 15 bp, Homo sapiens
tatccattttacact

SEQ ID NO: 543153 - DNA, 23 bp, Homo sapiens
tatcctgggcttttgttttgctt

SEQ ID NO: 543154 - DNA, 14 bp, Homo sapiens
tatccttttctgtg

SEQ ID NO: 543155 - DNA, 15 bp, Homo sapiens
tatccttttctgtgt

SEQ ID NO: 543156 - DNA, 17 bp, Homo sapiens
tatccttttctgtgttt

SEQ ID NO: 543157 - DNA, 12 bp, Homo sapiens
tatcgggggctg

SEQ ID NO: 543158 - DNA, 16 bp, Homo sapiens
tatcgtattcaccttc

SEQ ID NO: 543159 - DNA, 16 bp, Homo sapiens
tatctaaccagtgatt

SEQ ID NO: 543160 - DNA, 15 bp, Homo sapiens
tatctaccaactttc

SEQ ID NO: 543161 - DNA, 19 bp, Homo sapiens
tatctaccaactttcaaga

SEQ ID NO: 543162 - DNA, 20 bp, Homo sapiens
tatctaccaactttcaagaa

SEQ ID NO: 543163 - DNA, 13 bp, Homo sapiens
tatctagatgtaa

SEQ ID NO: 543164 - DNA, 15 bp, Homo sapiens
tatctagatgtaaat

SEQ ID NO: 543165 - DNA, 17 bp, Homo sapiens
tatctagatgtaaattt

SEQ ID NO: 543166 - DNA, 14 bp, Homo sapiens
tatctcatcaacaa

SEQ ID NO: 543167 - DNA, 21 bp, Homo sapiens
cccaaggttctgggtgcagga

SEQ ID NO: 543168 - DNA, 16 bp, Homo sapiens
cccaatgcacatccat

SEQ ID NO: 543169 - DNA, 22 bp, Homo sapiens
cccacaccctacagcagatcca

SEQ ID NO: 543170 - DNA, 12 bp, Homo sapiens
cccacacctggc

SEQ ID NO: 543171 - DNA, 17 bp, Homo sapiens
cccacatcccatcgtct

SEQ ID NO: 543172 - DNA, 12 bp, Homo sapiens
cccacatccccc

SEQ ID NO: 543173 - DNA, 15 bp, Homo sapiens
cccacattgcccaca

SEQ ID NO: 543174 - DNA, 17 bp, Homo sapiens
cccacattgcccacacc

SEQ ID NO: 543175 - DNA, 13 bp, Homo sapiens
cccacccagcctg

SEQ ID NO: 543176 - DNA, 14 bp, Homo sapiens
cccacccccgggtg

SEQ ID NO: 543177 - DNA, 12 bp, Homo sapiens
cccactggctgt

SEQ ID NO: 543178 - DNA, 21 bp, Homo sapiens
cccactggctgtgggctccct

SEQ ID NO: 543179 - DNA, 22 bp, Homo sapiens
cccactggctgtgggctccctt

SEQ ID NO: 543180 - DNA, 23 bp, Homo sapiens
cccactggctgtgggctcccttc

SEQ ID NO: 543181 - DNA, 21 bp, Homo sapiens
cccagaaatgccgctgtgtcc

SEQ ID NO: 543182 - DNA, 17 bp, Homo sapiens
cccagacaacagcccag

SEQ ID NO: 543183 - DNA, 17 bp, Homo sapiens
cccagaccactgtctcc

SEQ ID NO: 543184 - DNA, 20 bp, Homo sapiens
cccagaccagtagtgaccaa

SEQ ID NO: 543185 - DNA, 23 bp, Homo sapiens
cccagaccagtagtgaccaatcg

SEQ ID NO: 543186 - DNA, 17 bp, Homo sapiens
cccagaccccatccagc

SEQ ID NO: 543187 - DNA, 22 bp, Homo sapiens
cccagagattgcttctcatccc

SEQ ID NO: 543188 - DNA, 17 bp, Homo sapiens
cccagaggggcggggcc

SEQ ID NO: 543189 - DNA, 19 bp, Homo sapiens
cccagatccaggaacacat

SEQ ID NO: 543190 - DNA, 22 bp, Homo sapiens
cccagatccaggaacacatgca

SEQ ID NO: 543191 - DNA, 11 bp, Homo sapiens
cccagccccag

SEQ ID NO: 543192 - DNA, 17 bp, Homo sapiens
cccagcctatctctctt

SEQ ID NO: 543193 - DNA, 13 bp, Homo sapiens
cccagcctctttc

SEQ ID NO: 543194 - DNA, 16 bp, Homo sapiens
cccagcctctttccct

SEQ ID NO: 543195 - DNA, 21 bp, Homo sapiens
cccagctacaggggaggctga

SEQ ID NO: 543196 - DNA, 14 bp, Homo sapiens
cccagctgcccctc

SEQ ID NO: 543197 - DNA, 12 bp, Homo sapiens
cccaggagcgca

SEQ ID NO: 543198 - DNA, 15 bp, Homo sapiens
cccaggcactctctt

SEQ ID NO: 543199 - DNA, 15 bp, Homo sapiens
cccaggcatctcctt

SEQ ID NO: 543200 - DNA, 21 bp, Homo sapiens
cccaggcatctccttgggctg

SEQ ID NO: 543201 - DNA, 19 bp, Homo sapiens
cccagtgtccccaggggca

SEQ ID NO: 543202 - DNA, 18 bp, Homo sapiens
cccatcagcccaatccct

SEQ ID NO: 543203 - DNA, 14 bp, Homo sapiens
cccatccagccagg

SEQ ID NO: 543204 - DNA, 15 bp, Homo sapiens
cccatccagccaggg

SEQ ID NO: 543205 - DNA, 19 bp, Homo sapiens
cccatgaaacagcagctga

SEQ ID NO: 543206 - DNA, 17 bp, Homo sapiens
cccatggtagactgtga

SEQ ID NO: 543207 - DNA, 11 bp, Homo sapiens
cccatgtgtat

SEQ ID NO: 543208 - DNA, 12 bp, Homo sapiens
cccattctgtcc

SEQ ID NO: 543209 - DNA, 14 bp, Homo sapiens
ccccacacctggcc

SEQ ID NO: 543210 - DNA, 17 bp, Homo sapiens
ccccacacctggccctg

SEQ ID NO: 543211 - DNA, 13 bp, Homo sapiens
ccccacccctcca

SEQ ID NO: 543212 - DNA, 14 bp, Homo sapiens
ccccactggctgtg

SEQ ID NO: 543213 - DNA, 22 bp, Homo sapiens
ccccactggctgtgggctccct

SEQ ID NO: 543214 - DNA, 23 bp, Homo sapiens
ccccactggctgtgggctccctt

SEQ ID NO: 543215 - DNA, 15 bp, Homo sapiens
ccccagaactctgcc

SEQ ID NO: 543216 - DNA, 17 bp, Homo sapiens
ccccagaactctgcctg

SEQ ID NO: 543217 - DNA, 17 bp, Homo sapiens
ccccagacaacagccca

SEQ ID NO: 543218 - DNA, 21 bp, Homo sapiens
ccccagaccagtagtgaccaa

SEQ ID NO: 543219 - DNA, 18 bp, Homo sapiens
ccccagcccttcctctgc

SEQ ID NO: 543220 - DNA, 20 bp, Homo sapiens
ccccagcccttcctctgctc

SEQ ID NO: 543221 - DNA, 10 bp, Homo sapiens
ccccagctcc

SEQ ID NO: 543222 - DNA, 20 bp, Homo sapiens
ccccaggggcacacttcccc

SEQ ID NO: 543223 - DNA, 22 bp, Homo sapiens
ccccagtgctcacacaatcaga

SEQ ID NO: 543224 - DNA, 15 bp, Homo sapiens
ccccataatgcttct

SEQ ID NO: 543225 - DNA, 14 bp, Homo sapiens
ccccatctgctgag

SEQ ID NO: 543226 - DNA, 12 bp, Homo sapiens
ccccatttcctg

SEQ ID NO: 543227 - DNA, 14 bp, Homo sapiens
cccccacacctggc

SEQ ID NO: 543228 - DNA, 21 bp, Homo sapiens
cccccagtgctcacacaatca

SEQ ID NO: 543229 - DNA, 18 bp, Homo sapiens
cccccatgccctccctgc

SEQ ID NO: 543230 - DNA, 23 bp, Homo sapiens
cccccgtgccaaatcctgggcat

SEQ ID NO: 543231 - DNA, 14 bp, Homo sapiens
ccccctcttccctg

SEQ ID NO: 543232 - DNA, 19 bp, Homo sapiens
ccccctcttcctccctggg

SEQ ID NO: 543233 - DNA, 11 bp, Homo sapiens
cccccttggtg

SEQ ID NO: 543234 - DNA, 15 bp, Homo sapiens
ccccctttcttcctc

SEQ ID NO: 543235 - DNA, 16 bp, Homo sapiens
ccccctttcttcctca

SEQ ID NO: 543236 - DNA, 20 bp, Homo sapiens
ccccgctctgccatcagccc

SEQ ID NO: 543237 - DNA, 12 bp, Homo sapiens
ccccggagctgg

SEQ ID NO: 543238 - DNA, 15 bp, Homo sapiens
ccccgggtgcctgtg

SEQ ID NO: 543239 - DNA, 23 bp, Homo sapiens
cccctccctttttaaacaaatgg

SEQ ID NO: 543240 - DNA, 17 bp, Homo sapiens
cccctccttcccagctg

SEQ ID NO: 543241 - DNA, 12 bp, Homo sapiens
cccctcttccct

SEQ ID NO: 543242 - DNA, 14 bp, Homo sapiens
cccctcttccctgg

SEQ ID NO: 543243 - DNA, 14 bp, Homo sapiens
cccctgcacctgct

SEQ ID NO: 543244 - DNA, 23 bp, Homo sapiens
cccctgcccagatcagccagaag

SEQ ID NO: 543245 - DNA, 12 bp, Homo sapiens
cccctgcctgtg

SEQ ID NO: 543246 - DNA, 19 bp, Homo sapiens
cccctggggtacttctgtg

SEQ ID NO: 543247 - DNA, 21 bp, Homo sapiens
cccctggggtacttctgtgtt

SEQ ID NO: 543248 - DNA, 17 bp, Homo sapiens
cccctggtcctgcactg

SEQ ID NO: 543249 - DNA, 17 bp, Homo sapiens
ccccttccatttctgcc

SEQ ID NO: 543250 - DNA, 20 bp, Homo sapiens
ccccttgggatgggcacagg

SEQ ID NO: 543251 - DNA, 22 bp, Homo sapiens
ccccttgggatgggcacaggct

SEQ ID NO: 543252 - DNA, 13 bp, Homo sapiens
cccctttcttctc

SEQ ID NO: 543253 - DNA, 22 bp, Homo sapiens
cccgagccgagctctcctgggc

SEQ ID NO: 543254 - DNA, 18 bp, Homo sapiens
cccgcaatgtgcccccag

SEQ ID NO: 543255 - DNA, 22 bp, Homo sapiens
cccgcaatgtgcccccagacgc

SEQ ID NO: 543256 - DNA, 21 bp, Homo sapiens
cccgcatgtacaaaaacacaa

SEQ ID NO: 543257 - DNA, 23 bp, Homo sapiens
cccgcatgtacaaaaacacaaat

SEQ ID NO: 543258 - DNA, 12 bp, Homo sapiens
cccggagctggg

SEQ ID NO: 543259 - DNA, 15 bp, Homo sapiens
cccggcagcccccca

SEQ ID NO: 543260 - DNA, 14 bp, Homo sapiens
cccggcccaggagc

SEQ ID NO: 543261 - DNA, 15 bp, Homo sapiens
cccggcccaggagcg

SEQ ID NO: 543262 - DNA, 18 bp, Homo sapiens
cccgtgtattcaggaccc

SEQ ID NO: 543263 - DNA, 17 bp, Homo sapiens
ccctcaggaccctcgct

SEQ ID NO: 543264 - DNA, 18 bp, Homo sapiens
ccctcaggaccctcgctg

SEQ ID NO: 543265 - DNA, 21 bp, Homo sapiens
ccctcaggaccctcgctggcc

SEQ ID NO: 543266 - DNA, 12 bp, Homo sapiens
ccctccaggagt

SEQ ID NO: 543267 - DNA, 22 bp, Homo sapiens
ccctccatgattccaagggccc

SEQ ID NO: 543268 - DNA, 14 bp, Homo sapiens
ccctcccacatccc

SEQ ID NO: 543269 - DNA, 16 bp, Homo sapiens
ccctcccacatccccc

SEQ ID NO: 543270 - DNA, 14 bp, Homo sapiens
ccctcccagatcca

SEQ ID NO: 543271 - DNA, 15 bp, Homo sapiens
ccctcccagatccag

SEQ ID NO: 543272 - DNA, 21 bp, Homo sapiens
ccctcccctaatgcctgcgga

SEQ ID NO: 543273 - DNA, 16 bp, Homo sapiens
ccctccctcccagatc

SEQ ID NO: 543274 - DNA, 23 bp, Homo sapiens
ccctccctgtctgtctgtctctc

SEQ ID NO: 543275 - DNA, 17 bp, Homo sapiens
ccctccgtcctggcagg

SEQ ID NO: 543276 - DNA, 17 bp, Homo sapiens
ccctcctctgagaggcg

SEQ ID NO: 543277 - DNA, 13 bp, Homo sapiens
ccctccttcccac

SEQ ID NO: 543278 - DNA, 17 bp, Homo sapiens
ccctccttcccagctgc

SEQ ID NO: 543279 - DNA, 21 bp, Homo sapiens
ccctcgctggcccccactggc

SEQ ID NO: 543280 - DNA, 21 bp, Homo sapiens
ccctcggggcaggaagtccct

SEQ ID NO: 543281 - DNA, 14 bp, Homo sapiens
ccctcgtctttccc

SEQ ID NO: 543282 - DNA, 22 bp, Homo sapiens
ccctgaacaacgagccttttca

SEQ ID NO: 543283 - DNA, 20 bp, Homo sapiens
ccctgagggcccttcccaac

SEQ ID NO: 543284 - DNA, 13 bp, Homo sapiens
ccctgcagctctc

SEQ ID NO: 543285 - DNA, 20 bp, Homo sapiens
ccctgcccagatcagccaga

SEQ ID NO: 543286 - DNA, 21 bp, Homo sapiens
ccctgcccagatcagccagaa

SEQ ID NO: 543287 - DNA, 13 bp, Homo sapiens
ccctgcccagcct

SEQ ID NO: 543288 - DNA, 23 bp, Homo sapiens
ccctgcctgccctgtcaggaggc

SEQ ID NO: 543289 - DNA, 15 bp, Homo sapiens
ccctgctcatccact

SEQ ID NO: 543290 - DNA, 10 bp, Homo sapiens
ccctgctccc

SEQ ID NO: 543291 - DNA, 20 bp, Homo sapiens
ccctgctgtcattgcttctt

SEQ ID NO: 543292 - DNA, 17 bp, Homo sapiens
cctttggaaggtgacac

SEQ ID NO: 543293 - DNA, 19 bp, Homo sapiens
cctttgtttttttttcctg

SEQ ID NO: 543294 - DNA, 20 bp, Homo sapiens
ccttttccagagcattccag

SEQ ID NO: 543295 - DNA, 15 bp, Homo sapiens
ccttttctcctatct

SEQ ID NO: 543296 - DNA, 18 bp, Homo sapiens
ccttttctcctatcttca

SEQ ID NO: 543297 - DNA, 14 bp, Homo sapiens
ccttttctgtgttt

SEQ ID NO: 543298 - DNA, 15 bp, Homo sapiens
cctttttctatttta

SEQ ID NO: 543299 - DNA, 22 bp, Homo sapiens
ccttttttatatcttggcaggt

SEQ ID NO: 543300 - DNA, 19 bp, Homo sapiens
cgaaagctgggcaacatgc

SEQ ID NO: 543301 - DNA, 21 bp, Homo sapiens
cgaatcacgaggtcaggagtt

SEQ ID NO: 543302 - DNA, 16 bp, Homo sapiens
cgacaaatctgtctgc

SEQ ID NO: 543303 - DNA, 18 bp, Homo sapiens
cgacagagcagttgagag

SEQ ID NO: 543304 - DNA, 16 bp, Homo sapiens
cgaccaactccagact

SEQ ID NO: 543305 - DNA, 18 bp, Homo sapiens
cgaccaactccagacttg

SEQ ID NO: 543306 - DNA, 17 bp, Homo sapiens
cgacctcttagaaaata

SEQ ID NO: 543307 - DNA, 19 bp, Homo sapiens
cgacttgtgcacaggcaga

SEQ ID NO: 543308 - DNA, 14 bp, Homo sapiens
cgagcaaagatcaa

SEQ ID NO: 543309 - DNA, 19 bp, Homo sapiens
cgagcgctatcttcacata

SEQ ID NO: 543310 - DNA, 18 bp, Homo sapiens
cgagctctcctgggccag

SEQ ID NO: 543311 - DNA, 21 bp, Homo sapiens
cgagctctcctgggccagggt

SEQ ID NO: 543312 - DNA, 20 bp, Homo sapiens
cgagtaattgcatttgcttt

SEQ ID NO: 543313 - DNA, 19 bp, Homo sapiens
cgagtagaggtttaaagaa

SEQ ID NO: 543314 - DNA, 21 bp, Homo sapiens
cgagtgtgtttcatccttccc

SEQ ID NO: 543315 - DNA, 13 bp, Homo sapiens
cgatgtgttcttt

SEQ ID NO: 543316 - DNA, 15 bp, Homo sapiens
cgcaaatacaaaatg

SEQ ID NO: 543317 - DNA, 22 bp, Homo sapiens
cgcaaggatcacttgagcccag

SEQ ID NO: 543318 - DNA, 18 bp, Homo sapiens
cgcaatgtgcccccagac

SEQ ID NO: 543319 - DNA, 17 bp, Homo sapiens
cgcaattgtatatatat

SEQ ID NO: 543320 - DNA, 12 bp, Homo sapiens
cgcacccacacc

SEQ ID NO: 543321 - DNA, 18 bp, Homo sapiens
cgcacccacaccctacag

SEQ ID NO: 543322 - DNA, 14 bp, Homo sapiens
cgcactacatctga

SEQ ID NO: 543323 - DNA, 10 bp, Homo sapiens
cgcagacaca

SEQ ID NO: 543324 - DNA, 12 bp, Homo sapiens
cgcagacacaca

SEQ ID NO: 543325 - DNA, 16 bp, Homo sapiens
cgcagacacacacaca

SEQ ID NO: 543326 - DNA, 17 bp, Homo sapiens
cgcagatgagtcctcgg

SEQ ID NO: 543327 - DNA, 15 bp, Homo sapiens
cgcagggagaccctg

SEQ ID NO: 543328 - DNA, 15 bp, Homo sapiens
cgcagtgtttgtgtg

SEQ ID NO: 543329 - DNA, 16 bp, Homo sapiens
cgcataggcctgcttt

SEQ ID NO: 543330 - DNA, 12 bp, Homo sapiens
cgcatgtacaaa

SEQ ID NO: 543331 - DNA, 20 bp, Homo sapiens
cgccctcattacggctcctc

SEQ ID NO: 543332 - DNA, 22 bp, Homo sapiens
cgccctcattacggctcctctc

SEQ ID NO: 543333 - DNA, 16 bp, Homo sapiens
cgccctggcaggcagg

SEQ ID NO: 543334 - DNA, 13 bp, Homo sapiens
cgccctgggctct

SEQ ID NO: 543335 - DNA, 18 bp, Homo sapiens
cgccctgggctctgggtt

SEQ ID NO: 543336 - DNA, 23 bp, Homo sapiens
cgcccttccctgacactgtctgc

SEQ ID NO: 543337 - DNA, 18 bp, Homo sapiens
cgcctttcagcaggcagc

SEQ ID NO: 543338 - DNA, 15 bp, Homo sapiens
cgctagagcagccca

SEQ ID NO: 543339 - DNA, 15 bp, Homo sapiens
cgctagcacagctcc

SEQ ID NO: 543340 - DNA, 16 bp, Homo sapiens
cgctagcacagctccc

SEQ ID NO: 543341 - DNA, 16 bp, Homo sapiens
cgctcccttgacctgc

SEQ ID NO: 543342 - DNA, 19 bp, Homo sapiens
cgctctgccatcagcccct

SEQ ID NO: 543343 - DNA, 20 bp, Homo sapiens
cgctctgccatcagcccctg

SEQ ID NO: 543344 - DNA, 19 bp, Homo sapiens
cgctggcccccactggctg

SEQ ID NO: 543345 - DNA, 18 bp, Homo sapiens
cggaacctgtgagctgca

SEQ ID NO: 543346 - DNA, 24 bp, Homo sapiens
cggaagccccctcttcctccctgg

SEQ ID NO: 543347 - DNA, 15 bp, Homo sapiens
cggaatcctgtcctc

SEQ ID NO: 543348 - DNA, 15 bp, Homo sapiens
cggaggaccagggct

SEQ ID NO: 543349 - DNA, 20 bp, Homo sapiens
cggaggctgaggcaggagaa

SEQ ID NO: 543350 - DNA, 14 bp, Homo sapiens
cggatcagctgagc

SEQ ID NO: 543351 - DNA, 22 bp, Homo sapiens
cggcagccccccagtgtcccca

SEQ ID NO: 543352 - DNA, 12 bp, Homo sapiens
cggccagagctc

SEQ ID NO: 543353 - DNA, 15 bp, Homo sapiens
cggccagagctccca

SEQ ID NO: 543354 - DNA, 19 bp, Homo sapiens
cggccaggcacggaggctc

SEQ ID NO: 543355 - DNA, 14 bp, Homo sapiens
cggccggcctgggg

SEQ ID NO: 543356 - DNA, 19 bp, Homo sapiens
cggcgccttctacctgcag

SEQ ID NO: 543357 - DNA, 21 bp, Homo sapiens
cggcgccttctacctgcagga

SEQ ID NO: 543358 - DNA, 21 bp, Homo sapiens
cgggagatccgccctgggctc

SEQ ID NO: 543359 - DNA, 14 bp, Homo sapiens
cgggagcctgcgtg

SEQ ID NO: 543360 - DNA, 12 bp, Homo sapiens
cgggcagagcac

SEQ ID NO: 543361 - DNA, 22 bp, Homo sapiens
cgggcagtgacgtgagtgggga

SEQ ID NO: 543362 - DNA, 19 bp, Homo sapiens
cgggctaagtccagctctc

SEQ ID NO: 543363 - DNA, 13 bp, Homo sapiens
cgggctggcttct

SEQ ID NO: 543364 - DNA, 14 bp, Homo sapiens
cgggctgggcagct

SEQ ID NO: 543365 - DNA, 14 bp, Homo sapiens
cggggacacggcct

SEQ ID NO: 543366 - DNA, 17 bp, Homo sapiens
cggggacacggcctctg

SEQ ID NO: 543367 - DNA, 14 bp, Homo sapiens
cggggccaggatgg

SEQ ID NO: 543368 - DNA, 19 bp, Homo sapiens
cggggtcctgaggctgggg

SEQ ID NO: 543369 - DNA, 15 bp, Homo sapiens
cgggtgcctgtgacc

SEQ ID NO: 543370 - DNA, 19 bp, Homo sapiens
cggtaccaatgcagaactc

SEQ ID NO: 543371 - DNA, 18 bp, Homo sapiens
cggtttctttgttacttt

SEQ ID NO: 543372 - DNA, 23 bp, Homo sapiens
cgtaattcttattccatattaga

SEQ ID NO: 543373 - DNA, 12 bp, Homo sapiens
cgtagggccagg

SEQ ID NO: 543374 - DNA, 13 bp, Homo sapiens
cgtagggccaggg

SEQ ID NO: 543375 - DNA, 16 bp, Homo sapiens
cgtagggccagggctc

SEQ ID NO: 543376 - DNA, 20 bp, Homo sapiens
cgtattttaaaagccacata

SEQ ID NO: 543377 - DNA, 20 bp, Homo sapiens
cgtcaggaggtgcctgagag

SEQ ID NO: 543378 - DNA, 22 bp, Homo sapiens
cgtccacgtgcgtgttttctga

SEQ ID NO: 543379 - DNA, 14 bp, Homo sapiens
cgtccccagaccag

SEQ ID NO: 543380 - DNA, 22 bp, Homo sapiens
cgtccccagaccagtagtgacc

SEQ ID NO: 543381 - DNA, 20 bp, Homo sapiens
cgtccctgagggcccttccc

SEQ ID NO: 543382 - DNA, 22 bp, Homo sapiens
cgtccctgagggcccttcccaa

SEQ ID NO: 543383 - DNA, 14 bp, Homo sapiens
cgtctacagctccc

SEQ ID NO: 543384 - DNA, 18 bp, Homo sapiens
cgtctttcccaaaggcat

SEQ ID NO: 543385 - DNA, 13 bp, Homo sapiens
cgtcttttgaaaa

SEQ ID NO: 543386 - DNA, 12 bp, Homo sapiens
cgtgacctggtc

SEQ ID NO: 543387 - DNA, 19 bp, Homo sapiens
cgtgcacggggccagcatc

SEQ ID NO: 543388 - DNA, 17 bp, Homo sapiens
cgtgccaaatcctgggc

SEQ ID NO: 543389 - DNA, 15 bp, Homo sapiens
cgtgccaaggagctc

SEQ ID NO: 543390 - DNA, 19 bp, Homo sapiens
cgtgcgtgttttctgactg

SEQ ID NO: 543391 - DNA, 17 bp, Homo sapiens
cgtggcaaatataaaac

SEQ ID NO: 543392 - DNA, 12 bp, Homo sapiens
cgtggcctgggg

SEQ ID NO: 543393 - DNA, 14 bp, Homo sapiens
cgtggctgaccccc

SEQ ID NO: 543394 - DNA, 23 bp, Homo sapiens
cgtggctgtgctctcaccagctg

SEQ ID NO: 543395 - DNA, 16 bp, Homo sapiens
cgtggctttgtgctta

SEQ ID NO: 543396 - DNA, 20 bp, Homo sapiens
cgtggggcagcacagagagg

SEQ ID NO: 543397 - DNA, 14 bp, Homo sapiens
cgtggtcttttcct

SEQ ID NO: 543398 - DNA, 19 bp, Homo sapiens
cgtgtatatgaggatgtat

SEQ ID NO: 543399 - DNA, 13 bp, Homo sapiens
cgtgtattcagga

SEQ ID NO: 543400 - DNA, 18 bp, Homo sapiens
cgtgtatttggctgggct

SEQ ID NO: 543401 - DNA, 22 bp, Homo sapiens
cgtgtggagggctgcagagcct

SEQ ID NO: 543402 - DNA, 17 bp, Homo sapiens
cgtgtttgtctcttctg

SEQ ID NO: 543403 - DNA, 19 bp, Homo sapiens
cgtttgatttgtcactgct

SEQ ID NO: 543404 - DNA, 15 bp, Homo sapiens
ctaaaaataaaccaa

SEQ ID NO: 543405 - DNA, 13 bp, Homo sapiens
ctaaaaatacaaa

SEQ ID NO: 543406 - DNA, 16 bp, Homo sapiens
ctaaaactgtactttg

SEQ ID NO: 543407 - DNA, 20 bp, Homo sapiens
ctaaaagaatattcagagaa

SEQ ID NO: 543408 - DNA, 14 bp, Homo sapiens
ctaaaatgttttca

SEQ ID NO: 543409 - DNA, 15 bp, Homo sapiens
ctaaaatgttttcag

SEQ ID NO: 543410 - DNA, 17 bp, Homo sapiens
ctaaaatgttttcagct

SEQ ID NO: 543411 - DNA, 21 bp, Homo sapiens
ctaaacatttcctttttctat

SEQ ID NO: 543412 - DNA, 18 bp, Homo sapiens
ctaaacgtgtatgttttt

SEQ ID NO: 543413 - DNA, 21 bp, Homo sapiens
ctaaacgtgtatgtttttcag

SEQ ID NO: 543414 - DNA, 15 bp, Homo sapiens
ctaaactaggctcct

SEQ ID NO: 543415 - DNA, 21 bp, Homo sapiens
ctaaagcctaccctattctat

SEQ ID NO: 543416 - DNA, 15 bp, Homo sapiens
ctaaatgttaaagat

SEQ ID NO: 543417 - DNA, 19 bp, Homo sapiens
ctaaattctttatttctgt

SEQ ID NO: 543418 - DNA, 14 bp, Homo sapiens
ctaaattgatgttg

SEQ ID NO: 543419 - DNA, 15 bp, Homo sapiens
ctaaattgatgttga

SEQ ID NO: 543420 - DNA, 14 bp, Homo sapiens
ctaacagtaactgc

SEQ ID NO: 543421 - DNA, 18 bp, Homo sapiens
ctaacagtaactgccatt

SEQ ID NO: 543422 - DNA, 12 bp, Homo sapiens
ctaaccagggcc

SEQ ID NO: 543423 - DNA, 20 bp, Homo sapiens
ctaacggccgtctgctctca

SEQ ID NO: 543424 - DNA, 17 bp, Homo sapiens
ctaactccttacagaag

SEQ ID NO: 543425 - DNA, 15 bp, Homo sapiens
ctgaaaactggaata

SEQ ID NO: 543426 - DNA, 15 bp, Homo sapiens
ctgaaacatagatag

SEQ ID NO: 543427 - DNA, 16 bp, Homo sapiens
ctgaaactaatgaaag

SEQ ID NO: 543428 - DNA, 16 bp, Homo sapiens
ctgaaatattttctac

SEQ ID NO: 543429 - DNA, 11 bp, Homo sapiens
ctgaaatgtgt

SEQ ID NO: 543430 - DNA, 16 bp, Homo sapiens
ctgaaatgtgtgtgat

SEQ ID NO: 543431 - DNA, 22 bp, Homo sapiens
ctgaaatgtgtgtgatgtgaca

SEQ ID NO: 543432 - DNA, 15 bp, Homo sapiens
ctgaaatgtttccag

SEQ ID NO: 543433 - DNA, 24 bp, Homo sapiens
ctgaacagatgacccctgcccaga

SEQ ID NO: 543434 - DNA, 14 bp, Homo sapiens
ctgaacctgtcttt

SEQ ID NO: 543435 - DNA, 14 bp, Homo sapiens
ctgaagattgttta

SEQ ID NO: 543436 - DNA, 15 bp, Homo sapiens
ctgaagattgtttat

SEQ ID NO: 543437 - DNA, 16 bp, Homo sapiens
ctgaagattgtttatc

SEQ ID NO: 543438 - DNA, 12 bp, Homo sapiens
ctgaagcagagt

SEQ ID NO: 543439 - DNA, 15 bp, Homo sapiens
ctgaagccagctccc

SEQ ID NO: 543440 - DNA, 22 bp, Homo sapiens
ctgaaggtggccactttaagag

SEQ ID NO: 543441 - DNA, 14 bp, Homo sapiens
ctgaagtctgtatt

SEQ ID NO: 543442 - DNA, 20 bp, Homo sapiens
ctgaagttatatttcctata

SEQ ID NO: 543443 - DNA, 20 bp, Homo sapiens
ctgaagttctgcctctgatg

SEQ ID NO: 543444 - DNA, 23 bp, Homo sapiens
ctgaagttctgcctctgatgtat

SEQ ID NO: 543445 - DNA, 22 bp, Homo sapiens
ctgaagtttgataaatagtgtt

SEQ ID NO: 543446 - DNA, 16 bp, Homo sapiens
ctgaatcagaggcaga

SEQ ID NO: 543447 - DNA, 19 bp, Homo sapiens
ctgaatccaaaagaaaaac

SEQ ID NO: 543448 - DNA, 13 bp, Homo sapiens
ctgaatccctgta

SEQ ID NO: 543449 - DNA, 20 bp, Homo sapiens
ctgaatctgaccacagacac

SEQ ID NO: 543450 - DNA, 19 bp, Homo sapiens
ctgaatggggctttcctga

SEQ ID NO: 543451 - DNA, 15 bp, Homo sapiens
ctgaattggctgcca

SEQ ID NO: 543452 - DNA, 16 bp, Homo sapiens
ctgacagcaaacacag

SEQ ID NO: 543453 - DNA, 14 bp, Homo sapiens
ctgacagccagaac

SEQ ID NO: 543454 - DNA, 14 bp, Homo sapiens
ctgaccacagacac

SEQ ID NO: 543455 - DNA, 14 bp, Homo sapiens
ctgacccccctcag

SEQ ID NO: 543456 - DNA, 23 bp, Homo sapiens
ctgacctcacagagtatgatctc

SEQ ID NO: 543457 - DNA, 17 bp, Homo sapiens
ctgacctccccctcctt

SEQ ID NO: 543458 - DNA, 14 bp, Homo sapiens
ctgacctccgccat

SEQ ID NO: 543459 - DNA, 13 bp, Homo sapiens
ctgacctgccccc

SEQ ID NO: 543460 - DNA, 15 bp, Homo sapiens
ctgacctgcccccgc

SEQ ID NO: 543461 - DNA, 22 bp, Homo sapiens
ctgacctgcccccgctctgcca

SEQ ID NO: 543462 - DNA, 17 bp, Homo sapiens
ctgactcccccagtccc

SEQ ID NO: 543463 - DNA, 23 bp, Homo sapiens
ctgactgggactcccagctggag

SEQ ID NO: 543464 - DNA, 21 bp, Homo sapiens
ctgactttggagacgatgctt

SEQ ID NO: 543465 - DNA, 18 bp, Homo sapiens
ctgagaagcctcatggga

SEQ ID NO: 543466 - DNA, 20 bp, Homo sapiens
ctgagaaggcaaactgaggc

SEQ ID NO: 543467 - DNA, 11 bp, Homo sapiens
ctgagagcaaa

SEQ ID NO: 543468 - DNA, 16 bp, Homo sapiens
ctgagagcagaatgaa

SEQ ID NO: 543469 - DNA, 17 bp, Homo sapiens
ctgagatgggaggatca

SEQ ID NO: 543470 - DNA, 14 bp, Homo sapiens
ctgagctctgacct

SEQ ID NO: 543471 - DNA, 15 bp, Homo sapiens
ctgaggaggtgctgc

SEQ ID NO: 543472 - DNA, 16 bp, Homo sapiens
ctgaggaggtgctgca

SEQ ID NO: 543473 - DNA, 16 bp, Homo sapiens
ctgaggcaggagaatc

SEQ ID NO: 543474 - DNA, 17 bp, Homo sapiens
ctgaggggcagcctgcc

SEQ ID NO: 543475 - DNA, 18 bp, Homo sapiens
ctgaggggcagcctgcct

SEQ ID NO: 543476 - DNA, 20 bp, Homo sapiens
ctgagggtttccaccttggc

SEQ ID NO: 543477 - DNA, 20 bp, Homo sapiens
ctgaggttgggagaggtgca

SEQ ID NO: 543478 - DNA, 16 bp, Homo sapiens
ctgagtacaaatgtgt

SEQ ID NO: 543479 - DNA, 17 bp, Homo sapiens
ctgagtggtccacattc

SEQ ID NO: 543480 - DNA, 18 bp, Homo sapiens
ctgagtggtccacattct

SEQ ID NO: 543481 - DNA, 22 bp, Homo sapiens
ctgagttgaagtcatgctcccc

SEQ ID NO: 543482 - DNA, 18 bp, Homo sapiens
ctgatagatatccttggc

SEQ ID NO: 543483 - DNA, 16 bp, Homo sapiens
ctgatatattttccag

SEQ ID NO: 543484 - DNA, 17 bp, Homo sapiens
ctgatccctgatccctt

SEQ ID NO: 543485 - DNA, 21 bp, Homo sapiens
ctgatcccttccacctgctct

SEQ ID NO: 543486 - DNA, 21 bp, Homo sapiens
ctgatctgggttttgcctctg

SEQ ID NO: 543487 - DNA, 22 bp, Homo sapiens
ctgatctgggttttgcctctgc

SEQ ID NO: 543488 - DNA, 21 bp, Homo sapiens
ctgatgacccccccagcttca

SEQ ID NO: 543489 - DNA, 15 bp, Homo sapiens
ctgatgatggaaggg

SEQ ID NO: 543490 - DNA, 21 bp, Homo sapiens
ctgatgatgttctgaaatgga

SEQ ID NO: 543491 - DNA, 16 bp, Homo sapiens
ctgatgtaacaaggtg

SEQ ID NO: 543492 - DNA, 12 bp, Homo sapiens
ctgattctatgt

SEQ ID NO: 543493 - DNA, 18 bp, Homo sapiens
ctgattctatgtaacttg

SEQ ID NO: 543494 - DNA, 21 bp, Homo sapiens
ctgattctatgtaacttgttg

SEQ ID NO: 543495 - DNA, 19 bp, Homo sapiens
ctgatttattctggtgtct

SEQ ID NO: 543496 - DNA, 21 bp, Homo sapiens
ctgcaaagtacaggtactttg

SEQ ID NO: 543497 - DNA, 22 bp, Homo sapiens
ctgcaaagtacaggtactttgt

SEQ ID NO: 543498 - DNA, 18 bp, Homo sapiens
ctgcacaaacatagacag

SEQ ID NO: 543499 - DNA, 15 bp, Homo sapiens
ctgcacatgatttca

SEQ ID NO: 543500 - DNA, 17 bp, Homo sapiens
ctgcacatgatttcaca

SEQ ID NO: 543501 - DNA, 20 bp, Homo sapiens
ctgcaccaccgaccaactcc

SEQ ID NO: 543502 - DNA, 21 bp, Homo sapiens
ctgcaccaccgaccaactcca

SEQ ID NO: 543503 - DNA, 15 bp, Homo sapiens
ctgcacctgcttctc

SEQ ID NO: 543504 - DNA, 14 bp, Homo sapiens
ctgcactgccctcc

SEQ ID NO: 543505 - DNA, 15 bp, Homo sapiens
ctgcactgccctccg

SEQ ID NO: 543506 - DNA, 12 bp, Homo sapiens
ctgcagagcctg

SEQ ID NO: 543507 - DNA, 14 bp, Homo sapiens
ctgcagagcctgca

SEQ ID NO: 543508 - DNA, 15 bp, Homo sapiens
ctgcagattcctttg

SEQ ID NO: 543509 - DNA, 11 bp, Homo sapiens
ctgcagctccc

SEQ ID NO: 543510 - DNA, 13 bp, Homo sapiens
ctgcagctccctc

SEQ ID NO: 543511 - DNA, 14 bp, Homo sapiens
ctgcagctccctca

SEQ ID NO: 543512 - DNA, 17 bp, Homo sapiens
ctgcagctctcatgctg

SEQ ID NO: 543513 - DNA, 20 bp, Homo sapiens
ctgcaggattctcaccagct

SEQ ID NO: 543514 - DNA, 21 bp, Homo sapiens
ctgcagtcatctcccctcctg

SEQ ID NO: 543515 - DNA, 18 bp, Homo sapiens
ctgcagtgttctgtgaat

SEQ ID NO: 543516 - DNA, 22 bp, Homo sapiens
ctgcagtgttctgtgaatagca

SEQ ID NO: 543517 - DNA, 22 bp, Homo sapiens
ctgcataattctgaagttatat

SEQ ID NO: 543518 - DNA, 23 bp, Homo sapiens
ctgcataattctgaagttatatt

SEQ ID NO: 543519 - DNA, 17 bp, Homo sapiens
ctgcatggcacatacca

SEQ ID NO: 543520 - DNA, 20 bp, Homo sapiens
ctgcattttctgaaactaat

SEQ ID NO: 543521 - DNA, 13 bp, Homo sapiens
ctgccaagagtcc

SEQ ID NO: 543522 - DNA, 18 bp, Homo sapiens
ctgccaagagtccaagcc

SEQ ID NO: 543523 - DNA, 17 bp, Homo sapiens
ctgccaggctcccactg

SEQ ID NO: 543524 - DNA, 20 bp, Homo sapiens
ctgccagtggggcctgaggc

SEQ ID NO: 543525 - DNA, 24 bp, Homo sapiens
ctgccatcagcccctgctgctcct

SEQ ID NO: 543526 - DNA, 23 bp, Homo sapiens
ctgccatgaactggaggccagga

SEQ ID NO: 543527 - DNA, 19 bp, Homo sapiens
ctgccattttttgtctgtg

SEQ ID NO: 543528 - DNA, 18 bp, Homo sapiens
ctgcccagatcagccaga

SEQ ID NO: 543529 - DNA, 15 bp, Homo sapiens
ctgccccacaacaca

SEQ ID NO: 543530 - DNA, 18 bp, Homo sapiens
ctgccccacccctccatg

SEQ ID NO: 543531 - DNA, 20 bp, Homo sapiens
ctgcccccacacctggccct

SEQ ID NO: 543532 - DNA, 19 bp, Homo sapiens
ctgcccccgctctgccatc

SEQ ID NO: 543533 - DNA, 23 bp, Homo sapiens
ctgcccccgctctgccatcagcc

SEQ ID NO: 543534 - DNA, 13 bp, Homo sapiens
ctgccccctcctg

SEQ ID NO: 543535 - DNA, 15 bp, Homo sapiens
ctgccccctcctgag

SEQ ID NO: 543536 - DNA, 16 bp, Homo sapiens
ctgcccctccctgcca

SEQ ID NO: 543537 - DNA, 22 bp, Homo sapiens
ctgcccctccctgccagcaccc

SEQ ID NO: 543538 - DNA, 13 bp, Homo sapiens
ctgcccctgcacc

SEQ ID NO: 543539 - DNA, 20 bp, Homo sapiens
ctgcccctgcacctgcttct

SEQ ID NO: 543540 - DNA, 20 bp, Homo sapiens
ctgcccggcccaggagcgca

SEQ ID NO: 543541 - DNA, 19 bp, Homo sapiens
ctgccctccgcccttccct

SEQ ID NO: 543542 - DNA, 17 bp, Homo sapiens
ctgccctgtcaggaggc

SEQ ID NO: 543543 - DNA, 11 bp, Homo sapiens
ctgcccttggg

SEQ ID NO: 543544 - DNA, 14 bp, Homo sapiens
ctgccctttgtcct

SEQ ID NO: 543545 - DNA, 14 bp, Homo sapiens
ctgcctctgaactg

SEQ ID NO: 543546 - DNA, 15 bp, Homo sapiens
ctgcctctgaactgc

SEQ ID NO: 543547 - DNA, 22 bp, Homo sapiens
ctgcctctgaactgctgctggt

SEQ ID NO: 543548 - DNA, 23 bp, Homo sapiens
ctgcctgaggggcagcctgcctt

SEQ ID NO: 543549 - DNA, 15 bp, Homo sapiens
ctgcctggtctcctg

SEQ ID NO: 543550 - DNA, 16 bp, Homo sapiens
ctgcctggtctcctgc

SEQ ID NO: 543551 - DNA, 19 bp, Homo sapiens
ctgcctggtctcctgcccc

SEQ ID NO: 543552 - DNA, 19 bp, Homo sapiens
ctgcctgtggtgaggtcct

SEQ ID NO: 543553 - DNA, 12 bp, Homo sapiens
ctgccttccagg

SEQ ID NO: 543554 - DNA, 13 bp, Homo sapiens
ctgccttccaggc

SEQ ID NO: 543555 - DNA, 23 bp, Homo sapiens
ctgccttccaggcgtagggccag

SEQ ID NO: 543556 - DNA, 20 bp, Homo sapiens
ctgccttgcccactcctgct

SEQ ID NO: 543557 - DNA, 19 bp, Homo sapiens
ctgccttggggtcaggttg

SEQ ID NO: 543558 - DNA, 17 bp, Homo sapiens
ctgcgcaggccctccgc

SEQ ID NO: 543559 - DNA, 21 bp, Homo sapiens
ctgcggcacccttgcgctttt

SEQ ID NO: 543560 - DNA, 18 bp, Homo sapiens
ctgcgtaggagagaacag

SEQ ID NO: 543561 - DNA, 19 bp, Homo sapiens
ctgcgtcccactgagtctc

SEQ ID NO: 543562 - DNA, 15 bp, Homo sapiens
ctgcgtggctgaccc

SEQ ID NO: 543563 - DNA, 16 bp, Homo sapiens
ctgcgtggctgacccc

SEQ ID NO: 543564 - DNA, 22 bp, Homo sapiens
ctgctatgctgttcattgatga

SEQ ID NO: 543565 - DNA, 21 bp, Homo sapiens
ctgctcagcagtgagagcaga

SEQ ID NO: 543566 - DNA, 23 bp, Homo sapiens
ctgctcagcagtgagagcagatg

SEQ ID NO: 543567 - DNA, 19 bp, Homo sapiens
ctgctcccccttttccctc

SEQ ID NO: 543568 - DNA, 14 bp, Homo sapiens
ctgctcctcggcca

SEQ ID NO: 543569 - DNA, 11 bp, Homo sapiens
ctgctctgctg

SEQ ID NO: 543570 - DNA, 11 bp, Homo sapiens
ctgctcttgca

SEQ ID NO: 543571 - DNA, 19 bp, Homo sapiens
ctgctcttgggcaatattc

SEQ ID NO: 543572 - DNA, 14 bp, Homo sapiens
ctgctctttggcct

SEQ ID NO: 543573 - DNA, 19 bp, Homo sapiens
ctgctgagtccgacctggc

SEQ ID NO: 543574 - DNA, 22 bp, Homo sapiens
ctgctgatgacccccccagctt

SEQ ID NO: 543575 - DNA, 12 bp, Homo sapiens
ctgctgcactgc

SEQ ID NO: 543576 - DNA, 13 bp, Homo sapiens
ctgctgcactgcc

SEQ ID NO: 543577 - DNA, 12 bp, Homo sapiens
ctgctgccaggc

SEQ ID NO: 543578 - DNA, 22 bp, Homo sapiens
ctgctgccaggctcccactgcc

SEQ ID NO: 543579 - DNA, 18 bp, Homo sapiens
ctgctgccagtaccagcc

SEQ ID NO: 543580 - DNA, 21 bp, Homo sapiens
ctgctgccatgaactgtcaag

SEQ ID NO: 543581 - DNA, 18 bp, Homo sapiens
ctgctgctcctcggccag

SEQ ID NO: 543582 - DNA, 20 bp, Homo sapiens
ctgctggtcacttcttctgt

SEQ ID NO: 543583 - DNA, 13 bp, Homo sapiens
ctgctgtaaagca

SEQ ID NO: 543584 - DNA, 20 bp, Homo sapiens
ctgctgtaaagcaaaatatt

SEQ ID NO: 543585 - DNA, 18 bp, Homo sapiens
ctgctgtcattgcttctt

SEQ ID NO: 543586 - DNA, 19 bp, Homo sapiens
ctgctgtcattgcttcttc

SEQ ID NO: 543587 - DNA, 20 bp, Homo sapiens
ctgctgtcattgcttcttct

SEQ ID NO: 543588 - DNA, 22 bp, Homo sapiens
ctgctgtcattgcttcttctga

SEQ ID NO: 543589 - DNA, 14 bp, Homo sapiens
ctgctgtggcatca

SEQ ID NO: 543590 - DNA, 19 bp, Homo sapiens
ctgctgtgggcacaggtca

SEQ ID NO: 543591 - DNA, 19 bp, Homo sapiens
ctgcttctctgcccagctt

SEQ ID NO: 543592 - DNA, 18 bp, Homo sapiens
ctgctttaggattgaagt

SEQ ID NO: 543593 - DNA, 14 bp, Homo sapiens
ctgctttgtctcct

SEQ ID NO: 543594 - DNA, 13 bp, Homo sapiens
ctgcttttgcaaa

SEQ ID NO: 543595 - DNA, 17 bp, Homo sapiens
ctggaaaaaaaaaaata

SEQ ID NO: 543596 - DNA, 16 bp, Homo sapiens
ctggaaacctgtctga

SEQ ID NO: 543597 - DNA, 16 bp, Homo sapiens
ctggaagccctctctg

SEQ ID NO: 543598 - DNA, 16 bp, Homo sapiens
ctggaagggagggctt

SEQ ID NO: 543599 - DNA, 14 bp, Homo sapiens
ctggacatattccc

SEQ ID NO: 543600 - DNA, 19 bp, Homo sapiens
ctggacattaacaagatca

SEQ ID NO: 543601 - DNA, 15 bp, Homo sapiens
ctggaccagagactt

SEQ ID NO: 543602 - DNA, 20 bp, Homo sapiens
ctggactttctcttggacat

SEQ ID NO: 543603 - DNA, 14 bp, Homo sapiens
ctggagaccaggac

SEQ ID NO: 543604 - DNA, 15 bp, Homo sapiens
ctggagaccaggact

SEQ ID NO: 543605 - DNA, 17 bp, Homo sapiens
ctggagaccaggactct

SEQ ID NO: 543606 - DNA, 12 bp, Homo sapiens
ctggagagtaga

SEQ ID NO: 543607 - DNA, 14 bp, Homo sapiens
ctggagcccggcag

SEQ ID NO: 543608 - DNA, 17 bp, Homo sapiens
ctggaggagctgggccc

SEQ ID NO: 543609 - DNA, 16 bp, Homo sapiens
ctggaggggagctctg

SEQ ID NO: 543610 - DNA, 17 bp, Homo sapiens
ctggataggagaggaaa

SEQ ID NO: 543611 - DNA, 17 bp, Homo sapiens
ctggatggtggtgcatc

SEQ ID NO: 543612 - DNA, 20 bp, Homo sapiens
ctggattcccgtggctttgt

SEQ ID NO: 543613 - DNA, 21 bp, Homo sapiens
ctggattcccgtggctttgtg

SEQ ID NO: 543614 - DNA, 13 bp, Homo sapiens
ctggcactttaat

SEQ ID NO: 543615 - DNA, 14 bp, Homo sapiens
ctggcaggagacac

SEQ ID NO: 543616 - DNA, 18 bp, Homo sapiens
ctggcagggcaggcagag

SEQ ID NO: 543617 - DNA, 14 bp, Homo sapiens
ctggcaggtggcca

SEQ ID NO: 543618 - DNA, 20 bp, Homo sapiens
ctggcaggtggccagggctc

SEQ ID NO: 543619 - DNA, 23 bp, Homo sapiens
ctggccaggataatatatttgca

SEQ ID NO: 543620 - DNA, 15 bp, Homo sapiens
ctggcccccactggc

SEQ ID NO: 543621 - DNA, 19 bp, Homo sapiens
ctggcccccactggctgtg

SEQ ID NO: 543622 - DNA, 14 bp, Homo sapiens
ctggcccctcccac

SEQ ID NO: 543623 - DNA, 15 bp, Homo sapiens
ctggccctggggcct

SEQ ID NO: 543624 - DNA, 20 bp, Homo sapiens
ctggcctctcactgcctccc

SEQ ID NO: 543625 - DNA, 22 bp, Homo sapiens
ctggcgagttctctttggaaat

SEQ ID NO: 543626 - DNA, 15 bp, Homo sapiens
ctggctccagcctgg

SEQ ID NO: 543627 - DNA, 16 bp, Homo sapiens
ctggctccagcctgga

SEQ ID NO: 543628 - DNA, 15 bp, Homo sapiens
ctggctcccagggtc

SEQ ID NO: 543629 - DNA, 14 bp, Homo sapiens
ctggctgtgggctc

SEQ ID NO: 543630 - DNA, 15 bp, Homo sapiens
ctggctgtgggctcc

SEQ ID NO: 543631 - DNA, 15 bp, Homo sapiens
ctggcttctccctgg

SEQ ID NO: 543632 - DNA, 16 bp, Homo sapiens
ctgggaccctcggggc

SEQ ID NO: 543633 - DNA, 19 bp, Homo sapiens
ctgggaccctcggggcagg

SEQ ID NO: 543634 - DNA, 15 bp, Homo sapiens
ctgggacgctctgct

SEQ ID NO: 543635 - DNA, 16 bp, Homo sapiens
ctgggacgctctgctg

SEQ ID NO: 543636 - DNA, 22 bp, Homo sapiens
ctgggacttcttacccaaagca

SEQ ID NO: 543637 - DNA, 17 bp, Homo sapiens
ctgggagagtgaggtca

SEQ ID NO: 543638 - DNA, 21 bp, Homo sapiens
ctgggagatgctgggaccctc

SEQ ID NO: 543639 - DNA, 16 bp, Homo sapiens
ctgggcatccccagcc

SEQ ID NO: 543640 - DNA, 20 bp, Homo sapiens
ctgggcatccccagccccct

SEQ ID NO: 543641 - DNA, 15 bp, Homo sapiens
ctgggccctggttcc

SEQ ID NO: 543642 - DNA, 20 bp, Homo sapiens
ctgggccctggttcccccag

SEQ ID NO: 543643 - DNA, 20 bp, Homo sapiens
ctgggctgactgggccaggg

SEQ ID NO: 543644 - DNA, 23 bp, Homo sapiens
ctggggagaatggggctgggccc

SEQ ID NO: 543645 - DNA, 16 bp, Homo sapiens
ctggggagctcctggc

SEQ ID NO: 543646 - DNA, 21 bp, Homo sapiens
ctggggagctcctggccagga

SEQ ID NO: 543647 - DNA, 18 bp, Homo sapiens
ctggggggcctgaaagca

SEQ ID NO: 543648 - DNA, 19 bp, Homo sapiens
ctggggtttccacacaggc

SEQ ID NO: 543649 - DNA, 16 bp, Homo sapiens
ctgggtccccagccct

SEQ ID NO: 543650 - DNA, 12 bp, Homo sapiens
ctgggtcccggg

SEQ ID NO: 543651 - DNA, 13 bp, Homo sapiens
ctgggttattcag

SEQ ID NO: 543652 - DNA, 17 bp, Homo sapiens
ctgggttttgcctctgc

SEQ ID NO: 543653 - DNA, 18 bp, Homo sapiens
ctggtaagaaaaagcaaa

SEQ ID NO: 543654 - DNA, 16 bp, Homo sapiens
ctggtactttctgtac

SEQ ID NO: 543655 - DNA, 14 bp, Homo sapiens
ctggtcgccttcca

SEQ ID NO: 543656 - DNA, 15 bp, Homo sapiens
ctggtcgccttccac

SEQ ID NO: 543657 - DNA, 14 bp, Homo sapiens
ctggtctcagagga

SEQ ID NO: 543658 - DNA, 20 bp, Homo sapiens
ctggtctcctgcccccacac

SEQ ID NO: 543659 - DNA, 15 bp, Homo sapiens
ctggtgggggcatcc

SEQ ID NO: 543660 - DNA, 22 bp, Homo sapiens
ctggttcccccaggaccctgag

SEQ ID NO: 543661 - DNA, 23 bp, Homo sapiens
ctggttcccccaggaccctgagg

SEQ ID NO: 543662 - DNA, 19 bp, Homo sapiens
ctgtaaaagcaagtcctgc

SEQ ID NO: 543663 - DNA, 16 bp, Homo sapiens
ctgtaaataaaaatag

SEQ ID NO: 543664 - DNA, 17 bp, Homo sapiens
ctgtaaataaaaatagc

SEQ ID NO: 543665 - DNA, 21 bp, Homo sapiens
ctgtaaatcaagaccaaagag

SEQ ID NO: 543666 - DNA, 17 bp, Homo sapiens
ctgtaaattccaaagat

SEQ ID NO: 543667 - DNA, 18 bp, Homo sapiens
ctgtaaattccaaagatc

SEQ ID NO: 543668 - DNA, 16 bp, Homo sapiens
ctgtaacgtgtgctgt

SEQ ID NO: 543669 - DNA, 16 bp, Homo sapiens
ctgtaagacggccttg

SEQ ID NO: 543670 - DNA, 18 bp, Homo sapiens
ctgtaatagcctcacctt

SEQ ID NO: 543671 - DNA, 20 bp, Homo sapiens
ctgtaatcacactctcttct

SEQ ID NO: 543672 - DNA, 13 bp, Homo sapiens
ctgtacacacaca

SEQ ID NO: 543673 - DNA, 21 bp, Homo sapiens
ctgtacacacacagacacaca

SEQ ID NO: 543674 - DNA, 22 bp, Homo sapiens
ctgtacagagccgtaaaaactg

SEQ ID NO: 543675 - DNA, 13 bp, Homo sapiens
ctgtactggagag

SEQ ID NO: 543676 - DNA, 15 bp, Homo sapiens
ctgtactttgattca

SEQ ID NO: 543677 - DNA, 20 bp, Homo sapiens
ctgtagctttgggcagattt

SEQ ID NO: 543678 - DNA, 18 bp, Homo sapiens
ctgtataaacattaaatg

SEQ ID NO: 543679 - DNA, 19 bp, Homo sapiens
ctgtataaacattaaatgt

SEQ ID NO: 543680 - DNA, 14 bp, Homo sapiens
ctgtatcatttctt

SEQ ID NO: 543681 - DNA, 15 bp, Homo sapiens
ctgtatctgacatat

SEQ ID NO: 543682 - DNA, 12 bp, Homo sapiens
ctgtattcagca

SEQ ID NO: 543683 - DNA, 11 bp, Homo sapiens
ctgtattgcta

SEQ ID NO: 543684 - DNA, 21 bp, Homo sapiens
ctgtatttacttgttatgttg

SEQ ID NO: 543685 - DNA, 13 bp, Homo sapiens
ctgtatttgttaa

SEQ ID NO: 543686 - DNA, 15 bp, Homo sapiens
ctgtatttgttaatt

SEQ ID NO: 543687 - DNA, 12 bp, Homo sapiens
ctgtcaaacatt

SEQ ID NO: 543688 - DNA, 22 bp, Homo sapiens
ctgtcaaacattagtactttat

SEQ ID NO: 543689 - DNA, 18 bp, Homo sapiens
ctgtcaagtttttatacc

SEQ ID NO: 543690 - DNA, 16 bp, Homo sapiens
ctgtcaccaccctgct

SEQ ID NO: 543691 - DNA, 12 bp, Homo sapiens
ctgtcaggaggc

SEQ ID NO: 543692 - DNA, 19 bp, Homo sapiens
ctgtcatgtgcgaacacag

SEQ ID NO: 543693 - DNA, 20 bp, Homo sapiens
ctgtcatgtgcgaacacagt

SEQ ID NO: 543694 - DNA, 14 bp, Homo sapiens
ctgtcatttctctt

SEQ ID NO: 543695 - DNA, 18 bp, Homo sapiens
ctgtcatttctctttcaa

SEQ ID NO: 543696 - DNA, 14 bp, Homo sapiens
ctgtcctggctccc

SEQ ID NO: 543697 - DNA, 21 bp, Homo sapiens
ctgtccttccaacctgttcac

SEQ ID NO: 543698 - DNA, 21 bp, Homo sapiens
ctgtcgatgagactgtttatt

SEQ ID NO: 543699 - DNA, 16 bp, Homo sapiens
ctgtcgtccccagacc

SEQ ID NO: 543700 - DNA, 17 bp, Homo sapiens
ctgtctagcacttcctt

SEQ ID NO: 543701 - DNA, 18 bp, Homo sapiens
ctgtctagcacttccttg

SEQ ID NO: 543702 - DNA, 18 bp, Homo sapiens
ctgtctgaggttgggaga

SEQ ID NO: 543703 - DNA, 17 bp, Homo sapiens
ctgtctgctccagctct

SEQ ID NO: 543704 - DNA, 19 bp, Homo sapiens
ctgtctgctggtcacttct

SEQ ID NO: 543705 - DNA, 16 bp, Homo sapiens
ctgtctgtctctcttt

SEQ ID NO: 543706 - DNA, 17 bp, Homo sapiens
ctgtctgtgaagagcaa

SEQ ID NO: 543707 - DNA, 12 bp, Homo sapiens
ctgtctgtggct

SEQ ID NO: 543708 - DNA, 18 bp, Homo sapiens
ctgtgacacagctgagct

SEQ ID NO: 543709 - DNA, 13 bp, Homo sapiens
ctgtgataacaga

SEQ ID NO: 543710 - DNA, 21 bp, Homo sapiens
ctgtgcaaagcagagtgaaat

SEQ ID NO: 543711 - DNA, 21 bp, Homo sapiens
ctgtgcgcataggcctgcttt

SEQ ID NO: 543712 - DNA, 20 bp, Homo sapiens
ctgtgctaagttgtcttaca

SEQ ID NO: 543713 - DNA, 18 bp, Homo sapiens
ctgtgctatgctggacat

SEQ ID NO: 543714 - DNA, 14 bp, Homo sapiens
ctgtggcctcagga

SEQ ID NO: 543715 - DNA, 19 bp, Homo sapiens
ctgtggcctcaggaggcag

SEQ ID NO: 543716 - DNA, 20 bp, Homo sapiens
ctgtggctgatttactaaca

SEQ ID NO: 543717 - DNA, 22 bp, Homo sapiens
ctgtggctgatttactaacagt

SEQ ID NO: 543718 - DNA, 21 bp, Homo sapiens
ctgtgggcacaggtcaggcta

SEQ ID NO: 543719 - DNA, 13 bp, Homo sapiens
ctgtggggccaca

SEQ ID NO: 543720 - DNA, 22 bp, Homo sapiens
ctgtgtagtagctcgtgtgctt

SEQ ID NO: 543721 - DNA, 16 bp, Homo sapiens
ctgtgtcagtttatgt

SEQ ID NO: 543722 - DNA, 19 bp, Homo sapiens
ctgtgtcagtttatgtttt

SEQ ID NO: 543723 - DNA, 22 bp, Homo sapiens
ctgtgtcatttggctttccagt

SEQ ID NO: 543724 - DNA, 18 bp, Homo sapiens
ctgtgtccctcaattaca

SEQ ID NO: 543725 - DNA, 15 bp, Homo sapiens
ctgtgtccggcccag

SEQ ID NO: 543726 - DNA, 23 bp, Homo sapiens
ctgtgttgtgattccccggagct

SEQ ID NO: 543727 - DNA, 14 bp, Homo sapiens
ctgtgtttgctccc

SEQ ID NO: 543728 - DNA, 21 bp, Homo sapiens
ctgttaaggcatccacttcac

SEQ ID NO: 543729 - DNA, 15 bp, Homo sapiens
ctgttacaaaatgta

SEQ ID NO: 543730 - DNA, 20 bp, Homo sapiens
ctgttacataacaagaaaat

SEQ ID NO: 543731 - DNA, 20 bp, Homo sapiens
ctgttactcaatgtgtgccg

SEQ ID NO: 543732 - DNA, 15 bp, Homo sapiens
ctgttataaattttg

SEQ ID NO: 543733 - DNA, 20 bp, Homo sapiens
ctgttataaattttgtacat

SEQ ID NO: 543734 - DNA, 23 bp, Homo sapiens
ctgttataaattttgtacatttt

SEQ ID NO: 543735 - DNA, 17 bp, Homo sapiens
ctgttatctagaaatta

SEQ ID NO: 543736 - DNA, 20 bp, Homo sapiens
ctgttcacggggatgcttgg

SEQ ID NO: 543737 - DNA, 12 bp, Homo sapiens
ctgttcttcctg

SEQ ID NO: 543738 - DNA, 15 bp, Homo sapiens
ctgttgaccaggcac

SEQ ID NO: 543739 - DNA, 16 bp, Homo sapiens
ctgttgtaatatcagt

SEQ ID NO: 543740 - DNA, 22 bp, Homo sapiens
ctgttgtaatatcagttacagt

SEQ ID NO: 543741 - DNA, 15 bp, Homo sapiens
ctgttgtctcttctc

SEQ ID NO: 543742 - DNA, 23 bp, Homo sapiens
ctgtttaaaatttgtgctgggtt

SEQ ID NO: 543743 - DNA, 19 bp, Homo sapiens
ctgtttattaccagattca

SEQ ID NO: 543744 - DNA, 21 bp, Homo sapiens
ctgtttcaagttcacacctgc

SEQ ID NO: 543745 - DNA, 12 bp, Homo sapiens
ctgtttcatttg

SEQ ID NO: 543746 - DNA, 18 bp, Homo sapiens
ctgtttctcagtctcaca

SEQ ID NO: 543747 - DNA, 13 bp, Homo sapiens
ctgtttgctgtgc

SEQ ID NO: 543748 - DNA, 12 bp, Homo sapiens
ctgttttgtgcg

SEQ ID NO: 543749 - DNA, 14 bp, Homo sapiens
cttaaaaagtaact

SEQ ID NO: 543750 - DNA, 12 bp, Homo sapiens
cttaaaaatgca

SEQ ID NO: 543751 - DNA, 22 bp, Homo sapiens
cttaaaaatgcatttaagttgt

SEQ ID NO: 543752 - DNA, 13 bp, Homo sapiens
cttaaaatttgaa

SEQ ID NO: 543753 - DNA, 20 bp, Homo sapiens
cttaaaatttgaaacattgc

SEQ ID NO: 543754 - DNA, 12 bp, Homo sapiens
cttaaatgtgaa

SEQ ID NO: 543755 - DNA, 22 bp, Homo sapiens
cttaaatgtgaattactaactt

SEQ ID NO: 543756 - DNA, 16 bp, Homo sapiens
cttaacagatcacatg

SEQ ID NO: 543757 - DNA, 16 bp, Homo sapiens
cttaactggtctcctt

SEQ ID NO: 543758 - DNA, 22 bp, Homo sapiens
cttaactgtggtgttgaggctt

SEQ ID NO: 543759 - DNA, 21 bp, Homo sapiens
cttaagaagtatccctgattt

SEQ ID NO: 543760 - DNA, 14 bp, Homo sapiens
cttaagctgcagga

SEQ ID NO: 543761 - DNA, 20 bp, Homo sapiens
cttaatggccttaattaatt

SEQ ID NO: 543762 - DNA, 13 bp, Homo sapiens
cttaattaagtaa

SEQ ID NO: 543763 - DNA, 18 bp, Homo sapiens
cttacagaaccaattcac

SEQ ID NO: 543764 - DNA, 21 bp, Homo sapiens
cttacagaaccaattcacttt

SEQ ID NO: 543765 - DNA, 14 bp, Homo sapiens
cttacagttaagaa

SEQ ID NO: 543766 - DNA, 15 bp, Homo sapiens
cttactgattaactc

SEQ ID NO: 543767 - DNA, 16 bp, Homo sapiens
cttactgttttgtgcg

SEQ ID NO: 543768 - DNA, 14 bp, Homo sapiens
cttactttgttaat

SEQ ID NO: 543769 - DNA, 15 bp, Homo sapiens
cttactttgttaatt

SEQ ID NO: 543770 - DNA, 14 bp, Homo sapiens
cttagaaaataaat

SEQ ID NO: 543771 - DNA, 14 bp, Homo sapiens
cttagcctggagca

SEQ ID NO: 543772 - DNA, 20 bp, Homo sapiens
cttagcttatctttctttcc

SEQ ID NO: 543773 - DNA, 21 bp, Homo sapiens
cttagcttatctttctttcca

SEQ ID NO: 543774 - DNA, 17 bp, Homo sapiens
cttagggttttctctct

SEQ ID NO: 543775 - DNA, 13 bp, Homo sapiens
cttagtatctcat

SEQ ID NO: 543776 - DNA, 22 bp, Homo sapiens
cttagtatctcatcaacaaaga

SEQ ID NO: 543777 - DNA, 21 bp, Homo sapiens
cttagtctaggtccttgttgt

SEQ ID NO: 543778 - DNA, 19 bp, Homo sapiens
cttagttaatctttgaaaa

SEQ ID NO: 543779 - DNA, 14 bp, Homo sapiens
cttataacattgta

SEQ ID NO: 543780 - DNA, 18 bp, Homo sapiens
cttataacattgtatgtt

SEQ ID NO: 543781 - DNA, 21 bp, Homo sapiens
cttatatagcagcaaaaatat

SEQ ID NO: 543782 - DNA, 16 bp, Homo sapiens
cttatctttctttcca

SEQ ID NO: 543783 - DNA, 19 bp, Homo sapiens
cttatgaatagacataaat

SEQ ID NO: 543784 - DNA, 21 bp, Homo sapiens
cttatgaatagacataaattg

SEQ ID NO: 543785 - DNA, 15 bp, Homo sapiens
cttatgcttccagaa

SEQ ID NO: 543786 - DNA, 13 bp, Homo sapiens
cttattaaagttt

SEQ ID NO: 543787 - DNA, 14 bp, Homo sapiens
cttattaaagtttc

SEQ ID NO: 543788 - DNA, 23 bp, Homo sapiens
cttattaaagtttcaaaaatctg

SEQ ID NO: 543789 - DNA, 16 bp, Homo sapiens
cttattccatattaga

SEQ ID NO: 543790 - DNA, 22 bp, Homo sapiens
cttattccatattagaaaactt

SEQ ID NO: 543791 - DNA, 19 bp, Homo sapiens
cttcaaaacaaacagatgc

SEQ ID NO: 543792 - DNA, 17 bp, Homo sapiens
cttcaaattgtcttttg

SEQ ID NO: 543793 - DNA, 23 bp, Homo sapiens
cttcaatcaataacagccgctcc

SEQ ID NO: 543794 - DNA, 17 bp, Homo sapiens
cttcactctaagatgtt

SEQ ID NO: 543795 - DNA, 12 bp, Homo sapiens
cttcactgtcac

SEQ ID NO: 543796 - DNA, 13 bp, Homo sapiens
cttcacttctgac

SEQ ID NO: 543797 - DNA, 21 bp, Homo sapiens
cttcacttctgactcttcccc

SEQ ID NO: 543798 - DNA, 23 bp, Homo sapiens
cttcagaaacccggcttcctgtg

SEQ ID NO: 543799 - DNA, 12 bp, Homo sapiens
cttcagcccctg

SEQ ID NO: 543800 - DNA, 13 bp, Homo sapiens
cttcagcctctcc

SEQ ID NO: 543801 - DNA, 21 bp, Homo sapiens
cttcaggaaagcagcagtttt

SEQ ID NO: 543802 - DNA, 18 bp, Homo sapiens
cttcagggagtcagctgt

SEQ ID NO: 543803 - DNA, 15 bp, Homo sapiens
cttcagggcagattt

SEQ ID NO: 543804 - DNA, 22 bp, Homo sapiens
cttcagggcagattttagtttt

SEQ ID NO: 543805 - DNA, 15 bp, Homo sapiens
cttcagggggccagg

SEQ ID NO: 543806 - DNA, 23 bp, Homo sapiens
cttcagggggccaggtgcacaga

SEQ ID NO: 543807 - DNA, 16 bp, Homo sapiens
cttcagtttttgtgtt

SEQ ID NO: 543808 - DNA, 23 bp, Homo sapiens
cttcatgaaatgctatgtcattt

SEQ ID NO: 543809 - DNA, 22 bp, Homo sapiens
cttcatgcgcagtccccaggta

SEQ ID NO: 543810 - DNA, 14 bp, Homo sapiens
cttcatggaactca

SEQ ID NO: 543811 - DNA, 21 bp, Homo sapiens
cttcatggaactcagctgtct

SEQ ID NO: 543812 - DNA, 14 bp, Homo sapiens
cttcatttaacact

SEQ ID NO: 543813 - DNA, 12 bp, Homo sapiens
cttcattttccc

SEQ ID NO: 543814 - DNA, 14 bp, Homo sapiens
cttcatttttccta

SEQ ID NO: 543815 - DNA, 21 bp, Homo sapiens
cttccaaagcagagagcatta

SEQ ID NO: 543816 - DNA, 17 bp, Homo sapiens
cttccacaggtctcaga

SEQ ID NO: 543817 - DNA, 11 bp, Homo sapiens
cttccaggcag

SEQ ID NO: 543818 - DNA, 16 bp, Homo sapiens
cttccagttactttcc

SEQ ID NO: 543819 - DNA, 21 bp, Homo sapiens
cttccagttggactgtggcct

SEQ ID NO: 543820 - DNA, 16 bp, Homo sapiens
cttcccactcttctca

SEQ ID NO: 543821 - DNA, 15 bp, Homo sapiens
cttcccagctgcccc

SEQ ID NO: 543822 - DNA, 22 bp, Homo sapiens
cttcccagctgcccctccctgc

SEQ ID NO: 543823 - DNA, 21 bp, Homo sapiens
cttcccatgtctttctccaaa

SEQ ID NO: 543824 - DNA, 12 bp, Homo sapiens
cttcccattcca

SEQ ID NO: 543825 - DNA, 16 bp, Homo sapiens
cttcccattccatggc

SEQ ID NO: 543826 - DNA, 18 bp, Homo sapiens
cttccccacaataggctt

SEQ ID NO: 543827 - DNA, 13 bp, Homo sapiens
cttcccccaccac

SEQ ID NO: 543828 - DNA, 22 bp, Homo sapiens
cttccccttgggatgggcacag

SEQ ID NO: 543829 - DNA, 16 bp, Homo sapiens
cttccctccctgctgt

SEQ ID NO: 543830 - DNA, 14 bp, Homo sapiens
cttcctactcttct

SEQ ID NO: 543831 - DNA, 21 bp, Homo sapiens
cttcctactcttctctctgct

SEQ ID NO: 543832 - DNA, 22 bp, Homo sapiens
cttcctactcttctctctgctc

SEQ ID NO: 543833 - DNA, 16 bp, Homo sapiens
cttcctagttcatccc

SEQ ID NO: 543834 - DNA, 23 bp, Homo sapiens
cttcctcattccctcgtctttcc

SEQ ID NO: 543835 - DNA, 23 bp, Homo sapiens
cttcctccatcctcctccttcct

SEQ ID NO: 543836 - DNA, 12 bp, Homo sapiens
cttcctctgctc

SEQ ID NO: 543837 - DNA, 15 bp, Homo sapiens
cttcctctgctcccc

SEQ ID NO: 543838 - DNA, 15 bp, Homo sapiens
cttcctgcctggtct

SEQ ID NO: 543839 - DNA, 18 bp, Homo sapiens
cttcctgcctggtctcct

SEQ ID NO: 543840 - DNA, 21 bp, Homo sapiens
cttcctgttctgtgtctgctg

SEQ ID NO: 543841 - DNA, 15 bp, Homo sapiens
cttccttctttgccc

SEQ ID NO: 543842 - DNA, 17 bp, Homo sapiens
cttcggaggaccagggc

SEQ ID NO: 543843 - DNA, 20 bp, Homo sapiens
cttctaaaactgtactttga

SEQ ID NO: 543844 - DNA, 21 bp, Homo sapiens
cttctaaaactgtactttgat

SEQ ID NO: 543845 - DNA, 23 bp, Homo sapiens
cttctacaatacaacacattgaa

SEQ ID NO: 543846 - DNA, 14 bp, Homo sapiens
cttctactccatgg

SEQ ID NO: 543847 - DNA, 22 bp, Homo sapiens
cttctactccatggtgaactga

SEQ ID NO: 543848 - DNA, 23 bp, Homo sapiens
cttctactccatggtgaactgaa

SEQ ID NO: 543849 - DNA, 13 bp, Homo sapiens
cttctattttcaa

SEQ ID NO: 543850 - DNA, 21 bp, Homo sapiens
cttctcaaatgctactcagta

SEQ ID NO: 543851 - DNA, 23 bp, Homo sapiens
cttctcatcttgacagagcctgc

SEQ ID NO: 543852 - DNA, 17 bp, Homo sapiens
cttctcccccatcctac

SEQ ID NO: 543853 - DNA, 20 bp, Homo sapiens
cttctccctggactctgtgg

SEQ ID NO: 543854 - DNA, 21 bp, Homo sapiens
cttctccctggactctgtggg

SEQ ID NO: 543855 - DNA, 14 bp, Homo sapiens
cttctctcacctcc

SEQ ID NO: 543856 - DNA, 16 bp, Homo sapiens
cttctctcacctccta

SEQ ID NO: 543857 - DNA, 13 bp, Homo sapiens
cttctctctgctc

SEQ ID NO: 543858 - DNA, 15 bp, Homo sapiens
cttctctctgtgctg

SEQ ID NO: 543859 - DNA, 12 bp, Homo sapiens
cttctctgccca

SEQ ID NO: 543860 - DNA, 17 bp, Homo sapiens
cttctgagctggcctct

SEQ ID NO: 543861 - DNA, 15 bp, Homo sapiens
cttctgtcgtcccca

SEQ ID NO: 543862 - DNA, 23 bp, Homo sapiens
cttctgtcgtccccagaccagta

SEQ ID NO: 543863 - DNA, 20 bp, Homo sapiens
cttcttaatataactgcctt

SEQ ID NO: 543864 - DNA, 19 bp, Homo sapiens
cttcttctgtcatctacct

SEQ ID NO: 543865 - DNA, 19 bp, Homo sapiens
cttcttgtgcccttaaaac

SEQ ID NO: 543866 - DNA, 13 bp, Homo sapiens
cttctttcccttc

SEQ ID NO: 543867 - DNA, 16 bp, Homo sapiens
cttctttcccttcctc

SEQ ID NO: 543868 - DNA, 17 bp, Homo sapiens
cttctttctagagcagt

SEQ ID NO: 543869 - DNA, 13 bp, Homo sapiens
cttgaaaagtgtg

SEQ ID NO: 543870 - DNA, 20 bp, Homo sapiens
cttgaaattatatctgtggt

SEQ ID NO: 543871 - DNA, 13 bp, Homo sapiens
cttgaatgcttaa

SEQ ID NO: 543872 - DNA, 16 bp, Homo sapiens
cttgacagagcctgcc

SEQ ID NO: 543873 - DNA, 12 bp, Homo sapiens
cttgacagctca

SEQ ID NO: 543874 - DNA, 14 bp, Homo sapiens
cttgaccctgaaat

SEQ ID NO: 543875 - DNA, 23 bp, Homo sapiens
cttgaccctgaaatattttctac

SEQ ID NO: 543876 - DNA, 20 bp, Homo sapiens
cttgaccttctgtcgtcccc

SEQ ID NO: 543877 - DNA, 23 bp, Homo sapiens
cttgaccttctgtcgtccccaga

SEQ ID NO: 543878 - DNA, 20 bp, Homo sapiens
cttgacgtttcttctttcta

SEQ ID NO: 543879 - DNA, 21 bp, Homo sapiens
cttgacgtttcttctttctag

SEQ ID NO: 543880 - DNA, 20 bp, Homo sapiens
cttgaggggagccaggaggg

SEQ ID NO: 543881 - DNA, 17 bp, Homo sapiens
cttgatataaaaaatct

SEQ ID NO: 543882 - DNA, 22 bp, Homo sapiens
cttgatggtcagacacaaacaa

SEQ ID NO: 543883 - DNA, 17 bp, Homo sapiens
cttgatttgttcttaca

SEQ ID NO: 543884 - DNA, 16 bp, Homo sapiens
cttgatttttcaaaga

SEQ ID NO: 543885 - DNA, 23 bp, Homo sapiens
cttgcacacatcatctgtaagct

SEQ ID NO: 543886 - DNA, 12 bp, Homo sapiens
cttgcagaactt

SEQ ID NO: 543887 - DNA, 15 bp, Homo sapiens
cttgcagtcatcaga

SEQ ID NO: 543888 - DNA, 20 bp, Homo sapiens
cttgcattttagctaattta

SEQ ID NO: 543889 - DNA, 15 bp, Homo sapiens
cttgcccactcctgc

SEQ ID NO: 543890 - DNA, 22 bp, Homo sapiens
cttgcttaaatgtgaattacta

SEQ ID NO: 543891 - DNA, 17 bp, Homo sapiens
cttgctttatttttcat

SEQ ID NO: 543892 - DNA, 16 bp, Homo sapiens
cttggcaccaataaag

SEQ ID NO: 543893 - DNA, 22 bp, Homo sapiens
cttggcaccaataaaggaggaa

SEQ ID NO: 543894 - DNA, 17 bp, Homo sapiens
cttgggatgggcacagg

SEQ ID NO: 543895 - DNA, 18 bp, Homo sapiens
cttgggatgggcacaggc

SEQ ID NO: 543896 - DNA, 19 bp, Homo sapiens
cttgggcaatattctctgt

SEQ ID NO: 543897 - DNA, 22 bp, Homo sapiens
cttggtcacaaagctatttaag

SEQ ID NO: 543898 - DNA, 16 bp, Homo sapiens
cttggtcacagccagg

SEQ ID NO: 543899 - DNA, 13 bp, Homo sapiens
cttggtccttaaa

SEQ ID NO: 543900 - DNA, 19 bp, Homo sapiens
cttggtgattacctgaaag

SEQ ID NO: 543901 - DNA, 23 bp, Homo sapiens
cttggtgattacctgaaagccct

SEQ ID NO: 543902 - DNA, 19 bp, Homo sapiens
cttggtgcctaatgttcca

SEQ ID NO: 543903 - DNA, 23 bp, Homo sapiens
cttggtttccatcaaagccctcc

SEQ ID NO: 543904 - DNA, 14 bp, Homo sapiens
cttgtataaatgta

SEQ ID NO: 543905 - DNA, 15 bp, Homo sapiens
cttgtataaatgtat

SEQ ID NO: 543906 - DNA, 16 bp, Homo sapiens
cttgtcatagccagtg

SEQ ID NO: 543907 - DNA, 16 bp, Homo sapiens
cttgtctttctggggt

SEQ ID NO: 543908 - DNA, 16 bp, Homo sapiens
cttgtgcccttaaaac

SEQ ID NO: 543909 - DNA, 17 bp, Homo sapiens
cttgtgcccttaaaacc

SEQ ID NO: 543910 - DNA, 14 bp, Homo sapiens
cttgttcagtcact

SEQ ID NO: 543911 - DNA, 12 bp, Homo sapiens
cttgttcttcca

SEQ ID NO: 543912 - DNA, 20 bp, Homo sapiens
cttgttcttccaaagcagag

SEQ ID NO: 543913 - DNA, 13 bp, Homo sapiens
cttgttgcagact

SEQ ID NO: 543914 - DNA, 22 bp, Homo sapiens
cttgttgcagactggtgttaat

SEQ ID NO: 543915 - DNA, 17 bp, Homo sapiens
cttgttttgcttcccct

SEQ ID NO: 543916 - DNA, 16 bp, Homo sapiens
ctttaaaacttactat

SEQ ID NO: 543917 - DNA, 21 bp, Homo sapiens
ctttaaaagaaggtaaataat

SEQ ID NO: 543918 - DNA, 23 bp, Homo sapiens
ctttaaagagcaggatagctctt

SEQ ID NO: 543919 - DNA, 13 bp, Homo sapiens
ctttaaagttctt

SEQ ID NO: 543920 - DNA, 18 bp, Homo sapiens
ctttaaatccttaatggc

SEQ ID NO: 543921 - DNA, 21 bp, Homo sapiens
ctttaaatggggacgcagatg

SEQ ID NO: 543922 - DNA, 16 bp, Homo sapiens
ctttaaattgtggatg

SEQ ID NO: 543923 - DNA, 15 bp, Homo sapiens
ctttaagagagaaat

SEQ ID NO: 543924 - DNA, 21 bp, Homo sapiens
ctttaatatgtattttatgta

SEQ ID NO: 543925 - DNA, 12 bp, Homo sapiens
ctttaatgataa

SEQ ID NO: 543926 - DNA, 18 bp, Homo sapiens
ctttacaaacaaaagcat

SEQ ID NO: 543927 - DNA, 14 bp, Homo sapiens
ctttacacacacag

SEQ ID NO: 543928 - DNA, 23 bp, Homo sapiens
ctttacacggagcggattgcaaa

SEQ ID NO: 543929 - DNA, 14 bp, Homo sapiens
ctttaccctcatct

SEQ ID NO: 543930 - DNA, 16 bp, Homo sapiens
ctttacttgtctttct

SEQ ID NO: 543931 - DNA, 17 bp, Homo sapiens
ctttagaatgttttcct

SEQ ID NO: 543932 - DNA, 20 bp, Homo sapiens
ctttagagaagatggatatg

SEQ ID NO: 543933 - DNA, 18 bp, Homo sapiens
ctttagcagaatcaaaat

SEQ ID NO: 543934 - DNA, 14 bp, Homo sapiens
ctttagctgacaga

SEQ ID NO: 543935 - DNA, 14 bp, Homo sapiens
ctttatacagattt

SEQ ID NO: 543936 - DNA, 22 bp, Homo sapiens
ctttatctaccaactttcaaga

SEQ ID NO: 543937 - DNA, 17 bp, Homo sapiens
ctttattataatcaaag

SEQ ID NO: 543938 - DNA, 15 bp, Homo sapiens
ctttcaagaacttgt

SEQ ID NO: 543939 - DNA, 12 bp, Homo sapiens
ctttcacttctt

SEQ ID NO: 543940 - DNA, 20 bp, Homo sapiens
ctttcagatgaccttttgga

SEQ ID NO: 543941 - DNA, 16 bp, Homo sapiens
ctttcagcaggcagcc

SEQ ID NO: 543942 - DNA, 16 bp, Homo sapiens
ctttccaattctcctt

SEQ ID NO: 543943 - DNA, 18 bp, Homo sapiens
ctttccaattctccttta

SEQ ID NO: 543944 - DNA, 16 bp, Homo sapiens
ctttccagtgctgctc

SEQ ID NO: 543945 - DNA, 19 bp, Homo sapiens
ctttccatttacagtctct

SEQ ID NO: 543946 - DNA, 18 bp, Homo sapiens
ctttcccacccagcctgg

SEQ ID NO: 543947 - DNA, 14 bp, Homo sapiens
ctttcccttccagt

SEQ ID NO: 543948 - DNA, 17 bp, Homo sapiens
ctttcctgtttctcagt

SEQ ID NO: 543949 - DNA, 14 bp, Homo sapiens
ctttcggaaatgat

SEQ ID NO: 543950 - DNA, 15 bp, Homo sapiens
ctttctccaaagtta

SEQ ID NO: 543951 - DNA, 23 bp, Homo sapiens
ctttctccaaagttatccagagg

SEQ ID NO: 543952 - DNA, 14 bp, Homo sapiens
ctttctgaattgca

SEQ ID NO: 543953 - DNA, 17 bp, Homo sapiens
ctttctgaattgcacat

SEQ ID NO: 543954 - DNA, 22 bp, Homo sapiens
ctttctggggggatatttccta

SEQ ID NO: 543955 - DNA, 17 bp, Homo sapiens
ctttctggggtttttct

SEQ ID NO: 543956 - DNA, 15 bp, Homo sapiens
ctttctgttatctag

SEQ ID NO: 543957 - DNA, 21 bp, Homo sapiens
ctttcttcctcattccctcgt

SEQ ID NO: 543958 - DNA, 17 bp, Homo sapiens
ctttctttaaagttctt

SEQ ID NO: 543959 - DNA, 21 bp, Homo sapiens
ctttcttttcgccgtggctgc

SEQ ID NO: 543960 - DNA, 11 bp, Homo sapiens
ctttgaatttt

SEQ ID NO: 543961 - DNA, 20 bp, Homo sapiens
ctttgattcacatgttttca

SEQ ID NO: 543962 - DNA, 14 bp, Homo sapiens
ctttggaaaattca

SEQ ID NO: 543963 - DNA, 14 bp, Homo sapiens
ctttgggcagattt

SEQ ID NO: 543964 - DNA, 17 bp, Homo sapiens
ctttgggcagatttgca

SEQ ID NO: 543965 - DNA, 20 bp, Homo sapiens
ctttgtataaatttttaagt

SEQ ID NO: 543966 - DNA, 13 bp, Homo sapiens
ctttgtcctcctg

SEQ ID NO: 543967 - DNA, 15 bp, Homo sapiens
ctttgtgcttgttct

SEQ ID NO: 543968 - DNA, 19 bp, Homo sapiens
ctttgttttttgttttcat

SEQ ID NO: 543969 - DNA, 23 bp, Homo sapiens
ctttgtttttttttcctgtcctt

SEQ ID NO: 543970 - DNA, 14 bp, Homo sapiens
cttttaaaaagtat

SEQ ID NO: 543971 - DNA, 19 bp, Homo sapiens
cttttaaaactacttagca

SEQ ID NO: 543972 - DNA, 18 bp, Homo sapiens
cttttagtttttctgtcc

SEQ ID NO: 543973 - DNA, 23 bp, Homo sapiens
cttttataaaaaaaatgaaatgt

SEQ ID NO: 543974 - DNA, 15 bp, Homo sapiens
cttttatactgacac

SEQ ID NO: 543975 - DNA, 19 bp, Homo sapiens
cttttatgcgcaaatacaa

SEQ ID NO: 543976 - DNA, 18 bp, Homo sapiens
cttttattcattagctgt

SEQ ID NO: 543977 - DNA, 14 bp, Homo sapiens
cttttcacccttct

SEQ ID NO: 543978 - DNA, 16 bp, Homo sapiens
cttttcacccttctac

SEQ ID NO: 543979 - DNA, 20 bp, Homo sapiens
cttttcatggagtagagtca

SEQ ID NO: 543980 - DNA, 14 bp, Homo sapiens
cttttcattgctgt

SEQ ID NO: 543981 - DNA, 15 bp, Homo sapiens
cttttccaacccatg

SEQ ID NO: 543982 - DNA, 17 bp, Homo sapiens
cttttccaacccatgag

SEQ ID NO: 543983 - DNA, 14 bp, Homo sapiens
cttttccagtattt

SEQ ID NO: 543984 - DNA, 16 bp, Homo sapiens
cttttcctcgcttctt

SEQ ID NO: 543985 - DNA, 23 bp, Homo sapiens
cttttctaaactaggctccttca

SEQ ID NO: 543986 - DNA, 18 bp, Homo sapiens
cttttctcctatcttcat

SEQ ID NO: 543987 - DNA, 22 bp, Homo sapiens
cttttctgtgtttacagagatg

SEQ ID NO: 543988 - DNA, 13 bp, Homo sapiens
cttttgcaaataa

SEQ ID NO: 543989 - DNA, 17 bp, Homo sapiens
cttttgcatagaataat

SEQ ID NO: 543990 - DNA, 17 bp, Homo sapiens
cttttgggaggatttga

SEQ ID NO: 543991 - DNA, 20 bp, Homo sapiens
cttttgggaggatttgatgt

SEQ ID NO: 543992 - DNA, 16 bp, Homo sapiens
gacttcatttttccta

SEQ ID NO: 543993 - DNA, 22 bp, Homo sapiens
gacttggtcttttttctgggtc

SEQ ID NO: 543994 - DNA, 17 bp, Homo sapiens
gacttgtgcacaggcag

SEQ ID NO: 543995 - DNA, 23 bp, Homo sapiens
gagaacattccctggaattgcca

SEQ ID NO: 543996 - DNA, 23 bp, Homo sapiens
gagaaccgagcaaagatcaaaat

SEQ ID NO: 543997 - DNA, 20 bp, Homo sapiens
gagaagatggatatgaccag

SEQ ID NO: 543998 - DNA, 18 bp, Homo sapiens
gagaagcctcatgggagt

SEQ ID NO: 543999 - DNA, 23 bp, Homo sapiens
gagaagggtggtaaatattttca

SEQ ID NO: 544000 - DNA, 16 bp, Homo sapiens
gagaataaaattccta

SEQ ID NO: 544001 - DNA, 14 bp, Homo sapiens
gagaattcacagaa

SEQ ID NO: 544002 - DNA, 14 bp, Homo sapiens
gagacactggtctc

SEQ ID NO: 544003 - DNA, 20 bp, Homo sapiens
gagacactggtctcagagga

SEQ ID NO: 544004 - DNA, 22 bp, Homo sapiens
gagacactggtctcagaggagg

SEQ ID NO: 544005 - DNA, 20 bp, Homo sapiens
gagacactgtgctataaatc

SEQ ID NO: 544006 - DNA, 20 bp, Homo sapiens
gagacagagcgacagagcag

SEQ ID NO: 544007 - DNA, 13 bp, Homo sapiens
gagaccaggactc

SEQ ID NO: 544008 - DNA, 14 bp, Homo sapiens
gagaccaggactct

SEQ ID NO: 544009 - DNA, 19 bp, Homo sapiens
gagaccaggactctgcctt

SEQ ID NO: 544010 - DNA, 15 bp, Homo sapiens
gagaccctgggagag

SEQ ID NO: 544011 - DNA, 18 bp, Homo sapiens
gagaccctgggagagtga

SEQ ID NO: 544012 - DNA, 16 bp, Homo sapiens
gagaccgagtgtggag

SEQ ID NO: 544013 - DNA, 21 bp, Homo sapiens
gagaccgagtgtggagctgct

SEQ ID NO: 544014 - DNA, 13 bp, Homo sapiens
gagactcaggccc

SEQ ID NO: 544015 - DNA, 22 bp, Homo sapiens
gagactgtttattaccagattc

SEQ ID NO: 544016 - DNA, 22 bp, Homo sapiens
gagagagatgtgtaatttttct

SEQ ID NO: 544017 - DNA, 18 bp, Homo sapiens
gagagatatatctgaaaa

SEQ ID NO: 544018 - DNA, 13 bp, Homo sapiens
gagagatctccaa

SEQ ID NO: 544019 - DNA, 13 bp, Homo sapiens
gagagcagaatga

SEQ ID NO: 544020 - DNA, 23 bp, Homo sapiens
gagagctatggacagcattgcca

SEQ ID NO: 544021 - DNA, 15 bp, Homo sapiens
gagaggaaaaaggct

SEQ ID NO: 544022 - DNA, 17 bp, Homo sapiens
gagaggacgtgggcggc

SEQ ID NO: 544023 - DNA, 13 bp, Homo sapiens
gagaggccgggac

SEQ ID NO: 544024 - DNA, 22 bp, Homo sapiens
gagaggctaaaatgttttcagc

SEQ ID NO: 544025 - DNA, 23 bp, Homo sapiens
gagagggtgagtcctccagaact

SEQ ID NO: 544026 - DNA, 18 bp, Homo sapiens
gagatatatctgaaaact

SEQ ID NO: 544027 - DNA, 15 bp, Homo sapiens
gagatctccaactct

SEQ ID NO: 544028 - DNA, 15 bp, Homo sapiens
gagatgaggctggat

SEQ ID NO: 544029 - DNA, 18 bp, Homo sapiens
gagatgctgggaccctcg

SEQ ID NO: 544030 - DNA, 18 bp, Homo sapiens
gagatggggagaaaccta

SEQ ID NO: 544031 - DNA, 18 bp, Homo sapiens
gagcaaagatcaaaataa

SEQ ID NO: 544032 - DNA, 14 bp, Homo sapiens
gagcaagagagcag

SEQ ID NO: 544033 - DNA, 18 bp, Homo sapiens
gagcacaacccccagctc

SEQ ID NO: 544034 - DNA, 19 bp, Homo sapiens
gagcacaacccccagctcc

SEQ ID NO: 544035 - DNA, 13 bp, Homo sapiens
gagcacagccaat

SEQ ID NO: 544036 - DNA, 20 bp, Homo sapiens
gagcacagctttcctgggtc

SEQ ID NO: 544037 - DNA, 20 bp, Homo sapiens
gagcagagaagtacaggtca

SEQ ID NO: 544038 - DNA, 21 bp, Homo sapiens
gagcagagagcttagcctgga

SEQ ID NO: 544039 - DNA, 15 bp, Homo sapiens
gagcaggatagctct

SEQ ID NO: 544040 - DNA, 22 bp, Homo sapiens
gagcatgctccctcatgcagat

SEQ ID NO: 544041 - DNA, 21 bp, Homo sapiens
gagcattataatcaccagggc

SEQ ID NO: 544042 - DNA, 23 bp, Homo sapiens
gagcatttccaacaccacagaca

SEQ ID NO: 544043 - DNA, 18 bp, Homo sapiens
gagccattctggcacttt

SEQ ID NO: 544044 - DNA, 13 bp, Homo sapiens
gagccctggggtt

SEQ ID NO: 544045 - DNA, 24 bp, Homo sapiens
gagcccttcggaggaccagggctg

SEQ ID NO: 544046 - DNA, 22 bp, Homo sapiens
gagccgagctctcctgggccag

SEQ ID NO: 544047 - DNA, 18 bp, Homo sapiens
gagcctgccccagcgctg

SEQ ID NO: 544048 - DNA, 18 bp, Homo sapiens
gagcctgcgtggcctggg

SEQ ID NO: 544049 - DNA, 17 bp, Homo sapiens
gagcgatgtgttctttg

SEQ ID NO: 544050 - DNA, 19 bp, Homo sapiens
gagctcagcacagcctcac

SEQ ID NO: 544051 - DNA, 20 bp, Homo sapiens
gagctcaggccctggtgagg

SEQ ID NO: 544052 - DNA, 20 bp, Homo sapiens
gagctcccaggacgcaggga

SEQ ID NO: 544053 - DNA, 21 bp, Homo sapiens
gagctcctccttgtcttggca

SEQ ID NO: 544054 - DNA, 21 bp, Homo sapiens
gagctctcctgggccagggtc

SEQ ID NO: 544055 - DNA, 22 bp, Homo sapiens
gagctctcctgggccagggtct

SEQ ID NO: 544056 - DNA, 15 bp, Homo sapiens
gagctctgtctgtcc

SEQ ID NO: 544057 - DNA, 20 bp, Homo sapiens
gagctgagatcgcgccactg

SEQ ID NO: 544058 - DNA, 11 bp, Homo sapiens
gagctgccagt

SEQ ID NO: 544059 - DNA, 16 bp, Homo sapiens
gatatgcctgctcttt

SEQ ID NO: 544060 - DNA, 18 bp, Homo sapiens
gatatgtctttaaaatga

SEQ ID NO: 544061 - DNA, 21 bp, Homo sapiens
gatattctttgttaatttgga

SEQ ID NO: 544062 - DNA, 11 bp, Homo sapiens
gatatttccta

SEQ ID NO: 544063 - DNA, 20 bp, Homo sapiens
gatcaagaaaaaaagggaga

SEQ ID NO: 544064 - DNA, 17 bp, Homo sapiens
gatcactgaacttttca

SEQ ID NO: 544065 - DNA, 23 bp, Homo sapiens
gatcactgaacttttcaaaataa

SEQ ID NO: 544066 - DNA, 13 bp, Homo sapiens
gatccacctgcac

SEQ ID NO: 544067 - DNA, 15 bp, Homo sapiens
gatccacctgcacaa

SEQ ID NO: 544068 - DNA, 17 bp, Homo sapiens
gatccacctgcacaaac

SEQ ID NO: 544069 - DNA, 20 bp, Homo sapiens
gatccacctgcacaaacata

SEQ ID NO: 544070 - DNA, 17 bp, Homo sapiens
gatccaggaacacatgc

SEQ ID NO: 544071 - DNA, 19 bp, Homo sapiens
gatccaggaacacatgcac

SEQ ID NO: 544072 - DNA, 13 bp, Homo sapiens
gatcccttccacc

SEQ ID NO: 544073 - DNA, 22 bp, Homo sapiens
gatcccttccacctgctctgct

SEQ ID NO: 544074 - DNA, 13 bp, Homo sapiens
gatccgccctggg

SEQ ID NO: 544075 - DNA, 13 bp, Homo sapiens
gatccttgcacag

SEQ ID NO: 544076 - DNA, 16 bp, Homo sapiens
gatccttgcacagaca

SEQ ID NO: 544077 - DNA, 17 bp, Homo sapiens
gatcgcgccactgcact

SEQ ID NO: 544078 - DNA, 14 bp, Homo sapiens
gatctcctgtgcac

SEQ ID NO: 544079 - DNA, 22 bp, Homo sapiens
gatctgcaagaacactggacct

SEQ ID NO: 544080 - DNA, 22 bp, Homo sapiens
gatctgggttttgcctctgccc

SEQ ID NO: 544081 - DNA, 22 bp, Homo sapiens
gatctgtccttccaacctgttc

SEQ ID NO: 544082 - DNA, 22 bp, Homo sapiens
gatctgtgccttttttatatct

SEQ ID NO: 544083 - DNA, 13 bp, Homo sapiens
gatctgttgtaat

SEQ ID NO: 544084 - DNA, 19 bp, Homo sapiens
gatgaagaccctatctccc

SEQ ID NO: 544085 - DNA, 12 bp, Homo sapiens
gatgacccctcc

SEQ ID NO: 544086 - DNA, 15 bp, Homo sapiens
gatgacccctgccca

SEQ ID NO: 544087 - DNA, 15 bp, Homo sapiens
gatgatgttctgaaa

SEQ ID NO: 544088 - DNA, 20 bp, Homo sapiens
gatgcaatccttacaaatga

SEQ ID NO: 544089 - DNA, 20 bp, Homo sapiens
gatgcagacagggggccaga

SEQ ID NO: 544090 - DNA, 21 bp, Homo sapiens
gatgcagacagggggccagaa

SEQ ID NO: 544091 - DNA, 23 bp, Homo sapiens
gatgcagacagggggccagaaca

SEQ ID NO: 544092 - DNA, 12 bp, Homo sapiens
gatgcatattaa

SEQ ID NO: 544093 - DNA, 14 bp, Homo sapiens
gatgcatattaaag

SEQ ID NO: 544094 - DNA, 20 bp, Homo sapiens
gatgcatattaaagaaagtc

SEQ ID NO: 544095 - DNA, 23 bp, Homo sapiens
gatggcacaatgaatgtatattt

SEQ ID NO: 544096 - DNA, 14 bp, Homo sapiens
gatgggcacaggct

SEQ ID NO: 544097 - DNA, 12 bp, Homo sapiens
gatgtaaatttt

SEQ ID NO: 544098 - DNA, 17 bp, Homo sapiens
gatgtacagttgggaaa

SEQ ID NO: 544099 - DNA, 23 bp, Homo sapiens
gatgtacagttgggaaaatatgt

SEQ ID NO: 544100 - DNA, 15 bp, Homo sapiens
gatgtattttgtgag

SEQ ID NO: 544101 - DNA, 22 bp, Homo sapiens
gatgtccaaacttaacagatca

SEQ ID NO: 544102 - DNA, 13 bp, Homo sapiens
gatgtcccttccc

SEQ ID NO: 544103 - DNA, 14 bp, Homo sapiens
gatgtgacatttgt

SEQ ID NO: 544104 - DNA, 17 bp, Homo sapiens
gatgtgacatttgtcat

SEQ ID NO: 544105 - DNA, 20 bp, Homo sapiens
gatgtgattcaaaagatgcc

SEQ ID NO: 544106 - DNA, 20 bp, Homo sapiens
gatgtggacatgcacccgca

SEQ ID NO: 544107 - DNA, 16 bp, Homo sapiens
gatgttaacagtattt

SEQ ID NO: 544108 - DNA, 13 bp, Homo sapiens
gatgttatatttt

SEQ ID NO: 544109 - DNA, 16 bp, Homo sapiens
gatgttatatttttct

SEQ ID NO: 544110 - DNA, 16 bp, Homo sapiens
gatgttcatggaattg

SEQ ID NO: 544111 - DNA, 23 bp, Homo sapiens
gatgttgatgcaatccttacaaa

SEQ ID NO: 544112 - DNA, 15 bp, Homo sapiens
gatgtttttcttacc

SEQ ID NO: 544113 - DNA, 18 bp, Homo sapiens
gattaaattatcattgtt

SEQ ID NO: 544114 - DNA, 17 bp, Homo sapiens
gattcaaataaccctga

SEQ ID NO: 544115 - DNA, 18 bp, Homo sapiens
gattcaaataaccctgaa

SEQ ID NO: 544116 - DNA, 16 bp, Homo sapiens
gattcacatgttttca

SEQ ID NO: 544117 - DNA, 16 bp, Homo sapiens
gattccaagggcccag

SEQ ID NO: 544118 - DNA, 20 bp, Homo sapiens
gattccaagggcccagaggg

SEQ ID NO: 544119 - DNA, 20 bp, Homo sapiens
gattccccggagctgggaag

SEQ ID NO: 544120 - DNA, 16 bp, Homo sapiens
gcacacatcatctgta

SEQ ID NO: 544121 - DNA, 14 bp, Homo sapiens
gcacacttcccctt

SEQ ID NO: 544122 - DNA, 17 bp, Homo sapiens
gcacagacaattctaat

SEQ ID NO: 544123 - DNA, 22 bp, Homo sapiens
gcacagacaattctaatggtaa

SEQ ID NO: 544124 - DNA, 19 bp, Homo sapiens
gcacagagagggggccacc

SEQ ID NO: 544125 - DNA, 12 bp, Homo sapiens
gcacagaggcct

SEQ ID NO: 544126 - DNA, 13 bp, Homo sapiens
gcacaggtcaggc

SEQ ID NO: 544127 - DNA, 13 bp, Homo sapiens
gcacagtatttaa

SEQ ID NO: 544128 - DNA, 12 bp, Homo sapiens
gcacatgatttc

SEQ ID NO: 544129 - DNA, 22 bp, Homo sapiens
gcacatgatttcacaaatatta

SEQ ID NO: 544130 - DNA, 15 bp, Homo sapiens
gcacatgcttagctt

SEQ ID NO: 544131 - DNA, 13 bp, Homo sapiens
gcaccaataaagg

SEQ ID NO: 544132 - DNA, 18 bp, Homo sapiens
gcacccacaccctacagc

SEQ ID NO: 544133 - DNA, 20 bp, Homo sapiens
gcacccacaccctacagcag

SEQ ID NO: 544134 - DNA, 20 bp, Homo sapiens
gcacccaccagttgctgctg

SEQ ID NO: 544135 - DNA, 15 bp, Homo sapiens
gcacccccacgccct

SEQ ID NO: 544136 - DNA, 21 bp, Homo sapiens
gcacccggcagccccccagtg

SEQ ID NO: 544137 - DNA, 22 bp, Homo sapiens
gcacccggcagccccccagtgt

SEQ ID NO: 544138 - DNA, 19 bp, Homo sapiens
gcaccgactagacacacaa

SEQ ID NO: 544139 - DNA, 20 bp, Homo sapiens
gcaccgactagacacacaaa

SEQ ID NO: 544140 - DNA, 11 bp, Homo sapiens
gcacgcacaca

SEQ ID NO: 544141 - DNA, 14 bp, Homo sapiens
gcacgcacacacac

SEQ ID NO: 544142 - DNA, 15 bp, Homo sapiens
gcacgcacacacaca

SEQ ID NO: 544143 - DNA, 23 bp, Homo sapiens
gcacgcacccacaccctacagca

SEQ ID NO: 544144 - DNA, 22 bp, Homo sapiens
gcactaagtctcttttttacaa

SEQ ID NO: 544145 - DNA, 22 bp, Homo sapiens
gcactacatctgatatcaggaa

SEQ ID NO: 544146 - DNA, 19 bp, Homo sapiens
gcactatatgtttacacaa

SEQ ID NO: 544147 - DNA, 18 bp, Homo sapiens
gcactgagtacaaatgtg

SEQ ID NO: 544148 - DNA, 20 bp, Homo sapiens
gcactggatggagctggagg

SEQ ID NO: 544149 - DNA, 16 bp, Homo sapiens
gcactttaatgataaa

SEQ ID NO: 544150 - DNA, 17 bp, Homo sapiens
gcactttgggaggctga

SEQ ID NO: 544151 - DNA, 13 bp, Homo sapiens
gcagaattggaaa

SEQ ID NO: 544152 - DNA, 15 bp, Homo sapiens
gcagacaatcttctg

SEQ ID NO: 544153 - DNA, 15 bp, Homo sapiens
gcagacacacacaca

SEQ ID NO: 544154 - DNA, 15 bp, Homo sapiens
gcagacacacacata

SEQ ID NO: 544155 - DNA, 18 bp, Homo sapiens
gcagacacacacatatat

SEQ ID NO: 544156 - DNA, 20 bp, Homo sapiens
gcagacagggggccagaaca

SEQ ID NO: 544157 - DNA, 16 bp, Homo sapiens
gcagactggtgttaat

SEQ ID NO: 544158 - DNA, 15 bp, Homo sapiens
gcagagccctgctcc

SEQ ID NO: 544159 - DNA, 19 bp, Homo sapiens
gcagagctcagcacagcct

SEQ ID NO: 544160 - DNA, 14 bp, Homo sapiens
gcagagtgaaattc

SEQ ID NO: 544161 - DNA, 14 bp, Homo sapiens
gcagagttcaggga

SEQ ID NO: 544162 - DNA, 18 bp, Homo sapiens
gcagataattctggacca

SEQ ID NO: 544163 - DNA, 22 bp, Homo sapiens
gcagataattctggaccagaga

SEQ ID NO: 544164 - DNA, 15 bp, Homo sapiens
gcagatgacccctcc

SEQ ID NO: 544165 - DNA, 15 bp, Homo sapiens
gcagatgcagctctt

SEQ ID NO: 544166 - DNA, 22 bp, Homo sapiens
gcagatttatttttgaaacaaa

SEQ ID NO: 544167 - DNA, 13 bp, Homo sapiens
gcagatttgcaac

SEQ ID NO: 544168 - DNA, 15 bp, Homo sapiens
gcagatttgcaacag

SEQ ID NO: 544169 - DNA, 16 bp, Homo sapiens
gcagcaaaaatataaa

SEQ ID NO: 544170 - DNA, 18 bp, Homo sapiens
gcagcaaaaatataaaat

SEQ ID NO: 544171 - DNA, 15 bp, Homo sapiens
gcagcagcagcagca

SEQ ID NO: 544172 - DNA, 22 bp, Homo sapiens
gcagccccccagtgtccccagg

SEQ ID NO: 544173 - DNA, 15 bp, Homo sapiens
gcagcccgggagatc

SEQ ID NO: 544174 - DNA, 19 bp, Homo sapiens
gctctcctgggccagggtc

SEQ ID NO: 544175 - DNA, 11 bp, Homo sapiens
gctctctgtat

SEQ ID NO: 544176 - DNA, 23 bp, Homo sapiens
gctctctgtataaacattaaatg

SEQ ID NO: 544177 - DNA, 19 bp, Homo sapiens
gctctgacaaagcttcccg

SEQ ID NO: 544178 - DNA, 22 bp, Homo sapiens
gctctgccatcagcccctgctg

SEQ ID NO: 544179 - DNA, 13 bp, Homo sapiens
gctctgctcgcct

SEQ ID NO: 544180 - DNA, 22 bp, Homo sapiens
gctctgctgatgacccccccag

SEQ ID NO: 544181 - DNA, 23 bp, Homo sapiens
gctctggcaggtggccagggctc

SEQ ID NO: 544182 - DNA, 20 bp, Homo sapiens
gctctgtgtgttaaaatgag

SEQ ID NO: 544183 - DNA, 15 bp, Homo sapiens
gctcttcctccccag

SEQ ID NO: 544184 - DNA, 19 bp, Homo sapiens
gctcttcctggacaggcca

SEQ ID NO: 544185 - DNA, 16 bp, Homo sapiens
gctgaaagacagtaaa

SEQ ID NO: 544186 - DNA, 23 bp, Homo sapiens
gctgaacagatgacccctgccca

SEQ ID NO: 544187 - DNA, 16 bp, Homo sapiens
gctgaagccagctccc

SEQ ID NO: 544188 - DNA, 16 bp, Homo sapiens
gctgactgggccaggg

SEQ ID NO: 544189 - DNA, 23 bp, Homo sapiens
gctgagatgggaggatcacttga

SEQ ID NO: 544190 - DNA, 14 bp, Homo sapiens
gctgagcacatctc

SEQ ID NO: 544191 - DNA, 12 bp, Homo sapiens
gctgagtgagct

SEQ ID NO: 544192 - DNA, 16 bp, Homo sapiens
gctgcactgccctccg

SEQ ID NO: 544193 - DNA, 22 bp, Homo sapiens
gctgcagatactactgaccaga

SEQ ID NO: 544194 - DNA, 14 bp, Homo sapiens
gctgcatggcacat

SEQ ID NO: 544195 - DNA, 22 bp, Homo sapiens
gctgccagtggggcctgaggct

SEQ ID NO: 544196 - DNA, 14 bp, Homo sapiens
gctgccccacccct

SEQ ID NO: 544197 - DNA, 15 bp, Homo sapiens
gctgccccacccctc

SEQ ID NO: 544198 - DNA, 15 bp, Homo sapiens
gctgcccccagaccc

SEQ ID NO: 544199 - DNA, 22 bp, Homo sapiens
gctgctgagcacatctcttcat

SEQ ID NO: 544200 - DNA, 12 bp, Homo sapiens
gctgctgcactg

SEQ ID NO: 544201 - DNA, 16 bp, Homo sapiens
gctgctgcactgccct

SEQ ID NO: 544202 - DNA, 20 bp, Homo sapiens
gctgctggtcacccccaccc

SEQ ID NO: 544203 - DNA, 18 bp, Homo sapiens
gctggacacccccttggt

SEQ ID NO: 544204 - DNA, 14 bp, Homo sapiens
gctggataggagag

SEQ ID NO: 544205 - DNA, 18 bp, Homo sapiens
gctggataggagaggaaa

SEQ ID NO: 544206 - DNA, 20 bp, Homo sapiens
gctggcccccactggctgtg

SEQ ID NO: 544207 - DNA, 21 bp, Homo sapiens
gctggcccccactggctgtgg

SEQ ID NO: 544208 - DNA, 22 bp, Homo sapiens
gctggcccccactggctgtggg

SEQ ID NO: 544209 - DNA, 21 bp, Homo sapiens
gctggcttctccctggactct

SEQ ID NO: 544210 - DNA, 14 bp, Homo sapiens
gctgggcagctgtt

SEQ ID NO: 544211 - DNA, 15 bp, Homo sapiens
gctggggcagcctct

SEQ ID NO: 544212 - DNA, 20 bp, Homo sapiens
gctggggcttttgtgccagg

SEQ ID NO: 544213 - DNA, 22 bp, Homo sapiens
gctggggcttttgtgccaggag

SEQ ID NO: 544214 - DNA, 16 bp, Homo sapiens
gctggtactttctgta

SEQ ID NO: 544215 - DNA, 15 bp, Homo sapiens
gctggtcactgccat

SEQ ID NO: 544216 - DNA, 18 bp, Homo sapiens
gctggtcactgccatgga

SEQ ID NO: 544217 - DNA, 23 bp, Homo sapiens
gctggtgggggcatccttgagga

SEQ ID NO: 544218 - DNA, 12 bp, Homo sapiens
gctgtaaaagca

SEQ ID NO: 544219 - DNA, 18 bp, Homo sapiens
gctgtaaagcaaaatatt

SEQ ID NO: 544220 - DNA, 17 bp, Homo sapiens
gctgtaaataaaaatag

SEQ ID NO: 544221 - DNA, 18 bp, Homo sapiens
gctgtcatggtgcaattt

SEQ ID NO: 544222 - DNA, 21 bp, Homo sapiens
gctgtcatggtgcaatttgtc

SEQ ID NO: 544223 - DNA, 20 bp, Homo sapiens
gctgtcattgcttcttctga

SEQ ID NO: 544224 - DNA, 18 bp, Homo sapiens
gctgtggcatcaggaaag

SEQ ID NO: 544225 - DNA, 13 bp, Homo sapiens
gctgtgggctccc

SEQ ID NO: 544226 - DNA, 16 bp, Homo sapiens
gctgtgtttgctcccc

SEQ ID NO: 544227 - DNA, 14 bp, Homo sapiens
gctgttcttcctgg

SEQ ID NO: 544228 - DNA, 18 bp, Homo sapiens
gctgttgaccaggcacct

SEQ ID NO: 544229 - DNA, 15 bp, Homo sapiens
gctgttgtctcttct

SEQ ID NO: 544230 - DNA, 17 bp, Homo sapiens
gctgttgtctcttctcc

SEQ ID NO: 544231 - DNA, 13 bp, Homo sapiens
gcttaagaaaaaa

SEQ ID NO: 544232 - DNA, 21 bp, Homo sapiens
gcttagaggcatgggcttgct

SEQ ID NO: 544233 - DNA, 17 bp, Homo sapiens
gcttagcttatctttct

SEQ ID NO: 544234 - DNA, 23 bp, Homo sapiens
gcttagcttatctttctttccat

SEQ ID NO: 544235 - DNA, 22 bp, Homo sapiens
gcttagtatctcatcaacaaag

SEQ ID NO: 544236 - DNA, 14 bp, Homo sapiens
gcttcacaggacag

SEQ ID NO: 544237 - DNA, 17 bp, Homo sapiens
gcttcccatgtctttct

SEQ ID NO: 544238 - DNA, 12 bp, Homo sapiens
gcttcccctccc

SEQ ID NO: 544239 - DNA, 22 bp, Homo sapiens
gcttcctgtgctaagtctttcc

SEQ ID NO: 544240 - DNA, 16 bp, Homo sapiens
gcttctcagctcgctg

SEQ ID NO: 544241 - DNA, 12 bp, Homo sapiens
gcttctcatccc

SEQ ID NO: 544242 - DNA, 16 bp, Homo sapiens
gcttcttctgaggcct

SEQ ID NO: 544243 - DNA, 21 bp, Homo sapiens
gcttctttcaagggctttcct

SEQ ID NO: 544244 - DNA, 15 bp, Homo sapiens
gcttgaccctgaaat

SEQ ID NO: 544245 - DNA, 16 bp, Homo sapiens
gcttggagcagaggtg

SEQ ID NO: 544246 - DNA, 13 bp, Homo sapiens
gcttgtggctcca

SEQ ID NO: 544247 - DNA, 19 bp, Homo sapiens
gcttgtggctccacacaca

SEQ ID NO: 544248 - DNA, 15 bp, Homo sapiens
gcttgttcagtcact

SEQ ID NO: 544249 - DNA, 21 bp, Homo sapiens
gcttgtttaaggttcttgctg

SEQ ID NO: 544250 - DNA, 12 bp, Homo sapiens
gctttacacaca

SEQ ID NO: 544251 - DNA, 20 bp, Homo sapiens
gctttagaatgttttccttc

SEQ ID NO: 544252 - DNA, 14 bp, Homo sapiens
gctttcctgtgcca

SEQ ID NO: 544253 - DNA, 18 bp, Homo sapiens
gctttcctgtttctcagt

SEQ ID NO: 544254 - DNA, 19 bp, Homo sapiens
gctttgtctcctctatcct

SEQ ID NO: 544255 - DNA, 20 bp, Homo sapiens
gcttttaaaactacttagca

SEQ ID NO: 544256 - DNA, 17 bp, Homo sapiens
gcttttaggagaattca

SEQ ID NO: 544257 - DNA, 20 bp, Homo sapiens
gcttttagtttttctgtccc

SEQ ID NO: 544258 - DNA, 15 bp, Homo sapiens
gcttttctcccagct

SEQ ID NO: 544259 - DNA, 18 bp, Homo sapiens
gcttttgcaaataactta

SEQ ID NO: 544260 - DNA, 15 bp, Homo sapiens
gcttttgctggtcac

SEQ ID NO: 544261 - DNA, 20 bp, Homo sapiens
gctttttttttttaattttg

SEQ ID NO: 544262 - DNA, 20 bp, Homo sapiens
ggaaaaaaagactgatgaag

SEQ ID NO: 544263 - DNA, 16 bp, Homo sapiens
ggaaaaatatgtgaag

SEQ ID NO: 544264 - DNA, 13 bp, Homo sapiens
ggaaaagaaatct

SEQ ID NO: 544265 - DNA, 15 bp, Homo sapiens
ggaaaagactaagat

SEQ ID NO: 544266 - DNA, 21 bp, Homo sapiens
ggaaaaggcttgagtctggat

SEQ ID NO: 544267 - DNA, 17 bp, Homo sapiens
ggaaaataaaaaaagaa

SEQ ID NO: 544268 - DNA, 21 bp, Homo sapiens
ggaaaataaaaaaagaaaaaa

SEQ ID NO: 544269 - DNA, 21 bp, Homo sapiens
ggaaaattcagataatggtaa

SEQ ID NO: 544270 - DNA, 17 bp, Homo sapiens
ggaaacactaaatgtta

SEQ ID NO: 544271 - DNA, 19 bp, Homo sapiens
ggaaacactaaatgttaaa

SEQ ID NO: 544272 - DNA, 19 bp, Homo sapiens
ggaaagagtgatgcctggg

SEQ ID NO: 544273 - DNA, 16 bp, Homo sapiens
ggaaagccaaatttta

SEQ ID NO: 544274 - DNA, 20 bp, Homo sapiens
ggaaagtggcacctgtctgc

SEQ ID NO: 544275 - DNA, 19 bp, Homo sapiens
ggaaatcatcgaaaattca

SEQ ID NO: 544276 - DNA, 21 bp, Homo sapiens
ggaacaaatgcttttccaacc

SEQ ID NO: 544277 - DNA, 12 bp, Homo sapiens
ggaacacatgca

SEQ ID NO: 544278 - DNA, 13 bp, Homo sapiens
ggaacacatgcac

SEQ ID NO: 544279 - DNA, 14 bp, Homo sapiens
ggaacacatgcaca

SEQ ID NO: 544280 - DNA, 17 bp, Homo sapiens
ggaacacatgcacacac

SEQ ID NO: 544281 - DNA, 19 bp, Homo sapiens
ggaacacatgcacacacac

SEQ ID NO: 544282 - DNA, 23 bp, Homo sapiens
ggaacgtagtcggcacagcctgg

SEQ ID NO: 544283 - DNA, 15 bp, Homo sapiens
ggaagaagagatgca

SEQ ID NO: 544284 - DNA, 17 bp, Homo sapiens
ggaagacaaatacacat

SEQ ID NO: 544285 - DNA, 23 bp, Homo sapiens
ggaagacaaatacacatacatat

SEQ ID NO: 544286 - DNA, 22 bp, Homo sapiens
ggaagcaaaaacgaaagctggg

SEQ ID NO: 544287 - DNA, 13 bp, Homo sapiens
ggaagctgctact

SEQ ID NO: 544288 - DNA, 13 bp, Homo sapiens
ggaaggaaacaga

SEQ ID NO: 544289 - DNA, 15 bp, Homo sapiens
ggaaggctgccaggg

SEQ ID NO: 544290 - DNA, 17 bp, Homo sapiens
ggaaggggggtcagaag

SEQ ID NO: 544291 - DNA, 17 bp, Homo sapiens
ggaataagaagcaaata

SEQ ID NO: 544292 - DNA, 20 bp, Homo sapiens
ggaatcattgtccagagctg

SEQ ID NO: 544293 - DNA, 19 bp, Homo sapiens
ggaatcctgtcctcagctt

SEQ ID NO: 544294 - DNA, 16 bp, Homo sapiens
ggaattaaaaagaaga

SEQ ID NO: 544295 - DNA, 14 bp, Homo sapiens
ggacacggcctctg

SEQ ID NO: 544296 - DNA, 16 bp, Homo sapiens
ggacacggcctctggg

SEQ ID NO: 544297 - DNA, 18 bp, Homo sapiens
ggacagaaggctcctgcc

SEQ ID NO: 544298 - DNA, 17 bp, Homo sapiens
ggacagcattgccagta

SEQ ID NO: 544299 - DNA, 11 bp, Homo sapiens
ggacatgcacc

SEQ ID NO: 544300 - DNA, 21 bp, Homo sapiens
ggacatggcttctgaacctgt

SEQ ID NO: 544301 - DNA, 15 bp, Homo sapiens
ggacattatgtgtgc

SEQ ID NO: 544302 - DNA, 21 bp, Homo sapiens
ggaccatttctctgcaggcca

SEQ ID NO: 544303 - DNA, 14 bp, Homo sapiens
ggaccattttcctg

SEQ ID NO: 544304 - DNA, 20 bp, Homo sapiens
ggaccccatctgctgagctc

SEQ ID NO: 544305 - DNA, 17 bp, Homo sapiens
ggaccctcgctggcccc

SEQ ID NO: 544306 - DNA, 20 bp, Homo sapiens
ggaccctcgctggcccccac

SEQ ID NO: 544307 - DNA, 21 bp, Homo sapiens
ggaccctcgctggcccccact

SEQ ID NO: 544308 - DNA, 20 bp, Homo sapiens
ggaccctcggggcaggaagt

SEQ ID NO: 544309 - DNA, 14 bp, Homo sapiens
ggaccctgaaatgt

SEQ ID NO: 544310 - DNA, 13 bp, Homo sapiens
ggaccctgagggt

SEQ ID NO: 544311 - DNA, 15 bp, Homo sapiens
ggaccgggagcctgc

SEQ ID NO: 544312 - DNA, 21 bp, Homo sapiens
ggaccttcactctaagatgtt

SEQ ID NO: 544313 - DNA, 22 bp, Homo sapiens
ggaccttcactctaagatgtta

SEQ ID NO: 544314 - DNA, 19 bp, Homo sapiens
ggacgcagggagaccctgg

SEQ ID NO: 544315 - DNA, 13 bp, Homo sapiens
ggacgtcctccaa

SEQ ID NO: 544316 - DNA, 18 bp, Homo sapiens
ggactctgccttccaggc

SEQ ID NO: 544317 - DNA, 11 bp, Homo sapiens
ggactgtggcc

SEQ ID NO: 544318 - DNA, 23 bp, Homo sapiens
ggactgttgacatccaagcttcc

SEQ ID NO: 544319 - DNA, 11 bp, Homo sapiens
ggacttcctga

SEQ ID NO: 544320 - DNA, 22 bp, Homo sapiens
ggagaaaggggctagcactgga

SEQ ID NO: 544321 - DNA, 20 bp, Homo sapiens
ggagaatcgcttgaacccag

SEQ ID NO: 544322 - DNA, 17 bp, Homo sapiens
ggagacagtcaggaagc

SEQ ID NO: 544323 - DNA, 21 bp, Homo sapiens
ggagaccaggactctgccttc

SEQ ID NO: 544324 - DNA, 20 bp, Homo sapiens
ggagaccgagtgtggagctg

SEQ ID NO: 544325 - DNA, 22 bp, Homo sapiens
ggagatacttggtcacagccag

SEQ ID NO: 544326 - DNA, 16 bp, Homo sapiens
ggagatccgccctggg

SEQ ID NO: 544327 - DNA, 19 bp, Homo sapiens
ggagatccgccctgggctc

SEQ ID NO: 544328 - DNA, 22 bp, Homo sapiens
ggagatccgccctgggctctgg

SEQ ID NO: 544329 - DNA, 23 bp, Homo sapiens
ggagatccgccctgggctctggg

SEQ ID NO: 544330 - DNA, 13 bp, Homo sapiens
ggagatggggaga

SEQ ID NO: 544331 - DNA, 22 bp, Homo sapiens
ggagcattggggatgtttttct

SEQ ID NO: 544332 - DNA, 13 bp, Homo sapiens
ggagccaggaggg

SEQ ID NO: 544333 - DNA, 18 bp, Homo sapiens
ggagcccaggagtcccac

SEQ ID NO: 544334 - DNA, 13 bp, Homo sapiens
ggagcctgacagc

SEQ ID NO: 544335 - DNA, 18 bp, Homo sapiens
ggagcctgcgtggcctgg

SEQ ID NO: 544336 - DNA, 19 bp, Homo sapiens
ggagcggattgcaaagcaa

SEQ ID NO: 544337 - DNA, 12 bp, Homo sapiens
ggagctcctggc

SEQ ID NO: 544338 - DNA, 13 bp, Homo sapiens
ggagctgggaagg

SEQ ID NO: 544339 - DNA, 18 bp, Homo sapiens
ggagctgggaaggtcccg

SEQ ID NO: 544340 - DNA, 19 bp, Homo sapiens
ggagctgggaaggtcccga

SEQ ID NO: 544341 - DNA, 17 bp, Homo sapiens
ggagctttaaagagcag

SEQ ID NO: 544342 - DNA, 14 bp, Homo sapiens
ggagctttctcaat

SEQ ID NO: 544343 - DNA, 12 bp, Homo sapiens
ggaggaccaggg

SEQ ID NO: 544344 - DNA, 13 bp, Homo sapiens
ggaggaccagggc

SEQ ID NO: 544345 - DNA, 20 bp, Homo sapiens
ggaggccttgggctctgctg

SEQ ID NO: 544346 - DNA, 11 bp, Homo sapiens
ggaggggagct

SEQ ID NO: 544347 - DNA, 18 bp, Homo sapiens
ggaggggtggtacttggc

SEQ ID NO: 544348 - DNA, 23 bp, Homo sapiens
ggaggggtggtacttggcaccaa

SEQ ID NO: 544349 - DNA, 15 bp, Homo sapiens
ggaggtgtgaggcag

SEQ ID NO: 544350 - DNA, 15 bp, Homo sapiens
ggagtagagtcagga

SEQ ID NO: 544351 - DNA, 18 bp, Homo sapiens
ggagtcacccccaggact

SEQ ID NO: 544352 - DNA, 13 bp, Homo sapiens
ggagtcagggagc

SEQ ID NO: 544353 - DNA, 19 bp, Homo sapiens
ggagtcagggagccctggg

SEQ ID NO: 544354 - DNA, 21 bp, Homo sapiens
ggagtccagacctgggccctg

SEQ ID NO: 544355 - DNA, 23 bp, Homo sapiens
ggagtccagacctgggccctggt

SEQ ID NO: 544356 - DNA, 18 bp, Homo sapiens
ggagtgaggcaggtgaca

SEQ ID NO: 544357 - DNA, 20 bp, Homo sapiens
ggagttcattcatattacaa

SEQ ID NO: 544358 - DNA, 15 bp, Homo sapiens
ggataagaaaaatgc

SEQ ID NO: 544359 - DNA, 18 bp, Homo sapiens
ggataatatatttgcaga

SEQ ID NO: 544360 - DNA, 14 bp, Homo sapiens
ggataggggcagag

SEQ ID NO: 544361 - DNA, 13 bp, Homo sapiens
ggatatgaccagt

SEQ ID NO: 544362 - DNA, 12 bp, Homo sapiens
ggatatttccta

SEQ ID NO: 544363 - DNA, 13 bp, Homo sapiens
ggatcagctgagc

SEQ ID NO: 544364 - DNA, 21 bp, Homo sapiens
ggatggcgtgtcccctgcctg

SEQ ID NO: 544365 - DNA, 14 bp, Homo sapiens
ggatgggcacaggc

SEQ ID NO: 544366 - DNA, 18 bp, Homo sapiens
ggatggggttgggctctg

SEQ ID NO: 544367 - DNA, 15 bp, Homo sapiens
ggatgtatgtgtata

SEQ ID NO: 544368 - DNA, 19 bp, Homo sapiens
ggattcttgttttgcttcc

SEQ ID NO: 544369 - DNA, 10 bp, Homo sapiens
ggattgtttt

SEQ ID NO: 544370 - DNA, 19 bp, Homo sapiens
ggatttcgaagtttgcaac

SEQ ID NO: 544371 - DNA, 21 bp, Homo sapiens
ggcaaaccaatttgttctgtg

SEQ ID NO: 544372 - DNA, 13 bp, Homo sapiens
ggcaaactctcta

SEQ ID NO: 544373 - DNA, 13 bp, Homo sapiens
ggcaaagctgttc

SEQ ID NO: 544374 - DNA, 13 bp, Homo sapiens
ggcaaatataaaa

SEQ ID NO: 544375 - DNA, 22 bp, Homo sapiens
ggcaacatgcctgctttagaat

SEQ ID NO: 544376 - DNA, 18 bp, Homo sapiens
ggcaactaagcagtccct

SEQ ID NO: 544377 - DNA, 15 bp, Homo sapiens
ggcaatattctctgt

SEQ ID NO: 544378 - DNA, 20 bp, Homo sapiens
ggcaatattctctgtacata

SEQ ID NO: 544379 - DNA, 18 bp, Homo sapiens
ggcacaatgaatgtatat

SEQ ID NO: 544380 - DNA, 14 bp, Homo sapiens
ggcacaggctgccc

SEQ ID NO: 544381 - DNA, 15 bp, Homo sapiens
ggcacaggctgcccc

SEQ ID NO: 544382 - DNA, 13 bp, Homo sapiens
ggcacagggagag

SEQ ID NO: 544383 - DNA, 15 bp, Homo sapiens
ggcaccaataaagga

SEQ ID NO: 544384 - DNA, 13 bp, Homo sapiens
ggcacctgtctgc

SEQ ID NO: 544385 - DNA, 22 bp, Homo sapiens
ggcacctgtctgctccagctct

SEQ ID NO: 544386 - DNA, 14 bp, Homo sapiens
ggcagagccctgct

SEQ ID NO: 544387 - DNA, 19 bp, Homo sapiens
ggcagagctcagcacagcc

SEQ ID NO: 544388 - DNA, 20 bp, Homo sapiens
ggcagatgcagctcttcctg

SEQ ID NO: 544389 - DNA, 20 bp, Homo sapiens
ggcagcatgcacggaggcgg

SEQ ID NO: 544390 - DNA, 20 bp, Homo sapiens
ggcagcatgcgatgtcatat

SEQ ID NO: 544391 - DNA, 18 bp, Homo sapiens
ggcagccccccagtgtcc

SEQ ID NO: 544392 - DNA, 22 bp, Homo sapiens
ggcagcctactagggacctggg

SEQ ID NO: 544393 - DNA, 23 bp, Homo sapiens
ggcagcctctgggcccacatccg

SEQ ID NO: 544394 - DNA, 19 bp, Homo sapiens
ggcagcctgccttgcccac

SEQ ID NO: 544395 - DNA, 16 bp, Homo sapiens
ggcagcctgcgtggct

SEQ ID NO: 544396 - DNA, 10 bp, Homo sapiens
ggcaggcagg

SEQ ID NO: 544397 - DNA, 15 bp, Homo sapiens
ggcagggcaggcaga

SEQ ID NO: 544398 - DNA, 20 bp, Homo sapiens
ggcaggggccctgcagctct

SEQ ID NO: 544399 - DNA, 21 bp, Homo sapiens
ggcaggtgacagtgaggtcct

SEQ ID NO: 544400 - DNA, 18 bp, Homo sapiens
ggcagtgacgtgagtggg

SEQ ID NO: 544401 - DNA, 19 bp, Homo sapiens
ggcagtgacgtgagtgggg

SEQ ID NO: 544402 - DNA, 20 bp, Homo sapiens
ggcagtggcttggagcagag

SEQ ID NO: 544403 - DNA, 13 bp, Homo sapiens
ggcatccccagcc

SEQ ID NO: 544404 - DNA, 16 bp, Homo sapiens
ggcatttcccaccctg

SEQ ID NO: 544405 - DNA, 13 bp, Homo sapiens
ggccaaagacaaa

SEQ ID NO: 544406 - DNA, 13 bp, Homo sapiens
ggccaagcagaaa

SEQ ID NO: 544407 - DNA, 14 bp, Homo sapiens
ggccaagcagaaaa

SEQ ID NO: 544408 - DNA, 14 bp, Homo sapiens
ggccaagctgagga

SEQ ID NO: 544409 - DNA, 19 bp, Homo sapiens
ggccaagctgaggaggtgc

SEQ ID NO: 544410 - DNA, 19 bp, Homo sapiens
ggccagaagtagctttgca

SEQ ID NO: 544411 - DNA, 22 bp, Homo sapiens
ggccagcatccatgcggccggc

SEQ ID NO: 544412 - DNA, 13 bp, Homo sapiens
ggccagggctctg

SEQ ID NO: 544413 - DNA, 15 bp, Homo sapiens
ggccagggctctggc

SEQ ID NO: 544414 - DNA, 16 bp, Homo sapiens
ggccagggctctggca

SEQ ID NO: 544415 - DNA, 14 bp, Homo sapiens
ggccaggtgcacag

SEQ ID NO: 544416 - DNA, 20 bp, Homo sapiens
ggccatggaagctggcagga

SEQ ID NO: 544417 - DNA, 19 bp, Homo sapiens
ggcccaacaggggctccat

SEQ ID NO: 544418 - DNA, 20 bp, Homo sapiens
ggcccagaggggcggggcca

SEQ ID NO: 544419 - DNA, 13 bp, Homo sapiens
ggcccaggagcgc

SEQ ID NO: 544420 - DNA, 14 bp, Homo sapiens
ggcccatgccctcc

SEQ ID NO: 544421 - DNA, 13 bp, Homo sapiens
ggccccacaccag

SEQ ID NO: 544422 - DNA, 12 bp, Homo sapiens
ggcccccactgg

SEQ ID NO: 544423 - DNA, 17 bp, Homo sapiens
ggcccccactggctgtg

SEQ ID NO: 544424 - DNA, 15 bp, Homo sapiens
aaatataaaaataat

SEQ ID NO: 544425 - DNA, 11 bp, Homo sapiens
aaatataaaac

SEQ ID NO: 544426 - DNA, 12 bp, Homo sapiens
aaatataaaata

SEQ ID NO: 544427 - DNA, 19 bp, Homo sapiens
aaatataaagcatctaaac

SEQ ID NO: 544428 - DNA, 21 bp, Homo sapiens
aaatatactcaagtttcaggt

SEQ ID NO: 544429 - DNA, 15 bp, Homo sapiens
aaatatatatacata

SEQ ID NO: 544430 - DNA, 16 bp, Homo sapiens
aaatatatatacatat

SEQ ID NO: 544431 - DNA, 20 bp, Homo sapiens
aaatatatggtctaatgttt

SEQ ID NO: 544432 - DNA, 21 bp, Homo sapiens
aaatatatggtctaatgttta

SEQ ID NO: 544433 - DNA, 13 bp, Homo sapiens
aaatatgtaaact

SEQ ID NO: 544434 - DNA, 15 bp, Homo sapiens
aaatatgtaaacttt

SEQ ID NO: 544435 - DNA, 19 bp, Homo sapiens
aaatatgtccatatctaac

SEQ ID NO: 544436 - DNA, 14 bp, Homo sapiens
aaatattaaaaagt

SEQ ID NO: 544437 - DNA, 14 bp, Homo sapiens
aaatattatgttat

SEQ ID NO: 544438 - DNA, 17 bp, Homo sapiens
aaatatttggtctctat

SEQ ID NO: 544439 - DNA, 21 bp, Homo sapiens
aaatatttggtctctatttca

SEQ ID NO: 544440 - DNA, 20 bp, Homo sapiens
aaatatttgtgaaagtgcca

SEQ ID NO: 544441 - DNA, 20 bp, Homo sapiens
aaatattttcaaagagatgg

SEQ ID NO: 544442 - DNA, 17 bp, Homo sapiens
aaatattttctacttta

SEQ ID NO: 544443 - DNA, 21 bp, Homo sapiens
aaatattttctactttaaatt

SEQ ID NO: 544444 - DNA, 18 bp, Homo sapiens
aaatattttgtcactgct

SEQ ID NO: 544445 - DNA, 19 bp, Homo sapiens
aaatattttgtcactgctg

SEQ ID NO: 544446 - DNA, 22 bp, Homo sapiens
aaatcatgtggcctaatattga

SEQ ID NO: 544447 - DNA, 20 bp, Homo sapiens
aaatcccattgtatttaaaa

SEQ ID NO: 544448 - DNA, 17 bp, Homo sapiens
aaatctatagaaagtgt

SEQ ID NO: 544449 - DNA, 22 bp, Homo sapiens
aaatctatagaaagtgttctgt

SEQ ID NO: 544450 - DNA, 14 bp, Homo sapiens
aaatctcatcccta

SEQ ID NO: 544451 - DNA, 12 bp, Homo sapiens
aaatctcttctg

SEQ ID NO: 544452 - DNA, 16 bp, Homo sapiens
aaatctgaagattgtt

SEQ ID NO: 544453 - DNA, 21 bp, Homo sapiens
aaatctgaagattgtttatct

SEQ ID NO: 544454 - DNA, 23 bp, Homo sapiens
aaatctgaagattgtttatctag

SEQ ID NO: 544455 - DNA, 15 bp, Homo sapiens
aaatctgtattgcta

SEQ ID NO: 544456 - DNA, 12 bp, Homo sapiens
aaatcttattaa

SEQ ID NO: 544457 - DNA, 14 bp, Homo sapiens
aaatcttattaaag

SEQ ID NO: 544458 - DNA, 16 bp, Homo sapiens
aaatcttattaaagtt

SEQ ID NO: 544459 - DNA, 19 bp, Homo sapiens
aaatctttagggaatgaga

SEQ ID NO: 544460 - DNA, 11 bp, Homo sapiens
aaatgaaaata

SEQ ID NO: 544461 - DNA, 14 bp, Homo sapiens
aaatgaaatgtttt

SEQ ID NO: 544462 - DNA, 20 bp, Homo sapiens
aaatgagttcccttgattca

SEQ ID NO: 544463 - DNA, 19 bp, Homo sapiens
aaatgatacttggtcctta

SEQ ID NO: 544464 - DNA, 18 bp, Homo sapiens
aaatgatatgtctttaaa

SEQ ID NO: 544465 - DNA, 21 bp, Homo sapiens
aaatgatcaaggagggagaaa

SEQ ID NO: 544466 - DNA, 21 bp, Homo sapiens
aaatgattcacttttattgta

SEQ ID NO: 544467 - DNA, 13 bp, Homo sapiens
aaatgattgtctt

SEQ ID NO: 544468 - DNA, 14 bp, Homo sapiens
aaatgattgtcttt

SEQ ID NO: 544469 - DNA, 22 bp, Homo sapiens
aaatgattgtctttttcctatg

SEQ ID NO: 544470 - DNA, 18 bp, Homo sapiens
aaatgcacaatgtcttgg

SEQ ID NO: 544471 - DNA, 17 bp, Homo sapiens
aaatgcatttaagttgt

SEQ ID NO: 544472 - DNA, 15 bp, Homo sapiens
aaatgctactcagta

SEQ ID NO: 544473 - DNA, 20 bp, Homo sapiens
aaatgctatgtcatttcatg

SEQ ID NO: 544474 - DNA, 21 bp, Homo sapiens
aaatgctatgtcatttcatgt

SEQ ID NO: 544475 - DNA, 19 bp, Homo sapiens
aaatgcttgaccctgaaat

SEQ ID NO: 544476 - DNA, 15 bp, Homo sapiens
aaatggactacagta

SEQ ID NO: 544477 - DNA, 14 bp, Homo sapiens
aaatggagttggag

SEQ ID NO: 544478 - DNA, 17 bp, Homo sapiens
aaatggcaagttttgat

SEQ ID NO: 544479 - DNA, 15 bp, Homo sapiens
aaatggcatttagca

SEQ ID NO: 544480 - DNA, 21 bp, Homo sapiens
aaatggcatttagcacagtat

SEQ ID NO: 544481 - DNA, 23 bp, Homo sapiens
aaatggcatttagcacagtattt

SEQ ID NO: 544482 - DNA, 18 bp, Homo sapiens
aaatggggagacaaaggg

SEQ ID NO: 544483 - DNA, 19 bp, Homo sapiens
aaatggtcccaattaagaa

SEQ ID NO: 544484 - DNA, 20 bp, Homo sapiens
aaatggtggttgtttcttcc

SEQ ID NO: 544485 - DNA, 21 bp, Homo sapiens
aaatggtggttgtttcttcca

SEQ ID NO: 544486 - DNA, 20 bp, Homo sapiens
aaatgtaatgtggcttctgg

SEQ ID NO: 544487 - DNA, 13 bp, Homo sapiens
aaatgtatataca

SEQ ID NO: 544488 - DNA, 16 bp, Homo sapiens
aaatgtcttatatagc

SEQ ID NO: 544489 - DNA, 18 bp, Homo sapiens
aaatgtcttatatagcag

SEQ ID NO: 544490 - DNA, 15 bp, Homo sapiens
aaatgtcttcatgtt

SEQ ID NO: 544491 - DNA, 19 bp, Homo sapiens
aaatgtgtgtgatgtgaca

SEQ ID NO: 544492 - DNA, 20 bp, Homo sapiens
aaatgtgtgtgatgtgacat

SEQ ID NO: 544493 - DNA, 21 bp, Homo sapiens
aaatgttaaagatgtagcaaa

SEQ ID NO: 544494 - DNA, 18 bp, Homo sapiens
aaatgttcatcaattccc

SEQ ID NO: 544495 - DNA, 11 bp, Homo sapiens
aaatgttttca

SEQ ID NO: 544496 - DNA, 15 bp, Homo sapiens
aaatgttttcagcta

SEQ ID NO: 544497 - DNA, 16 bp, Homo sapiens
aaatgttttgtaaact

SEQ ID NO: 544498 - DNA, 13 bp, Homo sapiens
aaattaaaattta

SEQ ID NO: 544499 - DNA, 17 bp, Homo sapiens
aaattaaaatttaacat

SEQ ID NO: 544500 - DNA, 18 bp, Homo sapiens
aaattaatgtgtaaaatt

SEQ ID NO: 544501 - DNA, 20 bp, Homo sapiens
aaattagaaagcaacttatc

SEQ ID NO: 544502 - DNA, 23 bp, Homo sapiens
aaattagggctctaatttcctta

SEQ ID NO: 544503 - DNA, 15 bp, Homo sapiens
aaattatctttaaaa

SEQ ID NO: 544504 - DNA, 17 bp, Homo sapiens
aaattatctttaaaact

SEQ ID NO: 544505 - DNA, 21 bp, Homo sapiens
aaattatgctaagaatttttt

SEQ ID NO: 544506 - DNA, 18 bp, Homo sapiens
aaattcagataatggtaa

SEQ ID NO: 544507 - DNA, 24 bp, Homo sapiens
aaattcagataatggtaatttagt

SEQ ID NO: 544508 - DNA, 22 bp, Homo sapiens
aaattcaggtgaaaatgttcat

SEQ ID NO: 544509 - DNA, 14 bp, Homo sapiens
aaattcatttcaca

SEQ ID NO: 544510 - DNA, 16 bp, Homo sapiens
aaattcatttcacatt

SEQ ID NO: 544511 - DNA, 14 bp, Homo sapiens
aaattccaaagatc

SEQ ID NO: 544512 - DNA, 19 bp, Homo sapiens
aaattccatacttctctca

SEQ ID NO: 544513 - DNA, 17 bp, Homo sapiens
aaattctttatttctgt

SEQ ID NO: 544514 - DNA, 15 bp, Homo sapiens
aaattgtaatttggg

SEQ ID NO: 544515 - DNA, 13 bp, Homo sapiens
aaatttaacatct

SEQ ID NO: 544516 - DNA, 21 bp, Homo sapiens
aaatttaacatctgcagtgtt

SEQ ID NO: 544517 - DNA, 13 bp, Homo sapiens
aaatttaagcaca

SEQ ID NO: 544518 - DNA, 15 bp, Homo sapiens
aaatttattgaggaa

SEQ ID NO: 544519 - DNA, 21 bp, Homo sapiens
aaatttctggcaaatattttg

SEQ ID NO: 544520 - DNA, 23 bp, Homo sapiens
aaatttctggcaaatattttgtc

SEQ ID NO: 544521 - DNA, 15 bp, Homo sapiens
aaatttgaaacattg

SEQ ID NO: 544522 - DNA, 16 bp, Homo sapiens
aaatttgaaacattgc

SEQ ID NO: 544523 - DNA, 23 bp, Homo sapiens
aaatttgaaacattgcttttaaa

SEQ ID NO: 544524 - DNA, 12 bp, Homo sapiens
aaattttattga

SEQ ID NO: 544525 - DNA, 24 bp, Homo sapiens
aaattttgtacatttttgatcaaa

SEQ ID NO: 544526 - DNA, 12 bp, Homo sapiens
aaatttttaagt

SEQ ID NO: 544527 - DNA, 14 bp, Homo sapiens
aaatttttaagtgt

SEQ ID NO: 544528 - DNA, 16 bp, Homo sapiens
aaatttttcatatttt

SEQ ID NO: 544529 - DNA, 17 bp, Homo sapiens
aaatttttcatatttta

SEQ ID NO: 544530 - DNA, 11 bp, Homo sapiens
aacaaaaggca

SEQ ID NO: 544531 - DNA, 15 bp, Homo sapiens
aacaaactcaaaatg

SEQ ID NO: 544532 - DNA, 22 bp, Homo sapiens
aacaaactgcacatgatttcac

SEQ ID NO: 544533 - DNA, 12 bp, Homo sapiens
aacaaagaaata

SEQ ID NO: 544534 - DNA, 14 bp, Homo sapiens
aacaaagaaatatt

SEQ ID NO: 544535 - DNA, 12 bp, Homo sapiens
aacaaatgcttt

SEQ ID NO: 544536 - DNA, 14 bp, Homo sapiens
aacaaatggcttgt

SEQ ID NO: 544537 - DNA, 14 bp, Homo sapiens
aacaacataaaatt

SEQ ID NO: 544538 - DNA, 23 bp, Homo sapiens
aacaacccaaggcaatgatatgg

SEQ ID NO: 544539 - DNA, 23 bp, Homo sapiens
aacaactgctgggaatatccgtg

SEQ ID NO: 544540 - DNA, 13 bp, Homo sapiens
aacaagacaaggt

SEQ ID NO: 544541 - DNA, 20 bp, Homo sapiens
aacaagacccccaggaagga

SEQ ID NO: 544542 - DNA, 16 bp, Homo sapiens
aacaagcaataaacaa

SEQ ID NO: 544543 - DNA, 17 bp, Homo sapiens
aacaagcatataaaatg

SEQ ID NO: 544544 - DNA, 15 bp, Homo sapiens
aacaataaaacatta

SEQ ID NO: 544545 - DNA, 18 bp, Homo sapiens
aacaattttcagatttgc

SEQ ID NO: 544546 - DNA, 21 bp, Homo sapiens
aacacaaattatgctaagaat

SEQ ID NO: 544547 - DNA, 16 bp, Homo sapiens
aagaaagaactatctt

SEQ ID NO: 544548 - DNA, 14 bp, Homo sapiens
aagaaagatgctga

SEQ ID NO: 544549 - DNA, 16 bp, Homo sapiens
aagaaagatgctgatg

SEQ ID NO: 544550 - DNA, 16 bp, Homo sapiens
aagaaagccagtctta

SEQ ID NO: 544551 - DNA, 20 bp, Homo sapiens
aagaaatctatagaaagtgt

SEQ ID NO: 544552 - DNA, 22 bp, Homo sapiens
aagaaattccatacttctctca

SEQ ID NO: 544553 - DNA, 18 bp, Homo sapiens
aagaaatttattacttgt

SEQ ID NO: 544554 - DNA, 14 bp, Homo sapiens
aagaactaataaat

SEQ ID NO: 544555 - DNA, 15 bp, Homo sapiens
aagaactaataaatg

SEQ ID NO: 544556 - DNA, 18 bp, Homo sapiens
aagaacttgtttaataaa

SEQ ID NO: 544557 - DNA, 21 bp, Homo sapiens
aagaagacagcaaaaaaagca

SEQ ID NO: 544558 - DNA, 19 bp, Homo sapiens
aagaagagtaacacttgaa

SEQ ID NO: 544559 - DNA, 17 bp, Homo sapiens
aagaagatagttgtaaa

SEQ ID NO: 544560 - DNA, 21 bp, Homo sapiens
aagaagatagttgtaaagata

SEQ ID NO: 544561 - DNA, 16 bp, Homo sapiens
aagaataaaggcagct

SEQ ID NO: 544562 - DNA, 19 bp, Homo sapiens
aagaataggacttgttttt

SEQ ID NO: 544563 - DNA, 16 bp, Homo sapiens
aagaatattcagagaa

SEQ ID NO: 544564 - DNA, 22 bp, Homo sapiens
aagaatcatcctcatgccttta

SEQ ID NO: 544565 - DNA, 15 bp, Homo sapiens
aagaatggctttcaa

SEQ ID NO: 544566 - DNA, 13 bp, Homo sapiens
aagacaaatacac

SEQ ID NO: 544567 - DNA, 22 bp, Homo sapiens
aagacagacgcctgcttttgca

SEQ ID NO: 544568 - DNA, 23 bp, Homo sapiens
aagacagcaaaaaaagcaacttt

SEQ ID NO: 544569 - DNA, 15 bp, Homo sapiens
aagacattcttagtt

SEQ ID NO: 544570 - DNA, 21 bp, Homo sapiens
aagacattcttagttaatctt

SEQ ID NO: 544571 - DNA, 13 bp, Homo sapiens
aagaccagcctgg

SEQ ID NO: 544572 - DNA, 14 bp, Homo sapiens
aagacctcaagaaa

SEQ ID NO: 544573 - DNA, 12 bp, Homo sapiens
aagacggccttg

SEQ ID NO: 544574 - DNA, 12 bp, Homo sapiens
aagactccagaa

SEQ ID NO: 544575 - DNA, 13 bp, Homo sapiens
aagactgtaaatt

SEQ ID NO: 544576 - DNA, 14 bp, Homo sapiens
aatgctatttgtgt

SEQ ID NO: 544577 - DNA, 20 bp, Homo sapiens
aatgctatttgtgtaactga

SEQ ID NO: 544578 - DNA, 18 bp, Homo sapiens
aatgcttctttcctctta

SEQ ID NO: 544579 - DNA, 15 bp, Homo sapiens
aatggaagagaaatc

SEQ ID NO: 544580 - DNA, 15 bp, Homo sapiens
aatggagtccagacc

SEQ ID NO: 544581 - DNA, 20 bp, Homo sapiens
aatggcaacaaactgcacat

SEQ ID NO: 544582 - DNA, 21 bp, Homo sapiens
aatggcaacaaactgcacatg

SEQ ID NO: 544583 - DNA, 16 bp, Homo sapiens
aatggcatttagcaca

SEQ ID NO: 544584 - DNA, 20 bp, Homo sapiens
aatggcatttagcacagtat

SEQ ID NO: 544585 - DNA, 14 bp, Homo sapiens
aatggcctcttaaa

SEQ ID NO: 544586 - DNA, 16 bp, Homo sapiens
aatggcctcttaaaaa

SEQ ID NO: 544587 - DNA, 19 bp, Homo sapiens
aatggcctcttaaaaatta

SEQ ID NO: 544588 - DNA, 22 bp, Homo sapiens
aatgggtatacctctaactgtg

SEQ ID NO: 544589 - DNA, 22 bp, Homo sapiens
aatggtaacttttgtagtctta

SEQ ID NO: 544590 - DNA, 23 bp, Homo sapiens
aatggtggttgtttcttccaaga

SEQ ID NO: 544591 - DNA, 12 bp, Homo sapiens
aatgtaactgtt

SEQ ID NO: 544592 - DNA, 18 bp, Homo sapiens
aatgtatagtatttgaaa

SEQ ID NO: 544593 - DNA, 16 bp, Homo sapiens
aatgtatatacacata

SEQ ID NO: 544594 - DNA, 17 bp, Homo sapiens
aatgtatatacacatat

SEQ ID NO: 544595 - DNA, 18 bp, Homo sapiens
aatgtatatacacatata

SEQ ID NO: 544596 - DNA, 14 bp, Homo sapiens
aatgtatattttgt

SEQ ID NO: 544597 - DNA, 19 bp, Homo sapiens
aatgtattatcctgtgtgt

SEQ ID NO: 544598 - DNA, 15 bp, Homo sapiens
aatgtcactgttata

SEQ ID NO: 544599 - DNA, 14 bp, Homo sapiens
aatgtcttcatgtt

SEQ ID NO: 544600 - DNA, 17 bp, Homo sapiens
aatgtgaattactaact

SEQ ID NO: 544601 - DNA, 20 bp, Homo sapiens
aatgtgatggatggcacaat

SEQ ID NO: 544602 - DNA, 21 bp, Homo sapiens
aatgtgatggatggcacaatg

SEQ ID NO: 544603 - DNA, 21 bp, Homo sapiens
aatgtgtgtgatgtgacattt

SEQ ID NO: 544604 - DNA, 23 bp, Homo sapiens
aatgtgtgtgatgtgacatttgt

SEQ ID NO: 544605 - DNA, 13 bp, Homo sapiens
aatgttaaagatg

SEQ ID NO: 544606 - DNA, 15 bp, Homo sapiens
aatgttaaagatgta

SEQ ID NO: 544607 - DNA, 16 bp, Homo sapiens
aatgttaaagatgtag

SEQ ID NO: 544608 - DNA, 17 bp, Homo sapiens
aatgttcatcaattccc

SEQ ID NO: 544609 - DNA, 21 bp, Homo sapiens
aatgttgatttctagttattt

SEQ ID NO: 544610 - DNA, 23 bp, Homo sapiens
aatgttgatttctagttatttat

SEQ ID NO: 544611 - DNA, 23 bp, Homo sapiens
aatgttggcagatgcagctcttc

SEQ ID NO: 544612 - DNA, 15 bp, Homo sapiens
aatgtttaagcagaa

SEQ ID NO: 544613 - DNA, 23 bp, Homo sapiens
aatgtttccaggcatgaccctgg

SEQ ID NO: 544614 - DNA, 14 bp, Homo sapiens
aatgttttcagcta

SEQ ID NO: 544615 - DNA, 23 bp, Homo sapiens
aatgttttgtaaactttgaaata

SEQ ID NO: 544616 - DNA, 17 bp, Homo sapiens
aattaaaacaaaatcct

SEQ ID NO: 544617 - DNA, 18 bp, Homo sapiens
aattaaaatttaacatct

SEQ ID NO: 544618 - DNA, 12 bp, Homo sapiens
aattaaactgat

SEQ ID NO: 544619 - DNA, 18 bp, Homo sapiens
aattaacttctattttca

SEQ ID NO: 544620 - DNA, 14 bp, Homo sapiens
aattaaggaaatgt

SEQ ID NO: 544621 - DNA, 13 bp, Homo sapiens
aattaatttcagt

SEQ ID NO: 544622 - DNA, 13 bp, Homo sapiens
aattactaacttc

SEQ ID NO: 544623 - DNA, 15 bp, Homo sapiens
aattactaacttcta

SEQ ID NO: 544624 - DNA, 23 bp, Homo sapiens
aattactaacttctaaaactgta

SEQ ID NO: 544625 - DNA, 21 bp, Homo sapiens
aattaggaggctcaacaataa

SEQ ID NO: 544626 - DNA, 18 bp, Homo sapiens
aattagggctctaatttc

SEQ ID NO: 544627 - DNA, 16 bp, Homo sapiens
aattaggttaacattg

SEQ ID NO: 544628 - DNA, 15 bp, Homo sapiens
aattatcattgtttg

SEQ ID NO: 544629 - DNA, 21 bp, Homo sapiens
aattatcattgtttgtccttt

SEQ ID NO: 544630 - DNA, 23 bp, Homo sapiens
aattatcattgtttgtcctttat

SEQ ID NO: 544631 - DNA, 12 bp, Homo sapiens
aattatctttaa

SEQ ID NO: 544632 - DNA, 15 bp, Homo sapiens
aattatctttaaaac

SEQ ID NO: 544633 - DNA, 16 bp, Homo sapiens
aattatctttaaaact

SEQ ID NO: 544634 - DNA, 16 bp, Homo sapiens
aattatgctaagaatt

SEQ ID NO: 544635 - DNA, 16 bp, Homo sapiens
aattcaaacctaagtt

SEQ ID NO: 544636 - DNA, 14 bp, Homo sapiens
aattcaaagaatca

SEQ ID NO: 544637 - DNA, 19 bp, Homo sapiens
aattcattaaaaacatttt

SEQ ID NO: 544638 - DNA, 12 bp, Homo sapiens
aattctaatggt

SEQ ID NO: 544639 - DNA, 16 bp, Homo sapiens
aattctttatttctgt

SEQ ID NO: 544640 - DNA, 20 bp, Homo sapiens
aattctttatttctgtcatt

SEQ ID NO: 544641 - DNA, 9 bp, Homo sapiens
aattgaaag

SEQ ID NO: 544642 - DNA, 10 bp, Homo sapiens
aattgaaagg

SEQ ID NO: 544643 - DNA, 16 bp, Homo sapiens
aattgaaatacctatt

SEQ ID NO: 544644 - DNA, 23 bp, Homo sapiens
aattgaccgacagctttccagta

SEQ ID NO: 544645 - DNA, 12 bp, Homo sapiens
aattgatgttga

SEQ ID NO: 544646 - DNA, 16 bp, Homo sapiens
aattgatgttgatgca

SEQ ID NO: 544647 - DNA, 17 bp, Homo sapiens
aattgatgttgatgcaa

SEQ ID NO: 544648 - DNA, 19 bp, Homo sapiens
aattgatttcccttcttct

SEQ ID NO: 544649 - DNA, 16 bp, Homo sapiens
aattgcatttgctttt

SEQ ID NO: 544650 - DNA, 18 bp, Homo sapiens
aattgccacataattcat

SEQ ID NO: 544651 - DNA, 13 bp, Homo sapiens
aattgctgaggca

SEQ ID NO: 544652 - DNA, 19 bp, Homo sapiens
aattggaaaagactaagat

SEQ ID NO: 544653 - DNA, 17 bp, Homo sapiens
aattgtaatttgggaac

SEQ ID NO: 544654 - DNA, 16 bp, Homo sapiens
aattgtatatatatgt

SEQ ID NO: 544655 - DNA, 15 bp, Homo sapiens
aatttaacatctgca

SEQ ID NO: 544656 - DNA, 19 bp, Homo sapiens
aatttaagtcattttcatg

SEQ ID NO: 544657 - DNA, 21 bp, Homo sapiens
aatttaccacaggatgcatat

SEQ ID NO: 544658 - DNA, 13 bp, Homo sapiens
aatttacttttaa

SEQ ID NO: 544659 - DNA, 17 bp, Homo sapiens
aggacagaaggctcctg

SEQ ID NO: 544660 - DNA, 19 bp, Homo sapiens
aggacagaaggctcctgcc

SEQ ID NO: 544661 - DNA, 21 bp, Homo sapiens
aggacagaaggctcctgcccc

SEQ ID NO: 544662 - DNA, 22 bp, Homo sapiens
aggacaggaaagtggcacctgt

SEQ ID NO: 544663 - DNA, 15 bp, Homo sapiens
aggacatggcttctg

SEQ ID NO: 544664 - DNA, 15 bp, Homo sapiens
aggacattatgtgtg

SEQ ID NO: 544665 - DNA, 17 bp, Homo sapiens
aggacattatgtgtgca

SEQ ID NO: 544666 - DNA, 19 bp, Homo sapiens
aggacccatgaaacagcag

SEQ ID NO: 544667 - DNA, 18 bp, Homo sapiens
aggaccccatctgctgag

SEQ ID NO: 544668 - DNA, 23 bp, Homo sapiens
aggacctccacctgggagatgct

SEQ ID NO: 544669 - DNA, 21 bp, Homo sapiens
aggaccttcactctaagatgt

SEQ ID NO: 544670 - DNA, 21 bp, Homo sapiens
aggacgcagggagaccctggg

SEQ ID NO: 544671 - DNA, 22 bp, Homo sapiens
aggactgttactcaatgtgtgc

SEQ ID NO: 544672 - DNA, 14 bp, Homo sapiens
aggacttcctgcta

SEQ ID NO: 544673 - DNA, 22 bp, Homo sapiens
aggacttggtcttttttctggg

SEQ ID NO: 544674 - DNA, 23 bp, Homo sapiens
aggacttggtgattacctgaaag

SEQ ID NO: 544675 - DNA, 13 bp, Homo sapiens
aggagaagaaaat

SEQ ID NO: 544676 - DNA, 16 bp, Homo sapiens
aggagaattcacagaa

SEQ ID NO: 544677 - DNA, 13 bp, Homo sapiens
aggagacactggt

SEQ ID NO: 544678 - DNA, 16 bp, Homo sapiens
aggagcgcagctgcat

SEQ ID NO: 544679 - DNA, 22 bp, Homo sapiens
aggagcgctcccttgacctgct

SEQ ID NO: 544680 - DNA, 22 bp, Homo sapiens
aggagctcaggaagaagagatg

SEQ ID NO: 544681 - DNA, 20 bp, Homo sapiens
aggaggcagaggttgcagtg

SEQ ID NO: 544682 - DNA, 18 bp, Homo sapiens
aggaggcagtggcttgga

SEQ ID NO: 544683 - DNA, 20 bp, Homo sapiens
aggaggctcaacaataaaac

SEQ ID NO: 544684 - DNA, 12 bp, Homo sapiens
aggaggctccag

SEQ ID NO: 544685 - DNA, 13 bp, Homo sapiens
aggaggtgcctga

SEQ ID NO: 544686 - DNA, 22 bp, Homo sapiens
aggagtgcgtggcccaccaggc

SEQ ID NO: 544687 - DNA, 19 bp, Homo sapiens
aggagtgggtgggacacag

SEQ ID NO: 544688 - DNA, 21 bp, Homo sapiens
aggagtgggtgggacacagag

SEQ ID NO: 544689 - DNA, 22 bp, Homo sapiens
aggagttcaagaccagcctggc

SEQ ID NO: 544690 - DNA, 22 bp, Homo sapiens
aggagtttctttagctgacaga

SEQ ID NO: 544691 - DNA, 14 bp, Homo sapiens
aggataatatattt

SEQ ID NO: 544692 - DNA, 15 bp, Homo sapiens
aggatactgcctccc

SEQ ID NO: 544693 - DNA, 18 bp, Homo sapiens
aggatactgcctccccca

SEQ ID NO: 544694 - DNA, 19 bp, Homo sapiens
aggatcacttgagcccaga

SEQ ID NO: 544695 - DNA, 13 bp, Homo sapiens
aggatgcatatta

SEQ ID NO: 544696 - DNA, 19 bp, Homo sapiens
aggatgcatattaaagaaa

SEQ ID NO: 544697 - DNA, 14 bp, Homo sapiens
aggatggcgtgtcc

SEQ ID NO: 544698 - DNA, 17 bp, Homo sapiens
aggatgggggagagggg

SEQ ID NO: 544699 - DNA, 12 bp, Homo sapiens
aggatgtatgtg

SEQ ID NO: 544700 - DNA, 16 bp, Homo sapiens
aggatgtatgtgtata

SEQ ID NO: 544701 - DNA, 19 bp, Homo sapiens
aggattaggtttagaatca

SEQ ID NO: 544702 - DNA, 16 bp, Homo sapiens
aggcaagatggcacag

SEQ ID NO: 544703 - DNA, 18 bp, Homo sapiens
aggcacacagctgcagag

SEQ ID NO: 544704 - DNA, 16 bp, Homo sapiens
aggcacttctgcctga

SEQ ID NO: 544705 - DNA, 17 bp, Homo sapiens
aggcagaaggaagcagg

SEQ ID NO: 544706 - DNA, 14 bp, Homo sapiens
aggcagagcccaga

SEQ ID NO: 544707 - DNA, 21 bp, Homo sapiens
aggcagctgttgtctcttctc

SEQ ID NO: 544708 - DNA, 15 bp, Homo sapiens
aggcaggagagacag

SEQ ID NO: 544709 - DNA, 21 bp, Homo sapiens
aggcaggcacctagcaattcc

SEQ ID NO: 544710 - DNA, 16 bp, Homo sapiens
aggcaggtgacagtga

SEQ ID NO: 544711 - DNA, 18 bp, Homo sapiens
aggcaggtgacagtgagg

SEQ ID NO: 544712 - DNA, 14 bp, Homo sapiens
aggcagtggcttgg

SEQ ID NO: 544713 - DNA, 17 bp, Homo sapiens
aggcagttgcccagcct

SEQ ID NO: 544714 - DNA, 20 bp, Homo sapiens
aggcagttgcccagcctctt

SEQ ID NO: 544715 - DNA, 21 bp, Homo sapiens
aggcatctccttgggctggga

SEQ ID NO: 544716 - DNA, 20 bp, Homo sapiens
aggcatgaccctggagcccg

SEQ ID NO: 544717 - DNA, 22 bp, Homo sapiens
aggcatgtcccatgtgagctgc

SEQ ID NO: 544718 - DNA, 18 bp, Homo sapiens
aggcatttcccaccctga

SEQ ID NO: 544719 - DNA, 17 bp, Homo sapiens
aggccaaagacaaatag

SEQ ID NO: 544720 - DNA, 18 bp, Homo sapiens
aggccaaagacaaatagt

SEQ ID NO: 544721 - DNA, 19 bp, Homo sapiens
aggccaaagacaaatagta

SEQ ID NO: 544722 - DNA, 19 bp, Homo sapiens
aggccaaatgagttccctt

SEQ ID NO: 544723 - DNA, 15 bp, Homo sapiens
aggccaccctgtgca

SEQ ID NO: 544724 - DNA, 22 bp, Homo sapiens
aggccaccctgtgcagaaggga

SEQ ID NO: 544725 - DNA, 20 bp, Homo sapiens
aggccatggaggcagtagga

SEQ ID NO: 544726 - DNA, 18 bp, Homo sapiens
aggccccctgcctgccct

SEQ ID NO: 544727 - DNA, 14 bp, Homo sapiens
aggccgggcagagc

SEQ ID NO: 544728 - DNA, 14 bp, Homo sapiens
aggcctccctgcca

SEQ ID NO: 544729 - DNA, 15 bp, Homo sapiens
aggcctccctgccag

SEQ ID NO: 544730 - DNA, 23 bp, Homo sapiens
aggcctcctgtggcctgccagtc

SEQ ID NO: 544731 - DNA, 20 bp, Homo sapiens
aggcctgaatccaaaagaaa

SEQ ID NO: 544732 - DNA, 17 bp, Homo sapiens
aggccttgggctctgct

SEQ ID NO: 544733 - DNA, 22 bp, Homo sapiens
aggcgaggaggccgttgccgct

SEQ ID NO: 544734 - DNA, 13 bp, Homo sapiens
aggcgagtccagg

SEQ ID NO: 544735 - DNA, 19 bp, Homo sapiens
aggcgctagcacagctccc

SEQ ID NO: 544736 - DNA, 16 bp, Homo sapiens
aggcggtatccagagg

SEQ ID NO: 544737 - DNA, 16 bp, Homo sapiens
aggcgtagggccaggg

SEQ ID NO: 544738 - DNA, 14 bp, Homo sapiens
aggctaaaatgttt

SEQ ID NO: 544739 - DNA, 16 bp, Homo sapiens
aggctaaaatgttttc

SEQ ID NO: 544740 - DNA, 19 bp, Homo sapiens
aggctaatgttggcagatg

SEQ ID NO: 544741 - DNA, 23 bp, Homo sapiens
aggctaatgttggcagatgcagc

SEQ ID NO: 544742 - DNA, 17 bp, Homo sapiens
aggctcaacaataaaac

SEQ ID NO: 544743 - DNA, 15 bp, Homo sapiens
aggctccaggcagca

SEQ ID NO: 544744 - DNA, 18 bp, Homo sapiens
aggctccatccttctccc

SEQ ID NO: 544745 - DNA, 22 bp, Homo sapiens
aggctccctccctcccagatcc

SEQ ID NO: 544746 - DNA, 23 bp, Homo sapiens
aggctccttagggttttctctct

SEQ ID NO: 544747 - DNA, 15 bp, Homo sapiens
aggctctctgggctg

SEQ ID NO: 544748 - DNA, 21 bp, Homo sapiens
aggctgccccacccctccatg

SEQ ID NO: 544749 - DNA, 18 bp, Homo sapiens
aggctggataggagagga

SEQ ID NO: 544750 - DNA, 23 bp, Homo sapiens
aggcttgtgtaatttcctgctcc

SEQ ID NO: 544751 - DNA, 19 bp, Homo sapiens
agggaagataagttggaaa

SEQ ID NO: 544752 - DNA, 20 bp, Homo sapiens
agggaagataagttggaaac

SEQ ID NO: 544753 - DNA, 15 bp, Homo sapiens
agggaaggagggtag

SEQ ID NO: 544754 - DNA, 22 bp, Homo sapiens
agggaattaaaaagaagatgaa

SEQ ID NO: 544755 - DNA, 15 bp, Homo sapiens
agggagctggctcca

SEQ ID NO: 544756 - DNA, 19 bp, Homo sapiens
agggagctggctccagcct

SEQ ID NO: 544757 - DNA, 22 bp, Homo sapiens
agggatacgagcggagtcccct

SEQ ID NO: 544758 - DNA, 11 bp, Homo sapiens
agggcaggcag

SEQ ID NO: 544759 - DNA, 15 bp, Homo sapiens
agggcaggcagagct

SEQ ID NO: 544760 - DNA, 16 bp, Homo sapiens
agggcaggcagagctc

SEQ ID NO: 544761 - DNA, 16 bp, Homo sapiens
agggcagtgcaaggag

SEQ ID NO: 544762 - DNA, 14 bp, Homo sapiens
agggccaaaagctt

SEQ ID NO: 544763 - DNA, 15 bp, Homo sapiens
agggccagggctctg

SEQ ID NO: 544764 - DNA, 18 bp, Homo sapiens
agggccagggctctggca

SEQ ID NO: 544765 - DNA, 13 bp, Homo sapiens
agggcccagaggg

SEQ ID NO: 544766 - DNA, 14 bp, Homo sapiens
agggcccttcccaa

SEQ ID NO: 544767 - DNA, 18 bp, Homo sapiens
agggcccttcccaacctc

SEQ ID NO: 544768 - DNA, 22 bp, Homo sapiens
agggcgtgaaacacaatatcat

SEQ ID NO: 544769 - DNA, 14 bp, Homo sapiens
aggggagacgaggc

SEQ ID NO: 544770 - DNA, 12 bp, Homo sapiens
aggggaggctga

SEQ ID NO: 544771 - DNA, 15 bp, Homo sapiens
aggggcagaggaggc

SEQ ID NO: 544772 - DNA, 12 bp, Homo sapiens
aggggccctgca

SEQ ID NO: 544773 - DNA, 13 bp, Homo sapiens
aggggcggggcca

SEQ ID NO: 544774 - DNA, 18 bp, Homo sapiens
agggggaggggtggtact

SEQ ID NO: 544775 - DNA, 16 bp, Homo sapiens
aggggtaccactgaat

SEQ ID NO: 544776 - DNA, 19 bp, Homo sapiens
aggggtaccactgaatctg

SEQ ID NO: 544777 - DNA, 11 bp, Homo sapiens
aggggtggtac

SEQ ID NO: 544778 - DNA, 16 bp, Homo sapiens
aggggtggtacttggc

SEQ ID NO: 544779 - DNA, 14 bp, Homo sapiens
agggtagccttgat

SEQ ID NO: 544780 - DNA, 22 bp, Homo sapiens
agggtctcgtcaggaggtgcct

SEQ ID NO: 544781 - DNA, 23 bp, Homo sapiens
agggtctcgtcaggaggtgcctg

SEQ ID NO: 544782 - DNA, 15 bp, Homo sapiens
agggtgtctgccccc

SEQ ID NO: 544783 - DNA, 14 bp, Homo sapiens
agggttgtgatttt

SEQ ID NO: 544784 - DNA, 22 bp, Homo sapiens
agggttgtgattttgtctgctt

SEQ ID NO: 544785 - DNA, 19 bp, Homo sapiens
aggtaaactgatgctttca

SEQ ID NO: 544786 - DNA, 16 bp, Homo sapiens
aggtaaataatcatac

SEQ ID NO: 544787 - DNA, 16 bp, Homo sapiens
aggtaccaaaaaagaa

SEQ ID NO: 544788 - DNA, 16 bp, Homo sapiens
aggtactttgtctaag

SEQ ID NO: 544789 - DNA, 23 bp, Homo sapiens
aggtactttgtctaagaaacatt

SEQ ID NO: 544790 - DNA, 15 bp, Homo sapiens
aggtagaacgccagg

SEQ ID NO: 544791 - DNA, 18 bp, Homo sapiens
aggtagaacgccagggac

SEQ ID NO: 544792 - DNA, 17 bp, Homo sapiens
aggtagccccctcttcc

SEQ ID NO: 544793 - DNA, 18 bp, Homo sapiens
aggtagccccctcttccc

SEQ ID NO: 544794 - DNA, 21 bp, Homo sapiens
aggtatctgatgatgttctga

SEQ ID NO: 544795 - DNA, 20 bp, Homo sapiens
aggtcagtgttataaaatct

SEQ ID NO: 544796 - DNA, 13 bp, Homo sapiens
aggtcatcccggg

SEQ ID NO: 544797 - DNA, 20 bp, Homo sapiens
aggtcatcccggggccatgg

SEQ ID NO: 544798 - DNA, 16 bp, Homo sapiens
aggtcatctgctggga

SEQ ID NO: 544799 - DNA, 17 bp, Homo sapiens
aggtcctgggggcctga

SEQ ID NO: 544800 - DNA, 22 bp, Homo sapiens
agtggaaattcaggtgaaaatg

SEQ ID NO: 544801 - DNA, 20 bp, Homo sapiens
agtggactggaggagctggg

SEQ ID NO: 544802 - DNA, 16 bp, Homo sapiens
agtggactgtatttcg

SEQ ID NO: 544803 - DNA, 23 bp, Homo sapiens
agtggcaaaatattatgttatga

SEQ ID NO: 544804 - DNA, 22 bp, Homo sapiens
agtggcaaagctgttcttcctg

SEQ ID NO: 544805 - DNA, 13 bp, Homo sapiens
agtggcacctgtc

SEQ ID NO: 544806 - DNA, 17 bp, Homo sapiens
agtggcacctgtctgct

SEQ ID NO: 544807 - DNA, 17 bp, Homo sapiens
agtggcttcagcccctg

SEQ ID NO: 544808 - DNA, 18 bp, Homo sapiens
agtggcttcagcccctgg

SEQ ID NO: 544809 - DNA, 15 bp, Homo sapiens
agtggcttggagcag

SEQ ID NO: 544810 - DNA, 23 bp, Homo sapiens
agtggcttggagcagaggtgggg

SEQ ID NO: 544811 - DNA, 20 bp, Homo sapiens
agtggggaggagactcaggc

SEQ ID NO: 544812 - DNA, 22 bp, Homo sapiens
agtgtacaccactttcccacac

SEQ ID NO: 544813 - DNA, 13 bp, Homo sapiens
agtgtccccaggg

SEQ ID NO: 544814 - DNA, 23 bp, Homo sapiens
agtgtctcaaaggagctttctca

SEQ ID NO: 544815 - DNA, 18 bp, Homo sapiens
atacatacgcaattgtat

SEQ ID NO: 544816 - DNA, 15 bp, Homo sapiens
atacatatatacatt

SEQ ID NO: 544817 - DNA, 20 bp, Homo sapiens
atacatatatacattttgca

SEQ ID NO: 544818 - DNA, 21 bp, Homo sapiens
atacatatgtagactatatac

SEQ ID NO: 544819 - DNA, 22 bp, Homo sapiens
atacatatgtagactatataca

SEQ ID NO: 544820 - DNA, 23 bp, Homo sapiens
atacatatgtagactatatacat

SEQ ID NO: 544821 - DNA, 18 bp, Homo sapiens
atacatgtgtgtatatat

SEQ ID NO: 544822 - DNA, 19 bp, Homo sapiens
atacatgtgtgtatatatg

SEQ ID NO: 544823 - DNA, 21 bp, Homo sapiens
atacatgtgtgtatatatgtg

SEQ ID NO: 544824 - DNA, 14 bp, Homo sapiens
atacattttctggt

SEQ ID NO: 544825 - DNA, 17 bp, Homo sapiens
ataccatactcatttct

SEQ ID NO: 544826 - DNA, 21 bp, Homo sapiens
ataccatactcatttctaaaa

SEQ ID NO: 544827 - DNA, 16 bp, Homo sapiens
ataccattttgaaata

SEQ ID NO: 544828 - DNA, 15 bp, Homo sapiens
atacctataatgtgt

SEQ ID NO: 544829 - DNA, 18 bp, Homo sapiens
atacctataatgtgtgta

SEQ ID NO: 544830 - DNA, 19 bp, Homo sapiens
atacctctaactgtgcaaa

SEQ ID NO: 544831 - DNA, 19 bp, Homo sapiens
atacctgtacacacacaga

SEQ ID NO: 544832 - DNA, 15 bp, Homo sapiens
ataccttaaaatttg

SEQ ID NO: 544833 - DNA, 18 bp, Homo sapiens
ataccttaaaatttgaaa

SEQ ID NO: 544834 - DNA, 21 bp, Homo sapiens
ataccttaaaatttgaaacat

SEQ ID NO: 544835 - DNA, 22 bp, Homo sapiens
ataccttaaaatttgaaacatt

SEQ ID NO: 544836 - DNA, 14 bp, Homo sapiens
ataccttctgatga

SEQ ID NO: 544837 - DNA, 15 bp, Homo sapiens
atacgcaattgtata

SEQ ID NO: 544838 - DNA, 19 bp, Homo sapiens
atacgcaattgtatatata

SEQ ID NO: 544839 - DNA, 21 bp, Homo sapiens
atacgcaattgtatatatatg

SEQ ID NO: 544840 - DNA, 15 bp, Homo sapiens
atacgcacgcaccca

SEQ ID NO: 544841 - DNA, 21 bp, Homo sapiens
atacgcacgcacccacaccct

SEQ ID NO: 544842 - DNA, 14 bp, Homo sapiens
atacgttttctgca

SEQ ID NO: 544843 - DNA, 13 bp, Homo sapiens
atactaaaatatg

SEQ ID NO: 544844 - DNA, 14 bp, Homo sapiens
atactaaaatatgt

SEQ ID NO: 544845 - DNA, 16 bp, Homo sapiens
atactagccagagctc

SEQ ID NO: 544846 - DNA, 19 bp, Homo sapiens
atactatttattaaaacca

SEQ ID NO: 544847 - DNA, 12 bp, Homo sapiens
atactcaagttt

SEQ ID NO: 544848 - DNA, 16 bp, Homo sapiens
atactccttaaaaatg

SEQ ID NO: 544849 - DNA, 18 bp, Homo sapiens
atactgtagataattaac

SEQ ID NO: 544850 - DNA, 15 bp, Homo sapiens
atacttcctgggtca

SEQ ID NO: 544851 - DNA, 15 bp, Homo sapiens
atacttctctcagat

SEQ ID NO: 544852 - DNA, 17 bp, Homo sapiens
atacttggtccttaaaa

SEQ ID NO: 544853 - DNA, 22 bp, Homo sapiens
atagaaagtgttctgttacaaa

SEQ ID NO: 544854 - DNA, 23 bp, Homo sapiens
atagaaagtgttctgttacaaaa

SEQ ID NO: 544855 - DNA, 12 bp, Homo sapiens
atagaagaatgc

SEQ ID NO: 544856 - DNA, 18 bp, Homo sapiens
atagaagaatgcatgctt

SEQ ID NO: 544857 - DNA, 23 bp, Homo sapiens
atagaagaatgcatgctttccat

SEQ ID NO: 544858 - DNA, 23 bp, Homo sapiens
atagaagtcttcatgaaatgcta

SEQ ID NO: 544859 - DNA, 12 bp, Homo sapiens
atagacagatgt

SEQ ID NO: 544860 - DNA, 12 bp, Homo sapiens
atagacataaat

SEQ ID NO: 544861 - DNA, 14 bp, Homo sapiens
atagacataaattg

SEQ ID NO: 544862 - DNA, 22 bp, Homo sapiens
atagagtgactccaagaacaat

SEQ ID NO: 544863 - DNA, 13 bp, Homo sapiens
atagagttcatcc

SEQ ID NO: 544864 - DNA, 20 bp, Homo sapiens
atagataccattttgaaata

SEQ ID NO: 544865 - DNA, 12 bp, Homo sapiens
atagattgattt

SEQ ID NO: 544866 - DNA, 19 bp, Homo sapiens
atagattgatttacctttg

SEQ ID NO: 544867 - DNA, 20 bp, Homo sapiens
atagcatgacaggctgttca

SEQ ID NO: 544868 - DNA, 17 bp, Homo sapiens
atagcatttatggtaat

SEQ ID NO: 544869 - DNA, 19 bp, Homo sapiens
atagcccctctccccgcag

SEQ ID NO: 544870 - DNA, 21 bp, Homo sapiens
atagctacccaaaagagaaaa

SEQ ID NO: 544871 - DNA, 18 bp, Homo sapiens
atagctataaatagtgaa

SEQ ID NO: 544872 - DNA, 13 bp, Homo sapiens
ataggacttgttt

SEQ ID NO: 544873 - DNA, 22 bp, Homo sapiens
ataggcctgctttgtctcctct

SEQ ID NO: 544874 - DNA, 14 bp, Homo sapiens
atagtatttgaaaa

SEQ ID NO: 544875 - DNA, 18 bp, Homo sapiens
atagtatttgaaaacaga

SEQ ID NO: 544876 - DNA, 14 bp, Homo sapiens
atagtgctatatat

SEQ ID NO: 544877 - DNA, 14 bp, Homo sapiens
atagtgtgtccatg

SEQ ID NO: 544878 - DNA, 19 bp, Homo sapiens
atagttaccgatggtgtcc

SEQ ID NO: 544879 - DNA, 21 bp, Homo sapiens
atagtttttttcttttttaat

SEQ ID NO: 544880 - DNA, 13 bp, Homo sapiens
atataaaatacac

SEQ ID NO: 544881 - DNA, 14 bp, Homo sapiens
atataaaatacacg

SEQ ID NO: 544882 - DNA, 19 bp, Homo sapiens
atataaaatacacgtgtat

SEQ ID NO: 544883 - DNA, 21 bp, Homo sapiens
atataaaatacacgtgtatat

SEQ ID NO: 544884 - DNA, 21 bp, Homo sapiens
atataaaatagttgtccatat

SEQ ID NO: 544885 - DNA, 23 bp, Homo sapiens
atataaaatggcaacaaactgca

SEQ ID NO: 544886 - DNA, 17 bp, Homo sapiens
atataaccataaatcaa

SEQ ID NO: 544887 - DNA, 13 bp, Homo sapiens
atataactgcctt

SEQ ID NO: 544888 - DNA, 12 bp, Homo sapiens
atatacatacac

SEQ ID NO: 544889 - DNA, 13 bp, Homo sapiens
atatacatacact

SEQ ID NO: 544890 - DNA, 16 bp, Homo sapiens
atatacatacacttgt

SEQ ID NO: 544891 - DNA, 21 bp, Homo sapiens
atatacatacacttgtataaa

SEQ ID NO: 544892 - DNA, 14 bp, Homo sapiens
atatacatatgtag

SEQ ID NO: 544893 - DNA, 17 bp, Homo sapiens
atatacatgtgtgtata

SEQ ID NO: 544894 - DNA, 22 bp, Homo sapiens
atatacatgtgtgtatatatgt

SEQ ID NO: 544895 - DNA, 13 bp, Homo sapiens
atatacattttgc

SEQ ID NO: 544896 - DNA, 19 bp, Homo sapiens
atatacctataatgtgtgt

SEQ ID NO: 544897 - DNA, 18 bp, Homo sapiens
atatagcatttatggtaa

SEQ ID NO: 544898 - DNA, 20 bp, Homo sapiens
atatagcatttatggtaatc

SEQ ID NO: 544899 - DNA, 18 bp, Homo sapiens
atatagcgttcccaacaa

SEQ ID NO: 544900 - DNA, 13 bp, Homo sapiens
atatatacatacg

SEQ ID NO: 544901 - DNA, 13 bp, Homo sapiens
atatatatacata

SEQ ID NO: 544902 - DNA, 16 bp, Homo sapiens
atatatatatctgtat

SEQ ID NO: 544903 - DNA, 14 bp, Homo sapiens
atatatatgtatat

SEQ ID NO: 544904 - DNA, 13 bp, Homo sapiens
atatatatgtgaa

SEQ ID NO: 544905 - DNA, 14 bp, Homo sapiens
atatatatgtgaac

SEQ ID NO: 544906 - DNA, 18 bp, Homo sapiens
atatatctgaaaactgga

SEQ ID NO: 544907 - DNA, 23 bp, Homo sapiens
atatatgtatacgcacgcaccca

SEQ ID NO: 544908 - DNA, 20 bp, Homo sapiens
atatatgtgtatatatacat

SEQ ID NO: 544909 - DNA, 21 bp, Homo sapiens
atatatgtgtatatatacata

SEQ ID NO: 544910 - DNA, 18 bp, Homo sapiens
atatatttgcagataatt

SEQ ID NO: 544911 - DNA, 15 bp, Homo sapiens
atatatttgcataat

SEQ ID NO: 544912 - DNA, 18 bp, Homo sapiens
atatatttgcataatatg

SEQ ID NO: 544913 - DNA, 23 bp, Homo sapiens
atatatttgcataatatgcatat

SEQ ID NO: 544914 - DNA, 14 bp, Homo sapiens
atatattttgtatg

SEQ ID NO: 544915 - DNA, 16 bp, Homo sapiens
atatattttgtatgca

SEQ ID NO: 544916 - DNA, 17 bp, Homo sapiens
atatattttgtatgcaa

SEQ ID NO: 544917 - DNA, 20 bp, Homo sapiens
atatattttgtatgcaagca

SEQ ID NO: 544918 - DNA, 23 bp, Homo sapiens
atatattttgtatgcaagcagtt

SEQ ID NO: 544919 - DNA, 14 bp, Homo sapiens
atatcaaaagacac

SEQ ID NO: 544920 - DNA, 15 bp, Homo sapiens
atatcaagatgattc

SEQ ID NO: 544921 - DNA, 18 bp, Homo sapiens
atatcaggaaatatctgt

SEQ ID NO: 544922 - DNA, 17 bp, Homo sapiens
atatcagttacagtggc

SEQ ID NO: 544923 - DNA, 21 bp, Homo sapiens
atatcatccccaaatgtgtct

SEQ ID NO: 544924 - DNA, 20 bp, Homo sapiens
atatcatgctttaaagtgta

SEQ ID NO: 544925 - DNA, 22 bp, Homo sapiens
atatcatgctttaaagtgtaat

SEQ ID NO: 544926 - DNA, 11 bp, Homo sapiens
atatctgaaaa

SEQ ID NO: 544927 - DNA, 13 bp, Homo sapiens
atatctgtacaga

SEQ ID NO: 544928 - DNA, 21 bp, Homo sapiens
atatcttggcaggtaggaata

SEQ ID NO: 544929 - DNA, 16 bp, Homo sapiens
atatgaaaactaagtt

SEQ ID NO: 544930 - DNA, 19 bp, Homo sapiens
atatgagaaatataaaaat

SEQ ID NO: 544931 - DNA, 16 bp, Homo sapiens
atatgagattggaaaa

SEQ ID NO: 544932 - DNA, 14 bp, Homo sapiens
atatgaggatgtat

SEQ ID NO: 544933 - DNA, 16 bp, Homo sapiens
atatgattttttaaaa

SEQ ID NO: 544934 - DNA, 17 bp, Homo sapiens
atatgattttttaaaag

SEQ ID NO: 544935 - DNA, 16 bp, Homo sapiens
atatgcatatatatgt

SEQ ID NO: 544936 - DNA, 18 bp, Homo sapiens
atatgcatcccacagcca

SEQ ID NO: 544937 - DNA, 15 bp, Homo sapiens
atatggtctaatgtt

SEQ ID NO: 544938 - DNA, 13 bp, Homo sapiens
atatgtaaacttt

SEQ ID NO: 544939 - DNA, 13 bp, Homo sapiens
atatgtaacagtt

SEQ ID NO: 544940 - DNA, 14 bp, Homo sapiens
atatgtaacagttt

SEQ ID NO: 544941 - DNA, 16 bp, Homo sapiens
atatgtagactatata

SEQ ID NO: 544942 - DNA, 17 bp, Homo sapiens
atatgtagactatatac

SEQ ID NO: 544943 - DNA, 17 bp, Homo sapiens
atatgtattttatgtat

SEQ ID NO: 544944 - DNA, 19 bp, Homo sapiens
atatgtgaactttctcagc

SEQ ID NO: 544945 - DNA, 22 bp, Homo sapiens
atatgtgaaggaccttcactct

SEQ ID NO: 544946 - DNA, 16 bp, Homo sapiens
atatgtgattttcaaa

SEQ ID NO: 544947 - DNA, 15 bp, Homo sapiens
attatatttggatgc

SEQ ID NO: 544948 - DNA, 15 bp, Homo sapiens
attatctgatccttg

SEQ ID NO: 544949 - DNA, 18 bp, Homo sapiens
attatgccttgagaatga

SEQ ID NO: 544950 - DNA, 13 bp, Homo sapiens
attatgctaagaa

SEQ ID NO: 544951 - DNA, 17 bp, Homo sapiens
attattttcattacaat

SEQ ID NO: 544952 - DNA, 21 bp, Homo sapiens
attcaaaccaatttcttcctt

SEQ ID NO: 544953 - DNA, 22 bp, Homo sapiens
attcaaaccaatttcttccttc

SEQ ID NO: 544954 - DNA, 14 bp, Homo sapiens
attcaaatgggtga

SEQ ID NO: 544955 - DNA, 23 bp, Homo sapiens
attcaagaaagccagtcttaaca

SEQ ID NO: 544956 - DNA, 15 bp, Homo sapiens
attcacatgttttca

SEQ ID NO: 544957 - DNA, 16 bp, Homo sapiens
attcacatgttttcaa

SEQ ID NO: 544958 - DNA, 16 bp, Homo sapiens
attcaccagtacattc

SEQ ID NO: 544959 - DNA, 16 bp, Homo sapiens
attcagagaatatcaa

SEQ ID NO: 544960 - DNA, 21 bp, Homo sapiens
attcagcaaggcgctaacttg

SEQ ID NO: 544961 - DNA, 18 bp, Homo sapiens
attcaggtgaaaatgttc

SEQ ID NO: 544962 - DNA, 19 bp, Homo sapiens
attcaggtgaaaatgttca

SEQ ID NO: 544963 - DNA, 13 bp, Homo sapiens
attcatagaataa

SEQ ID NO: 544964 - DNA, 14 bp, Homo sapiens
attcatagaataac

SEQ ID NO: 544965 - DNA, 12 bp, Homo sapiens
attcatttcaca

SEQ ID NO: 544966 - DNA, 18 bp, Homo sapiens
attccaagggcccagagg

SEQ ID NO: 544967 - DNA, 17 bp, Homo sapiens
attccagggaaccagag

SEQ ID NO: 544968 - DNA, 20 bp, Homo sapiens
attccatattagaaaacttt

SEQ ID NO: 544969 - DNA, 22 bp, Homo sapiens
attccatattagaaaactttgt

SEQ ID NO: 544970 - DNA, 16 bp, Homo sapiens
attcccaagaaatgct

SEQ ID NO: 544971 - DNA, 21 bp, Homo sapiens
attcccatggtagactgtgac

SEQ ID NO: 544972 - DNA, 15 bp, Homo sapiens
attccccatttcctg

SEQ ID NO: 544973 - DNA, 17 bp, Homo sapiens
attccctggaattgcca

SEQ ID NO: 544974 - DNA, 11 bp, Homo sapiens
attcctatgaa

SEQ ID NO: 544975 - DNA, 14 bp, Homo sapiens
attcctctgtcccc

SEQ ID NO: 544976 - DNA, 16 bp, Homo sapiens
attctaggacctgtgt

SEQ ID NO: 544977 - DNA, 17 bp, Homo sapiens
attctaggacctgtgtc

SEQ ID NO: 544978 - DNA, 18 bp, Homo sapiens
attctatgtaacttgttg

SEQ ID NO: 544979 - DNA, 12 bp, Homo sapiens
attctatttcaa

SEQ ID NO: 544980 - DNA, 21 bp, Homo sapiens
attctatttcaacttcaggaa

SEQ ID NO: 544981 - DNA, 19 bp, Homo sapiens
attctcagaagtgaaaaag

SEQ ID NO: 544982 - DNA, 15 bp, Homo sapiens
attctgaagttatat

SEQ ID NO: 544983 - DNA, 19 bp, Homo sapiens
attctgggaatgtatagta

SEQ ID NO: 544984 - DNA, 22 bp, Homo sapiens
attctgggaatgtatagtattt

SEQ ID NO: 544985 - DNA, 16 bp, Homo sapiens
attcttagttaatctt

SEQ ID NO: 544986 - DNA, 22 bp, Homo sapiens
attcttttatactcagctttct

SEQ ID NO: 544987 - DNA, 11 bp, Homo sapiens
attgaaaagaa

SEQ ID NO: 544988 - DNA, 17 bp, Homo sapiens
attgaaaatgtcactgt

SEQ ID NO: 544989 - DNA, 20 bp, Homo sapiens
attgaaaatgtcactgttat

SEQ ID NO: 544990 - DNA, 18 bp, Homo sapiens
attgaagagagagctgag

SEQ ID NO: 544991 - DNA, 19 bp, Homo sapiens
attgaagagagatatatct

SEQ ID NO: 544992 - DNA, 21 bp, Homo sapiens
attgaagagagatatatctga

SEQ ID NO: 544993 - DNA, 20 bp, Homo sapiens
attgagagagatgtgtaatt

SEQ ID NO: 544994 - DNA, 17 bp, Homo sapiens
attgagagcagcctctt

SEQ ID NO: 544995 - DNA, 15 bp, Homo sapiens
attgaggaaaaatat

SEQ ID NO: 544996 - DNA, 17 bp, Homo sapiens
attgaggaaaaatatgt

SEQ ID NO: 544997 - DNA, 21 bp, Homo sapiens
attgaggaaaaatatgtgaag

SEQ ID NO: 544998 - DNA, 22 bp, Homo sapiens
attgagttggttacctattgct

SEQ ID NO: 544999 - DNA, 12 bp, Homo sapiens
attgatgttgat

SEQ ID NO: 545000 - DNA, 18 bp, Homo sapiens
attgatgttgatgcaatc

SEQ ID NO: 545001 - DNA, 14 bp, Homo sapiens
attgattgcttttt

SEQ ID NO: 545002 - DNA, 20 bp, Homo sapiens
attgcataagtggacccagc

SEQ ID NO: 545003 - DNA, 22 bp, Homo sapiens
attgccaaacattaatgttgat

SEQ ID NO: 545004 - DNA, 20 bp, Homo sapiens
attgcccacacctgcctctg

SEQ ID NO: 545005 - DNA, 22 bp, Homo sapiens
attgcccacacctgcctctgaa

SEQ ID NO: 545006 - DNA, 19 bp, Homo sapiens
attgctacttcctgcctgg

SEQ ID NO: 545007 - DNA, 23 bp, Homo sapiens
attgctacttcctgcctggtctc

SEQ ID NO: 545008 - DNA, 18 bp, Homo sapiens
attgctgtaaataaaaat

SEQ ID NO: 545009 - DNA, 17 bp, Homo sapiens
attgcttctctaaaaca

SEQ ID NO: 545010 - DNA, 16 bp, Homo sapiens
attgcttttaaaacta

SEQ ID NO: 545011 - DNA, 18 bp, Homo sapiens
attgcttttaaaactact

SEQ ID NO: 545012 - DNA, 16 bp, Homo sapiens
attgcttttaaaattt

SEQ ID NO: 545013 - DNA, 14 bp, Homo sapiens
attggaaatttcac

SEQ ID NO: 545014 - DNA, 15 bp, Homo sapiens
attggaaatttcacg

SEQ ID NO: 545015 - DNA, 22 bp, Homo sapiens
attggaagcaggttaaatgttt

SEQ ID NO: 545016 - DNA, 22 bp, Homo sapiens
attggattttatgttgacattt

SEQ ID NO: 545017 - DNA, 22 bp, Homo sapiens
attggctgccaagagtccaagc

SEQ ID NO: 545018 - DNA, 23 bp, Homo sapiens
attgggtaagggactccagaagc

SEQ ID NO: 545019 - DNA, 23 bp, Homo sapiens
attgggtgaatatggtggaaaat

SEQ ID NO: 545020 - DNA, 15 bp, Homo sapiens
attggtaattacctg

SEQ ID NO: 545021 - DNA, 19 bp, Homo sapiens
attggtaccttgcacacat

SEQ ID NO: 545022 - DNA, 17 bp, Homo sapiens
attggtttaaaagtcac

SEQ ID NO: 545023 - DNA, 17 bp, Homo sapiens
attggtttctcttctcc

SEQ ID NO: 545024 - DNA, 19 bp, Homo sapiens
attggtttctcttctcccc

SEQ ID NO: 545025 - DNA, 22 bp, Homo sapiens
attgtaatttgggaacataaaa

SEQ ID NO: 545026 - DNA, 21 bp, Homo sapiens
attgtatatatatgtgaactt

SEQ ID NO: 545027 - DNA, 18 bp, Homo sapiens
attgtatctcctttaata

SEQ ID NO: 545028 - DNA, 17 bp, Homo sapiens
attgtatttaaaacatt

SEQ ID NO: 545029 - DNA, 19 bp, Homo sapiens
attgtatttaaaacatttc

SEQ ID NO: 545030 - DNA, 17 bp, Homo sapiens
attgtcacctgcttctc

SEQ ID NO: 545031 - DNA, 21 bp, Homo sapiens
attgtcacctgcttctctgcc

SEQ ID NO: 545032 - DNA, 21 bp, Homo sapiens
attgtgctccaaatgtctact

SEQ ID NO: 545033 - DNA, 14 bp, Homo sapiens
attgtggatgaaga

SEQ ID NO: 545034 - DNA, 19 bp, Homo sapiens
attgtgtatgagactgtgt

SEQ ID NO: 545035 - DNA, 15 bp, Homo sapiens
attgttaatgtgatg

SEQ ID NO: 545036 - DNA, 16 bp, Homo sapiens
attgttcagaaaagca

SEQ ID NO: 545037 - DNA, 23 bp, Homo sapiens
attgttcagaaaagcacctcttg

SEQ ID NO: 545038 - DNA, 17 bp, Homo sapiens
attgtttatctagatgt

SEQ ID NO: 545039 - DNA, 21 bp, Homo sapiens
attgtttatctagatgtaaat

SEQ ID NO: 545040 - DNA, 18 bp, Homo sapiens
attgtttgtcctttatgt

SEQ ID NO: 545041 - DNA, 13 bp, Homo sapiens
atttaaaacattt

SEQ ID NO: 545042 - DNA, 18 bp, Homo sapiens
atttaaaacatttcatgt

SEQ ID NO: 545043 - DNA, 20 bp, Homo sapiens
atttaaacccaatcagatgc

SEQ ID NO: 545044 - DNA, 22 bp, Homo sapiens
atttaacatgcaacccgaaggt

SEQ ID NO: 545045 - DNA, 20 bp, Homo sapiens
atttaacattcttggtcaca

SEQ ID NO: 545046 - DNA, 22 bp, Homo sapiens
atttaagagattttatgtttaa

SEQ ID NO: 545047 - DNA, 12 bp, Homo sapiens
atttaagcacaa

SEQ ID NO: 545048 - DNA, 19 bp, Homo sapiens
atttaagcacaaaaaattt

SEQ ID NO: 545049 - DNA, 18 bp, Homo sapiens
atttaagtggactgtatt

SEQ ID NO: 545050 - DNA, 15 bp, Homo sapiens
atttaagttgtaaac

SEQ ID NO: 545051 - DNA, 19 bp, Homo sapiens
atttaagttgtaaacgtct

SEQ ID NO: 545052 - DNA, 20 bp, Homo sapiens
atttaagttgtaaacgtctt

SEQ ID NO: 545053 - DNA, 14 bp, Homo sapiens
atttaccacaggat

SEQ ID NO: 545054 - DNA, 22 bp, Homo sapiens
atttaccacaggatgcatatta

SEQ ID NO: 545055 - DNA, 18 bp, Homo sapiens
atttactaacagtaactg

SEQ ID NO: 545056 - DNA, 21 bp, Homo sapiens
atttacttgttatgttgtaat

SEQ ID NO: 545057 - DNA, 14 bp, Homo sapiens
atttacttttaata

SEQ ID NO: 545058 - DNA, 19 bp, Homo sapiens
atttacttttaataaagta

SEQ ID NO: 545059 - DNA, 16 bp, Homo sapiens
atttagcacagtattt

SEQ ID NO: 545060 - DNA, 16 bp, Homo sapiens
atttagtcctcacctt

SEQ ID NO: 545061 - DNA, 17 bp, Homo sapiens
atttagtgtatatgtga

SEQ ID NO: 545062 - DNA, 19 bp, Homo sapiens
atttagtgtatatgtgatt

SEQ ID NO: 545063 - DNA, 15 bp, Homo sapiens
atttataaaattaga

SEQ ID NO: 545064 - DNA, 16 bp, Homo sapiens
atttataacattgtaa

SEQ ID NO: 545065 - DNA, 17 bp, Homo sapiens
atttataacattgtaaa

SEQ ID NO: 545066 - DNA, 15 bp, Homo sapiens
atttatctttataca

SEQ ID NO: 545067 - DNA, 17 bp, Homo sapiens
atttatctttatacaga

SEQ ID NO: 545068 - DNA, 19 bp, Homo sapiens
atttatctttatacagatt

SEQ ID NO: 545069 - DNA, 15 bp, Homo sapiens
atttatgaagcagat

SEQ ID NO: 545070 - DNA, 17 bp, Homo sapiens
atttatgagatcactga

SEQ ID NO: 545071 - DNA, 19 bp, Homo sapiens
atttatggtaatcatatta

SEQ ID NO: 545072 - DNA, 12 bp, Homo sapiens
atttatgtgtga

SEQ ID NO: 545073 - DNA, 17 bp, Homo sapiens
atttattgaggaaaaat

SEQ ID NO: 545074 - DNA, 18 bp, Homo sapiens
atttattgaggaaaaata

SEQ ID NO: 545075 - DNA, 12 bp, Homo sapiens
atttattgccat

SEQ ID NO: 545076 - DNA, 14 bp, Homo sapiens
atttattgccatat

SEQ ID NO: 545077 - DNA, 19 bp, Homo sapiens
atttcaagaaaaaataaat

SEQ ID NO: 545078 - DNA, 13 bp, Homo sapiens
atttcaatcactg

SEQ ID NO: 545079 - DNA, 13 bp, Homo sapiens
atttcacaaatat

SEQ ID NO: 545080 - DNA, 14 bp, Homo sapiens
atttcacaaatatt

SEQ ID NO: 545081 - DNA, 18 bp, Homo sapiens
atttcacaaatattaaaa

SEQ ID NO: 545082 - DNA, 20 bp, Homo sapiens
atttcacaaatattaaaaag

SEQ ID NO: 545083 - DNA, 19 bp, Homo sapiens
atttcacgtcataggaagt

SEQ ID NO: 545084 - DNA, 22 bp, Homo sapiens
atttcagaaactaagaatcatc

SEQ ID NO: 545085 - DNA, 14 bp, Homo sapiens
atttcataagcaca

SEQ ID NO: 545086 - DNA, 19 bp, Homo sapiens
atttcataagcacatccaa

SEQ ID NO: 545087 - DNA, 16 bp, Homo sapiens
atttcatgtatttctt

SEQ ID NO: 545088 - DNA, 23 bp, Homo sapiens
atatgtgattttcaaatatgtaa

SEQ ID NO: 545089 - DNA, 15 bp, Homo sapiens
atatgtgtatatata

SEQ ID NO: 545090 - DNA, 18 bp, Homo sapiens
atatgtgtatatatacat

SEQ ID NO: 545091 - DNA, 21 bp, Homo sapiens
atatgtgtatatatacataca

SEQ ID NO: 545092 - DNA, 16 bp, Homo sapiens
atatgtttatacacac

SEQ ID NO: 545093 - DNA, 22 bp, Homo sapiens
atggcaacaaactgcacatgat

SEQ ID NO: 545094 - DNA, 15 bp, Homo sapiens
atggcaatattaaga

SEQ ID NO: 545095 - DNA, 17 bp, Homo sapiens
atggcacaatgaatgta

SEQ ID NO: 545096 - DNA, 22 bp, Homo sapiens
atggcagcatgcgatgtcatat

SEQ ID NO: 545097 - DNA, 22 bp, Homo sapiens
atggcatgtcatcttccgagcc

SEQ ID NO: 545098 - DNA, 13 bp, Homo sapiens
agagccctgctcc

SEQ ID NO: 545099 - DNA, 16 bp, Homo sapiens
agagccctgctccctc

SEQ ID NO: 545100 - DNA, 18 bp, Homo sapiens
agagccctgctccctccg

SEQ ID NO: 545101 - DNA, 12 bp, Homo sapiens
agagcctgcccc

SEQ ID NO: 545102 - DNA, 16 bp, Homo sapiens
agagcctgccccagcg

SEQ ID NO: 545103 - DNA, 17 bp, Homo sapiens
agagcctgccccagcgc

SEQ ID NO: 545104 - DNA, 10 bp, Homo sapiens
agagcctggt

SEQ ID NO: 545105 - DNA, 14 bp, Homo sapiens
agagcgcagcatcc

SEQ ID NO: 545106 - DNA, 19 bp, Homo sapiens
agagctatggacagcattg

SEQ ID NO: 545107 - DNA, 14 bp, Homo sapiens
agagctcccaggac

SEQ ID NO: 545108 - DNA, 15 bp, Homo sapiens
agagctcccaggacg

SEQ ID NO: 545109 - DNA, 12 bp, Homo sapiens
agagctgccagt

SEQ ID NO: 545110 - DNA, 13 bp, Homo sapiens
agagctgccagtg

SEQ ID NO: 545111 - DNA, 23 bp, Homo sapiens
agaggaaaaggcttgagtctgga

SEQ ID NO: 545112 - DNA, 21 bp, Homo sapiens
agaggacacctgtactggaga

SEQ ID NO: 545113 - DNA, 16 bp, Homo sapiens
agaggacgtgggcggc

SEQ ID NO: 545114 - DNA, 18 bp, Homo sapiens
agaggcagttgcccagcc

SEQ ID NO: 545115 - DNA, 14 bp, Homo sapiens
agaggccatggagg

SEQ ID NO: 545116 - DNA, 14 bp, Homo sapiens
agaggctaaaatgt

SEQ ID NO: 545117 - DNA, 15 bp, Homo sapiens
agaggctaaaatgtt

SEQ ID NO: 545118 - DNA, 17 bp, Homo sapiens
agaggctaaaatgtttt

SEQ ID NO: 545119 - DNA, 16 bp, Homo sapiens
agaggctatgaagaaa

SEQ ID NO: 545120 - DNA, 18 bp, Homo sapiens
agaggggagagctgaaca

SEQ ID NO: 545121 - DNA, 23 bp, Homo sapiens
agagggggaggggtggtacttgg

SEQ ID NO: 545122 - DNA, 20 bp, Homo sapiens
agagggtgagtcctccagaa

SEQ ID NO: 545123 - DNA, 21 bp, Homo sapiens
agagggtgagtcctccagaac

SEQ ID NO: 545124 - DNA, 21 bp, Homo sapiens
agaggtcccaaggttctgggt

SEQ ID NO: 545125 - DNA, 18 bp, Homo sapiens
agaggtgagggaggcctg

SEQ ID NO: 545126 - DNA, 20 bp, Homo sapiens
agaggtttggctcctgccca

SEQ ID NO: 545127 - DNA, 18 bp, Homo sapiens
agagtaacacttgaaaag

SEQ ID NO: 545128 - DNA, 20 bp, Homo sapiens
agagtagaactttaaaagaa

SEQ ID NO: 545129 - DNA, 18 bp, Homo sapiens
agagtgaagagtgaagag

SEQ ID NO: 545130 - DNA, 16 bp, Homo sapiens
agagtgactccaagaa

SEQ ID NO: 545131 - DNA, 23 bp, Homo sapiens
agagtgatttgtaaaacagtggt

SEQ ID NO: 545132 - DNA, 14 bp, Homo sapiens
agagttcatcccag

SEQ ID NO: 545133 - DNA, 14 bp, Homo sapiens
agagttccttctca

SEQ ID NO: 545134 - DNA, 16 bp, Homo sapiens
agagttccttctcact

SEQ ID NO: 545135 - DNA, 17 bp, Homo sapiens
agagttccttctcactt

SEQ ID NO: 545136 - DNA, 15 bp, Homo sapiens
agagttgcagtaaag

SEQ ID NO: 545137 - DNA, 17 bp, Homo sapiens
agagtttgccttataaa

SEQ ID NO: 545138 - DNA, 18 bp, Homo sapiens
agataagttggaaacact

SEQ ID NO: 545139 - DNA, 19 bp, Homo sapiens
agataagttggaaacacta

SEQ ID NO: 545140 - DNA, 13 bp, Homo sapiens
agataatggtaat

SEQ ID NO: 545141 - DNA, 20 bp, Homo sapiens
caaagatcaaaataaaaagt

SEQ ID NO: 545142 - DNA, 20 bp, Homo sapiens
caaagatgaaagctgtttca

SEQ ID NO: 545143 - DNA, 17 bp, Homo sapiens
caaagatgttaacagta

SEQ ID NO: 545144 - DNA, 17 bp, Homo sapiens
caaagcaaaccaacaag

SEQ ID NO: 545145 - DNA, 20 bp, Homo sapiens
caaagcagagtgaaattcaa

SEQ ID NO: 545146 - DNA, 15 bp, Homo sapiens
caaagcagtggagcc

SEQ ID NO: 545147 - DNA, 14 bp, Homo sapiens
caaagcagttgaat

SEQ ID NO: 545148 - DNA, 23 bp, Homo sapiens
caaagccctccctgtctgtctgt

SEQ ID NO: 545149 - DNA, 12 bp, Homo sapiens
caaagctattta

SEQ ID NO: 545150 - DNA, 15 bp, Homo sapiens
caaagctatttaagt

SEQ ID NO: 545151 - DNA, 19 bp, Homo sapiens
caaaggacattatgtgtgc

SEQ ID NO: 545152 - DNA, 20 bp, Homo sapiens
caaaggacattatgtgtgca

SEQ ID NO: 545153 - DNA, 19 bp, Homo sapiens
caaaggctgtattcagcaa

SEQ ID NO: 545154 - DNA, 18 bp, Homo sapiens
caaaggtctttttaaacc

SEQ ID NO: 545155 - DNA, 21 bp, Homo sapiens
caaagtacaggtactttgtct

SEQ ID NO: 545156 - DNA, 15 bp, Homo sapiens
caaagtcatgatgtt

SEQ ID NO: 545157 - DNA, 19 bp, Homo sapiens
caaagtcatgatgttttta

SEQ ID NO: 545158 - DNA, 13 bp, Homo sapiens
caaataacaactt

SEQ ID NO: 545159 - DNA, 14 bp, Homo sapiens
caaataacaacttt

SEQ ID NO: 545160 - DNA, 20 bp, Homo sapiens
caaataaccctgaatcagag

SEQ ID NO: 545161 - DNA, 22 bp, Homo sapiens
caaataacttacaagactgtaa

SEQ ID NO: 545162 - DNA, 13 bp, Homo sapiens
caaatacaaaatg

SEQ ID NO: 545163 - DNA, 14 bp, Homo sapiens
caaatacacataca

SEQ ID NO: 545164 - DNA, 15 bp, Homo sapiens
caaatacacatacat

SEQ ID NO: 545165 - DNA, 17 bp, Homo sapiens
caaatacacatacatat

SEQ ID NO: 545166 - DNA, 21 bp, Homo sapiens
caaatacacatacatatatac

SEQ ID NO: 545167 - DNA, 23 bp, Homo sapiens
caaatagtaggcaagatggcaca

SEQ ID NO: 545168 - DNA, 13 bp, Homo sapiens
caaatattaaaaa

SEQ ID NO: 545169 - DNA, 23 bp, Homo sapiens
caaatattaaaaagtcttttaaa

SEQ ID NO: 545170 - DNA, 22 bp, Homo sapiens
caaatattttgtcactgctgta

SEQ ID NO: 545171 - DNA, 23 bp, Homo sapiens
caaatattttgtcactgctgtaa

SEQ ID NO: 545172 - DNA, 17 bp, Homo sapiens
caaatgagacagcagtc

SEQ ID NO: 545173 - DNA, 22 bp, Homo sapiens
caaatgcttttccaacccatga

SEQ ID NO: 545174 - DNA, 21 bp, Homo sapiens
caaatggagttggagttcatt

SEQ ID NO: 545175 - DNA, 19 bp, Homo sapiens
caaatggattcctgtttca

SEQ ID NO: 545176 - DNA, 18 bp, Homo sapiens
caaatgggtgatatcctg

SEQ ID NO: 545177 - DNA, 22 bp, Homo sapiens
caaatgggtgatatcctgaaaa

SEQ ID NO: 545178 - DNA, 22 bp, Homo sapiens
caaatggtggttgtttcttcca

SEQ ID NO: 545179 - DNA, 22 bp, Homo sapiens
caaatgtaatgtggcttctgga

SEQ ID NO: 545180 - DNA, 19 bp, Homo sapiens
caaatgtgtcttgtattat

SEQ ID NO: 545181 - DNA, 13 bp, Homo sapiens
caaatgtgtgact

SEQ ID NO: 545182 - DNA, 18 bp, Homo sapiens
caaattaatgtgtaaaat

SEQ ID NO: 545183 - DNA, 20 bp, Homo sapiens
caaattaatgtgtaaaattg

SEQ ID NO: 545184 - DNA, 19 bp, Homo sapiens
caaattgtcacctgcttct

SEQ ID NO: 545185 - DNA, 20 bp, Homo sapiens
caaattgtcacctgcttctc

SEQ ID NO: 545186 - DNA, 22 bp, Homo sapiens
caaattgtcttttgtcatgtgg

SEQ ID NO: 545187 - DNA, 17 bp, Homo sapiens
caaattttattaaaaga

SEQ ID NO: 545188 - DNA, 20 bp, Homo sapiens
caaatttttctcagtttgta

SEQ ID NO: 545189 - DNA, 21 bp, Homo sapiens
caacaaactgcacatgatttc

SEQ ID NO: 545190 - DNA, 13 bp, Homo sapiens
caacaaagaaata

SEQ ID NO: 545191 - DNA, 14 bp, Homo sapiens
caacaacatccatg

SEQ ID NO: 545192 - DNA, 20 bp, Homo sapiens
caacaatttagaaggaaaac

SEQ ID NO: 545193 - DNA, 13 bp, Homo sapiens
caacaattttcag

SEQ ID NO: 545194 - DNA, 23 bp, Homo sapiens
caacaattttcagatttgcacaa

SEQ ID NO: 545195 - DNA, 16 bp, Homo sapiens
caacacacctggtgaa

SEQ ID NO: 545196 - DNA, 14 bp, Homo sapiens
caacaccacagaca

SEQ ID NO: 545197 - DNA, 15 bp, Homo sapiens
caacaccacagacac

SEQ ID NO: 545198 - DNA, 16 bp, Homo sapiens
caacaccacagacaca

SEQ ID NO: 545199 - DNA, 17 bp, Homo sapiens
caacaccacagacacac

SEQ ID NO: 545200 - DNA, 15 bp, Homo sapiens
caacagattggattt

SEQ ID NO: 545201 - DNA, 23 bp, Homo sapiens
caacagattggattttatgttga

SEQ ID NO: 545202 - DNA, 14 bp, Homo sapiens
caacagcccaggca

SEQ ID NO: 545203 - DNA, 19 bp, Homo sapiens
caacagctggacaccccct

SEQ ID NO: 545204 - DNA, 13 bp, Homo sapiens
caacataaaatta

SEQ ID NO: 545205 - DNA, 14 bp, Homo sapiens
caacataaaattaa

SEQ ID NO: 545206 - DNA, 16 bp, Homo sapiens
caacataaaattaaaa

SEQ ID NO: 545207 - DNA, 17 bp, Homo sapiens
caacataaaattaaaat

SEQ ID NO: 545208 - DNA, 19 bp, Homo sapiens
caacataaaattaaaattt

SEQ ID NO: 545209 - DNA, 23 bp, Homo sapiens
caacatccatgtcctatgtgtga

SEQ ID NO: 545210 - DNA, 21 bp, Homo sapiens
caacatggtgaaaccccatct

SEQ ID NO: 545211 - DNA, 12 bp, Homo sapiens
caaccaaatggt

SEQ ID NO: 545212 - DNA, 21 bp, Homo sapiens
caaccacgttgggacagggag

SEQ ID NO: 545213 - DNA, 14 bp, Homo sapiens
caacccccagctcc

SEQ ID NO: 545214 - DNA, 18 bp, Homo sapiens
caacccccagctcccgct

SEQ ID NO: 545215 - DNA, 15 bp, Homo sapiens
caaccctgcccagcc

SEQ ID NO: 545216 - DNA, 18 bp, Homo sapiens
caacgtactatggaagcc

SEQ ID NO: 545217 - DNA, 22 bp, Homo sapiens
caacgtactatggaagccacat

SEQ ID NO: 545218 - DNA, 12 bp, Homo sapiens
caacgtggggca

SEQ ID NO: 545219 - DNA, 17 bp, Homo sapiens
caacgtggggcagcaca

SEQ ID NO: 545220 - DNA, 18 bp, Homo sapiens
caacgtggggcagcacag

SEQ ID NO: 545221 - DNA, 16 bp, Homo sapiens
caactaagcagtccct

SEQ ID NO: 545222 - DNA, 16 bp, Homo sapiens
caactcagagcacagc

SEQ ID NO: 545223 - DNA, 17 bp, Homo sapiens
caactcagagcacagcc

SEQ ID NO: 545224 - DNA, 13 bp, Homo sapiens
caactctctctgt

SEQ ID NO: 545225 - DNA, 23 bp, Homo sapiens
caactggatgttgacgtatatat

SEQ ID NO: 545226 - DNA, 23 bp, Homo sapiens
caactgtggtcccagctacaggg

SEQ ID NO: 545227 - DNA, 17 bp, Homo sapiens
caactttcaagaacttg

SEQ ID NO: 545228 - DNA, 17 bp, Homo sapiens
caacttttttttctttt

SEQ ID NO: 545229 - DNA, 20 bp, Homo sapiens
caagaagatagttgtaaaga

SEQ ID NO: 545230 - DNA, 13 bp, Homo sapiens
caagaccatgggg

SEQ ID NO: 545231 - DNA, 20 bp, Homo sapiens
caagaccatggggtggaagg

SEQ ID NO: 545232 - DNA, 12 bp, Homo sapiens
caagacccccag

SEQ ID NO: 545233 - DNA, 21 bp, Homo sapiens
caagactgtaaattccaaaga

SEQ ID NO: 545234 - DNA, 22 bp, Homo sapiens
caagactgtaaattccaaagat

SEQ ID NO: 545235 - DNA, 20 bp, Homo sapiens
caagagagggccatgcaatt

SEQ ID NO: 545236 - DNA, 20 bp, Homo sapiens
caagaggtttggctcctgcc

SEQ ID NO: 545237 - DNA, 16 bp, Homo sapiens
caagatggcacagggc

SEQ ID NO: 545238 - DNA, 23 bp, Homo sapiens
caagatggcacagggcatgaaat

SEQ ID NO: 545239 - DNA, 18 bp, Homo sapiens
caagcagaaaaacaggca

SEQ ID NO: 545240 - DNA, 23 bp, Homo sapiens
caagcagaaaaacaggcacaggc

SEQ ID NO: 545241 - DNA, 14 bp, Homo sapiens
caagcagtttcaat

SEQ ID NO: 545242 - DNA, 20 bp, Homo sapiens
caagcagtttcaataaagtt

SEQ ID NO: 545243 - DNA, 22 bp, Homo sapiens
caagccagcaacacagagcact

SEQ ID NO: 545244 - DNA, 16 bp, Homo sapiens
caagcctcagcaaacc

SEQ ID NO: 545245 - DNA, 17 bp, Homo sapiens
caagctgttgaccaggc

SEQ ID NO: 545246 - DNA, 13 bp, Homo sapiens
caaggaaggacac

SEQ ID NO: 545247 - DNA, 16 bp, Homo sapiens
caaggcctccagccac

SEQ ID NO: 545248 - DNA, 16 bp, Homo sapiens
caaggcttgctgcaga

SEQ ID NO: 545249 - DNA, 23 bp, Homo sapiens
caagggaaaataaaaaaagaaaa

SEQ ID NO: 545250 - DNA, 13 bp, Homo sapiens
caagggctttcct

SEQ ID NO: 545251 - DNA, 18 bp, Homo sapiens
caagggctttcctgtgcc

SEQ ID NO: 545252 - DNA, 20 bp, Homo sapiens
caaggggtcccctccaggag

SEQ ID NO: 545253 - DNA, 20 bp, Homo sapiens
caaggtctgtggctcctccc

SEQ ID NO: 545254 - DNA, 17 bp, Homo sapiens
caaggtgcaggcaggct

SEQ ID NO: 545255 - DNA, 19 bp, Homo sapiens
caaggtgcaggcaggctgg

SEQ ID NO: 545256 - DNA, 13 bp, Homo sapiens
caaggttctgggt

SEQ ID NO: 545257 - DNA, 21 bp, Homo sapiens
caagtatcatctaaatattat

SEQ ID NO: 545258 - DNA, 21 bp, Homo sapiens
caagtggagcctgacagccag

SEQ ID NO: 545259 - DNA, 20 bp, Homo sapiens
caagtggcaaagctgttctt

SEQ ID NO: 545260 - DNA, 16 bp, Homo sapiens
caagttggtcttactt

SEQ ID NO: 545261 - DNA, 20 bp, Homo sapiens
caagttggtcttactttgtt

SEQ ID NO: 545262 - DNA, 15 bp, Homo sapiens
caagtttgaacaggc

SEQ ID NO: 545263 - DNA, 17 bp, Homo sapiens
caagttttgtgaaattt

SEQ ID NO: 545264 - DNA, 20 bp, Homo sapiens
caagttttgtgaaatttttc

SEQ ID NO: 545265 - DNA, 22 bp, Homo sapiens
caagttttgtgaaatttttcat

SEQ ID NO: 545266 - DNA, 16 bp, Homo sapiens
caataaactcagtcaa

SEQ ID NO: 545267 - DNA, 13 bp, Homo sapiens
caataaaggagga

SEQ ID NO: 545268 - DNA, 13 bp, Homo sapiens
caataaagtttga

SEQ ID NO: 545269 - DNA, 16 bp, Homo sapiens
caatatataaaaatat

SEQ ID NO: 545270 - DNA, 17 bp, Homo sapiens
caatatataaaaatata

SEQ ID NO: 545271 - DNA, 21 bp, Homo sapiens
caatatataaaaatatatata

SEQ ID NO: 545272 - DNA, 12 bp, Homo sapiens
caatattctctg

SEQ ID NO: 545273 - DNA, 15 bp, Homo sapiens
caatattctctgtac

SEQ ID NO: 545274 - DNA, 19 bp, Homo sapiens
caatatttgtgtgctaaac

SEQ ID NO: 545275 - DNA, 21 bp, Homo sapiens
caatcaataacagccgctcca

SEQ ID NO: 545276 - DNA, 17 bp, Homo sapiens
caatcagtagcttaaga

SEQ ID NO: 545277 - DNA, 17 bp, Homo sapiens
caatcatgaacagctct

SEQ ID NO: 545278 - DNA, 21 bp, Homo sapiens
caatcatgaacagctctgaga

SEQ ID NO: 545279 - DNA, 15 bp, Homo sapiens
caatcgggagtagca

SEQ ID NO: 545280 - DNA, 16 bp, Homo sapiens
caatcgggagtagcaa

SEQ ID NO: 545281 - DNA, 20 bp, Homo sapiens
caatctctacccctttcttc

SEQ ID NO: 545282 - DNA, 20 bp, Homo sapiens
catggagtagagtcaggaga

SEQ ID NO: 545283 - DNA, 17 bp, Homo sapiens
catggatacttcctggg

SEQ ID NO: 545284 - DNA, 19 bp, Homo sapiens
catggcacataccaaagct

SEQ ID NO: 545285 - DNA, 15 bp, Homo sapiens
catggcatccaagac

SEQ ID NO: 545286 - DNA, 16 bp, Homo sapiens
catggctcctcaccac

SEQ ID NO: 545287 - DNA, 13 bp, Homo sapiens
catggcttctgaa

SEQ ID NO: 545288 - DNA, 20 bp, Homo sapiens
catgggagtcagggagccct

SEQ ID NO: 545289 - DNA, 16 bp, Homo sapiens
catgggggaacaatga

SEQ ID NO: 545290 - DNA, 15 bp, Homo sapiens
catggggtggaagga

SEQ ID NO: 545291 - DNA, 14 bp, Homo sapiens
catggtatctcttt

SEQ ID NO: 545292 - DNA, 16 bp, Homo sapiens
catgtacaaaaacaca

SEQ ID NO: 545293 - DNA, 18 bp, Homo sapiens
catgtacaaaaacacaaa

SEQ ID NO: 545294 - DNA, 13 bp, Homo sapiens
catgtatttcttt

SEQ ID NO: 545295 - DNA, 17 bp, Homo sapiens
catgtatttctttagaa

SEQ ID NO: 545296 - DNA, 14 bp, Homo sapiens
catgtcctatgtgt

SEQ ID NO: 545297 - DNA, 18 bp, Homo sapiens
catgtgagctgctgccat

SEQ ID NO: 545298 - DNA, 20 bp, Homo sapiens
catgtggcctaatattgaaa

SEQ ID NO: 545299 - DNA, 11 bp, Homo sapiens
catgtgtgtat

SEQ ID NO: 545300 - DNA, 13 bp, Homo sapiens
catgtgtgtatat

SEQ ID NO: 545301 - DNA, 17 bp, Homo sapiens
catgtgtgtatatatgt

SEQ ID NO: 545302 - DNA, 20 bp, Homo sapiens
catgtgtgtatatatgtgta

SEQ ID NO: 545303 - DNA, 13 bp, Homo sapiens
catgttttcaaat

SEQ ID NO: 545304 - DNA, 13 bp, Homo sapiens
cattaaactaatt

SEQ ID NO: 545305 - DNA, 13 bp, Homo sapiens
cattaatgtgttg

SEQ ID NO: 545306 - DNA, 14 bp, Homo sapiens
cattaatgttgatt

SEQ ID NO: 545307 - DNA, 15 bp, Homo sapiens
cattacctgtagctt

SEQ ID NO: 545308 - DNA, 15 bp, Homo sapiens
cattactgtcccctt

SEQ ID NO: 545309 - DNA, 18 bp, Homo sapiens
cattagcaaaaaaagttg

SEQ ID NO: 545310 - DNA, 14 bp, Homo sapiens
cattagtactttat

SEQ ID NO: 545311 - DNA, 22 bp, Homo sapiens
cattagtactttatagaagaat

SEQ ID NO: 545312 - DNA, 11 bp, Homo sapiens
cattatgtgtg

SEQ ID NO: 545313 - DNA, 12 bp, Homo sapiens
cattatgtgtgc

SEQ ID NO: 545314 - DNA, 18 bp, Homo sapiens
cattatgtgtgcatgtgt

SEQ ID NO: 545315 - DNA, 23 bp, Homo sapiens
cattatgtgtgcatgtgtgtata

SEQ ID NO: 545316 - DNA, 17 bp, Homo sapiens
cattcattcatcctctt

SEQ ID NO: 545317 - DNA, 15 bp, Homo sapiens
cattctcagtttttc

SEQ ID NO: 545318 - DNA, 19 bp, Homo sapiens
cattctcagtttttcttaa

SEQ ID NO: 545319 - DNA, 12 bp, Homo sapiens
cattctctctcc

SEQ ID NO: 545320 - DNA, 17 bp, Homo sapiens
cattctggcactttaat

SEQ ID NO: 545321 - DNA, 19 bp, Homo sapiens
cattctggcactttaatga

SEQ ID NO: 545322 - DNA, 14 bp, Homo sapiens
cattgaaactgtat

SEQ ID NO: 545323 - DNA, 15 bp, Homo sapiens
cattgaaactgtatt

SEQ ID NO: 545324 - DNA, 16 bp, Homo sapiens
cattgaaactgtattt

SEQ ID NO: 545325 - DNA, 16 bp, Homo sapiens
cattgaagagagagct

SEQ ID NO: 545326 - DNA, 14 bp, Homo sapiens
cattgcccacacct

SEQ ID NO: 545327 - DNA, 20 bp, Homo sapiens
cattgcccacacctgcctct

SEQ ID NO: 545328 - DNA, 22 bp, Homo sapiens
cattgcccacacctgcctctga

SEQ ID NO: 545329 - DNA, 23 bp, Homo sapiens
cattgccccaaatggattcctgt

SEQ ID NO: 545330 - DNA, 22 bp, Homo sapiens
cattggaagcaggttaaatgtt

SEQ ID NO: 545331 - DNA, 13 bp, Homo sapiens
cattgtatttaaa

SEQ ID NO: 545332 - DNA, 14 bp, Homo sapiens
cattgtatttaaaa

SEQ ID NO: 545333 - DNA, 21 bp, Homo sapiens
cattgtatttaaaacatttca

SEQ ID NO: 545334 - DNA, 15 bp, Homo sapiens
cattgtccagagctg

SEQ ID NO: 545335 - DNA, 14 bp, Homo sapiens
cattgtgttttctt

SEQ ID NO: 545336 - DNA, 20 bp, Homo sapiens
cattgttcagaaaagcacct

SEQ ID NO: 545337 - DNA, 22 bp, Homo sapiens
cattgttcagaaaagcacctct

SEQ ID NO: 545338 - DNA, 21 bp, Homo sapiens
catttaacactgagtgaaata

SEQ ID NO: 545339 - DNA, 17 bp, Homo sapiens
catttaagttgtaaacg

SEQ ID NO: 545340 - DNA, 22 bp, Homo sapiens
catttagcacagtatttaacat

SEQ ID NO: 545341 - DNA, 21 bp, Homo sapiens
catttatgcaatttacttgga

SEQ ID NO: 545342 - DNA, 19 bp, Homo sapiens
catttatggtaatcatatt

SEQ ID NO: 545343 - DNA, 22 bp, Homo sapiens
catttatggtaatcatattaga

SEQ ID NO: 545344 - DNA, 13 bp, Homo sapiens
catttatgtgtga

SEQ ID NO: 545345 - DNA, 12 bp, Homo sapiens
catttcacatta

SEQ ID NO: 545346 - DNA, 19 bp, Homo sapiens
catttcatgtatttcttta

SEQ ID NO: 545347 - DNA, 20 bp, Homo sapiens
catttcatgtatttctttag

SEQ ID NO: 545348 - DNA, 16 bp, Homo sapiens
catttcatgtcctgtg

SEQ ID NO: 545349 - DNA, 19 bp, Homo sapiens
catttccgtaattcttatt

SEQ ID NO: 545350 - DNA, 14 bp, Homo sapiens
catttctaaaagaa

SEQ ID NO: 545351 - DNA, 22 bp, Homo sapiens
catttctaaaagaatattcaga

SEQ ID NO: 545352 - DNA, 13 bp, Homo sapiens
catttctctttca

SEQ ID NO: 545353 - DNA, 24 bp, Homo sapiens
catttctgccttttgttcatttca

SEQ ID NO: 545354 - DNA, 15 bp, Homo sapiens
catttgctttttgct

SEQ ID NO: 545355 - DNA, 18 bp, Homo sapiens
catttgctttttgcttgt

SEQ ID NO: 545356 - DNA, 14 bp, Homo sapiens
catttggggtgggg

SEQ ID NO: 545357 - DNA, 19 bp, Homo sapiens
catttggtacacacttgac

SEQ ID NO: 545358 - DNA, 20 bp, Homo sapiens
catttgtcattttcattagc

SEQ ID NO: 545359 - DNA, 16 bp, Homo sapiens
cattttacacttgctt

SEQ ID NO: 545360 - DNA, 16 bp, Homo sapiens
cattttagctaattta

SEQ ID NO: 545361 - DNA, 12 bp, Homo sapiens
cattttcatgtg

SEQ ID NO: 545362 - DNA, 15 bp, Homo sapiens
cattttcattagcaa

SEQ ID NO: 545363 - DNA, 17 bp, Homo sapiens
cattttctgaaactaat

SEQ ID NO: 545364 - DNA, 13 bp, Homo sapiens
cattttctttaca

SEQ ID NO: 545365 - DNA, 13 bp, Homo sapiens
catttttcctaac

SEQ ID NO: 545366 - DNA, 18 bp, Homo sapiens
catttttcctaacaggat

SEQ ID NO: 545367 - DNA, 18 bp, Homo sapiens
catttttgatcaaatgta

SEQ ID NO: 545368 - DNA, 13 bp, Homo sapiens
ccaaaaaagaaag

SEQ ID NO: 545369 - DNA, 11 bp, Homo sapiens
ccaaaactgct

SEQ ID NO: 545370 - DNA, 15 bp, Homo sapiens
ccaaacattaatgtt

SEQ ID NO: 545371 - DNA, 21 bp, Homo sapiens
ccaaacattaatgttgatttc

SEQ ID NO: 545372 - DNA, 18 bp, Homo sapiens
ccaaactcttccctctct

SEQ ID NO: 545373 - DNA, 15 bp, Homo sapiens
ccaaagacaaatagt

SEQ ID NO: 545374 - DNA, 21 bp, Homo sapiens
ccaaagatgttaacagtattt

SEQ ID NO: 545375 - DNA, 13 bp, Homo sapiens
ccaaagcacatgc

SEQ ID NO: 545376 - DNA, 22 bp, Homo sapiens
ccaaagcacatgcttagcttat

SEQ ID NO: 545377 - DNA, 18 bp, Homo sapiens
ccaaagctgctgcacagc

SEQ ID NO: 545378 - DNA, 19 bp, Homo sapiens
ccaaagctgctgcacagct

SEQ ID NO: 545379 - DNA, 21 bp, Homo sapiens
ccaacaagaataaaggcagct

SEQ ID NO: 545380 - DNA, 14 bp, Homo sapiens
ccaacaccacagac

SEQ ID NO: 545381 - DNA, 17 bp, Homo sapiens
ccaacaggggctccatg

SEQ ID NO: 545382 - DNA, 11 bp, Homo sapiens
ccaacccatga

SEQ ID NO: 545383 - DNA, 21 bp, Homo sapiens
ccaacctcccctggtcctgca

SEQ ID NO: 545384 - DNA, 19 bp, Homo sapiens
ccaacgatcatatctgtat

SEQ ID NO: 545385 - DNA, 16 bp, Homo sapiens
ccaacgtggggcagca

SEQ ID NO: 545386 - DNA, 19 bp, Homo sapiens
ccaactcagagcacagcca

SEQ ID NO: 545387 - DNA, 18 bp, Homo sapiens
ccaactctctctgtgtcc

SEQ ID NO: 545388 - DNA, 21 bp, Homo sapiens
ccaacttagtgtctctattta

SEQ ID NO: 545389 - DNA, 16 bp, Homo sapiens
ccaagactccagccct

SEQ ID NO: 545390 - DNA, 20 bp, Homo sapiens
ccaagagagggccatgcaat

SEQ ID NO: 545391 - DNA, 21 bp, Homo sapiens
ccaagaggtttggctcctgcc

SEQ ID NO: 545392 - DNA, 22 bp, Homo sapiens
ccaagaggtttggctcctgccc

SEQ ID NO: 545393 - DNA, 13 bp, Homo sapiens
ccaagcaggaggc

SEQ ID NO: 545394 - DNA, 14 bp, Homo sapiens
ccaagcaggaggct

SEQ ID NO: 545395 - DNA, 11 bp, Homo sapiens
ccaagcccagc

SEQ ID NO: 545396 - DNA, 14 bp, Homo sapiens
ccaaggaacaagac

SEQ ID NO: 545397 - DNA, 12 bp, Homo sapiens
ccaagggcccag

SEQ ID NO: 545398 - DNA, 13 bp, Homo sapiens
ccaagggcccaga

SEQ ID NO: 545399 - DNA, 23 bp, Homo sapiens
ccaagtggagcctgacagccaga

SEQ ID NO: 545400 - DNA, 17 bp, Homo sapiens
ccaagttatgcatcccc

SEQ ID NO: 545401 - DNA, 23 bp, Homo sapiens
ccaagttggtcttactttgttaa

SEQ ID NO: 545402 - DNA, 21 bp, Homo sapiens
ccaatcgggagtagcaaggaa

SEQ ID NO: 545403 - DNA, 20 bp, Homo sapiens
ccaatctctacccctttctt

SEQ ID NO: 545404 - DNA, 23 bp, Homo sapiens
ccaatctctacccctttcttctc

SEQ ID NO: 545405 - DNA, 17 bp, Homo sapiens
ccaattcactttagagt

SEQ ID NO: 545406 - DNA, 12 bp, Homo sapiens
ccaatttcttcc

SEQ ID NO: 545407 - DNA, 13 bp, Homo sapiens
ccaatttcttcct

SEQ ID NO: 545408 - DNA, 17 bp, Homo sapiens
ccaatttcttccttcca

SEQ ID NO: 545409 - DNA, 18 bp, Homo sapiens
ccaatttgttctgtgcaa

SEQ ID NO: 545410 - DNA, 21 bp, Homo sapiens
ccaattttaacttagagcttt

SEQ ID NO: 545411 - DNA, 20 bp, Homo sapiens
ccacaagggtgcccacctct

SEQ ID NO: 545412 - DNA, 14 bp, Homo sapiens
ccacaccagcccca

SEQ ID NO: 545413 - DNA, 17 bp, Homo sapiens
ccacaccctacagcaga

SEQ ID NO: 545414 - DNA, 17 bp, Homo sapiens
ccacacgtttgccaaat

SEQ ID NO: 545415 - DNA, 11 bp, Homo sapiens
ccacagacaca

SEQ ID NO: 545416 - DNA, 21 bp, Homo sapiens
ccacagacacacacacgcacg

SEQ ID NO: 545417 - DNA, 16 bp, Homo sapiens
ccacagacactcctgg

SEQ ID NO: 545418 - DNA, 16 bp, Homo sapiens
ccacagctccttttcc

SEQ ID NO: 545419 - DNA, 18 bp, Homo sapiens
ccacaggcatgtcccatg

SEQ ID NO: 545420 - DNA, 18 bp, Homo sapiens
ccacagttatcttagctg

SEQ ID NO: 545421 - DNA, 12 bp, Homo sapiens
ccacatccacag

SEQ ID NO: 545422 - DNA, 13 bp, Homo sapiens
ccacattctgctg

SEQ ID NO: 545423 - DNA, 16 bp, Homo sapiens
ccacattctgctgccc

SEQ ID NO: 545424 - DNA, 17 bp, Homo sapiens
ccacattctgctgcccc

SEQ ID NO: 545425 - DNA, 23 bp, Homo sapiens
atttcatgtcctgtgtcagttta

SEQ ID NO: 545426 - DNA, 19 bp, Homo sapiens
atttccaacaccacagaca

SEQ ID NO: 545427 - DNA, 22 bp, Homo sapiens
atttccaacaccacagacacac

SEQ ID NO: 545428 - DNA, 18 bp, Homo sapiens
atttccatgtatgcataa

SEQ ID NO: 545429 - DNA, 12 bp, Homo sapiens
atttcccttctt

SEQ ID NO: 545430 - DNA, 18 bp, Homo sapiens
atttcccttcttctgtca

SEQ ID NO: 545431 - DNA, 15 bp, Homo sapiens
atttcctataccatt

SEQ ID NO: 545432 - DNA, 14 bp, Homo sapiens
atttcctgctcctc

SEQ ID NO: 545433 - DNA, 21 bp, Homo sapiens
atttcctgtacaatcatgaac

SEQ ID NO: 545434 - DNA, 22 bp, Homo sapiens
atttcctgtacaatcatgaaca

SEQ ID NO: 545435 - DNA, 12 bp, Homo sapiens
atttccttgtct

SEQ ID NO: 545436 - DNA, 17 bp, Homo sapiens
atttcctttttctattt

SEQ ID NO: 545437 - DNA, 16 bp, Homo sapiens
atttcgaagtttgcaa

SEQ ID NO: 545438 - DNA, 20 bp, Homo sapiens
atttcgaagtttgcaacctt

SEQ ID NO: 545439 - DNA, 21 bp, Homo sapiens
atttcggaccgaaggtgacag

SEQ ID NO: 545440 - DNA, 12 bp, Homo sapiens
atttctaaaaga

SEQ ID NO: 545441 - DNA, 18 bp, Homo sapiens
atttctaactctgatgta

SEQ ID NO: 545442 - DNA, 19 bp, Homo sapiens
atttctaactctgatgtaa

SEQ ID NO: 545443 - DNA, 20 bp, Homo sapiens
atttctaactctgatgtaaa

SEQ ID NO: 545444 - DNA, 22 bp, Homo sapiens
atttctaactctgatgtaaatg

SEQ ID NO: 545445 - DNA, 12 bp, Homo sapiens
atttctaagtgt

SEQ ID NO: 545446 - DNA, 12 bp, Homo sapiens
atttctcctttt

SEQ ID NO: 545447 - DNA, 15 bp, Homo sapiens
atttctctttcaaaa

SEQ ID NO: 545448 - DNA, 11 bp, Homo sapiens
atttctgaaca

SEQ ID NO: 545449 - DNA, 17 bp, Homo sapiens
atttctggcaaatattt

SEQ ID NO: 545450 - DNA, 16 bp, Homo sapiens
atttctgtatctgaca

SEQ ID NO: 545451 - DNA, 18 bp, Homo sapiens
atttcttctctctgtgct

SEQ ID NO: 545452 - DNA, 13 bp, Homo sapiens
atttctttagaac

SEQ ID NO: 545453 - DNA, 17 bp, Homo sapiens
atttgaaacattgcttt

SEQ ID NO: 545454 - DNA, 19 bp, Homo sapiens
atttgaaacattgctttta

SEQ ID NO: 545455 - DNA, 20 bp, Homo sapiens
atttgaaacattgcttttaa

SEQ ID NO: 545456 - DNA, 18 bp, Homo sapiens
atttgactttctgtctgt

SEQ ID NO: 545457 - DNA, 16 bp, Homo sapiens
atttgcaacagcaaat

SEQ ID NO: 545458 - DNA, 23 bp, Homo sapiens
atttgcaacagcaaattaatgtg

SEQ ID NO: 545459 - DNA, 19 bp, Homo sapiens
atttgcataatatgcatat

SEQ ID NO: 545460 - DNA, 21 bp, Homo sapiens
atttgcataatatgcatatat

SEQ ID NO: 545461 - DNA, 15 bp, Homo sapiens
atttgctcataagta

SEQ ID NO: 545462 - DNA, 21 bp, Homo sapiens
atttgctcataagtaaatgtc

SEQ ID NO: 545463 - DNA, 15 bp, Homo sapiens
atttgctgcatttca

SEQ ID NO: 545464 - DNA, 16 bp, Homo sapiens
atttgtcactgcttca

SEQ ID NO: 545465 - DNA, 14 bp, Homo sapiens
atttgtcattttca

SEQ ID NO: 545466 - DNA, 16 bp, Homo sapiens
atttgtctttggaaaa

SEQ ID NO: 545467 - DNA, 14 bp, Homo sapiens
atttgtgctgggtt

SEQ ID NO: 545468 - DNA, 12 bp, Homo sapiens
atttgtgtaact

SEQ ID NO: 545469 - DNA, 15 bp, Homo sapiens
atttgtgtaactgaa

SEQ ID NO: 545470 - DNA, 21 bp, Homo sapiens
atttgtgtcagcatgtctcag

SEQ ID NO: 545471 - DNA, 22 bp, Homo sapiens
atttgttaatttcttgcaattt

SEQ ID NO: 545472 - DNA, 23 bp, Homo sapiens
atttgtttggttatagtgcaata

SEQ ID NO: 545473 - DNA, 13 bp, Homo sapiens
attttaacttaga

SEQ ID NO: 545474 - DNA, 17 bp, Homo sapiens
attttacacttgcttta

SEQ ID NO: 545475 - DNA, 14 bp, Homo sapiens
attttactgtctta

SEQ ID NO: 545476 - DNA, 22 bp, Homo sapiens
attttagtggaccctgaaatgt

SEQ ID NO: 545477 - DNA, 20 bp, Homo sapiens
attttagttttattttctaa

SEQ ID NO: 545478 - DNA, 13 bp, Homo sapiens
attttatctcttc

SEQ ID NO: 545479 - DNA, 14 bp, Homo sapiens
attttatctcttct

SEQ ID NO: 545480 - DNA, 14 bp, Homo sapiens
attttatgtatgtt

SEQ ID NO: 545481 - DNA, 15 bp, Homo sapiens
attttatgttgacat

SEQ ID NO: 545482 - DNA, 20 bp, Homo sapiens
attttatgttgacatttgtt

SEQ ID NO: 545483 - DNA, 22 bp, Homo sapiens
attttatgttgacatttgtttg

SEQ ID NO: 545484 - DNA, 13 bp, Homo sapiens
attttatgtttaa

SEQ ID NO: 545485 - DNA, 22 bp, Homo sapiens
attttatgtttaaaatggcatt

SEQ ID NO: 545486 - DNA, 15 bp, Homo sapiens
attttattgaatata

SEQ ID NO: 545487 - DNA, 15 bp, Homo sapiens
attttcaaagagatg

SEQ ID NO: 545488 - DNA, 16 bp, Homo sapiens
attttcaaagagatgg

SEQ ID NO: 545489 - DNA, 14 bp, Homo sapiens
attttcaaatatgt

SEQ ID NO: 545490 - DNA, 17 bp, Homo sapiens
attttcaaatatgtaaa

SEQ ID NO: 545491 - DNA, 18 bp, Homo sapiens
attttcaaatatgtaaac

SEQ ID NO: 545492 - DNA, 22 bp, Homo sapiens
attttcaaatatgtaaacttta

SEQ ID NO: 545493 - DNA, 14 bp, Homo sapiens
attttcagatttgc

SEQ ID NO: 545494 - DNA, 15 bp, Homo sapiens
attttcagatttgca

SEQ ID NO: 545495 - DNA, 17 bp, Homo sapiens
attttcagatttgcaca

SEQ ID NO: 545496 - DNA, 18 bp, Homo sapiens
attttcagatttgcacaa

SEQ ID NO: 545497 - DNA, 15 bp, Homo sapiens
attttcattacaatg

SEQ ID NO: 545498 - DNA, 14 bp, Homo sapiens
attttcatttctaa

SEQ ID NO: 545499 - DNA, 17 bp, Homo sapiens
attttcattttacagtt

SEQ ID NO: 545500 - DNA, 23 bp, Homo sapiens
attttccttcctgttctgtgtct

SEQ ID NO: 545501 - DNA, 18 bp, Homo sapiens
attttcctttatgtgatg

SEQ ID NO: 545502 - DNA, 15 bp, Homo sapiens
attttctaaagtact

SEQ ID NO: 545503 - DNA, 16 bp, Homo sapiens
attttctaaagtactg

SEQ ID NO: 545504 - DNA, 22 bp, Homo sapiens
attttctgaaactaatgaaagc

SEQ ID NO: 545505 - DNA, 23 bp, Homo sapiens
attttctggggctcctcacatag

SEQ ID NO: 545506 - DNA, 19 bp, Homo sapiens
attttgaaaggagaaaaaa

SEQ ID NO: 545507 - DNA, 14 bp, Homo sapiens
attttgatcagtgt

SEQ ID NO: 545508 - DNA, 15 bp, Homo sapiens
attttgatcagtgtt

SEQ ID NO: 545509 - DNA, 20 bp, Homo sapiens
attttgcctgttaaatcgta

SEQ ID NO: 545510 - DNA, 18 bp, Homo sapiens
attttggagagataggaa

SEQ ID NO: 545511 - DNA, 13 bp, Homo sapiens
attttgtacattt

SEQ ID NO: 545512 - DNA, 20 bp, Homo sapiens
attttgtacatttttgatca

SEQ ID NO: 545513 - DNA, 13 bp, Homo sapiens
attttgtcactgc

SEQ ID NO: 545514 - DNA, 18 bp, Homo sapiens
attttgtgagtttgtttc

SEQ ID NO: 545515 - DNA, 20 bp, Homo sapiens
atttttaagtgtcagactat

SEQ ID NO: 545516 - DNA, 18 bp, Homo sapiens
atttttattacccttctt

SEQ ID NO: 545517 - DNA, 13 bp, Homo sapiens
atttttatttcta

SEQ ID NO: 545518 - DNA, 15 bp, Homo sapiens
atttttgatcaaatg

SEQ ID NO: 545519 - DNA, 17 bp, Homo sapiens
atttttgatcaaatgta

SEQ ID NO: 545520 - DNA, 14 bp, Homo sapiens
attttttgtctgtg

SEQ ID NO: 545521 - DNA, 21 bp, Homo sapiens
attttttgtctgtgataacag

SEQ ID NO: 545522 - DNA, 19 bp, Homo sapiens
atttttttaagcaacactt

SEQ ID NO: 545523 - DNA, 22 bp, Homo sapiens
atttttttccttacataaacat

SEQ ID NO: 545524 - DNA, 24 bp, Homo sapiens
attttttttcttccaacatgtgat

SEQ ID NO: 545525 - DNA, 12 bp, Homo sapiens
caaaaaagaaag

SEQ ID NO: 545526 - DNA, 15 bp, Homo sapiens
caaaaacacaaatac

SEQ ID NO: 545527 - DNA, 18 bp, Homo sapiens
caaaaagataccttaaaa

SEQ ID NO: 545528 - DNA, 19 bp, Homo sapiens
caaaaagataccttaaaat

SEQ ID NO: 545529 - DNA, 19 bp, Homo sapiens
caaaagcctcagaaaggga

SEQ ID NO: 545530 - DNA, 13 bp, Homo sapiens
caaaagcttccct

SEQ ID NO: 545531 - DNA, 20 bp, Homo sapiens
caaaagcttccctccctgct

SEQ ID NO: 545532 - DNA, 21 bp, Homo sapiens
caaaaggatgatttaacatta

SEQ ID NO: 545533 - DNA, 15 bp, Homo sapiens
caaaaggcttgcaga

SEQ ID NO: 545534 - DNA, 16 bp, Homo sapiens
caaaataaaaccagaa

SEQ ID NO: 545535 - DNA, 17 bp, Homo sapiens
caaaataaagtctgtca

SEQ ID NO: 545536 - DNA, 13 bp, Homo sapiens
caaaatatttgtg

SEQ ID NO: 545537 - DNA, 14 bp, Homo sapiens
caaaatatttgtga

SEQ ID NO: 545538 - DNA, 17 bp, Homo sapiens
caaaatatttgtgaaag

SEQ ID NO: 545539 - DNA, 12 bp, Homo sapiens
caaaatgtaact

SEQ ID NO: 545540 - DNA, 16 bp, Homo sapiens
caaaatgtaactgtta

SEQ ID NO: 545541 - DNA, 19 bp, Homo sapiens
caaaatgtaactgttacca

SEQ ID NO: 545542 - DNA, 16 bp, Homo sapiens
caaacatagacagatg

SEQ ID NO: 545543 - DNA, 21 bp, Homo sapiens
caaacatctggaaaataaaag

SEQ ID NO: 545544 - DNA, 20 bp, Homo sapiens
caaacatggatacttcctgg

SEQ ID NO: 545545 - DNA, 22 bp, Homo sapiens
caaacatggatacttcctgggt

SEQ ID NO: 545546 - DNA, 15 bp, Homo sapiens
caaacattaatgttg

SEQ ID NO: 545547 - DNA, 18 bp, Homo sapiens
caaacattaatgttgatt

SEQ ID NO: 545548 - DNA, 20 bp, Homo sapiens
caaacattaatgttgatttc

SEQ ID NO: 545549 - DNA, 17 bp, Homo sapiens
caaacattagtacttta

SEQ ID NO: 545550 - DNA, 17 bp, Homo sapiens
caaaccaatttcttcct

SEQ ID NO: 545551 - DNA, 19 bp, Homo sapiens
caaaccaatttcttccttc

SEQ ID NO: 545552 - DNA, 18 bp, Homo sapiens
caaaccaatttgttctgt

SEQ ID NO: 545553 - DNA, 15 bp, Homo sapiens
caaacccaaagatgt

SEQ ID NO: 545554 - DNA, 20 bp, Homo sapiens
caaacccaaagatgttaaca

SEQ ID NO: 545555 - DNA, 17 bp, Homo sapiens
caaaccctttaaatggg

SEQ ID NO: 545556 - DNA, 13 bp, Homo sapiens
caaacctggagat

SEQ ID NO: 545557 - DNA, 12 bp, Homo sapiens
caaacctttccc

SEQ ID NO: 545558 - DNA, 14 bp, Homo sapiens
caaactgcacatga

SEQ ID NO: 545559 - DNA, 22 bp, Homo sapiens
caaactgcacatgatttcacaa

SEQ ID NO: 545560 - DNA, 14 bp, Homo sapiens
caaacttaacagat

SEQ ID NO: 545561 - DNA, 20 bp, Homo sapiens
caaacttcagaaacccggct

SEQ ID NO: 545562 - DNA, 15 bp, Homo sapiens
caaagacaaatagta

SEQ ID NO: 545563 - DNA, 23 bp, Homo sapiens
caaagaggcagttgcccagcctc

SEQ ID NO: 545564 - DNA, 18 bp, Homo sapiens
caaagagtagaactttaa

SEQ ID NO: 545565 - DNA, 16 bp, Homo sapiens
caaagatcaaaataaa

SEQ ID NO: 545566 - DNA, 17 bp, Homo sapiens
caaagatcaaaataaaa

SEQ ID NO: 545567 - DNA, 18 bp, Homo sapiens
caatctttagaaaaggca

SEQ ID NO: 545568 - DNA, 20 bp, Homo sapiens
caatgattattttcattaca

SEQ ID NO: 545569 - DNA, 13 bp, Homo sapiens
caatgcagaactc

SEQ ID NO: 545570 - DNA, 20 bp, Homo sapiens
caatgctacaaaatgtgtgc

SEQ ID NO: 545571 - DNA, 22 bp, Homo sapiens
caatgtgtgccgagcccttgcc

SEQ ID NO: 545572 - DNA, 15 bp, Homo sapiens
caatgtttgatgtcc

SEQ ID NO: 545573 - DNA, 17 bp, Homo sapiens
caattactttagaaaat

SEQ ID NO: 545574 - DNA, 22 bp, Homo sapiens
caattataaactcattttgctt

SEQ ID NO: 545575 - DNA, 18 bp, Homo sapiens
caattcatagaataacaa

SEQ ID NO: 545576 - DNA, 19 bp, Homo sapiens
caattccagggaaccagag

SEQ ID NO: 545577 - DNA, 14 bp, Homo sapiens
caattccatcaccc

SEQ ID NO: 545578 - DNA, 15 bp, Homo sapiens
caattctaatggtaa

SEQ ID NO: 545579 - DNA, 17 bp, Homo sapiens
caattctaatggtaact

SEQ ID NO: 545580 - DNA, 22 bp, Homo sapiens
caattctaatggtaacttttgt

SEQ ID NO: 545581 - DNA, 23 bp, Homo sapiens
caattctaatggtaacttttgta

SEQ ID NO: 545582 - DNA, 12 bp, Homo sapiens
caattgtatata

SEQ ID NO: 545583 - DNA, 19 bp, Homo sapiens
caattgtatatatatgtga

SEQ ID NO: 545584 - DNA, 22 bp, Homo sapiens
caattgtatatatatgtgaact

SEQ ID NO: 545585 - DNA, 13 bp, Homo sapiens
caatttcttcctt

SEQ ID NO: 545586 - DNA, 15 bp, Homo sapiens
caatttcttccttcc

SEQ ID NO: 545587 - DNA, 11 bp, Homo sapiens
caatttgaagg

SEQ ID NO: 545588 - DNA, 13 bp, Homo sapiens
caatttgtctttg

SEQ ID NO: 545589 - DNA, 16 bp, Homo sapiens
caatttgtctttggaa

SEQ ID NO: 545590 - DNA, 12 bp, Homo sapiens
caatttgttctg

SEQ ID NO: 545591 - DNA, 22 bp, Homo sapiens
caattttaacttagagcttttt

SEQ ID NO: 545592 - DNA, 22 bp, Homo sapiens
caattttataaggacttcctga

SEQ ID NO: 545593 - DNA, 12 bp, Homo sapiens
caattttcagat

SEQ ID NO: 545594 - DNA, 16 bp, Homo sapiens
caattttcagatttgc

SEQ ID NO: 545595 - DNA, 16 bp, Homo sapiens
cacaaaaaatttaaga

SEQ ID NO: 545596 - DNA, 18 bp, Homo sapiens
cacaaacaaacaagctag

SEQ ID NO: 545597 - DNA, 13 bp, Homo sapiens
cacaaacatagac

SEQ ID NO: 545598 - DNA, 18 bp, Homo sapiens
cacaaacatagacagatg

SEQ ID NO: 545599 - DNA, 13 bp, Homo sapiens
cacaaatattaaa

SEQ ID NO: 545600 - DNA, 14 bp, Homo sapiens
cacaaatattaaaa

SEQ ID NO: 545601 - DNA, 14 bp, Homo sapiens
cacaacccccagct

SEQ ID NO: 545602 - DNA, 18 bp, Homo sapiens
cacaacccccagctcccg

SEQ ID NO: 545603 - DNA, 18 bp, Homo sapiens
cacaacctcctcctccag

SEQ ID NO: 545604 - DNA, 13 bp, Homo sapiens
cacaatcagacca

SEQ ID NO: 545605 - DNA, 17 bp, Homo sapiens
cacaatcagaccaagga

SEQ ID NO: 545606 - DNA, 22 bp, Homo sapiens
cacacaagcagacacacacata

SEQ ID NO: 545607 - DNA, 14 bp, Homo sapiens
cacacaatcagacc

SEQ ID NO: 545608 - DNA, 15 bp, Homo sapiens
cacacaatcagacca

SEQ ID NO: 545609 - DNA, 14 bp, Homo sapiens
cacacacaaaaaaa

SEQ ID NO: 545610 - DNA, 13 bp, Homo sapiens
cacacacacaaaa

SEQ ID NO: 545611 - DNA, 16 bp, Homo sapiens
cacacacacacacaca

SEQ ID NO: 545612 - DNA, 16 bp, Homo sapiens
cacacacacacacata

SEQ ID NO: 545613 - DNA, 13 bp, Homo sapiens
cacacacacacgc

SEQ ID NO: 545614 - DNA, 13 bp, Homo sapiens
cacacacacatat

SEQ ID NO: 545615 - DNA, 14 bp, Homo sapiens
cacacacacgcaga

SEQ ID NO: 545616 - DNA, 13 bp, Homo sapiens
cacacacagacac

SEQ ID NO: 545617 - DNA, 13 bp, Homo sapiens
cacacaccccaat

SEQ ID NO: 545618 - DNA, 14 bp, Homo sapiens
cacacacgcacgca

SEQ ID NO: 545619 - DNA, 17 bp, Homo sapiens
cacacacgcacgcacac

SEQ ID NO: 545620 - DNA, 18 bp, Homo sapiens
cacacacgcacgcacaca

SEQ ID NO: 545621 - DNA, 18 bp, Homo sapiens
cacacacgcagacacaca

SEQ ID NO: 545622 - DNA, 19 bp, Homo sapiens
cacacacgcagacacacac

SEQ ID NO: 545623 - DNA, 20 bp, Homo sapiens
cacacacgcagacacacaca

SEQ ID NO: 545624 - DNA, 12 bp, Homo sapiens
cacacagaaata

SEQ ID NO: 545625 - DNA, 21 bp, Homo sapiens
cacacagaaatatatatacat

SEQ ID NO: 545626 - DNA, 22 bp, Homo sapiens
cacacagaaatatatatacata

SEQ ID NO: 545627 - DNA, 15 bp, Homo sapiens
cacacagctgcagag

SEQ ID NO: 545628 - DNA, 17 bp, Homo sapiens
cacacaggcccatgccc

SEQ ID NO: 545629 - DNA, 19 bp, Homo sapiens
cacacatatatacatacgc

SEQ ID NO: 545630 - DNA, 14 bp, Homo sapiens
cacacatcatctgt

SEQ ID NO: 545631 - DNA, 15 bp, Homo sapiens
cacacctgcctctga

SEQ ID NO: 545632 - DNA, 19 bp, Homo sapiens
cacacctggccctggggcc

SEQ ID NO: 545633 - DNA, 15 bp, Homo sapiens
cacacgcacgcacac

SEQ ID NO: 545634 - DNA, 19 bp, Homo sapiens
cacacgcacgcacacacac

SEQ ID NO: 545635 - DNA, 21 bp, Homo sapiens
cacacgcacgcacacacacaa

SEQ ID NO: 545636 - DNA, 14 bp, Homo sapiens
cacacgcagacaca

SEQ ID NO: 545637 - DNA, 14 bp, Homo sapiens
cacactctcttctt

SEQ ID NO: 545638 - DNA, 15 bp, Homo sapiens
cacactgagttctat

SEQ ID NO: 545639 - DNA, 17 bp, Homo sapiens
cacactgagttctatca

SEQ ID NO: 545640 - DNA, 23 bp, Homo sapiens
cacacttccccttgggatgggca

SEQ ID NO: 545641 - DNA, 13 bp, Homo sapiens
cacagaaatatat

SEQ ID NO: 545642 - DNA, 21 bp, Homo sapiens
cacagaaatatatatacatat

SEQ ID NO: 545643 - DNA, 14 bp, Homo sapiens
cacagacacacaca

SEQ ID NO: 545644 - DNA, 20 bp, Homo sapiens
cacagacacacacacgcacg

SEQ ID NO: 545645 - DNA, 13 bp, Homo sapiens
cacagacactcct

SEQ ID NO: 545646 - DNA, 16 bp, Homo sapiens
cacagacactcctggg

SEQ ID NO: 545647 - DNA, 16 bp, Homo sapiens
cacagacgtccctcca

SEQ ID NO: 545648 - DNA, 14 bp, Homo sapiens
cacagcatttcaag

SEQ ID NO: 545649 - DNA, 14 bp, Homo sapiens
cacagccaatctcc

SEQ ID NO: 545650 - DNA, 23 bp, Homo sapiens
cacagccaatctccaggctccct

SEQ ID NO: 545651 - DNA, 23 bp, Homo sapiens
cacagccagtttagagaaataca

SEQ ID NO: 545652 - DNA, 15 bp, Homo sapiens
cacagcctcacccct

SEQ ID NO: 545653 - DNA, 22 bp, Homo sapiens
cacagcctcacccctgcaggcg

SEQ ID NO: 545654 - DNA, 16 bp, Homo sapiens
cacagctcccttctgt

SEQ ID NO: 545655 - DNA, 12 bp, Homo sapiens
cacagctccttt

SEQ ID NO: 545656 - DNA, 21 bp, Homo sapiens
cacagctccttttccagagca

SEQ ID NO: 545657 - DNA, 18 bp, Homo sapiens
cacagctgagctggccta

SEQ ID NO: 545658 - DNA, 19 bp, Homo sapiens
cacagctttcctgggtctg

SEQ ID NO: 545659 - DNA, 15 bp, Homo sapiens
cacaggagacactgt

SEQ ID NO: 545660 - DNA, 19 bp, Homo sapiens
cacaggagaggatggccca

SEQ ID NO: 545661 - DNA, 19 bp, Homo sapiens
cacaggatgcatattaaag

SEQ ID NO: 545662 - DNA, 15 bp, Homo sapiens
cacaggccaccctgt

SEQ ID NO: 545663 - DNA, 16 bp, Homo sapiens
cacaggccaccctgtg

SEQ ID NO: 545664 - DNA, 15 bp, Homo sapiens
cacaggctgccccac

SEQ ID NO: 545665 - DNA, 17 bp, Homo sapiens
cacaggggacacccaga

SEQ ID NO: 545666 - DNA, 13 bp, Homo sapiens
cacaggtcaggct

SEQ ID NO: 545667 - DNA, 14 bp, Homo sapiens
cacaggtcaggcta

SEQ ID NO: 545668 - DNA, 16 bp, Homo sapiens
cacaggtgtggtgtaa

SEQ ID NO: 545669 - DNA, 13 bp, Homo sapiens
cacagtatttaac

SEQ ID NO: 545670 - DNA, 14 bp, Homo sapiens
cacagtatttaaca

SEQ ID NO: 545671 - DNA, 22 bp, Homo sapiens
cacagtcaccttctcggcaact

SEQ ID NO: 545672 - DNA, 14 bp, Homo sapiens
cacagtcaggttga

SEQ ID NO: 545673 - DNA, 17 bp, Homo sapiens
cacagtcaggttgaaga

SEQ ID NO: 545674 - DNA, 22 bp, Homo sapiens
cagtacaataaataaaagaaag

SEQ ID NO: 545675 - DNA, 22 bp, Homo sapiens
cagtacctgggtccccagccct

SEQ ID NO: 545676 - DNA, 23 bp, Homo sapiens
cagtacctgggtccccagccctt

SEQ ID NO: 545677 - DNA, 19 bp, Homo sapiens
cagtagctgtggggagctg

SEQ ID NO: 545678 - DNA, 21 bp, Homo sapiens
cagtagctgtggggagctggt

SEQ ID NO: 545679 - DNA, 23 bp, Homo sapiens
cagtaggacaaggtgcaggcagg

SEQ ID NO: 545680 - DNA, 13 bp, Homo sapiens
cagtataaagaat

SEQ ID NO: 545681 - DNA, 17 bp, Homo sapiens
cagtataaagaatagga

SEQ ID NO: 545682 - DNA, 12 bp, Homo sapiens
cagtatttaaca

SEQ ID NO: 545683 - DNA, 15 bp, Homo sapiens
cagtcaagcagaaaa

SEQ ID NO: 545684 - DNA, 16 bp, Homo sapiens
cagtcaggctctctgg

SEQ ID NO: 545685 - DNA, 12 bp, Homo sapiens
cagtcatctccc

SEQ ID NO: 545686 - DNA, 19 bp, Homo sapiens
cagtcatctcccctcctgg

SEQ ID NO: 545687 - DNA, 22 bp, Homo sapiens
cagtccaaggggtcccctccag

SEQ ID NO: 545688 - DNA, 19 bp, Homo sapiens
cagtcgcctttcagcaggc

SEQ ID NO: 545689 - DNA, 21 bp, Homo sapiens
cagtcgcctttcagcaggcag

SEQ ID NO: 545690 - DNA, 16 bp, Homo sapiens
cagtctctttcttcct

SEQ ID NO: 545691 - DNA, 19 bp, Homo sapiens
cagtctctttcttcctttc

SEQ ID NO: 545692 - DNA, 20 bp, Homo sapiens
cagtctctttcttcctttct

SEQ ID NO: 545693 - DNA, 19 bp, Homo sapiens
cagtcttccacctggaagc

SEQ ID NO: 545694 - DNA, 15 bp, Homo sapiens
cagtgaggtcctggg

SEQ ID NO: 545695 - DNA, 23 bp, Homo sapiens
cagtgaggtcctgggggcctgac

SEQ ID NO: 545696 - DNA, 19 bp, Homo sapiens
cagtgattcgagctatatt

SEQ ID NO: 545697 - DNA, 13 bp, Homo sapiens
cagtgcaccccct

SEQ ID NO: 545698 - DNA, 14 bp, Homo sapiens
cagtgcacccccta

SEQ ID NO: 545699 - DNA, 14 bp, Homo sapiens
cagtgctcacacaa

SEQ ID NO: 545700 - DNA, 17 bp, Homo sapiens
cagtggagcccaggagt

SEQ ID NO: 545701 - DNA, 21 bp, Homo sapiens
cagtggagtgcaaaaggcttg

SEQ ID NO: 545702 - DNA, 18 bp, Homo sapiens
cagtggcttggagcagag

SEQ ID NO: 545703 - DNA, 23 bp, Homo sapiens
cagtggttgttttttcattgtgt

SEQ ID NO: 545704 - DNA, 17 bp, Homo sapiens
cagtgtaccattaaaat

SEQ ID NO: 545705 - DNA, 18 bp, Homo sapiens
cagtgtaccattaaaata

SEQ ID NO: 545706 - DNA, 21 bp, Homo sapiens
cagtgtactctgagtcctcat

SEQ ID NO: 545707 - DNA, 23 bp, Homo sapiens
cagtgtactctgagtcctcattg

SEQ ID NO: 545708 - DNA, 14 bp, Homo sapiens
cagtgtccccaggg

SEQ ID NO: 545709 - DNA, 20 bp, Homo sapiens
cagtgtgcttacctgttgtc

SEQ ID NO: 545710 - DNA, 17 bp, Homo sapiens
cagtgttacaagggtat

SEQ ID NO: 545711 - DNA, 21 bp, Homo sapiens
cagtgttcccttctggctgtc

SEQ ID NO: 545712 - DNA, 13 bp, Homo sapiens
cagtgtttgtgtg

SEQ ID NO: 545713 - DNA, 15 bp, Homo sapiens
cagttacttttcctt

SEQ ID NO: 545714 - DNA, 16 bp, Homo sapiens
cagttacttttccttg

SEQ ID NO: 545715 - DNA, 13 bp, Homo sapiens
cagttatcctttg

SEQ ID NO: 545716 - DNA, 20 bp, Homo sapiens
cagttatcttagctggatat

SEQ ID NO: 545717 - DNA, 22 bp, Homo sapiens
cagttcaaagtcatgatgtttt

SEQ ID NO: 545718 - DNA, 14 bp, Homo sapiens
cagttccctcagcc

SEQ ID NO: 545719 - DNA, 17 bp, Homo sapiens
cagttccctcagccctc

SEQ ID NO: 545720 - DNA, 18 bp, Homo sapiens
cagttccctcagccctca

SEQ ID NO: 545721 - DNA, 19 bp, Homo sapiens
cagttccctcagccctcat

SEQ ID NO: 545722 - DNA, 15 bp, Homo sapiens
cagttctaacctcct

SEQ ID NO: 545723 - DNA, 13 bp, Homo sapiens
cagttctgatgag

SEQ ID NO: 545724 - DNA, 20 bp, Homo sapiens
cagttgcaataaactcagtc

SEQ ID NO: 545725 - DNA, 18 bp, Homo sapiens
cagttgcccagcctcttt

SEQ ID NO: 545726 - DNA, 19 bp, Homo sapiens
cagttgcccagcctctttc

SEQ ID NO: 545727 - DNA, 21 bp, Homo sapiens
cagttgcccagcctctttccc

SEQ ID NO: 545728 - DNA, 17 bp, Homo sapiens
cagttggactgtggcct

SEQ ID NO: 545729 - DNA, 21 bp, Homo sapiens
ccctgaaatattttctacttt

SEQ ID NO: 545730 - DNA, 17 bp, Homo sapiens
ccctgaatcagaggcag

SEQ ID NO: 545731 - DNA, 21 bp, Homo sapiens
ccctgaatctgaccacagaca

SEQ ID NO: 545732 - DNA, 16 bp, Homo sapiens
ccctgagaagcctcat

SEQ ID NO: 545733 - DNA, 16 bp, Homo sapiens
ccctgagggcccttcc

SEQ ID NO: 545734 - DNA, 18 bp, Homo sapiens
ccctgagggcccttccca

SEQ ID NO: 545735 - DNA, 22 bp, Homo sapiens
ccctgagggtttccaccttggc

SEQ ID NO: 545736 - DNA, 15 bp, Homo sapiens
ccctgatcccttcca

SEQ ID NO: 545737 - DNA, 16 bp, Homo sapiens
ccctgcacctgcttct

SEQ ID NO: 545738 - DNA, 22 bp, Homo sapiens
ccctgcaggcggtatccagagg

SEQ ID NO: 545739 - DNA, 14 bp, Homo sapiens
ccctgccagcaccc

SEQ ID NO: 545740 - DNA, 17 bp, Homo sapiens
ccctgccagcaccccca

SEQ ID NO: 545741 - DNA, 14 bp, Homo sapiens
ccctgcccagatca

SEQ ID NO: 545742 - DNA, 22 bp, Homo sapiens
ccctgcccagatcagccagaag

SEQ ID NO: 545743 - DNA, 14 bp, Homo sapiens
ccctgctgccaggc

SEQ ID NO: 545744 - DNA, 19 bp, Homo sapiens
ccctgctgctcctcggcca

SEQ ID NO: 545745 - DNA, 24 bp, Homo sapiens
ccctgctgctcctcggccagagct

SEQ ID NO: 545746 - DNA, 15 bp, Homo sapiens
ccctggagcccggca

SEQ ID NO: 545747 - DNA, 18 bp, Homo sapiens
ccctggagcccggcagtg

SEQ ID NO: 545748 - DNA, 15 bp, Homo sapiens
ccctggcaggcaggg

SEQ ID NO: 545749 - DNA, 14 bp, Homo sapiens
ccctgggagagtga

SEQ ID NO: 545750 - DNA, 21 bp, Homo sapiens
ccctggggtttccacacaggc

SEQ ID NO: 545751 - DNA, 22 bp, Homo sapiens
ccctggggtttccacacaggcc

SEQ ID NO: 545752 - DNA, 15 bp, Homo sapiens
ccctggtaagaaaaa

SEQ ID NO: 545753 - DNA, 20 bp, Homo sapiens
ccctggttcccccaggaccc

SEQ ID NO: 545754 - DNA, 15 bp, Homo sapiens
ccctgtcaaacatta

SEQ ID NO: 545755 - DNA, 21 bp, Homo sapiens
ccctgtctgtctgtctctctt

SEQ ID NO: 545756 - DNA, 14 bp, Homo sapiens
ccctgtgacaaaat

SEQ ID NO: 545757 - DNA, 13 bp, Homo sapiens
ccctgtgccagcc

SEQ ID NO: 545758 - DNA, 17 bp, Homo sapiens
cccttccacctgctctg

SEQ ID NO: 545759 - DNA, 14 bp, Homo sapiens
cccttcccagggca

SEQ ID NO: 545760 - DNA, 15 bp, Homo sapiens
cccttccccttcctt

SEQ ID NO: 545761 - DNA, 15 bp, Homo sapiens
cccttcctccatcct

SEQ ID NO: 545762 - DNA, 13 bp, Homo sapiens
cccttcctctgct

SEQ ID NO: 545763 - DNA, 15 bp, Homo sapiens
cccttctcttccagg

SEQ ID NO: 545764 - DNA, 12 bp, Homo sapiens
cccttctttcca

SEQ ID NO: 545765 - DNA, 19 bp, Homo sapiens
cccttgcccatgctgggct

SEQ ID NO: 545766 - DNA, 22 bp, Homo sapiens
cccttgctaccacggcctcctt

SEQ ID NO: 545767 - DNA, 17 bp, Homo sapiens
cccttgggatgggcaca

SEQ ID NO: 545768 - DNA, 12 bp, Homo sapiens
ccctttcttcct

SEQ ID NO: 545769 - DNA, 14 bp, Homo sapiens
ccctttcttctccc

SEQ ID NO: 545770 - DNA, 17 bp, Homo sapiens
ccctttcttctccccca

SEQ ID NO: 545771 - DNA, 21 bp, Homo sapiens
ccgaaggttatggtcaatccc

SEQ ID NO: 545772 - DNA, 17 bp, Homo sapiens
ccgaatggagtccagac

SEQ ID NO: 545773 - DNA, 13 bp, Homo sapiens
ccgacaagcacag

SEQ ID NO: 545774 - DNA, 15 bp, Homo sapiens
ccgacagctttccag

SEQ ID NO: 545775 - DNA, 16 bp, Homo sapiens
ccgaccaactccagac

SEQ ID NO: 545776 - DNA, 16 bp, Homo sapiens
ccgactagacacacaa

SEQ ID NO: 545777 - DNA, 20 bp, Homo sapiens
ccgacttgtgcacaggcaga

SEQ ID NO: 545778 - DNA, 20 bp, Homo sapiens
ccgagctctcctgggccagg

SEQ ID NO: 545779 - DNA, 21 bp, Homo sapiens
ccgagctctcctgggccaggg

SEQ ID NO: 545780 - DNA, 15 bp, Homo sapiens
ccgatcgccagcaaa

SEQ ID NO: 545781 - DNA, 11 bp, Homo sapiens
ccgcagtgttt

SEQ ID NO: 545782 - DNA, 13 bp, Homo sapiens
ccgcatgtacaaa

SEQ ID NO: 545783 - DNA, 13 bp, Homo sapiens
ccgccctgggctc

SEQ ID NO: 545784 - DNA, 17 bp, Homo sapiens
ccgccctgggctctggg

SEQ ID NO: 545785 - DNA, 17 bp, Homo sapiens
catcctcttatatgtgc

SEQ ID NO: 545786 - DNA, 15 bp, Homo sapiens
catccttcccactct

SEQ ID NO: 545787 - DNA, 16 bp, Homo sapiens
catccttctccccaag

SEQ ID NO: 545788 - DNA, 20 bp, Homo sapiens
catccttctccccaaggtct

SEQ ID NO: 545789 - DNA, 21 bp, Homo sapiens
catccttgaggacctccacct

SEQ ID NO: 545790 - DNA, 20 bp, Homo sapiens
catcctttcacttctttccc

SEQ ID NO: 545791 - DNA, 14 bp, Homo sapiens
catcggtcagcagg

SEQ ID NO: 545792 - DNA, 19 bp, Homo sapiens
catcggttcaggaggagac

SEQ ID NO: 545793 - DNA, 20 bp, Homo sapiens
catctaaactttaatatgta

SEQ ID NO: 545794 - DNA, 16 bp, Homo sapiens
catctaaatattatgc

SEQ ID NO: 545795 - DNA, 15 bp, Homo sapiens
catctcccctcctgg

SEQ ID NO: 545796 - DNA, 16 bp, Homo sapiens
catctcccctcctggc

SEQ ID NO: 545797 - DNA, 13 bp, Homo sapiens
catctcccttcct

SEQ ID NO: 545798 - DNA, 22 bp, Homo sapiens
catctcccttcctgtgggagca

SEQ ID NO: 545799 - DNA, 14 bp, Homo sapiens
catctgatatcagg

SEQ ID NO: 545800 - DNA, 22 bp, Homo sapiens
catctgatatcaggaaatatct

SEQ ID NO: 545801 - DNA, 19 bp, Homo sapiens
catctgcagtgttctgtga

SEQ ID NO: 545802 - DNA, 14 bp, Homo sapiens
catctgctgagctc

SEQ ID NO: 545803 - DNA, 16 bp, Homo sapiens
catctggaaaataaaa

SEQ ID NO: 545804 - DNA, 22 bp, Homo sapiens
catctggaagagctaggcaggg

SEQ ID NO: 545805 - DNA, 15 bp, Homo sapiens
catcttgacagagcc

SEQ ID NO: 545806 - DNA, 12 bp, Homo sapiens
catctttagaaa

SEQ ID NO: 545807 - DNA, 13 bp, Homo sapiens
catgaaacagcag

SEQ ID NO: 545808 - DNA, 14 bp, Homo sapiens
catgaaacagcagc

SEQ ID NO: 545809 - DNA, 15 bp, Homo sapiens
catgaaacagcagct

SEQ ID NO: 545810 - DNA, 16 bp, Homo sapiens
catgaaacagcagctg

SEQ ID NO: 545811 - DNA, 15 bp, Homo sapiens
catgaaatgaacaca

SEQ ID NO: 545812 - DNA, 20 bp, Homo sapiens
catgaaatgaacacaaatta

SEQ ID NO: 545813 - DNA, 21 bp, Homo sapiens
catgaaatgctatgtcatttc

SEQ ID NO: 545814 - DNA, 17 bp, Homo sapiens
catgaacagctctgaga

SEQ ID NO: 545815 - DNA, 14 bp, Homo sapiens
catgaaggagtgaa

SEQ ID NO: 545816 - DNA, 18 bp, Homo sapiens
catgacccgtacacacca

SEQ ID NO: 545817 - DNA, 19 bp, Homo sapiens
catgagtgctaagagcctc

SEQ ID NO: 545818 - DNA, 22 bp, Homo sapiens
catgagtgctaagagcctctgg

SEQ ID NO: 545819 - DNA, 23 bp, Homo sapiens
catgagtgctaagagcctctgga

SEQ ID NO: 545820 - DNA, 21 bp, Homo sapiens
catgagtggacgtcagaagaa

SEQ ID NO: 545821 - DNA, 17 bp, Homo sapiens
catgatgctctttccca

SEQ ID NO: 545822 - DNA, 17 bp, Homo sapiens
catgatgtttttaaaat

SEQ ID NO: 545823 - DNA, 18 bp, Homo sapiens
catgatgtttttaaaatc

SEQ ID NO: 545824 - DNA, 19 bp, Homo sapiens
catgatgtttttaaaatct

SEQ ID NO: 545825 - DNA, 15 bp, Homo sapiens
catgattccaagggc

SEQ ID NO: 545826 - DNA, 22 bp, Homo sapiens
catgattccaagggcccagagg

SEQ ID NO: 545827 - DNA, 17 bp, Homo sapiens
catgatttcacaaatat

SEQ ID NO: 545828 - DNA, 19 bp, Homo sapiens
catgatttcacaaatatta

SEQ ID NO: 545829 - DNA, 13 bp, Homo sapiens
catgcacacacac

SEQ ID NO: 545830 - DNA, 20 bp, Homo sapiens
catgcacccgcatgtacaaa

SEQ ID NO: 545831 - DNA, 23 bp, Homo sapiens
catgcacccgcatgtacaaaaac

SEQ ID NO: 545832 - DNA, 22 bp, Homo sapiens
catgccgagtgccccagaaatg

SEQ ID NO: 545833 - DNA, 20 bp, Homo sapiens
catgcctttatttctgtatc

SEQ ID NO: 545834 - DNA, 17 bp, Homo sapiens
catgcggccggcctggg

SEQ ID NO: 545835 - DNA, 18 bp, Homo sapiens
catgcggccggcctgggg

SEQ ID NO: 545836 - DNA, 21 bp, Homo sapiens
catgcggccggcctggggccg

SEQ ID NO: 545837 - DNA, 19 bp, Homo sapiens
catgcgggctgggcagctg

SEQ ID NO: 545838 - DNA, 19 bp, Homo sapiens
catgctcccctgtgccagc

SEQ ID NO: 545839 - DNA, 17 bp, Homo sapiens
catgcttagcttatctt

SEQ ID NO: 545840 - DNA, 19 bp, Homo sapiens
catgcttagcttatctttc

SEQ ID NO: 545841 - DNA, 21 bp, Homo sapiens
catgcttagcttatctttctt

SEQ ID NO: 545842 - DNA, 18 bp, Homo sapiens
catggaagctggcaggag

SEQ ID NO: 545843 - DNA, 16 bp, Homo sapiens
catggaggcacacagc

SEQ ID NO: 545844 - DNA, 20 bp, Homo sapiens
catggaggcacacagctgca

SEQ ID NO: 545845 - DNA, 16 bp, Homo sapiens
ccaccaaaactgctcc

SEQ ID NO: 545846 - DNA, 20 bp, Homo sapiens
ccacccggttcagtgtttct

SEQ ID NO: 545847 - DNA, 13 bp, Homo sapiens
ccaccctgctcat

SEQ ID NO: 545848 - DNA, 15 bp, Homo sapiens
ccaccctgtgcagaa

SEQ ID NO: 545849 - DNA, 15 bp, Homo sapiens
ccacccttgttccag

SEQ ID NO: 545850 - DNA, 18 bp, Homo sapiens
ccacctcccccactccca

SEQ ID NO: 545851 - DNA, 16 bp, Homo sapiens
ccacctgcacaaacat

SEQ ID NO: 545852 - DNA, 22 bp, Homo sapiens
ccacctgcacaaacatagacag

SEQ ID NO: 545853 - DNA, 23 bp, Homo sapiens
ccacctgcacaaacatagacaga

SEQ ID NO: 545854 - DNA, 17 bp, Homo sapiens
ccacctgcagctccctc

SEQ ID NO: 545855 - DNA, 20 bp, Homo sapiens
ccacctgggagatgctggga

SEQ ID NO: 545856 - DNA, 21 bp, Homo sapiens
ccacctggttccggaatcctg

SEQ ID NO: 545857 - DNA, 20 bp, Homo sapiens
ccaccttgacgtttcttctt

SEQ ID NO: 545858 - DNA, 14 bp, Homo sapiens
ccacgctgtgtccc

SEQ ID NO: 545859 - DNA, 16 bp, Homo sapiens
ccacggcctcctttcc

SEQ ID NO: 545860 - DNA, 11 bp, Homo sapiens
ccactaatttt

SEQ ID NO: 545861 - DNA, 16 bp, Homo sapiens
ccactccaagccagca

SEQ ID NO: 545862 - DNA, 22 bp, Homo sapiens
ccactgagtctcattcctctgt

SEQ ID NO: 545863 - DNA, 19 bp, Homo sapiens
ccactgcactctagccgga

SEQ ID NO: 545864 - DNA, 20 bp, Homo sapiens
ccactgcactctagccggag

SEQ ID NO: 545865 - DNA, 18 bp, Homo sapiens
ccactggctgtgggctcc

SEQ ID NO: 545866 - DNA, 14 bp, Homo sapiens
ccactgtttattca

SEQ ID NO: 545867 - DNA, 14 bp, Homo sapiens
ccacttatttccat

SEQ ID NO: 545868 - DNA, 17 bp, Homo sapiens
ccacttatttccatgga

SEQ ID NO: 545869 - DNA, 20 bp, Homo sapiens
ccactttccaagtcactgca

SEQ ID NO: 545870 - DNA, 18 bp, Homo sapiens
ccagaaacgccacatccc

SEQ ID NO: 545871 - DNA, 21 bp, Homo sapiens
ccagaaagaggaataaaatga

SEQ ID NO: 545872 - DNA, 18 bp, Homo sapiens
ccagaaatgtccctttct

SEQ ID NO: 545873 - DNA, 17 bp, Homo sapiens
ccagaactctgcctgcc

SEQ ID NO: 545874 - DNA, 14 bp, Homo sapiens
ccagaactcttcct

SEQ ID NO: 545875 - DNA, 19 bp, Homo sapiens
ccagaagctcaaggctgca

SEQ ID NO: 545876 - DNA, 17 bp, Homo sapiens
ccagaagtagctttgca

SEQ ID NO: 545877 - DNA, 14 bp, Homo sapiens
ccagaccccatcca

SEQ ID NO: 545878 - DNA, 19 bp, Homo sapiens
ccagaccccatccagccag

SEQ ID NO: 545879 - DNA, 16 bp, Homo sapiens
ccagacctgggccctg

SEQ ID NO: 545880 - DNA, 17 bp, Homo sapiens
ccagacctgggccctgg

SEQ ID NO: 545881 - DNA, 18 bp, Homo sapiens
ccagacgcacgtgggtct

SEQ ID NO: 545882 - DNA, 22 bp, Homo sapiens
ccagagaaatgaaagtcagttt

SEQ ID NO: 545883 - DNA, 23 bp, Homo sapiens
ccagagaaatgaaagtcagttta

SEQ ID NO: 545884 - DNA, 23 bp, Homo sapiens
ccagagcattccagtcaggctct

SEQ ID NO: 545885 - DNA, 20 bp, Homo sapiens
ccagagcatttccaacacca

SEQ ID NO: 545886 - DNA, 22 bp, Homo sapiens
ccagagcatttccaacaccaca

SEQ ID NO: 545887 - DNA, 23 bp, Homo sapiens
ccagagcatttccaacaccacag

SEQ ID NO: 545888 - DNA, 18 bp, Homo sapiens
ccagagcgatgtgttctt

SEQ ID NO: 545889 - DNA, 21 bp, Homo sapiens
ccagagcgatgtgttctttgt

SEQ ID NO: 545890 - DNA, 13 bp, Homo sapiens
ccagagctcccag

SEQ ID NO: 545891 - DNA, 19 bp, Homo sapiens
ccagagctcccaggacgca

SEQ ID NO: 545892 - DNA, 19 bp, Homo sapiens
ccagaggaaatctgaatgt

SEQ ID NO: 545893 - DNA, 17 bp, Homo sapiens
ccagaggggcggggcca

SEQ ID NO: 545894 - DNA, 19 bp, Homo sapiens
ccagaggtgagggaggcct

SEQ ID NO: 545895 - DNA, 23 bp, Homo sapiens
ccagagtctagcgtagtgcagca

SEQ ID NO: 545896 - DNA, 16 bp, Homo sapiens
ccagatcagccagaag

SEQ ID NO: 545897 - DNA, 21 bp, Homo sapiens
ccagatccaggaacacatgca

SEQ ID NO: 545898 - DNA, 23 bp, Homo sapiens
ccagatgatccttgcacagacaa

SEQ ID NO: 545899 - DNA, 18 bp, Homo sapiens
ccagattcacttctgaat

SEQ ID NO: 545900 - DNA, 14 bp, Homo sapiens
ccagattcccagct

SEQ ID NO: 545901 - DNA, 13 bp, Homo sapiens
ccagcaccaccct

SEQ ID NO: 545902 - DNA, 16 bp, Homo sapiens
ccagcacccccacgcc

SEQ ID NO: 545903 - DNA, 18 bp, Homo sapiens
ccagcacccccacgccct

SEQ ID NO: 545904 - DNA, 20 bp, Homo sapiens
ccagcatccatgcggccggc

SEQ ID NO: 545905 - DNA, 13 bp, Homo sapiens
ccagcccagaggc

SEQ ID NO: 545906 - DNA, 23 bp, Homo sapiens
ccagccccagacaacagcccagg

SEQ ID NO: 545907 - DNA, 13 bp, Homo sapiens
ccagcccttcctc

SEQ ID NO: 545908 - DNA, 18 bp, Homo sapiens
ccagcccttcctctgctc

SEQ ID NO: 545909 - DNA, 19 bp, Homo sapiens
ccagcctatctctcttctg

SEQ ID NO: 545910 - DNA, 20 bp, Homo sapiens
ccagcctggaaacctgtctg

SEQ ID NO: 545911 - DNA, 10 bp, Homo sapiens
ccagcctggc

SEQ ID NO: 545912 - DNA, 20 bp, Homo sapiens
ccagcgagtctggagaccag

SEQ ID NO: 545913 - DNA, 21 bp, Homo sapiens
ccagctactccggaggctgag

SEQ ID NO: 545914 - DNA, 13 bp, Homo sapiens
ctaacttctaaaa

SEQ ID NO: 545915 - DNA, 17 bp, Homo sapiens
ctaacttctaaaactgt

SEQ ID NO: 545916 - DNA, 18 bp, Homo sapiens
ctaacttctaaaactgta

SEQ ID NO: 545917 - DNA, 14 bp, Homo sapiens
ctaacttgcttaaa

SEQ ID NO: 545918 - DNA, 17 bp, Homo sapiens
ctaacttgcttaaatgt

SEQ ID NO: 545919 - DNA, 18 bp, Homo sapiens
ctaacttgcttaaatgtg

SEQ ID NO: 545920 - DNA, 20 bp, Homo sapiens
ctaacttgcttaaatgtgaa

SEQ ID NO: 545921 - DNA, 13 bp, Homo sapiens
ctaagaaacattg

SEQ ID NO: 545922 - DNA, 14 bp, Homo sapiens
ctaagaaacattgg

SEQ ID NO: 545923 - DNA, 19 bp, Homo sapiens
ctaagaaacattggaagca

SEQ ID NO: 545924 - DNA, 15 bp, Homo sapiens
ctaagagcctctgga

SEQ ID NO: 545925 - DNA, 17 bp, Homo sapiens
ctaagagcctctggaag

SEQ ID NO: 545926 - DNA, 20 bp, Homo sapiens
ctaagatcggttaacaaata

SEQ ID NO: 545927 - DNA, 21 bp, Homo sapiens
ctaagatcggttaacaaataa

SEQ ID NO: 545928 - DNA, 16 bp, Homo sapiens
ctaagcaactaggcct

SEQ ID NO: 545929 - DNA, 18 bp, Homo sapiens
ctaagtaaatctaaatta

SEQ ID NO: 545930 - DNA, 17 bp, Homo sapiens
ctaagtctcttttttac

SEQ ID NO: 545931 - DNA, 13 bp, Homo sapiens
ctaagtctttccc

SEQ ID NO: 545932 - DNA, 16 bp, Homo sapiens
ctaatattgaaaatgt

SEQ ID NO: 545933 - DNA, 18 bp, Homo sapiens
ctaatattgaaaatgtca

SEQ ID NO: 545934 - DNA, 18 bp, Homo sapiens
ctaatccatgtgctgctg

SEQ ID NO: 545935 - DNA, 18 bp, Homo sapiens
ctaatggtaacttttgta

SEQ ID NO: 545936 - DNA, 21 bp, Homo sapiens
ctaatggtaacttttgtagtc

SEQ ID NO: 545937 - DNA, 15 bp, Homo sapiens
ctaattaaaaagtta

SEQ ID NO: 545938 - DNA, 16 bp, Homo sapiens
ctaattaaaaagttaa

SEQ ID NO: 545939 - DNA, 15 bp, Homo sapiens
ctaattaaactgatg

SEQ ID NO: 545940 - DNA, 15 bp, Homo sapiens
ctaattaatttcagt

SEQ ID NO: 545941 - DNA, 14 bp, Homo sapiens
ctaattagagcaga

SEQ ID NO: 545942 - DNA, 15 bp, Homo sapiens
ctaattttgttttaa

SEQ ID NO: 545943 - DNA, 23 bp, Homo sapiens
ctacaaaaaaaatcaaaaaatta

SEQ ID NO: 545944 - DNA, 15 bp, Homo sapiens
ctacaaaatgtgtgc

SEQ ID NO: 545945 - DNA, 16 bp, Homo sapiens
ctacaaaatgtgtgct

SEQ ID NO: 545946 - DNA, 13 bp, Homo sapiens
ctacagcagatcc

SEQ ID NO: 545947 - DNA, 20 bp, Homo sapiens
ctacagcagatccacctgca

SEQ ID NO: 545948 - DNA, 21 bp, Homo sapiens
ctacagcagatccacctgcac

SEQ ID NO: 545949 - DNA, 13 bp, Homo sapiens
ctaccaactttca

SEQ ID NO: 545950 - DNA, 14 bp, Homo sapiens
ctaccaactttcaa

SEQ ID NO: 545951 - DNA, 19 bp, Homo sapiens
ctaccaatgccaagataat

SEQ ID NO: 545952 - DNA, 18 bp, Homo sapiens
ctaccacggcctcctttc

SEQ ID NO: 545953 - DNA, 21 bp, Homo sapiens
ctacccagagattgcttctca

SEQ ID NO: 545954 - DNA, 13 bp, Homo sapiens
ctacccctttctt

SEQ ID NO: 545955 - DNA, 17 bp, Homo sapiens
ctacccctttcttctcg

SEQ ID NO: 545956 - DNA, 16 bp, Homo sapiens
ctacctcctctcctga

SEQ ID NO: 545957 - DNA, 18 bp, Homo sapiens
ctacctgaaaattcaaca

SEQ ID NO: 545958 - DNA, 15 bp, Homo sapiens
ctacctgcaggactc

SEQ ID NO: 545959 - DNA, 13 bp, Homo sapiens
ctaccttttctct

SEQ ID NO: 545960 - DNA, 14 bp, Homo sapiens
ctaccttttctctt

SEQ ID NO: 545961 - DNA, 19 bp, Homo sapiens
ctactaaaaatacaaacaa

SEQ ID NO: 545962 - DNA, 18 bp, Homo sapiens
ctactagggacctgggga

SEQ ID NO: 545963 - DNA, 22 bp, Homo sapiens
ctactctagagaagtggactgg

SEQ ID NO: 545964 - DNA, 14 bp, Homo sapiens
ctactcttctctct

SEQ ID NO: 545965 - DNA, 18 bp, Homo sapiens
ctactgaccagacaagct

SEQ ID NO: 545966 - DNA, 18 bp, Homo sapiens
ctactgttcctttcagat

SEQ ID NO: 545967 - DNA, 19 bp, Homo sapiens
ctacttagcacttcagggc

SEQ ID NO: 545968 - DNA, 20 bp, Homo sapiens
ctacttcctgcctggtctcc

SEQ ID NO: 545969 - DNA, 19 bp, Homo sapiens
ctactttaaattgtggatg

SEQ ID NO: 545970 - DNA, 15 bp, Homo sapiens
ctactttctgttatc

SEQ ID NO: 545971 - DNA, 20 bp, Homo sapiens
ctagaaagagaaaaagccct

SEQ ID NO: 545972 - DNA, 22 bp, Homo sapiens
ctagaaagagaaaaagccctct

SEQ ID NO: 545973 - DNA, 20 bp, Homo sapiens
ctagaaatcacaagaacaaa

SEQ ID NO: 545974 - DNA, 13 bp, Homo sapiens
ctagacattacca

SEQ ID NO: 545975 - DNA, 22 bp, Homo sapiens
ctagagcagcccaaatttttct

SEQ ID NO: 545976 - DNA, 12 bp, Homo sapiens
ctagataaaatg

SEQ ID NO: 545977 - DNA, 15 bp, Homo sapiens
ctagatatgagaaat

SEQ ID NO: 545978 - DNA, 16 bp, Homo sapiens
ctagatatgagaaata

SEQ ID NO: 545979 - DNA, 14 bp, Homo sapiens
ctagatgtaaattt

SEQ ID NO: 545980 - DNA, 13 bp, Homo sapiens
ctagcaaaaggat

SEQ ID NO: 545981 - DNA, 13 bp, Homo sapiens
ctagccatatatt

SEQ ID NO: 545982 - DNA, 19 bp, Homo sapiens
ctagcgtagtgcagcaggg

SEQ ID NO: 545983 - DNA, 20 bp, Homo sapiens
ctagcgtagtgcagcagggc

SEQ ID NO: 545984 - DNA, 22 bp, Homo sapiens
ctagcgtagtgcagcagggcag

SEQ ID NO: 545985 - DNA, 14 bp, Homo sapiens
ctaggaaaagaaat

SEQ ID NO: 545986 - DNA, 22 bp, Homo sapiens
ctaggacatctctgtaaaaagc

SEQ ID NO: 545987 - DNA, 21 bp, Homo sapiens
ctaggacccccagtgctcaca

SEQ ID NO: 545988 - DNA, 18 bp, Homo sapiens
ctaggcagggtgtctgcc

SEQ ID NO: 545989 - DNA, 18 bp, Homo sapiens
ctagggacctggggaagc

SEQ ID NO: 545990 - DNA, 20 bp, Homo sapiens
ctaggtagccccctcttccc

SEQ ID NO: 545991 - DNA, 20 bp, Homo sapiens
ctagtaggggtaccactgaa

SEQ ID NO: 545992 - DNA, 14 bp, Homo sapiens
ctagtggcttcagc

SEQ ID NO: 545993 - DNA, 17 bp, Homo sapiens
ctagttcatcccttctc

SEQ ID NO: 545994 - DNA, 13 bp, Homo sapiens
ctataaaagccca

SEQ ID NO: 545995 - DNA, 17 bp, Homo sapiens
ctataaatagtgaaaat

SEQ ID NO: 545996 - DNA, 13 bp, Homo sapiens
ctataatgtgtgt

SEQ ID NO: 545997 - DNA, 14 bp, Homo sapiens
ctatagaaagtgtt

SEQ ID NO: 545998 - DNA, 15 bp, Homo sapiens
ctatagaaagtgttc

SEQ ID NO: 545999 - DNA, 22 bp, Homo sapiens
ctatagaaagtgttctgttaca

SEQ ID NO: 546000 - DNA, 22 bp, Homo sapiens
ctatagattgatttacctttgg

SEQ ID NO: 546001 - DNA, 17 bp, Homo sapiens
ctatatacatgtgtgta

SEQ ID NO: 546002 - DNA, 16 bp, Homo sapiens
ctatatatataaatat

SEQ ID NO: 546003 - DNA, 21 bp, Homo sapiens
ctatatgtacagctctcccct

SEQ ID NO: 546004 - DNA, 13 bp, Homo sapiens
ctatatttaagta

SEQ ID NO: 546005 - DNA, 22 bp, Homo sapiens
ctatatttaagtattcaagaaa

SEQ ID NO: 546006 - DNA, 17 bp, Homo sapiens
ctatcagttatcctttg

SEQ ID NO: 546007 - DNA, 15 bp, Homo sapiens
ctatccatctcctgg

SEQ ID NO: 546008 - DNA, 16 bp, Homo sapiens
ctatccatctcctggt

SEQ ID NO: 546009 - DNA, 17 bp, Homo sapiens
ctatccattttacactt

SEQ ID NO: 546010 - DNA, 14 bp, Homo sapiens
ctatctctcttctg

SEQ ID NO: 546011 - DNA, 12 bp, Homo sapiens
ctatctggaaaa

SEQ ID NO: 546012 - DNA, 19 bp, Homo sapiens
ctatctggggagctcctgg

SEQ ID NO: 546013 - DNA, 19 bp, Homo sapiens
ctatgaagttggcacattt

SEQ ID NO: 546014 - DNA, 16 bp, Homo sapiens
ctatgccttttgtagc

SEQ ID NO: 546015 - DNA, 15 bp, Homo sapiens
ctatgctgttcattg

SEQ ID NO: 546016 - DNA, 13 bp, Homo sapiens
ctatggaagccac

SEQ ID NO: 546017 - DNA, 14 bp, Homo sapiens
ctatggcctgtgcg

SEQ ID NO: 546018 - DNA, 18 bp, Homo sapiens
ctatgtctcatgttttat

SEQ ID NO: 546019 - DNA, 21 bp, Homo sapiens
ctattcaagaagatagttgta

SEQ ID NO: 546020 - DNA, 16 bp, Homo sapiens
ctattgagtcttcatg

SEQ ID NO: 546021 - DNA, 13 bp, Homo sapiens
ctattgctgtaaa

SEQ ID NO: 546022 - DNA, 20 bp, Homo sapiens
ctattgctgtaaataaaaat

SEQ ID NO: 546023 - DNA, 20 bp, Homo sapiens
ctatttaagtggactgtatt

SEQ ID NO: 546024 - DNA, 16 bp, Homo sapiens
cctcggccagagctcc

SEQ ID NO: 546025 - DNA, 17 bp, Homo sapiens
cctcggccagagctccc

SEQ ID NO: 546026 - DNA, 19 bp, Homo sapiens
cctcggccagagctcccag

SEQ ID NO: 546027 - DNA, 21 bp, Homo sapiens
cctcggccagagctcccagga

SEQ ID NO: 546028 - DNA, 21 bp, Homo sapiens
cctcggttgcggacctaggac

SEQ ID NO: 546029 - DNA, 13 bp, Homo sapiens
cctctagccctgc

SEQ ID NO: 546030 - DNA, 18 bp, Homo sapiens
cctctagccctgcccgga

SEQ ID NO: 546031 - DNA, 12 bp, Homo sapiens
cctctcactgcc

SEQ ID NO: 546032 - DNA, 20 bp, Homo sapiens
cctctctaacctcctttacc

SEQ ID NO: 546033 - DNA, 14 bp, Homo sapiens
cctctgcccttggg

SEQ ID NO: 546034 - DNA, 14 bp, Homo sapiens
cctctgctaaattg

SEQ ID NO: 546035 - DNA, 14 bp, Homo sapiens
cctcttcaatcccc

SEQ ID NO: 546036 - DNA, 21 bp, Homo sapiens
cctcttccctggtaagaaaaa

SEQ ID NO: 546037 - DNA, 15 bp, Homo sapiens
cctcttcctccctgg

SEQ ID NO: 546038 - DNA, 16 bp, Homo sapiens
cctcttcctccctggg

SEQ ID NO: 546039 - DNA, 15 bp, Homo sapiens
cctctttcccttcca

SEQ ID NO: 546040 - DNA, 12 bp, Homo sapiens
cctgaaatgtgt

SEQ ID NO: 546041 - DNA, 17 bp, Homo sapiens
cctgaaatgtgtgtgat

SEQ ID NO: 546042 - DNA, 15 bp, Homo sapiens
cctgaaatgtttcca

SEQ ID NO: 546043 - DNA, 21 bp, Homo sapiens
cctgaaatgtttccaggcatg

SEQ ID NO: 546044 - DNA, 23 bp, Homo sapiens
cctgaaccacaggagaggatggc

SEQ ID NO: 546045 - DNA, 19 bp, Homo sapiens
cctgaatccaaaagaaaaa

SEQ ID NO: 546046 - DNA, 21 bp, Homo sapiens
cctgaatctgaccacagacac

SEQ ID NO: 546047 - DNA, 18 bp, Homo sapiens
cctgacagcaaacacagt

SEQ ID NO: 546048 - DNA, 20 bp, Homo sapiens
cctgacagcccctccctcct

SEQ ID NO: 546049 - DNA, 14 bp, Homo sapiens
cctgacctcacaga

SEQ ID NO: 546050 - DNA, 16 bp, Homo sapiens
cctgacctccccctcc

SEQ ID NO: 546051 - DNA, 19 bp, Homo sapiens
cctgactcccccagtcccc

SEQ ID NO: 546052 - DNA, 18 bp, Homo sapiens
cctgagaccatttaacat

SEQ ID NO: 546053 - DNA, 20 bp, Homo sapiens
cctgaggacatggcttctga

SEQ ID NO: 546054 - DNA, 20 bp, Homo sapiens
cctgaggggcagcctgcctt

SEQ ID NO: 546055 - DNA, 21 bp, Homo sapiens
cctgaggggcagcctgccttg

SEQ ID NO: 546056 - DNA, 16 bp, Homo sapiens
cctgatatccaacaga

SEQ ID NO: 546057 - DNA, 18 bp, Homo sapiens
cctgattggtttctcttc

SEQ ID NO: 546058 - DNA, 20 bp, Homo sapiens
cctgcaaccaaactcccatc

SEQ ID NO: 546059 - DNA, 22 bp, Homo sapiens
cctgcacaaacatagacagatg

SEQ ID NO: 546060 - DNA, 15 bp, Homo sapiens
cctgcagctctcatg

SEQ ID NO: 546061 - DNA, 20 bp, Homo sapiens
cctgcaggcggtatccagag

SEQ ID NO: 546062 - DNA, 14 bp, Homo sapiens
cctgccagcacccc

SEQ ID NO: 546063 - DNA, 22 bp, Homo sapiens
cctgcccagatcagccagaagc

SEQ ID NO: 546064 - DNA, 20 bp, Homo sapiens
cctgcccccacacctggccc

SEQ ID NO: 546065 - DNA, 21 bp, Homo sapiens
cctgcccccacacctggccct

SEQ ID NO: 546066 - DNA, 17 bp, Homo sapiens
cctgcccccgctctgcc

SEQ ID NO: 546067 - DNA, 19 bp, Homo sapiens
cctgcctctgaactgctgc

SEQ ID NO: 546068 - DNA, 21 bp, Homo sapiens
cctgcctctgaactgctgctg

SEQ ID NO: 546069 - DNA, 14 bp, Homo sapiens
cctgcctgccctgt

SEQ ID NO: 546070 - DNA, 18 bp, Homo sapiens
cctgcctgccctgtcagg

SEQ ID NO: 546071 - DNA, 21 bp, Homo sapiens
cctttgggttctttctggggg

SEQ ID NO: 546072 - DNA, 21 bp, Homo sapiens
cctttgtcctcctgctgccag

SEQ ID NO: 546073 - DNA, 13 bp, Homo sapiens
ccttttctcttca

SEQ ID NO: 546074 - DNA, 13 bp, Homo sapiens
ccttttctgtgtt

SEQ ID NO: 546075 - DNA, 16 bp, Homo sapiens
cctttttctattttac

SEQ ID NO: 546076 - DNA, 15 bp, Homo sapiens
ccttttttatatctt

SEQ ID NO: 546077 - DNA, 14 bp, Homo sapiens
cgaaaggcgagtcc

SEQ ID NO: 546078 - DNA, 15 bp, Homo sapiens
cgaatggagtccaga

SEQ ID NO: 546079 - DNA, 14 bp, Homo sapiens
cgacaaatctgtct

SEQ ID NO: 546080 - DNA, 17 bp, Homo sapiens
cgacaacagattggatt

SEQ ID NO: 546081 - DNA, 20 bp, Homo sapiens
cgacaacagattggatttta

SEQ ID NO: 546082 - DNA, 16 bp, Homo sapiens
cgacaagcacagtcag

SEQ ID NO: 546083 - DNA, 16 bp, Homo sapiens
cgacaggagtattttt

SEQ ID NO: 546084 - DNA, 16 bp, Homo sapiens
cgacctcttagaaaat

SEQ ID NO: 546085 - DNA, 23 bp, Homo sapiens
cgacctgaggacatggcttctga

SEQ ID NO: 546086 - DNA, 18 bp, Homo sapiens
cgacttgtgcacaggcag

SEQ ID NO: 546087 - DNA, 12 bp, Homo sapiens
cgagagcgcagc

SEQ ID NO: 546088 - DNA, 15 bp, Homo sapiens
cgagcaaagatcaaa

SEQ ID NO: 546089 - DNA, 20 bp, Homo sapiens
cgagcaaagatcaaaataaa

SEQ ID NO: 546090 - DNA, 22 bp, Homo sapiens
cgagcccttgcccatgctgggc

SEQ ID NO: 546091 - DNA, 16 bp, Homo sapiens
cgagccgagctctcct

SEQ ID NO: 546092 - DNA, 21 bp, Homo sapiens
cgagccttttcacccttctac

SEQ ID NO: 546093 - DNA, 14 bp, Homo sapiens
cgagctctcctggg

SEQ ID NO: 546094 - DNA, 15 bp, Homo sapiens
cgagctctcctgggc

SEQ ID NO: 546095 - DNA, 24 bp, Homo sapiens
cgagctgggaccagtacctgggtc

SEQ ID NO: 546096 - DNA, 21 bp, Homo sapiens
cgaggacccatgaaacagcag

SEQ ID NO: 546097 - DNA, 22 bp, Homo sapiens
cgaggacccatgaaacagcagc

SEQ ID NO: 546098 - DNA, 14 bp, Homo sapiens
cgagtctggagacc

SEQ ID NO: 546099 - DNA, 15 bp, Homo sapiens
cgagtctggagacca

SEQ ID NO: 546100 - DNA, 18 bp, Homo sapiens
cgatcatatctgtatgcc

SEQ ID NO: 546101 - DNA, 15 bp, Homo sapiens
cgatgcagacagggg

SEQ ID NO: 546102 - DNA, 23 bp, Homo sapiens
cgatttgttttcttcaacatgtg

SEQ ID NO: 546103 - DNA, 18 bp, Homo sapiens
cgcaaatacaaaatgatt

SEQ ID NO: 546104 - DNA, 20 bp, Homo sapiens
cgcaatgtgcccccagacgc

SEQ ID NO: 546105 - DNA, 14 bp, Homo sapiens
cgcaattgtatata

SEQ ID NO: 546106 - DNA, 13 bp, Homo sapiens
cgcacacacacaa

SEQ ID NO: 546107 - DNA, 14 bp, Homo sapiens
cgcacccacaccct

SEQ ID NO: 546108 - DNA, 22 bp, Homo sapiens
cgcacccacaccctacagcaga

SEQ ID NO: 546109 - DNA, 18 bp, Homo sapiens
cgcacccggcagcccccc

SEQ ID NO: 546110 - DNA, 11 bp, Homo sapiens
cgcacgcacac

SEQ ID NO: 546111 - DNA, 15 bp, Homo sapiens
cgcacgcacacacac

SEQ ID NO: 546112 - DNA, 16 bp, Homo sapiens
cgcacgcacacacaca

SEQ ID NO: 546113 - DNA, 17 bp, Homo sapiens
cgcacgcacccacaccc

SEQ ID NO: 546114 - DNA, 18 bp, Homo sapiens
cgcacgtgggtcttcagg

SEQ ID NO: 546115 - DNA, 14 bp, Homo sapiens
cgcagacacacaca

SEQ ID NO: 546116 - DNA, 11 bp, Homo sapiens
cgcaggccctc

SEQ ID NO: 546117 - DNA, 19 bp, Homo sapiens
cgcaggcctccctgccagt

SEQ ID NO: 546118 - DNA, 19 bp, Homo sapiens
cgcatgtacaaaaacacaa

SEQ ID NO: 546119 - DNA, 19 bp, Homo sapiens
cgccctcattacggctcct

SEQ ID NO: 546120 - DNA, 20 bp, Homo sapiens
cgcgcagcccgggagatccg

SEQ ID NO: 546121 - DNA, 21 bp, Homo sapiens
cgctaacttgcttaaatgtga

SEQ ID NO: 546122 - DNA, 22 bp, Homo sapiens
cgctaacttgcttaaatgtgaa

SEQ ID NO: 546123 - DNA, 17 bp, Homo sapiens
cgctctgccatcagccc

SEQ ID NO: 546124 - DNA, 13 bp, Homo sapiens
cgctggcccccac

SEQ ID NO: 546125 - DNA, 21 bp, Homo sapiens
cgctggcccccactggctgtg

SEQ ID NO: 546126 - DNA, 14 bp, Homo sapiens
cgctgtgtccccgc

SEQ ID NO: 546127 - DNA, 20 bp, Homo sapiens
cggaagtaaacctgaacaaa

SEQ ID NO: 546128 - DNA, 21 bp, Homo sapiens
cggaatcctgtcctcagcttc

SEQ ID NO: 546129 - DNA, 16 bp, Homo sapiens
cggaccgaaggtgaca

SEQ ID NO: 546130 - DNA, 17 bp, Homo sapiens
cggacctaggaccattt

SEQ ID NO: 546131 - DNA, 20 bp, Homo sapiens
cggagcggattgcaaagcaa

SEQ ID NO: 546132 - DNA, 19 bp, Homo sapiens
cggcaactaagcagtccct

SEQ ID NO: 546133 - DNA, 16 bp, Homo sapiens
cggcaatttccggcca

SEQ ID NO: 546134 - DNA, 13 bp, Homo sapiens
cggcagagaggac

SEQ ID NO: 546135 - DNA, 12 bp, Homo sapiens
cggcagcccccc

SEQ ID NO: 546136 - DNA, 13 bp, Homo sapiens
cggcccaggagcg

SEQ ID NO: 546137 - DNA, 14 bp, Homo sapiens
cggccccagcttct

SEQ ID NO: 546138 - DNA, 14 bp, Homo sapiens
cggcctctcttgga

SEQ ID NO: 546139 - DNA, 21 bp, Homo sapiens
cggcctggggccgggctggct

SEQ ID NO: 546140 - DNA, 23 bp, Homo sapiens
cggcgtccctgagggcccttccc

SEQ ID NO: 546141 - DNA, 17 bp, Homo sapiens
cggctcaagcccaggag

SEQ ID NO: 546142 - DNA, 19 bp, Homo sapiens
cggctccagtccccagaac

SEQ ID NO: 546143 - DNA, 17 bp, Homo sapiens
cgggagatccgccctgg

SEQ ID NO: 546144 - DNA, 19 bp, Homo sapiens
cgggagatccgccctgggc

SEQ ID NO: 546145 - DNA, 20 bp, Homo sapiens
cgggagatccgccctgggct

SEQ ID NO: 546146 - DNA, 12 bp, Homo sapiens
cgggagtagcaa

SEQ ID NO: 546147 - DNA, 17 bp, Homo sapiens
cgggccccacctgcagc

SEQ ID NO: 546148 - DNA, 21 bp, Homo sapiens
cgggccccacctgcagctccc

SEQ ID NO: 546149 - DNA, 17 bp, Homo sapiens
cgggctaagtccagctc

SEQ ID NO: 546150 - DNA, 15 bp, Homo sapiens
cgggctgggcagctg

SEQ ID NO: 546151 - DNA, 12 bp, Homo sapiens
cggggcaggaag

SEQ ID NO: 546152 - DNA, 13 bp, Homo sapiens
cggggcaggaagt

SEQ ID NO: 546153 - DNA, 22 bp, Homo sapiens
cggggccagcatccatgcggcc

SEQ ID NO: 546154 - DNA, 15 bp, Homo sapiens
cgggggcctagtggc

SEQ ID NO: 546155 - DNA, 13 bp, Homo sapiens
cgggggctggggc

SEQ ID NO: 546156 - DNA, 17 bp, Homo sapiens
cggggtcctgaggctgg

SEQ ID NO: 546157 - DNA, 22 bp, Homo sapiens
cgggtcatattcataccttctg

SEQ ID NO: 546158 - DNA, 12 bp, Homo sapiens
cgggtcttccta

SEQ ID NO: 546159 - DNA, 17 bp, Homo sapiens
cgggtgccccccatgcc

SEQ ID NO: 546160 - DNA, 11 bp, Homo sapiens
cgggtgcctgt

SEQ ID NO: 546161 - DNA, 14 bp, Homo sapiens
cggtaccaatgcag

SEQ ID NO: 546162 - DNA, 20 bp, Homo sapiens
cggtttatcgccctggcagg

SEQ ID NO: 546163 - DNA, 16 bp, Homo sapiens
cgtaaaaactgaagtt

SEQ ID NO: 546164 - DNA, 17 bp, Homo sapiens
cgtaaaaactgaagttc

SEQ ID NO: 546165 - DNA, 14 bp, Homo sapiens
cgtaattcttattc

SEQ ID NO: 546166 - DNA, 13 bp, Homo sapiens
cgtagaaacaaga

SEQ ID NO: 546167 - DNA, 15 bp, Homo sapiens
cgtagggccagggct

SEQ ID NO: 546168 - DNA, 19 bp, Homo sapiens
cgtagtcggcacagcctgg

SEQ ID NO: 546169 - DNA, 14 bp, Homo sapiens
cgtatagaagtctt

SEQ ID NO: 546170 - DNA, 22 bp, Homo sapiens
cgtattttaaaagccacataga

SEQ ID NO: 546171 - DNA, 17 bp, Homo sapiens
cgtattttgatcagtgt

SEQ ID NO: 546172 - DNA, 18 bp, Homo sapiens
cgtattttgatcagtgtt

SEQ ID NO: 546173 - DNA, 15 bp, Homo sapiens
cgtcaggaggtgcct

SEQ ID NO: 546174 - DNA, 11 bp, Homo sapiens
cgtccccagac

SEQ ID NO: 546175 - DNA, 21 bp, Homo sapiens
cgtccccagaccagtagtgac

SEQ ID NO: 546176 - DNA, 14 bp, Homo sapiens
gcccttcctctgct

SEQ ID NO: 546177 - DNA, 15 bp, Homo sapiens
gcccttcctctgctc

SEQ ID NO: 546178 - DNA, 21 bp, Homo sapiens
gcccttcggaggaccagggct

SEQ ID NO: 546179 - DNA, 17 bp, Homo sapiens
gccctttacttgtcttt

SEQ ID NO: 546180 - DNA, 21 bp, Homo sapiens
gccctttacttgtctttctgg

SEQ ID NO: 546181 - DNA, 12 bp, Homo sapiens
gccgagctctcc

SEQ ID NO: 546182 - DNA, 16 bp, Homo sapiens
gccgagctctcctggg

SEQ ID NO: 546183 - DNA, 17 bp, Homo sapiens
gccgagctctcctgggc

SEQ ID NO: 546184 - DNA, 14 bp, Homo sapiens
gccgagtgccccag

SEQ ID NO: 546185 - DNA, 16 bp, Homo sapiens
gccgctccagagtcag

SEQ ID NO: 546186 - DNA, 17 bp, Homo sapiens
gccgggcagagcacagc

SEQ ID NO: 546187 - DNA, 16 bp, Homo sapiens
gccgtgcacggggcca

SEQ ID NO: 546188 - DNA, 19 bp, Homo sapiens
gccgtgcacggggccagca

SEQ ID NO: 546189 - DNA, 14 bp, Homo sapiens
gccgtggctgcggc

SEQ ID NO: 546190 - DNA, 18 bp, Homo sapiens
gccgttgccgctgatgtt

SEQ ID NO: 546191 - DNA, 17 bp, Homo sapiens
gcctaatattgaaaatg

SEQ ID NO: 546192 - DNA, 22 bp, Homo sapiens
gcctaccggcaatttccggcca

SEQ ID NO: 546193 - DNA, 20 bp, Homo sapiens
gcctactagggacctgggga

SEQ ID NO: 546194 - DNA, 20 bp, Homo sapiens
gcctagtggcttcagcccct

SEQ ID NO: 546195 - DNA, 22 bp, Homo sapiens
gcctagtggcttcagcccctgg

SEQ ID NO: 546196 - DNA, 23 bp, Homo sapiens
gcctcaggaggcagtggcttgga

SEQ ID NO: 546197 - DNA, 21 bp, Homo sapiens
gcctcatgggagtcagggagc

SEQ ID NO: 546198 - DNA, 13 bp, Homo sapiens
gcctcctgctgag

SEQ ID NO: 546199 - DNA, 21 bp, Homo sapiens
gcctctcttggaactgcacca

SEQ ID NO: 546200 - DNA, 17 bp, Homo sapiens
gcctctgaactgctgct

SEQ ID NO: 546201 - DNA, 17 bp, Homo sapiens
gcctctgattctatgta

SEQ ID NO: 546202 - DNA, 15 bp, Homo sapiens
gcctctgcccttggg

SEQ ID NO: 546203 - DNA, 16 bp, Homo sapiens
gcctctgcccttgggg

SEQ ID NO: 546204 - DNA, 20 bp, Homo sapiens
gcctctggaagggagggctt

SEQ ID NO: 546205 - DNA, 23 bp, Homo sapiens
gcctcttgaatgcttaaatgatc

SEQ ID NO: 546206 - DNA, 17 bp, Homo sapiens
gcctctttcccttccag

SEQ ID NO: 546207 - DNA, 18 bp, Homo sapiens
gcctgaaagcaacagctg

SEQ ID NO: 546208 - DNA, 19 bp, Homo sapiens
gcctgaaatgtttccaggc

SEQ ID NO: 546209 - DNA, 20 bp, Homo sapiens
gcctgaaatgtttccaggca

SEQ ID NO: 546210 - DNA, 21 bp, Homo sapiens
gcctgaaatgtttccaggcat

SEQ ID NO: 546211 - DNA, 16 bp, Homo sapiens
gcctgacagccagaac

SEQ ID NO: 546212 - DNA, 19 bp, Homo sapiens
gcctgacctccccctcctt

SEQ ID NO: 546213 - DNA, 22 bp, Homo sapiens
gcctgacctccccctccttccc

SEQ ID NO: 546214 - DNA, 13 bp, Homo sapiens
gcctgagatgcct

SEQ ID NO: 546215 - DNA, 16 bp, Homo sapiens
gcctgaggggcagcct

SEQ ID NO: 546216 - DNA, 19 bp, Homo sapiens
gcctgaggggcagcctgcc

SEQ ID NO: 546217 - DNA, 19 bp, Homo sapiens
gcctgatgaccaattttaa

SEQ ID NO: 546218 - DNA, 21 bp, Homo sapiens
gcctgatgccacctcctctgt

SEQ ID NO: 546219 - DNA, 20 bp, Homo sapiens
gcctgccctttgtcctcctg

SEQ ID NO: 546220 - DNA, 18 bp, Homo sapiens
gcctgcgtggcctggggc

SEQ ID NO: 546221 - DNA, 21 bp, Homo sapiens
gcctgcgtggcctggggctgc

SEQ ID NO: 546222 - DNA, 13 bp, Homo sapiens
ttgcactgaagtt

SEQ ID NO: 546223 - DNA, 11 bp, Homo sapiens
ttgcagaactt

SEQ ID NO: 546224 - DNA, 22 bp, Homo sapiens
ttgcagactggtgttaatgagt

SEQ ID NO: 546225 - DNA, 21 bp, Homo sapiens
ttgcataagtggacccagctg

SEQ ID NO: 546226 - DNA, 17 bp, Homo sapiens
ttgcataatatgcatat

SEQ ID NO: 546227 - DNA, 12 bp, Homo sapiens
ttgcatagaata

SEQ ID NO: 546228 - DNA, 17 bp, Homo sapiens
ttgcatagaataatgaa

SEQ ID NO: 546229 - DNA, 15 bp, Homo sapiens
ttgccaaacattaat

SEQ ID NO: 546230 - DNA, 22 bp, Homo sapiens
ttgccacataattcattaaaaa

SEQ ID NO: 546231 - DNA, 23 bp, Homo sapiens
ttgccacataattcattaaaaac

SEQ ID NO: 546232 - DNA, 19 bp, Homo sapiens
ttgccagtaacacaggcca

SEQ ID NO: 546233 - DNA, 19 bp, Homo sapiens
ttgcccacacctgcctctg

SEQ ID NO: 546234 - DNA, 16 bp, Homo sapiens
ttgcccactcctgctc

SEQ ID NO: 546235 - DNA, 17 bp, Homo sapiens
ttgcccactcctgctct

SEQ ID NO: 546236 - DNA, 22 bp, Homo sapiens
ttgcccactcctgctctgctcg

SEQ ID NO: 546237 - DNA, 21 bp, Homo sapiens
ttgcccccaaacccccattct

SEQ ID NO: 546238 - DNA, 16 bp, Homo sapiens
ttgctcagagtgaaga

SEQ ID NO: 546239 - DNA, 15 bp, Homo sapiens
ttgctcataagtaaa

SEQ ID NO: 546240 - DNA, 16 bp, Homo sapiens
ttgctcataagtaaat

SEQ ID NO: 546241 - DNA, 17 bp, Homo sapiens
ttgctccccttcccctt

SEQ ID NO: 546242 - DNA, 16 bp, Homo sapiens
ttgctctccattcttt

SEQ ID NO: 546243 - DNA, 12 bp, Homo sapiens
ttgcttaaatgt

SEQ ID NO: 546244 - DNA, 14 bp, Homo sapiens
ttgcttacctctca

SEQ ID NO: 546245 - DNA, 13 bp, Homo sapiens
ttgcttcttctga

SEQ ID NO: 546246 - DNA, 16 bp, Homo sapiens
ttgctttatttttcat

SEQ ID NO: 546247 - DNA, 14 bp, Homo sapiens
ttgcttttaaaact

SEQ ID NO: 546248 - DNA, 16 bp, Homo sapiens
ttggaaacactaaatg

SEQ ID NO: 546249 - DNA, 19 bp, Homo sapiens
ttggaacaaatgcttttcc

SEQ ID NO: 546250 - DNA, 13 bp, Homo sapiens
ttctaacataagt

SEQ ID NO: 546251 - DNA, 14 bp, Homo sapiens
ttctaatccatgtg

SEQ ID NO: 546252 - DNA, 13 bp, Homo sapiens
ttctaatggtaac

SEQ ID NO: 546253 - DNA, 17 bp, Homo sapiens
ttctaatggtaactttt

SEQ ID NO: 546254 - DNA, 19 bp, Homo sapiens
ttctaatggtaacttttgt

SEQ ID NO: 546255 - DNA, 16 bp, Homo sapiens
ttctaattagattaac

SEQ ID NO: 546256 - DNA, 13 bp, Homo sapiens
ttctacaaggact

SEQ ID NO: 546257 - DNA, 16 bp, Homo sapiens
ttctacaaggactcca

SEQ ID NO: 546258 - DNA, 14 bp, Homo sapiens
ttctacctgcagga

SEQ ID NO: 546259 - DNA, 20 bp, Homo sapiens
ttctacttcttgtgctttac

SEQ ID NO: 546260 - DNA, 14 bp, Homo sapiens
ttctagcaattgct

SEQ ID NO: 546261 - DNA, 17 bp, Homo sapiens
ttctatcagttatcctt

SEQ ID NO: 546262 - DNA, 12 bp, Homo sapiens
ttctatgtaact

SEQ ID NO: 546263 - DNA, 13 bp, Homo sapiens
ttctatgtaactt

SEQ ID NO: 546264 - DNA, 17 bp, Homo sapiens
ttctatgtaacttgttg

SEQ ID NO: 546265 - DNA, 16 bp, Homo sapiens
ttctcaaatgctactc

SEQ ID NO: 546266 - DNA, 14 bp, Homo sapiens
ttctcaccagctgt

SEQ ID NO: 546267 - DNA, 15 bp, Homo sapiens
ttctcagtttttctt

SEQ ID NO: 546268 - DNA, 19 bp, Homo sapiens
ttctcagtttttcttaata

SEQ ID NO: 546269 - DNA, 23 bp, Homo sapiens
ttctcatcttgacagagcctgcc

SEQ ID NO: 546270 - DNA, 16 bp, Homo sapiens
ttctcccctccaagtg

SEQ ID NO: 546271 - DNA, 13 bp, Homo sapiens
ttctccccttcca

SEQ ID NO: 546272 - DNA, 12 bp, Homo sapiens
ttctctccattt

SEQ ID NO: 546273 - DNA, 14 bp, Homo sapiens
ttctctctgtgctg

SEQ ID NO: 546274 - DNA, 15 bp, Homo sapiens
ttctctgcccagctt

SEQ ID NO: 546275 - DNA, 20 bp, Homo sapiens
ttctctgcccagcttttcat

SEQ ID NO: 546276 - DNA, 15 bp, Homo sapiens
ttctcttccaggcag

SEQ ID NO: 546277 - DNA, 16 bp, Homo sapiens
ttctcttccaggcagc

SEQ ID NO: 546278 - DNA, 18 bp, Homo sapiens
ttctcttctacttcttgt

SEQ ID NO: 546279 - DNA, 15 bp, Homo sapiens
ttctctttggaaata

SEQ ID NO: 546280 - DNA, 20 bp, Homo sapiens
ttctctttggaaatagcatg

SEQ ID NO: 546281 - DNA, 17 bp, Homo sapiens
ttctgaaactaatgaaa

SEQ ID NO: 546282 - DNA, 13 bp, Homo sapiens
ttctgaagttata

SEQ ID NO: 546283 - DNA, 19 bp, Homo sapiens
ttctgaagttatatttcct

SEQ ID NO: 546284 - DNA, 19 bp, Homo sapiens
ttctgcagtcatctcccct

SEQ ID NO: 546285 - DNA, 15 bp, Homo sapiens
ttctgcctctgatgt

SEQ ID NO: 546286 - DNA, 23 bp, Homo sapiens
ttctgcctgaggggcagcctgcc

SEQ ID NO: 546287 - DNA, 15 bp, Homo sapiens
ttctggctgaaaaag

SEQ ID NO: 546288 - DNA, 23 bp, Homo sapiens
ttctgtaactattgggtgaatat

SEQ ID NO: 546289 - DNA, 23 bp, Homo sapiens
ttctgtatagacaggagaagaaa

SEQ ID NO: 546290 - DNA, 17 bp, Homo sapiens
ttctgtcgtccccagac

SEQ ID NO: 546291 - DNA, 19 bp, Homo sapiens
ttctgtcgtccccagacca

SEQ ID NO: 546292 - DNA, 12 bp, Homo sapiens
ttctgtgaatag

SEQ ID NO: 546293 - DNA, 18 bp, Homo sapiens
ttctgtggctgatttact

SEQ ID NO: 546294 - DNA, 17 bp, Homo sapiens
ttctgtgtttacagaga

SEQ ID NO: 546295 - DNA, 14 bp, Homo sapiens
ttctgttacaaaat

SEQ ID NO: 546296 - DNA, 17 bp, Homo sapiens
ttctgttacaaaatgta

SEQ ID NO: 546297 - DNA, 15 bp, Homo sapiens
ttctgttttagagtt

SEQ ID NO: 546298 - DNA, 12 bp, Homo sapiens
ttctgttttcaa

SEQ ID NO: 546299 - DNA, 20 bp, Homo sapiens
ttcttaaaaatgcatttaag

SEQ ID NO: 546300 - DNA, 18 bp, Homo sapiens
ttcttacccaaagcacat

SEQ ID NO: 546301 - DNA, 16 bp, Homo sapiens
ttcttaccgacaagca

SEQ ID NO: 546302 - DNA, 17 bp, Homo sapiens
ttcttattccatattag

SEQ ID NO: 546303 - DNA, 14 bp, Homo sapiens
ttcttccaaagcag

SEQ ID NO: 546304 - DNA, 18 bp, Homo sapiens
ttcttcctcttacctgta

SEQ ID NO: 546305 - DNA, 11 bp, Homo sapiens
ttcttcctggt

SEQ ID NO: 546306 - DNA, 10 bp, Homo sapiens
ttcttccttc

SEQ ID NO: 546307 - DNA, 23 bp, Homo sapiens
ttcttgaatggcaatgttttgct

SEQ ID NO: 546308 - DNA, 14 bp, Homo sapiens
ttcttgcaatttga

SEQ ID NO: 546309 - DNA, 18 bp, Homo sapiens
ttcttgcagtcatcagaa

SEQ ID NO: 546310 - DNA, 19 bp, Homo sapiens
ttcttgcagtcatcagaag

SEQ ID NO: 546311 - DNA, 17 bp, Homo sapiens
ttcttgtgcccttaaaa

SEQ ID NO: 546312 - DNA, 13 bp, Homo sapiens
ttcttgttttgct

SEQ ID NO: 546313 - DNA, 13 bp, Homo sapiens
ttctttcctctta

SEQ ID NO: 546314 - DNA, 11 bp, Homo sapiens
ttctttgtgta

SEQ ID NO: 546315 - DNA, 22 bp, Homo sapiens
ttcttttgggaggatttgatgt

SEQ ID NO: 546316 - DNA, 19 bp, Homo sapiens
ttcttttgttttttgaagt

SEQ ID NO: 546317 - DNA, 12 bp, Homo sapiens
ttgaaaagaaaa

SEQ ID NO: 546318 - DNA, 13 bp, Homo sapiens
ttgaaaatgtcac

SEQ ID NO: 546319 - DNA, 18 bp, Homo sapiens
ttgaaacattgcttttaa

SEQ ID NO: 546320 - DNA, 16 bp, Homo sapiens
ttgaaattatatctgt

SEQ ID NO: 546321 - DNA, 17 bp, Homo sapiens
ttgaaattatatctgtg

SEQ ID NO: 546322 - DNA, 19 bp, Homo sapiens
ttgaagaaacagataccat

SEQ ID NO: 546323 - DNA, 20 bp, Homo sapiens
ttgaagagagatatatctga

SEQ ID NO: 546324 - DNA, 13 bp, Homo sapiens
ttgaagtggctgg

SEQ ID NO: 546325 - DNA, 18 bp, Homo sapiens
ttgaatgcttaaatgatc

SEQ ID NO: 546326 - DNA, 20 bp, Homo sapiens
ttgaatggcaatgttttgct

SEQ ID NO: 546327 - DNA, 23 bp, Homo sapiens
ttgaattttcattttacagttac

SEQ ID NO: 546328 - DNA, 19 bp, Homo sapiens
ttgacagagcctgccccag

SEQ ID NO: 546329 - DNA, 12 bp, Homo sapiens
ttgacaggaggt

SEQ ID NO: 546330 - DNA, 23 bp, Homo sapiens
ttgaccttaccaagttggtctta

SEQ ID NO: 546331 - DNA, 20 bp, Homo sapiens
ttgaccttctgtcgtcccca

SEQ ID NO: 546332 - DNA, 21 bp, Homo sapiens
ttgagaactacctggatttgt

SEQ ID NO: 546333 - DNA, 12 bp, Homo sapiens
ttgagcagctga

SEQ ID NO: 546334 - DNA, 17 bp, Homo sapiens
ttgaggaaaaatatgtg

SEQ ID NO: 546335 - DNA, 20 bp, Homo sapiens
ttgaggaaaaatatgtgaag

SEQ ID NO: 546336 - DNA, 23 bp, Homo sapiens
ttgaggacctccacctgggagat

SEQ ID NO: 546337 - DNA, 21 bp, Homo sapiens
ttgagtcttttttttttaagt

SEQ ID NO: 546338 - DNA, 13 bp, Homo sapiens
ttgatatgagtat

SEQ ID NO: 546339 - DNA, 17 bp, Homo sapiens
ttgatcaaatgtacatc

SEQ ID NO: 546340 - DNA, 23 bp, Homo sapiens
ttgatggtagaaattttatctct

SEQ ID NO: 546341 - DNA, 13 bp, Homo sapiens
ttgatgtttcctt

SEQ ID NO: 546342 - DNA, 16 bp, Homo sapiens
ttgattcacatgtttt

SEQ ID NO: 546343 - DNA, 18 bp, Homo sapiens
ttgattcacatgttttca

SEQ ID NO: 546344 - DNA, 19 bp, Homo sapiens
ttgattcacatgttttcaa

SEQ ID NO: 546345 - DNA, 20 bp, Homo sapiens
ttgattcacatgttttcaaa

SEQ ID NO: 546346 - DNA, 14 bp, Homo sapiens
ttgattctctccat

SEQ ID NO: 546347 - DNA, 12 bp, Homo sapiens
ttgattgctttt

SEQ ID NO: 546348 - DNA, 13 bp, Homo sapiens
ttgatttctaagt

SEQ ID NO: 546349 - DNA, 16 bp, Homo sapiens
ttgatttgttcttaca

SEQ ID NO: 546350 - DNA, 11 bp, Homo sapiens
ttgcaaagcaa

SEQ ID NO: 546351 - DNA, 21 bp, Homo sapiens
ttgcaaataacttacaagact

SEQ ID NO: 546352 - DNA, 14 bp, Homo sapiens
ttgcaatttgaagg

SEQ ID NO: 546353 - DNA, 15 bp, Homo sapiens
ttgcaatttgaaggt

SEQ ID NO: 546354 - DNA, 15 bp, Homo sapiens
ttgcacaaaaagata

SEQ ID NO: 546355 - DNA, 15 bp, Homo sapiens
ttgcacacatcatct

SEQ ID NO: 546356 - DNA, 18 bp, Homo sapiens
ttgcacacatcatctgta

SEQ ID NO: 546357 - DNA, 22 bp, Homo sapiens
tgtttggttttaaaatactgta

SEQ ID NO: 546358 - DNA, 14 bp, Homo sapiens
tgtttgtcctttat

SEQ ID NO: 546359 - DNA, 16 bp, Homo sapiens
tgtttgtgtgtcaagt

SEQ ID NO: 546360 - DNA, 14 bp, Homo sapiens
tgttttaaactgtg

SEQ ID NO: 546361 - DNA, 19 bp, Homo sapiens
tgttttgcttttgctcgat

SEQ ID NO: 546362 - DNA, 15 bp, Homo sapiens
tgttttgtaaacttt

SEQ ID NO: 546363 - DNA, 17 bp, Homo sapiens
tgttttgtaaactttga

SEQ ID NO: 546364 - DNA, 18 bp, Homo sapiens
tgttttgtaaactttgaa

SEQ ID NO: 546365 - DNA, 18 bp, Homo sapiens
tgttttgttgcactgaag

SEQ ID NO: 546366 - DNA, 20 bp, Homo sapiens
tgttttgttgcactgaagtt

SEQ ID NO: 546367 - DNA, 22 bp, Homo sapiens
tgttttgttgcactgaagtttg

SEQ ID NO: 546368 - DNA, 19 bp, Homo sapiens
tgtttttaaaatcttatta

SEQ ID NO: 546369 - DNA, 14 bp, Homo sapiens
tgtttttcagttca

SEQ ID NO: 546370 - DNA, 14 bp, Homo sapiens
tgtttttgttttgt

SEQ ID NO: 546371 - DNA, 18 bp, Homo sapiens
tgtttttgttttgttgca

SEQ ID NO: 546372 - DNA, 15 bp, Homo sapiens
tgttttttgaagtgt

SEQ ID NO: 546373 - DNA, 17 bp, Homo sapiens
tgttttttgagtctttt

SEQ ID NO: 546374 - DNA, 19 bp, Homo sapiens
tgttttttgttttcattaa

SEQ ID NO: 546375 - DNA, 16 bp, Homo sapiens
ttaaaaaaaaaaatga

SEQ ID NO: 546376 - DNA, 12 bp, Homo sapiens
ttaaaaacattt

SEQ ID NO: 546377 - DNA, 12 bp, Homo sapiens
ttaaaaagtatt

SEQ ID NO: 546378 - DNA, 16 bp, Homo sapiens
ttaaaaagtcttttaa

SEQ ID NO: 546379 - DNA, 17 bp, Homo sapiens
ttaaaaagtcttttaaa

SEQ ID NO: 546380 - DNA, 12 bp, Homo sapiens
ttaaaacatttc

SEQ ID NO: 546381 - DNA, 14 bp, Homo sapiens
ttaaaactttaatc

SEQ ID NO: 546382 - DNA, 12 bp, Homo sapiens
ttaaaatactgt

SEQ ID NO: 546383 - DNA, 17 bp, Homo sapiens
ttaaaatactgtagata

SEQ ID NO: 546384 - DNA, 18 bp, Homo sapiens
ttaaaatactgtagataa

SEQ ID NO: 546385 - DNA, 14 bp, Homo sapiens
ttaaaatatgcact

SEQ ID NO: 546386 - DNA, 16 bp, Homo sapiens
ttaaaatatgcactaa

SEQ ID NO: 546387 - DNA, 18 bp, Homo sapiens
ttaaaatggcatttagca

SEQ ID NO: 546388 - DNA, 16 bp, Homo sapiens
ttaaaatttaacatct

SEQ ID NO: 546389 - DNA, 15 bp, Homo sapiens
ttaaaatttgaaaca

SEQ ID NO: 546390 - DNA, 16 bp, Homo sapiens
ttaaagtaattgttcc

SEQ ID NO: 546391 - DNA, 20 bp, Homo sapiens
ttaaagtaattgttccagag

SEQ ID NO: 546392 - DNA, 22 bp, Homo sapiens
ttaaagtaattgttccagagac

SEQ ID NO: 546393 - DNA, 12 bp, Homo sapiens
ttaaagtttcaa

SEQ ID NO: 546394 - DNA, 18 bp, Homo sapiens
ttaaagtttcaaaaatct

SEQ ID NO: 546395 - DNA, 16 bp, Homo sapiens
ttaaatgtgaattact

SEQ ID NO: 546396 - DNA, 22 bp, Homo sapiens
ttaaatgtgaattactaacttc

SEQ ID NO: 546397 - DNA, 15 bp, Homo sapiens
ttaaatgttttgtaa

SEQ ID NO: 546398 - DNA, 21 bp, Homo sapiens
ttaaatgttttgtaaactttg

SEQ ID NO: 546399 - DNA, 20 bp, Homo sapiens
ttaaattatcattgtttgtc

SEQ ID NO: 546400 - DNA, 22 bp, Homo sapiens
ttaacatctgcagtgttctgtg

SEQ ID NO: 546401 - DNA, 17 bp, Homo sapiens
ttaacttctattttcaa

SEQ ID NO: 546402 - DNA, 16 bp, Homo sapiens
ttaactttaacttttg

SEQ ID NO: 546403 - DNA, 11 bp, Homo sapiens
ttaagaaaaaa

SEQ ID NO: 546404 - DNA, 20 bp, Homo sapiens
ttaagaagccctgcagagca

SEQ ID NO: 546405 - DNA, 22 bp, Homo sapiens
ttaagaagccctgcagagcaca

SEQ ID NO: 546406 - DNA, 22 bp, Homo sapiens
ttaagaagttgctgcagattcc

SEQ ID NO: 546407 - DNA, 19 bp, Homo sapiens
ttaagacaagcctggcaac

SEQ ID NO: 546408 - DNA, 13 bp, Homo sapiens
ttaagagaaatgg

SEQ ID NO: 546409 - DNA, 14 bp, Homo sapiens
ttaagagagaaatc

SEQ ID NO: 546410 - DNA, 18 bp, Homo sapiens
ttaagagattttatgttt

SEQ ID NO: 546411 - DNA, 17 bp, Homo sapiens
ttaagcaacacttggaa

SEQ ID NO: 546412 - DNA, 23 bp, Homo sapiens
ttaagcaacacttggaacagtgt

SEQ ID NO: 546413 - DNA, 17 bp, Homo sapiens
ttaagcacaaaaaattt

SEQ ID NO: 546414 - DNA, 20 bp, Homo sapiens
ttattgagagagatgtgtaa

SEQ ID NO: 546415 - DNA, 21 bp, Homo sapiens
ttattgaggaaaaatatgtga

SEQ ID NO: 546416 - DNA, 23 bp, Homo sapiens
ttattgaggaaaaatatgtgaag

SEQ ID NO: 546417 - DNA, 12 bp, Homo sapiens
ttattgcacaaa

SEQ ID NO: 546418 - DNA, 22 bp, Homo sapiens
ttatttattctgggaatgtata

SEQ ID NO: 546419 - DNA, 12 bp, Homo sapiens
ttatttctcctt

SEQ ID NO: 546420 - DNA, 16 bp, Homo sapiens
ttatttctgtcattca

SEQ ID NO: 546421 - DNA, 21 bp, Homo sapiens
ttattttggagagataggaag

SEQ ID NO: 546422 - DNA, 14 bp, Homo sapiens
ttcaaaaatctgaa

SEQ ID NO: 546423 - DNA, 16 bp, Homo sapiens
ttcaaaacaaacagat

SEQ ID NO: 546424 - DNA, 19 bp, Homo sapiens
ttcaaaagacatgttgtaa

SEQ ID NO: 546425 - DNA, 20 bp, Homo sapiens
ttcaaaccaatttcttcctt

SEQ ID NO: 546426 - DNA, 18 bp, Homo sapiens
ttcaaagacttcatttaa

SEQ ID NO: 546427 - DNA, 21 bp, Homo sapiens
ttcaaagagatgggccttttc

SEQ ID NO: 546428 - DNA, 23 bp, Homo sapiens
ttcaaagagatgggccttttctt

SEQ ID NO: 546429 - DNA, 18 bp, Homo sapiens
ttcaaagtcatgatgttt

SEQ ID NO: 546430 - DNA, 17 bp, Homo sapiens
ttcaaatatgtaaactt

SEQ ID NO: 546431 - DNA, 20 bp, Homo sapiens
ttcaaatatgtaaactttaa

SEQ ID NO: 546432 - DNA, 16 bp, Homo sapiens
ttcaaattgtcttttg

SEQ ID NO: 546433 - DNA, 23 bp, Homo sapiens
ttcaagaaaaaataaatggaaat

SEQ ID NO: 546434 - DNA, 21 bp, Homo sapiens
ttcaagaaagccagtcttaac

SEQ ID NO: 546435 - DNA, 14 bp, Homo sapiens
ttcaagaccagcct

SEQ ID NO: 546436 - DNA, 19 bp, Homo sapiens
ttcaagcttattttggaga

SEQ ID NO: 546437 - DNA, 13 bp, Homo sapiens
ttcaataaagttt

SEQ ID NO: 546438 - DNA, 14 bp, Homo sapiens
ttcaataaagtttg

SEQ ID NO: 546439 - DNA, 16 bp, Homo sapiens
ttcaataaagtttgat

SEQ ID NO: 546440 - DNA, 21 bp, Homo sapiens
ttcaataaagtttgatcttcc

SEQ ID NO: 546441 - DNA, 13 bp, Homo sapiens
ttcaatccccata

SEQ ID NO: 546442 - DNA, 22 bp, Homo sapiens
ttcaatccccataatgcttctt

SEQ ID NO: 546443 - DNA, 16 bp, Homo sapiens
ttcaattcatagaata

SEQ ID NO: 546444 - DNA, 18 bp, Homo sapiens
ttcaatttattgcacaaa

SEQ ID NO: 546445 - DNA, 20 bp, Homo sapiens
ttcacaaatattaaaaagtc

SEQ ID NO: 546446 - DNA, 22 bp, Homo sapiens
ttcacaaatattaaaaagtctt

SEQ ID NO: 546447 - DNA, 16 bp, Homo sapiens
ttcacatgttttcaaa

SEQ ID NO: 546448 - DNA, 18 bp, Homo sapiens
ttcacatgttttcaaatg

SEQ ID NO: 546449 - DNA, 19 bp, Homo sapiens
ttcacatgttttcaaatgg

SEQ ID NO: 546450 - DNA, 20 bp, Homo sapiens
ttcacattaatggtctaaaa

SEQ ID NO: 546451 - DNA, 12 bp, Homo sapiens
ttcaccagagca

SEQ ID NO: 546452 - DNA, 22 bp, Homo sapiens
ttcaccagtttccaagtttatt

SEQ ID NO: 546453 - DNA, 16 bp, Homo sapiens
ttcacgcaacttgaaa

SEQ ID NO: 546454 - DNA, 22 bp, Homo sapiens
ttcacgcaacttgaaattatat

SEQ ID NO: 546455 - DNA, 19 bp, Homo sapiens
ttcacgtcataggaagtta

SEQ ID NO: 546456 - DNA, 16 bp, Homo sapiens
ttcactctaagatgtt

SEQ ID NO: 546457 - DNA, 16 bp, Homo sapiens
ttcactgtctgtctgg

SEQ ID NO: 546458 - DNA, 13 bp, Homo sapiens
ttcacttctttcc

SEQ ID NO: 546459 - DNA, 21 bp, Homo sapiens
ttcagataatggtaatttagt

SEQ ID NO: 546460 - DNA, 15 bp, Homo sapiens
ttcagatttgcacaa

SEQ ID NO: 546461 - DNA, 19 bp, Homo sapiens
ttcagatttgcacaaaaag

SEQ ID NO: 546462 - DNA, 12 bp, Homo sapiens
ttcagcaggcag

SEQ ID NO: 546463 - DNA, 16 bp, Homo sapiens
ttcagctctctgtata

SEQ ID NO: 546464 - DNA, 17 bp, Homo sapiens
ttcagctctctgtataa

SEQ ID NO: 546465 - DNA, 19 bp, Homo sapiens
ttcaggaccccatctgctg

SEQ ID NO: 546466 - DNA, 20 bp, Homo sapiens
ttcaggaccccatctgctga

SEQ ID NO: 546467 - DNA, 19 bp, Homo sapiens
ttcagggaagataagttgg

SEQ ID NO: 546468 - DNA, 20 bp, Homo sapiens
ttcagggaagataagttgga

SEQ ID NO: 546469 - DNA, 21 bp, Homo sapiens
ttcagggaagataagttggaa

SEQ ID NO: 546470 - DNA, 18 bp, Homo sapiens
ttcagggcagattttagt

SEQ ID NO: 546471 - DNA, 14 bp, Homo sapiens
ttcaggtgaaaatg

SEQ ID NO: 546472 - DNA, 10 bp, Homo sapiens
ttcagtgttt

SEQ ID NO: 546473 - DNA, 13 bp, Homo sapiens
ttcagtgtttctg

SEQ ID NO: 546474 - DNA, 22 bp, Homo sapiens
ttcagttcaaagtcatgatgtt

SEQ ID NO: 546475 - DNA, 12 bp, Homo sapiens
ttcatagaataa

SEQ ID NO: 546476 - DNA, 13 bp, Homo sapiens
ttcatagaataac

SEQ ID NO: 546477 - DNA, 23 bp, Homo sapiens
ttcatagataccattttgaaata

SEQ ID NO: 546478 - DNA, 15 bp, Homo sapiens
ttcatcctttcactt

SEQ ID NO: 546479 - DNA, 20 bp, Homo sapiens
ttcatggaattggtttaaac

SEQ ID NO: 546480 - DNA, 14 bp, Homo sapiens
ttcatgtatttctt

SEQ ID NO: 546481 - DNA, 19 bp, Homo sapiens
ttcatgtcctgtgtcagtt

SEQ ID NO: 546482 - DNA, 22 bp, Homo sapiens
ttcatgtcctgtgtcagtttat

SEQ ID NO: 546483 - DNA, 20 bp, Homo sapiens
ttcattacaatggaaacaat

SEQ ID NO: 546484 - DNA, 17 bp, Homo sapiens
ttcattacctgtagctt

SEQ ID NO: 546485 - DNA, 22 bp, Homo sapiens
ttcattagcaaaaaaagttgta

SEQ ID NO: 546486 - DNA, 18 bp, Homo sapiens
ttcattcatattacaata

SEQ ID NO: 546487 - DNA, 12 bp, Homo sapiens
ttcatttaacac

SEQ ID NO: 546488 - DNA, 16 bp, Homo sapiens
ttcatttcatcctttc

SEQ ID NO: 546489 - DNA, 16 bp, Homo sapiens
ttcattttgagaacat

SEQ ID NO: 546490 - DNA, 20 bp, Homo sapiens
ttccaaactcttccctctct

SEQ ID NO: 546491 - DNA, 17 bp, Homo sapiens
ttccaacaccacagaca

SEQ ID NO: 546492 - DNA, 18 bp, Homo sapiens
ttccaacaccacagacac

SEQ ID NO: 546493 - DNA, 21 bp, Homo sapiens
ttccaacaccacagacacaca

SEQ ID NO: 546494 - DNA, 22 bp, Homo sapiens
ttccaacaccacagacacacac

SEQ ID NO: 546495 - DNA, 17 bp, Homo sapiens
ttccaacatacaattta

SEQ ID NO: 546496 - DNA, 16 bp, Homo sapiens
ttccacagttatctta

SEQ ID NO: 546497 - DNA, 11 bp, Homo sapiens
ttccagagcat

SEQ ID NO: 546498 - DNA, 13 bp, Homo sapiens
ttccagagcattc

SEQ ID NO: 546499 - DNA, 15 bp, Homo sapiens
ttccagattcccagc

SEQ ID NO: 546500 - DNA, 19 bp, Homo sapiens
ttccaggcatgaccctgga

SEQ ID NO: 546501 - DNA, 18 bp, Homo sapiens
ttccaggcgtagggccag

SEQ ID NO: 546502 - DNA, 22 bp, Homo sapiens
ttccaggcgtagggccagggct

SEQ ID NO: 546503 - DNA, 15 bp, Homo sapiens
ttccatacttctctc

SEQ ID NO: 546504 - DNA, 18 bp, Homo sapiens
ttccatacttctctcaga

SEQ ID NO: 546505 - DNA, 17 bp, Homo sapiens
ttccatattagaaaact

SEQ ID NO: 546506 - DNA, 18 bp, Homo sapiens
ttccatatttttttcctt

SEQ ID NO: 546507 - DNA, 21 bp, Homo sapiens
ttccatcaaagccctccctgt

SEQ ID NO: 546508 - DNA, 22 bp, Homo sapiens
ttccatcacccgtacaggcaat

SEQ ID NO: 546509 - DNA, 15 bp, Homo sapiens
tgtctagcacttcct

SEQ ID NO: 546510 - DNA, 13 bp, Homo sapiens
tgtctcaaaataa

SEQ ID NO: 546511 - DNA, 22 bp, Homo sapiens
tgtctcaaaggagctttctcaa

SEQ ID NO: 546512 - DNA, 16 bp, Homo sapiens
tgtctcagattgacct

SEQ ID NO: 546513 - DNA, 12 bp, Homo sapiens
tgtctcatgttt

SEQ ID NO: 546514 - DNA, 15 bp, Homo sapiens
tgtctcatgttttat

SEQ ID NO: 546515 - DNA, 20 bp, Homo sapiens
tgtctcatgttttatatgat

SEQ ID NO: 546516 - DNA, 20 bp, Homo sapiens
tgtctctacaaaaaaaatca

SEQ ID NO: 546517 - DNA, 21 bp, Homo sapiens
tgtctctacaaaaaaaatcaa

SEQ ID NO: 546518 - DNA, 17 bp, Homo sapiens
tgtctctatttatgaga

SEQ ID NO: 546519 - DNA, 16 bp, Homo sapiens
tgtctgccccaagttt

SEQ ID NO: 546520 - DNA, 17 bp, Homo sapiens
tgtctgctccagctctg

SEQ ID NO: 546521 - DNA, 15 bp, Homo sapiens
tgtctgtcatttctc

SEQ ID NO: 546522 - DNA, 20 bp, Homo sapiens
tgtctgtcatttctctttca

SEQ ID NO: 546523 - DNA, 16 bp, Homo sapiens
tgtctgtcccagttaa

SEQ ID NO: 546524 - DNA, 16 bp, Homo sapiens
tgtctgtctggtccat

SEQ ID NO: 546525 - DNA, 14 bp, Homo sapiens
tgtcttaattaagt

SEQ ID NO: 546526 - DNA, 22 bp, Homo sapiens
tgtcttaattaagtaaactaat

SEQ ID NO: 546527 - DNA, 14 bp, Homo sapiens
tgtcttatatagca

SEQ ID NO: 546528 - DNA, 22 bp, Homo sapiens
tgtcttcagcctctccaggcac

SEQ ID NO: 546529 - DNA, 15 bp, Homo sapiens
tgtctttaaaatgat

SEQ ID NO: 546530 - DNA, 13 bp, Homo sapiens
tgtctttctgggg

SEQ ID NO: 546531 - DNA, 20 bp, Homo sapiens
tgtgaaatttttcatatttt

SEQ ID NO: 546532 - DNA, 22 bp, Homo sapiens
tgtgaagatcacgttccttccc

SEQ ID NO: 546533 - DNA, 13 bp, Homo sapiens
tgtgaaggacctt

SEQ ID NO: 546534 - DNA, 13 bp, Homo sapiens
tgtgaattactaa

SEQ ID NO: 546535 - DNA, 15 bp, Homo sapiens
tgtgaattactaact

SEQ ID NO: 546536 - DNA, 17 bp, Homo sapiens
tgtgaattactaacttc

SEQ ID NO: 546537 - DNA, 12 bp, Homo sapiens
tgtgacaaaatt

SEQ ID NO: 546538 - DNA, 19 bp, Homo sapiens
tgtgacatttgtcattttc

SEQ ID NO: 546539 - DNA, 20 bp, Homo sapiens
tgtgacatttgtcattttca

SEQ ID NO: 546540 - DNA, 22 bp, Homo sapiens
tgtgacatttgtcattttcatt

SEQ ID NO: 546541 - DNA, 21 bp, Homo sapiens
tgtgaccggggtcctgaggct

SEQ ID NO: 546542 - DNA, 22 bp, Homo sapiens
tgtgaccggggtcctgaggctg

SEQ ID NO: 546543 - DNA, 22 bp, Homo sapiens
tgtgagaaaaccccttcccatt

SEQ ID NO: 546544 - DNA, 14 bp, Homo sapiens
tgtgaggcaggaga

SEQ ID NO: 546545 - DNA, 17 bp, Homo sapiens
tgtgagtttgtttcttt

SEQ ID NO: 546546 - DNA, 19 bp, Homo sapiens
tgtgatggatggcacaatg

SEQ ID NO: 546547 - DNA, 20 bp, Homo sapiens
tgtgatggatggcacaatga

SEQ ID NO: 546548 - DNA, 15 bp, Homo sapiens
tgtgatgtgacattt

SEQ ID NO: 546549 - DNA, 17 bp, Homo sapiens
tgtgatgtgacatttgt

SEQ ID NO: 546550 - DNA, 18 bp, Homo sapiens
tgtgatgtgacatttgtc

SEQ ID NO: 546551 - DNA, 15 bp, Homo sapiens
tgtgattcaaaagat

SEQ ID NO: 546552 - DNA, 17 bp, Homo sapiens
tgtgattccccggagct

SEQ ID NO: 546553 - DNA, 20 bp, Homo sapiens
tgtgattccccggagctggg

SEQ ID NO: 546554 - DNA, 16 bp, Homo sapiens
tgtgattttcaaatat

SEQ ID NO: 546555 - DNA, 19 bp, Homo sapiens
tgtgattttcaaatatgta

SEQ ID NO: 546556 - DNA, 13 bp, Homo sapiens
tgtgcacaggcag

SEQ ID NO: 546557 - DNA, 13 bp, Homo sapiens
tgtgcacctgact

SEQ ID NO: 546558 - DNA, 21 bp, Homo sapiens
tgtgcagagctgaagagctgg

SEQ ID NO: 546559 - DNA, 14 bp, Homo sapiens
tgtgccgagccctt

SEQ ID NO: 546560 - DNA, 14 bp, Homo sapiens
tgtgccttttttat

SEQ ID NO: 546561 - DNA, 20 bp, Homo sapiens
tgtgccttttttatatcttg

SEQ ID NO: 546562 - DNA, 15 bp, Homo sapiens
tgtgctaaacgtgta

SEQ ID NO: 546563 - DNA, 22 bp, Homo sapiens
tgtgctaaacgtgtatgttttt

SEQ ID NO: 546564 - DNA, 18 bp, Homo sapiens
tgtgctaagtctttccca

SEQ ID NO: 546565 - DNA, 15 bp, Homo sapiens
tgtgctataaatcct

SEQ ID NO: 546566 - DNA, 18 bp, Homo sapiens
tgtgctccaaatgtctac

SEQ ID NO: 546567 - DNA, 23 bp, Homo sapiens
tgtgctctacatctcgtatggat

SEQ ID NO: 546568 - DNA, 21 bp, Homo sapiens
tgtgctgtgtttgctcccctt

SEQ ID NO: 546569 - DNA, 18 bp, Homo sapiens
tgtgcttatgtcatttct

SEQ ID NO: 546570 - DNA, 14 bp, Homo sapiens
tgtgcttgttcttc

SEQ ID NO: 546571 - DNA, 19 bp, Homo sapiens
tgtgcttgttcttcctctt

SEQ ID NO: 546572 - DNA, 22 bp, Homo sapiens
tgtggaaggcacactgagcaag

SEQ ID NO: 546573 - DNA, 14 bp, Homo sapiens
tgtggacatgcacc

SEQ ID NO: 546574 - DNA, 18 bp, Homo sapiens
tgtggacatgcacccgca

SEQ ID NO: 546575 - DNA, 20 bp, Homo sapiens
tggtcgaaagttagtaggat

SEQ ID NO: 546576 - DNA, 13 bp, Homo sapiens
tggtctctgccat

SEQ ID NO: 546577 - DNA, 24 bp, Homo sapiens
tggtcttactttgttaatttatct

SEQ ID NO: 546578 - DNA, 18 bp, Homo sapiens
tggtcttttttctgggtc

SEQ ID NO: 546579 - DNA, 16 bp, Homo sapiens
tggtgaactgaagcag

SEQ ID NO: 546580 - DNA, 12 bp, Homo sapiens
tggtgagcatta

SEQ ID NO: 546581 - DNA, 18 bp, Homo sapiens
tggtgagcattacaggca

SEQ ID NO: 546582 - DNA, 16 bp, Homo sapiens
tggtgcaatttgtctt

SEQ ID NO: 546583 - DNA, 21 bp, Homo sapiens
tggtgggagcacagctttcct

SEQ ID NO: 546584 - DNA, 13 bp, Homo sapiens
tggtgtaatttat

SEQ ID NO: 546585 - DNA, 12 bp, Homo sapiens
tggtgttaatga

SEQ ID NO: 546586 - DNA, 14 bp, Homo sapiens
tggtgttaatgagt

SEQ ID NO: 546587 - DNA, 15 bp, Homo sapiens
tggttgtttcttcca

SEQ ID NO: 546588 - DNA, 22 bp, Homo sapiens
tggtttagcgttgttttgtgga

SEQ ID NO: 546589 - DNA, 23 bp, Homo sapiens
tggtttagcgttgttttgtggat

SEQ ID NO: 546590 - DNA, 21 bp, Homo sapiens
tggtttccatcaaagccctcc

SEQ ID NO: 546591 - DNA, 17 bp, Homo sapiens
tggtttttatttctcct

SEQ ID NO: 546592 - DNA, 12 bp, Homo sapiens
tgtaaaacagtg

SEQ ID NO: 546593 - DNA, 14 bp, Homo sapiens
tgtaaaacagtggt

SEQ ID NO: 546594 - DNA, 18 bp, Homo sapiens
tgtaaaattggattatta

SEQ ID NO: 546595 - DNA, 13 bp, Homo sapiens
tgtaaactttgaa

SEQ ID NO: 546596 - DNA, 14 bp, Homo sapiens
tgtaaactttgaaa

SEQ ID NO: 546597 - DNA, 18 bp, Homo sapiens
tgtaaactttgaaatata

SEQ ID NO: 546598 - DNA, 14 bp, Homo sapiens
tgtaaagcaaaata

SEQ ID NO: 546599 - DNA, 16 bp, Homo sapiens
tgtaaagcaaaatatt

SEQ ID NO: 546600 - DNA, 16 bp, Homo sapiens
tgtaaatgatatgtct

SEQ ID NO: 546601 - DNA, 20 bp, Homo sapiens
tgtaaatgatatgtctttaa

SEQ ID NO: 546602 - DNA, 15 bp, Homo sapiens
tgtaaattccaaaga

SEQ ID NO: 546603 - DNA, 16 bp, Homo sapiens
tgtaaattccaaagat

SEQ ID NO: 546604 - DNA, 13 bp, Homo sapiens
tgtaacagtttaa

SEQ ID NO: 546605 - DNA, 19 bp, Homo sapiens
tgtaacgtgtgctgtgttt

SEQ ID NO: 546606 - DNA, 22 bp, Homo sapiens
tgtaacgtgtgctgtgtttgct

SEQ ID NO: 546607 - DNA, 23 bp, Homo sapiens
tgtaactgctcttgggcaatatt

SEQ ID NO: 546608 - DNA, 14 bp, Homo sapiens
tgtaactgttacca

SEQ ID NO: 546609 - DNA, 22 bp, Homo sapiens
tgtaagaagctaaaatgaaaaa

SEQ ID NO: 546610 - DNA, 16 bp, Homo sapiens
tgtaagacggccttgg

SEQ ID NO: 546611 - DNA, 12 bp, Homo sapiens
tgtaatatcagt

SEQ ID NO: 546612 - DNA, 16 bp, Homo sapiens
tgtaatatcagttaca

SEQ ID NO: 546613 - DNA, 19 bp, Homo sapiens
tgtaatatcagttacagtg

SEQ ID NO: 546614 - DNA, 23 bp, Homo sapiens
tgtaatatcagttacagtggcag

SEQ ID NO: 546615 - DNA, 15 bp, Homo sapiens
tgtaatattttgctg

SEQ ID NO: 546616 - DNA, 19 bp, Homo sapiens
tgtaatcacactctcttct

SEQ ID NO: 546617 - DNA, 20 bp, Homo sapiens
tgtaatcacactctcttctt

SEQ ID NO: 546618 - DNA, 14 bp, Homo sapiens
tgtaatgtaactgc

SEQ ID NO: 546619 - DNA, 22 bp, Homo sapiens
tgtaatttttcagctctctgta

SEQ ID NO: 546620 - DNA, 16 bp, Homo sapiens
tgtaatttttctgtat

SEQ ID NO: 546621 - DNA, 15 bp, Homo sapiens
tgtacaaaaacacaa

SEQ ID NO: 546622 - DNA, 22 bp, Homo sapiens
tgtacaaaagggacatgaaata

SEQ ID NO: 546623 - DNA, 18 bp, Homo sapiens
tgtacaaaatatccaagc

SEQ ID NO: 546624 - DNA, 15 bp, Homo sapiens
tgtacaatcatgaac

SEQ ID NO: 546625 - DNA, 21 bp, Homo sapiens
tgtacacacacagacacacaa

SEQ ID NO: 546626 - DNA, 20 bp, Homo sapiens
tgtacaccactttcccacac

SEQ ID NO: 546627 - DNA, 21 bp, Homo sapiens
tgtacagagccgtaaaaactg

SEQ ID NO: 546628 - DNA, 15 bp, Homo sapiens
tgtacagatcaagaa

SEQ ID NO: 546629 - DNA, 12 bp, Homo sapiens
tgtacagctctc

SEQ ID NO: 546630 - DNA, 15 bp, Homo sapiens
tgtacagttgggaaa

SEQ ID NO: 546631 - DNA, 18 bp, Homo sapiens
tgtacatttatgtgtgaa

SEQ ID NO: 546632 - DNA, 24 bp, Homo sapiens
tgtacatttttgatcaaatgtaca

SEQ ID NO: 546633 - DNA, 12 bp, Homo sapiens
tgtactggagag

SEQ ID NO: 546634 - DNA, 17 bp, Homo sapiens
tgtactttgattcacat

SEQ ID NO: 546635 - DNA, 17 bp, Homo sapiens
tgtagactatatacatg

SEQ ID NO: 546636 - DNA, 18 bp, Homo sapiens
tgtagactatatacatgt

SEQ ID NO: 546637 - DNA, 21 bp, Homo sapiens
tgtagactatatacatgtgtg

SEQ ID NO: 546638 - DNA, 20 bp, Homo sapiens
tgtagatcaactcatgttaa

SEQ ID NO: 546639 - DNA, 21 bp, Homo sapiens
tgtagcaaaccctgtcaaaca

SEQ ID NO: 546640 - DNA, 14 bp, Homo sapiens
tgtagtcttatgaa

SEQ ID NO: 546641 - DNA, 18 bp, Homo sapiens
tgtagtcttatgaataga

SEQ ID NO: 546642 - DNA, 22 bp, Homo sapiens
tgtataagatgctgctgagcac

SEQ ID NO: 546643 - DNA, 16 bp, Homo sapiens
tgtataagtgcacaca

SEQ ID NO: 546644 - DNA, 18 bp, Homo sapiens
tgtataagtgcacacaga

SEQ ID NO: 546645 - DNA, 23 bp, Homo sapiens
tgtataagtgcacacagaaatat

SEQ ID NO: 546646 - DNA, 21 bp, Homo sapiens
tgtatacgcacgcacccacac

SEQ ID NO: 546647 - DNA, 13 bp, Homo sapiens
tgtatatacacat

SEQ ID NO: 546648 - DNA, 14 bp, Homo sapiens
tgtatatacacata

SEQ ID NO: 546649 - DNA, 16 bp, Homo sapiens
tgtatatacacatata

SEQ ID NO: 546650 - DNA, 19 bp, Homo sapiens
tgtatatacacatatacct

SEQ ID NO: 546651 - DNA, 12 bp, Homo sapiens
tggaacaaatgc

SEQ ID NO: 546652 - DNA, 13 bp, Homo sapiens
tggaacagtgttt

SEQ ID NO: 546653 - DNA, 18 bp, Homo sapiens
tggaacagtgtttacttt

SEQ ID NO: 546654 - DNA, 23 bp, Homo sapiens
tggaactcagctgtctgtggctt

SEQ ID NO: 546655 - DNA, 16 bp, Homo sapiens
tggaagacaaatacac

SEQ ID NO: 546656 - DNA, 16 bp, Homo sapiens
tggaagagaaatctca

SEQ ID NO: 546657 - DNA, 12 bp, Homo sapiens
tggaagccacat

SEQ ID NO: 546658 - DNA, 15 bp, Homo sapiens
tggaagctggcagga

SEQ ID NO: 546659 - DNA, 15 bp, Homo sapiens
tggaaggcccagcac

SEQ ID NO: 546660 - DNA, 21 bp, Homo sapiens
tggaaggcccagcaccaccct

SEQ ID NO: 546661 - DNA, 18 bp, Homo sapiens
tggaagggccttctccac

SEQ ID NO: 546662 - DNA, 18 bp, Homo sapiens
tggaatcattgtccagag

SEQ ID NO: 546663 - DNA, 17 bp, Homo sapiens
tggaatgcccttcactg

SEQ ID NO: 546664 - DNA, 15 bp, Homo sapiens
tggacacccccttgg

SEQ ID NO: 546665 - DNA, 22 bp, Homo sapiens
tggacagtgcctaactccttac

SEQ ID NO: 546666 - DNA, 15 bp, Homo sapiens
tggacatgcacccgc

SEQ ID NO: 546667 - DNA, 19 bp, Homo sapiens
tggaccagttccctcagcc

SEQ ID NO: 546668 - DNA, 16 bp, Homo sapiens
tggaccctgaaatgtg

SEQ ID NO: 546669 - DNA, 16 bp, Homo sapiens
tggactgtggcctcag

SEQ ID NO: 546670 - DNA, 21 bp, Homo sapiens
tggactgtggcctcaggaggc

SEQ ID NO: 546671 - DNA, 14 bp, Homo sapiens
tggagagataggaa

SEQ ID NO: 546672 - DNA, 13 bp, Homo sapiens
tggagatggggag

SEQ ID NO: 546673 - DNA, 15 bp, Homo sapiens
tggagatggggagaa

SEQ ID NO: 546674 - DNA, 13 bp, Homo sapiens
tggagcctgacag

SEQ ID NO: 546675 - DNA, 18 bp, Homo sapiens
tggagcctgacagccaga

SEQ ID NO: 546676 - DNA, 15 bp, Homo sapiens
tggaggagagcctgg

SEQ ID NO: 546677 - DNA, 18 bp, Homo sapiens
tggagggctgcagagcct

SEQ ID NO: 546678 - DNA, 14 bp, Homo sapiens
tggagtagagtcag

SEQ ID NO: 546679 - DNA, 23 bp, Homo sapiens
tggagtccagacctgggccctgg

SEQ ID NO: 546680 - DNA, 16 bp, Homo sapiens
tggagtgcaaaaggct

SEQ ID NO: 546681 - DNA, 12 bp, Homo sapiens
tggataagaaaa

SEQ ID NO: 546682 - DNA, 16 bp, Homo sapiens
tggatagattgtttta

SEQ ID NO: 546683 - DNA, 20 bp, Homo sapiens
tggatcaggaacccttacag

SEQ ID NO: 546684 - DNA, 19 bp, Homo sapiens
tggatggcacaatgaatgt

SEQ ID NO: 546685 - DNA, 16 bp, Homo sapiens
tggattttatgttgac

SEQ ID NO: 546686 - DNA, 13 bp, Homo sapiens
tggcaaaatatta

SEQ ID NO: 546687 - DNA, 17 bp, Homo sapiens
tggcaaaatattatgtt

SEQ ID NO: 546688 - DNA, 19 bp, Homo sapiens
tggcaaagctgttcttcct

SEQ ID NO: 546689 - DNA, 14 bp, Homo sapiens
tggcaaatataaaa

SEQ ID NO: 546690 - DNA, 22 bp, Homo sapiens
tggcaaatattttgtcactgct

SEQ ID NO: 546691 - DNA, 13 bp, Homo sapiens
tggcaacaaactg

SEQ ID NO: 546692 - DNA, 17 bp, Homo sapiens
tggcaacaaactgcaca

SEQ ID NO: 546693 - DNA, 18 bp, Homo sapiens
tggcaacaaactgcacat

SEQ ID NO: 546694 - DNA, 23 bp, Homo sapiens
tggcaagttttgatatgagtata

SEQ ID NO: 546695 - DNA, 15 bp, Homo sapiens
tggcaatattctgta

SEQ ID NO: 546696 - DNA, 15 bp, Homo sapiens
tggcacaatgaatgt

SEQ ID NO: 546697 - DNA, 16 bp, Homo sapiens
tggcaccaataaagga

SEQ ID NO: 546698 - DNA, 22 bp, Homo sapiens
tggcaccaataaaggaggaatc

SEQ ID NO: 546699 - DNA, 13 bp, Homo sapiens
tggcacctgtctg

SEQ ID NO: 546700 - DNA, 14 bp, Homo sapiens
tggcactttaatga

SEQ ID NO: 546701 - DNA, 21 bp, Homo sapiens
tggcagatgcagctcttcctg

SEQ ID NO: 546702 - DNA, 22 bp, Homo sapiens
tggcaggagacactggtctcag

SEQ ID NO: 546703 - DNA, 17 bp, Homo sapiens
tggcagggcaggcagag

SEQ ID NO: 546704 - DNA, 19 bp, Homo sapiens
tggcagggcaggcagagct

SEQ ID NO: 546705 - DNA, 23 bp, Homo sapiens
tggcaggtaggaatattatattt

SEQ ID NO: 546706 - DNA, 16 bp, Homo sapiens
tggcatggatttctgt

SEQ ID NO: 546707 - DNA, 13 bp, Homo sapiens
tggccactgtatt

SEQ ID NO: 546708 - DNA, 15 bp, Homo sapiens
tggccactgtatttg

SEQ ID NO: 546709 - DNA, 16 bp, Homo sapiens
tggccactttaagaga

SEQ ID NO: 546710 - DNA, 17 bp, Homo sapiens
tggccagaccaggtgac

SEQ ID NO: 546711 - DNA, 17 bp, Homo sapiens
tggccagggctccacgg

SEQ ID NO: 546712 - DNA, 14 bp, Homo sapiens
tggcccccactggc

SEQ ID NO: 546713 - DNA, 12 bp, Homo sapiens
tggcccctccca

SEQ ID NO: 546714 - DNA, 16 bp, Homo sapiens
tggcccctcccacatc

SEQ ID NO: 546715 - DNA, 12 bp, Homo sapiens
tggccctggggc

SEQ ID NO: 546716 - DNA, 19 bp, Homo sapiens
tggcccttgcttacctctc

SEQ ID NO: 546717 - DNA, 21 bp, Homo sapiens
tggcctaatattgaaaatgtc

SEQ ID NO: 546718 - DNA, 20 bp, Homo sapiens
tggcctctcactgcctcccc

SEQ ID NO: 546719 - DNA, 16 bp, Homo sapiens
tggcctggccagacca

SEQ ID NO: 546720 - DNA, 22 bp, Homo sapiens
tggcctgtgcgatcccacccgt

SEQ ID NO: 546721 - DNA, 18 bp, Homo sapiens
tggcgctagaggccatgg

SEQ ID NO: 546722 - DNA, 13 bp, Homo sapiens
tggctccagcctg

SEQ ID NO: 546723 - DNA, 15 bp, Homo sapiens
tggctccagcctgga

SEQ ID NO: 546724 - DNA, 14 bp, Homo sapiens
tggctcctcccgaa

SEQ ID NO: 546725 - DNA, 23 bp, Homo sapiens
tggctgggctacaatttgttaat

SEQ ID NO: 546726 - DNA, 13 bp, Homo sapiens
tggcttcagcccc

SEQ ID NO: 546727 - DNA, 15 bp, Homo sapiens
tggcttcagcccctg

SEQ ID NO: 546728 - DNA, 12 bp, Homo sapiens
tggctttgtgct

SEQ ID NO: 546729 - DNA, 13 bp, Homo sapiens
tgggaacataaaa

SEQ ID NO: 546730 - DNA, 21 bp, Homo sapiens
tgggaacataaaaactactga

SEQ ID NO: 546731 - DNA, 20 bp, Homo sapiens
tgggaatgtatagtatttga

SEQ ID NO: 546732 - DNA, 13 bp, Homo sapiens
tgggacacagaga

SEQ ID NO: 546733 - DNA, 15 bp, Homo sapiens
tgggacgctctgctg

SEQ ID NO: 546734 - DNA, 16 bp, Homo sapiens
tgggacgctctgctgt

SEQ ID NO: 546735 - DNA, 14 bp, Homo sapiens
tgggacttcttacc

SEQ ID NO: 546736 - DNA, 22 bp, Homo sapiens
tcttttcgccgtggctgcggca

SEQ ID NO: 546737 - DNA, 18 bp, Homo sapiens
tcttttgcatgtcgcaca

SEQ ID NO: 546738 - DNA, 19 bp, Homo sapiens
tctttttaagcctttgaag

SEQ ID NO: 546739 - DNA, 19 bp, Homo sapiens
tcttttttacaaaggctgt

SEQ ID NO: 546740 - DNA, 19 bp, Homo sapiens
tcttttttttttaagtgaa

SEQ ID NO: 546741 - DNA, 18 bp, Homo sapiens
tgaaaaagacttcaaatg

SEQ ID NO: 546742 - DNA, 21 bp, Homo sapiens
tgaaaaccctcgatgttcatg

SEQ ID NO: 546743 - DNA, 17 bp, Homo sapiens
tgaaaacctctttcgga

SEQ ID NO: 546744 - DNA, 12 bp, Homo sapiens
tgaaaactggaa

SEQ ID NO: 546745 - DNA, 13 bp, Homo sapiens
tgaaaactggaat

SEQ ID NO: 546746 - DNA, 11 bp, Homo sapiens
tgaaaagaaaa

SEQ ID NO: 546747 - DNA, 18 bp, Homo sapiens
tgaaaagaccaagacttt

SEQ ID NO: 546748 - DNA, 13 bp, Homo sapiens
tgaaaatgtcact

SEQ ID NO: 546749 - DNA, 22 bp, Homo sapiens
tgaaaatgtcactgttataaat

SEQ ID NO: 546750 - DNA, 18 bp, Homo sapiens
tgaaaattttattgaata

SEQ ID NO: 546751 - DNA, 14 bp, Homo sapiens
tgaaacacaatatc

SEQ ID NO: 546752 - DNA, 19 bp, Homo sapiens
tgaaacattgcttttaaaa

SEQ ID NO: 546753 - DNA, 14 bp, Homo sapiens
tgaaactgtattta

SEQ ID NO: 546754 - DNA, 21 bp, Homo sapiens
tgaaactgtatttacttgtta

SEQ ID NO: 546755 - DNA, 20 bp, Homo sapiens
tgaaagctgtttcatttgtg

SEQ ID NO: 546756 - DNA, 17 bp, Homo sapiens
tgaaaggaattttgcta

SEQ ID NO: 546757 - DNA, 13 bp, Homo sapiens
tgaaagggacaag

SEQ ID NO: 546758 - DNA, 16 bp, Homo sapiens
tgaaagggacaagtat

SEQ ID NO: 546759 - DNA, 14 bp, Homo sapiens
tgaaagtcagttta

SEQ ID NO: 546760 - DNA, 14 bp, Homo sapiens
tgaaagtgccaaaa

SEQ ID NO: 546761 - DNA, 17 bp, Homo sapiens
tgaaagtgccaaaataa

SEQ ID NO: 546762 - DNA, 22 bp, Homo sapiens
tgaaagtgccaaaataaagtct

SEQ ID NO: 546763 - DNA, 11 bp, Homo sapiens
tgaaagttgtg

SEQ ID NO: 546764 - DNA, 15 bp, Homo sapiens
tgaaagttgtgatct

SEQ ID NO: 546765 - DNA, 22 bp, Homo sapiens
tgaaatacatatgataaatttg

SEQ ID NO: 546766 - DNA, 17 bp, Homo sapiens
tgaaatattttctactt

SEQ ID NO: 546767 - DNA, 12 bp, Homo sapiens
tgaaatgtgtgt

SEQ ID NO: 546768 - DNA, 15 bp, Homo sapiens
tgaaattatatctgt

SEQ ID NO: 546769 - DNA, 14 bp, Homo sapiens
tgaaattcacaaag

SEQ ID NO: 546770 - DNA, 12 bp, Homo sapiens
tgaaatttaagc

SEQ ID NO: 546771 - DNA, 15 bp, Homo sapiens
tgaaatttattgagg

SEQ ID NO: 546772 - DNA, 23 bp, Homo sapiens
tgaaatttattgaggaaaaatat

SEQ ID NO: 546773 - DNA, 14 bp, Homo sapiens
tgaaatttttcata

SEQ ID NO: 546774 - DNA, 16 bp, Homo sapiens
tgaaatttttcatatt

SEQ ID NO: 546775 - DNA, 21 bp, Homo sapiens
tgaaatttttcatattttaat

SEQ ID NO: 546776 - DNA, 18 bp, Homo sapiens
tgaacaacgagccttttc

SEQ ID NO: 546777 - DNA, 17 bp, Homo sapiens
tgaacacaaattatgct

SEQ ID NO: 546778 - DNA, 14 bp, Homo sapiens
tgaactgctgctgg

SEQ ID NO: 546779 - DNA, 13 bp, Homo sapiens
tgaactttctcag

SEQ ID NO: 546780 - DNA, 13 bp, Homo sapiens
tgaacttttcaaa

SEQ ID NO: 546781 - DNA, 22 bp, Homo sapiens
tgaacttttcaaaataaagctt

SEQ ID NO: 546782 - DNA, 23 bp, Homo sapiens
tgaagaaaacagctgcatggcac

SEQ ID NO: 546783 - DNA, 18 bp, Homo sapiens
tgaagaaacagataccat

SEQ ID NO: 546784 - DNA, 22 bp, Homo sapiens
tgaagacctaaccagggccaga

SEQ ID NO: 546785 - DNA, 23 bp, Homo sapiens
tgaagagcaagagagcagcaagg

SEQ ID NO: 546786 - DNA, 14 bp, Homo sapiens
tgaagatctttgtt

SEQ ID NO: 546787 - DNA, 16 bp, Homo sapiens
tgaagcagagtcaagc

SEQ ID NO: 546788 - DNA, 23 bp, Homo sapiens
tgaagcagagtcaagctgatgaa

SEQ ID NO: 546789 - DNA, 19 bp, Homo sapiens
tgaagcagatttatttttg

SEQ ID NO: 546790 - DNA, 17 bp, Homo sapiens
tgaagcctgctccttcc

SEQ ID NO: 546791 - DNA, 18 bp, Homo sapiens
tgaagcctgctccttccc

SEQ ID NO: 546792 - DNA, 18 bp, Homo sapiens
tgaaggaggtgagagaag

SEQ ID NO: 546793 - DNA, 23 bp, Homo sapiens
tgaagggaaggaagaggaagagt

SEQ ID NO: 546794 - DNA, 16 bp, Homo sapiens
tgaagtcatgctcccc

SEQ ID NO: 546795 - DNA, 23 bp, Homo sapiens
tgaagtgcctctgattctatgta

SEQ ID NO: 546796 - DNA, 12 bp, Homo sapiens
tgaagttatatt

SEQ ID NO: 546797 - DNA, 14 bp, Homo sapiens
tgaataaatcatgt

SEQ ID NO: 546798 - DNA, 18 bp, Homo sapiens
tgaatagacataaattgt

SEQ ID NO: 546799 - DNA, 17 bp, Homo sapiens
tgaatagcagtggcaaa

SEQ ID NO: 546800 - DNA, 21 bp, Homo sapiens
tgaatccaaaagaaaaacagc

SEQ ID NO: 546801 - DNA, 17 bp, Homo sapiens
tgaatctgaccacagac

SEQ ID NO: 546802 - DNA, 15 bp, Homo sapiens
tgaattactaacttc

SEQ ID NO: 546803 - DNA, 18 bp, Homo sapiens
tgaattactaacttctaa

SEQ ID NO: 546804 - DNA, 19 bp, Homo sapiens
tgaattactaacttctaaa

SEQ ID NO: 546805 - DNA, 15 bp, Homo sapiens
tgaattgagctagaa

SEQ ID NO: 546806 - DNA, 23 bp, Homo sapiens
tgaattggccagaggaaatctga

SEQ ID NO: 546807 - DNA, 22 bp, Homo sapiens
tgaattggctgccaagagtcca

SEQ ID NO: 546808 - DNA, 18 bp, Homo sapiens
tgaatttggggctactta

SEQ ID NO: 546809 - DNA, 19 bp, Homo sapiens
tgaatttggggctacttat

SEQ ID NO: 546810 - DNA, 11 bp, Homo sapiens
tgaattttcat

SEQ ID NO: 546811 - DNA, 18 bp, Homo sapiens
tgaattttcattttacag

SEQ ID NO: 546812 - DNA, 18 bp, Homo sapiens
tgaattttttcctaccat

SEQ ID NO: 546813 - DNA, 14 bp, Homo sapiens
tgacaaagcttccc

SEQ ID NO: 546814 - DNA, 17 bp, Homo sapiens
tgacaagtttaaaggct

SEQ ID NO: 546815 - DNA, 16 bp, Homo sapiens
tgacaataagaaacag

SEQ ID NO: 546816 - DNA, 16 bp, Homo sapiens
tgacacagcagcttca

SEQ ID NO: 546817 - DNA, 16 bp, Homo sapiens
tgacaccttttcaggt

SEQ ID NO: 546818 - DNA, 18 bp, Homo sapiens
tgacactcatcaggtaaa

SEQ ID NO: 546819 - DNA, 16 bp, Homo sapiens
tgacactgtctgctgc

SEQ ID NO: 546820 - DNA, 15 bp, Homo sapiens
tgacagcaaacacag

SEQ ID NO: 546821 - DNA, 20 bp, Homo sapiens
tgacagcatttcagctgtga

SEQ ID NO: 546822 - DNA, 21 bp, Homo sapiens
tgacagcatttcagctgtgag

SEQ ID NO: 546823 - DNA, 19 bp, Homo sapiens
tgacagcccctccctcctc

SEQ ID NO: 546824 - DNA, 19 bp, Homo sapiens
tgacagtgaggtcctgggg

SEQ ID NO: 546825 - DNA, 20 bp, Homo sapiens
tgacatgcgggctgggcagc

SEQ ID NO: 546826 - DNA, 21 bp, Homo sapiens
tgacatgcgggctgggcagct

SEQ ID NO: 546827 - DNA, 22 bp, Homo sapiens
tgacatttcaatcactgaaaat

SEQ ID NO: 546828 - DNA, 19 bp, Homo sapiens
tgacatttgtcattttcat

SEQ ID NO: 546829 - DNA, 20 bp, Homo sapiens
tgacatttgtcattttcatt

SEQ ID NO: 546830 - DNA, 24 bp, Homo sapiens
tgacatttgtttggttatagtgca

SEQ ID NO: 546831 - DNA, 19 bp, Homo sapiens
tgaccaaatatcaccagga

SEQ ID NO: 546832 - DNA, 22 bp, Homo sapiens
tgaccaaatatcaccaggactg

SEQ ID NO: 546833 - DNA, 23 bp, Homo sapiens
tgaccaatcgggagtagcaagga

SEQ ID NO: 546834 - DNA, 16 bp, Homo sapiens
tgaccaattttaactt

SEQ ID NO: 546835 - DNA, 19 bp, Homo sapiens
tgaccagtggctatggcct

SEQ ID NO: 546836 - DNA, 13 bp, Homo sapiens
tgacccctgccca

SEQ ID NO: 546837 - DNA, 13 bp, Homo sapiens
tgacccgtacaca

SEQ ID NO: 546838 - DNA, 15 bp, Homo sapiens
tgacccgtacacacc

SEQ ID NO: 546839 - DNA, 18 bp, Homo sapiens
tgaccctggagcccggca

SEQ ID NO: 546840 - DNA, 14 bp, Homo sapiens
tgaccggggtcctg

SEQ ID NO: 546841 - DNA, 20 bp, Homo sapiens
tcttcctggtcgaaagttag

SEQ ID NO: 546842 - DNA, 12 bp, Homo sapiens
tcttctccccca

SEQ ID NO: 546843 - DNA, 16 bp, Homo sapiens
tcttctccccttccat

SEQ ID NO: 546844 - DNA, 14 bp, Homo sapiens
tcttctctctgctc

SEQ ID NO: 546845 - DNA, 17 bp, Homo sapiens
tcttctctctgctctga

SEQ ID NO: 546846 - DNA, 16 bp, Homo sapiens
tcttctctctgtgctg

SEQ ID NO: 546847 - DNA, 11 bp, Homo sapiens
tcttgcaattt

SEQ ID NO: 546848 - DNA, 15 bp, Homo sapiens
tcttgcaatttgaag

SEQ ID NO: 546849 - DNA, 16 bp, Homo sapiens
tcttgcaatttgaagg

SEQ ID NO: 546850 - DNA, 19 bp, Homo sapiens
tcttggaactgcaccaccg

SEQ ID NO: 546851 - DNA, 21 bp, Homo sapiens
tcttgggcaatattctctgta

SEQ ID NO: 546852 - DNA, 17 bp, Homo sapiens
tcttgtgtatttcagtt

SEQ ID NO: 546853 - DNA, 13 bp, Homo sapiens
tcttgttttgctt

SEQ ID NO: 546854 - DNA, 20 bp, Homo sapiens
tcttgttttgttgatttttc

SEQ ID NO: 546855 - DNA, 23 bp, Homo sapiens
tctttaaaatgattcacttttat

SEQ ID NO: 546856 - DNA, 15 bp, Homo sapiens
tctttagaacaacat

SEQ ID NO: 546857 - DNA, 14 bp, Homo sapiens
tctttatacagatt

SEQ ID NO: 546858 - DNA, 20 bp, Homo sapiens
tctttcaagggctttcctgt

SEQ ID NO: 546859 - DNA, 16 bp, Homo sapiens
tctttccatttctctc

SEQ ID NO: 546860 - DNA, 24 bp, Homo sapiens
tctttccatttctctctccagtct

SEQ ID NO: 546861 - DNA, 16 bp, Homo sapiens
tctttcccttccagtt

SEQ ID NO: 546862 - DNA, 12 bp, Homo sapiens
tctttcctctta

SEQ ID NO: 546863 - DNA, 14 bp, Homo sapiens
tctttgaaaactca

SEQ ID NO: 546864 - DNA, 16 bp, Homo sapiens
tctttgaattttcatt

SEQ ID NO: 546865 - DNA, 22 bp, Homo sapiens
tctttgccctttacttgtcttt

SEQ ID NO: 546866 - DNA, 17 bp, Homo sapiens
tctttgtaagagcaaaa

SEQ ID NO: 546867 - DNA, 14 bp, Homo sapiens
tctttgttaatttg

SEQ ID NO: 546868 - DNA, 20 bp, Homo sapiens
tctttgttttttgttttcat

SEQ ID NO: 546869 - DNA, 16 bp, Homo sapiens
tcttttaaaaagtatt

SEQ ID NO: 546870 - DNA, 17 bp, Homo sapiens
tcttttaaaaagtattg

SEQ ID NO: 546871 - DNA, 17 bp, Homo sapiens
tacctataatgtgtgta

SEQ ID NO: 546872 - DNA, 18 bp, Homo sapiens
tacctataatgtgtgtat

SEQ ID NO: 546873 - DNA, 18 bp, Homo sapiens
tacctattgctgtaaata

SEQ ID NO: 546874 - DNA, 13 bp, Homo sapiens
tacctctaactgt

SEQ ID NO: 546875 - DNA, 18 bp, Homo sapiens
tacctctgcataaatatt

SEQ ID NO: 546876 - DNA, 20 bp, Homo sapiens
tacctggcttagcgttctgt

SEQ ID NO: 546877 - DNA, 22 bp, Homo sapiens
tacctggcttagcgttctgttt

SEQ ID NO: 546878 - DNA, 14 bp, Homo sapiens
tacctgtacacaca

SEQ ID NO: 546879 - DNA, 14 bp, Homo sapiens
tacctgtaggtcta

SEQ ID NO: 546880 - DNA, 12 bp, Homo sapiens
taccttaaaatt

SEQ ID NO: 546881 - DNA, 17 bp, Homo sapiens
taccttaaaatttgaaa

SEQ ID NO: 546882 - DNA, 20 bp, Homo sapiens
taccttaaaatttgaaacat

SEQ ID NO: 546883 - DNA, 21 bp, Homo sapiens
taccttgcacacatcatctgt

SEQ ID NO: 546884 - DNA, 20 bp, Homo sapiens
tacgagtaattgcatttgct

SEQ ID NO: 546885 - DNA, 18 bp, Homo sapiens
tacgcaattgtatatata

SEQ ID NO: 546886 - DNA, 20 bp, Homo sapiens
tacgcaattgtatatatatg

SEQ ID NO: 546887 - DNA, 13 bp, Homo sapiens
tacgcacgcaccc

SEQ ID NO: 546888 - DNA, 14 bp, Homo sapiens
tactaaacatttcc

SEQ ID NO: 546889 - DNA, 23 bp, Homo sapiens
tactaaacatttcctttttctat

SEQ ID NO: 546890 - DNA, 17 bp, Homo sapiens
tactaacttctaaaact

SEQ ID NO: 546891 - DNA, 19 bp, Homo sapiens
tactaacttctaaaactgt

SEQ ID NO: 546892 - DNA, 16 bp, Homo sapiens
tactatggaagccaca

SEQ ID NO: 546893 - DNA, 14 bp, Homo sapiens
tctaccttttctct

SEQ ID NO: 546894 - DNA, 19 bp, Homo sapiens
tctactaatgcctcttcat

SEQ ID NO: 546895 - DNA, 20 bp, Homo sapiens
tctacttacacatcttccac

SEQ ID NO: 546896 - DNA, 16 bp, Homo sapiens
tctagacactttttct

SEQ ID NO: 546897 - DNA, 15 bp, Homo sapiens
tctagcacttccttg

SEQ ID NO: 546898 - DNA, 17 bp, Homo sapiens
tctagcacttccttgcc

SEQ ID NO: 546899 - DNA, 18 bp, Homo sapiens
tctagcacttccttgcca

SEQ ID NO: 546900 - DNA, 20 bp, Homo sapiens
tctaggacccccagtgctca

SEQ ID NO: 546901 - DNA, 23 bp, Homo sapiens
tctatagaaagtgttctgttaca

SEQ ID NO: 546902 - DNA, 15 bp, Homo sapiens
tctatgctcataact

SEQ ID NO: 546903 - DNA, 19 bp, Homo sapiens
tctatgtaacttgttgcag

SEQ ID NO: 546904 - DNA, 21 bp, Homo sapiens
tctatttccccctttcttcct

SEQ ID NO: 546905 - DNA, 18 bp, Homo sapiens
tctcaaaataaaaccaga

SEQ ID NO: 546906 - DNA, 21 bp, Homo sapiens
tctcaaaggagctttctcaat

SEQ ID NO: 546907 - DNA, 23 bp, Homo sapiens
tctcactgctttaggattgaagt

SEQ ID NO: 546908 - DNA, 20 bp, Homo sapiens
tctcagaagtgaaaaagact

SEQ ID NO: 546909 - DNA, 17 bp, Homo sapiens
tctcagcatatatataa

SEQ ID NO: 546910 - DNA, 12 bp, Homo sapiens
tctcagtttttc

SEQ ID NO: 546911 - DNA, 13 bp, Homo sapiens
tctcagtttttct

SEQ ID NO: 546912 - DNA, 14 bp, Homo sapiens
tctcatcttttatc

SEQ ID NO: 546913 - DNA, 22 bp, Homo sapiens
tctccacagggacacagtctgg

SEQ ID NO: 546914 - DNA, 20 bp, Homo sapiens
taaaatcccattgtatttaa

SEQ ID NO: 546915 - DNA, 17 bp, Homo sapiens
taaaatctgtattgcta

SEQ ID NO: 546916 - DNA, 17 bp, Homo sapiens
taaaatcttattaaagt

SEQ ID NO: 546917 - DNA, 23 bp, Homo sapiens
taaaatgagtcacttacttcata

SEQ ID NO: 546918 - DNA, 23 bp, Homo sapiens
taaaatgattcacttttattgta

SEQ ID NO: 546919 - DNA, 23 bp, Homo sapiens
taaaatgcggcactatttctgaa

SEQ ID NO: 546920 - DNA, 17 bp, Homo sapiens
taaaatggcaacaaact

SEQ ID NO: 546921 - DNA, 21 bp, Homo sapiens
taaaatgttttcagctaggaa

SEQ ID NO: 546922 - DNA, 15 bp, Homo sapiens
taaaattaaaattta

SEQ ID NO: 546923 - DNA, 18 bp, Homo sapiens
taaaattaaaatttaaca

SEQ ID NO: 546924 - DNA, 15 bp, Homo sapiens
taaaattatacctgt

SEQ ID NO: 546925 - DNA, 16 bp, Homo sapiens
taaaatttaacatctg

SEQ ID NO: 546926 - DNA, 12 bp, Homo sapiens
taaaatttgaaa

SEQ ID NO: 546927 - DNA, 16 bp, Homo sapiens
taaaatttgaaacatt

SEQ ID NO: 546928 - DNA, 19 bp, Homo sapiens
taaaattttaagctaggaa

SEQ ID NO: 546929 - DNA, 20 bp, Homo sapiens
taaacatcaggttaggcagt

SEQ ID NO: 546930 - DNA, 13 bp, Homo sapiens
taaacatttcctt

SEQ ID NO: 546931 - DNA, 14 bp, Homo sapiens
taaaccaaaggaca

SEQ ID NO: 546932 - DNA, 23 bp, Homo sapiens
taaaccaaaggacattatgtgtg

SEQ ID NO: 546933 - DNA, 14 bp, Homo sapiens
taaacctgaacaaa

SEQ ID NO: 546934 - DNA, 23 bp, Homo sapiens
taaacgtattttgatcagtgtta

SEQ ID NO: 546935 - DNA, 12 bp, Homo sapiens
taaactagcaaa

SEQ ID NO: 546936 - DNA, 15 bp, Homo sapiens
taaactttaatatgt

SEQ ID NO: 546937 - DNA, 17 bp, Homo sapiens
taaactttaatatgtat

SEQ ID NO: 546938 - DNA, 11 bp, Homo sapiens
taaactttgaa

SEQ ID NO: 546939 - DNA, 14 bp, Homo sapiens
taaactttgaaata

SEQ ID NO: 546940 - DNA, 16 bp, Homo sapiens
taaactttgaaatata

SEQ ID NO: 546941 - DNA, 17 bp, Homo sapiens
taaactttgaaatatat

SEQ ID NO: 546942 - DNA, 14 bp, Homo sapiens
taaagaaagtcata

SEQ ID NO: 546943 - DNA, 22 bp, Homo sapiens
taaagatctttttttaagtgtt

SEQ ID NO: 546944 - DNA, 14 bp, Homo sapiens
taaagcttttgcat

SEQ ID NO: 546945 - DNA, 16 bp, Homo sapiens
taaagcttttgcatag

SEQ ID NO: 546946 - DNA, 13 bp, Homo sapiens
taaaggaggaatc

SEQ ID NO: 546947 - DNA, 15 bp, Homo sapiens
taaaggaggaatcag

SEQ ID NO: 546948 - DNA, 19 bp, Homo sapiens
taaagtctgtcatgccaaa

SEQ ID NO: 546949 - DNA, 12 bp, Homo sapiens
taaagtgtaata

SEQ ID NO: 546950 - DNA, 17 bp, Homo sapiens
taaagtttgatcttcct

SEQ ID NO: 546951 - DNA, 21 bp, Homo sapiens
taaataaaaaataataataca

SEQ ID NO: 546952 - DNA, 23 bp, Homo sapiens
taaataaaaaataataatacaag

SEQ ID NO: 546953 - DNA, 17 bp, Homo sapiens
taaataaaaatagctat

SEQ ID NO: 546954 - DNA, 14 bp, Homo sapiens
taaataaaaattat

SEQ ID NO: 546955 - DNA, 15 bp, Homo sapiens
taatgtgtgtatgtg

SEQ ID NO: 546956 - DNA, 16 bp, Homo sapiens
taatgtgtgtatgtgt

SEQ ID NO: 546957 - DNA, 18 bp, Homo sapiens
taatgtgtgtatgtgtat

SEQ ID NO: 546958 - DNA, 17 bp, Homo sapiens
taatgttgatttctagt

SEQ ID NO: 546959 - DNA, 18 bp, Homo sapiens
taatgttgatttctagtt

SEQ ID NO: 546960 - DNA, 22 bp, Homo sapiens
taattaaatgaaatacttgaca

SEQ ID NO: 546961 - DNA, 19 bp, Homo sapiens
taattaattctcagattcc

SEQ ID NO: 546962 - DNA, 16 bp, Homo sapiens
taattacaatatttct

SEQ ID NO: 546963 - DNA, 22 bp, Homo sapiens
taattagagcagatgacccctc

SEQ ID NO: 546964 - DNA, 16 bp, Homo sapiens
taattaggttaacatt

SEQ ID NO: 546965 - DNA, 16 bp, Homo sapiens
taattctgaagttata

SEQ ID NO: 546966 - DNA, 17 bp, Homo sapiens
taattctgaagttatat

SEQ ID NO: 546967 - DNA, 19 bp, Homo sapiens
taattctgaagttatattt

SEQ ID NO: 546968 - DNA, 22 bp, Homo sapiens
taattcttattccatattagaa

SEQ ID NO: 546969 - DNA, 11 bp, Homo sapiens
taattgaaagg

SEQ ID NO: 546970 - DNA, 16 bp, Homo sapiens
taattgaaagggacaa

SEQ ID NO: 546971 - DNA, 20 bp, Homo sapiens
taattgaaagggacaagtat

SEQ ID NO: 546972 - DNA, 20 bp, Homo sapiens
taatttaggagttttgagaa

SEQ ID NO: 546973 - DNA, 13 bp, Homo sapiens
taatttatctgtt

SEQ ID NO: 546974 - DNA, 17 bp, Homo sapiens
taatttccttaaagcaa

SEQ ID NO: 546975 - DNA, 17 bp, Homo sapiens
taatttggaccattttc

SEQ ID NO: 546976 - DNA, 17 bp, Homo sapiens
taattttgttttaaact

SEQ ID NO: 546977 - DNA, 20 bp, Homo sapiens
taattttgttttaaactgtg

SEQ ID NO: 546978 - DNA, 15 bp, Homo sapiens
tacaaaaaaaatcaa

SEQ ID NO: 546979 - DNA, 13 bp, Homo sapiens
tacaaaaacacaa

SEQ ID NO: 546980 - DNA, 20 bp, Homo sapiens
tacaaaaccacagtgtacca

SEQ ID NO: 546981 - DNA, 21 bp, Homo sapiens
tacaaaaccacagtgtaccat

SEQ ID NO: 546982 - DNA, 15 bp, Homo sapiens
tacaaaatgtaactg

SEQ ID NO: 546983 - DNA, 14 bp, Homo sapiens
tacaaaatgtgtgc

SEQ ID NO: 546984 - DNA, 14 bp, Homo sapiens
tacaaacaagcata

SEQ ID NO: 546985 - DNA, 17 bp, Homo sapiens
tacaaaggctgtattca

SEQ ID NO: 546986 - DNA, 18 bp, Homo sapiens
tacaaatgattgctttta

SEQ ID NO: 546987 - DNA, 19 bp, Homo sapiens
tacaaatgattgcttttaa

SEQ ID NO: 546988 - DNA, 20 bp, Homo sapiens
tacaaatgattgcttttaaa

SEQ ID NO: 546989 - DNA, 21 bp, Homo sapiens
tacaaatgattgcttttaaaa

SEQ ID NO: 546990 - DNA, 23 bp, Homo sapiens
tacaaatgattgcttttaaaatt

SEQ ID NO: 546991 - DNA, 22 bp, Homo sapiens
tacaacacattgaaactgtatt

SEQ ID NO: 546992 - DNA, 20 bp, Homo sapiens
tacaacaccagcaacattat

SEQ ID NO: 546993 - DNA, 14 bp, Homo sapiens
tacaagactgtaaa

SEQ ID NO: 546994 - DNA, 18 bp, Homo sapiens
tacaatacaacacattga

SEQ ID NO: 546995 - DNA, 23 bp, Homo sapiens
tacaatacaacacattgaaactg

SEQ ID NO: 546996 - DNA, 23 bp, Homo sapiens
tacaatttacttttaataaagta

SEQ ID NO: 546997 - DNA, 20 bp, Homo sapiens
tacaatttgttaattcctat

SEQ ID NO: 546998 - DNA, 20 bp, Homo sapiens
tacacaattaattcatccct

SEQ ID NO: 546999 - DNA, 16 bp, Homo sapiens
tacacacacagacaca

SEQ ID NO: 547000 - DNA, 14 bp, Homo sapiens
tacacatacatata

SEQ ID NO: 547001 - DNA, 16 bp, Homo sapiens
tacacatacatatata

SEQ ID NO: 547002 - DNA, 18 bp, Homo sapiens
tacacatacatatataca

SEQ ID NO: 547003 - DNA, 13 bp, Homo sapiens
tacacatatacct

SEQ ID NO: 547004 - DNA, 14 bp, Homo sapiens
tacacgtgtatatg

SEQ ID NO: 547005 - DNA, 16 bp, Homo sapiens
tacacgtgtatatgag

SEQ ID NO: 547006 - DNA, 16 bp, Homo sapiens
tacacttgtataaatg

SEQ ID NO: 547007 - DNA, 20 bp, Homo sapiens
tacacttgtataaatgtata

SEQ ID NO: 547008 - DNA, 22 bp, Homo sapiens
tacagaacactttgctaggaga

SEQ ID NO: 547009 - DNA, 19 bp, Homo sapiens
tacagaaccaattcacttt

SEQ ID NO: 547010 - DNA, 22 bp, Homo sapiens
tacagaaccaattcactttaga

SEQ ID NO: 547011 - DNA, 13 bp, Homo sapiens
tacagaatactag

SEQ ID NO: 547012 - DNA, 19 bp, Homo sapiens
tacagagccgtaaaaactg

SEQ ID NO: 547013 - DNA, 20 bp, Homo sapiens
tacagagccgtaaaaactga

SEQ ID NO: 547014 - DNA, 16 bp, Homo sapiens
tacagctcccccagct

SEQ ID NO: 547015 - DNA, 18 bp, Homo sapiens
tacagctcccccagctcc

SEQ ID NO: 547016 - DNA, 20 bp, Homo sapiens
tacagctctcccctcccttg

SEQ ID NO: 547017 - DNA, 14 bp, Homo sapiens
tacaggtactttgt

SEQ ID NO: 547018 - DNA, 15 bp, Homo sapiens
tacaggtactttgtc

SEQ ID NO: 547019 - DNA, 20 bp, Homo sapiens
tacaggtactttgtctaaga

SEQ ID NO: 547020 - DNA, 13 bp, Homo sapiens
tacaggtcatctg

SEQ ID NO: 547021 - DNA, 19 bp, Homo sapiens
tacaggtcatctgctggga

SEQ ID NO: 547022 - DNA, 22 bp, Homo sapiens
tacagtagctgtggggagctgg

SEQ ID NO: 547023 - DNA, 17 bp, Homo sapiens
tacagtctctttcttcc

SEQ ID NO: 547024 - DNA, 22 bp, Homo sapiens
tacagtctctttcttcctttct

SEQ ID NO: 547025 - DNA, 16 bp, Homo sapiens
tacagtggcagtattg

SEQ ID NO: 547026 - DNA, 14 bp, Homo sapiens
tacagtgtgtagtt

SEQ ID NO: 547027 - DNA, 17 bp, Homo sapiens
tacagttacttttcctt

SEQ ID NO: 547028 - DNA, 14 bp, Homo sapiens
tacatacacttgta

SEQ ID NO: 547029 - DNA, 22 bp, Homo sapiens
tacatacacttgtataaatgta

SEQ ID NO: 547030 - DNA, 20 bp, Homo sapiens
tacatacgcaattgtatata

SEQ ID NO: 547031 - DNA, 20 bp, Homo sapiens
tacatatatacattttgcag

SEQ ID NO: 547032 - DNA, 16 bp, Homo sapiens
tacatctgatatcagg

SEQ ID NO: 547033 - DNA, 18 bp, Homo sapiens
tacatctgatatcaggaa

SEQ ID NO: 547034 - DNA, 17 bp, Homo sapiens
tacatgatgatttcaga

SEQ ID NO: 547035 - DNA, 14 bp, Homo sapiens
tacatgtgtgtata

SEQ ID NO: 547036 - DNA, 21 bp, Homo sapiens
tacatgtgtgtatatatgtgt

SEQ ID NO: 547037 - DNA, 15 bp, Homo sapiens
tacatttatgtgtga

SEQ ID NO: 547038 - DNA, 20 bp, Homo sapiens
tacatttttagcctgtgtca

SEQ ID NO: 547039 - DNA, 16 bp, Homo sapiens
tacatttttgatcaaa

SEQ ID NO: 547040 - DNA, 22 bp, Homo sapiens
tacatttttgatcaaatgtaca

SEQ ID NO: 547041 - DNA, 14 bp, Homo sapiens
taccaaatgccttt

SEQ ID NO: 547042 - DNA, 12 bp, Homo sapiens
taccaactttca

SEQ ID NO: 547043 - DNA, 14 bp, Homo sapiens
taccaactttcaag

SEQ ID NO: 547044 - DNA, 21 bp, Homo sapiens
taccaatgccaagataattca

SEQ ID NO: 547045 - DNA, 13 bp, Homo sapiens
taccacactgagt

SEQ ID NO: 547046 - DNA, 15 bp, Homo sapiens
taccacactgagttc

SEQ ID NO: 547047 - DNA, 14 bp, Homo sapiens
taccactaattttg

SEQ ID NO: 547048 - DNA, 21 bp, Homo sapiens
taccactaattttgttttaaa

SEQ ID NO: 547049 - DNA, 15 bp, Homo sapiens
taccactgaatctgt

SEQ ID NO: 547050 - DNA, 19 bp, Homo sapiens
taccactgaatctgtacag

SEQ ID NO: 547051 - DNA, 20 bp, Homo sapiens
taccactgaatctgtacaga

SEQ ID NO: 547052 - DNA, 21 bp, Homo sapiens
taccactggtgtatgaaatga

SEQ ID NO: 547053 - DNA, 16 bp, Homo sapiens
taccagggatgtagat

SEQ ID NO: 547054 - DNA, 17 bp, Homo sapiens
taccagggatgtagatt

SEQ ID NO: 547055 - DNA, 15 bp, Homo sapiens
taccattaaaatatg

SEQ ID NO: 547056 - DNA, 21 bp, Homo sapiens
taccattatggctttgtgctt

SEQ ID NO: 547057 - DNA, 15 bp, Homo sapiens
taccattggaaattt

SEQ ID NO: 547058 - DNA, 20 bp, Homo sapiens
taccattggaaatttcacgt

SEQ ID NO: 547059 - DNA, 13 bp, Homo sapiens
taccatttcagta

SEQ ID NO: 547060 - DNA, 17 bp, Homo sapiens
tacccaaaagagaaaaa

SEQ ID NO: 547061 - DNA, 22 bp, Homo sapiens
tacccttctttccatttctctc

SEQ ID NO: 547062 - DNA, 15 bp, Homo sapiens
taccgacaagcacag

SEQ ID NO: 547063 - DNA, 20 bp, Homo sapiens
tacctaattagagcagatga

SEQ ID NO: 547064 - DNA, 16 bp, Homo sapiens
tacctataatgtgtgt

SEQ ID NO: 547065 - DNA, 23 bp, Homo sapiens
gggcctgacctccccctccttcc

SEQ ID NO: 547066 - DNA, 14 bp, Homo sapiens
gggcggcagagagg

SEQ ID NO: 547067 - DNA, 16 bp, Homo sapiens
gggcgtgaaacacaat

SEQ ID NO: 547068 - DNA, 17 bp, Homo sapiens
gggctaagtccagctct

SEQ ID NO: 547069 - DNA, 19 bp, Homo sapiens
gggctccacttcatccaga

SEQ ID NO: 547070 - DNA, 13 bp, Homo sapiens
gggctctgggttc

SEQ ID NO: 547071 - DNA, 13 bp, Homo sapiens
ggggaagggtgga

SEQ ID NO: 547072 - DNA, 22 bp, Homo sapiens
ggggacaggaacacccagcccc

SEQ ID NO: 547073 - DNA, 21 bp, Homo sapiens
ggggagaccgagtgtggagct

SEQ ID NO: 547074 - DNA, 19 bp, Homo sapiens
ggggagagagcagagaagt

SEQ ID NO: 547075 - DNA, 13 bp, Homo sapiens
ggggagctggtgg

SEQ ID NO: 547076 - DNA, 14 bp, Homo sapiens
ggggagctggtggg

SEQ ID NO: 547077 - DNA, 12 bp, Homo sapiens
ggggaggctgag

SEQ ID NO: 547078 - DNA, 21 bp, Homo sapiens
ggggatttcgaagtttgcaac

SEQ ID NO: 547079 - DNA, 19 bp, Homo sapiens
ggggcagcctgccttgccc

SEQ ID NO: 547080 - DNA, 17 bp, Homo sapiens
ggggcagcctgcgtggc

SEQ ID NO: 547081 - DNA, 17 bp, Homo sapiens
ggggccatggaagctgg

SEQ ID NO: 547082 - DNA, 13 bp, Homo sapiens
ggggccgggctgg

SEQ ID NO: 547083 - DNA, 17 bp, Homo sapiens
ggggcctagtggcttca

SEQ ID NO: 547084 - DNA, 22 bp, Homo sapiens
ggggcctgtacaaaagggacat

SEQ ID NO: 547085 - DNA, 20 bp, Homo sapiens
ggggctacttatattctgca

SEQ ID NO: 547086 - DNA, 15 bp, Homo sapiens
ggggctggggcagga

SEQ ID NO: 547087 - DNA, 18 bp, Homo sapiens
ggggcttctctgctgaga

SEQ ID NO: 547088 - DNA, 22 bp, Homo sapiens
gggggacaggaacacccagccc

SEQ ID NO: 547089 - DNA, 17 bp, Homo sapiens
gggggcctagtggcttc

SEQ ID NO: 547090 - DNA, 11 bp, Homo sapiens
ggggggcagag

SEQ ID NO: 547091 - DNA, 17 bp, Homo sapiens
ggggtttccacacaggc

SEQ ID NO: 547092 - DNA, 21 bp, Homo sapiens
ggggtttccacacaggcccat

SEQ ID NO: 547093 - DNA, 11 bp, Homo sapiens
ggggtttttct

SEQ ID NO: 547094 - DNA, 21 bp, Homo sapiens
gggtcatattcataccttctg

SEQ ID NO: 547095 - DNA, 16 bp, Homo sapiens
gggtccccagcccttc

SEQ ID NO: 547096 - DNA, 16 bp, Homo sapiens
gggtcccctccaggag

SEQ ID NO: 547097 - DNA, 18 bp, Homo sapiens
gggtggcgctagaggcca

SEQ ID NO: 547098 - DNA, 21 bp, Homo sapiens
ggtaagaaaaagcaaaaggca

SEQ ID NO: 547099 - DNA, 11 bp, Homo sapiens
ggtaccttgca

SEQ ID NO: 547100 - DNA, 23 bp, Homo sapiens
ggtagaacgccagggaccccaga

SEQ ID NO: 547101 - DNA, 18 bp, Homo sapiens
ggtagaatgaccttgtaa

SEQ ID NO: 547102 - DNA, 19 bp, Homo sapiens
ggtagccccctcttccctg

SEQ ID NO: 547103 - DNA, 14 bp, Homo sapiens
ggtatctctttctc

SEQ ID NO: 547104 - DNA, 17 bp, Homo sapiens
ggtcacaaagctattta

SEQ ID NO: 547105 - DNA, 15 bp, Homo sapiens
ggtcacttcttctgt

SEQ ID NO: 547106 - DNA, 19 bp, Homo sapiens
ggtcatcccggggccatgg

SEQ ID NO: 547107 - DNA, 14 bp, Homo sapiens
ggtcctgaggctgg

SEQ ID NO: 547108 - DNA, 15 bp, Homo sapiens
ggtcctgggggcctg

SEQ ID NO: 547109 - DNA, 15 bp, Homo sapiens
ggtcctgggggctgc

SEQ ID NO: 547110 - DNA, 18 bp, Homo sapiens
ggtcctgggggctgctgc

SEQ ID NO: 547111 - DNA, 21 bp, Homo sapiens
ggtcctgggggctgctgcact

SEQ ID NO: 547112 - DNA, 21 bp, Homo sapiens
ggtcctgtcctggctcccagg

SEQ ID NO: 547113 - DNA, 11 bp, Homo sapiens
ggtccttaaaa

SEQ ID NO: 547114 - DNA, 21 bp, Homo sapiens
ggtccttaaaaaaaaaaatga

SEQ ID NO: 547115 - DNA, 14 bp, Homo sapiens
ggtcgtaggggaga

SEQ ID NO: 547116 - DNA, 15 bp, Homo sapiens
ggtctaaaaataaac

SEQ ID NO: 547117 - DNA, 18 bp, Homo sapiens
ggtctcagaatctttcct

SEQ ID NO: 547118 - DNA, 14 bp, Homo sapiens
ggtctcagaggagg

SEQ ID NO: 547119 - DNA, 14 bp, Homo sapiens
ggtctctatttcat

SEQ ID NO: 547120 - DNA, 21 bp, Homo sapiens
ggtctctgccatgaactggag

SEQ ID NO: 547121 - DNA, 19 bp, Homo sapiens
ggtctggaggacctgcccg

SEQ ID NO: 547122 - DNA, 17 bp, Homo sapiens
ggtcttaggatgtctgt

SEQ ID NO: 547123 - DNA, 18 bp, Homo sapiens
ggtcttcctactcttctc

SEQ ID NO: 547124 - DNA, 19 bp, Homo sapiens
ggtcttcctactcttctct

SEQ ID NO: 547125 - DNA, 21 bp, Homo sapiens
ggtcttcctactcttctctct

SEQ ID NO: 547126 - DNA, 22 bp, Homo sapiens
ggtcttttcctcgcttctttca

SEQ ID NO: 547127 - DNA, 18 bp, Homo sapiens
ggtcttttttctgggtct

SEQ ID NO: 547128 - DNA, 23 bp, Homo sapiens
ggtgaacaacgtactatggaagc

SEQ ID NO: 547129 - DNA, 19 bp, Homo sapiens
ggtgagcattacaggcaag

SEQ ID NO: 547130 - DNA, 13 bp, Homo sapiens
ggtgagggaggcc

SEQ ID NO: 547131 - DNA, 17 bp, Homo sapiens
gtcacctgcttctctgc

SEQ ID NO: 547132 - DNA, 22 bp, Homo sapiens
gtcacctgggcgtcatctggtc

SEQ ID NO: 547133 - DNA, 16 bp, Homo sapiens
gtcactgccatggagg

SEQ ID NO: 547134 - DNA, 20 bp, Homo sapiens
gtcactgccatggaggcaca

SEQ ID NO: 547135 - DNA, 23 bp, Homo sapiens
gtcactgttataaattttgtaca

SEQ ID NO: 547136 - DNA, 13 bp, Homo sapiens
gtcacttcttctg

SEQ ID NO: 547137 - DNA, 17 bp, Homo sapiens
gtcaggaggcagaagga

SEQ ID NO: 547138 - DNA, 13 bp, Homo sapiens
gtcaggaggtgcc

SEQ ID NO: 547139 - DNA, 17 bp, Homo sapiens
gtcaggaggtgcctgag

SEQ ID NO: 547140 - DNA, 16 bp, Homo sapiens
gtcaggccacggcagc

SEQ ID NO: 547141 - DNA, 18 bp, Homo sapiens
gtcaggccacggcagcct

SEQ ID NO: 547142 - DNA, 16 bp, Homo sapiens
gtcaggccgggcagag

SEQ ID NO: 547143 - DNA, 13 bp, Homo sapiens
gtcaggttgacag

SEQ ID NO: 547144 - DNA, 21 bp, Homo sapiens
gtcagtccaaggggtcccctc

SEQ ID NO: 547145 - DNA, 17 bp, Homo sapiens
gtcagtttatgttttgg

SEQ ID NO: 547146 - DNA, 13 bp, Homo sapiens
gtcatagtttttt

SEQ ID NO: 547147 - DNA, 20 bp, Homo sapiens
gtcatattcataccttctga

SEQ ID NO: 547148 - DNA, 18 bp, Homo sapiens
gtcatctaccttttctct

SEQ ID NO: 547149 - DNA, 20 bp, Homo sapiens
gtcatgatgtttttaaaatc

SEQ ID NO: 547150 - DNA, 23 bp, Homo sapiens
gtcatgatgtttttaaaatctta

SEQ ID NO: 547151 - DNA, 17 bp, Homo sapiens
gtcatgctcccctgtgc

SEQ ID NO: 547152 - DNA, 19 bp, Homo sapiens
gtcatggtgcaatttgtct

SEQ ID NO: 547153 - DNA, 18 bp, Homo sapiens
gtcatgtgcgaacacagt

SEQ ID NO: 547154 - DNA, 19 bp, Homo sapiens
gtcatgttggtaccctgga

SEQ ID NO: 547155 - DNA, 13 bp, Homo sapiens
gtcattaatgtgt

SEQ ID NO: 547156 - DNA, 13 bp, Homo sapiens
gtcattgcttctt

SEQ ID NO: 547157 - DNA, 15 bp, Homo sapiens
gtcattgcttcttct

SEQ ID NO: 547158 - DNA, 13 bp, Homo sapiens
gtcatttcatgtc

SEQ ID NO: 547159 - DNA, 12 bp, Homo sapiens
gtcatttccatg

SEQ ID NO: 547160 - DNA, 12 bp, Homo sapiens
gtcattttcatt

SEQ ID NO: 547161 - DNA, 20 bp, Homo sapiens
gtccaacgtggggcagcaca

SEQ ID NO: 547162 - DNA, 21 bp, Homo sapiens
gtccaacgtggggcagcacag

SEQ ID NO: 547163 - DNA, 13 bp, Homo sapiens
gtccaagcagatt

SEQ ID NO: 547164 - DNA, 20 bp, Homo sapiens
gtccaaggggtcccctccag

SEQ ID NO: 547165 - DNA, 15 bp, Homo sapiens
gtccacattctgctg

SEQ ID NO: 547166 - DNA, 22 bp, Homo sapiens
gtccacattctgctgcccccag

SEQ ID NO: 547167 - DNA, 13 bp, Homo sapiens
gtccactggggtg

SEQ ID NO: 547168 - DNA, 12 bp, Homo sapiens
gtccacttttcc

SEQ ID NO: 547169 - DNA, 18 bp, Homo sapiens
gtccacttttccagtatt

SEQ ID NO: 547170 - DNA, 12 bp, Homo sapiens
gtccagacctgg

SEQ ID NO: 547171 - DNA, 16 bp, Homo sapiens
gtccagacctgggccc

SEQ ID NO: 547172 - DNA, 16 bp, Homo sapiens
gtccagagctgcttcc

SEQ ID NO: 547173 - DNA, 15 bp, Homo sapiens
gtccagctctcccct

SEQ ID NO: 547174 - DNA, 17 bp, Homo sapiens
gtccagctctcccctgc

SEQ ID NO: 547175 - DNA, 21 bp, Homo sapiens
gtccaggagatgaggctggat

SEQ ID NO: 547176 - DNA, 17 bp, Homo sapiens
gtccaggagctcaggaa

SEQ ID NO: 547177 - DNA, 17 bp, Homo sapiens
gtcccaaggttctgggt

SEQ ID NO: 547178 - DNA, 23 bp, Homo sapiens
gtcccaatgcacatccattccca

SEQ ID NO: 547179 - DNA, 14 bp, Homo sapiens
gtcccactgagtct

SEQ ID NO: 547180 - DNA, 18 bp, Homo sapiens
gtcccatgtgagctgctg

SEQ ID NO: 547181 - DNA, 21 bp, Homo sapiens
gtcccatgtgagctgctgcca

SEQ ID NO: 547182 - DNA, 21 bp, Homo sapiens
gtccccaaagtaccacactga

SEQ ID NO: 547183 - DNA, 20 bp, Homo sapiens
gtccccgagccgagctctcc

SEQ ID NO: 547184 - DNA, 12 bp, Homo sapiens
gtccccttcccg

SEQ ID NO: 547185 - DNA, 20 bp, Homo sapiens
gtcccgaatggagtccagac

SEQ ID NO: 547186 - DNA, 23 bp, Homo sapiens
gtcccgaatggagtccagacctg

SEQ ID NO: 547187 - DNA, 15 bp, Homo sapiens
gtcccggagctcagg

SEQ ID NO: 547188 - DNA, 20 bp, Homo sapiens
gtccctccacgttcacccct

SEQ ID NO: 547189 - DNA, 17 bp, Homo sapiens
gtcccttacctggctta

SEQ ID NO: 547190 - DNA, 15 bp, Homo sapiens
gtccctttcttctcc

SEQ ID NO: 547191 - DNA, 13 bp, Homo sapiens
gtcctaagagatt

SEQ ID NO: 547192 - DNA, 19 bp, Homo sapiens
gtcctaagagatttatctt

SEQ ID NO: 547193 - DNA, 17 bp, Homo sapiens
gtcctcaccttctgttt

SEQ ID NO: 547194 - DNA, 21 bp, Homo sapiens
gtcctcattgttcagaaaagc

SEQ ID NO: 547195 - DNA, 12 bp, Homo sapiens
gtcctccagaac

SEQ ID NO: 547196 - DNA, 16 bp, Homo sapiens
gtcctgaggctggggc

SEQ ID NO: 547197 - DNA, 18 bp, Homo sapiens
gtcctgggggcctgacct

SEQ ID NO: 547198 - DNA, 18 bp, Homo sapiens
gtcctgggggctgctgca

SEQ ID NO: 547199 - DNA, 16 bp, Homo sapiens
gtcctgtgtcagttta

SEQ ID NO: 547200 - DNA, 21 bp, Homo sapiens
gtccttaaaaaatatgctctc

SEQ ID NO: 547201 - DNA, 18 bp, Homo sapiens
gtccttagaatactgtat

SEQ ID NO: 547202 - DNA, 17 bp, Homo sapiens
gtccttatctagctgca

SEQ ID NO: 547203 - DNA, 17 bp, Homo sapiens
gtccttctctcacctcc

SEQ ID NO: 547204 - DNA, 19 bp, Homo sapiens
gtccttctctcacctccta

SEQ ID NO: 547205 - DNA, 11 bp, Homo sapiens
gtcggctccag

SEQ ID NO: 547206 - DNA, 12 bp, Homo sapiens
gtcgtccccaga

SEQ ID NO: 547207 - DNA, 16 bp, Homo sapiens
gtcgtccccagaccag

SEQ ID NO: 547208 - DNA, 19 bp, Homo sapiens
gtcgtccccagaccagtag

SEQ ID NO: 547209 - DNA, 23 bp, Homo sapiens
gtcgtccccagaccagtagtgac

SEQ ID NO: 547210 - DNA, 22 bp, Homo sapiens
gtctaaccacagctccttttcc

SEQ ID NO: 547211 - DNA, 14 bp, Homo sapiens
gtctaagaaacatt

SEQ ID NO: 547212 - DNA, 15 bp, Homo sapiens
gtctaagaaacattg

SEQ ID NO: 547213 - DNA, 16 bp, Homo sapiens
ggcaaagggggaggag

SEQ ID NO: 547214 - DNA, 23 bp, Homo sapiens
ggcaaatattttgtcactgctgt

SEQ ID NO: 547215 - DNA, 18 bp, Homo sapiens
ggcaacaaactgcacatg

SEQ ID NO: 547216 - DNA, 22 bp, Homo sapiens
ggcaacctgacagcaaacacag

SEQ ID NO: 547217 - DNA, 19 bp, Homo sapiens
ggcaactaagcagtccctg

SEQ ID NO: 547218 - DNA, 14 bp, Homo sapiens
ggcaactgtggaag

SEQ ID NO: 547219 - DNA, 19 bp, Homo sapiens
ggcaatattctctgtacat

SEQ ID NO: 547220 - DNA, 21 bp, Homo sapiens
ggcacaggctgccccacccct

SEQ ID NO: 547221 - DNA, 16 bp, Homo sapiens
ggcacagggcatgaaa

SEQ ID NO: 547222 - DNA, 19 bp, Homo sapiens
ggcacagggcatgaaatga

SEQ ID NO: 547223 - DNA, 21 bp, Homo sapiens
ggcacctgtctgctccagctc

SEQ ID NO: 547224 - DNA, 16 bp, Homo sapiens
ggcagagacctcctga

SEQ ID NO: 547225 - DNA, 13 bp, Homo sapiens
ggcagagcacagc

SEQ ID NO: 547226 - DNA, 14 bp, Homo sapiens
ggcagagctcagca

SEQ ID NO: 547227 - DNA, 20 bp, Homo sapiens
ggcagagctcagcacagcct

SEQ ID NO: 547228 - DNA, 15 bp, Homo sapiens
ggcagatgcagctct

SEQ ID NO: 547229 - DNA, 15 bp, Homo sapiens
ggcagcagcagcagc

SEQ ID NO: 547230 - DNA, 19 bp, Homo sapiens
ggcagccgcggtgcccaac

SEQ ID NO: 547231 - DNA, 19 bp, Homo sapiens
ggcagcctgcgtggctgac

SEQ ID NO: 547232 - DNA, 14 bp, Homo sapiens
ggcaggaagtccct

SEQ ID NO: 547233 - DNA, 15 bp, Homo sapiens
ggcaggaagtccctg

SEQ ID NO: 547234 - DNA, 15 bp, Homo sapiens
ggcaggagacactgg

SEQ ID NO: 547235 - DNA, 18 bp, Homo sapiens
ggcaggagacactggtct

SEQ ID NO: 547236 - DNA, 14 bp, Homo sapiens
ggcaggaggctcca

SEQ ID NO: 547237 - DNA, 21 bp, Homo sapiens
ggcaggcagagctcagcacag

SEQ ID NO: 547238 - DNA, 16 bp, Homo sapiens
ggcaggtgacagtgag

SEQ ID NO: 547239 - DNA, 17 bp, Homo sapiens
ggcaggtgacagtgagg

SEQ ID NO: 547240 - DNA, 13 bp, Homo sapiens
ggcaggtggccag

SEQ ID NO: 547241 - DNA, 15 bp, Homo sapiens
ggcagtgcaccccct

SEQ ID NO: 547242 - DNA, 15 bp, Homo sapiens
ggcatcaggaaagga

SEQ ID NO: 547243 - DNA, 17 bp, Homo sapiens
ggcatccccagccccct

SEQ ID NO: 547244 - DNA, 18 bp, Homo sapiens
ggcatccccagccccctg

SEQ ID NO: 547245 - DNA, 19 bp, Homo sapiens
ggcatgaaatgaacacaaa

SEQ ID NO: 547246 - DNA, 20 bp, Homo sapiens
ggcatgaccctggagcccgg

SEQ ID NO: 547247 - DNA, 15 bp, Homo sapiens
ggcatgccgagtgcc

SEQ ID NO: 547248 - DNA, 18 bp, Homo sapiens
ggcatgccgagtgcccca

SEQ ID NO: 547249 - DNA, 13 bp, Homo sapiens
ggcatgtgaaggg

SEQ ID NO: 547250 - DNA, 12 bp, Homo sapiens
ggcattctctct

SEQ ID NO: 547251 - DNA, 22 bp, Homo sapiens
ggcatttagcacagtatttaac

SEQ ID NO: 547252 - DNA, 15 bp, Homo sapiens
ggccaaaagcttccc

SEQ ID NO: 547253 - DNA, 23 bp, Homo sapiens
ggccaaaagcttccctccctgct

SEQ ID NO: 547254 - DNA, 16 bp, Homo sapiens
ggccaaagacaaatag

SEQ ID NO: 547255 - DNA, 12 bp, Homo sapiens
ggccaagcagaa

SEQ ID NO: 547256 - DNA, 17 bp, Homo sapiens
ggccacacgctgcacct

SEQ ID NO: 547257 - DNA, 18 bp, Homo sapiens
ggccaccctgtgcagaag

SEQ ID NO: 547258 - DNA, 21 bp, Homo sapiens
ggccactttaagagagaaatc

SEQ ID NO: 547259 - DNA, 17 bp, Homo sapiens
ggccagaagtagctttg

SEQ ID NO: 547260 - DNA, 11 bp, Homo sapiens
ggccagagctc

SEQ ID NO: 547261 - DNA, 16 bp, Homo sapiens
ggccagagctcccagg

SEQ ID NO: 547262 - DNA, 12 bp, Homo sapiens
ggccagggctct

SEQ ID NO: 547263 - DNA, 22 bp, Homo sapiens
ggccatcgcaagtcacagaaaa

SEQ ID NO: 547264 - DNA, 19 bp, Homo sapiens
ggccatgcaattcatccca

SEQ ID NO: 547265 - DNA, 22 bp, Homo sapiens
ggccatggaagctggcaggaga

SEQ ID NO: 547266 - DNA, 15 bp, Homo sapiens
ggccatggaggcagt

SEQ ID NO: 547267 - DNA, 22 bp, Homo sapiens
ggcccacattgcccacacctgc

SEQ ID NO: 547268 - DNA, 18 bp, Homo sapiens
ggcccaccaggcccccct

SEQ ID NO: 547269 - DNA, 21 bp, Homo sapiens
ggcccacccggttcagtgttt

SEQ ID NO: 547270 - DNA, 17 bp, Homo sapiens
ggcccagaccactgtct

SEQ ID NO: 547271 - DNA, 23 bp, Homo sapiens
ggcccagaggggcggggccagga

SEQ ID NO: 547272 - DNA, 15 bp, Homo sapiens
ggcccaggagcgcag

SEQ ID NO: 547273 - DNA, 17 bp, Homo sapiens
ggcccaggagcgcagct

SEQ ID NO: 547274 - DNA, 16 bp, Homo sapiens
ggccccacctgcagct

SEQ ID NO: 547275 - DNA, 19 bp, Homo sapiens
ggccccacctgcagctccc

SEQ ID NO: 547276 - DNA, 16 bp, Homo sapiens
ggcccccactggctgt

SEQ ID NO: 547277 - DNA, 12 bp, Homo sapiens
ggccccctgcct

SEQ ID NO: 547278 - DNA, 17 bp, Homo sapiens
ggccccctgcctgccct

SEQ ID NO: 547279 - DNA, 23 bp, Homo sapiens
ggcccgaaggtctctctggctct

SEQ ID NO: 547280 - DNA, 14 bp, Homo sapiens
ggccctggggcctg

SEQ ID NO: 547281 - DNA, 12 bp, Homo sapiens
ggccggcctggg

SEQ ID NO: 547282 - DNA, 20 bp, Homo sapiens
ggcctgaaagcaacagctgg

SEQ ID NO: 547283 - DNA, 12 bp, Homo sapiens
ggcctgaaccac

SEQ ID NO: 547284 - DNA, 18 bp, Homo sapiens
ggcctgaaccacaggaga

SEQ ID NO: 547285 - DNA, 20 bp, Homo sapiens
ggcctgacctccccctcctt

SEQ ID NO: 547286 - DNA, 15 bp, Homo sapiens
gctgtaaagcaaaat

SEQ ID NO: 547287 - DNA, 17 bp, Homo sapiens
gctgtaagacggccttg

SEQ ID NO: 547288 - DNA, 16 bp, Homo sapiens
gctgtcattgcttctt

SEQ ID NO: 547289 - DNA, 18 bp, Homo sapiens
gctgtcattgcttcttct

SEQ ID NO: 547290 - DNA, 22 bp, Homo sapiens
gctgtgatttttgttgattaaa

SEQ ID NO: 547291 - DNA, 15 bp, Homo sapiens
gctgtggggagctgg

SEQ ID NO: 547292 - DNA, 17 bp, Homo sapiens
gctgtgtttgctcccct

SEQ ID NO: 547293 - DNA, 13 bp, Homo sapiens
gctgttcttcctg

SEQ ID NO: 547294 - DNA, 23 bp, Homo sapiens
gctgttgaccaggcacctcccct

SEQ ID NO: 547295 - DNA, 16 bp, Homo sapiens
gctgttgtctcttctc

SEQ ID NO: 547296 - DNA, 16 bp, Homo sapiens
gctgtttggttttaaa

SEQ ID NO: 547297 - DNA, 12 bp, Homo sapiens
gcttaagaaaaa

SEQ ID NO: 547298 - DNA, 21 bp, Homo sapiens
gcttaagcatccgtgtatttg

SEQ ID NO: 547299 - DNA, 12 bp, Homo sapiens
gcttagaggcat

SEQ ID NO: 547300 - DNA, 16 bp, Homo sapiens
gcttagcttatctttc

SEQ ID NO: 547301 - DNA, 22 bp, Homo sapiens
gcttagcttatctttctttcca

SEQ ID NO: 547302 - DNA, 14 bp, Homo sapiens
gcttagtatctcat

SEQ ID NO: 547303 - DNA, 15 bp, Homo sapiens
gcttatatttgtgta

SEQ ID NO: 547304 - DNA, 16 bp, Homo sapiens
gcttatctttctttcc

SEQ ID NO: 547305 - DNA, 20 bp, Homo sapiens
gcttcaatttattgcacaaa

SEQ ID NO: 547306 - DNA, 22 bp, Homo sapiens
gcttcacaggacaggaaagtgg

SEQ ID NO: 547307 - DNA, 15 bp, Homo sapiens
gcttcaccagagcat

SEQ ID NO: 547308 - DNA, 19 bp, Homo sapiens
gcttcagcccctggggtac

SEQ ID NO: 547309 - DNA, 21 bp, Homo sapiens
gcttccagttggactgtggcc

SEQ ID NO: 547310 - DNA, 23 bp, Homo sapiens
gcttccccaaaggccaacagcat

SEQ ID NO: 547311 - DNA, 22 bp, Homo sapiens
gcttcctttgtttttttttcct

SEQ ID NO: 547312 - DNA, 23 bp, Homo sapiens
gcttcctttgtttttttttcctg

SEQ ID NO: 547313 - DNA, 22 bp, Homo sapiens
gcttctccctggactctgtggg

SEQ ID NO: 547314 - DNA, 17 bp, Homo sapiens
gcttcttctgaggcctg

SEQ ID NO: 547315 - DNA, 23 bp, Homo sapiens
gcttctttcaagggctttcctgt

SEQ ID NO: 547316 - DNA, 16 bp, Homo sapiens
gcttgaacccaggagg

SEQ ID NO: 547317 - DNA, 13 bp, Homo sapiens
gcttgaccctgaa

SEQ ID NO: 547318 - DNA, 18 bp, Homo sapiens
gcttgcactctcttggct

SEQ ID NO: 547319 - DNA, 22 bp, Homo sapiens
gcttgtggctccacacacacaa

SEQ ID NO: 547320 - DNA, 16 bp, Homo sapiens
gctttaaagtgtaata

SEQ ID NO: 547321 - DNA, 17 bp, Homo sapiens
gctttaggattgaagtg

SEQ ID NO: 547322 - DNA, 17 bp, Homo sapiens
gctttcctgtgccaggt

SEQ ID NO: 547323 - DNA, 12 bp, Homo sapiens
gctttctcaatg

SEQ ID NO: 547324 - DNA, 13 bp, Homo sapiens
gctttctcaatgt

SEQ ID NO: 547325 - DNA, 13 bp, Homo sapiens
gctttgcactttt

SEQ ID NO: 547326 - DNA, 16 bp, Homo sapiens
gctttgggcagatttg

SEQ ID NO: 547327 - DNA, 13 bp, Homo sapiens
gctttgtctcctc

SEQ ID NO: 547328 - DNA, 16 bp, Homo sapiens
gcttttaaaattttaa

SEQ ID NO: 547329 - DNA, 21 bp, Homo sapiens
gcttttgcatagaataatgaa

SEQ ID NO: 547330 - DNA, 14 bp, Homo sapiens
gcttttgttttgct

SEQ ID NO: 547331 - DNA, 13 bp, Homo sapiens
ggaaaaatatgtg

SEQ ID NO: 547332 - DNA, 11 bp, Homo sapiens
ggaaaagctga

SEQ ID NO: 547333 - DNA, 13 bp, Homo sapiens
ggaaaaggcttga

SEQ ID NO: 547334 - DNA, 19 bp, Homo sapiens
ggaaaataaaaaaagaaaa

SEQ ID NO: 547335 - DNA, 20 bp, Homo sapiens
ggaaaataaaaaaagaaaaa

SEQ ID NO: 547336 - DNA, 18 bp, Homo sapiens
ggaaacaagaggtaccaa

SEQ ID NO: 547337 - DNA, 14 bp, Homo sapiens
ggaaacctgtctga

SEQ ID NO: 547338 - DNA, 14 bp, Homo sapiens
ggaaagcacagagg

SEQ ID NO: 547339 - DNA, 15 bp, Homo sapiens
ggaaatagcatgaca

SEQ ID NO: 547340 - DNA, 15 bp, Homo sapiens
ggaaatatctgtgaa

SEQ ID NO: 547341 - DNA, 14 bp, Homo sapiens
ggaaatgctgattt

SEQ ID NO: 547342 - DNA, 15 bp, Homo sapiens
ggaacaaatcttcct

SEQ ID NO: 547343 - DNA, 17 bp, Homo sapiens
ggaacaaatgcttttcc

SEQ ID NO: 547344 - DNA, 15 bp, Homo sapiens
ggaacaagaccccca

SEQ ID NO: 547345 - DNA, 16 bp, Homo sapiens
ggaacacatgcacaca

SEQ ID NO: 547346 - DNA, 21 bp, Homo sapiens
ggaacagtaaagaaagcagaa

SEQ ID NO: 547347 - DNA, 22 bp, Homo sapiens
ggaacagtaaagaaagcagaat

SEQ ID NO: 547348 - DNA, 19 bp, Homo sapiens
ggaagacaaatacacatac

SEQ ID NO: 547349 - DNA, 12 bp, Homo sapiens
ggaagagaaatc

SEQ ID NO: 547350 - DNA, 22 bp, Homo sapiens
ggaagccccctcttcctccctg

SEQ ID NO: 547351 - DNA, 22 bp, Homo sapiens
ggaaggaaccccctcaccacct

SEQ ID NO: 547352 - DNA, 18 bp, Homo sapiens
ggaaggagaaaggggcta

SEQ ID NO: 547353 - DNA, 18 bp, Homo sapiens
ggaagtccctgagaagcc

SEQ ID NO: 547354 - DNA, 20 bp, Homo sapiens
ggaataagaagcaaataaat

SEQ ID NO: 547355 - DNA, 21 bp, Homo sapiens
ggaataagaagcaaataaata

SEQ ID NO: 547356 - DNA, 20 bp, Homo sapiens
ggaatatgcatcccacagcc

SEQ ID NO: 547357 - DNA, 21 bp, Homo sapiens
ggaatattatatttggatgca

SEQ ID NO: 547358 - DNA, 17 bp, Homo sapiens
ggaatcattgtccagag

SEQ ID NO: 547359 - DNA, 16 bp, Homo sapiens
ggaatgtatagtattt

SEQ ID NO: 547360 - DNA, 19 bp, Homo sapiens
ggaatttggaaatctcttt

SEQ ID NO: 547361 - DNA, 22 bp, Homo sapiens
ggacaagggaaaataaaaaaag

SEQ ID NO: 547362 - DNA, 17 bp, Homo sapiens
ggacaaggtgcaggcag

SEQ ID NO: 547363 - DNA, 18 bp, Homo sapiens
ggacaaggtgcaggcagg

SEQ ID NO: 547364 - DNA, 19 bp, Homo sapiens
ggacacggcctctggggag

SEQ ID NO: 547365 - DNA, 21 bp, Homo sapiens
ggacacggcctctggggagac

SEQ ID NO: 547366 - DNA, 13 bp, Homo sapiens
ctcagcacagcct

SEQ ID NO: 547367 - DNA, 13 bp, Homo sapiens
ctcagcatatata

SEQ ID NO: 547368 - DNA, 23 bp, Homo sapiens
ctcagcatatatataaaatacac

SEQ ID NO: 547369 - DNA, 16 bp, Homo sapiens
ctcagccctcattaaa

SEQ ID NO: 547370 - DNA, 23 bp, Homo sapiens
ctcagccggcgtggcaaatataa

SEQ ID NO: 547371 - DNA, 14 bp, Homo sapiens
ctcaggaagaagag

SEQ ID NO: 547372 - DNA, 13 bp, Homo sapiens
ctcaggaggcagt

SEQ ID NO: 547373 - DNA, 17 bp, Homo sapiens
ctcaggcccacattgcc

SEQ ID NO: 547374 - DNA, 13 bp, Homo sapiens
ctcagtcaaatgt

SEQ ID NO: 547375 - DNA, 16 bp, Homo sapiens
ctcagtgagctggaga

SEQ ID NO: 547376 - DNA, 12 bp, Homo sapiens
ctcagtttttct

SEQ ID NO: 547377 - DNA, 18 bp, Homo sapiens
ctcatcaacaaagaaata

SEQ ID NO: 547378 - DNA, 20 bp, Homo sapiens
ctcatcagaaacaatttctg

SEQ ID NO: 547379 - DNA, 22 bp, Homo sapiens
ctcatccactctactaatgcct

SEQ ID NO: 547380 - DNA, 23 bp, Homo sapiens
ctcatcccgacctcttagaaaat

SEQ ID NO: 547381 - DNA, 15 bp, Homo sapiens
ctcatgggagtcagg

SEQ ID NO: 547382 - DNA, 19 bp, Homo sapiens
ctcatgggagtcagggagc

SEQ ID NO: 547383 - DNA, 16 bp, Homo sapiens
ctcattacggctcctc

SEQ ID NO: 547384 - DNA, 20 bp, Homo sapiens
ctcattccctcgtctttccc

SEQ ID NO: 547385 - DNA, 20 bp, Homo sapiens
ctcattcctctgtccccgag

SEQ ID NO: 547386 - DNA, 18 bp, Homo sapiens
ctcattctgcaatgagcc

SEQ ID NO: 547387 - DNA, 15 bp, Homo sapiens
ctcattgtggccagt

SEQ ID NO: 547388 - DNA, 23 bp, Homo sapiens
ctcattgtggccagtttagagtt

SEQ ID NO: 547389 - DNA, 13 bp, Homo sapiens
ctcattttgcttg

SEQ ID NO: 547390 - DNA, 15 bp, Homo sapiens
ctccaactcagagca

SEQ ID NO: 547391 - DNA, 19 bp, Homo sapiens
ctccaacttagtgtctcta

SEQ ID NO: 547392 - DNA, 22 bp, Homo sapiens
ctccaacttagtgtctctattt

SEQ ID NO: 547393 - DNA, 17 bp, Homo sapiens
ctccaaggacagaaggc

SEQ ID NO: 547394 - DNA, 20 bp, Homo sapiens
ctccaaggacagaaggctcc

SEQ ID NO: 547395 - DNA, 15 bp, Homo sapiens
ctccacacacacaaa

SEQ ID NO: 547396 - DNA, 14 bp, Homo sapiens
ctccacctgggaga

SEQ ID NO: 547397 - DNA, 21 bp, Homo sapiens
ctccacctgggagatgctggg

SEQ ID NO: 547398 - DNA, 18 bp, Homo sapiens
ctccacgttcacccctcc

SEQ ID NO: 547399 - DNA, 17 bp, Homo sapiens
ctccaggcaccatctcc

SEQ ID NO: 547400 - DNA, 11 bp, Homo sapiens
ctccaggcagc

SEQ ID NO: 547401 - DNA, 21 bp, Homo sapiens
ctccagggctcaacactgtga

SEQ ID NO: 547402 - DNA, 15 bp, Homo sapiens
ctccagtccccagaa

SEQ ID NO: 547403 - DNA, 19 bp, Homo sapiens
ctccagtcttccacctgga

SEQ ID NO: 547404 - DNA, 10 bp, Homo sapiens
ctccatcctt

SEQ ID NO: 547405 - DNA, 16 bp, Homo sapiens
ctccatccttctcccc

SEQ ID NO: 547406 - DNA, 18 bp, Homo sapiens
ctccatgattccaagggc

SEQ ID NO: 547407 - DNA, 21 bp, Homo sapiens
ctccatggtgaactgaagcag

SEQ ID NO: 547408 - DNA, 17 bp, Homo sapiens
ctccattcttttaaatc

SEQ ID NO: 547409 - DNA, 22 bp, Homo sapiens
ctcccacaaataagttcccatt

SEQ ID NO: 547410 - DNA, 17 bp, Homo sapiens
ctcccactgcccctgca

SEQ ID NO: 547411 - DNA, 11 bp, Homo sapiens
ctcccagatcc

SEQ ID NO: 547412 - DNA, 13 bp, Homo sapiens
ctcccagatccag

SEQ ID NO: 547413 - DNA, 19 bp, Homo sapiens
ctcccaggacgcagggaga

SEQ ID NO: 547414 - DNA, 22 bp, Homo sapiens
ctcccaggacgcagggagaccc

SEQ ID NO: 547415 - DNA, 13 bp, Homo sapiens
ctcccagggtcct

SEQ ID NO: 547416 - DNA, 14 bp, Homo sapiens
ctcccagtcatgtt

SEQ ID NO: 547417 - DNA, 23 bp, Homo sapiens
ctccccaaggccccctgcctgcc

SEQ ID NO: 547418 - DNA, 17 bp, Homo sapiens
ctccccaggacttggtc

SEQ ID NO: 547419 - DNA, 12 bp, Homo sapiens
ctcccccatcct

SEQ ID NO: 547420 - DNA, 13 bp, Homo sapiens
ctccccctccttc

SEQ ID NO: 547421 - DNA, 15 bp, Homo sapiens
ctcccccttttccct

SEQ ID NO: 547422 - DNA, 16 bp, Homo sapiens
ctcccctaatgcctgc

SEQ ID NO: 547423 - DNA, 20 bp, Homo sapiens
ctcccctgcgcaggccctcc

SEQ ID NO: 547424 - DNA, 13 bp, Homo sapiens
ctcccctggtcct

SEQ ID NO: 547425 - DNA, 19 bp, Homo sapiens
ctcccctggtcctgcactg

SEQ ID NO: 547426 - DNA, 16 bp, Homo sapiens
ctcccctgtgccagcc

SEQ ID NO: 547427 - DNA, 12 bp, Homo sapiens
ctccccttccca

SEQ ID NO: 547428 - DNA, 18 bp, Homo sapiens
ctccccttcccagggcaa

SEQ ID NO: 547429 - DNA, 17 bp, Homo sapiens
ctccccttccccttcct

SEQ ID NO: 547430 - DNA, 21 bp, Homo sapiens
ctcccgcccaaacctttcccc

SEQ ID NO: 547431 - DNA, 17 bp, Homo sapiens
ctcccggccctgcctgc

SEQ ID NO: 547432 - DNA, 12 bp, Homo sapiens
ctccctcccaga

SEQ ID NO: 547433 - DNA, 17 bp, Homo sapiens
ctccctgaatctgacca

SEQ ID NO: 547434 - DNA, 19 bp, Homo sapiens
ctccctgaatctgaccaca

SEQ ID NO: 547435 - DNA, 16 bp, Homo sapiens
ctccctgccagcaccc

SEQ ID NO: 547436 - DNA, 16 bp, Homo sapiens
ctccgcgggggacagg

SEQ ID NO: 547437 - DNA, 17 bp, Homo sapiens
ctccgcgggggacagga

SEQ ID NO: 547438 - DNA, 22 bp, Homo sapiens
ctccggaggctgaggcaggaga

SEQ ID NO: 547439 - DNA, 15 bp, Homo sapiens
ctccgggtcttccta

SEQ ID NO: 547440 - DNA, 14 bp, Homo sapiens
ctccgtcctggcag

SEQ ID NO: 547441 - DNA, 23 bp, Homo sapiens
ctcctagtaggggtaccactgaa

SEQ ID NO: 547442 - DNA, 23 bp, Homo sapiens
ctcctccagtacaataaataaaa

SEQ ID NO: 547443 - DNA, 15 bp, Homo sapiens
ctcctccttcctagt

SEQ ID NO: 547444 - DNA, 20 bp, Homo sapiens
ctcctcggccagagctccca

SEQ ID NO: 547445 - DNA, 23 bp, Homo sapiens
ctcctcggccagagctcccagga

SEQ ID NO: 547446 - DNA, 22 bp, Homo sapiens
ctcctctatcctgggcttttgt

SEQ ID NO: 547447 - DNA, 18 bp, Homo sapiens
ctcctctctaacctcctt

SEQ ID NO: 547448 - DNA, 19 bp, Homo sapiens
ctcctctctaacctccttt

SEQ ID NO: 547449 - DNA, 15 bp, Homo sapiens
ctcctgcccccacac

SEQ ID NO: 547450 - DNA, 15 bp, Homo sapiens
ctcctgtggcctgcc

SEQ ID NO: 547451 - DNA, 23 bp, Homo sapiens
ctccttcaacaaggcttgctgca

SEQ ID NO: 547452 - DNA, 13 bp, Homo sapiens
ctccttcccagct

SEQ ID NO: 547453 - DNA, 14 bp, Homo sapiens
ctccttcccagctg

SEQ ID NO: 547454 - DNA, 16 bp, Homo sapiens
ctccttcccagctgcc

SEQ ID NO: 547455 - DNA, 17 bp, Homo sapiens
ctccttcccagctgccc

SEQ ID NO: 547456 - DNA, 20 bp, Homo sapiens
ctccttcccagctgcccctc

SEQ ID NO: 547457 - DNA, 17 bp, Homo sapiens
ctccttcccttgctacc

SEQ ID NO: 547458 - DNA, 15 bp, Homo sapiens
ctcctttaccctcat

SEQ ID NO: 547459 - DNA, 17 bp, Homo sapiens
ctcctttaccctcatct

SEQ ID NO: 547460 - DNA, 19 bp, Homo sapiens
ctcctttggaaggtgacac

SEQ ID NO: 547461 - DNA, 13 bp, Homo sapiens
ctccttttgtgtt

SEQ ID NO: 547462 - DNA, 14 bp, Homo sapiens
ctcgatgcagacag

SEQ ID NO: 547463 - DNA, 13 bp, Homo sapiens
ctcgatgttcatg

SEQ ID NO: 547464 - DNA, 15 bp, Homo sapiens
ctcgatgttcatgga

SEQ ID NO: 547465 - DNA, 12 bp, Homo sapiens
ctcgctggcccc

SEQ ID NO: 547466 - DNA, 15 bp, Homo sapiens
ctcgctggcccccac

SEQ ID NO: 547467 - DNA, 20 bp, Homo sapiens
ctcgctggcccccactggct

SEQ ID NO: 547468 - DNA, 22 bp, Homo sapiens
ctcgctggcccccactggctgt

SEQ ID NO: 547469 - DNA, 11 bp, Homo sapiens
ctcgcttcttt

SEQ ID NO: 547470 - DNA, 14 bp, Homo sapiens
ctcggatcagctga

SEQ ID NO: 547471 - DNA, 13 bp, Homo sapiens
ctcggccagagct

SEQ ID NO: 547472 - DNA, 19 bp, Homo sapiens
ctcggccagagctcccagg

SEQ ID NO: 547473 - DNA, 20 bp, Homo sapiens
ctcggccagagctcccagga

SEQ ID NO: 547474 - DNA, 22 bp, Homo sapiens
ctcggccagagctcccaggacg

SEQ ID NO: 547475 - DNA, 18 bp, Homo sapiens
ctcggggcaggaagtccc

SEQ ID NO: 547476 - DNA, 21 bp, Homo sapiens
ctcggggcaggaagtccctga

SEQ ID NO: 547477 - DNA, 20 bp, Homo sapiens
ctctaaaactatcagcagcg

SEQ ID NO: 547478 - DNA, 19 bp, Homo sapiens
ctctaaattctttatttct

SEQ ID NO: 547479 - DNA, 15 bp, Homo sapiens
ctctaactgtgcaaa

SEQ ID NO: 547480 - DNA, 18 bp, Homo sapiens
ctctaagtgtttgctgca

SEQ ID NO: 547481 - DNA, 21 bp, Homo sapiens
gcccagggtgaggtggcatgg

SEQ ID NO: 547482 - DNA, 14 bp, Homo sapiens
gcccatgccctccg

SEQ ID NO: 547483 - DNA, 12 bp, Homo sapiens
gccccaaatata

SEQ ID NO: 547484 - DNA, 19 bp, Homo sapiens
gccccaacccaaacctgga

SEQ ID NO: 547485 - DNA, 22 bp, Homo sapiens
gccccaacccaaacctggagat

SEQ ID NO: 547486 - DNA, 17 bp, Homo sapiens
gccccacctgcagctcc

SEQ ID NO: 547487 - DNA, 22 bp, Homo sapiens
gccccagaaatgccgctgtgtc

SEQ ID NO: 547488 - DNA, 20 bp, Homo sapiens
gccccagacaacagcccagg

SEQ ID NO: 547489 - DNA, 20 bp, Homo sapiens
gccccagcgagtctggagac

SEQ ID NO: 547490 - DNA, 14 bp, Homo sapiens
gccccagcgctgac

SEQ ID NO: 547491 - DNA, 13 bp, Homo sapiens
gcccccactggct

SEQ ID NO: 547492 - DNA, 15 bp, Homo sapiens
gcccccactggctgt

SEQ ID NO: 547493 - DNA, 21 bp, Homo sapiens
gcccccactggctgtgggctc

SEQ ID NO: 547494 - DNA, 12 bp, Homo sapiens
gccccccagtgt

SEQ ID NO: 547495 - DNA, 22 bp, Homo sapiens
gccccccagtgtccccaggggc

SEQ ID NO: 547496 - DNA, 21 bp, Homo sapiens
gccccccatgccctccctgct

SEQ ID NO: 547497 - DNA, 16 bp, Homo sapiens
gccccctgcctgccct

SEQ ID NO: 547498 - DNA, 21 bp, Homo sapiens
gccccctggcccctcccacat

SEQ ID NO: 547499 - DNA, 15 bp, Homo sapiens
gccccgttctgtttg

SEQ ID NO: 547500 - DNA, 20 bp, Homo sapiens
gcccctctccccgcagtgtt

SEQ ID NO: 547501 - DNA, 19 bp, Homo sapiens
gcccgaaggtctctctggc

SEQ ID NO: 547502 - DNA, 16 bp, Homo sapiens
gcccggcccaggagcg

SEQ ID NO: 547503 - DNA, 21 bp, Homo sapiens
gcccgggagatccgccctggg

SEQ ID NO: 547504 - DNA, 13 bp, Homo sapiens
gccctccctgctg

SEQ ID NO: 547505 - DNA, 16 bp, Homo sapiens
gccctcccttcttgtg

SEQ ID NO: 547506 - DNA, 14 bp, Homo sapiens
gccctccgcccttc

SEQ ID NO: 547507 - DNA, 15 bp, Homo sapiens
gccctccgtcctggc

SEQ ID NO: 547508 - DNA, 17 bp, Homo sapiens
gccctccgtcctggcag

SEQ ID NO: 547509 - DNA, 19 bp, Homo sapiens
gccctccgtcctggcaggg

SEQ ID NO: 547510 - DNA, 19 bp, Homo sapiens
gccctgattgcgcaaaact

SEQ ID NO: 547511 - DNA, 12 bp, Homo sapiens
gccctgcagctc

SEQ ID NO: 547512 - DNA, 13 bp, Homo sapiens
gccctgcagctct

SEQ ID NO: 547513 - DNA, 19 bp, Homo sapiens
gccctgcagctctcatgct

SEQ ID NO: 547514 - DNA, 15 bp, Homo sapiens
gccctggcaggcagg

SEQ ID NO: 547515 - DNA, 13 bp, Homo sapiens
gccctgggctctg

SEQ ID NO: 547516 - DNA, 22 bp, Homo sapiens
gccctggggtttccacacaggc

SEQ ID NO: 547517 - DNA, 21 bp, Homo sapiens
gccctggttcccccaggaccc

SEQ ID NO: 547518 - DNA, 23 bp, Homo sapiens
gccctggttcccccaggaccctg

SEQ ID NO: 547519 - DNA, 18 bp, Homo sapiens
gccctgtcaggaggcaga

SEQ ID NO: 547520 - DNA, 14 bp, Homo sapiens
gcccttcccaacct

SEQ ID NO: 547521 - DNA, 15 bp, Homo sapiens
gcccttcccaacctc

SEQ ID NO: 547522 - DNA, 18 bp, Homo sapiens
gcccttcccaacctcccc

SEQ ID NO: 547523 - DNA, 21 bp, Homo sapiens
gcccttccctgacactgtctg

SEQ ID NO: 547524 - DNA, 15 bp, Homo sapiens
gcccttgcccatgct

SEQ ID NO: 547525 - DNA, 18 bp, Homo sapiens
gccctttgtcctcctgct

SEQ ID NO: 547526 - DNA, 18 bp, Homo sapiens
gccgagctctcctgggcc

SEQ ID NO: 547527 - DNA, 21 bp, Homo sapiens
gccgagctctcctgggccagg

SEQ ID NO: 547528 - DNA, 15 bp, Homo sapiens
ttccttgtctaaaga

SEQ ID NO: 547529 - DNA, 14 bp, Homo sapiens
ttcctttatgtgat

SEQ ID NO: 547530 - DNA, 22 bp, Homo sapiens
ttcctttctaatcctatctggg

SEQ ID NO: 547531 - DNA, 21 bp, Homo sapiens
ttcctttgtttttttttcctg

SEQ ID NO: 547532 - DNA, 15 bp, Homo sapiens
ttcgaagtttgcaac

SEQ ID NO: 547533 - DNA, 22 bp, Homo sapiens
ttcgagctatatttaagtattc

SEQ ID NO: 547534 - DNA, 20 bp, Homo sapiens
ttcgccccattttctttaca

SEQ ID NO: 547535 - DNA, 23 bp, Homo sapiens
ttcggaccgaaggtgacagccgt

SEQ ID NO: 547536 - DNA, 23 bp, Homo sapiens
ttcgtccttagaatactgtattg

SEQ ID NO: 547537 - DNA, 15 bp, Homo sapiens
ttctaaaactgtact

SEQ ID NO: 547538 - DNA, 16 bp, Homo sapiens
ttctaaaactgtactt

SEQ ID NO: 547539 - DNA, 14 bp, Homo sapiens
ttctaaaagaatat

SEQ ID NO: 547540 - DNA, 18 bp, Homo sapiens
ttctaaaggtttcactgt

SEQ ID NO: 547541 - DNA, 23 bp, Homo sapiens
ttctaactctgatgtaaatgaag

SEQ ID NO: 547542 - DNA, 12 bp, Homo sapiens
ttctaatggtaa

SEQ ID NO: 547543 - DNA, 22 bp, Homo sapiens
ttctaatggtaacttttgtagt

SEQ ID NO: 547544 - DNA, 14 bp, Homo sapiens
ttctacaaggactc

SEQ ID NO: 547545 - DNA, 21 bp, Homo sapiens
ttctacaatacaacacattga

SEQ ID NO: 547546 - DNA, 16 bp, Homo sapiens
ttctactgttcaattt

SEQ ID NO: 547547 - DNA, 21 bp, Homo sapiens
ttctagtgggtttaatgttta

SEQ ID NO: 547548 - DNA, 17 bp, Homo sapiens
ttctagttatttattct

SEQ ID NO: 547549 - DNA, 22 bp, Homo sapiens
ttctatcagttatcctttgtga

SEQ ID NO: 547550 - DNA, 19 bp, Homo sapiens
ttctcaaatgctactcagt

SEQ ID NO: 547551 - DNA, 20 bp, Homo sapiens
ttctcaaatgctactcagta

SEQ ID NO: 547552 - DNA, 13 bp, Homo sapiens
ttctcaccagctg

SEQ ID NO: 547553 - DNA, 16 bp, Homo sapiens
ttctcagaagtgaaaa

SEQ ID NO: 547554 - DNA, 21 bp, Homo sapiens
ttctcagaagtgaaaaagact

SEQ ID NO: 547555 - DNA, 16 bp, Homo sapiens
ttctcagtttttctta

SEQ ID NO: 547556 - DNA, 18 bp, Homo sapiens
ttctccccttccatttct

SEQ ID NO: 547557 - DNA, 22 bp, Homo sapiens
ttctccccttccatttctgcct

SEQ ID NO: 547558 - DNA, 20 bp, Homo sapiens
ttctctctactggtcctctt

SEQ ID NO: 547559 - DNA, 12 bp, Homo sapiens
ttctctctgctc

SEQ ID NO: 547560 - DNA, 13 bp, Homo sapiens
ttctctctgtgct

SEQ ID NO: 547561 - DNA, 18 bp, Homo sapiens
ttctctgcccagcttttc

SEQ ID NO: 547562 - DNA, 12 bp, Homo sapiens
ttctctgtacat

SEQ ID NO: 547563 - DNA, 19 bp, Homo sapiens
ttctcttctccccttccat

SEQ ID NO: 547564 - DNA, 20 bp, Homo sapiens
ttctcttctccccttccatt

SEQ ID NO: 547565 - DNA, 14 bp, Homo sapiens
ttctctttcaaaaa

SEQ ID NO: 547566 - DNA, 19 bp, Homo sapiens
ttctctttggaaatagcat

SEQ ID NO: 547567 - DNA, 13 bp, Homo sapiens
ttctgaaactaat

SEQ ID NO: 547568 - DNA, 18 bp, Homo sapiens
ttctgaaactaatgaaag

SEQ ID NO: 547569 - DNA, 16 bp, Homo sapiens
ttctgaacctgtcttt

SEQ ID NO: 547570 - DNA, 15 bp, Homo sapiens
ttctgaagttatatt

SEQ ID NO: 547571 - DNA, 17 bp, Homo sapiens
ttctgaagttatatttc

SEQ ID NO: 547572 - DNA, 18 bp, Homo sapiens
ttctgaagttatatttcc

SEQ ID NO: 547573 - DNA, 20 bp, Homo sapiens
ttctgaagttatatttccta

SEQ ID NO: 547574 - DNA, 12 bp, Homo sapiens
ttctgagaaaag

SEQ ID NO: 547575 - DNA, 13 bp, Homo sapiens
ttctgatgaagtt

SEQ ID NO: 547576 - DNA, 11 bp, Homo sapiens
ttctggcaaat

SEQ ID NO: 547577 - DNA, 18 bp, Homo sapiens
ttctggcaaatattttgt

SEQ ID NO: 547578 - DNA, 23 bp, Homo sapiens
ttctgggaatgtatagtatttga

SEQ ID NO: 547579 - DNA, 23 bp, Homo sapiens
ttctggggagctggacagtggag

SEQ ID NO: 547580 - DNA, 22 bp, Homo sapiens
ttctgtcatctaccttttctct

SEQ ID NO: 547581 - DNA, 15 bp, Homo sapiens
ttctgtcgtccccag

SEQ ID NO: 547582 - DNA, 16 bp, Homo sapiens
ttctgtcgtccccaga

SEQ ID NO: 547583 - DNA, 20 bp, Homo sapiens
ttctgttacaaaatgtaact

SEQ ID NO: 547584 - DNA, 22 bp, Homo sapiens
tttcagatttgcacaaaaagat

SEQ ID NO: 547585 - DNA, 15 bp, Homo sapiens
tttcagctaggaaca

SEQ ID NO: 547586 - DNA, 19 bp, Homo sapiens
tttcagctaggaacaaatc

SEQ ID NO: 547587 - DNA, 21 bp, Homo sapiens
tttcagctaggaacaaatctt

SEQ ID NO: 547588 - DNA, 22 bp, Homo sapiens
tttcagctaggaacaaatcttc

SEQ ID NO: 547589 - DNA, 21 bp, Homo sapiens
tttcagctctctgtataaaca

SEQ ID NO: 547590 - DNA, 22 bp, Homo sapiens
tttcaggcaggcacctagcaat

SEQ ID NO: 547591 - DNA, 19 bp, Homo sapiens
tttcagtaaacctgtctga

SEQ ID NO: 547592 - DNA, 22 bp, Homo sapiens
tttcatattttaatttcaagct

SEQ ID NO: 547593 - DNA, 21 bp, Homo sapiens
tttcattacaatggaaacaat

SEQ ID NO: 547594 - DNA, 18 bp, Homo sapiens
tttcattacctgtagctt

SEQ ID NO: 547595 - DNA, 13 bp, Homo sapiens
tttcattagcaaa

SEQ ID NO: 547596 - DNA, 19 bp, Homo sapiens
tttcattagcaaaaaaagt

SEQ ID NO: 547597 - DNA, 18 bp, Homo sapiens
tttcattgctgtgacagt

SEQ ID NO: 547598 - DNA, 11 bp, Homo sapiens
tttcattgtgt

SEQ ID NO: 547599 - DNA, 18 bp, Homo sapiens
tttcatttgtgtcagcat

SEQ ID NO: 547600 - DNA, 22 bp, Homo sapiens
tttccaacaccacagacacaca

SEQ ID NO: 547601 - DNA, 23 bp, Homo sapiens
tttccaacaccacagacacacac

SEQ ID NO: 547602 - DNA, 14 bp, Homo sapiens
tttccaagtaatat

SEQ ID NO: 547603 - DNA, 20 bp, Homo sapiens
tttccaagtttattgccctc

SEQ ID NO: 547604 - DNA, 15 bp, Homo sapiens
tttccagtgctgctc

SEQ ID NO: 547605 - DNA, 22 bp, Homo sapiens
tttcccaaagcatccctcttag

SEQ ID NO: 547606 - DNA, 19 bp, Homo sapiens
tttccccaattatcctcct

SEQ ID NO: 547607 - DNA, 12 bp, Homo sapiens
tttcccttccag

SEQ ID NO: 547608 - DNA, 14 bp, Homo sapiens
tttcccttccagtt

SEQ ID NO: 547609 - DNA, 16 bp, Homo sapiens
tttcctataccatttc

SEQ ID NO: 547610 - DNA, 23 bp, Homo sapiens
tttcctcttaatgtctcaaaata

SEQ ID NO: 547611 - DNA, 15 bp, Homo sapiens
tttcctgctcctcca

SEQ ID NO: 547612 - DNA, 22 bp, Homo sapiens
tttcctgctcctccagtacaat

SEQ ID NO: 547613 - DNA, 16 bp, Homo sapiens
tttccttgcatacaaa

SEQ ID NO: 547614 - DNA, 15 bp, Homo sapiens
tttcgaagtttgcaa

SEQ ID NO: 547615 - DNA, 14 bp, Homo sapiens
tttctactttaaat

SEQ ID NO: 547616 - DNA, 14 bp, Homo sapiens
tttctagaaatgtt

SEQ ID NO: 547617 - DNA, 17 bp, Homo sapiens
tttctagagttcctacc

SEQ ID NO: 547618 - DNA, 16 bp, Homo sapiens
tttctagcaattgctt

SEQ ID NO: 547619 - DNA, 19 bp, Homo sapiens
tttctagcatatatgtgtc

SEQ ID NO: 547620 - DNA, 18 bp, Homo sapiens
tttctcaatgtcttccca

SEQ ID NO: 547621 - DNA, 15 bp, Homo sapiens
tttctcagcatatat

SEQ ID NO: 547622 - DNA, 16 bp, Homo sapiens
tttctcagtttgtata

SEQ ID NO: 547623 - DNA, 13 bp, Homo sapiens
tttctcctatctt

SEQ ID NO: 547624 - DNA, 16 bp, Homo sapiens
tttctccttttgtgtt

SEQ ID NO: 547625 - DNA, 21 bp, Homo sapiens
tttctgagtagcatatataat

SEQ ID NO: 547626 - DNA, 19 bp, Homo sapiens
tttctggggtttttctgtt

SEQ ID NO: 547627 - DNA, 14 bp, Homo sapiens
tttctgtcttctct

SEQ ID NO: 547628 - DNA, 20 bp, Homo sapiens
tttctgttgttcacttggag

SEQ ID NO: 547629 - DNA, 13 bp, Homo sapiens
tttcttaatatat

SEQ ID NO: 547630 - DNA, 15 bp, Homo sapiens
tttcttccaacatgt

SEQ ID NO: 547631 - DNA, 14 bp, Homo sapiens
tttcttctttctag

SEQ ID NO: 547632 - DNA, 11 bp, Homo sapiens
tttctttcagt

SEQ ID NO: 547633 - DNA, 16 bp, Homo sapiens
tttctttgaattttca

SEQ ID NO: 547634 - DNA, 20 bp, Homo sapiens
tttctttgaattttcatttt

SEQ ID NO: 547635 - DNA, 23 bp, Homo sapiens
tttgaagtgcctctgattctatg

SEQ ID NO: 547636 - DNA, 17 bp, Homo sapiens
tttgaattttcatttta

SEQ ID NO: 547637 - DNA, 12 bp, Homo sapiens
tttgagtctttt

SEQ ID NO: 547638 - DNA, 22 bp, Homo sapiens
tttgagtcttttttttttaagt

SEQ ID NO: 547639 - DNA, 14 bp, Homo sapiens
tttgataaatagtg

SEQ ID NO: 547640 - DNA, 15 bp, Homo sapiens
tttgatatgagtata

SEQ ID NO: 547641 - DNA, 19 bp, Homo sapiens
tttgatgtccccaaagtac

SEQ ID NO: 547642 - DNA, 13 bp, Homo sapiens
tttgattcacatg

SEQ ID NO: 547643 - DNA, 16 bp, Homo sapiens
tttgattcacatgttt

SEQ ID NO: 547644 - DNA, 20 bp, Homo sapiens
tttgatttccaagtaatata

SEQ ID NO: 547645 - DNA, 15 bp, Homo sapiens
tttgcaaataactta

SEQ ID NO: 547646 - DNA, 23 bp, Homo sapiens
tttgcaacagcaaattaatgtgt

SEQ ID NO: 547647 - DNA, 15 bp, Homo sapiens
tttgcactcttgttt

SEQ ID NO: 547648 - DNA, 17 bp, Homo sapiens
tttgcataatatgcata

SEQ ID NO: 547649 - DNA, 15 bp, Homo sapiens
tttgcatagaataat

SEQ ID NO: 547650 - DNA, 17 bp, Homo sapiens
tttgcatagaataatga

SEQ ID NO: 547651 - DNA, 19 bp, Homo sapiens
tttgcatgtcgcacaatgt

SEQ ID NO: 547652 - DNA, 15 bp, Homo sapiens
tttgcatgtctgcat

SEQ ID NO: 547653 - DNA, 18 bp, Homo sapiens
tttgcctctgcccttggg

SEQ ID NO: 547654 - DNA, 18 bp, Homo sapiens
tttgcctgttaaatcgta

SEQ ID NO: 547655 - DNA, 13 bp, Homo sapiens
tttgctaattaaa

SEQ ID NO: 547656 - DNA, 22 bp, Homo sapiens
tttgctccccttccccttcctt

SEQ ID NO: 547657 - DNA, 10 bp, Homo sapiens
tttggaaata

SEQ ID NO: 547658 - DNA, 15 bp, Homo sapiens
tttggaaatctcttt

SEQ ID NO: 547659 - DNA, 21 bp, Homo sapiens
tttggccagtgacatttcaat

SEQ ID NO: 547660 - DNA, 18 bp, Homo sapiens
tttgggcagatttgcaac

SEQ ID NO: 547661 - DNA, 16 bp, Homo sapiens
tttggttatagtgcaa

SEQ ID NO: 547662 - DNA, 18 bp, Homo sapiens
tttggttttaaaatactg

SEQ ID NO: 547663 - DNA, 16 bp, Homo sapiens
tttgtaaactttgaaa

SEQ ID NO: 547664 - DNA, 16 bp, Homo sapiens
tttgtagctgtcatgg

SEQ ID NO: 547665 - DNA, 15 bp, Homo sapiens
tttgtagtcttatga

SEQ ID NO: 547666 - DNA, 19 bp, Homo sapiens
tttgtagtcttatgaatag

SEQ ID NO: 547667 - DNA, 21 bp, Homo sapiens
tttgtataaatttttaagtgt

SEQ ID NO: 547668 - DNA, 12 bp, Homo sapiens
tttgtatcctcc

SEQ ID NO: 547669 - DNA, 15 bp, Homo sapiens
tttgtcattttcatt

SEQ ID NO: 547670 - DNA, 16 bp, Homo sapiens
tttgtcattttcatta

SEQ ID NO: 547671 - DNA, 22 bp, Homo sapiens
tttgtcctaagagatttatctt

SEQ ID NO: 547672 - DNA, 23 bp, Homo sapiens
tttgtcctaagagatttatcttt

SEQ ID NO: 547673 - DNA, 20 bp, Homo sapiens
tttgtctaagaaacattgga

SEQ ID NO: 547674 - DNA, 12 bp, Homo sapiens
tttgtgaaattt

SEQ ID NO: 547675 - DNA, 16 bp, Homo sapiens
tttgtgagtttgtttc

SEQ ID NO: 547676 - DNA, 15 bp, Homo sapiens
tttgtgcttgttctt

SEQ ID NO: 547677 - DNA, 15 bp, Homo sapiens
tttgtggataagaaa

SEQ ID NO: 547678 - DNA, 13 bp, Homo sapiens
tttgtgttccaaa

SEQ ID NO: 547679 - DNA, 14 bp, Homo sapiens
tttgttaatttctt

SEQ ID NO: 547680 - DNA, 15 bp, Homo sapiens
tttgttcttaaaaat

SEQ ID NO: 547681 - DNA, 22 bp, Homo sapiens
tttgttcttaaaaatgcattta

SEQ ID NO: 547682 - DNA, 17 bp, Homo sapiens
tttgtttctgagaaaag

SEQ ID NO: 547683 - DNA, 22 bp, Homo sapiens
tttgtttctttgaattttcatt

SEQ ID NO: 547684 - DNA, 23 bp, Homo sapiens
tatgtatacgcacgcacccacac

SEQ ID NO: 547685 - DNA, 18 bp, Homo sapiens
tatgtatgtttacactgt

SEQ ID NO: 547686 - DNA, 15 bp, Homo sapiens
tatgtattctcttct

SEQ ID NO: 547687 - DNA, 12 bp, Homo sapiens
tatgtcatttca

SEQ ID NO: 547688 - DNA, 13 bp, Homo sapiens
tatgtccatatct

SEQ ID NO: 547689 - DNA, 15 bp, Homo sapiens
tatgtccatatctaa

SEQ ID NO: 547690 - DNA, 21 bp, Homo sapiens
tccaacaccacagacacacac

SEQ ID NO: 547691 - DNA, 19 bp, Homo sapiens
tccaacatacaatttactt

SEQ ID NO: 547692 - DNA, 18 bp, Homo sapiens
tccaacgtggggcagcac

SEQ ID NO: 547693 - DNA, 19 bp, Homo sapiens
tccaacgtggggcagcaca

SEQ ID NO: 547694 - DNA, 23 bp, Homo sapiens
tccaactgagaagtaccttatca

SEQ ID NO: 547695 - DNA, 14 bp, Homo sapiens
tccaagggcccaga

SEQ ID NO: 547696 - DNA, 18 bp, Homo sapiens
tccacaatcatctattga

SEQ ID NO: 547697 - DNA, 21 bp, Homo sapiens
tccacacacacaaaaaaagac

SEQ ID NO: 547698 - DNA, 13 bp, Homo sapiens
tccacacaggccc

SEQ ID NO: 547699 - DNA, 14 bp, Homo sapiens
tccacacaggccca

SEQ ID NO: 547700 - DNA, 14 bp, Homo sapiens
tccacagttatctt

SEQ ID NO: 547701 - DNA, 22 bp, Homo sapiens
tccacagttatcttagctggat

SEQ ID NO: 547702 - DNA, 19 bp, Homo sapiens
tccacattctgctgccccc

SEQ ID NO: 547703 - DNA, 16 bp, Homo sapiens
tccacctgctctgctg

SEQ ID NO: 547704 - DNA, 17 bp, Homo sapiens
tccacctgctctgctga

SEQ ID NO: 547705 - DNA, 16 bp, Homo sapiens
tccacctgggagatgc

SEQ ID NO: 547706 - DNA, 20 bp, Homo sapiens
tccacctgggagatgctggg

SEQ ID NO: 547707 - DNA, 17 bp, Homo sapiens
tccacgagagcgcagca

SEQ ID NO: 547708 - DNA, 18 bp, Homo sapiens
tccactggggtggcctga

SEQ ID NO: 547709 - DNA, 22 bp, Homo sapiens
tccactttgtataaatttttaa

SEQ ID NO: 547710 - DNA, 15 bp, Homo sapiens
tccagaagcagcagc

SEQ ID NO: 547711 - DNA, 20 bp, Homo sapiens
tccagagggttgtgattttg

SEQ ID NO: 547712 - DNA, 21 bp, Homo sapiens
tccagaggtgagggaggcctg

SEQ ID NO: 547713 - DNA, 22 bp, Homo sapiens
tccagcctggaaacctgtctga

SEQ ID NO: 547714 - DNA, 18 bp, Homo sapiens
tccaggaacacatgcaca

SEQ ID NO: 547715 - DNA, 20 bp, Homo sapiens
tccaggaacacatgcacaca

SEQ ID NO: 547716 - DNA, 23 bp, Homo sapiens
tccaggaacacatgcacacacac

SEQ ID NO: 547717 - DNA, 16 bp, Homo sapiens
tccaggagatgaggct

SEQ ID NO: 547718 - DNA, 13 bp, Homo sapiens
tccaggcagccgc

SEQ ID NO: 547719 - DNA, 16 bp, Homo sapiens
tccaggcatgaccctg

SEQ ID NO: 547720 - DNA, 14 bp, Homo sapiens
tccaggcgtagggc

SEQ ID NO: 547721 - DNA, 17 bp, Homo sapiens
tccaggcgtagggccag

SEQ ID NO: 547722 - DNA, 21 bp, Homo sapiens
tccaggcgtagggccagggct

SEQ ID NO: 547723 - DNA, 23 bp, Homo sapiens
tccaggcgtagggccagggctct

SEQ ID NO: 547724 - DNA, 20 bp, Homo sapiens
tccagggctcaacactgtga

SEQ ID NO: 547725 - DNA, 15 bp, Homo sapiens
tccagtccccagaac

SEQ ID NO: 547726 - DNA, 22 bp, Homo sapiens
tccagtccccagaactctgcct

SEQ ID NO: 547727 - DNA, 22 bp, Homo sapiens
tccagtgtggtcttgtttaata

SEQ ID NO: 547728 - DNA, 21 bp, Homo sapiens
tccagttggactgtggcctca

SEQ ID NO: 547729 - DNA, 13 bp, Homo sapiens
tccagtttattcc

SEQ ID NO: 547730 - DNA, 14 bp, Homo sapiens
tccatatctaacca

SEQ ID NO: 547731 - DNA, 17 bp, Homo sapiens
tccatatctaaccagtg

SEQ ID NO: 547732 - DNA, 19 bp, Homo sapiens
tccatatctaaccagtgat

SEQ ID NO: 547733 - DNA, 13 bp, Homo sapiens
tccatattagaaa

SEQ ID NO: 547734 - DNA, 17 bp, Homo sapiens
tccatatttttttcctt

SEQ ID NO: 547735 - DNA, 14 bp, Homo sapiens
tccatcaaagccct

SEQ ID NO: 547736 - DNA, 16 bp, Homo sapiens
tccatcaaagccctcc

SEQ ID NO: 547737 - DNA, 16 bp, Homo sapiens
tccatcctcctccttc

SEQ ID NO: 547738 - DNA, 17 bp, Homo sapiens
tccatcctcctccttcc

SEQ ID NO: 547739 - DNA, 15 bp, Homo sapiens
tccatgattccaagg

SEQ ID NO: 547740 - DNA, 19 bp, Homo sapiens
tccatgcggccggcctggg

SEQ ID NO: 547741 - DNA, 21 bp, Homo sapiens
tccatgcggccggcctggggc

SEQ ID NO: 547742 - DNA, 23 bp, Homo sapiens
tccatggcgaaaacatctcctta

SEQ ID NO: 547743 - DNA, 18 bp, Homo sapiens
tccatgtcctatgtgtga

SEQ ID NO: 547744 - DNA, 19 bp, Homo sapiens
tccattggatctgcaagaa

SEQ ID NO: 547745 - DNA, 23 bp, Homo sapiens
tccatttacagtctctttcttcc

SEQ ID NO: 547746 - DNA, 20 bp, Homo sapiens
tccattttggtgtctttctc

SEQ ID NO: 547747 - DNA, 22 bp, Homo sapiens
tccattttggtgtctttctctt

SEQ ID NO: 547748 - DNA, 19 bp, Homo sapiens
tcccaacaacatccatgtc

SEQ ID NO: 547749 - DNA, 15 bp, Homo sapiens
tcccaacctcccctg

SEQ ID NO: 547750 - DNA, 16 bp, Homo sapiens
tcccaaggttctgggt

SEQ ID NO: 547751 - DNA, 12 bp, Homo sapiens
tcccactccaag

SEQ ID NO: 547752 - DNA, 15 bp, Homo sapiens
tcccactcttctcat

SEQ ID NO: 547753 - DNA, 15 bp, Homo sapiens
tcccactgagtctca

SEQ ID NO: 547754 - DNA, 21 bp, Homo sapiens
tcccagatccaggaacacatg

SEQ ID NO: 547755 - DNA, 13 bp, Homo sapiens
tcccagctgcccc

SEQ ID NO: 547756 - DNA, 16 bp, Homo sapiens
tcccagctgcccctcc

SEQ ID NO: 547757 - DNA, 16 bp, Homo sapiens
tcccaggcactctctt

SEQ ID NO: 547758 - DNA, 20 bp, Homo sapiens
tcccatatcaaaagacacag

SEQ ID NO: 547759 - DNA, 14 bp, Homo sapiens
tcccattgtattta

SEQ ID NO: 547760 - DNA, 23 bp, Homo sapiens
tcccatttccttgtctaaagatc

SEQ ID NO: 547761 - DNA, 18 bp, Homo sapiens
tccccaaaggccaacagc

SEQ ID NO: 547762 - DNA, 17 bp, Homo sapiens
tccccagaactctgcct

SEQ ID NO: 547763 - DNA, 19 bp, Homo sapiens
tccccagaactctgcctgc

SEQ ID NO: 547764 - DNA, 12 bp, Homo sapiens
tccccagaccag

SEQ ID NO: 547765 - DNA, 20 bp, Homo sapiens
tccccagaccagtagtgacc

SEQ ID NO: 547766 - DNA, 21 bp, Homo sapiens
tccccagaccagtagtgacca

SEQ ID NO: 547767 - DNA, 12 bp, Homo sapiens
tccccagccccc

SEQ ID NO: 547768 - DNA, 17 bp, Homo sapiens
tccccagccccctggcc

SEQ ID NO: 547769 - DNA, 20 bp, Homo sapiens
tccccagccccctggcccct

SEQ ID NO: 547770 - DNA, 21 bp, Homo sapiens
tccccagcccttcctctgctc

SEQ ID NO: 547771 - DNA, 19 bp, Homo sapiens
tccccaggccgtggctgcc

SEQ ID NO: 547772 - DNA, 16 bp, Homo sapiens
tccccagtcccaatgc

SEQ ID NO: 547773 - DNA, 20 bp, Homo sapiens
tccccatggctcctcaccac

SEQ ID NO: 547774 - DNA, 12 bp, Homo sapiens
tcccccaggacc

SEQ ID NO: 547775 - DNA, 21 bp, Homo sapiens
tcccccgcaatgtgcccccag

SEQ ID NO: 547776 - DNA, 12 bp, Homo sapiens
tccccctccttc

SEQ ID NO: 547777 - DNA, 21 bp, Homo sapiens
tccccctccttcccagctgcc

SEQ ID NO: 547778 - DNA, 11 bp, Homo sapiens
tccccctttct

SEQ ID NO: 547779 - DNA, 15 bp, Homo sapiens
tccccgcgggcagtg

SEQ ID NO: 547780 - DNA, 13 bp, Homo sapiens
tccccggagctgg

SEQ ID NO: 547781 - DNA, 15 bp, Homo sapiens
tcccctgcgcaggcc

SEQ ID NO: 547782 - DNA, 15 bp, Homo sapiens
tcccctggtcctgca

SEQ ID NO: 547783 - DNA, 19 bp, Homo sapiens
tcccctgtgccagcccaga

SEQ ID NO: 547784 - DNA, 12 bp, Homo sapiens
tccccttcccag

SEQ ID NO: 547785 - DNA, 18 bp, Homo sapiens
tccccttccccttccttc

SEQ ID NO: 547786 - DNA, 11 bp, Homo sapiens
tccccttcctt

SEQ ID NO: 547787 - DNA, 17 bp, Homo sapiens
tccccttgggatgggca

SEQ ID NO: 547788 - DNA, 19 bp, Homo sapiens
tccccttgggatgggcaca

SEQ ID NO: 547789 - DNA, 23 bp, Homo sapiens
tccccttgggatgggcacaggct

SEQ ID NO: 547790 - DNA, 21 bp, Homo sapiens
tcccgaatggagtccagacct

SEQ ID NO: 547791 - DNA, 23 bp, Homo sapiens
tcccgaatggagtccagacctgg

SEQ ID NO: 547792 - DNA, 15 bp, Homo sapiens
tcccgacctcttaga

SEQ ID NO: 547793 - DNA, 17 bp, Homo sapiens
tcccgacctcttagaaa

SEQ ID NO: 547794 - DNA, 15 bp, Homo sapiens
tcccggccctgcctg

SEQ ID NO: 547795 - DNA, 24 bp, Homo sapiens
tcccggggccatggaagctggcag

SEQ ID NO: 547796 - DNA, 13 bp, Homo sapiens
tccctcaattaca

SEQ ID NO: 547797 - DNA, 16 bp, Homo sapiens
tccctcaattacagag

SEQ ID NO: 547798 - DNA, 20 bp, Homo sapiens
tccctccacgttcacccctc

SEQ ID NO: 547799 - DNA, 17 bp, Homo sapiens
tccctccctcccagatc

SEQ ID NO: 547800 - DNA, 21 bp, Homo sapiens
tccctcttagtctaggtcctt

SEQ ID NO: 547801 - DNA, 21 bp, Homo sapiens
tccctgaatctgaccacagac

SEQ ID NO: 547802 - DNA, 22 bp, Homo sapiens
tccctgaatctgaccacagaca

SEQ ID NO: 547803 - DNA, 18 bp, Homo sapiens
tccctgagggcccttccc

SEQ ID NO: 547804 - DNA, 16 bp, Homo sapiens
tccctgatgtacagtt

SEQ ID NO: 547805 - DNA, 18 bp, Homo sapiens
tccctgccagcaccccca

SEQ ID NO: 547806 - DNA, 17 bp, Homo sapiens
tccctggactctgtggg

SEQ ID NO: 547807 - DNA, 22 bp, Homo sapiens
tccctggactctgtggggccac

SEQ ID NO: 547808 - DNA, 12 bp, Homo sapiens
tccctggcttcc

SEQ ID NO: 547809 - DNA, 22 bp, Homo sapiens
tccctgtctgtctgtctctctt

SEQ ID NO: 547810 - DNA, 19 bp, Homo sapiens
tcccttccacctgctctgc

SEQ ID NO: 547811 - DNA, 13 bp, Homo sapiens
tcccttcctccat

SEQ ID NO: 547812 - DNA, 20 bp, Homo sapiens
tcccttctcttccaggcagc

SEQ ID NO: 547813 - DNA, 21 bp, Homo sapiens
tcccttcttgtgcccttaaaa

SEQ ID NO: 547814 - DNA, 16 bp, Homo sapiens
tcccttgattcaaata

SEQ ID NO: 547815 - DNA, 19 bp, Homo sapiens
tccgacctggcctgtctgt

SEQ ID NO: 547816 - DNA, 19 bp, Homo sapiens
tccgagtgtgtttcatcct

SEQ ID NO: 547817 - DNA, 21 bp, Homo sapiens
catataaaatggcaacaaact

SEQ ID NO: 547818 - DNA, 22 bp, Homo sapiens
catatacctataatgtgtgtat

SEQ ID NO: 547819 - DNA, 23 bp, Homo sapiens
catatacctataatgtgtgtatg

SEQ ID NO: 547820 - DNA, 23 bp, Homo sapiens
catatataaaagtttaaagaaga

SEQ ID NO: 547821 - DNA, 12 bp, Homo sapiens
catatatacata

SEQ ID NO: 547822 - DNA, 13 bp, Homo sapiens
catatatacattt

SEQ ID NO: 547823 - DNA, 14 bp, Homo sapiens
catatatatgtata

SEQ ID NO: 547824 - DNA, 15 bp, Homo sapiens
catatatatgtatat

SEQ ID NO: 547825 - DNA, 23 bp, Homo sapiens
catatatgtatacgcacgcaccc

SEQ ID NO: 547826 - DNA, 20 bp, Homo sapiens
catatgtagactatatacat

SEQ ID NO: 547827 - DNA, 21 bp, Homo sapiens
catatgtagactatatacatg

SEQ ID NO: 547828 - DNA, 12 bp, Homo sapiens
catattagaaaa

SEQ ID NO: 547829 - DNA, 13 bp, Homo sapiens
catattagaaaac

SEQ ID NO: 547830 - DNA, 18 bp, Homo sapiens
catattagaaaactttgt

SEQ ID NO: 547831 - DNA, 19 bp, Homo sapiens
catattagcgacaacagat

SEQ ID NO: 547832 - DNA, 23 bp, Homo sapiens
catattatatcagactgctttga

SEQ ID NO: 547833 - DNA, 20 bp, Homo sapiens
catattggtatatccttttc

SEQ ID NO: 547834 - DNA, 23 bp, Homo sapiens
catattttcctttatgtgatgta

SEQ ID NO: 547835 - DNA, 15 bp, Homo sapiens
catatttttttcctt

SEQ ID NO: 547836 - DNA, 16 bp, Homo sapiens
catcaacaaagaaata

SEQ ID NO: 547837 - DNA, 14 bp, Homo sapiens
catcaattcccatt

SEQ ID NO: 547838 - DNA, 13 bp, Homo sapiens
catcacctctgta

SEQ ID NO: 547839 - DNA, 21 bp, Homo sapiens
catcactattgggcccccagg

SEQ ID NO: 547840 - DNA, 19 bp, Homo sapiens
catcatctgtaagctgttt

SEQ ID NO: 547841 - DNA, 17 bp, Homo sapiens
catccagattgggtgcc

SEQ ID NO: 547842 - DNA, 22 bp, Homo sapiens
catccatgcggccggcctgggg

SEQ ID NO: 547843 - DNA, 20 bp, Homo sapiens
catccatgtcctatgtgtga

SEQ ID NO: 547844 - DNA, 14 bp, Homo sapiens
catccattcccaag

SEQ ID NO: 547845 - DNA, 14 bp, Homo sapiens
catcccacagccag

SEQ ID NO: 547846 - DNA, 16 bp, Homo sapiens
catcccggggccatgg

SEQ ID NO: 547847 - DNA, 20 bp, Homo sapiens
catcccggggccatggaagc

SEQ ID NO: 547848 - DNA, 14 bp, Homo sapiens
catccctcctgctt

SEQ ID NO: 547849 - DNA, 20 bp, Homo sapiens
catccgaccaggttgtcact

SEQ ID NO: 547850 - DNA, 17 bp, Homo sapiens
catccggggccagctcc

SEQ ID NO: 547851 - DNA, 21 bp, Homo sapiens
catcctcttatatgtgcccct

SEQ ID NO: 547852 - DNA, 13 bp, Homo sapiens
catccttctcccc

SEQ ID NO: 547853 - DNA, 14 bp, Homo sapiens
catccttgaggacc

SEQ ID NO: 547854 - DNA, 19 bp, Homo sapiens
catcctttcacttctttcc

SEQ ID NO: 547855 - DNA, 22 bp, Homo sapiens
catctaaactttaatatgtatt

SEQ ID NO: 547856 - DNA, 23 bp, Homo sapiens
catctaaactttaatatgtattt

SEQ ID NO: 547857 - DNA, 13 bp, Homo sapiens
catctaaatatta

SEQ ID NO: 547858 - DNA, 18 bp, Homo sapiens
catctaccttttctcttc

SEQ ID NO: 547859 - DNA, 19 bp, Homo sapiens
catctaccttttctcttca

SEQ ID NO: 547860 - DNA, 15 bp, Homo sapiens
catctaggatgattt

SEQ ID NO: 547861 - DNA, 17 bp, Homo sapiens
catctcccctcctggcg

SEQ ID NO: 547862 - DNA, 15 bp, Homo sapiens
catctcccctttgct

SEQ ID NO: 547863 - DNA, 12 bp, Homo sapiens
catctctgtaaa

SEQ ID NO: 547864 - DNA, 15 bp, Homo sapiens
catctcttcatgcgc

SEQ ID NO: 547865 - DNA, 20 bp, Homo sapiens
catctgagagaggctaaaat

SEQ ID NO: 547866 - DNA, 22 bp, Homo sapiens
catctgagagaggctaaaatgt

SEQ ID NO: 547867 - DNA, 18 bp, Homo sapiens
catctgcagtgttctgtg

SEQ ID NO: 547868 - DNA, 22 bp, Homo sapiens
catctgcagtgttctgtgaata

SEQ ID NO: 547869 - DNA, 19 bp, Homo sapiens
catctgctgagctctgacc

SEQ ID NO: 547870 - DNA, 17 bp, Homo sapiens
catctggaaaataaaag

SEQ ID NO: 547871 - DNA, 21 bp, Homo sapiens
catcttccacaggtctcagaa

SEQ ID NO: 547872 - DNA, 22 bp, Homo sapiens
catcttccacaggtctcagaat

SEQ ID NO: 547873 - DNA, 20 bp, Homo sapiens
catcttgacagagcctgccc

SEQ ID NO: 547874 - DNA, 17 bp, Homo sapiens
catgaaacagcagctga

SEQ ID NO: 547875 - DNA, 13 bp, Homo sapiens
catgaaatgaaca

SEQ ID NO: 547876 - DNA, 12 bp, Homo sapiens
catgaacagctc

SEQ ID NO: 547877 - DNA, 14 bp, Homo sapiens
catgaacagctctg

SEQ ID NO: 547878 - DNA, 20 bp, Homo sapiens
catgaacagctctgagatcc

SEQ ID NO: 547879 - DNA, 20 bp, Homo sapiens
catgaaggtctacctgaaaa

SEQ ID NO: 547880 - DNA, 21 bp, Homo sapiens
catgaatacgtaaactgcgta

SEQ ID NO: 547881 - DNA, 14 bp, Homo sapiens
catgacaggctgtt

SEQ ID NO: 547882 - DNA, 23 bp, Homo sapiens
catgacagttcattcagggccga

SEQ ID NO: 547883 - DNA, 14 bp, Homo sapiens
catgaccctggagc

SEQ ID NO: 547884 - DNA, 16 bp, Homo sapiens
catgaccctggagccc

SEQ ID NO: 547885 - DNA, 16 bp, Homo sapiens
catgatgatttcagaa

SEQ ID NO: 547886 - DNA, 21 bp, Homo sapiens
catgatgtttttaaaatctta

SEQ ID NO: 547887 - DNA, 19 bp, Homo sapiens
catgattccaagggcccag

SEQ ID NO: 547888 - DNA, 22 bp, Homo sapiens
catgatttcacaaatattaaaa

SEQ ID NO: 547889 - DNA, 12 bp, Homo sapiens
catgcacacaca

SEQ ID NO: 547890 - DNA, 17 bp, Homo sapiens
catgcccctcttagaag

SEQ ID NO: 547891 - DNA, 16 bp, Homo sapiens
catgccctcatcccga

SEQ ID NO: 547892 - DNA, 11 bp, Homo sapiens
catgccctccc

SEQ ID NO: 547893 - DNA, 21 bp, Homo sapiens
catgccctccctgctgccagg

SEQ ID NO: 547894 - DNA, 18 bp, Homo sapiens
catgccgagtgccccaga

SEQ ID NO: 547895 - DNA, 17 bp, Homo sapiens
catgcctgctttagaat

SEQ ID NO: 547896 - DNA, 16 bp, Homo sapiens
catgcggccggcctgg

SEQ ID NO: 547897 - DNA, 15 bp, Homo sapiens
catgcgggctgggca

SEQ ID NO: 547898 - DNA, 18 bp, Homo sapiens
catgcgggctgggcagct

SEQ ID NO: 547899 - DNA, 20 bp, Homo sapiens
catgcgggctgggcagctgt

SEQ ID NO: 547900 - DNA, 21 bp, Homo sapiens
catgcgggctgggcagctgtt

SEQ ID NO: 547901 - DNA, 16 bp, Homo sapiens
catgctgcccctgcct

SEQ ID NO: 547902 - DNA, 21 bp, Homo sapiens
catgcttaaataaaaattatg

SEQ ID NO: 547903 - DNA, 22 bp, Homo sapiens
catgcttaaataaaaattatgt

SEQ ID NO: 547904 - DNA, 13 bp, Homo sapiens
catgcttagctta

SEQ ID NO: 547905 - DNA, 22 bp, Homo sapiens
catgcttagcttatctttcttt

SEQ ID NO: 547906 - DNA, 14 bp, Homo sapiens
catgctttaaagtg

SEQ ID NO: 547907 - DNA, 15 bp, Homo sapiens
catgctttaaagtgt

SEQ ID NO: 547908 - DNA, 18 bp, Homo sapiens
catgctttaaagtgtaat

SEQ ID NO: 547909 - DNA, 23 bp, Homo sapiens
catgctttaaagtgtaataatat

SEQ ID NO: 547910 - DNA, 17 bp, Homo sapiens
catgctttccatatttt

SEQ ID NO: 547911 - DNA, 14 bp, Homo sapiens
catggaagctggca

SEQ ID NO: 547912 - DNA, 17 bp, Homo sapiens
catggaattggtttaaa

SEQ ID NO: 547913 - DNA, 13 bp, Homo sapiens
catggaggcacac

SEQ ID NO: 547914 - DNA, 19 bp, Homo sapiens
catggatacttcctgggtc

SEQ ID NO: 547915 - DNA, 19 bp, Homo sapiens
catggcttctgaacctgtc

SEQ ID NO: 547916 - DNA, 19 bp, Homo sapiens
catgggagtcagggagccc

SEQ ID NO: 547917 - DNA, 19 bp, Homo sapiens
catggtgaactgaagcaga

SEQ ID NO: 547918 - DNA, 20 bp, Homo sapiens
catggtgaactgaagcagag

SEQ ID NO: 547919 - DNA, 18 bp, Homo sapiens
aaatgtctactgaagctt

SEQ ID NO: 547920 - DNA, 22 bp, Homo sapiens
aaatgtgaattactaacttcta

SEQ ID NO: 547921 - DNA, 17 bp, Homo sapiens
aaatgtgtcttgtatta

SEQ ID NO: 547922 - DNA, 18 bp, Homo sapiens
aaatgtgtgcttggaaaa

SEQ ID NO: 547923 - DNA, 18 bp, Homo sapiens
aaatgtgtgtgatgtgac

SEQ ID NO: 547924 - DNA, 22 bp, Homo sapiens
aaatgtgtgtgatgtgacattt

SEQ ID NO: 547925 - DNA, 23 bp, Homo sapiens
aaatgtgtgtgatgtgacatttg

SEQ ID NO: 547926 - DNA, 15 bp, Homo sapiens
aaatgttaaagatgt

SEQ ID NO: 547927 - DNA, 15 bp, Homo sapiens
aaatgttcttccagt

SEQ ID NO: 547928 - DNA, 23 bp, Homo sapiens
aaatgttttaaggcttcaattta

SEQ ID NO: 547929 - DNA, 14 bp, Homo sapiens
aaatgttttgtaaa

SEQ ID NO: 547930 - DNA, 19 bp, Homo sapiens
aaatgttttgtaaactttg

SEQ ID NO: 547931 - DNA, 20 bp, Homo sapiens
aaatgttttgtaaactttga

SEQ ID NO: 547932 - DNA, 21 bp, Homo sapiens
aaatgttttgtaaactttgaa

SEQ ID NO: 547933 - DNA, 23 bp, Homo sapiens
aaatgttttgtaaactttgaaat

SEQ ID NO: 547934 - DNA, 14 bp, Homo sapiens
aaattaaaatttaa

SEQ ID NO: 547935 - DNA, 15 bp, Homo sapiens
aaattaatttgtgca

SEQ ID NO: 547936 - DNA, 23 bp, Homo sapiens
aaattaggaggctcaacaataaa

SEQ ID NO: 547937 - DNA, 19 bp, Homo sapiens
aaattagggctctaatttc

SEQ ID NO: 547938 - DNA, 20 bp, Homo sapiens
aaattagggctctaatttcc

SEQ ID NO: 547939 - DNA, 15 bp, Homo sapiens
aaattatcattgttt

SEQ ID NO: 547940 - DNA, 20 bp, Homo sapiens
aaattatcattgtttgtcct

SEQ ID NO: 547941 - DNA, 13 bp, Homo sapiens
aaattatctttaa

SEQ ID NO: 547942 - DNA, 22 bp, Homo sapiens
aaattcaattcatagaataaca

SEQ ID NO: 547943 - DNA, 16 bp, Homo sapiens
aaattcacaaagttaa

SEQ ID NO: 547944 - DNA, 17 bp, Homo sapiens
aaattcatttcacatta

SEQ ID NO: 547945 - DNA, 19 bp, Homo sapiens
aaattcatttcacattaat

SEQ ID NO: 547946 - DNA, 17 bp, Homo sapiens
aaattgaagagagatat

SEQ ID NO: 547947 - DNA, 13 bp, Homo sapiens
aaattgatgttga

SEQ ID NO: 547948 - DNA, 15 bp, Homo sapiens
acggggacacggcct

SEQ ID NO: 547949 - DNA, 19 bp, Homo sapiens
acgtattttgatcagtgtt

SEQ ID NO: 547950 - DNA, 22 bp, Homo sapiens
acgtcataggaagttagccttt

SEQ ID NO: 547951 - DNA, 12 bp, Homo sapiens
acgtccctccac

SEQ ID NO: 547952 - DNA, 18 bp, Homo sapiens
acgtctcaggttattcgt

SEQ ID NO: 547953 - DNA, 15 bp, Homo sapiens
acgtggggcagcaca

SEQ ID NO: 547954 - DNA, 13 bp, Homo sapiens
acgtgtatgtttt

SEQ ID NO: 547955 - DNA, 14 bp, Homo sapiens
acgttcacccctcc

SEQ ID NO: 547956 - DNA, 13 bp, Homo sapiens
actaaaaggaaac

SEQ ID NO: 547957 - DNA, 12 bp, Homo sapiens
actaaacatttc

SEQ ID NO: 547958 - DNA, 12 bp, Homo sapiens
actaaatgttaa

SEQ ID NO: 547959 - DNA, 19 bp, Homo sapiens
actaaatgttaaagatgta

SEQ ID NO: 547960 - DNA, 14 bp, Homo sapiens
actaacagtaactg

SEQ ID NO: 547961 - DNA, 14 bp, Homo sapiens
acttactatggtat

SEQ ID NO: 547962 - DNA, 21 bp, Homo sapiens
acttagctggagatgtctcta

SEQ ID NO: 547963 - DNA, 15 bp, Homo sapiens
acttagtgtctctat

SEQ ID NO: 547964 - DNA, 20 bp, Homo sapiens
acttatcagctacttaagag

SEQ ID NO: 547965 - DNA, 23 bp, Homo sapiens
acttatttataacattgtaaatg

SEQ ID NO: 547966 - DNA, 16 bp, Homo sapiens
acttcagggcagattt

SEQ ID NO: 547967 - DNA, 13 bp, Homo sapiens
acttccactttgt

SEQ ID NO: 547968 - DNA, 15 bp, Homo sapiens
acttccactttgtat

SEQ ID NO: 547969 - DNA, 22 bp, Homo sapiens
acttccactttgtataaatttt

SEQ ID NO: 547970 - DNA, 14 bp, Homo sapiens
acttccccttggga

SEQ ID NO: 547971 - DNA, 23 bp, Homo sapiens
acttccccttgggatgggcacag

SEQ ID NO: 547972 - DNA, 19 bp, Homo sapiens
acttcctgcctggtctcct

SEQ ID NO: 547973 - DNA, 14 bp, Homo sapiens
acttctaaaactgt

SEQ ID NO: 547974 - DNA, 14 bp, Homo sapiens
acttctgttttcaa

SEQ ID NO: 547975 - DNA, 15 bp, Homo sapiens
acttctgttttcaat

SEQ ID NO: 547976 - DNA, 22 bp, Homo sapiens
acttctgttttcaatctcgtat

SEQ ID NO: 547977 - DNA, 23 bp, Homo sapiens
acttctgttttcaatctcgtata

SEQ ID NO: 547978 - DNA, 11 bp, Homo sapiens
acttcttctgt

SEQ ID NO: 547979 - DNA, 20 bp, Homo sapiens
acttcttctgtccaagcaga

SEQ ID NO: 547980 - DNA, 19 bp, Homo sapiens
acttctttcccttcctcca

SEQ ID NO: 547981 - DNA, 17 bp, Homo sapiens
acttgaaattatatctg

SEQ ID NO: 547982 - DNA, 23 bp, Homo sapiens
acttgaaattatatctgtggtct

SEQ ID NO: 547983 - DNA, 23 bp, Homo sapiens
acttgatggtcagacacaaacaa

SEQ ID NO: 547984 - DNA, 14 bp, Homo sapiens
acttgatttttcaa

SEQ ID NO: 547985 - DNA, 12 bp, Homo sapiens
acttgctgtgaa

SEQ ID NO: 547986 - DNA, 18 bp, Homo sapiens
acttgctgtgaaatgact

SEQ ID NO: 547987 - DNA, 23 bp, Homo sapiens
acttggaatttgcttagccttta

SEQ ID NO: 547988 - DNA, 23 bp, Homo sapiens
acttggcaccaataaaggaggaa

SEQ ID NO: 547989 - DNA, 18 bp, Homo sapiens
acttgggagctttaaaga

SEQ ID NO: 547990 - DNA, 19 bp, Homo sapiens
acttgggagctttaaagag

SEQ ID NO: 547991 - DNA, 21 bp, Homo sapiens
agcacagcctcacccctgcag

SEQ ID NO: 547992 - DNA, 13 bp, Homo sapiens
agcacaggagaca

SEQ ID NO: 547993 - DNA, 13 bp, Homo sapiens
agcacctcttgaa

SEQ ID NO: 547994 - DNA, 16 bp, Homo sapiens
agcacttccttgccag

SEQ ID NO: 547995 - DNA, 15 bp, Homo sapiens
agcactttgggaggc

SEQ ID NO: 547996 - DNA, 16 bp, Homo sapiens
agcagaaaaacaggca

SEQ ID NO: 547997 - DNA, 13 bp, Homo sapiens
agcagaattggaa

SEQ ID NO: 547998 - DNA, 14 bp, Homo sapiens
agcagaattggaaa

SEQ ID NO: 547999 - DNA, 16 bp, Homo sapiens
agcagacacacacata

SEQ ID NO: 548000 - DNA, 19 bp, Homo sapiens
agcagagagcattataatc

SEQ ID NO: 548001 - DNA, 17 bp, Homo sapiens
agcagagtgaaattcaa

SEQ ID NO: 548002 - DNA, 15 bp, Homo sapiens
agcagcaaaaatata

SEQ ID NO: 548003 - DNA, 15 bp, Homo sapiens
agcagctagaaagag

SEQ ID NO: 548004 - DNA, 21 bp, Homo sapiens
agcagctgaagccagctccct

SEQ ID NO: 548005 - DNA, 15 bp, Homo sapiens
agcagcttcaccaga

SEQ ID NO: 548006 - DNA, 10 bp, Homo sapiens
agcaggcagc

SEQ ID NO: 548007 - DNA, 11 bp, Homo sapiens
agcaggcagcc

SEQ ID NO: 548008 - DNA, 13 bp, Homo sapiens
agcaggcagcctt

SEQ ID NO: 548009 - DNA, 18 bp, Homo sapiens
agcaggtgtgagggcagt

SEQ ID NO: 548010 - DNA, 21 bp, Homo sapiens
agcagtaaatgtatattgatg

SEQ ID NO: 548011 - DNA, 19 bp, Homo sapiens
agcagtcttatgcttccag

SEQ ID NO: 548012 - DNA, 18 bp, Homo sapiens
agcagtggcaaaatatta

SEQ ID NO: 548013 - DNA, 20 bp, Homo sapiens
agcagtggcaaaatattatg

SEQ ID NO: 548014 - DNA, 21 bp, Homo sapiens
agcagtggcaaaatattatgt

SEQ ID NO: 548015 - DNA, 13 bp, Homo sapiens
agcagtttcaata

SEQ ID NO: 548016 - DNA, 15 bp, Homo sapiens
agcagtttcaataaa

SEQ ID NO: 548017 - DNA, 17 bp, Homo sapiens
agcagtttgtgatctgt

SEQ ID NO: 548018 - DNA, 20 bp, Homo sapiens
agcagttttcttttaatttt

SEQ ID NO: 548019 - DNA, 14 bp, Homo sapiens
agcatacattttct

SEQ ID NO: 548020 - DNA, 15 bp, Homo sapiens
agcatacattttctg

SEQ ID NO: 548021 - DNA, 23 bp, Homo sapiens
agcatataaaatggcaacaaact

SEQ ID NO: 548022 - DNA, 11 bp, Homo sapiens
agcatatataa

SEQ ID NO: 548023 - DNA, 13 bp, Homo sapiens
agcatatatataa

SEQ ID NO: 548024 - DNA, 15 bp, Homo sapiens
agcatccgtgtattt

SEQ ID NO: 548025 - DNA, 23 bp, Homo sapiens
agcatccgtgtatttggctgggc

SEQ ID NO: 548026 - DNA, 14 bp, Homo sapiens
agcattacaggcaa

SEQ ID NO: 548027 - DNA, 21 bp, Homo sapiens
agcattggcctggccagacca

SEQ ID NO: 548028 - DNA, 17 bp, Homo sapiens
agcatttatggtaatca

SEQ ID NO: 548029 - DNA, 14 bp, Homo sapiens
agcatttccaacac

SEQ ID NO: 548030 - DNA, 18 bp, Homo sapiens
agcatttccaacaccaca

SEQ ID NO: 548031 - DNA, 19 bp, Homo sapiens
agcatttccaacaccacag

SEQ ID NO: 548032 - DNA, 21 bp, Homo sapiens
agcatttccaacaccacagac

SEQ ID NO: 548033 - DNA, 16 bp, Homo sapiens
agcatttgactttctg

SEQ ID NO: 548034 - DNA, 14 bp, Homo sapiens
agccacccaaagca

SEQ ID NO: 548035 - DNA, 15 bp, Homo sapiens
agccacccaaagcag

SEQ ID NO: 548036 - DNA, 19 bp, Homo sapiens
agccacttatttccatgga

SEQ ID NO: 548037 - DNA, 22 bp, Homo sapiens
agccagaagccacccaaagcag

SEQ ID NO: 548038 - DNA, 19 bp, Homo sapiens
agccaggcgctagcacagc

SEQ ID NO: 548039 - DNA, 23 bp, Homo sapiens
agccaggcgctagcacagctccc

SEQ ID NO: 548040 - DNA, 12 bp, Homo sapiens
agccagtcttaa

SEQ ID NO: 548041 - DNA, 21 bp, Homo sapiens
agcccagaagctcaaggctgc

SEQ ID NO: 548042 - DNA, 22 bp, Homo sapiens
agcccagcctatctctcttctg

SEQ ID NO: 548043 - DNA, 20 bp, Homo sapiens
agcccaggagggagcagagg

SEQ ID NO: 548044 - DNA, 20 bp, Homo sapiens
agcccaggagtcccactcca

SEQ ID NO: 548045 - DNA, 19 bp, Homo sapiens
agcccaggcatctccttgg

SEQ ID NO: 548046 - DNA, 21 bp, Homo sapiens
agccccaaattgtcacctgct

SEQ ID NO: 548047 - DNA, 22 bp, Homo sapiens
agccccaacccaaacctggaga

SEQ ID NO: 548048 - DNA, 21 bp, Homo sapiens
agccccagacaacagcccagg

SEQ ID NO: 548049 - DNA, 15 bp, Homo sapiens
agccccagcgagtct

SEQ ID NO: 548050 - DNA, 14 bp, Homo sapiens
agccccctcttccc

SEQ ID NO: 548051 - DNA, 15 bp, Homo sapiens
agccccctcttccct

SEQ ID NO: 548052 - DNA, 14 bp, Homo sapiens
agccccctcttcct

SEQ ID NO: 548053 - DNA, 15 bp, Homo sapiens
agccccctcttcctc

SEQ ID NO: 548054 - DNA, 12 bp, Homo sapiens
agccccctggcc

SEQ ID NO: 548055 - DNA, 15 bp, Homo sapiens
agccccctggcccct

SEQ ID NO: 548056 - DNA, 13 bp, Homo sapiens
agcccctgctgct

SEQ ID NO: 548057 - DNA, 16 bp, Homo sapiens
agcccctgctgctcct

SEQ ID NO: 548058 - DNA, 21 bp, Homo sapiens
agccctgattgcgcaaaactg

SEQ ID NO: 548059 - DNA, 16 bp, Homo sapiens
agcccttcctctgctc

SEQ ID NO: 548060 - DNA, 18 bp, Homo sapiens
agcccttcctctgctccc

SEQ ID NO: 548061 - DNA, 20 bp, Homo sapiens
agcccttcctctgctccccc

SEQ ID NO: 548062 - DNA, 21 bp, Homo sapiens
agcccttcctctgctccccct

SEQ ID NO: 548063 - DNA, 15 bp, Homo sapiens
agccgagctctcctg

SEQ ID NO: 548064 - DNA, 13 bp, Homo sapiens
agccgctccagag

SEQ ID NO: 548065 - DNA, 14 bp, Homo sapiens
agcctcacccctgc

SEQ ID NO: 548066 - DNA, 12 bp, Homo sapiens
agcctcctgctg

SEQ ID NO: 548067 - DNA, 14 bp, Homo sapiens
agcctcctgctgag

SEQ ID NO: 548068 - DNA, 20 bp, Homo sapiens
agcctctggaagggagggct

SEQ ID NO: 548069 - DNA, 18 bp, Homo sapiens
agcctgacagccagaact

SEQ ID NO: 548070 - DNA, 19 bp, Homo sapiens
agcctgacagccagaactc

SEQ ID NO: 548071 - DNA, 18 bp, Homo sapiens
agcctgcagggtgacctg

SEQ ID NO: 548072 - DNA, 19 bp, Homo sapiens
agcctgccccagcgctgac

SEQ ID NO: 548073 - DNA, 15 bp, Homo sapiens
agcctgcgtggcctg

SEQ ID NO: 548074 - DNA, 21 bp, Homo sapiens
agcctgcgtggcctggggctg

SEQ ID NO: 548075 - DNA, 20 bp, Homo sapiens
agcctgggataggggcagag

SEQ ID NO: 548076 - DNA, 22 bp, Homo sapiens
agcctgggataggggcagagga

SEQ ID NO: 548077 - DNA, 18 bp, Homo sapiens
acttggggcacagggaga

SEQ ID NO: 548078 - DNA, 14 bp, Homo sapiens
acttgtataaatgt

SEQ ID NO: 548079 - DNA, 15 bp, Homo sapiens
acttgtataaatgta

SEQ ID NO: 548080 - DNA, 12 bp, Homo sapiens
acttgtcttaaa

SEQ ID NO: 548081 - DNA, 23 bp, Homo sapiens
acttgtcttaaataaaagaaatg

SEQ ID NO: 548082 - DNA, 16 bp, Homo sapiens
acttgtctttctgggg

SEQ ID NO: 548083 - DNA, 23 bp, Homo sapiens
acttgtctttctggggtttttct

SEQ ID NO: 548084 - DNA, 19 bp, Homo sapiens
acttgttatgttgtaatat

SEQ ID NO: 548085 - DNA, 19 bp, Homo sapiens
acttgttcttccaaagcag

SEQ ID NO: 548086 - DNA, 14 bp, Homo sapiens
acttgttgcagact

SEQ ID NO: 548087 - DNA, 13 bp, Homo sapiens
actttaaattgtg

SEQ ID NO: 548088 - DNA, 18 bp, Homo sapiens
actttaaattgtggatga

SEQ ID NO: 548089 - DNA, 20 bp, Homo sapiens
actttaacttccactttgta

SEQ ID NO: 548090 - DNA, 12 bp, Homo sapiens
actttaagagag

SEQ ID NO: 548091 - DNA, 15 bp, Homo sapiens
actttaagagagaaa

SEQ ID NO: 548092 - DNA, 13 bp, Homo sapiens
actttaatatgta

SEQ ID NO: 548093 - DNA, 16 bp, Homo sapiens
actttaatatgtattt

SEQ ID NO: 548094 - DNA, 22 bp, Homo sapiens
actttaatatgtattttatgta

SEQ ID NO: 548095 - DNA, 17 bp, Homo sapiens
actttatagaagaatgc

SEQ ID NO: 548096 - DNA, 19 bp, Homo sapiens
actttcaagaacttgttta

SEQ ID NO: 548097 - DNA, 19 bp, Homo sapiens
actttccaattctccttta

SEQ ID NO: 548098 - DNA, 16 bp, Homo sapiens
actttcccacactgtg

SEQ ID NO: 548099 - DNA, 12 bp, Homo sapiens
actttctcagca

SEQ ID NO: 548100 - DNA, 20 bp, Homo sapiens
actttctcagcatatatata

SEQ ID NO: 548101 - DNA, 19 bp, Homo sapiens
actttctgaaattcacaaa

SEQ ID NO: 548102 - DNA, 13 bp, Homo sapiens
actttctgtacta

SEQ ID NO: 548103 - DNA, 21 bp, Homo sapiens
actttcttttcgccgtggctg

SEQ ID NO: 548104 - DNA, 10 bp, Homo sapiens
actttgaaat

SEQ ID NO: 548105 - DNA, 17 bp, Homo sapiens
actttgattcacatgtt

SEQ ID NO: 548106 - DNA, 19 bp, Homo sapiens
actttgattcacatgtttt

SEQ ID NO: 548107 - DNA, 14 bp, Homo sapiens
actttgggaggctg

SEQ ID NO: 548108 - DNA, 15 bp, Homo sapiens
actttgtataaattt

SEQ ID NO: 548109 - DNA, 19 bp, Homo sapiens
actttgtataaatttttaa

SEQ ID NO: 548110 - DNA, 16 bp, Homo sapiens
actttgtctaagaaac

SEQ ID NO: 548111 - DNA, 13 bp, Homo sapiens
actttgttaattt

SEQ ID NO: 548112 - DNA, 15 bp, Homo sapiens
acttttaataaagta

SEQ ID NO: 548113 - DNA, 23 bp, Homo sapiens
acttttaataaagtatgaatatt

SEQ ID NO: 548114 - DNA, 22 bp, Homo sapiens
acttttattgtataattatgaa

SEQ ID NO: 548115 - DNA, 15 bp, Homo sapiens
acttttcaaaataaa

SEQ ID NO: 548116 - DNA, 22 bp, Homo sapiens
acttttcaaaataaagcttttg

SEQ ID NO: 548117 - DNA, 14 bp, Homo sapiens
acttttccagtatt

SEQ ID NO: 548118 - DNA, 15 bp, Homo sapiens
acttttccagtattt

SEQ ID NO: 548119 - DNA, 15 bp, Homo sapiens
acttttccttgcata

SEQ ID NO: 548120 - DNA, 23 bp, Homo sapiens
acttttctaaactaggctccttc

SEQ ID NO: 548121 - DNA, 21 bp, Homo sapiens
acttttgtagtcttatgaata

SEQ ID NO: 548122 - DNA, 16 bp, Homo sapiens
agaaaaaaaagtgtct

SEQ ID NO: 548123 - DNA, 22 bp, Homo sapiens
agaaaaaaggttctttgtgtat

SEQ ID NO: 548124 - DNA, 15 bp, Homo sapiens
agaaaaaataaatgg

SEQ ID NO: 548125 - DNA, 16 bp, Homo sapiens
agaaaaaataaatgga

SEQ ID NO: 548126 - DNA, 13 bp, Homo sapiens
agaaaaagccctc

SEQ ID NO: 548127 - DNA, 23 bp, Homo sapiens
agaaaaatgcttgaccctgaaat

SEQ ID NO: 548128 - DNA, 23 bp, Homo sapiens
agaaaacttcagagaaattatgt

SEQ ID NO: 548129 - DNA, 14 bp, Homo sapiens
agaaaactttgtta

SEQ ID NO: 548130 - DNA, 20 bp, Homo sapiens
agaaaactttgttaggccaa

SEQ ID NO: 548131 - DNA, 20 bp, Homo sapiens
agaaaagaacgtattttaaa

SEQ ID NO: 548132 - DNA, 13 bp, Homo sapiens
agaaaagcacctc

SEQ ID NO: 548133 - DNA, 22 bp, Homo sapiens
agaaaatgcagccttaaacagt

SEQ ID NO: 548134 - DNA, 14 bp, Homo sapiens
agaaacagatacca

SEQ ID NO: 548135 - DNA, 15 bp, Homo sapiens
agaaacagtttaaca

SEQ ID NO: 548136 - DNA, 16 bp, Homo sapiens
agaaacagtttaacag

SEQ ID NO: 548137 - DNA, 14 bp, Homo sapiens
agaaacattggaag

SEQ ID NO: 548138 - DNA, 16 bp, Homo sapiens
agaaacattggaagca

SEQ ID NO: 548139 - DNA, 18 bp, Homo sapiens
agaaacccggcttcctgt

SEQ ID NO: 548140 - DNA, 23 bp, Homo sapiens
agaaactgtctagcacttccttg

SEQ ID NO: 548141 - DNA, 13 bp, Homo sapiens
agaaacttgttct

SEQ ID NO: 548142 - DNA, 16 bp, Homo sapiens
agaaagaactatcttc

SEQ ID NO: 548143 - DNA, 13 bp, Homo sapiens
agaaagacattct

SEQ ID NO: 548144 - DNA, 14 bp, Homo sapiens
agaaagcaacttat

SEQ ID NO: 548145 - DNA, 16 bp, Homo sapiens
agaaagtgttctgtta

SEQ ID NO: 548146 - DNA, 19 bp, Homo sapiens
agaaagtgttctgttacaa

SEQ ID NO: 548147 - DNA, 16 bp, Homo sapiens
agaaatataaaaataa

SEQ ID NO: 548148 - DNA, 18 bp, Homo sapiens
agaaatatatatacatat

SEQ ID NO: 548149 - DNA, 20 bp, Homo sapiens
agaaatatatatacatatgt

SEQ ID NO: 548150 - DNA, 13 bp, Homo sapiens
agaaatctgaaaa

SEQ ID NO: 548151 - DNA, 12 bp, Homo sapiens
agaaatgctttg

SEQ ID NO: 548152 - DNA, 21 bp, Homo sapiens
agaaattccatacttctctca

SEQ ID NO: 548153 - DNA, 19 bp, Homo sapiens
agaaattcgccccattttc

SEQ ID NO: 548154 - DNA, 23 bp, Homo sapiens
agaaattcgccccattttcttta

SEQ ID NO: 548155 - DNA, 13 bp, Homo sapiens
agaacaattgtcc

SEQ ID NO: 548156 - DNA, 21 bp, Homo sapiens
agaaccgagcaaagatcaaaa

SEQ ID NO: 548157 - DNA, 17 bp, Homo sapiens
agaacctactgttcctt

SEQ ID NO: 548158 - DNA, 17 bp, Homo sapiens
agaactaataaatggac

SEQ ID NO: 548159 - DNA, 15 bp, Homo sapiens
agaactcatgtgatt

SEQ ID NO: 548160 - DNA, 13 bp, Homo sapiens
agaactctgcctg

SEQ ID NO: 548161 - DNA, 22 bp, Homo sapiens
agaactcttcctccaaggacag

SEQ ID NO: 548162 - DNA, 17 bp, Homo sapiens
agaacttgaagcctgct

SEQ ID NO: 548163 - DNA, 17 bp, Homo sapiens
agaacttgtttaataaa

SEQ ID NO: 548164 - DNA, 13 bp, Homo sapiens
agaagaaagaact

SEQ ID NO: 548165 - DNA, 22 bp, Homo sapiens
agaagaatgcatgctttccata

SEQ ID NO: 548166 - DNA, 18 bp, Homo sapiens
agaagaatggctttcaat

SEQ ID NO: 548167 - DNA, 19 bp, Homo sapiens
agaagaatggctttcaata

SEQ ID NO: 548168 - DNA, 12 bp, Homo sapiens
agaagacacaga

SEQ ID NO: 548169 - DNA, 20 bp, Homo sapiens
agaagagatgcactatatgt

SEQ ID NO: 548170 - DNA, 14 bp, Homo sapiens
agaagatagttgta

SEQ ID NO: 548171 - DNA, 16 bp, Homo sapiens
agaagatagttgtaaa

SEQ ID NO: 548172 - DNA, 16 bp, Homo sapiens
agaagatgaatggtct

SEQ ID NO: 548173 - DNA, 22 bp, Homo sapiens
agaagcagcagctagaaagaga

SEQ ID NO: 548174 - DNA, 17 bp, Homo sapiens
agaaggcaaactgaggc

SEQ ID NO: 548175 - DNA, 13 bp, Homo sapiens
agaagtccagagt

SEQ ID NO: 548176 - DNA, 21 bp, Homo sapiens
agaagtgaaaaagacttcaaa

SEQ ID NO: 548177 - DNA, 15 bp, Homo sapiens
agaataaaattccta

SEQ ID NO: 548178 - DNA, 19 bp, Homo sapiens
agaataacaactgctggga

SEQ ID NO: 548179 - DNA, 18 bp, Homo sapiens
agaatattcagagaatat

SEQ ID NO: 548180 - DNA, 20 bp, Homo sapiens
agaatcatcctcatgccttt

SEQ ID NO: 548181 - DNA, 12 bp, Homo sapiens
agggagaccctg

SEQ ID NO: 548182 - DNA, 13 bp, Homo sapiens
agggagaccctgg

SEQ ID NO: 548183 - DNA, 12 bp, Homo sapiens
agggagaggccg

SEQ ID NO: 548184 - DNA, 21 bp, Homo sapiens
agggagcacaacccccagctc

SEQ ID NO: 548185 - DNA, 23 bp, Homo sapiens
agggagcacaacccccagctccc

SEQ ID NO: 548186 - DNA, 16 bp, Homo sapiens
agggagctggctccag

SEQ ID NO: 548187 - DNA, 20 bp, Homo sapiens
agggagctggctccagcctg

SEQ ID NO: 548188 - DNA, 22 bp, Homo sapiens
agggagctggctccagcctgga

SEQ ID NO: 548189 - DNA, 21 bp, Homo sapiens
agggaggctctgtgtgttaaa

SEQ ID NO: 548190 - DNA, 22 bp, Homo sapiens
agggaggctctgtgtgttaaaa

SEQ ID NO: 548191 - DNA, 19 bp, Homo sapiens
agggaggtgtgaggcagga

SEQ ID NO: 548192 - DNA, 22 bp, Homo sapiens
agggatgctatctcgctagcca

SEQ ID NO: 548193 - DNA, 17 bp, Homo sapiens
agggcaggcagagctca

SEQ ID NO: 548194 - DNA, 13 bp, Homo sapiens
agggcatgaaatg

SEQ ID NO: 548195 - DNA, 19 bp, Homo sapiens
agggccaaaagcttccctc

SEQ ID NO: 548196 - DNA, 21 bp, Homo sapiens
agggccaaaagcttccctccc

SEQ ID NO: 548197 - DNA, 17 bp, Homo sapiens
agggccagaagtagctt

SEQ ID NO: 548198 - DNA, 17 bp, Homo sapiens
agggccagggctctggc

SEQ ID NO: 548199 - DNA, 20 bp, Homo sapiens
agggcccttcccaacctccc

SEQ ID NO: 548200 - DNA, 14 bp, Homo sapiens
agggctcaacactg

SEQ ID NO: 548201 - DNA, 15 bp, Homo sapiens
agggctctggcaggt

SEQ ID NO: 548202 - DNA, 14 bp, Homo sapiens
agggctgcagagcc

SEQ ID NO: 548203 - DNA, 18 bp, Homo sapiens
agggctggggcagcctct

SEQ ID NO: 548204 - DNA, 20 bp, Homo sapiens
aggggagagagcagagaagt

SEQ ID NO: 548205 - DNA, 16 bp, Homo sapiens
aggggagccaggaggg

SEQ ID NO: 548206 - DNA, 16 bp, Homo sapiens
aggggagctctgtctg

SEQ ID NO: 548207 - DNA, 17 bp, Homo sapiens
aggggagctctgtctgt

SEQ ID NO: 548208 - DNA, 17 bp, Homo sapiens
aggggcacacttcccct

SEQ ID NO: 548209 - DNA, 22 bp, Homo sapiens
aggggcacacttccccttggga

SEQ ID NO: 548210 - DNA, 15 bp, Homo sapiens
aggggcggggccagg

SEQ ID NO: 548211 - DNA, 15 bp, Homo sapiens
aggggctagcactgg

SEQ ID NO: 548212 - DNA, 18 bp, Homo sapiens
aggggctccatgccagcc

SEQ ID NO: 548213 - DNA, 15 bp, Homo sapiens
agggggccacctccc

SEQ ID NO: 548214 - DNA, 15 bp, Homo sapiens
agggggccaggtgca

SEQ ID NO: 548215 - DNA, 20 bp, Homo sapiens
aggggtcccctccaggagta

SEQ ID NO: 548216 - DNA, 21 bp, Homo sapiens
aggggtggaggagagcctggt

SEQ ID NO: 548217 - DNA, 17 bp, Homo sapiens
aggggtggtacttggca

SEQ ID NO: 548218 - DNA, 18 bp, Homo sapiens
aggggtggtacttggcac

SEQ ID NO: 548219 - DNA, 23 bp, Homo sapiens
aggggtggtacttggcaccaata

SEQ ID NO: 548220 - DNA, 19 bp, Homo sapiens
agggtctcgtcaggaggtg

SEQ ID NO: 548221 - DNA, 16 bp, Homo sapiens
agggtgggcaaactct

SEQ ID NO: 548222 - DNA, 21 bp, Homo sapiens
agggtgtctgccccctcctga

SEQ ID NO: 548223 - DNA, 19 bp, Homo sapiens
agggttgtgattttgtctg

SEQ ID NO: 548224 - DNA, 17 bp, Homo sapiens
aggtagaacgccaggga

SEQ ID NO: 548225 - DNA, 17 bp, Homo sapiens
aggtagaatgaccttgt

SEQ ID NO: 548226 - DNA, 18 bp, Homo sapiens
aggtagaatgaccttgta

SEQ ID NO: 548227 - DNA, 21 bp, Homo sapiens
aggtagaatgaccttgtaatg

SEQ ID NO: 548228 - DNA, 19 bp, Homo sapiens
agtcctggtttcctcagcc

SEQ ID NO: 548229 - DNA, 20 bp, Homo sapiens
agtcctggtttcctcagcct

SEQ ID NO: 548230 - DNA, 21 bp, Homo sapiens
agtcgcctttcagcaggcagc

SEQ ID NO: 548231 - DNA, 23 bp, Homo sapiens
agtctagcgtagtgcagcagggc

SEQ ID NO: 548232 - DNA, 15 bp, Homo sapiens
agtctcattcctctg

SEQ ID NO: 548233 - DNA, 14 bp, Homo sapiens
agtctctttcttcc

SEQ ID NO: 548234 - DNA, 18 bp, Homo sapiens
agtctctttcttcctttc

SEQ ID NO: 548235 - DNA, 19 bp, Homo sapiens
agtctcttttttacaaagg

SEQ ID NO: 548236 - DNA, 21 bp, Homo sapiens
agtctcttttttacaaaggct

SEQ ID NO: 548237 - DNA, 14 bp, Homo sapiens
agtctggagaccag

SEQ ID NO: 548238 - DNA, 11 bp, Homo sapiens
agtctggataa

SEQ ID NO: 548239 - DNA, 15 bp, Homo sapiens
agtcttactgttttg

SEQ ID NO: 548240 - DNA, 22 bp, Homo sapiens
agtcttatgaatagacataaat

SEQ ID NO: 548241 - DNA, 17 bp, Homo sapiens
agtcttatgcttccaga

SEQ ID NO: 548242 - DNA, 18 bp, Homo sapiens
agtcttatgcttccagaa

SEQ ID NO: 548243 - DNA, 14 bp, Homo sapiens
agtcttcatgaaat

SEQ ID NO: 548244 - DNA, 17 bp, Homo sapiens
agtcttcatgaaatgct

SEQ ID NO: 548245 - DNA, 13 bp, Homo sapiens
agtctttcccaat

SEQ ID NO: 548246 - DNA, 18 bp, Homo sapiens
agtcttttaaaaagtatt

SEQ ID NO: 548247 - DNA, 19 bp, Homo sapiens
agtcttttaaaaagtattg

SEQ ID NO: 548248 - DNA, 21 bp, Homo sapiens
agtcttttgcatgtcgcacaa

SEQ ID NO: 548249 - DNA, 23 bp, Homo sapiens
agtcttttgcatgtcgcacaatg

SEQ ID NO: 548250 - DNA, 13 bp, Homo sapiens
agtgaaatttatt

SEQ ID NO: 548251 - DNA, 16 bp, Homo sapiens
agtgaagactccagaa

SEQ ID NO: 548252 - DNA, 13 bp, Homo sapiens
agtgaagagtgaa

SEQ ID NO: 548253 - DNA, 21 bp, Homo sapiens
agtgacatcggttcaggagga

SEQ ID NO: 548254 - DNA, 18 bp, Homo sapiens
agtgactccaagaacaat

SEQ ID NO: 548255 - DNA, 12 bp, Homo sapiens
agtgagagcaga

SEQ ID NO: 548256 - DNA, 18 bp, Homo sapiens
agtgaggtcctgggggcc

SEQ ID NO: 548257 - DNA, 15 bp, Homo sapiens
agtgatattctttgt

SEQ ID NO: 548258 - DNA, 18 bp, Homo sapiens
agtgatattctttgttaa

SEQ ID NO: 548259 - DNA, 20 bp, Homo sapiens
agtgatgcctggggaaggag

SEQ ID NO: 548260 - DNA, 23 bp, Homo sapiens
agtgatgtggtgggagcacagct

SEQ ID NO: 548261 - DNA, 17 bp, Homo sapiens
agtgatgtttttatgat

SEQ ID NO: 548262 - DNA, 13 bp, Homo sapiens
agtgatttgtaaa

SEQ ID NO: 548263 - DNA, 21 bp, Homo sapiens
agtgatttgtaaaacagtggt

SEQ ID NO: 548264 - DNA, 16 bp, Homo sapiens
agtgcaatatattttg

SEQ ID NO: 548265 - DNA, 17 bp, Homo sapiens
agtgcacacagaaatat

SEQ ID NO: 548266 - DNA, 20 bp, Homo sapiens
agtgcacctgggacagggag

SEQ ID NO: 548267 - DNA, 16 bp, Homo sapiens
agtgcagcagggcagt

SEQ ID NO: 548268 - DNA, 23 bp, Homo sapiens
agtgcattcattcatcctcttat

SEQ ID NO: 548269 - DNA, 13 bp, Homo sapiens
agtgccaaaataa

SEQ ID NO: 548270 - DNA, 17 bp, Homo sapiens
agtgccaaaataaagtc

SEQ ID NO: 548271 - DNA, 13 bp, Homo sapiens
agtgctatatata

SEQ ID NO: 548272 - DNA, 14 bp, Homo sapiens
agtgctatatatat

SEQ ID NO: 548273 - DNA, 15 bp, Homo sapiens
agtgctatatatata

SEQ ID NO: 548274 - DNA, 19 bp, Homo sapiens
agtgctatatatataaata

SEQ ID NO: 548275 - DNA, 19 bp, Homo sapiens
agtgctcacacaatcagac

SEQ ID NO: 548276 - DNA, 16 bp, Homo sapiens
agtgctgctcccttta

SEQ ID NO: 548277 - DNA, 14 bp, Homo sapiens
agtggacccagctg

SEQ ID NO: 548278 - DNA, 17 bp, Homo sapiens
agtggaccctgaaatgt

SEQ ID NO: 548279 - DNA, 19 bp, Homo sapiens
agtggagcctgacagccag

SEQ ID NO: 548280 - DNA, 20 bp, Homo sapiens
agtggatggaatatcagaag

SEQ ID NO: 548281 - DNA, 15 bp, Homo sapiens
agtggcaaaatatta

SEQ ID NO: 548282 - DNA, 19 bp, Homo sapiens
agtggcaaaatattatgtt

SEQ ID NO: 548283 - DNA, 21 bp, Homo sapiens
agtggcaaaatattatgttat

SEQ ID NO: 548284 - DNA, 16 bp, Homo sapiens
agtggcacctgtctgc

SEQ ID NO: 548285 - DNA, 15 bp, Homo sapiens
agtggcccaacaggg

SEQ ID NO: 548286 - DNA, 21 bp, Homo sapiens
agtggcccaacaggggctcca

SEQ ID NO: 548287 - DNA, 19 bp, Homo sapiens
agtggcttactacatgtgg

SEQ ID NO: 548288 - DNA, 16 bp, Homo sapiens
agtggggaggagactc

SEQ ID NO: 548289 - DNA, 16 bp, Homo sapiens
agtgggtgggacacag

SEQ ID NO: 548290 - DNA, 19 bp, Homo sapiens
agtgggtgggacacagaga

SEQ ID NO: 548291 - DNA, 20 bp, Homo sapiens
agtggtagagtcctaggaca

SEQ ID NO: 548292 - DNA, 15 bp, Homo sapiens
agtggtccacattct

SEQ ID NO: 548293 - DNA, 19 bp, Homo sapiens
agtggtccacattctgctg

SEQ ID NO: 548294 - DNA, 21 bp, Homo sapiens
agtggtccacattctgctgcc

SEQ ID NO: 548295 - DNA, 19 bp, Homo sapiens
agtgtaccattaaaatatg

SEQ ID NO: 548296 - DNA, 16 bp, Homo sapiens
agtgtactctgagtcc

SEQ ID NO: 548297 - DNA, 15 bp, Homo sapiens
agtgtatatgtgatt

SEQ ID NO: 548298 - DNA, 21 bp, Homo sapiens
agtgtatatgtgattttcaaa

SEQ ID NO: 548299 - DNA, 16 bp, Homo sapiens
agtgtgcttacctgtt

SEQ ID NO: 548300 - DNA, 19 bp, Homo sapiens
agtgtggagctgcttccag

SEQ ID NO: 548301 - DNA, 14 bp, Homo sapiens
agtgttctgtggct

SEQ ID NO: 548302 - DNA, 15 bp, Homo sapiens
agtgttctgttacaa

SEQ ID NO: 548303 - DNA, 17 bp, Homo sapiens
agtgttctgttacaaaa

SEQ ID NO: 548304 - DNA, 20 bp, Homo sapiens
agtgttctgttacaaaatgt

SEQ ID NO: 548305 - DNA, 22 bp, Homo sapiens
agtgttctgttacaaaatgtaa

SEQ ID NO: 548306 - DNA, 22 bp, Homo sapiens
agtgttggggtttggttttgtt

SEQ ID NO: 548307 - DNA, 16 bp, Homo sapiens
agttaagaagccctgc

SEQ ID NO: 548308 - DNA, 15 bp, Homo sapiens
agttaataacagctc

SEQ ID NO: 548309 - DNA, 18 bp, Homo sapiens
agttacagtggcagtatt

SEQ ID NO: 548310 - DNA, 23 bp, Homo sapiens
agttaccactggtgtatgaaatg

SEQ ID NO: 548311 - DNA, 16 bp, Homo sapiens
agttagcctttatcta

SEQ ID NO: 548312 - DNA, 23 bp, Homo sapiens
agttagcctttatctaccaactt

SEQ ID NO: 548313 - DNA, 14 bp, Homo sapiens
agttatatttccta

SEQ ID NO: 548314 - DNA, 10 bp, Homo sapiens
agttatctta

SEQ ID NO: 548315 - DNA, 23 bp, Homo sapiens
agttattgtccctggcttcctta

SEQ ID NO: 548316 - DNA, 17 bp, Homo sapiens
agttattttgtgtcctt

SEQ ID NO: 548317 - DNA, 19 bp, Homo sapiens
agttcaagaccagcctggc

SEQ ID NO: 548318 - DNA, 16 bp, Homo sapiens
agttcatcccttctct

SEQ ID NO: 548319 - DNA, 16 bp, Homo sapiens
agttcattcagggccg

SEQ ID NO: 548320 - DNA, 17 bp, Homo sapiens
agttcattcatattaca

SEQ ID NO: 548321 - DNA, 23 bp, Homo sapiens
agttcattcatattacaatattt

SEQ ID NO: 548322 - DNA, 19 bp, Homo sapiens
agttcccttgattcaaata

SEQ ID NO: 548323 - DNA, 23 bp, Homo sapiens
agttctatcagttatcctttgtg

SEQ ID NO: 548324 - DNA, 17 bp, Homo sapiens
agttgaagtcatgctcc

SEQ ID NO: 548325 - DNA, 17 bp, Homo sapiens
agttgcacactcactgg

SEQ ID NO: 548326 - DNA, 14 bp, Homo sapiens
agttgcccagcctc

SEQ ID NO: 548327 - DNA, 18 bp, Homo sapiens
agttgccgtggcaactgt

SEQ ID NO: 548328 - DNA, 13 bp, Homo sapiens
agttggaaacact

SEQ ID NO: 548329 - DNA, 20 bp, Homo sapiens
agttggaaacactaaatgtt

SEQ ID NO: 548330 - DNA, 19 bp, Homo sapiens
agttggactgtggcctcag

SEQ ID NO: 548331 - DNA, 19 bp, Homo sapiens
agttggttacctattgctg

SEQ ID NO: 548332 - DNA, 19 bp, Homo sapiens
agttgtaaacgtcttttta

SEQ ID NO: 548333 - DNA, 22 bp, Homo sapiens
agttgtaaagatattgtatctc

SEQ ID NO: 548334 - DNA, 15 bp, Homo sapiens
agttgtatgatctgt

SEQ ID NO: 548335 - DNA, 14 bp, Homo sapiens
agtttcaaaaatct

SEQ ID NO: 548336 - DNA, 18 bp, Homo sapiens
agtttcaaaaatctgaag

SEQ ID NO: 548337 - DNA, 21 bp, Homo sapiens
agtttcaaaaatctgaagatt

SEQ ID NO: 548338 - DNA, 23 bp, Homo sapiens
agtttcaaaaatctgaagattgt

SEQ ID NO: 548339 - DNA, 18 bp, Homo sapiens
agtttcaataaagtttga

SEQ ID NO: 548340 - DNA, 22 bp, Homo sapiens
agtttgtttctttgaattttca

SEQ ID NO: 548341 - DNA, 17 bp, Homo sapiens
agttttcttttaatttt

SEQ ID NO: 548342 - DNA, 23 bp, Homo sapiens
agttttgcttttagtttttctgt

SEQ ID NO: 548343 - DNA, 16 bp, Homo sapiens
agttttgtgaaatttt

SEQ ID NO: 548344 - DNA, 18 bp, Homo sapiens
agttttgtgaaatttttc

SEQ ID NO: 548345 - DNA, 11 bp, Homo sapiens
agtttttctgt

SEQ ID NO: 548346 - DNA, 13 bp, Homo sapiens
agtttttctgtcc

SEQ ID NO: 548347 - DNA, 18 bp, Homo sapiens
agtttttgttcttaaaaa

SEQ ID NO: 548348 - DNA, 15 bp, Homo sapiens
ataaaaaaaatgaaa

SEQ ID NO: 548349 - DNA, 20 bp, Homo sapiens
ataaaaactactgaataaat

SEQ ID NO: 548350 - DNA, 16 bp, Homo sapiens
ataaaaataattaaaa

SEQ ID NO: 548351 - DNA, 23 bp, Homo sapiens
ataaaaatatatatagtgctata

SEQ ID NO: 548352 - DNA, 21 bp, Homo sapiens
ataaaagaaatgcacaatgtc

SEQ ID NO: 548353 - DNA, 23 bp, Homo sapiens
ataaaagttaataacagctcctt

SEQ ID NO: 548354 - DNA, 11 bp, Homo sapiens
ataaaatacac

SEQ ID NO: 548355 - DNA, 19 bp, Homo sapiens
ataaaatacacgtgtatat

SEQ ID NO: 548356 - DNA, 20 bp, Homo sapiens
ataaaatacacgtgtatatg

SEQ ID NO: 548357 - DNA, 18 bp, Homo sapiens
ataaaatagttgtccata

SEQ ID NO: 548358 - DNA, 19 bp, Homo sapiens
ataaaattaaaatttaaca

SEQ ID NO: 548359 - DNA, 23 bp, Homo sapiens
ataaaattaaaatttaacatctg

SEQ ID NO: 548360 - DNA, 15 bp, Homo sapiens
ataaaattcctatct

SEQ ID NO: 548361 - DNA, 16 bp, Homo sapiens
ataaaattcctatctc

SEQ ID NO: 548362 - DNA, 17 bp, Homo sapiens
ataaaattcctatctca

SEQ ID NO: 548363 - DNA, 19 bp, Homo sapiens
ataaacatcaggttaggca

SEQ ID NO: 548364 - DNA, 22 bp, Homo sapiens
ataaacatcaggttaggcagta

SEQ ID NO: 548365 - DNA, 17 bp, Homo sapiens
ataaacattaaatgtct

SEQ ID NO: 548366 - DNA, 21 bp, Homo sapiens
ataaaccaaaggacattatgt

SEQ ID NO: 548367 - DNA, 17 bp, Homo sapiens
ataaactcattttgctt

SEQ ID NO: 548368 - DNA, 15 bp, Homo sapiens
ataaagcatctaaac

SEQ ID NO: 548369 - DNA, 17 bp, Homo sapiens
ataagcacagacaattc

SEQ ID NO: 548370 - DNA, 20 bp, Homo sapiens
ataagcacagacaattctaa

SEQ ID NO: 548371 - DNA, 23 bp, Homo sapiens
ataagcacagacaattctaatgg

SEQ ID NO: 548372 - DNA, 16 bp, Homo sapiens
ataaggcctcatcctc

SEQ ID NO: 548373 - DNA, 19 bp, Homo sapiens
ataagtgcacacagaaata

SEQ ID NO: 548374 - DNA, 23 bp, Homo sapiens
ataagtgcacacagaaatatata

SEQ ID NO: 548375 - DNA, 18 bp, Homo sapiens
ataagttggaaacactaa

SEQ ID NO: 548376 - DNA, 19 bp, Homo sapiens
ataagttggaaacactaaa

SEQ ID NO: 548377 - DNA, 22 bp, Homo sapiens
ataagttggaaacactaaatgt

SEQ ID NO: 548378 - DNA, 22 bp, Homo sapiens
ataataattaggttaacattgt

SEQ ID NO: 548379 - DNA, 16 bp, Homo sapiens
ataatatatttgcaga

SEQ ID NO: 548380 - DNA, 13 bp, Homo sapiens
ataatatgatttt

SEQ ID NO: 548381 - DNA, 14 bp, Homo sapiens
ataatatgcatata

SEQ ID NO: 548382 - DNA, 15 bp, Homo sapiens
ataatatgcatatat

SEQ ID NO: 548383 - DNA, 15 bp, Homo sapiens
ataatcctgcaaagt

SEQ ID NO: 548384 - DNA, 18 bp, Homo sapiens
ataatggaagagaaatct

SEQ ID NO: 548385 - DNA, 20 bp, Homo sapiens
ataatggaagagaaatctca

SEQ ID NO: 548386 - DNA, 19 bp, Homo sapiens
ataatggcctcttaaaaat

SEQ ID NO: 548387 - DNA, 13 bp, Homo sapiens
ataatggtaattt

SEQ ID NO: 548388 - DNA, 14 bp, Homo sapiens
ataatgtattttca

SEQ ID NO: 548389 - DNA, 15 bp, Homo sapiens
ataatgtgtgtatgt

SEQ ID NO: 548390 - DNA, 16 bp, Homo sapiens
ataatgtgtgtatgtg

SEQ ID NO: 548391 - DNA, 14 bp, Homo sapiens
ataattaaaacaaa

SEQ ID NO: 548392 - DNA, 21 bp, Homo sapiens
ataattaaaacaaaatccttg

SEQ ID NO: 548393 - DNA, 16 bp, Homo sapiens
ataattaggttaacat

SEQ ID NO: 548394 - DNA, 17 bp, Homo sapiens
ataattaggttaacatt

SEQ ID NO: 548395 - DNA, 21 bp, Homo sapiens
ataattcattaaaaacatttt

SEQ ID NO: 548396 - DNA, 20 bp, Homo sapiens
ataattctgaagttatattt

SEQ ID NO: 548397 - DNA, 22 bp, Homo sapiens
ataattctgaagttatatttcc

SEQ ID NO: 548398 - DNA, 20 bp, Homo sapiens
atacaaaatgattgtctttt

SEQ ID NO: 548399 - DNA, 19 bp, Homo sapiens
atacaacacattgaaactg

SEQ ID NO: 548400 - DNA, 23 bp, Homo sapiens
atacaacacattgaaactgtatt

SEQ ID NO: 548401 - DNA, 15 bp, Homo sapiens
atacaagtttgaaca

SEQ ID NO: 548402 - DNA, 13 bp, Homo sapiens
atacaatatataa

SEQ ID NO: 548403 - DNA, 15 bp, Homo sapiens
atacaatatataaaa

SEQ ID NO: 548404 - DNA, 15 bp, Homo sapiens
atacaatttactttt

SEQ ID NO: 548405 - DNA, 13 bp, Homo sapiens
atacacatacata

SEQ ID NO: 548406 - DNA, 14 bp, Homo sapiens
atacacatatacct

SEQ ID NO: 548407 - DNA, 23 bp, Homo sapiens
atacacatatacctataatgtgt

SEQ ID NO: 548408 - DNA, 14 bp, Homo sapiens
atacacgtgtatat

SEQ ID NO: 548409 - DNA, 18 bp, Homo sapiens
atacacttgtataaatgt

SEQ ID NO: 548410 - DNA, 19 bp, Homo sapiens
atacacttgtataaatgta

SEQ ID NO: 548411 - DNA, 14 bp, Homo sapiens
atacatacacttgt

SEQ ID NO: 548412 - DNA, 19 bp, Homo sapiens
atacatacacttgtataaa

SEQ ID NO: 548413 - DNA, 19 bp, Homo sapiens
atacatacgcaattgtata

SEQ ID NO: 548414 - DNA, 17 bp, Homo sapiens
atacatgtgtgtatata

SEQ ID NO: 548415 - DNA, 22 bp, Homo sapiens
atacatgtgtgtatatatgtgt

SEQ ID NO: 548416 - DNA, 17 bp, Homo sapiens
ataccaaagctgctgca

SEQ ID NO: 548417 - DNA, 23 bp, Homo sapiens
ataccagctactccggaggctga

SEQ ID NO: 548418 - DNA, 19 bp, Homo sapiens
ataccatactcatttctaa

SEQ ID NO: 548419 - DNA, 15 bp, Homo sapiens
ataccatttccgtaa

SEQ ID NO: 548420 - DNA, 17 bp, Homo sapiens
ataccattttgaaatat

SEQ ID NO: 548421 - DNA, 16 bp, Homo sapiens
atacctataatgtgtg

SEQ ID NO: 548422 - DNA, 17 bp, Homo sapiens
atacctataatgtgtgt

SEQ ID NO: 548423 - DNA, 22 bp, Homo sapiens
atacctattcaagaagatagtt

SEQ ID NO: 548424 - DNA, 15 bp, Homo sapiens
atacctctaactgtg

SEQ ID NO: 548425 - DNA, 20 bp, Homo sapiens
atacctgtacacacacagac

SEQ ID NO: 548426 - DNA, 12 bp, Homo sapiens
atacctgttgct

SEQ ID NO: 548427 - DNA, 13 bp, Homo sapiens
ataccttaaaatt

SEQ ID NO: 548428 - DNA, 19 bp, Homo sapiens
ataccttaaaatttgaaac

SEQ ID NO: 548429 - DNA, 22 bp, Homo sapiens
ataccttctgatgaagttgtac

SEQ ID NO: 548430 - DNA, 17 bp, Homo sapiens
atacgcaattgtatata

SEQ ID NO: 548431 - DNA, 22 bp, Homo sapiens
atacgcaattgtatatatatgt

SEQ ID NO: 548432 - DNA, 19 bp, Homo sapiens
atacggaagtaaacctgaa

SEQ ID NO: 548433 - DNA, 22 bp, Homo sapiens
atacggaagtaaacctgaacaa

SEQ ID NO: 548434 - DNA, 16 bp, Homo sapiens
atactaaaatatgtct

SEQ ID NO: 548435 - DNA, 17 bp, Homo sapiens
atactatttattaaaac

SEQ ID NO: 548436 - DNA, 17 bp, Homo sapiens
atactcaagtttcaggt

SEQ ID NO: 548437 - DNA, 16 bp, Homo sapiens
atactcatttctaaaa

SEQ ID NO: 548438 - DNA, 20 bp, Homo sapiens
atactcatttctaaaagaat

SEQ ID NO: 548439 - DNA, 23 bp, Homo sapiens
atactcatttctaaaagaatatt

SEQ ID NO: 548440 - DNA, 18 bp, Homo sapiens
atacttgacaacattttt

SEQ ID NO: 548441 - DNA, 13 bp, Homo sapiens
atacttggtcctt

SEQ ID NO: 548442 - DNA, 22 bp, Homo sapiens
atactttgtcctaagagattta

SEQ ID NO: 548443 - DNA, 23 bp, Homo sapiens
atagaaactgtctagcacttcct

SEQ ID NO: 548444 - DNA, 19 bp, Homo sapiens
atagaaagtgttctgttac

SEQ ID NO: 548445 - DNA, 18 bp, Homo sapiens
atagaagtcttcatgaaa

SEQ ID NO: 548446 - DNA, 21 bp, Homo sapiens
atagaagtcttcatgaaatgc

SEQ ID NO: 548447 - DNA, 19 bp, Homo sapiens
atagaataatgaagatctt

SEQ ID NO: 548448 - DNA, 22 bp, Homo sapiens
atagacagatgtggacatgcac

SEQ ID NO: 548449 - DNA, 18 bp, Homo sapiens
atagacataaattgtaat

SEQ ID NO: 548450 - DNA, 19 bp, Homo sapiens
atagacataaattgtaatt

SEQ ID NO: 548451 - DNA, 18 bp, Homo sapiens
atagataccattttgaaa

SEQ ID NO: 548452 - DNA, 19 bp, Homo sapiens
atagcagtggcaaaatatt

SEQ ID NO: 548453 - DNA, 16 bp, Homo sapiens
atagcatttatggtaa

SEQ ID NO: 548454 - DNA, 16 bp, Homo sapiens
atagcttaagaagtat

SEQ ID NO: 548455 - DNA, 21 bp, Homo sapiens
ataggaagttagcctttatct

SEQ ID NO: 548456 - DNA, 13 bp, Homo sapiens
ataggagaggaaa

SEQ ID NO: 548457 - DNA, 23 bp, Homo sapiens
ataggcttgtgtaatttcctgct

SEQ ID NO: 548458 - DNA, 19 bp, Homo sapiens
atagtatttgaaaacagaa

SEQ ID NO: 548459 - DNA, 20 bp, Homo sapiens
atagtatttgaaaacagaaa

SEQ ID NO: 548460 - DNA, 12 bp, Homo sapiens
atagtgaaaatt

SEQ ID NO: 548461 - DNA, 19 bp, Homo sapiens
atagtgaaaattttattga

SEQ ID NO: 548462 - DNA, 12 bp, Homo sapiens
atagtgcaatat

SEQ ID NO: 548463 - DNA, 13 bp, Homo sapiens
atagtgcaatata

SEQ ID NO: 548464 - DNA, 20 bp, Homo sapiens
atagtgcaatatattttgta

SEQ ID NO: 548465 - DNA, 16 bp, Homo sapiens
atagtgctatatatat

SEQ ID NO: 548466 - DNA, 21 bp, Homo sapiens
atagttctccagttgtatgga

SEQ ID NO: 548467 - DNA, 23 bp, Homo sapiens
atagttgtaaagatattgtatct

SEQ ID NO: 548468 - DNA, 12 bp, Homo sapiens
atataaaaataa

SEQ ID NO: 548469 - DNA, 14 bp, Homo sapiens
atataaaatagttg

SEQ ID NO: 548470 - DNA, 18 bp, Homo sapiens
atataaagcatctaaact

SEQ ID NO: 548471 - DNA, 19 bp, Homo sapiens
atataaagcatctaaactt

SEQ ID NO: 548472 - DNA, 16 bp, Homo sapiens
atataatggaagagaa

SEQ ID NO: 548473 - DNA, 22 bp, Homo sapiens
atataatggaagagaaatctca

SEQ ID NO: 548474 - DNA, 16 bp, Homo sapiens
atatacacatatacct

SEQ ID NO: 548475 - DNA, 20 bp, Homo sapiens
atatacatacgcaattgtat

SEQ ID NO: 548476 - DNA, 23 bp, Homo sapiens
atatacatacgcaattgtatata

SEQ ID NO: 548477 - DNA, 21 bp, Homo sapiens
atatacatgtgtgtatatatg

SEQ ID NO: 548478 - DNA, 23 bp, Homo sapiens
atatacatgtgtgtatatatgtg

SEQ ID NO: 548479 - DNA, 23 bp, Homo sapiens
atgtttttaaaatcttattaaag

SEQ ID NO: 548480 - DNA, 17 bp, Homo sapiens
atgtttttcagttcaaa

SEQ ID NO: 548481 - DNA, 22 bp, Homo sapiens
atgtttttcagttcaaagtcat

SEQ ID NO: 548482 - DNA, 14 bp, Homo sapiens
attaaaaagaagat

SEQ ID NO: 548483 - DNA, 13 bp, Homo sapiens
attaaaacaaaat

SEQ ID NO: 548484 - DNA, 16 bp, Homo sapiens
attaaaacaaaatcct

SEQ ID NO: 548485 - DNA, 13 bp, Homo sapiens
attaaaatatgca

SEQ ID NO: 548486 - DNA, 18 bp, Homo sapiens
attaaaatatgcactaag

SEQ ID NO: 548487 - DNA, 23 bp, Homo sapiens
attaaaatatgcactaagtctct

SEQ ID NO: 548488 - DNA, 11 bp, Homo sapiens
attaaactaat

SEQ ID NO: 548489 - DNA, 23 bp, Homo sapiens
attaaatgaaatacttgacaaca

SEQ ID NO: 548490 - DNA, 14 bp, Homo sapiens
attaaatgtcttat

SEQ ID NO: 548491 - DNA, 16 bp, Homo sapiens
attaaattatcattgt

SEQ ID NO: 548492 - DNA, 19 bp, Homo sapiens
attaaattatcattgtttg

SEQ ID NO: 548493 - DNA, 21 bp, Homo sapiens
attaagaaaccccctcatgga

SEQ ID NO: 548494 - DNA, 16 bp, Homo sapiens
attaaggtgatgtgat

SEQ ID NO: 548495 - DNA, 15 bp, Homo sapiens
attaagtaaactaat

SEQ ID NO: 548496 - DNA, 13 bp, Homo sapiens
attaatactaaaa

SEQ ID NO: 548497 - DNA, 22 bp, Homo sapiens
attaatataaccataaatcaat

SEQ ID NO: 548498 - DNA, 17 bp, Homo sapiens
attaatggtctaaaaat

SEQ ID NO: 548499 - DNA, 15 bp, Homo sapiens
attaatgtgtaaaat

SEQ ID NO: 548500 - DNA, 12 bp, Homo sapiens
attaatgttgat

SEQ ID NO: 548501 - DNA, 13 bp, Homo sapiens
attacaatatttg

SEQ ID NO: 548502 - DNA, 14 bp, Homo sapiens
attacaatatttgt

SEQ ID NO: 548503 - DNA, 14 bp, Homo sapiens
attacctgtagctt

SEQ ID NO: 548504 - DNA, 16 bp, Homo sapiens
attactaacttctaaa

SEQ ID NO: 548505 - DNA, 21 bp, Homo sapiens
attactaacttctaaaactgt

SEQ ID NO: 548506 - DNA, 22 bp, Homo sapiens
attactaacttctaaaactgta

SEQ ID NO: 548507 - DNA, 14 bp, Homo sapiens
attagacttctgtt

SEQ ID NO: 548508 - DNA, 21 bp, Homo sapiens
attagagcagatgacccctcc

SEQ ID NO: 548509 - DNA, 14 bp, Homo sapiens
attagcaaaaaaag

SEQ ID NO: 548510 - DNA, 16 bp, Homo sapiens
attaggtttagaatca

SEQ ID NO: 548511 - DNA, 23 bp, Homo sapiens
attatattcccaaatctcaaaag

SEQ ID NO: 548512 - DNA, 16 bp, Homo sapiens
attatatttggatgca

SEQ ID NO: 548513 - DNA, 14 bp, Homo sapiens
attatcattgtttg

SEQ ID NO: 548514 - DNA, 14 bp, Homo sapiens
attatcctgtgtgt

SEQ ID NO: 548515 - DNA, 14 bp, Homo sapiens
attatcttcatgtt

SEQ ID NO: 548516 - DNA, 15 bp, Homo sapiens
attatctttaaaact

SEQ ID NO: 548517 - DNA, 11 bp, Homo sapiens
attatgtgtgc

SEQ ID NO: 548518 - DNA, 19 bp, Homo sapiens
attattcaaaccaatttct

SEQ ID NO: 548519 - DNA, 22 bp, Homo sapiens
attattcaaaccaatttcttcc

SEQ ID NO: 548520 - DNA, 19 bp, Homo sapiens
attattttcattacaatgg

SEQ ID NO: 548521 - DNA, 21 bp, Homo sapiens
attattttcattacaatggaa

SEQ ID NO: 548522 - DNA, 12 bp, Homo sapiens
attcaagaacat

SEQ ID NO: 548523 - DNA, 18 bp, Homo sapiens
attcaagaagatagttgt

SEQ ID NO: 548524 - DNA, 18 bp, Homo sapiens
attcaattcatagaataa

SEQ ID NO: 548525 - DNA, 22 bp, Homo sapiens
attcacagaacctactgttcct

SEQ ID NO: 548526 - DNA, 17 bp, Homo sapiens
attcacatgttttcaaa

SEQ ID NO: 548527 - DNA, 19 bp, Homo sapiens
attcacatgttttcaaatg

SEQ ID NO: 548528 - DNA, 13 bp, Homo sapiens
attcaccttcagt

SEQ ID NO: 548529 - DNA, 15 bp, Homo sapiens
attcacttctgaatt

SEQ ID NO: 548530 - DNA, 16 bp, Homo sapiens
attcacttctgaattg

SEQ ID NO: 548531 - DNA, 20 bp, Homo sapiens
attcacttctgaattggcca

SEQ ID NO: 548532 - DNA, 23 bp, Homo sapiens
attcagcaaggcgctaacttgct

SEQ ID NO: 548533 - DNA, 18 bp, Homo sapiens
attcataccttctgatga

SEQ ID NO: 548534 - DNA, 16 bp, Homo sapiens
attcatagaataacaa

SEQ ID NO: 548535 - DNA, 23 bp, Homo sapiens
attcatagaataacaactgctgg

SEQ ID NO: 548536 - DNA, 14 bp, Homo sapiens
attcatattacaat

SEQ ID NO: 548537 - DNA, 17 bp, Homo sapiens
attcatattacaatatt

SEQ ID NO: 548538 - DNA, 17 bp, Homo sapiens
attcattaaaaacattt

SEQ ID NO: 548539 - DNA, 17 bp, Homo sapiens
attcattcatcctctta

SEQ ID NO: 548540 - DNA, 12 bp, Homo sapiens
attccaaagatc

SEQ ID NO: 548541 - DNA, 15 bp, Homo sapiens
attccaaagatctga

SEQ ID NO: 548542 - DNA, 17 bp, Homo sapiens
attccagagctgccagt

SEQ ID NO: 548543 - DNA, 15 bp, Homo sapiens
attccatattagaaa

SEQ ID NO: 548544 - DNA, 21 bp, Homo sapiens
attccatattagaaaactttg

SEQ ID NO: 548545 - DNA, 21 bp, Homo sapiens
attcccaactagacattacca

SEQ ID NO: 548546 - DNA, 14 bp, Homo sapiens
attcccaagaaatg

SEQ ID NO: 548547 - DNA, 15 bp, Homo sapiens
attcccaagaaatgc

SEQ ID NO: 548548 - DNA, 17 bp, Homo sapiens
attccccatttcctgta

SEQ ID NO: 548549 - DNA, 14 bp, Homo sapiens
attccccggagctg

SEQ ID NO: 548550 - DNA, 17 bp, Homo sapiens
attccctcatttaaacc

SEQ ID NO: 548551 - DNA, 18 bp, Homo sapiens
attccctcgtctttccca

SEQ ID NO: 548552 - DNA, 20 bp, Homo sapiens
attcctatgaagttggcaca

SEQ ID NO: 548553 - DNA, 22 bp, Homo sapiens
attcctgacctccgccatccac

SEQ ID NO: 548554 - DNA, 17 bp, Homo sapiens
attcctttggccactgt

SEQ ID NO: 548555 - DNA, 17 bp, Homo sapiens
attcgggccccacctgc

SEQ ID NO: 548556 - DNA, 17 bp, Homo sapiens
attctaatggtaacttt

SEQ ID NO: 548557 - DNA, 20 bp, Homo sapiens
attctaatggtaacttttgt

SEQ ID NO: 548558 - DNA, 17 bp, Homo sapiens
attctatccatctcctg

SEQ ID NO: 548559 - DNA, 19 bp, Homo sapiens
attctatccatctcctggt

SEQ ID NO: 548560 - DNA, 12 bp, Homo sapiens
attctatgtaac

SEQ ID NO: 548561 - DNA, 11 bp, Homo sapiens
attctctgtac

SEQ ID NO: 548562 - DNA, 17 bp, Homo sapiens
attctctgtacatatta

SEQ ID NO: 548563 - DNA, 18 bp, Homo sapiens
attctgaagttatatttc

SEQ ID NO: 548564 - DNA, 20 bp, Homo sapiens
attctgaagttatatttcct

SEQ ID NO: 548565 - DNA, 16 bp, Homo sapiens
attctgctgcccccag

SEQ ID NO: 548566 - DNA, 15 bp, Homo sapiens
attctggaccagaga

SEQ ID NO: 548567 - DNA, 18 bp, Homo sapiens
attctggcactttaatga

SEQ ID NO: 548568 - DNA, 15 bp, Homo sapiens
attctgggaatgtat

SEQ ID NO: 548569 - DNA, 17 bp, Homo sapiens
attcttataacattgta

SEQ ID NO: 548570 - DNA, 21 bp, Homo sapiens
attcttataacattgtatgtt

SEQ ID NO: 548571 - DNA, 22 bp, Homo sapiens
attcttattccatattagaaaa

SEQ ID NO: 548572 - DNA, 23 bp, Homo sapiens
attcttattccatattagaaaac

SEQ ID NO: 548573 - DNA, 15 bp, Homo sapiens
attcttgttttgctt

SEQ ID NO: 548574 - DNA, 17 bp, Homo sapiens
attctttgttaatttgg

SEQ ID NO: 548575 - DNA, 15 bp, Homo sapiens
attcttttaaatctc

SEQ ID NO: 548576 - DNA, 22 bp, Homo sapiens
attgaaaatgtcactgttataa

SEQ ID NO: 548577 - DNA, 20 bp, Homo sapiens
attgaaaattaaggaaatgt

SEQ ID NO: 548578 - DNA, 14 bp, Homo sapiens
attgaaactgtatt

SEQ ID NO: 548579 - DNA, 15 bp, Homo sapiens
attgaaactgtattt

SEQ ID NO: 548580 - DNA, 20 bp, Homo sapiens
attgaaactgtatttacttg

SEQ ID NO: 548581 - DNA, 15 bp, Homo sapiens
attgaaagggacaag

SEQ ID NO: 548582 - DNA, 19 bp, Homo sapiens
attgaaagggacaagtatc

SEQ ID NO: 548583 - DNA, 17 bp, Homo sapiens
attgaagctaaaacact

SEQ ID NO: 548584 - DNA, 16 bp, Homo sapiens
attgaggttaggaacc

SEQ ID NO: 548585 - DNA, 14 bp, Homo sapiens
attgatgttgatgc

SEQ ID NO: 548586 - DNA, 14 bp, Homo sapiens
attgatttaccttt

SEQ ID NO: 548587 - DNA, 18 bp, Homo sapiens
attgatttacctttggaa

SEQ ID NO: 548588 - DNA, 20 bp, Homo sapiens
attgatttacctttggaatt

SEQ ID NO: 548589 - DNA, 21 bp, Homo sapiens
attgatttacctttggaattg

SEQ ID NO: 548590 - DNA, 21 bp, Homo sapiens
attgcataagtggacccagct

SEQ ID NO: 548591 - DNA, 19 bp, Homo sapiens
attgcatgccgggtgcagc

SEQ ID NO: 548592 - DNA, 23 bp, Homo sapiens
attgcatgccgggtgcagcatct

SEQ ID NO: 548593 - DNA, 16 bp, Homo sapiens
attgcatttgcttttg

SEQ ID NO: 548594 - DNA, 19 bp, Homo sapiens
attgccaaacattaatgtt

SEQ ID NO: 548595 - DNA, 20 bp, Homo sapiens
attgccacataattcattaa

SEQ ID NO: 548596 - DNA, 22 bp, Homo sapiens
attgccacataattcattaaaa

SEQ ID NO: 548597 - DNA, 22 bp, Homo sapiens
attgctgtaaataaaaatagct

SEQ ID NO: 548598 - DNA, 13 bp, Homo sapiens
attgcttcttctg

SEQ ID NO: 548599 - DNA, 13 bp, Homo sapiens
attgcttttaaaa

SEQ ID NO: 548600 - DNA, 17 bp, Homo sapiens
attgcttttaaaatttt

SEQ ID NO: 548601 - DNA, 19 bp, Homo sapiens
attgcttttaaaattttaa

SEQ ID NO: 548602 - DNA, 15 bp, Homo sapiens
attggaaaagactaa

SEQ ID NO: 548603 - DNA, 13 bp, Homo sapiens
attggaaatttca

SEQ ID NO: 548604 - DNA, 19 bp, Homo sapiens
attggaagcaggttaaatg

SEQ ID NO: 548605 - DNA, 13 bp, Homo sapiens
attggattttatg

SEQ ID NO: 548606 - DNA, 18 bp, Homo sapiens
attggattttatgttgac

SEQ ID NO: 548607 - DNA, 17 bp, Homo sapiens
attgggcccccaggtct

SEQ ID NO: 548608 - DNA, 22 bp, Homo sapiens
attggtaattacctggagaaga

SEQ ID NO: 548609 - DNA, 17 bp, Homo sapiens
attggtaccttgcacac

SEQ ID NO: 548610 - DNA, 18 bp, Homo sapiens
attggtaccttgcacaca

SEQ ID NO: 548611 - DNA, 13 bp, Homo sapiens
attggtttaaact

SEQ ID NO: 548612 - DNA, 18 bp, Homo sapiens
attggtttaaacttttat

SEQ ID NO: 548613 - DNA, 20 bp, Homo sapiens
attggtttaaacttttatgc

SEQ ID NO: 548614 - DNA, 14 bp, Homo sapiens
attggtttctcttc

SEQ ID NO: 548615 - DNA, 17 bp, Homo sapiens
attgtaatttgggaaca

SEQ ID NO: 548616 - DNA, 14 bp, Homo sapiens
attgtatatatatg

SEQ ID NO: 548617 - DNA, 15 bp, Homo sapiens
attgtatatatatgt

SEQ ID NO: 548618 - DNA, 16 bp, Homo sapiens
attgtatatatatgtg

SEQ ID NO: 548619 - DNA, 13 bp, Homo sapiens
attgtatcttcat

SEQ ID NO: 548620 - DNA, 16 bp, Homo sapiens
attgtcacctgcttct

SEQ ID NO: 548621 - DNA, 18 bp, Homo sapiens
attgtcttttgtcatgtg

SEQ ID NO: 548622 - DNA, 12 bp, Homo sapiens
atccgccctggg

SEQ ID NO: 548623 - DNA, 14 bp, Homo sapiens
atccgccctgggct

SEQ ID NO: 548624 - DNA, 19 bp, Homo sapiens
atccgccctgggctctggg

SEQ ID NO: 548625 - DNA, 16 bp, Homo sapiens
atccggggccagctcc

SEQ ID NO: 548626 - DNA, 20 bp, Homo sapiens
atccgtaccatcggtcagca

SEQ ID NO: 548627 - DNA, 12 bp, Homo sapiens
atcctccagggc

SEQ ID NO: 548628 - DNA, 17 bp, Homo sapiens
atcctctcgttcagttt

SEQ ID NO: 548629 - DNA, 20 bp, Homo sapiens
atcctcttatatgtgcccct

SEQ ID NO: 548630 - DNA, 21 bp, Homo sapiens
atcctgccttcatggaactca

SEQ ID NO: 548631 - DNA, 17 bp, Homo sapiens
atcctgggcatccccag

SEQ ID NO: 548632 - DNA, 22 bp, Homo sapiens
atcctgggcatccccagccccc

SEQ ID NO: 548633 - DNA, 23 bp, Homo sapiens
atcctgggcatccccagccccct

SEQ ID NO: 548634 - DNA, 24 bp, Homo sapiens
atcctgggcatccccagccccctg

SEQ ID NO: 548635 - DNA, 14 bp, Homo sapiens
atcctgtcctcagc

SEQ ID NO: 548636 - DNA, 17 bp, Homo sapiens
atccttacaaatgattg

SEQ ID NO: 548637 - DNA, 21 bp, Homo sapiens
caacgtactatggaagccaca

SEQ ID NO: 548638 - DNA, 15 bp, Homo sapiens
caacgtggggcagca

SEQ ID NO: 548639 - DNA, 15 bp, Homo sapiens
caactcagagcacag

SEQ ID NO: 548640 - DNA, 18 bp, Homo sapiens
caactctgactgtaaaat

SEQ ID NO: 548641 - DNA, 17 bp, Homo sapiens
caacttacatatgtctt

SEQ ID NO: 548642 - DNA, 16 bp, Homo sapiens
caacttagtgtctcta

SEQ ID NO: 548643 - DNA, 15 bp, Homo sapiens
caacttgattcttgt

SEQ ID NO: 548644 - DNA, 19 bp, Homo sapiens
caactttagcagaatcaaa

SEQ ID NO: 548645 - DNA, 15 bp, Homo sapiens
caacttttttttctt

SEQ ID NO: 548646 - DNA, 15 bp, Homo sapiens
caagaaaaaaaggga

SEQ ID NO: 548647 - DNA, 15 bp, Homo sapiens
caagaaagccagtct

SEQ ID NO: 548648 - DNA, 13 bp, Homo sapiens
caagaacttgttt

SEQ ID NO: 548649 - DNA, 14 bp, Homo sapiens
caagaacttgttta

SEQ ID NO: 548650 - DNA, 17 bp, Homo sapiens
caagaacttgtttaata

SEQ ID NO: 548651 - DNA, 18 bp, Homo sapiens
caagaataaaggcagctg

SEQ ID NO: 548652 - DNA, 19 bp, Homo sapiens
caagaataaaggcagctgt

SEQ ID NO: 548653 - DNA, 14 bp, Homo sapiens
caagaccagcctgg

SEQ ID NO: 548654 - DNA, 17 bp, Homo sapiens
caagacccccaggaagg

SEQ ID NO: 548655 - DNA, 21 bp, Homo sapiens
caagagagcagcaaggtcttg

SEQ ID NO: 548656 - DNA, 20 bp, Homo sapiens
caagaggtaccaaaaaagaa

SEQ ID NO: 548657 - DNA, 20 bp, Homo sapiens
caagatggcacagggcatga

SEQ ID NO: 548658 - DNA, 12 bp, Homo sapiens
caagattttgtt

SEQ ID NO: 548659 - DNA, 14 bp, Homo sapiens
caagcacagtcagg

SEQ ID NO: 548660 - DNA, 12 bp, Homo sapiens
caagcagattcg

SEQ ID NO: 548661 - DNA, 12 bp, Homo sapiens
caagcaggaggc

SEQ ID NO: 548662 - DNA, 22 bp, Homo sapiens
caagcagtttcaataaagtttg

SEQ ID NO: 548663 - DNA, 14 bp, Homo sapiens
caagcccaggaggg

SEQ ID NO: 548664 - DNA, 23 bp, Homo sapiens
caagcctcagcaaacccaaagat

SEQ ID NO: 548665 - DNA, 17 bp, Homo sapiens
caagctaggtgctaatt

SEQ ID NO: 548666 - DNA, 18 bp, Homo sapiens
caagctcacttgctttag

SEQ ID NO: 548667 - DNA, 12 bp, Homo sapiens
caagctgaggag

SEQ ID NO: 548668 - DNA, 19 bp, Homo sapiens
caagctgttgaccaggcac

SEQ ID NO: 548669 - DNA, 21 bp, Homo sapiens
caaggacagaaggctcctgcc

SEQ ID NO: 548670 - DNA, 21 bp, Homo sapiens
caaggacgcttcacaggacag

SEQ ID NO: 548671 - DNA, 15 bp, Homo sapiens
caaggccccctgcct

SEQ ID NO: 548672 - DNA, 17 bp, Homo sapiens
caaggccccctgcctgc

SEQ ID NO: 548673 - DNA, 13 bp, Homo sapiens
caagggcccagag

SEQ ID NO: 548674 - DNA, 15 bp, Homo sapiens
caagggcccagaggg

SEQ ID NO: 548675 - DNA, 22 bp, Homo sapiens
caaggggaatctggaggtagcc

SEQ ID NO: 548676 - DNA, 15 bp, Homo sapiens
caaggtcttgctctc

SEQ ID NO: 548677 - DNA, 17 bp, Homo sapiens
caaggtgtgccccgtgg

SEQ ID NO: 548678 - DNA, 23 bp, Homo sapiens
caagtaatataatggaagagaaa

SEQ ID NO: 548679 - DNA, 11 bp, Homo sapiens
caagtctgtga

SEQ ID NO: 548680 - DNA, 12 bp, Homo sapiens
caagtctgtgaa

SEQ ID NO: 548681 - DNA, 13 bp, Homo sapiens
caagtctgtgaaa

SEQ ID NO: 548682 - DNA, 22 bp, Homo sapiens
caagttcacacctgcagattct

SEQ ID NO: 548683 - DNA, 23 bp, Homo sapiens
caagttcacacctgcagattcta

SEQ ID NO: 548684 - DNA, 14 bp, Homo sapiens
cagttacttttcct

SEQ ID NO: 548685 - DNA, 19 bp, Homo sapiens
cagttacttttccttgcat

SEQ ID NO: 548686 - DNA, 23 bp, Homo sapiens
cagttatcctttgtgagcctatg

SEQ ID NO: 548687 - DNA, 23 bp, Homo sapiens
cagttattgtccctggcttcctt

SEQ ID NO: 548688 - DNA, 14 bp, Homo sapiens
cagttatttatagt

SEQ ID NO: 548689 - DNA, 13 bp, Homo sapiens
cagttcaaagtca

SEQ ID NO: 548690 - DNA, 15 bp, Homo sapiens
cagttcaaagtcatg

SEQ ID NO: 548691 - DNA, 21 bp, Homo sapiens
cagttctttaagaagatcttt

SEQ ID NO: 548692 - DNA, 22 bp, Homo sapiens
cagttgcaataaactcagtcaa

SEQ ID NO: 548693 - DNA, 17 bp, Homo sapiens
cagttgcccagcctctt

SEQ ID NO: 548694 - DNA, 18 bp, Homo sapiens
cagttggccaagcagaaa

SEQ ID NO: 548695 - DNA, 18 bp, Homo sapiens
cagttggttttgcatgtc

SEQ ID NO: 548696 - DNA, 21 bp, Homo sapiens
cagttgttagttactacctcc

SEQ ID NO: 548697 - DNA, 19 bp, Homo sapiens
cagtttagatttcaagaaa

SEQ ID NO: 548698 - DNA, 14 bp, Homo sapiens
cagtttattccaga

SEQ ID NO: 548699 - DNA, 16 bp, Homo sapiens
cagtttcaataaagtt

SEQ ID NO: 548700 - DNA, 18 bp, Homo sapiens
cagtttcaataaagtttg

SEQ ID NO: 548701 - DNA, 17 bp, Homo sapiens
cagtttttgttcttaaa

SEQ ID NO: 548702 - DNA, 22 bp, Homo sapiens
cataaaattaaaatttaacatc

SEQ ID NO: 548703 - DNA, 14 bp, Homo sapiens
cataaattgtaatt

SEQ ID NO: 548704 - DNA, 15 bp, Homo sapiens
cataagcaacaattt

SEQ ID NO: 548705 - DNA, 23 bp, Homo sapiens
cataagtaaatgtcttcatgttg

SEQ ID NO: 548706 - DNA, 16 bp, Homo sapiens
cataagtggacccagc

SEQ ID NO: 548707 - DNA, 23 bp, Homo sapiens
cataatatgcatatatatgtata

SEQ ID NO: 548708 - DNA, 15 bp, Homo sapiens
cataattcattaaaa

SEQ ID NO: 548709 - DNA, 22 bp, Homo sapiens
cataattcattaaaaacatttt

SEQ ID NO: 548710 - DNA, 21 bp, Homo sapiens
catacaaacaagcatataaaa

SEQ ID NO: 548711 - DNA, 17 bp, Homo sapiens
catacaatttactttta

SEQ ID NO: 548712 - DNA, 16 bp, Homo sapiens
catacacttgtataaa

SEQ ID NO: 548713 - DNA, 16 bp, Homo sapiens
catacgcaattgtata

SEQ ID NO: 548714 - DNA, 14 bp, Homo sapiens
catacttctctcag

SEQ ID NO: 548715 - DNA, 16 bp, Homo sapiens
catacttctctcagat

SEQ ID NO: 548716 - DNA, 20 bp, Homo sapiens
catagaaactgtctagcact

SEQ ID NO: 548717 - DNA, 22 bp, Homo sapiens
catagacagatgtggacatgca

SEQ ID NO: 548718 - DNA, 23 bp, Homo sapiens
catagacagatgtggacatgcac

SEQ ID NO: 548719 - DNA, 17 bp, Homo sapiens
cataggaagttagcctt

SEQ ID NO: 548720 - DNA, 15 bp, Homo sapiens
catagtaaatgtagt

SEQ ID NO: 548721 - DNA, 19 bp, Homo sapiens
catagtaaatgtagttcat

SEQ ID NO: 548722 - DNA, 20 bp, Homo sapiens
catagtaaatgtagttcata

SEQ ID NO: 548723 - DNA, 19 bp, Homo sapiens
catatacctataatgtgtg

SEQ ID NO: 548724 - DNA, 21 bp, Homo sapiens
catatacctataatgtgtgta

SEQ ID NO: 548725 - DNA, 13 bp, Homo sapiens
catatatacatac

SEQ ID NO: 548726 - DNA, 17 bp, Homo sapiens
catatatataaaataca

SEQ ID NO: 548727 - DNA, 18 bp, Homo sapiens
catatctaaccagtgatt

SEQ ID NO: 548728 - DNA, 13 bp, Homo sapiens
catatctatcaga

SEQ ID NO: 548729 - DNA, 17 bp, Homo sapiens
catatctatcagagtat

SEQ ID NO: 548730 - DNA, 19 bp, Homo sapiens
catatgtagactatataca

SEQ ID NO: 548731 - DNA, 23 bp, Homo sapiens
catatgtagactatatacatgtg

SEQ ID NO: 548732 - DNA, 19 bp, Homo sapiens
catattaaagaaagtcata

SEQ ID NO: 548733 - DNA, 22 bp, Homo sapiens
catattacaatatttgtgtgct

SEQ ID NO: 548734 - DNA, 18 bp, Homo sapiens
catattagacttctgttt

SEQ ID NO: 548735 - DNA, 22 bp, Homo sapiens
catattagacttctgttttcaa

SEQ ID NO: 548736 - DNA, 20 bp, Homo sapiens
catattagcgacaacagatt

SEQ ID NO: 548737 - DNA, 17 bp, Homo sapiens
catattggcatggattt

SEQ ID NO: 548738 - DNA, 23 bp, Homo sapiens
catattttaatttcaagcttatt

SEQ ID NO: 548739 - DNA, 13 bp, Homo sapiens
catattttcacag

SEQ ID NO: 548740 - DNA, 18 bp, Homo sapiens
catatttttttccttaca

SEQ ID NO: 548741 - DNA, 18 bp, Homo sapiens
catcagcccaatccctga

SEQ ID NO: 548742 - DNA, 20 bp, Homo sapiens
catcagcccaatccctgatc

SEQ ID NO: 548743 - DNA, 12 bp, Homo sapiens
catcagcccctg

SEQ ID NO: 548744 - DNA, 20 bp, Homo sapiens
catttacagtctctttcttc

SEQ ID NO: 548745 - DNA, 23 bp, Homo sapiens
catttacagtctctttcttcctt

SEQ ID NO: 548746 - DNA, 13 bp, Homo sapiens
catttagcacagt

SEQ ID NO: 548747 - DNA, 15 bp, Homo sapiens
catttagcacagtat

SEQ ID NO: 548748 - DNA, 17 bp, Homo sapiens
catttagtcctcacctt

SEQ ID NO: 548749 - DNA, 14 bp, Homo sapiens
catttcatgtattt

SEQ ID NO: 548750 - DNA, 13 bp, Homo sapiens
catttccaacacc

SEQ ID NO: 548751 - DNA, 18 bp, Homo sapiens
catttccaacaccacaga

SEQ ID NO: 548752 - DNA, 20 bp, Homo sapiens
catttccaacaccacagaca

SEQ ID NO: 548753 - DNA, 21 bp, Homo sapiens
catttccaacaccacagacac

SEQ ID NO: 548754 - DNA, 12 bp, Homo sapiens
catttccatgta

SEQ ID NO: 548755 - DNA, 18 bp, Homo sapiens
catttccttgtctaaaga

SEQ ID NO: 548756 - DNA, 21 bp, Homo sapiens
catttctaacataagtaagac

SEQ ID NO: 548757 - DNA, 20 bp, Homo sapiens
catttctaactctgatgtaa

SEQ ID NO: 548758 - DNA, 23 bp, Homo sapiens
catttctaactctgatgtaaatg

SEQ ID NO: 548759 - DNA, 22 bp, Homo sapiens
catttcttctctctgtgctggt

SEQ ID NO: 548760 - DNA, 20 bp, Homo sapiens
catttggctttccagtcata

SEQ ID NO: 548761 - DNA, 12 bp, Homo sapiens
catttgtcattt

SEQ ID NO: 548762 - DNA, 14 bp, Homo sapiens
catttgtcattttc

SEQ ID NO: 548763 - DNA, 18 bp, Homo sapiens
catttgtttggttatagt

SEQ ID NO: 548764 - DNA, 14 bp, Homo sapiens
cattttttgtctgt

SEQ ID NO: 548765 - DNA, 15 bp, Homo sapiens
cattttttgtctgtg

SEQ ID NO: 548766 - DNA, 11 bp, Homo sapiens
ccaaaagaaaa

SEQ ID NO: 548767 - DNA, 15 bp, Homo sapiens
ccaaaataaagtctg

SEQ ID NO: 548768 - DNA, 13 bp, Homo sapiens
ccaaacctggaga

SEQ ID NO: 548769 - DNA, 13 bp, Homo sapiens
ccaaagacaaata

SEQ ID NO: 548770 - DNA, 16 bp, Homo sapiens
ccaaagacaaatagta

SEQ ID NO: 548771 - DNA, 13 bp, Homo sapiens
ccaaagatgttaa

SEQ ID NO: 548772 - DNA, 19 bp, Homo sapiens
ccaaagcagtggagcccag

SEQ ID NO: 548773 - DNA, 23 bp, Homo sapiens
ccaaagcagtggagcccaggagt

SEQ ID NO: 548774 - DNA, 15 bp, Homo sapiens
ccaaagtaccacact

SEQ ID NO: 548775 - DNA, 18 bp, Homo sapiens
ccaaatatagcgttccca

SEQ ID NO: 548776 - DNA, 21 bp, Homo sapiens
ccaaatcctgggcatccccag

SEQ ID NO: 548777 - DNA, 19 bp, Homo sapiens
ccaaatggattcctgtttc

SEQ ID NO: 548778 - DNA, 22 bp, Homo sapiens
ccaaatgtgtcttgtattatca

SEQ ID NO: 548779 - DNA, 22 bp, Homo sapiens
ccaaattttattaaaagagtag

SEQ ID NO: 548780 - DNA, 19 bp, Homo sapiens
ccaaattttccttcctgtt

SEQ ID NO: 548781 - DNA, 15 bp, Homo sapiens
ccaacaccacagaca

SEQ ID NO: 548782 - DNA, 16 bp, Homo sapiens
ccaacaccacagacac

SEQ ID NO: 548783 - DNA, 17 bp, Homo sapiens
ccaacaccacagacaca

SEQ ID NO: 548784 - DNA, 21 bp, Homo sapiens
ccaacaccacagacacacaca

SEQ ID NO: 548785 - DNA, 17 bp, Homo sapiens
ccaacagcattggcctg

SEQ ID NO: 548786 - DNA, 17 bp, Homo sapiens
ccaacccaaacctggag

SEQ ID NO: 548787 - DNA, 18 bp, Homo sapiens
ccaacccaaacctggaga

SEQ ID NO: 548788 - DNA, 17 bp, Homo sapiens
ccaacccatgagtgcta

SEQ ID NO: 548789 - DNA, 17 bp, Homo sapiens
ccaacgacccatgaccg

SEQ ID NO: 548790 - DNA, 15 bp, Homo sapiens
ccaacggccccagct

SEQ ID NO: 548791 - DNA, 22 bp, Homo sapiens
ccaactttcaagaacttgttta

SEQ ID NO: 548792 - DNA, 23 bp, Homo sapiens
ccaagaggtttggctcctgccca

SEQ ID NO: 548793 - DNA, 11 bp, Homo sapiens
ccaagcagaaa

SEQ ID NO: 548794 - DNA, 18 bp, Homo sapiens
ccaagctataaaagccca

SEQ ID NO: 548795 - DNA, 22 bp, Homo sapiens
ccaaggacagaaggctcctgcc

SEQ ID NO: 548796 - DNA, 17 bp, Homo sapiens
ccaaggccccctgcctg

SEQ ID NO: 548797 - DNA, 14 bp, Homo sapiens
ccaagggcccagag

SEQ ID NO: 548798 - DNA, 15 bp, Homo sapiens
ccaagggcccagagg

SEQ ID NO: 548799 - DNA, 18 bp, Homo sapiens
ccaagtggagcctgacag

SEQ ID NO: 548800 - DNA, 22 bp, Homo sapiens
ccaagttggtcttactttgtta

SEQ ID NO: 548801 - DNA, 16 bp, Homo sapiens
ccaatcgggagtagca

SEQ ID NO: 548802 - DNA, 17 bp, Homo sapiens
ccaatcgggagtagcaa

SEQ ID NO: 548803 - DNA, 19 bp, Homo sapiens
ccaatctccaggctccctc

SEQ ID NO: 548804 - DNA, 14 bp, Homo sapiens
ccaatttcttcctt

SEQ ID NO: 548805 - DNA, 12 bp, Homo sapiens
ccacaataggct

SEQ ID NO: 548806 - DNA, 12 bp, Homo sapiens
ccacacacccca

SEQ ID NO: 548807 - DNA, 11 bp, Homo sapiens
ccacacaggcc

SEQ ID NO: 548808 - DNA, 19 bp, Homo sapiens
ccacacatttcactgtctg

SEQ ID NO: 548809 - DNA, 13 bp, Homo sapiens
ccacaccctacag

SEQ ID NO: 548810 - DNA, 14 bp, Homo sapiens
ccacaccctacagc

SEQ ID NO: 548811 - DNA, 13 bp, Homo sapiens
ccacacctggccc

SEQ ID NO: 548812 - DNA, 14 bp, Homo sapiens
ccacacctggccct

SEQ ID NO: 548813 - DNA, 20 bp, Homo sapiens
ccacacctggccctggggcc

SEQ ID NO: 548814 - DNA, 16 bp, Homo sapiens
ccacactgagttctat

SEQ ID NO: 548815 - DNA, 20 bp, Homo sapiens
ccacactgagttctatcagt

SEQ ID NO: 548816 - DNA, 13 bp, Homo sapiens
ccacagacacaca

SEQ ID NO: 548817 - DNA, 14 bp, Homo sapiens
ccacagacacacac

SEQ ID NO: 548818 - DNA, 15 bp, Homo sapiens
ccacagacacacaca

SEQ ID NO: 548819 - DNA, 20 bp, Homo sapiens
ccacagacacacacacgcac

SEQ ID NO: 548820 - DNA, 21 bp, Homo sapiens
ccacagacactcctggggggc

SEQ ID NO: 548821 - DNA, 14 bp, Homo sapiens
ccacagctcctttt

SEQ ID NO: 548822 - DNA, 15 bp, Homo sapiens
ccacaggatgcatat

SEQ ID NO: 548823 - DNA, 17 bp, Homo sapiens
ccacagttatcttagct

SEQ ID NO: 548824 - DNA, 23 bp, Homo sapiens
ccacataattcattaaaaacatt

SEQ ID NO: 548825 - DNA, 16 bp, Homo sapiens
ccacatcccatcgtct

SEQ ID NO: 548826 - DNA, 22 bp, Homo sapiens
ccacattctgctgcccccagac

SEQ ID NO: 548827 - DNA, 23 bp, Homo sapiens
ccacattgcataagtggacccag

SEQ ID NO: 548828 - DNA, 13 bp, Homo sapiens
ccacccccgggtg

SEQ ID NO: 548829 - DNA, 19 bp, Homo sapiens
ccacccccgggtgcctgtg

SEQ ID NO: 548830 - DNA, 19 bp, Homo sapiens
ccacccgtggtggctcaag

SEQ ID NO: 548831 - DNA, 16 bp, Homo sapiens
ccacctccccaggccg

SEQ ID NO: 548832 - DNA, 12 bp, Homo sapiens
ccacctgcacaa

SEQ ID NO: 548833 - DNA, 18 bp, Homo sapiens
ccacctgcacaaacatag

SEQ ID NO: 548834 - DNA, 15 bp, Homo sapiens
ccacctgcagctccc

SEQ ID NO: 548835 - DNA, 15 bp, Homo sapiens
ccagagctcccagga

SEQ ID NO: 548836 - DNA, 13 bp, Homo sapiens
ccagagctgccag

SEQ ID NO: 548837 - DNA, 14 bp, Homo sapiens
ccagagctgccagt

SEQ ID NO: 548838 - DNA, 17 bp, Homo sapiens
ccagaggaaatctgaat

SEQ ID NO: 548839 - DNA, 18 bp, Homo sapiens
ccagaggggcggggccag

SEQ ID NO: 548840 - DNA, 21 bp, Homo sapiens
ccagaggtgagggaggcctga

SEQ ID NO: 548841 - DNA, 18 bp, Homo sapiens
ccagatccaggaacacat

SEQ ID NO: 548842 - DNA, 20 bp, Homo sapiens
ccagatccaggaacacatgc

SEQ ID NO: 548843 - DNA, 20 bp, Homo sapiens
ccagatgatccttgcacaga

SEQ ID NO: 548844 - DNA, 21 bp, Homo sapiens
ccagatgatccttgcacagac

SEQ ID NO: 548845 - DNA, 18 bp, Homo sapiens
ccagatgtgacagtgttg

SEQ ID NO: 548846 - DNA, 23 bp, Homo sapiens
ccagcaacattataatggccctg

SEQ ID NO: 548847 - DNA, 20 bp, Homo sapiens
ccagcacccccacgccctca

SEQ ID NO: 548848 - DNA, 13 bp, Homo sapiens
ccagcatacattt

SEQ ID NO: 548849 - DNA, 22 bp, Homo sapiens
ccagccccagacaacagcccag

SEQ ID NO: 548850 - DNA, 17 bp, Homo sapiens
ccagccccagcgagtct

SEQ ID NO: 548851 - DNA, 22 bp, Homo sapiens
ccagcccctggtggtgggggct

SEQ ID NO: 548852 - DNA, 17 bp, Homo sapiens
ccagcccttcctctgct

SEQ ID NO: 548853 - DNA, 13 bp, Homo sapiens
ccagcctctttcc

SEQ ID NO: 548854 - DNA, 15 bp, Homo sapiens
ccagcgctgacgtgt

SEQ ID NO: 548855 - DNA, 22 bp, Homo sapiens
ccagctctcccctgcgcaggcc

SEQ ID NO: 548856 - DNA, 16 bp, Homo sapiens
ccagctgcaggaatca

SEQ ID NO: 548857 - DNA, 19 bp, Homo sapiens
ccagctgcccctccctgcc

SEQ ID NO: 548858 - DNA, 18 bp, Homo sapiens
ccagctttcagggacagc

SEQ ID NO: 548859 - DNA, 21 bp, Homo sapiens
ccaggaacacatgcacacaca

SEQ ID NO: 548860 - DNA, 16 bp, Homo sapiens
ccaggaaggaaacaga

SEQ ID NO: 548861 - DNA, 16 bp, Homo sapiens
ccaggaccctgagggt

SEQ ID NO: 548862 - DNA, 14 bp, Homo sapiens
ccaggagcgcagct

SEQ ID NO: 548863 - DNA, 18 bp, Homo sapiens
ccaggagtgggtgggaca

SEQ ID NO: 548864 - DNA, 11 bp, Homo sapiens
ccaggatggcg

SEQ ID NO: 548865 - DNA, 20 bp, Homo sapiens
ccaggatggcgtgtcccctg

SEQ ID NO: 548866 - DNA, 17 bp, Homo sapiens
ccaggcatctccttggg

SEQ ID NO: 548867 - DNA, 18 bp, Homo sapiens
ccaggcatctccttgggc

SEQ ID NO: 548868 - DNA, 15 bp, Homo sapiens
ccaggcatgaccctg

SEQ ID NO: 548869 - DNA, 19 bp, Homo sapiens
ccaggcatgaccctggagc

SEQ ID NO: 548870 - DNA, 21 bp, Homo sapiens
ccaggcatgaccctggagccc

SEQ ID NO: 548871 - DNA, 18 bp, Homo sapiens
ccaggcgtagggccaggg

SEQ ID NO: 548872 - DNA, 18 bp, Homo sapiens
ccaggctcccactgcccc

SEQ ID NO: 548873 - DNA, 23 bp, Homo sapiens
ccaggctctcgcacacctctgca

SEQ ID NO: 548874 - DNA, 16 bp, Homo sapiens
ccagggaaccagagcg

SEQ ID NO: 548875 - DNA, 17 bp, Homo sapiens
ccagggaaccagagcga

SEQ ID NO: 548876 - DNA, 18 bp, Homo sapiens
ccagggctggggcagcct

SEQ ID NO: 548877 - DNA, 21 bp, Homo sapiens
ccagggctggggcagcctctg

SEQ ID NO: 548878 - DNA, 16 bp, Homo sapiens
ccaggtgaaggaggct

SEQ ID NO: 548879 - DNA, 20 bp, Homo sapiens
ccagtaacacaggccaccct

SEQ ID NO: 548880 - DNA, 22 bp, Homo sapiens
ccagtacattctcagtttttct

SEQ ID NO: 548881 - DNA, 23 bp, Homo sapiens
ccagtacctgggtccccagccct

SEQ ID NO: 548882 - DNA, 13 bp, Homo sapiens
ccagtagtgacca

SEQ ID NO: 548883 - DNA, 14 bp, Homo sapiens
ccagtagtgaccaa

SEQ ID NO: 548884 - DNA, 16 bp, Homo sapiens
ccagtagtgaccaatc

SEQ ID NO: 548885 - DNA, 17 bp, Homo sapiens
ccagtagtgaccaatcg

SEQ ID NO: 548886 - DNA, 17 bp, Homo sapiens
ccagtcataccaacttt

SEQ ID NO: 548887 - DNA, 18 bp, Homo sapiens
ccagtcttccacctggaa

SEQ ID NO: 548888 - DNA, 14 bp, Homo sapiens
ccagtcttctagtg

SEQ ID NO: 548889 - DNA, 15 bp, Homo sapiens
ccagtgctcacacaa

SEQ ID NO: 548890 - DNA, 20 bp, Homo sapiens
ccagtgctcacacaatcaga

SEQ ID NO: 548891 - DNA, 14 bp, Homo sapiens
ccagtgtccccagg

SEQ ID NO: 548892 - DNA, 18 bp, Homo sapiens
ccagtgtccccaggggca

SEQ ID NO: 548893 - DNA, 17 bp, Homo sapiens
ccagttccctcagccct

SEQ ID NO: 548894 - DNA, 13 bp, Homo sapiens
ccagttctgatga

SEQ ID NO: 548895 - DNA, 14 bp, Homo sapiens
ccagttgctgctgc

SEQ ID NO: 548896 - DNA, 15 bp, Homo sapiens
ccatactcatttcta

SEQ ID NO: 548897 - DNA, 12 bp, Homo sapiens
ccataggccctt

SEQ ID NO: 548898 - DNA, 14 bp, Homo sapiens
ccataggccctttc

SEQ ID NO: 548899 - DNA, 21 bp, Homo sapiens
ccatagtggatcactcaccat

SEQ ID NO: 548900 - DNA, 18 bp, Homo sapiens
ccatatcaaaagacacag

SEQ ID NO: 548901 - DNA, 16 bp, Homo sapiens
ccatatctaaccagtg

SEQ ID NO: 548902 - DNA, 19 bp, Homo sapiens
ccatattagaaaactttgt

SEQ ID NO: 548903 - DNA, 20 bp, Homo sapiens
ccatattagaaaactttgtt

SEQ ID NO: 548904 - DNA, 22 bp, Homo sapiens
ccatattagaaaactttgttag

SEQ ID NO: 548905 - DNA, 22 bp, Homo sapiens
ccatcagaggacacctgtactg

SEQ ID NO: 548906 - DNA, 13 bp, Homo sapiens
ccatccagccagg

SEQ ID NO: 548907 - DNA, 16 bp, Homo sapiens
ccatcctcctccttcc

SEQ ID NO: 548908 - DNA, 15 bp, Homo sapiens
ccatctgctgagctc

SEQ ID NO: 548909 - DNA, 18 bp, Homo sapiens
ccatctgctgagctctga

SEQ ID NO: 548910 - DNA, 20 bp, Homo sapiens
ccatctttttaacctctgtt

SEQ ID NO: 548911 - DNA, 14 bp, Homo sapiens
ccatgaaacagcag

SEQ ID NO: 548912 - DNA, 15 bp, Homo sapiens
ccatgaaacagcagc

SEQ ID NO: 548913 - DNA, 23 bp, Homo sapiens
ccatgagtgctaagagcctctgg

SEQ ID NO: 548914 - DNA, 16 bp, Homo sapiens
ccatgattccaagggc

SEQ ID NO: 548915 - DNA, 20 bp, Homo sapiens
ccatgattccaagggcccag

SEQ ID NO: 548916 - DNA, 22 bp, Homo sapiens
ccatgattccaagggcccagag

SEQ ID NO: 548917 - DNA, 14 bp, Homo sapiens
ccatgccctccctg

SEQ ID NO: 548918 - DNA, 13 bp, Homo sapiens
ccatggaagctgg

SEQ ID NO: 548919 - DNA, 17 bp, Homo sapiens
ccatggaagctggcagg

SEQ ID NO: 548920 - DNA, 13 bp, Homo sapiens
ccatggaggcaca

SEQ ID NO: 548921 - DNA, 17 bp, Homo sapiens
ccatggaggcacacagc

SEQ ID NO: 548922 - DNA, 21 bp, Homo sapiens
ccatgtgagctgctgccatga

SEQ ID NO: 548923 - DNA, 11 bp, Homo sapiens
ccatgtgtatg

SEQ ID NO: 548924 - DNA, 18 bp, Homo sapiens
ccattatggctttgtgct

SEQ ID NO: 548925 - DNA, 21 bp, Homo sapiens
ccattcccaagaaatgctttg

SEQ ID NO: 548926 - DNA, 19 bp, Homo sapiens
ccattctgtcctaccttta

SEQ ID NO: 548927 - DNA, 20 bp, Homo sapiens
ccattgcatcacctctgtaa

SEQ ID NO: 548928 - DNA, 15 bp, Homo sapiens
ccattggaaatttca

SEQ ID NO: 548929 - DNA, 16 bp, Homo sapiens
ccattggatctgcaag

SEQ ID NO: 548930 - DNA, 22 bp, Homo sapiens
ccatttacagtctctttcttcc

SEQ ID NO: 548931 - DNA, 23 bp, Homo sapiens
ccatttacagtctctttcttcct

SEQ ID NO: 548932 - DNA, 23 bp, Homo sapiens
ccctgggagagtgaggtcatccc

SEQ ID NO: 548933 - DNA, 20 bp, Homo sapiens
ccctggggtttccacacagg

SEQ ID NO: 548934 - DNA, 20 bp, Homo sapiens
ccctggtaagaaaaagcaaa

SEQ ID NO: 548935 - DNA, 13 bp, Homo sapiens
ccctggtcctgca

SEQ ID NO: 548936 - DNA, 14 bp, Homo sapiens
ccctggtcctgcac

SEQ ID NO: 548937 - DNA, 17 bp, Homo sapiens
ccctggttcccccagga

SEQ ID NO: 548938 - DNA, 19 bp, Homo sapiens
ccctggttcccccaggacc

SEQ ID NO: 548939 - DNA, 14 bp, Homo sapiens
cccttaaaaccaaa

SEQ ID NO: 548940 - DNA, 16 bp, Homo sapiens
cccttccacctgctct

SEQ ID NO: 548941 - DNA, 19 bp, Homo sapiens
cccttccacctgctctgct

SEQ ID NO: 548942 - DNA, 18 bp, Homo sapiens
cccttccatttctgcctt

SEQ ID NO: 548943 - DNA, 20 bp, Homo sapiens
cccttccatttctgcctttt

SEQ ID NO: 548944 - DNA, 11 bp, Homo sapiens
cccttcccaac

SEQ ID NO: 548945 - DNA, 14 bp, Homo sapiens
cccttccccttcct

SEQ ID NO: 548946 - DNA, 18 bp, Homo sapiens
cccttccccttccttctt

SEQ ID NO: 548947 - DNA, 14 bp, Homo sapiens
cccttcctctgctc

SEQ ID NO: 548948 - DNA, 19 bp, Homo sapiens
cccttctcttccaggcagc

SEQ ID NO: 548949 - DNA, 12 bp, Homo sapiens
cccttgggatgg

SEQ ID NO: 548950 - DNA, 19 bp, Homo sapiens
cccttgggatgggcacagg

SEQ ID NO: 548951 - DNA, 13 bp, Homo sapiens
ccctttcttcctc

SEQ ID NO: 548952 - DNA, 21 bp, Homo sapiens
ccctttgtcctcctgctgcca

SEQ ID NO: 548953 - DNA, 9 bp, Homo sapiens
cccttttcc

SEQ ID NO: 548954 - DNA, 16 bp, Homo sapiens
ccgaaggtctctctgg

SEQ ID NO: 548955 - DNA, 18 bp, Homo sapiens
ccgaaggtctctctggct

SEQ ID NO: 548956 - DNA, 17 bp, Homo sapiens
ccgacagctttccagta

SEQ ID NO: 548957 - DNA, 17 bp, Homo sapiens
ccgactagacacacaaa

SEQ ID NO: 548958 - DNA, 20 bp, Homo sapiens
ccgactagacacacaaagca

SEQ ID NO: 548959 - DNA, 23 bp, Homo sapiens
ccgagcaaagatcaaaataaaaa

SEQ ID NO: 548960 - DNA, 13 bp, Homo sapiens
ccgagccgagctc

SEQ ID NO: 548961 - DNA, 17 bp, Homo sapiens
ccgagccgagctctcct

SEQ ID NO: 548962 - DNA, 16 bp, Homo sapiens
ccgagctctcctgggc

SEQ ID NO: 548963 - DNA, 18 bp, Homo sapiens
ccgagctctcctgggcca

SEQ ID NO: 548964 - DNA, 22 bp, Homo sapiens
ccgagctctcctgggccagggt

SEQ ID NO: 548965 - DNA, 23 bp, Homo sapiens
ccgaggacccatgaaacagcagc

SEQ ID NO: 548966 - DNA, 13 bp, Homo sapiens
ccgagtgccccag

SEQ ID NO: 548967 - DNA, 22 bp, Homo sapiens
ccgagtgtgtttcatccttccc

SEQ ID NO: 548968 - DNA, 18 bp, Homo sapiens
ccgcccaaacctttcccc

SEQ ID NO: 548969 - DNA, 18 bp, Homo sapiens
ccgcgggggacaggaaca

SEQ ID NO: 548970 - DNA, 15 bp, Homo sapiens
ccgctccagagtcag

SEQ ID NO: 548971 - DNA, 19 bp, Homo sapiens
ccgctctgccatcagcccc

SEQ ID NO: 548972 - DNA, 22 bp, Homo sapiens
ccgctctgccatcagcccctgc

SEQ ID NO: 548973 - DNA, 20 bp, Homo sapiens
ccggaatcctgtcctcagct

SEQ ID NO: 548974 - DNA, 19 bp, Homo sapiens
ccggcctggggccgggctg

SEQ ID NO: 548975 - DNA, 20 bp, Homo sapiens
ccgggagatccgccctgggc

SEQ ID NO: 548976 - DNA, 20 bp, Homo sapiens
ccgggcagagcacagcgggg

SEQ ID NO: 548977 - DNA, 19 bp, Homo sapiens
ccgggctggcttctccctg

SEQ ID NO: 548978 - DNA, 18 bp, Homo sapiens
ccggggccatggaagctg

SEQ ID NO: 548979 - DNA, 21 bp, Homo sapiens
ccgggtcttcctactcttctc

SEQ ID NO: 548980 - DNA, 21 bp, Homo sapiens
ccgggtgccccccatgccctc

SEQ ID NO: 548981 - DNA, 22 bp, Homo sapiens
ccgggtgccccccatgccctcc

SEQ ID NO: 548982 - DNA, 12 bp, Homo sapiens
ccgtaaggcaag

SEQ ID NO: 548983 - DNA, 19 bp, Homo sapiens
ccgtctttcttttatactg

SEQ ID NO: 548984 - DNA, 15 bp, Homo sapiens
ccgtgcacggggcca

SEQ ID NO: 548985 - DNA, 18 bp, Homo sapiens
ccgtgtttgtctcttctg

SEQ ID NO: 548986 - DNA, 20 bp, Homo sapiens
cctaaagatggcgcacccgg

SEQ ID NO: 548987 - DNA, 16 bp, Homo sapiens
cctaactgaagagaca

SEQ ID NO: 548988 - DNA, 13 bp, Homo sapiens
cctaagagattta

SEQ ID NO: 548989 - DNA, 18 bp, Homo sapiens
cctaagagatttatcttt

SEQ ID NO: 548990 - DNA, 19 bp, Homo sapiens
cctaagtaaatctaaatta

SEQ ID NO: 548991 - DNA, 21 bp, Homo sapiens
cctaatattgaaaatgtcact

SEQ ID NO: 548992 - DNA, 23 bp, Homo sapiens
cctaatattgaaaatgtcactgt

SEQ ID NO: 548993 - DNA, 18 bp, Homo sapiens
cctaatcactcagagcag

SEQ ID NO: 548994 - DNA, 23 bp, Homo sapiens
cctaattagagcagatgacccct

SEQ ID NO: 548995 - DNA, 11 bp, Homo sapiens
cctacagcaga

SEQ ID NO: 548996 - DNA, 20 bp, Homo sapiens
cctaccggcaatttccggcc

SEQ ID NO: 548997 - DNA, 21 bp, Homo sapiens
cctaccggcaatttccggcca

SEQ ID NO: 548998 - DNA, 17 bp, Homo sapiens
cctactagggacctggg

SEQ ID NO: 548999 - DNA, 18 bp, Homo sapiens
cctactcttctctctgct

SEQ ID NO: 549000 - DNA, 14 bp, Homo sapiens
cctaggagtacaag

SEQ ID NO: 549001 - DNA, 23 bp, Homo sapiens
cctaggtagccccctcttccctg

SEQ ID NO: 549002 - DNA, 20 bp, Homo sapiens
cctagtggcttcagcccctg

SEQ ID NO: 549003 - DNA, 22 bp, Homo sapiens
cctagtggcttcagcccctggg

SEQ ID NO: 549004 - DNA, 22 bp, Homo sapiens
cctatagattgatttacctttg

SEQ ID NO: 549005 - DNA, 23 bp, Homo sapiens
cctatctggaaaaaaaaaaatat

SEQ ID NO: 549006 - DNA, 16 bp, Homo sapiens
cctatctggggagctc

SEQ ID NO: 549007 - DNA, 19 bp, Homo sapiens
cctatctggggagctcctg

SEQ ID NO: 549008 - DNA, 21 bp, Homo sapiens
cctatctggggagctcctggc

SEQ ID NO: 549009 - DNA, 12 bp, Homo sapiens
cctatgcctttt

SEQ ID NO: 549010 - DNA, 20 bp, Homo sapiens
cctattctatccatctcctg

SEQ ID NO: 549011 - DNA, 24 bp, Homo sapiens
cctattgctgtaaataaaaatagc

SEQ ID NO: 549012 - DNA, 21 bp, Homo sapiens
cctcacagagtatgatctcag

SEQ ID NO: 549013 - DNA, 14 bp, Homo sapiens
cctcacccctgcag

SEQ ID NO: 549014 - DNA, 23 bp, Homo sapiens
cctcacccggtgacctctagccc

SEQ ID NO: 549015 - DNA, 17 bp, Homo sapiens
cctcaggaccctcgctg

SEQ ID NO: 549016 - DNA, 18 bp, Homo sapiens
cctcaggaccctcgctgg

SEQ ID NO: 549017 - DNA, 19 bp, Homo sapiens
cctcaggaccctcgctggc

SEQ ID NO: 549018 - DNA, 21 bp, Homo sapiens
cctcaggaccctcgctggccc

SEQ ID NO: 549019 - DNA, 22 bp, Homo sapiens
cctcaggaccctcgctggcccc

SEQ ID NO: 549020 - DNA, 15 bp, Homo sapiens
cctcatgggagtcag

SEQ ID NO: 549021 - DNA, 15 bp, Homo sapiens
cctcattccctcgtc

SEQ ID NO: 549022 - DNA, 21 bp, Homo sapiens
cctcatttaaacccaatcaga

SEQ ID NO: 549023 - DNA, 20 bp, Homo sapiens
cctccagccacttatttcca

SEQ ID NO: 549024 - DNA, 20 bp, Homo sapiens
cctccatcctcctccttcct

SEQ ID NO: 549025 - DNA, 21 bp, Homo sapiens
cctccatcctcctccttccta

SEQ ID NO: 549026 - DNA, 12 bp, Homo sapiens
cctcccagatcc

SEQ ID NO: 549027 - DNA, 13 bp, Homo sapiens
cctcccagatcca

SEQ ID NO: 549028 - DNA, 22 bp, Homo sapiens
cctcccagatccaggaacacat

SEQ ID NO: 549029 - DNA, 21 bp, Homo sapiens
cctccccctccttcccagctg

SEQ ID NO: 549030 - DNA, 14 bp, Homo sapiens
cctcccctggtcct

SEQ ID NO: 549031 - DNA, 22 bp, Homo sapiens
cctcccctggtcctgcactgtc

SEQ ID NO: 549032 - DNA, 14 bp, Homo sapiens
cctcccggccctgc

SEQ ID NO: 549033 - DNA, 13 bp, Homo sapiens
cctccctgccagt

SEQ ID NO: 549034 - DNA, 14 bp, Homo sapiens
cctccctgctgcca

SEQ ID NO: 549035 - DNA, 15 bp, Homo sapiens
cctccctgctgccag

SEQ ID NO: 549036 - DNA, 22 bp, Homo sapiens
cctccctgctgccaggctccca

SEQ ID NO: 549037 - DNA, 22 bp, Homo sapiens
cctccctgctgtcattgcttct

SEQ ID NO: 549038 - DNA, 17 bp, Homo sapiens
cctccctgggggcccca

SEQ ID NO: 549039 - DNA, 21 bp, Homo sapiens
cctccctgggggccccaggat

SEQ ID NO: 549040 - DNA, 16 bp, Homo sapiens
cctccctgtctgtctg

SEQ ID NO: 549041 - DNA, 21 bp, Homo sapiens
cctccgcgggggacaggaaca

SEQ ID NO: 549042 - DNA, 16 bp, Homo sapiens
cctccgggtcttccta

SEQ ID NO: 549043 - DNA, 16 bp, Homo sapiens
cctcctttaccctcat

SEQ ID NO: 549044 - DNA, 19 bp, Homo sapiens
cctcctttaccctcatctg

SEQ ID NO: 549045 - DNA, 19 bp, Homo sapiens
cctcgcaggcctccctgcc

SEQ ID NO: 549046 - DNA, 23 bp, Homo sapiens
cctcgcaggcctccctgccagta

SEQ ID NO: 549047 - DNA, 16 bp, Homo sapiens
cctcgctggcccccac

SEQ ID NO: 549048 - DNA, 20 bp, Homo sapiens
cctcgctggcccccactggc

SEQ ID NO: 549049 - DNA, 14 bp, Homo sapiens
cctcgcttctttca

SEQ ID NO: 549050 - DNA, 18 bp, Homo sapiens
cctcggccagagctccca

SEQ ID NO: 549051 - DNA, 22 bp, Homo sapiens
cctcggccagagctcccaggac

SEQ ID NO: 549052 - DNA, 21 bp, Homo sapiens
cctcggtaaaccgaggaccca

SEQ ID NO: 549053 - DNA, 14 bp, Homo sapiens
cctcgtctttccca

SEQ ID NO: 549054 - DNA, 18 bp, Homo sapiens
cctctaggtaaactagca

SEQ ID NO: 549055 - DNA, 18 bp, Homo sapiens
cctctccccgcagtgttt

SEQ ID NO: 549056 - DNA, 18 bp, Homo sapiens
cctctcttggaactgcac

SEQ ID NO: 549057 - DNA, 18 bp, Homo sapiens
cctctgaactgctgctgg

SEQ ID NO: 549058 - DNA, 17 bp, Homo sapiens
cctctgatgtattttgt

SEQ ID NO: 549059 - DNA, 23 bp, Homo sapiens
cctctgattctatgtaacttgtt

SEQ ID NO: 549060 - DNA, 15 bp, Homo sapiens
cctctgcccttgggg

SEQ ID NO: 549061 - DNA, 12 bp, Homo sapiens
cctctgctaaat

SEQ ID NO: 549062 - DNA, 11 bp, Homo sapiens
cctctggggag

SEQ ID NO: 549063 - DNA, 14 bp, Homo sapiens
cctctgtccccgag

SEQ ID NO: 549064 - DNA, 23 bp, Homo sapiens
cctctgtgaggaaagcacacagt

SEQ ID NO: 549065 - DNA, 16 bp, Homo sapiens
cctctttcccttccag

SEQ ID NO: 549066 - DNA, 18 bp, Homo sapiens
cctctttcccttccagtt

SEQ ID NO: 549067 - DNA, 21 bp, Homo sapiens
ctaactctgatgtaaatgaag

SEQ ID NO: 549068 - DNA, 16 bp, Homo sapiens
ctaacttctaaaactg

SEQ ID NO: 549069 - DNA, 19 bp, Homo sapiens
ctaacttgcttaaatgtga

SEQ ID NO: 549070 - DNA, 18 bp, Homo sapiens
ctaagaaacattggaagc

SEQ ID NO: 549071 - DNA, 22 bp, Homo sapiens
ctaagaaacattggaagcaggt

SEQ ID NO: 549072 - DNA, 12 bp, Homo sapiens
ctaagagattta

SEQ ID NO: 549073 - DNA, 14 bp, Homo sapiens
ctaagagcctctgg

SEQ ID NO: 549074 - DNA, 22 bp, Homo sapiens
ctaagataattaaatgaaatac

SEQ ID NO: 549075 - DNA, 13 bp, Homo sapiens
ctaagatgttata

SEQ ID NO: 549076 - DNA, 21 bp, Homo sapiens
ctaaggtcagtgttataaaat

SEQ ID NO: 549077 - DNA, 17 bp, Homo sapiens
ctaagtaaatctcttct

SEQ ID NO: 549078 - DNA, 23 bp, Homo sapiens
ctaagtaaatctcttctgtgttt

SEQ ID NO: 549079 - DNA, 18 bp, Homo sapiens
ctaagtctcttttttaca

SEQ ID NO: 549080 - DNA, 14 bp, Homo sapiens
ctaatatacagtgt

SEQ ID NO: 549081 - DNA, 14 bp, Homo sapiens
ctaatattgaaaat

SEQ ID NO: 549082 - DNA, 20 bp, Homo sapiens
ctaatattgaaaatgtcact

SEQ ID NO: 549083 - DNA, 16 bp, Homo sapiens
ctaatgacaagtgact

SEQ ID NO: 549084 - DNA, 19 bp, Homo sapiens
ctaatgagtttcttttata

SEQ ID NO: 549085 - DNA, 19 bp, Homo sapiens
ctaatggtaacttttgtag

SEQ ID NO: 549086 - DNA, 22 bp, Homo sapiens
ctaatgtttaagcagaattgga

SEQ ID NO: 549087 - DNA, 13 bp, Homo sapiens
ctaattaaactga

SEQ ID NO: 549088 - DNA, 13 bp, Homo sapiens
ctaattaatttca

SEQ ID NO: 549089 - DNA, 16 bp, Homo sapiens
ctaattttgttttaaa

SEQ ID NO: 549090 - DNA, 22 bp, Homo sapiens
ctacaatttgttaattcctatg

SEQ ID NO: 549091 - DNA, 22 bp, Homo sapiens
ctacagaatactagccagagct

SEQ ID NO: 549092 - DNA, 11 bp, Homo sapiens
ctacagcagat

SEQ ID NO: 549093 - DNA, 14 bp, Homo sapiens
ctacagcagatcca

SEQ ID NO: 549094 - DNA, 19 bp, Homo sapiens
ctacagctcccccagctcc

SEQ ID NO: 549095 - DNA, 22 bp, Homo sapiens
ctacagtagctgtggggagctg

SEQ ID NO: 549096 - DNA, 23 bp, Homo sapiens
ctacagtagctgtggggagctgg

SEQ ID NO: 549097 - DNA, 17 bp, Homo sapiens
ctacatgtgggagcttt

SEQ ID NO: 549098 - DNA, 23 bp, Homo sapiens
ctaccaactttcaagaacttgtt

SEQ ID NO: 549099 - DNA, 11 bp, Homo sapiens
ctacctgcagg

SEQ ID NO: 549100 - DNA, 22 bp, Homo sapiens
ctacctttaatcaggtcctgct

SEQ ID NO: 549101 - DNA, 21 bp, Homo sapiens
ctacctttggcttaattccaa

SEQ ID NO: 549102 - DNA, 18 bp, Homo sapiens
ctactaaaaatacaaaca

SEQ ID NO: 549103 - DNA, 14 bp, Homo sapiens
ctactgaataaatc

SEQ ID NO: 549104 - DNA, 17 bp, Homo sapiens
ctactgggtgtagactg

SEQ ID NO: 549105 - DNA, 15 bp, Homo sapiens
ctactgttcctttca

SEQ ID NO: 549106 - DNA, 13 bp, Homo sapiens
ctacttacacatc

SEQ ID NO: 549107 - DNA, 16 bp, Homo sapiens
ctacttagcacttcag

SEQ ID NO: 549108 - DNA, 14 bp, Homo sapiens
ctacttatattctg

SEQ ID NO: 549109 - DNA, 20 bp, Homo sapiens
ctactttaaattgtggatga

SEQ ID NO: 549110 - DNA, 21 bp, Homo sapiens
ctagaaagagaaaaagccctc

SEQ ID NO: 549111 - DNA, 13 bp, Homo sapiens
ctagacacacaaa

SEQ ID NO: 549112 - DNA, 18 bp, Homo sapiens
ctagacattattttgtat

SEQ ID NO: 549113 - DNA, 21 bp, Homo sapiens
ctagagaagtggactggagga

SEQ ID NO: 549114 - DNA, 23 bp, Homo sapiens
ctagagaagtggactggaggagc

SEQ ID NO: 549115 - DNA, 14 bp, Homo sapiens
ctagcacagctccc

SEQ ID NO: 549116 - DNA, 17 bp, Homo sapiens
ctagcacagctcccttc

SEQ ID NO: 549117 - DNA, 13 bp, Homo sapiens
ctagcacttcctt

SEQ ID NO: 549118 - DNA, 15 bp, Homo sapiens
ctagcatatatgtgt

SEQ ID NO: 549119 - DNA, 13 bp, Homo sapiens
ctagccctgcccg

SEQ ID NO: 549120 - DNA, 16 bp, Homo sapiens
ctagcgtagtgcagca

SEQ ID NO: 549121 - DNA, 13 bp, Homo sapiens
ctaggacccccag

SEQ ID NO: 549122 - DNA, 17 bp, Homo sapiens
ctaggcagggtgtctgc

SEQ ID NO: 549123 - DNA, 13 bp, Homo sapiens
ctaggctccttca

SEQ ID NO: 549124 - DNA, 19 bp, Homo sapiens
ctaggtagccccctcttcc

SEQ ID NO: 549125 - DNA, 18 bp, Homo sapiens
ctagtggcttcagcccct

SEQ ID NO: 549126 - DNA, 12 bp, Homo sapiens
ctagttatttat

SEQ ID NO: 549127 - DNA, 16 bp, Homo sapiens
ctagttatttattctg

SEQ ID NO: 549128 - DNA, 20 bp, Homo sapiens
ctagttatttattctgggaa

SEQ ID NO: 549129 - DNA, 16 bp, Homo sapiens
ctagttcatcccttct

SEQ ID NO: 549130 - DNA, 23 bp, Homo sapiens
ctagttcatcccttctcttccag

SEQ ID NO: 549131 - DNA, 18 bp, Homo sapiens
ctagttctttgcattcgt

SEQ ID NO: 549132 - DNA, 22 bp, Homo sapiens
ctataaaagcccatgcttaaat

SEQ ID NO: 549133 - DNA, 17 bp, Homo sapiens
ctatagaaagtgttctg

SEQ ID NO: 549134 - DNA, 22 bp, Homo sapiens
ctatatacatgtgtgtatatat

SEQ ID NO: 549135 - DNA, 15 bp, Homo sapiens
ctatatatataaata

SEQ ID NO: 549136 - DNA, 20 bp, Homo sapiens
ctatatcatgctttaaagtg

SEQ ID NO: 549137 - DNA, 21 bp, Homo sapiens
ctatcagcagcggcagcagca

SEQ ID NO: 549138 - DNA, 20 bp, Homo sapiens
ctatctcccacaaataagtt

SEQ ID NO: 549139 - DNA, 22 bp, Homo sapiens
ctatctggaaaaaaaaaaatat

SEQ ID NO: 549140 - DNA, 16 bp, Homo sapiens
ctatctggggagctcc

SEQ ID NO: 549141 - DNA, 22 bp, Homo sapiens
ctatctggggagctcctggcca

SEQ ID NO: 549142 - DNA, 23 bp, Homo sapiens
ctatgatattccccatttcctgt

SEQ ID NO: 549143 - DNA, 18 bp, Homo sapiens
ctatgccctgttaaatgg

SEQ ID NO: 549144 - DNA, 14 bp, Homo sapiens
ctatgccttttgta

SEQ ID NO: 549145 - DNA, 15 bp, Homo sapiens
ctatgccttttgtag

SEQ ID NO: 549146 - DNA, 18 bp, Homo sapiens
ctatgccttttgtagctg

SEQ ID NO: 549147 - DNA, 14 bp, Homo sapiens
ctatggaagccaca

SEQ ID NO: 549148 - DNA, 16 bp, Homo sapiens
ctatggacaatttacc

SEQ ID NO: 549149 - DNA, 15 bp, Homo sapiens
ctatgtctcatgttt

SEQ ID NO: 549150 - DNA, 21 bp, Homo sapiens
ctatttaagtggactgtattt

SEQ ID NO: 549151 - DNA, 19 bp, Homo sapiens
ctatttatgagatcactga

SEQ ID NO: 549152 - DNA, 16 bp, Homo sapiens
ctatttgtgtaactga

SEQ ID NO: 549153 - DNA, 21 bp, Homo sapiens
ctattttactgtcttaattaa

SEQ ID NO: 549154 - DNA, 23 bp, Homo sapiens
ctcaaaataaaaccagaaagagg

SEQ ID NO: 549155 - DNA, 14 bp, Homo sapiens
ctcaaagaggcagt

SEQ ID NO: 549156 - DNA, 15 bp, Homo sapiens
ctcaaaggagctttc

SEQ ID NO: 549157 - DNA, 19 bp, Homo sapiens
ctcaaaggagctttctcaa

SEQ ID NO: 549158 - DNA, 22 bp, Homo sapiens
ctcaacggaagccccctcttcc

SEQ ID NO: 549159 - DNA, 21 bp, Homo sapiens
ctcaagccaccagatgtgaca

SEQ ID NO: 549160 - DNA, 16 bp, Homo sapiens
ctcaagcccaggaggg

SEQ ID NO: 549161 - DNA, 16 bp, Homo sapiens
ctcaatgtcttcccac

SEQ ID NO: 549162 - DNA, 22 bp, Homo sapiens
ctccacctgggagatgctggga

SEQ ID NO: 549163 - DNA, 19 bp, Homo sapiens
ctccacgggggcctagtgg

SEQ ID NO: 549164 - DNA, 14 bp, Homo sapiens
ctccacttcatcca

SEQ ID NO: 549165 - DNA, 19 bp, Homo sapiens
ctccagaactcttcctcca

SEQ ID NO: 549166 - DNA, 16 bp, Homo sapiens
ctccagaagcagcagc

SEQ ID NO: 549167 - DNA, 17 bp, Homo sapiens
ctccagaagcagcagct

SEQ ID NO: 549168 - DNA, 12 bp, Homo sapiens
ctccaggcagca

SEQ ID NO: 549169 - DNA, 23 bp, Homo sapiens
ctccaggctccctccctcccaga

SEQ ID NO: 549170 - DNA, 10 bp, Homo sapiens
ctccagggct

SEQ ID NO: 549171 - DNA, 19 bp, Homo sapiens
ctccagtacaataaataaa

SEQ ID NO: 549172 - DNA, 14 bp, Homo sapiens
ctccagtccccaga

SEQ ID NO: 549173 - DNA, 16 bp, Homo sapiens
ctccagtccccagaac

SEQ ID NO: 549174 - DNA, 20 bp, Homo sapiens
ctccagtcttccacctggaa

SEQ ID NO: 549175 - DNA, 16 bp, Homo sapiens
ctccatcctcctcctt

SEQ ID NO: 549176 - DNA, 17 bp, Homo sapiens
ctccatcctcctccttc

SEQ ID NO: 549177 - DNA, 19 bp, Homo sapiens
ctccatgattccaagggcc

SEQ ID NO: 549178 - DNA, 22 bp, Homo sapiens
ctccatggtgaactgaagcaga

SEQ ID NO: 549179 - DNA, 22 bp, Homo sapiens
ctcccaaaagtatcgggggctg

SEQ ID NO: 549180 - DNA, 12 bp, Homo sapiens
ctcccagatcca

SEQ ID NO: 549181 - DNA, 16 bp, Homo sapiens
ctcccaggacgcaggg

SEQ ID NO: 549182 - DNA, 22 bp, Homo sapiens
ctcccagggtcctgggggctgc

SEQ ID NO: 549183 - DNA, 21 bp, Homo sapiens
ctccccatggctcctcaccac

SEQ ID NO: 549184 - DNA, 14 bp, Homo sapiens
ctccccctccttcc

SEQ ID NO: 549185 - DNA, 14 bp, Homo sapiens
ctcccccttttccc

SEQ ID NO: 549186 - DNA, 20 bp, Homo sapiens
ctccccgcagtgtttgtgtg

SEQ ID NO: 549187 - DNA, 15 bp, Homo sapiens
ctcccctaatgcctg

SEQ ID NO: 549188 - DNA, 14 bp, Homo sapiens
ctcccctggtcctg

SEQ ID NO: 549189 - DNA, 16 bp, Homo sapiens
ctcccctggtcctgca

SEQ ID NO: 549190 - DNA, 14 bp, Homo sapiens
ctcccctgtgccag

SEQ ID NO: 549191 - DNA, 16 bp, Homo sapiens
ctccccttccatttct

SEQ ID NO: 549192 - DNA, 12 bp, Homo sapiens
ctccccttcccc

SEQ ID NO: 549193 - DNA, 15 bp, Homo sapiens
ctcccgctccgggct

SEQ ID NO: 549194 - DNA, 15 bp, Homo sapiens
ctccctccctcccag

SEQ ID NO: 549195 - DNA, 12 bp, Homo sapiens
ctccctgatgta

SEQ ID NO: 549196 - DNA, 18 bp, Homo sapiens
ctccctgccagcaccccc

SEQ ID NO: 549197 - DNA, 15 bp, Homo sapiens
ctccctgctgccagg

SEQ ID NO: 549198 - DNA, 22 bp, Homo sapiens
ctccctgctgccaggctcccac

SEQ ID NO: 549199 - DNA, 16 bp, Homo sapiens
ctccctggactctgtg

SEQ ID NO: 549200 - DNA, 22 bp, Homo sapiens
ctccctggactctgtggggcca

SEQ ID NO: 549201 - DNA, 14 bp, Homo sapiens
ctcccttcctccca

SEQ ID NO: 549202 - DNA, 22 bp, Homo sapiens
ctccgacttgtgcacaggcaga

SEQ ID NO: 549203 - DNA, 13 bp, Homo sapiens
ctccgccatccac

SEQ ID NO: 549204 - DNA, 14 bp, Homo sapiens
ctccgcccttccct

SEQ ID NO: 549205 - DNA, 18 bp, Homo sapiens
ctccgtcctggcagggca

SEQ ID NO: 549206 - DNA, 14 bp, Homo sapiens
ctcctatcttcata

SEQ ID NO: 549207 - DNA, 17 bp, Homo sapiens
ctcctatcttcatatct

SEQ ID NO: 549208 - DNA, 23 bp, Homo sapiens
ctcctcaattccagggaaccaga

SEQ ID NO: 549209 - DNA, 17 bp, Homo sapiens
ctcctccagtacaataa

SEQ ID NO: 549210 - DNA, 13 bp, Homo sapiens
ctcctccttccta

SEQ ID NO: 549211 - DNA, 13 bp, Homo sapiens
ctcctcggccaga

SEQ ID NO: 549212 - DNA, 15 bp, Homo sapiens
ctcctcggccagagc

SEQ ID NO: 549213 - DNA, 22 bp, Homo sapiens
ctcctgagttgaagtcatgctc

SEQ ID NO: 549214 - DNA, 13 bp, Homo sapiens
ctcctgcccccac

SEQ ID NO: 549215 - DNA, 20 bp, Homo sapiens
ctcctgcccccacacctggc

SEQ ID NO: 549216 - DNA, 23 bp, Homo sapiens
ctcctgcccccacacctggccct

SEQ ID NO: 549217 - DNA, 12 bp, Homo sapiens
ctcctgctgcca

SEQ ID NO: 549218 - DNA, 14 bp, Homo sapiens
ctcctgctgccagt

SEQ ID NO: 549219 - DNA, 15 bp, Homo sapiens
ctcctgggccagggt

SEQ ID NO: 549220 - DNA, 18 bp, Homo sapiens
ctcctgtggcctgccagt

SEQ ID NO: 549221 - DNA, 22 bp, Homo sapiens
ctccttacagaagggagtgaaa

SEQ ID NO: 549222 - DNA, 18 bp, Homo sapiens
ctccttagggttttctct

SEQ ID NO: 549223 - DNA, 15 bp, Homo sapiens
ctccttcccactctt

SEQ ID NO: 549224 - DNA, 20 bp, Homo sapiens
ctgatatctgtttgcttcta

SEQ ID NO: 549225 - DNA, 22 bp, Homo sapiens
ctgatatctgtttgcttctaaa

SEQ ID NO: 549226 - DNA, 14 bp, Homo sapiens
ctgatcccttccac

SEQ ID NO: 549227 - DNA, 18 bp, Homo sapiens
ctgatcccttccacctgc

SEQ ID NO: 549228 - DNA, 21 bp, Homo sapiens
ctgatcctaactgaagagaca

SEQ ID NO: 549229 - DNA, 19 bp, Homo sapiens
ctgatgaagttaagcacaa

SEQ ID NO: 549230 - DNA, 21 bp, Homo sapiens
ctgatgggtatcatgcttcta

SEQ ID NO: 549231 - DNA, 17 bp, Homo sapiens
ctgatgtattttgtgag

SEQ ID NO: 549232 - DNA, 16 bp, Homo sapiens
ctgatgtgttgccact

SEQ ID NO: 549233 - DNA, 18 bp, Homo sapiens
ctgattggtttctcttct

SEQ ID NO: 549234 - DNA, 19 bp, Homo sapiens
ctgattggtttctcttctc

SEQ ID NO: 549235 - DNA, 14 bp, Homo sapiens
ctgatttattctgg

SEQ ID NO: 549236 - DNA, 14 bp, Homo sapiens
ctgcaaaaccaggt

SEQ ID NO: 549237 - DNA, 13 bp, Homo sapiens
ctgcaattcaact

SEQ ID NO: 549238 - DNA, 19 bp, Homo sapiens
ctgcacaaacatagacaga

SEQ ID NO: 549239 - DNA, 22 bp, Homo sapiens
ctgcacaaacatagacagatgt

SEQ ID NO: 549240 - DNA, 18 bp, Homo sapiens
ctgcacatgatttcacaa

SEQ ID NO: 549241 - DNA, 21 bp, Homo sapiens
ctgcacatgatttcacaaata

SEQ ID NO: 549242 - DNA, 22 bp, Homo sapiens
ctgcacatgatttcacaaatat

SEQ ID NO: 549243 - DNA, 16 bp, Homo sapiens
ctgcacctgcttctca

SEQ ID NO: 549244 - DNA, 18 bp, Homo sapiens
ctgcacctgcttctcagc

SEQ ID NO: 549245 - DNA, 16 bp, Homo sapiens
ctgcactctagccgga

SEQ ID NO: 549246 - DNA, 22 bp, Homo sapiens
ctgcagaaaattaattgaaata

SEQ ID NO: 549247 - DNA, 17 bp, Homo sapiens
ctgcagagacagagagg

SEQ ID NO: 549248 - DNA, 11 bp, Homo sapiens
ctgcagagcct

SEQ ID NO: 549249 - DNA, 21 bp, Homo sapiens
ctgcagatactactgaccaga

SEQ ID NO: 549250 - DNA, 15 bp, Homo sapiens
ctgcaggaatcaaaa

SEQ ID NO: 549251 - DNA, 19 bp, Homo sapiens
ctgcaggcggtatccagag

SEQ ID NO: 549252 - DNA, 16 bp, Homo sapiens
ctgcagtcatctcccc

SEQ ID NO: 549253 - DNA, 13 bp, Homo sapiens
ctgcagtgttctg

SEQ ID NO: 549254 - DNA, 14 bp, Homo sapiens
ctgcataaccgcac

SEQ ID NO: 549255 - DNA, 14 bp, Homo sapiens
ctgcatatcttcat

SEQ ID NO: 549256 - DNA, 22 bp, Homo sapiens
ctgcatggcacataccaaagct

SEQ ID NO: 549257 - DNA, 18 bp, Homo sapiens
ctgcattgggtgatcatt

SEQ ID NO: 549258 - DNA, 18 bp, Homo sapiens
ctgcatttggggtggggg

SEQ ID NO: 549259 - DNA, 12 bp, Homo sapiens
ctgccaagagag

SEQ ID NO: 549260 - DNA, 16 bp, Homo sapiens
ctgccagcacccccac

SEQ ID NO: 549261 - DNA, 23 bp, Homo sapiens
ctgccaggctcccactgcccctg

SEQ ID NO: 549262 - DNA, 22 bp, Homo sapiens
ctgccagtggggcctgaggctc

SEQ ID NO: 549263 - DNA, 16 bp, Homo sapiens
ctgccatcagcccctg

SEQ ID NO: 549264 - DNA, 19 bp, Homo sapiens
ctgccatcagcccctgctg

SEQ ID NO: 549265 - DNA, 18 bp, Homo sapiens
ctgccatgaactggaggc

SEQ ID NO: 549266 - DNA, 17 bp, Homo sapiens
ctgccatggaggcacac

SEQ ID NO: 549267 - DNA, 22 bp, Homo sapiens
ctgcccagatcagccagaagcc

SEQ ID NO: 549268 - DNA, 15 bp, Homo sapiens
ctgccccaagttttg

SEQ ID NO: 549269 - DNA, 15 bp, Homo sapiens
ctgcccccagacccc

SEQ ID NO: 549270 - DNA, 14 bp, Homo sapiens
ctgccccctcctga

SEQ ID NO: 549271 - DNA, 15 bp, Homo sapiens
ctgcccggcccagga

SEQ ID NO: 549272 - DNA, 17 bp, Homo sapiens
ctgcccggcccaggagc

SEQ ID NO: 549273 - DNA, 18 bp, Homo sapiens
ctgcccggcccaggagcg

SEQ ID NO: 549274 - DNA, 21 bp, Homo sapiens
ctgcccggtgggggggcagag

SEQ ID NO: 549275 - DNA, 20 bp, Homo sapiens
ctgccctgtcaggaggcaga

SEQ ID NO: 549276 - DNA, 22 bp, Homo sapiens
ctgcctgaggggcagcctgcct

SEQ ID NO: 549277 - DNA, 21 bp, Homo sapiens
ctgcctgccctgtcaggaggc

SEQ ID NO: 549278 - DNA, 21 bp, Homo sapiens
ctgcctggtctcctgccccca

SEQ ID NO: 549279 - DNA, 15 bp, Homo sapiens
ctgcctgtcaagttt

SEQ ID NO: 549280 - DNA, 22 bp, Homo sapiens
ctgcctgtggtgaggtcctgtc

SEQ ID NO: 549281 - DNA, 14 bp, Homo sapiens
ctgccttccaggcg

SEQ ID NO: 549282 - DNA, 22 bp, Homo sapiens
ctgccttccaggcgtagggcca

SEQ ID NO: 549283 - DNA, 17 bp, Homo sapiens
ctgccttgcccactcct

SEQ ID NO: 549284 - DNA, 22 bp, Homo sapiens
ctgccttgcccactcctgctct

SEQ ID NO: 549285 - DNA, 20 bp, Homo sapiens
ctgccttggggtcaggttga

SEQ ID NO: 549286 - DNA, 13 bp, Homo sapiens
ctgccttttgttc

SEQ ID NO: 549287 - DNA, 14 bp, Homo sapiens
ctgcgcaggccctc

SEQ ID NO: 549288 - DNA, 13 bp, Homo sapiens
ctgcgtggcctgg

SEQ ID NO: 549289 - DNA, 14 bp, Homo sapiens
ctgcgtggcctggg

SEQ ID NO: 549290 - DNA, 16 bp, Homo sapiens
ctgcgtggcctggggc

SEQ ID NO: 549291 - DNA, 20 bp, Homo sapiens
ctgcgtggctgacccccctc

SEQ ID NO: 549292 - DNA, 23 bp, Homo sapiens
ctgcgtggctgacccccctcagg

SEQ ID NO: 549293 - DNA, 17 bp, Homo sapiens
ctgctaaattgatgttg

SEQ ID NO: 549294 - DNA, 18 bp, Homo sapiens
ctgctacagtagctgtgg

SEQ ID NO: 549295 - DNA, 15 bp, Homo sapiens
ctgctattttactgt

SEQ ID NO: 549296 - DNA, 13 bp, Homo sapiens
ctgctcatccact

SEQ ID NO: 549297 - DNA, 14 bp, Homo sapiens
ctgctccagctctg

SEQ ID NO: 549298 - DNA, 14 bp, Homo sapiens
ctgctccccctttt

SEQ ID NO: 549299 - DNA, 17 bp, Homo sapiens
ctgctcctcggccagag

SEQ ID NO: 549300 - DNA, 20 bp, Homo sapiens
ctgctcctcggccagagctc

SEQ ID NO: 549301 - DNA, 22 bp, Homo sapiens
ctgctcctcggccagagctccc

SEQ ID NO: 549302 - DNA, 23 bp, Homo sapiens
ctgctcctcggccagagctccca

SEQ ID NO: 549303 - DNA, 16 bp, Homo sapiens
ctgctccttcccttgc

SEQ ID NO: 549304 - DNA, 11 bp, Homo sapiens
ctgctctgacg

SEQ ID NO: 549305 - DNA, 23 bp, Homo sapiens
ctgctctgagttatgttaaaatc

SEQ ID NO: 549306 - DNA, 12 bp, Homo sapiens
ctgctctgctcg

SEQ ID NO: 549307 - DNA, 12 bp, Homo sapiens
ctgctctgctga

SEQ ID NO: 549308 - DNA, 21 bp, Homo sapiens
ctgctgagtccgacctggcct

SEQ ID NO: 549309 - DNA, 12 bp, Homo sapiens
ctgctgcacagc

SEQ ID NO: 549310 - DNA, 20 bp, Homo sapiens
ctgctgcacagctggccacc

SEQ ID NO: 549311 - DNA, 16 bp, Homo sapiens
ctgctgcactgccctc

SEQ ID NO: 549312 - DNA, 17 bp, Homo sapiens
cgactgagggcaggagg

SEQ ID NO: 549313 - DNA, 23 bp, Homo sapiens
cgagcaaagatcaaaataaaaag

SEQ ID NO: 549314 - DNA, 20 bp, Homo sapiens
cgagccgagctctcctgggc

SEQ ID NO: 549315 - DNA, 17 bp, Homo sapiens
cgagctctcctgggcca

SEQ ID NO: 549316 - DNA, 22 bp, Homo sapiens
cgagctctcctgggccagggtc

SEQ ID NO: 549317 - DNA, 23 bp, Homo sapiens
cgagctctcctgggccagggtct

SEQ ID NO: 549318 - DNA, 17 bp, Homo sapiens
cgagtagaggtttaaag

SEQ ID NO: 549319 - DNA, 13 bp, Homo sapiens
cgagtgccccaga

SEQ ID NO: 549320 - DNA, 16 bp, Homo sapiens
cgagtgtggagctgct

SEQ ID NO: 549321 - DNA, 20 bp, Homo sapiens
cgagtgtggagctgcttcca

SEQ ID NO: 549322 - DNA, 17 bp, Homo sapiens
cgagttctctttggaaa

SEQ ID NO: 549323 - DNA, 23 bp, Homo sapiens
cgatgcagacagggggccagaac

SEQ ID NO: 549324 - DNA, 20 bp, Homo sapiens
cgcaaatacatgcctttcca

SEQ ID NO: 549325 - DNA, 20 bp, Homo sapiens
cgcaacagctgtgtgtgccc

SEQ ID NO: 549326 - DNA, 15 bp, Homo sapiens
cgcaagtcacagaaa

SEQ ID NO: 549327 - DNA, 19 bp, Homo sapiens
cgcaattgtatatatatgt

SEQ ID NO: 549328 - DNA, 14 bp, Homo sapiens
cgcacgcacacaca

SEQ ID NO: 549329 - DNA, 15 bp, Homo sapiens
cgcacgcacccacac

SEQ ID NO: 549330 - DNA, 23 bp, Homo sapiens
cgcacgcacccacaccctacagc

SEQ ID NO: 549331 - DNA, 13 bp, Homo sapiens
cgcagacacacac

SEQ ID NO: 549332 - DNA, 18 bp, Homo sapiens
cgcaggcctccctgccag

SEQ ID NO: 549333 - DNA, 13 bp, Homo sapiens
cgcagggagaccc

SEQ ID NO: 549334 - DNA, 14 bp, Homo sapiens
cgcagggagaccct

SEQ ID NO: 549335 - DNA, 16 bp, Homo sapiens
cgcagggagaccctgg

SEQ ID NO: 549336 - DNA, 17 bp, Homo sapiens
cgcagggagaccctggg

SEQ ID NO: 549337 - DNA, 16 bp, Homo sapiens
cgcatgtacaaaaaca

SEQ ID NO: 549338 - DNA, 20 bp, Homo sapiens
cgcatgtacaaaaacacaaa

SEQ ID NO: 549339 - DNA, 21 bp, Homo sapiens
cgcatgtacaaaaacacaaat

SEQ ID NO: 549340 - DNA, 11 bp, Homo sapiens
cgccacatccc

SEQ ID NO: 549341 - DNA, 21 bp, Homo sapiens
cgccactgcactctagccgga

SEQ ID NO: 549342 - DNA, 17 bp, Homo sapiens
cgccagggaccccagaa

SEQ ID NO: 549343 - DNA, 20 bp, Homo sapiens
cgcccaaacctttcccccat

SEQ ID NO: 549344 - DNA, 18 bp, Homo sapiens
cgccctcattacggctcc

SEQ ID NO: 549345 - DNA, 14 bp, Homo sapiens
cgccctggcaggca

SEQ ID NO: 549346 - DNA, 20 bp, Homo sapiens
cgcccttccctgacactgtc

SEQ ID NO: 549347 - DNA, 13 bp, Homo sapiens
cgccgtggctgcg

SEQ ID NO: 549348 - DNA, 17 bp, Homo sapiens
cgcctcggatcagctga

SEQ ID NO: 549349 - DNA, 19 bp, Homo sapiens
cgccttcggcctctcttgg

SEQ ID NO: 549350 - DNA, 22 bp, Homo sapiens
cgccttgtaggtattacatccc

SEQ ID NO: 549351 - DNA, 22 bp, Homo sapiens
cgcgggcagtgacgtgagtggg

SEQ ID NO: 549352 - DNA, 18 bp, Homo sapiens
cgctaacttgcttaaatg

SEQ ID NO: 549353 - DNA, 17 bp, Homo sapiens
cgctagagcagcccaaa

SEQ ID NO: 549354 - DNA, 15 bp, Homo sapiens
cgctctgccatcagc

SEQ ID NO: 549355 - DNA, 13 bp, Homo sapiens
cgctctgctgtgg

SEQ ID NO: 549356 - DNA, 12 bp, Homo sapiens
cgctggccccca

SEQ ID NO: 549357 - DNA, 19 bp, Homo sapiens
cgcttttgctggtcactgc

SEQ ID NO: 549358 - DNA, 18 bp, Homo sapiens
cggaatcctgtcctcagc

SEQ ID NO: 549359 - DNA, 19 bp, Homo sapiens
cggagctgggaaggtcccg

SEQ ID NO: 549360 - DNA, 13 bp, Homo sapiens
cggaggaccaggg

SEQ ID NO: 549361 - DNA, 15 bp, Homo sapiens
cggattgcaaagcaa

SEQ ID NO: 549362 - DNA, 14 bp, Homo sapiens
cggcactatttctg

SEQ ID NO: 549363 - DNA, 11 bp, Homo sapiens
cggcagagagg

SEQ ID NO: 549364 - DNA, 19 bp, Homo sapiens
cggcagccccccagtgtcc

SEQ ID NO: 549365 - DNA, 16 bp, Homo sapiens
cggcagtgcaccccct

SEQ ID NO: 549366 - DNA, 14 bp, Homo sapiens
cggccagagctccc

SEQ ID NO: 549367 - DNA, 13 bp, Homo sapiens
cggccggcctggg

SEQ ID NO: 549368 - DNA, 14 bp, Homo sapiens
cggcctctggggag

SEQ ID NO: 549369 - DNA, 22 bp, Homo sapiens
cggcctggggccgggctggctt

SEQ ID NO: 549370 - DNA, 20 bp, Homo sapiens
cggctccagtccccagaact

SEQ ID NO: 549371 - DNA, 22 bp, Homo sapiens
cggctcctctctaacctccttt

SEQ ID NO: 549372 - DNA, 23 bp, Homo sapiens
cggctcctctctaacctccttta

SEQ ID NO: 549373 - DNA, 15 bp, Homo sapiens
cgggagatccgccct

SEQ ID NO: 549374 - DNA, 16 bp, Homo sapiens
cgggagtagcaaggaa

SEQ ID NO: 549375 - DNA, 19 bp, Homo sapiens
cgggagtagcaaggaagga

SEQ ID NO: 549376 - DNA, 15 bp, Homo sapiens
cgggccccacctgca

SEQ ID NO: 549377 - DNA, 22 bp, Homo sapiens
cgggctccgacttgtgcacagg

SEQ ID NO: 549378 - DNA, 17 bp, Homo sapiens
cgggctgggcagctgtt

SEQ ID NO: 549379 - DNA, 17 bp, Homo sapiens
cggggcaggaagtccct

SEQ ID NO: 549380 - DNA, 14 bp, Homo sapiens
cggggccagctccg

SEQ ID NO: 549381 - DNA, 13 bp, Homo sapiens
cgggggacaggaa

SEQ ID NO: 549382 - DNA, 19 bp, Homo sapiens
cgggggcctagtggcttca

SEQ ID NO: 549383 - DNA, 14 bp, Homo sapiens
cgggggctggggca

SEQ ID NO: 549384 - DNA, 16 bp, Homo sapiens
cggggtcctgaggctg

SEQ ID NO: 549385 - DNA, 18 bp, Homo sapiens
cggggtcctgaggctggg

SEQ ID NO: 549386 - DNA, 16 bp, Homo sapiens
cgggtcttcctactct

SEQ ID NO: 549387 - DNA, 14 bp, Homo sapiens
cgggtgcagcatct

SEQ ID NO: 549388 - DNA, 21 bp, Homo sapiens
cgggtgccccccatgccctcc

SEQ ID NO: 549389 - DNA, 14 bp, Homo sapiens
cggtatccagaggt

SEQ ID NO: 549390 - DNA, 19 bp, Homo sapiens
cggtgacctctagccctgc

SEQ ID NO: 549391 - DNA, 16 bp, Homo sapiens
cggtgggggggcagag

SEQ ID NO: 549392 - DNA, 14 bp, Homo sapiens
cggttaacaaataa

SEQ ID NO: 549393 - DNA, 19 bp, Homo sapiens
cggttaacaaataacaact

SEQ ID NO: 549394 - DNA, 13 bp, Homo sapiens
cggttcagtgttt

SEQ ID NO: 549395 - DNA, 19 bp, Homo sapiens
cggttcagtgtttctgggg

SEQ ID NO: 549396 - DNA, 22 bp, Homo sapiens
cggtttatcgccctggcaggca

SEQ ID NO: 549397 - DNA, 17 bp, Homo sapiens
cgtagtagggtcaggcc

SEQ ID NO: 549398 - DNA, 16 bp, Homo sapiens
cgtatagaagtcttca

SEQ ID NO: 549399 - DNA, 14 bp, Homo sapiens
cgtatatataaaca

SEQ ID NO: 549400 - DNA, 17 bp, Homo sapiens
cgtcactttatttcatt

SEQ ID NO: 549401 - DNA, 18 bp, Homo sapiens
cgtcccaaccctgcccag

SEQ ID NO: 549402 - DNA, 13 bp, Homo sapiens
cgtccccagacca

SEQ ID NO: 549403 - DNA, 15 bp, Homo sapiens
cgtccccagaccagt

SEQ ID NO: 549404 - DNA, 20 bp, Homo sapiens
cgtccccagaccagtagtga

SEQ ID NO: 549405 - DNA, 23 bp, Homo sapiens
cgtccccagaccagtagtgacca

SEQ ID NO: 549406 - DNA, 21 bp, Homo sapiens
cgtccctgagggcccttccca

SEQ ID NO: 549407 - DNA, 23 bp, Homo sapiens
cgtccctgagggcccttcccaac

SEQ ID NO: 549408 - DNA, 15 bp, Homo sapiens
cgtcctggcagggca

SEQ ID NO: 549409 - DNA, 17 bp, Homo sapiens
cgtctaaccacagctcc

SEQ ID NO: 549410 - DNA, 18 bp, Homo sapiens
cgtctaaccacagctcct

SEQ ID NO: 549411 - DNA, 19 bp, Homo sapiens
cgtctaaccacagctcctt

SEQ ID NO: 549412 - DNA, 16 bp, Homo sapiens
cgtctcggccttcaca

SEQ ID NO: 549413 - DNA, 16 bp, Homo sapiens
cgtgacctggtcaggg

SEQ ID NO: 549414 - DNA, 13 bp, Homo sapiens
cgtggcaaatata

SEQ ID NO: 549415 - DNA, 13 bp, Homo sapiens
tcccacagccagt

SEQ ID NO: 549416 - DNA, 15 bp, Homo sapiens
tcccacccagcctgg

SEQ ID NO: 549417 - DNA, 19 bp, Homo sapiens
tcccaccccatcctccagg

SEQ ID NO: 549418 - DNA, 15 bp, Homo sapiens
tcccactgcccctgc

SEQ ID NO: 549419 - DNA, 17 bp, Homo sapiens
tcccacttcaaaacaaa

SEQ ID NO: 549420 - DNA, 23 bp, Homo sapiens
tcccagatccaggaacacatgca

SEQ ID NO: 549421 - DNA, 21 bp, Homo sapiens
tcccagcactttgggaggccg

SEQ ID NO: 549422 - DNA, 18 bp, Homo sapiens
tcccaggacgcagggaga

SEQ ID NO: 549423 - DNA, 23 bp, Homo sapiens
tcccaggacgcagggagaccctg

SEQ ID NO: 549424 - DNA, 23 bp, Homo sapiens
tcccatctttttaacctctgttc

SEQ ID NO: 549425 - DNA, 17 bp, Homo sapiens
tccccaaagtaccacac

SEQ ID NO: 549426 - DNA, 20 bp, Homo sapiens
tccccaaagtaccacactga

SEQ ID NO: 549427 - DNA, 20 bp, Homo sapiens
tccccaaggccccctgcctg

SEQ ID NO: 549428 - DNA, 18 bp, Homo sapiens
tccccagaccagtagtga

SEQ ID NO: 549429 - DNA, 18 bp, Homo sapiens
tccccagcccttcctctg

SEQ ID NO: 549430 - DNA, 22 bp, Homo sapiens
tccccagcccttcctctgctcc

SEQ ID NO: 549431 - DNA, 16 bp, Homo sapiens
tccccaggacttggtc

SEQ ID NO: 549432 - DNA, 21 bp, Homo sapiens
tccccaggccgtggctgccca

SEQ ID NO: 549433 - DNA, 13 bp, Homo sapiens
tccccaggggcac

SEQ ID NO: 549434 - DNA, 17 bp, Homo sapiens
tccccatgctcagctca

SEQ ID NO: 549435 - DNA, 22 bp, Homo sapiens
tccccatttcctgtacaatcat

SEQ ID NO: 549436 - DNA, 13 bp, Homo sapiens
tcccccactccca

SEQ ID NO: 549437 - DNA, 16 bp, Homo sapiens
tcccccaggaccctga

SEQ ID NO: 549438 - DNA, 16 bp, Homo sapiens
tcccccagtccccttc

SEQ ID NO: 549439 - DNA, 18 bp, Homo sapiens
tccccctccttcccagct

SEQ ID NO: 549440 - DNA, 15 bp, Homo sapiens
tccccctttcttcct

SEQ ID NO: 549441 - DNA, 16 bp, Homo sapiens
tccccctttcttcctc

SEQ ID NO: 549442 - DNA, 14 bp, Homo sapiens
tccccgagccgagc

SEQ ID NO: 549443 - DNA, 14 bp, Homo sapiens
tccccggagctggg

SEQ ID NO: 549444 - DNA, 15 bp, Homo sapiens
tccccggagctggga

SEQ ID NO: 549445 - DNA, 13 bp, Homo sapiens
tcccctaatgcct

SEQ ID NO: 549446 - DNA, 13 bp, Homo sapiens
tcccctccctttt

SEQ ID NO: 549447 - DNA, 17 bp, Homo sapiens
tcccctgcctgtgagtg

SEQ ID NO: 549448 - DNA, 20 bp, Homo sapiens
tcccctgcgcaggccctccg

SEQ ID NO: 549449 - DNA, 16 bp, Homo sapiens
tccccttccccttcct

SEQ ID NO: 549450 - DNA, 18 bp, Homo sapiens
tccccttcccgtgacctg

SEQ ID NO: 549451 - DNA, 18 bp, Homo sapiens
tcccgcccaaacctttcc

SEQ ID NO: 549452 - DNA, 19 bp, Homo sapiens
tcccgcccaaacctttccc

SEQ ID NO: 549453 - DNA, 18 bp, Homo sapiens
tcccggagctcaggccct

SEQ ID NO: 549454 - DNA, 14 bp, Homo sapiens
tcccggccctgcct

SEQ ID NO: 549455 - DNA, 14 bp, Homo sapiens
tcccggggccatgg

SEQ ID NO: 549456 - DNA, 22 bp, Homo sapiens
tcccgggtgccccccatgccct

SEQ ID NO: 549457 - DNA, 18 bp, Homo sapiens
tcccgtggctttgtgctt

SEQ ID NO: 549458 - DNA, 13 bp, Homo sapiens
tccctagttcttt

SEQ ID NO: 549459 - DNA, 14 bp, Homo sapiens
tccctcatgcagat

SEQ ID NO: 549460 - DNA, 15 bp, Homo sapiens
tccctcatgcagata

SEQ ID NO: 549461 - DNA, 14 bp, Homo sapiens
tccctcccagatcc

SEQ ID NO: 549462 - DNA, 16 bp, Homo sapiens
tccctcccagatccag

SEQ ID NO: 549463 - DNA, 12 bp, Homo sapiens
tccctccctgct

SEQ ID NO: 549464 - DNA, 20 bp, Homo sapiens
tccctcggagttcttcttga

SEQ ID NO: 549465 - DNA, 18 bp, Homo sapiens
tccctgaattaaggtaat

SEQ ID NO: 549466 - DNA, 16 bp, Homo sapiens
tccctgagggcccttc

SEQ ID NO: 549467 - DNA, 15 bp, Homo sapiens
tccctgatccctgat

SEQ ID NO: 549468 - DNA, 17 bp, Homo sapiens
tccctgatcccttccac

SEQ ID NO: 549469 - DNA, 15 bp, Homo sapiens
tccctgccagcaccc

SEQ ID NO: 549470 - DNA, 15 bp, Homo sapiens
tccctgctgccaggc

SEQ ID NO: 549471 - DNA, 17 bp, Homo sapiens
tccctgctgccaggctc

SEQ ID NO: 549472 - DNA, 17 bp, Homo sapiens
tccctggcttccttact

SEQ ID NO: 549473 - DNA, 17 bp, Homo sapiens
tccctggtaagaaaaag

SEQ ID NO: 549474 - DNA, 21 bp, Homo sapiens
tcccttctcttccaggcagcc

SEQ ID NO: 549475 - DNA, 20 bp, Homo sapiens
tccctttatcatgtgtttct

SEQ ID NO: 549476 - DNA, 23 bp, Homo sapiens
tccctttatcatgtgtttctgtg

SEQ ID NO: 549477 - DNA, 23 bp, Homo sapiens
tccgagtgtgtttcatccttccc

SEQ ID NO: 549478 - DNA, 16 bp, Homo sapiens
tccggggccagctccg

SEQ ID NO: 549479 - DNA, 14 bp, Homo sapiens
tccgggtcttccta

SEQ ID NO: 549480 - DNA, 12 bp, Homo sapiens
tcctaaggcatg

SEQ ID NO: 549481 - DNA, 18 bp, Homo sapiens
tcctaatcactcagagca

SEQ ID NO: 549482 - DNA, 18 bp, Homo sapiens
tcctactcttctctctgc

SEQ ID NO: 549483 - DNA, 19 bp, Homo sapiens
tcctaggacatctctgtaa

SEQ ID NO: 549484 - DNA, 18 bp, Homo sapiens
tcctatgactcaaagatg

SEQ ID NO: 549485 - DNA, 18 bp, Homo sapiens
tcctcaccttctgtttta

SEQ ID NO: 549486 - DNA, 23 bp, Homo sapiens
tcctcattccctcgtctttccca

SEQ ID NO: 549487 - DNA, 16 bp, Homo sapiens
tcctcggccagagctc

SEQ ID NO: 549488 - DNA, 21 bp, Homo sapiens
tcctcggccagagctcccagg

SEQ ID NO: 549489 - DNA, 22 bp, Homo sapiens
tcctcggtaaaccgaggaccca

SEQ ID NO: 549490 - DNA, 18 bp, Homo sapiens
tcctctctaacctccttt

SEQ ID NO: 549491 - DNA, 23 bp, Homo sapiens
tcctctgctaaattgatgttgat

SEQ ID NO: 549492 - DNA, 19 bp, Homo sapiens
tcctctgctcccccttttc

SEQ ID NO: 549493 - DNA, 16 bp, Homo sapiens
tcctcttaactgtggt

SEQ ID NO: 549494 - DNA, 20 bp, Homo sapiens
tcctcttatatgtgcccctt

SEQ ID NO: 549495 - DNA, 23 bp, Homo sapiens
tcctgattggtttctcttctccc

SEQ ID NO: 549496 - DNA, 23 bp, Homo sapiens
tcctgcattgggtgatcattcac

SEQ ID NO: 549497 - DNA, 16 bp, Homo sapiens
tcctgccccatcactt

SEQ ID NO: 549498 - DNA, 23 bp, Homo sapiens
tcctgcccccacacctggccctg

SEQ ID NO: 549499 - DNA, 17 bp, Homo sapiens
tcctgcctggtctcctg

SEQ ID NO: 549500 - DNA, 13 bp, Homo sapiens
tcgggagtagcaa

SEQ ID NO: 549501 - DNA, 20 bp, Homo sapiens
tcgggccccacctgcagctc

SEQ ID NO: 549502 - DNA, 22 bp, Homo sapiens
tcggggcaggaagtccctgaga

SEQ ID NO: 549503 - DNA, 14 bp, Homo sapiens
tcgggggctggggc

SEQ ID NO: 549504 - DNA, 17 bp, Homo sapiens
tcggttcaggaggagac

SEQ ID NO: 549505 - DNA, 16 bp, Homo sapiens
tcgtatagaagtcttc

SEQ ID NO: 549506 - DNA, 20 bp, Homo sapiens
tcgtatagaagtcttcatga

SEQ ID NO: 549507 - DNA, 22 bp, Homo sapiens
tcgtatagaagtcttcatgaaa

SEQ ID NO: 549508 - DNA, 15 bp, Homo sapiens
tcgtatggatttcta

SEQ ID NO: 549509 - DNA, 20 bp, Homo sapiens
tcgtcaggaggtgcctgaga

SEQ ID NO: 549510 - DNA, 14 bp, Homo sapiens
tcgtccccagacca

SEQ ID NO: 549511 - DNA, 15 bp, Homo sapiens
tcgtccccagaccag

SEQ ID NO: 549512 - DNA, 21 bp, Homo sapiens
tcgtccccagaccagtagtga

SEQ ID NO: 549513 - DNA, 13 bp, Homo sapiens
tcgtgcatgtaat

SEQ ID NO: 549514 - DNA, 16 bp, Homo sapiens
tcgtgtgcttagaaac

SEQ ID NO: 549515 - DNA, 18 bp, Homo sapiens
tcgttaggatactgcctc

SEQ ID NO: 549516 - DNA, 12 bp, Homo sapiens
tctaaaactgta

SEQ ID NO: 549517 - DNA, 18 bp, Homo sapiens
tctaaactaggctccttc

SEQ ID NO: 549518 - DNA, 15 bp, Homo sapiens
tctaaactggtacaa

SEQ ID NO: 549519 - DNA, 18 bp, Homo sapiens
tctaaactggtacaattt

SEQ ID NO: 549520 - DNA, 16 bp, Homo sapiens
tctaaagtactgagca

SEQ ID NO: 549521 - DNA, 14 bp, Homo sapiens
tctaaatctgtcca

SEQ ID NO: 549522 - DNA, 17 bp, Homo sapiens
tctaacataagtaagac

SEQ ID NO: 549523 - DNA, 16 bp, Homo sapiens
tctaaccacagctcct

SEQ ID NO: 549524 - DNA, 17 bp, Homo sapiens
tctaactctgatgtaaa

SEQ ID NO: 549525 - DNA, 21 bp, Homo sapiens
tctaactctgatgtaaatgaa

SEQ ID NO: 549526 - DNA, 14 bp, Homo sapiens
tctaactgtgcaaa

SEQ ID NO: 549527 - DNA, 13 bp, Homo sapiens
tctaagaaacatt

SEQ ID NO: 549528 - DNA, 16 bp, Homo sapiens
tctaagaaacattgga

SEQ ID NO: 549529 - DNA, 17 bp, Homo sapiens
tctaagaaacattggaa

SEQ ID NO: 549530 - DNA, 14 bp, Homo sapiens
tctaagatgttata

SEQ ID NO: 549531 - DNA, 22 bp, Homo sapiens
tctaagatgttatatttttctt

SEQ ID NO: 549532 - DNA, 12 bp, Homo sapiens
tctaatggtaac

SEQ ID NO: 549533 - DNA, 19 bp, Homo sapiens
tctaatggtaacttttgta

SEQ ID NO: 549534 - DNA, 11 bp, Homo sapiens
tctaatgttta

SEQ ID NO: 549535 - DNA, 13 bp, Homo sapiens
tctacaaggactc

SEQ ID NO: 549536 - DNA, 15 bp, Homo sapiens
tctacaaggactcca

SEQ ID NO: 549537 - DNA, 15 bp, Homo sapiens
tctacagctccccca

SEQ ID NO: 549538 - DNA, 20 bp, Homo sapiens
tctacagctcccccagctcc

SEQ ID NO: 549539 - DNA, 18 bp, Homo sapiens
tctaccaactttcaagaa

SEQ ID NO: 549540 - DNA, 22 bp, Homo sapiens
tctaccaactttcaagaacttg

SEQ ID NO: 549541 - DNA, 23 bp, Homo sapiens
tctacccctcccggccctgcctg

SEQ ID NO: 549542 - DNA, 16 bp, Homo sapiens
tctacctgcaggactc

SEQ ID NO: 549543 - DNA, 19 bp, Homo sapiens
tctacttacacatcttcca

SEQ ID NO: 549544 - DNA, 16 bp, Homo sapiens
tctactttaaattgtg

SEQ ID NO: 549545 - DNA, 23 bp, Homo sapiens
tctagacactttttctttacaaa

SEQ ID NO: 549546 - DNA, 21 bp, Homo sapiens
tctagagaagtggactggagg

SEQ ID NO: 549547 - DNA, 17 bp, Homo sapiens
tctagatatgagaaata

SEQ ID NO: 549548 - DNA, 14 bp, Homo sapiens
tctagcacttcctt

SEQ ID NO: 549549 - DNA, 14 bp, Homo sapiens
tctagttatttatt

SEQ ID NO: 549550 - DNA, 13 bp, Homo sapiens
tctagttgcattt

SEQ ID NO: 549551 - DNA, 12 bp, Homo sapiens
tctatagaaagt

SEQ ID NO: 549552 - DNA, 13 bp, Homo sapiens
tctatagaaagtg

SEQ ID NO: 549553 - DNA, 15 bp, Homo sapiens
tctatagaaagtgtt

SEQ ID NO: 549554 - DNA, 19 bp, Homo sapiens
tctatagaaagtgttctgt

SEQ ID NO: 549555 - DNA, 21 bp, Homo sapiens
tctatagaaagtgttctgtta

SEQ ID NO: 549556 - DNA, 13 bp, Homo sapiens
tctatcagttatc

SEQ ID NO: 549557 - DNA, 16 bp, Homo sapiens
tctatcagttatcctt

SEQ ID NO: 549558 - DNA, 20 bp, Homo sapiens
tctatccatctcctggtgtt

SEQ ID NO: 549559 - DNA, 18 bp, Homo sapiens
tctatctaatcagatctt

SEQ ID NO: 549560 - DNA, 23 bp, Homo sapiens
tctatgatgtccaaacttaacag

SEQ ID NO: 549561 - DNA, 12 bp, Homo sapiens
tctatgtaactt

SEQ ID NO: 549562 - DNA, 14 bp, Homo sapiens
tctatttatgagat

SEQ ID NO: 549563 - DNA, 22 bp, Homo sapiens
tctatttatgagatcactgaac

SEQ ID NO: 549564 - DNA, 15 bp, Homo sapiens
tctcaccagctgctg

SEQ ID NO: 549565 - DNA, 17 bp, Homo sapiens
tctcaccagctgctgct

SEQ ID NO: 549566 - DNA, 14 bp, Homo sapiens
tctcactgacacag

SEQ ID NO: 549567 - DNA, 19 bp, Homo sapiens
tctcagaagtgaaaaagac

SEQ ID NO: 549568 - DNA, 23 bp, Homo sapiens
tctcagcatatatataaaataca

SEQ ID NO: 549569 - DNA, 13 bp, Homo sapiens
tctcagtctcaca

SEQ ID NO: 549570 - DNA, 18 bp, Homo sapiens
tctcagtttttcttaata

SEQ ID NO: 549571 - DNA, 21 bp, Homo sapiens
tctcagtttttcttaatatat

SEQ ID NO: 549572 - DNA, 21 bp, Homo sapiens
tctcatactcccccacagttt

SEQ ID NO: 549573 - DNA, 16 bp, Homo sapiens
tctcatccccagtccc

SEQ ID NO: 549574 - DNA, 17 bp, Homo sapiens
tctcatcttgacagagc

SEQ ID NO: 549575 - DNA, 22 bp, Homo sapiens
tctcatcttgacagagcctgcc

SEQ ID NO: 549576 - DNA, 13 bp, Homo sapiens
tctcatgctgccc

SEQ ID NO: 549577 - DNA, 17 bp, Homo sapiens
tctcatgttttatatga

SEQ ID NO: 549578 - DNA, 20 bp, Homo sapiens
tctcatgttttatatgatta

SEQ ID NO: 549579 - DNA, 11 bp, Homo sapiens
tctcattccca

SEQ ID NO: 549580 - DNA, 15 bp, Homo sapiens
tctcattcctctgtc

SEQ ID NO: 549581 - DNA, 17 bp, Homo sapiens
tctccattcttttaaat

SEQ ID NO: 549582 - DNA, 14 bp, Homo sapiens
tctccctggactct

SEQ ID NO: 549583 - DNA, 16 bp, Homo sapiens
tctccctggactctgt

SEQ ID NO: 549584 - DNA, 12 bp, Homo sapiens
tctcctgggcca

SEQ ID NO: 549585 - DNA, 14 bp, Homo sapiens
tctcctgtatcatt

SEQ ID NO: 549586 - DNA, 17 bp, Homo sapiens
tctccttgggctgggac

SEQ ID NO: 549587 - DNA, 18 bp, Homo sapiens
tctcggccttcacaatct

SEQ ID NO: 549588 - DNA, 14 bp, Homo sapiens
tctcgtatagaagt

SEQ ID NO: 549589 - DNA, 24 bp, Homo sapiens
tctcgtatagaagtcttcatgaaa

SEQ ID NO: 549590 - DNA, 14 bp, Homo sapiens
tctctaaaacagca

SEQ ID NO: 549591 - DNA, 16 bp, Homo sapiens
tctctaaactggtaca

SEQ ID NO: 549592 - DNA, 14 bp, Homo sapiens
tctctaacctcctt

SEQ ID NO: 549593 - DNA, 15 bp, Homo sapiens
tctctaacctccttt

SEQ ID NO: 549594 - DNA, 14 bp, Homo sapiens
tctctattccccac

SEQ ID NO: 549595 - DNA, 21 bp, Homo sapiens
tctctatttatgagatcactg

SEQ ID NO: 549596 - DNA, 14 bp, Homo sapiens
tctctctccagtct

SEQ ID NO: 549597 - DNA, 17 bp, Homo sapiens
tctctggggtctgtgat

SEQ ID NO: 549598 - DNA, 20 bp, Homo sapiens
tctctgtaaaaagcaggtga

SEQ ID NO: 549599 - DNA, 18 bp, Homo sapiens
tctcttccaggcagccgc

SEQ ID NO: 549600 - DNA, 16 bp, Homo sapiens
tctcttggacattgta

SEQ ID NO: 549601 - DNA, 18 bp, Homo sapiens
tctctttggaaatagcat

SEQ ID NO: 549602 - DNA, 17 bp, Homo sapiens
tctcttttttacaaagg

SEQ ID NO: 549603 - DNA, 12 bp, Homo sapiens
tctgaaagcaca

SEQ ID NO: 549604 - DNA, 13 bp, Homo sapiens
tctgaaagcacag

SEQ ID NO: 549605 - DNA, 17 bp, Homo sapiens
tctgaactgctgctggt

SEQ ID NO: 549606 - DNA, 20 bp, Homo sapiens
tctgaactgctgctggtcac

SEQ ID NO: 549607 - DNA, 14 bp, Homo sapiens
tctgaagattgttt

SEQ ID NO: 549608 - DNA, 19 bp, Homo sapiens
tctgaagattgtttatcta

SEQ ID NO: 549609 - DNA, 20 bp, Homo sapiens
tctgaagcttcactcactgt

SEQ ID NO: 549610 - DNA, 14 bp, Homo sapiens
tctgaagttatatt

SEQ ID NO: 549611 - DNA, 18 bp, Homo sapiens
tctgaagttatatttcct

SEQ ID NO: 549612 - DNA, 19 bp, Homo sapiens
tctgaagttatatttccta

SEQ ID NO: 549613 - DNA, 22 bp, Homo sapiens
tctgagaaaagaacgtatttta

SEQ ID NO: 549614 - DNA, 20 bp, Homo sapiens
tctgagagaggctaaaatgt

SEQ ID NO: 549615 - DNA, 21 bp, Homo sapiens
tctgagagaggctaaaatgtt

SEQ ID NO: 549616 - DNA, 22 bp, Homo sapiens
tctgagctggcctctcactgcc

SEQ ID NO: 549617 - DNA, 17 bp, Homo sapiens
tctgaggacaaggaaat

SEQ ID NO: 549618 - DNA, 12 bp, Homo sapiens
tctgagttatgt

SEQ ID NO: 549619 - DNA, 21 bp, Homo sapiens
tctgatgatgttctgaaatgg

SEQ ID NO: 549620 - DNA, 15 bp, Homo sapiens
tctgatgtaaatgaa

SEQ ID NO: 549621 - DNA, 18 bp, Homo sapiens
tctgatgtaaatgaagta

SEQ ID NO: 549622 - DNA, 19 bp, Homo sapiens
tctgatgtaaatgaagtaa

SEQ ID NO: 549623 - DNA, 15 bp, Homo sapiens
tctgatgtattttgt

SEQ ID NO: 549624 - DNA, 19 bp, Homo sapiens
tctgattctatgtaacttg

SEQ ID NO: 549625 - DNA, 21 bp, Homo sapiens
tctgattctatgtaacttgtt

SEQ ID NO: 549626 - DNA, 19 bp, Homo sapiens
tctgcattttctgaaacta

SEQ ID NO: 549627 - DNA, 16 bp, Homo sapiens
tctgccatcagcccct

SEQ ID NO: 549628 - DNA, 17 bp, Homo sapiens
tctgccatcagcccctg

SEQ ID NO: 549629 - DNA, 20 bp, Homo sapiens
tctgccatcagcccctgctg

SEQ ID NO: 549630 - DNA, 22 bp, Homo sapiens
tctgccatcagcccctgctgct

SEQ ID NO: 549631 - DNA, 13 bp, Homo sapiens
tctgcccagcttt

SEQ ID NO: 549632 - DNA, 15 bp, Homo sapiens
tctgccccaagtttt

SEQ ID NO: 549633 - DNA, 14 bp, Homo sapiens
tctgcctctgatgt

SEQ ID NO: 549634 - DNA, 18 bp, Homo sapiens
tctgcctctgatgtattt

SEQ ID NO: 549635 - DNA, 15 bp, Homo sapiens
tctgcctgtcaagtt

SEQ ID NO: 549636 - DNA, 13 bp, Homo sapiens
tctgctagagagt

SEQ ID NO: 549637 - DNA, 20 bp, Homo sapiens
tctgctgagctctgacctgc

SEQ ID NO: 549638 - DNA, 22 bp, Homo sapiens
tctgctgtgggcacaggtcagg

SEQ ID NO: 549639 - DNA, 15 bp, Homo sapiens
tctggaaaataaaag

SEQ ID NO: 549640 - DNA, 17 bp, Homo sapiens
tctggagaccaggactc

SEQ ID NO: 549641 - DNA, 23 bp, Homo sapiens
tctggagaccaggactctgcctt

SEQ ID NO: 549642 - DNA, 15 bp, Homo sapiens
tctggaggggagctc

SEQ ID NO: 549643 - DNA, 18 bp, Homo sapiens
tgactggccaaaaatatc

SEQ ID NO: 549644 - DNA, 20 bp, Homo sapiens
tgactgtacttgatttttca

SEQ ID NO: 549645 - DNA, 13 bp, Homo sapiens
tgacttatttgct

SEQ ID NO: 549646 - DNA, 16 bp, Homo sapiens
tgacttatttgctcat

SEQ ID NO: 549647 - DNA, 16 bp, Homo sapiens
tgagagagatgtgtaa

SEQ ID NO: 549648 - DNA, 22 bp, Homo sapiens
tgagagagatgtgtaatttttc

SEQ ID NO: 549649 - DNA, 13 bp, Homo sapiens
tgagagcagcctc

SEQ ID NO: 549650 - DNA, 21 bp, Homo sapiens
tgagaggcgacaggagtattt

SEQ ID NO: 549651 - DNA, 19 bp, Homo sapiens
tgagaggggagagctgaac

SEQ ID NO: 549652 - DNA, 16 bp, Homo sapiens
tgagagttccttctca

SEQ ID NO: 549653 - DNA, 18 bp, Homo sapiens
tgagagttccttctcact

SEQ ID NO: 549654 - DNA, 17 bp, Homo sapiens
tgagatgagaggggaga

SEQ ID NO: 549655 - DNA, 17 bp, Homo sapiens
tgagcacatctcttcat

SEQ ID NO: 549656 - DNA, 17 bp, Homo sapiens
tgagcagtgatattctt

SEQ ID NO: 549657 - DNA, 15 bp, Homo sapiens
tgagcatgctccctc

SEQ ID NO: 549658 - DNA, 23 bp, Homo sapiens
tgagcatgctccctcatgcagat

SEQ ID NO: 549659 - DNA, 16 bp, Homo sapiens
tgagccctgaggaggc

SEQ ID NO: 549660 - DNA, 12 bp, Homo sapiens
tgagcctatgat

SEQ ID NO: 549661 - DNA, 13 bp, Homo sapiens
tgagcctatgata

SEQ ID NO: 549662 - DNA, 18 bp, Homo sapiens
tgaggaaaaatatgtgaa

SEQ ID NO: 549663 - DNA, 17 bp, Homo sapiens
tgaggacataaatcttc

SEQ ID NO: 549664 - DNA, 17 bp, Homo sapiens
tgaggacctccacctgg

SEQ ID NO: 549665 - DNA, 20 bp, Homo sapiens
tgaggacctccacctgggag

SEQ ID NO: 549666 - DNA, 23 bp, Homo sapiens
tgaggacctccacctgggagatg

SEQ ID NO: 549667 - DNA, 18 bp, Homo sapiens
tgaggatgtatgtgtata

SEQ ID NO: 549668 - DNA, 12 bp, Homo sapiens
tgaggcaggaga

SEQ ID NO: 549669 - DNA, 18 bp, Homo sapiens
tgaggctggataggagag

SEQ ID NO: 549670 - DNA, 14 bp, Homo sapiens
tgagggcagtgcaa

SEQ ID NO: 549671 - DNA, 19 bp, Homo sapiens
tgagggcgtgaaacacaat

SEQ ID NO: 549672 - DNA, 18 bp, Homo sapiens
tgaggggagccaggaggg

SEQ ID NO: 549673 - DNA, 18 bp, Homo sapiens
tgagtatacaatatataa

SEQ ID NO: 549674 - DNA, 22 bp, Homo sapiens
tgagtatatgtaacagtttaaa

SEQ ID NO: 549675 - DNA, 12 bp, Homo sapiens
tgagtcctccag

SEQ ID NO: 549676 - DNA, 23 bp, Homo sapiens
tgagtctcattcctctgtccccg

SEQ ID NO: 549677 - DNA, 22 bp, Homo sapiens
tgagtcttttttttttaagtga

SEQ ID NO: 549678 - DNA, 20 bp, Homo sapiens
tgagtgacatcggttcagga

SEQ ID NO: 549679 - DNA, 23 bp, Homo sapiens
tgagtgagaggcgacaggagtat

SEQ ID NO: 549680 - DNA, 20 bp, Homo sapiens
tgagtggtccacattctgct

SEQ ID NO: 549681 - DNA, 16 bp, Homo sapiens
tgagttatgttaaaat

SEQ ID NO: 549682 - DNA, 21 bp, Homo sapiens
tgagttggttacctattgctg

SEQ ID NO: 549683 - DNA, 21 bp, Homo sapiens
tgataaaatcccattgtattt

SEQ ID NO: 549684 - DNA, 22 bp, Homo sapiens
tgataaaatcccattgtattta

SEQ ID NO: 549685 - DNA, 14 bp, Homo sapiens
tgataaatagtgtt

SEQ ID NO: 549686 - DNA, 19 bp, Homo sapiens
tgataaatagtgttattga

SEQ ID NO: 549687 - DNA, 14 bp, Homo sapiens
tgatatattttcca

SEQ ID NO: 549688 - DNA, 11 bp, Homo sapiens
tgatatcagga

SEQ ID NO: 549689 - DNA, 12 bp, Homo sapiens
tgatatccctga

SEQ ID NO: 549690 - DNA, 15 bp, Homo sapiens
tgatatgagtataca

SEQ ID NO: 549691 - DNA, 14 bp, Homo sapiens
tgatatgtctttaa

SEQ ID NO: 549692 - DNA, 20 bp, Homo sapiens
tgatatgtctttaaaatgat

SEQ ID NO: 549693 - DNA, 17 bp, Homo sapiens
tgatattctttgttaat

SEQ ID NO: 549694 - DNA, 17 bp, Homo sapiens
tgatcaaatgtacatct

SEQ ID NO: 549695 - DNA, 14 bp, Homo sapiens
tgatcaagtggttt

SEQ ID NO: 549696 - DNA, 24 bp, Homo sapiens
tgatcactttctgaaattcacaaa

SEQ ID NO: 549697 - DNA, 12 bp, Homo sapiens
tgatcagtgtta

SEQ ID NO: 549698 - DNA, 14 bp, Homo sapiens
tgatcagtgttaca

SEQ ID NO: 549699 - DNA, 19 bp, Homo sapiens
tgatcattcaccagtacat

SEQ ID NO: 549700 - DNA, 20 bp, Homo sapiens
tgatcctaactgaagagaca

SEQ ID NO: 549701 - DNA, 18 bp, Homo sapiens
tgatccttgcacagacaa

SEQ ID NO: 549702 - DNA, 18 bp, Homo sapiens
tgatcgtttcttccagtt

SEQ ID NO: 549703 - DNA, 13 bp, Homo sapiens
tgatctgtccttc

SEQ ID NO: 549704 - DNA, 14 bp, Homo sapiens
tgatctgtgccttt

SEQ ID NO: 549705 - DNA, 21 bp, Homo sapiens
tgatcttcctctgctaaattg

SEQ ID NO: 549706 - DNA, 19 bp, Homo sapiens
tgatgaagttgtacaacac

SEQ ID NO: 549707 - DNA, 18 bp, Homo sapiens
tgatgacccccccagctt

SEQ ID NO: 549708 - DNA, 16 bp, Homo sapiens
tgatgatttcagaaac

SEQ ID NO: 549709 - DNA, 18 bp, Homo sapiens
tgatgcaatccttacaaa

SEQ ID NO: 549710 - DNA, 13 bp, Homo sapiens
tgatgctgtattc

SEQ ID NO: 549711 - DNA, 17 bp, Homo sapiens
tgatggcaatattaaga

SEQ ID NO: 549712 - DNA, 18 bp, Homo sapiens
tgatgtcacatcttggca

SEQ ID NO: 549713 - DNA, 14 bp, Homo sapiens
tgatgtccaaactt

SEQ ID NO: 549714 - DNA, 18 bp, Homo sapiens
tgatgtgacatttgtcat

SEQ ID NO: 549715 - DNA, 15 bp, Homo sapiens
tgatgttgatgcaat

SEQ ID NO: 549716 - DNA, 19 bp, Homo sapiens
tgatgttgatgcaatcctt

SEQ ID NO: 549717 - DNA, 13 bp, Homo sapiens
tgattacctgaaa

SEQ ID NO: 549718 - DNA, 19 bp, Homo sapiens
tgattcaaataaccctgaa

SEQ ID NO: 549719 - DNA, 15 bp, Homo sapiens
tgattcacatgtttt

SEQ ID NO: 549720 - DNA, 19 bp, Homo sapiens
tgattcacatgttttcaaa

SEQ ID NO: 549721 - DNA, 17 bp, Homo sapiens
tgattccaagggcccag

SEQ ID NO: 549722 - DNA, 15 bp, Homo sapiens
tgattcgagctatat

SEQ ID NO: 549723 - DNA, 15 bp, Homo sapiens
tgattctatgtaact

SEQ ID NO: 549724 - DNA, 16 bp, Homo sapiens
tgattctatgtaactt

SEQ ID NO: 549725 - DNA, 17 bp, Homo sapiens
tgattctatgtaacttg

SEQ ID NO: 549726 - DNA, 13 bp, Homo sapiens
tgattcttgtgat

SEQ ID NO: 549727 - DNA, 19 bp, Homo sapiens
ttaaaatatgcactaagtc

SEQ ID NO: 549728 - DNA, 15 bp, Homo sapiens
ttaaaatcttattaa

SEQ ID NO: 549729 - DNA, 20 bp, Homo sapiens
ttaaaatcttattaaagttt

SEQ ID NO: 549730 - DNA, 20 bp, Homo sapiens
ttaaaatggcatttagcaca

SEQ ID NO: 549731 - DNA, 14 bp, Homo sapiens
ttaaaatttgaaac

SEQ ID NO: 549732 - DNA, 19 bp, Homo sapiens
ttaaacccaatcagatgcc

SEQ ID NO: 549733 - DNA, 18 bp, Homo sapiens
ttaaactaattaaactga

SEQ ID NO: 549734 - DNA, 21 bp, Homo sapiens
ttaaagaaaagttcttaaaac

SEQ ID NO: 549735 - DNA, 21 bp, Homo sapiens
ttaaagagcaggatagctctt

SEQ ID NO: 549736 - DNA, 11 bp, Homo sapiens
ttaaagatgta

SEQ ID NO: 549737 - DNA, 17 bp, Homo sapiens
ttaaagtgtaataatat

SEQ ID NO: 549738 - DNA, 13 bp, Homo sapiens
ttaaagtttcaaa

SEQ ID NO: 549739 - DNA, 20 bp, Homo sapiens
ttaaagtttcaaaaatctga

SEQ ID NO: 549740 - DNA, 21 bp, Homo sapiens
ttaaagtttcaaaaatctgaa

SEQ ID NO: 549741 - DNA, 20 bp, Homo sapiens
ttaaataaaagaaatgcaca

SEQ ID NO: 549742 - DNA, 12 bp, Homo sapiens
ttaaatgaaata

SEQ ID NO: 549743 - DNA, 15 bp, Homo sapiens
ttaaatgaaatactt

SEQ ID NO: 549744 - DNA, 17 bp, Homo sapiens
ttaaatggggacgcaga

SEQ ID NO: 549745 - DNA, 11 bp, Homo sapiens
ttaaatgtttt

SEQ ID NO: 549746 - DNA, 12 bp, Homo sapiens
ttaaatgttttg

SEQ ID NO: 549747 - DNA, 18 bp, Homo sapiens
ttaaatgttttgtaaact

SEQ ID NO: 549748 - DNA, 17 bp, Homo sapiens
ttaaattggcttgttta

SEQ ID NO: 549749 - DNA, 13 bp, Homo sapiens
ttaaattgtggat

SEQ ID NO: 549750 - DNA, 17 bp, Homo sapiens
ttaacaaataacaactt

SEQ ID NO: 549751 - DNA, 16 bp, Homo sapiens
ttaacagtattttaag

SEQ ID NO: 549752 - DNA, 17 bp, Homo sapiens
ttaacagtattttaaga

SEQ ID NO: 549753 - DNA, 14 bp, Homo sapiens
ttaacatccctcct

SEQ ID NO: 549754 - DNA, 20 bp, Homo sapiens
ttaaccgaagaactaataaa

SEQ ID NO: 549755 - DNA, 16 bp, Homo sapiens
ttaacttccactttgt

SEQ ID NO: 549756 - DNA, 17 bp, Homo sapiens
ttaacttccactttgta

SEQ ID NO: 549757 - DNA, 23 bp, Homo sapiens
ttaacttccactttgtataaatt

SEQ ID NO: 549758 - DNA, 20 bp, Homo sapiens
ttaagaaattccatacttct

SEQ ID NO: 549759 - DNA, 21 bp, Homo sapiens
ttaagaagccctgcagagcac

SEQ ID NO: 549760 - DNA, 10 bp, Homo sapiens
ttaagacaag

SEQ ID NO: 549761 - DNA, 22 bp, Homo sapiens
ttaagacacttccgtcacatcc

SEQ ID NO: 549762 - DNA, 15 bp, Homo sapiens
ttaagagagaaatct

SEQ ID NO: 549763 - DNA, 16 bp, Homo sapiens
ttaagagattttatgt

SEQ ID NO: 549764 - DNA, 22 bp, Homo sapiens
ttaagcacaaccatgttcttga

SEQ ID NO: 549765 - DNA, 13 bp, Homo sapiens
ttaagcctttgaa

SEQ ID NO: 549766 - DNA, 16 bp, Homo sapiens
ttaagcctttgaagtg

SEQ ID NO: 549767 - DNA, 19 bp, Homo sapiens
ttaagctaggaaaagaaat

SEQ ID NO: 549768 - DNA, 11 bp, Homo sapiens
ttaagctgcag

SEQ ID NO: 549769 - DNA, 13 bp, Homo sapiens
ttaagtgaaattt

SEQ ID NO: 549770 - DNA, 15 bp, Homo sapiens
ttaagtgaaatttat

SEQ ID NO: 549771 - DNA, 21 bp, Homo sapiens
ttaagtgcttgaggccaaatg

SEQ ID NO: 549772 - DNA, 23 bp, Homo sapiens
ttaagtgtcagactatccatttt

SEQ ID NO: 549773 - DNA, 22 bp, Homo sapiens
ttaagtgttctgtggctgattt

SEQ ID NO: 549774 - DNA, 23 bp, Homo sapiens
ttaagttgtaaacgtctttttaa

SEQ ID NO: 549775 - DNA, 14 bp, Homo sapiens
ttaatagaaaatat

SEQ ID NO: 549776 - DNA, 17 bp, Homo sapiens
ttaataggcttgtgtaa

SEQ ID NO: 549777 - DNA, 13 bp, Homo sapiens
ttaatcttcatgg

SEQ ID NO: 549778 - DNA, 17 bp, Homo sapiens
ttaatgagtatatgtaa

SEQ ID NO: 549779 - DNA, 19 bp, Homo sapiens
ttaatgagtatatgtaaca

SEQ ID NO: 549780 - DNA, 22 bp, Homo sapiens
ttaatgagtatatgtaacagtt

SEQ ID NO: 549781 - DNA, 22 bp, Homo sapiens
ttaatgataaaatcccattgta

SEQ ID NO: 549782 - DNA, 22 bp, Homo sapiens
ttaatggtctaaaaataaacca

SEQ ID NO: 549783 - DNA, 14 bp, Homo sapiens
ttaatgttgatttc

SEQ ID NO: 549784 - DNA, 18 bp, Homo sapiens
ttaatgtttagtcagtgt

SEQ ID NO: 549785 - DNA, 14 bp, Homo sapiens
ttaattaattctca

SEQ ID NO: 549786 - DNA, 17 bp, Homo sapiens
ttaattgatagaataaa

SEQ ID NO: 549787 - DNA, 14 bp, Homo sapiens
ttaatttcaagctt

SEQ ID NO: 549788 - DNA, 14 bp, Homo sapiens
ttaatttcagtaag

SEQ ID NO: 549789 - DNA, 21 bp, Homo sapiens
ttaatttcttgcaatttgaag

SEQ ID NO: 549790 - DNA, 22 bp, Homo sapiens
ttaatttcttgcaatttgaagg

SEQ ID NO: 549791 - DNA, 19 bp, Homo sapiens
ttaatttggaccattttcc

SEQ ID NO: 549792 - DNA, 12 bp, Homo sapiens
ttacaaaatgta

SEQ ID NO: 549793 - DNA, 13 bp, Homo sapiens
ttacaaaatgtaa

SEQ ID NO: 549794 - DNA, 15 bp, Homo sapiens
ttacaaaatgtaact

SEQ ID NO: 549795 - DNA, 17 bp, Homo sapiens
ttacaaaatgtaactgt

SEQ ID NO: 549796 - DNA, 12 bp, Homo sapiens
ttacaaatgatt

SEQ ID NO: 549797 - DNA, 14 bp, Homo sapiens
ttacaaatgattgc

SEQ ID NO: 549798 - DNA, 17 bp, Homo sapiens
ttacaaatgattgcttt

SEQ ID NO: 549799 - DNA, 21 bp, Homo sapiens
ttacaaatgattgcttttaaa

SEQ ID NO: 549800 - DNA, 18 bp, Homo sapiens
ttacaatatttgtgtgct

SEQ ID NO: 549801 - DNA, 14 bp, Homo sapiens
ttacaatggaaaca

SEQ ID NO: 549802 - DNA, 15 bp, Homo sapiens
ttacacaattaattc

SEQ ID NO: 549803 - DNA, 23 bp, Homo sapiens
ttacacttgctttatttttcatt

SEQ ID NO: 549804 - DNA, 15 bp, Homo sapiens
ttacagtggcagtat

SEQ ID NO: 549805 - DNA, 19 bp, Homo sapiens
ttacagttacttttccttg

SEQ ID NO: 549806 - DNA, 19 bp, Homo sapiens
ttaccacaggatgcatatt

SEQ ID NO: 549807 - DNA, 20 bp, Homo sapiens
ttaccagattcacttctgaa

SEQ ID NO: 549808 - DNA, 17 bp, Homo sapiens
ttaccagggatgtagat

SEQ ID NO: 549809 - DNA, 14 bp, Homo sapiens
ttacccaaagcaca

SEQ ID NO: 549810 - DNA, 21 bp, Homo sapiens
ttacctgtaatagcctcacct

SEQ ID NO: 549811 - DNA, 21 bp, Homo sapiens
ttacctgttgtctgaaacata

SEQ ID NO: 549812 - DNA, 14 bp, Homo sapiens
ttacggctcctctc

SEQ ID NO: 549813 - DNA, 22 bp, Homo sapiens
ttactaacagtaactgccattt

SEQ ID NO: 549814 - DNA, 11 bp, Homo sapiens
ttactaacttc

SEQ ID NO: 549815 - DNA, 21 bp, Homo sapiens
ttactaacttctaaaactgta

SEQ ID NO: 549816 - DNA, 17 bp, Homo sapiens
ttactacctcctctcct

SEQ ID NO: 549817 - DNA, 20 bp, Homo sapiens
ttactctgcctgtcaagttt

SEQ ID NO: 549818 - DNA, 23 bp, Homo sapiens
ttactctgtgctaagttgtctta

SEQ ID NO: 549819 - DNA, 19 bp, Homo sapiens
ttactgtccccttgatata

SEQ ID NO: 549820 - DNA, 19 bp, Homo sapiens
ttactgtcttaattaagta

SEQ ID NO: 549821 - DNA, 19 bp, Homo sapiens
ttacttttaataaagtatg

SEQ ID NO: 549822 - DNA, 20 bp, Homo sapiens
ttacttttccttgcatacaa

SEQ ID NO: 549823 - DNA, 14 bp, Homo sapiens
ttagaaaactttgt

SEQ ID NO: 549824 - DNA, 15 bp, Homo sapiens
ttagaaaactttgtt

SEQ ID NO: 549825 - DNA, 13 bp, Homo sapiens
ttagaatgttgaa

SEQ ID NO: 549826 - DNA, 16 bp, Homo sapiens
ttagaatgttttcctt

SEQ ID NO: 549827 - DNA, 14 bp, Homo sapiens
ttagacttctgttt

SEQ ID NO: 549828 - DNA, 15 bp, Homo sapiens
ttagacttctgtttt

SEQ ID NO: 549829 - DNA, 16 bp, Homo sapiens
ttagcaaaaaaagttg

SEQ ID NO: 549830 - DNA, 15 bp, Homo sapiens
ttagcacagtattta

SEQ ID NO: 549831 - DNA, 18 bp, Homo sapiens
ttagcacagtatttaaca

SEQ ID NO: 549832 - DNA, 21 bp, Homo sapiens
ttagcacagtatttaacattc

SEQ ID NO: 549833 - DNA, 12 bp, Homo sapiens
ttagcctggagc

SEQ ID NO: 549834 - DNA, 15 bp, Homo sapiens
ttagcgttctgtttc

SEQ ID NO: 549835 - DNA, 16 bp, Homo sapiens
ttagcgttgttttgtg

SEQ ID NO: 549836 - DNA, 17 bp, Homo sapiens
ttagcgttgttttgtgg

SEQ ID NO: 549837 - DNA, 19 bp, Homo sapiens
ttagcgttgttttgtggat

SEQ ID NO: 549838 - DNA, 17 bp, Homo sapiens
ttagctgtaacagttct

SEQ ID NO: 549839 - DNA, 15 bp, Homo sapiens
ttaggagttttgaga

SEQ ID NO: 549840 - DNA, 14 bp, Homo sapiens
ttaggattgaagtg

SEQ ID NO: 549841 - DNA, 18 bp, Homo sapiens
ttaggcagtataaagaat

SEQ ID NO: 549842 - DNA, 14 bp, Homo sapiens
ttagggaatgagag

SEQ ID NO: 549843 - DNA, 17 bp, Homo sapiens
ttagtactttatagaag

SEQ ID NO: 549844 - DNA, 22 bp, Homo sapiens
ttagtaggatatgcctgctctt

SEQ ID NO: 549845 - DNA, 19 bp, Homo sapiens
ttagtcatatctatctaat

SEQ ID NO: 549846 - DNA, 16 bp, Homo sapiens
ttagtggaccctgaaa

SEQ ID NO: 549847 - DNA, 19 bp, Homo sapiens
ttagtggaccctgaaatgt

SEQ ID NO: 549848 - DNA, 16 bp, Homo sapiens
ttagtggatggaatat

SEQ ID NO: 549849 - DNA, 19 bp, Homo sapiens
ttagtgtctctatttatga

SEQ ID NO: 549850 - DNA, 13 bp, Homo sapiens
ttagttttgcttt

SEQ ID NO: 549851 - DNA, 22 bp, Homo sapiens
ttagttttgcttttagtttttc

SEQ ID NO: 549852 - DNA, 22 bp, Homo sapiens
ttataaaaaaaatgaaatgttt

SEQ ID NO: 549853 - DNA, 12 bp, Homo sapiens
ttataaaatctg

SEQ ID NO: 549854 - DNA, 15 bp, Homo sapiens
ttataaattttgtac

SEQ ID NO: 549855 - DNA, 18 bp, Homo sapiens
ttataacattgtatgtta

SEQ ID NO: 549856 - DNA, 16 bp, Homo sapiens
ttataagcacagacaa

SEQ ID NO: 549857 - DNA, 17 bp, Homo sapiens
ttataagcacagacaat

SEQ ID NO: 549858 - DNA, 23 bp, Homo sapiens
ttataagcacagacaattctaat

SEQ ID NO: 549859 - DNA, 12 bp, Homo sapiens
ttatacacacag

SEQ ID NO: 549860 - DNA, 15 bp, Homo sapiens
ttatacctgtacaca

SEQ ID NO: 549861 - DNA, 19 bp, Homo sapiens
ttatactatttattaaaac

SEQ ID NO: 549862 - DNA, 17 bp, Homo sapiens
ttatagaagaatgcatg

SEQ ID NO: 549863 - DNA, 19 bp, Homo sapiens
ttatagaagaatgcatgct

SEQ ID NO: 549864 - DNA, 22 bp, Homo sapiens
ttatagtcatttattttaaaaa

SEQ ID NO: 549865 - DNA, 21 bp, Homo sapiens
ttatattctgcagaaaattaa

SEQ ID NO: 549866 - DNA, 20 bp, Homo sapiens
ttatatttggatgcagagtt

SEQ ID NO: 549867 - DNA, 20 bp, Homo sapiens
ttatatttttcttaaaaagt

SEQ ID NO: 549868 - DNA, 11 bp, Homo sapiens
ttatcatgtgt

SEQ ID NO: 549869 - DNA, 21 bp, Homo sapiens
tgcactatatgtttacacaat

SEQ ID NO: 549870 - DNA, 21 bp, Homo sapiens
tgcactcttttgagcagtaaa

SEQ ID NO: 549871 - DNA, 21 bp, Homo sapiens
tgcacttggggcacagggaga

SEQ ID NO: 549872 - DNA, 21 bp, Homo sapiens
tgcacttttctaaactaggct

SEQ ID NO: 549873 - DNA, 21 bp, Homo sapiens
tgcagaacttgaagcctgctc

SEQ ID NO: 549874 - DNA, 23 bp, Homo sapiens
tgcagaacttgaagcctgctcct

SEQ ID NO: 549875 - DNA, 15 bp, Homo sapiens
tgcagaagggagctg

SEQ ID NO: 549876 - DNA, 21 bp, Homo sapiens
tgcagacagggggccagaaca

SEQ ID NO: 549877 - DNA, 16 bp, Homo sapiens
tgcagactggtgttaa

SEQ ID NO: 549878 - DNA, 14 bp, Homo sapiens
tgcagagcacaaac

SEQ ID NO: 549879 - DNA, 20 bp, Homo sapiens
tgcagagcctgcagggtgac

SEQ ID NO: 549880 - DNA, 17 bp, Homo sapiens
tgcagataattctggac

SEQ ID NO: 549881 - DNA, 23 bp, Homo sapiens
tgcagatactactgaccagacaa

SEQ ID NO: 549882 - DNA, 19 bp, Homo sapiens
tgcagattcctttggccac

SEQ ID NO: 549883 - DNA, 15 bp, Homo sapiens
tgcagccttaaacag

SEQ ID NO: 549884 - DNA, 22 bp, Homo sapiens
tgcagccttaaacagtgtccag

SEQ ID NO: 549885 - DNA, 19 bp, Homo sapiens
tgcagctatggacaattta

SEQ ID NO: 549886 - DNA, 11 bp, Homo sapiens
tgcaggcaggc

SEQ ID NO: 549887 - DNA, 23 bp, Homo sapiens
tgcaggcggtatccagaggtgag

SEQ ID NO: 549888 - DNA, 16 bp, Homo sapiens
tgcagggtgacctgct

SEQ ID NO: 549889 - DNA, 13 bp, Homo sapiens
tgcagtgagctga

SEQ ID NO: 549890 - DNA, 12 bp, Homo sapiens
tgcagtgttctg

SEQ ID NO: 549891 - DNA, 13 bp, Homo sapiens
tgcagtgttctgt

SEQ ID NO: 549892 - DNA, 16 bp, Homo sapiens
tgcagtgttctgtgaa

SEQ ID NO: 549893 - DNA, 23 bp, Homo sapiens
tgcataattctgaagttatattt

SEQ ID NO: 549894 - DNA, 13 bp, Homo sapiens
tgcatacaaacaa

SEQ ID NO: 549895 - DNA, 13 bp, Homo sapiens
tgcatatatatgt

SEQ ID NO: 549896 - DNA, 14 bp, Homo sapiens
tgcatatatatgta

SEQ ID NO: 549897 - DNA, 14 bp, Homo sapiens
tgcatattaaagaa

SEQ ID NO: 549898 - DNA, 16 bp, Homo sapiens
tgcatcacctctgtaa

SEQ ID NO: 549899 - DNA, 12 bp, Homo sapiens
tgcatcccagca

SEQ ID NO: 549900 - DNA, 18 bp, Homo sapiens
tgcatgaaggtctacctg

SEQ ID NO: 549901 - DNA, 15 bp, Homo sapiens
tgcatgctttccata

SEQ ID NO: 549902 - DNA, 20 bp, Homo sapiens
tgcattcattcatcctctta

SEQ ID NO: 549903 - DNA, 15 bp, Homo sapiens
tgcatttaagttgta

SEQ ID NO: 549904 - DNA, 20 bp, Homo sapiens
tgccaaacattaatgttgat

SEQ ID NO: 549905 - DNA, 15 bp, Homo sapiens
tgccaaatcctgggc

SEQ ID NO: 549906 - DNA, 22 bp, Homo sapiens
tgccaaatcctgggcatcccca

SEQ ID NO: 549907 - DNA, 18 bp, Homo sapiens
tgccacataattcattaa

SEQ ID NO: 549908 - DNA, 15 bp, Homo sapiens
tgccacctcctctgt

SEQ ID NO: 549909 - DNA, 17 bp, Homo sapiens
tgccaggagtgggtggg

SEQ ID NO: 549910 - DNA, 23 bp, Homo sapiens
tgccaggagtgggtgggacacag

SEQ ID NO: 549911 - DNA, 19 bp, Homo sapiens
tgccaggctcccactgccc

SEQ ID NO: 549912 - DNA, 24 bp, Homo sapiens
tgccagtaacacaggccaccctgt

SEQ ID NO: 549913 - DNA, 14 bp, Homo sapiens
tgccatcagcccct

SEQ ID NO: 549914 - DNA, 18 bp, Homo sapiens
tgccatcagcccctgctg

SEQ ID NO: 549915 - DNA, 19 bp, Homo sapiens
tgccatcagcccctgctgc

SEQ ID NO: 549916 - DNA, 17 bp, Homo sapiens
tgccatggaggcacaca

SEQ ID NO: 549917 - DNA, 18 bp, Homo sapiens
tgccatggaggcacacag

SEQ ID NO: 549918 - DNA, 18 bp, Homo sapiens
tgccattcatagagagcc

SEQ ID NO: 549919 - DNA, 20 bp, Homo sapiens
tgccattttttgtctgtgat

SEQ ID NO: 549920 - DNA, 23 bp, Homo sapiens
tgccattttttgtctgtgataac

SEQ ID NO: 549921 - DNA, 19 bp, Homo sapiens
tgcccacacctgcctctga

SEQ ID NO: 549922 - DNA, 19 bp, Homo sapiens
tgcccactcctgctctgct

SEQ ID NO: 549923 - DNA, 16 bp, Homo sapiens
tgccccacccctccat

SEQ ID NO: 549924 - DNA, 19 bp, Homo sapiens
tgccccatcacttacagaa

SEQ ID NO: 549925 - DNA, 18 bp, Homo sapiens
tgcccccacacctggccc

SEQ ID NO: 549926 - DNA, 14 bp, Homo sapiens
tgcccctcttagaa

SEQ ID NO: 549927 - DNA, 19 bp, Homo sapiens
tgcccctgcacctgcttct

SEQ ID NO: 549928 - DNA, 14 bp, Homo sapiens
tgcccggcccagga

SEQ ID NO: 549929 - DNA, 15 bp, Homo sapiens
tgcccggcccaggag

SEQ ID NO: 549930 - DNA, 19 bp, Homo sapiens
tgccctccctgctgccagg

SEQ ID NO: 549931 - DNA, 22 bp, Homo sapiens
tgccctccctgctgccaggctc

SEQ ID NO: 549932 - DNA, 17 bp, Homo sapiens
tgccctccgcccttccc

SEQ ID NO: 549933 - DNA, 18 bp, Homo sapiens
tgccctccgcccttccct

SEQ ID NO: 549934 - DNA, 19 bp, Homo sapiens
tgccctccgtcctggcagg

SEQ ID NO: 549935 - DNA, 13 bp, Homo sapiens
tgccgctgatgtt

SEQ ID NO: 549936 - DNA, 18 bp, Homo sapiens
tgccgggtgcagcatctg

SEQ ID NO: 549937 - DNA, 18 bp, Homo sapiens
tgccgtgcacggggccag

SEQ ID NO: 549938 - DNA, 21 bp, Homo sapiens
tgcctctgaactgctgctggt

SEQ ID NO: 549939 - DNA, 22 bp, Homo sapiens
tgcctctgatgtattttgtgag

SEQ ID NO: 549940 - DNA, 17 bp, Homo sapiens
tgcctgagagcagaatg

SEQ ID NO: 549941 - DNA, 16 bp, Homo sapiens
tgcctgaggggcagcc

SEQ ID NO: 549942 - DNA, 23 bp, Homo sapiens
tgcctgccctgtcaggaggcaga

SEQ ID NO: 549943 - DNA, 19 bp, Homo sapiens
tgcctgcggagttgtgcac

SEQ ID NO: 549944 - DNA, 12 bp, Homo sapiens
tgcctgctcttt

SEQ ID NO: 549945 - DNA, 18 bp, Homo sapiens
tgcctggactcagcaact

SEQ ID NO: 549946 - DNA, 18 bp, Homo sapiens
tgcctggtctcctgcccc

SEQ ID NO: 549947 - DNA, 20 bp, Homo sapiens
tgcctggtctcctgccccca

SEQ ID NO: 549948 - DNA, 21 bp, Homo sapiens
tgcctggtctcctgcccccac

SEQ ID NO: 549949 - DNA, 21 bp, Homo sapiens
tgcctgtggtgaggtcctgtc

SEQ ID NO: 549950 - DNA, 22 bp, Homo sapiens
tgcctgtggtgaggtcctgtcc

SEQ ID NO: 549951 - DNA, 13 bp, Homo sapiens
tgccttccaggcg

SEQ ID NO: 549952 - DNA, 18 bp, Homo sapiens
tgcctttatttctgtatc

SEQ ID NO: 549953 - DNA, 15 bp, Homo sapiens
tgcctttctagcaat

SEQ ID NO: 549954 - DNA, 11 bp, Homo sapiens
tgccttttgta

SEQ ID NO: 549955 - DNA, 12 bp, Homo sapiens
tgccttttgtag

SEQ ID NO: 549956 - DNA, 14 bp, Homo sapiens
tgccttttgtagct

SEQ ID NO: 549957 - DNA, 21 bp, Homo sapiens
tgcgagcgctatcttcacata

SEQ ID NO: 549958 - DNA, 23 bp, Homo sapiens
tgcgcaggccctccgcgggggac

SEQ ID NO: 549959 - DNA, 19 bp, Homo sapiens
tgcgcttgttttaaagtgg

SEQ ID NO: 549960 - DNA, 17 bp, Homo sapiens
tgcgcttttgctggtca

SEQ ID NO: 549961 - DNA, 18 bp, Homo sapiens
tgcgcttttgctggtcac

SEQ ID NO: 549962 - DNA, 15 bp, Homo sapiens
tgcgggctgggcagc

SEQ ID NO: 549963 - DNA, 13 bp, Homo sapiens
tgcgtggcctggg

SEQ ID NO: 549964 - DNA, 17 bp, Homo sapiens
tgcgtggcctggggctg

SEQ ID NO: 549965 - DNA, 23 bp, Homo sapiens
tgctaaacgtgtatgtttttcag

SEQ ID NO: 549966 - DNA, 13 bp, Homo sapiens
tgctaaccttttc

SEQ ID NO: 549967 - DNA, 22 bp, Homo sapiens
tgctaacggccgtctgctctca

SEQ ID NO: 549968 - DNA, 13 bp, Homo sapiens
tgctaagagcctc

SEQ ID NO: 549969 - DNA, 17 bp, Homo sapiens
tgctaagagcctctgga

SEQ ID NO: 549970 - DNA, 18 bp, Homo sapiens
tgctaagtaaatctcttc

SEQ ID NO: 549971 - DNA, 20 bp, Homo sapiens
tgctaagtaaatctcttctg

SEQ ID NO: 549972 - DNA, 15 bp, Homo sapiens
tgctaattaaaaagt

SEQ ID NO: 549973 - DNA, 17 bp, Homo sapiens
tgctaattaaaaagtta

SEQ ID NO: 549974 - DNA, 15 bp, Homo sapiens
tgctacaaaatgtgt

SEQ ID NO: 549975 - DNA, 19 bp, Homo sapiens
tgctacagtagctgtgggg

SEQ ID NO: 549976 - DNA, 20 bp, Homo sapiens
tgctaccacggcctcctttc

SEQ ID NO: 549977 - DNA, 21 bp, Homo sapiens
tgctaccacggcctcctttcc

SEQ ID NO: 549978 - DNA, 12 bp, Homo sapiens
tgctactcagta

SEQ ID NO: 549979 - DNA, 12 bp, Homo sapiens
tgctatatatat

SEQ ID NO: 549980 - DNA, 17 bp, Homo sapiens
tgctatctcgctagcca

SEQ ID NO: 549981 - DNA, 15 bp, Homo sapiens
tgctatgtcatttca

SEQ ID NO: 549982 - DNA, 15 bp, Homo sapiens
tgtaatttttctgta

SEQ ID NO: 549983 - DNA, 17 bp, Homo sapiens
tgtaatttttctgtata

SEQ ID NO: 549984 - DNA, 22 bp, Homo sapiens
tgtacaatcatgaacagctctg

SEQ ID NO: 549985 - DNA, 11 bp, Homo sapiens
tgtacacacac

SEQ ID NO: 549986 - DNA, 22 bp, Homo sapiens
tgtacagagccgtaaaaactga

SEQ ID NO: 549987 - DNA, 17 bp, Homo sapiens
tgtacatgtggaaaact

SEQ ID NO: 549988 - DNA, 18 bp, Homo sapiens
tgtacatttttgatcaaa

SEQ ID NO: 549989 - DNA, 22 bp, Homo sapiens
tgtacatttttgatcaaatgta

SEQ ID NO: 549990 - DNA, 14 bp, Homo sapiens
tgtaccattaaaat

SEQ ID NO: 549991 - DNA, 19 bp, Homo sapiens
tgtaccattaaaatatgca

SEQ ID NO: 549992 - DNA, 23 bp, Homo sapiens
tgtaccattaaaatatgcactaa

SEQ ID NO: 549993 - DNA, 19 bp, Homo sapiens
tgtactggagagcaacaca

SEQ ID NO: 549994 - DNA, 22 bp, Homo sapiens
tgtacttgatttttcaaagact

SEQ ID NO: 549995 - DNA, 20 bp, Homo sapiens
tgtactttgattcacatgtt

SEQ ID NO: 549996 - DNA, 15 bp, Homo sapiens
tgtagactatataca

SEQ ID NO: 549997 - DNA, 22 bp, Homo sapiens
tgtagactatatacatgtgtgt

SEQ ID NO: 549998 - DNA, 21 bp, Homo sapiens
tgtagattaaggtgatgtgat

SEQ ID NO: 549999 - DNA, 18 bp, Homo sapiens
tgtagcaaaccctgtcaa

SEQ ID NO: 550000 - DNA, 19 bp, Homo sapiens
tgtagcaaaccctgtcaaa

SEQ ID NO: 550001 - DNA, 23 bp, Homo sapiens
tgtagcaaaccctgtcaaacatt

SEQ ID NO: 550002 - DNA, 19 bp, Homo sapiens
tgtagctctgaatgctatt

SEQ ID NO: 550003 - DNA, 13 bp, Homo sapiens
tgtagctgtcatg

SEQ ID NO: 550004 - DNA, 20 bp, Homo sapiens
tgtagctttgggcagatttg

SEQ ID NO: 550005 - DNA, 15 bp, Homo sapiens
tgtagtcttatgaat

SEQ ID NO: 550006 - DNA, 20 bp, Homo sapiens
tgtataaacattaaatgtct

SEQ ID NO: 550007 - DNA, 14 bp, Homo sapiens
tgtataaatgtata

SEQ ID NO: 550008 - DNA, 20 bp, Homo sapiens
tgtataagtgcacacagaaa

SEQ ID NO: 550009 - DNA, 22 bp, Homo sapiens
tgtataagtgcacacagaaata

SEQ ID NO: 550010 - DNA, 20 bp, Homo sapiens
tgtatacgcacgcacccaca

SEQ ID NO: 550011 - DNA, 23 bp, Homo sapiens
tgtatagccaaatgactgaaagc

SEQ ID NO: 550012 - DNA, 16 bp, Homo sapiens
tgtatagtatttgaaa

SEQ ID NO: 550013 - DNA, 17 bp, Homo sapiens
tgtatatacacatatac

SEQ ID NO: 550014 - DNA, 13 bp, Homo sapiens
tgtatatatacat

SEQ ID NO: 550015 - DNA, 14 bp, Homo sapiens
tgtatatatacata

SEQ ID NO: 550016 - DNA, 17 bp, Homo sapiens
tgtatatatacatacac

SEQ ID NO: 550017 - DNA, 18 bp, Homo sapiens
tgtatatatacatacact

SEQ ID NO: 550018 - DNA, 19 bp, Homo sapiens
tgtatatatacatacactt

SEQ ID NO: 550019 - DNA, 15 bp, Homo sapiens
tgtatatatatgtga

SEQ ID NO: 550020 - DNA, 16 bp, Homo sapiens
tgtatatatatgtgaa

SEQ ID NO: 550021 - DNA, 15 bp, Homo sapiens
tgtatatatgtgtat

SEQ ID NO: 550022 - DNA, 18 bp, Homo sapiens
tgtatatgaggatgtatg

SEQ ID NO: 550023 - DNA, 21 bp, Homo sapiens
tgtatatgaggatgtatgtgt

SEQ ID NO: 550024 - DNA, 15 bp, Homo sapiens
tgtatatgtgatttt

SEQ ID NO: 550025 - DNA, 18 bp, Homo sapiens
tgtatatgtgattttcaa

SEQ ID NO: 550026 - DNA, 15 bp, Homo sapiens
tgtatctgacatatt

SEQ ID NO: 550027 - DNA, 19 bp, Homo sapiens
tgtatctgacatatttcat

SEQ ID NO: 550028 - DNA, 19 bp, Homo sapiens
tgtatgcaagcagtttcaa

SEQ ID NO: 550029 - DNA, 17 bp, Homo sapiens
tgtatgcataataatcc

SEQ ID NO: 550030 - DNA, 19 bp, Homo sapiens
tgtatggaagacaaataca

SEQ ID NO: 550031 - DNA, 22 bp, Homo sapiens
tgtatggaagacaaatacacat

SEQ ID NO: 550032 - DNA, 13 bp, Homo sapiens
tgtatgtgtatat

SEQ ID NO: 550033 - DNA, 17 bp, Homo sapiens
tgtatgtttacactgtc

SEQ ID NO: 550034 - DNA, 19 bp, Homo sapiens
tgtattatacttagtcaaa

SEQ ID NO: 550035 - DNA, 19 bp, Homo sapiens
tgtatttaaaacatttcat

SEQ ID NO: 550036 - DNA, 22 bp, Homo sapiens
tgtatttaaaacatttcatgta

SEQ ID NO: 550037 - DNA, 23 bp, Homo sapiens
tgtatttattgaagaaacagata

SEQ ID NO: 550038 - DNA, 16 bp, Homo sapiens
tgtattttatgtatgt

SEQ ID NO: 550039 - DNA, 18 bp, Homo sapiens
tgtattttatgtatgttt

SEQ ID NO: 550040 - DNA, 15 bp, Homo sapiens
tgtattttgtgagtt

SEQ ID NO: 550041 - DNA, 22 bp, Homo sapiens
tgtattttgtgagtttgtttct

SEQ ID NO: 550042 - DNA, 18 bp, Homo sapiens
tgtcaagtggcaaagctg

SEQ ID NO: 550043 - DNA, 22 bp, Homo sapiens
tgtcaagtttttatacctgtac

SEQ ID NO: 550044 - DNA, 13 bp, Homo sapiens
tgtcactgctgta

SEQ ID NO: 550045 - DNA, 18 bp, Homo sapiens
tgtcactgttataaattt

SEQ ID NO: 550046 - DNA, 22 bp, Homo sapiens
tgtcactgttataaattttgta

SEQ ID NO: 550047 - DNA, 23 bp, Homo sapiens
tgtcagactatccattttacact

SEQ ID NO: 550048 - DNA, 22 bp, Homo sapiens
tgtcatattttcctttatgtga

SEQ ID NO: 550049 - DNA, 13 bp, Homo sapiens
tgtcattgcttct

SEQ ID NO: 550050 - DNA, 18 bp, Homo sapiens
tgtcattgcttcttctga

SEQ ID NO: 550051 - DNA, 14 bp, Homo sapiens
tgtcattttcatta

SEQ ID NO: 550052 - DNA, 23 bp, Homo sapiens
tgtccaactgagaagtaccttat

SEQ ID NO: 550053 - DNA, 16 bp, Homo sapiens
tgtccatattttcaca

SEQ ID NO: 550054 - DNA, 12 bp, Homo sapiens
tgtccccaaagt

SEQ ID NO: 550055 - DNA, 21 bp, Homo sapiens
tgtccccaaagtaccacactg

SEQ ID NO: 550056 - DNA, 13 bp, Homo sapiens
tgtcccctgcctg

SEQ ID NO: 550057 - DNA, 16 bp, Homo sapiens
tgtccctcaattacag

SEQ ID NO: 550058 - DNA, 17 bp, Homo sapiens
tgtccctggcttcctta

SEQ ID NO: 550059 - DNA, 20 bp, Homo sapiens
tgtccctttctgtgtgaaga

SEQ ID NO: 550060 - DNA, 12 bp, Homo sapiens
tgtccctttctt

SEQ ID NO: 550061 - DNA, 14 bp, Homo sapiens
tgtccctttcttct

SEQ ID NO: 550062 - DNA, 17 bp, Homo sapiens
tgtccctttcttctccc

SEQ ID NO: 550063 - DNA, 21 bp, Homo sapiens
tgtccgtgaaagttgtgatct

SEQ ID NO: 550064 - DNA, 13 bp, Homo sapiens
tgtcctatgtgtg

SEQ ID NO: 550065 - DNA, 14 bp, Homo sapiens
tgtcctatgtgtga

SEQ ID NO: 550066 - DNA, 14 bp, Homo sapiens
tgtccttggggaca

SEQ ID NO: 550067 - DNA, 17 bp, Homo sapiens
tgtcgatgagactgttt

SEQ ID NO: 550068 - DNA, 19 bp, Homo sapiens
tgtcggctccagtccccag

SEQ ID NO: 550069 - DNA, 23 bp, Homo sapiens
tgtcggctccagtccccagaact

SEQ ID NO: 550070 - DNA, 13 bp, Homo sapiens
tgtcgtccccaga

SEQ ID NO: 550071 - DNA, 14 bp, Homo sapiens
tgtctactgaagct

SEQ ID NO: 550072 - DNA, 16 bp, Homo sapiens
tgtctagcacttcctt

SEQ ID NO: 550073 - DNA, 18 bp, Homo sapiens
tgtctagcacttccttgc

SEQ ID NO: 550074 - DNA, 21 bp, Homo sapiens
tgtctagcacttccttgccag

SEQ ID NO: 550075 - DNA, 22 bp, Homo sapiens
tgtctaggtagagatattggaa

SEQ ID NO: 550076 - DNA, 23 bp, Homo sapiens
tgtctaggtagagatattggaag

SEQ ID NO: 550077 - DNA, 14 bp, Homo sapiens
tgtctcaaaataaa

SEQ ID NO: 550078 - DNA, 19 bp, Homo sapiens
tgtctcaaaataaaaccag

SEQ ID NO: 550079 - DNA, 18 bp, Homo sapiens
tgtctccacccaccttga

SEQ ID NO: 550080 - DNA, 14 bp, Homo sapiens
tgtctccagctgat

SEQ ID NO: 550081 - DNA, 16 bp, Homo sapiens
tgtctccagctgattt

SEQ ID NO: 550082 - DNA, 17 bp, Homo sapiens
tgtctgccccaagtttt

SEQ ID NO: 550083 - DNA, 18 bp, Homo sapiens
tgtctgctggtcacttct

SEQ ID NO: 550084 - DNA, 22 bp, Homo sapiens
tgtctgctggtcacttcttctg

SEQ ID NO: 550085 - DNA, 23 bp, Homo sapiens
tgtctgctggtcacttcttctgt

SEQ ID NO: 550086 - DNA, 23 bp, Homo sapiens
tgtctgcttagtatctcatcaac

SEQ ID NO: 550087 - DNA, 22 bp, Homo sapiens
tgtctggaggggagctctgtct

SEQ ID NO: 550088 - DNA, 14 bp, Homo sapiens
tgtctgtcctttat

SEQ ID NO: 550089 - DNA, 21 bp, Homo sapiens
tgtaaagatattgtatctcct

SEQ ID NO: 550090 - DNA, 21 bp, Homo sapiens
tgtaaatgaagtaacttgtct

SEQ ID NO: 550091 - DNA, 15 bp, Homo sapiens
tgtaaatggcattga

SEQ ID NO: 550092 - DNA, 17 bp, Homo sapiens
tgtaaattccaaagatc

SEQ ID NO: 550093 - DNA, 13 bp, Homo sapiens
tgtaactatgttt

SEQ ID NO: 550094 - DNA, 18 bp, Homo sapiens
tgtaactattgggtgaat

SEQ ID NO: 550095 - DNA, 17 bp, Homo sapiens
tgtaactgttaccattg

SEQ ID NO: 550096 - DNA, 23 bp, Homo sapiens
tgtaagctgtttggttttaaaat

SEQ ID NO: 550097 - DNA, 20 bp, Homo sapiens
tgtaagtactctaatataca

SEQ ID NO: 550098 - DNA, 23 bp, Homo sapiens
tgtaagtactctaatatacagtg

SEQ ID NO: 550099 - DNA, 22 bp, Homo sapiens
tgtaatatcagttacagtggca

SEQ ID NO: 550100 - DNA, 17 bp, Homo sapiens
tgtaatcacactctctt

SEQ ID NO: 550101 - DNA, 12 bp, Homo sapiens
tgtaatgtaact

SEQ ID NO: 550102 - DNA, 18 bp, Homo sapiens
tgtaatgtaactgctctt

SEQ ID NO: 550103 - DNA, 17 bp, Homo sapiens
tgtaatttcctgctcct

SEQ ID NO: 550104 - DNA, 12 bp, Homo sapiens
ttatcattgttt

SEQ ID NO: 550105 - DNA, 13 bp, Homo sapiens
ttatcctttgtga

SEQ ID NO: 550106 - DNA, 13 bp, Homo sapiens
ttatctcttcttc

SEQ ID NO: 550107 - DNA, 14 bp, Homo sapiens
ttatctttctttcc

SEQ ID NO: 550108 - DNA, 17 bp, Homo sapiens
ttatgagatcactgaac

SEQ ID NO: 550109 - DNA, 21 bp, Homo sapiens
ttatgatctggcccttgctta

SEQ ID NO: 550110 - DNA, 22 bp, Homo sapiens
ttatgcgcaaatacaaaatgat

SEQ ID NO: 550111 - DNA, 14 bp, Homo sapiens
ttatgcttccagaa

SEQ ID NO: 550112 - DNA, 15 bp, Homo sapiens
ttatgcttccagaaa

SEQ ID NO: 550113 - DNA, 16 bp, Homo sapiens
ttatgcttccagaaac

SEQ ID NO: 550114 - DNA, 19 bp, Homo sapiens
ttatgtatgtttacactgt

SEQ ID NO: 550115 - DNA, 13 bp, Homo sapiens
ttatgttaaaatc

SEQ ID NO: 550116 - DNA, 12 bp, Homo sapiens
ttatgttatgaa

SEQ ID NO: 550117 - DNA, 13 bp, Homo sapiens
ttatgttgtaata

SEQ ID NO: 550118 - DNA, 19 bp, Homo sapiens
ttatgtttaaaatggcatt

SEQ ID NO: 550119 - DNA, 20 bp, Homo sapiens
ttatgtttaaaatggcattt

SEQ ID NO: 550120 - DNA, 18 bp, Homo sapiens
ttatgttttggtccactt

SEQ ID NO: 550121 - DNA, 20 bp, Homo sapiens
ttatgttttggtccactttt

SEQ ID NO: 550122 - DNA, 14 bp, Homo sapiens
ttattaaagtttca

SEQ ID NO: 550123 - DNA, 19 bp, Homo sapiens
ttattaaagtttcaaaaat

SEQ ID NO: 550124 - DNA, 15 bp, Homo sapiens
ttattaccagattca

SEQ ID NO: 550125 - DNA, 20 bp, Homo sapiens
ttattacttgttgcaaaggt

SEQ ID NO: 550126 - DNA, 16 bp, Homo sapiens
ttattcattagctgtg

SEQ ID NO: 550127 - DNA, 20 bp, Homo sapiens
ttattccatattagaaaact

SEQ ID NO: 550128 - DNA, 23 bp, Homo sapiens
ttattccatattagaaaactttg

SEQ ID NO: 550129 - DNA, 19 bp, Homo sapiens
ttattgagagagatgtgta

SEQ ID NO: 550130 - DNA, 19 bp, Homo sapiens
ttattgaggaaaaatatgt

SEQ ID NO: 550131 - DNA, 22 bp, Homo sapiens
ttattgaggaaaaatatgtgaa

SEQ ID NO: 550132 - DNA, 14 bp, Homo sapiens
ttatttatagtcat

SEQ ID NO: 550133 - DNA, 12 bp, Homo sapiens
ttatttattctg

SEQ ID NO: 550134 - DNA, 14 bp, Homo sapiens
ttatttctcctttt

SEQ ID NO: 550135 - DNA, 18 bp, Homo sapiens
ttatttgctcataagtaa

SEQ ID NO: 550136 - DNA, 20 bp, Homo sapiens
ttatttgctcataagtaaat

SEQ ID NO: 550137 - DNA, 21 bp, Homo sapiens
ttattttttttcttccaacat

SEQ ID NO: 550138 - DNA, 23 bp, Homo sapiens
ttcaaaataaagcttttgcatag

SEQ ID NO: 550139 - DNA, 23 bp, Homo sapiens
ttcaaaccaatttcttccttcca

SEQ ID NO: 550140 - DNA, 13 bp, Homo sapiens
ttcaaagaatcac

SEQ ID NO: 550141 - DNA, 15 bp, Homo sapiens
ttcaaatatgtaaac

SEQ ID NO: 550142 - DNA, 17 bp, Homo sapiens
ttcaagaaaaaataaat

SEQ ID NO: 550143 - DNA, 14 bp, Homo sapiens
ttcaagaacttgtt

SEQ ID NO: 550144 - DNA, 15 bp, Homo sapiens
ttcaagaacttgttt

SEQ ID NO: 550145 - DNA, 14 bp, Homo sapiens
ttcaagcttatttt

SEQ ID NO: 550146 - DNA, 20 bp, Homo sapiens
ttcaagcttattttggagag

SEQ ID NO: 550147 - DNA, 22 bp, Homo sapiens
ttcaagggctttcctgtgccag

SEQ ID NO: 550148 - DNA, 15 bp, Homo sapiens
ttcaataaagtttga

SEQ ID NO: 550149 - DNA, 22 bp, Homo sapiens
ttcaatctcgtatagaagtctt

SEQ ID NO: 550150 - DNA, 23 bp, Homo sapiens
ttcaatctcgtatagaagtcttc

SEQ ID NO: 550151 - DNA, 16 bp, Homo sapiens
ttcaatgctacaaaat

SEQ ID NO: 550152 - DNA, 20 bp, Homo sapiens
ttcaattcatagaataacaa

SEQ ID NO: 550153 - DNA, 16 bp, Homo sapiens
ttcaatttattgcaca

SEQ ID NO: 550154 - DNA, 12 bp, Homo sapiens
ttcacaaatatt

SEQ ID NO: 550155 - DNA, 14 bp, Homo sapiens
ttcacaaatattaa

SEQ ID NO: 550156 - DNA, 15 bp, Homo sapiens
ttcacaaatattaaa

SEQ ID NO: 550157 - DNA, 19 bp, Homo sapiens
ttcacaaatattaaaaagt

SEQ ID NO: 550158 - DNA, 18 bp, Homo sapiens
ttcacaggtgtggtgtaa

SEQ ID NO: 550159 - DNA, 20 bp, Homo sapiens
ttcacaggtgtggtgtaatt

SEQ ID NO: 550160 - DNA, 14 bp, Homo sapiens
ttcacagtgtctgt

SEQ ID NO: 550161 - DNA, 17 bp, Homo sapiens
ttcacagtgtctgtaaa

SEQ ID NO: 550162 - DNA, 15 bp, Homo sapiens
ttcacatgttttcaa

SEQ ID NO: 550163 - DNA, 14 bp, Homo sapiens
ttcacgcaacttga

SEQ ID NO: 550164 - DNA, 22 bp, Homo sapiens
ttcactctaagatgttatattt

SEQ ID NO: 550165 - DNA, 20 bp, Homo sapiens
ttcactgtcaccaccctgct

SEQ ID NO: 550166 - DNA, 15 bp, Homo sapiens
ttcactgtctgtctg

SEQ ID NO: 550167 - DNA, 19 bp, Homo sapiens
ttcacttctgactcttccc

SEQ ID NO: 550168 - DNA, 16 bp, Homo sapiens
ttcacttctttccctt

SEQ ID NO: 550169 - DNA, 22 bp, Homo sapiens
ttcacttctttcccttcctcca

SEQ ID NO: 550170 - DNA, 18 bp, Homo sapiens
tttattaaaagagtagaa

SEQ ID NO: 550171 - DNA, 22 bp, Homo sapiens
tttattaccagattcacttctg

SEQ ID NO: 550172 - DNA, 18 bp, Homo sapiens
tttattgaggaaaaatat

SEQ ID NO: 550173 - DNA, 16 bp, Homo sapiens
tttatttctgtatctg

SEQ ID NO: 550174 - DNA, 13 bp, Homo sapiens
tttcaaaaatctg

SEQ ID NO: 550175 - DNA, 24 bp, Homo sapiens
tttcaaaaatctgaagattgttta

SEQ ID NO: 550176 - DNA, 18 bp, Homo sapiens
tttcaaaagacatgttgt

SEQ ID NO: 550177 - DNA, 19 bp, Homo sapiens
tttcaaagacttcatttaa

SEQ ID NO: 550178 - DNA, 23 bp, Homo sapiens
tttcaaagacttcatttaacact

SEQ ID NO: 550179 - DNA, 19 bp, Homo sapiens
tttcaaatatgtaaacttt

SEQ ID NO: 550180 - DNA, 21 bp, Homo sapiens
tttcaaatatgtaaactttaa

SEQ ID NO: 550181 - DNA, 18 bp, Homo sapiens
tttcaagcttattttgga

SEQ ID NO: 550182 - DNA, 13 bp, Homo sapiens
tttcaataaagtt

SEQ ID NO: 550183 - DNA, 12 bp, Homo sapiens
tttcacaaatat

SEQ ID NO: 550184 - DNA, 20 bp, Homo sapiens
tttcacaaatattaaaaagt

SEQ ID NO: 550185 - DNA, 22 bp, Homo sapiens
tttcacaaatattaaaaagtct

SEQ ID NO: 550186 - DNA, 16 bp, Homo sapiens
tttcacctatctggaa

SEQ ID NO: 550187 - DNA, 23 bp, Homo sapiens
tttcacttctttcccttcctcca

SEQ ID NO: 550188 - DNA, 19 bp, Homo sapiens
tttcagatttgcacaaaaa

SEQ ID NO: 550189 - DNA, 13 bp, Homo sapiens
tttcagcaggcag

SEQ ID NO: 550190 - DNA, 14 bp, Homo sapiens
tttcagcaggcagc

SEQ ID NO: 550191 - DNA, 13 bp, Homo sapiens
tttcagttcaaag

SEQ ID NO: 550192 - DNA, 14 bp, Homo sapiens
tttcagttcaaagt

SEQ ID NO: 550193 - DNA, 21 bp, Homo sapiens
tttcatagataccattttgaa

SEQ ID NO: 550194 - DNA, 18 bp, Homo sapiens
tttcatattttaatttca

SEQ ID NO: 550195 - DNA, 18 bp, Homo sapiens
tttcatggagtagagtca

SEQ ID NO: 550196 - DNA, 15 bp, Homo sapiens
tttcatgtatttctt

SEQ ID NO: 550197 - DNA, 22 bp, Homo sapiens
tttcatgtcctgtgtcagttta

SEQ ID NO: 550198 - DNA, 12 bp, Homo sapiens
tttcattagcaa

SEQ ID NO: 550199 - DNA, 15 bp, Homo sapiens
tttcattagcaaaaa

SEQ ID NO: 550200 - DNA, 16 bp, Homo sapiens
tttcattagcaaaaaa

SEQ ID NO: 550201 - DNA, 21 bp, Homo sapiens
tttcattagcaaaaaaagttg

SEQ ID NO: 550202 - DNA, 21 bp, Homo sapiens
tttcattttacagttactttt

SEQ ID NO: 550203 - DNA, 15 bp, Homo sapiens
tttccaacaccacag

SEQ ID NO: 550204 - DNA, 20 bp, Homo sapiens
tttccaacaccacagacaca

SEQ ID NO: 550205 - DNA, 21 bp, Homo sapiens
tttccaacaccacagacacac

SEQ ID NO: 550206 - DNA, 16 bp, Homo sapiens
tttccaacatacaatt

SEQ ID NO: 550207 - DNA, 18 bp, Homo sapiens
tttccaagtaatataatg

SEQ ID NO: 550208 - DNA, 21 bp, Homo sapiens
tttccaagtaatataatggaa

SEQ ID NO: 550209 - DNA, 17 bp, Homo sapiens
tttccaattctccttta

SEQ ID NO: 550210 - DNA, 14 bp, Homo sapiens
tttccagtgctgct

SEQ ID NO: 550211 - DNA, 14 bp, Homo sapiens
tttccatgtatgca

SEQ ID NO: 550212 - DNA, 15 bp, Homo sapiens
tttccatgtatgcat

SEQ ID NO: 550213 - DNA, 23 bp, Homo sapiens
tttcccaatctctacccctttct

SEQ ID NO: 550214 - DNA, 13 bp, Homo sapiens
tttcccacactgt

SEQ ID NO: 550215 - DNA, 18 bp, Homo sapiens
tttcccacactgtgaact

SEQ ID NO: 550216 - DNA, 18 bp, Homo sapiens
tttccccaattatcctcc

SEQ ID NO: 550217 - DNA, 13 bp, Homo sapiens
tttccccctttct

SEQ ID NO: 550218 - DNA, 14 bp, Homo sapiens
tttccccctttctt

SEQ ID NO: 550219 - DNA, 17 bp, Homo sapiens
tttccccctttcttcct

SEQ ID NO: 550220 - DNA, 15 bp, Homo sapiens
tttcccttcttctgt

SEQ ID NO: 550221 - DNA, 22 bp, Homo sapiens
tttcctaacaggattagacagt

SEQ ID NO: 550222 - DNA, 14 bp, Homo sapiens
tttcctataccatt

SEQ ID NO: 550223 - DNA, 16 bp, Homo sapiens
tttccttacataaaca

SEQ ID NO: 550224 - DNA, 19 bp, Homo sapiens
tttccttcaagccagcaac

SEQ ID NO: 550225 - DNA, 15 bp, Homo sapiens
tttcgatgtttttga

SEQ ID NO: 550226 - DNA, 20 bp, Homo sapiens
tttcggaccgaaggtgacag

SEQ ID NO: 550227 - DNA, 18 bp, Homo sapiens
tttctaactctgatgtaa

SEQ ID NO: 550228 - DNA, 20 bp, Homo sapiens
tttctaactctgatgtaaat

SEQ ID NO: 550229 - DNA, 22 bp, Homo sapiens
tttctaactctgatgtaaatga

SEQ ID NO: 550230 - DNA, 18 bp, Homo sapiens
tttctagacactttttct

SEQ ID NO: 550231 - DNA, 15 bp, Homo sapiens
tttctagcaattgct

SEQ ID NO: 550232 - DNA, 14 bp, Homo sapiens
tttctagttattta

SEQ ID NO: 550233 - DNA, 12 bp, Homo sapiens
tttctattttac

SEQ ID NO: 550234 - DNA, 19 bp, Homo sapiens
tttctattttaccactaat

SEQ ID NO: 550235 - DNA, 19 bp, Homo sapiens
tttctccttttgtgttcca

SEQ ID NO: 550236 - DNA, 19 bp, Homo sapiens
tttctcttctccccttcca

SEQ ID NO: 550237 - DNA, 17 bp, Homo sapiens
tttctgaaactaatgaa

SEQ ID NO: 550238 - DNA, 20 bp, Homo sapiens
tttctggggggatatttcct

SEQ ID NO: 550239 - DNA, 12 bp, Homo sapiens
tttctgtataga

SEQ ID NO: 550240 - DNA, 13 bp, Homo sapiens
tttctgtcattca

SEQ ID NO: 550241 - DNA, 16 bp, Homo sapiens
tttcttaatatatagc

SEQ ID NO: 550242 - DNA, 14 bp, Homo sapiens
tttcttgcaatttg

SEQ ID NO: 550243 - DNA, 15 bp, Homo sapiens
tttcttgcaatttga

SEQ ID NO: 550244 - DNA, 21 bp, Homo sapiens
tttctttagaacaacataaaa

SEQ ID NO: 550245 - DNA, 19 bp, Homo sapiens
tttctttccatttacagtc

SEQ ID NO: 550246 - DNA, 21 bp, Homo sapiens
tttcttttgttttttgaagtg

SEQ ID NO: 550247 - DNA, 18 bp, Homo sapiens
tttcttttttaattgaaa

SEQ ID NO: 550248 - DNA, 12 bp, Homo sapiens
tttgaaacattg

SEQ ID NO: 550249 - DNA, 18 bp, Homo sapiens
tttgaaacattgctttta

SEQ ID NO: 550250 - DNA, 23 bp, Homo sapiens
tttgaaacattgcttttaaaact

SEQ ID NO: 550251 - DNA, 22 bp, Homo sapiens
tttgaaatatatggtctaatgt

SEQ ID NO: 550252 - DNA, 15 bp, Homo sapiens
tttgaagtgcctctg

SEQ ID NO: 550253 - DNA, 17 bp, Homo sapiens
tttgaagtgcctctgat

SEQ ID NO: 550254 - DNA, 20 bp, Homo sapiens
tttgaattttcattttacag

SEQ ID NO: 550255 - DNA, 13 bp, Homo sapiens
tttgataaatagt

SEQ ID NO: 550256 - DNA, 18 bp, Homo sapiens
tttgatatgagtatacaa

SEQ ID NO: 550257 - DNA, 16 bp, Homo sapiens
tttgatcaaatgtaca

SEQ ID NO: 550258 - DNA, 20 bp, Homo sapiens
tttgatcaaatgtacatctc

SEQ ID NO: 550259 - DNA, 18 bp, Homo sapiens
tttgatcttcctctgcta

SEQ ID NO: 550260 - DNA, 19 bp, Homo sapiens
tttgatcttcctctgctaa

SEQ ID NO: 550261 - DNA, 20 bp, Homo sapiens
tttgatcttcctctgctaaa

SEQ ID NO: 550262 - DNA, 21 bp, Homo sapiens
tttgattcacatgttttcaaa

SEQ ID NO: 550263 - DNA, 16 bp, Homo sapiens
tttgatttctaagtgt

SEQ ID NO: 550264 - DNA, 19 bp, Homo sapiens
tttgcaacagcaaattaat

SEQ ID NO: 550265 - DNA, 20 bp, Homo sapiens
tttgcaacagcaaattaatg

SEQ ID NO: 550266 - DNA, 22 bp, Homo sapiens
tttgcaacagcaaattaatgtg

SEQ ID NO: 550267 - DNA, 13 bp, Homo sapiens
tttgcaaccttta

SEQ ID NO: 550268 - DNA, 18 bp, Homo sapiens
tttgcagataattctgga

SEQ ID NO: 550269 - DNA, 20 bp, Homo sapiens
tttgcagctatggacaattt

SEQ ID NO: 550270 - DNA, 17 bp, Homo sapiens
tttgcatgtcgcacaat

SEQ ID NO: 550271 - DNA, 23 bp, Homo sapiens
tttgcccccaaacccccattctg

SEQ ID NO: 550272 - DNA, 23 bp, Homo sapiens
tttgctaagtaaatctcttctgt

SEQ ID NO: 550273 - DNA, 14 bp, Homo sapiens
tttgctaattaaaa

SEQ ID NO: 550274 - DNA, 19 bp, Homo sapiens
tttgctaattaaaaagtta

SEQ ID NO: 550275 - DNA, 15 bp, Homo sapiens
tttgctcataagtaa

SEQ ID NO: 550276 - DNA, 19 bp, Homo sapiens
tttgctcataagtaaatgt

SEQ ID NO: 550277 - DNA, 19 bp, Homo sapiens
tttgctttttagttttgct

SEQ ID NO: 550278 - DNA, 21 bp, Homo sapiens
tttggaaaacgatttaattta

SEQ ID NO: 550279 - DNA, 13 bp, Homo sapiens
tttggaaaattca

SEQ ID NO: 550280 - DNA, 15 bp, Homo sapiens
atatacctataatgt

SEQ ID NO: 550281 - DNA, 14 bp, Homo sapiens
atatactcaagttt

SEQ ID NO: 550282 - DNA, 15 bp, Homo sapiens
atatataaaatacac

SEQ ID NO: 550283 - DNA, 17 bp, Homo sapiens
atatataaaatacacgt

SEQ ID NO: 550284 - DNA, 21 bp, Homo sapiens
atatataaaatacacgtgtat

SEQ ID NO: 550285 - DNA, 23 bp, Homo sapiens
atatataaaatacacgtgtatat

SEQ ID NO: 550286 - DNA, 12 bp, Homo sapiens
atatatacatac

SEQ ID NO: 550287 - DNA, 14 bp, Homo sapiens
atatatacatacac

SEQ ID NO: 550288 - DNA, 18 bp, Homo sapiens
atatatacatacacttgt

SEQ ID NO: 550289 - DNA, 15 bp, Homo sapiens
atatatacatacgca

SEQ ID NO: 550290 - DNA, 14 bp, Homo sapiens
atatatacatatgt

SEQ ID NO: 550291 - DNA, 16 bp, Homo sapiens
atatatacattttgca

SEQ ID NO: 550292 - DNA, 13 bp, Homo sapiens
atatatataaata

SEQ ID NO: 550293 - DNA, 18 bp, Homo sapiens
atatatggtctaatgttt

SEQ ID NO: 550294 - DNA, 19 bp, Homo sapiens
atatatggtctaatgttta

SEQ ID NO: 550295 - DNA, 19 bp, Homo sapiens
atatatgtgtatatataca

SEQ ID NO: 550296 - DNA, 23 bp, Homo sapiens
atatatgtgtatatatacataca

SEQ ID NO: 550297 - DNA, 23 bp, Homo sapiens
atatatttgcagataattctgga

SEQ ID NO: 550298 - DNA, 14 bp, Homo sapiens
atatatttgcataa

SEQ ID NO: 550299 - DNA, 16 bp, Homo sapiens
atatcaaaagacacag

SEQ ID NO: 550300 - DNA, 16 bp, Homo sapiens
atatcaagatgattct

SEQ ID NO: 550301 - DNA, 19 bp, Homo sapiens
tttgttcttaaaaatgcat

SEQ ID NO: 550302 - DNA, 12 bp, Homo sapiens
tttgttcttaca

SEQ ID NO: 550303 - DNA, 19 bp, Homo sapiens
tttgttttttgaagtgttg

SEQ ID NO: 550304 - DNA, 22 bp, Homo sapiens
ttttaaaaaatgaaaataagtg

SEQ ID NO: 550305 - DNA, 18 bp, Homo sapiens
ttttaaaaagtattgcca

SEQ ID NO: 550306 - DNA, 13 bp, Homo sapiens
ttttaaaagaaat

SEQ ID NO: 550307 - DNA, 12 bp, Homo sapiens
ttttaaaatctt

SEQ ID NO: 550308 - DNA, 20 bp, Homo sapiens
ttttaaaggaaaaatcataa

SEQ ID NO: 550309 - DNA, 16 bp, Homo sapiens
ttttaagcaacacttg

SEQ ID NO: 550310 - DNA, 18 bp, Homo sapiens
ttttaagcctttgaagtg

SEQ ID NO: 550311 - DNA, 16 bp, Homo sapiens
ttttaagtgaaattta

SEQ ID NO: 550312 - DNA, 19 bp, Homo sapiens
ttttaatttcaagcttatt

SEQ ID NO: 550313 - DNA, 16 bp, Homo sapiens
ttttaattttgtctgc

SEQ ID NO: 550314 - DNA, 23 bp, Homo sapiens
ttttacaaaggctgtattcagca

SEQ ID NO: 550315 - DNA, 22 bp, Homo sapiens
ttttaccactaattttgtttta

SEQ ID NO: 550316 - DNA, 22 bp, Homo sapiens
ttttactaccaatgccaagata

SEQ ID NO: 550317 - DNA, 18 bp, Homo sapiens
ttttactgtcttaattaa

SEQ ID NO: 550318 - DNA, 13 bp, Homo sapiens
ttttagttttgct

SEQ ID NO: 550319 - DNA, 16 bp, Homo sapiens
ttttagtttttctgtc

SEQ ID NO: 550320 - DNA, 20 bp, Homo sapiens
ttttataaaaaaaatgaaat

SEQ ID NO: 550321 - DNA, 20 bp, Homo sapiens
ttttatacctgtacacacac

SEQ ID NO: 550322 - DNA, 13 bp, Homo sapiens
ttttatgcgcaaa

SEQ ID NO: 550323 - DNA, 17 bp, Homo sapiens
ttttatgcgcaaataca

SEQ ID NO: 550324 - DNA, 12 bp, Homo sapiens
ttttatgttgac

SEQ ID NO: 550325 - DNA, 18 bp, Homo sapiens
ttttatgttgacatttgt

SEQ ID NO: 550326 - DNA, 18 bp, Homo sapiens
ttttatgtttaaaatggc

SEQ ID NO: 550327 - DNA, 13 bp, Homo sapiens
ttttattgctgga

SEQ ID NO: 550328 - DNA, 18 bp, Homo sapiens
ttttatttctccttttgt

SEQ ID NO: 550329 - DNA, 20 bp, Homo sapiens
ttttcaaatatgtaaacttt

SEQ ID NO: 550330 - DNA, 23 bp, Homo sapiens
ttttcaaatatgtaaactttaac

SEQ ID NO: 550331 - DNA, 14 bp, Homo sapiens
ttttcaaggcattt

SEQ ID NO: 550332 - DNA, 20 bp, Homo sapiens
ttttcaatctcgtatagaag

SEQ ID NO: 550333 - DNA, 13 bp, Homo sapiens
ttttcagatttgc

SEQ ID NO: 550334 - DNA, 15 bp, Homo sapiens
ttttcagatttgcac

SEQ ID NO: 550335 - DNA, 21 bp, Homo sapiens
ttttcagctaggaacaaatct

SEQ ID NO: 550336 - DNA, 22 bp, Homo sapiens
ttttcagctaggaacaaatctt

SEQ ID NO: 550337 - DNA, 23 bp, Homo sapiens
ttttcagctcaattgttaatgtg

SEQ ID NO: 550338 - DNA, 15 bp, Homo sapiens
ttttcatattttaat

SEQ ID NO: 550339 - DNA, 19 bp, Homo sapiens
ttttcattacaatggaaac

SEQ ID NO: 550340 - DNA, 14 bp, Homo sapiens
ttttcattgtgttt

SEQ ID NO: 550341 - DNA, 20 bp, Homo sapiens
ttttccagggcaatcaatgt

SEQ ID NO: 550342 - DNA, 21 bp, Homo sapiens
ttttcctatgactcaaagatg

SEQ ID NO: 550343 - DNA, 19 bp, Homo sapiens
ttttccttacataaacatc

SEQ ID NO: 550344 - DNA, 13 bp, Homo sapiens
ttttccttgcata

SEQ ID NO: 550345 - DNA, 22 bp, Homo sapiens
ttttctactttaaattgtggat

SEQ ID NO: 550346 - DNA, 14 bp, Homo sapiens
ttttcttaaaaagt

SEQ ID NO: 550347 - DNA, 22 bp, Homo sapiens
ttttcttccaacatgtgatgtg

SEQ ID NO: 550348 - DNA, 16 bp, Homo sapiens
ttttctttacagtctt

SEQ ID NO: 550349 - DNA, 12 bp, Homo sapiens
ttttctttcagt

SEQ ID NO: 550350 - DNA, 15 bp, Homo sapiens
ttttcttttaatttt

SEQ ID NO: 550351 - DNA, 13 bp, Homo sapiens
ttttgaaacaaac

SEQ ID NO: 550352 - DNA, 21 bp, Homo sapiens
ttttgatcaaatgtacatctc

SEQ ID NO: 550353 - DNA, 15 bp, Homo sapiens
ttttgatcagtgtta

SEQ ID NO: 550354 - DNA, 18 bp, Homo sapiens
ttttgcatgtcgcacaat

SEQ ID NO: 550355 - DNA, 16 bp, Homo sapiens
ttttgctgctgaattt

SEQ ID NO: 550356 - DNA, 16 bp, Homo sapiens
ttttgggaggatttga

SEQ ID NO: 550357 - DNA, 15 bp, Homo sapiens
ttttgtaaactttga

SEQ ID NO: 550358 - DNA, 19 bp, Homo sapiens
ttttgtaaactttgaaata

SEQ ID NO: 550359 - DNA, 15 bp, Homo sapiens
ttttgtacatttttg

SEQ ID NO: 550360 - DNA, 19 bp, Homo sapiens
ttttgttgattaaaacatt

SEQ ID NO: 550361 - DNA, 12 bp, Homo sapiens
ttttgttgcact

SEQ ID NO: 550362 - DNA, 21 bp, Homo sapiens
ttttgttgcactgaagtttga

SEQ ID NO: 550363 - DNA, 12 bp, Homo sapiens
ttttgttttcat

SEQ ID NO: 550364 - DNA, 14 bp, Homo sapiens
ttttgttttcatta

SEQ ID NO: 550365 - DNA, 17 bp, Homo sapiens
tttttaacctctgttca

SEQ ID NO: 550366 - DNA, 14 bp, Homo sapiens
tttttaagtgaaat

SEQ ID NO: 550367 - DNA, 23 bp, Homo sapiens
tttttatacctgtacacacacag

SEQ ID NO: 550368 - DNA, 15 bp, Homo sapiens
tttttatttctcctt

SEQ ID NO: 550369 - DNA, 17 bp, Homo sapiens
tttttcaaagacttcat

SEQ ID NO: 550370 - DNA, 23 bp, Homo sapiens
tttttcaaggcatttattgccat

SEQ ID NO: 550371 - DNA, 13 bp, Homo sapiens
tttttcattgtgt

SEQ ID NO: 550372 - DNA, 14 bp, Homo sapiens
tttttcattgtgtt

SEQ ID NO: 550373 - DNA, 15 bp, Homo sapiens
tttttccttacataa

SEQ ID NO: 550374 - DNA, 19 bp, Homo sapiens
tttttccttacataaacat

SEQ ID NO: 550375 - DNA, 14 bp, Homo sapiens
tttttgaagtgttg

SEQ ID NO: 550376 - DNA, 13 bp, Homo sapiens
tttttgttttcat

SEQ ID NO: 550377 - DNA, 17 bp, Homo sapiens
aaatgcacaatgtcttg

SEQ ID NO: 550378 - DNA, 16 bp, Homo sapiens
aaatgccgctgtgtcc

SEQ ID NO: 550379 - DNA, 22 bp, Homo sapiens
aaatgctatgtcatttcatgtc

SEQ ID NO: 550380 - DNA, 18 bp, Homo sapiens
aaatgcttttccaaccca

SEQ ID NO: 550381 - DNA, 21 bp, Homo sapiens
aaatgcttttccaacccatga

SEQ ID NO: 550382 - DNA, 17 bp, Homo sapiens
aaatggatagattgttt

SEQ ID NO: 550383 - DNA, 15 bp, Homo sapiens
aaatggcaacaaact

SEQ ID NO: 550384 - DNA, 20 bp, Homo sapiens
aaatggcttgttcagtcact

SEQ ID NO: 550385 - DNA, 11 bp, Homo sapiens
aaatggggacg

SEQ ID NO: 550386 - DNA, 15 bp, Homo sapiens
aaatgtatatacaca

SEQ ID NO: 550387 - DNA, 18 bp, Homo sapiens
aaatgtatatacacatat

SEQ ID NO: 550388 - DNA, 19 bp, Homo sapiens
aaatgtatatacacatata

SEQ ID NO: 550389 - DNA, 23 bp, Homo sapiens
aaatgtatatacacatataccta

SEQ ID NO: 550390 - DNA, 22 bp, Homo sapiens
aaatgtcactgttataaatttt

SEQ ID NO: 550391 - DNA, 15 bp, Homo sapiens
aaatgtgaattacta

SEQ ID NO: 550392 - DNA, 16 bp, Homo sapiens
aaatgtgaattactaa

SEQ ID NO: 550393 - DNA, 19 bp, Homo sapiens
aaatgtgtatttttcaagg

SEQ ID NO: 550394 - DNA, 20 bp, Homo sapiens
aaatgtgtcttgtattatca

SEQ ID NO: 550395 - DNA, 17 bp, Homo sapiens
aaatgtgtgcttggaaa

SEQ ID NO: 550396 - DNA, 12 bp, Homo sapiens
aaatgttaaaga

SEQ ID NO: 550397 - DNA, 13 bp, Homo sapiens
aaatgttcttcca

SEQ ID NO: 550398 - DNA, 16 bp, Homo sapiens
aaatgttttaaggctt

SEQ ID NO: 550399 - DNA, 13 bp, Homo sapiens
aaatgttttgtaa

SEQ ID NO: 550400 - DNA, 17 bp, Homo sapiens
aaattaacttctatttt

SEQ ID NO: 550401 - DNA, 15 bp, Homo sapiens
aaattaatgtgtaaa

SEQ ID NO: 550402 - DNA, 13 bp, Homo sapiens
aaattacatttcg

SEQ ID NO: 550403 - DNA, 18 bp, Homo sapiens
aaattagggctctaattt

SEQ ID NO: 550404 - DNA, 21 bp, Homo sapiens
aaattagggctctaatttcct

SEQ ID NO: 550405 - DNA, 17 bp, Homo sapiens
aaattatgctaagaatt

SEQ ID NO: 550406 - DNA, 21 bp, Homo sapiens
aaattgaagagagatatatct

SEQ ID NO: 550407 - DNA, 12 bp, Homo sapiens
aaattgatgttg

SEQ ID NO: 550408 - DNA, 21 bp, Homo sapiens
aaattggattattactacaaa

SEQ ID NO: 550409 - DNA, 18 bp, Homo sapiens
aaattggtaccttgcaca

SEQ ID NO: 550410 - DNA, 14 bp, Homo sapiens
aaattgtaatttgg

SEQ ID NO: 550411 - DNA, 21 bp, Homo sapiens
aaattgtggatgaagacccta

SEQ ID NO: 550412 - DNA, 11 bp, Homo sapiens
aaatttaagag

SEQ ID NO: 550413 - DNA, 21 bp, Homo sapiens
aaatttaagagattttatgtt

SEQ ID NO: 550414 - DNA, 15 bp, Homo sapiens
aaatttaagcacaaa

SEQ ID NO: 550415 - DNA, 23 bp, Homo sapiens
aaatttattgaggaaaaatatgt

SEQ ID NO: 550416 - DNA, 12 bp, Homo sapiens
aaatttctggca

SEQ ID NO: 550417 - DNA, 19 bp, Homo sapiens
aaatttctggcaaatattt

SEQ ID NO: 550418 - DNA, 13 bp, Homo sapiens
aaatttgaaacat

SEQ ID NO: 550419 - DNA, 20 bp, Homo sapiens
aaatttgaaacattgctttt

SEQ ID NO: 550420 - DNA, 16 bp, Homo sapiens
aaatttgtgctgggtt

SEQ ID NO: 550421 - DNA, 16 bp, Homo sapiens
aaattttaagctagga

SEQ ID NO: 550422 - DNA, 22 bp, Homo sapiens
aaattttataagcaaatttcaa

SEQ ID NO: 550423 - DNA, 16 bp, Homo sapiens
aaattttattgaatat

SEQ ID NO: 550424 - DNA, 14 bp, Homo sapiens
aaattttgtacatt

SEQ ID NO: 550425 - DNA, 15 bp, Homo sapiens
aaatttttcatattt

SEQ ID NO: 550426 - DNA, 21 bp, Homo sapiens
aaatttttctcagtttgtata

SEQ ID NO: 550427 - DNA, 20 bp, Homo sapiens
aacaaacatggatacttcct

SEQ ID NO: 550428 - DNA, 14 bp, Homo sapiens
aacaaactgcacat

SEQ ID NO: 550429 - DNA, 24 bp, Homo sapiens
aacaaactgcacatgatttcacaa

SEQ ID NO: 550430 - DNA, 11 bp, Homo sapiens
aacaacataaa

SEQ ID NO: 550431 - DNA, 12 bp, Homo sapiens
aacaacataaaa

SEQ ID NO: 550432 - DNA, 15 bp, Homo sapiens
aacaacataaaatta

SEQ ID NO: 550433 - DNA, 14 bp, Homo sapiens
aacaactactactt

SEQ ID NO: 550434 - DNA, 22 bp, Homo sapiens
aacaactttcactttgcaaaga

SEQ ID NO: 550435 - DNA, 19 bp, Homo sapiens
aacaagctaggtgctaatt

SEQ ID NO: 550436 - DNA, 16 bp, Homo sapiens
aacaataaaacattat

SEQ ID NO: 550437 - DNA, 17 bp, Homo sapiens
aacaattttcagatttg

SEQ ID NO: 550438 - DNA, 19 bp, Homo sapiens
aacaattttcagatttgca

SEQ ID NO: 550439 - DNA, 20 bp, Homo sapiens
aacaattttcagatttgcac

SEQ ID NO: 550440 - DNA, 22 bp, Homo sapiens
aacaattttcagatttgcacaa

SEQ ID NO: 550441 - DNA, 16 bp, Homo sapiens
aacacaggccaccctg

SEQ ID NO: 550442 - DNA, 19 bp, Homo sapiens
aacacattgaaactgtatt

SEQ ID NO: 550443 - DNA, 16 bp, Homo sapiens
aacaccacagacacac

SEQ ID NO: 550444 - DNA, 16 bp, Homo sapiens
aacaccagcaacatta

SEQ ID NO: 550445 - DNA, 18 bp, Homo sapiens
aacacctgacagcccctc

SEQ ID NO: 550446 - DNA, 16 bp, Homo sapiens
aacactaaatgttaaa

SEQ ID NO: 550447 - DNA, 14 bp, Homo sapiens
aacactgagtgaaa

SEQ ID NO: 550448 - DNA, 15 bp, Homo sapiens
aacactgagtgaaat

SEQ ID NO: 550449 - DNA, 17 bp, Homo sapiens
aacactgagtgaaatat

SEQ ID NO: 550450 - DNA, 19 bp, Homo sapiens
aacactgagtgaaatatta

SEQ ID NO: 550451 - DNA, 21 bp, Homo sapiens
aacactgagtgaaatattact

SEQ ID NO: 550452 - DNA, 17 bp, Homo sapiens
aacacttgaaaagtgtg

SEQ ID NO: 550453 - DNA, 15 bp, Homo sapiens
aacagaaagcataga

SEQ ID NO: 550454 - DNA, 21 bp, Homo sapiens
aacagatcacatgcccctctt

SEQ ID NO: 550455 - DNA, 14 bp, Homo sapiens
aacagatgctctga

SEQ ID NO: 550456 - DNA, 17 bp, Homo sapiens
aacagatgctctgagag

SEQ ID NO: 550457 - DNA, 18 bp, Homo sapiens
aacagattggattttatg

SEQ ID NO: 550458 - DNA, 24 bp, Homo sapiens
aacagattggattttatgttgaca

SEQ ID NO: 550459 - DNA, 19 bp, Homo sapiens
aacagatttaagcaagacc

SEQ ID NO: 550460 - DNA, 20 bp, Homo sapiens
aacagatttaagcaagacca

SEQ ID NO: 550461 - DNA, 14 bp, Homo sapiens
aacagcaaattaat

SEQ ID NO: 550462 - DNA, 22 bp, Homo sapiens
aacagcagctgaagccagctcc

SEQ ID NO: 550463 - DNA, 19 bp, Homo sapiens
aacagcattggcctggcca

SEQ ID NO: 550464 - DNA, 20 bp, Homo sapiens
aacagcccaggcatctcctt

SEQ ID NO: 550465 - DNA, 15 bp, Homo sapiens
aacagctctgagatc

SEQ ID NO: 550466 - DNA, 17 bp, Homo sapiens
aacagtgtttactttaa

SEQ ID NO: 550467 - DNA, 23 bp, Homo sapiens
aacagtttaaaaaaaaagttggt

SEQ ID NO: 550468 - DNA, 14 bp, Homo sapiens
aacatagacagatg

SEQ ID NO: 550469 - DNA, 19 bp, Homo sapiens
aacatagacagatgtggac

SEQ ID NO: 550470 - DNA, 21 bp, Homo sapiens
aacatcaggttaggcagtata

SEQ ID NO: 550471 - DNA, 22 bp, Homo sapiens
aacatccatgtcctatgtgtga

SEQ ID NO: 550472 - DNA, 12 bp, Homo sapiens
aacatgtgtgac

SEQ ID NO: 550473 - DNA, 24 bp, Homo sapiens
aacattagtactttatagaagaat

SEQ ID NO: 550474 - DNA, 21 bp, Homo sapiens
aacattatagattttcatgtt

SEQ ID NO: 550475 - DNA, 12 bp, Homo sapiens
aacattggaagc

SEQ ID NO: 550476 - DNA, 22 bp, Homo sapiens
aacattggaagcaggttaaatg

SEQ ID NO: 550477 - DNA, 23 bp, Homo sapiens
aacattggaagcaggttaaatgt

SEQ ID NO: 550478 - DNA, 15 bp, Homo sapiens
aacatttcatgtatt

SEQ ID NO: 550479 - DNA, 14 bp, Homo sapiens
aacatttttttaag

SEQ ID NO: 550480 - DNA, 24 bp, Homo sapiens
aaccaagctataaaagcccatgct

SEQ ID NO: 550481 - DNA, 23 bp, Homo sapiens
aaccaaggtagaatgaccttgta

SEQ ID NO: 550482 - DNA, 16 bp, Homo sapiens
aaccaatttgttctgt

SEQ ID NO: 550483 - DNA, 17 bp, Homo sapiens
aaccacagtgtaccatt

SEQ ID NO: 550484 - DNA, 18 bp, Homo sapiens
aaccacagtgtaccatta

SEQ ID NO: 550485 - DNA, 21 bp, Homo sapiens
aaccacagtgtaccattaaaa

SEQ ID NO: 550486 - DNA, 23 bp, Homo sapiens
aaccacagtgtaccattaaaata

SEQ ID NO: 550487 - DNA, 17 bp, Homo sapiens
aaccagtttagatttca

SEQ ID NO: 550488 - DNA, 13 bp, Homo sapiens
aacccaaacctgg

SEQ ID NO: 550489 - DNA, 15 bp, Homo sapiens
aacccaaacctggag

SEQ ID NO: 550490 - DNA, 17 bp, Homo sapiens
aacccaaacctggagat

SEQ ID NO: 550491 - DNA, 19 bp, Homo sapiens
aaccctcgatgttcatgga

SEQ ID NO: 550492 - DNA, 17 bp, Homo sapiens
aaccctgcccagcctga

SEQ ID NO: 550493 - DNA, 19 bp, Homo sapiens
aaccgtgtttgtctcttct

SEQ ID NO: 550494 - DNA, 20 bp, Homo sapiens
aaccgtgtttgtctcttctg

SEQ ID NO: 550495 - DNA, 15 bp, Homo sapiens
aacctactgttcctt

SEQ ID NO: 550496 - DNA, 21 bp, Homo sapiens
aacctactgttcctttcagat

SEQ ID NO: 550497 - DNA, 14 bp, Homo sapiens
aacctcccctggtc

SEQ ID NO: 550498 - DNA, 18 bp, Homo sapiens
aacctgacagcaaacaca

SEQ ID NO: 550499 - DNA, 23 bp, Homo sapiens
aacctgacagcaaacacagtcac

SEQ ID NO: 550500 - DNA, 18 bp, Homo sapiens
aacctgtgagctgcacca

SEQ ID NO: 550501 - DNA, 22 bp, Homo sapiens
aacgatagcctagctttctaaa

SEQ ID NO: 550502 - DNA, 15 bp, Homo sapiens
aacggccccagcttc
